United States Patent 11,640,849 (METHODS FOR HISTOLOGICAL DIAGNOSIS AND TREATMENT OF DISEASES) - sequence listing, part 7

SEQ ID NO: 231904 - protein, 10 aa, Mycobacterium bovis
ADDSALTAEA

SEQ ID NO: 231905 - protein, 6 aa, Mycobacterium bovis
ADEVST

SEQ ID NO: 231906 - protein, 7 aa, Mycobacterium bovis
ADEVSTQ

SEQ ID NO: 231907 - protein, 15 aa, Mycobacterium bovis
ADGDGGNRGRQSRVR

SEQ ID NO: 231908 - protein, 9 aa, Mycobacterium bovis
ADGKKMENA

SEQ ID NO: 231909 - protein, 7 aa, Mycobacterium bovis
ADPRLNT

SEQ ID NO: 231910 - protein, 5 aa, Mycobacterium bovis
ADRGS

SEQ ID NO: 231911 - protein, 17 aa, Mycobacterium bovis
ADRKRGASAGRGGSAPS

SEQ ID NO: 231912 - protein, 6 aa, Mycobacterium bovis
ADTALD

SEQ ID NO: 231913 - protein, 6 aa, Mycobacterium bovis
ADTIGA

SEQ ID NO: 231914 - protein, 7 aa, Mycobacterium bovis
ADVENIG

SEQ ID NO: 231915 - protein, 23 aa, Mycobacterium bovis
AEEMTGRHATTATSFSITDQSCA

SEQ ID NO: 231916 - protein, 5 aa, Mycobacterium bovis
AEGEP

SEQ ID NO: 231917 - protein, 16 aa, Mycobacterium bovis
AEIPATAKSAALGRQL

SEQ ID NO: 231918 - protein, 4 aa, Mycobacterium bovis
AELD

SEQ ID NO: 231919 - protein, 10 aa, Mycobacterium bovis
AELPQTSTAA

SEQ ID NO: 231920 - protein, 9 aa, Mycobacterium bovis
AEPHYRPSA

SEQ ID NO: 231921 - protein, 27 aa, Mycobacterium bovis
AFGGDGGNGSDGVAAGSGGGSGGAGGG

SEQ ID NO: 231922 - protein, 4 aa, Mycobacterium bovis
AGAA

SEQ ID NO: 231923 - protein, 32 aa, Mycobacterium bovis
AGAGGAGAAGGAGTGDTESFGGHGGAGGDGGA

SEQ ID NO: 231924 - protein, 115 aa, Mycobacterium bovis; identical to SEQ ID NO: 193618

SEQ ID NO: 231925 - protein, 4 aa, Mycobacterium bovis
AGAP

SEQ ID NO: 231926 - protein, 25 aa, Mycobacterium bovis
AGGAGGLGGQGNHTGGHGGAGGSAG

SEQ ID NO: 231927 - protein, 10 aa, Mycobacterium bovis
AGGAGGNGGL

SEQ ID NO: 231928 - protein, 24 aa, Mycobacterium bovis
AGGAGGSGGGGSVAGDGGAGGNAG

SEQ ID NO: 231929 - protein, 9 aa, Mycobacterium bovis
AGGARPIGT

SEQ ID NO: 231930 - protein, 7 aa, Mycobacterium bovis
AGGDEVS

SEQ ID NO: 231931 - protein, 25 aa, Mycobacterium bovis
AGGGAGGAGGSGNNVGGAGGAGGVG

SEQ ID NO: 231932 - protein, 27 aa, Mycobacterium bovis
AGGGHGGTGGLSTNGDGGVGGAGGNAG

SEQ ID NO: 231933 - protein, 7 aa, Mycobacterium bovis
AGGGLAS

SEQ ID NO: 231934 - protein, 25 aa, Mycobacterium bovis
AGGHGGAGGLGAVTGGVGGAGGAGG

SEQ ID NO: 231935 - protein, 9 aa, Mycobacterium bovis
AGGNGGDGG

SEQ ID NO: 231936 - protein, 7 aa, Mycobacterium bovis
AGGNSYA

SEQ ID NO: 231937 - protein, 224 aa, Mycobacterium bovis; identical to SEQ ID NO: 193639

SEQ ID NO: 231938 - protein, 14 aa, Mycobacterium bovis
AGIGGAGGNGGNAG

SEQ ID NO: 231939 - protein, 6 aa, Mycobacterium bovis
AGNGRY

SEQ ID NO: 231940 - protein, 17 aa, Mycobacterium bovis
AGRSAHGWANADLISWT

SEQ ID NO: 231941 - protein, 40 aa, Mycobacterium bovis
AGSADCSSATAATAVPADSVPDPSALPVGSAGPVEPPSGC

SEQ ID NO: 231942 - protein, 10 aa, Mycobacterium bovis
AGSGGFGGAG

SEQ ID NO: 231943 - protein, 9 aa, Mycobacterium bovis
AHAGPSGDD

SEQ ID NO: 231944 - protein, 11 aa, Mycobacterium bovis
AHPEFQPRAGS

SEQ ID NO: 231945 - protein, 6 aa, Mycobacterium bovis
AISGGA

SEQ ID NO: 231946 - protein, 13 aa, Mycobacterium bovis
AISSANAAAAVNT

SEQ ID NO: 231947 - protein, 13 aa, Mycobacterium bovis
AKAEGRDTINGQN

SEQ ID NO: 231948 - protein, 12 aa, Mycobacterium bovis
AKRRDATQLLEV

SEQ ID NO: 231949 - protein, 7 aa, Mycobacterium bovis
AKSAAES

SEQ ID NO: 231950 - protein, 21 aa, Mycobacterium bovis
ALASAAPAGPAARAATAAPAG

SEQ ID NO: 231951 - protein, 21 aa, Mycobacterium bovis
ALPGGSSNRFSPAPAPAPIAS

SEQ ID NO: 231952 - protein, 8 aa, Mycobacterium bovis
ALRESAGR

SEQ ID NO: 231953 - protein, 26 aa, Mycobacterium bovis
ANGGAGGLGDGVGVDRGTGGAGGRGG

SEQ ID NO: 231954 - protein, 13 aa, Mycobacterium bovis
APAGGRAAHADPC

SEQ ID NO: 231955 - protein, 8 aa, Mycobacterium bovis
APDGGPAQ

SEQ ID NO: 231956 - protein, 5 aa, Mycobacterium bovis
APGMT

SEQ ID NO: 231957 - protein, 4 aa, Mycobacterium bovis
APHS

SEQ ID NO: 231958 - protein, 8 aa, Mycobacterium bovis
APNAGLDP

SEQ ID NO: 231959 - protein, 9 aa, Mycobacterium bovis
APPSGQPRV

SEQ ID NO: 231960 - protein, 5 aa, Mycobacterium bovis
APTQA

SEQ ID NO: 231961 - protein, 4 aa, Mycobacterium bovis
APVA

SEQ ID NO: 231962 - protein, 6 aa, Mycobacterium bovis
APVAGS

SEQ ID NO: 231963 - protein, 13 aa, Mycobacterium bovis
APVGGTGGNGGRA

SEQ ID NO: 231964 - protein, 17 aa, Mycobacterium bovis
APVTAGPVGGTAEVPTP

SEQ ID NO: 231965 - protein, 6 aa, Mycobacterium bovis
AQSTPQ

SEQ ID NO: 231966 - protein, 8 aa, Mycobacterium bovis
ARRDGAPP

SEQ ID NO: 231967 - protein, 9 aa, Mycobacterium bovis
ASAAAVDTN

SEQ ID NO: 231968 - protein, 8 aa, Mycobacterium bovis
ASAAENYG

SEQ ID NO: 231969 - protein, 5 aa, Mycobacterium bovis
ASDAA

SEQ ID NO: 231970 - protein, 11 aa, Mycobacterium bovis
ASENPAELAPG

SEQ ID NO: 231971 - protein, 7 aa, Mycobacterium bovis
ASEQGRG

SEQ ID NO: 231972 - protein, 26 aa, Mycobacterium bovis
ASGGAGGAGGSGGTGGAGGTGGAGGL

SEQ ID NO: 231973 - protein, 8 aa, Mycobacterium bovis
ASGGPNCR

SEQ ID NO: 231974 - protein, 10 aa, Mycobacterium bovis
ASGGSGGFGG

SEQ ID NO: 231975 - protein, 7 aa, Mycobacterium bovis
ASLPSGG

SEQ ID NO: 231976 - protein, 15 aa, Mycobacterium bovis
ASQSDAPVGAPRQFR

SEQ ID NO: 231977 - protein, 28 aa, Mycobacterium bovis
ASSEDAEAESDASNPSRGETVVHYRSDP

SEQ ID NO: 231978 - protein, 5 aa, Mycobacterium bovis
ASSIG

SEQ ID NO: 231979 - protein, 7 aa, Mycobacterium bovis
ATAAPKT

SEQ ID NO: 231980 - protein, 10 aa, Mycobacterium bovis
ATADPAASGW

SEQ ID NO: 231981 - protein, 4 aa, Mycobacterium bovis
ATDM

SEQ ID NO: 231982 - protein, 7 aa, Mycobacterium bovis
ATDNPVG

SEQ ID NO: 231983 - protein, 6 aa, Mycobacterium bovis
ATDTGS

SEQ ID NO: 231984 - protein, 8 aa, Mycobacterium bovis
ATGSGKSE

SEQ ID NO: 231985 - protein, 7 aa, Mycobacterium bovis
ATPGDGW

SEQ ID NO: 231986 - protein, 36 aa, Mycobacterium bovis
ATSTGGSGGFGGNGAASAASGADGGAGGAGGNGGAG

SEQ ID NO: 231987 - protein, 10 aa, Mycobacterium bovis
ATTDPSPFDP

SEQ ID NO: 231988 - protein, 4 aa, Mycobacterium bovis
ATYQ

SEQ ID NO: 231989 - protein, 4 aa, Mycobacterium bovis
AVGG

SEQ ID NO: 231990 - protein, 40 aa, Mycobacterium bovis; identical to SEQ ID NO: 193797

SEQ ID NO: 231991 - protein, 21 aa, Mycobacterium bovis
AVNGEPAPLAPPPADPAPPVE

SEQ ID NO: 231992 - protein, 8 aa, Mycobacterium bovis
AVPGTDTM

SEQ ID NO: 231993 - protein, 15 aa, Mycobacterium bovis
AVSGNSGVDPDQAAR

SEQ ID NO: 231994 - protein, 6 aa, Mycobacterium bovis
AVSPQV

SEQ ID NO: 231995 - protein, 13 aa, Mycobacterium bovis
AYAASKAGVRSLG

SEQ ID NO: 231996 - protein, 18 aa, Mycobacterium bovis
CGGPGAQIAAEGAENAGP

SEQ ID NO: 231997 - protein, 11 aa, Mycobacterium bovis
CNDQGDPPYQG

SEQ ID NO: 231998 - protein, 11 aa, Mycobacterium bovis
CRGGGAVTSRD

SEQ ID NO: 231999 - protein, 22 aa, Mycobacterium bovis
CRNTTDHHHDDETTNITNQLVQ

SEQ ID NO: 232000 - protein, 6 aa, Mycobacterium bovis
DAAGDL

SEQ ID NO: 232001 - protein, 8 aa, Mycobacterium bovis
DAEPAQAE

SEQ ID NO: 232002 - protein, 5 aa, Mycobacterium bovis
DAGGE

SEQ ID NO: 232003 - protein, 15 aa, Mycobacterium bovis
DAGHAARTRYDSFPR

SEQ ID NO: 232004 - protein, 13 aa, Mycobacterium bovis
DAGVKPPRTEAPD

SEQ ID NO: 232005 - protein, 15 aa, Mycobacterium bovis
DAPHGSKQANTGGSI

SEQ ID NO: 232006 - protein, 10 aa, Mycobacterium bovis
DATDKDRTRV

SEQ ID NO: 232007 - protein, 6 aa, Mycobacterium bovis
DDVRAA

SEQ ID NO: 232008 - protein, 4 aa, Mycobacterium bovis
DEPP

SEQ ID NO: 232009 - protein, 5 aa, Mycobacterium bovis
DETSD

SEQ ID NO: 232010 - protein, 28 aa, Mycobacterium bovis
DGANATTPGGAGGAGGSGGGTGGAGGAG

SEQ ID NO: 232011 - protein, 16 aa, Mycobacterium bovis
DGAPGTATSPNGGAGG

SEQ ID NO: 232012 - protein, 6 aa, Mycobacterium bovis
DGGGAV

SEQ ID NO: 232013 - protein, 43 aa, Mycobacterium bovis; identical to SEQ ID NO: 193861

SEQ ID NO: 232014 - protein, 23 aa, Mycobacterium bovis
DGGNGYSQTTPGAVGGAGGSAGF

SEQ ID NO: 232015 - protein, 6 aa, Mycobacterium bovis
DGGSSY

SEQ ID NO: 232016 - protein, 7 aa, Mycobacterium bovis
DGPPPGQ

SEQ ID NO: 232017 - protein, 12 aa, Mycobacterium bovis
DGSGGASGTAPL

SEQ ID NO: 232018 - protein, 7 aa, Mycobacterium bovis
DKNAAAQ

SEQ ID NO: 232019 - protein, 34 aa, Mycobacterium bovis
DLPAPLGEPLPAAPADPAPPADLAPPAPADVAPP

SEQ ID NO: 232020 - protein, 7 aa, Mycobacterium bovis
DLTDSGR

SEQ ID NO: 232021 - protein, 10 aa, Mycobacterium bovis
DNTPSGSTVA

SEQ ID NO: 232022 - protein, 15 aa, Mycobacterium bovis
DPADSELDRRQAQRV

SEQ ID NO: 232023 - protein, 5 aa, Mycobacterium bovis
DPARR

SEQ ID NO: 232024 - protein, 9 aa, Mycobacterium bovis
DPDEDAGTA

SEQ ID NO: 232025 - protein, 5 aa, Mycobacterium bovis
DPFRR

SEQ ID NO: 232026 - protein, 5 aa, Mycobacterium bovis
DPGAL

SEQ ID NO: 232027 - protein, 7 aa, Mycobacterium bovis
DPNDPTP

SEQ ID NO: 232028 - protein, 9 aa, Mycobacterium bovis
DPSADSTTT

SEQ ID NO: 232029 - protein, 26 aa, Mycobacterium bovis
DPSYRLKTTTAEQIASRADPWDPGSV

SEQ ID NO: 232030 - protein, 7 aa, Mycobacterium bovis
DPTTTPF

SEQ ID NO: 232031 - protein, 31 aa, Mycobacterium bovis; identical to SEQ ID NO: 155566

SEQ ID NO: 232032 - protein, 7 aa, Mycobacterium bovis
DQKDNLN

SEQ ID NO: 232033 - protein, 4 aa, Mycobacterium bovis
DRNR

SEQ ID NO: 232034 - protein, 9 aa, Mycobacterium bovis
DSTSGFQNI

SEQ ID NO: 232035 - protein, 4 aa, Mycobacterium bovis
DTDP

SEQ ID NO: 232036 - protein, 7 aa, Mycobacterium bovis
DTSSWAA

SEQ ID NO: 232037 - protein, 5 aa, Mycobacterium bovis
DYRPT

SEQ ID NO: 232038 - protein, 5 aa, Mycobacterium bovis
EATHR

SEQ ID NO: 232039 - protein, 10 aa, Mycobacterium bovis
EDDPRTLAQR

SEQ ID NO: 232040 - protein, 14 aa, Mycobacterium bovis
EGQSAVKTAKTIDQ

SEQ ID NO: 232041 - protein, 11 aa, Mycobacterium bovis
EPDVDCPSTNL

SEQ ID NO: 232042 - protein, 6 aa, Mycobacterium bovis
EPNDGH

SEQ ID NO: 232043 - protein, 6 aa, Mycobacterium bovis
EPSSGF

SEQ ID NO: 232044 - protein, 6 aa, Mycobacterium bovis
EQSGTA

SEQ ID NO: 232045 - protein, 11 aa, Mycobacterium bovis
ERDGRTDPFGQ

SEQ ID NO: 232046 - protein, 6 aa, Mycobacterium bovis
ERRGQP

SEQ ID NO: 232047 - protein, 8 aa, Mycobacterium bovis
ESVPLPDD

SEQ ID NO: 232048 - protein, 6 aa, Mycobacterium bovis
ETANAT

SEQ ID NO: 232049 - protein, 6 aa, Mycobacterium bovis
ETATAA

SEQ ID NO: 232050 - protein, 4 aa, Mycobacterium bovis
ETEI

SEQ ID NO: 232051 - protein, 8 aa, Mycobacterium bovis
ETLAPAEQ

SEQ ID NO: 232052 - protein, 8 aa, Mycobacterium bovis
FANPGLGA

SEQ ID NO: 232053 - protein, 17 aa, Mycobacterium bovis
FASTGTGGAGGTGGAGG

SEQ ID NO: 232054 - protein, 69 aa, Mycobacterium bovis
FDGGQGGQGGDGGSAGAGGINGAGGAGGDGGDGGDGATGAAGLGDNGGVGGDGGAGGAAGNGGNAGVGL

SEQ ID NO: 232055 - protein, 135 aa, Mycobacterium bovis
FDGGRGGDGGPGGGGGAGGDGSGTFNAQANNGGDGGAGGVGGAGGTGGTGGVGADGGRGGDSGRGGDGGNAGHGGAAQFSGRGAYGGEGGSGGAGGNAGGAGTGGTAGSGGAGGFGGNGADGGNGGNGGNGGFGG

SEQ ID NO: 232056 - protein, 7 aa, Mycobacterium bovis
FHPGGAT

SEQ ID NO: 232057 - protein, 6 aa, Mycobacterium bovis
FNKPGT

SEQ ID NO: 232058 - protein, 13 aa, Mycobacterium bovis
FNTGFGNGGNTNF

SEQ ID NO: 232059 - protein, 5 aa, Mycobacterium bovis
FPRGA

SEQ ID NO: 232060 - protein, 4 aa, Mycobacterium bovis
FRDA

SEQ ID NO: 232061 - protein, 203 aa, Mycobacterium bovis; identical to SEQ ID NO: 194054

SEQ ID NO: 232062 - protein, 9 aa, Mycobacterium bovis
FSPATASAD

SEQ ID NO: 232063 - protein, 14 aa, Mycobacterium bovis
FTSTDTVTVSSPRA

SEQ ID NO: 232064 - protein, 5 aa, Mycobacterium bovis
GAAGN

SEQ ID NO: 232065 - protein, 5 aa, Mycobacterium bovis
GAATD

SEQ ID NO: 232066 - protein, 6 aa, Mycobacterium bovis
GAEPAQ

SEQ ID NO: 232067 - protein, 15 aa, Mycobacterium bovis
GAGDEQLVQVAWSPP

SEQ ID NO: 232068 - protein, 94 aa, Mycobacterium bovis
GAGGAGGDGGIGGAGANGNQAVNGGAGGHGGNGGNPGTGGAGGTGGAGSITGAQGAIGATPTSGGNGGAGGNGANATTAGTNGANGGPGGHGGL

SEQ ID NO: 232069 - protein, 11 aa, Mycobacterium bovis
GAGGAGGDSAV

SEQ ID NO: 232070 - protein, 19 aa, Mycobacterium bovis
GAGGNGGMGGVAPSTGPSM

SEQ ID NO: 232071 - protein, 15 aa, Mycobacterium bovis
GANAPASTNPLHTAQ

SEQ ID NO: 232072 - protein, 6 aa, Mycobacterium bovis
GAPATS

SEQ ID NO: 232073 - protein, 10 aa, Mycobacterium bovis
GAPQTGKSTA

SEQ ID NO: 232074 - protein, 17 aa, Mycobacterium bovis
GASADQSRGVADGKPAD

SEQ ID NO: 232075 - protein, 4 aa, Mycobacterium bovis
GATL

SEQ ID NO: 232076 - protein, 6 aa, Mycobacterium bovis
GAYGAQ

SEQ ID NO: 232077 - protein, 6 aa, Mycobacterium bovis
GDDPYG

SEQ ID NO: 232078 - protein, 6 aa, Mycobacterium bovis
GDFPES

SEQ ID NO: 232079 - protein, 26 aa, Mycobacterium bovis
GDGGAGGAGGAATTGTGGAGGAGGKA

SEQ ID NO: 232080 - protein, 87 aa, Mycobacterium bovis; identical to SEQ ID NO: 194093

SEQ ID NO: 232081 - protein, 90 aa, Mycobacterium bovis
GDGNGGHGGNGGNPGAGGQGGSGGAGSTPGAKGAHGFTPTSGGDGGDGGNGGNSQVVGGNGGDGGNGGNGGSAGTGGNGGRGGDGAFGGM

SEQ ID NO: 232082 - protein, 20 aa, Mycobacterium bovis
GDGNLGSGNVGSTNLGSGNF

SEQ ID NO: 232083 - protein, 41 aa, Mycobacterium bovis; identical to SEQ ID NO: 194109

SEQ ID NO: 232084 - protein, 26 aa, Mycobacterium bovis
GEGGNGGDGGATIAGKGGSGGNGGNA

SEQ ID NO: 232085 - protein, 5 aa, Mycobacterium bovis
GEMSR

SEQ ID NO: 232086 - protein, 4 aa, Mycobacterium bovis
GENT

SEQ ID NO: 232087 - protein, 5 aa, Mycobacterium bovis
GEPTI

SEQ ID NO: 232088 - protein, 9 aa, Mycobacterium bovis
GEPYSTTNP

SEQ ID NO: 232089 - protein, 137 aa, Mycobacterium bovis
GEQGGQGGDGGAGGAGGIGGSAGGIGGSQGAGGHGGDGGQGGAGGSGGVGGGGAGAGGDGGAGGIGGTGGNGSIGGAAGNGGNGGRGGAGGMATAGSDGGNGGGGGNGGVGVGSAGGAGGTGGDGGAAGAGGAPGHG

SEQ ID NO: 232090 - protein, 15 aa, Mycobacterium bovis
GERLNEQAATDTFGN

SEQ ID NO: 232091 - protein, 9 aa, Mycobacterium bovis
GFGNNGNNN

SEQ ID NO: 232092 - protein, 12 aa, Mycobacterium bovis
GGAGGAGAAAAI

SEQ ID NO: 232093 - protein, 9 aa, Mycobacterium bovis
GGAGGAGGA

SEQ ID NO: 232094 - protein, 25 aa, Mycobacterium bovis
GGAGGAGGAVTGTGATGGSGGAGGG

SEQ ID NO: 232095 - protein, 26 aa, Mycobacterium bovis
GGAGGAGGSGGSGAAGGAGGAGGAGG

SEQ ID NO: 232096 - protein, 15 aa, Mycobacterium bovis
GGAGGAGGSSGIGGF

SEQ ID NO: 232097 - protein, 34 aa, Mycobacterium bovis
GGAGGGGGAGGDGGRGGVATPGGQGGDAGDGGAG

SEQ ID NO: 232098 - protein, 103 aa, Mycobacterium bovis; identical to SEQ ID NO: 194128

SEQ ID NO: 232099 - protein, 12 aa, Mycobacterium bovis
GGASAAAAALPS

SEQ ID NO: 232100 - protein, 12 aa, Mycobacterium bovis
GGFGGAGGGGAV

SEQ ID NO: 232101 - protein, 14 aa, Mycobacterium bovis
GGFGGQGGNGGQSG

SEQ ID NO: 232102 - protein, 8 aa, Mycobacterium bovis
GGGGGNFG

SEQ ID NO: 232103 - protein, 14 aa, Mycobacterium bovis
GGGSWGDDCRPAGI

SEQ ID NO: 232104 - protein, 20 aa, Mycobacterium bovis
GGGTGGSGVSGGAGGDGGAG

SEQ ID NO: 232105 - protein, 24 aa, Mycobacterium bovis
GGIGGAGGFGGFRGGEGGAGGAGG

SEQ ID NO: 232106 - protein, 9 aa, Mycobacterium bovis
GGLGGRGSR

SEQ ID NO: 232107 - protein, 20 aa, Mycobacterium bovis
GGMGGSGGGIGAGTTTVVPP

SEQ ID NO: 232108 - protein, 49 aa, Mycobacterium bovis
GGNAGHGGAGGNGAAGGNGADTQLGISGKGGTGGGGGGAGAGGTGGDGG

SEQ ID NO: 232109 - protein, 47 aa, Mycobacterium bovis
GGNAGHGGAGGNGAVSGNGGSSITAVGGKGGTGGGGGGGAGGTGGDA

SEQ ID NO: 232110 - protein, 11 aa, Mycobacterium bovis
GGPGDSGAPVT

SEQ ID NO: 232111 - protein, 15 aa, Mycobacterium bovis
GGTGAAGMTSAGEAA

SEQ ID NO: 232112 - protein, 6 aa, Mycobacterium bovis
GGTPIP

SEQ ID NO: 232113 - protein, 14 aa, Mycobacterium bovis
GGVGGPGGSGGASA

SEQ ID NO: 232114 - protein, 26 aa, Mycobacterium bovis
GGVGGTGGGAGSGGTGGVGGTGGAGG

SEQ ID NO: 232115 - protein, 7 aa, Mycobacterium bovis
GGVTGTI

SEQ ID NO: 232116 - protein, 45 aa, Mycobacterium bovis
GHGGAGGHGAAGIAGAAGKGGIFPDGSNGGAGGDAGDGGAGGRGG

SEQ ID NO: 232117 - protein, 25 aa, Mycobacterium bovis
GIGGNTGSFNSGNLNTGFGNAGDLN

SEQ ID NO: 232118 - protein, 26 aa, Mycobacterium bovis
GIGGPGGASSIPGMSGGAGGTGGATG

SEQ ID NO: 232119 - protein, 4 aa, Mycobacterium bovis
GIGP

SEQ ID NO: 232120 - protein, 15 aa, Mycobacterium bovis
GIGPARLDKLRNLVR

SEQ ID NO: 232121 - protein, 13 aa, Mycobacterium bovis
GINDDTIEQAAEA

SEQ ID NO: 232122 - protein, 7 aa, Mycobacterium bovis
GINGTIP

SEQ ID NO: 232123 - protein, 10 aa, Mycobacterium bovis
GIPVDDPDGY

SEQ ID NO: 232124 - protein, 6 aa, Mycobacterium bovis
GKADTV

SEQ ID NO: 232125 - protein, 177 aa, Mycobacterium bovis; identical to SEQ ID NO: 194163

SEQ ID NO: 232126 - protein, 40 aa, Mycobacterium bovis; identical to SEQ ID NO: 194164

SEQ ID NO: 232127 - protein, 16 aa, Mycobacterium bovis
GKVDKDWDADATKGIP

SEQ ID NO: 232128 - protein, 26 aa, Mycobacterium bovis
GLAGGAGGGGGQGFDTGGAGGPGGDA

SEQ ID NO: 232129 - protein, 8 aa, Mycobacterium bovis
GLRGHGDD

SEQ ID NO: 232130 - protein, 13 aa, Mycobacterium bovis
GMGGNGGATSVGG

SEQ ID NO: 232131 - protein, 216 aa, Mycobacterium bovis
GNAGIGGTGGKGGAGGAGGAGADATATGATGGTGFAGGAGGAGGQGGSSGAGGTNGSGGAGGTGGQGGAGGAGGAGGAIGTGGTGGAVGSVGNAGIGGTGGTGGVGGAGGAGAAAAAGSSATGGAGFAGGAGGEGGAGGNSGVGGTGGAGGSGADNPTGAGFAGGAGGTGGAAGAGGAGGATGTGGTGGVVGATGSAGIGGAGGRGGDGGDGASGL

SEQ ID NO: 232132 - protein, 39 aa, Mycobacterium bovis
GNGGGGGNGGAGGTGSPGAVVGGNGGVGGLGGAGSPGGL

SEQ ID NO: 232133 - protein, 4 aa, Mycobacterium bovis
GNGN

SEQ ID NO: 232134 - protein, 7 aa, Mycobacterium bovis
GNPKNIR

SEQ ID NO: 232135 - protein, 5 aa, Mycobacterium bovis
GPNLA

SEQ ID NO: 232136 - protein, 9 aa, Mycobacterium bovis
GPPGTGKTT

SEQ ID NO: 232137 - protein, 8 aa, Mycobacterium bovis
GQAGGAVT

SEQ ID NO: 232138 - protein, 4 aa, Mycobacterium bovis
GQAN

SEQ ID NO: 232139 - protein, 7 aa, Mycobacterium bovis
GRAFTSG

SEQ ID NO: 232140 - protein, 7 aa, Mycobacterium bovis
GRAGLGA

SEQ ID NO: 232141 - protein, 7 aa, Mycobacterium bovis
GRAQPQL

SEQ ID NO: 232142 - protein, 10 aa, Mycobacterium bovis
GRGIPTGTCP

SEQ ID NO: 232143 - protein, 8 aa, Mycobacterium bovis
GRPDEGAL

SEQ ID NO: 232144 - protein, 10 aa, Mycobacterium bovis
GRPEYPTPVG

SEQ ID NO: 232145 - protein, 5 aa, Mycobacterium bovis
GSAPM

SEQ ID NO: 232146 - protein, 6 aa, Mycobacterium bovis
GSDEQF

SEQ ID NO: 232147 - protein, 15 aa, Mycobacterium bovis
GSGAGVQVIEHAAGT

SEQ ID NO: 232148 - protein, 21 aa, Mycobacterium bovis
GSGGVGGAGGLGGPTDGTVQG

SEQ ID NO: 232149 - protein, 4 aa, Mycobacterium bovis
GSTG

SEQ ID NO: 232150 - protein, 5 aa, Mycobacterium bovis
GTATA

SEQ ID NO: 232151 - protein, 8 aa, Mycobacterium bovis
GTDARTRA

SEQ ID NO: 232152 - protein, 10 aa, Mycobacterium bovis
GTEDQPVAAE

SEQ ID NO: 232153 - protein, 14 aa, Mycobacterium bovis
GTFGTNGAGGTGGL

SEQ ID NO: 232154 - protein, 19 aa, Mycobacterium bovis
GTGGAGGVGGGGGVGGLGG

SEQ ID NO: 232155 - protein, 16 aa, Mycobacterium bovis
GTGGKGGNGGNGGAGM

SEQ ID NO: 232156 - protein, 7 aa, Mycobacterium bovis
GTLPANT

SEQ ID NO: 232157 - protein, 6 aa, Mycobacterium bovis
GTLPGI

SEQ ID NO: 232158 - protein, 10 aa, Mycobacterium bovis
GTQPTGTENH

SEQ ID NO: 232159 - protein, 26 aa, Mycobacterium bovis
GTYGPGYHSDSTRTYSIGEPDSDVAQ

SEQ ID NO: 232160 - protein, 9 aa, Mycobacterium bovis
GVHPNDAGH

SEQ ID NO: 232161 - protein, 11 aa, Mycobacterium bovis
GVSGPGGDGRT

SEQ ID NO: 232162 - protein, 11 aa, Mycobacterium bovis
GVTAEQVDAAA

SEQ ID NO: 232163 - protein, 19 aa, Mycobacterium bovis
GYTTTGSIDDAVASLRAAL

SEQ ID NO: 232164 - protein, 9 aa, Mycobacterium bovis
HASDTDTIR

SEQ ID NO: 232165 - protein, 4 aa, Mycobacterium bovis
HDAG

SEQ ID NO: 232166 - protein, 6 aa, Mycobacterium bovis
HDKNGD

SEQ ID NO: 232167 - protein, 8 aa, Mycobacterium bovis
HEDPSGPV

SEQ ID NO: 232168 - protein, 7 aa, Mycobacterium bovis
HERAGSG

SEQ ID NO: 232169 - protein, 41 aa, Mycobacterium bovis
HGAAGATPTSGGNGGDGGIGATANSPLQAGGAGGNGGHGGL

SEQ ID NO: 232170 - protein, 18 aa, Mycobacterium bovis
HGGPSDVVGRAGPDRAHT

SEQ ID NO: 232171 - protein, 7 aa, Mycobacterium bovis
HGKASGQ

SEQ ID NO: 232172 - protein, 26 aa, Mycobacterium bovis
HGNAGGVNVGSGNAGLANTGDFNSGG

SEQ ID NO: 232173 - protein, 4 aa, Mycobacterium bovis
HGPA

SEQ ID NO: 232174 - protein, 4 aa, Mycobacterium bovis
HPDP

SEQ ID NO: 232175 - protein, 5 aa, Mycobacterium bovis
HPGDL

SEQ ID NO: 232176 - protein, 6 aa, Mycobacterium bovis
HPLTTS

SEQ ID NO: 232177 - protein, 12 aa, Mycobacterium bovis
HQDRTGADPTPS

SEQ ID NO: 232178 - protein, 13 aa, Mycobacterium bovis
HREPPTAERAVTP

SEQ ID NO: 232179 - protein, 5 aa, Mycobacterium bovis
HRKGD

SEQ ID NO: 232180 - protein, 19 aa, Mycobacterium bovis
HSAGSSNPWDDSAHPLTDD

SEQ ID NO: 232181 - protein, 7 aa, Mycobacterium bovis
HVTPPQT

SEQ ID NO: 232182 - protein, 11 aa, Mycobacterium bovis
IATERAGKPVQ

SEQ ID NO: 232183 - protein, 8 aa, Mycobacterium bovis
IDGDPTKV

SEQ ID NO: 232184 - protein, 75 aa, Mycobacterium bovis
IGGDGGAGGAGGVFSGGGAGGAGDAIGGSGGAGGTGGLLGGGGGAGGAGGAGGNGGGASNSASIGGDGGSGGAGG

SEQ ID NO: 232185 - protein, 23 aa, Mycobacterium bovis
IGNGGNGGAGGTGAAGGAGGNGG

SEQ ID NO: 232186 - protein, 17 aa, Mycobacterium bovis
IGNGGNGGNGGKGGTGL

SEQ ID NO: 232187 - protein, 23 aa, Mycobacterium bovis
IGNGGNGGSGGMGDAPGGTGVGG

SEQ ID NO: 232188 - protein, 33 aa, Mycobacterium bovis; identical to SEQ ID NO: 194351

SEQ ID NO: 232189 - protein, 7 aa, Mycobacterium bovis
IGPDPSF

SEQ ID NO: 232190 - protein, 22 aa, Mycobacterium bovis
INGTGGAGGSRGQISGNPGTPG

SEQ ID NO: 232191 - protein, 8 aa, Mycobacterium bovis
INTGNGYY

SEQ ID NO: 232192 - protein, 10 aa, Mycobacterium bovis
INTTRYNPDY

SEQ ID NO: 232193 - protein, 11 aa, Mycobacterium bovis
IPPAPTGGDAV

SEQ ID NO: 232194 - protein, 4 aa, Mycobacterium bovis
ISAR

SEQ ID NO: 232195 - protein, 8 aa, Mycobacterium bovis
ISYSGNQA

SEQ ID NO: 232196 - protein, 12 aa, Mycobacterium bovis
ITNPANRHAAER

SEQ ID NO: 232197 - protein, 24 aa, Mycobacterium bovis
KAGNGGAGGNGGAAGNGGGGAAGD

SEQ ID NO: 232198 - protein, 8 aa, Mycobacterium bovis
KGTDTGQA

SEQ ID NO: 232199 - protein, 6 aa, Mycobacterium bovis
KLTTAG

SEQ ID NO: 232200 - protein, 15 aa, Mycobacterium bovis
KPDCPSGAGNDERAA

SEQ ID NO: 232201 - protein, 4 aa, Mycobacterium bovis
KPID

SEQ ID NO: 232202 - protein, 7 aa, Mycobacterium bovis
KSAGKWP

SEQ ID NO: 232203 - protein, 5 aa, Mycobacterium bovis
KSDSI

SEQ ID NO: 232204 - protein, 7 aa, Mycobacterium bovis
KSTPAMT

SEQ ID NO: 232205 - protein, 6 aa, Mycobacterium bovis
KVAQPS

SEQ ID NO: 232206 - protein, 9 aa, Mycobacterium bovis
LAGPTRGAP

SEQ ID NO: 232207 - protein, 9 aa, Mycobacterium bovis
LAQADREHA

SEQ ID NO: 232208 - protein, 5 aa, Mycobacterium bovis
LARDG

SEQ ID NO: 232209 - protein, 19 aa, Mycobacterium bovis
LDATDTPPPAPATSGQTSL

SEQ ID NO: 232210 - protein, 6 aa, Mycobacterium bovis
LETNAT

SEQ ID NO: 232211 - protein, 5 aa, Mycobacterium bovis
LGDGE

SEQ ID NO: 232212 - protein, 11 aa, Mycobacterium bovis
LGEDARSQHID

SEQ ID NO: 232213 - protein, 11 aa, Mycobacterium bovis
LGGGLGANSRH

SEQ ID NO: 232214 - protein, 15 aa, Mycobacterium bovis
LGGGNTGNANLGGGN

SEQ ID NO: 232215 - protein, 11 aa, Mycobacterium bovis
LGQPGTYTDFG

SEQ ID NO: 232216 - protein, 65 aa, Mycobacterium bovis; identical to SEQ ID NO: 194459

SEQ ID NO: 232217 - protein, 8 aa, Mycobacterium bovis
LNPSPLGY

SEQ ID NO: 232218 - protein, 22 aa, Mycobacterium bovis
LPATNGPSGARPDTPAASGTVI

SEQ ID NO: 232219 - protein, 6 aa, Mycobacterium bovis
LPEEPW

SEQ ID NO: 232220 - protein, 98 aa, Mycobacterium bovis; identical to SEQ ID NO: 194470

SEQ ID NO: 232221 - protein, 11 aa, Mycobacterium bovis
LPPAQRADPVT

SEQ ID NO: 232222 - protein, 4 aa, Mycobacterium bovis
LPPQ

SEQ ID NO: 232223 - protein, 16 aa, Mycobacterium bovis
LPSDTDLDTPGPQRSL

SEQ ID NO: 232224 - protein, 10 aa, Mycobacterium bovis
LQPDDGPQFA

SEQ ID NO: 232225 - protein, 9 aa, Mycobacterium bovis
LRRASPSAV

SEQ ID NO: 232226 - protein, 10 aa, Mycobacterium bovis
LRSTGDPRRV

SEQ ID NO: 232227 - protein, 13 aa, Mycobacterium bovis
LSAANAAAAAPTT

SEQ ID NO: 232228 - protein, 11 aa, Mycobacterium bovis
LSGLSSAGTAL

SEQ ID NO: 232229 - protein, 16 aa, Mycobacterium bovis
LSGNPVRDGPAAPAQV

SEQ ID NO: 232230 - protein, 9 aa, Mycobacterium bovis
LSKQTGQQV

SEQ ID NO: 232231 - protein, 11 aa, Mycobacterium bovis
LSSAEKGAAAS

SEQ ID NO: 232232 - protein, 13 aa, Mycobacterium bovis
LTTGGPGAAGGDA

SEQ ID NO: 232233 - protein, 26 aa, Mycobacterium bovis
MAGPAGPAGSARPASRAGPAAPAAPA

SEQ ID NO: 232234 - protein, 5 aa, Mycobacterium bovis
MGEKD

SEQ ID NO: 232235 - protein, 15 aa, Mycobacterium bovis
MPEQTAAAVSRSGRQ

SEQ ID NO: 232236 - protein, 5 aa, Mycobacterium bovis
MPPCP

SEQ ID NO: 232237 - protein, 12 aa, Mycobacterium bovis
NADPLGSATGSV

SEQ ID NO: 232238 - protein, 10 aa, Mycobacterium bovis
NAGGTHPTTT

SEQ ID NO: 232239 - protein, 14 aa, Mycobacterium bovis
NAKNRPGAGFVPVP

SEQ ID NO: 232240 - protein, 5 aa, Mycobacterium bovis
NAPAI

SEQ ID NO: 232241 - protein, 6 aa, Mycobacterium bovis
NAPTET

SEQ ID NO: 232242 - protein, 6 aa, Mycobacterium bovis
NASPVA

SEQ ID NO: 232243 - protein, 7 aa, Mycobacterium bovis
NATQPVP

SEQ ID NO: 232244 - protein, 13 aa, Mycobacterium bovis
NDGTPIPDQVDSV

SEQ ID NO: 232245 - protein, 4 aa, Mycobacterium bovis
NDTL

SEQ ID NO: 232246 - protein, 7 aa, Mycobacterium bovis
NECGKTA

SEQ ID NO: 232247 - protein, 4 aa, Mycobacterium bovis
NEGL

SEQ ID NO: 232248 - protein, 18 aa, Mycobacterium bovis
NGAGGGGGGVGGNGATGP

SEQ ID NO: 232249 - protein, 16 aa, Mycobacterium bovis
NGANGAPGSGAPGGHG

SEQ ID NO: 232250 - protein, 17 aa, Mycobacterium bovis
NGANGAPGTGANGGPGG

SEQ ID NO: 232251 - protein, 17 aa, Mycobacterium bovis
NGANGLPGTGQNGGDGG

SEQ ID NO: 232252 - protein, 17 aa, Mycobacterium bovis
NGANGQPGTGAPGGPGG

SEQ ID NO: 232253 - protein, 21 aa, Mycobacterium bovis
NGGAGGAGGAGGIGAGGAGGF

SEQ ID NO: 232254 - protein, 16 aa, Mycobacterium bovis
NGGAGGAGGHGGPAPL

SEQ ID NO: 232255 - protein, 24 aa, Mycobacterium bovis
NGGAGGAGGVGGDGGKGGAGDPSF

SEQ ID NO: 232256 - protein, 50 aa, Mycobacterium bovis
NGGAGGNGGNGGAAGKGGIGAPGLSTAQGGDGGNGGSGGNAGNGGNGGRG

SEQ ID NO: 232257 - protein, 22 aa, Mycobacterium bovis
NGGAGGSGAPGAIGGAGGPAGL

SEQ ID NO: 232258 - protein, 21 aa, Mycobacterium bovis
NGGAGGSGAPGGIGAGGNGGN

SEQ ID NO: 232259 - protein, 52 aa, Mycobacterium bovis
NGGAGGTGGSGGAGARGGDGGAGSGTAQGGDGGAGGVGGNAGNGGNGGSAGW

SEQ ID NO: 232260 - protein, 28 aa, Mycobacterium bovis
NGGGAGGAGGSGVSGGAGGEGGAGGAGG

SEQ ID NO: 232261 - protein, 22 aa, Mycobacterium bovis
NGGNGAAGGFGQTGGSGGAAGL

SEQ ID NO: 232262 - protein, 31 aa, Mycobacterium bovis
NGGNGGAGTGGAAGGAGGSGGLLFGQNGMPG

SEQ ID NO: 232263 - protein, 38 aa, Mycobacterium bovis
NGGNGGNGGIGQPGGAGGDAGLIGNGGNGGIGGPGRPA

SEQ ID NO: 232264 - protein, 22 aa, Mycobacterium bovis
NGGNGGSGGVNQAGGNGGNAGL

SEQ ID NO: 232265 - protein, 46 aa, Mycobacterium bovis
NGGNGYSATASGVGGGAGGSAGLIGNGGAGGAGGPNAPGGAGGNGG

SEQ ID NO: 232266 - protein, 25 aa, Mycobacterium bovis
NGGTGGSGGAGGAGSVGNGGAGGNA

SEQ ID NO: 232267 - protein, 10 aa, Mycobacterium bovis
NGHTYTTHPG

SEQ ID NO: 232268 - protein, 20 aa, Mycobacterium bovis
NGNIGLNGATGGIGSTTLTN

SEQ ID NO: 232269 - protein, 5 aa, Mycobacterium bovis
NGPLQ

SEQ ID NO: 232270 - protein, 5 aa, Mycobacterium bovis
NGRFT

SEQ ID NO: 232271 - protein, 5 aa, Mycobacterium bovis
NGSDM

SEQ ID NO: 232272 - protein, 4 aa, Mycobacterium bovis
NGYT

SEQ ID NO: 232273 - protein, 30 aa, Mycobacterium bovis
NLPPAPDAAPVDTPPAPEDAGFDPNLPPPL

SEQ ID NO: 232274 - protein, 24 aa, Mycobacterium bovis
NNGAGGNGGHGGNPGVGGAGGAGG

SEQ ID NO: 232275 - protein, 7 aa, Mycobacterium bovis
NNQRGDL

SEQ ID NO: 232276 - protein, 12 aa, Mycobacterium bovis
NPEPTPLSGSAT

SEQ ID NO: 232277 - protein, 7 aa, Mycobacterium bovis
NPLPAPN

SEQ ID NO: 232278 - protein, 92 aa, Mycobacterium bovis
NQGAGGDGGNGGEVGVGGKGGAGGVSANPALNGSAGANGTAPTSGGNGGNGGAGATPTVAGENGGAGGNGGHGGSVGNGGAGGAGGNGVAGT

SEQ ID NO: 232279 - protein, 9 aa, Mycobacterium bovis
NSAQGYKLT

SEQ ID NO: 232280 - protein, 14 aa, Mycobacterium bovis
NSASGSYAAAEATI

SEQ ID NO: 232281 - protein, 6 aa, Mycobacterium bovis
NSLPES

SEQ ID NO: 232282 - protein, 4 aa, Mycobacterium bovis
NSPE

SEQ ID NO: 232283 - protein, 5 aa, Mycobacterium bovis
NTLTG

SEQ ID NO: 232284 - protein, 6 aa, Mycobacterium bovis
NVDTSE

SEQ ID NO: 232285 - protein, 16 aa, Mycobacterium bovis
PAAATAAVTPPALNTG

SEQ ID NO: 232286 - protein, 9 aa, Mycobacterium bovis
PAATTIPGR

SEQ ID NO: 232287 - protein, 8 aa, Mycobacterium bovis
PAGSGGSV

SEQ ID NO: 232288 - protein, 11 aa, Mycobacterium bovis
PANATAKIGQT

SEQ ID NO: 232289 - protein, 9 aa, Mycobacterium bovis
PAPDVSQAQ

SEQ ID NO: 232290 - protein, 48 aa, Mycobacterium bovis
PAPLGEPLPAAPADPAPPADLAPPAPAELAPPAPADLAPPAPADLAPP

SEQ ID NO: 232291 - protein, 11 aa, Mycobacterium bovis
PARPNRPEADR

SEQ ID NO: 232292 - protein, 21 aa, Mycobacterium bovis
PASDDYRASASNGSDDASAHI

SEQ ID NO: 232293 - protein, 7 aa, Mycobacterium bovis
PATAQGI

SEQ ID NO: 232294 - protein, 7 aa, Mycobacterium bovis
PATLPES

SEQ ID NO: 232295 - protein, 15 aa, Mycobacterium bovis
PDIAPPRRREPTCPD

SEQ ID NO: 232296 - protein, 12 aa, Mycobacterium bovis
PDIPTKQTGGSF

SEQ ID NO: 232297 - protein, 5 aa, Mycobacterium bovis
PDPTE

SEQ ID NO: 232298 - protein, 5 aa, Mycobacterium bovis
PDQQA

SEQ ID NO: 232299 - protein, 4 aa, Mycobacterium bovis
PDVN

SEQ ID NO: 232300 - protein, 4 aa, Mycobacterium bovis
PDWQ

SEQ ID NO: 232301 - protein, 8 aa, Mycobacterium bovis
PEAAGPTQ

SEQ ID NO: 232302 - protein, 4 aa, Mycobacterium bovis
PEDV

SEQ ID NO: 232303 - protein, 5 aa, Mycobacterium bovis
PEMPE

SEQ ID NO: 232304 - protein, 4 aa, Mycobacterium bovis
PEPG

SEQ ID NO: 232305 - protein, 4 aa, Mycobacterium bovis
PEPW

SEQ ID NO: 232306 - protein, 36 aa, Mycobacterium bovis; identical to SEQ ID NO: 194622

SEQ ID NO: 232307 - protein, 4 aa, Mycobacterium bovis
PGFG

SEQ ID NO: 232308 - protein, 13 aa, Mycobacterium bovis
PGTAAPAPESLHG

SEQ ID NO: 232309 - protein, 17 aa, Mycobacterium bovis
PGVEGHPYRQRATPIPT

SEQ ID NO: 232310 - protein, 6 aa, Mycobacterium bovis
PGVKPH

SEQ ID NO: 232311 - protein, 6 aa, Mycobacterium bovis
PICTGG

SEQ ID NO: 232312 - protein, 8 aa, Mycobacterium bovis
PKNARTQD

SEQ ID NO: 232313 - protein, 7 aa, Mycobacterium bovis
PLPPTGP

SEQ ID NO: 232314 - protein, 11 aa, Mycobacterium bovis
PNAVGPGPSIP

SEQ ID NO: 232315 - protein, 9 aa, Mycobacterium bovis
PNNGFPGTS

SEQ ID NO: 232316 - protein, 14 aa, Mycobacterium bovis
PPKTPSPKPLSPNA

SEQ ID NO: 232317 - protein, 25 aa, Mycobacterium bovis
PPVEPVSPTNPRSSASPGSPDRSGL

SEQ ID NO: 232318 - protein, 10 aa, Mycobacterium bovis
PSGRALESRP

SEQ ID NO: 232319 - protein, 10 aa, Mycobacterium bovis
PSPLSSGSAK

SEQ ID NO: 232320 - protein, 14 aa, Mycobacterium bovis
PSWATPSSTPVSAL

SEQ ID NO: 232321 - protein, 4 aa, Mycobacterium bovis
PTRG

SEQ ID NO: 232322 - protein, 8 aa, Mycobacterium bovis
PTVQQPNS

SEQ ID NO: 232323 - protein, 11 aa, Mycobacterium bovis
PVDRPGRGLSR

SEQ ID NO: 232324 - protein, 10 aa, Mycobacterium bovis
QAAVAQTGLT

SEQ ID NO: 232325 - protein, 25 aa, Mycobacterium bovis
QALGGEDVESDLSPRKRSATGRSGL

SEQ ID NO: 232326 - protein, 5 aa, Mycobacterium bovis
QARPV

SEQ ID NO: 232327 - protein, 11 aa, Mycobacterium bovis
QAYQAASAQAA

SEQ ID NO: 232328 - protein, 223 aa, Mycobacterium bovis; identical to SEQ ID NO: 194717

SEQ ID NO: 232329 - protein, 6 aa, Mycobacterium bovis
QGGTAG

SEQ ID NO: 232330 - protein, 9 aa, Mycobacterium bovis
QGRTTGNSC

SEQ ID NO: 232331 - protein, 5 aa, Mycobacterium bovis
QHPNA

SEQ ID NO: 232332 - protein, 7 aa, Mycobacterium bovis
QKPFPPP

SEQ ID NO: 232333 - protein, 14 aa, Mycobacterium bovis
QKYDPSRVMFSGLN

SEQ ID NO: 232334 - protein, 5 aa, Mycobacterium bovis
QLEPQ

SEQ ID NO: 232335 - protein, 9 aa, Mycobacterium bovis
QLPNTPGAG

SEQ ID NO: 232336 - protein, 13 aa, Mycobacterium bovis
QLPPLPRATTATT

SEQ ID NO: 232337 - protein, 33 aa, Mycobacterium bovis
QPAPQGLPIGTGGTGGEGGAGGAGGDGGQGDIG

SEQ ID NO: 232338 - protein, 8 aa, Mycobacterium bovis
QPGSGESL

SEQ ID NO: 232339 - protein, 6 aa, Mycobacterium bovis
QPPARY

SEQ ID NO: 232340 - protein, 12 aa, Mycobacterium bovis
QRRQDEAMRPRT

SEQ ID NO: 232341 - protein, 6 aa, Mycobacterium bovis
QSAAAE

SEQ ID NO: 232342 - protein, 5 aa, Mycobacterium bovis
QTGTG

SEQ ID NO: 232343 - protein, 7 aa, Mycobacterium bovis
QTPPQPL

SEQ ID NO: 232344 - protein, 18 aa, Mycobacterium bovis
RAAGAKAGISVKPGTPLE

SEQ ID NO: 232345 - protein, 5 aa, Mycobacterium bovis
RAGDE

SEQ ID NO: 232346 - protein, 18 aa, Mycobacterium bovis
RANGGSGSAANASREEQI

SEQ ID NO: 232347 - protein, 7 aa, Mycobacterium bovis
RAPRGDE

SEQ ID NO: 232348 - protein, 8 aa, Mycobacterium bovis
RARQTGAQ

SEQ ID NO: 232349 - protein, 28 aa, Mycobacterium bovis
RCPPEGPSKGSSGGSSQGPPDGAAAGFG

SEQ ID NO: 232350 - protein, 16 aa, Mycobacterium bovis
RDDIGGMSTATGPEGL

SEQ ID NO: 232351 - protein, 8 aa, Mycobacterium bovis
RDEAPADL

SEQ ID NO: 232352 - protein, 6 aa, Mycobacterium bovis
RDGCPS

SEQ ID NO: 232353 - protein, 19 aa, Mycobacterium bovis
RESASQALPGLLERLPALL

SEQ ID NO: 232354 - protein, 5 aa, Mycobacterium bovis
RIDNS

SEQ ID NO: 232355 - protein, 7 aa, Mycobacterium bovis
RKKSDHL

SEQ ID NO: 232356 - protein, 6 aa, Mycobacterium bovis
RLDEGR

SEQ ID NO: 232357 - protein, 10 aa, Mycobacterium bovis
RMAEPKLGQP

SEQ ID NO: 232358 - protein, 6 aa, Mycobacterium bovis
RPDGTR

SEQ ID NO: 232359 - protein, 9 aa, Mycobacterium bovis
RPGSGREAT

SEQ ID NO: 232360 - protein, 10 aa, Mycobacterium bovis
RPKTPPPADA

SEQ ID NO: 232361 - protein, 8 aa, Mycobacterium bovis
RPMPLPPG

SEQ ID NO: 232362 - protein, 6 aa, Mycobacterium bovis
RQTLQG

SEQ ID NO: 232363 - protein, 29 aa, Mycobacterium bovis
RRGTRSPRPSRLRAPQDSQARASEVRRER

SEQ ID NO: 232364 - protein, 14 aa, Mycobacterium bovis
RRLTEANDSPAGEA

SEQ ID NO: 232365 - protein, 5 aa, Mycobacterium bovis
RRPGA

SEQ ID NO: 232366 - protein, 10 aa, Mycobacterium bovis
RRSGDPVAPP

SEQ ID NO: 232367 - protein, 4 aa, Mycobacterium bovis
RSAT

SEQ ID NO: 232368 - protein, 5 aa, Mycobacterium bovis
RSDDG

SEQ ID NO: 232369 - protein, 7 aa, Mycobacterium bovis
RSGGAAR

SEQ ID NO: 232370 - protein, 8 aa, Mycobacterium bovis
RSQGNESA

SEQ ID NO: 232371 - protein, 8 aa, Mycobacterium bovis
RSRGGAHS

SEQ ID NO: 232372 - protein, 16 aa, Mycobacterium bovis
RSTSEQVHADLGVTPL

SEQ ID NO: 232373 - protein, 6 aa, Mycobacterium bovis
RTEADV

SEQ ID NO: 232374 - protein, 4 aa, Mycobacterium bovis
RTGK

SEQ ID NO: 232375 - protein, 5 aa, Mycobacterium bovis
RTRAA

SEQ ID NO: 232376 - protein, 10 aa, Mycobacterium bovis
RWAPPYAEAG

SEQ ID NO: 232377 - protein, 6 aa, Mycobacterium bovis
SADGYR

SEQ ID NO: 232378 - protein, 27 aa, Mycobacterium bovis
SAEPHATDGSPVANRVEPGKRPRSSMA

SEQ ID NO: 232379 - protein, 13 aa, Mycobacterium bovis
SAESGVPTFRDDK

SEQ ID NO: 232380 - protein, 11 aa, Mycobacterium bovis
SAGRAGSIGPM

SEQ ID NO: 232381 - protein, 9 aa, Mycobacterium bovis
SAIPPRGTQ

SEQ ID NO: 232382 - protein, 25 aa, Mycobacterium bovis
SALDAQPDPHLSGDEPPSRPLTPET

SEQ ID NO: 232383 - protein, 6 aa, Mycobacterium bovis
SAMPPA

SEQ ID NO: 232384 - protein, 7 aa, Mycobacterium bovis
SAPAGVT

SEQ ID NO: 232385 - protein, 4 aa, Mycobacterium bovis
SAPL

SEQ ID NO: 232386 - protein, 4 aa, Mycobacterium bovis
SARR

SEQ ID NO: 232387 - protein, 11 aa, Mycobacterium bovis
SASESRNVLGT

SEQ ID NO: 232388 - protein, 6 aa, Mycobacterium bovis
SDLAGI

SEQ ID NO: 232389 - protein, 6 aa, Mycobacterium bovis
SDSGRA

SEQ ID NO: 232390 - protein, 5 aa, Mycobacterium bovis
SEEVE

SEQ ID NO: 232391 - protein, 10 aa, Mycobacterium bovis
SEKGDSGGPV

SEQ ID NO: 232392 - protein, 5 aa, Mycobacterium bovis
SEPHD

SEQ ID NO: 232393 - protein, 4 aa, Mycobacterium bovis
SEQC

SEQ ID NO: 232394 - protein, 35 aa, Mycobacterium bovis; identical to SEQ ID NO: 194957

SEQ ID NO: 232395 - protein, 15 aa, Mycobacterium bovis
SGDGNTGFGNAGDVN

SEQ ID NO: 232396 - protein, 6 aa, Mycobacterium bovis
SGESGL

SEQ ID NO: 232397 - protein, 8 aa, Mycobacterium bovis
SGFGGGGH

SEQ ID NO: 232398 - protein, 49 aa, Mycobacterium bovis; identical to SEQ ID NO: 194972

SEQ ID NO: 232399 - protein, 30 aa, Mycobacterium bovis; identical to SEQ ID NO: 194973

SEQ ID NO: 232400 - protein, 30 aa, Mycobacterium bovis; identical to SEQ ID NO: 194974

SEQ ID NO: 232401 - protein, 10 aa, Mycobacterium bovis
SGGVGGAGGF

SEQ ID NO: 232402 - protein, 8 aa, Mycobacterium bovis
SGHQPDGY

SEQ ID NO: 232403 - protein, 18 aa, Mycobacterium bovis
SGLAGRGRIPAHSARRRG

SEQ ID NO: 232404 - protein, 5 aa, Mycobacterium bovis
SGLNP

SEQ ID NO: 232405 - protein, 24 aa, Mycobacterium bovis
SGLSGGDGGAGGAGGAGGAGGTGG

SEQ ID NO: 232406 - protein, 7 aa, Mycobacterium bovis
SGMQRQE

SEQ ID NO: 232407 - protein, 18 aa, Mycobacterium bovis
SGMTSQAATFAANRLDHA

SEQ ID NO: 232408 - protein, 50 aa, Mycobacterium bovis; identical to SEQ ID NO: 194986

SEQ ID NO: 232409 - protein, 18 aa, Mycobacterium bovis
SGNIGNTNFGNGNQGNLN

SEQ ID NO: 232410 - protein, 4 aa, Mycobacterium bovis
SGNM

SEQ ID NO: 232411 - protein, 8 aa, Mycobacterium bovis
SGNSNEGF

SEQ ID NO: 232412 - protein, 19 aa, Mycobacterium bovis
SGPHGADPHHGYSDRELRE

SEQ ID NO: 232413 - protein, 13 aa, Mycobacterium bovis
SGQAVTASATDHP

SEQ ID NO: 232414 - protein, 5 aa, Mycobacterium bovis
SGTGI

SEQ ID NO: 232415 - protein, 41 aa, Mycobacterium bovis; identical to SEQ ID NO: 194996

SEQ ID NO: 232416 - protein, 4 aa, Mycobacterium bovis
SGYS

SEQ ID NO: 232417 - protein, 10 aa, Mycobacterium bovis
SHPDQAIASG

SEQ ID NO: 232418 - protein, 6 aa, Mycobacterium bovis
SKSALR

SEQ ID NO: 232419 - protein, 9 aa, Mycobacterium bovis
SLGSSSDLR

SEQ ID NO: 232420 - protein, 5 aa, Mycobacterium bovis
SLPTI

SEQ ID NO: 232421 - protein, 11 aa, Mycobacterium bovis
SPPAEEAPPVP

SEQ ID NO: 232422 - protein, 13 aa, Mycobacterium bovis
SPSGIGTTVFDHP

SEQ ID NO: 232423 - protein, 8 aa, Mycobacterium bovis
SPVAAAKT

SEQ ID NO: 232424 - protein, 7 aa, Mycobacterium bovis
SQVGGRS

SEQ ID NO: 232425 - protein, 13 aa, Mycobacterium bovis
SRHPQQETTCRRV

SEQ ID NO: 232426 - protein, 9 aa, Mycobacterium bovis
SSDFKTGPA

SEQ ID NO: 232427 - protein, 4 aa, Mycobacterium bovis
SSGL

SEQ ID NO: 232428 - protein, 12 aa, Mycobacterium bovis
SSGVAAGVTGPA

SEQ ID NO: 232429 - protein, 5 aa, Mycobacterium bovis
SSNPL

SEQ ID NO: 232430 - protein, 9 aa, Mycobacterium bovis
SSPAALGAK

SEQ ID NO: 232431 - protein, 8 aa, Mycobacterium bovis
SSPTTSAA

SEQ ID NO: 232432 - protein, 9 aa, Mycobacterium bovis
STAAPMSTT

SEQ ID NO: 232433 - protein, 15 aa, Mycobacterium bovis
STGAGAYASAEAAAA

SEQ ID NO: 232434 - protein, 7 aa, Mycobacterium bovis
STQDRRV

SEQ ID NO: 232435 - protein, 27 aa, Mycobacterium bovis
SVGAGTPGPAGTSGTATTGPKTAPKTA

SEQ ID NO: 232436 - protein, 5 aa, Mycobacterium bovis
SYTYP

SEQ ID NO: 232437 - protein, 9 aa, Mycobacterium bovis
SYYPDQKSL

SEQ ID NO: 232438 - protein, 6 aa, Mycobacterium bovis
TAATAA

SEQ ID NO: 232439 - protein, 14 aa, Mycobacterium bovis
TAATAATPGPAGMA

SEQ ID NO: 232440 - protein, 11 aa, Mycobacterium bovis
TADAEEALGGA

SEQ ID NO: 232441 - protein, 7 aa, Mycobacterium bovis
TADPANR

SEQ ID NO: 232442 - protein, 9 aa, Mycobacterium bovis
TAERGNGAI

SEQ ID NO: 232443 - protein, 6 aa, Mycobacterium bovis
TAGGDL

SEQ ID NO: 232444 - protein, 126 aa, Mycobacterium bovis
TAKAGDGGAAGNGGNGGAGGAGGAGDNNFNGGQGGAGGQGGQGGLGGASTTSINANGGAGGNGGTGGKGGAGGAGTLGVGGSGGTGGDGGDAGAGGGGGFGGAAGKAGGGGNGGVGGDGGEGASGL

SEQ ID NO: 232445 - protein, 6 aa, Mycobacterium bovis
TDSGSG

SEQ ID NO: 232446 - protein, 4 aa, Mycobacterium bovis
TEIG

SEQ ID NO: 232447 - protein, 4 aa, Mycobacterium bovis
TEPV

SEQ ID NO: 232448 - protein, 5 aa, Mycobacterium bovis
TESLG

SEQ ID NO: 232449 - protein, 10 aa, Mycobacterium bovis
TGAGGAYAAA

SEQ ID NO: 232450 - protein, 8 aa, Mycobacterium bovis
TGETCGTV

SEQ ID NO: 232451 - protein, 23 aa, Mycobacterium bovis
TGGAGGAGGFGGFGGDGGDDGIG

SEQ ID NO: 232452 - protein, 20 aa, Mycobacterium bovis
TGGAGGNGGPGGDGGTGATV

SEQ ID NO: 232453 - protein, 4 aa, Mycobacterium bovis
TGGG

SEQ ID NO: 232454 - protein, 4 aa, Mycobacterium bovis
TGGI

SEQ ID NO: 232455 - protein, 61 aa, Mycobacterium bovis
TGIDPSHAAGPAPAVAPTVTPPVAAPPASAPAPAPDAAQPVAVPGPPPAPPAPRAAAPPTQ

SEQ ID NO: 232456 - protein, 6 aa, Mycobacterium bovis
TGRGRR

SEQ ID NO: 232457 - protein, 11 aa, Mycobacterium bovis
TGRRTGADQRA

SEQ ID NO: 232458 - protein, 12 aa, Mycobacterium bovis
TGSITKIYLRAT

SEQ ID NO: 232459 - protein, 9 aa, Mycobacterium bovis
TGTAGYAGG

SEQ ID NO: 232460 - protein, 6 aa, Mycobacterium bovis
THPEPK

SEQ ID NO: 232461 - protein, 10 aa, Mycobacterium bovis
THQASGLGDV

SEQ ID NO: 232462 - protein, 60 aa, Mycobacterium bovis
TLGSPGADGGMGGNGGKGGDGGGGGAGGTAVAGTAGKAGDGGAGGDGGKAGDGGAGAAGD

SEQ ID NO: 232463 - protein, 7 aa, Mycobacterium bovis
TLPPDAI

SEQ ID NO: 232464 - protein, 6 aa, Mycobacterium bovis
TPAPSF

SEQ ID NO: 232465 - protein, 14 aa, Mycobacterium bovis
TPDPEPDPPATHAP

SEQ ID NO: 232466 - protein, 12 aa, Mycobacterium bovis
TPPTAAAAESGM

SEQ ID NO: 232467 - protein, 12 aa, Mycobacterium bovis
TPSPASDTDTVT

SEQ ID NO: 232468 - protein, 99 aa, Mycobacterium bovis
TQGGDGTPGGAGVNGGNGGAGGDANGNPANTSIANAGAGGNGAAGGDGGANGGAGGAGGQAASAGSSVGGDGGNGGAGGTGTNGHAGGAGGAGGAGGRG

SEQ ID NO: 232469 - protein, 10 aa, Mycobacterium bovis
TRADGKRDRD

SEQ ID NO: 232470 - protein, 6 aa, Mycobacterium bovis
TRINQE

SEQ ID NO: 232471 - protein, 6 aa, Mycobacterium bovis
TRNPGF

SEQ ID NO: 232472 - protein, 7 aa, Mycobacterium bovis
TRNRPGH

SEQ ID NO: 232473 - protein, 8 aa, Mycobacterium bovis
TRPSGLPG

SEQ ID NO: 232474 - protein, 10 aa, Mycobacterium bovis
TRQANPKLPA

SEQ ID NO: 232475 - protein, 12 aa, Mycobacterium bovis
TRQRRRFNGGLV

SEQ ID NO: 232476 - protein, 5 aa, Mycobacterium bovis
TSDGQ

SEQ ID NO: 232477 - protein, 10 aa, Mycobacterium bovis
TSGSPSEATS

SEQ ID NO: 232478 - protein, 25 aa, Mycobacterium bovis
TSPAGIANADDAGLDPNAAAGPDAV

SEQ ID NO: 232479 - protein, 24 aa, Mycobacterium bovis
TSPRSRNRSFGERLGRGETLQSAG

SEQ ID NO: 232480 - protein, 4 aa, Mycobacterium bovis
TSQL

SEQ ID NO: 232481 - protein, 9 aa, Mycobacterium bovis
TSSSPGTLG

SEQ ID NO: 232482 - protein, 10 aa, Mycobacterium bovis
TTASNSPVVT

SEQ ID NO: 232483 - protein, 9 aa, Mycobacterium bovis
TTATNTPFV

SEQ ID NO: 232484 - protein, 10 aa, Mycobacterium bovis
TTKITGTIPA

SEQ ID NO: 232485 - protein, 6 aa, Mycobacterium bovis
TTQQAE

SEQ ID NO: 232486 - protein, 10 aa, Mycobacterium bovis
TTSAAARQLT

SEQ ID NO: 232487 - protein, 7 aa, Mycobacterium bovis
TVSPGAT

SEQ ID NO: 232488 - protein, 4 aa, Mycobacterium bovis
TVTD

SEQ ID NO: 232489 - protein, 4 aa, Mycobacterium bovis
TYTT

SEQ ID NO: 232490 - protein, 8 aa, Mycobacterium bovis
VAPPSVRP

SEQ ID NO: 232491 - protein, 10 aa, Mycobacterium bovis
VAPRGGGHSY

SEQ ID NO: 232492 - protein, 21 aa, Mycobacterium bovis
VDAGSGAGGGGGGAGGTGGTA

SEQ ID NO: 232493 - protein, 11 aa, Mycobacterium bovis
VDDQSRARAAL

SEQ ID NO: 232494 - protein, 7 aa, Mycobacterium bovis
VEATGSA

SEQ ID NO: 232495 - protein, 11 aa, Mycobacterium bovis
VEEGPPPPLPA

SEQ ID NO: 232496 - protein, 5 aa, Mycobacterium bovis
VETSR

SEQ ID NO: 232497 - protein, 100 aa, Mycobacterium bovis
VGAPGQPGGAGGHGGAGGNGGAGGNGGQGVVSDGAGGAGGAGGDGGAPGDGANGGNGQGAGAFAGGGGGRGGDGGNAGNAGAGGPAGTGSTAGKAGPAGS

SEQ ID NO: 232498 - protein, 8 aa, Mycobacterium bovis
VGASTANG

SEQ ID NO: 232499 - protein, 10 aa, Mycobacterium bovis
VGDGGLPAEL

SEQ ID NO: 232500 - protein, 7 aa, Mycobacterium bovis
VGGEPGS

SEQ ID NO: 232501 - protein, 5 aa, Mycobacterium bovis
VGGST

SEQ ID NO: 232502 - protein, 14 aa, Mycobacterium bovis
VGGTATAGAFSRPG

SEQ ID NO: 232503 - protein, 27 aa, Mycobacterium bovis
VGNGGAGGNGQLGSGAVSSAGGMGGNG

SEQ ID NO: 232504 - protein, 74 aa, Mycobacterium bovis
VGNGGTGGAGGAGHAGSTGATGTALQPTGGNGTNGGAGGHGGNGGNGGAQHGDGGVGGKGGAGGSGGAGGNGFD

SEQ ID NO: 232505 - protein, 14 aa, Mycobacterium bovis
VGTTGGAGGNGGGA

SEQ ID NO: 232506 - protein, 8 aa, Mycobacterium bovis
VNGGPTST

SEQ ID NO: 232507 - protein, 7 aa, Mycobacterium bovis
VPPGPGE

SEQ ID NO: 232508 - protein, 4 aa, Mycobacterium bovis
VQTG

SEQ ID NO: 232509 - protein, 9 aa, Mycobacterium bovis
VTDNSGRER

SEQ ID NO: 232510 - protein, 5 aa, Mycobacterium bovis
VTPAT

SEQ ID NO: 232511 - protein, 7 aa, Mycobacterium bovis
VTPDGTA

SEQ ID NO: 232512 - protein, 7 aa, Mycobacterium bovis
VTQTAAA

SEQ ID NO: 232513 - protein, 10 aa, Mycobacterium bovis
VYGADDPAAA

SEQ ID NO: 232514 - protein, 14 aa, Mycobacterium bovis
WESSPTPPADPTPI

SEQ ID NO: 232515 - protein, 30 aa, Mycobacterium bovis
WGNGGSGGAGGNATTAGRNGFNGGAGGSGG

SEQ ID NO: 232516 - protein, 9 aa, Mycobacterium bovis
WGPGESPGT

SEQ ID NO: 232517 - protein, 10 aa, Mycobacterium bovis
WGPLSAPKLE

SEQ ID NO: 232518 - protein, 8 aa, Mycobacterium bovis
WGRDPDTM

SEQ ID NO: 232519 - protein, 5 aa, Mycobacterium bovis
WPGAG

SEQ ID NO: 232520 - protein, 9 aa, Mycobacterium bovis
WPLGPTHPS

SEQ ID NO: 232521 - protein, 15 aa, Mycobacterium bovis
YAHSSYHRGVFAPAR

SEQ ID NO: 232522 - protein, 8 aa, Mycobacterium bovis
YDATTGRV

SEQ ID NO: 232523 - protein, 4 aa, Mycobacterium bovis
YDES

SEQ ID NO: 232524 - protein, 5 aa, Mycobacterium bovis
YGVRP

SEQ ID NO: 232525 - protein, 9 aa, Mycobacterium bovis
YPEPPPPGM

SEQ ID NO: 232526 - protein, 4 aa, Mycobacterium bovis
YSPE

SEQ ID NO: 232527 - protein, 17 aa, Mycobacterium bovis
YTPNPNDAPGGPLVERA

SEQ ID NO: 232528 - protein, 8 aa, Mycobacterium bovis
YTPPEAEE

SEQ ID NO: 232529 - protein, 8 aa, Mycobacterium bovis
YTSPGGDR

SEQ ID NO: 232530 - protein, 4 aa, Mycobacterium bovis
YYGQ

SEQ ID NO: 232531 - protein, 34 aa, Mycobacterium bovis
AAAAGSSATGGAAPVGAGAMGQGAQSGGSTRPGL

SEQ ID NO: 232532 - protein, 8 aa, Mycobacterium bovis
AAAPPTLP

SEQ ID NO: 232533 - protein, 5 aa, Mycobacterium bovis
AAAPY

SEQ ID NO: 232534 - protein, 19 aa, Mycobacterium bovis
AADDDHDHDHDHGGEPTPL

SEQ ID NO: 232535 - protein, 32 aa, Mycobacterium bovis
AADPALDAKHRDAARASDRLPHNDRNGEWWHS

SEQ ID NO: 232536 - protein, 6 aa, Mycobacterium bovis
AADPYD

SEQ ID NO: 232537 - protein, 9 aa, Mycobacterium bovis
AAGADPAAV

SEQ ID NO: 232538 - protein, 30 aa, Mycobacterium bovis; identical to SEQ ID NO: 192057

SEQ ID NO: 232539 - protein, 7 aa, Mycobacterium bovis
AALAPTT

SEQ ID NO: 232540 - protein, 4 aa, Mycobacterium bovis
AAMT

SEQ ID NO: 232541 - protein, 13 aa, Mycobacterium bovis
AAPAETDSTPPPW

SEQ ID NO: 232542 - protein, 19 aa, Mycobacterium bovis
AAQGRGASTISGALRSRDT

SEQ ID NO: 232543 - protein, 15 aa, Mycobacterium bovis
AAQTKQTATQARAAA

SEQ ID NO: 232544 - protein, 4 aa, Mycobacterium bovis
AARA

SEQ ID NO: 232545 - protein, 16 aa, Mycobacterium bovis
AASAPPPTHPYKPAGP

SEQ ID NO: 232546 - protein, 4 aa, Mycobacterium bovis
AAST

SEQ ID NO: 232547 - protein, 11 aa, Mycobacterium bovis
AATPAWAGPVG

SEQ ID NO: 232548 - protein, 8 aa, Mycobacterium bovis
AATTKTLP

SEQ ID NO: 232549 - protein, 14 aa, Mycobacterium bovis
AAYAASKAGVRSLG

SEQ ID NO: 232550 - protein, 9 aa, Mycobacterium bovis
ADAGFTASA

SEQ ID NO: 232551 - protein, 16 aa, Mycobacterium bovis
ADAGHAARTRYDSFPR

SEQ ID NO: 232552 - protein, 15 aa, Mycobacterium bovis
ADDANAVCVQALVAV

SEQ ID NO: 232553 - protein, 4 aa, Mycobacterium bovis
ADGQ

SEQ ID NO: 232554 - protein, 5 aa, Mycobacterium bovis
ADGTR

SEQ ID NO: 232555 - protein, 6 aa, Mycobacterium bovis
ADRAGR

SEQ ID NO: 232556 - protein, 7 aa, Mycobacterium bovis
ADRTDAP

SEQ ID NO: 232557 - protein, 23 aa, Mycobacterium bovis
AEPMPAKSVAADASTSGAPPDTT

SEQ ID NO: 232558 - protein, 11 aa, Mycobacterium bovis
AETAADPVAKL

SEQ ID NO: 232559 - protein, 7 aa, Mycobacterium bovis
AETANAT

SEQ ID NO: 232560 - protein, 5 aa, Mycobacterium bovis
AGDDV

SEQ ID NO: 232561 - protein, 9 aa, Mycobacterium bovis
AGDGPSRRF

SEQ ID NO: 232562 - protein, 13 aa, Mycobacterium bovis
AGDYTTAAEDKPA

SEQ ID NO: 232563 - protein, 158 aa, Mycobacterium bovis
AGGAAGAVGVGGTGGQGGAGGAGAAGADAPASTGLTGGTGFAGGAGGVGGQGGNAIAGGINGSGGAGGTGGQGGAGGMGGSGADNASGIGADGGAGGTGGNAGAGGAGGAAGTGGTGGVVGAAGKAGIGGTGGQGGACGAGSSGTDATATGATGGTGF

SEQ ID NO: 232564 - protein, 243 aa, Mycobacterium bovis
AGGAAGAVGVGGTGGQGGAGGAGAAGADAPASTGLTGGTGFAGGAGGVGGQGGNAIAGGINGSGGAGGTGGQGGAGGMGGSGADNASGIGADGGAGGTGGNAGAGGAGGAAGTGGTGGVVGAAGKAGIGGTGGQGGAGGAGSAGTDATATGATGGTGFSGGAGGAGGAGGNTGVGGTNGSGGQGGTGGAGGAGGAGGVGADNPTGIGGAGGTGGAGGTGGTGGAAGAGGAGGAVGTGGTGGVV

SEQ ID NO: 232565 - protein, 187 aa, Mycobacterium bovis
AGGAAGAVGVGGTGGQGGAGGMGGSGADNASGIGADGGAGGTGGNAGAGGAGGAAGTGGTGGVVGAAGKAGIGGTGGQGGAGGAGSAGTDATATGATGGTGFSGGAGGAGGAGGNTGVGGTNGSGGQGGTGGAGGAGGAGGVGADNPTGIGGAGGTGGAGGTGGTGGAAGAGGAGGAVGTGGTGGVV

SEQ ID NO: 232566 - protein, 11 aa, Mycobacterium bovis
AGGDGGAGGNA

SEQ ID NO: 232567 - protein, 11 aa, Mycobacterium bovis
AGGEGGSGGHS

SEQ ID NO: 232568 - protein, 27 aa, Mycobacterium bovis
AGGGHGGTGGLNTNGDGGVGGAGGNAG

SEQ ID NO: 232569 - protein, 5 aa, Mycobacterium bovis
AGMTT

SEQ ID NO: 232570 - protein, 12 aa, Mycobacterium bovis
AGPAGPAASAAT

SEQ ID NO: 232571 - protein, 6 aa, Mycobacterium bovis
AGPAPM

SEQ ID NO: 232572 - protein, 8 aa, Mycobacterium bovis
AGRSAHGW

SEQ ID NO: 232573 - protein, 23 aa, Mycobacterium bovis
AGTGGAGASTKAGGTGGTGGNGG

SEQ ID NO: 232574 - protein, 6 aa, Mycobacterium bovis
AHPDNR

SEQ ID NO: 232575 - protein, 11 aa, Mycobacterium bovis
AHPEFQPRASS

SEQ ID NO: 232576 - protein, 9 aa, Mycobacterium bovis
AITEAAQSR

SEQ ID NO: 232577 - protein, 14 aa, Mycobacterium bovis
AKAEGRDTINGQNT

SEQ ID NO: 232578 - protein, 22 aa, Mycobacterium bovis
ALPGGSSNRFSPAPAPAPIASP

SEQ ID NO: 232579 - protein, 6 aa, Mycobacterium bovis
AMKPPV

SEQ ID NO: 232580 - protein, 5 aa, Mycobacterium bovis
ANLPG

SEQ ID NO: 232581 - protein, 8 aa, Mycobacterium bovis
ANPQHHRR

SEQ ID NO: 232582 - protein, 23 aa, Mycobacterium bovis
APAAPRSPAPPARPGTAAPAVTA

SEQ ID NO: 232583 - protein, 6 aa, Mycobacterium bovis
APGPGE

SEQ ID NO: 232584 - protein, 4 aa, Mycobacterium bovis
APGV

SEQ ID NO: 232585 - protein, 9 aa, Mycobacterium bovis
APMAAPGAT

SEQ ID NO: 232586 - protein, 7 aa, Mycobacterium bovis
APNPDFP

SEQ ID NO: 232587 - protein, 14 aa, Mycobacterium bovis
APSTATAASAARAV

SEQ ID NO: 232588 - protein, 9 aa, Mycobacterium bovis
AQPGSGESL

SEQ ID NO: 232589 - protein, 4 aa, Mycobacterium bovis
AQSD

SEQ ID NO: 232590 - protein, 5 aa, Mycobacterium bovis
AQTHV

SEQ ID NO: 232591 - protein, 6 aa, Mycobacterium bovis
ARAPRV

SEQ ID NO: 232592 - protein, 4 aa, Mycobacterium bovis
ARDL

SEQ ID NO: 232593 - protein, 18 aa, Mycobacterium bovis
ARDTATVGGMASTNAGGL

SEQ ID NO: 232594 - protein, 15 aa, Mycobacterium bovis
ARGVNGGPGRWRWRR

SEQ ID NO: 232595 - protein, 8 aa, Mycobacterium bovis
ARLDESVP

SEQ ID NO: 232596 - protein, 11 aa, Mycobacterium bovis
ARMAEPKLGQP

SEQ ID NO: 232597 - protein, 6 aa, Mycobacterium bovis
ARPTPW

SEQ ID NO: 232598 - protein, 8 aa, Mycobacterium bovis
ARRTGATR

SEQ ID NO: 232599 - protein, 8 aa, Mycobacterium bovis
ARTESRGC

SEQ ID NO: 232600 - protein, 12 aa, Mycobacterium bovis
ASAPQTTPAPPI

SEQ ID NO: 232601 - protein, 7 aa, Mycobacterium bovis
ASASSQF

SEQ ID NO: 232602 - protein, 12 aa, Mycobacterium bovis
ASATQSQPPLPA

SEQ ID NO: 232603 - protein, 4 aa, Mycobacterium bovis
ASDA

SEQ ID NO: 232604 - protein, 409 aa, Mycobacterium bovis
ASGAAGNAGVGGAGGQGGDGGAGGAGADADQPGATGGTGFAGGAGGAGGAGGSSGAGGTNGSGGAGGTGGQGGMGGAGGAGADNPTGIGGTGGDGGTGGAAGAGGAGGAAGTGGTGGMIGTTGNAGVGGAGGQGGDGGAGGAGADADQPGATGGTGFAGGAGGAGGAGGSSGAGGTNGSGGAGGTGGQGGAGGAGGAGADNPTGIGGTGGDGGTGGAAGAGGAGGAAGTGGTGGMIGTTGNAGVGGAGGQGGDGGAGGAGGAGGSSGAGGTNGSGGAGGTGGQGGAGGAGGAGADNPTGIGGTGGDGGTGGAAGAGGAGGAAGTGGTGGMIGTTGNAGVGGAGGQGGDGGAGGAGADADQPGATGGTGFAGGAGGAGGAGGSSGAGGTNGSGGAGGTGGQGGAGGAGIS

SEQ ID NO: 232605 - protein, 327 aa, Mycobacterium bovis
ASGAAGNAGVGGAGGQGGDGGAGGAGADADQPGATGGTGFAGGAGGAGGAGGSSGAGGTNGSGGAGGTGGQGGMGGAGGAGADNPTGIGGTGGDGGTGGAAGAGGAGGAAGTGGTGGMIGTTGNAGVGGAGGQGGDGGAGGAGADADQPGATGGTGFAGGAGGAGGAGGSSGAGGTNGSGGAGGTGGQGGAGGAGGAGADNPTGIGGTGGDGGTGGAAGAGGAGGAAGTGGTGGMIGTTGNAGVGGAGGQGGDGGAGGAGGAGGSSGAGGTNGSGGAGGTGGQGGAGGAGGAGADNPTGIGGTGGDGGTGGSAGARRGRRSGRHRRH

SEQ ID NO: 232606 - protein, 529 aa, Mycobacterium bovis
ASGAAGNAGVGGAGGQGGDGGAGGAGADADQPGATGGTGFAGGAGGAGGAGGSSGAGGTNGSGGAGGTGGQGGMGGAGGAGADNPTGIGGTGGDGGTGGAAGAGGAGGAAGTGGTGGMIGTTGNAGVGGAGGQGGDGGAGGAGADADQPGATGGTGFAGGAGGAGGAGGSSGAGGTNGSGGAGGTGGQGGAGGAGGAGADNPTGIGGTGGDGGTGGAAGAGGAGGAAGTGGTGGMIGTTGNAGVGGAGGQGGDGGTGGAGGAGGSSGAGGTNGSGGAGGTGGQGGAGGAGGAGADNPTGIGGTGGDGGTGGAAGAGGAGGAAGTGGTGGMIGTTGNAGVGGAGGQGGDGGAGGAGADADQPGATGGTGFAGGAGGAGGAGGAGGSSGAGGTNGSGGAGGTGGQGGAGGAGGAGADNPTGIGGTGGDGGTGGAAGAGGAGGAAGTGGTGGMIGTTGNAGVGGAGGQGGDGGAGGAGADADQPGATGGTGFAGGAGGAGGAGGSSGAGGTNGSGGAGGTGGQGGAGGAGIS

SEQ ID NO: 232607 - protein, 25 aa, Mycobacterium bovis
ASGGAGGSGGSSLTDSGGIGGVGGA

SEQ ID NO: 232608 - protein, 7 aa, Mycobacterium bovis
ASQSTPQ

SEQ ID NO: 232609 - protein, 17 aa, Mycobacterium bovis
ASSTGAGAYASAEATAA

SEQ ID NO: 232610 - protein, 18 aa, Mycobacterium bovis
ASSTGAGAYASAEATAAE

SEQ ID NO: 232611 - protein, 19 aa, Mycobacterium bovis
ASTQAKTRAMQATAQAAAY

SEQ ID NO: 232612 - protein, 9 aa, Mycobacterium bovis
ATAAPAAPA

SEQ ID NO: 232613 - protein, 10 aa, Mycobacterium bovis
ATAGAFSRPG

SEQ ID NO: 232614 - protein, 10 aa, Mycobacterium bovis
ATAPPADQIA

SEQ ID NO: 232615 - protein, 4 aa, Mycobacterium bovis
ATPG

SEQ ID NO: 232616 - protein, 6 aa, Mycobacterium bovis
ATPIPT

SEQ ID NO: 232617 - protein, 7 aa, Mycobacterium bovis
ATQESEM

SEQ ID NO: 232618 - protein, 10 aa, Mycobacterium bovis
ATSPAPGTAN

SEQ ID NO: 232619 - protein, 12 aa, Mycobacterium bovis
ATTNPAGSTGDG

SEQ ID NO: 232620 - protein, 8 aa, Mycobacterium bovis
ATTPSLPE

SEQ ID NO: 232621 - protein, 7 aa, Mycobacterium bovis
ATVTTAD

SEQ ID NO: 232622 - protein, 35 aa, Mycobacterium bovis
AVNGEPAPLAPPPADLAPPAPADLAPPAPADLAPP

SEQ ID NO: 232623 - protein, 14 aa, Mycobacterium bovis
AWTGGGSDKALAAA

SEQ ID NO: 232624 - protein, 16 aa, Mycobacterium bovis
AYAHSSYHRGVFAPAR

SEQ ID NO: 232625 - protein, 6 aa, Mycobacterium bovis
DAADWE

SEQ ID NO: 232626 - protein, 15 aa, Mycobacterium bovis
DAAIPTGIQNPCFSH

SEQ ID NO: 232627 - protein, 8 aa, Mycobacterium bovis
DAGKTKRA

SEQ ID NO: 232628 - protein, 11 aa, Mycobacterium bovis
DAGVKPPRTEA

SEQ ID NO: 232629 - protein, 10 aa, Mycobacterium bovis
DAPGGGLGGS

SEQ ID NO: 232630 - protein, 9 aa, Mycobacterium bovis
DARHGSPAF

SEQ ID NO: 232631 - protein, 8 aa, Mycobacterium bovis
DATPQVRG

SEQ ID NO: 232632 - protein, 12 aa, Mycobacterium bovis
DDFGDGPTTPMV

SEQ ID NO: 232633 - protein, 9 aa, Mycobacterium bovis
DDVAGSDSA

SEQ ID NO: 232634 - protein, 8 aa, Mycobacterium bovis
DDVGGTWR

SEQ ID NO: 232635 - protein, 8 aa, Mycobacterium bovis
DGAASGLR

SEQ ID NO: 232636 - protein, 8 aa, Mycobacterium bovis
DGAGPGSE

SEQ ID NO: 232637 - protein, 7 aa, Mycobacterium bovis
DGAYGAQ

SEQ ID NO: 232638 - protein, 11 aa, Mycobacterium bovis
DGDQQARGRPI

SEQ ID NO: 232639 - protein, 44 aa, Mycobacterium bovis
DGGNGYSQTTPGAVGGAGGSAGFIGNGGAAGAGGPGAGGGTGGL

SEQ ID NO: 232640 - protein, 14 aa, Mycobacterium bovis
DGGQGGPGGNAGTV

SEQ ID NO: 232641 - protein, 23 aa, Mycobacterium bovis
DGGSGGSTLQGFSDGGTGGNAGM

SEQ ID NO: 232642 - protein, 6 aa, Mycobacterium bovis
DGPHAH

SEQ ID NO: 232643 - protein, 12 aa, Mycobacterium bovis
DGRARCTPTDAA

SEQ ID NO: 232644 - protein, 7 aa, Mycobacterium bovis
DHDQTDR

SEQ ID NO: 232645 - protein, 21 aa, Mycobacterium bovis
DLASLGSSISAANAAAAANTT

SEQ ID NO: 232646 - protein, 5 aa, Mycobacterium bovis
DLPAA

SEQ ID NO: 232647 - protein, 7 aa, Mycobacterium bovis
DNDDSVD

SEQ ID NO: 232648 - protein, 6 aa, Mycobacterium bovis
DNTYPG

SEQ ID NO: 232649 - protein, 6 aa, Mycobacterium bovis
DPAPTP

SEQ ID NO: 232650 - protein, 8 aa, Mycobacterium bovis
DPAVPGTN

SEQ ID NO: 232651 - protein, 6 aa, Mycobacterium bovis
DPFRRP

SEQ ID NO: 232652 - protein, 11 aa, Mycobacterium bovis
DPGASQSTTNP

SEQ ID NO: 232653 - protein, 10 aa, Mycobacterium bovis
DPTGKTVVPD

SEQ ID NO: 232654 - protein, 11 aa, Mycobacterium bovis
DPTGKTVVPDP

SEQ ID NO: 232655 - protein, 14 aa, Mycobacterium bovis
DQGERKVRDHPDFP

SEQ ID NO: 232656 - protein, 12 aa, Mycobacterium bovis
DQPNLGGSGGYS

SEQ ID NO: 232657 - protein, 7 aa, Mycobacterium bovis
DRVDPSS

SEQ ID NO: 232658 - protein, 5 aa, Mycobacterium bovis
DSEGC

SEQ ID NO: 232659 - protein, 7 aa, Mycobacterium bovis
DSGTEST

SEQ ID NO: 232660 - protein, 5 aa, Mycobacterium bovis
DSGYP

SEQ ID NO: 232661 - protein, 5 aa, Mycobacterium bovis
DSIPT

SEQ ID NO: 232662 - protein, 7 aa, Mycobacterium bovis
DSRGQAY

SEQ ID NO: 232663 - protein, 6 aa, Mycobacterium bovis
EAPTGW

SEQ ID NO: 232664 - protein, 6 aa, Mycobacterium bovis
EDPPRR

SEQ ID NO: 232665 - protein, 13 aa, Mycobacterium bovis
EETDNAEDKPETL

SEQ ID NO: 232666 - protein, 13 aa, Mycobacterium bovis
EGERATADAVGRT

SEQ ID NO: 232667 - protein, 7 aa, Mycobacterium bovis
EGIKESV

SEQ ID NO: 232668 - protein, 4 aa, Mycobacterium bovis
EGTM

SEQ ID NO: 232669 - protein, 5 aa, Mycobacterium bovis
EHGYP

SEQ ID NO: 232670 - protein, 9 aa, Mycobacterium bovis
EINGNGSRI

SEQ ID NO: 232671 - protein, 20 aa, Mycobacterium bovis
ENRPSYSDTNLENSKPFNPK

SEQ ID NO: 232672 - protein, 7 aa, Mycobacterium bovis
EPTPAER

SEQ ID NO: 232673 - protein, 5 aa, Mycobacterium bovis
ERAEQ

SEQ ID NO: 232674 - protein, 4 aa, Mycobacterium bovis
ESAG

SEQ ID NO: 232675 - protein, 4 aa, Mycobacterium bovis
ESQA

SEQ ID NO: 232676 - protein, 16 aa, Mycobacterium bovis
ESTTNARRAHAPTRTS

SEQ ID NO: 232677 - protein, 11 aa, Mycobacterium bovis
ETAGNQIRDAK

SEQ ID NO: 232678 - protein, 10 aa, Mycobacterium bovis
EVRGPTGYDG

SEQ ID NO: 232679 - protein, 8 aa, Mycobacterium bovis
EVSTRTPV

SEQ ID NO: 232680 - protein, 444 aa, Mycobacterium bovis
FAGGQGGQGGAGGNAGAGGINGAGGTGGTGGAGGDGAPATLIGGPDGGDGGQGGIGGDGGNAGFGAGVPGDGGIGGTGGAGGAGGAGGAGDAGADGDPSIDGGQGGAGGHGGQGGKGGLNSTGLASAASGDGGNGGAGGAGGNGGDGDGFIGGSGGTGGTGGDAGAGGLANTGGTAGNAGIGGAGGRGGDGGAGDSGALSQDGNGFAGGQGGQGGAGGNAGAGGINGAGGTGGTGGAGGDGAPATLIGGPDGGDGGQGGGAGFGSGVAGAAGAGGNGGKGGDGGTGGTGGTNFAGGQGGAGGRGGAGGNGANGVGDNAAGGDGGNGGAGGLGGGGGTGGTNGNGGLGGGGGNGGAGGAGGTPTGSGTEGTGGDGGDAGAGGNGGSATGVGNGGNGGDGGNGGDGGNGAPGGFGGGAGAGGLGGSGAGGGTDGDDGNGGSPGTDG

SEQ ID NO: 232681 - protein, 9 aa, Mycobacterium bovis
FANPGLGAS

SEQ ID NO: 232682 - protein, 14 aa, Mycobacterium bovis
FAPGGGSGGNGGNG

SEQ ID NO: 232683 - protein, 6 aa, Mycobacterium bovis
FDETSD

SEQ ID NO: 232684 - protein, 848 aa, Mycobacterium bovis
FDGGQGGQGGAGGNAGAGGINGAGGAGGTGGAGGDGAPATLIGGPDGGDGGQGGIGGDGGNAGFGAGVPGDGGIGGTGGAGGAGGAGADGDPSIDGGQGGAGGHGGQGGKGGLNSTGLASAASGDGGNGGAGGAGGNGGDGDGFIGGSGGTGGTGGDAGVGGLANTGGTAGNAGIGGAGGRGGDGGAGDSGALSQDGNGFAGGQGGQGGAGGNAGAGGINGAGGTGGTGGAGGDGAPATLIGGPDGGDGGQGGIGGDGGNAGFGAGVPGDGGIGGTGGAGGAGGAGADGDPSIDGGQGGAGGHGGQGGKGGLNSTGLASAASGDGGNGGAGGAGGNGGDGDGFIGGSGGTGGTGGDAGVGGLANTGGTAGNAGIGGAGGRGGDGGAGDSGALSQDGNGFAGGQGGQGGAGGNAGAGGINGAGGTGGTGGAGGDGQNGTTGVASEGGAGGQGGDGGDGGQGGIGGDGGNAGFGAGVPGDGGIGGTGGAGGAGGAGADGDPSIDGGQGGAGGHGGQGGKGGLNSTGLASAASGDGGNGGAGGAGGNGGDGDGFIGGSGGTGGTGGDAGVGGLANTGGTAGNAGIGGAGGRGGDGGAGDSGALSQDGNGFAGGQGGQGGAGGNAGAGGINGAGGTGGTGGAGGDGAPATLIGGPDGGDGGDGGQGGGAGFGSGVAGAAGAGGNGGKGGDGGTGGTGGTNFAGGQGGAGGRGGAGGNGANGVGDNAAGGDGGNGGAGGLGGGGGTGGTNGNGGLGGGGGNGGAGGAGGTPTGSGTEGTGGDGGDAGAGGNGGSATGVGNGGNGGDGGNGGDGGNGAPGGFGGGAGAGGLGGSGAGGGTDGDDGNGGSPGTDG

SEQ ID NO: 232685 - protein, 1047 aa, Mycobacterium bovis
FDGGQGGQGGAGGNAGAGGINGAGGAGGTGGAGGDGAPATLIGGPDGGDGGQGGIGGDGGNAGFGAGVPGDGGIGGTGGAGGAGGAGADGDPSIDGGQGGAGGHGGQGGKGGLNSTGLASAASGDGGNGGAGGAGGNGGDGDGFIGGSGGTGGTGGDAGVGGLANTGGTAGNAGIGGAGGRGGDGGAGDSGALSQDGNGFAGGQGGQGGAGGNAGAGGINGAGGTGGTGGAGGDGAPATLIGGPDGGDGGQGGIGGDGGNAGFGAGVPGDGGIGGTGGAGGAGGAGADGDPSIDGGQGGAGGHGGQGGKGGLNSTGLASAASGDGGNGGAGGAGGNGGDGDGFIGGSGGTGGTGGDAGVGGLANTGGTAGNAGIGGAGGRGGDGGAGDSGALSQDGNGFAGGQGGQGGAGGNAGAGGINGAGGTGGTGGAGGDGQNGTTGVASEGGAGGQGGDGGDGGQGGIGGDGGNAGFGAGVPGDGGIGGTGGAGGAGGAGADGDPSIDGGQGGAGGHGGQGGKGGLNSTGLASAASGDGGNGGAGGAGGNGGDGDGFIGGSGGTGGTGGDAGVGGLANTGGTAGNAGIGGAGGRGGDGGAGDSGALSQDGNGFAGGQGGQGGAGGNAGAGGINGAGGTGGTGGAGGDGAPATLIGGPDGGDGGQGGIGGDGGNAGFGAGVPGDGGIGGTGGAGGAGGAGADGDPSIDGGQGGAGGHGGQGGKGGLNSTGLASAASGDGGNGGAGGAGGNGGDGDGFIGGSGGTGGTGGDAGVGGLANTGGTAGNAGIGGAGGRGGDGGAGDSGALSQDGNGFAGGQGGQGGAGGNAGAGGINGAGGTGGTGGAGGDGAPATLIGGPDGGDGGDGGQGGGAGFGSGVAGAAGAGGNGGKGGDGGTGGTGGTNFAGGQGGAGGRGGAGGNGANGVGDNAAGGDGGNGGAGGLGGGGGTGGTNGNGGLGGGGGNGGAGGAGGTPTGSGTEGTGGDGGDAGAGGNGGSATGVGNGGNGGDGGNGGDGGNGAPGGFGGGAGAGGLGGSGAGGGTDGDDGNGGSPGTDG

SEQ ID NO: 232686 - protein, 68 aa, Mycobacterium bovis
FDGGQGGQGGDGGSAGAGGINGAGGAGGDGGDGGDGATGAAGLGDNGGVGGDGGAGGAAGNGGNAGVG

SEQ ID NO: 232687 - protein, 8 aa, Mycobacterium bovis
FGDGGNGG

SEQ ID NO: 232688 - protein, 6 aa, Mycobacterium bovis
FGRGSN

SEQ ID NO: 232689 - protein, 15 aa, Mycobacterium bovis
FGSGGAGGNGGVGQG

SEQ ID NO: 232690 - protein, 9 aa, Mycobacterium bovis
FPAPGVKPH

SEQ ID NO: 232691 - protein, 28 aa, Mycobacterium bovis
FSAEPHATDGSPVANRVEPGKRPRSSMA

SEQ ID NO: 232692 - protein, 12 aa, Mycobacterium bovis
FTGTEDQPAAVE

SEQ ID NO: 232693 - protein, 28 aa, Mycobacterium bovis
FVGNGGAGGNGQLGSGAVSSAGGMGGNG

SEQ ID NO: 232694 - protein, 12 aa, Mycobacterium bovis
GAEGAAARTADR

SEQ ID NO: 232695 - protein, 80 aa, Mycobacterium bovis
GAGGAGGNTGVGGTNGSGGQDGTTGAGGACGAGGVGADNPTGIGGAGGTGGAGGTGGTGGAAGAGGAGGAVGTGGTGGVV

SEQ ID NO: 232696 - protein, 79 aa, Mycobacterium bovis; identical to SEQ ID NO: 192510

SEQ ID NO: 232697 - protein, 45 aa, Mycobacterium bovis
GAGGDGGAGGKGGDGGDGGSDPTEGRGFGGLGGAGGAGGKGGAGT

SEQ ID NO: 232698 - protein, 26 aa, Mycobacterium bovis
GAGGHGGAGGLGAVTGGVGGAGGAGG

SEQ ID NO: 232699 - protein, 27 aa, Mycobacterium bovis
GAGGTGGAGGGSTLAGGAGGAGGNGGL

SEQ ID NO: 232700 - protein, 25 aa, Mycobacterium bovis
GAGGTGGAGGSLGPGAGGAGGNGGL

SEQ ID NO: 232701 - protein, 28 aa, Mycobacterium bovis
GAGGTGGHGGFADSSFGGVGGAGGAGGL

SEQ ID NO: 232702 - protein, 28 aa, Mycobacterium bovis
GAGGTGGSGGHGTPAAVPGGAGGAGGNA

SEQ ID NO: 232703 - protein, 4 aa, Mycobacterium bovis
GAGS

SEQ ID NO: 232704 - protein, 7 aa, Mycobacterium bovis
GAHTPAA

SEQ ID NO: 232705 - protein, 7 aa, Mycobacterium bovis
GANGATL

SEQ ID NO: 232706 - protein, 7 aa, Mycobacterium bovis
GAREDLP

SEQ ID NO: 232707 - protein, 8 aa, Mycobacterium bovis
GATPENAA

SEQ ID NO: 232708 - protein, 9 aa, Mycobacterium bovis
GAWQGPSAA

SEQ ID NO: 232709 - protein, 11 aa, Mycobacterium bovis
GCSADTGDRHP

SEQ ID NO: 232710 - protein, 32 aa, Mycobacterium bovis; identical to SEQ ID NO: 192533

SEQ ID NO: 232711 - protein, 90 aa, Mycobacterium bovis
GDGNGGHGGNGGNPGAGGQGGSGGAGSTPGAKGAHGFTPTSGGDGGDGGNGGHSQVVGGNGGDGGNGGNGGSAGTGGNGGRGGDGAFGGM

SEQ ID NO: 232712 - protein, 6 aa, Mycobacterium bovis
GDGVGG

SEQ ID NO: 232713 - protein, 10 aa, Mycobacterium bovis
GDVPLRPTTT

SEQ ID NO: 232714 - protein, 9 aa, Mycobacterium bovis
GEPHSTTNP

SEQ ID NO: 232715 - protein, 136 aa, Mycobacterium bovis
GEQGGQGGDGGAGGAGGIGGSAGGIGGSQGAGGHGGDGGQGGAGGSGGVGGGGAGAGGDGGAGGIGGTGGNGSIGGAAGNGGNGGRGGAGGMATAGSDGGNGGGGGNGGVGVGSAGGAGGTGGDGGAAGAGGAPGQ

SEQ ID NO: 232716 - protein, 11 aa, Mycobacterium bovis
GGAGGAGAAAI

SEQ ID NO: 232717 - protein, 9 aa, Mycobacterium bovis
GGAGGAGGG

SEQ ID NO: 232718 - protein, 23 aa, Mycobacterium bovis
GGAGGFTNGSALGGAGGAGGAGG

SEQ ID NO: 232719 - protein, 50 aa, Mycobacterium bovis; identical to SEQ ID NO: 192562

SEQ ID NO: 232720 - protein, 9 aa, Mycobacterium bovis
GGDATGAEV

SEQ ID NO: 232721 - protein, 23 aa, Mycobacterium bovis
GGGSWGDDCRPAGIGGLGGRGSR

SEQ ID NO: 232722 - protein, 37 aa, Mycobacterium bovis; identical to SEQ ID NO: 192569

SEQ ID NO: 232723 - protein, 53 aa, Mycobacterium bovis
GGIGGNGGDAGLFGNGGAGGAGAAGLPGAAGLNGGDGSDGGNGGTGGNGGRGG

SEQ ID NO: 232724 - protein, 9 aa, Mycobacterium bovis
GGIRDDESL

SEQ ID NO: 232725 - protein, 8 aa, Mycobacterium bovis
GGITPGNS

SEQ ID NO: 232726 - protein, 11 aa, Mycobacterium bovis
GGNGGNGGTGW

SEQ ID NO: 232727 - protein, 11 aa, Mycobacterium bovis
GGNGGVGGTSV

SEQ ID NO: 232728 - protein, 12 aa, Mycobacterium bovis
GGNGGVGGTSVA

SEQ ID NO: 232729 - protein, 14 aa, Mycobacterium bovis
GGNVSSEHGVGSRK

SEQ ID NO: 232730 - protein, 4 aa, Mycobacterium bovis
GGSS

SEQ ID NO: 232731 - protein, 4 aa, Mycobacterium bovis
GGTF

SEQ ID NO: 232732 - protein, 16 aa, Mycobacterium bovis
GGTGAAGMTSAGEATV

SEQ ID NO: 232733 - protein, 36 aa, Mycobacterium bovis
GGTGGPGGPGGPGGPGGPGGPGGVGGTGGAGGLGGT

SEQ ID NO: 232734 - protein, 7 aa, Mycobacterium bovis
GGTLPGI

SEQ ID NO: 232735 - protein, 24 aa, Mycobacterium bovis
GGVGGSGGAGSSGGAGGAGGAGGL

SEQ ID NO: 232736 - protein, 6 aa, Mycobacterium bovis
GGVSSL

SEQ ID NO: 232737 - protein, 30 aa, Mycobacterium bovis; identical to SEQ ID NO: 155247

SEQ ID NO: 232738 - protein, 52 aa, Mycobacterium bovis
GIGGNGGDAGLFGNGGAGGAGAAGLPGAAGLNGGDGSDGGNGGTGGNGGRGG

SEQ ID NO: 232739 - protein, 24 aa, Mycobacterium bovis
GIGGNGGDAGLFGNGGAGGPGPRA

SEQ ID NO: 232740 - protein, 12 aa, Mycobacterium bovis
GKAGSQTEYGSA

SEQ ID NO: 232741 - protein, 7 aa, Mycobacterium bovis
GKLPDSL

SEQ ID NO: 232742 - protein, 5 aa, Mycobacterium bovis
GKPYD

SEQ ID NO: 232743 - protein, 15 aa, Mycobacterium bovis
GKRLNEQAATDTFGN

SEQ ID NO: 232744 - protein, 8 aa, Mycobacterium bovis
GLASGNCY

SEQ ID NO: 232745 - protein, 38 aa, Mycobacterium bovis; identical to SEQ ID NO: 192603

SEQ ID NO: 232746 - protein, 241 aa, Mycobacterium bovis
GNAGIGGTGGKGGAGGTGFAGGAGGAGGQGGSSGAGGTNGSGGAGGTGGQGGAGGAGGAGADNPTGIGGAGGTGGTGGAAGAGGAGGAIGTGGTGGAVGSVGNAGIGGTGGTGGVGGAGGAGAAAAAGSSATGGAGFAGGAGGEGGAGGNSGVGGTNGSGGAGGAGGKGGTGGAGGSGADNPTGAGFAGGAGGTGGAAGAGGAGGATGTGGTGGVVGATGSAGIGGAGGRGGDGGDGASGL

SEQ ID NO: 232747 - protein, 18 aa, Mycobacterium bovis
GNGANGAPGTGANGGPGG

SEQ ID NO: 232748 - protein, 20 aa, Mycobacterium bovis
GNGGAGGAGGPGAGGGTGGL

SEQ ID NO: 232749 - protein, 117 aa, Mycobacterium bovis
GNGGAGGNGGTAGQGGDGGTALGAGGIGGDGGTGGAGGTGGTAGIGGSSAGAGGAGGDGGAGGTGGGSSMIGGKGGTGGNGGVGGTGGASALTIGNGSSAGAGGAGGAGGTGGTGGY

SEQ ID NO: 232750 - protein, 26 aa, Mycobacterium bovis
GNGGDGGSVGAAPTGIGNGGNGGNGG

SEQ ID NO: 232751 - protein, 12 aa, Mycobacterium bovis
GNGGDGGTGGTL

SEQ ID NO: 232752 - protein, 23 aa, Mycobacterium bovis
GNGGNGGNVPSGAADGGAGGDAR

SEQ ID NO: 232753 - protein, 7 aa, Mycobacterium bovis
GNSGNNN

SEQ ID NO: 232754 - protein, 4 aa, Mycobacterium bovis
GPAT

SEQ ID NO: 232755 - protein, 26 aa, Mycobacterium bovis
GPGQGWGYPQPRSGQRARRATGQGSG

SEQ ID NO: 232756 - protein, 9 aa, Mycobacterium bovis
GQAGGAVTA

SEQ ID NO: 232757 - protein, 105 aa, Mycobacterium bovis
GQGAGGDGGDGGAGGVGGDRGAGANGNQAVNAGAGGAGGHGGDPGAGGAGGTGGAGSTIGAHGAAGASPTSGGNGGAGGNGAHFSSGGKAGGNGGAGGAGGHGGL

SEQ ID NO: 232758 - protein, 7 aa, Mycobacterium bovis
GQISGSV

SEQ ID NO: 232759 - protein, 28 aa, Mycobacterium bovis
GRAGKAAAAHAAAAGRSRATSSATWPEP

SEQ ID NO: 232760 - protein, 5 aa, Mycobacterium bovis
GRLGG

SEQ ID NO: 232761 - protein, 12 aa, Mycobacterium bovis
GRNANDLNRPQF

SEQ ID NO: 232762 - protein, 4 aa, Mycobacterium bovis
GRQG

SEQ ID NO: 232763 - protein, 29 aa, Mycobacterium bovis
GRSAGKTSEPTCPTEPIDAADSSTTPDPS

SEQ ID NO: 232764 - protein, 13 aa, Mycobacterium bovis
GRSAPPSATIAFG

SEQ ID NO: 232765 - protein, 8 aa, Mycobacterium bovis
GSDENGAV

SEQ ID NO: 232766 - protein, 4 aa, Mycobacterium bovis
GSEL

SEQ ID NO: 232767 - protein, 15 aa, Mycobacterium bovis
GSGAGSRFIEHAAGT

SEQ ID NO: 232768 - protein, 84 aa, Mycobacterium bovis
GSGGAGGSGGTGTLSGGRGGAGGNAGTFYGSGGAGGAGGESDNGDGGNGGVGGKAGLVGEGGNGGDGGATIAGKGGSGGNGGNA

SEQ ID NO: 232769 - protein, 24 aa, Mycobacterium bovis
GSGGGEDDMGNGGNAGTRWYRCPR

SEQ ID NO: 232770 - protein, 6 aa, Mycobacterium bovis
GSGPGF

SEQ ID NO: 232771 - protein, 16 aa, Mycobacterium bovis
GSSISAANAAAAAPTT

SEQ ID NO: 232772 - protein, 17 aa, Mycobacterium bovis
GSSISAANAAAAAPTTA

SEQ ID NO: 232773 - protein, 35 aa, Mycobacterium bovis; identical to SEQ ID NO: 155272

SEQ ID NO: 232774 - protein, 15 aa, Mycobacterium bovis
GSTGEFKDKYGKSSA

SEQ ID NO: 232775 - protein, 7 aa, Mycobacterium bovis
GSTPDSE

SEQ ID NO: 232776 - protein, 4 aa, Mycobacterium bovis
GSVG

SEQ ID NO: 232777 - protein, 53 aa, Mycobacterium bovis
GTGGAGGVGGGGGAGGDGGRGGVATPGGQGGDAGDGGAGGAGGNGGGGASGAG

SEQ ID NO: 232778 - protein, 11 aa, Mycobacterium bovis
GTKRGPIPSYD

SEQ ID NO: 232779 - protein, 13 aa, Mycobacterium bovis
GTPPTAAAAESGM

SEQ ID NO: 232780 - protein, 12 aa, Mycobacterium bovis
GVETHPPNRHES

SEQ ID NO: 232781 - protein, 37 aa, Mycobacterium bovis
GVGGDGGSAGWLSGNGGDAGTGGGGGNAGAGGEGGIF

SEQ ID NO: 232782 - protein, 60 aa, Mycobacterium bovis
GVGGDGGSAGWLSGNGGDAGTGGGGGNAGAGGEGGIFGGNGGNGGTGGTAGGGGNGGRGA

SEQ ID NO: 232783 - protein, 44 aa, Mycobacterium bovis
GVGGDGGTGGQGGDGVQGEPGDTGAAGGAGGAGGRGGDGGSAGW

SEQ ID NO: 232784 - protein, 10 aa, Mycobacterium bovis
GVHPNDAGHE

SEQ ID NO: 232785 - protein, 4 aa, Mycobacterium bovis
HAEY

SEQ ID NO: 232786 - protein, 4 aa, Mycobacterium bovis
HETD

SEQ ID NO: 232787 - protein, 8 aa, Mycobacterium bovis
HGGDGGNA

SEQ ID NO: 232788 - protein, 24 aa, Mycobacterium bovis
HGGDGNHGRFGGNGGTGGNGGNTR

SEQ ID NO: 232789 - protein, 7 aa, Mycobacterium bovis
HPADGTV

SEQ ID NO: 232790 - protein, 5 aa, Mycobacterium bovis
HPSLE

SEQ ID NO: 232791 - protein, 11 aa, Mycobacterium bovis
HQDRTGADLTP

SEQ ID NO: 232792 - protein, 11 aa, Mycobacterium bovis
HQPSSEHTQPA

SEQ ID NO: 232793 - protein, 25 aa, Mycobacterium bovis
HQRHSPPQAGGAPTSSLRSASSSAQ

SEQ ID NO: 232794 - protein, 10 aa, Mycobacterium bovis
HTGSSLPSAP

SEQ ID NO: 232795 - protein, 8 aa, Mycobacterium bovis
IDDSTPNR

SEQ ID NO: 232796 - protein, 4 aa, Mycobacterium bovis
IDNS

SEQ ID NO: 232797 - protein, 7 aa, Mycobacterium bovis
IETATAA

SEQ ID NO: 232798 - protein, 37 aa, Mycobacterium bovis
IGGDGGAGGAGGVFSGGGAGGAGDAIGGSGGACGTGG

SEQ ID NO: 232799 - protein, 21 aa, Mycobacterium bovis
IGNGGAGGAGGPGAGGGTGGL

SEQ ID NO: 232800 - protein, 14 aa, Mycobacterium bovis
IGNGGDGGNSVQTD

SEQ ID NO: 232801 - protein, 27 aa, Mycobacterium bovis
IGNGGNGGAAGVSGDGTPGTGGNGGYA

SEQ ID NO: 232802 - protein, 12 aa, Mycobacterium bovis
ISGGGGDGGHGG

SEQ ID NO: 232803 - protein, 14 aa, Mycobacterium bovis
ITPTAVATTDGASH

SEQ ID NO: 232804 - protein, 9 aa, Mycobacterium bovis
KAAPGGDRE

SEQ ID NO: 232805 - protein, 6 aa, Mycobacterium bovis
KAPTGW

SEQ ID NO: 232806 - protein, 7 aa, Mycobacterium bovis
KARKTSL

SEQ ID NO: 232807 - protein, 6 aa, Mycobacterium bovis
KATGDP

SEQ ID NO: 232808 - protein, 5 aa, Mycobacterium bovis
KDDAI

SEQ ID NO: 232809 - protein, 9 aa, Mycobacterium bovis
KDGTLGGPN

SEQ ID NO: 232810 - protein, 6 aa, Mycobacterium bovis
KETVQS

SEQ ID NO: 232811 - protein, 10 aa, Mycobacterium bovis
KGQGRSVTDA

SEQ ID NO: 232812 - protein, 11 aa, Mycobacterium bovis
KNTPNSRGTIG

SEQ ID NO: 232813 - protein, 8 aa, Mycobacterium bovis
KQTPPQPL

SEQ ID NO: 232814 - protein, 21 aa, Mycobacterium bovis
KRSSPPAPSLPPVTSSPLEAA

SEQ ID NO: 232815 - protein, 4 aa, Mycobacterium bovis
KSYP

SEQ ID NO: 232816 - protein, 12 aa, Mycobacterium bovis
KTVNPSENRASD

SEQ ID NO: 232817 - protein, 7 aa, Mycobacterium bovis
LAGNSAK

SEQ ID NO: 232818 - protein, 9 aa, Mycobacterium bovis
LASPGSVSR

SEQ ID NO: 232819 - protein, 20 aa, Mycobacterium bovis
LDATDTPPPAPATSGQTSLD

SEQ ID NO: 232820 - protein, 13 aa, Mycobacterium bovis
LDPTGYLNAAVLF

SEQ ID NO: 232821 - protein, 8 aa, Mycobacterium bovis
LGANGATL

SEQ ID NO: 232822 - protein, 12 aa, Mycobacterium bovis
LGEDARSQHIDP

SEQ ID NO: 232823 - protein, 37 aa, Mycobacterium bovis
LGGGGGAGGAGGAGGNGGGASNSASIGGDGGSGGAGG

SEQ ID NO: 232824 - protein, 27 aa, Mycobacterium bovis
LGNGGNGGNGGTGTSAGSPGAGGAGGS

SEQ ID NO: 232825 - protein, 38 aa, Mycobacterium bovis
LGNGGNGGNGGTGTSAGSPGAGGAGGSLIGAEGLPGLL

SEQ ID NO: 232826 - protein, 15 aa, Mycobacterium bovis
LGQPGTYTDFGNGTS

SEQ ID NO: 232827 - protein, 9 aa, Mycobacterium bovis
LNDNNSRSK

SEQ ID NO: 232828 - protein, 21 aa, Mycobacterium bovis
LPATNGPSGARPDAPAASGTV

SEQ ID NO: 232829 - protein, 13 aa, Mycobacterium bovis
LSDQPPGVIVVVT

SEQ ID NO: 232830 - protein, 7 aa, Mycobacterium bovis
LSEERKV

SEQ ID NO: 232831 - protein, 25 aa, Mycobacterium bovis
LSGLSGGDGGAGGAGGAGGAGGTGG

SEQ ID NO: 232832 - protein, 49 aa, Mycobacterium bovis
LSGNGGDAGTGGGGGNAGAGGEGGIFGGNGGNGGTGGTAGGGGNGGRGA

SEQ ID NO: 232833 - protein, 9 aa, Mycobacterium bovis
LTGPGGATQ

SEQ ID NO: 232834 - protein, 4 aa, Mycobacterium bovis
LTPS

SEQ ID NO: 232835 - protein, 38 aa, Mycobacterium bovis; identical to SEQ ID NO: 192837

SEQ ID NO: 232836 - protein, 11 aa, Mycobacterium bovis
MEPKSAATEAY

SEQ ID NO: 232837 - protein, 16 aa, Mycobacterium bovis
MPEQTAAAVSRSGRQV

SEQ ID NO: 232838 - protein, 9 aa, Mycobacterium bovis
NAGHSGADG

SEQ ID NO: 232839 - protein, 9 aa, Mycobacterium bovis
NAPASTSPL

SEQ ID NO: 232840 - protein, 7 aa, Mycobacterium bovis
NASPVAQ

SEQ ID NO: 232841 - protein, 4 aa, Mycobacterium bovis
NEET

SEQ ID NO: 232842 - protein, 17 aa, Mycobacterium bovis
NGAGGGGGVGGNGATGP

SEQ ID NO: 232843 - protein, 17 aa, Mycobacterium bovis
NGANGAPGTGANGGDGG

SEQ ID NO: 232844 - protein, 17 aa, Mycobacterium bovis
NGANGQPGTGAPGGPAG

SEQ ID NO: 232845 - protein, 4 aa, Mycobacterium bovis
NGET

SEQ ID NO: 232846 - protein, 14 aa, Mycobacterium bovis
NGGAGGAGSAGTGV

SEQ ID NO: 232847 - protein, 116 aa, Mycobacterium bovis
NGGAGGNGGTAGQGGDGGTALGAGGIGGDGGTGGAGGTGGTAGIGGSSAGAGGAGGDGGAGGNGGGSSMIGGKGGTGGNGGVGGTGGASALTIGNGSSAGAGGAGGAGGTGGTGGY

SEQ ID NO: 232848 - protein, 116 aa, Mycobacterium bovis
NGGAGGNGGTAGQGGDGGTALGAGGIGGDGGTGGAGGTGGTAGIGGSSAGAGGAGGDGGAGGTGGGSSMIGGKGGTGGNGGVGGTGGASALTIGNGSSAGAGGAGGAGGTGGTGGY

SEQ ID NO: 232849 - protein, 25 aa, Mycobacterium bovis
NGGAGGSGGLGGDAGTGGAGGNGGL

SEQ ID NO: 232850 - protein, 14 aa, Mycobacterium bovis
NGGAGGSGGPTQIP

SEQ ID NO: 232851 - protein, 9 aa, Mycobacterium bovis
NGGGPRGTD

SEQ ID NO: 232852 - protein, 63 aa, Mycobacterium bovis
NGGNGGNGGIGQPGGAGGDAGLIGNGGNGGIGGPGATGLAGGAGGLGKAGFAGGAGGTGGTGG

SEQ ID NO: 232853 - protein, 22 aa, Mycobacterium bovis
NGGNGGNGGKAGGTPGAGGTSG

SEQ ID NO: 232854 - protein, 23 aa, Mycobacterium bovis
NGGNGGSGATGTNGGDGGDGGAG

SEQ ID NO: 232855 - protein, 20 aa, Mycobacterium bovis
NGGNGGSGGIGAGKAGVGGV

SEQ ID NO: 232856 - protein, 8 aa, Mycobacterium bovis
NGSLAGGT

SEQ ID NO: 232857 - protein, 8 aa, Mycobacterium bovis
NPAATTIP

SEQ ID NO: 232858 - protein, 4 aa, Mycobacterium bovis
NPGL

SEQ ID NO: 232859 - protein, 5 aa, Mycobacterium bovis
NPRAR

SEQ ID NO: 232860 - protein, 4 aa, Mycobacterium bovis
NPRY

SEQ ID NO: 232861 - protein, 6 aa, Mycobacterium bovis
NPTNTA

SEQ ID NO: 232862 - protein, 8 aa, Mycobacterium bovis
NRLRTKDS

SEQ ID NO: 232863 - protein, 6 aa, Mycobacterium bovis
NRRDEA

SEQ ID NO: 232864 - protein, 6 aa, Mycobacterium bovis
NSAQGY

SEQ ID NO: 232865 - protein, 21 aa, Mycobacterium bovis
NSPDSTPSATSPAPAPSPTPP

SEQ ID NO: 232866 - protein, 14 aa, Mycobacterium bovis
NTAAADDKLPLGGG

SEQ ID NO: 232867 - protein, 5 aa, Mycobacterium bovis
NTAGQ

SEQ ID NO: 232868 - protein, 12 aa, Mycobacterium bovis
PANATAKIGQTS

SEQ ID NO: 232869 - protein, 32 aa, Mycobacterium bovis
PAPQGLPIGTRGTGGEGGAGGAGGDGGQGDIG

SEQ ID NO: 232870 - protein, 4 aa, Mycobacterium bovis
PDAD

SEQ ID NO: 232871 - protein, 18 aa, Mycobacterium bovis
PDIAPPAAGNQLARTAEC

SEQ ID NO: 232872 - protein, 5 aa, Mycobacterium bovis
PDQRA

SEQ ID NO: 232873 - protein, 6 aa, Mycobacterium bovis
PDSPEA

SEQ ID NO: 232874 - protein, 23 aa, Mycobacterium bovis
PDWGPPPGEDPVTSTVASDRGAG

SEQ ID NO: 232875 - protein, 4 aa, Mycobacterium bovis
PDYE

SEQ ID NO: 232876 - protein, 5 aa, Mycobacterium bovis
PESAT

SEQ ID NO: 232877 - protein, 5 aa, Mycobacterium bovis
PGPVA

SEQ ID NO: 232878 - protein, 10 aa, Mycobacterium bovis
PGSDPIPRRS

SEQ ID NO: 232879 - protein, 11 aa, Mycobacterium bovis
PGVEGHPYRQR

SEQ ID NO: 232880 - protein, 7 aa, Mycobacterium bovis
PHTRTQD

SEQ ID NO: 232881 - protein, 19 aa, Mycobacterium bovis
PLAQEREEDDEDDWDEEDD

SEQ ID NO: 232882 - protein, 18 aa, Mycobacterium bovis
PLPTGPDAAPACPTGGAG

SEQ ID NO: 232883 - protein, 10 aa, Mycobacterium bovis
PNPEEPGATD

SEQ ID NO: 232884 - protein, 13 aa, Mycobacterium bovis
PPAPPPPAAATAA

SEQ ID NO: 232885 - protein, 7 aa, Mycobacterium bovis
PPDREPA

SEQ ID NO: 232886 - protein, 4 aa, Mycobacterium bovis
PPEV

SEQ ID NO: 232887 - protein, 10 aa, Mycobacterium bovis
PPFNATQPVP

SEQ ID NO: 232888 - protein, 4 aa, Mycobacterium bovis
PPGI

SEQ ID NO: 232889 - protein, 4 aa, Mycobacterium bovis
PQDP

SEQ ID NO: 232890 - protein, 5 aa, Mycobacterium bovis
PREFR

SEQ ID NO: 232891 - protein, 20 aa, Mycobacterium bovis
PSPGSSTPVGQLPPAATQTL

SEQ ID NO: 232892 - protein, 9 aa, Mycobacterium bovis
PTGKTVVPD

SEQ ID NO: 232893 - protein, 8 aa, Mycobacterium bovis
PTGTVDVG

SEQ ID NO: 232894 - protein, 9 aa, Mycobacterium bovis
PTLSSKQKW

SEQ ID NO: 232895 - protein, 5 aa, Mycobacterium bovis
PTPSH

SEQ ID NO: 232896 - protein, 7 aa, Mycobacterium bovis
PTVQQPN

SEQ ID NO: 232897 - protein, 6 aa, Mycobacterium bovis
PVPPYN

SEQ ID NO: 232898 - protein, 13 aa, Mycobacterium bovis
PVSPRLPRRTGSR

SEQ ID NO: 232899 - protein, 7 aa, Mycobacterium bovis
QALGGED

SEQ ID NO: 232900 - protein, 6 aa, Mycobacterium bovis
QALRAD

SEQ ID NO: 232901 - protein, 4 aa, Mycobacterium bovis
QAND

SEQ ID NO: 232902 - protein, 6 aa, Mycobacterium bovis
QATASF

SEQ ID NO: 232903 - protein, 5 aa, Mycobacterium bovis
QDLTG

SEQ ID NO: 232904 - protein, 6 aa, Mycobacterium bovis
QGGRTS

SEQ ID NO: 232905 - protein, 10 aa, Mycobacterium bovis
QGKAASYRAA

SEQ ID NO: 232906 - protein, 7 aa, Mycobacterium bovis
QGNSDSI

SEQ ID NO: 232907 - protein, 6 aa, Mycobacterium bovis
QGNSIT

SEQ ID NO: 232908 - protein, 8 aa, Mycobacterium bovis
QKPFPPPC

SEQ ID NO: 232909 - protein, 10 aa, Mycobacterium bovis
QPDASVRSDA

SEQ ID NO: 232910 - protein, 8 aa, Mycobacterium bovis
QSNADEDK

SEQ ID NO: 232911 - protein, 12 aa, Mycobacterium bovis
QTDDRASPPETR

SEQ ID NO: 232912 - protein, 5 aa, Mycobacterium bovis
QVTST

SEQ ID NO: 232913 - protein, 7 aa, Mycobacterium bovis
RAGGRRP

SEQ ID NO: 232914 - protein, 7 aa, Mycobacterium bovis
RAVSPQV

SEQ ID NO: 232915 - protein, 7 aa, Mycobacterium bovis
REGGHSR

SEQ ID NO: 232916 - protein, 16 aa, Mycobacterium bovis
RGDIGGMSTATGPEGL

SEQ ID NO: 232917 - protein, 6 aa, Mycobacterium bovis
RGLAGS

SEQ ID NO: 232918 - protein, 8 aa, Mycobacterium bovis
RGWETDGG

SEQ ID NO: 232919 - protein, 12 aa, Mycobacterium bovis
RHQRGRRHRGCG

SEQ ID NO: 232920 - protein, 9 aa, Mycobacterium bovis
RIEPGPGAR

SEQ ID NO: 232921 - protein, 7 aa, Mycobacterium bovis
RKEFGPA

SEQ ID NO: 232922 - protein, 6 aa, Mycobacterium bovis
RKTTSV

SEQ ID NO: 232923 - protein, 14 aa, Mycobacterium bovis
RNDGTPIPDQVDSV

SEQ ID NO: 232924 - protein, 6 aa, Mycobacterium bovis
RPGEPL

SEQ ID NO: 232925 - protein, 4 aa, Mycobacterium bovis
RPPV

SEQ ID NO: 232926 - protein, 8 aa, Mycobacterium bovis
RPSGTEPK

SEQ ID NO: 232927 - protein, 9 aa, Mycobacterium bovis
RPVGGAVET

SEQ ID NO: 232928 - protein, 12 aa, Mycobacterium bovis
RQRRCRRGRRPR

SEQ ID NO: 232929 - protein, 7 aa, Mycobacterium bovis
RQTLQGA

SEQ ID NO: 232930 - protein, 4 aa, Mycobacterium bovis
RRQR

SEQ ID NO: 232931 - protein, 12 aa, Mycobacterium bovis
RRRRSSAQLFLS

SEQ ID NO: 232932 - protein, 12 aa, Mycobacterium bovis
RRRSSAPLSPAS

SEQ ID NO: 232933 - protein, 7 aa, Mycobacterium bovis
RSGNRQL

SEQ ID NO: 232934 - protein, 5 aa, Mycobacterium bovis
RTGKL

SEQ ID NO: 232935 - protein, 7 aa, Mycobacterium bovis
RTTTPYT

SEQ ID NO: 232936 - protein, 14 aa, Mycobacterium bovis
SAISSANAAAAVNT

SEQ ID NO: 232937 - protein, 5 aa, Mycobacterium bovis
SARRP

SEQ ID NO: 232938 - protein, 9 aa, Mycobacterium bovis
SAVDDASER

SEQ ID NO: 232939 - protein, 4 aa, Mycobacterium bovis
SDGG

SEQ ID NO: 232940 - protein, 7 aa, Mycobacterium bovis
SDLAGIG

SEQ ID NO: 232941 - protein, 8 aa, Mycobacterium bovis
SDNKPSDV

SEQ ID NO: 232942 - protein, 4 aa, Mycobacterium bovis
SDSI

SEQ ID NO: 232943 - protein, 5 aa, Mycobacterium bovis
SEGGI

SEQ ID NO: 232944 - protein, 8 aa, Mycobacterium bovis
SELPPPLH

SEQ ID NO: 232945 - protein, 7 aa, Mycobacterium bovis
SEPQRVD

SEQ ID NO: 232946 - protein, 12 aa, Mycobacterium bovis
SETSAEAAARHE

SEQ ID NO: 232947 - protein, 16 aa, Mycobacterium bovis
SFGSVTSGLAGQSWQG

SEQ ID NO: 232948 - protein, 17 aa, Mycobacterium bovis
SFGSVTSGLAGQSWQGA

SEQ ID NO: 232949 - protein, 5 aa, Mycobacterium bovis
SFRDA

SEQ ID NO: 232950 - protein, 4 aa, Mycobacterium bovis
SGAQ

SEQ ID NO: 232951 - protein, 26 aa, Mycobacterium bovis
SGGNGGSGGAGLTAGGDGGDGGNAGS

SEQ ID NO: 232952 - protein, 10 aa, Mycobacterium bovis
SGGSGGAGGF

SEQ ID NO: 232953 - protein, 7 aa, Mycobacterium bovis
SGLPNQT

SEQ ID NO: 232954 - protein, 10 aa, Mycobacterium bovis
SGLSSAGTAL

SEQ ID NO: 232955 - protein, 8 aa, Mycobacterium bovis
SGMQRQEA

SEQ ID NO: 232956 - protein, 8 aa, Mycobacterium bovis
SGNENHVH

SEQ ID NO: 232957 - protein, 9 aa, Mycobacterium bovis
SHNPATDNG

SEQ ID NO: 232958 - protein, 10 aa, Mycobacterium bovis
SLGSSSDLRV

SEQ ID NO: 232959 - protein, 12 aa, Mycobacterium bovis
SLPGAGGSLTRT

SEQ ID NO: 232960 - protein, 4 aa, Mycobacterium bovis
SLYE

SEQ ID NO: 232961 - protein, 20 aa, Mycobacterium bovis
SNRRQRRRGRVDRQRRQRRG

SEQ ID NO: 232962 - protein, 19 aa, Mycobacterium bovis
SPLSNHPLAGGSGPSAGAG

SEQ ID NO: 232963 - protein, 4 aa, Mycobacterium bovis
SPML

SEQ ID NO: 232964 - protein, 13 aa, Mycobacterium bovis
SPRKRSATGRSGL

SEQ ID NO: 232965 - protein, 7 aa, Mycobacterium bovis
SPSTTVP

SEQ ID NO: 232966 - protein, 4 aa, Mycobacterium bovis
SQSP

SEQ ID NO: 232967 - protein, 9 aa, Mycobacterium bovis
SSGPGPGSV

SEQ ID NO: 232968 - protein, 13 aa, Mycobacterium bovis
SSLTGAGGAYAAA

SEQ ID NO: 232969 - protein, 19 aa, Mycobacterium bovis
SSPAHADTDIGQPCSPEGA

SEQ ID NO: 232970 - protein, 15 aa, Mycobacterium bovis
STGAGAYASAEATAA

SEQ ID NO: 232971 - protein, 16 aa, Mycobacterium bovis
STGAGAYASAEATAAE

SEQ ID NO: 232972 - protein, 10 aa, Mycobacterium bovis
STNSAQLHTD

SEQ ID NO: 232973 - protein, 17 aa, Mycobacterium bovis
SWDPDRDAPGSAEPGDR

SEQ ID NO: 232974 - protein, 13 aa, Mycobacterium bovis
TAAADDKLPLGGG

SEQ ID NO: 232975 - protein, 16 aa, Mycobacterium bovis
TAAQTKQTATQARAAA

SEQ ID NO: 232976 - protein, 8 aa, Mycobacterium bovis
TADPANRH

SEQ ID NO: 232977 - protein, 155 aa, Mycobacterium bovis
TAKAGDGGAAGNGGNGGAGGAGGAGDNNFNGGQGGAGGQGGQGGLGGASTTSINANGGAGGNGGTGGKGGAGGAGTLGVGGSGGTGGDGGDAGAGGGGGFGGAAGKAGGGGNGGVGGDGGDGATGAAGLGDNGGVGGDGGAGGAAGNGGNAGVGL

SEQ ID NO: 232978 - protein, 126 aa, Mycobacterium bovis
TAKAGDGGAAGNGGNGGAGGAGGAGDNNFNGGQGGAGGQGGQGGLGGASTTSINANGGAGGNGGTGGKGGAGGAGTLGVGGSGGTGGDGGDAGAGGGGGFGGAAGKAGGGGNGGVGGDGGEGATGL

SEQ ID NO: 232979 - protein, 10 aa, Mycobacterium bovis
TAKAWGGGDL

SEQ ID NO: 232980 - protein, 8 aa, Mycobacterium bovis
TARREAVA

SEQ ID NO: 232981 - protein, 11 aa, Mycobacterium bovis
TAVANRSGTEP

SEQ ID NO: 232982 - protein, 10 aa, Mycobacterium bovis
TAVRDKDGIS

SEQ ID NO: 232983 - protein, 7 aa, Mycobacterium bovis
TCRETPD

SEQ ID NO: 232984 - protein, 7 aa, Mycobacterium bovis
TDPGGEI

SEQ ID NO: 232985 - protein, 5 aa, Mycobacterium bovis
TDRQI

SEQ ID NO: 232986 - protein, 10 aa, Mycobacterium bovis
TDVAAGQALQ

SEQ ID NO: 232987 - protein, 5 aa, Mycobacterium bovis
TEEAN

SEQ ID NO: 232988 - protein, 5 aa, Mycobacterium bovis
TEHRG

SEQ ID NO: 232989 - protein, 15 aa, Mycobacterium bovis
TGAGGTGGNGGTAGL

SEQ ID NO: 232990 - protein, 24 aa, Mycobacterium bovis
TGGAGGAGGFGGFGGDGGDDGIGG

SEQ ID NO: 232991 - protein, 24 aa, Mycobacterium bovis
TGGTGGAGGVGTTGTGGDGGAGGA

SEQ ID NO: 232992 - protein, 86 aa, Mycobacterium bovis
TGIDPSHAAGPAPAVAPTVTPPVAAPPASAPAPAPDAAQPVAVPGPPPAPPAPRAAAPAPASAAPAPAAAPAPASGFGADAPPTQD

SEQ ID NO: 232993 - protein, 5 aa, Mycobacterium bovis
TGSTG

SEQ ID NO: 232994 - protein, 7 aa, Mycobacterium bovis
TGTGGAS

SEQ ID NO: 232995 - protein, 4 aa, Mycobacterium bovis
THRR

SEQ ID NO: 232996 - protein, 5 aa, Mycobacterium bovis
TKATG

SEQ ID NO: 232997 - protein, 4 aa, Mycobacterium bovis
TPES

SEQ ID NO: 232998 - protein, 6 aa, Mycobacterium bovis
TPLPAP

SEQ ID NO: 232999 - protein, 134 aa, Mycobacterium bovis
TQGGDGTPGGAGVNGGNGGAGGDANGNPANTSIANAGAGGNGAAGGDGGANGGAGGAGGQAASAGSSVGGDGGNGGAGGTGTNGHAGGAGGAGGQAASAGSSVGGDGGNGGAGGTGTNGHAGGAGGAGGAGGRG

SEQ ID NO: 233000 - protein, 7 aa, Mycobacterium bovis
TRINQET

SEQ ID NO: 233001 - protein, 14 aa, Mycobacterium bovis
TSGGGAYAAAEAAA

SEQ ID NO: 233002 - protein, 8 aa, Mycobacterium bovis
TTADPDIP

SEQ ID NO: 233003 - protein, 17 aa, Mycobacterium bovis
TTASNSPVVTADPRLNT

SEQ ID NO: 233004 - protein, 11 aa, Mycobacterium bovis
TTKITGTIPAS

SEQ ID NO: 233005 - protein, 5 aa, Mycobacterium bovis
TVPEH

SEQ ID NO: 233006 - protein, 5 aa, Mycobacterium bovis
TYTTQ

SEQ ID NO: 233007 - protein, 6 aa, Mycobacterium bovis
VARTGL

SEQ ID NO: 233008 - protein, 11 aa, Mycobacterium bovis
VASTGSLPGIT

SEQ ID NO: 233009 - protein, 13 aa, Mycobacterium bovis
VDGSGGASGTAPL

SEQ ID NO: 233010 - protein, 10 aa, Mycobacterium bovis
VDHTGRYRGR

SEQ ID NO: 233011 - protein, 11 aa, Mycobacterium bovis
VETHPPNRHES

SEQ ID NO: 233012 - protein, 100 aa, Mycobacterium bovis
VGAPGQPGGAGGHGGAGGNGGAGGNGGQGVVSDGAGGAGGAGGDGGAPGDGANGGNGQGAGAFAGGGGGRGGDGGNAGNAGAGGPGGTGSTAGKAGPAGS

SEQ ID NO: 233013 - protein, 6 aa, Mycobacterium bovis
VGGSTA

SEQ ID NO: 233014 - protein, 15 aa, Mycobacterium bovis
VGGTGGGNPADEEAA

SEQ ID NO: 233015 - protein, 254 aa, Mycobacterium bovis
VGNGGAGGAGGNGANGAAGTNASDSGAVGGKGNSGGNGGQGGAGGDGGTLAGNGGAGGTGGRGADGGLGGSGAEGANATTAGERGQDGGKGGNGGVGGTGGNAVAPGANGGHGGNGGNPGFSGAGGLGGLSGDGVTRAAQGATPDFADTGGKGGNGGNGANAVAPGGTGASGGAGGNAGAGGKGGENIIGDGGGGGNGGAGGQGGDGTAGAGGDGGAGGKGGDGGDGGSDPTEGRGFGGLGGAGGAGGKGGAGT

SEQ ID NO: 233016 - protein, 221 aa, Mycobacterium bovis
VGNGGAGGAGGNGANGAAGTNASDSGAVGGKGNSGGNGGQGGAGGDGGTLAGNGGAGGTGGRGADGGLGGSGAEGANATTAGERGQDGGKGGNGGVGGTGGNAVAPGANGGHGGNGGNPGFSGAGGLGGLSGDGVTRAAQGATPDFADTGGKGGNGGNGANAVAPGGTGASGGAGGNAGAGGKGGENIIGDGGGGGNGGAGGQGGDGTAGAGGDGGAGGQD

SEQ ID NO: 233017 - protein, 271 aa, Mycobacterium bovis
VGNGGAGGAGGNGANGAAGTNASDSGAVGGKGNSGGNGGQGGAGGDGGTLAGNGGAGGTGGRGADGGLGGSGAEGANATTAGERGQDGGKGGNGGVGGTGGNAVAPGANGGHGGNGGNPGFSGAGGLGGLSGDGVTRAAQGATPDFADTGGKGGNGGNGANAVAPGGTGASGGAGGNAGAGGKGGENIIGDGGGGGNGGAGGQGGDGTAGAGGDGGAGGQGGDGTAGAGGDGGAGGKGGDGGDGGSDPTEGRGFGGLGGAGGAGGKGGAGT

SEQ ID NO: 233018 - protein, 7 aa, Mycobacterium bovis
VKSATTN

SEQ ID NO: 233019 - protein, 4 aa, Mycobacterium bovis
VPAG

SEQ ID NO: 233020 - protein, 4 aa, Mycobacterium bovis
VPEQ

SEQ ID NO: 233021 - protein, 25 aa, Mycobacterium bovis
VPPASTAATAATAATAEPAATAGAA

SEQ ID NO: 233022 - protein, 5 aa, Mycobacterium bovis
VPPPH

SEQ ID NO: 233023 - protein, 4 aa, Mycobacterium bovis
VPTQ

SEQ ID NO: 233024 - protein, 4 aa, Mycobacterium bovis
VPVP

SEQ ID NO: 233025 - protein, 9 aa, Mycobacterium bovis
VRAERVSNE

SEQ ID NO: 233026 - protein, 9 aa, Mycobacterium bovis
VRPGSAEEV

SEQ ID NO: 233027 - protein, 9 aa, Mycobacterium bovis
VRRDNTGYD

SEQ ID NO: 233028 - protein, 13 aa, Mycobacterium bovis
VSNRNSPTPQIDR

SEQ ID NO: 233029 - protein, 15 aa, Mycobacterium bovis
VSPAGSGKSTTIPLS

SEQ ID NO: 233030 - protein, 8 aa, Mycobacterium bovis
VSTVTGAA

SEQ ID NO: 233031 - protein, 7 aa, Mycobacterium bovis
VTDSGSG

SEQ ID NO: 233032 - protein, 8 aa, Mycobacterium bovis
VTGGSANY

SEQ ID NO: 233033 - protein, 7 aa, Mycobacterium bovis
VTRRGYG

SEQ ID NO: 233034 - protein, 6 aa, Mycobacterium bovis
VTTDPD

SEQ ID NO: 233035 - protein, 6 aa, Mycobacterium bovis
YAPGHE

SEQ ID NO: 233036 - protein, 12 aa, Mycobacterium bovis
YDAAATQSGGVC

SEQ ID NO: 233037 - protein, 8 aa, Mycobacterium bovis
YDQPATTV

SEQ ID NO: 233038 - protein, 4 aa, Mycobacterium bovis
YGVR

SEQ ID NO: 233039 - protein, 8 aa, Mycobacterium bovis
YPEPPPGM

SEQ ID NO: 233040 - protein, 14 aa, Mycobacterium bovis
YVTRQRRRFNGGLV

SEQ ID NO: 233041 - protein, 5 aa, Mycobacterium bovis
YYGQF

SEQ ID NO: 233042 - protein, 26 aa, Mycobacterium bovis
GAGGNGGDGDGFIGGSGGTGGTGGDA

SEQ ID NO: 233043 - protein, 23 aa, Mycobacterium bovis
GALSQDGNGFAGGQGGQGGAGGN

SEQ ID NO: 233044 - protein, 24 aa, Mycobacterium bovis
GNAGIGGAGGRGGDGGAGDSGALS

SEQ ID NO: 233045 - protein, 25 aa, Mycobacterium bovis
DADQPGATGGTGFAGGAGGAGGAGG

SEQ ID NO: 233046 - protein, 27 aa, Mycobacterium bovis
GAGGAGGRGALLLGAGGQGGLGGAGGQ

SEQ ID NO: 233047 - protein, 20 aa, Mycobacterium bovis
GDGAPATLIGGPDGGDGGQG

SEQ ID NO: 233048 - protein, 29 aa, Mycobacterium bovis
GTGGAGGAGGWLFGVGGAGGVGGAGGGTG

SEQ ID NO: 233049 - protein, 30 aa, Mycobacterium bovis
IGGDGGNAGFGAGVPGDGGIGGTGGAGGAG

SEQ ID NO: 233050 - protein, 25 aa, Mycobacterium bovis
VPDYYWCPGQPFDPAWGPNWDPYTC

SEQ ID NO: 233051 - protein, 17 aa, Mycobacterium bovis
APLGEPLPAAPADPAPP

SEQ ID NO: 233052 - protein, 17 aa, Mycobacterium bovis
ATLSVPFSAFPKPQNYP

SEQ ID NO: 233053 - protein, 20 aa, Mycobacterium bovis
DNPTGIGGTGGDGGTGGAAG

SEQ ID NO: 233054 - protein, 20 aa, Mycobacterium bovis
EFVTAAAGDLTNLGSSISAA

SEQ ID NO: 233055 - protein, 23 aa, Mycobacterium bovis
GDAWLNRHLSAYANWAKTNNSLL

SEQ ID NO: 233056 - protein, 19 aa, Mycobacterium bovis
GNAGVGLTAKAGDGGAAGN

SEQ ID NO: 233057 - protein, 29 aa, Mycobacterium bovis
INAPTQALLGRPLIGDGANATTPGGAGGA

SEQ ID NO: 233058 - protein, 18 aa, Mycobacterium bovis
LSAGYTFMGFAEDLPAVG

SEQ ID NO: 233059 - protein, 23 aa, Mycobacterium bovis
MSIARCVGNTLLLNGRTYSPPYT

SEQ ID NO: 233060 - protein, 22 aa, Mycobacterium bovis
SATWRARPRLAITPDGLAIRGW

SEQ ID NO: 233061 - protein, 24 aa, Mycobacterium bovis
TAGAFSRPGLPVEYLQVPSPSMGR

SEQ ID NO: 233062 - protein, 27 aa, Mycobacterium bovis
TGGHGGVGGDGGWLAPGGAGGAGGQGG

SEQ ID NO: 233063 - protein, 25 aa, Mycobacterium bovis
AAAEIAAATGMVFAVFADDDSLAAF

SEQ ID NO: 233064 - protein, 22 aa, Mycobacterium bovis
AAARAADLWRFTAGAVDQPNPV

SEQ ID NO: 233065 - protein, 17 aa, Mycobacterium bovis
AAARAAGATVFLVPAKN

SEQ ID NO: 233066 - protein, 19 aa, Mycobacterium bovis
AAARCPQLFIATADADRDA

SEQ ID NO: 233067 - protein, 26 aa, Mycobacterium bovis
AADEVSAAIAALFSSYARDYQTLSVQ

SEQ ID NO: 233068 - protein, 24 aa, Mycobacterium bovis
AADLIGRGCAQYAAQNPTGPGSVA

SEQ ID NO: 233069 - protein, 24 aa, Mycobacterium bovis
AADQRIRQVAPFLSYGQFTGSAPR

SEQ ID NO: 233070 - protein, 18 aa, Mycobacterium bovis
AADVAAMVSYHSGASAVA

SEQ ID NO: 233071 - protein, 25 aa, Mycobacterium bovis
AAEALSWGLVSAVYPAADFDAEVDK

SEQ ID NO: 233072 - protein, 24 aa, Mycobacterium bovis
AAESHTVEQMVLNAINAPTQTLFG

SEQ ID NO: 233073 - protein, 26 aa, Mycobacterium bovis
AAGGNGGAGGWLFGNGGAGGAGGLGV

SEQ ID NO: 233074 - protein, 25 aa, Mycobacterium bovis
AAGGNGGAGGWLYGNGGAGGAGGTS

SEQ ID NO: 233075 - protein, 25 aa, Mycobacterium bovis
AAHKVCRKLDGGMPVNDIVDGLRND

SEQ ID NO: 233076 - protein, 20 aa, Mycobacterium bovis
AAHPPWDPVIAVGNTARQPA

SEQ ID NO: 233077 - protein, 27 aa, Mycobacterium bovis
AAHQKLCEVYKLAARAVQIATNGDNPA

SEQ ID NO: 233078 - protein, 19 aa, Mycobacterium bovis
AAISALVLPSAFRPIPDPN

SEQ ID NO: 233079 - protein, 23 aa, Mycobacterium bovis
AALEVNWPFVFASMLENAVKGGV

SEQ ID NO: 233080 - protein, 23 aa, Mycobacterium bovis
AALHHPCCGDLVYGADPKLAKRL

SEQ ID NO: 233081 - protein, 23 aa, Mycobacterium bovis
AALNPPPMFPWMAPDPSAPMPGC

SEQ ID NO: 233082 - protein, 25 aa, Mycobacterium bovis
AALSAAGYLCWRGKDLATPRGWITA

SEQ ID NO: 233083 - protein, 19 aa, Mycobacterium bovis
AALTGEWFGALAVIAPSVS

SEQ ID NO: 233084 - protein, 19 aa, Mycobacterium bovis
AALVQVHRDGEFVVATVTA

SEQ ID NO: 233085 - protein, 18 aa, Mycobacterium bovis
AALYKKAFAPLNELAGSL

SEQ ID NO: 233086 - protein, 19 aa, Mycobacterium bovis
AANTIEWLSDYGLTGLLRR

SEQ ID NO: 233087 - protein, 26 aa, Mycobacterium bovis
AAQPLEWFCLFSSAAALVGSPGQGAY

SEQ ID NO: 233088 - protein, 23 aa, Mycobacterium bovis
AARYLCSGGLNLRDPAQVMAALL

SEQ ID NO: 233089 - protein, 28 aa, Mycobacterium bovis
AASAQAAAFYAQFVQALSAGGGAYAAAE

SEQ ID NO: 233090 - protein, 18 aa, Mycobacterium bovis
AATARPVFGDRFNTGNEE

SEQ ID NO: 233091 - protein, 25 aa, Mycobacterium bovis
AAVEAEYELMWAADVAAMAGYHSGA

SEQ ID NO: 233092 - protein, 20 aa, Mycobacterium bovis
AAVEGLKAIVLLANGADTYA

SEQ ID NO: 233093 - protein, 17 aa, Mycobacterium bovis
AAVGSYVSAEATNAAPL

SEQ ID NO: 233094 - protein, 24 aa, Mycobacterium bovis
ACELPGRLHALFARGDGVTPRVVL

SEQ ID NO: 233095 - protein, 26 aa, Mycobacterium bovis
ACPDAEVVFARGRFEPPGIGTVGNAF

SEQ ID NO: 233096 - protein, 21 aa, Mycobacterium bovis
ACTPDTFVFDGQRRLVYRGQL

SEQ ID NO: 233097 - protein, 24 aa, Mycobacterium bovis
ADAEARVLLARRFHNDAVRDTLAL

SEQ ID NO: 233098 - protein, 18 aa, Mycobacterium bovis
ADAVIRIVRDFMTQAHLK

SEQ ID NO: 233099 - protein, 19 aa, Mycobacterium bovis
ADDLFARFSAQWKECDGTT

SEQ ID NO: 233100 - protein, 18 aa, Mycobacterium bovis
ADESMLLSFERWAPDMGW

SEQ ID NO: 233101 - protein, 18 aa, Mycobacterium bovis
ADGCLVDGPLGRVGLEME

SEQ ID NO: 233102 - protein, 24 aa, Mycobacterium bovis
ADGTLDHAGAWAGFVTAFHISSDR

SEQ ID NO: 233103 - protein, 18 aa, Mycobacterium bovis
ADISFGSAVAVIGLGAVG

SEQ ID NO: 233104 - protein, 22 aa, Mycobacterium bovis
ADTRGGQLLVYGVDPLILRQAY

SEQ ID NO: 233105 - protein, 25 aa, Mycobacterium bovis
AEAVARLRRAGAIIMGKTNMPTGNQ

SEQ ID NO: 233106 - protein, 20 aa, Mycobacterium bovis
AEERRTCVFFESPRRLAACL

SEQ ID NO: 233107 - protein, 25 aa, Mycobacterium bovis
AEGISVNVTLIFSVQRYREVMDAYL

SEQ ID NO: 233108 - protein, 18 aa, Mycobacterium bovis
AEHGDLPLSFSVTNIQPA

SEQ ID NO: 233109 - protein, 26 aa, Mycobacterium bovis
AEKRPPPAPRLTFRPADSAADVVPIA

SEQ ID NO: 233110 - protein, 19 aa, Mycobacterium bovis
AELGVALRAAIAGPVAGLA

SEQ ID NO: 233111 - protein, 30 aa, Mycobacterium bovis
AENPDGQNGGLLFGNGGNGFTQTTAGVAGG

SEQ ID NO: 233112 - protein, 18 aa, Mycobacterium bovis
AEPGRITVILALHDLING

SEQ ID NO: 233113 - protein, 20 aa, Mycobacterium bovis
AEPKRYVVVPGVGHNDPELL

SEQ ID NO: 233114 - protein, 20 aa, Mycobacterium bovis
AEQAELWGGTADEPFDPNYH

SEQ ID NO: 233115 - protein, 19 aa, Mycobacterium bovis
AFHDQFVRALAAGAGAYAG

SEQ ID NO: 233116 - protein, 34 aa, Mycobacterium bovis
AFISGNFSNGVLWRGDYEGLWGLSGGSTIPAIPI

SEQ ID NO: 233117 - protein, 18 aa, Mycobacterium bovis
AFLGERIGVRRGVVVDAD

SEQ ID NO: 233118 - protein, 22 aa, Mycobacterium bovis
AFPEQWSGNFLFYNKQLFDDAG

SEQ ID NO: 233119 - protein, 29 aa, Mycobacterium bovis
AGADEVSAAIAALFGAHGQAYQTVSAQAS

SEQ ID NO: 233120 - protein, 57 aa, Mycobacterium bovis
AGADEVSAAIATLFGSHAREYQAISTQVAAFHDRFAQTLSAAVGSYVSAEATNAAPL

SEQ ID NO: 233121 - protein, 32 aa, Mycobacterium bovis
AGADEVSVLIAALFEAYAQEYQALSAQALAFH

SEQ ID NO: 233122 - protein, 20 aa, Mycobacterium bovis
AGADMLVRAWVRSYGVRATI

SEQ ID NO: 233123 - protein, 23 aa, Mycobacterium bovis
AGDARLPASGMLFVGTPDGQIVA

SEQ ID NO: 233124 - protein, 20 aa, Mycobacterium bovis
AGEFGRAWFVDLAPITDPDL

SEQ ID NO: 233125 - protein, 27 aa, Mycobacterium bovis
AGEPGRWSADRAHRWYQAHGWLVGANY

SEQ ID NO: 233126 - protein, 26 aa, Mycobacterium bovis
AGGAGGAGGWIHGHGGAGGDGGAGGA

SEQ ID NO: 233127 - protein, 28 aa, Mycobacterium bovis
AGGAGGNARLWGVGGAGGAGGDGGAGGA

SEQ ID NO: 233128 - protein, 24 aa, Mycobacterium bovis
AGGAGGNGGWLFGNGGAGGSGGDG

SEQ ID NO: 233129 - protein, 22 aa, Mycobacterium bovis
AGGAGGRLFGNGGAGGNGGTAG

SEQ ID NO: 233130 - protein, 24 aa, Mycobacterium bovis
AGGAGGTGGWLFGNGGAGGTGGAV

SEQ ID NO: 233131 - protein, 22 aa, Mycobacterium bovis
AGGAGGWLSGNGGAGGNGGTGA

SEQ ID NO: 233132 - protein, 20 aa, Mycobacterium bovis
AGGAGGWLYGDGGAGGAGGG

SEQ ID NO: 233133 - protein, 20 aa, Mycobacterium bovis
AGGAGGWLYGDGGAGGVGGV

SEQ ID NO: 233134 - protein, 20 aa, Mycobacterium bovis
AGGAGGWLYGDGGDGGAGGN

SEQ ID NO: 233135 - protein, 19 aa, Mycobacterium bovis
AGGEHVMATAGKGGTGGVG

SEQ ID NO: 233136 - protein, 17 aa, Mycobacterium bovis
AGGGAPVGNPADLQSLL

SEQ ID NO: 233137 - protein, 19 aa, Mycobacterium bovis
AGGISRSVGDGAAGGAGGA

SEQ ID NO: 233138 - protein, 23 aa, Mycobacterium bovis
AGGLGGAFRRGRFAATERFTQPT

SEQ ID NO: 233139 - protein, 26 aa, Mycobacterium bovis
AGGNGGRGAVLFGHGGNAGHGGAGGN

SEQ ID NO: 233140 - protein, 23 aa, Mycobacterium bovis
AGGSGGHALLWGAGGAGGNGGSG

SEQ ID NO: 233141 - protein, 22 aa, Mycobacterium bovis
AGGYAVAACKTVTLTVDGTAMR

SEQ ID NO: 233142 - protein, 29 aa, Mycobacterium bovis
AGHGGAGGSARLIGAGGHGGDGGAGGNTA

SEQ ID NO: 233143 - protein, 20 aa, Mycobacterium bovis
AGIASGFALAACASKPTASG

SEQ ID NO: 233144 - protein, 23 aa, Mycobacterium bovis
AGKAGPAGSILHDGGNGGHGGHG

SEQ ID NO: 233145 - protein, 27 aa, Mycobacterium bovis
AGPPEHLQWIGQWGIFDALRAGREVVR

SEQ ID NO: 233146 - protein, 17 aa, Mycobacterium bovis
AGPRYAGPLFVTDLDSP

SEQ ID NO: 233147 - protein, 31 aa, Mycobacterium bovis
AGQYQQLGARAALFHEQFVQALTGAASAYAS

SEQ ID NO: 233148 - protein, 20 aa, Mycobacterium bovis
AGRYGDGWIAQARDINDAKL

SEQ ID NO: 233149 - protein, 18 aa, Mycobacterium bovis
AGSSGWWNQAHAALAGAG

SEQ ID NO: 233150 - protein, 24 aa, Mycobacterium bovis
AGTGFLAQLCVDWETATRPAQQSG

SEQ ID NO: 233151 - protein, 24 aa, Mycobacterium bovis
AGTRDFPENTVLAITNAVAAGVDG

SEQ ID NO: 233152 - protein, 18 aa, Mycobacterium bovis
AGVDGMWLTVQVSSDGVP

SEQ ID NO: 233153 - protein, 19 aa, Mycobacterium bovis
AGVGCTRLAIHAVTANGEE

SEQ ID NO: 233154 - protein, 18 aa, Mycobacterium bovis
AGVVGWWVNPQAPGIDAC

SEQ ID NO: 233155 - protein, 24 aa, Mycobacterium bovis
AGYLAKRRQPLCTTYRGREICGMP

SEQ ID NO: 233156 - protein, 21 aa, Mycobacterium bovis
AHRCARDGADLVLAARSAERL

SEQ ID NO: 233157 - protein, 19 aa, Mycobacterium bovis
AHSFVDAWNYGALSTNAQL

SEQ ID NO: 233158 - protein, 18 aa, Mycobacterium bovis
AHVKRYLPQLTQQHALAL

SEQ ID NO: 233159 - protein, 24 aa, Mycobacterium bovis
AHYGEMWAQDALAMYGYAASSAAA

SEQ ID NO: 233160 - protein, 23 aa, Mycobacterium bovis
AIAELRHLNPLNIVNLGNVGSYN

SEQ ID NO: 233161 - protein, 20 aa, Mycobacterium bovis
AIPARWTLDNGATFRGVDPG

SEQ ID NO: 233162 - protein, 18 aa, Mycobacterium bovis
AIPCVALGKFADAVAAEC

SEQ ID NO: 233163 - protein, 18 aa, Mycobacterium bovis
AITLWLGLVAQFGQMITG

SEQ ID NO: 233164 - protein, 26 aa, Mycobacterium bovis
AKAGGLPGDLTFSWYAVDKTGQPWVV

SEQ ID NO: 233165 - protein, 18 aa, Mycobacterium bovis
AKLRCRLTDGSKTYGISV

SEQ ID NO: 233166 - protein, 18 aa, Mycobacterium bovis
AKPSPPAAYCPATNTIVV

SEQ ID NO: 233167 - protein, 19 aa, Mycobacterium bovis
AKVDNGRCDPVAGTSTGES

SEQ ID NO: 233168 - protein, 19 aa, Mycobacterium bovis
AKVVVVGGLVVVLAVVAAA

SEQ ID NO: 233169 - protein, 17 aa, Mycobacterium bovis
ALAEGKNALARALLSTG

SEQ ID NO: 233170 - protein, 26 aa, Mycobacterium bovis
ALAVASPCAYFLVYESTETTERPEHH

SEQ ID NO: 233171 - protein, 38 aa, Mycobacterium bovis
ALEASNGIQCFLRDLPATWPPFIRPGVVTTHLQSQWSL

SEQ ID NO: 233172 - protein, 18 aa, Mycobacterium bovis
ALELTWRSLGEIGNLSSA

SEQ ID NO: 233173 - protein, 19 aa, Mycobacterium bovis
ALLESGRGPRRYTAGGHRI

SEQ ID NO: 233174 - protein, 18 aa, Mycobacterium bovis
ALLPMLACWLRRPAQQGR

SEQ ID NO: 233175 - protein, 17 aa, Mycobacterium bovis
ALREKLSAADNFDIQVG

SEQ ID NO: 233176 - protein, 20 aa, Mycobacterium bovis
ALRPPVFAGTIWVQQGSQPL

SEQ ID NO: 233177 - protein, 33 aa, Mycobacterium bovis
ALRPVKPPPRRPAHRVLVGWLSLAAGLLAIAAL

SEQ ID NO: 233178 - protein, 18 aa, Mycobacterium bovis
ALRQRISQQLFSFGDPTV

SEQ ID NO: 233179 - protein, 28 aa, Mycobacterium bovis
ALRSWRPRVAVWGIHLLRRGGLTGDGIP

SEQ ID NO: 233180 - protein, 24 aa, Mycobacterium bovis
ALSDLQPGDVLTFYSDASHAGIYI

SEQ ID NO: 233181 - protein, 24 aa, Mycobacterium bovis
ALSQDRFADFPALPLDPSAMVAQV

SEQ ID NO: 233182 - protein, 18 aa, Mycobacterium bovis
ALTFPFAGGLGLMSNRAS

SEQ ID NO: 233183 - protein, 19 aa, Mycobacterium bovis
ALTGRPLIGNGANGAPGTG

SEQ ID NO: 233184 - protein, 19 aa, Mycobacterium bovis
ANAAALAPTTALLAAGADE

SEQ ID NO: 233185 - protein, 17 aa, Mycobacterium bovis
ANARLAYAAYREVFEDS

SEQ ID NO: 233186 - protein, 18 aa, Mycobacterium bovis
ANATPLQALQTVQQNVLT

SEQ ID NO: 233187 - protein, 25 aa, Mycobacterium bovis
ANGAQCPRCNEEYRQLCAALAAALS

SEQ ID NO: 233188 - protein, 17 aa, Mycobacterium bovis
ANIPPERYVQVNGTPGP

SEQ ID NO: 233189 - protein, 17 aa, Mycobacterium bovis
ANLRSDPFVAILRFPFI

SEQ ID NO: 233190 - protein, 17 aa, Mycobacterium bovis
APASASPLHTLKQQALA

SEQ ID NO: 233191 - protein, 19 aa, Mycobacterium bovis
APCRLSTKHALALTNRGGA

SEQ ID NO: 233192 - protein, 27 aa, Mycobacterium bovis
APDAGPPQRWFVVWLGTANNPVDKGAA

SEQ ID NO: 233193 - protein, 24 aa, Mycobacterium bovis
APEDVGWDWFGLQFYNGTALMLFQ

SEQ ID NO: 233194 - protein, 23 aa, Mycobacterium bovis
APELQFKPGTRFDYSNSNYLLLG

SEQ ID NO: 233195 - protein, 25 aa, Mycobacterium bovis
APGLVPRPGVPAAAAVPRVGPPAVP

SEQ ID NO: 233196 - protein, 17 aa, Mycobacterium bovis
APGSFDGPDDWSANSVF

SEQ ID NO: 233197 - protein, 25 aa, Mycobacterium bovis
APILKGDKGEPCWPDGVVGSLTHCA

SEQ ID NO: 233198 - protein, 21 aa, Mycobacterium bovis
APLPSWTHRTLMLSREDSHRS

SEQ ID NO: 233199 - protein, 20 aa, Mycobacterium bovis
APLQRPILCTEYLARSQGST

SEQ ID NO: 233200 - protein, 20 aa, Mycobacterium bovis
APLRYGELIAALNATSGERA

SEQ ID NO: 233201 - protein, 23 aa, Mycobacterium bovis
APRDLCALWPVPATSTPHPAAPA

SEQ ID NO: 233202 - protein, 17 aa, Mycobacterium bovis
APSCDRVVFRGNVAGRE

SEQ ID NO: 233203 - protein, 29 aa, Mycobacterium bovis
APVARDALFHWGVAMLPAGPAGRVSVTNG

SEQ ID NO: 233204 - protein, 39 aa, Mycobacterium bovis
AQGILCGSIVSGLRMRPGNWAGIYACWGTENREAAVRFV

SEQ ID NO: 233205 - protein, 24 aa, Mycobacterium bovis
AQGRIPRVYGRQASEYVIRRGMSQ

SEQ ID NO: 233206 - protein, 21 aa, Mycobacterium bovis
AQLTRQLRLELGHESVRQARE

SEQ ID NO: 233207 - protein, 21 aa, Mycobacterium bovis
AQLVCKKLASGETGTEIAEEV

SEQ ID NO: 233208 - protein, 24 aa, Mycobacterium bovis
AQPIGCPAFHAFPASRWRRYDKLE

SEQ ID NO: 233209 - protein, 22 aa, Mycobacterium bovis
AQPIPRECRFIYAETAVFGSEI

SEQ ID NO: 233210 - protein, 23 aa, Mycobacterium bovis
AQRQLCDTYKLVAHAVPVDTNGS

SEQ ID NO: 233211 - protein, 18 aa, Mycobacterium bovis
AQTVPRKAARLTIDGVTH

SEQ ID NO: 233212 - protein, 20 aa, Mycobacterium bovis
ARAAAPLAPLALAMVLASCG

SEQ ID NO: 233213 - protein, 23 aa, Mycobacterium bovis
ARAFQTLLRYGRAYSGYAPIMGT

SEQ ID NO: 233214 - protein, 29 aa, Mycobacterium bovis
ARAMGPMQFLPGTWARYATDGDDDGVADP

SEQ ID NO: 233215 - protein, 18 aa, Mycobacterium bovis
ARFNVSRAALLVVALTER

SEQ ID NO: 233216 - protein, 22 aa, Mycobacterium bovis
ARFTQHLKLGYRDAVAVVDSAL

SEQ ID NO: 233217 - protein, 17 aa, Mycobacterium bovis
ARGAWRASRATAGYSSA

SEQ ID NO: 233218 - protein, 17 aa, Mycobacterium bovis
ARGTTSLRRIREIAPPP

SEQ ID NO: 233219 - protein, 26 aa, Mycobacterium bovis
ARLLSEEDRRFAVVFVHDQSDYARME

SEQ ID NO: 233220 - protein, 22 aa, Mycobacterium bovis
ARPADCVGVGYLTQRNVYRSVE

SEQ ID NO: 233221 - protein, 21 aa, Mycobacterium bovis
ARQRAPVAIFVKHPSDSVVAG

SEQ ID NO: 233222 - protein, 22 aa, Mycobacterium bovis
ARRVADVLGIPFYVWDFAEKFK

SEQ ID NO: 233223 - protein, 26 aa, Mycobacterium bovis
ARTADGINYRVLWQAAGPDTISGATI

SEQ ID NO: 233224 - protein, 24 aa, Mycobacterium bovis
ARTGESLAVLGWNMSVSNLRWSGD

SEQ ID NO: 233225 - protein, 20 aa, Mycobacterium bovis
ARTTVLLDEIVTLVGTDQRL

SEQ ID NO: 233226 - protein, 18 aa, Mycobacterium bovis
ASAAAFEAAFAMTVPPAE

SEQ ID NO: 233227 - protein, 19 aa, Mycobacterium bovis
ASAEAAGAAVLANPAQSVQ

SEQ ID NO: 233228 - protein, 25 aa, Mycobacterium bovis
ASAEEVPGVLIARGLAEQTGKRIRL

SEQ ID NO: 233229 - protein, 18 aa, Mycobacterium bovis
ASAGCPDAEVVFARGTGE

SEQ ID NO: 233230 - protein, 25 aa, Mycobacterium bovis
ASCSVPGAWPPVTIAGRRYMDGGVA

SEQ ID NO: 233231 - protein, 26 aa, Mycobacterium bovis
ASGIPKAAGVEAIFRLDECPRGLYSG

SEQ ID NO: 233232 - protein, 19 aa, Mycobacterium bovis
ASGPLGLMKTILALRHGVV

SEQ ID NO: 233233 - protein, 17 aa, Mycobacterium bovis
ASGRSIGVPGILRMLEM

SEQ ID NO: 233234 - protein, 26 aa, Mycobacterium bovis
ASLTGWQWLGPSSVRMGAAVTPYVEW

SEQ ID NO: 233235 - protein, 18 aa, Mycobacterium bovis
ASPAGWLFVSRWTAGGNS

SEQ ID NO: 233236 - protein, 28 aa, Mycobacterium bovis
ASQAIDLLKGVLMPSIMQAVQNGGAAAP

SEQ ID NO: 233237 - protein, 17 aa, Mycobacterium bovis
ASSIAIAAVMFSGVAGG

SEQ ID NO: 233238 - protein, 24 aa, Mycobacterium bovis
ASVDCFRSQSGMKVMGFAVKTVDD

SEQ ID NO: 233239 - protein, 18 aa, Mycobacterium bovis
ASVFLPLQRVLGCQQNTA

SEQ ID NO: 233240 - protein, 21 aa, Mycobacterium bovis
ATAKFEFANGYATVTIATTGV

SEQ ID NO: 233241 - protein, 17 aa, Mycobacterium bovis
ATAWGLTADTPWRGLDV

SEQ ID NO: 233242 - protein, 19 aa, Mycobacterium bovis
ATGGAGFAGGAGGEGGAGG

SEQ ID NO: 233243 - protein, 25 aa, Mycobacterium bovis
ATGLSAKGAKTFAVDAASAYCPQYV

SEQ ID NO: 233244 - protein, 18 aa, Mycobacterium bovis
ATLLRGGGLVNLEGIQQE

SEQ ID NO: 233245 - protein, 18 aa, Mycobacterium bovis
ATNAAPLATLEHNVLNAL

SEQ ID NO: 233246 - protein, 18 aa, Mycobacterium bovis
ATSGGFCGKKNLYTVYFA

SEQ ID NO: 233247 - protein, 30 aa, Mycobacterium bovis
ATSMKVWFNAKAMWDWSKSVADKNCLAIDG

SEQ ID NO: 233248 - protein, 22 aa, Mycobacterium bovis
ATVGGLMLPVGVRRLRNYHSTR

SEQ ID NO: 233249 - protein, 25 aa, Mycobacterium bovis
AVAAQLAPWAQAVRALPNPTAPALA

SEQ ID NO: 233250 - protein, 23 aa, Mycobacterium bovis
AVAEFPGFAFFEIQLRLPVNGRW

SEQ ID NO: 233251 - protein, 18 aa, Mycobacterium bovis
AVASRFPGAINDLQLSRD

SEQ ID NO: 233252 - protein, 34 aa, Mycobacterium bovis
AVAVTRATPRFGFEQVCATPAFPHDSRDWAVAGR

SEQ ID NO: 233253 - protein, 18 aa, Mycobacterium bovis
AVCSLALMLAMFGANVYA

SEQ ID NO: 233254 - protein, 17 aa, Mycobacterium bovis
AVFDQLGAIGIDLTDVF

SEQ ID NO: 233255 - protein, 17 aa, Mycobacterium bovis
AVHAQFVEALSAGAGAY

SEQ ID NO: 233256 - protein, 26 aa, Mycobacterium bovis
AVPWWPWAPLVRLMWVLPPRLTRRFA

SEQ ID NO: 233257 - protein, 26 aa, Mycobacterium bovis
AVSLRLHPDIRLFTAIPEQRSSTAET

SEQ ID NO: 233258 - protein, 24 aa, Mycobacterium bovis
AVTFADSYQPAWVYQGQDVDDVRD

SEQ ID NO: 233259 - protein, 27 aa, Mycobacterium bovis
AVVVAFLTTGCIRWSTQSRPVVNGPAA

SEQ ID NO: 233260 - protein, 24 aa, Mycobacterium bovis
AWDGLWDPTLPMIPSANIPGDPIA

SEQ ID NO: 233261 - protein, 20 aa, Mycobacterium bovis
AWFPLTKRWLGFEDAHITFE

SEQ ID NO: 233262 - protein, 23 aa, Mycobacterium bovis
AWKAPAVTTVRAFDATPMTTLPG

SEQ ID NO: 233263 - protein, 25 aa, Mycobacterium bovis
AWLYSQRRFEVPSDKIANTMKLAIV

SEQ ID NO: 233264 - protein, 23 aa, Mycobacterium bovis
AYLRALPADGWLRVLCTCVEIGQ

SEQ ID NO: 233265 - protein, 19 aa, Mycobacterium bovis
AYPAAFPVGMLPTNQNDAG

SEQ ID NO: 233266 - protein, 21 aa, Mycobacterium bovis
CFSGPMIFGAGVLGGAQADLL

SEQ ID NO: 233267 - protein, 21 aa, Mycobacterium bovis
CHPELRIDFPPLRVANDDVAH

SEQ ID NO: 233268 - protein, 24 aa, Mycobacterium bovis
CPNHHSKMAFAMANFEPGSNEPTH

SEQ ID NO: 233269 - protein, 20 aa, Mycobacterium bovis
CRPAGIGGLGGRGSRLAVAC

SEQ ID NO: 233270 - protein, 26 aa, Mycobacterium bovis
CRQLDAFLKWHHGVREFLQSAIDANS

SEQ ID NO: 233271 - protein, 17 aa, Mycobacterium bovis
CSVLALGLLAGCAPPRT

SEQ ID NO: 233272 - protein, 17 aa, Mycobacterium bovis
CTGEVRWVSARDLRFGY

SEQ ID NO: 233273 - protein, 17 aa, Mycobacterium bovis
CVKSGWRKATAGTPTSM

SEQ ID NO: 233274 - protein, 22 aa, Mycobacterium bovis
DAASVFARRVPLAAAVWTQRGW

SEQ ID NO: 233275 - protein, 18 aa, Mycobacterium bovis
DAHKVLAMASNRKYGLDL

SEQ ID NO: 233276 - protein, 17 aa, Mycobacterium bovis
DALKACVKSGWRKATAG

SEQ ID NO: 233277 - protein, 22 aa, Mycobacterium bovis
DALRPMMRLVVTNGTAKEIAGC

SEQ ID NO: 233278 - protein, 25 aa, Mycobacterium bovis
DAQSGSIGLGFAIPVDQAKRIADEL

SEQ ID NO: 233279 - protein, 23 aa, Mycobacterium bovis
DARTYLADHGWRTASASTTDLLA

SEQ ID NO: 233280 - protein, 25 aa, Mycobacterium bovis
DDLGALSSWYVWAALGLYPSTPGTT

SEQ ID NO: 233281 - protein, 19 aa, Mycobacterium bovis
DDLVLAWAAQSGRFPGFDA

SEQ ID NO: 233282 - protein, 17 aa, Mycobacterium bovis
DEIRAAASTDCQISRFT

SEQ ID NO: 233283 - protein, 22 aa, Mycobacterium bovis
DELRPRMRVVNEFQRRYPDIKV

SEQ ID NO: 233284 - protein, 24 aa, Mycobacterium bovis
DEQFRIAYDASQQVFGFAPYPAVA

SEQ ID NO: 233285 - protein, 17 aa, Mycobacterium bovis
DEWPEPAESLPPPYDNR

SEQ ID NO: 233286 - protein, 20 aa, Mycobacterium bovis
DFDPAEAITHGYIDSQKLLA

SEQ ID NO: 233287 - protein, 25 aa, Mycobacterium bovis
DFEEGLRTTIDWYRDNESWWRPLKD

SEQ ID NO: 233288 - protein, 26 aa, Mycobacterium bovis
DFVTSLQLLLTFPFPNFGIKQAVRGD

SEQ ID NO: 233289 - protein, 24 aa, Mycobacterium bovis
DGGFDISARMGAAISDAAPQLRDD

SEQ ID NO: 233290 - protein, 27 aa, Mycobacterium bovis
DGGGAGGNGAWLFGNGGAGGGGGKGGN

SEQ ID NO: 233291 - protein, 22 aa, Mycobacterium bovis
DGGGGLPPVPASPGGNGGGGGA

SEQ ID NO: 233292 - protein, 25 aa, Mycobacterium bovis
DGGTGGRGGWLAGAGGAGGDGGIGG

SEQ ID NO: 233293 - protein, 24 aa, Mycobacterium bovis
DGLACVVLRVARFFVEGDDMPDLY

SEQ ID NO: 233294 - protein, 26 aa, Mycobacterium bovis
DGLRVICRRSRLMSRIAGSGAMASVE

SEQ ID NO: 233295 - protein, 23 aa, Mycobacterium bovis
DGYPQRFGIPDGLYAEPVAVKQG

SEQ ID NO: 233296 - protein, 19 aa, Mycobacterium bovis
DIDADFVVFDGILYATLTP

SEQ ID NO: 233297 - protein, 25 aa, Mycobacterium bovis
DIFLREVQDVWIWVRPYFDDRATAA

SEQ ID NO: 233298 - protein, 19 aa, Mycobacterium bovis
DINDAKLLAAFAAGAQAAG

SEQ ID NO: 233299 - protein, 21 aa, Mycobacterium bovis
DIRARGRLIVGLDIGSNLFSF

SEQ ID NO: 233300 - protein, 27 aa, Mycobacterium bovis
DIYGDTRLGLFPFRRNLSLYAVDLALL

SEQ ID NO: 233301 - protein, 23 aa, Mycobacterium bovis
DKIARMLLIWAALAAVALVLVGC

SEQ ID NO: 233302 - protein, 24 aa, Mycobacterium bovis
DKLISRLLAGPALAIAKTKNAINA

SEQ ID NO: 233303 - protein, 29 aa, Mycobacterium bovis
DLDMAVDMLEMLPTPWGLVRSGVAPDHPK

SEQ ID NO: 233304 - protein, 28 aa, Mycobacterium bovis
DLPSSTQLPVWLAHAGIDVLRSHPIVAV

SEQ ID NO: 233305 - protein, 26 aa, Mycobacterium bovis
DLTDLLWRMGIRTIGQFAALSRTDVA

SEQ ID NO: 233306 - protein, 19 aa, Mycobacterium bovis
DNPTGIGGTGGDGGTGGAA

SEQ ID NO: 233307 - protein, 17 aa, Mycobacterium bovis
DNSAHVFVEADIVTADL

SEQ ID NO: 233308 - protein, 26 aa, Mycobacterium bovis
DNVNYRITVKPGWKFTDGSPVTAHSF

SEQ ID NO: 233309 - protein, 20 aa, Mycobacterium bovis
DPDVLLREFLKATADPANRH

SEQ ID NO: 233310 - protein, 26 aa, Mycobacterium bovis
DPGAKSARPATVWIAQDGSHHLVRAS

SEQ ID NO: 233311 - protein, 20 aa, Mycobacterium bovis
DPGTALLLCYRQRRWYLEGS

SEQ ID NO: 233312 - protein, 19 aa, Mycobacterium bovis
DPIVWAFNCALNVVSTTPQ

SEQ ID NO: 233313 - protein, 19 aa, Mycobacterium bovis
DPLTFAWVNHMKIFFNNKG

SEQ ID NO: 233314 - protein, 25 aa, Mycobacterium bovis
DPSAPMPGCTLICIGSHGPPVGAPP

SEQ ID NO: 233315 - protein, 18 aa, Mycobacterium bovis
DPTSVHWHGIALRNDMDG

SEQ ID NO: 233316 - protein, 33 aa, Mycobacterium bovis
DQLFRFSRILDVQPRLAILLGDCAVPAEGRVRL

SEQ ID NO: 233317 - protein, 23 aa, Mycobacterium bovis
DREPRPGHRRMVFRFLTSPIEIK

SEQ ID NO: 233318 - protein, 23 aa, Mycobacterium bovis
DRQHRVAAVFLRELLAADLQPVV

SEQ ID NO: 233319 - protein, 21 aa, Mycobacterium bovis
DRQLARFALRGDRTMFLFVFR

SEQ ID NO: 233320 - protein, 17 aa, Mycobacterium bovis
DRVPAAEALSWGLVSAV

SEQ ID NO: 233321 - protein, 25 aa, Mycobacterium bovis
DSLPRIAQAIALPAVRKTGVLENEA

SEQ ID NO: 233322 - protein, 18 aa, Mycobacterium bovis
DSPPAQWMPPNKAFACQY

SEQ ID NO: 233323 - protein, 25 aa, Mycobacterium bovis
DSVPDEVWPAVVFTLVTLLDDPVAA

SEQ ID NO: 233324 - protein, 18 aa, Mycobacterium bovis
DTIVLRRSRPLQISLDGH

SEQ ID NO: 233325 - protein, 21 aa, Mycobacterium bovis
DTNVPGPCRVVGSSDRTFGTD

SEQ ID NO: 233326 - protein, 17 aa, Mycobacterium bovis
DTPAMPPPIFVAASGPQ

SEQ ID NO: 233327 - protein, 23 aa, Mycobacterium bovis
DTRARLIDLGRPFIAETVFSHPS

SEQ ID NO: 233328 - protein, 24 aa, Mycobacterium bovis
DVAHGLPVHLTRFVGRGAQITEVH

SEQ ID NO: 233329 - protein, 26 aa, Mycobacterium bovis
DVDTFYTCLYRSLLHPNTFNDVDGRY

SEQ ID NO: 233330 - protein, 20 aa, Mycobacterium bovis
DVGGFDCDFFGLTEREATAI

SEQ ID NO: 233331 - protein, 20 aa, Mycobacterium bovis
DVLVPGYLYHYSLDAGQAGR

SEQ ID NO: 233332 - protein, 21 aa, Mycobacterium bovis
DVRTARIVTPRVMQFTLRANV

SEQ ID NO: 233333 - protein, 19 aa, Mycobacterium bovis
DVSDRLVGITSDIGSVTVA

SEQ ID NO: 233334 - protein, 24 aa, Mycobacterium bovis
DVVHYGNGVSIVYADVPTTVDFGG

SEQ ID NO: 233335 - protein, 19 aa, Mycobacterium bovis
DWAKYALKAPVMMVRSPDT

SEQ ID NO: 233336 - protein, 23 aa, Mycobacterium bovis
DYDRLPVSGAVVLVDRGVCPFAQ

SEQ ID NO: 233337 - protein, 18 aa, Mycobacterium bovis
DYFAEINLAGFYDLAQTL

SEQ ID NO: 233338 - protein, 17 aa, Mycobacterium bovis
DYQQITDVVIARGLSQR

SEQ ID NO: 233339 - protein, 38 aa, Mycobacterium bovis
EAAAVSPLLAPINAQFVAATGRPLIGNGANGAPGTGAN

SEQ ID NO: 233340 - protein, 22 aa, Mycobacterium bovis
EAAELGEYFAGMGYSALTTAAL

SEQ ID NO: 233341 - protein, 22 aa, Mycobacterium bovis
EAKAVDVLARIMGSSYQRLVAA

SEQ ID NO: 233342 - protein, 19 aa, Mycobacterium bovis
EALEHGRIAVAIAGVPFKC

SEQ ID NO: 233343 - protein, 26 aa, Mycobacterium bovis
EALVAVASDLAGIGSALAEANAAALA

SEQ ID NO: 233344 - protein, 19 aa, Mycobacterium bovis
EALVSMLKDHGVGFHPRKA

SEQ ID NO: 233345 - protein, 25 aa, Mycobacterium bovis
EANGGLRYAPRADLATREEQIAVAE

SEQ ID NO: 233346 - protein, 19 aa, Mycobacterium bovis
EARQALAAAPELQFKPGTR

SEQ ID NO: 233347 - protein, 17 aa, Mycobacterium bovis
EASRLVATTSGYRAGLL

SEQ ID NO: 233348 - protein, 25 aa, Mycobacterium bovis
EATMARWPRRRSMRFESSPHGKRID

SEQ ID NO: 233349 - protein, 18 aa, Mycobacterium bovis
EAVEMFCYRAQRVRPDFR

SEQ ID NO: 233350 - protein, 22 aa, Mycobacterium bovis
EAVLALRARKGMVLDPTDHDTW

SEQ ID NO: 233351 - protein, 17 aa, Mycobacterium bovis
EDLFRRMGDLAGGNVEF

SEQ ID NO: 233352 - protein, 17 aa, Mycobacterium bovis
EDLVGMCLFLLSDSASW

SEQ ID NO: 233353 - protein, 21 aa, Mycobacterium bovis
EDPRFRFFGNVVVGEHVQPGE

SEQ ID NO: 233354 - protein, 25 aa, Mycobacterium bovis
EDVFARGGPYLARAAADLVPTATLL

SEQ ID NO: 233355 - protein, 23 aa, Mycobacterium bovis
EDVKTVPTTVWIASDGSSHLVQI

SEQ ID NO: 233356 - protein, 17 aa, Mycobacterium bovis
EELPAQLVVRSVGYRGV

SEQ ID NO: 233357 - protein, 21 aa, Mycobacterium bovis
EEPRLFYMHYWAVDDAVTLAR

SEQ ID NO: 233358 - protein, 20 aa, Mycobacterium bovis
EFFDRRLALHSPEMAAKTIV

SEQ ID NO: 233359 - protein, 38 aa, Mycobacterium bovis
EFLKRLPMSTRLGIRLVIVLVRRWPKVISRAMVMRTVI

SEQ ID NO: 233360 - protein, 19 aa, Mycobacterium bovis
EFRTLPVVRYDNIDGQDVN

SEQ ID NO: 233361 - protein, 19 aa, Mycobacterium bovis
EGFAPRKGAARRAWLAELA

SEQ ID NO: 233362 - protein, 23 aa, Mycobacterium bovis
EGGAIYQRWQALGGMNSALGAPT

SEQ ID NO: 233363 - protein, 24 aa, Mycobacterium bovis
EGGQGAPPFRMWDPGSGPAGGRAW

SEQ ID NO: 233364 - protein, 19 aa, Mycobacterium bovis
EGRHGPFFPQCGGVSDQTV

SEQ ID NO: 233365 - protein, 17 aa, Mycobacterium bovis
EGWAERVRLAHALGPTM

SEQ ID NO: 233366 - protein, 17 aa, Mycobacterium bovis
EHTCCRETPAAIPTGPD

SEQ ID NO: 233367 - protein, 20 aa, Mycobacterium bovis
EIAPPPVIVSVVNWADCLVA

SEQ ID NO: 233368 - protein, 24 aa, Mycobacterium bovis
EIKGKRKVERIVLGRNELVSDGSG

SEQ ID NO: 233369 - protein, 22 aa, Mycobacterium bovis
EKKCLLDLVELVGFDTEIDHRA

SEQ ID NO: 233370 - protein, 30 aa, Mycobacterium bovis
EKKLRLDDKLSRWLPDFPHADRVTLGQLAQ

SEQ ID NO: 233371 - protein, 20 aa, Mycobacterium bovis
ELADVAVLLGRYTAALTEAV

SEQ ID NO: 233372 - protein, 24 aa, Mycobacterium bovis
ELERRYDARLGVYVPATGTTAAIE

SEQ ID NO: 233373 - protein, 22 aa, Mycobacterium bovis
ELPGEPPRLFVVTRSAASVLPS

SEQ ID NO: 233374 - protein, 21 aa, Mycobacterium bovis
ELVSKLLAGPRPEMARTVRNL

SEQ ID NO: 233375 - protein, 27 aa, Mycobacterium bovis
EMLAAAATDLAGIRSAISAATAAAAAP

SEQ ID NO: 233376 - protein, 23 aa, Mycobacterium bovis
ENRPDCIYLGAAGHVLGTGHTLR

SEQ ID NO: 233377 - protein, 21 aa, Mycobacterium bovis
EPEMPAPCPTQRPPVTPRHNL

SEQ ID NO: 233378 - protein, 17 aa, Mycobacterium bovis
EPFGCLKPAPPPDGVGV

SEQ ID NO: 233379 - protein, 25 aa, Mycobacterium bovis
EPGFGVPWLYNYIGQPWKTQRTVDR

SEQ ID NO: 233380 - protein, 24 aa, Mycobacterium bovis
EPLPRWWRPAGSLFDQFLGAAETD

SEQ ID NO: 233381 - protein, 27 aa, Mycobacterium bovis
EQAVQRSVVLSSGWDIMDFVRQLQKLA

SEQ ID NO: 233382 - protein, 19 aa, Mycobacterium bovis
EQPRLFYMHFWAENDAVAL

SEQ ID NO: 233383 - protein, 21 aa, Mycobacterium bovis
EQYLWWVPHNVAGLVTALGGR

SEQ ID NO: 233384 - protein, 17 aa, Mycobacterium bovis
ERIKMQGARQVDLIRAQ

SEQ ID NO: 233385 - protein, 23 aa, Mycobacterium bovis
ERLPGAIRWAASALRQARDYLSG

SEQ ID NO: 233386 - protein, 24 aa, Mycobacterium bovis
ERRAALKIPAGVPFYEESTFWNPS

SEQ ID NO: 233387 - protein, 18 aa, Mycobacterium bovis
ERRYIMVIESLQPADDAT

SEQ ID NO: 233388 - protein, 28 aa, Mycobacterium bovis
ERTLFRRLAVFVGCFFVDDAQAVACSGD

SEQ ID NO: 233389 - protein, 18 aa, Mycobacterium bovis
ESAPKAPAVEELRSPLDQ

SEQ ID NO: 233390 - protein, 20 aa, Mycobacterium bovis
ESIVRTGGDLTFSLAGTPNK

SEQ ID NO: 233391 - protein, 28 aa, Mycobacterium bovis
ESLPLASIFKLYVLHALAGAVQHNTVSW

SEQ ID NO: 233392 - protein, 24 aa, Mycobacterium bovis
ETAYGEWKGGWVDFDGIHLQVGSA

SEQ ID NO: 233393 - protein, 20 aa, Mycobacterium bovis
ETDQAFGWVAFEFGVHRYGL

SEQ ID NO: 233394 - protein, 19 aa, Mycobacterium bovis
ETKQFVGRCVDKMGKNFLA

SEQ ID NO: 233395 - protein, 29 aa, Mycobacterium bovis
ETLTILGRFSASFGETFASGPYFKVLLAN

SEQ ID NO: 233396 - protein, 22 aa, Mycobacterium bovis
ETPGCVAYIGISFLDQASQRGL

SEQ ID NO: 233397 - protein, 19 aa, Mycobacterium bovis
EVLAAAASDLAGIGSTLAQ

SEQ ID NO: 233398 - protein, 26 aa, Mycobacterium bovis
EVLGSAATDLAALGSVLGAADAAAAA

SEQ ID NO: 233399 - protein, 24 aa, Mycobacterium bovis
EVRRFARERSRWLFSNPEMTHLSV

SEQ ID NO: 233400 - protein, 17 aa, Mycobacterium bovis
EYVIRRAGSQMGVPYSW

SEQ ID NO: 233401 - protein, 21 aa, Mycobacterium bovis
FADAMAIRTHYFDNFFLDATR

SEQ ID NO: 233402 - protein, 18 aa, Mycobacterium bovis
FADHSGVDWKGTLTGLAG

SEQ ID NO: 233403 - protein, 24 aa, Mycobacterium bovis
FADLTRPGLNVVVCQPSVPCGSAT

SEQ ID NO: 233404 - protein, 25 aa, Mycobacterium bovis
FAERGFRRARTWLGATAEAIEACEC

SEQ ID NO: 233405 - protein, 18 aa, Mycobacterium bovis
FAFDNPGAIEAFRYLVGL

SEQ ID NO: 233406 - protein, 23 aa, Mycobacterium bovis
FALLCGDLSAPVTFAVDRTGWAP

SEQ ID NO: 233407 - protein, 18 aa, Mycobacterium bovis
FALRGDRTMFLFVFRAEH

SEQ ID NO: 233408 - protein, 27 aa, Mycobacterium bovis
FALTYPRRLGFGLGSSVVSLSWRTGDD

SEQ ID NO: 233409 - protein, 22 aa, Mycobacterium bovis
FASGRVAYTLGLHGPAVTVDTA

SEQ ID NO: 233410 - protein, 18 aa, Mycobacterium bovis
FATIPVLDGAGWSDDGMQ

SEQ ID NO: 233411 - protein, 20 aa, Mycobacterium bovis
FAVGPDRLARFVLVVLTQAE

SEQ ID NO: 233412 - protein, 20 aa, Mycobacterium bovis
FDARRVRQWGYNAANDPQAI

SEQ ID NO: 233413 - protein, 20 aa, Mycobacterium bovis
FDCSGLVRYAFAGVGVLIPR

SEQ ID NO: 233414 - protein, 24 aa, Mycobacterium bovis
FDIHELVNIGPFRIEPIDVPAVVL

SEQ ID NO: 233415 - protein, 26 aa, Mycobacterium bovis
FDQLGAIGIDLTDVFAVLEEEGVRKF

SEQ ID NO: 233416 - protein, 26 aa, Mycobacterium bovis
FDQPLLALRIPWYVTVLDLGSAGAVY

SEQ ID NO: 233417 - protein, 25 aa, Mycobacterium bovis
FDYAEGRLGWRTLDFEVEVLPIGDF

SEQ ID NO: 233418 - protein, 24 aa, Mycobacterium bovis
FEPWSVADFSRYLSTLGLPAAGDA

SEQ ID NO: 233419 - protein, 23 aa, Mycobacterium bovis
FFQAAGPWLKNALISNLNIVSTV

SEQ ID NO: 233420 - protein, 18 aa, Mycobacterium bovis
FGFAGSMSGFLYPSNTTT

SEQ ID NO: 233421 - protein, 27 aa, Mycobacterium bovis
FGFAVIVYLVWRFIVPLVGRLMSARQD

SEQ ID NO: 233422 - protein, 22 aa, Mycobacterium bovis
FGGPDFPAPLDVATSPPNPDGP

SEQ ID NO: 233423 - protein, 24 aa, Mycobacterium bovis
FGPNPLDPLCRVNSAMAGRQQGRR

SEQ ID NO: 233424 - protein, 24 aa, Mycobacterium bovis
FGQVTSGLTAGVWQGAAAAAMAAA

SEQ ID NO: 233425 - protein, 18 aa, Mycobacterium bovis
FHDMPVVPLWDYISVVGW

SEQ ID NO: 233426 - protein, 18 aa, Mycobacterium bovis
FHPDRFGFAGSMSGFLYP

SEQ ID NO: 233427 - protein, 18 aa, Mycobacterium bovis
FIVPLVGRLMSARQDTVR

SEQ ID NO: 233428 - protein, 17 aa, Mycobacterium bovis
FKAKPGQRIRIRIINSA

SEQ ID NO: 233429 - protein, 17 aa, Mycobacterium bovis
FKKRGISPEDFWRSAGL

SEQ ID NO: 233430 - protein, 17 aa, Mycobacterium bovis
FLHTNVIGTFTILEAVR

SEQ ID NO: 233431 - protein, 24 aa, Mycobacterium bovis
FLSAELPDWLAANRGLAPGGHAAV

SEQ ID NO: 233432 - protein, 25 aa, Mycobacterium bovis
FNCLAPGMWPAWWLSNDDPGRSGEI

SEQ ID NO: 233433 - protein, 28 aa, Mycobacterium bovis
FNLTAWAVGWLPYIGILAPQINFFYYLG

SEQ ID NO: 233434 - protein, 24 aa, Mycobacterium bovis
FNVNLKLQFLHDAFPNEFPDPTIS

SEQ ID NO: 233435 - protein, 20 aa, Mycobacterium bovis
FPFAGGLGLMSNRASEVVAN

SEQ ID NO: 233436 - protein, 19 aa, Mycobacterium bovis
FPQRVRAMILDGAVDPNAD

SEQ ID NO: 233437 - protein, 21 aa, Mycobacterium bovis
FPVTVNWSTPAVTIFPNGISI

SEQ ID NO: 233438 - protein, 22 aa, Mycobacterium bovis
FQTRLAQFVAIAARYHIKPLFV

SEQ ID NO: 233439 - protein, 19 aa, Mycobacterium bovis
FRVPSMKPLAGTTFEHIRD

SEQ ID NO: 233440 - protein, 17 aa, Mycobacterium bovis
FSAHGRAYQVASAQAAA

SEQ ID NO: 233441 - protein, 21 aa, Mycobacterium bovis
FSERARGAAGLADVVVTNHAL

SEQ ID NO: 233442 - protein, 21 aa, Mycobacterium bovis
FSLTMSEGMLFSGGTGAAGMT

SEQ ID NO: 233443 - protein, 18 aa, Mycobacterium bovis
FSVLSLPTTLIFDVDGRQ

SEQ ID NO: 233444 - protein, 20 aa, Mycobacterium bovis
FSWYRGSPIGRERKTEELSR

SEQ ID NO: 233445 - protein, 17 aa, Mycobacterium bovis
FTGVTPFADAYKPRPCD

SEQ ID NO: 233446 - protein, 20 aa, Mycobacterium bovis
FTLYHLPAVPPLAGLAGTQA

SEQ ID NO: 233447 - protein, 22 aa, Mycobacterium bovis
FTVITGIVYPLAVTGVGQLFFG

SEQ ID NO: 233448 - protein, 17 aa, Mycobacterium bovis
FVVKTLVAMLDWGLNPQ

SEQ ID NO: 233449 - protein, 19 aa, Mycobacterium bovis
FYAAGLFAMNNGVPWSVPR

SEQ ID NO: 233450 - protein, 21 aa, Mycobacterium bovis
FYAAVKLDLDKNVLLPANAVA

SEQ ID NO: 233451 - protein, 20 aa, Mycobacterium bovis
GAAESLWALLARVLPEPWRV

SEQ ID NO: 233452 - protein, 17 aa, Mycobacterium bovis
GAAGKGGIFPDGSNGGA

SEQ ID NO: 233453 - protein, 26 aa, Mycobacterium bovis
GAAQRAGIELLAFGGRFVEIGKRDIY

SEQ ID NO: 233454 - protein, 26 aa, Mycobacterium bovis
GAARLRWARRPDWGGLEVDVDVAGTT

SEQ ID NO: 233455 - protein, 18 aa, Mycobacterium bovis
GAAWLIVDVRDVAALHAA

SEQ ID NO: 233456 - protein, 18 aa, Mycobacterium bovis
GADESLRCETPEYDRGVR

SEQ ID NO: 233457 - protein, 26 aa, Mycobacterium bovis
GADEVSAAIASLFGAHGQAYQAVSAQ

SEQ ID NO: 233458 - protein, 49 aa, Mycobacterium bovis
GADEVSAAIASLFSGYARDYQALSAQMARFHQQFVQALTASVGSYAAAE

SEQ ID NO: 233459 - protein, 25 aa, Mycobacterium bovis
GADEVSAAVAALFSAHAGQYQQLGA

SEQ ID NO: 233460 - protein, 24 aa, Mycobacterium bovis
GADEVSAAVAAVFSSYAQQYQALS

SEQ ID NO: 233461 - protein, 29 aa, Mycobacterium bovis
GADEVSLAISALFGQHAQAYQALSAQATI

SEQ ID NO: 233462 - protein, 25 aa, Mycobacterium bovis
GADEVSTAIAALFGAQGQAYQAASA

SEQ ID NO: 233463 - protein, 17 aa, Mycobacterium bovis
GAGAWLLVRGHGPQQPE

SEQ ID NO: 233464 - protein, 25 aa, Mycobacterium bovis
GAGGAGGDAGMFFGSGGSGGAGGAG

SEQ ID NO: 233465 - protein, 27 aa, Mycobacterium bovis
GAGGAGGDGGWLFGDGGAGGTGGNGGS

SEQ ID NO: 233466 - protein, 23 aa, Mycobacterium bovis
GAGGKSGAFGLGGDGGAGGATGL

SEQ ID NO: 233467 - protein, 25 aa, Mycobacterium bovis
GAGGLLYGNGGNGFSQTTAGLTGGT

SEQ ID NO: 233468 - protein, 20 aa, Mycobacterium bovis
GAGGNAMLFGAGGAGGAGGA

SEQ ID NO: 233469 - protein, 22 aa, Mycobacterium bovis
GAGGSAGLWGTGGAGGDGGNGR

SEQ ID NO: 233470 - protein, 19 aa, Mycobacterium bovis
GAGLKLPRSSGQMYKVGQK

SEQ ID NO: 233471 - protein, 23 aa, Mycobacterium bovis
GAGTVGFDCSGLVLYSFAGVGIK

SEQ ID NO: 233472 - protein, 21 aa, Mycobacterium bovis
GAHPSTWYKAFNYNLATSQPI

SEQ ID NO: 233473 - protein, 18 aa, Mycobacterium bovis
GAIEAFRYLVGLINDDHV

SEQ ID NO: 233474 - protein, 19 aa, Mycobacterium bovis
GAIYEAWASQSYERGPLGL

SEQ ID NO: 233475 - protein, 24 aa, Mycobacterium bovis
GALALASSLLRVWMTRGRIQEGRA

SEQ ID NO: 233476 - protein, 25 aa, Mycobacterium bovis
GAVGLCALRSAFIHGAATVFAVDRV

SEQ ID NO: 233477 - protein, 19 aa, Mycobacterium bovis
GAVICSAVALGIALHSGDP

SEQ ID NO: 233478 - protein, 17 aa, Mycobacterium bovis
GCSRGGSSKAGRSSSVA

SEQ ID NO: 233479 - protein, 22 aa, Mycobacterium bovis
GCYGPCKGAVVALEPSTGKILA

SEQ ID NO: 233480 - protein, 40 aa, Mycobacterium bovis
GDGGDAGLFGFGGDGGWGGRGVDARFGAAGGAAGAGGAGG

SEQ ID NO: 233481 - protein, 25 aa, Mycobacterium bovis
GDGGDGASGLGLGLSGFDGGQGGQG

SEQ ID NO: 233482 - protein, 29 aa, Mycobacterium bovis
GDGGNGANGNFAFGDGNGGHGGNGGNPGA

SEQ ID NO: 233483 - protein, 25 aa, Mycobacterium bovis
GDGGNGRSGPVNVAGSAGGNGGAGG

SEQ ID NO: 233484 - protein, 20 aa, Mycobacterium bovis
GDGWTCQRALTARNNVTIDI

SEQ ID NO: 233485 - protein, 24 aa, Mycobacterium bovis
GDHRIHNVAAFPGAAYCEMALAAA

SEQ ID NO: 233486 - protein, 25 aa, Mycobacterium bovis
GDKTCKVVSRFTRCGAVAYNGSKYQ

SEQ ID NO: 233487 - protein, 27 aa, Mycobacterium bovis
GDLKRSCLDIGLAERVLGWRPQIELAD

SEQ ID NO: 233488 - protein, 24 aa, Mycobacterium bovis
GDNISVKLFDDWSNLGSISELSTS

SEQ ID NO: 233489 - protein, 18 aa, Mycobacterium bovis
GDRVIPQWVKIRNVDGFN

SEQ ID NO: 233490 - protein, 21 aa, Mycobacterium bovis
GDSRVLAGMNVNVWDVVDDVK

SEQ ID NO: 233491 - protein, 18 aa, Mycobacterium bovis
GDTLKSYFDHQAGKYGTT

SEQ ID NO: 233492 - protein, 19 aa, Mycobacterium bovis
GDTLLALADMYMRRDSHGR

SEQ ID NO: 233493 - protein, 23 aa, Mycobacterium bovis
GDYRCRSYQAGLFCVNYAHQSAV

SEQ ID NO: 233494 - protein, 19 aa, Mycobacterium bovis
GEGLVVWFNTLLVSAGGSV

SEQ ID NO: 233495 - protein, 42 aa, Mycobacterium bovis
GFGNSGLGRRSASAISGWAMRAAPTLAWPTWVWATSGSPTPA

SEQ ID NO: 233496 - protein, 19 aa, Mycobacterium bovis
GFHPRKALARVDEAARTMH

SEQ ID NO: 233497 - protein, 22 aa, Mycobacterium bovis
GFRYVWASDHLQPWQDNEGHSM

SEQ ID NO: 233498 - protein, 23 aa, Mycobacterium bovis
GGAAGLLGVGGHGGAGGHGAAGI

SEQ ID NO: 233499 - protein, 19 aa, Mycobacterium bovis
GGAAGLWGGGGAGGVGGTG

SEQ ID NO: 233500 - protein, 19 aa, Mycobacterium bovis
GGAAGLWGTGGAGGAGGWL

SEQ ID NO: 233501 - protein, 17 aa, Mycobacterium bovis
GGAGAWFGNGGAGGVGG

SEQ ID NO: 233502 - protein, 26 aa, Mycobacterium bovis
GGAGDRGGAGGTGFISSDGGAGGDGG

SEQ ID NO: 233503 - protein, 25 aa, Mycobacterium bovis
GGAGGAAGWLYGSGGAGGAGGLNNA

SEQ ID NO: 233504 - protein, 24 aa, Mycobacterium bovis
GGAGGAGGLLFGNGGAGAAGAPGQ

SEQ ID NO: 233505 - protein, 23 aa, Mycobacterium bovis
GGAGGAGGWLLGNGGAGGAGGAA

SEQ ID NO: 233506 - protein, 22 aa, Mycobacterium bovis
GGAGGAGGWLYGDAGAGGDGGV

SEQ ID NO: 233507 - protein, 23 aa, Mycobacterium bovis
GGAGGGGGWLFGNGGDGGAGGGG

SEQ ID NO: 233508 - protein, 21 aa, Mycobacterium bovis
GGAGGKAGLLIGNGGAGGAGV

SEQ ID NO: 233509 - protein, 23 aa, Mycobacterium bovis
GGAGGSGGWLLGNGGVGGAGGQS

SEQ ID NO: 233510 - protein, 24 aa, Mycobacterium bovis
GGAGGSGGWLLGNGGVGGAGGQSL

SEQ ID NO: 233511 - protein, 22 aa, Mycobacterium bovis
GGAGGSGGWLLGTGGVGGVGGL

SEQ ID NO: 233512 - protein, 23 aa, Mycobacterium bovis
GGAGGTGGWLYGGGGAAGSGGDG

SEQ ID NO: 233513 - protein, 25 aa, Mycobacterium bovis
GGAIARLPAIFTHRDVGNTDCPGNA

SEQ ID NO: 233514 - protein, 19 aa, Mycobacterium bovis
GGAPGNFLSAGGHYHVPGH

SEQ ID NO: 233515 - protein, 18 aa, Mycobacterium bovis
GGDAGWLGSGGVGGAGGF

SEQ ID NO: 233516 - protein, 23 aa, Mycobacterium bovis
GGDARFLSLLSIRQLATEPSLSG

SEQ ID NO: 233517 - protein, 25 aa, Mycobacterium bovis
GGFGGPGLAGGLFGNPGNGGVGGIG

SEQ ID NO: 233518 - protein, 26 aa, Mycobacterium bovis
GGFSAWQLGGSYSKNGKLRTVAQKTV

SEQ ID NO: 233519 - protein, 20 aa, Mycobacterium bovis
GGGAGFGSGVAGAAGAGGNG

SEQ ID NO: 233520 - protein, 27 aa, Mycobacterium bovis
GGGGAAGPAGWLFGDGGAGGNGGAAAA

SEQ ID NO: 233521 - protein, 21 aa, Mycobacterium bovis
GGGGNGRFMGNGGVGGAGGYG

SEQ ID NO: 233522 - protein, 24 aa, Mycobacterium bovis
GGGTGGLGGWLWGNNGAAGTGDPV

SEQ ID NO: 233523 - protein, 20 aa, Mycobacterium bovis
GGGVGGLWGAGGAGGAGGTG

SEQ ID NO: 233524 - protein, 17 aa, Mycobacterium bovis
GGHPEVFAFSTSLTRLT

SEQ ID NO: 233525 - protein, 18 aa, Mycobacterium bovis
GGHPRLGHNLALHPATML

SEQ ID NO: 233526 - protein, 22 aa, Mycobacterium bovis
GGIGGAGGLLFGSGGAGGSGGF

SEQ ID NO: 233527 - protein, 25 aa, Mycobacterium bovis
GGIIQDIEELLGITFVQNAINGAVN

SEQ ID NO: 233528 - protein, 26 aa, Mycobacterium bovis
GGKGGAGGAAFSINFTAGDGGAGGAG

SEQ ID NO: 233529 - protein, 25 aa, Mycobacterium bovis
GGKGGDTPNGLAINPGIGGNGGDTG

SEQ ID NO: 233530 - protein, 17 aa, Mycobacterium bovis
GGLAGIGGNAGFVGNGG

SEQ ID NO: 233531 - protein, 19 aa, Mycobacterium bovis
GGLSHSISVASLVDRWRAV

SEQ ID NO: 233532 - protein, 17 aa, Mycobacterium bovis
GGMGGNGGLVFGNGGPG

SEQ ID NO: 233533 - protein, 20 aa, Mycobacterium bovis
GGMPGLPFVQPDGAGGDRTA

SEQ ID NO: 233534 - protein, 19 aa, Mycobacterium bovis
GGNGAHFSSGGKAGGNGGA

SEQ ID NO: 233535 - protein, 18 aa, Mycobacterium bovis
GGNGGKGGAGLIAGLDGA

SEQ ID NO: 233536 - protein, 27 aa, Mycobacterium bovis
GGNGGSAARLFGGGGAGGAGGTGSTAG

SEQ ID NO: 233537 - protein, 27 aa, Mycobacterium bovis
GGPGGLAGNLFGQNGIQGVGGSGGKGG

SEQ ID NO: 233538 - protein, 26 aa, Mycobacterium bovis
GGRGGDGGSAGWLSGNGGDAGNGGGG

SEQ ID NO: 233539 - protein, 26 aa, Mycobacterium bovis
GGSDPTEGRGFGGLGGAGGAGGKGGA

SEQ ID NO: 233540 - protein, 25 aa, Mycobacterium bovis
GGTCSAGQQCDRLAAVLMPDTATPS

SEQ ID NO: 233541 - protein, 29 aa, Mycobacterium bovis
GGTGGAGGRAELLFGAGGAGGAGGAGTDG

SEQ ID NO: 233542 - protein, 19 aa, Mycobacterium bovis
GGTPGDWGTGGTGGTGGTG

SEQ ID NO: 233543 - protein, 26 aa, Mycobacterium bovis
GGVGGHGSALFGHGGINGDGGTGGMG

SEQ ID NO: 233544 - protein, 24 aa, Mycobacterium bovis
GGVGGPAGLWGHGGAGGAGGAGVA

SEQ ID NO: 233545 - protein, 28 aa, Mycobacterium bovis
GITIPEFPIHWTSTGGIGPIIIPDTTIL

SEQ ID NO: 233546 - protein, 17 aa, Mycobacterium bovis
GKAGWRVVSVNQNGVDV

SEQ ID NO: 233547 - protein, 25 aa, Mycobacterium bovis
GKGGAGGDAGMLFGSGGSGGAGGIS

SEQ ID NO: 233548 - protein, 19 aa, Mycobacterium bovis
GKGGAGLIAGLDGAGGAGG

SEQ ID NO: 233549 - protein, 20 aa, Mycobacterium bovis
GKGGDGMAGVAGSSPTTAGE

SEQ ID NO: 233550 - protein, 19 aa, Mycobacterium bovis
GKLKRRAVAQAYRDGTLPR

SEQ ID NO: 233551 - protein, 18 aa, Mycobacterium bovis
GKLYPQFGAVAALNLVKC

SEQ ID NO: 233552 - protein, 17 aa, Mycobacterium bovis
GKPGEDGVFRFEPSPVE

SEQ ID NO: 233553 - protein, 23 aa, Mycobacterium bovis
GKQASAAKFIWFFRHPNPIRPVV

SEQ ID NO: 233554 - protein, 24 aa, Mycobacterium bovis
GKTLARICALNALAAVDSLVDLDA

SEQ ID NO: 233555 - protein, 21 aa, Mycobacterium bovis
GKVKADLGVDVFRRMVGDDFT

SEQ ID NO: 233556 - protein, 22 aa, Mycobacterium bovis
GLADRRLYLAANRCLAIAARRV

SEQ ID NO: 233557 - protein, 26 aa, Mycobacterium bovis
GLGGGSFGLPGLNGSGGDGGDGGNGA

SEQ ID NO: 233558 - protein, 20 aa, Mycobacterium bovis
GLGGLECLSGIPGSAGATPV

SEQ ID NO: 233559 - protein, 18 aa, Mycobacterium bovis
GLHDPYFDFILGRPDAST

SEQ ID NO: 233560 - protein, 20 aa, Mycobacterium bovis
GLLACNCYVLAERPGTDAVI

SEQ ID NO: 233561 - protein, 19 aa, Mycobacterium bovis
GLQVKTIWVARAVSVLFPQ

SEQ ID NO: 233562 - protein, 25 aa, Mycobacterium bovis
GMSSPIDCRDHFDRDEMRDQAQFQA

SEQ ID NO: 233563 - protein, 18 aa, Mycobacterium bovis
GMTPRAALTKHLLDGDDS

SEQ ID NO: 233564 - protein, 30 aa, Mycobacterium bovis
GMWGAPQLGRWKWHDPWVHASLLAQNNTRV

SEQ ID NO: 233565 - protein, 17 aa, Mycobacterium bovis
GNAGMLAGPGGAGGAGG

SEQ ID NO: 233566 - protein, 21 aa, Mycobacterium bovis
GNEPSRTWFAAMKPIANNFGE

SEQ ID NO: 233567 - protein, 25 aa, Mycobacterium bovis
GNGGNGATGGWLYGNGGAGGQGATA

SEQ ID NO: 233568 - protein, 18 aa, Mycobacterium bovis
GNGGSGFNSLTSSVGGAG

SEQ ID NO: 233569 - protein, 20 aa, Mycobacterium bovis
GNGGSRGIGGAGGIGGAGST

SEQ ID NO: 233570 - protein, 25 aa, Mycobacterium bovis
GNNVRRLAGPYAWSNALSAGYTAEE

SEQ ID NO: 233571 - protein, 26 aa, Mycobacterium bovis
GNTAGRRADAIAGTGGDGGNGGNGGL

SEQ ID NO: 233572 - protein, 19 aa, Mycobacterium bovis
GNTIAWLYSQRRFEVPSDK

SEQ ID NO: 233573 - protein, 24 aa, Mycobacterium bovis
GPAKMLRLNAGLGNVGNYNVGLGN

SEQ ID NO: 233574 - protein, 19 aa, Mycobacterium bovis
GPAPGSWRTRTWWTGTPDS

SEQ ID NO: 233575 - protein, 18 aa, Mycobacterium bovis
GPDGGWNKPPTPLWPDQL

SEQ ID NO: 233576 - protein, 21 aa, Mycobacterium bovis
GPDPLGVLYWQVPKGSTLDST

SEQ ID NO: 233577 - protein, 19 aa, Mycobacterium bovis
GPEVGEALVSMLKDHGVGF

SEQ ID NO: 233578 - protein, 25 aa, Mycobacterium bovis
GPIELVKTSGGWRIDRLPNGVFLDW

SEQ ID NO: 233579 - protein, 18 aa, Mycobacterium bovis
GPLGYSYNTGCHLPAAWR

SEQ ID NO: 233580 - protein, 18 aa, Mycobacterium bovis
GPQLPAPFINPGGTGGSG

SEQ ID NO: 233581 - protein, 19 aa, Mycobacterium bovis
GPTGFPPGLWARQTTEIRS

SEQ ID NO: 233582 - protein, 24 aa, Mycobacterium bovis
GQAGGAGGILWGNGGAGGSGAPGQ

SEQ ID NO: 233583 - protein, 28 aa, Mycobacterium bovis
GQAGGPGGPAGLWGNGGPGGAGGSGGGT

SEQ ID NO: 233584 - protein, 17 aa, Mycobacterium bovis
GQANYGFAVPDIPIPAI

SEQ ID NO: 233585 - protein, 18 aa, Mycobacterium bovis
GQFELNRPATLIAALPAI

SEQ ID NO: 233586 - protein, 20 aa, Mycobacterium bovis
GQGAGAFAGGGGGRGGDGGN

SEQ ID NO: 233587 - protein, 17 aa, Mycobacterium bovis
GQGFAIPIGQAMAIAGQ

SEQ ID NO: 233588 - protein, 28 aa, Mycobacterium bovis
GQGGGGGFSILLGLGGLGGLGSPGSIAT

SEQ ID NO: 233589 - protein, 27 aa, Mycobacterium bovis
GQLKMARDEGRWHVRWTTSGLHPKLGE

SEQ ID NO: 233590 - protein, 36 aa, Mycobacterium bovis
GQMLFDLPPRWFAGWSRLGLRTSLRYKVPRMPFSMS

SEQ ID NO: 233591 - protein, 30 aa, Mycobacterium bovis
GQPLPEFLSAEIFQPLGLAMVVDPVGKVPN

SEQ ID NO: 233592 - protein, 25 aa, Mycobacterium bovis
GQPWVVSFQLNWPRDHGPTVTGWML

SEQ ID NO: 233593 - protein, 25 aa, Mycobacterium bovis
GQVVLGWKVSDLKSSTAVIPGYPVA

SEQ ID NO: 233594 - protein, 17 aa, Mycobacterium bovis
GQWRLRQQRHFGCGGQP

SEQ ID NO: 233595 - protein, 22 aa, Mycobacterium bovis
GRDIPVAFLAGGPHAVYLLDAF

SEQ ID NO: 233596 - protein, 25 aa, Mycobacterium bovis
GRHCGRRLGCGGGSWGDDCRPAGIG

SEQ ID NO: 233597 - protein, 22 aa, Mycobacterium bovis
GRIAGASVTLEWSVDDFAISRF

SEQ ID NO: 233598 - protein, 29 aa, Mycobacterium bovis
GRLRRLALSAAINRPQICQQIFAGTRSPA

SEQ ID NO: 233599 - protein, 26 aa, Mycobacterium bovis
GRLSPDGLRWSTTEQLGYNRRYTLNA

SEQ ID NO: 233600 - protein, 18 aa, Mycobacterium bovis
GRPMGRYAGCNVINDLFD

SEQ ID NO: 233601 - protein, 25 aa, Mycobacterium bovis
GRPRGWPEWAEPDVVDAFADRGISS

SEQ ID NO: 233602 - protein, 32 aa, Mycobacterium bovis
GRQEASELFFGRPAPTPQQWLQIVTELAPVFK

SEQ ID NO: 233603 - protein, 25 aa, Mycobacterium bovis
GRQKLNGPQALSFVRQRHDLPRGDL

SEQ ID NO: 233604 - protein, 26 aa, Mycobacterium bovis
GRQRLNAAQALAFVRQRHGLDNGDLD

SEQ ID NO: 233605 - protein, 32 aa, Mycobacterium bovis
GRRVVINLWAHWCAPCMTELPVMAEYQRRVGP

SEQ ID NO: 233606 - protein, 18 aa, Mycobacterium bovis
GRSGLSVHGHARLLSEED

SEQ ID NO: 233607 - protein, 18 aa, Mycobacterium bovis
GRTPWRDLFGPAVTLADG

SEQ ID NO: 233608 - protein, 21 aa, Mycobacterium bovis
GRVPDRLAVVRVETGESLHDV

SEQ ID NO: 233609 - protein, 24 aa, Mycobacterium bovis
GSAGIGGAGGRGGDGGDGASGLGL

SEQ ID NO: 233610 - protein, 21 aa, Mycobacterium bovis
GSANRPAAVAVTRADADMAAE

SEQ ID NO: 233611 - protein, 25 aa, Mycobacterium bovis
GSAPRRPPIPGSDAAGVHYLRSYND

SEQ ID NO: 233612 - protein, 21 aa, Mycobacterium bovis
GSAYAEEFPQRVRAMILDGAV

SEQ ID NO: 233613 - protein, 21 aa, Mycobacterium bovis
GSFDGPDDWSANSVFGLPALG

SEQ ID NO: 233614 - protein, 24 aa, Mycobacterium bovis
GSGADNPTGAGFAGGAGGTGGAAG

SEQ ID NO: 233615 - protein, 21 aa, Mycobacterium bovis
GSGADPLWFTSLFSQHTLDLL

SEQ ID NO: 233616 - protein, 19 aa, Mycobacterium bovis
GSGGFGLPSGGKGGAGGDA

SEQ ID NO: 233617 - protein, 26 aa, Mycobacterium bovis
GSGGLPLDRAAVIIADLAQSTPTGID

SEQ ID NO: 233618 - protein, 23 aa, Mycobacterium bovis
GSPRGARTVALWEPALRSDVIGE

SEQ ID NO: 233619 - protein, 23 aa, Mycobacterium bovis
GSQWPGMGTELLVAEPVFAATVA

SEQ ID NO: 233620 - protein, 26 aa, Mycobacterium bovis
GSRLGPARTAAICAVSPALWLSAGAV

SEQ ID NO: 233621 - protein, 17 aa, Mycobacterium bovis
GSSNRFSPAPAPAPIAS

SEQ ID NO: 233622 - protein, 31 aa, Mycobacterium bovis
GSTLLYPLFNLWGPAFHERYPNVTITAQGTG

SEQ ID NO: 233623 - protein, 25 aa, Mycobacterium bovis
GSTPGAKGAHGFTPTSGGDGGDGGN

SEQ ID NO: 233624 - protein, 19 aa, Mycobacterium bovis
GSVLEVRTALSYVSVDGAR

SEQ ID NO: 233625 - protein, 22 aa, Mycobacterium bovis
GTDAVVLPGGFPEQFTAELSAN

SEQ ID NO: 233626 - protein, 23 aa, Mycobacterium bovis
GTDLPPTPISVIFRSDKSGTSDN

SEQ ID NO: 233627 - protein, 28 aa, Mycobacterium bovis
GTEVLQRLRGMFAFALWDTVTRELFCAR

SEQ ID NO: 233628 - protein, 26 aa, Mycobacterium bovis
GTGADGGAGGWLFGNGGNGGQGTIGG

SEQ ID NO: 233629 - protein, 25 aa, Mycobacterium bovis
GTGANGAPGGWLLGNGGAGGSAAAG

SEQ ID NO: 233630 - protein, 27 aa, Mycobacterium bovis
GTGGAGGAGFSRALIVAGDNGGDGGNG

SEQ ID NO: 233631 - protein, 19 aa, Mycobacterium bovis
GTGGLLFGNGGAGGHGAAA

SEQ ID NO: 233632 - protein, 18 aa, Mycobacterium bovis
GTGGVLLGLDGFTAPAST

SEQ ID NO: 233633 - protein, 27 aa, Mycobacterium bovis
GTLGLSLLWVLRGWRRPDDVRVRPTAA

SEQ ID NO: 233634 - protein, 24 aa, Mycobacterium bovis
GTPISANFAHRVSVLVDLSVASDD

SEQ ID NO: 233635 - protein, 18 aa, Mycobacterium bovis
GTQSVALYLGKGQMLEVG

SEQ ID NO: 233636 - protein, 17 aa, Mycobacterium bovis
GTSEPFDLLAVVPPHVP

SEQ ID NO: 233637 - protein, 21 aa, Mycobacterium bovis
GTYKMAKSVLLAMSHSLATEL

SEQ ID NO: 233638 - protein, 18 aa, Mycobacterium bovis
GVAACGLSLAVLAAAPTA

SEQ ID NO: 233639 - protein, 20 aa, Mycobacterium bovis
GVASDAAGVVGWWVNPQAPG

SEQ ID NO: 233640 - protein, 25 aa, Mycobacterium bovis
GVDKFPRMVDYVVPTGVRIADADRV

SEQ ID NO: 233641 - protein, 20 aa, Mycobacterium bovis
GVDWKGTLTGLAGYASGDLD

SEQ ID NO: 233642 - protein, 29 aa, Mycobacterium bovis
GVLVCTRAVYKHMAKRGGGAIVNQSSTAA

SEQ ID NO: 233643 - protein, 26 aa, Mycobacterium bovis
GVPGRSVSRWGAFLDDVGGFDCDFFG

SEQ ID NO: 233644 - protein, 20 aa, Mycobacterium bovis
GVRVPPRIIKATVAPDGSRT

SEQ ID NO: 233645 - protein, 27 aa, Mycobacterium bovis
GVTVAPALSLGSWVAFARTPDGQTMLM

SEQ ID NO: 233646 - protein, 19 aa, Mycobacterium bovis
GVVLGSGFFSDTLLSSLRS

SEQ ID NO: 233647 - protein, 17 aa, Mycobacterium bovis
GVVNVYAIAVLKRTSQP

SEQ ID NO: 233648 - protein, 18 aa, Mycobacterium bovis
GWTGRFVSRILIDGSTLS

SEQ ID NO: 233649 - protein, 23 aa, Mycobacterium bovis
GYGRPNARLAATIGTIADACAPA

SEQ ID NO: 233650 - protein, 17 aa, Mycobacterium bovis
GYMLLGLEVDAVPDRYR

SEQ ID NO: 233651 - protein, 17 aa, Mycobacterium bovis
HAAAKVNGRHLVLPLQQ

SEQ ID NO: 233652 - protein, 17 aa, Mycobacterium bovis
HAAVVAWWAHREAALCG

SEQ ID NO: 233653 - protein, 26 aa, Mycobacterium bovis
HAGTGGRGGLLAGQHANSGNGGGGGT

SEQ ID NO: 233654 - protein, 17 aa, Mycobacterium bovis
HARALATEIARAAGKLV

SEQ ID NO: 233655 - protein, 18 aa, Mycobacterium bovis
HDGQLRLSLGPKNQTFDL

SEQ ID NO: 233656 - protein, 26 aa, Mycobacterium bovis
HEMRDRWAGFFNEFDVLLLPVTPTPA

SEQ ID NO: 233657 - protein, 22 aa, Mycobacterium bovis
HESARAVLRVAPLSVAELLATQ

SEQ ID NO: 233658 - protein, 24 aa, Mycobacterium bovis
HGENRFPYDIEFIIRGESEQHRTK

SEQ ID NO: 233659 - protein, 21 aa, Mycobacterium bovis
HGLDLDMSGLVYFGDRTDART

SEQ ID NO: 233660 - protein, 25 aa, Mycobacterium bovis
HGLRLRLSPDLTNLIERYLANDVTT

SEQ ID NO: 233661 - protein, 25 aa, Mycobacterium bovis
HGTAFLAARGGYFVADLSSGHTARV

SEQ ID NO: 233662 - protein, 25 aa, Mycobacterium bovis
HIRAGDCGRDYRVLSAALLEVTFCG

SEQ ID NO: 233663 - protein, 25 aa, Mycobacterium bovis
HIVNISSLFGLIAVPGQSAYNAAKF

SEQ ID NO: 233664 - protein, 21 aa, Mycobacterium bovis
HKPQLAFLPRQAFLDTNIIGT

SEQ ID NO: 233665 - protein, 24 aa, Mycobacterium bovis
HKSTWRSVPLVGHIPSAPGNPGRW

SEQ ID NO: 233666 - protein, 18 aa, Mycobacterium bovis
HLGLTGQANYGFAVPDIP

SEQ ID NO: 233667 - protein, 29 aa, Mycobacterium bovis
HLSVLRNHARWAVLLRNLRFVIVDECHYY

SEQ ID NO: 233668 - protein, 22 aa, Mycobacterium bovis
HNALRELAQVAGRLGDSRGDIF

SEQ ID NO: 233669 - protein, 19 aa, Mycobacterium bovis
HPQCRRCRRRTATLRRSSG

SEQ ID NO: 233670 - protein, 25 aa, Mycobacterium bovis
HPVSPRARASFYGYGFNVGVTSSGR

SEQ ID NO: 233671 - protein, 20 aa, Mycobacterium bovis
HRALMAAGVGCTRLAIHAVT

SEQ ID NO: 233672 - protein, 25 aa, Mycobacterium bovis
HRGHEWKFAITKNGRHSLTHYDTLE

SEQ ID NO: 233673 - protein, 26 aa, Mycobacterium bovis
HRHLFTVLMDREWKHGVAAAVDVTLL

SEQ ID NO: 233674 - protein, 17 aa, Mycobacterium bovis
HRPEVVFHLAAQIDVRR

SEQ ID NO: 233675 - protein, 24 aa, Mycobacterium bovis
HSAAPLFHNIAGWLMQRENVPLSP

SEQ ID NO: 233676 - protein, 17 aa, Mycobacterium bovis
HSGDLNTGFGSPVDQPV

SEQ ID NO: 233677 - protein, 23 aa, Mycobacterium bovis
HSLSKIHSVASFFVSRVDTEIDK

SEQ ID NO: 233678 - protein, 29 aa, Mycobacterium bovis
HTGGFNRNTWGVAMIGNFDDVAPTPIQIR

SEQ ID NO: 233679 - protein, 23 aa, Mycobacterium bovis
HTSGTLACLVRLANPPPRPETAY

SEQ ID NO: 233680 - protein, 20 aa, Mycobacterium bovis
HTVAPFKVGPDFIDPGYHAL

SEQ ID NO: 233681 - protein, 22 aa, Mycobacterium bovis
HVPLTCWNTWGGVDQFDVGIGA

SEQ ID NO: 233682 - protein, 30 aa, Mycobacterium bovis
HVSNAVRFAFWGAEEFGLIGSRNYVESLDI

SEQ ID NO: 233683 - protein, 19 aa, Mycobacterium bovis
HVYTKLGFTSRLQLAQAAA

SEQ ID NO: 233684 - protein, 23 aa, Mycobacterium bovis
IAADDFWYLWQQMVTQPGVVDPA

SEQ ID NO: 233685 - protein, 21 aa, Mycobacterium bovis
IADACAPAGITVSDVTVDTPG

SEQ ID NO: 233686 - protein, 17 aa, Mycobacterium bovis
IAPPLTWSAPFGGALVV

SEQ ID NO: 233687 - protein, 22 aa, Mycobacterium bovis
IARGLSQRGVPFSWAGGGISGP

SEQ ID NO: 233688 - protein, 24 aa, Mycobacterium bovis
ICSDGNRWRAHLGYVPGMTNQAAR

SEQ ID NO: 233689 - protein, 22 aa, Mycobacterium bovis
IDAAREAARLAARGDVRSATDV

SEQ ID NO: 233690 - protein, 18 aa, Mycobacterium bovis
IDGYRVLTDPVWSDRCSP

SEQ ID NO: 233691 - protein, 20 aa, Mycobacterium bovis
IDKRLDRIGSRQALELRGQA

SEQ ID NO: 233692 - protein, 17 aa, Mycobacterium bovis
IDLSGPVVIAMKRPPTS

SEQ ID NO: 233693 - protein, 32 aa, Mycobacterium bovis
IDPAKVLQFAPGELKNLPGFQGSGDGSAATLG

SEQ ID NO: 233694 - protein, 25 aa, Mycobacterium bovis
IDPQHRLLLEVSWEAIEHAGVDPAT

SEQ ID NO: 233695 - protein, 26 aa, Mycobacterium bovis
IDRCWAPKVHGAWNIHRATAAQPLEW

SEQ ID NO: 233696 - protein, 18 aa, Mycobacterium bovis
IEPAEPIANVILQTISDR

SEQ ID NO: 233697 - protein, 33 aa, Mycobacterium bovis
IEYRADERFAFCSTFKAPLVAAVLHQNPLTHLD

SEQ ID NO: 233698 - protein, 20 aa, Mycobacterium bovis
IGALNSGIGNLGFGNSGNNN

SEQ ID NO: 233699 - protein, 21 aa, Mycobacterium bovis
IGATDLCEFVEFPSQLLQVCG

SEQ ID NO: 233700 - protein, 30 aa, Mycobacterium bovis
IGDHSNALWCRWCLGYAQLMRGELAAAAAQ

SEQ ID NO: 233701 - protein, 29 aa, Mycobacterium bovis
IGGDGGNAGFGAGVPGDGGIGGTGGAGGA

SEQ ID NO: 233702 - protein, 24 aa, Mycobacterium bovis
IGNGGDGGPGMFGGPGGAGGSGGT

SEQ ID NO: 233703 - protein, 33 aa, Mycobacterium bovis
IGPGGDFTYRFSVPDPGTYWAHPHVGLQGDHGL

SEQ ID NO: 233704 - protein, 22 aa, Mycobacterium bovis
IGQMSVPPAWKAPAVTTVRAFD

SEQ ID NO: 233705 - protein, 23 aa, Mycobacterium bovis
IGRACWPSWTPPPLMSRWSNRPE

SEQ ID NO: 233706 - protein, 23 aa, Mycobacterium bovis
IIDRLFAGLMSYDAVGKPSLEVA

SEQ ID NO: 233707 - protein, 20 aa, Mycobacterium bovis
IISRAEWGADESLRCETPEY

SEQ ID NO: 233708 - protein, 18 aa, Mycobacterium bovis
IKLAWITAVVAGLMVGVA

SEQ ID NO: 233709 - protein, 17 aa, Mycobacterium bovis
IKLKNWVATLTLSLKKD

SEQ ID NO: 233710 - protein, 17 aa, Mycobacterium bovis
IKMQGARQVDLIRAQLT

SEQ ID NO: 233711 - protein, 17 aa, Mycobacterium bovis
IKPLFVLFDSCWDPLPR

SEQ ID NO: 233712 - protein, 23 aa, Mycobacterium bovis
ILATLIYLGWRAARAQMNRPKTR

SEQ ID NO: 233713 - protein, 17 aa, Mycobacterium bovis
ILTRYLNLVSFGNNSFG

SEQ ID NO: 233714 - protein, 24 aa, Mycobacterium bovis
ILVCPADRGPLVLVEDGDIQVLYN

SEQ ID NO: 233715 - protein, 24 aa, Mycobacterium bovis
INAPTEFMFGRSLIGDGADGTAAS

SEQ ID NO: 233716 - protein, 28 aa, Mycobacterium bovis
INAPTQALWGRPLIGNGADGTAANPNGG

SEQ ID NO: 233717 - protein, 23 aa, Mycobacterium bovis
INTEINWIRGFLPPLPPISPPGF

SEQ ID NO: 233718 - protein, 19 aa, Mycobacterium bovis
IPSGGLFSGAEVKKSAEQA

SEQ ID NO: 233719 - protein, 31 aa, Mycobacterium bovis
IQIRTVGRLLGWRLGMDDVDPRSMVDLQSAG

SEQ ID NO: 233720 - protein, 23 aa, Mycobacterium bovis
IQLRLPVNGRWVLVVTGGTGAIS

SEQ ID NO: 233721 - protein, 26 aa, Mycobacterium bovis
IQSTFVGAICRWQAANPAGLIDITRF

SEQ ID NO: 233722 - protein, 19 aa, Mycobacterium bovis
IRAEVAAAFGSAPPTSQTA

SEQ ID NO: 233723 - protein, 17 aa, Mycobacterium bovis
IRHLTRLGVDIHFNTRV

SEQ ID NO: 233724 - protein, 17 aa, Mycobacterium bovis
IRIGGRVVSLFDRVEAL

SEQ ID NO: 233725 - protein, 26 aa, Mycobacterium bovis
IRRAGSQMGVPYSWGGGSLQGPSKGV

SEQ ID NO: 233726 - protein, 19 aa, Mycobacterium bovis
IRSTNRLAYLDAHATSQFE

SEQ ID NO: 233727 - protein, 17 aa, Mycobacterium bovis
IRTHYFDNFFLDATRAG

SEQ ID NO: 233728 - protein, 21 aa, Mycobacterium bovis
ISETYPPGSTFKVITTAAALA

SEQ ID NO: 233729 - protein, 23 aa, Mycobacterium bovis
ISIIDIPALPGFGNSTELPSSGF

SEQ ID NO: 233730 - protein, 32 aa, Mycobacterium bovis
ISPEDFWRSAGLPAYRWPDPNGTRFPNGAPPP

SEQ ID NO: 233731 - protein, 26 aa, Mycobacterium bovis
ISSIPPVPGKFYWMSPTQVRWRPFEF

SEQ ID NO: 233732 - protein, 20 aa, Mycobacterium bovis
ISVEVGDGWFQRVALTNSAG

SEQ ID NO: 233733 - protein, 17 aa, Mycobacterium bovis
ITVILALHDLINGGHVG

SEQ ID NO: 233734 - protein, 18 aa, Mycobacterium bovis
ITVKDSYETAGMRTTCGR

SEQ ID NO: 233735 - protein, 20 aa, Mycobacterium bovis
IVAGGGPLPLAVSVDEEGGR

SEQ ID NO: 233736 - protein, 37 aa, Mycobacterium bovis
IVNAIPFPSIVGDEFCLLDGLLAWYATIGSINNINSM

SEQ ID NO: 233737 - protein, 17 aa, Mycobacterium bovis
IVSVVNWADCLVALQQR

SEQ ID NO: 233738 - protein, 18 aa, Mycobacterium bovis
IWDRGRELGMVNRLQRVG

SEQ ID NO: 233739 - protein, 19 aa, Mycobacterium bovis
IWRRDEVFEFNGSLIDSEE

SEQ ID NO: 233740 - protein, 26 aa, Mycobacterium bovis
IYGGMKLDLLLTVPLDYYKKFMSVNH

SEQ ID NO: 233741 - protein, 31 aa, Mycobacterium bovis; identical to SEQ ID NO: 99027

SEQ ID NO: 233742 - protein, 27 aa, Mycobacterium bovis
IYREAALRLDHHFAISVIDCGSSMEAA

SEQ ID NO: 233743 - protein, 19 aa, Mycobacterium bovis
IYTYHSKTLGWCDIAYNAL

SEQ ID NO: 233744 - protein, 21 aa, Mycobacterium bovis
KAGNPGVNVNFAFAGSSELAT

SEQ ID NO: 233745 - protein, 18 aa, Mycobacterium bovis
KALEGGAIYQRWQALGGM

SEQ ID NO: 233746 - protein, 20 aa, Mycobacterium bovis
KAYPSHELTAVGDWMLLAAI

SEQ ID NO: 233747 - protein, 21 aa, Mycobacterium bovis
KCPAAPFEAAFLIAAQLGDRY

SEQ ID NO: 233748 - protein, 17 aa, Mycobacterium bovis
KDRQCQFMPTIGSTVVP

SEQ ID NO: 233749 - protein, 20 aa, Mycobacterium bovis
KDVGFPYRSALVPRRNAELD

SEQ ID NO: 233750 - protein, 18 aa, Mycobacterium bovis
KGAARRAWLAELAEERRT

SEQ ID NO: 233751 - protein, 18 aa, Mycobacterium bovis
KGAVSALLSAARSGDGPG

SEQ ID NO: 233752 - protein, 25 aa, Mycobacterium bovis
KGGSGGNGGNAWLTGQGGNGGNAAF

SEQ ID NO: 233753 - protein, 23 aa, Mycobacterium bovis
KHMRADVTVGAFLSGGIDSTAIA

SEQ ID NO: 233754 - protein, 21 aa, Mycobacterium bovis
KLALIDVRDPVEWDIVHIDGA

SEQ ID NO: 233755 - protein, 19 aa, Mycobacterium bovis
KLEAQRPHGFKALDITLPM

SEQ ID NO: 233756 - protein, 21 aa, Mycobacterium bovis
KLERFPRGIVPFGDAVASFNP

SEQ ID NO: 233757 - protein, 18 aa, Mycobacterium bovis
KLGQPVEWTPCRSSNPQV

SEQ ID NO: 233758 - protein, 17 aa, Mycobacterium bovis
KLLSSILTYHVIAGQAS

SEQ ID NO: 233759 - protein, 17 aa, Mycobacterium bovis
KNALARALLSTGAGSPP

SEQ ID NO: 233760 - protein, 20 aa, Mycobacterium bovis
KPSMPYRLRVIVHEDENGRM

SEQ ID NO: 233761 - protein, 25 aa, Mycobacterium bovis
KQDPEGWGKSPGFGTTVDFPAVPGA

SEQ ID NO: 233762 - protein, 19 aa, Mycobacterium bovis
KQTAIEPLPPMPGPSPTRP

SEQ ID NO: 233763 - protein, 18 aa, Mycobacterium bovis
KRPATGWESLTPTEIDVV

SEQ ID NO: 233764 - protein, 23 aa, Mycobacterium bovis
KRRFSRRGFLGAGIASGFALAAC

SEQ ID NO: 233765 - protein, 21 aa, Mycobacterium bovis
KRSEAAAEYAALGYLKYPKAV

SEQ ID NO: 233766 - protein, 18 aa, Mycobacterium bovis
KTIQQAIELWKIVDRPNL

SEQ ID NO: 233767 - protein, 18 aa, Mycobacterium bovis
KTTYPVWMMNAIGDISFH

SEQ ID NO: 233768 - protein, 24 aa, Mycobacterium bovis
KTVDDYRLAHKIGLDAVLVDSPLA

SEQ ID NO: 233769 - protein, 22 aa, Mycobacterium bovis
KTVVPDPRYVAVSDRDQLATEL

SEQ ID NO: 233770 - protein, 22 aa, Mycobacterium bovis
KYGGLQFKPATWAAFGGVGNPA

SEQ ID NO: 233771 - protein, 25 aa, Mycobacterium bovis
LAAACARATLVARAMRVEHAQCRVV

SEQ ID NO: 233772 - protein, 23 aa, Mycobacterium bovis
LAALGEAVGKVFADLHRDQGVDL

SEQ ID NO: 233773 - protein, 17 aa, Mycobacterium bovis
LAANVVGGIDWDGHGLL

SEQ ID NO: 233774 - protein, 25 aa, Mycobacterium bovis
LAARREFSEEIGLCVPDGPRIDFGS

SEQ ID NO: 233775 - protein, 20 aa, Mycobacterium bovis
LAEPGPRSAKEFYRGAPHGV

SEQ ID NO: 233776 - protein, 17 aa, Mycobacterium bovis
LAETLTILGRFSASFGE

SEQ ID NO: 233777 - protein, 17 aa, Mycobacterium bovis
LAGCCLLASVVATALTF

SEQ ID NO: 233778 - protein, 23 aa, Mycobacterium bovis
LAHEFGHALQVMANLVTRKDPTI

SEQ ID NO: 233779 - protein, 25 aa, Mycobacterium bovis
LAIRGNRVLIGFSLPGKTIGMQSRA

SEQ ID NO: 233780 - protein, 19 aa, Mycobacterium bovis
LALAPRLAGMAELVQITDK

SEQ ID NO: 233781 - protein, 22 aa, Mycobacterium bovis
LALLGRPLIGNGADGAAGTGQA

SEQ ID NO: 233782 - protein, 23 aa, Mycobacterium bovis
LALVKACRGVRLLATCREPLRVE

SEQ ID NO: 233783 - protein, 23 aa, Mycobacterium bovis
LANGRGRWLAIAASLVVSAAILY

SEQ ID NO: 233784 - protein, 17 aa, Mycobacterium bovis
LAPHTPLARVFSPRTRI

SEQ ID NO: 233785 - protein, 18 aa, Mycobacterium bovis
LAPPRAGALKDFRVAVWA

SEQ ID NO: 233786 - protein, 24 aa, Mycobacterium bovis
LAQDCVDRMGFSFLANIGTASVAR

SEQ ID NO: 233787 - protein, 31 aa, Mycobacterium bovis
LAQSRTRRALALCVPRDAIARDAGVPIANSR

SEQ ID NO: 233788 - protein, 22 aa, Mycobacterium bovis
LARDRGRQMRKLGITIDFAPVV

SEQ ID NO: 233789 - protein, 23 aa, Mycobacterium bovis
LASSCTWQLSLFIPDGVPPPPGD

SEQ ID NO: 233790 - protein, 19 aa, Mycobacterium bovis
LATEIARAAGKLVSATSET

SEQ ID NO: 233791 - protein, 21 aa, Mycobacterium bovis
LATQVACRVLRDGGTAADAVV

SEQ ID NO: 233792 - protein, 26 aa, Mycobacterium bovis
LAVTAAEVPLAFALAAGSFRDATRVA

SEQ ID NO: 233793 - protein, 21 aa, Mycobacterium bovis
LDAGRELAKALGLDPAAVTIA

SEQ ID NO: 233794 - protein, 24 aa, Mycobacterium bovis
LDGLNRVSAILARDKDNLGRALDT

SEQ ID NO: 233795 - protein, 26 aa, Mycobacterium bovis
LDIHETMVIPPIVFLPSMTIGGQTYT

SEQ ID NO: 233796 - protein, 25 aa, Mycobacterium bovis
LDRQWLHARSLAFAHPADGRRVEIV

SEQ ID NO: 233797 - protein, 18 aa, Mycobacterium bovis
LDSLVLIASGGAFGPNGN

SEQ ID NO: 233798 - protein, 28 aa, Mycobacterium bovis
LDSRAYRLRWPAGTIVFEVDQPQVIDFK

SEQ ID NO: 233799 - protein, 20 aa, Mycobacterium bovis
LDVNPRYISLIPVNVVADIE

SEQ ID NO: 233800 - protein, 18 aa, Mycobacterium bovis
LDVPYTRIHEFRHFHPER

SEQ ID NO: 233801 - protein, 19 aa, Mycobacterium bovis
LDYADGIEPYFSVPATGIE

SEQ ID NO: 233802 - protein, 18 aa, Mycobacterium bovis
LEEGRRWTVEEFRSTHPV

SEQ ID NO: 233803 - protein, 17 aa, Mycobacterium bovis
LEIEPRGAQALPPGGVL

SEQ ID NO: 233804 - protein, 20 aa, Mycobacterium bovis
LELDLHYLPRLEGHGAPGVT

SEQ ID NO: 233805 - protein, 18 aa, Mycobacterium bovis
LEQLRILTDLLVDRKEDL

SEQ ID NO: 233806 - protein, 22 aa, Mycobacterium bovis
LEQSPPIWWTHIAGHGDAADLA

SEQ ID NO: 233807 - protein, 20 aa, Mycobacterium bovis
LERRYIRDARWCDANDIAQL

SEQ ID NO: 233808 - protein, 17 aa, Mycobacterium bovis
LESGCFARIRADQLAPV

SEQ ID NO: 233809 - protein, 18 aa, Mycobacterium bovis
LESRIIIDSMHLGRYLGI

SEQ ID NO: 233810 - protein, 20 aa, Mycobacterium bovis
LGAADGRRALQTWRRLAVTR

SEQ ID NO: 233811 - protein, 20 aa, Mycobacterium bovis
LGASPVWHTFCIDQCSIAFT

SEQ ID NO: 233812 - protein, 18 aa, Mycobacterium bovis
LGAWLEATMARWPRRRSM

SEQ ID NO: 233813 - protein, 18 aa, Mycobacterium bovis
LGDMVAELIELSRLQGAE

SEQ ID NO: 233814 - protein, 17 aa, Mycobacterium bovis
LGGLGINLGGPAASAPS

SEQ ID NO: 233815 - protein, 18 aa, Mycobacterium bovis
LGGVDVCLKEPVYEPLSG

SEQ ID NO: 233816 - protein, 19 aa, Mycobacterium bovis
LGHDQLRAAHALAAAVPRL

SEQ ID NO: 233817 - protein, 24 aa, Mycobacterium bovis
LGKPSRPTPIGSFHAMSKERTVVM

SEQ ID NO: 233818 - protein, 25 aa, Mycobacterium bovis
LGQHGVNIMEFCKAYNAATENQRGN

SEQ ID NO: 233819 - protein, 22 aa, Mycobacterium bovis
LGQSVCPILAEPGGSFNTAVAS

SEQ ID NO: 233820 - protein, 22 aa, Mycobacterium bovis
LGRDVQRLTAWASTTVSGDRDD

SEQ ID NO: 233821 - protein, 25 aa, Mycobacterium bovis
LGSPGGSMIIQFVVKTLVAMLDWGL

SEQ ID NO: 233822 - protein, 24 aa, Mycobacterium bovis
LGYTLSCRRAHRPVRTVVTASSFD

SEQ ID NO: 233823 - protein, 24 aa, Mycobacterium bovis
LHKANSLQGLAFALAYQGELSAAR

SEQ ID NO: 233824 - protein, 21 aa, Mycobacterium bovis
LHKGDRVRIAGLGVGTVEGLK

SEQ ID NO: 233825 - protein, 19 aa, Mycobacterium bovis
LHVTAARLADWVDQNGNAG

SEQ ID NO: 233826 - protein, 20 aa, Mycobacterium bovis
LKYPKAVTVASVMDPGPSVD

SEQ ID NO: 233827 - protein, 17 aa, Mycobacterium bovis
LLAEALAVTAAEVPLAF

SEQ ID NO: 233828 - protein, 24 aa, Mycobacterium bovis
LLAPKFRAMPELMFSADRYHPSAP

SEQ ID NO: 233829 - protein, 22 aa, Mycobacterium bovis
LLCAMVLALAWLSAVAGCSRGG

SEQ ID NO: 233830 - protein, 21 aa, Mycobacterium bovis
LLCGATLLIAACTRVVGGTAS

SEQ ID NO: 233831 - protein, 17 aa, Mycobacterium bovis
LLLVLAFAGGYAVAACK

SEQ ID NO: 233832 - protein, 25 aa, Mycobacterium bovis
LLNKNARFVAVAGIGLLSPGNTGQL

SEQ ID NO: 233833 - protein, 17 aa, Mycobacterium bovis
LLVLCMLASKPIGAATA

SEQ ID NO: 233834 - protein, 25 aa, Mycobacterium bovis
LMCRAYDGLFTRGGKWAINPMFIDP

SEQ ID NO: 233835 - protein, 21 aa, Mycobacterium bovis
LMTGAGYWVAHGALGGITISQ

SEQ ID NO: 233836 - protein, 23 aa, Mycobacterium bovis
LNDNRVDAIVGWRQAGGNLATLL

SEQ ID NO: 233837 - protein, 18 aa, Mycobacterium bovis
LNTGFGSPVDQPVMNSGF

SEQ ID NO: 233838 - protein, 17 aa, Mycobacterium bovis
LPAILGFVPEKSLVLVS

SEQ ID NO: 233839 - protein, 18 aa, Mycobacterium bovis
LPAQLVVRSVGYRGVPTP

SEQ ID NO: 233840 - protein, 20 aa, Mycobacterium bovis
LPAVRASLYSDPQFQAKYPM

SEQ ID NO: 233841 - protein, 20 aa, Mycobacterium bovis
LPEGTRYVLSITWSDVETPG

SEQ ID NO: 233842 - protein, 23 aa, Mycobacterium bovis
LPEVPQIDAGSWLLLSASEADPL

SEQ ID NO: 233843 - protein, 29 aa, Mycobacterium bovis
LPIQILPTIPLNIHQTFSLGPLVVPDIVI

SEQ ID NO: 233844 - protein, 22 aa, Mycobacterium bovis
LPKRVHERFDLVGFDPRGVASS

SEQ ID NO: 233845 - protein, 17 aa, Mycobacterium bovis
LPLLLAAGTVLGQAPRA

SEQ ID NO: 233846 - protein, 19 aa, Mycobacterium bovis
LPLPTPVGMEIMPPQPPLP

SEQ ID NO: 233847 - protein, 18 aa, Mycobacterium bovis
LPLSFSVTNIQPAAAGSA

SEQ ID NO: 233848 - protein, 18 aa, Mycobacterium bovis
LPPPAALTGEWFGALAVI

SEQ ID NO: 233849 - protein, 23 aa, Mycobacterium bovis
LPQQARKGDLIFYGPEGTQSVAL

SEQ ID NO: 233850 - protein, 23 aa, Mycobacterium bovis
LPRGCIAAGDRAFFCDYVQEYLS

SEQ ID NO: 233851 - protein, 17 aa, Mycobacterium bovis
LQAARLVAWSSEGGQGA

SEQ ID NO: 233852 - protein, 24 aa, Mycobacterium bovis
LQARRYEAVRVWRSGLCSASNAYR

SEQ ID NO: 233853 - protein, 26 aa, Mycobacterium bovis
LQCPLKELRRAAPYLVGALKLILTQP

SEQ ID NO: 233854 - protein, 23 aa, Mycobacterium bovis
LQIVTELAPVFKAAGFRPNNSVP

SEQ ID NO: 233855 - protein, 20 aa, Mycobacterium bovis
LRAGELLEWAYATVGSSQAG

SEQ ID NO: 233856 - protein, 19 aa, Mycobacterium bovis
LRAKVEALEHGRIAVAIAG

SEQ ID NO: 233857 - protein, 18 aa, Mycobacterium bovis
LRALAPMAAAAQYVETFD

SEQ ID NO: 233858 - protein, 20 aa, Mycobacterium bovis
LRGVARGQTLVLYRPDPAGD

SEQ ID NO: 233859 - protein, 21 aa, Mycobacterium bovis
LRKRLTGLLGAFRAFSYGSLY

SEQ ID NO: 233860 - protein, 19 aa, Mycobacterium bovis
LRLLWMCRERLLAELGDIS

SEQ ID NO: 233861 - protein, 18 aa, Mycobacterium bovis
LRVGQPVLAIGSPLGLEG

SEQ ID NO: 233862 - protein, 17 aa, Mycobacterium bovis
LRVPPGRGLWVNMALST

SEQ ID NO: 233863 - protein, 22 aa, Mycobacterium bovis
LRWSWLLSVLAAVGLGLATAPA

SEQ ID NO: 233864 - protein, 26 aa, Mycobacterium bovis
LSACGFKPGFPMAEWASKRRAQLDSQ

SEQ ID NO: 233865 - protein, 22 aa, Mycobacterium bovis
LSARPVIEQALLDNGVETRTGV

SEQ ID NO: 233866 - protein, 19 aa, Mycobacterium bovis
LSGADFPAGRQKLNGPQAL

SEQ ID NO: 233867 - protein, 26 aa, Mycobacterium bovis
LSGNGLKIVSCYQYGKGSTADWLGGA

SEQ ID NO: 233868 - protein, 21 aa, Mycobacterium bovis
LSQRDIVLWAAHVVDRVAAGG

SEQ ID NO: 233869 - protein, 24 aa, Mycobacterium bovis
LSRNTTLWASWAFVGPNHRAYFGG

SEQ ID NO: 233870 - protein, 19 aa, Mycobacterium bovis
LSSRIDPRAAGSFWELTTD

SEQ ID NO: 233871 - protein, 17 aa, Mycobacterium bovis
LSVPAGWSTAAPAMTSG

SEQ ID NO: 233872 - protein, 17 aa, Mycobacterium bovis
LSYADGDIWDWAVDWDT

SEQ ID NO: 233873 - protein, 20 aa, Mycobacterium bovis
LTAFAQRSRFAEAFHATGQN

SEQ ID NO: 233874 - protein, 24 aa, Mycobacterium bovis
LTAVGDWMLLAAIEALIDEQDYLA

SEQ ID NO: 233875 - protein, 26 aa, Mycobacterium bovis
LTLVAFWWWQRPRTNAVAADSLVGVL

SEQ ID NO: 233876 - protein, 20 aa, Mycobacterium bovis
LTMLLVFTVITGIVYPLAVT

SEQ ID NO: 233877 - protein, 18 aa, Mycobacterium bovis
LTSVLSHRSAEMALHRAN

SEQ ID NO: 233878 - protein, 22 aa, Mycobacterium bovis
LTTEQWLGPASMSMVVAAQPYL

SEQ ID NO: 233879 - protein, 26 aa, Mycobacterium bovis
LTTLFPPVRPRQWLEIRYLDSVPDEV

SEQ ID NO: 233880 - protein, 25 aa, Mycobacterium bovis
LTVEGLRLAAGISEHERANRVFDER

SEQ ID NO: 233881 - protein, 17 aa, Mycobacterium bovis
LTVGEAVRWSPTVRVPG

SEQ ID NO: 233882 - protein, 19 aa, Mycobacterium bovis
LTYNFTFKFEKAGQGSVMV

SEQ ID NO: 233883 - protein, 17 aa, Mycobacterium bovis
LVAARFIQLTPVYTGGA

SEQ ID NO: 233884 - protein, 20 aa, Mycobacterium bovis
LVAFGRYPTFEGYRQQLGID

SEQ ID NO: 233885 - protein, 24 aa, Mycobacterium bovis
LVALAAKLVHDFDIAPGHVFATGM

SEQ ID NO: 233886 - protein, 27 aa, Mycobacterium bovis
LVATTSGYRAGLLASIAASCTASYTVA

SEQ ID NO: 233887 - protein, 19 aa, Mycobacterium bovis
LVGMCLFLLSDSASWITGQ

SEQ ID NO: 233888 - protein, 21 aa, Mycobacterium bovis
LVGPGCAEYAAANPTGPASVQ

SEQ ID NO: 233889 - protein, 19 aa, Mycobacterium bovis
LVLVLVYKQFRGEFTPKTE

SEQ ID NO: 233890 - protein, 29 aa, Mycobacterium bovis
LVNAFFSSRCNLIAWDRGVFMAVAQEYFG

SEQ ID NO: 233891 - protein, 19 aa, Mycobacterium bovis
LVRAVGVDFFVRMASGELD

SEQ ID NO: 233892 - protein, 18 aa, Mycobacterium bovis
LWPAPYLVMDTGASLAPY

SEQ ID NO: 233893 - protein, 20 aa, Mycobacterium bovis
LYECDGQWVLAAGVQAMVEL

SEQ ID NO: 233894 - protein, 26 aa, Mycobacterium bovis
LYNAVEPWVQYGFNLTAWAVGWLPYI

SEQ ID NO: 233895 - protein, 18 aa, Mycobacterium bovis
LYRARAGVVDVLLAHPGG

SEQ ID NO: 233896 - protein, 25 aa, Mycobacterium bovis
LYSPQRWKYLTSGLLGLQRGSDAGD

SEQ ID NO: 233897 - protein, 30 aa, Mycobacterium bovis
MAAAAPGCGVSWNLLAGIGRIESMHANGGA

SEQ ID NO: 233898 - protein, 19 aa, Mycobacterium bovis
MAATVVIVAWIANRPPASS

SEQ ID NO: 233899 - protein, 21 aa, Mycobacterium bovis
MATGMACRTRFFDQFFLDATH

SEQ ID NO: 233900 - protein, 24 aa, Mycobacterium bovis
MEQFVYAYVRSCPGYTLDYNANGS

SEQ ID NO: 233901 - protein, 21 aa, Mycobacterium bovis
MGGNGGLVFGNGGPGGLGGPG

SEQ ID NO: 233902 - protein, 29 aa, Mycobacterium bovis
MGGQGGAGGNGWAAEGITVGIGEQGGQGG

SEQ ID NO: 233903 - protein, 22 aa, Mycobacterium bovis
MGSMVFPGYGAELLRWLDRAPQ

SEQ ID NO: 233904 - protein, 20 aa, Mycobacterium bovis
MGTPWLTAFAQRSRFAEAFH

SEQ ID NO: 233905 - protein, 28 aa, Mycobacterium bovis
MKTQGPGAWPKCSSCSQGDAPLGSLTHI

SEQ ID NO: 233906 - protein, 27 aa, Mycobacterium bovis
MLLSFERWAPDMGWEIATGKSVLAGEL

SEQ ID NO: 233907 - protein, 19 aa, Mycobacterium bovis
MLRHRGPQLLPAVFSHSQQ

SEQ ID NO: 233908 - protein, 18 aa, Mycobacterium bovis
MLVPVHWGTFRLAPHPWG

SEQ ID NO: 233909 - protein, 19 aa, Mycobacterium bovis
MNNGVPWSVPRMNPTHLNF

SEQ ID NO: 233910 - protein, 27 aa, Mycobacterium bovis
MPEGKYIPRLGGMAFRDPDWADEVYVF

SEQ ID NO: 233911 - protein, 17 aa, Mycobacterium bovis
MQQGCYGPCKGAVVALE

SEQ ID NO: 233912 - protein, 22 aa, Mycobacterium bovis
MRADGGFSYALAPPRAGALKDF

SEQ ID NO: 233913 - protein, 21 aa, Mycobacterium bovis
MRRRSTMYLTYWTAGDTRNRG

SEQ ID NO: 233914 - protein, 18 aa, Mycobacterium bovis
MSGLRVVNDLEFTVRLKA

SEQ ID NO: 233915 - protein, 19 aa, Mycobacterium bovis
MSLHFQIGRRQVVKAEVSS

SEQ ID NO: 233916 - protein, 23 aa, Mycobacterium bovis
MSNPRWTCDYGLAVVPHAVLVLS

SEQ ID NO: 233917 - protein, 19 aa, Mycobacterium bovis
MSRAFASSCNTTFAELSSR

SEQ ID NO: 233918 - protein, 21 aa, Mycobacterium bovis
MSVSNLRWSGDYVLIDVDASP

SEQ ID NO: 233919 - protein, 17 aa, Mycobacterium bovis
MVDRAVGAFGGIDYLVN

SEQ ID NO: 233920 - protein, 26 aa, Mycobacterium bovis
MVVNLLPYQILQPWVDAAFKKRGIDP

SEQ ID NO: 233921 - protein, 19 aa, Mycobacterium bovis
NAGVALSVGSTGGLGGNGG

SEQ ID NO: 233922 - protein, 24 aa, Mycobacterium bovis
NAGWLGFGGAGGIGGIGGNANGGA

SEQ ID NO: 233923 - protein, 21 aa, Mycobacterium bovis
NDPPTIVAILSKLTGDIDPAK

SEQ ID NO: 233924 - protein, 29 aa, Mycobacterium bovis
NDSNGILWRGNFEGLFGLNVGITIPEFPI

SEQ ID NO: 233925 - protein, 19 aa, Mycobacterium bovis
NFAGGQGGAGGRGGAGGNG

SEQ ID NO: 233926 - protein, 32 aa, Mycobacterium bovis
NGGAGGFGGNGFAGVGGRGGMGGSGGTGGTGD

SEQ ID NO: 233927 - protein, 23 aa, Mycobacterium bovis
NGGAGGNGGWLYGSGGNGGAGGA

SEQ ID NO: 233928 - protein, 23 aa, Mycobacterium bovis
NGGMGGNAVGLFGQGGAGGAGGS

SEQ ID NO: 233929 - protein, 26 aa, Mycobacterium bovis
NGIWYTARLRPGPLRPAERRTAVVEY

SEQ ID NO: 233930 - protein, 29 aa, Mycobacterium bovis
NGTQWVREISWQWDCLLPDGTIEYAPAKS

SEQ ID NO: 233931 - protein, 18 aa, Mycobacterium bovis
NKAFACQYAMQFIAVLRG

SEQ ID NO: 233932 - protein, 23 aa, Mycobacterium bovis
NKGLRFEFYANLDTAYADLLSGN

SEQ ID NO: 233933 - protein, 19 aa, Mycobacterium bovis
NLAQYPSILVELGNMKNPA

SEQ ID NO: 233934 - protein, 18 aa, Mycobacterium bovis
NLHFCRLPDQLAEIDTEL

SEQ ID NO: 233935 - protein, 20 aa, Mycobacterium bovis
NLLEEIGILLLPIAPELTPF

SEQ ID NO: 233936 - protein, 39 aa, Mycobacterium bovis
NLPRVNAHGGPGGRPGCWQTITRELWPAPYLVMDTGASL

SEQ ID NO: 233937 - protein, 23 aa, Mycobacterium bovis
NLSEKRAKLALSDVDTDGLAKTV

SEQ ID NO: 233938 - protein, 24 aa, Mycobacterium bovis
NMANALRPNAIVSLHADGGPASGR

SEQ ID NO: 233939 - protein, 18 aa, Mycobacterium bovis
NNFPGASVPFGMVQYSPD

SEQ ID NO: 233940 - protein, 22 aa, Mycobacterium bovis
NNLPAKFLEGFVRTSNIKFQDA

SEQ ID NO: 233941 - protein, 27 aa, Mycobacterium bovis
NNREVRWRPEHFWKPGTAVDVAVNTYG

SEQ ID NO: 233942 - protein, 25 aa, Mycobacterium bovis
NNRMLSQIWSHWSLLSAPSCAAQLD

SEQ ID NO: 233943 - protein, 23 aa, Mycobacterium bovis
NPPEVKSVGLGNVNGVTLGYTSG

SEQ ID NO: 233944 - protein, 17 aa, Mycobacterium bovis
NPVDSWGTGLVVDHNHV

SEQ ID NO: 233945 - protein, 26 aa, Mycobacterium bovis
NPVGGFSFALPAGWVESDAAHLDYGS

SEQ ID NO: 233946 - protein, 22 aa, Mycobacterium bovis
NPVQFICGGSFDTAAGPSAPDY

SEQ ID NO: 233947 - protein, 18 aa, Mycobacterium bovis
NPVTGWRLVEWDGIRNFT

SEQ ID NO: 233948 - protein, 23 aa, Mycobacterium bovis
NQIVPYLRSWESVIGHQRTGVYA

SEQ ID NO: 233949 - protein, 17 aa, Mycobacterium bovis
NQRGNVIPVEITVYEDR

SEQ ID NO: 233950 - protein, 20 aa, Mycobacterium bovis
NRGPTVPILLDTGSSSLVIP

SEQ ID NO: 233951 - protein, 21 aa, Mycobacterium bovis
NRGREMLAFATAYRDAGVKPP

SEQ ID NO: 233952 - protein, 17 aa, Mycobacterium bovis
NRLNVRYDLSWQSLDSA

SEQ ID NO: 233953 - protein, 20 aa, Mycobacterium bovis
NRLYRGRADLVLLYIDPAAL

SEQ ID NO: 233954 - protein, 30 aa, Mycobacterium bovis
NRPTPDRVRELVVAWGKLYPQFGAVAALNL

SEQ ID NO: 233955 - protein, 24 aa, Mycobacterium bovis
NRVLAEQGLDAWPTCGAASGLPIA

SEQ ID NO: 233956 - protein, 20 aa, Mycobacterium bovis
NRYFGGLVHGLWRGGIGTTW

SEQ ID NO: 233957 - protein, 25 aa, Mycobacterium bovis
NSPNGYRTDVDWATQISYSGVFVHS

SEQ ID NO: 233958 - protein, 23 aa, Mycobacterium bovis
NTTFPVGPFFGLGVVNISGIEIK

SEQ ID NO: 233959 - protein, 28 aa, Mycobacterium bovis
NVCWPTPRPPMRIWPRRFDAPPGTCRAS

SEQ ID NO: 233960 - protein, 32 aa, Mycobacterium bovis
NVIQTEFNVALPWRKEVSLSKSSLHPASVTIV

SEQ ID NO: 233961 - protein, 18 aa, Mycobacterium bovis
NVLGWRIDHELKHLDEAE

SEQ ID NO: 233962 - protein, 19 aa, Mycobacterium bovis
NVRYDLSWQSLDSALARRA

SEQ ID NO: 233963 - protein, 25 aa, Mycobacterium bovis
PAANITRLPVRYTFDNRYFSDTYEG

SEQ ID NO: 233964 - protein, 18 aa, Mycobacterium bovis
PAAPIPLASPNIYRGDAS

SEQ ID NO: 233965 - protein, 25 aa, Mycobacterium bovis
PADVQRLPLNVTWVNLTTGKSGSAT

SEQ ID NO: 233966 - protein, 26 aa, Mycobacterium bovis
PAGGMLRRMRPLFSVGLGARLGSGRQ

SEQ ID NO: 233967 - protein, 20 aa, Mycobacterium bovis
PAGGRAWDGLWDPTLPMIPS

SEQ ID NO: 233968 - protein, 20 aa, Mycobacterium bovis
PAIPDRSDVVWLEHEDNHES

SEQ ID NO: 233969 - protein, 17 aa, Mycobacterium bovis
PAMRTLIAFGGKYPTSV

SEQ ID NO: 233970 - protein, 26 aa, Mycobacterium bovis
PAPDGVKLAAGWLVERAGFGKGYPDA

SEQ ID NO: 233971 - protein, 26 aa, Mycobacterium bovis
PAPTHRRWSQYLAWVADHIGLKVIHG

SEQ ID NO: 233972 - protein, 26 aa, Mycobacterium bovis
PARKLREIRMALTLDKTFTKSEILTR

SEQ ID NO: 233973 - protein, 22 aa, Mycobacterium bovis
PDELNWRVGTVEMFTAATTANL

SEQ ID NO: 233974 - protein, 20 aa, Mycobacterium bovis
PDGAAVRYDKLLLATGSAPR

SEQ ID NO: 233975 - protein, 20 aa, Mycobacterium bovis
PDIPIPAIHIDFDGAADAGF

SEQ ID NO: 233976 - protein, 18 aa, Mycobacterium bovis
PDNVARLILDSPIALGVS

SEQ ID NO: 233977 - protein, 24 aa, Mycobacterium bovis
PDQPALRPLLDLLPIAGGSGTLGE

SEQ ID NO: 233978 - protein, 35 aa, Mycobacterium bovis
PDRAAERCGSPAWDLPTVFGPIAITYNIKGVSTLN

SEQ ID NO: 233979 - protein, 21 aa, Mycobacterium bovis
PECSAALLFKGSPLRPDGSSD

SEQ ID NO: 233980 - protein, 21 aa, Mycobacterium bovis
PEFSARVFKAEKGVVTLGGNT

SEQ ID NO: 233981 - protein, 17 aa, Mycobacterium bovis
PELIPLLQSGRLDVDGI

SEQ ID NO: 233982 - protein, 17 aa, Mycobacterium bovis
PELPVAAAAAVPTASAT

SEQ ID NO: 233983 - protein, 29 aa, Mycobacterium bovis
PENFWRSAGLPEFRWPDPNGTRFPNGAPP

SEQ ID NO: 233984 - protein, 23 aa, Mycobacterium bovis
PEPWRVEALVLLAFSAYARGDGP

SEQ ID NO: 233985 - protein, 23 aa, Mycobacterium bovis
PERYYDMLRKFGLGQRTGVGLPG

SEQ ID NO: 233986 - protein, 33 aa, Mycobacterium bovis
PESVTCPSDLPAEVGAELNCEMKIKDRTFNVNV

SEQ ID NO: 233987 - protein, 31 aa, Mycobacterium bovis
PETVAAAALDVARIGSSIGVANSAAAGSTTS

SEQ ID NO: 233988 - protein, 32 aa, Mycobacterium bovis
PETVAAAALDVARIGSSIGVANSAAAGSTTSV

SEQ ID NO: 233989 - protein, 21 aa, Mycobacterium bovis
PEVNSALMFAGAGSGPTLAAA

SEQ ID NO: 233990 - protein, 20 aa, Mycobacterium bovis
PEVVFHLAAQIDVRRSVADP

SEQ ID NO: 233991 - protein, 19 aa, Mycobacterium bovis
PFYVWDFAEKFKEDVINDF

SEQ ID NO: 233992 - protein, 19 aa, Mycobacterium bovis
PGDRAEVLASLNKLGYTPG

SEQ ID NO: 233993 - protein, 32 aa, Mycobacterium bovis
PGECVNIGNALWARLQPCVNWISQHWTVQPDG

SEQ ID NO: 233994 - protein, 19 aa, Mycobacterium bovis
PGEYAELPYLFTDQYDLGM

SEQ ID NO: 233995 - protein, 23 aa, Mycobacterium bovis
PGGAGGLISLLGGQGAGGDGGDG

SEQ ID NO: 233996 - protein, 23 aa, Mycobacterium bovis
PGGAGGTGGRGFLNDGGVGGAGG

SEQ ID NO: 233997 - protein, 29 aa, Mycobacterium bovis
PGGSHSWFAGYRGDLAFASLIVGGGSSEY

SEQ ID NO: 233998 - protein, 23 aa, Mycobacterium bovis
PGHTRGSVVFRVLQATNNDKDIV

SEQ ID NO: 233999 - protein, 23 aa, Mycobacterium bovis
PGKRPRSSMAPTLVFDHSSAGRG

SEQ ID NO: 234000 - protein, 23 aa, Mycobacterium bovis
PGNPRVLSIAQFWDRAAGHDRIN

SEQ ID NO: 234001 - protein, 24 aa, Mycobacterium bovis
PGSPCSYTPPADGLPRPWDPLPCA

SEQ ID NO: 234002 - protein, 30 aa, Mycobacterium bovis
PGVASAARNSAGFGAPRYGVKPIVMPKPAT

SEQ ID NO: 234003 - protein, 19 aa, Mycobacterium bovis
PHFSFSWYRGSPIGRERKT

SEQ ID NO: 234004 - protein, 18 aa, Mycobacterium bovis
PITIFPGGFTIDPLPLSL

SEQ ID NO: 234005 - protein, 19 aa, Mycobacterium bovis
PIVQAVLFNAIDFVDGTVT

SEQ ID NO: 234006 - protein, 26 aa, Mycobacterium bovis
PIYGLGPRIAQLVAGAFFREPKQVVE

SEQ ID NO: 234007 - protein, 21 aa, Mycobacterium bovis
PKFRTGGYMIDFWGVGYQVAK

SEQ ID NO: 234008 - protein, 21 aa, Mycobacterium bovis
PKLAKRLGLDRQWLHARSLAF

SEQ ID NO: 234009 - protein, 21 aa, Mycobacterium bovis
PKPQNYPGLPTVSFVIPNADN

SEQ ID NO: 234010 - protein, 22 aa, Mycobacterium bovis
PLATLEHNVLNALNAPTQALLG

SEQ ID NO: 234011 - protein, 23 aa, Mycobacterium bovis
PLATLEHNVLNALNAPTQALLGR

SEQ ID NO: 234012 - protein, 24 aa, Mycobacterium bovis
PLHLPGFPVQFFVYKQIAANNAAR

SEQ ID NO: 234013 - protein, 19 aa, Mycobacterium bovis
PLHTLKQQALAAINAPTQT

SEQ ID NO: 234014 - protein, 24 aa, Mycobacterium bovis
PLHVRLGQRPTLMFDNTTMMYHPI

SEQ ID NO: 234015 - protein, 22 aa, Mycobacterium bovis
PLSSALLSFGLLLGGLPLAAPP

SEQ ID NO: 234016 - protein, 29 aa, Mycobacterium bovis
PLTDLSTRCSLPISGLQAIGLMQAVQGAR

SEQ ID NO: 234017 - protein, 18 aa, Mycobacterium bovis
PNGSCDFVAGANLRTPDG

SEQ ID NO: 234018 - protein, 17 aa, Mycobacterium bovis
PNPEVYAPVTGFYSLRY

SEQ ID NO: 234019 - protein, 19 aa, Mycobacterium bovis
PPGQDTWYHGAARIGDLVE

SEQ ID NO: 234020 - protein, 21 aa, Mycobacterium bovis
PPHAWYIAFAPAQAPKVAVAV

SEQ ID NO: 234021 - protein, 24 aa, Mycobacterium bovis
PPLAAPKNDLSWHDCTSRVYSNAG

SEQ ID NO: 234022 - protein, 17 aa, Mycobacterium bovis
PPPFRPPTFNPVDGAMV

SEQ ID NO: 234023 - protein, 20 aa, Mycobacterium bovis
PPTAPRRPSDPGALVKAPSN

SEQ ID NO: 234024 - protein, 18 aa, Mycobacterium bovis
PQAGRPRGWPEWAEPDVV

SEQ ID NO: 234025 - protein, 30 aa, Mycobacterium bovis
PQFGAVAALNLVKCVHWPSSSPPQPPKDLK

SEQ ID NO: 234026 - protein, 22 aa, Mycobacterium bovis
PREPYVHWIVIGIAPGAGSTAD

SEQ ID NO: 234027 - protein, 19 aa, Mycobacterium bovis
PRGDLAAAIYTTIEDQVET

SEQ ID NO: 234028 - protein, 17 aa, Mycobacterium bovis
PRLEGHGAPGVTVCHGL

SEQ ID NO: 234029 - protein, 19 aa, Mycobacterium bovis
PRLGHNLALHPATMLAGLF

SEQ ID NO: 234030 - protein, 17 aa, Mycobacterium bovis
PRRVLLLCDVSRSMQPY

SEQ ID NO: 234031 - protein, 33 aa, Mycobacterium bovis
PRSTPPPPRRPTQIIMGIDWIGPGFNPHLLSDL

SEQ ID NO: 234032 - protein, 23 aa, Mycobacterium bovis
PRTLSTSADNVWAIGDATVLTLP

SEQ ID NO: 234033 - protein, 24 aa, Mycobacterium bovis
PRTMPAALHWDRILFCAKEATYKA

SEQ ID NO: 234034 - protein, 17 aa, Mycobacterium bovis
PRYVTAIDADTATVHVG

SEQ ID NO: 234035 - protein, 24 aa, Mycobacterium bovis
PSGVAGSWHIRWAALTPARQAAVI

SEQ ID NO: 234036 - protein, 23 aa, Mycobacterium bovis
PSHDWPDRVLRVTAIDIATGELV

SEQ ID NO: 234037 - protein, 18 aa, Mycobacterium bovis
PTACSFSIGTSHSHSVSK

SEQ ID NO: 234038 - protein, 26 aa, Mycobacterium bovis
PTDSFAVLALLCRRLSHDEVKAVANE

SEQ ID NO: 234039 - protein, 20 aa, Mycobacterium bovis
PTFEGYRQQLGIDFAGVVTA

SEQ ID NO: 234040 - protein, 27 aa, Mycobacterium bovis
PTITARLNFQLAFGARVGQRLADAREQ

SEQ ID NO: 234041 - protein, 21 aa, Mycobacterium bovis
PTLAAAAAWDGLAAELGQAAN

SEQ ID NO: 234042 - protein, 23 aa, Mycobacterium bovis
PTPDSPTGWVYIVADSFTRGEPA

SEQ ID NO: 234043 - protein, 20 aa, Mycobacterium bovis
PTQPRSITLTFIRNAQSQAN

SEQ ID NO: 234044 - protein, 25 aa, Mycobacterium bovis
PTQTLFGRPLIGDGANGTAENPDGQ

SEQ ID NO: 234045 - protein, 24 aa, Mycobacterium bovis
PTTEEVFSALGVVVNKGNVGALEE

SEQ ID NO: 234046 - protein, 28 aa, Mycobacterium bovis
PTVGCGVSLALACDLVLASDNAFFMLAH

SEQ ID NO: 234047 - protein, 24 aa, Mycobacterium bovis
PVADPALVPLFFVAREARKHVKVV

SEQ ID NO: 234048 - protein, 17 aa, Mycobacterium bovis
PVGFDRPQFFGQYRDSR

SEQ ID NO: 234049 - protein, 23 aa, Mycobacterium bovis
PVHAECAGLLYLVSELDGHPMCG

SEQ ID NO: 234050 - protein, 26 aa, Mycobacterium bovis
PVPRSCAEPAGIPALLSPRDKLAQLL

SEQ ID NO: 234051 - protein, 25 aa, Mycobacterium bovis
PVVPLWDYISVVGWSSQVSNVTVTW

SEQ ID NO: 234052 - protein, 19 aa, Mycobacterium bovis
PYAVWLDDWYARESNNNSV

SEQ ID NO: 234053 - protein, 23 aa, Mycobacterium bovis
PYQHVEKFIPRQITNVLTGRRPK

SEQ ID NO: 234054 - protein, 21 aa, Mycobacterium bovis
QAALKDGYRVFGELAPHPLLT

SEQ ID NO: 234055 - protein, 23 aa, Mycobacterium bovis
QACAAGARIISWARVERILHRAG

SEQ ID NO: 234056 - protein, 22 aa, Mycobacterium bovis
QADAISPWSGRYAIAYNADAGH

SEQ ID NO: 234057 - protein, 22 aa, Mycobacterium bovis
QADCFAGVYLWWVAEGKSTRFT

SEQ ID NO: 234058 - protein, 26 aa, Mycobacterium bovis
QAFPCIPNGGSVFGCQPCSAPDRSLG

SEQ ID NO: 234059 - protein, 21 aa, Mycobacterium bovis
QALLGRPIIGNGANGLPNTGQ

SEQ ID NO: 234060 - protein, 21 aa, Mycobacterium bovis
QALLGRPLIGDGAAGAPGTGQ

SEQ ID NO: 234061 - protein, 25 aa, Mycobacterium bovis
QAYQFPMGLGLVSQFFGKYFTPEQA

SEQ ID NO: 234062 - protein, 23 aa, Mycobacterium bovis
QDGMRLGGWYFPHTSGGSGPAVL

SEQ ID NO: 234063 - protein, 26 aa, Mycobacterium bovis
QDNEGHSMFPWLTLALVGNSTSSILF

SEQ ID NO: 234064 - protein, 23 aa, Mycobacterium bovis
QFISETWRLYGVAARNDGIANVD

SEQ ID NO: 234065 - protein, 17 aa, Mycobacterium bovis
QFQETYKRNTLYFADPT

SEQ ID NO: 234066 - protein, 25 aa, Mycobacterium bovis
QFVQALNMGAVCYAAAETANATPLQ

SEQ ID NO: 234067 - protein, 19 aa, Mycobacterium bovis
QGPAGWLRAKTGSLTAINS

SEQ ID NO: 234068 - protein, 19 aa, Mycobacterium bovis
QGVAIMIWTLMNARNSRDS

SEQ ID NO: 234069 - protein, 23 aa, Mycobacterium bovis
QHGHCRSAAMARRSPNASTKARR

SEQ ID NO: 234070 - protein, 18 aa, Mycobacterium bovis
QHLAGAYVSSGMVNQAAD

SEQ ID NO: 234071 - protein, 20 aa, Mycobacterium bovis
QKKARVSFIPDRSVVDHSQL

SEQ ID NO: 234072 - protein, 17 aa, Mycobacterium bovis
QKMRAVLVADNPGVWVM

SEQ ID NO: 234073 - protein, 31 aa, Mycobacterium bovis
QLATFCAGGKCPDVLMAWELTYAELADRGVL

SEQ ID NO: 234074 - protein, 26 aa, Mycobacterium bovis
QLLSTDFRAGCPIAAVSVEAGDEQDR

SEQ ID NO: 234075 - protein, 20 aa, Mycobacterium bovis
QLLWYRPDLVNSPPTDWNAM

SEQ ID NO: 234076 - protein, 37 aa, Mycobacterium bovis
QLPYLPLQVPQQLSLPADLPALASGVIPAAPIAPTPP

SEQ ID NO: 234077 - protein, 23 aa, Mycobacterium bovis
QPACGKAGCQTYKWETFLTSELP

SEQ ID NO: 234078 - protein, 25 aa, Mycobacterium bovis
QPDPGKWAGFELHRDVTVTEEFTLG

SEQ ID NO: 234079 - protein, 22 aa, Mycobacterium bovis
QPFPLPALTCLLRSITLRMTMA

SEQ ID NO: 234080 - protein, 21 aa, Mycobacterium bovis
QQDPPVWWTHIHGMGDAARLA

SEQ ID NO: 234081 - protein, 18 aa, Mycobacterium bovis
QQEMAAAVAHAFETGEHL

SEQ ID NO: 234082 - protein, 18 aa, Mycobacterium bovis
QQLGIDFAGVVTAVGPDV

SEQ ID NO: 234083 - protein, 21 aa, Mycobacterium bovis
QRAPQLGFGRYLVSATTPFTR

SEQ ID NO: 234084 - protein, 21 aa, Mycobacterium bovis
QRARLAPIRLRIGVHTGEVAL

SEQ ID NO: 234085 - protein, 19 aa, Mycobacterium bovis
QRDGKFAFDNPGAIEAFRY

SEQ ID NO: 234086 - protein, 27 aa, Mycobacterium bovis
QRDGLTLGEALALWLSGQEQLMPRDLV

SEQ ID NO: 234087 - protein, 31 aa, Mycobacterium bovis
QRPHGFKALDITLPMPPRWTQVPDPNVPDAF

SEQ ID NO: 234088 - protein, 20 aa, Mycobacterium bovis
QRPPAALVLRSPFTSLAEVG

SEQ ID NO: 234089 - protein, 24 aa, Mycobacterium bovis
QRTRLTEVLSRIYGHPVTVQLHID

SEQ ID NO: 234090 - protein, 17 aa, Mycobacterium bovis
QRVAVAVAVTYAPEAFD

SEQ ID NO: 234091 - protein, 18 aa, Mycobacterium bovis
QSAVRFASAGIEPFGCLK

SEQ ID NO: 234092 - protein, 17 aa, Mycobacterium bovis
QSDETFVYLARAVDPAV

SEQ ID NO: 234093 - protein, 20 aa, Mycobacterium bovis
QSTDQRLLDLINGPTQALLG

SEQ ID NO: 234094 - protein, 19 aa, Mycobacterium bovis
QTLQAFLHWAITDGNKASF

SEQ ID NO: 234095 - protein, 30 aa, Mycobacterium bovis
QVLQRLKYLPLAPFRISYAYTNFGVTAAAE

SEQ ID NO: 234096 - protein, 17 aa, Mycobacterium bovis
QVTAFHVQFAQTLTNAG

SEQ ID NO: 234097 - protein, 19 aa, Mycobacterium bovis
QYVVRFGLGYREEVHPDLQ

SEQ ID NO: 234098 - protein, 19 aa, Mycobacterium bovis
RAAYQVGGRTWLRAGAGII

SEQ ID NO: 234099 - protein, 20 aa, Mycobacterium bovis
RAGAAFLVLGIAAATFPQSA

SEQ ID NO: 234100 - protein, 22 aa, Mycobacterium bovis
RAGALKDFRVAVWAEDPHCPID

SEQ ID NO: 234101 - protein, 19 aa, Mycobacterium bovis
RAGGLMSALTPQFGSKTIN

SEQ ID NO: 234102 - protein, 30 aa, Mycobacterium bovis
RAGLLLPLGWDPRLPVMGQKYISQGTISKG

SEQ ID NO: 234103 - protein, 17 aa, Mycobacterium bovis
RALDPAIYREAALRLDH

SEQ ID NO: 234104 - protein, 17 aa, Mycobacterium bovis
RALELDLHYLPRLEGHG

SEQ ID NO: 234105 - protein, 23 aa, Mycobacterium bovis
RALTACGLIAVAVARADAAASYF

SEQ ID NO: 234106 - protein, 19 aa, Mycobacterium bovis
RALWIAALSFGLGGVAVAA

SEQ ID NO: 234107 - protein, 22 aa, Mycobacterium bovis
RANDIAVVWSPTGVPYVVAVMS

SEQ ID NO: 234108 - protein, 31 aa, Mycobacterium bovis
RARLLAEAAPVLWDEMPTLPLYRQQRTLLMS

SEQ ID NO: 234109 - protein, 27 aa, Mycobacterium bovis
RCNQQIKFAALSARAVALGFDTVATGH

SEQ ID NO: 234110 - protein, 22 aa, Mycobacterium bovis
RDAYLQSWVHRTARFQDALQDP

SEQ ID NO: 234111 - protein, 19 aa, Mycobacterium bovis
RDDRLRWWAGPWPDDERWW

SEQ ID NO: 234112 - protein, 20 aa, Mycobacterium bovis
RDGAAPKWWFTVGGQVRPGE

SEQ ID NO: 234113 - protein, 17 aa, Mycobacterium bovis
RDGRPAAKLVLDVNPRY

SEQ ID NO: 234114 - protein, 19 aa, Mycobacterium bovis
RDRFALLTGGARTAAHRQQ

SEQ ID NO: 234115 - protein, 18 aa, Mycobacterium bovis
RDRLRSGNLQELIDTKSV

SEQ ID NO: 234116 - protein, 24 aa, Mycobacterium bovis
REAARAATLRAVRSLTGVPIDYFA

SEQ ID NO: 234117 - protein, 24 aa, Mycobacterium bovis
REFHLCVVDAPTLHNAAEALHRQF

SEQ ID NO: 234118 - protein, 19 aa, Mycobacterium bovis
REHYAELEIKAFAVEHAGS

SEQ ID NO: 234119 - protein, 17 aa, Mycobacterium bovis
REIAPFMSYGKFTGDAP

SEQ ID NO: 234120 - protein, 24 aa, Mycobacterium bovis
RELFCARDPFGIKPLFIATGAGGT

SEQ ID NO: 234121 - protein, 20 aa, Mycobacterium bovis
RELFCSGLRTPKAVLSAERQ

SEQ ID NO: 234122 - protein, 19 aa, Mycobacterium bovis
RELLVAMAMLVSVTGCARH

SEQ ID NO: 234123 - protein, 19 aa, Mycobacterium bovis
REPLRVEGEVSYRVPSLSL

SEQ ID NO: 234124 - protein, 27 aa, Mycobacterium bovis
RFRYPRNGWPALFHVRSGASLAGNYAA

SEQ ID NO: 234125 - protein, 20 aa, Mycobacterium bovis
RFSGWQSTRQRVWGQMDSAR

SEQ ID NO: 234126 - protein, 24 aa, Mycobacterium bovis
RFVIVDECHYYRGVFGSNVAMVLR

SEQ ID NO: 234127 - protein, 17 aa, Mycobacterium bovis
RGAALMANQELRLSRTY

SEQ ID NO: 234128 - protein, 19 aa, Mycobacterium bovis
RGAAVLAARIMSRLATQPN

SEQ ID NO: 234129 - protein, 18 aa, Mycobacterium bovis
RGAQALPPGGVLPVGQST

SEQ ID NO: 234130 - protein, 18 aa, Mycobacterium bovis
RGHTRNCRLHWVQIIPTI

SEQ ID NO: 234131 - protein, 31 aa, Mycobacterium bovis
RGREGGYELARPGTEISIADVLRCIDGPLAS

SEQ ID NO: 234132 - protein, 20 aa, Mycobacterium bovis
RGRVGMMGAVVTVLVVGVAQ

SEQ ID NO: 234133 - protein, 19 aa, Mycobacterium bovis
RGSDGVVIPGSYRNRHKAV

SEQ ID NO: 234134 - protein, 23 aa, Mycobacterium bovis
RGTRLPVWLTQWGYRRPAEDTVD

SEQ ID NO: 234135 - protein, 23 aa, Mycobacterium bovis
RGVASSRPAIWCNSDADNDRLRA

SEQ ID NO: 234136 - protein, 30 aa, Mycobacterium bovis; identical to SEQ ID NO: 143350

SEQ ID NO: 234137 - protein, 18 aa, Mycobacterium bovis
RGVRRLESGCFARIRADQ

SEQ ID NO: 234138 - protein, 25 aa, Mycobacterium bovis
RHDLPRGDLDRVVRQQAVMAALAHR

SEQ ID NO: 234139 - protein, 19 aa, Mycobacterium bovis
RHQLVSLVLSNLFGQNAPA

SEQ ID NO: 234140 - protein, 18 aa, Mycobacterium bovis
RHRARPRPGSHAGVGCLR

SEQ ID NO: 234141 - protein, 20 aa, Mycobacterium bovis
RINQSFPVTVNWSTPAVTIF

SEQ ID NO: 234142 - protein, 18 aa, Mycobacterium bovis
RIRLIERLVSGKVGAPTL

SEQ ID NO: 234143 - protein, 18 aa, Mycobacterium bovis
RKAARLTIDGVTHTTRPA

SEQ ID NO: 234144 - protein, 19 aa, Mycobacterium bovis
RKRGRRISVADVELTQGGR

SEQ ID NO: 234145 - protein, 25 aa, Mycobacterium bovis
RLAARVLVALAALFAMIALTGSACL

SEQ ID NO: 234146 - protein, 20 aa, Mycobacterium bovis
RLAGMTTWVASIALLAAALS

SEQ ID NO: 234147 - protein, 17 aa, Mycobacterium bovis
RLAIRTDTILGRKVLEI

SEQ ID NO: 234148 - protein, 18 aa, Mycobacterium bovis
RLAVVAGTAAAVTTPGLL

SEQ ID NO: 234149 - protein, 19 aa, Mycobacterium bovis
RLDNLMAVARKDVVLSAGW

SEQ ID NO: 234150 - protein, 31 aa, Mycobacterium bovis
RLEVADPVAAFKWRAQLPIEDSGRVEQQLAK

SEQ ID NO: 234151 - protein, 19 aa, Mycobacterium bovis
RLHELRLAPSNAVDLFKQY

SEQ ID NO: 234152 - protein, 25 aa, Mycobacterium bovis
RLLFKRNICHQAIFYRRGLFGTIGP

SEQ ID NO: 234153 - protein, 24 aa, Mycobacterium bovis
RLLLQAAKSLGWRAAPIPRNAPGC

SEQ ID NO: 234154 - protein, 28 aa, Mycobacterium bovis
RLQNFSGRARMSSMLWTFQVNQADGVAC

SEQ ID NO: 234155 - protein, 21 aa, Mycobacterium bovis
RLVAACIDAGVSVTCLPGPSA

SEQ ID NO: 234156 - protein, 19 aa, Mycobacterium bovis
RLYPVRLTTTMTRFISAAV

SEQ ID NO: 234157 - protein, 20 aa, Mycobacterium bovis
RMGALALHVAKIARRRHPQH

SEQ ID NO: 234158 - protein, 24 aa, Mycobacterium bovis
RNAPGCRGCCQCAIGCPSNAKFGV

SEQ ID NO: 234159 - protein, 18 aa, Mycobacterium bovis
RNQFLAGKMALFQSGTYS

SEQ ID NO: 234160 - protein, 26 aa, Mycobacterium bovis
RNVTHGCINLSPANAKWFYDNFGSGD

SEQ ID NO: 234161 - protein, 18 aa, Mycobacterium bovis
RPDLLMAATEDLLHQPQR

SEQ ID NO: 234162 - protein, 24 aa, Mycobacterium bovis
RPEHHEFKQAAVLTDLPGELMSAL

SEQ ID NO: 234163 - protein, 26 aa, Mycobacterium bovis
RPELGLRPRLAIGIHQPGVGALRPPV

SEQ ID NO: 234164 - protein, 19 aa, Mycobacterium bovis
RPGSHAGVGCLRAGRHCGR

SEQ ID NO: 234165 - protein, 19 aa, Mycobacterium bovis
RPIEYTWNGTQWVREISWQ

SEQ ID NO: 234166 - protein, 19 aa, Mycobacterium bovis
RPPVIQLWARPRGVAPDAL

SEQ ID NO: 234167 - protein, 19 aa, Mycobacterium bovis
RPRRRPRRVLLLCDVSRSM

SEQ ID NO: 234168 - protein, 18 aa, Mycobacterium bovis
RQAGHTVAPFKVGPDFID

SEQ ID NO: 234169 - protein, 22 aa, Mycobacterium bovis
RQQTLWASVDWSYTLLTEPERT

SEQ ID NO: 234170 - protein, 18 aa, Mycobacterium bovis
RREVPFDVHLMIFGDSTA

SEQ ID NO: 234171 - protein, 24 aa, Mycobacterium bovis
RRGMSQIGVPYSWGGGNAAGPSKG

SEQ ID NO: 234172 - protein, 17 aa, Mycobacterium bovis
RRIAVLAAVSIAATVVA

SEQ ID NO: 234173 - protein, 20 aa, Mycobacterium bovis
RRIGETFFTTAYFDPNMAHM

SEQ ID NO: 234174 - protein, 20 aa, Mycobacterium bovis
RRITSPEALLLVYTPQVISR

SEQ ID NO: 234175 - protein, 23 aa, Mycobacterium bovis
RRKDQAWEFVKFATGPVGQALIG

SEQ ID NO: 234176 - protein, 20 aa, Mycobacterium bovis
RRKNEPPGIAQITLGKNKDR

SEQ ID NO: 234177 - protein, 24 aa, Mycobacterium bovis
RRLDLKRGEPVLITAHTNLEFLSC

SEQ ID NO: 234178 - protein, 20 aa, Mycobacterium bovis
RRLFGRRLADFFTGRDPRGG

SEQ ID NO: 234179 - protein, 20 aa, Mycobacterium bovis
RRPSWEEITEVLEWLSPLPG

SEQ ID NO: 234180 - protein, 22 aa, Mycobacterium bovis
RRRGDLPTTLRVDASGNPETGE

SEQ ID NO: 234181 - protein, 19 aa, Mycobacterium bovis
RRRLLAVLIALALPGAAVA

SEQ ID NO: 234182 - protein, 19 aa, Mycobacterium bovis
RRSDAPRLVDLVRRAQASV

SEQ ID NO: 234183 - protein, 23 aa, Mycobacterium bovis
RSDPSRPVACIVRVRATNGSETG

SEQ ID NO: 234184 - protein, 18 aa, Mycobacterium bovis
RSLLGGRLTGVVVVTGPP

SEQ ID NO: 234185 - protein, 17 aa, Mycobacterium bovis
RTALSYVSVDGARANLD

SEQ ID NO: 234186 - protein, 19 aa, Mycobacterium bovis
RTDTILGRKVLEIEPRGAQ

SEQ ID NO: 234187 - protein, 24 aa, Mycobacterium bovis
RTEGPSNPLILVFGRVSELSTCSW

SEQ ID NO: 234188 - protein, 23 aa, Mycobacterium bovis
RTLDVMALDVVWTAEFAEAGWAL

SEQ ID NO: 234189 - protein, 23 aa, Mycobacterium bovis
RTLQAGADIALWVTTKEVPAVLD

SEQ ID NO: 234190 - protein, 19 aa, Mycobacterium bovis
RTPAALYWGARLTLVSRVD

SEQ ID NO: 234191 - protein, 18 aa, Mycobacterium bovis
RTTCGRRDLADYVPTQDA

SEQ ID NO: 234192 - protein, 20 aa, Mycobacterium bovis
RTVAELRALAPMAAAAQYVE

SEQ ID NO: 234193 - protein, 23 aa, Mycobacterium bovis
RTVSGQLTLLVPFIDRVRARVDL

SEQ ID NO: 234194 - protein, 25 aa, Mycobacterium bovis
RVAPADMIGPIWRRDEVFEFNGSLI

SEQ ID NO: 234195 - protein, 17 aa, Mycobacterium bovis
RVAVWAEDPHCPIDADV

SEQ ID NO: 234196 - protein, 19 aa, Mycobacterium bovis
RVCVARGTTSLRRIREIAP

SEQ ID NO: 234197 - protein, 24 aa, Mycobacterium bovis
RVCVTVGALVALACMVLAGCTVSP

SEQ ID NO: 234198 - protein, 23 aa, Mycobacterium bovis
RVFAGGMATGFIGVVLVTAGKAS

SEQ ID NO: 234199 - protein, 19 aa, Mycobacterium bovis
RVLGWRPQIELADGVRRTV

SEQ ID NO: 234200 - protein, 23 aa, Mycobacterium bovis
RVMRHRAWQGLVLLVLALLLSSC

SEQ ID NO: 234201 - protein, 33 aa, Mycobacterium bovis
RVPLAAAVWTQRGWRFPDRLDRVYVNSRARRDL

SEQ ID NO: 234202 - protein, 19 aa, Mycobacterium bovis
RVQRPLWASTGVKNPDYSD

SEQ ID NO: 234203 - protein, 25 aa, Mycobacterium bovis
RVRAKRPDGDWGPWYQTEYETEPRD

SEQ ID NO: 234204 - protein, 18 aa, Mycobacterium bovis
RWTIAILAVVAALMAALV

SEQ ID NO: 234205 - protein, 35 aa, Mycobacterium bovis
RYHKVILSRCVEVPFAIDFPLTYRLGRRHNTPVRS

SEQ ID NO: 234206 - protein, 17 aa, Mycobacterium bovis
RYKVPRMPFSMSVAQAA

SEQ ID NO: 234207 - protein, 18 aa, Mycobacterium bovis
SAARRAGDRAGRQARLGN

SEQ ID NO: 234208 - protein, 24 aa, Mycobacterium bovis
SAAVGVEGKVIWSGVRGIADLASG

SEQ ID NO: 234209 - protein, 18 aa, Mycobacterium bovis
SAEPCPDVEVVFARGTGE

SEQ ID NO: 234210 - protein, 19 aa, Mycobacterium bovis
SAEYLRLLRRHNVAAALSG

SEQ ID NO: 234211 - protein, 17 aa, Mycobacterium bovis
SAFPKPQNYPGLPTVSF

SEQ ID NO: 234212 - protein, 18 aa, Mycobacterium bovis
SAHAGQYQQLGARAALFH

SEQ ID NO: 234213 - protein, 39 aa, Mycobacterium bovis
SAPDYYRRAEICRERLGPVLRRLTVNYPPIMFHPLNTIT

SEQ ID NO: 234214 - protein, 23 aa, Mycobacterium bovis
SAPGSRLAFEFVPDTAIFADERW

SEQ ID NO: 234215 - protein, 24 aa, Mycobacterium bovis
SAQASAFHAQFVQALTGGGGAYAA

SEQ ID NO: 234216 - protein, 22 aa, Mycobacterium bovis
SAQATIFHDQFVQALTSGGNLY

SEQ ID NO: 234217 - protein, 23 aa, Mycobacterium bovis
SAQMSAFHAQFMQALTGAGGAYA

SEQ ID NO: 234218 - protein, 24 aa, Mycobacterium bovis
SAQRLADCVRRLRTRGAVVVVGTC

SEQ ID NO: 234219 - protein, 24 aa, Mycobacterium bovis
SARDLRFGYRTSVLKHADGLAVPT

SEQ ID NO: 234220 - protein, 23 aa, Mycobacterium bovis
SASPEPIVKVWAGEVGLDDQHVV

SEQ ID NO: 234221 - protein, 25 aa, Mycobacterium bovis
SASRRALTSLVDWFGTMAQDLDHQG

SEQ ID NO: 234222 - protein, 19 aa, Mycobacterium bovis
SCAEGGVLGIICASVASVM

SEQ ID NO: 234223 - protein, 19 aa, Mycobacterium bovis
SCNTAFVQLGIRTGADALR

SEQ ID NO: 234224 - protein, 22 aa, Mycobacterium bovis
SDEVLYRPLGMGSTSSRFTDFL

SEQ ID NO: 234225 - protein, 23 aa, Mycobacterium bovis
SDGRRFACDYALLAVPYLTLREL

SEQ ID NO: 234226 - protein, 28 aa, Mycobacterium bovis
SDIERLRKLWDVPALAFVGIGNGTQVAL

SEQ ID NO: 234227 - protein, 31 aa, Mycobacterium bovis
SDPFVAILRFPFIPQAMREHYAELEIKAFAV

SEQ ID NO: 234228 - protein, 21 aa, Mycobacterium bovis
SDPGNPACRVFEGELNEHWTI

SEQ ID NO: 234229 - protein, 20 aa, Mycobacterium bovis
SDPTDWAALTFDERRDALAR

SEQ ID NO: 234230 - protein, 24 aa, Mycobacterium bovis
SDRRPGGAWMLGKPIQLSEARDLS

SEQ ID NO: 234231 - protein, 22 aa, Mycobacterium bovis
SDVPVELAALIGRDDDRRTETI

SEQ ID NO: 234232 - protein, 21 aa, Mycobacterium bovis
SEDAKFVYVDGHLYSDLGQPG

SEQ ID NO: 234233 - protein, 22 aa, Mycobacterium bovis
SEIRTARCATVSVPVDYDQPGG

SEQ ID NO: 234234 - protein, 20 aa, Mycobacterium bovis
SELPGWLQANRHVKPTGSAV

SEQ ID NO: 234235 - protein, 20 aa, Mycobacterium bovis
SEWNAALSRIAVAGRGPGDV

SEQ ID NO: 234236 - protein, 25 aa, Mycobacterium bovis
SFAGQGVGFGGWYAPVALHVDTESI

SEQ ID NO: 234237 - protein, 21 aa, Mycobacterium bovis
SFAIGLAMMLAPMVAAPGLAA

SEQ ID NO: 234238 - protein, 21 aa, Mycobacterium bovis
SFGSYHLVDGFILNNQLSDFS

SEQ ID NO: 234239 - protein, 20 aa, Mycobacterium bovis
SGALLKRGYTAGQVRDRESG

SEQ ID NO: 234240 - protein, 24 aa, Mycobacterium bovis
SGATGAPGGWLLGDGGAGGSGAAG

SEQ ID NO: 234241 - protein, 21 aa, Mycobacterium bovis
SGATPSFLGYHGYPASICASI

SEQ ID NO: 234242 - protein, 21 aa, Mycobacterium bovis
SGAYPRWALANSATGMMSGDS

SEQ ID NO: 234243 - protein, 22 aa, Mycobacterium bovis
SGDHPGIDWAKYALKAPVMMVR

SEQ ID NO: 234244 - protein, 21 aa, Mycobacterium bovis
SGEGCVVLLLKRLPDAVRDGD

SEQ ID NO: 234245 - protein, 24 aa, Mycobacterium bovis
SGERLAAATVVWCAGMRASRLTEQ

SEQ ID NO: 234246 - protein, 19 aa, Mycobacterium bovis
SGFAGLWAALGAARRLDEL

SEQ ID NO: 234247 - protein, 27 aa, Mycobacterium bovis
SGGAGGAGGFGFLGGDGGAGGNAGLLL

SEQ ID NO: 234248 - protein, 25 aa, Mycobacterium bovis
SGGAGGASGWLMGNGGNGGNGGTGG

SEQ ID NO: 234249 - protein, 27 aa, Mycobacterium bovis
SGGAKGCPKETWCVVNAGNYRGSMNVT

SEQ ID NO: 234250 - protein, 29 aa, Mycobacterium bovis
SGLDARAYRLAWPVGSIVYEVDMPEVIEF

SEQ ID NO: 234251 - protein, 18 aa, Mycobacterium bovis
SGMYFWLDYADGIEPYFS

SEQ ID NO: 234252 - protein, 22 aa, Mycobacterium bovis
SGPFFKAMVVNLLPYQILQPWV

SEQ ID NO: 234253 - protein, 22 aa, Mycobacterium bovis
SGPRWLALLLQPLSGPPSTSAK

SEQ ID NO: 234254 - protein, 20 aa, Mycobacterium bovis
SGPYFKVLLANLVPGQILQP

SEQ ID NO: 234255 - protein, 22 aa, Mycobacterium bovis
SGRNRLKYIDGLTIDRQPSNQT

SEQ ID NO: 234256 - protein, 22 aa, Mycobacterium bovis
SGSFNNGALWTGDHHGLVGFSY

SEQ ID NO: 234257 - protein, 22 aa, Mycobacterium bovis
SGTEFNSQFSAAVRKIYDSGHN

SEQ ID NO: 234258 - protein, 23 aa, Mycobacterium bovis
SGTIAGGVYKFFIARRDPVTMSG

SEQ ID NO: 234259 - protein, 24 aa, Mycobacterium bovis
SHVYRLKSSVFISVGVLGIEPAEP

SEQ ID NO: 234260 - protein, 20 aa, Mycobacterium bovis
SIADVLRCIDGPLASVRDIG

SEQ ID NO: 234261 - protein, 19 aa, Mycobacterium bovis
SIAPRAALVQVHRDGEFVV

SEQ ID NO: 234262 - protein, 18 aa, Mycobacterium bovis
SIGKRCLLGANSGLGISL

SEQ ID NO: 234263 - protein, 19 aa, Mycobacterium bovis
SIGVPGILRMLEMVHNEHG

SEQ ID NO: 234264 - protein, 27 aa, Mycobacterium bovis
SITYNEWSFAVGKQLNMAQIITSAGPD

SEQ ID NO: 234265 - protein, 20 aa, Mycobacterium bovis
SIYSSCAVPPLVAYLDTGKL

SEQ ID NO: 234266 - protein, 30 aa, Mycobacterium bovis
SKAAARLGSDMGEFYMPYPGTRINQETVSL

SEQ ID NO: 234267 - protein, 23 aa, Mycobacterium bovis
SKAPGATVALTFQDPSGGSRTVQ

SEQ ID NO: 234268 - protein, 18 aa, Mycobacterium bovis
SKTGARYSFQVAKVDNGR

SEQ ID NO: 234269 - protein, 35 aa, Mycobacterium bovis
SLAADCLQLSALLPEWRTELPLRYLESVITQLSQG

SEQ ID NO: 234270 - protein, 39 aa, Mycobacterium bovis
SLDARIAGRLGLRPDVRRMPLFGLGCVAGAAGVARLRDY

SEQ ID NO: 234271 - protein, 25 aa, Mycobacterium bovis
SLGAPCSSWERFIFGRGPSGQAEAC

SEQ ID NO: 234272 - protein, 17 aa, Mycobacterium bovis
SLTRLTSVLSHRSAEMA

SEQ ID NO: 234273 - protein, 20 aa, Mycobacterium bovis
SLVIPFWKIGWQNLGLPTGF

SEQ ID NO: 234274 - protein, 18 aa, Mycobacterium bovis
SMGSARPGDFGAPTAVAP

SEQ ID NO: 234275 - protein, 25 aa, Mycobacterium bovis
SMLFPHLYGPLPVRAVIGAAAYPPA

SEQ ID NO: 234276 - protein, 17 aa, Mycobacterium bovis
SNALCANEILSLLDGET

SEQ ID NO: 234277 - protein, 19 aa, Mycobacterium bovis
SPAAVGCVISHDFRPRQSG

SEQ ID NO: 234278 - protein, 23 aa, Mycobacterium bovis
SPLQALEQQVLAAINAPTQTLLG

SEQ ID NO: 234279 - protein, 21 aa, Mycobacterium bovis
SPPPKTTVTFSDGRTAPFTVV

SEQ ID NO: 234280 - protein, 17 aa, Mycobacterium bovis
SPQRLWEALLRGDDLVG

SEQ ID NO: 234281 - protein, 32 aa, Mycobacterium bovis
SPTIDLPVPDDWRLLPESSRAPYGGIVYTQPA

SEQ ID NO: 234282 - protein, 18 aa, Mycobacterium bovis
SQLPAGVVQINRRNYLMV

SEQ ID NO: 234283 - protein, 23 aa, Mycobacterium bovis
SQMLQCIVTLMPLGAAVVDTHRD

SEQ ID NO: 234284 - protein, 18 aa, Mycobacterium bovis
SQWERYRRGIYCGTVGLA

SEQ ID NO: 234285 - protein, 21 aa, Mycobacterium bovis
SRQLLAAQIIWTLARADIRGP

SEQ ID NO: 234286 - protein, 17 aa, Mycobacterium bovis
SRYALAVQHERGLPMQS

SEQ ID NO: 234287 - protein, 29 aa, Mycobacterium bovis
SSDHSRRLWTMLIFMLWHAIFVEHSVVPQ

SEQ ID NO: 234288 - protein, 25 aa, Mycobacterium bovis
SSKLLRCILGDPVVDAVVAVRQLEH

SEQ ID NO: 234289 - protein, 24 aa, Mycobacterium bovis
SSLNDMTHWLAMVLADGVYNGRRI

SEQ ID NO: 234290 - protein, 24 aa, Mycobacterium bovis
SSLYPDSLHIMGWDVGSHGLRLRL

SEQ ID NO: 234291 - protein, 19 aa, Mycobacterium bovis
SSSDLRVGQPVLAIGSPLG

SEQ ID NO: 234292 - protein, 17 aa, Mycobacterium bovis
SSSLVIPFWKIGWQNLG

SEQ ID NO: 234293 - protein, 18 aa, Mycobacterium bovis
SSVGGLSVPAGWSTAAPA

SEQ ID NO: 234294 - protein, 19 aa, Mycobacterium bovis
STEDFPIPRRMIATTCDAE

SEQ ID NO: 234295 - protein, 30 aa, Mycobacterium bovis
STFVRCDARLAVTLPPELPVAAAAAVPTAS

SEQ ID NO: 234296 - protein, 17 aa, Mycobacterium bovis
STIDELKTNSSLLTSIL

SEQ ID NO: 234297 - protein, 18 aa, Mycobacterium bovis
STIDELRIFVSQWDTRAR

SEQ ID NO: 234298 - protein, 25 aa, Mycobacterium bovis
STNTICLDIDWVIGGCMSVDPTHNT

SEQ ID NO: 234299 - protein, 24 aa, Mycobacterium bovis
STSSRFTDFLARPNHAVNHVKVAD

SEQ ID NO: 234300 - protein, 25 aa, Mycobacterium bovis
SVADIPTLLAHYGVDAVITDEDHAT

SEQ ID NO: 234301 - protein, 26 aa, Mycobacterium bovis
SVATDGRFRFLRVYPNPEVYAPVTGF

SEQ ID NO: 234302 - protein, 24 aa, Mycobacterium bovis
SVESRPGWADVPGLMVPGAAPVLP

SEQ ID NO: 234303 - protein, 21 aa, Mycobacterium bovis
SVLSALFLGAGAALLSACSSP

SEQ ID NO: 234304 - protein, 17 aa, Mycobacterium bovis
SVPAGFTRIAAFRAGVG

SEQ ID NO: 234305 - protein, 22 aa, Mycobacterium bovis
SVRMGAAVTPYVEWLTTTAAQA

SEQ ID NO: 234306 - protein, 18 aa, Mycobacterium bovis
SWDHPYRAPPKVWFHDLL

SEQ ID NO: 234307 - protein, 20 aa, Mycobacterium bovis
SWTARTWQMLAARGVRIAAD

SEQ ID NO: 234308 - protein, 19 aa, Mycobacterium bovis
SYETAGMRTTCGRRDLADY

SEQ ID NO: 234309 - protein, 28 aa, Mycobacterium bovis
SYGVDIKPGLSLGGYAAFARYDNNETLL

SEQ ID NO: 234310 - protein, 26 aa, Mycobacterium bovis
TAADPAGWPRLDWSMDAALLLAALAS

SEQ ID NO: 234311 - protein, 23 aa, Mycobacterium bovis
TAAKAMCGLCANGVTGLQLVADL

SEQ ID NO: 234312 - protein, 23 aa, Mycobacterium bovis
TAGHGGLFNRAPWVVSVDDHVDP

SEQ ID NO: 234313 - protein, 20 aa, Mycobacterium bovis
TALGTCWAVTVMGSSNTVVA

SEQ ID NO: 234314 - protein, 33 aa, Mycobacterium bovis
TAPEIPYYSATLWDPRERPSFTGEYWVENLRYT

SEQ ID NO: 234315 - protein, 25 aa, Mycobacterium bovis
TAPSRSAFVAGPWGAVASLSPELFL

SEQ ID NO: 234316 - protein, 26 aa, Mycobacterium bovis
TAVKSCGYSDCKVLTSFTACGAVAAN

SEQ ID NO: 234317 - protein, 24 aa, Mycobacterium bovis
TDARGLGFLGERAVNVLRLNLALD

SEQ ID NO: 234318 - protein, 18 aa, Mycobacterium bovis
TDAVEFGAAKGFAVTELT

SEQ ID NO: 234319 - protein, 21 aa, Mycobacterium bovis
TDGQWGGAMLVVAKSTVSDVD

SEQ ID NO: 234320 - protein, 27 aa, Mycobacterium bovis
TDLPGELMSALSQGLSQFGINIPPVPS

SEQ ID NO: 234321 - protein, 30 aa, Mycobacterium bovis
TDPVLAEWFLRRFSLLDSLYMVPSVPIIGR

SEQ ID NO: 234322 - protein, 17 aa, Mycobacterium bovis
TEHRVPIDVLRGALADA

SEQ ID NO: 234323 - protein, 24 aa, Mycobacterium bovis
TEIDNLRAAFVWNRENSDTEGALA

SEQ ID NO: 234324 - protein, 19 aa, Mycobacterium bovis
TENYLRWVSDVDRSAPRPN

SEQ ID NO: 234325 - protein, 17 aa, Mycobacterium bovis
TEVLEWLSPLPGGSVVS

SEQ ID NO: 234326 - protein, 17 aa, Mycobacterium bovis
TEVPPVIDESIWDAIAG

SEQ ID NO: 234327 - protein, 30 aa, Mycobacterium bovis
TFAQPYPAWRELFTDILPAHIVKDIPGGFA

SEQ ID NO: 234328 - protein, 27 aa, Mycobacterium bovis
TGGAGGPGGLIWGGGGAGGVGGAGGGT

SEQ ID NO: 234329 - protein, 25 aa, Mycobacterium bovis
TGGAGGSGAWLYGNGGAAGAGGNGG

SEQ ID NO: 234330 - protein, 19 aa, Mycobacterium bovis
TGGASRSGGFGGAGGAGGD

SEQ ID NO: 234331 - protein, 17 aa, Mycobacterium bovis
TGGGGGVGGLWGAGGAG

SEQ ID NO: 234332 - protein, 17 aa, Mycobacterium bovis
TGGLLFGAGGNGGPGGS

SEQ ID NO: 234333 - protein, 21 aa, Mycobacterium bovis
TGGSAGWLSGNGGAGGSGGSA

SEQ ID NO: 234334 - protein, 18 aa, Mycobacterium bovis
TGGTNFAGGQGGAGGRGG

SEQ ID NO: 234335 - protein, 21 aa, Mycobacterium bovis
TGIAGAGGRGGAGGSGGSGGD

SEQ ID NO: 234336 - protein, 25 aa, Mycobacterium bovis
TGLFPPELSGGIGNILNIGAGNWAS

SEQ ID NO: 234337 - protein, 25 aa, Mycobacterium bovis
TGLSGAFHIGGKGGVGGSAVLIGNG

SEQ ID NO: 234338 - protein, 20 aa, Mycobacterium bovis
TGLYPPGSTFKMITAGAAVE

SEQ ID NO: 234339 - protein, 24 aa, Mycobacterium bovis
TGPEGLPSVFVYDGYPGGAGFAER

SEQ ID NO: 234340 - protein, 25 aa, Mycobacterium bovis
TGQAGGAGGILWGNGGAGGSGAPGQ

SEQ ID NO: 234341 - protein, 25 aa, Mycobacterium bovis
TGSRGLRYATVIALVAALVGGVYVL

SEQ ID NO: 234342 - protein, 23 aa, Mycobacterium bovis
TGSRWEMDPTLLVSADVTNNHPF

SEQ ID NO: 234343 - protein, 25 aa, Mycobacterium bovis
THTFMPNFALEWLINAYHRRGADIE

SEQ ID NO: 234344 - protein, 20 aa, Mycobacterium bovis
TIARWLLTRRSVILREVGPE

SEQ ID NO: 234345 - protein, 22 aa, Mycobacterium bovis
TIDRIPLNLGASVTVGPILING

SEQ ID NO: 234346 - protein, 19 aa, Mycobacterium bovis
TINKAHWFFSLSPAERRDY

SEQ ID NO: 234347 - protein, 27 aa, Mycobacterium bovis
TIPAIPIGLELNGGVGPITVLPIQILP

SEQ ID NO: 234348 - protein, 24 aa, Mycobacterium bovis
TLARADIRGPYVINADGAPLEDRF

SEQ ID NO: 234349 - protein, 21 aa, Mycobacterium bovis
TLFRPDTRLAVTIPTVDPQRG

SEQ ID NO: 234350 - protein, 24 aa, Mycobacterium bovis
TLGNPVCLCRNVPVVRLNHLGRQP

SEQ ID NO: 234351 - protein, 20 aa, Mycobacterium bovis
TLLGRLLVYDALEMSYRTIT

SEQ ID NO: 234352 - protein, 19 aa, Mycobacterium bovis
TLLSALGITGQFRFGPITV

SEQ ID NO: 234353 - protein, 21 aa, Mycobacterium bovis
TLRERFGYDAWALIYDVDTVR

SEQ ID NO: 234354 - protein, 18 aa, Mycobacterium bovis
TLTGFGYHGPDGQVVADR

SEQ ID NO: 234355 - protein, 17 aa, Mycobacterium bovis
TLVGLMLTLLPAPTSAA

SEQ ID NO: 234356 - protein, 20 aa, Mycobacterium bovis
TLYDELCWAPKHTDFEEGLR

SEQ ID NO: 234357 - protein, 21 aa, Mycobacterium bovis
TMEALWWDRPFALAGVDIGAS

SEQ ID NO: 234358 - protein, 33 aa, Mycobacterium bovis
TNALPRRPKFALLKGRRNYLCLNKIHNSVTASD

SEQ ID NO: 234359 - protein, 20 aa, Mycobacterium bovis
TNFRWGGAFDLDRLLFKRNI

SEQ ID NO: 234360 - protein, 25 aa, Mycobacterium bovis
TNLEFLSCFLGLMLHGAVPVPIPPR

SEQ ID NO: 234361 - protein, 23 aa, Mycobacterium bovis
TNTGAFFIGHSGLLNSGGGQHVG

SEQ ID NO: 234362 - protein, 19 aa, Mycobacterium bovis
TPAFEWYDQSGLSVVMPVG

SEQ ID NO: 234363 - protein, 18 aa, Mycobacterium bovis
TPEALAWSRQRANLPPCP

SEQ ID NO: 234364 - protein, 20 aa, Mycobacterium bovis
TPETLLGCPGEIDIGHRTIP

SEQ ID NO: 234365 - protein, 30 aa, Mycobacterium bovis
TPFPTMYELFSVGWGKPDLRDQWKHATQQV

SEQ ID NO: 234366 - protein, 20 aa, Mycobacterium bovis
TPHAIALVLQQLVLGNALPP

SEQ ID NO: 234367 - protein, 23 aa, Mycobacterium bovis
TPKLRARQLISQWERYRRGIYCG

SEQ ID NO: 234368 - protein, 20 aa, Mycobacterium bovis
TPNPCVRCNQQIKFAALSAR

SEQ ID NO: 234369 - protein, 31 aa, Mycobacterium bovis
TPPAPAPPPFRLPLLFVNALGDNWIVGASNS

SEQ ID NO: 234370 - protein, 20 aa, Mycobacterium bovis
TPVPACSRGTLSRIEAALAD

SEQ ID NO: 234371 - protein, 22 aa, Mycobacterium bovis
TPVVSKLPWFALRDPYVTGQVT

SEQ ID NO: 234372 - protein, 24 aa, Mycobacterium bovis
TQALLGRPLIGDGAAGAPGTGQAG

SEQ ID NO: 234373 - protein, 25 aa, Mycobacterium bovis
TQALLGRPLIGDGANGGPGQDGGPG

SEQ ID NO: 234374 - protein, 26 aa, Mycobacterium bovis
TRAAELRYGRSFGIVAGYGGHGIGRQ

SEQ ID NO: 234375 - protein, 21 aa, Mycobacterium bovis
TRKKSSIGWVLLACSVAGCKG

SEQ ID NO: 234376 - protein, 23 aa, Mycobacterium bovis
TRLGPLLRHHRVLICTPAEHDEI

SEQ ID NO: 234377 - protein, 24 aa, Mycobacterium bovis
TRRKGRLAALAIAAMASASLVTVA

SEQ ID NO: 234378 - protein, 24 aa, Mycobacterium bovis
TSDADWKPVADILGRTGKLNDGSV

SEQ ID NO: 234379 - protein, 33 aa, Mycobacterium bovis
TSPIPLKIDVSGGLPAFTLFPGGLNIPQNAIPL

SEQ ID NO: 234380 - protein, 29 aa, Mycobacterium bovis
TSSFYRPTQPGSYPIVLATYEIVCSKYPD

SEQ ID NO: 234381 - protein, 21 aa, Mycobacterium bovis
TSTLPGAGWTAAAPQAAAGTF

SEQ ID NO: 234382 - protein, 24 aa, Mycobacterium bovis
TSVPMLFAKPSYYGQFTDSGGLHK

SEQ ID NO: 234383 - protein, 19 aa, Mycobacterium bovis
TSVSAWRADGMQLGKPQLG

SEQ ID NO: 234384 - protein, 20 aa, Mycobacterium bovis
TTALTDVWRALRASMRSVLE

SEQ ID NO: 234385 - protein, 25 aa, Mycobacterium bovis
TTDPPVEGGWAWLPDEAQGARVHWR

SEQ ID NO: 234386 - protein, 28 aa, Mycobacterium bovis
TTNPPVEGAFYWLNNREVRWRPEHFWKP

SEQ ID NO: 234387 - protein, 23 aa, Mycobacterium bovis
TVEGLKIDGDHIVVKFSIGTNTI

SEQ ID NO: 234388 - protein, 17 aa, Mycobacterium bovis
TVLPIQILPTIPLNIHQ

SEQ ID NO: 234389 - protein, 17 aa, Mycobacterium bovis
TVRLKAPTIDFTLRLGH

SEQ ID NO: 234390 - protein, 17 aa, Mycobacterium bovis
TVWSMVMTLALDCGAMV

SEQ ID NO: 234391 - protein, 17 aa, Mycobacterium bovis
TVYGWDETVFFRNGDPF

SEQ ID NO: 234392 - protein, 17 aa, Mycobacterium bovis
TWNPSGMYFWLDYADGI

SEQ ID NO: 234393 - protein, 21 aa, Mycobacterium bovis
TWNTLYRKWLTVLGPAPAPPT

SEQ ID NO: 234394 - protein, 20 aa, Mycobacterium bovis
TYPIAWEIEIERIGLTLRGA

SEQ ID NO: 234395 - protein, 20 aa, Mycobacterium bovis
TYWEGAVALEGRYQGMPISG

SEQ ID NO: 234396 - protein, 31 aa, Mycobacterium bovis
VAAECRRVGVPDARCVLPLAHRVTQAARDAY

SEQ ID NO: 234397 - protein, 25 aa, Mycobacterium bovis
VACGSGRGPAPIKVIADKGTPFADL

SEQ ID NO: 234398 - protein, 24 aa, Mycobacterium bovis
VADAHGVPFLGIRGMSDGPGDPLH

SEQ ID NO: 234399 - protein, 19 aa, Mycobacterium bovis
VADQGKRNVTHGCINLSPA

SEQ ID NO: 234400 - protein, 24 aa, Mycobacterium bovis
VAELLPQVFRWARTVDPVQPLTSG

SEQ ID NO: 234401 - protein, 22 aa, Mycobacterium bovis
VAIVLGTGVAWSSVRSFEDGIF

SEQ ID NO: 234402 - protein, 22 aa, Mycobacterium bovis
VALPEAIPVPHVPPLGAEPGVQ

SEQ ID NO: 234403 - protein, 26 aa, Mycobacterium bovis
VAMVLRRLLRLCARYSAHPTVIFASA

SEQ ID NO: 234404 - protein, 18 aa, Mycobacterium bovis
VAPGYIWGDTLKSYFDHQ

SEQ ID NO: 234405 - protein, 25 aa, Mycobacterium bovis
VARPAPACRIDWEPADRAAHRDGVL

SEQ ID NO: 234406 - protein, 25 aa, Mycobacterium bovis
VARQEPRISWAAGLRDDGTTTLLVT

SEQ ID NO: 234407 - protein, 24 aa, Mycobacterium bovis
VAVDLRDDWPTALQKAGFDNAQRT

SEQ ID NO: 234408 - protein, 18 aa, Mycobacterium bovis
VAVGQSFTSVPMLFAKPS

SEQ ID NO: 234409 - protein, 27 aa, Mycobacterium bovis
VDAFAALKRLTMVTSHVLAETKVDFGE

SEQ ID NO: 234410 - protein, 25 aa, Mycobacterium bovis
VDDRWRLAQILTFQAVDAVVAGDPV

SEQ ID NO: 234411 - protein, 25 aa, Mycobacterium bovis
VDDYLRVIGVPAMFAAGDVAAARMD

SEQ ID NO: 234412 - protein, 17 aa, Mycobacterium bovis
VDFFVRMASGELDPDEL

SEQ ID NO: 234413 - protein, 23 aa, Mycobacterium bovis
VDHYAEIGLLGFALIADALGGVD

SEQ ID NO: 234414 - protein, 19 aa, Mycobacterium bovis
VDMAIKLGLRSYANPGTAR

SEQ ID NO: 234415 - protein, 17 aa, Mycobacterium bovis
VDPDLGKLAGRITDALT

SEQ ID NO: 234416 - protein, 25 aa, Mycobacterium bovis
VDQFTRSGVLWGVPQLTDAGIAVFY

SEQ ID NO: 234417 - protein, 18 aa, Mycobacterium bovis
VDSLDFQDGIAFVHAEDP

SEQ ID NO: 234418 - protein, 24 aa, Mycobacterium bovis
VDVQAVIMSPNLVAARFIQLTPVY

SEQ ID NO: 234419 - protein, 17 aa, Mycobacterium bovis
VEGSTWLWETHPDDMGA

SEQ ID NO: 234420 - protein, 25 aa, Mycobacterium bovis
VELPLCALLTAWVRGQARPEARAQV

SEQ ID NO: 234421 - protein, 22 aa, Mycobacterium bovis
VENLRYTVRFAAAVQAALKDGY

SEQ ID NO: 234422 - protein, 26 aa, Mycobacterium bovis
VENNFPLVNLLVNRGPTVPILLDTGS

SEQ ID NO: 234423 - protein, 18 aa, Mycobacterium bovis
VEPRARWERLYHLVNHVL

SEQ ID NO: 234424 - protein, 22 aa, Mycobacterium bovis
VEPRLWNMSTVLPILQDTTIVA

SEQ ID NO: 234425 - protein, 34 aa, Mycobacterium bovis
VEQDLLAAINARFERIFGRPLIGDGANGGPGQDG

SEQ ID NO: 234426 - protein, 24 aa, Mycobacterium bovis
VFFESPRRLAACLNDAVEQLGGAR

SEQ ID NO: 234427 - protein, 24 aa, Mycobacterium bovis
VFNFPPNGTHSWEYWGAQLNAMKG

SEQ ID NO: 234428 - protein, 27 aa, Mycobacterium bovis
VGADFGASIYAEYRLSTTVRKAANLRS

SEQ ID NO: 234429 - protein, 18 aa, Mycobacterium bovis
VGALKLILTQPFDVDTVP

SEQ ID NO: 234430 - protein, 20 aa, Mycobacterium bovis
VGALLPRAGAAAAAALPALA

SEQ ID NO: 234431 - protein, 27 aa, Mycobacterium bovis
VGGAGGRAGLFGVGGLGGAGGDAGDSG

SEQ ID NO: 234432 - protein, 20 aa, Mycobacterium bovis
VGGNARLLGTGGAGGVGGGG

SEQ ID NO: 234433 - protein, 17 aa, Mycobacterium bovis
VGIAAPVIIQFDSPISD

SEQ ID NO: 234434 - protein, 25 aa, Mycobacterium bovis
VGIQFSDDFIEWSVSFSQKPFPPPC

SEQ ID NO: 234435 - protein, 23 aa, Mycobacterium bovis
VGKLTPGFHGLHIHQVGKCEPNS

SEQ ID NO: 234436 - protein, 17 aa, Mycobacterium bovis
VGLYPGDQVRVLGVPVG

SEQ ID NO: 234437 - protein, 31 aa, Mycobacterium bovis
VGNIVGAPMGWEAVFTRPFQAFWVELPACNN

SEQ ID NO: 234438 - protein, 22 aa, Mycobacterium bovis
VGPDGTYPCIIRVENLSAGYNH

SEQ ID NO: 234439 - protein, 18 aa, Mycobacterium bovis
VGRGRAAINGDFILIAPE

SEQ ID NO: 234440 - protein, 25 aa, Mycobacterium bovis
VGSTVCSAGKYARKHVPWVNFSNVP

SEQ ID NO: 234441 - protein, 18 aa, Mycobacterium bovis
VGVAQSFTSVPMLFATPT

SEQ ID NO: 234442 - protein, 19 aa, Mycobacterium bovis
VHGLWRGGIGTTWEARIKF

SEQ ID NO: 234443 - protein, 17 aa, Mycobacterium bovis
VHLARGHAVNWVLVTDD

SEQ ID NO: 234444 - protein, 22 aa, Mycobacterium bovis
VHWRPREYYPAGTTVDVDAKLY

SEQ ID NO: 234445 - protein, 23 aa, Mycobacterium bovis
VIARAAAVFDRWSDLTAQRFIAD

SEQ ID NO: 234446 - protein, 23 aa, Mycobacterium bovis
VIVGRRGPLQAAFTTLELRELAD

SEQ ID NO: 234447 - protein, 17 aa, Mycobacterium bovis
VIVNAGIGKGARLGSGK

SEQ ID NO: 234448 - protein, 19 aa, Mycobacterium bovis
VKGGVPFLPLNRIPQLAGS

SEQ ID NO: 234449 - protein, 27 aa, Mycobacterium bovis
VKIPGGALCGKLAVPVDYDRPDGDVAA

SEQ ID NO: 234450 - protein, 21 aa, Mycobacterium bovis
VKQGWMCCIGSSWMHLSTGVI

SEQ ID NO: 234451 - protein, 17 aa, Mycobacterium bovis
VKVVGFVASAPGFHGQP

SEQ ID NO: 234452 - protein, 20 aa, Mycobacterium bovis
VKVVRLGGAGRGFSSGGAIS

SEQ ID NO: 234453 - protein, 24 aa, Mycobacterium bovis
VLAGFPGTVASFWQQAGRSGRRGQ

SEQ ID NO: 234454 - protein, 18 aa, Mycobacterium bovis
VLAGIAVLPKRIHRYDYR

SEQ ID NO: 234455 - protein, 26 aa, Mycobacterium bovis
VLALLLSSCGWRGISNVAIPGGPGTG

SEQ ID NO: 234456 - protein, 18 aa, Mycobacterium bovis
VLDGAGWSDDGMQSVVRV

SEQ ID NO: 234457 - protein, 18 aa, Mycobacterium bovis
VLECLAGLASDAGTHHAA

SEQ ID NO: 234458 - protein, 31 aa, Mycobacterium bovis
VLHRPKLGFPVPIRHWLRAGELLEWAYATVG

SEQ ID NO: 234459 - protein, 20 aa, Mycobacterium bovis
VLINNAFRVPSMKPLAGTTF

SEQ ID NO: 234460 - protein, 27 aa, Mycobacterium bovis
VMATIRNAVFLGHAFAALNPATVTAAA

SEQ ID NO: 234461 - protein, 21 aa, Mycobacterium bovis
VNAWVSFYAAGLFAMNNGVPW

SEQ ID NO: 234462 - protein, 18 aa, Mycobacterium bovis
VNGTRYLCTGSPKQVATT

SEQ ID NO: 234463 - protein, 27 aa, Mycobacterium bovis
VNSGTCFRPSLAVQRRWRDEFGLGLAD

SEQ ID NO: 234464 - protein, 17 aa, Mycobacterium bovis
VPDAFVVIADRLGNSVY

SEQ ID NO: 234465 - protein, 18 aa, Mycobacterium bovis
VPELPDWAQTVTVEQLMH

SEQ ID NO: 234466 - protein, 20 aa, Mycobacterium bovis
VPFTGVPGYNHIKIKEAYGL

SEQ ID NO: 234467 - protein, 20 aa, Mycobacterium bovis
VPGAIRFPRDLGPHYDYQTE

SEQ ID NO: 234468 - protein, 19 aa, Mycobacterium bovis
VPPAEAKRGDLIFYGPGGG

SEQ ID NO: 234469 - protein, 26 aa, Mycobacterium bovis
VPRAELLRPGLLVLPVRGPARFFGSE

SEQ ID NO: 234470 - protein, 21 aa, Mycobacterium bovis
VPRPLMGSLIQRVPLDGAALS

SEQ ID NO: 234471 - protein, 17 aa, Mycobacterium bovis
VPSRPHLEWQLRRRVLQ

SEQ ID NO: 234472 - protein, 26 aa, Mycobacterium bovis
VQDEVSAAIAALFSAHGRAYQVASAQ

SEQ ID NO: 234473 - protein, 18 aa, Mycobacterium bovis
VRAEAGAVLTEISDTASR

SEQ ID NO: 234474 - protein, 19 aa, Mycobacterium bovis
VRARLRRRGPVTVYGVDKF

SEQ ID NO: 234475 - protein, 19 aa, Mycobacterium bovis
VRGGVYWDAYRDPVSVVVL

SEQ ID NO: 234476 - protein, 17 aa, Mycobacterium bovis
VRGQLRPGSPAAPVVYT

SEQ ID NO: 234477 - protein, 17 aa, Mycobacterium bovis
VRHCARIALDQLGVPPA

SEQ ID NO: 234478 - protein, 21 aa, Mycobacterium bovis
VRSRFPSSGPYKIESVLDDGA

SEQ ID NO: 234479 - protein, 24 aa, Mycobacterium bovis
VRVDPRQVQDWVVGLLHEQDQGKT

SEQ ID NO: 234480 - protein, 25 aa, Mycobacterium bovis
VSAARAGKMTNWAIARPPGQTQALR

SEQ ID NO: 234481 - protein, 23 aa, Mycobacterium bovis
VSADVGGGLRFNIGTGKETSDRQ

SEQ ID NO: 234482 - protein, 19 aa, Mycobacterium bovis
VSALNRPVSTTGEAGNQNT

SEQ ID NO: 234483 - protein, 21 aa, Mycobacterium bovis
VSALQAALFTAYGTFYQQVSA

SEQ ID NO: 234484 - protein, 23 aa, Mycobacterium bovis
VSGLSWKDHEYMTSALAPEDVGW

SEQ ID NO: 234485 - protein, 21 aa, Mycobacterium bovis
VSINAEMIWGQPVEETDSAGN

SEQ ID NO: 234486 - protein, 26 aa, Mycobacterium bovis
VTADPRLNTGLTPFLLGPVYISNNPS

SEQ ID NO: 234487 - protein, 27 aa, Mycobacterium bovis
VTASGGLRVNPEFHCEIVVDGQVVVSQ

SEQ ID NO: 234488 - protein, 19 aa, Mycobacterium bovis
VTCPIYRYHPATVAQAFAS

SEQ ID NO: 234489 - protein, 21 aa, Mycobacterium bovis
VTDDLRPGGPVMVETVSQAIA

SEQ ID NO: 234490 - protein, 24 aa, Mycobacterium bovis
VTFSDGRTAPFTVVGADPTSDIAV

SEQ ID NO: 234491 - protein, 17 aa, Mycobacterium bovis
VTQVARRYGLRSTAPPS

SEQ ID NO: 234492 - protein, 17 aa, Mycobacterium bovis
VTTMKSRVIDIVEENGF

SEQ ID NO: 234493 - protein, 20 aa, Mycobacterium bovis
VVAAQPYLAWLTYTAESAAH

SEQ ID NO: 234494 - protein, 20 aa, Mycobacterium bovis
VVAFSIPRDDWVPFTGVPGY

SEQ ID NO: 234495 - protein, 20 aa, Mycobacterium bovis
VVAGSARFTQHLKLGYRDAV

SEQ ID NO: 234496 - protein, 23 aa, Mycobacterium bovis
VVDAPWAPFAVDFHLANVGGPSA

SEQ ID NO: 234497 - protein, 23 aa, Mycobacterium bovis
VVGGIDWDGHGLLGLEDSLDAVL

SEQ ID NO: 234498 - protein, 18 aa, Mycobacterium bovis
VVITGNPVTGWRLVEWDG

SEQ ID NO: 234499 - protein, 18 aa, Mycobacterium bovis
VVNDLEFTVRLKAPTIDF

SEQ ID NO: 234500 - protein, 22 aa, Mycobacterium bovis
VVPVDPPPGFAYTRSGVPVKSF

SEQ ID NO: 234501 - protein, 25 aa, Mycobacterium bovis
VVQRLRAGSVPHLPGSVPQLPGSVL

SEQ ID NO: 234502 - protein, 23 aa, Mycobacterium bovis
VVSLSWRTGDDIVVTRTDAAHPV

SEQ ID NO: 234503 - protein, 17 aa, Mycobacterium bovis
VVTTHLQSQWSLVCVLQ

SEQ ID NO: 234504 - protein, 18 aa, Mycobacterium bovis
VWHTFCIDQCSIAFTADI

SEQ ID NO: 234505 - protein, 19 aa, Mycobacterium bovis
VWRALRASMRSVLEETTLA

SEQ ID NO: 234506 - protein, 23 aa, Mycobacterium bovis
VWTAEFAEAGWALPLSDDPAGLA

SEQ ID NO: 234507 - protein, 17 aa, Mycobacterium bovis
VYAGTGWTAMRGQRLDD

SEQ ID NO: 234508 - protein, 18 aa, Mycobacterium bovis
VYANDYWGPATVTYHDGQ

SEQ ID NO: 234509 - protein, 18 aa, Mycobacterium bovis
VYAPVTGFYSLRYSSTAL

SEQ ID NO: 234510 - protein, 30 aa, Mycobacterium bovis
VYFDYWSARGVDVTPFFAVLNGPRIAAPGG

SEQ ID NO: 234511 - protein, 19 aa, Mycobacterium bovis
VYGAIAYSGNGSWGRSWDY

SEQ ID NO: 234512 - protein, 24 aa, Mycobacterium bovis
VYTRGGGPVQRWRREVPFDVHLMI

SEQ ID NO: 234513 - protein, 20 aa, Mycobacterium bovis
WCGPCRAEVSQLQRVYDATR

SEQ ID NO: 234514 - protein, 27 aa, Mycobacterium bovis
WDEVKEGLTRLAADLSPAAGELQGPLG

SEQ ID NO: 234515 - protein, 18 aa, Mycobacterium bovis
WDQLKWNALANIAGTPAT

SEQ ID NO: 234516 - protein, 18 aa, Mycobacterium bovis
WDRPFALAGVDIGASVAA

SEQ ID NO: 234517 - protein, 17 aa, Mycobacterium bovis
WEIEIERIGLTLRGAAL

SEQ ID NO: 234518 - protein, 20 aa, Mycobacterium bovis
WFVDRPELIGADGVHPNDAG

SEQ ID NO: 234519 - protein, 18 aa, Mycobacterium bovis
WGQWCGPCRAEVSQLQRV

SEQ ID NO: 234520 - protein, 27 aa, Mycobacterium bovis
WGTGGAGGAGGWLLGDGGAGGIGGAST

SEQ ID NO: 234521 - protein, 19 aa, Mycobacterium bovis
WIIILDDWTDGIGKSPQQL

SEQ ID NO: 234522 - protein, 19 aa, Mycobacterium bovis
WIPLLILVVVAIAGFTVQR

SEQ ID NO: 234523 - protein, 18 aa, Mycobacterium bovis
WIPMVIVIVVAVAAVTVS

SEQ ID NO: 234524 - protein, 29 aa, Mycobacterium bovis
WMSPTQVRWRPFEFWPANTAVNIDAAGTK

SEQ ID NO: 234525 - protein, 17 aa, Mycobacterium bovis
WQALGGMNSALGAPTSP

SEQ ID NO: 234526 - protein, 27 aa, Mycobacterium bovis
WQASEIYPPLKAWQRMGRPTIAVNANF

SEQ ID NO: 234527 - protein, 18 aa, Mycobacterium bovis
WQASGGWTDGAHRLGTSP

SEQ ID NO: 234528 - protein, 18 aa, Mycobacterium bovis
WQGWAGGPDGGWNKPPTP

SEQ ID NO: 234529 - protein, 17 aa, Mycobacterium bovis
WQMLAARGVRIAADVAA

SEQ ID NO: 234530 - protein, 17 aa, Mycobacterium bovis
WRAGAARRLTSLVAAAF

SEQ ID NO: 234531 - protein, 17 aa, Mycobacterium bovis
WRDEFGLGLADPDQLGR

SEQ ID NO: 234532 - protein, 17 aa, Mycobacterium bovis
WRGKDLATPRGWITALR

SEQ ID NO: 234533 - protein, 25 aa, Mycobacterium bovis
WRIDRLPNGVFLDWQQFQETYKRNT

SEQ ID NO: 234534 - protein, 22 aa, Mycobacterium bovis
WRQGYYPGIGAPSWTADYGSET

SEQ ID NO: 234535 - protein, 17 aa, Mycobacterium bovis
WSSLTTMILPVGGAPYV

SEQ ID NO: 234536 - protein, 23 aa, Mycobacterium bovis
WVASNVVRWVPHRYWPPHTRVSV

SEQ ID NO: 234537 - protein, 20 aa, Mycobacterium bovis
WYRDNESWWRPLKDATEARY

SEQ ID NO: 234538 - protein, 19 aa, Mycobacterium bovis
WYYQSGLSIVMPVGGQSSF

SEQ ID NO: 234539 - protein, 19 aa, Mycobacterium bovis
YAASRPDNVARLILDSPIA

SEQ ID NO: 234540 - protein, 29 aa, Mycobacterium bovis
YADGDIWDWAVDWDTWVSMSALPPPAAKP

SEQ ID NO: 234541 - protein, 30 aa, Mycobacterium bovis
YAEDTGTVAYRFSWHLPKDRIWTYDGQLKM

SEQ ID NO: 234542 - protein, 17 aa, Mycobacterium bovis
YDHVKRGDIVEVVNTVG

SEQ ID NO: 234543 - protein, 17 aa, Mycobacterium bovis
YDPAMRTLIAFGGKYPT

SEQ ID NO: 234544 - protein, 20 aa, Mycobacterium bovis
YDSFPRSDIVTVVIGADKWR

SEQ ID NO: 234545 - protein, 18 aa, Mycobacterium bovis
YFAGMGYSALTTAALAAG

SEQ ID NO: 234546 - protein, 23 aa, Mycobacterium bovis
YFAMKFSQPFSSYGTWDGYAVYP

SEQ ID NO: 234547 - protein, 24 aa, Mycobacterium bovis
YGRRARLAVQAMTAVVARHVDLAA

SEQ ID NO: 234548 - protein, 17 aa, Mycobacterium bovis
YISLIPVNVVADIEAAT

SEQ ID NO: 234549 - protein, 17 aa, Mycobacterium bovis
YKPRPCDASDWLDAALG

SEQ ID NO: 234550 - protein, 19 aa, Mycobacterium bovis
YKQFRGEFTPKTELTMVAS

SEQ ID NO: 234551 - protein, 17 aa, Mycobacterium bovis
YKRNTLYFADPTGKTVV

SEQ ID NO: 234552 - protein, 19 aa, Mycobacterium bovis
YLDGKRCWANQVIFGVTGP

SEQ ID NO: 234553 - protein, 17 aa, Mycobacterium bovis
YLPRLEGHGAPGVTVCH

SEQ ID NO: 234554 - protein, 17 aa, Mycobacterium bovis
YLSRAGISKEQVATGGY

SEQ ID NO: 234555 - protein, 17 aa, Mycobacterium bovis
YLYHYSLDAGQAGRELF

SEQ ID NO: 234556 - protein, 23 aa, Mycobacterium bovis
YNHIKIKEAYGLTKQYVAEQLAN

SEQ ID NO: 234557 - protein, 18 aa, Mycobacterium bovis
YPDIKVRALLSGPGVMQQ

SEQ ID NO: 234558 - protein, 19 aa, Mycobacterium bovis
YRLSTTVRKAANLRSDPFV

SEQ ID NO: 234559 - protein, 24 aa, Mycobacterium bovis
YSDGRPVTCDDLVLAWAAQSGRFP

SEQ ID NO: 234560 - protein, 18 aa, Mycobacterium bovis
YSFQVAKVDNGRCDPVAG

SEQ ID NO: 234561 - protein, 18 aa, Mycobacterium bovis
YSGNGSWGRSWDYPTRAA

SEQ ID NO: 234562 - protein, 18 aa, Mycobacterium bovis
YSGPTTALTDVWRALRAS

SEQ ID NO: 234563 - protein, 24 aa, Mycobacterium bovis
YSYGLGIVISGHWLLQNPMFAGYA

SEQ ID NO: 234564 - protein, 22 aa, Mycobacterium bovis
YTGPCPPAGTGTHHYRFTLYHL

SEQ ID NO: 234565 - protein, 23 aa, Mycobacterium bovis
YWGPPSKPGIILFRRAGAPAALA

SEQ ID NO: 234566 - protein, 18 aa, Mycobacterium bovis
YYLGEPIVQAVLFNAIDF

SEQ ID NO: 234567 - protein, 53 aa, Mycobacterium bovis
AAADEVSAAIAALFSAHGRDFQALSARAAAFHHEFVQALAAGAGSYAVAEIAA

SEQ ID NO: 234568 - protein, 18 aa, Mycobacterium bovis
AAAEAMYEQMWAADVAAM

SEQ ID NO: 234569 - protein, 27 aa, Mycobacterium bovis
AAANSWLDAFAHWRRAQGLPATSIAWG

SEQ ID NO: 234570 - protein, 30 aa, Mycobacterium bovis
AADEVSAAIAGLFGAHARQYQALSVQVAAF

SEQ ID NO: 234571 - protein, 52 aa, Mycobacterium bovis
AAGDEVSAAIAALFGTHAQEYQALSARVATFHEQFVRSLTAAGSAYATAEAA

SEQ ID NO: 234572 - protein, 25 aa, Mycobacterium bovis
AAGGVGGSGGWLNGNGGAGGAGGTG

SEQ ID NO: 234573 - protein, 19 aa, Mycobacterium bovis
AALASRAGDHVDFLAHDRI

SEQ ID NO: 234574 - protein, 24 aa, Mycobacterium bovis
AALRIVLGHELFHYAARADTALDA

SEQ ID NO: 234575 - protein, 47 aa, Mycobacterium bovis
AANASPLQALEQQVLGAINAPTQLWLGRPLIGDGVHGAPGTGQPGGA

SEQ ID NO: 234576 - protein, 20 aa, Mycobacterium bovis
AAPYAGWLAAAAARAAGASA

SEQ ID NO: 234577 - protein, 25 aa, Mycobacterium bovis
AATDMPGRFVVAAAMVRHLLTDPML

SEQ ID NO: 234578 - protein, 20 aa, Mycobacterium bovis
AAVVAPRRFTKTRSLVSGRS

SEQ ID NO: 234579 - protein, 29 aa, Mycobacterium bovis
ADEVSIAVAALFGMHGQAYQALSVQASAF

SEQ ID NO: 234580 - protein, 23 aa, Mycobacterium bovis
ADPCSDIAVVFARGTHQASGLGD

SEQ ID NO: 234581 - protein, 26 aa, Mycobacterium bovis
ADQRADWACDFWDCAAAEVAAALTIS

SEQ ID NO: 234582 - protein, 17 aa, Mycobacterium bovis
ADREALWKIVHDRCEFG

SEQ ID NO: 234583 - protein, 20 aa, Mycobacterium bovis
ADTQLGISGKGGTGGGGGGA

SEQ ID NO: 234584 - protein, 21 aa, Mycobacterium bovis
AECLHKAAPIVGLPAATRTTP

SEQ ID NO: 234585 - protein, 21 aa, Mycobacterium bovis
AELGLRVCDWVDGDDPYGLVS

SEQ ID NO: 234586 - protein, 17 aa, Mycobacterium bovis
AGADAPASTGLTGGTGF

SEQ ID NO: 234587 - protein, 24 aa, Mycobacterium bovis
AGAGGEGGIFGGNGGNGGTGGTAG

SEQ ID NO: 234588 - protein, 25 aa, Mycobacterium bovis
AGEACARAIAWYLAMARRSQGNESA

SEQ ID NO: 234589 - protein, 24 aa, Mycobacterium bovis
AGGDGGAGGILFGAGGAGGAGGAV

SEQ ID NO: 234590 - protein, 19 aa, Mycobacterium bovis
AGGNGGWLLGNGGIGGPGG

SEQ ID NO: 234591 - protein, 22 aa, Mycobacterium bovis
AGKGGIGAPGLSTAQGGDGGNG

SEQ ID NO: 234592 - protein, 25 aa, Mycobacterium bovis
AGSAPMLAASVAWDGLAAELAVAAS

SEQ ID NO: 234593 - protein, 21 aa, Mycobacterium bovis
AGSIGPMSVPPSWATPSSTPV

SEQ ID NO: 234594 - protein, 24 aa, Mycobacterium bovis
AGVAGVSFGNAVGGDGGNGGNGGH

SEQ ID NO: 234595 - protein, 18 aa, Mycobacterium bovis
AIARRSDGKLVLGSADGA

SEQ ID NO: 234596 - protein, 17 aa, Mycobacterium bovis
ALNTGLGNIGSWNLGGG

SEQ ID NO: 234597 - protein, 37 aa, Mycobacterium bovis
ALTQVGAPYAWGGAAPGGFDCSGLVMWAFQQAGIALP

SEQ ID NO: 234598 - protein, 20 aa, Mycobacterium bovis
ALVCECAFCTFPDKNAAAQQ

SEQ ID NO: 234599 - protein, 22 aa, Mycobacterium bovis
ANGFDVGRRLGIGSRETYIPAL

SEQ ID NO: 234600 - protein, 26 aa, Mycobacterium bovis
APALPVGLAVTAAVVAPRRFTKTRSL

SEQ ID NO: 234601 - protein, 19 aa, Mycobacterium bovis
APDGGFGGNGGKGGQGGIG

SEQ ID NO: 234602 - protein, 25 aa, Mycobacterium bovis
APIAIPLRVGGPIAIDGDPTKVRGL

SEQ ID NO: 234603 - protein, 26 aa, Mycobacterium bovis
APIQAATGRPLIGNGANGQPGTGAPG

SEQ ID NO: 234604 - protein, 21 aa, Mycobacterium bovis
APPAPRAAAPPTQDFMYPSIG

SEQ ID NO: 234605 - protein, 27 aa, Mycobacterium bovis
APQSARTETWINLQVGDCLADLPPADL

SEQ ID NO: 234606 - protein, 24 aa, Mycobacterium bovis
APTEALLGRPLIGNGADGTAPGQP

SEQ ID NO: 234607 - protein, 32 aa, Mycobacterium bovis; identical to SEQ ID NO: 210562

SEQ ID NO: 234608 - protein, 24 aa, Mycobacterium bovis
APVVLTSCTWRGIANVPLPVGRGM

SEQ ID NO: 234609 - protein, 23 aa, Mycobacterium bovis
AQAAMFHEQFVRALAAGGNSYAV

SEQ ID NO: 234610 - protein, 38 aa, Mycobacterium bovis; identical to SEQ ID NO: 210565

SEQ ID NO: 234611 - protein, 25 aa, Mycobacterium bovis
ARFNKPGTFPLRFQTEVRDGCPSDC

SEQ ID NO: 234612 - protein, 24 aa, Mycobacterium bovis
ARLGSGRQYMSWISLEDEVRALQF

SEQ ID NO: 234613 - protein, 19 aa, Mycobacterium bovis
ARRDLNWRPRFDLNAVAAR

SEQ ID NO: 234614 - protein, 25 aa, Mycobacterium bovis
ASAASDLGGIASMISEANAMAAVRT

SEQ ID NO: 234615 - protein, 19 aa, Mycobacterium bovis
ASGAGRAGVVPRYGVRLTV

SEQ ID NO: 234616 - protein, 21 aa, Mycobacterium bovis
ASIWNRRRVLLLNSTYEPLTA

SEQ ID NO: 234617 - protein, 18 aa, Mycobacterium bovis
ASRILASFAPAIPDRSDV

SEQ ID NO: 234618 - protein, 27 aa, Mycobacterium bovis
ASSPDGQDGGLLFGNGGAGYNSAATPG

SEQ ID NO: 234619 - protein, 21 aa, Mycobacterium bovis
ASTWSVCKGLAAVVITSAAAF

SEQ ID NO: 234620 - protein, 19 aa, Mycobacterium bovis
ATLATAATEVARIGSALSL

SEQ ID NO: 234621 - protein, 20 aa, Mycobacterium bovis
ATPGDGWASLASSIGGQVLL

SEQ ID NO: 234622 - protein, 17 aa, Mycobacterium bovis
ATVHPMLVAANRNAFVQ

SEQ ID NO: 234623 - protein, 18 aa, Mycobacterium bovis
AVHYPWLPLRRLLLDHYP

SEQ ID NO: 234624 - protein, 17 aa, Mycobacterium bovis
AVRQKYDPSRVMFSGLN

SEQ ID NO: 234625 - protein, 22 aa, Mycobacterium bovis
AWPAFRAATRWESSPTPPADPT

SEQ ID NO: 234626 - protein, 18 aa, Mycobacterium bovis
CKNIIALACGMAVGIGLG

SEQ ID NO: 234627 - protein, 26 aa, Mycobacterium bovis
DAPASTGLTGGTGFAGGAGGVGGQGG

SEQ ID NO: 234628 - protein, 25 aa, Mycobacterium bovis
DDPDGYRLSVDYAVRITSRGLYVHS

SEQ ID NO: 234629 - protein, 24 aa, Mycobacterium bovis
DGGAGGRGGWLAGAGGAGGDGGIG

SEQ ID NO: 234630 - protein, 17 aa, Mycobacterium bovis
DGGVGGKGGAGGSGGAG

SEQ ID NO: 234631 - protein, 24 aa, Mycobacterium bovis
DIDALKGIALYLNFDMLASPNPGY

SEQ ID NO: 234632 - protein, 17 aa, Mycobacterium bovis
DLPLPLRWGEYRAGGLA

SEQ ID NO: 234633 - protein, 21 aa, Mycobacterium bovis
DPATLWTLIGGPRMWERRPGA

SEQ ID NO: 234634 - protein, 23 aa, Mycobacterium bovis
DQPGATGGTGFAGGAGGAGGAGG

SEQ ID NO: 234635 - protein, 17 aa, Mycobacterium bovis
DRDRLVVIIAGYSSDID

SEQ ID NO: 234636 - protein, 24 aa, Mycobacterium bovis
DRSGLPVVVSVVGLVHTPGLVTLA

SEQ ID NO: 234637 - protein, 18 aa, Mycobacterium bovis
DSAFRAGWQGDYPSMIEF

SEQ ID NO: 234638 - protein, 17 aa, Mycobacterium bovis
DVDAVKFTQVLRGYKTS

SEQ ID NO: 234639 - protein, 20 aa, Mycobacterium bovis
DVHVAPRVIFLPGPAAALTS

SEQ ID NO: 234640 - protein, 19 aa, Mycobacterium bovis
DWADEVYVFGYPRVPMTAE

SEQ ID NO: 234641 - protein, 17 aa, Mycobacterium bovis
EAAWRNLSLALPLSAAV

SEQ ID NO: 234642 - protein, 19 aa, Mycobacterium bovis
EAGVDCFVAGSAVYGADDP

SEQ ID NO: 234643 - protein, 17 aa, Mycobacterium bovis
EALAATATYLTGIGSAI

SEQ ID NO: 234644 - protein, 20 aa, Mycobacterium bovis
EAPPVPVAYSVNWDAIAQCE

SEQ ID NO: 234645 - protein, 21 aa, Mycobacterium bovis
EARRHGWTFPYLYDETQDVAR

SEQ ID NO: 234646 - protein, 19 aa, Mycobacterium bovis
EAYFGAVGVDGVLGVGPNA

SEQ ID NO: 234647 - protein, 19 aa, Mycobacterium bovis
EFQPRAGSMAAALPYCDLF

SEQ ID NO: 234648 - protein, 19 aa, Mycobacterium bovis
EFVDVFLAIGRVGRSLGMH

SEQ ID NO: 234649 - protein, 18 aa, Mycobacterium bovis
EKVRDTFDLARHRAPSAS

SEQ ID NO: 234650 - protein, 19 aa, Mycobacterium bovis
ELLPADWPGAGLRAAYHDF

SEQ ID NO: 234651 - protein, 19 aa, Mycobacterium bovis
ELVAAAATDLANIGSSISA

SEQ ID NO: 234652 - protein, 17 aa, Mycobacterium bovis
EPLPEEPWRSAVEATGS

SEQ ID NO: 234653 - protein, 19 aa, Mycobacterium bovis
ESPGTLVMQVCGGPGDSGA

SEQ ID NO: 234654 - protein, 27 aa, Mycobacterium bovis
EVSAAVAALFARFGQEYQAVSAQASAF

SEQ ID NO: 234655 - protein, 22 aa, Mycobacterium bovis
EVSTAISALFGAHAQAYQALSA

SEQ ID NO: 234656 - protein, 17 aa, Mycobacterium bovis
FCAYNSVGYREQVREQL

SEQ ID NO: 234657 - protein, 17 aa, Mycobacterium bovis
FEMPEGKYIPRLGGMAF

SEQ ID NO: 234658 - protein, 19 aa, Mycobacterium bovis
FGNGLLTLPTSVNVVTSSS

SEQ ID NO: 234659 - protein, 19 aa, Mycobacterium bovis
FICNHCPYVQHVAAGLATL

SEQ ID NO: 234660 - protein, 18 aa, Mycobacterium bovis
FLTQNFGPVIGTGTAGYA

SEQ ID NO: 234661 - protein, 19 aa, Mycobacterium bovis
FNGRHYAVPYARSTPLFYY

SEQ ID NO: 234662 - protein, 24 aa, Mycobacterium bovis
FQHVRAAMLSHGWIDGPPPGQYFH

SEQ ID NO: 234663 - protein, 23 aa, Mycobacterium bovis
FQTLTGRPLIGNGANGTPGTGAD

SEQ ID NO: 234664 - protein, 27 aa, Mycobacterium bovis
FSIEPGIYFPGRWGARIEDIVIVTEDG

SEQ ID NO: 234665 - protein, 23 aa, Mycobacterium bovis
FSMDGCCKFAAISAHVYCPHQIT

SEQ ID NO: 234666 - protein, 22 aa, Mycobacterium bovis
FTAGHCRGGGAVTSRDYKVIGH

SEQ ID NO: 234667 - protein, 24 aa, Mycobacterium bovis
FVQALTAAAGRYASTEAAVERSLL

SEQ ID NO: 234668 - protein, 17 aa, Mycobacterium bovis
GAAGGDAGLLFGSGGAG

SEQ ID NO: 234669 - protein, 23 aa, Mycobacterium bovis
GAAGLPGAAGLNGGDGSDGGNGG

SEQ ID NO: 234670 - protein, 23 aa, Mycobacterium bovis
GAAGQLFSAGGAAGAVGVGGTGG

SEQ ID NO: 234671 - protein, 29 aa, Mycobacterium bovis
GADGLPGQNGGAGGLLWGNGGNGGAGDAA

SEQ ID NO: 234672 - protein, 25 aa, Mycobacterium bovis
GAGANGLNSGAMLPGGGTVGNPGTG

SEQ ID NO: 234673 - protein, 21 aa, Mycobacterium bovis
GAGGAAGLWGSGGSGGQGGNG

SEQ ID NO: 234674 - protein, 24 aa, Mycobacterium bovis
GAGGAGGFGAVLFGNGGAGGSGAP

SEQ ID NO: 234675 - protein, 24 aa, Mycobacterium bovis
GAGGAGGRGGWLVGSGGNGGNGGN

SEQ ID NO: 234676 - protein, 20 aa, Mycobacterium bovis
GAGGGAFVHIATATSTGGSG

SEQ ID NO: 234677 - protein, 19 aa, Mycobacterium bovis
GAGGHAGLFGAGGTGGTGG

SEQ ID NO: 234678 - protein, 19 aa, Mycobacterium bovis
GAGGLFGIGGAGGGCGSAV

SEQ ID NO: 234679 - protein, 18 aa, Mycobacterium bovis
GAGGLLFGDGGNGGAGGA

SEQ ID NO: 234680 - protein, 23 aa, Mycobacterium bovis
GAGGPGGAAFGLGNGGNGGNGGT

SEQ ID NO: 234681 - protein, 18 aa, Mycobacterium bovis
GALNSGIGNMGFGNSGNN

SEQ ID NO: 234682 - protein, 23 aa, Mycobacterium bovis
GATVGFAGSGGFGGAGGIAQLFG

SEQ ID NO: 234683 - protein, 25 aa, Mycobacterium bovis
GDAGDGGAGGWLLGTGGAGGAGGNG

SEQ ID NO: 234684 - protein, 19 aa, Mycobacterium bovis
GDGAPATLIGGPDGGDGGD

SEQ ID NO: 234685 - protein, 19 aa, Mycobacterium bovis
GDGAPATLIGGPDGGDGGQ

SEQ ID NO: 234686 - protein, 22 aa, Mycobacterium bovis
GDGGGGISLGGQGGNGGFGGAG

SEQ ID NO: 234687 - protein, 25 aa, Mycobacterium bovis
GDGGKGGAGDPSFAVNNGAGGNGGH

SEQ ID NO: 234688 - protein, 19 aa, Mycobacterium bovis
GDRLYAFNTNDYRPTVISS

SEQ ID NO: 234689 - protein, 25 aa, Mycobacterium bovis
GDTDRVTLFRAWYSRRNFGQLSGSV

SEQ ID NO: 234690 - protein, 20 aa, Mycobacterium bovis
GEGAAAYGVLVTRPDGTRVE

SEQ ID NO: 234691 - protein, 23 aa, Mycobacterium bovis
GGAGDFASGVGGVGGAGGDGGAG

SEQ ID NO: 234692 - protein, 25 aa, Mycobacterium bovis
GGAGGFASTGLGGPGGAGGPGGAGD

SEQ ID NO: 234693 - protein, 23 aa, Mycobacterium bovis
GGAGGKAGLLFGSGGAGGSGGAA

SEQ ID NO: 234694 - protein, 23 aa, Mycobacterium bovis
GGAGGKAGLLFGSGGAGGSGGAG

SEQ ID NO: 234695 - protein, 18 aa, Mycobacterium bovis
GGAGGLFAGGGIGGAGGF

SEQ ID NO: 234696 - protein, 27 aa, Mycobacterium bovis
GGAGGLLYGNGGNGFSQTTAGLTGGTG

SEQ ID NO: 234697 - protein, 23 aa, Mycobacterium bovis
GGAGGNAGMLFGAAGVGGVGGFS

SEQ ID NO: 234698 - protein, 28 aa, Mycobacterium bovis
GGAGGNGFDAATLGSPGADGGMGGNGGK

SEQ ID NO: 234699 - protein, 23 aa, Mycobacterium bovis
GGAGGNGGWLWGNGGNGGVGGTS

SEQ ID NO: 234700 - protein, 24 aa, Mycobacterium bovis
GGAGGRGGLLYGGYGVSGPGGDGR

SEQ ID NO: 234701 - protein, 26 aa, Mycobacterium bovis
GGAGGSGFFGGKGGFGGDGGQGGPNG

SEQ ID NO: 234702 - protein, 24 aa, Mycobacterium bovis
GGAGGSGGWLYGNGGNGGIGGNAI

SEQ ID NO: 234703 - protein, 20 aa, Mycobacterium bovis
GGATGLLGWGANGGAGGLGD

SEQ ID NO: 234704 - protein, 30 aa, Mycobacterium bovis
GGDEVSAAIAALFGAHARAYQALSAQAAMF

SEQ ID NO: 234705 - protein, 30 aa, Mycobacterium bovis
GGDGGEGASGLGLDLSGFDGGQGGQGGAGG

SEQ ID NO: 234706 - protein, 29 aa, Mycobacterium bovis
GGFGGQGGIGGEGRTGGNGGSGGDGGGGI

SEQ ID NO: 234707 - protein, 23 aa, Mycobacterium bovis
GGGAGLFYGFGGAGGNGGMGGVA

SEQ ID NO: 234708 - protein, 27 aa, Mycobacterium bovis
GGGNGGRGAALFGHGGNAGHGGAGGNG

SEQ ID NO: 234709 - protein, 21 aa, Mycobacterium bovis
GGGPACRPAELFATDNTTDGF

SEQ ID NO: 234710 - protein, 30 aa, Mycobacterium bovis
GGGTGGAGGRAELLFGAGGAGGAGGAGTDG

SEQ ID NO: 234711 - protein, 19 aa, Mycobacterium bovis
GGIAQLFGTGGMGGSGGGI

SEQ ID NO: 234712 - protein, 25 aa, Mycobacterium bovis
GGIGGNGGDAGLFGNGGAGGAGAAG

SEQ ID NO: 234713 - protein, 23 aa, Mycobacterium bovis
GGIGGPGRPALPVVPAGSADCSS

SEQ ID NO: 234714 - protein, 23 aa, Mycobacterium bovis
GGNGGDGGLVWGNGGTGGSGGAG

SEQ ID NO: 234715 - protein, 19 aa, Mycobacterium bovis
GGNGGEVGVGGKGGAGGVS

SEQ ID NO: 234716 - protein, 28 aa, Mycobacterium bovis
GGNGGKGGTGLMPGINGTGGAGGSRGQI

SEQ ID NO: 234717 - protein, 24 aa, Mycobacterium bovis
GGNGGTGGQLWGSGGAGGEGGAAL

SEQ ID NO: 234718 - protein, 18 aa, Mycobacterium bovis
GGVGGLFGAGGAGGSGGG

SEQ ID NO: 234719 - protein, 29 aa, Mycobacterium bovis
GHGGAGGAGGRAWLWGTGGAGGAGAAAAI

SEQ ID NO: 234720 - protein, 19 aa, Mycobacterium bovis
GHSWRKRPATGWESLTPTE

SEQ ID NO: 234721 - protein, 20 aa, Mycobacterium bovis
GKAGFSPGPTNFGLNGAGGG

SEQ ID NO: 234722 - protein, 22 aa, Mycobacterium bovis
GKGAIPAMKGATGADGTAPTSG

SEQ ID NO: 234723 - protein, 18 aa, Mycobacterium bovis
GKVDKDWDADATKGIPFG

SEQ ID NO: 234724 - protein, 17 aa, Mycobacterium bovis
GLAEYFVHRTGHGIGLC

SEQ ID NO: 234725 - protein, 23 aa, Mycobacterium bovis
GLETHLSYRMCLKTWSASESRNV

SEQ ID NO: 234726 - protein, 22 aa, Mycobacterium bovis
GLFASGGSGGFGGFASTGTGGA

SEQ ID NO: 234727 - protein, 23 aa, Mycobacterium bovis
GLGIYRLHSIFGVHEQPTVMVKP

SEQ ID NO: 234728 - protein, 19 aa, Mycobacterium bovis
GLVRVLPPFLSRKHLPSRL

SEQ ID NO: 234729 - protein, 26 aa, Mycobacterium bovis
GNGGGALNQAGFFGTGGKGGNGGNGG

SEQ ID NO: 234730 - protein, 22 aa, Mycobacterium bovis
GNGGSAGWLSGNGGTGGGGGTA

SEQ ID NO: 234731 - protein, 17 aa, Mycobacterium bovis
GNIGSWNLGGGNVGLLN

SEQ ID NO: 234732 - protein, 23 aa, Mycobacterium bovis
GPGEAAATLASRGLTAQTPRQNP

SEQ ID NO: 234733 - protein, 19 aa, Mycobacterium bovis
GPNGRPRYVTAIDADTATV

SEQ ID NO: 234734 - protein, 19 aa, Mycobacterium bovis
GQRGGNLWLSEVFGAELII

SEQ ID NO: 234735 - protein, 25 aa, Mycobacterium bovis
GQVGGPGGAAGLFGNGGSGGSGGAG

SEQ ID NO: 234736 - protein, 18 aa, Mycobacterium bovis
GQVRDAWPPSARAQPHTH

SEQ ID NO: 234737 - protein, 24 aa, Mycobacterium bovis
GRTTGNSCGVTWGPGESPGTLVMQ

SEQ ID NO: 234738 - protein, 17 aa, Mycobacterium bovis
GRVVSLFDRVEALRVTA

SEQ ID NO: 234739 - protein, 19 aa, Mycobacterium bovis
GSGGLLWGNGGAGGAGGHG

SEQ ID NO: 234740 - protein, 18 aa, Mycobacterium bovis
GSRIELRLADPADSELDR

SEQ ID NO: 234741 - protein, 23 aa, Mycobacterium bovis
GSYFWQHNWGSPKGYTHPAAHLH

SEQ ID NO: 234742 - protein, 23 aa, Mycobacterium bovis
GTAGYAGGLTYNYNTYSTTVDFG

SEQ ID NO: 234743 - protein, 25 aa, Mycobacterium bovis
GTGANGGPGGWLIGNGGAGGSGAPG

SEQ ID NO: 234744 - protein, 26 aa, Mycobacterium bovis
GTGAPGGPGGWLIGNGGAGGSGAPGA

SEQ ID NO: 234745 - protein, 22 aa, Mycobacterium bovis
GVAQGDIASAFGGDGGNGSDGV

SEQ ID NO: 234746 - protein, 27 aa, Mycobacterium bovis
GVGGNGATGPWLFGDGGAGGGGGAGGI

SEQ ID NO: 234747 - protein, 21 aa, Mycobacterium bovis
HASGPKYMLDMTFPVDYPDQQ

SEQ ID NO: 234748 - protein, 23 aa, Mycobacterium bovis
HDEVSAAIAALFSAHGQAYQAAS

SEQ ID NO: 234749 - protein, 20 aa, Mycobacterium bovis
HFDTLLVMSVEPGFGGQRFI

SEQ ID NO: 234750 - protein, 17 aa, Mycobacterium bovis
HGLNAGGLFGVLTNVVW

SEQ ID NO: 234751 - protein, 24 aa, Mycobacterium bovis
HGNHEPGWVVAPGMQGMQVQPFTA

SEQ ID NO: 234752 - protein, 24 aa, Mycobacterium bovis
HLGARLFSIIAWRTYLVRDPHALS

SEQ ID NO: 234753 - protein, 30 aa, Mycobacterium bovis
HPTTTYKAFDWDQAYRKPITYDTLWQADTD

SEQ ID NO: 234754 - protein, 17 aa, Mycobacterium bovis
HPVHIYLQFDGLDEATH

SEQ ID NO: 234755 - protein, 23 aa, Mycobacterium bovis
HTFNYLDLVRYLAVGNLNPSPLG

SEQ ID NO: 234756 - protein, 20 aa, Mycobacterium bovis
HYRPSAKLAEFVRMRDLTCR

SEQ ID NO: 234757 - protein, 19 aa, Mycobacterium bovis
IAPPRRREPTCPDRRMRMT

SEQ ID NO: 234758 - protein, 24 aa, Mycobacterium bovis
IARVIMRSAIGFFASFTVSSGVLA

SEQ ID NO: 234759 - protein, 23 aa, Mycobacterium bovis
IDHSAPWPLGPTHPSNLKCACRK

SEQ ID NO: 234760 - protein, 25 aa, Mycobacterium bovis
IDLVPEYIGNLLLYFQPDATVTMLD

SEQ ID NO: 234761 - protein, 24 aa, Mycobacterium bovis
IDNPDRWAPPYAEAGAYNVTFHAE

SEQ ID NO: 234762 - protein, 25 aa, Mycobacterium bovis
IEACECPSGCPSCVQSPKCGNGNDP

SEQ ID NO: 234763 - protein, 20 aa, Mycobacterium bovis
IGGAGERGADGAGPNANGAN

SEQ ID NO: 234764 - protein, 18 aa, Mycobacterium bovis
INGTGGAGGSRGQISGNP

SEQ ID NO: 234765 - protein, 18 aa, Mycobacterium bovis
IPEVLSKVRAVRKMVDAG

SEQ ID NO: 234766 - protein, 23 aa, Mycobacterium bovis
IQAVTGRPLIGNGANGAPGSGAP

SEQ ID NO: 234767 - protein, 22 aa, Mycobacterium bovis
IREFLERLATFTAELNNQRGDL

SEQ ID NO: 234768 - protein, 23 aa, Mycobacterium bovis
ISGYSGGLYYIFATYTTTVDFGN

SEQ ID NO: 234769 - protein, 19 aa, Mycobacterium bovis
IYAGLATDTGSFRWASVRG

SEQ ID NO: 234770 - protein, 24 aa, Mycobacterium bovis
KGGAGTLLGLTVFGDNGGAGVLGD

SEQ ID NO: 234771 - protein, 17 aa, Mycobacterium bovis
KHHLLKTFWTGWRDVQL

SEQ ID NO: 234772 - protein, 21 aa, Mycobacterium bovis
KSELLRTIALGMMARNSPEVL

SEQ ID NO: 234773 - protein, 17 aa, Mycobacterium bovis
LAAELAVAASSFGSVTS

SEQ ID NO: 234774 - protein, 54 aa, Mycobacterium bovis
LAAGADEVSARIAALFGGFGLEYQAISAQVAAYHQRFVQALSTGAGAYASAEAA

SEQ ID NO: 234775 - protein, 54 aa, Mycobacterium bovis
LAAGADEVSARIAALFGGFGLEYQAISAQVAAYHQRFVQALSTGAGAYASAEAT

SEQ ID NO: 234776 - protein, 19 aa, Mycobacterium bovis
LACGCGKPDCPSGAGNDER

SEQ ID NO: 234777 - protein, 23 aa, Mycobacterium bovis
LADAGGEVTLWARRAEVADQINT

SEQ ID NO: 234778 - protein, 17 aa, Mycobacterium bovis
LADALGVLPVLATDVLR

SEQ ID NO: 234779 - protein, 22 aa, Mycobacterium bovis
LALLGRPLIGDGTDAAPGSGGA

SEQ ID NO: 234780 - protein, 28 aa, Mycobacterium bovis
LANAKRWGVLHVIWRQGYYPGIGAPSWT

SEQ ID NO: 234781 - protein, 25 aa, Mycobacterium bovis
LATAVLPRSATPVLLPDVVAAAPGM

SEQ ID NO: 234782 - protein, 17 aa, Mycobacterium bovis
LATDVLRRLRMVKEETE

SEQ ID NO: 234783 - protein, 40 aa, Mycobacterium bovis
LATQGRGAWPVCGRGLSNATPREVLPASAAMDAPLDAAAV

SEQ ID NO: 234784 - protein, 18 aa, Mycobacterium bovis
LDDQAWRAARQALGGEDV

SEQ ID NO: 234785 - protein, 17 aa, Mycobacterium bovis
LDGDSRVLAGMNVNVWD

SEQ ID NO: 234786 - protein, 23 aa, Mycobacterium bovis
LELYKRLPGDLSILTPSPASDTD

SEQ ID NO: 234787 - protein, 29 aa, Mycobacterium bovis
LFAGGGIGGAGGFGGFRGGEGGAGGAGGL

SEQ ID NO: 234788 - protein, 27 aa, Mycobacterium bovis
LFGEPSSGFSSMLWGGGSLPTIGPLYS

SEQ ID NO: 234789 - protein, 19 aa, Mycobacterium bovis
LFSSYARDYQTLSVQVTAF

SEQ ID NO: 234790 - protein, 18 aa, Mycobacterium bovis
LGAAVLVALTTAAAACGA

SEQ ID NO: 234791 - protein, 19 aa, Mycobacterium bovis
LGGQGNHTGGHGGAGGSAG

SEQ ID NO: 234792 - protein, 17 aa, Mycobacterium bovis
LGLTAPFNIDEVPNVIR

SEQ ID NO: 234793 - protein, 34 aa, Mycobacterium bovis
LGNFLSRSGAVGVLGIGPNNGFPGTSSIVTAMPG

SEQ ID NO: 234794 - protein, 18 aa, Mycobacterium bovis
LGVLPVLATDVLRRLRMV

SEQ ID NO: 234795 - protein, 29 aa, Mycobacterium bovis
LHGSLFEFRCARCGVPYTDALPEMPEPAI

SEQ ID NO: 234796 - protein, 25 aa, Mycobacterium bovis
LKAPTIDFTLRLGHSSFYPLPDSAF

SEQ ID NO: 234797 - protein, 18 aa, Mycobacterium bovis
LLCCSGVATAAPKTYCEE

SEQ ID NO: 234798 - protein, 24 aa, Mycobacterium bovis
LLGNGNFGFGNAFGDGNLGSGNVG

SEQ ID NO: 234799 - protein, 17 aa, Mycobacterium bovis
LLRAMICQLAVWHSPEE

SEQ ID NO: 234800 - protein, 17 aa, Mycobacterium bovis
LLTELGWALRRAPLPPT

SEQ ID NO: 234801 - protein, 23 aa, Mycobacterium bovis
LMDSHPFTWLPLLSRVLGSAQLV

SEQ ID NO: 234802 - protein, 17 aa, Mycobacterium bovis
LMLDPRLAKSVAAAAIT

SEQ ID NO: 234803 - protein, 23 aa, Mycobacterium bovis
LNAGGLFGVLTNVVWTNHGPCAI

SEQ ID NO: 234804 - protein, 22 aa, Mycobacterium bovis
LPAELTPLAAWVACIADARTVT

SEQ ID NO: 234805 - protein, 20 aa, Mycobacterium bovis
LPDRGLQSWSEFDEWGPELQ

SEQ ID NO: 234806 - protein, 18 aa, Mycobacterium bovis
LPEEPWRSAVEATGSADV

SEQ ID NO: 234807 - protein, 24 aa, Mycobacterium bovis
LPIVNASGGPNCRGLPDIPTKQTG

SEQ ID NO: 234808 - protein, 29 aa, Mycobacterium bovis
LPLRWGEYRAGGLARARWGLLEPPEPWLP

SEQ ID NO: 234809 - protein, 23 aa, Mycobacterium bovis
LPSGGFVPAGTTISVYTSDGQTL

SEQ ID NO: 234810 - protein, 20 aa, Mycobacterium bovis
LPVGRGMGPDRMTIYVQMPD

SEQ ID NO: 234811 - protein, 17 aa, Mycobacterium bovis
LPWSVLKQLHAGDSDDG

SEQ ID NO: 234812 - protein, 18 aa, Mycobacterium bovis
LQQAPVMFDSGGINGTIP

SEQ ID NO: 234813 - protein, 17 aa, Mycobacterium bovis
LRMFTGAGSAPMLAASV

SEQ ID NO: 234814 - protein, 21 aa, Mycobacterium bovis
LRSLPGCHLLVRPEVMRRDVD

SEQ ID NO: 234815 - protein, 17 aa, Mycobacterium bovis
LRTADRGSWALADATVD

SEQ ID NO: 234816 - protein, 20 aa, Mycobacterium bovis
LSAHVAAFHDQFVHTLTAGA

SEQ ID NO: 234817 - protein, 18 aa, Mycobacterium bovis
LTALVLPAAGAPAVVLPR

SEQ ID NO: 234818 - protein, 17 aa, Mycobacterium bovis
LTASDAVRIDNSGNFVH

SEQ ID NO: 234819 - protein, 18 aa, Mycobacterium bovis
LTNARPAATPATTSVPTY

SEQ ID NO: 234820 - protein, 21 aa, Mycobacterium bovis
LTSELPQWLSANRAVKPTGSA

SEQ ID NO: 234821 - protein, 19 aa, Mycobacterium bovis
LVAAAAADLTGIGQAISAA

SEQ ID NO: 234822 - protein, 28 aa, Mycobacterium bovis
LVVLGACLALWLSGCSSPKPDAEEQGVP

SEQ ID NO: 234823 - protein, 19 aa, Mycobacterium bovis
LWAQAGFRPVDPAVAADFA

SEQ ID NO: 234824 - protein, 22 aa, Mycobacterium bovis
MALPGDLNQGVLIDAPAGELVF

SEQ ID NO: 234825 - protein, 18 aa, Mycobacterium bovis
METFVEAWATSHDFMAVT

SEQ ID NO: 234826 - protein, 18 aa, Mycobacterium bovis
MGRPEYPTPVGSYTVLSK

SEQ ID NO: 234827 - protein, 24 aa, Mycobacterium bovis
MISEANAMAAVRTTALAPAAADEV

SEQ ID NO: 234828 - protein, 17 aa, Mycobacterium bovis
MLASLWSSTGMSLVSAG

SEQ ID NO: 234829 - protein, 22 aa, Mycobacterium bovis
MLRGRRALDVAGNGRYARQLVE

SEQ ID NO: 234830 - protein, 25 aa, Mycobacterium bovis
MRANLERWAPLLPEGATLVSLAKGI

SEQ ID NO: 234831 - protein, 17 aa, Mycobacterium bovis
MSVPPSWATPSSTPVSA

SEQ ID NO: 234832 - protein, 24 aa, Mycobacterium bovis
NAHLRAAHHLSLCAQCAAEVDDQS

SEQ ID NO: 234833 - protein, 23 aa, Mycobacterium bovis
NANLGGGNWGFANLGSGNIGNTN

SEQ ID NO: 234834 - protein, 26 aa, Mycobacterium bovis
NAPFRSALGRPLIGNGANGKPGTGQD

SEQ ID NO: 234835 - protein, 17 aa, Mycobacterium bovis
NDLPWSVLKQLHAGDSD

SEQ ID NO: 234836 - protein, 20 aa, Mycobacterium bovis
NGGAGGLIWGTAGTGGNGGF

SEQ ID NO: 234837 - protein, 24 aa, Mycobacterium bovis
NGGAGGNGGWLYGSGGNGGAGGAG

SEQ ID NO: 234838 - protein, 25 aa, Mycobacterium bovis
NGGAGMINGGLGGFGGAGGGGAVDV

SEQ ID NO: 234839 - protein, 24 aa, Mycobacterium bovis
NGGHGGSAAKLFGDGGAGGAGGMG

SEQ ID NO: 234840 - protein, 28 aa, Mycobacterium bovis
NGGIGGKGGDAFATFAKAGNGGAGGNGG

SEQ ID NO: 234841 - protein, 27 aa, Mycobacterium bovis
NGGNGGRGSVLFGHGGNAGHGGAGGNG

SEQ ID NO: 234842 - protein, 26 aa, Mycobacterium bovis
NGGVGGRGGDGVFAGAGGQGGLGGQG

SEQ ID NO: 234843 - protein, 27 aa, Mycobacterium bovis
NGGVGGSGGFVYGNGGAGGIGGIGGIG

SEQ ID NO: 234844 - protein, 23 aa, Mycobacterium bovis
NGPFQALFGRPLIGDGANGAPGQ

SEQ ID NO: 234845 - protein, 17 aa, Mycobacterium bovis
NNIGFGLTGDNLVGIGA

SEQ ID NO: 234846 - protein, 26 aa, Mycobacterium bovis
NYGSVIARLTGMHWWGPASTSMLAMS

SEQ ID NO: 234847 - protein, 17 aa, Mycobacterium bovis
PAFEWYYQSGLSIVMPV

SEQ ID NO: 234848 - protein, 26 aa, Mycobacterium bovis
PAKLWTIADLGGWGSVDPQLFDKATG

SEQ ID NO: 234849 - protein, 19 aa, Mycobacterium bovis
PAVEELRSPLDQARHDGAL

SEQ ID NO: 234850 - protein, 20 aa, Mycobacterium bovis
PAVLAVAVVVAFLTTGCIRW

SEQ ID NO: 234851 - protein, 17 aa, Mycobacterium bovis
PEVLNLLLVDFKGGATF

SEQ ID NO: 234852 - protein, 28 aa, Mycobacterium bovis
PFDPCRDIPFDVIQRLGLAYTPPEAEEG

SEQ ID NO: 234853 - protein, 27 aa, Mycobacterium bovis
PGATAFPWRRQSALVQWYVETSGSPSE

SEQ ID NO: 234854 - protein, 17 aa, Mycobacterium bovis
PGHPVHIYLQFDGLDEA

SEQ ID NO: 234855 - protein, 23 aa, Mycobacterium bovis
PGQPGAAGGLLFGNGGNGAAGGF

SEQ ID NO: 234856 - protein, 30 aa, Mycobacterium bovis; identical to SEQ ID NO: 211473

SEQ ID NO: 234857 - protein, 27 aa, Mycobacterium bovis
PGTGQPGGAGGLLWGNGGNGGSGAAGQ

SEQ ID NO: 234858 - protein, 18 aa, Mycobacterium bovis
PKVAVALKDPSYRLKTTT

SEQ ID NO: 234859 - protein, 23 aa, Mycobacterium bovis
PLRRASPSAVHPVAPPSVRPFTT

SEQ ID NO: 234860 - protein, 19 aa, Mycobacterium bovis
PMDCHLMIDNPDRWAPPYA

SEQ ID NO: 234861 - protein, 25 aa, Mycobacterium bovis
PNGGNGGDAGMFGNGGAGGAGYSPA

SEQ ID NO: 234862 - protein, 25 aa, Mycobacterium bovis
PPARYFGPNLSRLSAVRQKYDPSRV

SEQ ID NO: 234863 - protein, 21 aa, Mycobacterium bovis
PPCPERLATAVLPRSATPVLL

SEQ ID NO: 234864 - protein, 17 aa, Mycobacterium bovis
PPMLGALLRDAEPAQAE

SEQ ID NO: 234865 - protein, 18 aa, Mycobacterium bovis
PPQTFKIENPLAVVATST

SEQ ID NO: 234866 - protein, 21 aa, Mycobacterium bovis
PPTGPHWRLLSAVKELDPSWA

SEQ ID NO: 234867 - protein, 21 aa, Mycobacterium bovis
PQLLIDRLSVQRVMAHQMSTQ

SEQ ID NO: 234868 - protein, 17 aa, Mycobacterium bovis
PQVAALFLAGHLGARLF

SEQ ID NO: 234869 - protein, 21 aa, Mycobacterium bovis
PRVAHCIYAGLATDTGSFRWA

SEQ ID NO: 234870 - protein, 19 aa, Mycobacterium bovis
PTTQVLAAAGDEVSAAIAA

SEQ ID NO: 234871 - protein, 35 aa, Mycobacterium bovis
PTVISSGLMNTGFLPFRFQPVYIDYSPSGIGTTVF

SEQ ID NO: 234872 - protein, 20 aa, Mycobacterium bovis
PYQGTVRMAFLLQGDHDAYF

SEQ ID NO: 234873 - protein, 30 aa, Mycobacterium bovis
QAIELWKIVDRPNLFIKIPATKAGLPAISA

SEQ ID NO: 234874 - protein, 22 aa, Mycobacterium bovis
QALLGRPLIGNGANGLPGTGQN

SEQ ID NO: 234875 - protein, 20 aa, Mycobacterium bovis
QEDFRKAAVVANVYADAAGD

SEQ ID NO: 234876 - protein, 23 aa, Mycobacterium bovis
QGPISRRLALTALGFGVLAPNVL

SEQ ID NO: 234877 - protein, 17 aa, Mycobacterium bovis
QGYKLTASDAVRIDNSG

SEQ ID NO: 234878 - protein, 25 aa, Mycobacterium bovis
QIERYRAATLMARVRAAKGMKVAQP

SEQ ID NO: 234879 - protein, 17 aa, Mycobacterium bovis
QKAMAFAAANNLKVAPR

SEQ ID NO: 234880 - protein, 21 aa, Mycobacterium bovis
QLLATAALDLASIGSQVSAAN

SEQ ID NO: 234881 - protein, 22 aa, Mycobacterium bovis
QLPCLPILFIVVDEFSELLSQH

SEQ ID NO: 234882 - protein, 40 aa, Mycobacterium bovis
QLVNTTEPVVFISLNGGQMVPVLLDTGSTGLVMDSQFLTQ

SEQ ID NO: 234883 - protein, 18 aa, Mycobacterium bovis
QNAPAIAAAEAMYEQMWA

SEQ ID NO: 234884 - protein, 20 aa, Mycobacterium bovis
QPYAAIYLHLMRAAVLRRAG

SEQ ID NO: 234885 - protein, 21 aa, Mycobacterium bovis
QRMGRPTIAVNANFFDVRGQK

SEQ ID NO: 234886 - protein, 22 aa, Mycobacterium bovis
QTLTGRPLIGNGANGTPGTGAD

SEQ ID NO: 234887 - protein, 20 aa, Mycobacterium bovis
QTLTGRPLIGNGTPGAVGSG

SEQ ID NO: 234888 - protein, 23 aa, Mycobacterium bovis
QTLVGRPLIGDGTHGAPGTGQNG

SEQ ID NO: 234889 - protein, 17 aa, Mycobacterium bovis
RAAHALAAAVPRLADVA

SEQ ID NO: 234890 - protein, 25 aa, Mycobacterium bovis
RALESRPGVVLHPGQAVCHFGVSTG

SEQ ID NO: 234891 - protein, 21 aa, Mycobacterium bovis
RATVAAAVWLATVCLVASCAN

SEQ ID NO: 234892 - protein, 18 aa, Mycobacterium bovis
RAYQALSAQAAMFHEQFV

SEQ ID NO: 234893 - protein, 19 aa, Mycobacterium bovis
RDDWVPFTGVPGYNHIKIK

SEQ ID NO: 234894 - protein, 19 aa, Mycobacterium bovis
RDGCPSDCGLCPDHKQHAC

SEQ ID NO: 234895 - protein, 19 aa, Mycobacterium bovis
RDGRGCVIVEDMAIASKSA

SEQ ID NO: 234896 - protein, 18 aa, Mycobacterium bovis
RDPDTMIPDVRYTPNPND

SEQ ID NO: 234897 - protein, 19 aa, Mycobacterium bovis
RELSGSSNLLFRRNSVSGA

SEQ ID NO: 234898 - protein, 21 aa, Mycobacterium bovis
RGREICGMPSSGGVAVAATLG

SEQ ID NO: 234899 - protein, 21 aa, Mycobacterium bovis
RLDSVSLPWSVTVETTLPAVS

SEQ ID NO: 234900 - protein, 22 aa, Mycobacterium bovis
RLRLTRQALLAAAVAPLLAGCA

SEQ ID NO: 234901 - protein, 20 aa, Mycobacterium bovis
RLVKAGKVDKDWDADATKGI

SEQ ID NO: 234902 - protein, 19 aa, Mycobacterium bovis
RNAFVQLVLSNLFGQNAPA

SEQ ID NO: 234903 - protein, 21 aa, Mycobacterium bovis
RNCRLHWVQIIPTIAAQSTPQ

SEQ ID NO: 234904 - protein, 20 aa, Mycobacterium bovis
RNVHIRPGVPPLVIAAPVEL

SEQ ID NO: 234905 - protein, 24 aa, Mycobacterium bovis
RNYLYDAWAARFLVTARLNNSLPE

SEQ ID NO: 234906 - protein, 23 aa, Mycobacterium bovis
RPGAADFCRIRVGVGSAPLATRL

SEQ ID NO: 234907 - protein, 29 aa, Mycobacterium bovis
RRREPTCPDRRMRMTSPIRCRRRGTRSPR

SEQ ID NO: 234908 - protein, 25 aa, Mycobacterium bovis
RSLAYDRAWWFARFVAAAYGTAKLR

SEQ ID NO: 234909 - protein, 22 aa, Mycobacterium bovis
RTFIRGSGWAELVGIGDVAAFD

SEQ ID NO: 234910 - protein, 19 aa, Mycobacterium bovis
RVNSVAPGYIWGDTLKSYF

SEQ ID NO: 234911 - protein, 21 aa, Mycobacterium bovis
RWDDPFRALDMLASLWSSTGM

SEQ ID NO: 234912 - protein, 25 aa, Mycobacterium bovis
RYASTEAAVERSLLGAVNAPTEALL

SEQ ID NO: 234913 - protein, 20 aa, Mycobacterium bovis
RYDPGALRRSRISARTRDLC

SEQ ID NO: 234914 - protein, 26 aa, Mycobacterium bovis
RYNPDYLPGALLPPSIHATADAEEAL

SEQ ID NO: 234915 - protein, 19 aa, Mycobacterium bovis
SAAENYGSVIARLTGMHWW

SEQ ID NO: 234916 - protein, 24 aa, Mycobacterium bovis
SAELCAQYLAPVLDALKFNYLPFG

SEQ ID NO: 234917 - protein, 19 aa, Mycobacterium bovis
SAGKWPDKFLAGAAGVAHG

SEQ ID NO: 234918 - protein, 18 aa, Mycobacterium bovis
SAIQAGSRLGYQESAELC

SEQ ID NO: 234919 - protein, 20 aa, Mycobacterium bovis
SALASLPSGGFVPAGTTISV

SEQ ID NO: 234920 - protein, 25 aa, Mycobacterium bovis
SATDHPDLFWALRGGGGGNFGVTTS

SEQ ID NO: 234921 - protein, 19 aa, Mycobacterium bovis
SAVRFREAFFRDHGIDSVA

SEQ ID NO: 234922 - protein, 18 aa, Mycobacterium bovis
SDCGLCPDHKQHACLGLI

SEQ ID NO: 234923 - protein, 21 aa, Mycobacterium bovis
SDNLPSCITKYIPLHTPAVVM

SEQ ID NO: 234924 - protein, 38 aa, Mycobacterium bovis
SDYSPVFGCLFKGIARGVKEFAPLIGVRKAGLFTSSSF

SEQ ID NO: 234925 - protein, 17 aa, Mycobacterium bovis
SFVFRHRTGNAVILVLM

SEQ ID NO: 234926 - protein, 19 aa, Mycobacterium bovis
SGGAASMFAAPAAATAAVT

SEQ ID NO: 234927 - protein, 24 aa, Mycobacterium bovis
SGGNWSINTGNGYLGGLQFTQSTW

SEQ ID NO: 234928 - protein, 26 aa, Mycobacterium bovis
SGNQARLKLAIDSGEMGFIPSNATVR

SEQ ID NO: 234929 - protein, 20 aa, Mycobacterium bovis
SGSAKWNLLAPYAAKSDGGR

SEQ ID NO: 234930 - protein, 18 aa, Mycobacterium bovis
SGTEPGFGGDGGLGGAGA

SEQ ID NO: 234931 - protein, 21 aa, Mycobacterium bovis
SIPLMIGLAVPAHAGPSGDDA

SEQ ID NO: 234932 - protein, 19 aa, Mycobacterium bovis
SLRLPKLSAKVVVVGGLVV

SEQ ID NO: 234933 - protein, 23 aa, Mycobacterium bovis
SPACGKAGCQTYKWETLLTSELP

SEQ ID NO: 234934 - protein, 25 aa, Mycobacterium bovis
SPLQALQLELLNAINAPTLALLGRP

SEQ ID NO: 234935 - protein, 19 aa, Mycobacterium bovis
SRSGGFGGAGGAGGDAGMF

SEQ ID NO: 234936 - protein, 19 aa, Mycobacterium bovis
SSCMVTFKTSYGVIQQSLF

SEQ ID NO: 234937 - protein, 19 aa, Mycobacterium bovis
SSEVIRALDELDFGGIVEM

SEQ ID NO: 234938 - protein, 26 aa, Mycobacterium bovis
SSLRLWPDRRLSRRGVEIISRRAPRG

SEQ ID NO: 234939 - protein, 19 aa, Mycobacterium bovis
STGPSMGILPAGGVGGPGG

SEQ ID NO: 234940 - protein, 21 aa, Mycobacterium bovis
STSSIPFDAHGGNGGAGGDAG

SEQ ID NO: 234941 - protein, 25 aa, Mycobacterium bovis
SVAKIAFTGAVLGGGGIAMAAQATA

SEQ ID NO: 234942 - protein, 24 aa, Mycobacterium bovis
SVWGGFPAAVSWRSTSEQVHADLG

SEQ ID NO: 234943 - protein, 26 aa, Mycobacterium bovis
SWQQALRGLPGLGQVASAISGGAASM

SEQ ID NO: 234944 - protein, 28 aa, Mycobacterium bovis
TAATEVARIGSALSLASAVAAAQTSAVQ

SEQ ID NO: 234945 - protein, 19 aa, Mycobacterium bovis
TALDAARARLATFQTAVNK

SEQ ID NO: 234946 - protein, 33 aa, Mycobacterium bovis
TAQTPRQNPMWSAARVVMAARAAAALASAAPAG

SEQ ID NO: 234947 - protein, 33 aa, Mycobacterium bovis
TDTGSFRWASVRGYRLAARLVEIGVDNATVSRT

SEQ ID NO: 234948 - protein, 25 aa, Mycobacterium bovis
TEAPDYLPVVLEFAATVDPEAGRRL

SEQ ID NO: 234949 - protein, 18 aa, Mycobacterium bovis
TESLGRFSEVANRALAAT

SEQ ID NO: 234950 - protein, 29 aa, Mycobacterium bovis
TGANGGAGGNAWLFGAGGSGGAGTNGGVG

SEQ ID NO: 234951 - protein, 21 aa, Mycobacterium bovis
TGATGGTGFAGGAGGAGGQGG

SEQ ID NO: 234952 - protein, 21 aa, Mycobacterium bovis
TGATGGTGFSGGAGGAGGAGG

SEQ ID NO: 234953 - protein, 28 aa, Mycobacterium bovis
TGGAGGPGGLIWGGGGAGGVGGAGGGTG

SEQ ID NO: 234954 - protein, 26 aa, Mycobacterium bovis
TGGNGGRAGLLLGVGGMGGNGGATSV

SEQ ID NO: 234955 - protein, 25 aa, Mycobacterium bovis
TGGNGGRGGLLVGNGGAGGAGGVGG

SEQ ID NO: 234956 - protein, 25 aa, Mycobacterium bovis
TGKFEWLDNDVVQWVPDRFWPAHST

SEQ ID NO: 234957 - protein, 24 aa, Mycobacterium bovis
TGQNGGAGGILWGNGGNGGSGAPG

SEQ ID NO: 234958 - protein, 17 aa, Mycobacterium bovis
TILARATPGDGWASLAS

SEQ ID NO: 234959 - protein, 19 aa, Mycobacterium bovis
TKGIPFGSVVTFVVRAGNP

SEQ ID NO: 234960 - protein, 23 aa, Mycobacterium bovis
TKSICPVCKVVVDAQVNIRHDKV

SEQ ID NO: 234961 - protein, 24 aa, Mycobacterium bovis
TQALLGRPLIGDGAVGTASSPDGQ

SEQ ID NO: 234962 - protein, 32 aa, Mycobacterium bovis; identical to SEQ ID NO: 211882

SEQ ID NO: 234963 - protein, 27 aa, Mycobacterium bovis
TQTLLGRPLIGNGADGLPGQNGGAGGL

SEQ ID NO: 234964 - protein, 17 aa, Mycobacterium bovis
TSAVLVVLGACLALWLS

SEQ ID NO: 234965 - protein, 17 aa, Mycobacterium bovis
TSPGGDRLYAFNTNDYR

SEQ ID NO: 234966 - protein, 20 aa, Mycobacterium bovis
TVASCPNTRIVLGGYSQGAT

SEQ ID NO: 234967 - protein, 23 aa, Mycobacterium bovis
TVSSPRAGLVMEKGAKVKYRGIQ

SEQ ID NO: 234968 - protein, 20 aa, Mycobacterium bovis
VAVGAPGQPGGAGGHGGAGG

SEQ ID NO: 234969 - protein, 17 aa, Mycobacterium bovis
VAYSVNWDAIAQCESGG

SEQ ID NO: 234970 - protein, 19 aa, Mycobacterium bovis
VCDCGGLIRPDIVWFGEPL

SEQ ID NO: 234971 - protein, 18 aa, Mycobacterium bovis
VDAFPRGAGRMLAIMHAL

SEQ ID NO: 234972 - protein, 17 aa, Mycobacterium bovis
VEQQVLGLINAPTQALW

SEQ ID NO: 234973 - protein, 17 aa, Mycobacterium bovis
VFGDNGGAGVLGDSTDP

SEQ ID NO: 234974 - protein, 30 aa, Mycobacterium bovis; identical to SEQ ID NO: 211949

SEQ ID NO: 234975 - protein, 25 aa, Mycobacterium bovis
VGALRDGGCNDVILVLGAVEVSAPA

SEQ ID NO: 234976 - protein, 17 aa, Mycobacterium bovis
VGQKVLPQQARKGDLIF

SEQ ID NO: 234977 - protein, 17 aa, Mycobacterium bovis
VHIYLQFDGLDEATHRR

SEQ ID NO: 234978 - protein, 21 aa, Mycobacterium bovis
VITSAAAFALCPNAAADPATP

SEQ ID NO: 234979 - protein, 24 aa, Mycobacterium bovis
VLASLRDLGCRALLMSGRPDEGAL

SEQ ID NO: 234980 - protein, 33 aa, Mycobacterium bovis
VLGLINAPTQALWGRPLIGNGADGTAANPNGGA

SEQ ID NO: 234981 - protein, 25 aa, Mycobacterium bovis
VLLDDRWWFHFALIGVLTALDDLFG

SEQ ID NO: 234982 - protein, 27 aa, Mycobacterium bovis
VLNLLLVDFKGGATFLDLAGAPHVAAV

SEQ ID NO: 234983 - protein, 17 aa, Mycobacterium bovis
VLTNVVWTNHGPCAIDG

SEQ ID NO: 234984 - protein, 19 aa, Mycobacterium bovis
VLVAGCSSNPLANFAPGYP

SEQ ID NO: 234985 - protein, 19 aa, Mycobacterium bovis
VMGAGAWGTALAKVLADAG

SEQ ID NO: 234986 - protein, 17 aa, Mycobacterium bovis
VMVKPDFDVPLFNPKRV

SEQ ID NO: 234987 - protein, 18 aa, Mycobacterium bovis
VNQHDRLRVPIGVTPDGT

SEQ ID NO: 234988 - protein, 17 aa, Mycobacterium bovis
VNTTAWFVMATIRNAVF

SEQ ID NO: 234989 - protein, 19 aa, Mycobacterium bovis
VPLPELPHGLRITDVSLAA

SEQ ID NO: 234990 - protein, 25 aa, Mycobacterium bovis
VRATADPAASGWEALSSALGGKVLQ

SEQ ID NO: 234991 - protein, 26 aa, Mycobacterium bovis
VSAVVASLFARHAQAYQALSLQATAF

SEQ ID NO: 234992 - protein, 26 aa, Mycobacterium bovis
VSDRNRAHWDWLKWLPHNQHPNACDA

SEQ ID NO: 234993 - protein, 21 aa, Mycobacterium bovis
VSLAAVFLALAMGVVLGSGFF

SEQ ID NO: 234994 - protein, 25 aa, Mycobacterium bovis
VSVARFAAALAPRGSGTLLAGRDGS

SEQ ID NO: 234995 - protein, 20 aa, Mycobacterium bovis
VTAMPGLLNNGVLIDESAGI

SEQ ID NO: 234996 - protein, 18 aa, Mycobacterium bovis
VTKDIGYHLTRIASSDRS

SEQ ID NO: 234997 - protein, 19 aa, Mycobacterium bovis
VTLGGTMAKYDWTINGEPY

SEQ ID NO: 234998 - protein, 25 aa, Mycobacterium bovis
VVAVPEALAAAASDVANIGSALSAA

SEQ ID NO: 234999 - protein, 21 aa, Mycobacterium bovis
VVGALKLGLTAPFNIDEVPNV

SEQ ID NO: 235000 - protein, 19 aa, Mycobacterium bovis
VYLRKRCREHGSFEALVYG

SEQ ID NO: 235001 - protein, 24 aa, Mycobacterium bovis
WDDLLRPGIEVITPSPLSSGSAKW

SEQ ID NO: 235002 - protein, 20 aa, Mycobacterium bovis
WDQVARCESGGNWSINTGNG

SEQ ID NO: 235003 - protein, 20 aa, Mycobacterium bovis
WEALSSALGGKVLQPDDGPQ

SEQ ID NO: 235004 - protein, 18 aa, Mycobacterium bovis
WIATLTLELEPTVRLPAN

SEQ ID NO: 235005 - protein, 18 aa, Mycobacterium bovis
WLAEGVADFVARPKTPPP

SEQ ID NO: 235006 - protein, 18 aa, Mycobacterium bovis
WLPLRRLLLDHYPSIERI

SEQ ID NO: 235007 - protein, 17 aa, Mycobacterium bovis
WNLLAPYAAKSDGGRNN

SEQ ID NO: 235008 - protein, 27 aa, Mycobacterium bovis
WRFSVPLVCLLAGLLLAATHGVSGGTE

SEQ ID NO: 235009 - protein, 27 aa, Mycobacterium bovis
YAVAEIAAASPLQSLIDVFNAPIQAAT

SEQ ID NO: 235010 - protein, 31 aa, Mycobacterium bovis
YAVVDVGNGVLLKTEQQVLGVINAPTQTLVG

SEQ ID NO: 235011 - protein, 23 aa, Mycobacterium bovis
YDESACDAWIGRIRCGDTDRVTL

SEQ ID NO: 235012 - protein, 20 aa, Mycobacterium bovis
YFAQGELLPSFVGACQAQVP

SEQ ID NO: 235013 - protein, 22 aa, Mycobacterium bovis
YGVDPLILRQAYPVRQAPYGLA

SEQ ID NO: 235014 - protein, 21 aa, Mycobacterium bovis
YKADFDPYQFLLIPLARITGI

SEQ ID NO: 235015 - protein, 17 aa, Mycobacterium bovis
YMLDMTFPVDYPDQQAL

SEQ ID NO: 235016 - protein, 21 aa, Mycobacterium bovis
YPSMIEFLAPLFTAGAGSNDV

SEQ ID NO: 235017 - protein, 22 aa, Mycobacterium bovis
YQMAVEPIIWRTYAQTLPPDAI

SEQ ID NO: 235018 - protein, 24 aa, Mycobacterium bovis
YSEERLRPPPGYKDTTVPGIFSRD

SEQ ID NO: 235019 - protein, 22 aa, Mycobacterium bovis
YTVQAQKLWAQAGFRPVDPAVA

SEQ ID NO: 235020 - protein, 22 aa, Mycobacterium bovis
YVHSAPWALPALGLENVSHGCI

SEQ ID NO: 235021 - protein, 17 aa, Mycobacterium bovis
YVLEKFATVVMDSSTYG

SEQ ID NO: 235022 - protein, 20 aa, Mycobacterium bovis
YVLHRAWVGPMVLVVLDDPN

SEQ ID NO: 235023 - protein, 17 aa, Mycobacterium bovis
AAAADVASIGAALSAAN

SEQ ID NO: 235024 - protein, 18 aa, Mycobacterium bovis
AAAAEVLAAAGFSVLLLP

SEQ ID NO: 235025 - protein, 36 aa, Mycobacterium bovis
AAGADEVSARIAALFGGFGLEYQAISAQVAAYHQRF

SEQ ID NO: 235026 - protein, 19 aa, Mycobacterium bovis
AAGGLLFGQRWQRRGWRVR

SEQ ID NO: 235027 - protein, 17 aa, Mycobacterium bovis
AAGQLFSASGAAGNAGV

SEQ ID NO: 235028 - protein, 19 aa, Mycobacterium bovis
AAIPRLRRALVAPCTTTIR

SEQ ID NO: 235029 - protein, 38 aa, Mycobacterium bovis
AALTQVGAPYAWGGAAPGGFDCSGLVMWAFQQAGIALP

SEQ ID NO: 235030 - protein, 26 aa, Mycobacterium bovis
AANSWLDAFAHWRRAQGLPATSIAWG

SEQ ID NO: 235031 - protein, 17 aa, Mycobacterium bovis
AAPRSPAPPARPGTAAP

SEQ ID NO: 235032 - protein, 28 aa, Mycobacterium bovis
AARAPRVSAVIKVDWRPGVTDAMTQKVA

SEQ ID NO: 235033 - protein, 17 aa, Mycobacterium bovis
AATVVRAALAIRVSPST

SEQ ID NO: 235034 - protein, 28 aa, Mycobacterium bovis
AAVSPLLDPINEFFLANTGRPLIGNGAN

SEQ ID NO: 235035 - protein, 25 aa, Mycobacterium bovis
AEATAAEQIVLGVINAPTQALLGRP

SEQ ID NO: 235036 - protein, 20 aa, Mycobacterium bovis
AECLHKAAPIVGLPAATRTT

SEQ ID NO: 235037 - protein, 19 aa, Mycobacterium bovis
AEEGLRCHFDAGNYQMAVE

SEQ ID NO: 235038 - protein, 20 aa, Mycobacterium bovis
AEEGLRCHFDAGNYQMAVEP

SEQ ID NO: 235039 - protein, 21 aa, Mycobacterium bovis
AEIGRRPVVVLSRDAAIPRLR

SEQ ID NO: 235040 - protein, 19 aa, Mycobacterium bovis
AEKVRDTFDLARHRAPSAS

SEQ ID NO: 235041 - protein, 26 aa, Mycobacterium bovis
AERYGLRHRIRFGATVVSARFDDGRW

SEQ ID NO: 235042 - protein, 34 aa, Mycobacterium bovis
AGADEVSAAIATLFGSHAREYQAISTQVAAFHDR

SEQ ID NO: 235043 - protein, 30 aa, Mycobacterium bovis
AGADEVSAALASLFSGHAVSYQQVAAQATA

SEQ ID NO: 235044 - protein, 31 aa, Mycobacterium bovis
AGADEVSAALASLFSGHAVSYQQVAAQATAL

SEQ ID NO: 235045 - protein, 29 aa, Mycobacterium bovis
AGADEVSTAIAALFGAHGQAYQALSAQAQ

SEQ ID NO: 235046 - protein, 21 aa, Mycobacterium bovis
AGAFSRPGLPVEYLQVPSPSM

SEQ ID NO: 235047 - protein, 22 aa, Mycobacterium bovis
AGAFSRPGLPVEYLQVPSPSMG

SEQ ID NO: 235048 - protein, 20 aa, Mycobacterium bovis
AGGAAGLWGSGGSGGQGGNG

SEQ ID NO: 235049 - protein, 25 aa, Mycobacterium bovis
AGGAAGQLFSASGAAGNAGVGGAGG

SEQ ID NO: 235050 - protein, 25 aa, Mycobacterium bovis
AGGACGAGGVGADNPTGIGGAGGTG

SEQ ID NO: 235051 - protein, 26 aa, Mycobacterium bovis
AGGAGGAGGWIHGHGGVGGDGGSAGW

SEQ ID NO: 235052 - protein, 27 aa, Mycobacterium bovis
AGGAGGAGGWIHGHGGVGGDGGTGGQG

SEQ ID NO: 235053 - protein, 25 aa, Mycobacterium bovis
AGGAGGRGALLLGAGGQGGLGGAGG

SEQ ID NO: 235054 - protein, 21 aa, Mycobacterium bovis
AGGAGGWIHGHGGVGGDGGSA

SEQ ID NO: 235055 - protein, 17 aa, Mycobacterium bovis
AGGLFGIGGAGGGCGSA

SEQ ID NO: 235056 - protein, 23 aa, Mycobacterium bovis
AGLPDRGLQSWSEFDEWGPELQR

SEQ ID NO: 235057 - protein, 26 aa, Mycobacterium bovis
AGWQGDYPSMIGFLAPLFTAGAGSND

SEQ ID NO: 235058 - protein, 19 aa, Mycobacterium bovis
AHCALWRALIGLDSMERIS

SEQ ID NO: 235059 - protein, 17 aa, Mycobacterium bovis
AIARRSDGKLVLGSADG

SEQ ID NO: 235060 - protein, 28 aa, Mycobacterium bovis
AISAQVAAYHQRFVQASSTGAGAYASAE

SEQ ID NO: 235061 - protein, 29 aa, Mycobacterium bovis
ALANAKRWGVLHVIWRQGYYPGIGAPSWT

SEQ ID NO: 235062 - protein, 18 aa, Mycobacterium bovis
ALASRAGDHVDFLAHDRI

SEQ ID NO: 235063 - protein, 20 aa, Mycobacterium bovis
ALDATITWSSEGIKESVQNA

SEQ ID NO: 235064 - protein, 23 aa, Mycobacterium bovis
APAVPVMRVPPALPVPPYNRRAV

SEQ ID NO: 235065 - protein, 23 aa, Mycobacterium bovis
APGQPGGPGGLLYGNGGNGGNGG

SEQ ID NO: 235066 - protein, 25 aa, Mycobacterium bovis
APPDTTWPHLIVGSLRHAVFSTDSS

SEQ ID NO: 235067 - protein, 25 aa, Mycobacterium bovis
APTQALWGRPLIGNGADGTAANPNG

SEQ ID NO: 235068 - protein, 24 aa, Mycobacterium bovis
APTQLWLGRPLIGDGVHGAPGTGQ

SEQ ID NO: 235069 - protein, 26 aa, Mycobacterium bovis
AQAALFHEQFVHAMTAGAGAYAGAEA

SEQ ID NO: 235070 - protein, 20 aa, Mycobacterium bovis
ARAAAFHHEFVQALAAGAGS

SEQ ID NO: 235071 - protein, 20 aa, Mycobacterium bovis
ARELSGSSNLLFRRNSVSGA

SEQ ID NO: 235072 - protein, 18 aa, Mycobacterium bovis
ARRHGWTFPYLYDETQDV

SEQ ID NO: 235073 - protein, 21 aa, Mycobacterium bovis
ARTADRLKAAGFTVTDVGNLS

SEQ ID NO: 235074 - protein, 30 aa, Mycobacterium bovis; identical to SEQ ID NO: 209135

SEQ ID NO: 235075 - protein, 18 aa, Mycobacterium bovis
ASFVFRHRTGNAVILVLM

SEQ ID NO: 235076 - protein, 19 aa, Mycobacterium bovis
ASGPKYMLDMTFPVDYPDQ

SEQ ID NO: 235077 - protein, 26 aa, Mycobacterium bovis
ASMYRAAAGLHRLCDSLSGAQVRDVA

SEQ ID NO: 235078 - protein, 26 aa, Mycobacterium bovis
ASSPDGQDGGLLFGNGGAGYNSAATP

SEQ ID NO: 235079 - protein, 25 aa, Mycobacterium bovis
ATEVARIGSALSLASAVAAAQTSAV

SEQ ID NO: 235080 - protein, 25 aa, Mycobacterium bovis
ATFPIAAHYFAVFPLAKHMESAGRR

SEQ ID NO: 235081 - protein, 31 aa, Mycobacterium bovis
ATGATGGTGFSLGACGAGGAGGNTGVGGTNG

SEQ ID NO: 235082 - protein, 19 aa, Mycobacterium bovis
AVGAPGQPGGAGGHGGAGG

SEQ ID NO: 235083 - protein, 17 aa, Mycobacterium bovis
AVGELTPSVAALAALAS

SEQ ID NO: 235084 - protein, 30 aa, Mycobacterium bovis
AWAGPVGPAACWRVRTVPPAPPPPAAATAA

SEQ ID NO: 235085 - protein, 26 aa, Mycobacterium bovis
AYSEERLRPPPGYKDTTVPGIFSRDT

SEQ ID NO: 235086 - protein, 22 aa, Mycobacterium bovis
DDLRAIATLTHRGVEGAIVGKA

SEQ ID NO: 235087 - protein, 21 aa, Mycobacterium bovis
DDVHVAPRVIFLPGPAAALTS

SEQ ID NO: 235088 - protein, 23 aa, Mycobacterium bovis
DESVPGRWALTREGGHSRRRIVH

SEQ ID NO: 235089 - protein, 23 aa, Mycobacterium bovis
DEVSAAIAALFSAHGRDFQALSA

SEQ ID NO: 235090 - protein, 20 aa, Mycobacterium bovis
DGGAGGAAFLVGSGGNGGSG

SEQ ID NO: 235091 - protein, 23 aa, Mycobacterium bovis
DGGDGGAGGIFFGTGGTGGAGGV

SEQ ID NO: 235092 - protein, 25 aa, Mycobacterium bovis
DGIPEVWPFAPAKHRAMLANLHPEE

SEQ ID NO: 235093 - protein, 24 aa, Mycobacterium bovis
DGQLQWVSIPAWALCVAFCDRPGG

SEQ ID NO: 235094 - protein, 17 aa, Mycobacterium bovis
DKMRVTLHYSNKYQVPA

SEQ ID NO: 235095 - protein, 24 aa, Mycobacterium bovis
DLARIDVWDGYYCFAAELTSATLE

SEQ ID NO: 235096 - protein, 31 aa, Mycobacterium bovis
DLMRRLREDPPRRLAGFPATVTDIGDTLILT

SEQ ID NO: 235097 - protein, 19 aa, Mycobacterium bovis
DNPTGIGGTGGDGGTGGSA

SEQ ID NO: 235098 - protein, 20 aa, Mycobacterium bovis
DNPTGIGGTGGDGGTGGSAG

SEQ ID NO: 235099 - protein, 18 aa, Mycobacterium bovis
DNRKEFGPALSKLNLVLA

SEQ ID NO: 235100 - protein, 18 aa, Mycobacterium bovis
DQVARCESGGNWSINTGN

SEQ ID NO: 235101 - protein, 25 aa, Mycobacterium bovis
DRCAVGIPTVSGWRMLSGDETGWLL

SEQ ID NO: 235102 - protein, 18 aa, Mycobacterium bovis
DSAFRAGWQGDYPSMIGF

SEQ ID NO: 235103 - protein, 23 aa, Mycobacterium bovis
DSILRVLAMHRFAKAPMLVGGQM

SEQ ID NO: 235104 - protein, 24 aa, Mycobacterium bovis
DSNIEPQTSVLIGTQGGDGTPGGA

SEQ ID NO: 235105 - protein, 27 aa, Mycobacterium bovis
DVGNGVLLKTEQQVLGVINAPTQTLVG

SEQ ID NO: 235106 - protein, 17 aa, Mycobacterium bovis
DVISCRIIVNGAVKDER

SEQ ID NO: 235107 - protein, 24 aa, Mycobacterium bovis
EACECPSGCPSCVQSPKCGNGNDP

SEQ ID NO: 235108 - protein, 22 aa, Mycobacterium bovis
EERKVNALKFIAFVTNPTNTAY

SEQ ID NO: 235109 - protein, 20 aa, Mycobacterium bovis
EFNGRHYAVPYARSTPLFYY

SEQ ID NO: 235110 - protein, 21 aa, Mycobacterium bovis
EFVTAAAGDLTNLGSSISAAN

SEQ ID NO: 235111 - protein, 20 aa, Mycobacterium bovis
EGAAAYGVLVTRADGTRVEV

SEQ ID NO: 235112 - protein, 17 aa, Mycobacterium bovis
EIAANHITQAVLTATNF

SEQ ID NO: 235113 - protein, 19 aa, Mycobacterium bovis
EIDGLLPTLIRGQGTEFDS

SEQ ID NO: 235114 - protein, 25 aa, Mycobacterium bovis
ELTARLNSLGEAWTGGGSDKALAAA

SEQ ID NO: 235115 - protein, 25 aa, Mycobacterium bovis
ESAELCAQYLAPVLDALKFNYLPFG

SEQ ID NO: 235116 - protein, 17 aa, Mycobacterium bovis
ETFVEAWATSHDFMAVT

SEQ ID NO: 235117 - protein, 21 aa, Mycobacterium bovis
EVIAAAATDLASLGSSISAAN

SEQ ID NO: 235118 - protein, 21 aa, Mycobacterium bovis
EVSTAISALFGAHAQAYQALS

SEQ ID NO: 235119 - protein, 21 aa, Mycobacterium bovis
EYQAISTQVAAFHDRFAQTLS

SEQ ID NO: 235120 - protein, 20 aa, Mycobacterium bovis
FAALDARRAALSALISGIDD

SEQ ID NO: 235121 - protein, 23 aa, Mycobacterium bovis
FAALRAGQLVAAWTTTADPDIPA

SEQ ID NO: 235122 - protein, 17 aa, Mycobacterium bovis
FEAARAATVHPMLVAAN

SEQ ID NO: 235123 - protein, 17 aa, Mycobacterium bovis
FEDGGWVWFDITTDTAV

SEQ ID NO: 235124 - protein, 18 aa, Mycobacterium bovis
FEQSRHWSRTYAPGHELK

SEQ ID NO: 235125 - protein, 19 aa, Mycobacterium bovis
FGGNGGNGGTGWISGGGGD

SEQ ID NO: 235126 - protein, 17 aa, Mycobacterium bovis
FGPPGTVADISYFDVNS

SEQ ID NO: 235127 - protein, 18 aa, Mycobacterium bovis
FGQRWQRRGWRVRSNRRQ

SEQ ID NO: 235128 - protein, 26 aa, Mycobacterium bovis
FHLRNRLVVAAMHWDGPKAQVIGLVR

SEQ ID NO: 235129 - protein, 20 aa, Mycobacterium bovis
FIQFHPTMLFAGRAGGRRPL

SEQ ID NO: 235130 - protein, 17 aa, Mycobacterium bovis
FLISACGILTVPKLPDI

SEQ ID NO: 235131 - protein, 22 aa, Mycobacterium bovis
FLTSELPQWLSANRAVKPTGSA

SEQ ID NO: 235132 - protein, 25 aa, Mycobacterium bovis
FNAFPASYWRRWTTCKSVVLRVQVT

SEQ ID NO: 235133 - protein, 17 aa, Mycobacterium bovis
FNIKVIAGAGLFAAAIA

SEQ ID NO: 235134 - protein, 17 aa, Mycobacterium bovis
FPTLSVKLIDAGKDYDE

SEQ ID NO: 235135 - protein, 18 aa, Mycobacterium bovis
FQPRASSMAAALPYCDLF

SEQ ID NO: 235136 - protein, 19 aa, Mycobacterium bovis
FSYQFSFEQSRHWSRTYAP

SEQ ID NO: 235137 - protein, 20 aa, Mycobacterium bovis
GAAGLLGVGGHGGAGGHGAA

SEQ ID NO: 235138 - protein, 21 aa, Mycobacterium bovis
GAAGLLGVGGHGGAGGHGAAG

SEQ ID NO: 235139 - protein, 22 aa, Mycobacterium bovis
GAAGLLGVGGHGGAGGHGAAGI

SEQ ID NO: 235140 - protein, 32 aa, Mycobacterium bovis
GADEVSAAIATLFGSHAREYQAISTQVAAFHD

SEQ ID NO: 235141 - protein, 33 aa, Mycobacterium bovis
GADEVSAAIATLFGSHAREYQAISTQVAAFHDR

SEQ ID NO: 235142 - protein, 29 aa, Mycobacterium bovis
GADEVSAALASLFSGHAVSYQQVAAQATA

SEQ ID NO: 235143 - protein, 30 aa, Mycobacterium bovis
GADEVSIAVAALFGMHGQAYQALSVQASAF

SEQ ID NO: 235144 - protein, 26 aa, Mycobacterium bovis
GAGGAAGQLFSASGAAGNAGVGGAGG

SEQ ID NO: 235145 - protein, 23 aa, Mycobacterium bovis
GAGGAGGLLFGNGGAGAAGAPGQ

SEQ ID NO: 235146 - protein, 25 aa, Mycobacterium bovis
GAGGAGGRGGWLVGSGGNGGNGGNG

SEQ ID NO: 235147 - protein, 28 aa, Mycobacterium bovis
GAGGAPGQCYFQQPAPQGLPIGTRGTGG

SEQ ID NO: 235148 - protein, 17 aa, Mycobacterium bovis
GAGGHAGLFGAGGTGGT

SEQ ID NO: 235149 - protein, 20 aa, Mycobacterium bovis
GAGGLISLLGGQGAGGDGGD

SEQ ID NO: 235150 - protein, 20 aa, Mycobacterium bovis
GAGGNAMLFGAGGAGGAGGG

SEQ ID NO: 235151 - protein, 26 aa, Mycobacterium bovis
GALRDGGCNDVFWCWVLSRCRHRPVS

SEQ ID NO: 235152 - protein, 24 aa, Mycobacterium bovis
GANGGAGGNAWLFGAGGSGGAGTN

SEQ ID NO: 235153 - protein, 25 aa, Mycobacterium bovis
GARLGSGRQYMSWISLEDEVRALQF

SEQ ID NO: 235154 - protein, 23 aa, Mycobacterium bovis
GDEVSAAIAALFGTHAQEYQALS

SEQ ID NO: 235155 - protein, 17 aa, Mycobacterium bovis
GDLTNLGSSISAANASA

SEQ ID NO: 235156 - protein, 24 aa, Mycobacterium bovis
GGAAGQLFSAGGAAGAVGVGGTGG

SEQ ID NO: 235157 - protein, 27 aa, Mycobacterium bovis
GGADALRYPARYLFVFLDHHGMLSVFG

SEQ ID NO: 235158 - protein, 19 aa, Mycobacterium bovis
GGAGGLGKAGFAGGAGGTG

SEQ ID NO: 235159 - protein, 24 aa, Mycobacterium bovis
GGAGGNAGMLFGAAGVGGVGGFSN

SEQ ID NO: 235160 - protein, 23 aa, Mycobacterium bovis
GGAGGSGGWLYGNGGNGGIGGNA

SEQ ID NO: 235161 - protein, 22 aa, Mycobacterium bovis
GGASGAGGWLLGTGGAGGAGGN

SEQ ID NO: 235162 - protein, 33 aa, Mycobacterium bovis
GGDGGEGATGLGLDLSGFAGGQGGQGGAGGNAG

SEQ ID NO: 235163 - protein, 21 aa, Mycobacterium bovis
GGDGNHGRFGGNGGTGGNGGN

SEQ ID NO: 235164 - protein, 18 aa, Mycobacterium bovis
GGEGGIFGGNGGNGGTGW

SEQ ID NO: 235165 - protein, 22 aa, Mycobacterium bovis
GGEITARFLISACGILTVPKLP

SEQ ID NO: 235166 - protein, 17 aa, Mycobacterium bovis
GGENIIGDGGGGGNGGA

SEQ ID NO: 235167 - protein, 28 aa, Mycobacterium bovis
GGGDGGHGGGLFTHGGDGNHGRFGGNGG

SEQ ID NO: 235168 - protein, 20 aa, Mycobacterium bovis
GGGPACRPAELFATDNTTDG

SEQ ID NO: 235169 - protein, 31 aa, Mycobacterium bovis
GGGTGGAGGRAELLFGAGGAGGAGGAGTDGG

SEQ ID NO: 235170 - protein, 17 aa, Mycobacterium bovis
GGHAGLFGAGGTGGTGG

SEQ ID NO: 235171 - protein, 25 aa, Mycobacterium bovis
GGHGGVGGDGGWLAPGGAGGAGGQG

SEQ ID NO: 235172 - protein, 21 aa, Mycobacterium bovis
GGKGGMGGIAGDGGPGGDGGN

SEQ ID NO: 235173 - protein, 20 aa, Mycobacterium bovis
GGNAGTVFGSGGAGGNGGVG

SEQ ID NO: 235174 - protein, 23 aa, Mycobacterium bovis
GGNGGTGGQLWGSGGAGGEGGAA

SEQ ID NO: 235175 - protein, 26 aa, Mycobacterium bovis
GGRGGDGGSAGWLSGNGGDAGTGGGG

SEQ ID NO: 235176 - protein, 17 aa, Mycobacterium bovis
GGSAGWLSGNGGDAGTG

SEQ ID NO: 235177 - protein, 23 aa, Mycobacterium bovis
GGTGGRGGWLAGAGGAGGDGGIG

SEQ ID NO: 235178 - protein, 19 aa, Mycobacterium bovis
GGVGQGFAGGIGGAGGTPG

SEQ ID NO: 235179 - protein, 29 aa, Mycobacterium bovis
GHGGAGGAGGRAWLWGTGGAGGAGAAAIG

SEQ ID NO: 235180 - protein, 18 aa, Mycobacterium bovis
GHSWRKRPATGWESLTPT

SEQ ID NO: 235181 - protein, 19 aa, Mycobacterium bovis
GKAGFSPGPTNFGLNGAGG

SEQ ID NO: 235182 - protein, 24 aa, Mycobacterium bovis
GLGIYRLHSIFGVHEQPTVMVKPD

SEQ ID NO: 235183 - protein, 18 aa, Mycobacterium bovis
GLVRVLPPFLSRKHLPSR

SEQ ID NO: 235184 - protein, 17 aa, Mycobacterium bovis
GMLSAAAADVASIGAAL

SEQ ID NO: 235185 - protein, 19 aa, Mycobacterium bovis
GNAGSFFGAAGTGGAGAST

SEQ ID NO: 235186 - protein, 18 aa, Mycobacterium bovis
GNGAHFSSGGKAGGNGGA

SEQ ID NO: 235187 - protein, 22 aa, Mycobacterium bovis
GNGGAGGLIWGTAGTGGNGGFT

SEQ ID NO: 235188 - protein, 24 aa, Mycobacterium bovis
GNGGNGGNGGWLYGDGGSGGSTLQ

SEQ ID NO: 235189 - protein, 21 aa, Mycobacterium bovis
GPGPRACRVPPASTAATAATA

SEQ ID NO: 235190 - protein, 20 aa, Mycobacterium bovis
GPNGRPRYVTAIDADTATVH

SEQ ID NO: 235191 - protein, 29 aa, Mycobacterium bovis
GQAGGPGGPAGLWGNGGPGGAGGSGGGTG

SEQ ID NO: 235192 - protein, 19 aa, Mycobacterium bovis
GQGDIGFDGARGVNGGPGR

SEQ ID NO: 235193 - protein, 23 aa, Mycobacterium bovis
GQNGGAGGILWGNGGNGGSGAPG

SEQ ID NO: 235194 - protein, 20 aa, Mycobacterium bovis
GREICGMPSSGGVAVAATLG

SEQ ID NO: 235195 - protein, 18 aa, Mycobacterium bovis
GRFALKIGDGRARCTPTD

SEQ ID NO: 235196 - protein, 27 aa, Mycobacterium bovis
GRSAHGWANADLISWTFQGPNWAFGGA

SEQ ID NO: 235197 - protein, 18 aa, Mycobacterium bovis
GRVVSLFDRVEALRVTAL

SEQ ID NO: 235198 - protein, 17 aa, Mycobacterium bovis
GSGPIDFWSSHPGQSSA

SEQ ID NO: 235199 - protein, 22 aa, Mycobacterium bovis
GSLTRTPLMSQLIEKPVAPSVM

SEQ ID NO: 235200 - protein, 24 aa, Mycobacterium bovis
GSLYHAGVKLDWMVATTLLTGRRT

SEQ ID NO: 235201 - protein, 24 aa, Mycobacterium bovis
GSTVCSAGKYARKHVPWVNFSNVP

SEQ ID NO: 235202 - protein, 22 aa, Mycobacterium bovis
GSYFWQHNWGSPKGYTHPAAHL

SEQ ID NO: 235203 - protein, 18 aa, Mycobacterium bovis
GTCRETPDGLVITATPLR

SEQ ID NO: 235204 - protein, 24 aa, Mycobacterium bovis
GTGANGGDGGWLIGNGGAGGSGAA

SEQ ID NO: 235205 - protein, 26 aa, Mycobacterium bovis
GTGANGGPGGWLIGNGGAGGSGAPGA

SEQ ID NO: 235206 - protein, 30 aa, Mycobacterium bovis
GTGGAGGAGGWLFGVGGAGGVGGAGGGTGG

SEQ ID NO: 235207 - protein, 25 aa, Mycobacterium bovis
GTGGKGGAGGTGFAGGAGGAGGQGG

SEQ ID NO: 235208 - protein, 24 aa, Mycobacterium bovis
GVGGAGGLLFGYGGAGGAGGYSNI

SEQ ID NO: 235209 - protein, 26 aa, Mycobacterium bovis
GVGGNGATGPWLFGDGGAGGGGGAGG

SEQ ID NO: 235210 - protein, 21 aa, Mycobacterium bovis
GVRLGLALRRAVVWNSGNENH

SEQ ID NO: 235211 - protein, 18 aa, Mycobacterium bovis
HDRHHRQRRCRRGRRPRR

SEQ ID NO: 235212 - protein, 27 aa, Mycobacterium bovis
HGGVGGDGGSAGWLSGNGGDAGTGGGG

SEQ ID NO: 235213 - protein, 27 aa, Mycobacterium bovis
HGLNAGGLFGVLTNVVWTNHGPCAIDG

SEQ ID NO: 235214 - protein, 25 aa, Mycobacterium bovis
HGNHEPGWVVAPGMQGMQVQPFTAN

SEQ ID NO: 235215 - protein, 17 aa, Mycobacterium bovis
HGVALPEAIPVPHVPPL

SEQ ID NO: 235216 - protein, 20 aa, Mycobacterium bovis
HHGMLSVFGSPTWRTVTGGS

SEQ ID NO: 235217 - protein, 22 aa, Mycobacterium bovis
HRLDSVSLPWSVTVETTLPAVS

SEQ ID NO: 235218 - protein, 25 aa, Mycobacterium bovis
HSARWDHTVPLLGRRIAVIGTGSTG

SEQ ID NO: 235219 - protein, 18 aa, Mycobacterium bovis
ICNHCPYVQHVAAGLATL

SEQ ID NO: 235220 - protein, 20 aa, Mycobacterium bovis
ICSAIQAGSRLGYQESAELC

SEQ ID NO: 235221 - protein, 19 aa, Mycobacterium bovis
IESICAGIIGAGNNLGLLG

SEQ ID NO: 235222 - protein, 25 aa, Mycobacterium bovis
IGGTGGQGGACGAGSSGTDATATGA

SEQ ID NO: 235223 - protein, 17 aa, Mycobacterium bovis
IGLLGAVQTGAWQGPSA

SEQ ID NO: 235224 - protein, 17 aa, Mycobacterium bovis
IGLRGADVTKTFTNIQK

SEQ ID NO: 235225 - protein, 19 aa, Mycobacterium bovis
IIRCLKRARRTGATRIEVT

SEQ ID NO: 235226 - protein, 27 aa, Mycobacterium bovis
INAPFRSALGRPLIGNGANGKPGTGQD

SEQ ID NO: 235227 - protein, 18 aa, Mycobacterium bovis
INTGNGYLGGLQFTQSTW

SEQ ID NO: 235228 - protein, 17 aa, Mycobacterium bovis
IPPRGTQAVVLKVYQNA

SEQ ID NO: 235229 - protein, 18 aa, Mycobacterium bovis
IPPRGTQAVVLKVYQNAG

SEQ ID NO: 235230 - protein, 20 aa, Mycobacterium bovis
IRRSDAPRLVDLVRRAQASV

SEQ ID NO: 235231 - protein, 17 aa, Mycobacterium bovis
ITKYIPLHTPAVVMSIN

SEQ ID NO: 235232 - protein, 24 aa, Mycobacterium bovis
KAPTIDFTLRLGHSSFYPLPDSAF

SEQ ID NO: 235233 - protein, 25 aa, Mycobacterium bovis
KGGAGTLLGLTVFGDNGGAGVLGDS

SEQ ID NO: 235234 - protein, 18 aa, Mycobacterium bovis
KGGENIIGDGGGGGNGGA

SEQ ID NO: 235235 - protein, 24 aa, Mycobacterium bovis
KIVDRPNLFIKIPATKAGLPAISA

SEQ ID NO: 235236 - protein, 20 aa, Mycobacterium bovis
KPQNYPGLPTVSFVIPNADN

SEQ ID NO: 235237 - protein, 21 aa, Mycobacterium bovis
KQYVVRFGLGYREEVHPDLQI

SEQ ID NO: 235238 - protein, 17 aa, Mycobacterium bovis
KSLLAQEFIDHGQPVVE

SEQ ID NO: 235239 - protein, 20 aa, Mycobacterium bovis
KTSEVDWVLERLGRELEALR

SEQ ID NO: 235240 - protein, 18 aa, Mycobacterium bovis
KVGQKVLPQQARKGDLIF

SEQ ID NO: 235241 - protein, 21 aa, Mycobacterium bovis
LALLGRPLIGDGTDAAPGSGG

SEQ ID NO: 235242 - protein, 22 aa, Mycobacterium bovis
LANTGRPLIGNGANGAPGTGAN

SEQ ID NO: 235243 - protein, 23 aa, Mycobacterium bovis
LATQGRGAWPVCGRGLSNATPRE

SEQ ID NO: 235244 - protein, 25 aa, Mycobacterium bovis
LDIDALKGIALYLNFDMLASPNPGY

SEQ ID NO: 235245 - protein, 17 aa, Mycobacterium bovis
LENPQWCARVIGEHGDQ

SEQ ID NO: 235246 - protein, 22 aa, Mycobacterium bovis
LESVKVMRGCLVQSRKTTSVLA

SEQ ID NO: 235247 - protein, 18 aa, Mycobacterium bovis
LFSSYARDYQTLSVQVTA

SEQ ID NO: 235248 - protein, 25 aa, Mycobacterium bovis
LGACLALWLSGCSSPKPDAEEQGVP

SEQ ID NO: 235249 - protein, 24 aa, Mycobacterium bovis
LGLSGCSHPEFKRSSPPAPSLPPV

SEQ ID NO: 235250 - protein, 23 aa, Mycobacterium bovis
LGVRPPVEADWLLLVELAADHDQ

SEQ ID NO: 235251 - protein, 17 aa, Mycobacterium bovis
LHDQFVQALTGAGGSYA

SEQ ID NO: 235252 - protein, 23 aa, Mycobacterium bovis
LHHPRIPPIAGLDDFRGTVFHSA

SEQ ID NO: 235253 - protein, 28 aa, Mycobacterium bovis
LICVLPIALSPWPARAFVMLLVALAVAV

SEQ ID NO: 235254 - protein, 20 aa, Mycobacterium bovis
LKATLKHLACLEYSTVAIQN

SEQ ID NO: 235255 - protein, 18 aa, Mycobacterium bovis
LLALICVLPIALSPWPAR

SEQ ID NO: 235256 - protein, 28 aa, Mycobacterium bovis
LMAGAGPAPMLAAAAGWQTLSAALDAQA

SEQ ID NO: 235257 - protein, 18 aa, Mycobacterium bovis
LPEFPRLWAEMVGPGQGW

SEQ ID NO: 235258 - protein, 17 aa, Mycobacterium bovis
LPLRRLLLDHYPSIERI

SEQ ID NO: 235259 - protein, 17 aa, Mycobacterium bovis
LQVILDRQIMRKLAGHG

SEQ ID NO: 235260 - protein, 24 aa, Mycobacterium bovis
LRLNRARPTPWRVPDVDSLPELVA

SEQ ID NO: 235261 - protein, 21 aa, Mycobacterium bovis
LRNVHIRPGVPPLVIAAPVEL

SEQ ID NO: 235262 - protein, 22 aa, Mycobacterium bovis
LRPIRRLACRRRRFISSSSLTG

SEQ ID NO: 235263 - protein, 17 aa, Mycobacterium bovis
LRPRTVITGQRRWTLPA

SEQ ID NO: 235264 - protein, 24 aa, Mycobacterium bovis
LSELPSHCRGLLVGRVAGAHTPAA

SEQ ID NO: 235265 - protein, 20 aa, Mycobacterium bovis
LSNATPREVLPASAAMDAPL

SEQ ID NO: 235266 - protein, 17 aa, Mycobacterium bovis
LTALVAGGLPMLAAAGL

SEQ ID NO: 235267 - protein, 19 aa, Mycobacterium bovis
LTEMDYFIRMWNQAALAME

SEQ ID NO: 235268 - protein, 18 aa, Mycobacterium bovis
LVAEILRIISGGRLIWDP

SEQ ID NO: 235269 - protein, 18 aa, Mycobacterium bovis
LWAGVAVSDLEFIQFHPT

SEQ ID NO: 235270 - protein, 23 aa, Mycobacterium bovis
MISEANAMAAVRTTALAPAAADE

SEQ ID NO: 235271 - protein, 24 aa, Mycobacterium bovis
MLAMSAPYVEWLERTAAQTKQTAT

SEQ ID NO: 235272 - protein, 25 aa, Mycobacterium bovis
MLAMSAPYVEWLERTAAQTKQTATQ

SEQ ID NO: 235273 - protein, 17 aa, Mycobacterium bovis
MQVCGGPGDSGAPVTVD

SEQ ID NO: 235274 - protein, 19 aa, Mycobacterium bovis
MRVTLHYSNKYQVPATATA

SEQ ID NO: 235275 - protein, 24 aa, Mycobacterium bovis
MYEQMWAADVAAMVGYHGGASAAA

SEQ ID NO: 235276 - protein, 26 aa, Mycobacterium bovis
NAGMFGDGGNGGFSFFDGNGGDGGTG

SEQ ID NO: 235277 - protein, 19 aa, Mycobacterium bovis
NDLPWSVLKQLHAGDSDDG

SEQ ID NO: 235278 - protein, 25 aa, Mycobacterium bovis
NPVEAFQFYFELLLFDYPTHIVQIV

SEQ ID NO: 235279 - protein, 23 aa, Mycobacterium bovis
NRTALDAARARLATFQTAVNKVA

SEQ ID NO: 235280 - protein, 17 aa, Mycobacterium bovis
NSSDGYLLTAHYAVRVT

SEQ ID NO: 235281 - protein, 17 aa, Mycobacterium bovis
NSVAPGYIWGDTLKSYF

SEQ ID NO: 235282 - protein, 17 aa, Mycobacterium bovis
NTRLGIYGKGGTVVFGR

SEQ ID NO: 235283 - protein, 23 aa, Mycobacterium bovis
PALPVPPYNRRAVTAPMAAPGAT

SEQ ID NO: 235284 - protein, 18 aa, Mycobacterium bovis
PAVEELRSPLDQARHDGA

SEQ ID NO: 235285 - protein, 22 aa, Mycobacterium bovis
PDSEAMLLAAIYVAALRSYGFA

SEQ ID NO: 235286 - protein, 30 aa, Mycobacterium bovis
PDSSGLPLRAMVMVLLFLGVVFLLLGWQAL

SEQ ID NO: 235287 - protein, 21 aa, Mycobacterium bovis
PEALAAAASDVANIGSALSAA

SEQ ID NO: 235288 - protein, 18 aa, Mycobacterium bovis
PEPISYTALDRGDLQRAM

SEQ ID NO: 235289 - protein, 25 aa, Mycobacterium bovis
PFDPHLRPGGVIDMSHEMAPTTRLK

SEQ ID NO: 235290 - protein, 27 aa, Mycobacterium bovis
PGTGADGGAGGWLFGNGGNGGSGATGT

SEQ ID NO: 235291 - protein, 27 aa, Mycobacterium bovis
PKFDVPLPTAVRWAMRIPGGKAVHRLL

SEQ ID NO: 235292 - protein, 42 aa, Mycobacterium bovis
PLAHIALASGCCDLAGCVLAAWGWVVMSFVVAVPEALAAAAS

SEQ ID NO: 235293 - protein, 23 aa, Mycobacterium bovis
PLQALQLELLNAINAPTLALLGR

SEQ ID NO: 235294 - protein, 24 aa, Mycobacterium bovis
PNGGNGGDAGMFGNGGAGGAGYSP

SEQ ID NO: 235295 - protein, 24 aa, Mycobacterium bovis
PQLLIDRLSVQRVMAHQMSTQMAR

SEQ ID NO: 235296 - protein, 26 aa, Mycobacterium bovis
PQSARTETWINLQVGDCLADLPPADL

SEQ ID NO: 235297 - protein, 20 aa, Mycobacterium bovis
PRDDWVPFTGVPGYNHIKIK

SEQ ID NO: 235298 - protein, 19 aa, Mycobacterium bovis
PREVLPASAAMDAPLDAAA

SEQ ID NO: 235299 - protein, 20 aa, Mycobacterium bovis
PRLGAAVLVALTTAAAACGA

SEQ ID NO: 235300 - protein, 24 aa, Mycobacterium bovis
PTHPYKPAGPAVMAVMAGWSATAA

SEQ ID NO: 235301 - protein, 21 aa, Mycobacterium bovis
QAIELWKIVDRPNLFIKIPAT

SEQ ID NO: 235302 - protein, 21 aa, Mycobacterium bovis
QAQAFHAQFVQALTSGGGAYA

SEQ ID NO: 235303 - protein, 17 aa, Mycobacterium bovis
QGVRLGRGRGFYDRSLR

SEQ ID NO: 235304 - protein, 19 aa, Mycobacterium bovis
QPYAAIYLHLMRAAVLRRA

SEQ ID NO: 235305 - protein, 23 aa, Mycobacterium bovis
QRDRAKMFALLWQSLRRQRQLLK

SEQ ID NO: 235306 - protein, 18 aa, Mycobacterium bovis
QRGGNLWLSEVFGAELII

SEQ ID NO: 235307 - protein, 17 aa, Mycobacterium bovis
QSVRLGRGRGFYDRSLR

SEQ ID NO: 235308 - protein, 22 aa, Mycobacterium bovis
QTLVGRPLIGDGTHGAPGTGQN

SEQ ID NO: 235309 - protein, 27 aa, Mycobacterium bovis
QVAAFHDRFAQTLSAAVGSYVSAEATN

SEQ ID NO: 235310 - protein, 28 aa, Mycobacterium bovis
QVAAFHDRFAQTLSAAVGSYVSAEATNA

SEQ ID NO: 235311 - protein, 17 aa, Mycobacterium bovis
QVRDAWPPSARAQPHTH

SEQ ID NO: 235312 - protein, 17 aa, Mycobacterium bovis
QYAEMWAQDAAAMYGYA

SEQ ID NO: 235313 - protein, 21 aa, Mycobacterium bovis
RAALRCLKRRLARTVFQALRT

SEQ ID NO: 235314 - protein, 22 aa, Mycobacterium bovis
RAAMPNTVWTTGCDSWYLNKDG

SEQ ID NO: 235315 - protein, 20 aa, Mycobacterium bovis
RARRDLNWRPRFDLNAVAAR

SEQ ID NO: 235316 - protein, 27 aa, Mycobacterium bovis
RDHPDFPAAAARLGSRLSIHDQPNLGG

SEQ ID NO: 235317 - protein, 22 aa, Mycobacterium bovis
RDPLTVFLVLIIVFSLVLAGLI

SEQ ID NO: 235318 - protein, 17 aa, Mycobacterium bovis
RDPRLRRALTPDYEPMC

SEQ ID NO: 235319 - protein, 24 aa, Mycobacterium bovis
REDLPSAIYHRFGRVHTYAKARKT

SEQ ID NO: 235320 - protein, 20 aa, Mycobacterium bovis
REIDGLLPTLIRGQGTEFDS

SEQ ID NO: 235321 - protein, 20 aa, Mycobacterium bovis
RGAGHLGFAGTARREAVADA

SEQ ID NO: 235322 - protein, 29 aa, Mycobacterium bovis
RGRWYRRGRRCRWERGVVVGQRRQRRCRR

SEQ ID NO: 235323 - protein, 17 aa, Mycobacterium bovis
RHHRARASWNYLVTPGQ

SEQ ID NO: 235324 - protein, 17 aa, Mycobacterium bovis
RLATFQTAVNKVAAATY

SEQ ID NO: 235325 - protein, 26 aa, Mycobacterium bovis
RLGIYGKGGTVVFGRGVNAGHSGADG

SEQ ID NO: 235326 - protein, 20 aa, Mycobacterium bovis
RMGRPTIAVNANFFDVRGQK

SEQ ID NO: 235327 - protein, 20 aa, Mycobacterium bovis
RNCRLHWVQIIPTIASQSTP

SEQ ID NO: 235328 - protein, 25 aa, Mycobacterium bovis
RQHAVSLAAVFLALAMGVVLGSGFF

SEQ ID NO: 235329 - protein, 31 aa, Mycobacterium bovis; identical to SEQ ID NO: 210048

SEQ ID NO: 235330 - protein, 31 aa, Mycobacterium bovis
RRSAWRFSVPLVCLLAGLLLAATHGVSGGTE

SEQ ID NO: 235331 - protein, 20 aa, Mycobacterium bovis
RTAQWVLPWPNPRYSKLARV

SEQ ID NO: 235332 - protein, 21 aa, Mycobacterium bovis
RTGHVALRVLHDGTAVTGLLV

SEQ ID NO: 235333 - protein, 17 aa, Mycobacterium bovis
RVNSVAPGYIWGDTLKS

SEQ ID NO: 235334 - protein, 17 aa, Mycobacterium bovis
RVRDPRLRRALTPDYEP

SEQ ID NO: 235335 - protein, 24 aa, Mycobacterium bovis
RVVFAGAYHGWGFHEDGAASGLRA

SEQ ID NO: 235336 - protein, 19 aa, Mycobacterium bovis
SAAIAGLFGAHARQYQALS

SEQ ID NO: 235337 - protein, 24 aa, Mycobacterium bovis
SAASDLGGIASMISEANAMAAVRT

SEQ ID NO: 235338 - protein, 17 aa, Mycobacterium bovis
SAHGRDFQALSARAAAF

SEQ ID NO: 235339 - protein, 18 aa, Mycobacterium bovis
SAHVAAFHDQFVHTLTAG

SEQ ID NO: 235340 - protein, 17 aa, Mycobacterium bovis
SDIVTVVIGADKWREQL

SEQ ID NO: 235341 - protein, 25 aa, Mycobacterium bovis
SFLSQAVKAPTGWPNILPDDFTILD

SEQ ID NO: 235342 - protein, 18 aa, Mycobacterium bovis
SGAGRAGVVPRYGVRLTV

SEQ ID NO: 235343 - protein, 18 aa, Mycobacterium bovis
SGGANFNGGTGGTGGTGG

SEQ ID NO: 235344 - protein, 19 aa, Mycobacterium bovis
SGGNWSINTGNGYLGGLQF

SEQ ID NO: 235345 - protein, 24 aa, Mycobacterium bovis
SGGSGGAGGFGFADGGQGGPGGNA

SEQ ID NO: 235346 - protein, 27 aa, Mycobacterium bovis
SGTEPKLKCYLEIRCAVTGDLPAARQL

SEQ ID NO: 235347 - protein, 24 aa, Mycobacterium bovis
SGWCPHLIATLCIVVGAGHQRHSP

SEQ ID NO: 235348 - protein, 17 aa, Mycobacterium bovis
SIGPLGLAGRQSSQSVP

SEQ ID NO: 235349 - protein, 18 aa, Mycobacterium bovis
SLPEIAANHITQAVLTAT

SEQ ID NO: 235350 - protein, 23 aa, Mycobacterium bovis
SLRLPKLSAKVVVVGGLVVVLAV

SEQ ID NO: 235351 - protein, 22 aa, Mycobacterium bovis
SNIEPQTSVLIGTQGGDGTPGG

SEQ ID NO: 235352 - protein, 23 aa, Mycobacterium bovis
SNIEPQTSVLIGTQGGDGTPGGA

SEQ ID NO: 235353 - protein, 23 aa, Mycobacterium bovis
SPACGKAGCQTYKWETFLTSELP

SEQ ID NO: 235354 - protein, 27 aa, Mycobacterium bovis
SRPLTRVYRALAVIGVLAASLLASWVG

SEQ ID NO: 235355 - protein, 20 aa, Mycobacterium bovis
SRSGGFGGAGGAGGDAGMFF

SEQ ID NO: 235356 - protein, 25 aa, Mycobacterium bovis
STPNRWQVRPGPVAARRWDIEPDLT

SEQ ID NO: 235357 - protein, 24 aa, Mycobacterium bovis
SVAKIAFTGAVLGGGGIAMAAQAT

SEQ ID NO: 235358 - protein, 19 aa, Mycobacterium bovis
SVFGSPTWRTVTGGSANYV

SEQ ID NO: 235359 - protein, 19 aa, Mycobacterium bovis
TASRILASFAPAIPDRSDV

SEQ ID NO: 235360 - protein, 26 aa, Mycobacterium bovis
TATPLRPGIWRAYADHRMAMAGAIIG

SEQ ID NO: 235361 - protein, 30 aa, Mycobacterium bovis
TDAAQPIWWVVRAIEFSKDFETFVQELFVN

SEQ ID NO: 235362 - protein, 30 aa, Mycobacterium bovis
TDSTPPPWVRPVPMAVWAATAARAVTAVVA

SEQ ID NO: 235363 - protein, 24 aa, Mycobacterium bovis
TEALDYLPVVLEFAATVDPEAGRR

SEQ ID NO: 235364 - protein, 34 aa, Mycobacterium bovis
TFPMEFVSFKGGWQLSRQTAEMLLAMGNSPDSTP

SEQ ID NO: 235365 - protein, 26 aa, Mycobacterium bovis
TGGAGGAGFSRALIVAGDNGGDGGNG

SEQ ID NO: 235366 - protein, 26 aa, Mycobacterium bovis
TGGAGGPGGLIWGGGGAGGVGGAGGG

SEQ ID NO: 235367 - protein, 29 aa, Mycobacterium bovis
TGGHGGVGGDGGWLAPGGAGGAGGQGGAG

SEQ ID NO: 235368 - protein, 22 aa, Mycobacterium bovis
TGGKGGMGGIAGDGGPGGDGGN

SEQ ID NO: 235369 - protein, 23 aa, Mycobacterium bovis
TGQPGGAGGLLWGNGGNGGSGAA

SEQ ID NO: 235370 - protein, 17 aa, Mycobacterium bovis
TLALTSSAGAYASAEAT

SEQ ID NO: 235371 - protein, 18 aa, Mycobacterium bovis
TLTGFKWLARADANLPGT

SEQ ID NO: 235372 - protein, 19 aa, Mycobacterium bovis
TLTGRPLIGNGTPGAVGSG

SEQ ID NO: 235373 - protein, 20 aa, Mycobacterium bovis
TPAFEWYYQSGLSIVMPVGG

SEQ ID NO: 235374 - protein, 25 aa, Mycobacterium bovis
TPRYAVGCKRPGFHNTYLSTFNRDN

SEQ ID NO: 235375 - protein, 24 aa, Mycobacterium bovis
TQALLGRPLIGDGANATTPGGAGG

SEQ ID NO: 235376 - protein, 25 aa, Mycobacterium bovis
TQALLGRPLIGDGAVGTASSPDGQD

SEQ ID NO: 235377 - protein, 41 aa, Mycobacterium bovis
TQTLLGRPLIGNGADGLPGQNGGAGGLLWGNGGNGGAGDAA

SEQ ID NO: 235378 - protein, 29 aa, Mycobacterium bovis
TQVAAFHDRFAQTLSAAVGSYVSAEATNA

SEQ ID NO: 235379 - protein, 17 aa, Mycobacterium bovis
TQVLAAGADEVSARIAA

SEQ ID NO: 235380 - protein, 18 aa, Mycobacterium bovis
TSEVDWVLERLGRELEAL

SEQ ID NO: 235381 - protein, 23 aa, Mycobacterium bovis
TSTSSIPFDAHGGNGGAGGDAGH

SEQ ID NO: 235382 - protein, 18 aa, Mycobacterium bovis
TVFGDNGGAGVLGDSTDP

SEQ ID NO: 235383 - protein, 21 aa, Mycobacterium bovis
TYPTLCRLFAELGVATQESEM

SEQ ID NO: 235384 - protein, 26 aa, Mycobacterium bovis
VAEELGQPLPLFIKWDDADYGLRAAE

SEQ ID NO: 235385 - protein, 18 aa, Mycobacterium bovis
VASDRGAGHLGFAGTARR

SEQ ID NO: 235386 - protein, 22 aa, Mycobacterium bovis
VASTWSVCKGLAAVVITSAAAF

SEQ ID NO: 235387 - protein, 20 aa, Mycobacterium bovis
VEAPTGWPNILPDDFTILDG

SEQ ID NO: 235388 - protein, 17 aa, Mycobacterium bovis
VFEKLASILGLVAAPLM

SEQ ID NO: 235389 - protein, 24 aa, Mycobacterium bovis
VFQRTPIWCFPKFDVPLPTAVRWA

SEQ ID NO: 235390 - protein, 18 aa, Mycobacterium bovis
VGGTRWVVYEGSDENGAV

SEQ ID NO: 235391 - protein, 20 aa, Mycobacterium bovis
VGGTWHWNTYPGIAVDIPSF

SEQ ID NO: 235392 - protein, 22 aa, Mycobacterium bovis
VITSAAAFALCPNAAADPATPQ

SEQ ID NO: 235393 - protein, 56 aa, Mycobacterium bovis
VLAAGADEVSARIAALFGGFGLEYQAISAQVAAYHQRFVQASSTGAGAYASAEATA

SEQ ID NO: 235394 - protein, 27 aa, Mycobacterium bovis
VLNGPFQALFGRPLIGDGANGAPGQPG

SEQ ID NO: 235395 - protein, 17 aa, Mycobacterium bovis
VMSFVVAVPEALAAAAS

SEQ ID NO: 235396 - protein, 18 aa, Mycobacterium bovis
VMVKPDFDVPLFNPKRVT

SEQ ID NO: 235397 - protein, 24 aa, Mycobacterium bovis
VNTHCNLDCPICFADSGHQPDGYA

SEQ ID NO: 235398 - protein, 25 aa, Mycobacterium bovis
VNTHCNLDCPICFADSGHQPDGYAI

SEQ ID NO: 235399 - protein, 18 aa, Mycobacterium bovis
VNTTAWFVMATIRNAVFL

SEQ ID NO: 235400 - protein, 26 aa, Mycobacterium bovis
VPDSPEALPLLFGHIGEGNLHLNVLR

SEQ ID NO: 235401 - protein, 20 aa, Mycobacterium bovis
VPLPELPHGLRITDVSLAAD

SEQ ID NO: 235402 - protein, 18 aa, Mycobacterium bovis
VPVVKVLAPGLVLSSASP

SEQ ID NO: 235403 - protein, 19 aa, Mycobacterium bovis
VQNAIPILGAFVTSSVVTH

SEQ ID NO: 235404 - protein, 18 aa, Mycobacterium bovis
VRDVACRRDFEDVALTLV

SEQ ID NO: 235405 - protein, 21 aa, Mycobacterium bovis
VSAAVADLFGAHAQAYQALSA

SEQ ID NO: 235406 - protein, 24 aa, Mycobacterium bovis
VSVARFAAALAPRGSGTLLAGRDG

SEQ ID NO: 235407 - protein, 20 aa, Mycobacterium bovis
VTLGGTMAKYDWTINGEPHS

SEQ ID NO: 235408 - protein, 23 aa, Mycobacterium bovis
VTLPGAAIWHMAWSDKDDAIDWQ

SEQ ID NO: 235409 - protein, 24 aa, Mycobacterium bovis
VVGCILLAGLVGMCSFQLGGTKRG

SEQ ID NO: 235410 - protein, 17 aa, Mycobacterium bovis
VVIARGLSQRGVPFSWA

SEQ ID NO: 235411 - protein, 26 aa, Mycobacterium bovis
VVLLDDRWWFHFALIGVLTALDDLFG

SEQ ID NO: 235412 - protein, 21 aa, Mycobacterium bovis
VVLTSCTWRGIANVPLPVGRG

SEQ ID NO: 235413 - protein, 27 aa, Mycobacterium bovis
VVVSLAGSGWCGWVLFEKHQTDVAAGQ

SEQ ID NO: 235414 - protein, 24 aa, Mycobacterium bovis
VWLATVCLVASCANADPLGSATGS

SEQ ID NO: 235415 - protein, 18 aa, Mycobacterium bovis
WADEVYVFGYPRVPMTAE

SEQ ID NO: 235416 - protein, 17 aa, Mycobacterium bovis
WDGPKAQVIGLVRSHLK

SEQ ID NO: 235417 - protein, 19 aa, Mycobacterium bovis
WDIEPDLTNAVAFLSAAVV

SEQ ID NO: 235418 - protein, 18 aa, Mycobacterium bovis
WEPPMFEMDTTGLASGNC

SEQ ID NO: 235419 - protein, 23 aa, Mycobacterium bovis
WLATVCLVASCANADPLGSATGS

SEQ ID NO: 235420 - protein, 21 aa, Mycobacterium bovis
WPVCGRGLSNATPREVLPASA

SEQ ID NO: 235421 - protein, 17 aa, Mycobacterium bovis
WTCMIPRQVAEELGQPL

SEQ ID NO: 235422 - protein, 17 aa, Mycobacterium bovis
WTTCKSVVLRVQVTGAG

SEQ ID NO: 235423 - protein, 24 aa, Mycobacterium bovis
YAGALGARGLFACRQSLRPRYLCM

SEQ ID NO: 235424 - protein, 29 aa, Mycobacterium bovis
YASAEAAAAEQIVLGVINAPTQALLGRPL

SEQ ID NO: 235425 - protein, 30 aa, Mycobacterium bovis
YASAEAAAAEQIVLGVINAPTQALLGRPLI

SEQ ID NO: 235426 - protein, 29 aa, Mycobacterium bovis
YASAEATAAEQIVLGVINAPTQALLGRPL

SEQ ID NO: 235427 - protein, 30 aa, Mycobacterium bovis
YASAEATAAEQIVLGVINAPTQALLGRPLI

SEQ ID NO: 235428 - protein, 46 aa, Mycobacterium bovis
YASAEATAAEQIVLGVINAPTQALLGRPLIGDGANATTPGGAGGAG

SEQ ID NO: 235429 - protein, 18 aa, Mycobacterium bovis
YAVPYARSTPLFYYNKAA

SEQ ID NO: 235430 - protein, 18 aa, Mycobacterium bovis
YAVVDVGNGVLLKTEQQV

SEQ ID NO: 235431 - protein, 17 aa, Mycobacterium bovis
YDAEWIIILDDWTDGIG

SEQ ID NO: 235432 - protein, 26 aa, Mycobacterium bovis
YEPMCKRLVMSGGFYRAIQRDDVELV

SEQ ID NO: 235433 - protein, 23 aa, Mycobacterium bovis
YEQMWAADVAAMVGYHGGASAAA

SEQ ID NO: 235434 - protein, 21 aa, Mycobacterium bovis
YFAQGELLPSFVGACQAQVPR

SEQ ID NO: 235435 - protein, 19 aa, Mycobacterium bovis
YFIRMWNQAALAMEVYQAE

SEQ ID NO: 235436 - protein, 23 aa, Mycobacterium bovis
YGVDPLILRQAYPVRQAPYGLAG

SEQ ID NO: 235437 - protein, 18 aa, Mycobacterium bovis
YIQRAAGVRRCAGSVRVA

SEQ ID NO: 235438 - protein, 21 aa, Mycobacterium bovis
YPNFFTVFGPYGYVGSSYFAL

SEQ ID NO: 235439 - protein, 19 aa, Mycobacterium bovis
YQAISTQVAAFHDRFAQTL

SEQ ID NO: 235440 - protein, 20 aa, Mycobacterium bovis
YQAISTQVAAFHDRFAQTLS

SEQ ID NO: 235441 - protein, 17 aa, Mycobacterium bovis
YQALSARVATFHEQFVR

SEQ ID NO: 235442 - protein, 26 aa, Mycobacterium bovis
YSVLPGPLVATVFDLVFQPGKLPDSL

SEQ ID NO: 235443 - protein, 24 aa, Mycobacterium bovis
YVAAHAPYLAWLMRASETSAEAAA

SEQ ID NO: 235444 - protein, 18 aa, Mycobacterium bovis
YYVLEKFATVVMDSSTYG

SEQ ID NO: 235445 - protein, 21 aa, Mycobacterium bovis
GNGGDGDGFIGGSGGTGGTGG

SEQ ID NO: 235446 - protein, 18 aa, Mycobacterium bovis
DGGNAGFGAGVPGDGGIG

SEQ ID NO: 235447 - protein, 25 aa, Mycobacterium bovis
GGHGGVGGDGGWLAPGGAGGAGGQG

SEQ ID NO: 235448 - protein, 18 aa, Mycobacterium bovis
YYWCPGQPFDPAWGPNWD

SEQ ID NO: 235449 - protein, 35 aa, Mycobacterium bovis
AAGADEVSARIAALFGGFGLEYQAISAQVAAYHQR

SEQ ID NO: 235450 - protein, 24 aa, Mycobacterium bovis
AGGAGGRGALLLGAGGQGGLGGAG

SEQ ID NO: 235451 - protein, 25 aa, Mycobacterium bovis
GGAGGPGGLIWGGGGAGGVGGAGGG

SEQ ID NO: 235452 - protein, 27 aa, Mycobacterium bovis
GTGGAGGRAELLFGAGGAGGAGGAGTD

SEQ ID NO: 235453 - protein, 20 aa, Mycobacterium bovis
PGATGGTGFAGGAGGAGGAG

SEQ ID NO: 235454 - protein, 27 aa, Mycobacterium bovis
SAQVAAYHQRFVQALSTGAGAYASAEA

SEQ ID NO: 235455 - protein, 27 aa, Mycobacterium bovis
TGGAGGAGGWLFGVGGAGGVGGAGGGT

SEQ ID NO: 235456 - protein, 23 aa, Mycobacterium bovis
TQALLGRPLIGDGANATTPGGAG

SEQ ID NO: 235457 - protein, 17 aa, Mycobacterium bovis
AAARLGSDMGEFYMPYP

SEQ ID NO: 235458 - protein, 17 aa, Mycobacterium bovis
AAATVVWCAGMRASRLT

SEQ ID NO: 235459 - protein, 19 aa, Mycobacterium bovis
AAECRRVGVPDARCVLPLA

SEQ ID NO: 235460 - protein, 18 aa, Mycobacterium bovis
AAGYLCWRGKDLATPRGW

SEQ ID NO: 235461 - protein, 19 aa, Mycobacterium bovis
AANITRLPVRYTFDNRYFS

SEQ ID NO: 235462 - protein, 18 aa, Mycobacterium bovis
AAQALAFVRQRHGLDNGD

SEQ ID NO: 235463 - protein, 18 aa, Mycobacterium bovis
AARNSAGFGAPRYGVKPI

SEQ ID NO: 235464 - protein, 17 aa, Mycobacterium bovis
AATGMVFAVFADDDSLA

SEQ ID NO: 235465 - protein, 17 aa, Mycobacterium bovis
AAVAAVFSSYAQQYQAL

SEQ ID NO: 235466 - protein, 19 aa, Mycobacterium bovis
ACLALWLSGCSSPKPDAEE

SEQ ID NO: 235467 - protein, 25 aa, Mycobacterium bovis
ADEVSAAIATLFGSHAREYQAISTQ

SEQ ID NO: 235468 - protein, 24 aa, Mycobacterium bovis
ADEVSVLIAALFEAYAQEYQALSA

SEQ ID NO: 235469 - protein, 20 aa, Mycobacterium bovis
AEGRLGWRTLDFEVEVLPIG

SEQ ID NO: 235470 - protein, 18 aa, Mycobacterium bovis
AELLRPGLLVLPVRGPAR

SEQ ID NO: 235471 - protein, 17 aa, Mycobacterium bovis
AELPDWLAANRGLAPGG

SEQ ID NO: 235472 - protein, 29 aa, Mycobacterium bovis
AERCGSPAWDLPTVFGPIAITYNIKGVST

SEQ ID NO: 235473 - protein, 17 aa, Mycobacterium bovis
AGDCGRDYRVLSAALLE

SEQ ID NO: 235474 - protein, 20 aa, Mycobacterium bovis
AGDRGGAGGTGFISSDGGAG

SEQ ID NO: 235475 - protein, 20 aa, Mycobacterium bovis
AGGAGGWIHGHGGAGGDGGA

SEQ ID NO: 235476 - protein, 19 aa, Mycobacterium bovis
AGGKCPDVLMAWELTYAEL

SEQ ID NO: 235477 - protein, 22 aa, Mycobacterium bovis
AGGNARLWGVGGAGGAGGDGGA

SEQ ID NO: 235478 - protein, 20 aa, Mycobacterium bovis
AGGSGAWLYGNGGAAGAGGN

SEQ ID NO: 235479 - protein, 19 aa, Mycobacterium bovis
AGGSGGWLLGNGGVGGAGG

SEQ ID NO: 235480 - protein, 20 aa, Mycobacterium bovis
AGGSGGWLLGNGGVGGAGGQ

SEQ ID NO: 235481 - protein, 20 aa, Mycobacterium bovis
AGGTGGWLFGNGGAGGTGGA

SEQ ID NO: 235482 - protein, 18 aa, Mycobacterium bovis
AGKMTNWAIARPPGQTQA

SEQ ID NO: 235483 - protein, 18 aa, Mycobacterium bovis
AGQQCDRLAAVLMPDTAT

SEQ ID NO: 235484 - protein, 24 aa, Mycobacterium bovis
AIDLLKGVLMPSIMQAVQNGGAAA

SEQ ID NO: 235485 - protein, 18 aa, Mycobacterium bovis
AKMLRLNAGLGNVGNYNV

SEQ ID NO: 235486 - protein, 19 aa, Mycobacterium bovis
ALLGRPLIGDGANGGPGQD

SEQ ID NO: 235487 - protein, 19 aa, Mycobacterium bovis
ALLGRPLIGNGADGAAGTG

SEQ ID NO: 235488 - protein, 18 aa, Mycobacterium bovis
ALLPEWRTELPLRYLESV

SEQ ID NO: 235489 - protein, 19 aa, Mycobacterium bovis
ALNLVKCVHWPSSSPPQPP

SEQ ID NO: 235490 - protein, 30 aa, Mycobacterium bovis
ALPRRPKFALLKGRRNYLCLNKIHNSVTAS

SEQ ID NO: 235491 - protein, 18 aa, Mycobacterium bovis
ALPSRLCTPGFGPIGVCI

SEQ ID NO: 235492 - protein, 23 aa, Mycobacterium bovis
ALTYPRRLGFGLGSSVVSLSWRT

SEQ ID NO: 235493 - protein, 19 aa, Mycobacterium bovis
ANGNFAFGDGNGGHGGNGG

SEQ ID NO: 235494 - protein, 17 aa, Mycobacterium bovis
APGGWLLGDGGAGGSGA

SEQ ID NO: 235495 - protein, 24 aa, Mycobacterium bovis
APTQALWGRPLIGNGADGTAANPN

SEQ ID NO: 235496 - protein, 18 aa, Mycobacterium bovis
AQLAPWAQAVRALPNPTA

SEQ ID NO: 235497 - protein, 17 aa, Mycobacterium bovis
ARTETWINLQVGDCLAD

SEQ ID NO: 235498 - protein, 24 aa, Mycobacterium bovis
ASAQAAAFYAQFVQALSAGGGAYA

SEQ ID NO: 235499 - protein, 17 aa, Mycobacterium bovis
ASFGETFASGPYFKVLL

SEQ ID NO: 235500 - protein, 18 aa, Mycobacterium bovis
ATDGRFRFLRVYPNPEVY

SEQ ID NO: 235501 - protein, 18 aa, Mycobacterium bovis
ATGGTGFAGGAGGAGGAG

SEQ ID NO: 235502 - protein, 24 aa, Mycobacterium bovis
AVTAAEVPLAFALAAGSFRDATRV

SEQ ID NO: 235503 - protein, 17 aa, Mycobacterium bovis
CGFKPGFPMAEWASKRR

SEQ ID NO: 235504 - protein, 17 aa, Mycobacterium bovis
CSVPGAWPPVTIAGRRY

SEQ ID NO: 235505 - protein, 18 aa, Mycobacterium bovis
CVDRMGFSFLANIGTASV

SEQ ID NO: 235506 - protein, 21 aa, Mycobacterium bovis
CWPTPRPPMRIWPRRFDAPPG

SEQ ID NO: 235507 - protein, 17 aa, Mycobacterium bovis
DAEVVFARGRFEPPGIG

SEQ ID NO: 235508 - protein, 26 aa, Mycobacterium bovis
DAGLFGFGGDGGWGGRGVDARFGAAG

SEQ ID NO: 235509 - protein, 22 aa, Mycobacterium bovis
DAGPPQRWFVVWLGTANNPVDK

SEQ ID NO: 235510 - protein, 19 aa, Mycobacterium bovis
DAHGVPFLGIRGMSDGPGD

SEQ ID NO: 235511 - protein, 23 aa, Mycobacterium bovis
DDYLRVIGVPAMFAAGDVAAARM

SEQ ID NO: 235512 - protein, 17 aa, Mycobacterium bovis
DEVWPAVVFTLVTLLDD

SEQ ID NO: 235513 - protein, 20 aa, Mycobacterium bovis
DGASGLGLGLSGFDGGQGGQ

SEQ ID NO: 235514 - protein, 17 aa, Mycobacterium bovis
DGGNAGFGAGVPGDGGI

SEQ ID NO: 235515 - protein, 18 aa, Mycobacterium bovis
DGLNRVSAILARDKDNLG

SEQ ID NO: 235516 - protein, 17 aa, Mycobacterium bovis
DGLPMLCLGARGWQPGW

SEQ ID NO: 235517 - protein, 17 aa, Mycobacterium bovis
DGLRWSTTEQLGYNRRY

SEQ ID NO: 235518 - protein, 24 aa, Mycobacterium bovis
DGLTLGEALALWLSGQEQLMPRDL

SEQ ID NO: 235519 - protein, 17 aa, Mycobacterium bovis
DKFPRMVDYVVPTGVRI

SEQ ID NO: 235520 - protein, 18 aa, Mycobacterium bovis
DKIARMLLIWAALAAVAL

SEQ ID NO: 235521 - protein, 24 aa, Mycobacterium bovis
DLKRSCLDIGLAERVLGWRPQIEL

SEQ ID NO: 235522 - protein, 22 aa, Mycobacterium bovis
DPPVEGGWAWLPDEAQGARVHW

SEQ ID NO: 235523 - protein, 18 aa, Mycobacterium bovis
DPSRPVACIVRVRATNGS

SEQ ID NO: 235524 - protein, 17 aa, Mycobacterium bovis
DRWRLAQILTFQAVDAV

SEQ ID NO: 235525 - protein, 25 aa, Mycobacterium bovis
EDFWRSAGLPAYRWPDPNGTRFPNG

SEQ ID NO: 235526 - protein, 17 aa, Mycobacterium bovis
EFAEAGWALPLSDDPAG

SEQ ID NO: 235527 - protein, 18 aa, Mycobacterium bovis
EFLSCFLGLMLHGAVPVP

SEQ ID NO: 235528 - protein, 24 aa, Mycobacterium bovis
EFNVALPWRKEVSLSKSSLHPASV

SEQ ID NO: 235529 - protein, 18 aa, Mycobacterium bovis
EFPIHWTSTGGIGPIIIP

SEQ ID NO: 235530 - protein, 21 aa, Mycobacterium bovis
EGHSMFPWLTLALVGNSTSSI

SEQ ID NO: 235531 - protein, 19 aa, Mycobacterium bovis
EGLPSVFVYDGYPGGAGFA

SEQ ID NO: 235532 - protein, 17 aa, Mycobacterium bovis
EHHEFKQAAVLTDLPGE

SEQ ID NO: 235533 - protein, 22 aa, Mycobacterium bovis
ELGLRPRLAIGIHQPGVGALRP

SEQ ID NO: 235534 - protein, 18 aa, Mycobacterium bovis
ELPGRLHALFARGDGVTP

SEQ ID NO: 235535 - protein, 30 aa, Mycobacterium bovis
EQDLLAAINARFERIFGRPLIGDGANGGPG

SEQ ID NO: 235536 - protein, 24 aa, Mycobacterium bovis
EVSLAISALFGQHAQAYQALSAQA

SEQ ID NO: 235537 - protein, 21 aa, Mycobacterium bovis
EVSTAIAALFGAQGQAYQAAS

SEQ ID NO: 235538 - protein, 18 aa, Mycobacterium bovis
EWFCLFSSAAALVGSPGQ

SEQ ID NO: 235539 - protein, 19 aa, Mycobacterium bovis
FAALSARAVALGFDTVATG

SEQ ID NO: 235540 - protein, 17 aa, Mycobacterium bovis
FARERSRWLFSNPEMTH

SEQ ID NO: 235541 - protein, 19 aa, Mycobacterium bovis
FEEGLRTTIDWYRDNESWW

SEQ ID NO: 235542 - protein, 24 aa, Mycobacterium bovis
FGFAVIVYLVWRFIVPLVGRLMSA

SEQ ID NO: 235543 - protein, 17 aa, Mycobacterium bovis
FGGPGLAGGLFGNPGNG

SEQ ID NO: 235544 - protein, 19 aa, Mycobacterium bovis
FGSHAREYQAISTQVAAFH

SEQ ID NO: 235545 - protein, 19 aa, Mycobacterium bovis
FLRRFSLLDSLYMVPSVPI

SEQ ID NO: 235546 - protein, 21 aa, Mycobacterium bovis
FMPNFALEWLINAYHRRGADI

SEQ ID NO: 235547 - protein, 22 aa, Mycobacterium bovis
FNRNTWGVAMIGNFDDVAPTPI

SEQ ID NO: 235548 - protein, 21 aa, Mycobacterium bovis
FRNGDPFIWDRGRELGMVNRL

SEQ ID NO: 235549 - protein, 19 aa, Mycobacterium bovis
FRYVWASDHLQPWQDNEGH

SEQ ID NO: 235550 - protein, 19 aa, Mycobacterium bovis
FYTCLYRSLLHPNTFNDVD

SEQ ID NO: 235551 - protein, 19 aa, Mycobacterium bovis
GAAPGGFDCSGLVMWAFQQ

SEQ ID NO: 235552 - protein, 25 aa, Mycobacterium bovis
GADEVSAAIAALFGAHGQAYQTVSA

SEQ ID NO: 235553 - protein, 18 aa, Mycobacterium bovis
GAGGAAFSINFTAGDGGA

SEQ ID NO: 235554 - protein, 23 aa, Mycobacterium bovis
GAGGAGFSRALIVAGDNGGDGGN

SEQ ID NO: 235555 - protein, 21 aa, Mycobacterium bovis
GAGGSARLIGAGGHGGDGGAG

SEQ ID NO: 235556 - protein, 23 aa, Mycobacterium bovis
GAIARLPAIFTHRDVGNTDCPGN

SEQ ID NO: 235557 - protein, 19 aa, Mycobacterium bovis
GAIYQRWQALGGMNSALGA

SEQ ID NO: 235558 - protein, 19 aa, Mycobacterium bovis
GALSSWYVWAALGLYPSTP

SEQ ID NO: 235559 - protein, 20 aa, Mycobacterium bovis
GAPCSSWERFIFGRGPSGQA

SEQ ID NO: 235560 - protein, 18 aa, Mycobacterium bovis
GAPGGWLLGNGGAGGSAA

SEQ ID NO: 235561 - protein, 19 aa, Mycobacterium bovis
GCGVSWNLLAGIGRIESMH

SEQ ID NO: 235562 - protein, 17 aa, Mycobacterium bovis
GDAGMLFGSGGSGGAGG

SEQ ID NO: 235563 - protein, 19 aa, Mycobacterium bovis
GDKGEPCWPDGVVGSLTHC

SEQ ID NO: 235564 - protein, 17 aa, Mycobacterium bovis
GEMWAQDALAMYGYAAS

SEQ ID NO: 235565 - protein, 19 aa, Mycobacterium bovis
GFDISARMGAAISDAAPQL

SEQ ID NO: 235566 - protein, 26 aa, Mycobacterium bovis
GFGGNGFAGVGGRGGMGGSGGTGGTG

SEQ ID NO: 235567 - protein, 23 aa, Mycobacterium bovis
GGAAGPAGWLFGDGGAGGNGGAA

SEQ ID NO: 235568 - protein, 19 aa, Mycobacterium bovis
GGAAGWLYGSGGAGGAGGL

SEQ ID NO: 235569 - protein, 22 aa, Mycobacterium bovis
GGAGGDGGWLFGDGGAGGTGGN

SEQ ID NO: 235570 - protein, 21 aa, Mycobacterium bovis
GGAGGFGFLGGDGGAGGNAGL

SEQ ID NO: 235571 - protein, 22 aa, Mycobacterium bovis
GGAGGNGAWLFGNGGAGGGGGK

SEQ ID NO: 235572 - protein, 19 aa, Mycobacterium bovis
GGGGFSILLGLGGLGGLGS

SEQ ID NO: 235573 - protein, 21 aa, Mycobacterium bovis
GGGSFGLPGLNGSGGDGGDGG

SEQ ID NO: 235574 - protein, 18 aa, Mycobacterium bovis
GGLFGVLTNVVWTNHGPC

SEQ ID NO: 235575 - protein, 18 aa, Mycobacterium bovis
GGMLRRMRPLFSVGLGAR

SEQ ID NO: 235576 - protein, 22 aa, Mycobacterium bovis
GGNGGAGGWLFGNGGAGGAGGL

SEQ ID NO: 235577 - protein, 22 aa, Mycobacterium bovis
GGNGGAGGWLYGNGGAGGAGGT

SEQ ID NO: 235578 - protein, 24 aa, Mycobacterium bovis
GGNGGRGAVLFGHGGNAGHGGAGG

SEQ ID NO: 235579 - protein, 17 aa, Mycobacterium bovis
GHEWKFAITKNGRHSLT

SEQ ID NO: 235580 - protein, 23 aa, Mycobacterium bovis
GILCGSIVSGLRMRPGNWAGIYA

SEQ ID NO: 235581 - protein, 23 aa, Mycobacterium bovis
GIPKAAGVEAIFRLDECPRGLYS

SEQ ID NO: 235582 - protein, 24 aa, Mycobacterium bovis
GKGGDTPNGLAINPGIGGNGGDTG

SEQ ID NO: 235583 - protein, 17 aa, Mycobacterium bovis
GLGGWLWGNNGAAGTGD

SEQ ID NO: 235584 - protein, 36 aa, Mycobacterium bovis
GLGRRSASAISGWAMRAAPTLAWPTWVWATSGSPTP

SEQ ID NO: 235585 - protein, 26 aa, Mycobacterium bovis
GNFSNGVLWRGDYEGLWGLSGGSTIP

SEQ ID NO: 235586 - protein, 17 aa, Mycobacterium bovis
GPAGSILHDGGNGGHGG

SEQ ID NO: 235587 - protein, 18 aa, Mycobacterium bovis
GPQALSFVRQRHDLPRGD

SEQ ID NO: 235588 - protein, 19 aa, Mycobacterium bovis
GQNGGAGGLLWGNGGNGGA

SEQ ID NO: 235589 - protein, 18 aa, Mycobacterium bovis
GRAAVPWWPWAPLVRLMW

SEQ ID NO: 235590 - protein, 17 aa, Mycobacterium bovis
GRGRWLAIAASLVVSAA

SEQ ID NO: 235591 - protein, 19 aa, Mycobacterium bovis
GRGVDARFGAAGGAAGAGG

SEQ ID NO: 235592 - protein, 19 aa, Mycobacterium bovis
GRLLGWRLGMDDVDPRSMV

SEQ ID NO: 235593 - protein, 18 aa, Mycobacterium bovis
GRSVSRWGAFLDDVGGFD

SEQ ID NO: 235594 - protein, 19 aa, Mycobacterium bovis
GSAARLFGGGGAGGAGGTG

SEQ ID NO: 235595 - protein, 18 aa, Mycobacterium bovis
GSMIIQFVVKTLVAMLDW

SEQ ID NO: 235596 - protein, 23 aa, Mycobacterium bovis
GTAFLAARGGYFVADLSSGHTAR

SEQ ID NO: 235597 - protein, 25 aa, Mycobacterium bovis
GTGADGGAGGWLFGNGGNGGQGTIG

SEQ ID NO: 235598 - protein, 18 aa, Mycobacterium bovis
GTGGQLWGSGGAGGEGGA

SEQ ID NO: 235599 - protein, 26 aa, Mycobacterium bovis
HGGAGGAGGRAWLWGTGGAGGAGAAA

SEQ ID NO: 235600 - protein, 24 aa, Mycobacterium bovis
HQKLCEVYKLAARAVQIATNGDNP

SEQ ID NO: 235601 - protein, 24 aa, Mycobacterium bovis
HSNALWCRWCLGYAQLMRGELAAA

SEQ ID NO: 235602 - protein, 19 aa, Mycobacterium bovis
IAGRLGLRPDVRRMPLFGL

SEQ ID NO: 235603 - protein, 18 aa, Mycobacterium bovis
IDNLRAAFVWNRENSDTE

SEQ ID NO: 235604 - protein, 17 aa, Mycobacterium bovis
IDRLPNGVFLDWQQFQE

SEQ ID NO: 235605 - protein, 24 aa, Mycobacterium bovis
IDVSGGLPAFTLFPGGLNIPQNAI

SEQ ID NO: 235606 - protein, 18 aa, Mycobacterium bovis
IIMGIDWIGPGFNPHLLS

SEQ ID NO: 235607 - protein, 18 aa, Mycobacterium bovis
ILGRFSASFGETFASGPY

SEQ ID NO: 235608 - protein, 18 aa, Mycobacterium bovis
IPNGGSVFGCQPCSAPDR

SEQ ID NO: 235609 - protein, 19 aa, Mycobacterium bovis
IPTLLAHYGVDAVITDEDH

SEQ ID NO: 235610 - protein, 21 aa, Mycobacterium bovis
IPYYSATLWDPRERPSFTGEY

SEQ ID NO: 235611 - protein, 17 aa, Mycobacterium bovis
IQTEFNVALPWRKEVSL

SEQ ID NO: 235612 - protein, 18 aa, Mycobacterium bovis
IRGNRVLIGFSLPGKTIG

SEQ ID NO: 235613 - protein, 20 aa, Mycobacterium bovis
ISVNVTLIFSVQRYREVMDA

SEQ ID NO: 235614 - protein, 27 aa, Mycobacterium bovis
IVGDEFCLLDGLLAWYATIGSINNINS

SEQ ID NO: 235615 - protein, 24 aa, Mycobacterium bovis
KALDITLPMPPRWTQVPDPNVPDA

SEQ ID NO: 235616 - protein, 17 aa, Mycobacterium bovis
KEGLTRLAADLSPAAGE

SEQ ID NO: 235617 - protein, 19 aa, Mycobacterium bovis
KLGFPVPIRHWLRAGELLE

SEQ ID NO: 235618 - protein, 19 aa, Mycobacterium bovis
KLREIRMALTLDKTFTKSE

SEQ ID NO: 235619 - protein, 27 aa, Mycobacterium bovis
KVILSRCVEVPFAIDFPLTYRLGRRHN

SEQ ID NO: 235620 - protein, 20 aa, Mycobacterium bovis
LACVVLRVARFFVEGDDMPD

SEQ ID NO: 235621 - protein, 25 aa, Mycobacterium bovis
LANAKRWGVLHVIWRQGYYPGIGAP

SEQ ID NO: 235622 - protein, 17 aa, Mycobacterium bovis
LAQILTFQAVDAVVAGD

SEQ ID NO: 235623 - protein, 18 aa, Mycobacterium bovis
LARADIRGPYVINADGAP

SEQ ID NO: 235624 - protein, 19 aa, Mycobacterium bovis
LDAFLKWHHGVREFLQSAI

SEQ ID NO: 235625 - protein, 17 aa, Mycobacterium bovis
LDIDWVIGGCMSVDPTH

SEQ ID NO: 235626 - protein, 17 aa, Mycobacterium bovis
LDPLCRVNSAMAGRQQG

SEQ ID NO: 235627 - protein, 30 aa, Mycobacterium bovis
LFDLPPRWFAGWSRLGLRTSLRYKVPRMPF

SEQ ID NO: 235628 - protein, 18 aa, Mycobacterium bovis
LFPPELSGGIGNILNIGA

SEQ ID NO: 235629 - protein, 19 aa, Mycobacterium bovis
LHHPCCGDLVYGADPKLAK

SEQ ID NO: 235630 - protein, 18 aa, Mycobacterium bovis
LHLPGFPVQFFVYKQIAA

SEQ ID NO: 235631 - protein, 21 aa, Mycobacterium bovis
LKYLPLAPFRISYAYTNFGVT

SEQ ID NO: 235632 - protein, 21 aa, Mycobacterium bovis
LLALRIPWYVTVLDLGSAGAV

SEQ ID NO: 235633 - protein, 23 aa, Mycobacterium bovis
LLDDRWWFHFALIGVLTALDDLF

SEQ ID NO: 235634 - protein, 19 aa, Mycobacterium bovis
LLFKRNICHQAIFYRRGLF

SEQ ID NO: 235635 - protein, 19 aa, Mycobacterium bovis
LLPQVFRWARTVDPVQPLT

SEQ ID NO: 235636 - protein, 23 aa, Mycobacterium bovis
LLSTDFRAGCPIAAVSVEAGDEQ

SEQ ID NO: 235637 - protein, 22 aa, Mycobacterium bovis
LPGELMSALSQGLSQFGINIPP

SEQ ID NO: 235638 - protein, 20 aa, Mycobacterium bovis
LPLDRAAVIIADLAQSTPTG

SEQ ID NO: 235639 - protein, 17 aa, Mycobacterium bovis
LPVWLTQWGYRRPAEDT

SEQ ID NO: 235640 - protein, 17 aa, Mycobacterium bovis
LRAAFVWNRENSDTEGA

SEQ ID NO: 235641 - protein, 21 aa, Mycobacterium bovis
LRLHPDIRLFTAIPEQRSSTA

SEQ ID NO: 235642 - protein, 17 aa, Mycobacterium bovis
LRLNAGLGNVGNYNVGL

SEQ ID NO: 235643 - protein, 19 aa, Mycobacterium bovis
LRPRMRVVNEFQRRYPDIK

SEQ ID NO: 235644 - protein, 18 aa, Mycobacterium bovis
LRTTIDWYRDNESWWRPL

SEQ ID NO: 235645 - protein, 18 aa, Mycobacterium bovis
LRVNPEFHCEIVVDGQVV

SEQ ID NO: 235646 - protein, 21 aa, Mycobacterium bovis
LRWSWLLSVLAAVGLGLATAP

SEQ ID NO: 235647 - protein, 20 aa, Mycobacterium bovis
LSDLQPGDVLTFYSDASHAG

SEQ ID NO: 235648 - protein, 23 aa, Mycobacterium bovis
LSFERWAPDMGWEIATGKSVLAG

SEQ ID NO: 235649 - protein, 19 aa, Mycobacterium bovis
LSSCGWRGISNVAIPGGPG

SEQ ID NO: 235650 - protein, 24 aa, Mycobacterium bovis
LTAWAVGWLPYIGILAPQINFFYY

SEQ ID NO: 235651 - protein, 18 aa, Mycobacterium bovis
LTMLLVFTVITGIVYPLA

SEQ ID NO: 235652 - protein, 18 aa, Mycobacterium bovis
LWRMGIRTIGQFAALSRT

SEQ ID NO: 235653 - protein, 17 aa, Mycobacterium bovis
LYGLDCSHIAPANVYGP

SEQ ID NO: 235654 - protein, 24 aa, Mycobacterium bovis
MATIRNAVFLGHAFAALNPATVTA

SEQ ID NO: 235655 - protein, 20 aa, Mycobacterium bovis
MKLDLLLTVPLDYYKKFMSV

SEQ ID NO: 235656 - protein, 18 aa, Mycobacterium bovis
MRDRWAGFFNEFDVLLLP

SEQ ID NO: 235657 - protein, 23 aa, Mycobacterium bovis
MRPGNWAGIYACWGTENREAAVR

SEQ ID NO: 235658 - protein, 24 aa, Mycobacterium bovis
NAFFSSRCNLIAWDRGVFMAVAQE

SEQ ID NO: 235659 - protein, 17 aa, Mycobacterium bovis
NDIAVVWSPTGVPYVVA

SEQ ID NO: 235660 - protein, 24 aa, Mycobacterium bovis
NFWRSAGLPEFRWPDPNGTRFPNG

SEQ ID NO: 235661 - protein, 19 aa, Mycobacterium bovis
NGAQCPRCNEEYRQLCAAL

SEQ ID NO: 235662 - protein, 19 aa, Mycobacterium bovis
NGATGGWLYGNGGAGGQGA

SEQ ID NO: 235663 - protein, 20 aa, Mycobacterium bovis
NGGPGGWLIGNGGAGGSGAP

SEQ ID NO: 235664 - protein, 20 aa, Mycobacterium bovis
NKNARFVAVAGIGLLSPGNT

SEQ ID NO: 235665 - protein, 23 aa, Mycobacterium bovis
NNVRRLAGPYAWSNALSAGYTAE

SEQ ID NO: 235666 - protein, 24 aa, Mycobacterium bovis
NREVRWRPEHFWKPGTAVDVAVNT

SEQ ID NO: 235667 - protein, 17 aa, Mycobacterium bovis
NRFPYDIEFIIRGESEQ

SEQ ID NO: 235668 - protein, 23 aa, Mycobacterium bovis
NRMLSQIWSHWSLLSAPSCAAQL

SEQ ID NO: 235669 - protein, 19 aa, Mycobacterium bovis
NRVLIGFSLPGKTIGMQSR

SEQ ID NO: 235670 - protein, 17 aa, Mycobacterium bovis
NTFRHLYGLDCSHIAPA

SEQ ID NO: 235671 - protein, 24 aa, Mycobacterium bovis
NVNYRITVKPGWKFTDGSPVTAHS

SEQ ID NO: 235672 - protein, 17 aa, Mycobacterium bovis
PADCVGVGYLTQRNVYR

SEQ ID NO: 235673 - protein, 25 aa, Mycobacterium bovis
PAPPPFRLPLLFVNALGDNWIVGAS

SEQ ID NO: 235674 - protein, 21 aa, Mycobacterium bovis
PDGQDGGLLFGNGGAGYNSAA

SEQ ID NO: 235675 - protein, 22 aa, Mycobacterium bovis
PDGQNGGLLFGNGGNGFTQTTA

SEQ ID NO: 235676 - protein, 23 aa, Mycobacterium bovis
PDPGKWAGFELHRDVTVTEEFTL

SEQ ID NO: 235677 - protein, 17 aa, Mycobacterium bovis
PELSGGIGNILNIGAGN

SEQ ID NO: 235678 - protein, 20 aa, Mycobacterium bovis
PETVAAAALDVARIGSSIGV

SEQ ID NO: 235679 - protein, 31 aa, Mycobacterium bovis; identical to SEQ ID NO: 233987

SEQ ID NO: 235680 - protein, 20 aa, Mycobacterium bovis
PEVNSALMFAGAGSGPTLAA

SEQ ID NO: 235681 - protein, 20 aa, Mycobacterium bovis
PGAKGAHGFTPTSGGDGGDG

SEQ ID NO: 235682 - protein, 23 aa, Mycobacterium bovis
PGAKSARPATVWIAQDGSHHLVR

SEQ ID NO: 235683 - protein, 19 aa, Mycobacterium bovis
PGTEISIADVLRCIDGPLA

SEQ ID NO: 235684 - protein, 18 aa, Mycobacterium bovis
PIGLELNGGVGPITVLPI

SEQ ID NO: 235685 - protein, 18 aa, Mycobacterium bovis
PINAQFVAATGRPLIGNG

SEQ ID NO: 235686 - protein, 17 aa, Mycobacterium bovis
PISGCRGFSTSLLAKRN

SEQ ID NO: 235687 - protein, 18 aa, Mycobacterium bovis
PKNDLSWHDCTSRVYSNA

SEQ ID NO: 235688 - protein, 18 aa, Mycobacterium bovis
PMGLGLVSQFFGKYFTPE

SEQ ID NO: 235689 - protein, 21 aa, Mycobacterium bovis
PPEHLQWIGQWGIFDALRAGR

SEQ ID NO: 235690 - protein, 17 aa, Mycobacterium bovis
PPFRMWDPGSGPAGGRA

SEQ ID NO: 235691 - protein, 25 aa, Mycobacterium bovis
PPPRRPAHRVLVGWLSLAAGLLAIA

SEQ ID NO: 235692 - protein, 20 aa, Mycobacterium bovis
PQLGRWKWHDPWVHASLLAQ

SEQ ID NO: 235693 - protein, 19 aa, Mycobacterium bovis
PRGWPEWAEPDVVDAFADR

SEQ ID NO: 235694 - protein, 19 aa, Mycobacterium bovis
PSAPMPGCTLICIGSHGPP

SEQ ID NO: 235695 - protein, 18 aa, Mycobacterium bovis
PTIDLPVPDDWRLLPESS

SEQ ID NO: 235696 - protein, 24 aa, Mycobacterium bovis
PVGGFSFALPAGWVESDAAHLDYG

SEQ ID NO: 235697 - protein, 25 aa, Mycobacterium bovis
QAGGPGGPAGLWGNGGPGGAGGSGG

SEQ ID NO: 235698 - protein, 21 aa, Mycobacterium bovis
QFAPGELKNLPGFQGSGDGSA

SEQ ID NO: 235699 - protein, 21 aa, Mycobacterium bovis
QGGAGGNGWAAEGITVGIGEQ

SEQ ID NO: 235700 - protein, 17 aa, Mycobacterium bovis
QGYYPGIGAPSWTADYG

SEQ ID NO: 235701 - protein, 21 aa, Mycobacterium bovis
QLGAIGIDLTDVFAVLEEEGV

SEQ ID NO: 235702 - protein, 22 aa, Mycobacterium bovis
QLGARAALFHEQFVQALTGAAS

SEQ ID NO: 235703 - protein, 25 aa, Mycobacterium bovis
QPLPEFLSAEIFQPLGLAMVVDPVG

SEQ ID NO: 235704 - protein, 24 aa, Mycobacterium bovis
QSRTRRALALCVPRDAIARDAGVP

SEQ ID NO: 235705 - protein, 20 aa, Mycobacterium bovis
QTLFGRPLIGDGANGTAENP

SEQ ID NO: 235706 - protein, 17 aa, Mycobacterium bovis
QVQDWVVGLLHEQDQGK

SEQ ID NO: 235707 - protein, 23 aa, Mycobacterium bovis
RAAELRYGRSFGIVAGYGGHGIG

SEQ ID NO: 235708 - protein, 20 aa, Mycobacterium bovis
RADERFAFCSTFKAPLVAAV

SEQ ID NO: 235709 - protein, 20 aa, Mycobacterium bovis
RAGSQMGVPYSWGGGSLQGP

SEQ ID NO: 235710 - protein, 20 aa, Mycobacterium bovis
RAYRLRWPAGTIVFEVDQPQ

SEQ ID NO: 235711 - protein, 19 aa, Mycobacterium bovis
RDALFHWGVAMLPAGPAGR

SEQ ID NO: 235712 - protein, 18 aa, Mycobacterium bovis
RDEGRWHVRWTTSGLHPK

SEQ ID NO: 235713 - protein, 17 aa, Mycobacterium bovis
RDLRFGYRTSVLKHADG

SEQ ID NO: 235714 - protein, 23 aa, Mycobacterium bovis
REAALRLDHHFAISVIDCGSSME

SEQ ID NO: 235715 - protein, 19 aa, Mycobacterium bovis
REVQDVWIWVRPYFDDRAT

SEQ ID NO: 235716 - protein, 17 aa, Mycobacterium bovis
RFACDYALLAVPYLTLR

SEQ ID NO: 235717 - protein, 24 aa, Mycobacterium bovis
RHLFTVLMDREWKHGVAAAVDVTL

SEQ ID NO: 235718 - protein, 19 aa, Mycobacterium bovis
RIAYDASQQVFGFAPYPAV

SEQ ID NO: 235719 - protein, 20 aa, Mycobacterium bovis
RLGSDMGEFYMPYPGTRINQ

SEQ ID NO: 235720 - protein, 17 aa, Mycobacterium bovis
RNICHQAIFYRRGLFGT

SEQ ID NO: 235721 - protein, 19 aa, Mycobacterium bovis
RRADAIAGTGGDGGNGGNG

SEQ ID NO: 235722 - protein, 17 aa, Mycobacterium bovis
RRARTWLGATAEAIEAC

SEQ ID NO: 235723 - protein, 18 aa, Mycobacterium bovis
RRLLRLCARYSAHPTVIF

SEQ ID NO: 235724 - protein, 22 aa, Mycobacterium bovis
RRVGVPDARCVLPLAHRVTQAA

SEQ ID NO: 235725 - protein, 22 aa, Mycobacterium bovis
RSWRPRVAVWGIHLLRRGGLTG

SEQ ID NO: 235726 - protein, 17 aa, Mycobacterium bovis
RVFAGGMATGFIGVVLV

SEQ ID NO: 235727 - protein, 21 aa, Mycobacterium bovis
RYPRNGWPALFHVRSGASLAG

SEQ ID NO: 235728 - protein, 20 aa, Mycobacterium bovis
SCGYSDCKVLTSFTACGAVA

SEQ ID NO: 235729 - protein, 20 aa, Mycobacterium bovis
SEEDRRFAVVFVHDQSDYAR

SEQ ID NO: 235730 - protein, 19 aa, Mycobacterium bovis
SFAIGLAMMLAPMVAAPGL

SEQ ID NO: 235731 - protein, 20 aa, Mycobacterium bovis
SGPRWLALLLQPLSGPPSTS

SEQ ID NO: 235732 - protein, 20 aa, Mycobacterium bovis
SGSIGLGFAIPVDQAKRIAD

SEQ ID NO: 235733 - protein, 23 aa, Mycobacterium bovis
SGTCFRPSLAVQRRWRDEFGLGL

SEQ ID NO: 235734 - protein, 17 aa, Mycobacterium bovis
SKMAFAMANFEPGSNEP

SEQ ID NO: 235735 - protein, 25 aa, Mycobacterium bovis
SNAVRFAFWGAEEFGLIGSRNYVES

SEQ ID NO: 235736 - protein, 24 aa, Mycobacterium bovis
SNGILWRGNFEGLFGLNVGITIPE

SEQ ID NO: 235737 - protein, 18 aa, Mycobacterium bovis
SRGLRYATVIALVAALVG

SEQ ID NO: 235738 - protein, 22 aa, Mycobacterium bovis
SRRLWTMLIFMLWHAIFVEHSV

SEQ ID NO: 235739 - protein, 18 aa, Mycobacterium bovis
SSIPPVPGKFYWMSPTQV

SEQ ID NO: 235740 - protein, 24 aa, Mycobacterium bovis
SSTQLPVWLAHAGIDVLRSHPIVA

SEQ ID NO: 235741 - protein, 17 aa, Mycobacterium bovis
STPGAKGAHGFTPTSGG

SEQ ID NO: 235742 - protein, 19 aa, Mycobacterium bovis
SVPLVCLLAGLLLAATHGV

SEQ ID NO: 235743 - protein, 22 aa, Mycobacterium bovis
TDLSTRCSLPISGLQAIGLMQA

SEQ ID NO: 235744 - protein, 17 aa, Mycobacterium bovis
TETWINLQVGDCLADLP

SEQ ID NO: 235745 - protein, 26 aa, Mycobacterium bovis
TEVLQRLRGMFAFALWDTVTRELFCA

SEQ ID NO: 235746 - protein, 19 aa, Mycobacterium bovis
TGGRGGWLAGAGGAGGDGG

SEQ ID NO: 235747 - protein, 24 aa, Mycobacterium bovis
TGTVAYRFSWHLPKDRIWTYDGQL

SEQ ID NO: 235748 - protein, 24 aa, Mycobacterium bovis
TITARLNFQLAFGARVGQRLADAR

SEQ ID NO: 235749 - protein, 17 aa, Mycobacterium bovis
TLFPPVRPRQWLEIRYL

SEQ ID NO: 235750 - protein, 23 aa, Mycobacterium bovis
TLFRRLAVFVGCFFVDDAQAVAC

SEQ ID NO: 235751 - protein, 20 aa, Mycobacterium bovis
TLLGRPLIGNGADGLPGQNG

SEQ ID NO: 235752 - protein, 20 aa, Mycobacterium bovis
TMVIPPIVFLPSMTIGGQTY

SEQ ID NO: 235753 - protein, 18 aa, Mycobacterium bovis
TMYELFSVGWGKPDLRDQ

SEQ ID NO: 235754 - protein, 17 aa, Mycobacterium bovis
TPRFGFEQVCATPAFPH

SEQ ID NO: 235755 - protein, 18 aa, Mycobacterium bovis
TRAVYKHMAKRGGGAIVN

SEQ ID NO: 235756 - protein, 21 aa, Mycobacterium bovis
TRLTEVLSRIYGHPVTVQLHI

SEQ ID NO: 235757 - protein, 22 aa, Mycobacterium bovis
TRRKGRLAALAIAAMASASLVT

SEQ ID NO: 235758 - protein, 18 aa, Mycobacterium bovis
TTGCIRWSTQSRPVVNGP

SEQ ID NO: 235759 - protein, 22 aa, Mycobacterium bovis
TVAPALSLGSWVAFARTPDGQT

SEQ ID NO: 235760 - protein, 18 aa, Mycobacterium bovis
VAAFKWRAQLPIEDSGRV

SEQ ID NO: 235761 - protein, 18 aa, Mycobacterium bovis
VAFWWWQRPRTNAVAADS

SEQ ID NO: 235762 - protein, 21 aa, Mycobacterium bovis
VASPCAYFLVYESTETTERPE

SEQ ID NO: 235763 - protein, 21 aa, Mycobacterium bovis
VDIKPGLSLGGYAAFARYDNN

SEQ ID NO: 235764 - protein, 23 aa, Mycobacterium bovis
VDMLEMLPTPWGLVRSGVAPDHP

SEQ ID NO: 235765 - protein, 17 aa, Mycobacterium bovis
VEGAFYWLNNREVRWRP

SEQ ID NO: 235766 - protein, 17 aa, Mycobacterium bovis
VEGKVIWSGVRGIADLA

SEQ ID NO: 235767 - protein, 18 aa, Mycobacterium bovis
VGAICRWQAANPAGLIDI

SEQ ID NO: 235768 - protein, 20 aa, Mycobacterium bovis
VGAPMGWEAVFTRPFQAFWV

SEQ ID NO: 235769 - protein, 19 aa, Mycobacterium bovis
VICRRSRLMSRIAGSGAMA

SEQ ID NO: 235770 - protein, 18 aa, Mycobacterium bovis
VKLFDDWSNLGSISELST

SEQ ID NO: 235771 - protein, 25 aa, Mycobacterium bovis
VLDEATGRWGLRVARVELRSIDPPP

SEQ ID NO: 235772 - protein, 18 aa, Mycobacterium bovis
VNLKLQFLHDAFPNEFPD

SEQ ID NO: 235773 - protein, 17 aa, Mycobacterium bovis
VNWPFVFASMLENAVKG

SEQ ID NO: 235774 - protein, 19 aa, Mycobacterium bovis
VPDDWRLLPESSRAPYGGI

SEQ ID NO: 235775 - protein, 17 aa, Mycobacterium bovis
VPDEVWPAVVFTLVTLL

SEQ ID NO: 235776 - protein, 17 aa, Mycobacterium bovis
VPDPRYVAVSDRDQLAT

SEQ ID NO: 235777 - protein, 18 aa, Mycobacterium bovis
VQALNMGAVCYAAAETAN

SEQ ID NO: 235778 - protein, 19 aa, Mycobacterium bovis
VQPRLAILLGDCAVPAEGR

SEQ ID NO: 235779 - protein, 19 aa, Mycobacterium bovis
VRCDARLAVTLPPELPVAA

SEQ ID NO: 235780 - protein, 20 aa, Mycobacterium bovis
VSAAIAALFSAHGRAYQVAS

SEQ ID NO: 235781 - protein, 21 aa, Mycobacterium bovis
VSAAIAALFSSYARDYQTLSV

SEQ ID NO: 235782 - protein, 20 aa, Mycobacterium bovis
VSAAIASLFGAHGQAYQAVS

SEQ ID NO: 235783 - protein, 20 aa, Mycobacterium bovis
VSAAVAALFSAHAGQYQQLG

SEQ ID NO: 235784 - protein, 17 aa, Mycobacterium bovis
VSNLRWSGDYVLIDVDA

SEQ ID NO: 235785 - protein, 18 aa, Mycobacterium bovis
VVHYGNGVSIVYADVPTT

SEQ ID NO: 235786 - protein, 19 aa, Mycobacterium bovis
VVLSSGWDIMDFVRQLQKL

SEQ ID NO: 235787 - protein, 17 aa, Mycobacterium bovis
VWPAVVFTLVTLLDDPV

SEQ ID NO: 235788 - protein, 19 aa, Mycobacterium bovis
WDWAVDWDTWVSMSALPPP

SEQ ID NO: 235789 - protein, 17 aa, Mycobacterium bovis
WIGQWGIFDALRAGREV

SEQ ID NO: 235790 - protein, 17 aa, Mycobacterium bovis
WIPLLILVVVAIAGFTV

SEQ ID NO: 235791 - protein, 20 aa, Mycobacterium bovis
WLDAFAHWRRAQGLPATSIA

SEQ ID NO: 235792 - protein, 17 aa, Mycobacterium bovis
WRAQLPIEDSGRVEQQL

SEQ ID NO: 235793 - protein, 20 aa, Mycobacterium bovis
WRELFTDILPAHIVKDIPGG

SEQ ID NO: 235794 - protein, 17 aa, Mycobacterium bovis
WRFPDRLDRVYVNSRAR

SEQ ID NO: 235795 - protein, 19 aa, Mycobacterium bovis
WRTELPLRYLESVITQLSQ

SEQ ID NO: 235796 - protein, 19 aa, Mycobacterium bovis
WSARGVDVTPFFAVLNGPR

SEQ ID NO: 235797 - protein, 18 aa, Mycobacterium bovis
WWWQRPRTNAVAADSLVG

SEQ ID NO: 235798 - protein, 17 aa, Mycobacterium bovis
YELARPGTEISIADVLR

SEQ ID NO: 235799 - protein, 24 aa, Mycobacterium bovis
YNAVEPWVQYGFNLTAWAVGWLPY

SEQ ID NO: 235800 - protein, 21 aa, Mycobacterium bovis
YPLFNLWGPAFHERYPNVTIT

SEQ ID NO: 235801 - protein, 21 aa, Mycobacterium bovis
YRPTQPGSYPIVLATYEIVCS

SEQ ID NO: 235802 - protein, 19 aa, Mycobacterium bovis
YRRAEICRERLGPVLRRLT

SEQ ID NO: 235803 - protein, 18 aa, Mycobacterium bovis
YRTDVDWATQISYSGVFV

SEQ ID NO: 235804 - protein, 24 aa, Mycobacterium bovis
AADPAGWPRLDWSMDAALLLAALA

SEQ ID NO: 235805 - protein, 25 aa, Mycobacterium bovis
AALDVARIGSSIGVANSAAAGSTTS

SEQ ID NO: 235806 - protein, 23 aa, Mycobacterium bovis
AARLRWARRPDWGGLEVDVDVAG

SEQ ID NO: 235807 - protein, 26 aa, Mycobacterium bovis
AATEVARIGSALSLASAVAAAQTSAV

SEQ ID NO: 235808 - protein, 32 aa, Mycobacterium bovis
ADEVSAAIAALFSAHGRDFQALSARAAAFHHE

SEQ ID NO: 235809 - protein, 28 aa, Mycobacterium bovis
ADEVSAAIASLFSGYARDYQALSAQMAR

SEQ ID NO: 235810 - protein, 20 aa, Mycobacterium bovis
ADVQRLPLNVTWVNLTTGKS

SEQ ID NO: 235811 - protein, 26 aa, Mycobacterium bovis
AGDEVSAAIAALFGTHAQEYQALSAR

SEQ ID NO: 235812 - protein, 19 aa, Mycobacterium bovis
AGGNGGWLFGNGGAGGSGG

SEQ ID NO: 235813 - protein, 24 aa, Mycobacterium bovis
AGTGGRGGLLAGQHANSGNGGGGG

SEQ ID NO: 235814 - protein, 30 aa, Mycobacterium bovis
AINAPTQLWLGRPLIGDGVHGAPGTGQPGG

SEQ ID NO: 235815 - protein, 23 aa, Mycobacterium bovis
AKLWTIADLGGWGSVDPQLFDKA

SEQ ID NO: 235816 - protein, 17 aa, Mycobacterium bovis
ALGRPLIGNGANGKPGT

SEQ ID NO: 235817 - protein, 18 aa, Mycobacterium bovis
ALLGRPLIGNGADGTAPG

SEQ ID NO: 235818 - protein, 26 aa, Mycobacterium bovis
ALSAQMARFHQQFVQALTASVGSYAA

SEQ ID NO: 235819 - protein, 26 aa, Mycobacterium bovis
ALSARAAAFHHEFVQALAAGAGSYAV

SEQ ID NO: 235820 - protein, 17 aa, Mycobacterium bovis
ANLERWAPLLPEGATLV

SEQ ID NO: 235821 - protein, 20 aa, Mycobacterium bovis
APASTGLTGGTGFAGGAGGV

SEQ ID NO: 235822 - protein, 19 aa, Mycobacterium bovis
APDYLPVVLEFAATVDPEA

SEQ ID NO: 235823 - protein, 25 aa, Mycobacterium bovis
APTQALWGRPLIGNGADGTAANPNG

SEQ ID NO: 235824 - protein, 26 aa, Mycobacterium bovis
ASAEAAAAEQIVLGVINAPTQALLGR

SEQ ID NO: 235825 - protein, 23 aa, Mycobacterium bovis
ATAFPWRRQSALVQWYVETSGSP

SEQ ID NO: 235826 - protein, 17 aa, Mycobacterium bovis
AVTGRPLIGNGANGAPG

SEQ ID NO: 235827 - protein, 19 aa, Mycobacterium bovis
AYDRAWWFARFVAAAYGTA

SEQ ID NO: 235828 - protein, 23 aa, Mycobacterium bovis
DEVSAAIATLFGSHAREYQAIST

SEQ ID NO: 235829 - protein, 17 aa, Mycobacterium bovis
DNPDRWAPPYAEAGAYN

SEQ ID NO: 235830 - protein, 23 aa, Mycobacterium bovis
DRNRAHWDWLKWLPHNQHPNACD

SEQ ID NO: 235831 - protein, 25 aa, Mycobacterium bovis
DTGSFRWASVRGYRLAARLVEIGVD

SEQ ID NO: 235832 - protein, 20 aa, Mycobacterium bovis
EFRCARCGVPYTDALPEMPE

SEQ ID NO: 235833 - protein, 24 aa, Mycobacterium bovis
EGKYIPRLGGMAFRDPDWADEVYV

SEQ ID NO: 235834 - protein, 20 aa, Mycobacterium bovis
ELYKRLPGDLSILTPSPASD

SEQ ID NO: 235835 - protein, 22 aa, Mycobacterium bovis
EPGIYFPGRWGARIEDIVIVTE

SEQ ID NO: 235836 - protein, 21 aa, Mycobacterium bovis
EVSAAIAALFGAHARAYQALS

SEQ ID NO: 235837 - protein, 24 aa, Mycobacterium bovis
EVSIAVAALFGMHGQAYQALSVQA

SEQ ID NO: 235838 - protein, 20 aa, Mycobacterium bovis
FAGGMATGFIGVVLVTAGKA

SEQ ID NO: 235839 - protein, 17 aa, Mycobacterium bovis
FDAATLGSPGADGGMGG

SEQ ID NO: 235840 - protein, 17 aa, Mycobacterium bovis
FHLCVVDAPTLHNAAEA

SEQ ID NO: 235841 - protein, 18 aa, Mycobacterium bovis
FISLNGGQMVPVLLDTGS

SEQ ID NO: 235842 - protein, 18 aa, Mycobacterium bovis
FKPGFPMAEWASKRRAQL

SEQ ID NO: 235843 - protein, 21 aa, Mycobacterium bovis
FNKPGTFPLRFQTEVRDGCPS

SEQ ID NO: 235844 - protein, 18 aa, Mycobacterium bovis
FNYLDLVRYLAVGNLNPS

SEQ ID NO: 235845 - protein, 17 aa, Mycobacterium bovis
FQALSARAAAFHHEFVQ

SEQ ID NO: 235846 - protein, 18 aa, Mycobacterium bovis
GAGDPSFAVNNGAGGNGG

SEQ ID NO: 235847 - protein, 17 aa, Mycobacterium bovis
GAGGLLWGNGGNGGAGD

SEQ ID NO: 235848 - protein, 19 aa, Mycobacterium bovis
GAGGNGFDAATLGSPGADG

SEQ ID NO: 235849 - protein, 25 aa, Mycobacterium bovis
GANGGAGGNAWLFGAGGSGGAGTNG

SEQ ID NO: 235850 - protein, 21 aa, Mycobacterium bovis
GDGGAGGWLLGTGGAGGAGGN

SEQ ID NO: 235851 - protein, 25 aa, Mycobacterium bovis
GDGGEGASGLGLDLSGFDGGQGGQG

SEQ ID NO: 235852 - protein, 20 aa, Mycobacterium bovis
GGAGGRGGWLVGSGGNGGNG

SEQ ID NO: 235853 - protein, 21 aa, Mycobacterium bovis
GGALNQAGFFGTGGKGGNGGN

SEQ ID NO: 235854 - protein, 18 aa, Mycobacterium bovis
GGEGGIFGGNGGNGGTGG

SEQ ID NO: 235855 - protein, 19 aa, Mycobacterium bovis
GGGLPPVPASPGGNGGGGG

SEQ ID NO: 235856 - protein, 25 aa, Mycobacterium bovis
GGIGGKGGDAFATFAKAGNGGAGGN

SEQ ID NO: 235857 - protein, 21 aa, Mycobacterium bovis
GGKGGTGLMPGINGTGGAGGS

SEQ ID NO: 235858 - protein, 22 aa, Mycobacterium bovis
GGNGATGPWLFGDGGAGGGGGA

SEQ ID NO: 235859 - protein, 24 aa, Mycobacterium bovis
GGNGGRAGLLLGVGGMGGNGGATS

SEQ ID NO: 235860 - protein, 25 aa, Mycobacterium bovis
GGNGGRGAALFGHGGNAGHGGAGGN

SEQ ID NO: 235861 - protein, 23 aa, Mycobacterium bovis
GGNGGRGGLLVGNGGAGGAGGVG

SEQ ID NO: 235862 - protein, 25 aa, Mycobacterium bovis
GGNGGRGSVLFGHGGNAGHGGAGGN

SEQ ID NO: 235863 - protein, 17 aa, Mycobacterium bovis
GGSGFFGGKGGFGGDGG

SEQ ID NO: 235864 - protein, 20 aa, Mycobacterium bovis
GGSGGFVYGNGGAGGIGGIG

SEQ ID NO: 235865 - protein, 18 aa, Mycobacterium bovis
GGSGGWLNGNGGAGGAGG

SEQ ID NO: 235866 - protein, 20 aa, Mycobacterium bovis
GGVGGRGGDGVFAGAGGQGG

SEQ ID NO: 235867 - protein, 23 aa, Mycobacterium bovis
GNFLSRSGAVGVLGIGPNNGFPG

SEQ ID NO: 235868 - protein, 18 aa, Mycobacterium bovis
GPGGAAFGLGNGGNGGNG

SEQ ID NO: 235869 - protein, 24 aa, Mycobacterium bovis
GSGADNPTGAGFAGGAGGTGGAAG

SEQ ID NO: 235870 - protein, 25 aa, Mycobacterium bovis
GSGAPGGHGGWLFGGGGTGGSGVSG

SEQ ID NO: 235871 - protein, 17 aa, Mycobacterium bovis
GSVIARLTGMHWWGPAS

SEQ ID NO: 235872 - protein, 25 aa, Mycobacterium bovis
GTDKRASGVIPRYGVRLTVMSRPPA

SEQ ID NO: 235873 - protein, 25 aa, Mycobacterium bovis
GTGQPGGAGGLLWGNGGNGGSGAAG

SEQ ID NO: 235874 - protein, 20 aa, Mycobacterium bovis
HGGSAAKLFGDGGAGGAGGM

SEQ ID NO: 235875 - protein, 17 aa, Mycobacterium bovis
IARVIMRSAIGFFASFT

SEQ ID NO: 235876 - protein, 19 aa, Mycobacterium bovis
IERYRAATLMARVRAAKGM

SEQ ID NO: 235877 - protein, 18 aa, Mycobacterium bovis
IGGAGGFGGFRGGEGGAG

SEQ ID NO: 235878 - protein, 20 aa, Mycobacterium bovis
IGGNGGDAGLFGNGGAGGAG

SEQ ID NO: 235879 - protein, 19 aa, Mycobacterium bovis
KGCPKETWCVVNAGNYRGS

SEQ ID NO: 235880 - protein, 20 aa, Mycobacterium bovis
KSTWRSVPLVGHIPSAPGNP

SEQ ID NO: 235881 - protein, 35 aa, Mycobacterium bovis
LFGTHAQEYQALSARVATFHEQFVRSLTAAGSAYA

SEQ ID NO: 235882 - protein, 17 aa, Mycobacterium bovis
LGGIASMISEANAMAAV

SEQ ID NO: 235883 - protein, 17 aa, Mycobacterium bovis
LIGNGADGLPGQNGGAG

SEQ ID NO: 235884 - protein, 17 aa, Mycobacterium bovis
LKELRRAAPYLVGALKL

SEQ ID NO: 235885 - protein, 18 aa, Mycobacterium bovis
LKIVSCYQYGKGSTADWL

SEQ ID NO: 235886 - protein, 17 aa, Mycobacterium bovis
LPLNVTWVNLTTGKSGS

SEQ ID NO: 235887 - protein, 20 aa, Mycobacterium bovis
LQALEQQVLGAINAPTQLWL

SEQ ID NO: 235888 - protein, 17 aa, Mycobacterium bovis
LRDGGCNDVILVLGAVE

SEQ ID NO: 235889 - protein, 22 aa, Mycobacterium bovis
LRWGEYRAGGLARARWGLLEPP

SEQ ID NO: 235890 - protein, 18 aa, Mycobacterium bovis
LTGGTGFAGGAGGVGGQG

SEQ ID NO: 235891 - protein, 17 aa, Mycobacterium bovis
LTGRPLIGNGANGTPGT

SEQ ID NO: 235892 - protein, 17 aa, Mycobacterium bovis
LTSCTWRGIANVPLPVG

SEQ ID NO: 235893 - protein, 17 aa, Mycobacterium bovis
LVPEYIGNLLLYFQPDA

SEQ ID NO: 235894 - protein, 20 aa, Mycobacterium bovis
NGGQMVPVLLDTGSTGLVMD

SEQ ID NO: 235895 - protein, 19 aa, Mycobacterium bovis
NPDYLPGALLPPSIHATAD

SEQ ID NO: 235896 - protein, 18 aa, Mycobacterium bovis
PAVLAVAVVVAFLTTGCI

SEQ ID NO: 235897 - protein, 18 aa, Mycobacterium bovis
PDLFWALRGGGGGNFGVT

SEQ ID NO: 235898 - protein, 19 aa, Mycobacterium bovis
PEYIGNLLLYFQPDATVTM

SEQ ID NO: 235899 - protein, 17 aa, Mycobacterium bovis
PGDFFPVPCCFPSCRSI

SEQ ID NO: 235900 - protein, 20 aa, Mycobacterium bovis
PGGPGGWLIGNGGAGGSGAP

SEQ ID NO: 235901 - protein, 20 aa, Mycobacterium bovis
PSGLPGLRHKYSLDIAPGNF

SEQ ID NO: 235902 - protein, 24 aa, Mycobacterium bovis
PTQVRWRPFEFWPANTAVNIDAAG

SEQ ID NO: 235903 - protein, 19 aa, Mycobacterium bovis
QAATGRPLIGNGANGQPGT

SEQ ID NO: 235904 - protein, 25 aa, Mycobacterium bovis
QTPRQNPMWSAARVVMAARAAAALA

SEQ ID NO: 235905 - protein, 17 aa, Mycobacterium bovis
RATVAAAVWLATVCLVA

SEQ ID NO: 235906 - protein, 21 aa, Mycobacterium bovis
RDIPFDVIQRLGLAYTPPEAE

SEQ ID NO: 235907 - protein, 19 aa, Mycobacterium bovis
RGGDGVFAGAGGQGGLGGQ

SEQ ID NO: 235908 - protein, 20 aa, Mycobacterium bovis
RGVKEFAPLIGVRKAGLFTS

SEQ ID NO: 235909 - protein, 26 aa, Mycobacterium bovis
RNPERVWGWYLWRHYLVANVEPNDGH

SEQ ID NO: 235910 - protein, 20 aa, Mycobacterium bovis
RRPGGAWMLGKPIQLSEARD

SEQ ID NO: 235911 - protein, 18 aa, Mycobacterium bovis
RVAHCIYAGLATDTGSFR

SEQ ID NO: 235912 - protein, 21 aa, Mycobacterium bovis
SAAVAALFARFGQEYQAVSAQ

SEQ ID NO: 235913 - protein, 17 aa, Mycobacterium bovis
SALFGHGGINGDGGTGG

SEQ ID NO: 235914 - protein, 28 aa, Mycobacterium bovis
SGLMNTGFLPFRFQPVYIDYSPSGIGTT

SEQ ID NO: 235915 - protein, 20 aa, Mycobacterium bovis
SLRDLGCRALLMSGRPDEGA

SEQ ID NO: 235916 - protein, 19 aa, Mycobacterium bovis
SPVFGCLFKGIARGVKEFA

SEQ ID NO: 235917 - protein, 19 aa, Mycobacterium bovis
TADGINYRVLWQAAGPDTI

SEQ ID NO: 235918 - protein, 21 aa, Mycobacterium bovis
TDMPGRFVVAAAMVRHLLTDP

SEQ ID NO: 235919 - protein, 17 aa, Mycobacterium bovis
TEGRGFGGLGGAGGAGG

SEQ ID NO: 235920 - protein, 19 aa, Mycobacterium bovis
THCNLDCPICFADSGHQPD

SEQ ID NO: 235921 - protein, 18 aa, Mycobacterium bovis
TLTGRPLIGNGANGTPGT

SEQ ID NO: 235922 - protein, 17 aa, Mycobacterium bovis
TVAAAVWLATVCLVASC

SEQ ID NO: 235923 - protein, 20 aa, Mycobacterium bovis
TYKAFDWDQAYRKPITYDTL

SEQ ID NO: 235924 - protein, 20 aa, Mycobacterium bovis
VAATGRPLIGNGANGAPGTG

SEQ ID NO: 235925 - protein, 18 aa, Mycobacterium bovis
VAGVSFGNAVGGDGGNGG

SEQ ID NO: 235926 - protein, 19 aa, Mycobacterium bovis
VIMRSAIGFFASFTVSSGV

SEQ ID NO: 235927 - protein, 19 aa, Mycobacterium bovis
VPCCFPSCRSITYLLTDGE

SEQ ID NO: 235928 - protein, 18 aa, Mycobacterium bovis
VQAQKLWAQAGFRPVDPA

SEQ ID NO: 235929 - protein, 21 aa, Mycobacterium bovis
VSAAIAGLFGAHARQYQALSV

SEQ ID NO: 235930 - protein, 18 aa, Mycobacterium bovis
VSLAAVFLALAMGVVLGS

SEQ ID NO: 235931 - protein, 23 aa, Mycobacterium bovis
AADPAGWPRLDWSMDAALLLAAL

SEQ ID NO: 235932 - protein, 36 aa, Mycobacterium bovis; identical to SEQ ID NO: 235025

SEQ ID NO: 235933 - protein, 17 aa, Mycobacterium bovis
AAIAALFSAHGRDFQAL

SEQ ID NO: 235934 - protein, 24 aa, Mycobacterium bovis
AALDVARIGSSIGVANSAAAGSTT

SEQ ID NO: 235935 - protein, 23 aa, Mycobacterium bovis
AAQPIWWVVRAIEFSKDFETFVQ

SEQ ID NO: 235936 - protein, 24 aa, Mycobacterium bovis
AARLRWARRPDWGGLEVDVDVAGT

SEQ ID NO: 235937 - protein, 24 aa, Mycobacterium bovis
ADEVSAAIATLFGSHAREYQAIST

SEQ ID NO: 235938 - protein, 25 aa, Mycobacterium bovis
ADEVSAALASLFSGHAVSYQQVAAQ

SEQ ID NO: 235939 - protein, 23 aa, Mycobacterium bovis
ADVQRLPLNVTWVNLTTGKSGSA

SEQ ID NO: 235940 - protein, 18 aa, Mycobacterium bovis
ADYLRGFIQERWIIRPKS

SEQ ID NO: 235941 - protein, 24 aa, Mycobacterium bovis
AEATAAEQIVLGVINAPTQALLGR

SEQ ID NO: 235942 - protein, 25 aa, Mycobacterium bovis
AEATAAEQIVLGVINAPTQALLGRP

SEQ ID NO: 235943 - protein, 32 aa, Mycobacterium bovis
AGADEVSARIAALFGGFGLEYQAISAQVAAYH

SEQ ID NO: 235944 - protein, 20 aa, Mycobacterium bovis
AGGAGFSRALIVAGDNGGDG

SEQ ID NO: 235945 - protein, 17 aa, Mycobacterium bovis
AGGAGGDAGMFFGSGGS

SEQ ID NO: 235946 - protein, 25 aa, Mycobacterium bovis
AGGAGGRGALLLGAGGQGGLGGAGG

SEQ ID NO: 235947 - protein, 22 aa, Mycobacterium bovis
AGGAGGWIHGHGGVGGDGGSAG

SEQ ID NO: 235948 - protein, 22 aa, Mycobacterium bovis
AGGAGGWIHGHGGVGGDGGTGG

SEQ ID NO: 235949 - protein, 21 aa, Mycobacterium bovis
AGGASGWLMGNGGNGGNGGTG

SEQ ID NO: 235950 - protein, 17 aa, Mycobacterium bovis
AGGLLFGYGGAGGAGGY

SEQ ID NO: 235951 - protein, 19 aa, Mycobacterium bovis
AGGMATGFIGVVLVTAGKA

SEQ ID NO: 235952 - protein, 19 aa, Mycobacterium bovis
AGGRGGWLAGAGGAGGDGG

SEQ ID NO: 235953 - protein, 17 aa, Mycobacterium bovis
AGGRGGWLVGSGGNGGN

SEQ ID NO: 235954 - protein, 25 aa, Mycobacterium bovis
AGPVGPAACWRVRTVPPAPPPPAAA

SEQ ID NO: 235955 - protein, 23 aa, Mycobacterium bovis
AGTGGRGGLLAGQHANSGNGGGG

SEQ ID NO: 235956 - protein, 28 aa, Mycobacterium bovis
AISAQVAAYHQRFVQASSTGAGAYASAE

SEQ ID NO: 235957 - protein, 19 aa, Mycobacterium bovis
ALLGRPLIGDGANATTPGG

SEQ ID NO: 235958 - protein, 18 aa, Mycobacterium bovis
ALLGRPLIGDGAVGTASS

SEQ ID NO: 235959 - protein, 19 aa, Mycobacterium bovis
ALWGRPLIGNGADGTAANP

SEQ ID NO: 235960 - protein, 20 aa, Mycobacterium bovis
ARIGSALSLASAVAAAQTSA

SEQ ID NO: 235961 - protein, 24 aa, Mycobacterium bovis
ATPLRPGIWRAYADHRMAMAGAII

SEQ ID NO: 235962 - protein, 17 aa, Mycobacterium bovis
ATVCLVASCANADPLGS

SEQ ID NO: 235963 - protein, 27 aa, Mycobacterium bovis
DEVSAAIASLFSGYARDYQALSAQMAR

SEQ ID NO: 235964 - protein, 24 aa, Mycobacterium bovis
DEVSAALASLFSGHAVSYQQVAAQ

SEQ ID NO: 235965 - protein, 23 aa, Mycobacterium bovis
EATAAEQIVLGVINAPTQALLGR

SEQ ID NO: 235966 - protein, 19 aa, Mycobacterium bovis
EFVTAAAGDLTNLGSSISA

SEQ ID NO: 235967 - protein, 20 aa, Mycobacterium bovis
ELGQPLPLFIKWDDADYGLR

SEQ ID NO: 235968 - protein, 19 aa, Mycobacterium bovis
EPMCKRLVMSGGFYRAIQR

SEQ ID NO: 235969 - protein, 17 aa, Mycobacterium bovis
EVARIGSALSLASAVAA

SEQ ID NO: 235970 - protein, 23 aa, Mycobacterium bovis
EVSAALASLFSGHAVSYQQVAAQ

SEQ ID NO: 235971 - protein, 25 aa, Mycobacterium bovis
EVSIAVAALFGMHGQAYQALSVQAS

SEQ ID NO: 235972 - protein, 21 aa, Mycobacterium bovis
EVSTAIAALFGAHGQAYQALS

SEQ ID NO: 235973 - protein, 17 aa, Mycobacterium bovis
FKPGFPMAEWASKRRAQ

SEQ ID NO: 235974 - protein, 21 aa, Mycobacterium bovis
FVAATGRPLIGNGANGAPGTG

SEQ ID NO: 235975 - protein, 22 aa, Mycobacterium bovis
GAGGASGWLMGNGGNGGNGGTG

SEQ ID NO: 235976 - protein, 18 aa, Mycobacterium bovis
GAGGNAWLFGAGGSGGAG

SEQ ID NO: 235977 - protein, 23 aa, Mycobacterium bovis
GAGGPGGLIWGGGGAGGVGGAGG

SEQ ID NO: 235978 - protein, 20 aa, Mycobacterium bovis
GAGGRGGWLAGAGGAGGDGG

SEQ ID NO: 235979 - protein, 18 aa, Mycobacterium bovis
GAPYAWGGAAPGGFDCSG

SEQ ID NO: 235980 - protein, 28 aa, Mycobacterium bovis
GATGGTGFSLGACGAGGAGGNTGVGGTN

SEQ ID NO: 235981 - protein, 18 aa, Mycobacterium bovis
GCNDVFWCWVLSRCRHRP

SEQ ID NO: 235982 - protein, 31 aa, Mycobacterium bovis
GDGGEGATGLGLDLSGFAGGQGGQGGAGGNA

SEQ ID NO: 235983 - protein, 24 aa, Mycobacterium bovis
GGAGGAGGWLFGVGGAGGVGGAGG

SEQ ID NO: 235984 - protein, 23 aa, Mycobacterium bovis
GGAGGASGWLMGNGGNGGNGGTG

SEQ ID NO: 235985 - protein, 25 aa, Mycobacterium bovis
GGAGGRAELLFGAGGAGGAGGAGTD

SEQ ID NO: 235986 - protein, 19 aa, Mycobacterium bovis
GGAGGRGALLLGAGGQGGL

SEQ ID NO: 235987 - protein, 21 aa, Mycobacterium bovis
GGAPGQCYFQQPAPQGLPIGT

SEQ ID NO: 235988 - protein, 18 aa, Mycobacterium bovis
GGGLPPVPASPGGNGGGG

SEQ ID NO: 235989 - protein, 18 aa, Mycobacterium bovis
GGNGGWLFGNGGAGGSGG

SEQ ID NO: 235990 - protein, 17 aa, Mycobacterium bovis
GGSAGWLSGNGGDAGTG

SEQ ID NO: 235991 - protein, 23 aa, Mycobacterium bovis
GHGGVGGDGGWLAPGGAGGAGGQ

SEQ ID NO: 235992 - protein, 23 aa, Mycobacterium bovis
GKYIPRLGGMAFRDPDWADEVYV

SEQ ID NO: 235993 - protein, 21 aa, Mycobacterium bovis
GLPLRAMVMVLLFLGVVFLLL

SEQ ID NO: 235994 - protein, 21 aa, Mycobacterium bovis
GNGATGPWLFGDGGAGGGGGA

SEQ ID NO: 235995 - protein, 22 aa, Mycobacterium bovis
GPFQALFGRPLIGDGANGAPGQ

SEQ ID NO: 235996 - protein, 31 aa, Mycobacterium bovis
GSAGARRGRRSGRHRRHRRHDRHHRQRRCRR

SEQ ID NO: 235997 - protein, 17 aa, Mycobacterium bovis
GSAGWLSGNGGTGGGGG

SEQ ID NO: 235998 - protein, 23 aa, Mycobacterium bovis
GSGADNPTGAGFAGGAGGTGGAA

SEQ ID NO: 235999 - protein, 25 aa, Mycobacterium bovis
GTGADGGAGGWLFGNGGNGGSGATG

SEQ ID NO: 236000 - protein, 29 aa, Mycobacterium bovis
GTGGAGGAGGWLFGVGGAGGVGGAGGGTG

SEQ ID NO: 236001 - protein, 28 aa, Mycobacterium bovis
GTGGAGGRAELLFGAGGAGGAGGAGTDG

SEQ ID NO: 236002 - protein, 20 aa, Mycobacterium bovis
HAVSLAAVFLALAMGVVLGS

SEQ ID NO: 236003 - protein, 17 aa, Mycobacterium bovis
HRIRFGATVVSARFDDG

SEQ ID NO: 236004 - protein, 18 aa, Mycobacterium bovis
ILLAGLVGMCSFQLGGTK

SEQ ID NO: 236005 - protein, 17 aa, Mycobacterium bovis
IWCFPKFDVPLPTAVRW

SEQ ID NO: 236006 - protein, 20 aa, Mycobacterium bovis
KGCPKETWCVVNAGNYRGSM

SEQ ID NO: 236007 - protein, 17 aa, Mycobacterium bovis
KRLQVILDRQIMRKLAG

SEQ ID NO: 236008 - protein, 21 aa, Mycobacterium bovis
KSTWRSVPLVGHIPSAPGNPG

SEQ ID NO: 236009 - protein, 20 aa, Mycobacterium bovis
LAGTVLRFVPPLAALGSVPV

SEQ ID NO: 236010 - protein, 18 aa, Mycobacterium bovis
LATVCLVASCANADPLGS

SEQ ID NO: 236011 - protein, 17 aa, Mycobacterium bovis
LDYLPVVLEFAATVDPE

SEQ ID NO: 236012 - protein, 17 aa, Mycobacterium bovis
LKIVSCYQYGKGSTADW

SEQ ID NO: 236013 - protein, 17 aa, Mycobacterium bovis
LPSAIYHRFGRVHTYAK

SEQ ID NO: 236014 - protein, 19 aa, Mycobacterium bovis
LPSHCRGLLVGRVAGAHTP

SEQ ID NO: 236015 - protein, 18 aa, Mycobacterium bovis
LPTAVRWAMRIPGGKAVH

SEQ ID NO: 236016 - protein, 19 aa, Mycobacterium bovis
LREDPPRRLAGFPATVTDI

SEQ ID NO: 236017 - protein, 25 aa, Mycobacterium bovis
LSAQMARFHQQFVQALTASVGSYAA

SEQ ID NO: 236018 - protein, 23 aa, Mycobacterium bovis
MEFVSFKGGWQLSRQTAEMLLAM

SEQ ID NO: 236019 - protein, 19 aa, Mycobacterium bovis
NGGDGGWLIGNGGAGGSGA

SEQ ID NO: 236020 - protein, 17 aa, Mycobacterium bovis
NGGNAWLTGQGGNGGNA

SEQ ID NO: 236021 - protein, 17 aa, Mycobacterium bovis
NTGRPLIGNGANGAPGT

SEQ ID NO: 236022 - protein, 19 aa, Mycobacterium bovis
PAAAARLGSRLSIHDQPNL

SEQ ID NO: 236023 - protein, 23 aa, Mycobacterium bovis
PDSPEALPLLFGHIGEGNLHLNV

SEQ ID NO: 236024 - protein, 41 aa, Mycobacterium bovis
PLAHIALASGCCDLAGCVLAAWGWVVMSFVVAVPEALAAAA

SEQ ID NO: 236025 - protein, 18 aa, Mycobacterium bovis
PLKELRRAAPYLVGALKL

SEQ ID NO: 236026 - protein, 26 aa, Mycobacterium bovis
QAGGPGGPAGLWGNGGPGGAGGSGGG

SEQ ID NO: 236027 - protein, 20 aa, Mycobacterium bovis
RCAVGIPTVSGWRMLSGDET

SEQ ID NO: 236028 - protein, 17 aa, Mycobacterium bovis
RKVNALKFIAFVTNPTN

SEQ ID NO: 236029 - protein, 19 aa, Mycobacterium bovis
RLVMSGGFYRAIQRDDVEL

SEQ ID NO: 236030 - protein, 19 aa, Mycobacterium bovis
RRPGGAWMLGKPIQLSEAR

SEQ ID NO: 236031 - protein, 20 aa, Mycobacterium bovis
RYGLRHRIRFGATVVSARFD

SEQ ID NO: 236032 - protein, 18 aa, Mycobacterium bovis
RYLCMLAEILRFHRAAAR

SEQ ID NO: 236033 - protein, 18 aa, Mycobacterium bovis
SALGRPLIGNGANGKPGT

SEQ ID NO: 236034 - protein, 19 aa, Mycobacterium bovis
SEERLRPPPGYKDTTVPGI

SEQ ID NO: 236035 - protein, 25 aa, Mycobacterium bovis
SPTQVRWRPFEFWPANTAVNIDAAG

SEQ ID NO: 236036 - protein, 26 aa, Mycobacterium bovis
STPPPWVRPVPMAVWAATAARAVTAV

SEQ ID NO: 236037 - protein, 21 aa, Mycobacterium bovis
TEPKLKCYLEIRCAVTGDLPA

SEQ ID NO: 236038 - protein, 26 aa, Mycobacterium bovis
TGGAGGPGGLIWGGGGAGGVGGAGGG

SEQ ID NO: 236039 - protein, 23 aa, Mycobacterium bovis
TGGKGGAGGTGFAGGAGGAGGQG

SEQ ID NO: 236040 - protein, 24 aa, Mycobacterium bovis
TQALLGRPLIGDGANATTPGGAGG

SEQ ID NO: 236041 - protein, 24 aa, Mycobacterium bovis
VSLAGSGWCGWVLFEKHQTDVAAG

SEQ ID NO: 236042 - protein, 24 aa, Mycobacterium bovis
VSPLLDPINEFFLANTGRPLIGNG

SEQ ID NO: 236043 - protein, 17 aa, Mycobacterium bovis
WPFAPAKHRAMLANLHP

SEQ ID NO: 236044 - protein, 21 aa, Mycobacterium bovis
YGKGGTVVFGRGVNAGHSGAD

SEQ ID NO: 236045 - protein, 18 aa, Mycobacterium bovis
YPSMIGFLAPLFTAGAGS

SEQ ID NO: 236046 - protein, 24 aa, Mycobacterium bovis
YRRGRRCRWERGVVVGQRRQRRCR

SEQ ID NO: 236047 - protein, 24 aa, Mycobacterium bovis
GTAGNAGIGGAGGRGGDGGAGDSG

SEQ ID NO: 236048 - protein, 29 aa, Mycobacterium bovis
GTGGAGGRAELLFGAGGAGGAGGAGTDGG

SEQ ID NO: 236049 - protein, 17 aa, Mycobacterium bovis
LMLAACILATGVAGLGV

SEQ ID NO: 236050 - protein, 28 aa, Mycobacterium bovis
TGGAGGAGGWLFGVGGAGGVGGAGGGTG

SEQ ID NO: 236051 - protein, 20 aa, Mycobacterium bovis
YWCPGQPFDPAWGPNWDPYT

SEQ ID NO: 236052 - protein, 18 aa, Mycobacterium bovis
EFVTAAAGDLTNLGSSIS

SEQ ID NO: 236053 - protein, 25 aa, Mycobacterium bovis
PATLSVPFSAFPKPQNYPGLPTVSF

SEQ ID NO: 236054 - protein, 32 aa, Mycobacterium bovis
TGGHGGVGGDGGWLAPGGAGGAGGQGGAGGAG

SEQ ID NO: 236055 - protein, 19 aa, Mycobacterium bovis
TQVLAAGADEVSARIAALF

SEQ ID NO: 236056 - protein, 25 aa, Mycobacterium bovis
AAAASLAAIAIAFLAGCSSTKPVSQ

SEQ ID NO: 236057 - protein, 28 aa, Mycobacterium bovis
AAAFAAATLLLTPALAPPASAGCPDAEV

SEQ ID NO: 236058 - protein, 25 aa, Mycobacterium bovis
AAAGAPTMALLAAGADEVSAAVAAV

SEQ ID NO: 236059 - protein, 29 aa, Mycobacterium bovis
AAAHHKPQLAFLPRQAFLDTNIIGTQTVL

SEQ ID NO: 236060 - protein, 25 aa, Mycobacterium bovis
AAAKYWRQQTYDDCVLMSAADVIGQ

SEQ ID NO: 236061 - protein, 19 aa, Mycobacterium bovis
AAALPYCDLFLPAHSLAGL

SEQ ID NO: 236062 - protein, 42 aa, Mycobacterium bovis
AAASPLQALQLELLNAINAPTLALLGRPLIGDGTDAAPGSGG

SEQ ID NO: 236063 - protein, 24 aa, Mycobacterium bovis
AAAVDVTLLSRFYERFADHAVEVA

SEQ ID NO: 236064 - protein, 17 aa, Mycobacterium bovis
AAAVSALLLTGCSGRDA

SEQ ID NO: 236065 - protein, 27 aa, Mycobacterium bovis
AAESLWALLARVLPEPWRVEALVLLAF

SEQ ID NO: 236066 - protein, 26 aa, Mycobacterium bovis
AAGAVVAAALRAIRAAAAPGTSSLSL

SEQ ID NO: 236067 - protein, 17 aa, Mycobacterium bovis
AAGLLGVGGHGGAGGHG

SEQ ID NO: 236068 - protein, 24 aa, Mycobacterium bovis
AAGVITIAVALAAPPPAAHAKNGD

SEQ ID NO: 236069 - protein, 24 aa, Mycobacterium bovis
AAKSLGWRAAPIPRNAPGCRGCCQ

SEQ ID NO: 236070 - protein, 25 aa, Mycobacterium bovis
AALADTAWQGPAATAMAAAAAPYAS

SEQ ID NO: 236071 - protein, 22 aa, Mycobacterium bovis
AALITALLVLTGCTKSISGTAV

SEQ ID NO: 236072 - protein, 17 aa, Mycobacterium bovis
AALPALAAGGLPPGLPA

SEQ ID NO: 236073 - protein, 44 aa, Mycobacterium bovis
AANASPLQALEQQVLAAINAPTQTLLGRPLIGNGADGLPGQNGG

SEQ ID NO: 236074 - protein, 26 aa, Mycobacterium bovis
AANSWLDAFAHWRRAQGLPATSIAWG

SEQ ID NO: 236075 - protein, 22 aa, Mycobacterium bovis
AATAIGIPPQVAAALTVVATQR

SEQ ID NO: 236076 - protein, 17 aa, Mycobacterium bovis
AAVFLALAMGVVLGSGF

SEQ ID NO: 236077 - protein, 41 aa, Mycobacterium bovis
AAVYEAARAATVDPLLVAANRHQLVSLVLSNLFGQNAPAIA

SEQ ID NO: 236078 - protein, 27 aa, Mycobacterium bovis
ADEVSVLIAALFEAYAQEYQALSAQAL

SEQ ID NO: 236079 - protein, 27 aa, Mycobacterium bovis
ADLVYHLTTLFPPVRPRQWLEIRYLDS

SEQ ID NO: 236080 - protein, 32 aa, Mycobacterium bovis
ADPPAPAPRPILPPLAPGQVLRIGPTAGTGTP

SEQ ID NO: 236081 - protein, 18 aa, Mycobacterium bovis
ADVLINNAFRVPSMKPLA

SEQ ID NO: 236082 - protein, 26 aa, Mycobacterium bovis
AEGARAFQTLLRYGRAYSGYAPIMGT

SEQ ID NO: 236083 - protein, 25 aa, Mycobacterium bovis
AELPGEPPRLFVVTRSAASVLPSDL

SEQ ID NO: 236084 - protein, 17 aa, Mycobacterium bovis
AELSSRLPPRGLTQAAR

SEQ ID NO: 236085 - protein, 19 aa, Mycobacterium bovis
AESIRPLVAPPPAPAPAPA

SEQ ID NO: 236086 - protein, 23 aa, Mycobacterium bovis
AFGWVAFEFGVHRYGLQQRLAPH

SEQ ID NO: 236087 - protein, 19 aa, Mycobacterium bovis
AFKTATFALAAGAVALGLA

SEQ ID NO: 236088 - protein, 19 aa, Mycobacterium bovis
AFTIEARALTFQPKRIRRQ

SEQ ID NO: 236089 - protein, 24 aa, Mycobacterium bovis
AGAAGKGGIFPDGSNGGAGGDAGD

SEQ ID NO: 236090 - protein, 54 aa, Mycobacterium bovis
AGADEVSLAISALFGQHAQAYQALSAQATIFHDQFVQALTSGGNLYAAAESHTV

SEQ ID NO: 236091 - protein, 26 aa, Mycobacterium bovis
AGDGGTGGRGGWLAGAGGAGGDGGIG

SEQ ID NO: 236092 - protein, 18 aa, Mycobacterium bovis
AGDLTNLGSSISAANASA

SEQ ID NO: 236093 - protein, 21 aa, Mycobacterium bovis
AGGAGGFGFLGGDGGAGGNAG

SEQ ID NO: 236094 - protein, 29 aa, Mycobacterium bovis
AGGAGGRGALLLGAGGQGGLGGAGGQGGT

SEQ ID NO: 236095 - protein, 22 aa, Mycobacterium bovis
AGGDGGWLFGDGGAGGTGGNGG

SEQ ID NO: 236096 - protein, 22 aa, Mycobacterium bovis
AGGLGGTLYGAGGHGGAGGPGP

SEQ ID NO: 236097 - protein, 24 aa, Mycobacterium bovis
AGGMLRRMRPLFSVGLGARLGSGR

SEQ ID NO: 236098 - protein, 24 aa, Mycobacterium bovis
AGGNAGLFGVGGTGGPGGPGGPGG

SEQ ID NO: 236099 - protein, 24 aa, Mycobacterium bovis
AGGNAGLLGVGGAGGHGASGGAGD

SEQ ID NO: 236100 - protein, 20 aa, Mycobacterium bovis
AGGNAGMLFGAAGVGGVGGF

SEQ ID NO: 236101 - protein, 23 aa, Mycobacterium bovis
AGGNAGWLGFGGAGGIGGIGGNA

SEQ ID NO: 236102 - protein, 23 aa, Mycobacterium bovis
AGGNGGWLYGSGGNGGAGGAGPA

SEQ ID NO: 236103 - protein, 26 aa, Mycobacterium bovis
AGGPGGAGGLISLLGGQGAGGDGGDG

SEQ ID NO: 236104 - protein, 24 aa, Mycobacterium bovis
AGIERTFVAYLKMAGKTAQDTSFD

SEQ ID NO: 236105 - protein, 30 aa, Mycobacterium bovis
AGKASADPLLPPPPIPAPVSAPATVPPVQN

SEQ ID NO: 236106 - protein, 17 aa, Mycobacterium bovis
AGLLYLVSELDGHPMCG

SEQ ID NO: 236107 - protein, 33 aa, Mycobacterium bovis
AGLPPLPAVPALPAPPPLPGPPPLPALPSRLCT

SEQ ID NO: 236108 - protein, 29 aa, Mycobacterium bovis
AGPDQPALRPLLDLLPIAGGSGTLGERFL

SEQ ID NO: 236109 - protein, 26 aa, Mycobacterium bovis
AGRLGLRPDVRRMPLFGLGCVAGAAG

SEQ ID NO: 236110 - protein, 23 aa, Mycobacterium bovis
AGSWHIRWAALTPARQAAVIVAA

SEQ ID NO: 236111 - protein, 19 aa, Mycobacterium bovis
AGVGIKLPHYSGSQYNLGR

SEQ ID NO: 236112 - protein, 17 aa, Mycobacterium bovis
AGWLVERAGFGKGYPDA

SEQ ID NO: 236113 - protein, 19 aa, Mycobacterium bovis
AHLPLIDLTPRQAALNPPP

SEQ ID NO: 236114 - protein, 18 aa, Mycobacterium bovis
AHMVLTVNGKIPGLSLKT

SEQ ID NO: 236115 - protein, 19 aa, Mycobacterium bovis
AHSHQPLRWGPPEAPDRYV

SEQ ID NO: 236116 - protein, 25 aa, Mycobacterium bovis
AIAPGAPPAALPPGAPPGDGPAPGV

SEQ ID NO: 236117 - protein, 28 aa, Mycobacterium bovis
AIGRIRAMHMALLPDRVPAAEALSWGLV

SEQ ID NO: 236118 - protein, 19 aa, Mycobacterium bovis
AIKLKNWVATLTLSLKKDV

SEQ ID NO: 236119 - protein, 24 aa, Mycobacterium bovis
AIPGGQFRWLTVDLPPIVDLRTRL

SEQ ID NO: 236120 - protein, 17 aa, Mycobacterium bovis
AIQPIYGPTLDGTLPGN

SEQ ID NO: 236121 - protein, 19 aa, Mycobacterium bovis
AIRGNRVLIGFSLPGKTIG

SEQ ID NO: 236122 - protein, 20 aa, Mycobacterium bovis
AITLWLGLVAQFGQMITGGS

SEQ ID NO: 236123 - protein, 30 aa, Mycobacterium bovis
AIYGGMKLDLLLTVPLDYYKKFMSVNHDGV

SEQ ID NO: 236124 - protein, 22 aa, Mycobacterium bovis
AIYQRWQALGGMNSALGAPTSP

SEQ ID NO: 236125 - protein, 23 aa, Mycobacterium bovis
AKAVEALRRSDFGGRIILFGDEE

SEQ ID NO: 236126 - protein, 28 aa, Mycobacterium bovis
AKHTTTPSVLFLLLKTIATSRSHRASTS

SEQ ID NO: 236127 - protein, 23 aa, Mycobacterium bovis
ALAAAAPVWPAPISGCRGFSTSL

SEQ ID NO: 236128 - protein, 24 aa, Mycobacterium bovis
ALAADLLFLALRDALTEKLDIPIH

SEQ ID NO: 236129 - protein, 18 aa, Mycobacterium bovis
ALAALFAMIALTGSACLA

SEQ ID NO: 236130 - protein, 27 aa, Mycobacterium bovis
ALAALLAVAGLFVPFIVGVPTAYDGEP

SEQ ID NO: 236131 - protein, 18 aa, Mycobacterium bovis
ALADKLLPARFTAALAQA

SEQ ID NO: 236132 - protein, 25 aa, Mycobacterium bovis
ALAGRRVVINLWAHWCAPCMTELPV

SEQ ID NO: 236133 - protein, 24 aa, Mycobacterium bovis
ALARQFVAMVTAAAGRRILDQSGF

SEQ ID NO: 236134 - protein, 27 aa, Mycobacterium bovis
ALASGPAALAIPALGIGNTGIGNIFSI

SEQ ID NO: 236135 - protein, 24 aa, Mycobacterium bovis
ALASSLLRVWMTRGRIQEGRAWFD

SEQ ID NO: 236136 - protein, 26 aa, Mycobacterium bovis
ALATIARWLLTRRSVILREVGPETTP

SEQ ID NO: 236137 - protein, 17 aa, Mycobacterium bovis
ALCVPRDAIARDAGVPI

SEQ ID NO: 236138 - protein, 23 aa, Mycobacterium bovis
ALDRVSAFQLGFINGTPACAAID

SEQ ID NO: 236139 - protein, 38 aa, Mycobacterium bovis
ALHWDRILFCAKEATYKAWFPLTKRWLGFEDAHITFET

SEQ ID NO: 236140 - protein, 17 aa, Mycobacterium bovis
ALMLFQIRQADGSVTRF

SEQ ID NO: 236141 - protein, 23 aa, Mycobacterium bovis
ALQQLVPRTPAALYWGARLTLVS

SEQ ID NO: 236142 - protein, 26 aa, Mycobacterium bovis
ALRGDRTMFLFVFRAEHDNPGVAPKD

SEQ ID NO: 236143 - protein, 19 aa, Mycobacterium bovis
ALSQPLTDLSTRCSLPISG

SEQ ID NO: 236144 - protein, 22 aa, Mycobacterium bovis
ALTSPGLTPTLPGSLAAPGTTL

SEQ ID NO: 236145 - protein, 17 aa, Mycobacterium bovis
ALVLVGCIRVVGGRARM

SEQ ID NO: 236146 - protein, 19 aa, Mycobacterium bovis
ALYSPNLWQHLTDGLSELV

SEQ ID NO: 236147 - protein, 18 aa, Mycobacterium bovis
ALYWGARLTLVSRVDELA

SEQ ID NO: 236148 - protein, 23 aa, Mycobacterium bovis
AMAAAAAPYAGWLGSVAAQAVAV

SEQ ID NO: 236149 - protein, 19 aa, Mycobacterium bovis
AMHDMFVNTLGISAGTYGV

SEQ ID NO: 236150 - protein, 29 aa, Mycobacterium bovis
AMTASAEYLRLLRRHNVAAALSGAGPSLI

SEQ ID NO: 236151 - protein, 25 aa, Mycobacterium bovis
AMTVPPAEVAANRALLAALVATNVL

SEQ ID NO: 236152 - protein, 23 aa, Mycobacterium bovis
ANDPQAIYLNYIGSAGGVFQRDG

SEQ ID NO: 236153 - protein, 26 aa, Mycobacterium bovis
ANGGITMRPYLVGSLKGPDLANISTT

SEQ ID NO: 236154 - protein, 21 aa, Mycobacterium bovis
ANIISDKLFQRVGARPDSVTC

SEQ ID NO: 236155 - protein, 31 aa, Mycobacterium bovis
ANLRSDPFVAILRFPFIPQAMREHYAELEIK

SEQ ID NO: 236156 - protein, 19 aa, Mycobacterium bovis
ANYHLAWYAVTTRRGGSRG

SEQ ID NO: 236157 - protein, 28 aa, Mycobacterium bovis
APDAGPPQRWFVVWLGTANNPVDKGAAK

SEQ ID NO: 236158 - protein, 23 aa, Mycobacterium bovis
APFLSYGQFTGSAPRDLCALWPV

SEQ ID NO: 236159 - protein, 18 aa, Mycobacterium bovis
APGSWRTRTWWTGTPDSS

SEQ ID NO: 236160 - protein, 19 aa, Mycobacterium bovis
APIVLKGLFRLKSNCPSAL

SEQ ID NO: 236161 - protein, 17 aa, Mycobacterium bovis
APKWWFTVGGQVRPGER

SEQ ID NO: 236162 - protein, 22 aa, Mycobacterium bovis
APLGEPLPAAPAELAPPADLAP

SEQ ID NO: 236163 - protein, 24 aa, Mycobacterium bovis
APREPYVHWIVIGIAPGAGSTADG

SEQ ID NO: 236164 - protein, 17 aa, Mycobacterium bovis
APRGVVITYRNLLSNMR

SEQ ID NO: 236165 - protein, 18 aa, Mycobacterium bovis
APTLLYLAAAGVGTIGIV

SEQ ID NO: 236166 - protein, 29 aa, Mycobacterium bovis
APTVALTAYLRALPADGWLRVLCTCVEIG

SEQ ID NO: 236167 - protein, 27 aa, Mycobacterium bovis
APVLWDEMPTLPLYRQQRTLLMSTKMY

SEQ ID NO: 236168 - protein, 17 aa, Mycobacterium bovis
APWAPFAVDFHLANVGG

SEQ ID NO: 236169 - protein, 17 aa, Mycobacterium bovis
AQAAAVHAQFVEALSAG

SEQ ID NO: 236170 - protein, 19 aa, Mycobacterium bovis
AQFVAIAARYHIKPLFVLF

SEQ ID NO: 236171 - protein, 25 aa, Mycobacterium bovis
AQGIPPQFLVDILTNLRTDRLVRSH

SEQ ID NO: 236172 - protein, 17 aa, Mycobacterium bovis
AQLNPRLPQLGYDVRRL

SEQ ID NO: 236173 - protein, 26 aa, Mycobacterium bovis
AQNFNTTFPVGPFFGLGVVNISGIEI

SEQ ID NO: 236174 - protein, 36 aa, Mycobacterium bovis
AQSVEQDLLAAINARFERIFGRPLIGDGANGGPGQD

SEQ ID NO: 236175 - protein, 25 aa, Mycobacterium bovis
AQTLIPPPPIVAPPPPRPAPPQQPP

SEQ ID NO: 236176 - protein, 20 aa, Mycobacterium bovis
ARAAAPLAPLALAMVLASCG

SEQ ID NO: 236177 - protein, 30 aa, Mycobacterium bovis
ARHRAPSASLLVIAPPWPTADVPGPMLRIR

SEQ ID NO: 236178 - protein, 17 aa, Mycobacterium bovis
ARRAWLAELAEERRTCV

SEQ ID NO: 236179 - protein, 29 aa, Mycobacterium bovis
ARRVADVLGIPFYVWDFAEKFKEDVINDF

SEQ ID NO: 236180 - protein, 26 aa, Mycobacterium bovis
ARYHIKPLFVLFDSCWDPLPRPGRQR

SEQ ID NO: 236181 - protein, 22 aa, Mycobacterium bovis
ASAIGMLSVPPAWAGQATLVST

SEQ ID NO: 236182 - protein, 26 aa, Mycobacterium bovis
ASAQAAAFYAQFVQALSAGGGAYAAA

SEQ ID NO: 236183 - protein, 24 aa, Mycobacterium bovis
ASDNAFFMLAHTNVGLMPDGGASA

SEQ ID NO: 236184 - protein, 24 aa, Mycobacterium bovis
ASEIYPPLKAWQRMGRPTIAVNAN

SEQ ID NO: 236185 - protein, 21 aa, Mycobacterium bovis
ASELFFGRPAPTPQQWLQIVT

SEQ ID NO: 236186 - protein, 26 aa, Mycobacterium bovis
ASGQPLPEFLSAEIFQPLGLAMVVDP

SEQ ID NO: 236187 - protein, 19 aa, Mycobacterium bovis
ASGRVAYTLGLHGPAVTVD

SEQ ID NO: 236188 - protein, 22 aa, Mycobacterium bovis
ASLAAGTWLLRALHGTPAALGA

SEQ ID NO: 236189 - protein, 25 aa, Mycobacterium bovis
ASNVVRWVPHRYWPPHTRVSVGVQE

SEQ ID NO: 236190 - protein, 17 aa, Mycobacterium bovis
ASPFGMALVAATVAAGK

SEQ ID NO: 236191 - protein, 26 aa, Mycobacterium bovis
ASVVATALTFPFAGGLGLMSNRASEV

SEQ ID NO: 236192 - protein, 24 aa, Mycobacterium bovis
ATAIDPQHRLLLEVSWEAIEHAGV

SEQ ID NO: 236193 - protein, 32 aa, Mycobacterium bovis
ATDGRPPVIQLWARPRGVAPDALFALLCGDLS

SEQ ID NO: 236194 - protein, 24 aa, Mycobacterium bovis
ATDLCEFVEFPSQLLQVCGDSFAG

SEQ ID NO: 236195 - protein, 30 aa, Mycobacterium bovis
ATDVLHYLYAHLRLLWMCRERLLAELGDIS

SEQ ID NO: 236196 - protein, 21 aa, Mycobacterium bovis
ATFAKGAMYWSPVTDAQPITG

SEQ ID NO: 236197 - protein, 19 aa, Mycobacterium bovis
ATIALQRQLVDRDLPQLVD

SEQ ID NO: 236198 - protein, 22 aa, Mycobacterium bovis
ATLGILEHFPMSDYAPSKVDLN

SEQ ID NO: 236199 - protein, 21 aa, Mycobacterium bovis
ATMFVALLGLSTISSKADDID

SEQ ID NO: 236200 - protein, 17 aa, Mycobacterium bovis
ATTGLYPPGSTFKMITA

SEQ ID NO: 236201 - protein, 18 aa, Mycobacterium bovis
ATVALSLALAGCSFNIKT

SEQ ID NO: 236202 - protein, 25 aa, Mycobacterium bovis
ATYGSSVLILPDALLDAVHISASLC

SEQ ID NO: 236203 - protein, 31 aa, Mycobacterium bovis
AVAEFPGFAFFEIQLRLPVNGRWVLVVTGGT

SEQ ID NO: 236204 - protein, 23 aa, Mycobacterium bovis
AVAEVTRLRQGWGAWPVCAVRAG

SEQ ID NO: 236205 - protein, 20 aa, Mycobacterium bovis
AVALFIAAIVVLVVAIRRPK

SEQ ID NO: 236206 - protein, 17 aa, Mycobacterium bovis
AVASPCAYFLVYESTET

SEQ ID NO: 236207 - protein, 24 aa, Mycobacterium bovis
AVDFVGWYNAHPHFEQISPDLSGA

SEQ ID NO: 236208 - protein, 50 aa, Mycobacterium bovis
AVEPWVQYGFNLTAWAVGWLPYIGILAPQINFFYYLGEPIVQAVLFNAID

SEQ ID NO: 236209 - protein, 18 aa, Mycobacterium bovis
AVHAQFVEALSAGAGAYA

SEQ ID NO: 236210 - protein, 24 aa, Mycobacterium bovis
AVIAAASLLPKSWIAVGTGRADDV

SEQ ID NO: 236211 - protein, 24 aa, Mycobacterium bovis
AVKGGVPFLPLNRIPQLAGSINDI

SEQ ID NO: 236212 - protein, 17 aa, Mycobacterium bovis
AVLQLRGAGGLPSAAIG

SEQ ID NO: 236213 - protein, 19 aa, Mycobacterium bovis
AVLSAQPVYFDYWSARGVD

SEQ ID NO: 236214 - protein, 23 aa, Mycobacterium bovis
AVPLNSQYRWPAMAGAAVAVTRA

SEQ ID NO: 236215 - protein, 18 aa, Mycobacterium bovis
AVPPLQPIPGVASVSPAN

SEQ ID NO: 236216 - protein, 27 aa, Mycobacterium bovis
AVPVELPLCALLTAWVRGQARPEARAQ

SEQ ID NO: 236217 - protein, 17 aa, Mycobacterium bovis
AVRAFMQAAIGPGQEGL

SEQ ID NO: 236218 - protein, 27 aa, Mycobacterium bovis
AVSIGILLSLIAPLGPPLARADGTSQL

SEQ ID NO: 236219 - protein, 34 aa, Mycobacterium bovis
AVTPLQQLVDVINAPFRSALGRPLIGNGANGKPG

SEQ ID NO: 236220 - protein, 23 aa, Mycobacterium bovis
AVVPHAVLVLSACGFKPGFPMAE

SEQ ID NO: 236221 - protein, 19 aa, Mycobacterium bovis
AYQPKFTHHMYLPMDVDAG

SEQ ID NO: 236222 - protein, 23 aa, Mycobacterium bovis
CGSIVSGLRMRPGNWAGIYACWG

SEQ ID NO: 236223 - protein, 26 aa, Mycobacterium bovis
CGSPAWDLPTVFGPIAITYNIKGVST

SEQ ID NO: 236224 - protein, 17 aa, Mycobacterium bovis
CNLIAWDRGVFMAVAQE

SEQ ID NO: 236225 - protein, 19 aa, Mycobacterium bovis
CSVLALGLLAGCAPPRTGP

SEQ ID NO: 236226 - protein, 22 aa, Mycobacterium bovis
CVAYIGISFLDQASQRGLGEAQ

SEQ ID NO: 236227 - protein, 23 aa, Mycobacterium bovis
CVDSAVMHYFLDGTLPPTSLRCA

SEQ ID NO: 236228 - protein, 29 aa, Mycobacterium bovis
CWQTITRELWPAPYLVMDTGASLAPYNHV

SEQ ID NO: 236229 - protein, 18 aa, Mycobacterium bovis
CYLLAFLGGSAVAWVVVT

SEQ ID NO: 236230 - protein, 23 aa, Mycobacterium bovis
DAARLLTERFAAPLLLSSRTTEH

SEQ ID NO: 236231 - protein, 26 aa, Mycobacterium bovis
DAEPGRITVILALHDLINGGHVGHYG

SEQ ID NO: 236232 - protein, 25 aa, Mycobacterium bovis
DAGHSVRFLVRNPARLKTSVAKLGV

SEQ ID NO: 236233 - protein, 29 aa, Mycobacterium bovis
DAQRILFHDMPVVPLWDYISVVGWSSQVS

SEQ ID NO: 236234 - protein, 23 aa, Mycobacterium bovis
DASQQVFGFAPYPAVAPGQPAKV

SEQ ID NO: 236235 - protein, 28 aa, Mycobacterium bovis
DCAASPAGWLFVSRWTAGGNSLHIRAGD

SEQ ID NO: 236236 - protein, 26 aa, Mycobacterium bovis
DDPEFHPPRLGDLKRSCLDIGLAERV

SEQ ID NO: 236237 - protein, 23 aa, Mycobacterium bovis
DDVGFLVALAAKLVHDFDIAPGH

SEQ ID NO: 236238 - protein, 24 aa, Mycobacterium bovis
DELKLYDTPAMPPPIFVAASGPQS

SEQ ID NO: 236239 - protein, 24 aa, Mycobacterium bovis
DEVSALQAALFTAYGTFYQQVSAE

SEQ ID NO: 236240 - protein, 23 aa, Mycobacterium bovis
DEVWPAVVFTLVTLLDDPVAADL

SEQ ID NO: 236241 - protein, 31 aa, Mycobacterium bovis
DFVTSLQLLLTFPFPNFGIKQAVRGDYLNVF

SEQ ID NO: 236242 - protein, 24 aa, Mycobacterium bovis
DGAALPWSLTLKTTAPSAAPNILA

SEQ ID NO: 236243 - protein, 28 aa, Mycobacterium bovis
DGAYLVTGGLGGLGLFLAGELAAAGCGR

SEQ ID NO: 236244 - protein, 34 aa, Mycobacterium bovis
DGDIWDWAVDWDTWVSMSALPPPAAKPAATQIPV

SEQ ID NO: 236245 - protein, 34 aa, Mycobacterium bovis
DGNWLGNLLEEIGILLLPIAPELTPFFLEAGEIV

SEQ ID NO: 236246 - protein, 19 aa, Mycobacterium bovis
DGRFRFLRVYPNPEVYAPV

SEQ ID NO: 236247 - protein, 28 aa, Mycobacterium bovis
DGVLVWTMSNPRWTCDYGLAVVPHAVLV

SEQ ID NO: 236248 - protein, 18 aa, Mycobacterium bovis
DHGPFDLTLLPIGAYNTA

SEQ ID NO: 236249 - protein, 26 aa, Mycobacterium bovis
DIHETMVIPPIVFLPSMTIGGQTYTI

SEQ ID NO: 236250 - protein, 24 aa, Mycobacterium bovis
DINTPAFEWYYQSGLSIVMPVGGQ

SEQ ID NO: 236251 - protein, 31 aa, Mycobacterium bovis
DKIARMLLIWAALAAVALVLVGCIRVVGGRA

SEQ ID NO: 236252 - protein, 28 aa, Mycobacterium bovis
DLGALSSWYVWAALGLYPSTPGTTILTV

SEQ ID NO: 236253 - protein, 22 aa, Mycobacterium bovis
DLGVITAIPQPLRALAHTRGVR

SEQ ID NO: 236254 - protein, 37 aa, Mycobacterium bovis
DLGYDRRQVLQRLKYLPLAPFRISYAYTNFGVTAAAE

SEQ ID NO: 236255 - protein, 21 aa, Mycobacterium bovis
DLHKMRRLIIASEPVHAEGMR

SEQ ID NO: 236256 - protein, 18 aa, Mycobacterium bovis
DLNWRPRFDLNAVAARLA

SEQ ID NO: 236257 - protein, 26 aa, Mycobacterium bovis
DLPSSTQLPVWLAHAGIDVLRSHPIV

SEQ ID NO: 236258 - protein, 25 aa, Mycobacterium bovis
DLQPFPLPALTCLLRSITLRMTMAP

SEQ ID NO: 236259 - protein, 17 aa, Mycobacterium bovis
DLTLLPIGAYNTAWPDI

SEQ ID NO: 236260 - protein, 17 aa, Mycobacterium bovis
DMHMAIASALNMYDNVL

SEQ ID NO: 236261 - protein, 23 aa, Mycobacterium bovis
DMPIATLAAMRRGEQLPFGLRGF

SEQ ID NO: 236262 - protein, 25 aa, Mycobacterium bovis
DNLTVLRTLLRLMDRDPDDFDHVTD

SEQ ID NO: 236263 - protein, 20 aa, Mycobacterium bovis
DNPRYVIGIMLDNPARNSDG

SEQ ID NO: 236264 - protein, 25 aa, Mycobacterium bovis
DPANPAFRDGAAPKWWFTVGGQVRP

SEQ ID NO: 236265 - protein, 18 aa, Mycobacterium bovis
DPDVHYPYLYGSPGGRTR

SEQ ID NO: 236266 - protein, 18 aa, Mycobacterium bovis
DPFLPNEGAPGRGPLLAA

SEQ ID NO: 236267 - protein, 30 aa, Mycobacterium bovis
DPHSRQLLAAQIIWTLARADIRGPYVINAD

SEQ ID NO: 236268 - protein, 25 aa, Mycobacterium bovis
DPLIPNPPPIPVPPPAAQTLIPPPP

SEQ ID NO: 236269 - protein, 29 aa, Mycobacterium bovis
DPRLNTGLTPFLLGPVYISNNPSGVGTVV

SEQ ID NO: 236270 - protein, 29 aa, Mycobacterium bovis
DPVLAEWFLRRFSLLDSLYMVPSVPIIGR

SEQ ID NO: 236271 - protein, 20 aa, Mycobacterium bovis
DQISLLLRRTIDPDRPLSDY

SEQ ID NO: 236272 - protein, 25 aa, Mycobacterium bovis
DQLKTDAKLLSSILTYHVIAGQASP

SEQ ID NO: 236273 - protein, 19 aa, Mycobacterium bovis
DQRIRQVAPFLSYGQFTGS

SEQ ID NO: 236274 - protein, 22 aa, Mycobacterium bovis
DQYGSIPLPKSFQAKLAAAVNA

SEQ ID NO: 236275 - protein, 24 aa, Mycobacterium bovis
DRDVASVFLPLQRVLGCQQNTAGS

SEQ ID NO: 236276 - protein, 24 aa, Mycobacterium bovis
DRFADFPALPLDPSAMVAQVGPQV

SEQ ID NO: 236277 - protein, 27 aa, Mycobacterium bovis
DRSLHRVVLLALLPLGLAAAPGRTTRA

SEQ ID NO: 236278 - protein, 25 aa, Mycobacterium bovis
DSVVPLIVNLYAFGARDFDLKSALH

SEQ ID NO: 236279 - protein, 30 aa, Mycobacterium bovis
DTVKTTMEALWWDRPFALAGVDIGASVAAL

SEQ ID NO: 236280 - protein, 24 aa, Mycobacterium bovis
DVAALALIRFPATGDKIGSLVINP

SEQ ID NO: 236281 - protein, 22 aa, Mycobacterium bovis
DVDTFYTCLYRSLLHPNTFNDV

SEQ ID NO: 236282 - protein, 17 aa, Mycobacterium bovis
DVDYPLLAKMRSASRRA

SEQ ID NO: 236283 - protein, 17 aa, Mycobacterium bovis
DVRLLFSLGLRAMERTA

SEQ ID NO: 236284 - protein, 25 aa, Mycobacterium bovis
DVSGGLPAFTLFPGGLNIPQNAIPL

SEQ ID NO: 236285 - protein, 18 aa, Mycobacterium bovis
DYVPFTDWVDGRVLLDGR

SEQ ID NO: 236286 - protein, 21 aa, Mycobacterium bovis
EAALGVFQTLPKRVHERFDLV

SEQ ID NO: 236287 - protein, 22 aa, Mycobacterium bovis
EAAWRNLSLALPLSAAVQRAFN

SEQ ID NO: 236288 - protein, 22 aa, Mycobacterium bovis
EALAATATYLTGIGSAINAANA

SEQ ID NO: 236289 - protein, 18 aa, Mycobacterium bovis
EALVAVASDLAGIGSALA

SEQ ID NO: 236290 - protein, 25 aa, Mycobacterium bovis
EARRHGWTFPYLYDETQDVARAFSA

SEQ ID NO: 236291 - protein, 17 aa, Mycobacterium bovis
EDFWRSAGLPAYRWPDP

SEQ ID NO: 236292 - protein, 19 aa, Mycobacterium bovis
EDIRFGLYGALAHPMESAA

SEQ ID NO: 236293 - protein, 22 aa, Mycobacterium bovis
EELRKMFNSLGIQYGPAFSGLV

SEQ ID NO: 236294 - protein, 22 aa, Mycobacterium bovis
EERRTCVFFESPRRLAACLNDA

SEQ ID NO: 236295 - protein, 22 aa, Mycobacterium bovis
EFNVALPWRKEVSLSKSSLHPA

SEQ ID NO: 236296 - protein, 18 aa, Mycobacterium bovis
EFYLVHRTRRFEPAVQGR

SEQ ID NO: 236297 - protein, 25 aa, Mycobacterium bovis
EGPSNPLILVFGRVSELSTCSWSTH

SEQ ID NO: 236298 - protein, 24 aa, Mycobacterium bovis
EHGRTPWRDLFGPAVTLADGGFDI

SEQ ID NO: 236299 - protein, 18 aa, Mycobacterium bovis
EIDIGHRTIPNYGGFDLG

SEQ ID NO: 236300 - protein, 24 aa, Mycobacterium bovis
EINWIRGFLPPLPPISPPGFPSLP

SEQ ID NO: 236301 - protein, 19 aa, Mycobacterium bovis
EIYLNTFRHLYGLDCSHIA

SEQ ID NO: 236302 - protein, 39 aa, Mycobacterium bovis
EKTIQQAIELWKIVDRPNLFIKIPATKAGLPAISAVLAE

SEQ ID NO: 236303 - protein, 17 aa, Mycobacterium bovis
ELGKQVEILPGLQAINA

SEQ ID NO: 236304 - protein, 25 aa, Mycobacterium bovis
ELKTNSSLLTSILTYHVVAGQTSPA

SEQ ID NO: 236305 - protein, 26 aa, Mycobacterium bovis
ELLRPGLLVLPVRGPARFFGSEQMAA

SEQ ID NO: 236306 - protein, 18 aa, Mycobacterium bovis
ELPVMAEYQRRVGPAVLV

SEQ ID NO: 236307 - protein, 27 aa, Mycobacterium bovis
ELSALGTLRLIQAFTPALAQSHGAIVN

SEQ ID NO: 236308 - protein, 25 aa, Mycobacterium bovis
EMLAAAATDLAGIRSAISAATAAAA

SEQ ID NO: 236309 - protein, 24 aa, Mycobacterium bovis
ENAMEQFVYAYVRSCPGYTLDYNA

SEQ ID NO: 236310 - protein, 27 aa, Mycobacterium bovis
ENFWRSAGLPEFRWPDPNGTRFPNGAP

SEQ ID NO: 236311 - protein, 21 aa, Mycobacterium bovis
EPAESLPPPYDNRLAQPYGGY

SEQ ID NO: 236312 - protein, 25 aa, Mycobacterium bovis
EPALLSRALTACGLIAVAVARADAA

SEQ ID NO: 236313 - protein, 20 aa, Mycobacterium bovis
ERSRWLFSNPEMTHLSVLRN

SEQ ID NO: 236314 - protein, 27 aa, Mycobacterium bovis
ETGSTLLYPLFNLWGPAFHERYPNVTI

SEQ ID NO: 236315 - protein, 23 aa, Mycobacterium bovis
EVDKLISRLLAGPALAIAKTKNA

SEQ ID NO: 236316 - protein, 29 aa, Mycobacterium bovis
EVEDQLFRFSRILDVQPRLAILLGDCAVP

SEQ ID NO: 236317 - protein, 25 aa, Mycobacterium bovis
EVENPKCHLAWTTLAGIGRVESHHG

SEQ ID NO: 236318 - protein, 17 aa, Mycobacterium bovis
EVLNRVLTDLPPLIKHF

SEQ ID NO: 236319 - protein, 24 aa, Mycobacterium bovis
FAIGLAMMLAPMVAAPGLAAADPA

SEQ ID NO: 236320 - protein, 32 aa, Mycobacterium bovis
FARRVPLAAAVWTQRGWRFPDRLDRVYVNSRA

SEQ ID NO: 236321 - protein, 24 aa, Mycobacterium bovis
FASGPYFKVLLANLVPGQILQPFV

SEQ ID NO: 236322 - protein, 26 aa, Mycobacterium bovis
FCARDPFGIKPLFIATGAGGTAVASE

SEQ ID NO: 236323 - protein, 25 aa, Mycobacterium bovis
FDASGLIQYAYAGAGLKLPRSSGQM

SEQ ID NO: 236324 - protein, 26 aa, Mycobacterium bovis
FDCSGLVLYSFAGVGIKLPHYSGSQY

SEQ ID NO: 236325 - protein, 25 aa, Mycobacterium bovis
FDCSGLVRYAFAGVGVLIPRFSGDQ

SEQ ID NO: 236326 - protein, 26 aa, Mycobacterium bovis
FEPWSVADFSRYLSTLGLPAAGDAVT

SEQ ID NO: 236327 - protein, 18 aa, Mycobacterium bovis
FFDQFFLDATHSGIGQFV

SEQ ID NO: 236328 - protein, 30 aa, Mycobacterium bovis
FGFAVIVYLVWRFIVPLVGRLMSARQDTVR

SEQ ID NO: 236329 - protein, 24 aa, Mycobacterium bovis
FGRAWFVDLAPITDPDLVPVTVAG

SEQ ID NO: 236330 - protein, 20 aa, Mycobacterium bovis
FGYQLTFFRRALAPPGEGVA

SEQ ID NO: 236331 - protein, 19 aa, Mycobacterium bovis
FHRFALAILGLALPVALVA

SEQ ID NO: 236332 - protein, 26 aa, Mycobacterium bovis
FKCPAAPFEAAFLIAAQLGDRYATGT

SEQ ID NO: 236333 - protein, 18 aa, Mycobacterium bovis
FLDQAHFQPLPPAVVKLS

SEQ ID NO: 236334 - protein, 27 aa, Mycobacterium bovis
FLREVQDVWIWVRPYFDDRATAAAKQL

SEQ ID NO: 236335 - protein, 22 aa, Mycobacterium bovis
FMPNFALEWLINAYHRRGADIE

SEQ ID NO: 236336 - protein, 27 aa, Mycobacterium bovis
FNVNLKLQFLHDAFPNEFPDPTISVQI

SEQ ID NO: 236337 - protein, 19 aa, Mycobacterium bovis
FPEVDRVSWFPVARARTKL

SEQ ID NO: 236338 - protein, 28 aa, Mycobacterium bovis
FSDDFIEWSVSFSQKPFPPPCDIAKELT

SEQ ID NO: 236339 - protein, 30 aa, Mycobacterium bovis
FTGDAPLGTCAFWPVPPTSQPHAVSAPGLV

SEQ ID NO: 236340 - protein, 19 aa, Mycobacterium bovis
FVQALNMGAVCYAAAETAN

SEQ ID NO: 236341 - protein, 19 aa, Mycobacterium bovis
FVQTRLRENVLLQAKVCQS

SEQ ID NO: 236342 - protein, 23 aa, Mycobacterium bovis
FWRSAGLPAYRWPDPNGTRFPNG

SEQ ID NO: 236343 - protein, 20 aa, Mycobacterium bovis
FYRRGLFGTIGPYNLRYRVL

SEQ ID NO: 236344 - protein, 20 aa, Mycobacterium bovis
FYSLRYSSTALERAEDPILN

SEQ ID NO: 236345 - protein, 23 aa, Mycobacterium bovis
GAAASLVGFNRAPAGPSGGPVAA

SEQ ID NO: 236346 - protein, 30 aa, Mycobacterium bovis
GAAGLWGTGGAGGAGGWLLGDGGAGGIGGA

SEQ ID NO: 236347 - protein, 25 aa, Mycobacterium bovis
GAASGLPIALWSKPAQGIKQIINEI

SEQ ID NO: 236348 - protein, 18 aa, Mycobacterium bovis
GADEVSAAIAALFGAHGQ

SEQ ID NO: 236349 - protein, 52 aa, Mycobacterium bovis
GADEVSAAIATLFGSHAREYQAISTQVAAFHDRFAQTLSAAVGSYVSAEATN

SEQ ID NO: 236350 - protein, 24 aa, Mycobacterium bovis
GADPLWFTSLFSQHTLDLLELGLG

SEQ ID NO: 236351 - protein, 18 aa, Mycobacterium bovis
GAFFIGHSGLLNSGGGQH

SEQ ID NO: 236352 - protein, 22 aa, Mycobacterium bovis
GAGGAAGLWGGGGAGGVGGTGG

SEQ ID NO: 236353 - protein, 27 aa, Mycobacterium bovis
GAGGAGGLLAGLLAGPGGAGGTGGRGF

SEQ ID NO: 236354 - protein, 23 aa, Mycobacterium bovis
GAGGAGGWLLGNGGAGGAGGAAS

SEQ ID NO: 236355 - protein, 18 aa, Mycobacterium bovis
GAGGAGGWLYGDAGAGGD

SEQ ID NO: 236356 - protein, 21 aa, Mycobacterium bovis
GAGGAGGWLYGDGGAGGVGGV

SEQ ID NO: 236357 - protein, 24 aa, Mycobacterium bovis
GAGGAGVFSLFGSGGGPGGNGGVG

SEQ ID NO: 236358 - protein, 17 aa, Mycobacterium bovis
GAGGHAGLFGAGGTGGT

SEQ ID NO: 236359 - protein, 24 aa, Mycobacterium bovis
GAGGLGGTLYGAGGHGGAGGPGPI

SEQ ID NO: 236360 - protein, 24 aa, Mycobacterium bovis
GAGGRAGLFGVGGLGGAGGDAGDS

SEQ ID NO: 236361 - protein, 26 aa, Mycobacterium bovis
GAGGTGGLLFGAGGNGGPGGSGGAAD

SEQ ID NO: 236362 - protein, 18 aa, Mycobacterium bovis
GAGGWLFGNGGNGGQGTI

SEQ ID NO: 236363 - protein, 18 aa, Mycobacterium bovis
GAGGWLYGDAGAGGDGGV

SEQ ID NO: 236364 - protein, 23 aa, Mycobacterium bovis
GAGSIFKIFTTAAALDMGMGINA

SEQ ID NO: 236365 - protein, 21 aa, Mycobacterium bovis
GAKLRCRLTDGSKTYGISVIV

SEQ ID NO: 236366 - protein, 20 aa, Mycobacterium bovis
GALLLGSRLGPARTAAICAV

SEQ ID NO: 236367 - protein, 24 aa, Mycobacterium bovis
GARKDTVIVLPKQKMRAVLVADNP

SEQ ID NO: 236368 - protein, 21 aa, Mycobacterium bovis
GCHLPAAWRTAPPPLNMRPAN

SEQ ID NO: 236369 - protein, 24 aa, Mycobacterium bovis
GDALFVQLHAPLRGVARGQTLVLY

SEQ ID NO: 236370 - protein, 24 aa, Mycobacterium bovis
GDEFCLLDGLLAWYATIGSINNIN

SEQ ID NO: 236371 - protein, 28 aa, Mycobacterium bovis
GDPGSPTIDLPVPDDWRLLPESSRAPYG

SEQ ID NO: 236372 - protein, 24 aa, Mycobacterium bovis
GDPLHLPGFPVQFFVYKQIAANNA

SEQ ID NO: 236373 - protein, 27 aa, Mycobacterium bovis
GEPAPAVPGIPMPLPPNAPPGARTQPL

SEQ ID NO: 236374 - protein, 17 aa, Mycobacterium bovis
GESRLFVPVLRSAINSH

SEQ ID NO: 236375 - protein, 18 aa, Mycobacterium bovis
GETFFTTAYFDPNMAHMD

SEQ ID NO: 236376 - protein, 24 aa, Mycobacterium bovis
GEVRWVSARDLRFGYRTSVLKHAD

SEQ ID NO: 236377 - protein, 27 aa, Mycobacterium bovis
GFDEQPRLFYMHFWAENDAVALARTLR

SEQ ID NO: 236378 - protein, 19 aa, Mycobacterium bovis
GFGRYLVSATTPFTRDDLT

SEQ ID NO: 236379 - protein, 22 aa, Mycobacterium bovis
GGAAFSINFTAGDGGAGGAGGS

SEQ ID NO: 236380 - protein, 24 aa, Mycobacterium bovis
GGAGGAAGLFGTGGAGGAGGAGAA

SEQ ID NO: 236381 - protein, 25 aa, Mycobacterium bovis
GGAGGNGAWLFGNGGAGGGGGKGGN

SEQ ID NO: 236382 - protein, 24 aa, Mycobacterium bovis
GGAGGSGAWLYGNGGAAGAGGNGG

SEQ ID NO: 236383 - protein, 28 aa, Mycobacterium bovis
GGAGGSGGHALLWGAGGAGGNGGSGGTG

SEQ ID NO: 236384 - protein, 24 aa, Mycobacterium bovis
GGAGGSGGWLLGNGGVGGAGGQSL

SEQ ID NO: 236385 - protein, 25 aa, Mycobacterium bovis
GGAGGSGGWLLGNGGVGGAGGQSLL

SEQ ID NO: 236386 - protein, 23 aa, Mycobacterium bovis
GGAGGTGGWLYGGGGAAGSGGDG

SEQ ID NO: 236387 - protein, 21 aa, Mycobacterium bovis
GGAGGWLFGNGGAGGAGGLGV

SEQ ID NO: 236388 - protein, 20 aa, Mycobacterium bovis
GGAGGWLYGDGGAGGAGGGG

SEQ ID NO: 236389 - protein, 21 aa, Mycobacterium bovis
GGAGLIAGLDGAGGAGGTRGL

SEQ ID NO: 236390 - protein, 22 aa, Mycobacterium bovis
GGDAGLLSLGASGGAGGSGGSS

SEQ ID NO: 236391 - protein, 22 aa, Mycobacterium bovis
GGDAGMFFGSGGSGGAGGAGGS

SEQ ID NO: 236392 - protein, 25 aa, Mycobacterium bovis
GGDARFLSLLSIRQLATEPSLSGPG

SEQ ID NO: 236393 - protein, 27 aa, Mycobacterium bovis
GGDGGDIAYPYYLINGRIPVAATSFKA

SEQ ID NO: 236394 - protein, 26 aa, Mycobacterium bovis
GGGAAGPAGWLFGDGGAGGNGGAAAA

SEQ ID NO: 236395 - protein, 24 aa, Mycobacterium bovis
GGGGTGGLLFGNGGAGGHGAAAGN

SEQ ID NO: 236396 - protein, 26 aa, Mycobacterium bovis
GGGILGPHFSFSWYRGSPIGRERKTE

SEQ ID NO: 236397 - protein, 22 aa, Mycobacterium bovis
GGGSFGLPGLNGSGGDGGDGGN

SEQ ID NO: 236398 - protein, 17 aa, Mycobacterium bovis
GGGWLFGNGGDGGAGGG

SEQ ID NO: 236399 - protein, 19 aa, Mycobacterium bovis
GGHAGLFGAGGTGGTGGIG

SEQ ID NO: 236400 - protein, 25 aa, Mycobacterium bovis
GGIIGRACWPSWTPPPLMSRWSNRP

SEQ ID NO: 236401 - protein, 20 aa, Mycobacterium bovis
GGISGLLLGADGFNAPASAS

SEQ ID NO: 236402 - protein, 28 aa, Mycobacterium bovis
GGKWAINPMFIDPLPQHAPYVCGEAFIN

SEQ ID NO: 236403 - protein, 17 aa, Mycobacterium bovis
GGLFTTGGVGGAGGAGG

SEQ ID NO: 236404 - protein, 22 aa, Mycobacterium bovis
GGNAGLLFGAGGTGGSGGAGLG

SEQ ID NO: 236405 - protein, 25 aa, Mycobacterium bovis
GGNGATGPWLFGDGGAGGGGGAGGI

SEQ ID NO: 236406 - protein, 20 aa, Mycobacterium bovis
GGNGGLGGFGGNGAAGANGV

SEQ ID NO: 236407 - protein, 20 aa, Mycobacterium bovis
GGPGGLLYGNGGNGGTSTTA

SEQ ID NO: 236408 - protein, 18 aa, Mycobacterium bovis
GGPGPIGGVGGHGGVGGA

SEQ ID NO: 236409 - protein, 20 aa, Mycobacterium bovis
GGRIILFGDEEHLPYDRPPL

SEQ ID NO: 236410 - protein, 22 aa, Mycobacterium bovis
GGSAARLFGGGGAGGAGGTGST

SEQ ID NO: 236411 - protein, 23 aa, Mycobacterium bovis
GGSADDIFWLSNAYFAAYADSGR

SEQ ID NO: 236412 - protein, 23 aa, Mycobacterium bovis
GGSARLIGAGGHGGDGGAGGNTA

SEQ ID NO: 236413 - protein, 20 aa, Mycobacterium bovis
GGTGGWLFGNGGAGGTGGAV

SEQ ID NO: 236414 - protein, 33 aa, Mycobacterium bovis
GGVGPITVLPIQILPTIPLNIHQTFSLGPLVVP

SEQ ID NO: 236415 - protein, 17 aa, Mycobacterium bovis
GGWLLGTGGVGGVGGLG

SEQ ID NO: 236416 - protein, 23 aa, Mycobacterium bovis
GHPRLGHNLALHPATMLAGLFDD

SEQ ID NO: 236417 - protein, 25 aa, Mycobacterium bovis
GHYDAEWIIILDDWTDGIGKSPQQL

SEQ ID NO: 236418 - protein, 25 aa, Mycobacterium bovis
GIQCFLRDLPATWPPFIRPGVVTTH

SEQ ID NO: 236419 - protein, 26 aa, Mycobacterium bovis
GISVNVTLIFSVQRYREVMDAYLTGM

SEQ ID NO: 236420 - protein, 26 aa, Mycobacterium bovis
GITIPEFPIHWTSTGGIGPIIIPDTT

SEQ ID NO: 236421 - protein, 20 aa, Mycobacterium bovis
GIYACWGTENREAAVRFVKG

SEQ ID NO: 236422 - protein, 29 aa, Mycobacterium bovis
GKGGAGTLLGLTVFGDNGGAGVLGDSTDP

SEQ ID NO: 236423 - protein, 26 aa, Mycobacterium bovis
GKSLAYLVPAIIRALCDDAPVVVSTA

SEQ ID NO: 236424 - protein, 25 aa, Mycobacterium bovis
GLDGFLERPGIAAYLRLGYGPQTAE

SEQ ID NO: 236425 - protein, 18 aa, Mycobacterium bovis
GLKLVKVETLSQAVDALH

SEQ ID NO: 236426 - protein, 17 aa, Mycobacterium bovis
GLPALPAGLPPLPAVPA

SEQ ID NO: 236427 - protein, 21 aa, Mycobacterium bovis
GLPGDLTFSWYAVDKTGQPWV

SEQ ID NO: 236428 - protein, 24 aa, Mycobacterium bovis
GLQVKTIWVARAVSVLFPQITNIF

SEQ ID NO: 236429 - protein, 20 aa, Mycobacterium bovis
GLSESGWIPVDPRTLSTSAD

SEQ ID NO: 236430 - protein, 19 aa, Mycobacterium bovis
GLSGAFHIGGKGGVGGSAV

SEQ ID NO: 236431 - protein, 20 aa, Mycobacterium bovis
GLSLAVLAAAPTAGAEPTGA

SEQ ID NO: 236432 - protein, 23 aa, Mycobacterium bovis
GLSQFGINIPPVPSLTGSGDAST

SEQ ID NO: 236433 - protein, 24 aa, Mycobacterium bovis
GLVRTVHLPAPNVAGLLSAAGVPL

SEQ ID NO: 236434 - protein, 25 aa, Mycobacterium bovis
GLVSQFFGKYFTPEQARQLIAEQAA

SEQ ID NO: 236435 - protein, 19 aa, Mycobacterium bovis
GLVVWFNTLLVSAGGSVLS

SEQ ID NO: 236436 - protein, 22 aa, Mycobacterium bovis
GLYGHKSTWRSVPLVGHIPSAP

SEQ ID NO: 236437 - protein, 19 aa, Mycobacterium bovis
GNAGLIGAGGHGGAGGAGG

SEQ ID NO: 236438 - protein, 19 aa, Mycobacterium bovis
GNALWARLQPCVNWISQHW

SEQ ID NO: 236439 - protein, 26 aa, Mycobacterium bovis
GNDSNGILWRGNFEGLFGLNVGITIP

SEQ ID NO: 236440 - protein, 22 aa, Mycobacterium bovis
GNGATGGWLYGNGGAGGQGATA

SEQ ID NO: 236441 - protein, 23 aa, Mycobacterium bovis
GNGGAGGWLYGNGGAGGAGGTSV

SEQ ID NO: 236442 - protein, 23 aa, Mycobacterium bovis
GNKRTIVGYFTSAVGLYPGDQVR

SEQ ID NO: 236443 - protein, 21 aa, Mycobacterium bovis
GNLDPIIAFYPKHVLYEVFGP

SEQ ID NO: 236444 - protein, 21 aa, Mycobacterium bovis
GNTKAFLGERIGVRRGVVVDA

SEQ ID NO: 236445 - protein, 24 aa, Mycobacterium bovis
GPEGLPSVFVYDGYPGGAGFAERG

SEQ ID NO: 236446 - protein, 17 aa, Mycobacterium bovis
GPERDFEHYLGCKVAAC

SEQ ID NO: 236447 - protein, 22 aa, Mycobacterium bovis
GPERRYIMVIESLQPADDATAR

SEQ ID NO: 236448 - protein, 26 aa, Mycobacterium bovis
GPGGLAGNLFGQNGIQGVGGSGGKGG

SEQ ID NO: 236449 - protein, 19 aa, Mycobacterium bovis
GPHAVYLLDAFNAGPDVSN

SEQ ID NO: 236450 - protein, 28 aa, Mycobacterium bovis
GPSLSLVLIDRIPFPRPDDPLLSARQRA

SEQ ID NO: 236451 - protein, 23 aa, Mycobacterium bovis
GPVQRWRREVPFDVHLMIFGDST

SEQ ID NO: 236452 - protein, 26 aa, Mycobacterium bovis
GPVVYQMQPVVFGAPLPLDPASAPDV

SEQ ID NO: 236453 - protein, 17 aa, Mycobacterium bovis
GPVWVFSGQGSQWPGMG

SEQ ID NO: 236454 - protein, 25 aa, Mycobacterium bovis
GQAGGAGGILWGNGGAGGSGAPGQV

SEQ ID NO: 236455 - protein, 20 aa, Mycobacterium bovis
GQFELNRPATLIAALPAILG

SEQ ID NO: 236456 - protein, 19 aa, Mycobacterium bovis
GQGALVVLIARDDPLDTYL

SEQ ID NO: 236457 - protein, 25 aa, Mycobacterium bovis
GQGAPPFRMWDPGSGPAGGRAWDGL

SEQ ID NO: 236458 - protein, 21 aa, Mycobacterium bovis
GQGVGFGGWYAPVALHVDTES

SEQ ID NO: 236459 - protein, 24 aa, Mycobacterium bovis
GQSFTSVPMLFAKPSYYGQFTDSG

SEQ ID NO: 236460 - protein, 27 aa, Mycobacterium bovis
GQYGAPPIAIGPLYQPKTLQLCADGDS

SEQ ID NO: 236461 - protein, 29 aa, Mycobacterium bovis
GRAAVPWWPWAPLVRLMWVLPPRLTRRFA

SEQ ID NO: 236462 - protein, 19 aa, Mycobacterium bovis
GRGAAWLIVDVRDVAALHA

SEQ ID NO: 236463 - protein, 24 aa, Mycobacterium bovis
GRGTRLPVWLTQWGYRRPAEDTVD

SEQ ID NO: 236464 - protein, 26 aa, Mycobacterium bovis
GRPGEYAELPYLFTDQYDLGMEYVGH

SEQ ID NO: 236465 - protein, 22 aa, Mycobacterium bovis
GRPVTCDDLVLAWAAQSGRFPG

SEQ ID NO: 236466 - protein, 27 aa, Mycobacterium bovis
GRRALQTWRRLAVTRYPVVGLFERIWE

SEQ ID NO: 236467 - protein, 17 aa, Mycobacterium bovis
GRYIGFDGVIHSVASGH

SEQ ID NO: 236468 - protein, 23 aa, Mycobacterium bovis
GSDMGEFYMPYPGTRINQETVSL

SEQ ID NO: 236469 - protein, 32 aa, Mycobacterium bovis
GSKQWDTFLSAELPDWLAANRGLAPGGHAAVG

SEQ ID NO: 236470 - protein, 21 aa, Mycobacterium bovis
GSLTHILTFLAAETGGCSGSR

SEQ ID NO: 236471 - protein, 25 aa, Mycobacterium bovis
GSPNEYVVGWIKRGPTGVIGTNKKD

SEQ ID NO: 236472 - protein, 24 aa, Mycobacterium bovis
GSRGLRYATVIALVAALVGGVYVL

SEQ ID NO: 236473 - protein, 26 aa, Mycobacterium bovis
GTGGAGGAGFSRALIVAGDNGGDGGN

SEQ ID NO: 236474 - protein, 29 aa, Mycobacterium bovis
GTGGAGGPGGLIWGGGGAGGVGGAGGGTG

SEQ ID NO: 236475 - protein, 28 aa, Mycobacterium bovis
GTRGLRTYVQLFVLIAAANDVRCDVASN

SEQ ID NO: 236476 - protein, 19 aa, Mycobacterium bovis
GVDWKGTLTGLAGYASGDL

SEQ ID NO: 236477 - protein, 25 aa, Mycobacterium bovis
GVGAFLNAIFAGPAKMLRLNAGLGN

SEQ ID NO: 236478 - protein, 23 aa, Mycobacterium bovis
GVGGPAGLWGHGGAGGAGGAGVA

SEQ ID NO: 236479 - protein, 24 aa, Mycobacterium bovis
GVRSALWMHVIPGRGAAWLIVDVR

SEQ ID NO: 236480 - protein, 25 aa, Mycobacterium bovis
GVSRSYWDQLKWNALANIAGTPATT

SEQ ID NO: 236481 - protein, 25 aa, Mycobacterium bovis
GVVITPQAELLPTDKHFAPAVLNDV

SEQ ID NO: 236482 - protein, 26 aa, Mycobacterium bovis
GWDETVFFRNGDPFIWDRGRELGMVN

SEQ ID NO: 236483 - protein, 17 aa, Mycobacterium bovis
GWLLGDGGAGGIGGAST

SEQ ID NO: 236484 - protein, 18 aa, Mycobacterium bovis
GWLRAKTGSLTAINSLVG

SEQ ID NO: 236485 - protein, 17 aa, Mycobacterium bovis
GWTGRFVSRILIDGSTL

SEQ ID NO: 236486 - protein, 20 aa, Mycobacterium bovis
GYATNYYMLQHSLVLQPANQ

SEQ ID NO: 236487 - protein, 20 aa, Mycobacterium bovis
HAFPASRWRRYDKLERFPRG

SEQ ID NO: 236488 - protein, 24 aa, Mycobacterium bovis
HDPLVQGLRALGHRVNLAEQSSGL

SEQ ID NO: 236489 - protein, 17 aa, Mycobacterium bovis
HERGLPMQSPWTALRTA

SEQ ID NO: 236490 - protein, 24 aa, Mycobacterium bovis
HGEAGVVAIFAQALLSGKPTRVFG

SEQ ID NO: 236491 - protein, 19 aa, Mycobacterium bovis
HGFTIGQRRGLGIAGPGPN

SEQ ID NO: 236492 - protein, 37 aa, Mycobacterium bovis
HGGQGGGGGFSILLGLGGLGGLGSPGSIATGTAGGAG

SEQ ID NO: 236493 - protein, 17 aa, Mycobacterium bovis
HGGVGGAAGLLGVGGHG

SEQ ID NO: 236494 - protein, 28 aa, Mycobacterium bovis
HGLTEEPRLFYMHYWAVDDAVTLARALR

SEQ ID NO: 236495 - protein, 25 aa, Mycobacterium bovis
HHYRFTLYHLPAVPPLAGLAGTQAA

SEQ ID NO: 236496 - protein, 22 aa, Mycobacterium bovis
HPGIDWAKYALKAPVMMVRSPD

SEQ ID NO: 236497 - protein, 18 aa, Mycobacterium bovis
HSLLRPSWSLDDAVWVVV

SEQ ID NO: 236498 - protein, 29 aa, Mycobacterium bovis
IAAVVLGAAALIVALTRPTNSGPATAAGT

SEQ ID NO: 236499 - protein, 18 aa, Mycobacterium bovis
IAAYLRLGYGPQTAEFRA

SEQ ID NO: 236500 - protein, 26 aa, Mycobacterium bovis
IAGAAGKGGIFPDGSNGGAGGDAGDG

SEQ ID NO: 236501 - protein, 24 aa, Mycobacterium bovis
IAGGVYKFFIARRDPVTMSGMLIP

SEQ ID NO: 236502 - protein, 27 aa, Mycobacterium bovis
IAGLPIPPIIHYGAIAYAPSGASGKAW

SEQ ID NO: 236503 - protein, 22 aa, Mycobacterium bovis
IAPFMSYGKFTGDAPLGTCAFW

SEQ ID NO: 236504 - protein, 22 aa, Mycobacterium bovis
IDADFVVFDGILYATLTPNQWS

SEQ ID NO: 236505 - protein, 30 aa, Mycobacterium bovis
IDALKGIALYLNFDMLASPNPGYFTYDGDQ

SEQ ID NO: 236506 - protein, 20 aa, Mycobacterium bovis
IDFRDPAPFAVLRRVDRWFW

SEQ ID NO: 236507 - protein, 19 aa, Mycobacterium bovis
IDNAFLTGTGFSGALRALE

SEQ ID NO: 236508 - protein, 24 aa, Mycobacterium bovis
IDSMHLGRYLGISDLMVAAPRQES

SEQ ID NO: 236509 - protein, 18 aa, Mycobacterium bovis
IDSPQRLWEALLRGDDLV

SEQ ID NO: 236510 - protein, 27 aa, Mycobacterium bovis
IDVRALELDLHYLPRLEGHGAPGVTVC

SEQ ID NO: 236511 - protein, 23 aa, Mycobacterium bovis
IEDYWMAVYSESLKGTFRPVGKL

SEQ ID NO: 236512 - protein, 18 aa, Mycobacterium bovis
IEGKQASAAKFIWFFRHP

SEQ ID NO: 236513 - protein, 19 aa, Mycobacterium bovis
IEVVDAPWAPFAVDFHLAN

SEQ ID NO: 236514 - protein, 27 aa, Mycobacterium bovis
IFPGGFTIDPLPLSLALNISVPDSSVP

SEQ ID NO: 236515 - protein, 24 aa, Mycobacterium bovis
IGATAMLLASSCTWQLSLFIPDGV

SEQ ID NO: 236516 - protein, 27 aa, Mycobacterium bovis
IGGTGGVLLGLDGFTAPASTSPLHTLQ

SEQ ID NO: 236517 - protein, 18 aa, Mycobacterium bovis
IGGVGGHGGVGGAAGLLG

SEQ ID NO: 236518 - protein, 32 aa, Mycobacterium bovis
IGKRDIYGDTRLGLFPFRRNLSLYAVDLALLT

SEQ ID NO: 236519 - protein, 28 aa, Mycobacterium bovis
IGPIIIPDTTILPPIHLGLTGQANYGFA

SEQ ID NO: 236520 - protein, 17 aa, Mycobacterium bovis
IGQLCDAAIRYSDGTAA

SEQ ID NO: 236521 - protein, 19 aa, Mycobacterium bovis
IGRQMHMDPFLPNEGAPGR

SEQ ID NO: 236522 - protein, 28 aa, Mycobacterium bovis
IGTLGFTIPGFTIPAAPLPLTIDIDGQI

SEQ ID NO: 236523 - protein, 19 aa, Mycobacterium bovis
IHQTFSLGPLVVPDIVIPA

SEQ ID NO: 236524 - protein, 17 aa, Mycobacterium bovis
IIAAFTTAVGAAAIGLA

SEQ ID NO: 236525 - protein, 18 aa, Mycobacterium bovis
IKLAWITAVVAGLMVGVA

SEQ ID NO: 236526 - protein, 21 aa, Mycobacterium bovis
ILATMLVAGRLLATLMAAPSA

SEQ ID NO: 236527 - protein, 35 aa, Mycobacterium bovis
ILIARNDRYWGPPSKPGIILFRRAGAPAALADSVR

SEQ ID NO: 236528 - protein, 29 aa, Mycobacterium bovis
ILSSMERAGLLLPLGWDPRLPVMGQKYIS

SEQ ID NO: 236529 - protein, 35 aa, Mycobacterium bovis
ILVDRSFDGTLGLSLLWVLRGWRRPDDVRVRPTAA

SEQ ID NO: 236530 - protein, 31 aa, Mycobacterium bovis
INAALGATSMKVWFNAKAMWDWSKSVADKNC

SEQ ID NO: 236531 - protein, 18 aa, Mycobacterium bovis
INASDLNWQQAALLAGMV

SEQ ID NO: 236532 - protein, 26 aa, Mycobacterium bovis
INMVNDPFQTLTGRPLIGNGANGTPG

SEQ ID NO: 236533 - protein, 23 aa, Mycobacterium bovis
INNAFRVPSMKPLAGTTFEHIRD

SEQ ID NO: 236534 - protein, 17 aa, Mycobacterium bovis
IPIPAIHIDFDGAADAG

SEQ ID NO: 236535 - protein, 18 aa, Mycobacterium bovis
IPVDPRTLSTSADNVWAI

SEQ ID NO: 236536 - protein, 27 aa, Mycobacterium bovis
IPVSALEGLLLDLSQINAALGATSMKV

SEQ ID NO: 236537 - protein, 23 aa, Mycobacterium bovis
IQLDRSVWPYIGAKAGGLPGDLT

SEQ ID NO: 236538 - protein, 18 aa, Mycobacterium bovis
IQTEFNVALPWRKEVSLS

SEQ ID NO: 236539 - protein, 28 aa, Mycobacterium bovis
IRDKPMPLFQLLVLCMLASKPIGAATAA

SEQ ID NO: 236540 - protein, 27 aa, Mycobacterium bovis
IRESGATPSFLGYHGYPASICASINDR

SEQ ID NO: 236541 - protein, 19 aa, Mycobacterium bovis
IRRASNVCWPTPRPPMRIW

SEQ ID NO: 236542 - protein, 20 aa, Mycobacterium bovis
IRVNSVAPGYIWGDTLKSYF

SEQ ID NO: 236543 - protein, 28 aa, Mycobacterium bovis
ISRGPDPLGVLYWQVPKGSTLDSTIGQT

SEQ ID NO: 236544 - protein, 17 aa, Mycobacterium bovis
ISYPLYGVQQVGAPCPK

SEQ ID NO: 236545 - protein, 20 aa, Mycobacterium bovis
ITNFYNIYDPAQGTLNGLLS

SEQ ID NO: 236546 - protein, 18 aa, Mycobacterium bovis
ITTSPIPLKIDVSGGLPA

SEQ ID NO: 236547 - protein, 26 aa, Mycobacterium bovis
IVHVSSFTALFRPNLATLSADLPVAG

SEQ ID NO: 236548 - protein, 18 aa, Mycobacterium bovis
IVLVRRWPKVISRAMVMR

SEQ ID NO: 236549 - protein, 33 aa, Mycobacterium bovis
IVREQQADCFAGVYLWWVAEGKSTRFTLSTADG

SEQ ID NO: 236550 - protein, 17 aa, Mycobacterium bovis
IVVIKPSTGEILAIAQN

SEQ ID NO: 236551 - protein, 23 aa, Mycobacterium bovis
IYREPLSLRPFDYLPKPLRRSMG

SEQ ID NO: 236552 - protein, 20 aa, Mycobacterium bovis
KALAATHQDGSMGAGGAGGN

SEQ ID NO: 236553 - protein, 26 aa, Mycobacterium bovis
KAVDVLARIMGSSYQRLVAAGVAKFF

SEQ ID NO: 236554 - protein, 17 aa, Mycobacterium bovis
KDVVLSAGWDEDLFRRM

SEQ ID NO: 236555 - protein, 18 aa, Mycobacterium bovis
KFAAFLRGVNVGGVNLKM

SEQ ID NO: 236556 - protein, 24 aa, Mycobacterium bovis
KFRTGGYMIDFWGVGYQVAKRMGI

SEQ ID NO: 236557 - protein, 41 aa, Mycobacterium bovis
KITTNPPVEGAFYWLNNREVRWRPEHFWKPGTAVDVAVNTY

SEQ ID NO: 236558 - protein, 24 aa, Mycobacterium bovis
KKNLYTVYFAMKFSQPFSSYGTWD

SEQ ID NO: 236559 - protein, 26 aa, Mycobacterium bovis
KLSKQPFSLQLIGPPPSPVQRYPLYC

SEQ ID NO: 236560 - protein, 20 aa, Mycobacterium bovis
KNEFIPRPIEYTWNGTQWVR

SEQ ID NO: 236561 - protein, 19 aa, Mycobacterium bovis
KPRNKGLRFEFYANLDTAY

SEQ ID NO: 236562 - protein, 28 aa, Mycobacterium bovis
KQASAAKFIWFFRHPNPIRPVVSQRCDA

SEQ ID NO: 236563 - protein, 18 aa, Mycobacterium bovis
KRCWANQVIFGVTGPQAF

SEQ ID NO: 236564 - protein, 18 aa, Mycobacterium bovis
KRLDGLPLAIELAAARLR

SEQ ID NO: 236565 - protein, 24 aa, Mycobacterium bovis
KRLGLDRQWLHARSLAFAHPADGR

SEQ ID NO: 236566 - protein, 24 aa, Mycobacterium bovis
KRSCLDIGLAERVLGWRPQIELAD

SEQ ID NO: 236567 - protein, 24 aa, Mycobacterium bovis
KSARPATVWIAQDGSHHLVRASID

SEQ ID NO: 236568 - protein, 26 aa, Mycobacterium bovis
KSTFVALTLAPLLPGIVFVNADEIAK

SEQ ID NO: 236569 - protein, 25 aa, Mycobacterium bovis
KSYPLASFGAALLPPELGGPLPAQF

SEQ ID NO: 236570 - protein, 23 aa, Mycobacterium bovis
KTPVGAMALLAEALLASADDSET

SEQ ID NO: 236571 - protein, 20 aa, Mycobacterium bovis
KVTERLPLPPNARRVEDPEM

SEQ ID NO: 236572 - protein, 24 aa, Mycobacterium bovis
LAADGSVLDTWFPAPELTESGTSA

SEQ ID NO: 236573 - protein, 30 aa, Mycobacterium bovis
LAAINAPTQTLTGRPLIGNGTPGAVGSGAT

SEQ ID NO: 236574 - protein, 18 aa, Mycobacterium bovis
LAALALAPRLAGMAELVQ

SEQ ID NO: 236575 - protein, 19 aa, Mycobacterium bovis
LAARVLVALAALFAMIALT

SEQ ID NO: 236576 - protein, 31 aa, Mycobacterium bovis
LAEANAAALAPTTALLAAGADEVSAAIAALF

SEQ ID NO: 236577 - protein, 31 aa, Mycobacterium bovis
LAECAGLHDPYFDFILGRPDASTVRIGAAGW

SEQ ID NO: 236578 - protein, 24 aa, Mycobacterium bovis
LAEKRPPPAPRLTFRPADSAADVV

SEQ ID NO: 236579 - protein, 18 aa, Mycobacterium bovis
LAGMSLLASAIGLAAFGA

SEQ ID NO: 236580 - protein, 18 aa, Mycobacterium bovis
LAGPYAWSNALSAGYTAE

SEQ ID NO: 236581 - protein, 17 aa, Mycobacterium bovis
LAGVLSALALAVGGAVG

SEQ ID NO: 236582 - protein, 26 aa, Mycobacterium bovis
LALGERRLVRLLRLGGTAVLPTYFEI

SEQ ID NO: 236583 - protein, 21 aa, Mycobacterium bovis
LAVLTAAPLLLAAAGCGSKPP

SEQ ID NO: 236584 - protein, 21 aa, Mycobacterium bovis
LAVLTRLPAQVLGRVAFQVLA

SEQ ID NO: 236585 - protein, 17 aa, Mycobacterium bovis
LAVTLPPELPVAAAAAV

SEQ ID NO: 236586 - protein, 34 aa, Mycobacterium bovis
LCAQYLAPVLDALKFNYLPFGSNPFSSAATLPKE

SEQ ID NO: 236587 - protein, 32 aa, Mycobacterium bovis
LDTGSSSLVIPFWKIGWQNLGLPTGFDVVHYG

SEQ ID NO: 236588 - protein, 25 aa, Mycobacterium bovis
LDTSSFYRPTQPGSYPIVLATYEIV

SEQ ID NO: 236589 - protein, 17 aa, Mycobacterium bovis
LDVNPRYISLIPVNVVA

SEQ ID NO: 236590 - protein, 18 aa, Mycobacterium bovis
LETDQAFGWVAFEFGVHR

SEQ ID NO: 236591 - protein, 18 aa, Mycobacterium bovis
LFGSHAREYQAISTQVAA

SEQ ID NO: 236592 - protein, 26 aa, Mycobacterium bovis
LFKRNICHQAIFYRRGLFGTIGPYNL

SEQ ID NO: 236593 - protein, 17 aa, Mycobacterium bovis
LGAVLAGCASVPSTSAP

SEQ ID NO: 236594 - protein, 17 aa, Mycobacterium bovis
LGGFGGNGAAGANGVAV

SEQ ID NO: 236595 - protein, 22 aa, Mycobacterium bovis
LGIVISGHWLLQNPMFAGYAAV

SEQ ID NO: 236596 - protein, 19 aa, Mycobacterium bovis
LGPLVVPDIVIPAFGGGTA

SEQ ID NO: 236597 - protein, 18 aa, Mycobacterium bovis
LIFYGPEGTQSVALYLGK

SEQ ID NO: 236598 - protein, 21 aa, Mycobacterium bovis
LIVLMVCLAGCGGDQLLARHA

SEQ ID NO: 236599 - protein, 18 aa, Mycobacterium bovis
LLAKMRSASRRALTSLVD

SEQ ID NO: 236600 - protein, 28 aa, Mycobacterium bovis
LLASGAATALIAIPTACSFSIGTSHSHS

SEQ ID NO: 236601 - protein, 23 aa, Mycobacterium bovis
LLCAMVLALAWLSAVAGCSRGGS

SEQ ID NO: 236602 - protein, 23 aa, Mycobacterium bovis
LLDATAALVLALVKACRGVRLLA

SEQ ID NO: 236603 - protein, 29 aa, Mycobacterium bovis
LLGAWLEATMARWPRRRSMRFESSPHGKR

SEQ ID NO: 236604 - protein, 18 aa, Mycobacterium bovis
LLLLNATMTQVFTADGLR

SEQ ID NO: 236605 - protein, 21 aa, Mycobacterium bovis
LLLVLAFAGGYAVAACKTVTL

SEQ ID NO: 236606 - protein, 23 aa, Mycobacterium bovis
LLMTGAGYWVAHGALGGITISQA

SEQ ID NO: 236607 - protein, 28 aa, Mycobacterium bovis
LLSGDRVIPQWVKIRNVDGFNGSFWHGG

SEQ ID NO: 236608 - protein, 28 aa, Mycobacterium bovis
LLVTDLAGGWIPPHVRLPANVTLLEPTA

SEQ ID NO: 236609 - protein, 23 aa, Mycobacterium bovis
LNDMTHWLAMVLADGVYNGRRIT

SEQ ID NO: 236610 - protein, 20 aa, Mycobacterium bovis
LNRVLTDLPPLIKHFADKQE

SEQ ID NO: 236611 - protein, 18 aa, Mycobacterium bovis
LNTTPALVPGERTDALAL

SEQ ID NO: 236612 - protein, 18 aa, Mycobacterium bovis
LPALAQLSPIIQQAAMNP

SEQ ID NO: 236613 - protein, 18 aa, Mycobacterium bovis
LPGLGFTQPLPPAADDHI

SEQ ID NO: 236614 - protein, 18 aa, Mycobacterium bovis
LPGNPRVLSIAQFWDRAA

SEQ ID NO: 236615 - protein, 26 aa, Mycobacterium bovis
LPGQNGGAGGLLWGNGGNGGAGDAAH

SEQ ID NO: 236616 - protein, 17 aa, Mycobacterium bovis
LPLLLAAGTVLGQAPRA

SEQ ID NO: 236617 - protein, 19 aa, Mycobacterium bovis
LQFKPGTRFDYSNSNYLLL

SEQ ID NO: 236618 - protein, 17 aa, Mycobacterium bovis
LQMTGMYQAIANDGVRV

SEQ ID NO: 236619 - protein, 18 aa, Mycobacterium bovis
LQVGDCLADLPPADLSRI

SEQ ID NO: 236620 - protein, 18 aa, Mycobacterium bovis
LRCILGDPVVDAVVAVRQ

SEQ ID NO: 236621 - protein, 26 aa, Mycobacterium bovis
LRGRATLGSFSAWLGVTAKAAEAAAP

SEQ ID NO: 236622 - protein, 25 aa, Mycobacterium bovis
LRNHARWAVLLRNLRFVIVDECHYY

SEQ ID NO: 236623 - protein, 17 aa, Mycobacterium bovis
LRRSGLGGHPRLGHNLA

SEQ ID NO: 236624 - protein, 25 aa, Mycobacterium bovis
LRTTIDWYRDNESWWRPLKDATEAR

SEQ ID NO: 236625 - protein, 25 aa, Mycobacterium bovis
LRWSWLLSVLAAVGLGLATAPAQAA

SEQ ID NO: 236626 - protein, 23 aa, Mycobacterium bovis
LSAGYTFMGFAEDLPAVGSTVCS

SEQ ID NO: 236627 - protein, 18 aa, Mycobacterium bovis
LSAIAALALVVAYQTLGS

SEQ ID NO: 236628 - protein, 19 aa, Mycobacterium bovis
LSALGITGQFRFGPITVSN

SEQ ID NO: 236629 - protein, 26 aa, Mycobacterium bovis
LSAQALAFHDQFVQALNMGAVCYAAA

SEQ ID NO: 236630 - protein, 20 aa, Mycobacterium bovis
LSSLSPLFGSKAIDLCNPTD

SEQ ID NO: 236631 - protein, 28 aa, Mycobacterium bovis
LSTLLNQPFQALPPFPPVFGGSDSLGDS

SEQ ID NO: 236632 - protein, 25 aa, Mycobacterium bovis
LSVQASAFHQQFVQALTAGAYSYAS

SEQ ID NO: 236633 - protein, 17 aa, Mycobacterium bovis
LTALAAVTLVVVAGCEA

SEQ ID NO: 236634 - protein, 19 aa, Mycobacterium bovis
LTAMAATVVIVAWIANRPP

SEQ ID NO: 236635 - protein, 18 aa, Mycobacterium bovis
LTDLSTRCSLPISGLQAI

SEQ ID NO: 236636 - protein, 17 aa, Mycobacterium bovis
LTERPDLLMAATEDLLH

SEQ ID NO: 236637 - protein, 22 aa, Mycobacterium bovis
LTLRLLAASAGILSAAAFAAPA

SEQ ID NO: 236638 - protein, 33 aa, Mycobacterium bovis
LTMLLVFTVITGIVYPLAVTGVGQLFFGDQANG

SEQ ID NO: 236639 - protein, 19 aa, Mycobacterium bovis
LTSATLGGLALPLQQTIDA

SEQ ID NO: 236640 - protein, 24 aa, Mycobacterium bovis
LVANDRWWGTKAITKRITVWPQGA

SEQ ID NO: 236641 - protein, 23 aa, Mycobacterium bovis
LVATALVLVAILLGVTAVLLGLS

SEQ ID NO: 236642 - protein, 17 aa, Mycobacterium bovis
LVVLDNCEHLLDATAAL

SEQ ID NO: 236643 - protein, 27 aa, Mycobacterium bovis
LWSSLTTMILPVGGAPYVLRPKSRQDY

SEQ ID NO: 236644 - protein, 17 aa, Mycobacterium bovis
LYALSAVTMLAACSSNG

SEQ ID NO: 236645 - protein, 18 aa, Mycobacterium bovis
LYETFTFNGGQYAFPEQW

SEQ ID NO: 236646 - protein, 25 aa, Mycobacterium bovis
MAAAAAPYASWLSTAATRALSAAAQ

SEQ ID NO: 236647 - protein, 27 aa, Mycobacterium bovis
MAPVQRTWPELIPLLQSGRLDVDGIFT

SEQ ID NO: 236648 - protein, 26 aa, Mycobacterium bovis
MARTVRNLLAPPLRLRGPVTRADGGK

SEQ ID NO: 236649 - protein, 25 aa, Mycobacterium bovis
MAVDMLEMLPTPWGLVRSGVAPDHP

SEQ ID NO: 236650 - protein, 26 aa, Mycobacterium bovis
MDDLHRHLFTVLMDREWKHGVAAAVD

SEQ ID NO: 236651 - protein, 18 aa, Mycobacterium bovis
MGPMQFISETWRLYGVAA

SEQ ID NO: 236652 - protein, 30 aa, Mycobacterium bovis
MGSMVFPGYGAELLRWLDRAPQIATFGAMV

SEQ ID NO: 236653 - protein, 24 aa, Mycobacterium bovis
MGSWLPLHHDMGLVGSLFAALFNS

SEQ ID NO: 236654 - protein, 27 aa, Mycobacterium bovis
MGTPEDLVGMCLFLLSDSASWITGQIF

SEQ ID NO: 236655 - protein, 18 aa, Mycobacterium bovis
MKTILALRHGVVPQNLHF

SEQ ID NO: 236656 - protein, 26 aa, Mycobacterium bovis
MLAAVLLLTPITVPAGYPGAVAPATA

SEQ ID NO: 236657 - protein, 27 aa, Mycobacterium bovis
MLAGLFDDDVFAWRGVLQSAAVHEFHE

SEQ ID NO: 236658 - protein, 17 aa, Mycobacterium bovis
MLATLGLGRLERFLARD

SEQ ID NO: 236659 - protein, 17 aa, Mycobacterium bovis
MLQQTLNTTPALVPGER

SEQ ID NO: 236660 - protein, 19 aa, Mycobacterium bovis
MPTLLQRKVLSPLGLTATA

SEQ ID NO: 236661 - protein, 31 aa, Mycobacterium bovis
MRDRWAGFFNEFDVLLLPVTPTPAPLHHNKD

SEQ ID NO: 236662 - protein, 25 aa, Mycobacterium bovis
MRRRSTMYLTYWTAGDTRNRGREML

SEQ ID NO: 236663 - protein, 18 aa, Mycobacterium bovis
MTRYSWQSYLIATASFAE

SEQ ID NO: 236664 - protein, 31 aa, Mycobacterium bovis
MVLNAINAPTQTLFGRPLIGDGANGTAENPD

SEQ ID NO: 236665 - protein, 19 aa, Mycobacterium bovis
NAGLGLVFLGADPLRSPVR

SEQ ID NO: 236666 - protein, 26 aa, Mycobacterium bovis
NAKRWGVLHVIWRQGYYPGIGAPSWT

SEQ ID NO: 236667 - protein, 17 aa, Mycobacterium bovis
NALPRRPKFALLKGRRN

SEQ ID NO: 236668 - protein, 29 aa, Mycobacterium bovis
NALYSPQRWKYLTSGLLGLQRGSDAGDLL

SEQ ID NO: 236669 - protein, 20 aa, Mycobacterium bovis
NAQLVVYRLIGDFDPAEAIT

SEQ ID NO: 236670 - protein, 23 aa, Mycobacterium bovis
NAQRTAWIAEGLLGYLSAEAQDR

SEQ ID NO: 236671 - protein, 24 aa, Mycobacterium bovis
NEPSRTWFAAMKPIANNFGEVQLP

SEQ ID NO: 236672 - protein, 28 aa, Mycobacterium bovis
NFSGRARMSSMLWTFQVNQADGVACPDG

SEQ ID NO: 236673 - protein, 24 aa, Mycobacterium bovis
NFSNGVLWRGDYEGLWGLSGGSTI

SEQ ID NO: 236674 - protein, 25 aa, Mycobacterium bovis
NGGAAGLIGNGGFGGGGGPGAAGGN

SEQ ID NO: 236675 - protein, 20 aa, Mycobacterium bovis
NGGKAGFSPGPTNFGLNGAG

SEQ ID NO: 236676 - protein, 17 aa, Mycobacterium bovis
NGGLLFGNGGNGFTQTT

SEQ ID NO: 236677 - protein, 18 aa, Mycobacterium bovis
NGGWLFGNGGAGGSGGDG

SEQ ID NO: 236678 - protein, 25 aa, Mycobacterium bovis
NGQAYQFPMGLGLVSQFFGKYFTPE

SEQ ID NO: 236679 - protein, 23 aa, Mycobacterium bovis
NGSRIYVLLPQTTTGRAVTSWVR

SEQ ID NO: 236680 - protein, 29 aa, Mycobacterium bovis
NHAAVSTSVLSALFLGAGAALLSACSSPQ

SEQ ID NO: 236681 - protein, 31 aa, Mycobacterium bovis
NIHRATAAQPLEWFCLFSSAAALVGSPGQGA

SEQ ID NO: 236682 - protein, 20 aa, Mycobacterium bovis
NISAILISPPQAPPGTQWTP

SEQ ID NO: 236683 - protein, 17 aa, Mycobacterium bovis
NISIIDIPALPGFGNST

SEQ ID NO: 236684 - protein, 24 aa, Mycobacterium bovis
NISVKLFDDWSNLGSISELSTSRV

SEQ ID NO: 236685 - protein, 17 aa, Mycobacterium bovis
NITRLPVRYTFDNRYFS

SEQ ID NO: 236686 - protein, 19 aa, Mycobacterium bovis
NKLRTMPGALSAALAAAAP

SEQ ID NO: 236687 - protein, 23 aa, Mycobacterium bovis
NLAQYPSILVELGNMKNPADSAL

SEQ ID NO: 236688 - protein, 23 aa, Mycobacterium bovis
NLDPVLVGERLIGPLYAHGVAGA

SEQ ID NO: 236689 - protein, 17 aa, Mycobacterium bovis
NLMAVARKDVVLSAGWD

SEQ ID NO: 236690 - protein, 18 aa, Mycobacterium bovis
NLSLYAVDLALLTHSHPH

SEQ ID NO: 236691 - protein, 25 aa, Mycobacterium bovis
NLVAARFIQLTPVYTGGAVLPDNGR

SEQ ID NO: 236692 - protein, 24 aa, Mycobacterium bovis
NMGRKFLEQLGILQPTDTGITNAP

SEQ ID NO: 236693 - protein, 18 aa, Mycobacterium bovis
NNAAIYGGMKLDLLLTVP

SEQ ID NO: 236694 - protein, 28 aa, Mycobacterium bovis
NPEPFLHTNVIGTFTILEAVRRHGVRLH

SEQ ID NO: 236695 - protein, 19 aa, Mycobacterium bovis
NSGSFNNGALWTGDHHGLV

SEQ ID NO: 236696 - protein, 23 aa, Mycobacterium bovis
NSGYPEHTFTWETGLRLRAALNA

SEQ ID NO: 236697 - protein, 28 aa, Mycobacterium bovis
NVAMVLRRLLRLCARYSAHPTVIFASAT

SEQ ID NO: 236698 - protein, 35 aa, Mycobacterium bovis
NVEQQLLNAINAPTLALLGRPLIGNGADGAAGTGQ

SEQ ID NO: 236699 - protein, 36 aa, Mycobacterium bovis
NVINDLFDQPLLALRIPWYVTVLDLGSAGAVYTEGW

SEQ ID NO: 236700 - protein, 26 aa, Mycobacterium bovis
NWNYAHTNYLLLGLALEKAAGQDMPT

SEQ ID NO: 236701 - protein, 21 aa, Mycobacterium bovis
NWRVTWNPSGMYFWLDYADGI

SEQ ID NO: 236702 - protein, 17 aa, Mycobacterium bovis
PAALTGEWFGALAVIAP

SEQ ID NO: 236703 - protein, 26 aa, Mycobacterium bovis
PADLQSLLVPPAPGPAPAPPAPGAGP

SEQ ID NO: 236704 - protein, 18 aa, Mycobacterium bovis
PAFHAFPASRWRRYDKLE

SEQ ID NO: 236705 - protein, 27 aa, Mycobacterium bovis
PAGGRAWDGLWDPTLPMIPSANIPGDP

SEQ ID NO: 236706 - protein, 19 aa, Mycobacterium bovis
PALLSPRDKLAQLLVVGVR

SEQ ID NO: 236707 - protein, 22 aa, Mycobacterium bovis
PAPPPPPLPEDGGPPPPVGSQV

SEQ ID NO: 236708 - protein, 18 aa, Mycobacterium bovis
PAQVLGRVAFQVLAGLAE

SEQ ID NO: 236709 - protein, 24 aa, Mycobacterium bovis
PARHFSGRFLSRNTTLWASWAFVG

SEQ ID NO: 236710 - protein, 24 aa, Mycobacterium bovis
PASASPLHTLKQQALAAINAPTQT

SEQ ID NO: 236711 - protein, 32 aa, Mycobacterium bovis
PASMSMVVAAQPYLAWLTYTAESAAHAAAQAM

SEQ ID NO: 236712 - protein, 25 aa, Mycobacterium bovis
PASMTPFPTMYELFSVGWGKPDLRD

SEQ ID NO: 236713 - protein, 17 aa, Mycobacterium bovis
PDDPLLSARQRAVAARG

SEQ ID NO: 236714 - protein, 22 aa, Mycobacterium bovis
PDSHDICFIPSGNTKAFLGERI

SEQ ID NO: 236715 - protein, 23 aa, Mycobacterium bovis
PDSSVPIIIVPPTPGFGNATATP

SEQ ID NO: 236716 - protein, 19 aa, Mycobacterium bovis
PEIVWYLDEPVADPALVPL

SEQ ID NO: 236717 - protein, 17 aa, Mycobacterium bovis
PELFCMIRNFHDAAPKV

SEQ ID NO: 236718 - protein, 26 aa, Mycobacterium bovis
PEPWRVEALVLLAFSAYARGDGPLAG

SEQ ID NO: 236719 - protein, 25 aa, Mycobacterium bovis
PEVNSALMFAGAGSGPTLAAAAAWD

SEQ ID NO: 236720 - protein, 23 aa, Mycobacterium bovis
PEVYAPVTGFYSLRYSSTALERA

SEQ ID NO: 236721 - protein, 20 aa, Mycobacterium bovis
PFADLLVPKLTASVTDGAVG

SEQ ID NO: 236722 - protein, 20 aa, Mycobacterium bovis
PFAVLRRVDRWFWSRRRRPP

SEQ ID NO: 236723 - protein, 19 aa, Mycobacterium bovis
PGAKGAHGFTPTSGGDGGD

SEQ ID NO: 236724 - protein, 27 aa, Mycobacterium bovis
PGGAGGAGGLLFGNGGAGAAGAPGQAG

SEQ ID NO: 236725 - protein, 17 aa, Mycobacterium bovis
PGGLNIPQNAIPLTIDA

SEQ ID NO: 236726 - protein, 27 aa, Mycobacterium bovis
PGGQMLFDLPPRWFAGWSRLGLRTSLR

SEQ ID NO: 236727 - protein, 20 aa, Mycobacterium bovis
PGGTPGDWGTGGTGGTGGTG

SEQ ID NO: 236728 - protein, 20 aa, Mycobacterium bovis
PGLLTIEDLAGYLAKRRQPL

SEQ ID NO: 236729 - protein, 21 aa, Mycobacterium bovis
PGQWDPTLPALVSAGAPGDPL

SEQ ID NO: 236730 - protein, 27 aa, Mycobacterium bovis
PGRDDLTDLLWRMGIRTIGQFAALSRT

SEQ ID NO: 236731 - protein, 22 aa, Mycobacterium bovis
PGSRLAFEFVPDTAIFADERWR

SEQ ID NO: 236732 - protein, 25 aa, Mycobacterium bovis
PHVSNAVRFAFWGAEEFGLIGSRNY

SEQ ID NO: 236733 - protein, 25 aa, Mycobacterium bovis
PIAADDFWYLWQQMVTQPGVVDPAG

SEQ ID NO: 236734 - protein, 19 aa, Mycobacterium bovis
PIANGLTYNFTFKFEKAGQ

SEQ ID NO: 236735 - protein, 25 aa, Mycobacterium bovis
PIQIRTVGRLLGWRLGMDDVDPRSM

SEQ ID NO: 236736 - protein, 18 aa, Mycobacterium bovis
PITIDRIPLNLGASVTVG

SEQ ID NO: 236737 - protein, 20 aa, Mycobacterium bovis
PLDFFIDGFGRTAPSRSAFV

SEQ ID NO: 236738 - protein, 20 aa, Mycobacterium bovis
PLHQDPIPVSALEGLLLDLS

SEQ ID NO: 236739 - protein, 31 aa, Mycobacterium bovis
PLSSALLSFGLLLGGLPLAAPPLAGATEEPG

SEQ ID NO: 236740 - protein, 33 aa, Mycobacterium bovis; identical to SEQ ID NO: 146912

SEQ ID NO: 236741 - protein, 20 aa, Mycobacterium bovis
PNEGAPGRGPLLAAGSVLAI

SEQ ID NO: 236742 - protein, 17 aa, Mycobacterium bovis
PPECSAALLFKGSPLRP

SEQ ID NO: 236743 - protein, 25 aa, Mycobacterium bovis
PPEHLQWIGQWGIFDALRAGREVVR

SEQ ID NO: 236744 - protein, 18 aa, Mycobacterium bovis
PPLRRLDLKRGEPVLITA

SEQ ID NO: 236745 - protein, 24 aa, Mycobacterium bovis
PQAARRFSVLSLPTTLIFDVDGRQ

SEQ ID NO: 236746 - protein, 19 aa, Mycobacterium bovis
PQGPGPAAEKFFAALAIGD

SEQ ID NO: 236747 - protein, 23 aa, Mycobacterium bovis
PRARASFYGYGFNVGVTSSGRTE

SEQ ID NO: 236748 - protein, 25 aa, Mycobacterium bovis
PRDLCALWPVPATSTPHPAAPAGAG

SEQ ID NO: 236749 - protein, 21 aa, Mycobacterium bovis
PRPWDPLPCANLTQGPFGGPD

SEQ ID NO: 236750 - protein, 22 aa, Mycobacterium bovis
PRQWLEIRYLDSVPDEVWPAVV

SEQ ID NO: 236751 - protein, 24 aa, Mycobacterium bovis
PRRALDPAIYREAALRLDHHFAIS

SEQ ID NO: 236752 - protein, 38 aa, Mycobacterium bovis
PRRPAHRVLVGWLSLAAGLLAIAALAWGVTALVMQNRD

SEQ ID NO: 236753 - protein, 17 aa, Mycobacterium bovis
PRRVLLLCDVSRSMQPY

SEQ ID NO: 236754 - protein, 26 aa, Mycobacterium bovis
PRSMLFPHLYGPLPVRAVIGAAAYPP

SEQ ID NO: 236755 - protein, 19 aa, Mycobacterium bovis
PRVLSIAQFWDRAAGHDRI

SEQ ID NO: 236756 - protein, 25 aa, Mycobacterium bovis
PSANPYLASAAILGLALDGMKTKAV

SEQ ID NO: 236757 - protein, 21 aa, Mycobacterium bovis
PSPSMGRDIPVAFLAGGPHAV

SEQ ID NO: 236758 - protein, 17 aa, Mycobacterium bovis
PSQGAVFVLQLNADALD

SEQ ID NO: 236759 - protein, 22 aa, Mycobacterium bovis
PSRSAFVAGPWGAVASLSPELF

SEQ ID NO: 236760 - protein, 25 aa, Mycobacterium bovis
PSWEEITEVLEWLSPLPGGSVVSVE

SEQ ID NO: 236761 - protein, 17 aa, Mycobacterium bovis
PTATLLDTYSPELFCMI

SEQ ID NO: 236762 - protein, 40 aa, Mycobacterium bovis
PTYVHPADRFMLTDPIYGLGPRIAQLVAGAFFREPKQVVE

SEQ ID NO: 236763 - protein, 19 aa, Mycobacterium bovis
PVAAQQFQFALPAGVASEE

SEQ ID NO: 236764 - protein, 29 aa, Mycobacterium bovis
PVAQSYLRNFLAAPPPQRAAMAAQLQAVP

SEQ ID NO: 236765 - protein, 17 aa, Mycobacterium bovis
PVATTGLYPPGSTFKMI

SEQ ID NO: 236766 - protein, 18 aa, Mycobacterium bovis
PVEGGWAWLPDEAQGARV

SEQ ID NO: 236767 - protein, 33 aa, Mycobacterium bovis
PVGAPPFPPTAPPPPFLPAAPPPPDPLAGPPGD

SEQ ID NO: 236768 - protein, 19 aa, Mycobacterium bovis
PVGVRRLRNYHSTRSAHYC

SEQ ID NO: 236769 - protein, 20 aa, Mycobacterium bovis
PVHAECAGLLYLVSELDGHP

SEQ ID NO: 236770 - protein, 20 aa, Mycobacterium bovis
PVILVILLSVAAGAGAWLLV

SEQ ID NO: 236771 - protein, 17 aa, Mycobacterium bovis
PVLASAASDLGGIASMI

SEQ ID NO: 236772 - protein, 17 aa, Mycobacterium bovis
PVRVNPGARYRAMEQFF

SEQ ID NO: 236773 - protein, 17 aa, Mycobacterium bovis
PYAVWLDDWYARESNNN

SEQ ID NO: 236774 - protein, 24 aa, Mycobacterium bovis
QAAGPWLKNALISNLNIVSTVNPG

SEQ ID NO: 236775 - protein, 23 aa, Mycobacterium bovis
QAGDLLGIALLSNADPAAPTVEQ

SEQ ID NO: 236776 - protein, 21 aa, Mycobacterium bovis
QAIDLLKGVLMPSIMQAVQNG

SEQ ID NO: 236777 - protein, 29 aa, Mycobacterium bovis
QALSAAAAAFHDQFVRALAAGAGAYAGAE

SEQ ID NO: 236778 - protein, 20 aa, Mycobacterium bovis
QARRYEAVRVWRSGLCSASN

SEQ ID NO: 236779 - protein, 24 aa, Mycobacterium bovis
QFQAKYPMHAIIRQQLTDAAVRPA

SEQ ID NO: 236780 - protein, 25 aa, Mycobacterium bovis
QGKAALEVNWPFVFASMLENAVKGG

SEQ ID NO: 236781 - protein, 17 aa, Mycobacterium bovis
QGLPATSIAWGAWAEIG

SEQ ID NO: 236782 - protein, 18 aa, Mycobacterium bovis
QGPAGWLRAKTGSLTAIN

SEQ ID NO: 236783 - protein, 18 aa, Mycobacterium bovis
QIVPYLRSWESVIGHQRT

SEQ ID NO: 236784 - protein, 17 aa, Mycobacterium bovis
QLAFGARVGQRLADARE

SEQ ID NO: 236785 - protein, 20 aa, Mycobacterium bovis
QLVRILLRGPMVIVGLAQRG

SEQ ID NO: 236786 - protein, 18 aa, Mycobacterium bovis
QNTNTGAFFIGHSGLLNS

SEQ ID NO: 236787 - protein, 32 aa, Mycobacterium bovis
QQINPGCGCYFDDVYWITFAGIATADNPRYVI

SEQ ID NO: 236788 - protein, 19 aa, Mycobacterium bovis
QQLLFFDRNIPLGSPTRNP

SEQ ID NO: 236789 - protein, 19 aa, Mycobacterium bovis
QQRTLLMSTKMYAVSRNPT

SEQ ID NO: 236790 - protein, 21 aa, Mycobacterium bovis
QRGFLDRLMAHPAVAGLSEGP

SEQ ID NO: 236791 - protein, 25 aa, Mycobacterium bovis
QRLRGMFAFALWDTVTRELFCARDP

SEQ ID NO: 236792 - protein, 25 aa, Mycobacterium bovis
QRPHGFKALDITLPMPPRWTQVPDP

SEQ ID NO: 236793 - protein, 18 aa, Mycobacterium bovis
QSGMAKFAAFLRGVNVGG

SEQ ID NO: 236794 - protein, 24 aa, Mycobacterium bovis
QSGSIGLGFAIPVDQAKRIADELI

SEQ ID NO: 236795 - protein, 22 aa, Mycobacterium bovis
QSMTGHHLAMALATRARIAVAE

SEQ ID NO: 236796 - protein, 36 aa, Mycobacterium bovis
QSTDQRLLDLINGPTQALLGRPLIGDGANGGPGQDG

SEQ ID NO: 236797 - protein, 19 aa, Mycobacterium bovis
QSYLIATASFAEWIDRGRP

SEQ ID NO: 236798 - protein, 24 aa, Mycobacterium bovis
QTFAEFFDRRLALHSPEMAAKTIV

SEQ ID NO: 236799 - protein, 22 aa, Mycobacterium bovis
QVAAPLAAYVPAVRTGNLVYTA

SEQ ID NO: 236800 - protein, 25 aa, Mycobacterium bovis
QVHDADTIVLRRSRPLQISLDGHDA

SEQ ID NO: 236801 - protein, 18 aa, Mycobacterium bovis
QVVLGWKVSDLKSSTAVI

SEQ ID NO: 236802 - protein, 33 aa, Mycobacterium bovis
QWMPPNKAFACQYAMQFIAVLRGYSLPVDQPSS

SEQ ID NO: 236803 - protein, 23 aa, Mycobacterium bovis
RAAPYLVGALKLILTQPFDVDTV

SEQ ID NO: 236804 - protein, 25 aa, Mycobacterium bovis
RAEESAFVLLALQAPVAGDLRAIVS

SEQ ID NO: 236805 - protein, 21 aa, Mycobacterium bovis
RALWIAALSFGLGGVAVAAEP

SEQ ID NO: 236806 - protein, 23 aa, Mycobacterium bovis
RANRVFDERLLTIEWERGELPEV

SEQ ID NO: 236807 - protein, 24 aa, Mycobacterium bovis
RAPPKVWFHDLLHPNGRPYRDGEV

SEQ ID NO: 236808 - protein, 17 aa, Mycobacterium bovis
RAPWRLLQVYQDPANTT

SEQ ID NO: 236809 - protein, 20 aa, Mycobacterium bovis
RAVDMAIKLGLRSYANPGTA

SEQ ID NO: 236810 - protein, 26 aa, Mycobacterium bovis
RAVNRPTPLMLPSVAVRAAFGEFADE

SEQ ID NO: 236811 - protein, 21 aa, Mycobacterium bovis
RAYDGLFTRGGKWAINPMFID

SEQ ID NO: 236812 - protein, 26 aa, Mycobacterium bovis
RCVEVPFAIDFPLTYRLGRRHNTPVR

SEQ ID NO: 236813 - protein, 20 aa, Mycobacterium bovis
RDAGVLPVLKHFPGHGRGSG

SEQ ID NO: 236814 - protein, 22 aa, Mycobacterium bovis
RDALFHWGVAMLPAGPAGRVSV

SEQ ID NO: 236815 - protein, 26 aa, Mycobacterium bovis
RDEGRWHVRWTTSGLHPKLGEHQTFA

SEQ ID NO: 236816 - protein, 21 aa, Mycobacterium bovis
RDGQWWYESLSGAPIADWLAS

SEQ ID NO: 236817 - protein, 29 aa, Mycobacterium bovis
RDRQWGFVNAWVSFYAAGLFAMNNGVPWS

SEQ ID NO: 236818 - protein, 26 aa, Mycobacterium bovis
RDSIVAINPLIRVRLHELRLAPSNAV

SEQ ID NO: 236819 - protein, 23 aa, Mycobacterium bovis
RDSLLTTHPLPNIGRVVITGNPV

SEQ ID NO: 236820 - protein, 18 aa, Mycobacterium bovis
RDYRVLSAALLEVTFCGF

SEQ ID NO: 236821 - protein, 21 aa, Mycobacterium bovis
REDWAALYKKAFAPLNELAGS

SEQ ID NO: 236822 - protein, 21 aa, Mycobacterium bovis
RELLVAMAMLVSVTGCARHAS

SEQ ID NO: 236823 - protein, 28 aa, Mycobacterium bovis
RELVVAWGKLYPQFGAVAALNLVKCVHW

SEQ ID NO: 236824 - protein, 35 aa, Mycobacterium bovis
RERLGPVLRRLTVNYPPIMFHPLNTITAYKGQIIY

SEQ ID NO: 236825 - protein, 18 aa, Mycobacterium bovis
RGLMRVIDSEHPHLGATA

SEQ ID NO: 236826 - protein, 17 aa, Mycobacterium bovis
RGRWLAIAASLVVSAAI

SEQ ID NO: 236827 - protein, 20 aa, Mycobacterium bovis
RGSAYHYFPGGRTQLLCEAV

SEQ ID NO: 236828 - protein, 20 aa, Mycobacterium bovis
RGVVITYRNLLSNMRAMAVG

SEQ ID NO: 236829 - protein, 24 aa, Mycobacterium bovis
RHDRLIEAIVLIRQLWSGERISFT

SEQ ID NO: 236830 - protein, 17 aa, Mycobacterium bovis
RIAGRLGLRPDVRRMPL

SEQ ID NO: 236831 - protein, 24 aa, Mycobacterium bovis
RIDPIPLNFDVLSSAGPINISIID

SEQ ID NO: 236832 - protein, 18 aa, Mycobacterium bovis
RIKKVTERLPLPPNARRV

SEQ ID NO: 236833 - protein, 23 aa, Mycobacterium bovis
RIVTPRVMQFTLRANVPKLADTQ

SEQ ID NO: 236834 - protein, 26 aa, Mycobacterium bovis
RLAGMTTWVASIALLAAALSGCGAGQ

SEQ ID NO: 236835 - protein, 22 aa, Mycobacterium bovis
RLGIRLVIVLVRRWPKVISRAM

SEQ ID NO: 236836 - protein, 17 aa, Mycobacterium bovis
RLRQQRHFGCGGQPEFR

SEQ ID NO: 236837 - protein, 18 aa, Mycobacterium bovis
RLVSDQISLLLRRTIDPD

SEQ ID NO: 236838 - protein, 18 aa, Mycobacterium bovis
RLVWQSASLLLAYPDDGL

SEQ ID NO: 236839 - protein, 31 aa, Mycobacterium bovis
RMATARYGEFLRASLPPFWQTTNATQVRAAL

SEQ ID NO: 236840 - protein, 18 aa, Mycobacterium bovis
RMGALALHVAKIARRRHP

SEQ ID NO: 236841 - protein, 17 aa, Mycobacterium bovis
RMRPGNWAGIYACWGTE

SEQ ID NO: 236842 - protein, 27 aa, Mycobacterium bovis
RPATLIAALPAILGFVPEKSLVLVSLA

SEQ ID NO: 236843 - protein, 20 aa, Mycobacterium bovis
RPDNPLPCAGATVGPFGGPD

SEQ ID NO: 236844 - protein, 27 aa, Mycobacterium bovis
RPQPQPVELLLRAITPPRAPAASPNVG

SEQ ID NO: 236845 - protein, 23 aa, Mycobacterium bovis
RPRVAVWGIHLLRRGGLTGDGIP

SEQ ID NO: 236846 - protein, 22 aa, Mycobacterium bovis
RPTPEMLAYQYLQTLPEMARGD

SEQ ID NO: 236847 - protein, 27 aa, Mycobacterium bovis
RPTPTITARLNFQLAFGARVGQRLADA

SEQ ID NO: 236848 - protein, 21 aa, Mycobacterium bovis
RPVKPPPRRPAHRVLVGWLSL

SEQ ID NO: 236849 - protein, 21 aa, Mycobacterium bovis
RQLDAFLKWHHGVREFLQSAI

SEQ ID NO: 236850 - protein, 18 aa, Mycobacterium bovis
RQPVAVSASFLWAPDPGT

SEQ ID NO: 236851 - protein, 23 aa, Mycobacterium bovis
RQVDLIRAQLTRQLRLELGHESV

SEQ ID NO: 236852 - protein, 18 aa, Mycobacterium bovis
RRHGLRVSLSPAPFAGSI

SEQ ID NO: 236853 - protein, 30 aa, Mycobacterium bovis
RRHNTPVRSFLLQLGGIRALGYSPELVTAV

SEQ ID NO: 236854 - protein, 17 aa, Mycobacterium bovis
RRIAVLAAVSIAATVVA

SEQ ID NO: 236855 - protein, 27 aa, Mycobacterium bovis
RRITSPEALLLVYTPQVISRHPVSPRA

SEQ ID NO: 236856 - protein, 17 aa, Mycobacterium bovis
RRPKFALLKGRRNYLCL

SEQ ID NO: 236857 - protein, 25 aa, Mycobacterium bovis
RRRLLAVLIALALPGAAVALLAEPS

SEQ ID NO: 236858 - protein, 21 aa, Mycobacterium bovis
RRWSQYLAWVADHIGLKVIHG

SEQ ID NO: 236859 - protein, 23 aa, Mycobacterium bovis
RSLGYTGNFFQAAGPWLKNALIS

SEQ ID NO: 236860 - protein, 18 aa, Mycobacterium bovis
RSLKVDGARVQRPLWAST

SEQ ID NO: 236861 - protein, 29 aa, Mycobacterium bovis
RSTTDTVLRFLGGRPALVVLDNCEHLLDA

SEQ ID NO: 236862 - protein, 28 aa, Mycobacterium bovis
RSVIASLTGWQWLGPSSVRMGAAVTPYV

SEQ ID NO: 236863 - protein, 21 aa, Mycobacterium bovis
RSYRLHVPPAEPSGLVISLHG

SEQ ID NO: 236864 - protein, 21 aa, Mycobacterium bovis
RSYRPLTLDYRLNPVAVIGDS

SEQ ID NO: 236865 - protein, 26 aa, Mycobacterium bovis
RTNGMTPYLVRVLGTQPTPVQQAPVQ

SEQ ID NO: 236866 - protein, 27 aa, Mycobacterium bovis
RTVSGQLTLLVPFIDRVRARVDLRERV

SEQ ID NO: 236867 - protein, 17 aa, Mycobacterium bovis
RTWQMLAARGVRIAADV

SEQ ID NO: 236868 - protein, 22 aa, Mycobacterium bovis
RVAAVFLRELLAADLQPVVERV

SEQ ID NO: 236869 - protein, 18 aa, Mycobacterium bovis
RVLADWDFNIRCFSNPAL

SEQ ID NO: 236870 - protein, 33 aa, Mycobacterium bovis
RVMRHRAWQGLVLLVLALLLSSCGWRGISNVAI

SEQ ID NO: 236871 - protein, 29 aa, Mycobacterium bovis
RVRGRDDRLRWWAGPWPDDERWWDPDRAS

SEQ ID NO: 236872 - protein, 18 aa, Mycobacterium bovis
RVWSKPGTGSTFTLALPA

SEQ ID NO: 236873 - protein, 17 aa, Mycobacterium bovis
RWLAIAASLVVSAAILY

SEQ ID NO: 236874 - protein, 21 aa, Mycobacterium bovis
RWTIAILAVVAALMAALVAQL

SEQ ID NO: 236875 - protein, 17 aa, Mycobacterium bovis
RYALIDDPYAAPLVRAV

SEQ ID NO: 236876 - protein, 17 aa, Mycobacterium bovis
RYFDYAEGRLGWRTLDF

SEQ ID NO: 236877 - protein, 21 aa, Mycobacterium bovis
RYYDMLRKFGLGQRTGVGLPG

SEQ ID NO: 236878 - protein, 24 aa, Mycobacterium bovis
SAAAAALPAFSPPAQALGGGVGAF

SEQ ID NO: 236879 - protein, 23 aa, Mycobacterium bovis
SADRAHRWYQAHGWLVGANYITS

SEQ ID NO: 236880 - protein, 36 aa, Mycobacterium bovis
SAHAGQYQQLGARAALFHEQFVQALTGAASAYASAE

SEQ ID NO: 236881 - protein, 26 aa, Mycobacterium bovis
SAHVAAFHDQFVHTLTAGAGSYMAAE

SEQ ID NO: 236882 - protein, 36 aa, Mycobacterium bovis
SAISGWAMRAAPTLAWPTWVWATSGSPTPAPTTSGL

SEQ ID NO: 236883 - protein, 23 aa, Mycobacterium bovis
SAQMSAFHAQFMQALTGAGGAYA

SEQ ID NO: 236884 - protein, 26 aa, Mycobacterium bovis
SAVAAQLAPWAQAVRALPNPTAPALA

SEQ ID NO: 236885 - protein, 23 aa, Mycobacterium bovis
SAYAIDMLLQPRTSHAAPAAAIG

SEQ ID NO: 236886 - protein, 30 aa, Mycobacterium bovis
SDGRRFACDYALLAVPYLTLRELAKSAHVK

SEQ ID NO: 236887 - protein, 22 aa, Mycobacterium bovis
SDGVPVLYRPSDLATLTDGAGP

SEQ ID NO: 236888 - protein, 29 aa, Mycobacterium bovis
SDHSRRLWTMLIFMLWHAIFVEHSVVPQI

SEQ ID NO: 236889 - protein, 29 aa, Mycobacterium bovis
SDIERLRKLWDVPALAFVGIGNGTQVALA

SEQ ID NO: 236890 - protein, 17 aa, Mycobacterium bovis
SDKALARITLTNAAAIL

SEQ ID NO: 236891 - protein, 18 aa, Mycobacterium bovis
SDWDTYRSLAPLQGLLFP

SEQ ID NO: 236892 - protein, 25 aa, Mycobacterium bovis
SDYDGFTLAGIPSGGLFSGAEVKKS

SEQ ID NO: 236893 - protein, 23 aa, Mycobacterium bovis
SETPVPELTWVPAGGGAPVGNPA

SEQ ID NO: 236894 - protein, 23 aa, Mycobacterium bovis
SFTSVPMLFATPTYYAQFADMGG

SEQ ID NO: 236895 - protein, 25 aa, Mycobacterium bovis
SGATGAPGGWLLGDGGAGGSGAAGS

SEQ ID NO: 236896 - protein, 21 aa, Mycobacterium bovis
SGDGQWRLRQQRHFGCGGQPE

SEQ ID NO: 236897 - protein, 24 aa, Mycobacterium bovis
SGEGCVVLLLKRLPDAVRDGDRVL

SEQ ID NO: 236898 - protein, 24 aa, Mycobacterium bovis
SGEGGFGGPGLAGGLFGNPGNGGV

SEQ ID NO: 236899 - protein, 20 aa, Mycobacterium bovis
SGIGQFVILASGLDARAYRL

SEQ ID NO: 236900 - protein, 26 aa, Mycobacterium bovis
SGLDSRAYRLRWPAGTIVFEVDQPQV

SEQ ID NO: 236901 - protein, 26 aa, Mycobacterium bovis
SGMLVPVHWGTFRLAPHPWGEPVERL

SEQ ID NO: 236902 - protein, 19 aa, Mycobacterium bovis
SGMYFWLDYADGIEPYFSV

SEQ ID NO: 236903 - protein, 26 aa, Mycobacterium bovis
SGPFFKAMVVNLLPYQILQPWVDAAF

SEQ ID NO: 236904 - protein, 24 aa, Mycobacterium bovis
SGPRWLALLLQPLSGPPSTSAKHT

SEQ ID NO: 236905 - protein, 19 aa, Mycobacterium bovis
SGPTTALTDVWRALRASMR

SEQ ID NO: 236906 - protein, 24 aa, Mycobacterium bovis
SGRQYMSWISLEDEVRALQFAIAQ

SEQ ID NO: 236907 - protein, 19 aa, Mycobacterium bovis
SGRWRAGAARRLTSLVAAA

SEQ ID NO: 236908 - protein, 26 aa, Mycobacterium bovis
SHELTAVGDWMLLAAIEALIDEQDYL

SEQ ID NO: 236909 - protein, 17 aa, Mycobacterium bovis
SHVYRLKSSVFISVGVL

SEQ ID NO: 236910 - protein, 17 aa, Mycobacterium bovis
SIAISMYCPSVMADAAS

SEQ ID NO: 236911 - protein, 18 aa, Mycobacterium bovis
SIIDAAIAELRHLNPLNI

SEQ ID NO: 236912 - protein, 17 aa, Mycobacterium bovis
SILTYHVVAGQTSPANV

SEQ ID NO: 236913 - protein, 26 aa, Mycobacterium bovis
SIYSSCAVPPLVAYLDTGKLPDTDTY

SEQ ID NO: 236914 - protein, 20 aa, Mycobacterium bovis
SKQFTATAILLLVEAGKLTL

SEQ ID NO: 236915 - protein, 21 aa, Mycobacterium bovis
SLAVLGWNMSVSNLRWSGDYV

SEQ ID NO: 236916 - protein, 25 aa, Mycobacterium bovis
SLNNRMLSQIWSHWSLLSAPSCAAQ

SEQ ID NO: 236917 - protein, 19 aa, Mycobacterium bovis
SMCNNGWTYPPFADTRRGE

SEQ ID NO: 236918 - protein, 28 aa, Mycobacterium bovis
SMIIQFVVKTLVAMLDWGLNPQQAVSLV

SEQ ID NO: 236919 - protein, 23 aa, Mycobacterium bovis
SNALWCRWCLGYAQLMRGELAAA

SEQ ID NO: 236920 - protein, 32 aa, Mycobacterium bovis
SNVCWPTPRPPMRIWPRRFDAPPGTCRASRSM

SEQ ID NO: 236921 - protein, 19 aa, Mycobacterium bovis
SNYLLLGEIVHRASGQPLP

SEQ ID NO: 236922 - protein, 17 aa, Mycobacterium bovis
SPDEVRRFARERSRWLF

SEQ ID NO: 236923 - protein, 23 aa, Mycobacterium bovis
SPPVTHCTTVASYTARVLGSIER

SEQ ID NO: 236924 - protein, 29 aa, Mycobacterium bovis
SPVNAAISALVLPSAFRPIPDPNTPTGSR

SEQ ID NO: 236925 - protein, 28 aa, Mycobacterium bovis
SRNTTLWASWAFVGPNHRAYFGGDTGYT

SEQ ID NO: 236926 - protein, 22 aa, Mycobacterium bovis
SRVAFLGWSMGGYGALLLGSRL

SEQ ID NO: 236927 - protein, 24 aa, Mycobacterium bovis
SSALLAGCQFGGLNSLPLPGTAGH

SEQ ID NO: 236928 - protein, 24 aa, Mycobacterium bovis
SSCTWQLSLFIPDGVPPPPGDPVP

SEQ ID NO: 236929 - protein, 26 aa, Mycobacterium bovis
SSDLRVGQPVLAIGSPLGLEGTVTTG

SEQ ID NO: 236930 - protein, 39 aa, Mycobacterium bovis
SSIPPVPGKFYWMSPTQVRWRPFEFWPANTAVNIDAAGT

SEQ ID NO: 236931 - protein, 22 aa, Mycobacterium bovis
SSLFGLIAVPGQSAYNAAKFAV

SEQ ID NO: 236932 - protein, 17 aa, Mycobacterium bovis
SSNLLFRRNSVSGAVEV

SEQ ID NO: 236933 - protein, 23 aa, Mycobacterium bovis
STAIAALFGAQGQAYQAASAQAA

SEQ ID NO: 236934 - protein, 25 aa, Mycobacterium bovis
SVGPITISPITLFPAQNFNTTFPVG

SEQ ID NO: 236935 - protein, 28 aa, Mycobacterium bovis
SVLDQAGPYLPFNTPFTAAGMQYYTQMP

SEQ ID NO: 236936 - protein, 24 aa, Mycobacterium bovis
SVQIDHIVPLSYAWDMGAYRWPNS

SEQ ID NO: 236937 - protein, 24 aa, Mycobacterium bovis
SWFAGYRGDLAFASLIVGGGSSEY

SEQ ID NO: 236938 - protein, 18 aa, Mycobacterium bovis
SWSSCSNRRFVEVTPGQD

SEQ ID NO: 236939 - protein, 18 aa, Mycobacterium bovis
SYSGVFVHSAPWSVGAQG

SEQ ID NO: 236940 - protein, 21 aa, Mycobacterium bovis
TAAEVPLAFALAAGSFRDATR

SEQ ID NO: 236941 - protein, 21 aa, Mycobacterium bovis
TAALLGIAALLAGCIKPNTFD

SEQ ID NO: 236942 - protein, 20 aa, Mycobacterium bovis
TAATLGLAALGFAGTASASS

SEQ ID NO: 236943 - protein, 25 aa, Mycobacterium bovis
TADGINYRVLWQAAGPDTISGATIP

SEQ ID NO: 236944 - protein, 18 aa, Mycobacterium bovis
TADTLRQLLPPEDRIILV

SEQ ID NO: 236945 - protein, 25 aa, Mycobacterium bovis
TAEPLPRWWRPAGSLFDQFLGAAET

SEQ ID NO: 236946 - protein, 23 aa, Mycobacterium bovis
TAGQLPLEAGKLVRTGKLGADVN

SEQ ID NO: 236947 - protein, 25 aa, Mycobacterium bovis
TALHKHLLEQSPPIWWTHIAGHGDA

SEQ ID NO: 236948 - protein, 26 aa, Mycobacterium bovis
TCKGANIAPPLTWSAPFGGALVVDDP

SEQ ID NO: 236949 - protein, 22 aa, Mycobacterium bovis
TDELIDRCWAPKVHGAWNIHRA

SEQ ID NO: 236950 - protein, 28 aa, Mycobacterium bovis
TDPRHTPPHAWYIAFAPAQAPKVAVAVL

SEQ ID NO: 236951 - protein, 20 aa, Mycobacterium bovis
TDRSGRVLTFAFISNEAGPN

SEQ ID NO: 236952 - protein, 25 aa, Mycobacterium bovis
TDVTPKLFLPTLSGLTQGPGFPNLS

SEQ ID NO: 236953 - protein, 31 aa, Mycobacterium bovis
TEATLRERFGYDAWALIYDVDTVRTIVAAYP

SEQ ID NO: 236954 - protein, 17 aa, Mycobacterium bovis
TFAAATYMNGPSVSYLS

SEQ ID NO: 236955 - protein, 25 aa, Mycobacterium bovis
TGANGAPGGWLLGNGGAGGSAAAGS

SEQ ID NO: 236956 - protein, 30 aa, Mycobacterium bovis
TGESLPLASIFKLYVLHALAGAVQHNTVSW

SEQ ID NO: 236957 - protein, 18 aa, Mycobacterium bovis
TGFIGVVLVTAGKASADP

SEQ ID NO: 236958 - protein, 26 aa, Mycobacterium bovis
TGGAGGAAGWLYGSGGAGGAGGLNNA

SEQ ID NO: 236959 - protein, 17 aa, Mycobacterium bovis
TGLYPPGSTFKMITAGA

SEQ ID NO: 236960 - protein, 26 aa, Mycobacterium bovis
TGQAGGAGGILWGNGGAGGSGAPGQV

SEQ ID NO: 236961 - protein, 25 aa, Mycobacterium bovis
TGQPWVVSFQLNWPRDHGPTVTGWM

SEQ ID NO: 236962 - protein, 26 aa, Mycobacterium bovis
TGTGERLVFGPVALGLVPVTVTNHVV

SEQ ID NO: 236963 - protein, 27 aa, Mycobacterium bovis
TGTVAYRFSWHLPKDRIWTYDGQLKMA

SEQ ID NO: 236964 - protein, 23 aa, Mycobacterium bovis
TGVFPVDLPPITGPPPPLGDAHL

SEQ ID NO: 236965 - protein, 26 aa, Mycobacterium bovis
TGVGRFRYPRNGWPALFHVRSGASLA

SEQ ID NO: 236966 - protein, 17 aa, Mycobacterium bovis
THHMYLPMDVDAGEDQP

SEQ ID NO: 236967 - protein, 23 aa, Mycobacterium bovis
THYFDNFFLDATRAGIRQAVILA

SEQ ID NO: 236968 - protein, 23 aa, Mycobacterium bovis
TIATGLIGALRQAGHTVAPFKVG

SEQ ID NO: 236969 - protein, 22 aa, Mycobacterium bovis
TIDAPIGRHRGHEWKFAITKNG

SEQ ID NO: 236970 - protein, 25 aa, Mycobacterium bovis
TKAITKRITVWPQGADIQDRVNNRS

SEQ ID NO: 236971 - protein, 22 aa, Mycobacterium bovis
TLAAAAAWDGLAAELGQAANSF

SEQ ID NO: 236972 - protein, 20 aa, Mycobacterium bovis
TLFRRLAVFVGCFFVDDAQA

SEQ ID NO: 236973 - protein, 23 aa, Mycobacterium bovis
TLGEALALWLSGQEQLMPRDLVY

SEQ ID NO: 236974 - protein, 19 aa, Mycobacterium bovis
TLLDTYSPELFCMIRNFHD

SEQ ID NO: 236975 - protein, 23 aa, Mycobacterium bovis
TLLGRLLVYDALEMSYRTITIRK

SEQ ID NO: 236976 - protein, 20 aa, Mycobacterium bovis
TLQAFLHWAITDGNKASFLD

SEQ ID NO: 236977 - protein, 22 aa, Mycobacterium bovis
TLVGLMLTLLPAPTSAAGSNTA

SEQ ID NO: 236978 - protein, 21 aa, Mycobacterium bovis
TLVLVLVLCLAGVTAVSMQVR

SEQ ID NO: 236979 - protein, 44 aa, Mycobacterium bovis
TNAAPLATLEHNVLNALNAPTQALLGRPLIGDGAAGAPGTGQAG

SEQ ID NO: 236980 - protein, 21 aa, Mycobacterium bovis
TNTICLDIDWVIGGCMSVDPT

SEQ ID NO: 236981 - protein, 37 aa, Mycobacterium bovis
TNVEQQVLGLINAPTQALWGRPLIGNGADGTAANPNG

SEQ ID NO: 236982 - protein, 22 aa, Mycobacterium bovis
TPFVGPPPFRPPTFNPVDGAMV

SEQ ID NO: 236983 - protein, 25 aa, Mycobacterium bovis
TPISQKMIDALRPMMRLVVTNGTAK

SEQ ID NO: 236984 - protein, 24 aa, Mycobacterium bovis
TPMRLRYFATLSDGVLVWTMSNPR

SEQ ID NO: 236985 - protein, 20 aa, Mycobacterium bovis
TPNGLAINPGIGGNGGDTGN

SEQ ID NO: 236986 - protein, 28 aa, Mycobacterium bovis
TPTSVHVGILPYPRNLDSLVLIASGGAF

SEQ ID NO: 236987 - protein, 28 aa, Mycobacterium bovis
TQAGQFALTYPRRLGFGLGSSVVSLSWR

SEQ ID NO: 236988 - protein, 18 aa, Mycobacterium bovis
TQFNFHAAMYQAVGAQAI

SEQ ID NO: 236989 - protein, 24 aa, Mycobacterium bovis
TQQVDGYIRVYPQMKDLIGTLQAH

SEQ ID NO: 236990 - protein, 17 aa, Mycobacterium bovis
TRRALALCVPRDAIARD

SEQ ID NO: 236991 - protein, 26 aa, Mycobacterium bovis
TSGGWRIDRLPNGVFLDWQQFQETYK

SEQ ID NO: 236992 - protein, 18 aa, Mycobacterium bovis
TTALFVVATGCSSATNVA

SEQ ID NO: 236993 - protein, 24 aa, Mycobacterium bovis
TTERFMTRLGPLLRHHRVLICTPA

SEQ ID NO: 236994 - protein, 23 aa, Mycobacterium bovis
TTNPLHVRLGQRPTLMFDNTTMM

SEQ ID NO: 236995 - protein, 24 aa, Mycobacterium bovis
TTNTQLLWYRPDLVNSPPTDWNAM

SEQ ID NO: 236996 - protein, 22 aa, Mycobacterium bovis
TTSTLPGAGWTAAAPQAAAGTF

SEQ ID NO: 236997 - protein, 21 aa, Mycobacterium bovis
TTYPVWMMNAIGDISFHHATA

SEQ ID NO: 236998 - protein, 21 aa, Mycobacterium bovis
TVGGLMLPVGVRRLRNYHSTR

SEQ ID NO: 236999 - protein, 19 aa, Mycobacterium bovis
TVPDIGIARFRDAFASDLA

SEQ ID NO: 237000 - protein, 23 aa, Mycobacterium bovis
TVPGTTPSIWTGSPAPSGLSGHD

SEQ ID NO: 237001 - protein, 17 aa, Mycobacterium bovis
TVRVFLHDLLWAQDAPG

SEQ ID NO: 237002 - protein, 25 aa, Mycobacterium bovis
TVTVPELLVVRPAPGVWHLVSTVSA

SEQ ID NO: 237003 - protein, 17 aa, Mycobacterium bovis
TVVYFQVTVPQAAVYEI

SEQ ID NO: 237004 - protein, 17 aa, Mycobacterium bovis
TYLTGIGSAINAANAVA

SEQ ID NO: 237005 - protein, 28 aa, Mycobacterium bovis
TYPSIYDPAMRTLIAFGGKYPTSVIPST

SEQ ID NO: 237006 - protein, 40 aa, Mycobacterium bovis
TYTIPLDTPPAPAPPPFRLPLLFVNALGDNWIVGASNSTG

SEQ ID NO: 237007 - protein, 24 aa, Mycobacterium bovis
VAAADQLVLTRLIIGRTARRHGLR

SEQ ID NO: 237008 - protein, 23 aa, Mycobacterium bovis
VAAATAILAVVLAIGGCSTEGDA

SEQ ID NO: 237009 - protein, 34 aa, Mycobacterium bovis
VAADPYDAYLRLHLLSHRLVAPHGLNAGGLFGVL

SEQ ID NO: 237010 - protein, 20 aa, Mycobacterium bovis
VADRRRYYLGSISGKKVIVA

SEQ ID NO: 237011 - protein, 18 aa, Mycobacterium bovis
VADWLAARQPKLVTSAHW

SEQ ID NO: 237012 - protein, 20 aa, Mycobacterium bovis
VAGAAILVAGLSGCSSNKST

SEQ ID NO: 237013 - protein, 24 aa, Mycobacterium bovis
VAGREFLSFWLDGDSRVLAGMNVN

SEQ ID NO: 237014 - protein, 18 aa, Mycobacterium bovis
VAILSKLTGDIDPAKVLQ

SEQ ID NO: 237015 - protein, 20 aa, Mycobacterium bovis
VALQAIGRLFFAAGAVEVLT

SEQ ID NO: 237016 - protein, 17 aa, Mycobacterium bovis
VALRSWRPRVAVWGIHL

SEQ ID NO: 237017 - protein, 18 aa, Mycobacterium bovis
VAPGYIWGDTLKSYFDHQ

SEQ ID NO: 237018 - protein, 17 aa, Mycobacterium bovis
VAPVRTAGMTPYVVRYI

SEQ ID NO: 237019 - protein, 17 aa, Mycobacterium bovis
VARFAAALAPRGSGTLL

SEQ ID NO: 237020 - protein, 21 aa, Mycobacterium bovis
VCSLALMLAMFGANVYASRMA

SEQ ID NO: 237021 - protein, 25 aa, Mycobacterium bovis
VDAKGNTIAWLYSQRRFEVPSDKIA

SEQ ID NO: 237022 - protein, 24 aa, Mycobacterium bovis
VDEDYLLYECDGQWVLAAGVQAMV

SEQ ID NO: 237023 - protein, 29 aa, Mycobacterium bovis
VDHYAEIGLLGFALIADALGGVDVCLKEP

SEQ ID NO: 237024 - protein, 42 aa, Mycobacterium bovis
VDLLAPPPDPLALPPALDPLAPPPPDPLAPPPPDPLAVPVAA

SEQ ID NO: 237025 - protein, 22 aa, Mycobacterium bovis
VDTSPYSVAYLIDSHQDRTGAD

SEQ ID NO: 237026 - protein, 24 aa, Mycobacterium bovis
VDVDAKLYGLPFGDGAYGAQDMSL

SEQ ID NO: 237027 - protein, 18 aa, Mycobacterium bovis
VEGKVIWSGVRGIADLAS

SEQ ID NO: 237028 - protein, 23 aa, Mycobacterium bovis
VEIPGLPPITIPLLAPPPPAPPP

SEQ ID NO: 237029 - protein, 25 aa, Mycobacterium bovis
VENNFPLVNLLVNRGPTVPILLDTG

SEQ ID NO: 237030 - protein, 23 aa, Mycobacterium bovis
VEPRARWERLYHLVNHVLEHHGD

SEQ ID NO: 237031 - protein, 28 aa, Mycobacterium bovis
VFDDVHVAPRVIFLPGPAAALTSDDHGT

SEQ ID NO: 237032 - protein, 29 aa, Mycobacterium bovis
VFGVLLAVVTVPFVALGPGPTFDTLGEID

SEQ ID NO: 237033 - protein, 22 aa, Mycobacterium bovis
VFLAVLVIFAIIVVAKSVALIP

SEQ ID NO: 237034 - protein, 19 aa, Mycobacterium bovis
VFLDWQQFQETYKRNTLYF

SEQ ID NO: 237035 - protein, 22 aa, Mycobacterium bovis
VGALVLVLVYKQFRGEFTPKTE

SEQ ID NO: 237036 - protein, 33 aa, Mycobacterium bovis
VGAPMGWEAVFTRPFQAFWVELPACNNWVDIGL

SEQ ID NO: 237037 - protein, 23 aa, Mycobacterium bovis
VGDDLVPYRTLVTQAPVGVMVGH

SEQ ID NO: 237038 - protein, 27 aa, Mycobacterium bovis
VGDQRLRIDLSALRIIGDGLAWAPAGF

SEQ ID NO: 237039 - protein, 17 aa, Mycobacterium bovis
VGGNARLLGTGGAGGVG

SEQ ID NO: 237040 - protein, 24 aa, Mycobacterium bovis
VGLFERIWEIRANLSAYDASYVAL

SEQ ID NO: 237041 - protein, 18 aa, Mycobacterium bovis
VGTPLIALGPVLAGAPGD

SEQ ID NO: 237042 - protein, 28 aa, Mycobacterium bovis
VGWDWFGLQFYNGTALMLFQIRQADGSV

SEQ ID NO: 237043 - protein, 19 aa, Mycobacterium bovis
VHDALVGKSVVIFRTPDAH

SEQ ID NO: 237044 - protein, 19 aa, Mycobacterium bovis
VIAVIGYQRISTSAVTGSL

SEQ ID NO: 237045 - protein, 17 aa, Mycobacterium bovis
VIDFKTTTLAGLGAAPT

SEQ ID NO: 237046 - protein, 18 aa, Mycobacterium bovis
VKIPGGALCGKLAVPVDY

SEQ ID NO: 237047 - protein, 18 aa, Mycobacterium bovis
VLAIEPMLTLGTTKTVVL

SEQ ID NO: 237048 - protein, 24 aa, Mycobacterium bovis
VLAVPTQMWGFTNPLPPGSDEHIA

SEQ ID NO: 237049 - protein, 17 aa, Mycobacterium bovis
VLGAIPRTAELELPTRY

SEQ ID NO: 237050 - protein, 35 aa, Mycobacterium bovis
VLHRPKLGFPVPIRHWLRAGELLEWAYATVGSSQA

SEQ ID NO: 237051 - protein, 17 aa, Mycobacterium bovis
VLIGFSLPGKTIGMQSR

SEQ ID NO: 237052 - protein, 17 aa, Mycobacterium bovis
VLPILQDTTIVAAGPSV

SEQ ID NO: 237053 - protein, 26 aa, Mycobacterium bovis
VLSSGWDIMDFVRQLQKLAGGNVAFA

SEQ ID NO: 237054 - protein, 31 aa, Mycobacterium bovis
VLTVVNAPTQALLGRPIIGNGANGLPNTGQD

SEQ ID NO: 237055 - protein, 24 aa, Mycobacterium bovis
VLVAVVLVGWPAAGAPPSCAGLGG

SEQ ID NO: 237056 - protein, 28 aa, Mycobacterium bovis
VLVLTLTLVAFWWWQRPRTNAVAADSLV

SEQ ID NO: 237057 - protein, 22 aa, Mycobacterium bovis
VLVPGYLYHYSLDAGQAGRELF

SEQ ID NO: 237058 - protein, 19 aa, Mycobacterium bovis
VNAFFSSRCNLIAWDRGVF

SEQ ID NO: 237059 - protein, 24 aa, Mycobacterium bovis
VNGRHLVLPLQQYPSLTDFGDANE

SEQ ID NO: 237060 - protein, 17 aa, Mycobacterium bovis
VNIGPFRIEPIDVPAVV

SEQ ID NO: 237061 - protein, 29 aa, Mycobacterium bovis
VNTTAWFVMATIRNAVFLGHAFAALNPAT

SEQ ID NO: 237062 - protein, 26 aa, Mycobacterium bovis
VPLAPLTTLRVGPIARRVITCTSAEQ

SEQ ID NO: 237063 - protein, 18 aa, Mycobacterium bovis
VPLFAVFLAAGCTTTTTG

SEQ ID NO: 237064 - protein, 24 aa, Mycobacterium bovis
VPRPLMGSLIQRVPLDGAALSTLL

SEQ ID NO: 237065 - protein, 31 aa, Mycobacterium bovis
VPSAKVDLPQLPYLPLQVPQQLSLPADLPAL

SEQ ID NO: 237066 - protein, 17 aa, Mycobacterium bovis
VQRLPLNVTWVNLTTGK

SEQ ID NO: 237067 - protein, 21 aa, Mycobacterium bovis
VRRFARERSRWLFSNPEMTHL

SEQ ID NO: 237068 - protein, 18 aa, Mycobacterium bovis
VRSLTGVPIDYFAEINLA

SEQ ID NO: 237069 - protein, 25 aa, Mycobacterium bovis
VSAAIAALFGAHGQAYQTVSAQASA

SEQ ID NO: 237070 - protein, 25 aa, Mycobacterium bovis
VSAQASAFHAQFVQALTGGGGAYAA

SEQ ID NO: 237071 - protein, 32 aa, Mycobacterium bovis
VSAVFTTPHRFLYDPLGFLRLLTSSGATHTFM

SEQ ID NO: 237072 - protein, 34 aa, Mycobacterium bovis
VSHDDARFNVSRAALLVVALTERPDLLMAATEDL

SEQ ID NO: 237073 - protein, 20 aa, Mycobacterium bovis
VSPALWLSAGAVAPGSFDGP

SEQ ID NO: 237074 - protein, 24 aa, Mycobacterium bovis
VSQMLQCIVTLMPLGAAVVDTHRD

SEQ ID NO: 237075 - protein, 17 aa, Mycobacterium bovis
VSSDGVPVLYRPSDLAT

SEQ ID NO: 237076 - protein, 18 aa, Mycobacterium bovis
VTAAPLPGLGFTQPLPPA

SEQ ID NO: 237077 - protein, 29 aa, Mycobacterium bovis
VTFAQPYPAWRELFTDILPAHIVKDIPGG

SEQ ID NO: 237078 - protein, 25 aa, Mycobacterium bovis
VTIFPNGISIPNNPLALLASASIGT

SEQ ID NO: 237079 - protein, 28 aa, Mycobacterium bovis
VVFSQGVAIMIWTLMNARNSRDSLLTTH

SEQ ID NO: 237080 - protein, 24 aa, Mycobacterium bovis
VVLARTGVVLSPAGGMLRRMRPLF

SEQ ID NO: 237081 - protein, 23 aa, Mycobacterium bovis
VVNVYAIAVLKRTSQPALARQFV

SEQ ID NO: 237082 - protein, 31 aa, Mycobacterium bovis
VVTWDTPVVSKLPWFALRDPYVTGQVTIADL

SEQ ID NO: 237083 - protein, 18 aa, Mycobacterium bovis
VYFDYWSARGVDVTPFFA

SEQ ID NO: 237084 - protein, 30 aa, Mycobacterium bovis
WAGNEPGFGVPWLYNYIGQPWKTQRTVDRV

SEQ ID NO: 237085 - protein, 26 aa, Mycobacterium bovis
WESVLLARIRPRRRPRRVLLLCDVSR

SEQ ID NO: 237086 - protein, 20 aa, Mycobacterium bovis
WGAPQLGRWKWHDPWVHASL

SEQ ID NO: 237087 - protein, 20 aa, Mycobacterium bovis
WGVVNGTKAFLPHVIASGDG

SEQ ID NO: 237088 - protein, 17 aa, Mycobacterium bovis
WHNWRVTWNPSGMYFWL

SEQ ID NO: 237089 - protein, 21 aa, Mycobacterium bovis
WIPLLILVVVAIAGFTVQRIR

SEQ ID NO: 237090 - protein, 20 aa, Mycobacterium bovis
WIPMVIVIVVAVAAVTVSRL

SEQ ID NO: 237091 - protein, 20 aa, Mycobacterium bovis
WLMQRENVPLSPDPGPPLVL

SEQ ID NO: 237092 - protein, 19 aa, Mycobacterium bovis
WLQIVTELAPVFKAAGFRP

SEQ ID NO: 237093 - protein, 18 aa, Mycobacterium bovis
WLSDYGLTGLLRRSIVVL

SEQ ID NO: 237094 - protein, 33 aa, Mycobacterium bovis
WNGTQWVREISWQWDCLLPDGTIEYAPAKSITA

SEQ ID NO: 237095 - protein, 17 aa, Mycobacterium bovis
WPDPNGTRFPNGAPPAA

SEQ ID NO: 237096 - protein, 21 aa, Mycobacterium bovis
WPGGRQYLPKAVIGATTRAFD

SEQ ID NO: 237097 - protein, 30 aa, Mycobacterium bovis
WQDNEGHSMFPWLTLALVGNSTSSILFGTG

SEQ ID NO: 237098 - protein, 18 aa, Mycobacterium bovis
WQRLDDVPLVPASTNKIL

SEQ ID NO: 237099 - protein, 19 aa, Mycobacterium bovis
WYARADPPAPAPRPILPPL

SEQ ID NO: 237100 - protein, 21 aa, Mycobacterium bovis
YAALGYLKYPKAVTVASVMDP

SEQ ID NO: 237101 - protein, 19 aa, Mycobacterium bovis
YATLTPNQWSDFGPAADIY

SEQ ID NO: 237102 - protein, 30 aa, Mycobacterium bovis
YDEGNAEQYLWWVPHNVAGLVTALGGRTAV

SEQ ID NO: 237103 - protein, 29 aa, Mycobacterium bovis
YEDRSFTFTLKTPPAAKLLLKAAGVAKGS

SEQ ID NO: 237104 - protein, 24 aa, Mycobacterium bovis
YFAEINLAGFYDLAQTLGGVDVCL

SEQ ID NO: 237105 - protein, 22 aa, Mycobacterium bovis
YHPSAPAYALAADLLFLALRDA

SEQ ID NO: 237106 - protein, 21 aa, Mycobacterium bovis
YKSATFLQRNLPRGTTQGQAF

SEQ ID NO: 237107 - protein, 17 aa, Mycobacterium bovis
YLANYHLAWYAVTTRRG

SEQ ID NO: 237108 - protein, 25 aa, Mycobacterium bovis
YNGDPLTFAWVNHMKIFFNNKGVVA

SEQ ID NO: 237109 - protein, 24 aa, Mycobacterium bovis
YNHGAYVFLGPGFTPGSPSGGSGG

SEQ ID NO: 237110 - protein, 17 aa, Mycobacterium bovis
YPPFADTRRGEEGYFVL

SEQ ID NO: 237111 - protein, 22 aa, Mycobacterium bovis
YPSAGIEQLIFAPQGSLAQSRT

SEQ ID NO: 237112 - protein, 19 aa, Mycobacterium bovis
YQALSIRLAAVLSPITEID

SEQ ID NO: 237113 - protein, 18 aa, Mycobacterium bovis
YRGRADLVLLYIDPAALD

SEQ ID NO: 237114 - protein, 17 aa, Mycobacterium bovis
YSDGRPVTCDDLVLAWA

SEQ ID NO: 237115 - protein, 30 aa, Mycobacterium bovis
YSGYAPIMGTPWLTAFAQRSRFAEAFHATG

SEQ ID NO: 237116 - protein, 18 aa, Mycobacterium bovis
YTSNAQLVVYRLIGDFDP

SEQ ID NO: 237117 - protein, 18 aa, Mycobacterium bovis
YTVFAPTNAAFSKLPAST

SEQ ID NO: 237118 - protein, 23 aa, Mycobacterium bovis
YTYHSKTLGWCDIAYNALVDKYG

SEQ ID NO: 237119 - protein, 20 aa, Mycobacterium bovis
YVATLLLKLVDEKKLRLDDK

SEQ ID NO: 237120 - protein, 33 aa, Mycobacterium bovis; identical to SEQ ID NO: 225833

SEQ ID NO: 237121 - protein, 55 aa, Mycobacterium bovis
AAAGDEVSAAIAALFGTHAQEYQALSARVATFHEQFVRSLTAAGSAYATAEAANA

SEQ ID NO: 237122 - protein, 25 aa, Mycobacterium bovis
AAAPLVTLYKQYVVRFGLGYREEVH

SEQ ID NO: 237123 - protein, 25 aa, Mycobacterium bovis
AAEAMYEQMWAADVAAMVGYHGGAS

SEQ ID NO: 237124 - protein, 23 aa, Mycobacterium bovis
AAFYRLSSLRLWPDRRLSRRGVE

SEQ ID NO: 237125 - protein, 34 aa, Mycobacterium bovis
AAGAPGQAGGPGGPAGLWGNGGPGGAGGSGGGTG

SEQ ID NO: 237126 - protein, 23 aa, Mycobacterium bovis
AAGDVTLAINQGAGGAGGNGGNV

SEQ ID NO: 237127 - protein, 24 aa, Mycobacterium bovis
AAIAALFSAHGRAYQVASAQAAAV

SEQ ID NO: 237128 - protein, 17 aa, Mycobacterium bovis
AAIASLFGAHGQAYQAV

SEQ ID NO: 237129 - protein, 17 aa, Mycobacterium bovis
AALFARFGQEYQAVSAQ

SEQ ID NO: 237130 - protein, 17 aa, Mycobacterium bovis
AALFGMHGQAYQALSVQ

SEQ ID NO: 237131 - protein, 26 aa, Mycobacterium bovis
AAMAAAAAPYAGWLAAAAARAAGASA

SEQ ID NO: 237132 - protein, 29 aa, Mycobacterium bovis
ACRKHHLLKTFWTGWRDVQLPDGTVIWTA

SEQ ID NO: 237133 - protein, 27 aa, Mycobacterium bovis
ADFADLFPVPAKLWTIADLGGWGSVDP

SEQ ID NO: 237134 - protein, 27 aa, Mycobacterium bovis
ADPAGWPRLDWSMDAALLLAALASRAG

SEQ ID NO: 237135 - protein, 48 aa, Mycobacterium bovis
AEAANASPLQALEQQVLGAINAPTQLWLGRPLIGDGVHGAPGTGQPGG

SEQ ID NO: 237136 - protein, 19 aa, Mycobacterium bovis
AEIIRLGTALGANGATLAG

SEQ ID NO: 237137 - protein, 26 aa, Mycobacterium bovis
AGANGLNSGAMLPGGGTVGNPGTGGN

SEQ ID NO: 237138 - protein, 25 aa, Mycobacterium bovis
AGDGGAGGRGGWLAGAGGAGGDGGI

SEQ ID NO: 237139 - protein, 27 aa, Mycobacterium bovis
AGEACARAIAWYLAMARRSQGNESAAV

SEQ ID NO: 237140 - protein, 17 aa, Mycobacterium bovis
AGGILFGAGGAGGAGGA

SEQ ID NO: 237141 - protein, 17 aa, Mycobacterium bovis
AGGLIWGTAGTGGNGGF

SEQ ID NO: 237142 - protein, 21 aa, Mycobacterium bovis
AGGNGGWLWGNGGNGGVGGTS

SEQ ID NO: 237143 - protein, 18 aa, Mycobacterium bovis
AGGRLFGNGGAGGNGGTA

SEQ ID NO: 237144 - protein, 20 aa, Mycobacterium bovis
AGGSAGLLALGDGGAGGAGG

SEQ ID NO: 237145 - protein, 22 aa, Mycobacterium bovis
AGGSGGWLYGNGGNGGIGGNAI

SEQ ID NO: 237146 - protein, 20 aa, Mycobacterium bovis
AGKGGIGAPGLSTAQGGDGG

SEQ ID NO: 237147 - protein, 19 aa, Mycobacterium bovis
AGPADIHLVAAKQSYGFAV

SEQ ID NO: 237148 - protein, 23 aa, Mycobacterium bovis
AGRMLAIMHALDGALATVSPGAT

SEQ ID NO: 237149 - protein, 26 aa, Mycobacterium bovis
AGRNYLYDAWAARFLVTARLNNSLPE

SEQ ID NO: 237150 - protein, 21 aa, Mycobacterium bovis
AGSPGGLLYGTGGAGGNGGPG

SEQ ID NO: 237151 - protein, 23 aa, Mycobacterium bovis
AHTNLEFLSCFLGLMLHGAVPVP

SEQ ID NO: 237152 - protein, 29 aa, Mycobacterium bovis
AISTQVAAFHDRFAQTLSAAVGSYVSAEA

SEQ ID NO: 237153 - protein, 20 aa, Mycobacterium bovis
ALDRGALTAFLSWLESRPSP

SEQ ID NO: 237154 - protein, 27 aa, Mycobacterium bovis
ALDVLNGPFQALFGRPLIGDGANGAPG

SEQ ID NO: 237155 - protein, 22 aa, Mycobacterium bovis
ALGTPAPSFTLPQPATGATVSL

SEQ ID NO: 237156 - protein, 22 aa, Mycobacterium bovis
ALIVLAVPMPALPGMLAHIRKS

SEQ ID NO: 237157 - protein, 26 aa, Mycobacterium bovis
ALSARAAAFHHEFVQALAAGAGSYAV

SEQ ID NO: 237158 - protein, 37 aa, Mycobacterium bovis
ANVQQNLLNAINAPTQALLGRPLIGDGAVGTASSPDG

SEQ ID NO: 237159 - protein, 20 aa, Mycobacterium bovis
APAGPAARAATAAPAGCCSA

SEQ ID NO: 237160 - protein, 22 aa, Mycobacterium bovis
APTETLLGRPLIGDGAPGTATS

SEQ ID NO: 237161 - protein, 18 aa, Mycobacterium bovis
APVVLTSCTWRGIANVPL

SEQ ID NO: 237162 - protein, 22 aa, Mycobacterium bovis
AQLRARSWWSGPDIYVVVDDYD

SEQ ID NO: 237163 - protein, 25 aa, Mycobacterium bovis
ASGLDARAYRLAWPVGSIVYEVDMP

SEQ ID NO: 237164 - protein, 19 aa, Mycobacterium bovis
ASLLASWVGAVPQVGLAAS

SEQ ID NO: 237165 - protein, 25 aa, Mycobacterium bovis
ATAFRNFQYTVQAQKLWAQAGFRPV

SEQ ID NO: 237166 - protein, 23 aa, Mycobacterium bovis
ATDHPDLFWALRGGGGGNFGVTT

SEQ ID NO: 237167 - protein, 26 aa, Mycobacterium bovis
ATDTGSFRWASVRGYRLAARLVEIGV

SEQ ID NO: 237168 - protein, 24 aa, Mycobacterium bovis
ATLQSHRAWLFADAARHEMRDRWA

SEQ ID NO: 237169 - protein, 38 aa, Mycobacterium bovis
ATNVEQQVLGLINAPTQALWGRPLIGNGADGTAANPNG

SEQ ID NO: 237170 - protein, 25 aa, Mycobacterium bovis
AVELELYKRLPGDLSILTPSPASDT

SEQ ID NO: 237171 - protein, 26 aa, Mycobacterium bovis
AVLPRSATPVLLPDVVAAAPGMTAAL

SEQ ID NO: 237172 - protein, 17 aa, Mycobacterium bovis
AVRARLRRRGPVTVYGV

SEQ ID NO: 237173 - protein, 17 aa, Mycobacterium bovis
AVVASLFARHAQAYQAL

SEQ ID NO: 237174 - protein, 20 aa, Mycobacterium bovis
AVVLLIALGAVWTPVAFADG

SEQ ID NO: 237175 - protein, 18 aa, Mycobacterium bovis
AWHGNWHMLIVTSIGTDA

SEQ ID NO: 237176 - protein, 18 aa, Mycobacterium bovis
AWPAFRAATRWESSPTPP

SEQ ID NO: 237177 - protein, 18 aa, Mycobacterium bovis
AYVLHRAWVGPMVLVVLD

SEQ ID NO: 237178 - protein, 29 aa, Mycobacterium bovis
CGDTDRVTLFRAWYSRRNFGQLSGSVQIS

SEQ ID NO: 237179 - protein, 18 aa, Mycobacterium bovis
CRDIPFDVIQRLGLAYTP

SEQ ID NO: 237180 - protein, 22 aa, Mycobacterium bovis
CTLGYVDPALKIAFTAGHCRGG

SEQ ID NO: 237181 - protein, 24 aa, Mycobacterium bovis
DAAQPVAVPGPPPAPPAPRAAAPP

SEQ ID NO: 237182 - protein, 23 aa, Mycobacterium bovis
DAPASTGLTGGTGFAGGAGGVGG

SEQ ID NO: 237183 - protein, 19 aa, Mycobacterium bovis
DDIAWLPATAQLAVLAAKK

SEQ ID NO: 237184 - protein, 17 aa, Mycobacterium bovis
DDPFRALDMLASLWSST

SEQ ID NO: 237185 - protein, 18 aa, Mycobacterium bovis
DEVSAAIAALFSAHGRDF

SEQ ID NO: 237186 - protein, 22 aa, Mycobacterium bovis
DEVSAAIATLFGSHAREYQAIS

SEQ ID NO: 237187 - protein, 22 aa, Mycobacterium bovis
DGGAGGWLLGTGGAGGAGGNGG

SEQ ID NO: 237188 - protein, 24 aa, Mycobacterium bovis
DGGGGLPPVPASPGGNGGGGGAGG

SEQ ID NO: 237189 - protein, 25 aa, Mycobacterium bovis
DGLGSYFWQHNWGSPKGYTHPAAHL

SEQ ID NO: 237190 - protein, 19 aa, Mycobacterium bovis
DIEILLTATMLRCGRPTAC

SEQ ID NO: 237191 - protein, 19 aa, Mycobacterium bovis
DISLRNWIATLTLELEPTV

SEQ ID NO: 237192 - protein, 18 aa, Mycobacterium bovis
DLAPPAPAELAPPAPADL

SEQ ID NO: 237193 - protein, 18 aa, Mycobacterium bovis
DLESLEFVTFDRVPPGPG

SEQ ID NO: 237194 - protein, 17 aa, Mycobacterium bovis
DLLSRARDSLQSHGSIA

SEQ ID NO: 237195 - protein, 34 aa, Mycobacterium bovis; identical to SEQ ID NO: 226075

SEQ ID NO: 237196 - protein, 21 aa, Mycobacterium bovis
DWADEVYVFGYPRVPMTAEMA

SEQ ID NO: 237197 - protein, 31 aa, Mycobacterium bovis
EARIKFNCLAPGMWPAWWLSNDDPGRSGEID

SEQ ID NO: 237198 - protein, 27 aa, Mycobacterium bovis
EDAGFDPNLPPPLAPDFLSPPAEEAPP

SEQ ID NO: 237199 - protein, 31 aa, Mycobacterium bovis
EDETAWRNGIWYTARLRPGPLRPAERRTAVV

SEQ ID NO: 237200 - protein, 18 aa, Mycobacterium bovis
EFCDIDHSAPWPLGPTHP

SEQ ID NO: 237201 - protein, 25 aa, Mycobacterium bovis
ELIRFQTAFVSGPLRRASPSAVHPV

SEQ ID NO: 237202 - protein, 26 aa, Mycobacterium bovis
ELPTRYLGLVTAVEYGRRARLAVQAM

SEQ ID NO: 237203 - protein, 30 aa, Mycobacterium bovis; identical to SEQ ID NO: 226132

SEQ ID NO: 237204 - protein, 22 aa, Mycobacterium bovis
EPGIYFPGRWGARIEDIVIVTE

SEQ ID NO: 237205 - protein, 24 aa, Mycobacterium bovis
ERASPYVVGALKLGLTAPFNIDEV

SEQ ID NO: 237206 - protein, 24 aa, Mycobacterium bovis
ERTLASVALILTGGGIVNLDVIQT

SEQ ID NO: 237207 - protein, 17 aa, Mycobacterium bovis
EVHLDRDFRVLDTEPAD

SEQ ID NO: 237208 - protein, 18 aa, Mycobacterium bovis
EVYARRLALAAAATADAG

SEQ ID NO: 237209 - protein, 17 aa, Mycobacterium bovis
FAATVALLAAGFSPATA

SEQ ID NO: 237210 - protein, 18 aa, Mycobacterium bovis
FARILRPGGLAGITDVTV

SEQ ID NO: 237211 - protein, 25 aa, Mycobacterium bovis
FAVTNDGVIFFFNPGELLPEAAGPT

SEQ ID NO: 237212 - protein, 18 aa, Mycobacterium bovis
FDAATLGSPGADGGMGGN

SEQ ID NO: 237213 - protein, 17 aa, Mycobacterium bovis
FDVIQRLGLAYTPPEAE

SEQ ID NO: 237214 - protein, 17 aa, Mycobacterium bovis
FEPVLASLRDLGCRALL

SEQ ID NO: 237215 - protein, 24 aa, Mycobacterium bovis
FGAKSVEFIPPKTPSPKPLSPNAH

SEQ ID NO: 237216 - protein, 27 aa, Mycobacterium bovis
FGEPSSGFSSMLWGGGSLPTIGPLYSS

SEQ ID NO: 237217 - protein, 23 aa, Mycobacterium bovis
FGSSRPMPLPPGRGILVTGAGDE

SEQ ID NO: 237218 - protein, 18 aa, Mycobacterium bovis
FRALDMLASLWSSTGMSL

SEQ ID NO: 237219 - protein, 17 aa, Mycobacterium bovis
FTLIRDRTEPVMSAKLP

SEQ ID NO: 237220 - protein, 53 aa, Mycobacterium bovis
GADEVSARIAALFGGFGLEYQAISAQVAAYHQRFVQALSTGAGAYASAEATAA

SEQ ID NO: 237221 - protein, 23 aa, Mycobacterium bovis
GAGDPSFAVNNGAGGNGGHGGNP

SEQ ID NO: 237222 - protein, 25 aa, Mycobacterium bovis
GAGGAAGQLFSAGGAAGAVGVGGTG

SEQ ID NO: 237223 - protein, 24 aa, Mycobacterium bovis
GAGGAGGLFAGGGIGGAGGFGGFR

SEQ ID NO: 237224 - protein, 26 aa, Mycobacterium bovis
GAGGAGGSGFFGGKGGFGGDGGQGGP

SEQ ID NO: 237225 - protein, 18 aa, Mycobacterium bovis
GAGGAGGWLSGNGGAGGN

SEQ ID NO: 237226 - protein, 20 aa, Mycobacterium bovis
GAGGFASTGLGGPGGAGGPG

SEQ ID NO: 237227 - protein, 18 aa, Mycobacterium bovis
GAGGLLYGNGGNGFSQTT

SEQ ID NO: 237228 - protein, 18 aa, Mycobacterium bovis
GAGGLLYGSGGNGGSGLA

SEQ ID NO: 237229 - protein, 26 aa, Mycobacterium bovis
GAGGNAGLLAPGLAGGAGGGGGQGFD

SEQ ID NO: 237230 - protein, 25 aa, Mycobacterium bovis
GAGGNGGWLYGSGGNGGAGGAGPAG

SEQ ID NO: 237231 - protein, 19 aa, Mycobacterium bovis
GAGGSGGLLWGNGGAGGAG

SEQ ID NO: 237232 - protein, 18 aa, Mycobacterium bovis
GARLYRKLTTTTVVAYFS

SEQ ID NO: 237233 - protein, 23 aa, Mycobacterium bovis
GASIYNVSVLLDPNKGLANLLAN

SEQ ID NO: 237234 - protein, 25 aa, Mycobacterium bovis
GATAFPWRRQSALVQWYVETSGSPS

SEQ ID NO: 237235 - protein, 24 aa, Mycobacterium bovis
GATGSAGIGGAGGRGGDGGDGASG

SEQ ID NO: 237236 - protein, 27 aa, Mycobacterium bovis
GCQTYKWETFLTSELPGWLQANRHVKP

SEQ ID NO: 237237 - protein, 18 aa, Mycobacterium bovis
GDAGLLFGSGGAGGAGGS

SEQ ID NO: 237238 - protein, 19 aa, Mycobacterium bovis
GDPVAPPIPLLPARVDYDS

SEQ ID NO: 237239 - protein, 22 aa, Mycobacterium bovis
GDRLLTELGWALRRAPLPPTGP

SEQ ID NO: 237240 - protein, 26 aa, Mycobacterium bovis
GDVNTGFWNGGPFNTGFGNGGNTNFG

SEQ ID NO: 237241 - protein, 19 aa, Mycobacterium bovis
GEHVVPIPRLLNVEDYLDY

SEQ ID NO: 237242 - protein, 19 aa, Mycobacterium bovis
GGAALLFGAGGAGGAGGSG

SEQ ID NO: 237243 - protein, 19 aa, Mycobacterium bovis
GGAALLFGSGGAGGSGGAG

SEQ ID NO: 237244 - protein, 25 aa, Mycobacterium bovis
GGAGAAGLPGAAGLNGGDGSDGGNG

SEQ ID NO: 237245 - protein, 24 aa, Mycobacterium bovis
GGAGGFGAVLFGNGGAGGSGAPGG

SEQ ID NO: 237246 - protein, 25 aa, Mycobacterium bovis
GGAGGKGAIPAMKGATGADGTAPTS

SEQ ID NO: 237247 - protein, 17 aa, Mycobacterium bovis
GGALLFGAGGAGGAGGS

SEQ ID NO: 237248 - protein, 25 aa, Mycobacterium bovis
GGAPGHGYFQQPAPQGLPIGTGGTG

SEQ ID NO: 237249 - protein, 31 aa, Mycobacterium bovis
GGDGGDGASGLGLGLSGFDGGQGGQGGDGGS

SEQ ID NO: 237250 - protein, 27 aa, Mycobacterium bovis
GGEGASGLGLDLSGFDGGQGGQGGAGG

SEQ ID NO: 237251 - protein, 27 aa, Mycobacterium bovis
GGFDCSGLVMWAFQQAGIALPHSSQAL

SEQ ID NO: 237252 - protein, 21 aa, Mycobacterium bovis
GGFTTFLDAAGGAGGAGGAGG

SEQ ID NO: 237253 - protein, 19 aa, Mycobacterium bovis
GGIGGAGERGADGAGPNAN

SEQ ID NO: 237254 - protein, 23 aa, Mycobacterium bovis
GGILGVLHMGLPTGLSISGYSGG

SEQ ID NO: 237255 - protein, 21 aa, Mycobacterium bovis
GGKAGLLFGSGGAGGSGGAGG

SEQ ID NO: 237256 - protein, 18 aa, Mycobacterium bovis
GGLQFTAGTWRANGGSGS

SEQ ID NO: 237257 - protein, 17 aa, Mycobacterium bovis
GGNAGVAGVSFGNAVGG

SEQ ID NO: 237258 - protein, 26 aa, Mycobacterium bovis
GGNGGAGMINGGLGGFGGAGGGGAVD

SEQ ID NO: 237259 - protein, 30 aa, Mycobacterium bovis
GGNGGGALNQAGFFGTGGKGGNGGNGGAGM

SEQ ID NO: 237260 - protein, 21 aa, Mycobacterium bovis
GGNGVAGTGLALNGGNGGIGG

SEQ ID NO: 237261 - protein, 19 aa, Mycobacterium bovis
GGTAGLLGSGGTGGDGGNG

SEQ ID NO: 237262 - protein, 24 aa, Mycobacterium bovis
GGVGGSGGWLNGNGGAGGAGGTGA

SEQ ID NO: 237263 - protein, 26 aa, Mycobacterium bovis
GHFVPNLTIGLPVVESLLAVTDIPMD

SEQ ID NO: 237264 - protein, 29 aa, Mycobacterium bovis
GHLGARLFSIIAWRTYLVRDPHALSLLDA

SEQ ID NO: 237265 - protein, 17 aa, Mycobacterium bovis
GIGATANSPLQAGGAGG

SEQ ID NO: 237266 - protein, 20 aa, Mycobacterium bovis
GKAGLLFGSGGAGGSGGAAG

SEQ ID NO: 237267 - protein, 20 aa, Mycobacterium bovis
GLAEYFVHRTGHGIGLCVHE

SEQ ID NO: 237268 - protein, 24 aa, Mycobacterium bovis
GLARARWGLLEPPEPWLPEAALAQ

SEQ ID NO: 237269 - protein, 20 aa, Mycobacterium bovis
GLGNIGSWNLGGGNVGLLNL

SEQ ID NO: 237270 - protein, 20 aa, Mycobacterium bovis
GNAALLFGNGGAGGAGGAGG

SEQ ID NO: 237271 - protein, 21 aa, Mycobacterium bovis
GNAGLFGVGGTGGPGGPGGPG

SEQ ID NO: 237272 - protein, 24 aa, Mycobacterium bovis
GNGGGAGLFYGFGGAGGNGGMGGV

SEQ ID NO: 237273 - protein, 19 aa, Mycobacterium bovis
GNLWLSEVFGAELIIPSYN

SEQ ID NO: 237274 - protein, 17 aa, Mycobacterium bovis
GNPGFSGAGGLGGLSGD

SEQ ID NO: 237275 - protein, 22 aa, Mycobacterium bovis
GPAPGVAPPPGGMPGLPFVQPD

SEQ ID NO: 237276 - protein, 19 aa, Mycobacterium bovis
GPASIGVTGAPGGNGGKGG

SEQ ID NO: 237277 - protein, 19 aa, Mycobacterium bovis
GPHWRLLSAVKELDPSWAR

SEQ ID NO: 237278 - protein, 30 aa, Mycobacterium bovis
GQLLVYGVDPLILRQAYPVRQAPYGLAGSR

SEQ ID NO: 237279 - protein, 21 aa, Mycobacterium bovis
GQSGLLFGNAGAGGAGAAGGA

SEQ ID NO: 237280 - protein, 22 aa, Mycobacterium bovis
GRALSILNDPFRVGGLPATNGP

SEQ ID NO: 237281 - protein, 17 aa, Mycobacterium bovis
GRRLMIGTAAAVVLPGL

SEQ ID NO: 237282 - protein, 17 aa, Mycobacterium bovis
GSGGTAGLLGSGGTGGD

SEQ ID NO: 237283 - protein, 27 aa, Mycobacterium bovis
GSVIARLTGMHWWGPASTSMLAMSAPY

SEQ ID NO: 237284 - protein, 20 aa, Mycobacterium bovis
GTAGLLYGVGGAGGGGGAGG

SEQ ID NO: 237285 - protein, 30 aa, Mycobacterium bovis
GTGANGGAGGNAWLFGAGGSGGAGTNGGVG

SEQ ID NO: 237286 - protein, 26 aa, Mycobacterium bovis
GTGAPGGPGGWLIGNGGAGGSGAPGA

SEQ ID NO: 237287 - protein, 18 aa, Mycobacterium bovis
GVGGAGGFGLTTGGPGAA

SEQ ID NO: 237288 - protein, 25 aa, Mycobacterium bovis
GVGGIGGLLLGLDGANAPASTNPLH

SEQ ID NO: 237289 - protein, 24 aa, Mycobacterium bovis
GVINAPTQTLVGRPLIGDGTHGAP

SEQ ID NO: 237290 - protein, 25 aa, Mycobacterium bovis
GWALRRAPLPPTGPHWRLLSAVKEL

SEQ ID NO: 237291 - protein, 26 aa, Mycobacterium bovis
GWQGDYPSMIEFLAPLFTAGAGSNDV

SEQ ID NO: 237292 - protein, 31 aa, Mycobacterium bovis
HGGAGGAGGRAWLWGTGGAGGAGAAAAIGNA

SEQ ID NO: 237293 - protein, 20 aa, Mycobacterium bovis
HPEPKVAVALKDPSYRLKTT

SEQ ID NO: 237294 - protein, 17 aa, Mycobacterium bovis
HVSLNWTHPDPATLWTL

SEQ ID NO: 237295 - protein, 27 aa, Mycobacterium bovis
IACITAQLPEWFRPGDFFPVPCCFPSC

SEQ ID NO: 237296 - protein, 28 aa, Mycobacterium bovis
IAIGGLYGDITYPVTSPLAITMGFAACE

SEQ ID NO: 237297 - protein, 17 aa, Mycobacterium bovis
IALLAAITPAAGERPES

SEQ ID NO: 237298 - protein, 22 aa, Mycobacterium bovis
IARVIMRSAIGFFASFTVSSGV

SEQ ID NO: 237299 - protein, 30 aa, Mycobacterium bovis; identical to SEQ ID NO: 226398

SEQ ID NO: 237300 - protein, 29 aa, Mycobacterium bovis
IGATPPDMTLFLDLKQTPPQPLVSAVAQV

SEQ ID NO: 237301 - protein, 26 aa, Mycobacterium bovis
IGGKGGDAFATFAKAGNGGAGGNGGA

SEQ ID NO: 237302 - protein, 21 aa, Mycobacterium bovis
IKVIAGAGLFAAAIALSPDAA

SEQ ID NO: 237303 - protein, 32 aa, Mycobacterium bovis
ISSGLMNTGFLPFRFQPVYIDYSPSGIGTTVF

SEQ ID NO: 237304 - protein, 19 aa, Mycobacterium bovis
ITEPLGYDTTYTWSGSAVG

SEQ ID NO: 237305 - protein, 29 aa, Mycobacterium bovis
ITSRGLYVHSAPWALPALGLENVSHGCIS

SEQ ID NO: 237306 - protein, 19 aa, Mycobacterium bovis
ITYDTLWQADTDPLPVVFP

SEQ ID NO: 237307 - protein, 18 aa, Mycobacterium bovis
IVALLLGDSFHPGGATLT

SEQ ID NO: 237308 - protein, 28 aa, Mycobacterium bovis
KADFDPYQFLLIPLARITGIEDPALRES

SEQ ID NO: 237309 - protein, 24 aa, Mycobacterium bovis
KCCVQQITPDGRLIPFCAYNSVGY

SEQ ID NO: 237310 - protein, 21 aa, Mycobacterium bovis
KFEWLDNDVVQWVPDRFWPAH

SEQ ID NO: 237311 - protein, 23 aa, Mycobacterium bovis
KGGTGLMPGINGTGGAGGSRGQI

SEQ ID NO: 237312 - protein, 17 aa, Mycobacterium bovis
LAALKQSAAAELGLRVC

SEQ ID NO: 237313 - protein, 25 aa, Mycobacterium bovis
LAAVNAPIQAVTGRPLIGNGANGAP

SEQ ID NO: 237314 - protein, 32 aa, Mycobacterium bovis
LAEVGAVHYPWLPLRRLLLDHYPSIERIASVH

SEQ ID NO: 237315 - protein, 18 aa, Mycobacterium bovis
LAGCALVMHKPHSAGSSN

SEQ ID NO: 237316 - protein, 17 aa, Mycobacterium bovis
LAPPAPAELAPPAPADL

SEQ ID NO: 237317 - protein, 18 aa, Mycobacterium bovis
LARITLTNAAAILDNAAA

SEQ ID NO: 237318 - protein, 17 aa, Mycobacterium bovis
LEVEFALDPSGRSAPLR

SEQ ID NO: 237319 - protein, 25 aa, Mycobacterium bovis
LEVNTLFQSLIDLLHKIDPLETNAT

SEQ ID NO: 237320 - protein, 19 aa, Mycobacterium bovis
LFGAHARQYQALSVQVAAF

SEQ ID NO: 237321 - protein, 29 aa, Mycobacterium bovis
LGAVNAPTEALLGRPLIGNGADGTAPGQP

SEQ ID NO: 237322 - protein, 18 aa, Mycobacterium bovis
LIPYQPFTELQVDAPSTL

SEQ ID NO: 237323 - protein, 18 aa, Mycobacterium bovis
LLALLALLALIVGLGASG

SEQ ID NO: 237324 - protein, 17 aa, Mycobacterium bovis
LLNVGKLIANNTRVWVY

SEQ ID NO: 237325 - protein, 26 aa, Mycobacterium bovis
LLSIPTSPFAISTYFSALLADPTTTP

SEQ ID NO: 237326 - protein, 29 aa, Mycobacterium bovis
LLTDPMLPAELLPADWPGAGLRAAYHDFA

SEQ ID NO: 237327 - protein, 25 aa, Mycobacterium bovis
LMVGSAVLTYLSYTAAFTSTDTVTV

SEQ ID NO: 237328 - protein, 17 aa, Mycobacterium bovis
LPARTPAYRVPLPELPH

SEQ ID NO: 237329 - protein, 18 aa, Mycobacterium bovis
LPVLPQLSARHHVLVAAV

SEQ ID NO: 237330 - protein, 26 aa, Mycobacterium bovis
LQLSALLPEWRTELPLRYLESVITQL

SEQ ID NO: 237331 - protein, 20 aa, Mycobacterium bovis
LRMFTGAGSAPMLAASVAWD

SEQ ID NO: 237332 - protein, 19 aa, Mycobacterium bovis
LRRRGPVTVYGVDKFPRMV

SEQ ID NO: 237333 - protein, 26 aa, Mycobacterium bovis
LSAQAALFHEQFVHAMTAGAGAYAGA

SEQ ID NO: 237334 - protein, 30 aa, Mycobacterium bovis
LSISGYSGGLYYIFATYTTTVDFGNGIVTA

SEQ ID NO: 237335 - protein, 17 aa, Mycobacterium bovis
LSLQATAFHQQFVQALT

SEQ ID NO: 237336 - protein, 30 aa, Mycobacterium bovis
LSVQVAAFHEQFVQALTAAAGRYASTEAAV

SEQ ID NO: 237337 - protein, 17 aa, Mycobacterium bovis
LTAFLSWLESRPSPRAP

SEQ ID NO: 237338 - protein, 19 aa, Mycobacterium bovis
LVDAPLPSWTHRTLMLSRE

SEQ ID NO: 237339 - protein, 18 aa, Mycobacterium bovis
MLDAVELELYKRLPGDLS

SEQ ID NO: 237340 - protein, 18 aa, Mycobacterium bovis
MVPVLLDTGSTGLVMDSQ

SEQ ID NO: 237341 - protein, 19 aa, Mycobacterium bovis
MWERRPGAADFCRIRVGVG

SEQ ID NO: 237342 - protein, 43 aa, Mycobacterium bovis
NAAPLATLEHNVLNALNAPTQALLGRPLIGDGAAGAPGTGQAG

SEQ ID NO: 237343 - protein, 18 aa, Mycobacterium bovis
NDPLLNVGKLIANNTRVW

SEQ ID NO: 237344 - protein, 23 aa, Mycobacterium bovis
NGGDAGLFGNGGAGGAGAAGLPG

SEQ ID NO: 237345 - protein, 23 aa, Mycobacterium bovis
NGGRAGLLLGVGGMGGNGGATSV

SEQ ID NO: 237346 - protein, 23 aa, Mycobacterium bovis
NGGRGGLLVGNGGAGGAGGVGGD

SEQ ID NO: 237347 - protein, 17 aa, Mycobacterium bovis
NLALFTEAERRLTEAND

SEQ ID NO: 237348 - protein, 17 aa, Mycobacterium bovis
NWHMLIVTSIGTDARTR

SEQ ID NO: 237349 - protein, 17 aa, Mycobacterium bovis
NWIATLTLELEPTVRLP

SEQ ID NO: 237350 - protein, 27 aa, Mycobacterium bovis
NYQMAVEPIIWRTYAQTLPPDAIETTI

SEQ ID NO: 237351 - protein, 24 aa, Mycobacterium bovis
NYSAVSLRLHPDIRLFTAIPEQRS

SEQ ID NO: 237352 - protein, 24 aa, Mycobacterium bovis
PESLRSLPGCHLLVRPEVMRRDVD

SEQ ID NO: 237353 - protein, 19 aa, Mycobacterium bovis
PGGWLIGNGGAGGSGAPGA

SEQ ID NO: 237354 - protein, 26 aa, Mycobacterium bovis
PGRQKIFLYSAIARPGNSGGPIVAQD

SEQ ID NO: 237355 - protein, 19 aa, Mycobacterium bovis
PIRIPSTLLGLLSEIPRCP

SEQ ID NO: 237356 - protein, 27 aa, Mycobacterium bovis
PIVRPQTLIYRAGVAAWWTSPMTRADG

SEQ ID NO: 237357 - protein, 23 aa, Mycobacterium bovis
PLEPYLDILPHFDTLLVMSVEPG

SEQ ID NO: 237358 - protein, 18 aa, Mycobacterium bovis
PLIGVRKAGLFTSSSFVL

SEQ ID NO: 237359 - protein, 25 aa, Mycobacterium bovis
PMLAASVAWDGLAAELAVAASSFGS

SEQ ID NO: 237360 - protein, 19 aa, Mycobacterium bovis
PPARYFGPNLSRLSAVRQK

SEQ ID NO: 237361 - protein, 25 aa, Mycobacterium bovis
PPQSFAQVLVGWQNWLRTADRGSWA

SEQ ID NO: 237362 - protein, 25 aa, Mycobacterium bovis
PPVCDCGGLIRPDIVWFGEPLPEEP

SEQ ID NO: 237363 - protein, 24 aa, Mycobacterium bovis
PSTGPSMGILPAGGVGGPGGSGGA

SEQ ID NO: 237364 - protein, 23 aa, Mycobacterium bovis
PTPSTVICLLQPANGQLLTGSAR

SEQ ID NO: 237365 - protein, 21 aa, Mycobacterium bovis
PYQGTVRMAFLLQGDHDAYFQ

SEQ ID NO: 237366 - protein, 17 aa, Mycobacterium bovis
QADTDPLPVVFPIVQGE

SEQ ID NO: 237367 - protein, 27 aa, Mycobacterium bovis
QALSAQAAMFHEQFVRALAAGGNSYAV

SEQ ID NO: 237368 - protein, 30 aa, Mycobacterium bovis
QALSAQMARFHQQFVQALTASVGSYAAAEA

SEQ ID NO: 237369 - protein, 20 aa, Mycobacterium bovis
QGGNAIAGGINGSGGAGGTG

SEQ ID NO: 237370 - protein, 19 aa, Mycobacterium bovis
QHPEFVDVFLAIGRVGRSL

SEQ ID NO: 237371 - protein, 19 aa, Mycobacterium bovis
QLLATAALDLASIGSQVSA

SEQ ID NO: 237372 - protein, 18 aa, Mycobacterium bovis
QLLIVDFRHTLLDVIESE

SEQ ID NO: 237373 - protein, 24 aa, Mycobacterium bovis
QLVNTTEPVVFISLNGGQMVPVLL

SEQ ID NO: 237374 - protein, 28 aa, Mycobacterium bovis
QMHLSLALNRLPQVAALFLAGHLGARLF

SEQ ID NO: 237375 - protein, 21 aa, Mycobacterium bovis
QNGGAGGILWGNGGNGGSGAP

SEQ ID NO: 237376 - protein, 37 aa, Mycobacterium bovis
QSVQQDLLNLINAPTQALLGRPLIGNGANGLPGTGQN

SEQ ID NO: 237377 - protein, 26 aa, Mycobacterium bovis
QTGAQLPCLPILFIVVDEFSELLSQH

SEQ ID NO: 237378 - protein, 21 aa, Mycobacterium bovis
QTMRANLERWAPLLPEGATLV

SEQ ID NO: 237379 - protein, 18 aa, Mycobacterium bovis
QVLAAAGDEVSAAIAALF

SEQ ID NO: 237380 - protein, 18 aa, Mycobacterium bovis
RAGIELLAFGGRFVEIGK

SEQ ID NO: 237381 - protein, 17 aa, Mycobacterium bovis
RAQLLIVDFRHTLLDVI

SEQ ID NO: 237382 - protein, 17 aa, Mycobacterium bovis
RARLRRRGPVTVYGVDK

SEQ ID NO: 237383 - protein, 18 aa, Mycobacterium bovis
RDSHPIRIPSTLLGLLSE

SEQ ID NO: 237384 - protein, 28 aa, Mycobacterium bovis
RGDYLNVFTTFDLTLRRIGETFFTTAYF

SEQ ID NO: 237385 - protein, 17 aa, Mycobacterium bovis
RGFYDRSLRCRDPHARL

SEQ ID NO: 237386 - protein, 24 aa, Mycobacterium bovis
RGLLRAMICQLAVWHSPEELLIAG

SEQ ID NO: 237387 - protein, 18 aa, Mycobacterium bovis
RLELAALKQSAAAELGLR

SEQ ID NO: 237388 - protein, 23 aa, Mycobacterium bovis
RLRLTRQALLAAAVAPLLAGCAL

SEQ ID NO: 237389 - protein, 18 aa, Mycobacterium bovis
RLWEALLRGDDLVGEIPA

SEQ ID NO: 237390 - protein, 17 aa, Mycobacterium bovis
RMAFLLQGDHDAYFQHV

SEQ ID NO: 237391 - protein, 25 aa, Mycobacterium bovis
RNRAHWDWLKWLPHNQHPNACDALG

SEQ ID NO: 237392 - protein, 23 aa, Mycobacterium bovis
RNRGREMLAFATAYRDAGVKPPR

SEQ ID NO: 237393 - protein, 19 aa, Mycobacterium bovis
RPDIVWFGEPLPEEPWRSA

SEQ ID NO: 237394 - protein, 24 aa, Mycobacterium bovis
RRRAELLVWLNPRAAHPEFQPRAG

SEQ ID NO: 237395 - protein, 20 aa, Mycobacterium bovis
RTRAALRTCMHHKRFGELRE

SEQ ID NO: 237396 - protein, 19 aa, Mycobacterium bovis
RTVVGQRIVFAPGAAHMSP

SEQ ID NO: 237397 - protein, 22 aa, Mycobacterium bovis
RYLSVVVAITLMLTAESVSIAT

SEQ ID NO: 237398 - protein, 26 aa, Mycobacterium bovis
SAAIAALFGAHARAYQALSAQAAMFH

SEQ ID NO: 237399 - protein, 23 aa, Mycobacterium bovis
SAAIAALFSAHGRDFQALSARAA

SEQ ID NO: 237400 - protein, 20 aa, Mycobacterium bovis
SAAIAALFSSYARDYQTLSV

SEQ ID NO: 237401 - protein, 29 aa, Mycobacterium bovis
SAAIASLFSGYARDYQALSAQMARFHQQF

SEQ ID NO: 237402 - protein, 42 aa, Mycobacterium bovis
SAEATAAEQIVLGVINAPTQALLGRPLIGDGANATTPGGAGG

SEQ ID NO: 237403 - protein, 22 aa, Mycobacterium bovis
SAQAAAFHTRFIRARSRHPQQE

SEQ ID NO: 237404 - protein, 22 aa, Mycobacterium bovis
SAVFPTILARATPGDGWASLAS

SEQ ID NO: 237405 - protein, 24 aa, Mycobacterium bovis
SDGQTLLYSYTTTATNTPFVTSGG

SEQ ID NO: 237406 - protein, 21 aa, Mycobacterium bovis
SEHLVAWMKAVVYGAAERWTD

SEQ ID NO: 237407 - protein, 42 aa, Mycobacterium bovis
SFVFRHRTGNAVILVLMLVAATQLFFLQVSHAAGLRAQAAGQ

SEQ ID NO: 237408 - protein, 26 aa, Mycobacterium bovis
SGAPGGHGGWLFGGGGTGGSGVSGGA

SEQ ID NO: 237409 - protein, 24 aa, Mycobacterium bovis
SGGANSPALYLLDGLRAQDDFSGW

SEQ ID NO: 237410 - protein, 24 aa, Mycobacterium bovis
SGNPLMVLLEYLPHARDLGLHLVV

SEQ ID NO: 237411 - protein, 18 aa, Mycobacterium bovis
SIPLMIGLAVPAHAGPSG

SEQ ID NO: 237412 - protein, 19 aa, Mycobacterium bovis
SLEFVTFDRVPPGPGEIEV

SEQ ID NO: 237413 - protein, 33 aa, Mycobacterium bovis
SLNWTHPDPATLWTLIGGPRMWERRPGAADFCR

SEQ ID NO: 237414 - protein, 24 aa, Mycobacterium bovis
SNEGFFNTGMFNNGIYNSGVASTG

SEQ ID NO: 237415 - protein, 22 aa, Mycobacterium bovis
SNPLANFAPGYPPTIEPAQPAV

SEQ ID NO: 237416 - protein, 24 aa, Mycobacterium bovis
SPEVLNLLLVDFKGGATFLDLAGA

SEQ ID NO: 237417 - protein, 23 aa, Mycobacterium bovis
SPGTLGNFLSRSGAVGVLGIGPN

SEQ ID NO: 237418 - protein, 33 aa, Mycobacterium bovis
SQGPISRRLALTALGFGVLAPNVLVACAGKVTK

SEQ ID NO: 237419 - protein, 31 aa, Mycobacterium bovis; identical to SEQ ID NO: 226941

SEQ ID NO: 237420 - protein, 18 aa, Mycobacterium bovis
STGKIYFDVTGPSPTIVA

SEQ ID NO: 237421 - protein, 27 aa, Mycobacterium bovis
STGLVMDSQFLTQNFGPVIGTGTAGYA

SEQ ID NO: 237422 - protein, 25 aa, Mycobacterium bovis
STSMLAMSAPYVEWLERTAAQTKQT

SEQ ID NO: 237423 - protein, 18 aa, Mycobacterium bovis
SVDYAVRITSRGLYVHSA

SEQ ID NO: 237424 - protein, 27 aa, Mycobacterium bovis
SVPGLVRVLPPFLSRKHLPSRLAKLRE

SEQ ID NO: 237425 - protein, 23 aa, Mycobacterium bovis
SVVGLVHTPGLVTLAPGARIADA

SEQ ID NO: 237426 - protein, 40 aa, Mycobacterium bovis
SYAVAEIAAASPLQSLIDVFNAPIQAATGRPLIGNGANGQ

SEQ ID NO: 237427 - protein, 20 aa, Mycobacterium bovis
TAARWNLKTIADLAPHSADV

SEQ ID NO: 237428 - protein, 24 aa, Mycobacterium bovis
TAGGDLPLPLRWGEYRAGGLARAR

SEQ ID NO: 237429 - protein, 21 aa, Mycobacterium bovis
TALDEGLLPVLPQLSARHHVL

SEQ ID NO: 237430 - protein, 27 aa, Mycobacterium bovis
TAQTPRQNPMWSAARVVMAARAAAALA

SEQ ID NO: 237431 - protein, 23 aa, Mycobacterium bovis
TDKRASGVIPRYGVRLTVMSRPP

SEQ ID NO: 237432 - protein, 18 aa, Mycobacterium bovis
TDRVFAIVIQDFQDPYTL

SEQ ID NO: 237433 - protein, 22 aa, Mycobacterium bovis
TEVARIGSALSLASAVAAAQTS

SEQ ID NO: 237434 - protein, 27 aa, Mycobacterium bovis
TGGAGGPGGLIWGGGGAGGVGGAGGGT

SEQ ID NO: 237435 - protein, 20 aa, Mycobacterium bovis
TGGATGLLGWGANGGAGGLG

SEQ ID NO: 237436 - protein, 25 aa, Mycobacterium bovis
TGSTFTLALPALIEAYHDDERPEQA

SEQ ID NO: 237437 - protein, 17 aa, Mycobacterium bovis
TIDQALGGVLFIDEAYA

SEQ ID NO: 237438 - protein, 21 aa, Mycobacterium bovis
TIGAGLALALVLDGCGKRVEV

SEQ ID NO: 237439 - protein, 23 aa, Mycobacterium bovis
TIPSALASLPSGGFVPAGTTISV

SEQ ID NO: 237440 - protein, 19 aa, Mycobacterium bovis
TLALTSSAGAYASAEATNV

SEQ ID NO: 237441 - protein, 33 aa, Mycobacterium bovis; identical to SEQ ID NO: 227026

SEQ ID NO: 237442 - protein, 30 aa, Mycobacterium bovis
TSAVLVVLGACLALWLSGCSSPKPDAEEQG

SEQ ID NO: 237443 - protein, 23 aa, Mycobacterium bovis
TSDYSPVFGCLFKGIARGVKEFA

SEQ ID NO: 237444 - protein, 17 aa, Mycobacterium bovis
TSPLAITMGFAACEAAQ

SEQ ID NO: 237445 - protein, 26 aa, Mycobacterium bovis
TTRYNPDYLPGALLPPSIHATADAEE

SEQ ID NO: 237446 - protein, 18 aa, Mycobacterium bovis
TWRGIANVPLPVGRGMGP

SEQ ID NO: 237447 - protein, 17 aa, Mycobacterium bovis
VFQTRPSGLPGLRHKYS

SEQ ID NO: 237448 - protein, 17 aa, Mycobacterium bovis
VGAIRYVSDRRPGGAWM

SEQ ID NO: 237449 - protein, 26 aa, Mycobacterium bovis
VGGAGGAGGLLAGAHGAAGATPTSGG

SEQ ID NO: 237450 - protein, 25 aa, Mycobacterium bovis
VGGPGGAAGLFGNGGSGGSGGAGAA

SEQ ID NO: 237451 - protein, 20 aa, Mycobacterium bovis
VGGSGGFVYGNGGAGGIGGI

SEQ ID NO: 237452 - protein, 20 aa, Mycobacterium bovis
VGGVAGLGGAGGAAGQLFSA

SEQ ID NO: 237453 - protein, 34 aa, Mycobacterium bovis
VHGAPGTGQPGGAGGLLWGNGGNGGSGAAGQVGG

SEQ ID NO: 237454 - protein, 18 aa, Mycobacterium bovis
VHIYLQFDGLDEATHRRI

SEQ ID NO: 237455 - protein, 18 aa, Mycobacterium bovis
VKEFAPLIGVRKAGLFTS

SEQ ID NO: 237456 - protein, 24 aa, Mycobacterium bovis
VLAAALLFCGLLGPGTAPPATGGG

SEQ ID NO: 237457 - protein, 18 aa, Mycobacterium bovis
VLAALRETGFITYQPRDR

SEQ ID NO: 237458 - protein, 21 aa, Mycobacterium bovis
VLQFAPGELKNLPGFQGSGDG

SEQ ID NO: 237459 - protein, 19 aa, Mycobacterium bovis
VLVTVFTLIRDRTEPVMSA

SEQ ID NO: 237460 - protein, 31 aa, Mycobacterium bovis
VPDVVLLDDRWWFHFALIGVLTALDDLFGQV

SEQ ID NO: 237461 - protein, 19 aa, Mycobacterium bovis
VPNAIPLAGLLADAPHGSK

SEQ ID NO: 237462 - protein, 19 aa, Mycobacterium bovis
VRVPYRARVPMTRAALMHR

SEQ ID NO: 237463 - protein, 17 aa, Mycobacterium bovis
VSAMLVAGLVACGSNSP

SEQ ID NO: 237464 - protein, 20 aa, Mycobacterium bovis
VSNIAYTKKLWQAIRAQDVC

SEQ ID NO: 237465 - protein, 22 aa, Mycobacterium bovis
VTAITAPDWQQGLSASVRAGLA

SEQ ID NO: 237466 - protein, 27 aa, Mycobacterium bovis
VTDSMPALHMLPLADALGVLPVLATDV

SEQ ID NO: 237467 - protein, 18 aa, Mycobacterium bovis
VVAAAAVLAVLIAEPIRA

SEQ ID NO: 237468 - protein, 18 aa, Mycobacterium bovis
VWGGFPAAVSWRSTSEQV

SEQ ID NO: 237469 - protein, 28 aa, Mycobacterium bovis
VWLPPLDEPPMLGALLRDAEPAQAELAV

SEQ ID NO: 237470 - protein, 25 aa, Mycobacterium bovis
WGGGSLPTIGPLYSSKTINLCAPDD

SEQ ID NO: 237471 - protein, 23 aa, Mycobacterium bovis
WRFSVPLVCLLAGLLLAATHGVS

SEQ ID NO: 237472 - protein, 17 aa, Mycobacterium bovis
WVGAVPQVGLAASALPT

SEQ ID NO: 237473 - protein, 32 aa, Mycobacterium bovis
YAAAEAAAVSPLLAPINAQFVAATGRPLIGNG

SEQ ID NO: 237474 - protein, 23 aa, Mycobacterium bovis
YARSTPLFYYNKAAWQQAGLPDR

SEQ ID NO: 237475 - protein, 38 aa, Mycobacterium bovis
YASNFNNLYYPLHSSLVGQFVFPNFANPIQLICSAIQA

SEQ ID NO: 237476 - protein, 17 aa, Mycobacterium bovis
YFHGITLHKNGVTANMS

SEQ ID NO: 237477 - protein, 18 aa, Mycobacterium bovis
YGKPKVLVDGWLDTAVGA

SEQ ID NO: 237478 - protein, 19 aa, Mycobacterium bovis
YLGGLQFTQSTWAAHGGGE

SEQ ID NO: 237479 - protein, 18 aa, Mycobacterium bovis
YRFSVPDPGTYWAHPHVG

SEQ ID NO: 237480 - protein, 21 aa, Mycobacterium bovis
YWVRKPTYHNSFWYSSCMVTF

SEQ ID NO: 237481 - protein, 36 aa, Mycobacterium bovis; identical to SEQ ID NO: 224730

SEQ ID NO: 237482 - protein, 21 aa, Mycobacterium bovis
AAAFAAVLLAVVCLPANTAAA

SEQ ID NO: 237483 - protein, 25 aa, Mycobacterium bovis
AAAGFSVLLLPDPAPTPVVAFAVRH

SEQ ID NO: 237484 - protein, 31 aa, Mycobacterium bovis
AAALDVLNGPFQALFGRPLIGDGANGAPGQP

SEQ ID NO: 237485 - protein, 19 aa, Mycobacterium bovis
AAGAPGQAGGPGGPAGLWG

SEQ ID NO: 237486 - protein, 18 aa, Mycobacterium bovis
AAGLFGTGGAGGAGGAGA

SEQ ID NO: 237487 - protein, 18 aa, Mycobacterium bovis
AAGQLFSASGAAGNAGVG

SEQ ID NO: 237488 - protein, 27 aa, Mycobacterium bovis
AAIASLFSGYARDYQALSAQMARFHQQ

SEQ ID NO: 237489 - protein, 38 aa, Mycobacterium bovis
AANVQQNLLNAINAPTQALLGRPLIGDGAVGTASSPDG

SEQ ID NO: 237490 - protein, 41 aa, Mycobacterium bovis
AAPLATLEHNVLNALNAPTQALLGRPLIGDGAAGAPGTGQA

SEQ ID NO: 237491 - protein, 26 aa, Mycobacterium bovis
AATVHPMLVAANRNAFVQLVLSNLFG

SEQ ID NO: 237492 - protein, 37 aa, Mycobacterium bovis
AATVHPMLVAANRNAFVQLVLSNLFGQNAPAIAAAEA

SEQ ID NO: 237493 - protein, 20 aa, Mycobacterium bovis
AAYHQRFVQASSTGAGAYAS

SEQ ID NO: 237494 - protein, 33 aa, Mycobacterium bovis
ADEVSARIAALFGGFGLEYQAISAQVAAYHQRF

SEQ ID NO: 237495 - protein, 51 aa, Mycobacterium bovis
ADEVSARIAALFGGFGLEYQAISAQVAAYHQRFVQALSTGAGAYASAEAAA

SEQ ID NO: 237496 - protein, 20 aa, Mycobacterium bovis
ADLAPPAPADLAPPAPADLA

SEQ ID NO: 237497 - protein, 20 aa, Mycobacterium bovis
ADLAPPAPAELAPPAPADLA

SEQ ID NO: 237498 - protein, 24 aa, Mycobacterium bovis
AENIVPLYRRNALTERKLLAVNEV

SEQ ID NO: 237499 - protein, 29 aa, Mycobacterium bovis
AETDSTPPPWVRPVPMAVWAATAARAVTA

SEQ ID NO: 237500 - protein, 31 aa, Mycobacterium bovis
AEVGAVHYPWLPLRRLLLDHYPSIERIASVH

SEQ ID NO: 237501 - protein, 17 aa, Mycobacterium bovis
AGAPGQAGGPGGPAGLW

SEQ ID NO: 237502 - protein, 20 aa, Mycobacterium bovis
AGGAALLFGSGGAGGSGGAG

SEQ ID NO: 237503 - protein, 30 aa, Mycobacterium bovis
AGGAGGRGALLLGAGGQGGLGGAGGQGGMG

SEQ ID NO: 237504 - protein, 26 aa, Mycobacterium bovis
AGGAPGQCYFQQPAPQGLPIGTRGTG

SEQ ID NO: 237505 - protein, 23 aa, Mycobacterium bovis
AGGNAGLFSLGASGGAGGSGGSS

SEQ ID NO: 237506 - protein, 24 aa, Mycobacterium bovis
AGGNAGMLALGAAGGAGGIGGDGG

SEQ ID NO: 237507 - protein, 22 aa, Mycobacterium bovis
AGGWRLVTALPARGEVWWCEMA

SEQ ID NO: 237508 - protein, 32 aa, Mycobacterium bovis; identical to SEQ ID NO: 224772

SEQ ID NO: 237509 - protein, 18 aa, Mycobacterium bovis
AGLLFGSGGSGGAGGFGF

SEQ ID NO: 237510 - protein, 19 aa, Mycobacterium bovis
AGLVIALLAAITPAAGERP

SEQ ID NO: 237511 - protein, 18 aa, Mycobacterium bovis
AGQSWQGAAAAAMAAAAA

SEQ ID NO: 237512 - protein, 17 aa, Mycobacterium bovis
AGWLSGNGGTGGGGGTA

SEQ ID NO: 237513 - protein, 28 aa, Mycobacterium bovis
AISTQVAAFHDRFAQTLSAAVGSYVSAE

SEQ ID NO: 237514 - protein, 26 aa, Mycobacterium bovis
AKTLGFPIRLPQLPGGWTPNSGGRGG

SEQ ID NO: 237515 - protein, 25 aa, Mycobacterium bovis
ALAAATPMVVWLQTASTQAKTRAMQ

SEQ ID NO: 237516 - protein, 19 aa, Mycobacterium bovis
ALAMGVVLGSGFFSDTLLS

SEQ ID NO: 237517 - protein, 18 aa, Mycobacterium bovis
ALDEGLLPVLPQLSARHH

SEQ ID NO: 237518 - protein, 19 aa, Mycobacterium bovis
ALLALLALLALIVGLGASG

SEQ ID NO: 237519 - protein, 19 aa, Mycobacterium bovis
ALQAARSYVVKLATMDCER

SEQ ID NO: 237520 - protein, 25 aa, Mycobacterium bovis
ALRDGSYLPMTFAANDIAWSDNKPS

SEQ ID NO: 237521 - protein, 29 aa, Mycobacterium bovis
ALSAQMARFHQQFVQALTASVGSYAAAEA

SEQ ID NO: 237522 - protein, 24 aa, Mycobacterium bovis
AMAAIATFAAPVALAAYPITGKLG

SEQ ID NO: 237523 - protein, 17 aa, Mycobacterium bovis
ANADLISWTFQGPNWAF

SEQ ID NO: 237524 - protein, 20 aa, Mycobacterium bovis
ANPNGGAGGLLYGNGGNGFS

SEQ ID NO: 237525 - protein, 24 aa, Mycobacterium bovis
APPDTTWPHLIVGSLRHAVFSTDS

SEQ ID NO: 237526 - protein, 21 aa, Mycobacterium bovis
APPPTHPYKPAGPAVMAVMAG

SEQ ID NO: 237527 - protein, 17 aa, Mycobacterium bovis
ARITLTNAAAILDNAAA

SEQ ID NO: 237528 - protein, 26 aa, Mycobacterium bovis
ARVFHRAFPCLGSLAYKAYSLSFETF

SEQ ID NO: 237529 - protein, 43 aa, Mycobacterium bovis
ASAEAAAAEQIVLGVINAPTQALLGRPLIGDGANATTPGGAGG

SEQ ID NO: 237530 - protein, 43 aa, Mycobacterium bovis
ASFVFRHRTGNAVILVLMLVAATQLFFLQVSHAAGLRAQAAGQ

SEQ ID NO: 237531 - protein, 26 aa, Mycobacterium bovis
ASGLDARAYRLAWPVGSIVYEVDMPE

SEQ ID NO: 237532 - protein, 20 aa, Mycobacterium bovis
ASTFTIVAIGTYCPAVIAPL

SEQ ID NO: 237533 - protein, 38 aa, Mycobacterium bovis
ATAAEQIVLGVINAPTQALLGRPLIGDGANATTPGGAG

SEQ ID NO: 237534 - protein, 36 aa, Mycobacterium bovis
ATAAPAAPAVPVMRVPPALPVPPYNRRAVTAPMAAP

SEQ ID NO: 237535 - protein, 27 aa, Mycobacterium bovis
ATASFGVAPLLLWQVATRHFTNISVET

SEQ ID NO: 237536 - protein, 30 aa, Mycobacterium bovis
ATTIPCRQKIFLYSAIARPGNSGGPIVAQD

SEQ ID NO: 237537 - protein, 20 aa, Mycobacterium bovis
AVLTATNFFGINTIPIALTE

SEQ ID NO: 237538 - protein, 19 aa, Mycobacterium bovis
AVVCDFADACVPVVKVLAP

SEQ ID NO: 237539 - protein, 21 aa, Mycobacterium bovis
AVVLLIALGAVWTPVAFADGC

SEQ ID NO: 237540 - protein, 27 aa, Mycobacterium bovis
CGLAGTVLRFVPPLAALGSVPVTFDGD

SEQ ID NO: 237541 - protein, 25 aa, Mycobacterium bovis
CQTYKWETFLTSELPQWLSANRAVK

SEQ ID NO: 237542 - protein, 25 aa, Mycobacterium bovis
CQTYKWETLLTSELPQWLSANRAVK

SEQ ID NO: 237543 - protein, 24 aa, Mycobacterium bovis
DAAQPVAVPGPPPAPPAPRAAAPA

SEQ ID NO: 237544 - protein, 17 aa, Mycobacterium bovis
DASLLLCNGGRRRFRGQ

SEQ ID NO: 237545 - protein, 28 aa, Mycobacterium bovis
DEVSAAIAALFSSYARDYQTLSVQVTAF

SEQ ID NO: 237546 - protein, 22 aa, Mycobacterium bovis
DGGAGGIFFGTGGTGGAGGVGT

SEQ ID NO: 237547 - protein, 21 aa, Mycobacterium bovis
DGGGGLPPVPASPGGNGGGGG

SEQ ID NO: 237548 - protein, 19 aa, Mycobacterium bovis
DGGWLIGNGGAGGSGAAGV

SEQ ID NO: 237549 - protein, 24 aa, Mycobacterium bovis
DGLDYAVIKFDPAKVTPVAVFNGF

SEQ ID NO: 237550 - protein, 28 aa, Mycobacterium bovis
DGLDYAVIKFDPAKVTPVAVFNGFAING

SEQ ID NO: 237551 - protein, 24 aa, Mycobacterium bovis
DGLGSYFWQHNWGSPKGYTHPAAH

SEQ ID NO: 237552 - protein, 31 aa, Mycobacterium bovis; identical to SEQ ID NO: 216916

SEQ ID NO: 237553 - protein, 26 aa, Mycobacterium bovis
DGPAPGVAPPPGGMPGLPFVQPDGAG

SEQ ID NO: 237554 - protein, 22 aa, Mycobacterium bovis
DGQDGGLLFGNGGAGYNSAATP

SEQ ID NO: 237555 - protein, 18 aa, Mycobacterium bovis
DGQLQWVSIPAWALCVAF

SEQ ID NO: 237556 - protein, 18 aa, Mycobacterium bovis
DGYRLSVDYAVRITSRGL

SEQ ID NO: 237557 - protein, 19 aa, Mycobacterium bovis
DGYRLSVDYAVRITSRGLY

SEQ ID NO: 237558 - protein, 19 aa, Mycobacterium bovis
DIEAVLNALWNAGAEAIQM

SEQ ID NO: 237559 - protein, 17 aa, Mycobacterium bovis
DIRLEPDSILRVLAMHR

SEQ ID NO: 237560 - protein, 25 aa, Mycobacterium bovis
DPAGWPRLDWSMDAALLLAALASRA

SEQ ID NO: 237561 - protein, 17 aa, Mycobacterium bovis
DPLLNVGKLIANNTRVW

SEQ ID NO: 237562 - protein, 24 aa, Mycobacterium bovis
DSILRVLAMHRFAKAPMLVGGQML

SEQ ID NO: 237563 - protein, 18 aa, Mycobacterium bovis
DVMVRTWRPERDRRVVIV

SEQ ID NO: 237564 - protein, 32 aa, Mycobacterium bovis
DVPDVVLLDDRWWFHFALIGVLTALDDLFGQV

SEQ ID NO: 237565 - protein, 20 aa, Mycobacterium bovis
DWADEVYVFGYPRVPMTAEM

SEQ ID NO: 237566 - protein, 32 aa, Mycobacterium bovis
EARIKFNCLAPGMWPAWWLSNDDPGRSGEIDL

SEQ ID NO: 237567 - protein, 17 aa, Mycobacterium bovis
EAVLTFDYLPQNAPEAD

SEQ ID NO: 237568 - protein, 25 aa, Mycobacterium bovis
EAVRARLRRRGPVTVYGVDKFPRMV

SEQ ID NO: 237569 - protein, 30 aa, Mycobacterium bovis
EDETAWRNGIWYTARLRPGPLRPAERRTAV

SEQ ID NO: 237570 - protein, 17 aa, Mycobacterium bovis
EFVTAAAGDLTNLGSSI

SEQ ID NO: 237571 - protein, 22 aa, Mycobacterium bovis
EGNLHLNVLRCPPDREPALYAK

SEQ ID NO: 237572 - protein, 25 aa, Mycobacterium bovis
ELGQPLPLFIKWDDADYGLRAAEHG

SEQ ID NO: 237573 - protein, 21 aa, Mycobacterium bovis
EVSAAIATLFGSHAREYQAIS

SEQ ID NO: 237574 - protein, 25 aa, Mycobacterium bovis
EVSAALASLFSGHAVSYQQVAAQAT

SEQ ID NO: 237575 - protein, 23 aa, Mycobacterium bovis
EVSIAVAALFGMHGQAYQALSVQ

SEQ ID NO: 237576 - protein, 17 aa, Mycobacterium bovis
FAPLIGVRKAGLFTSSS

SEQ ID NO: 237577 - protein, 19 aa, Mycobacterium bovis
FDPAKVTPVAVFNGFAING

SEQ ID NO: 237578 - protein, 17 aa, Mycobacterium bovis
FHEQFVRSLTAAGSAYA

SEQ ID NO: 237579 - protein, 18 aa, Mycobacterium bovis
FPEAAGVVNVYAIAVLKR

SEQ ID NO: 237580 - protein, 25 aa, Mycobacterium bovis
FSDNLPSCITKYIPLHTPAVVMSIN

SEQ ID NO: 237581 - protein, 25 aa, Mycobacterium bovis
FVEATFPIAAHYFAVFPLAKHMESA

SEQ ID NO: 237582 - protein, 31 aa, Mycobacterium bovis; identical to SEQ ID NO: 225031

SEQ ID NO: 237583 - protein, 22 aa, Mycobacterium bovis
GAAGFGYPYAIAPPGIGFGSGM

SEQ ID NO: 237584 - protein, 26 aa, Mycobacterium bovis
GAAGGLLFGQRWQRRGWRVRSNRRQR

SEQ ID NO: 237585 - protein, 24 aa, Mycobacterium bovis
GAAGKAGIGGTGGQGGACGAGSSG

SEQ ID NO: 237586 - protein, 19 aa, Mycobacterium bovis
GAAGLFGTGGAGGAGGAGA

SEQ ID NO: 237587 - protein, 19 aa, Mycobacterium bovis
GAAIWHMAWSDKDDAIDWQ

SEQ ID NO: 237588 - protein, 28 aa, Mycobacterium bovis
GADEVSAALASLFSGHAVSYQQVAAQAT

SEQ ID NO: 237589 - protein, 52 aa, Mycobacterium bovis
GADEVSARIAALFGGFGLEYQAISAQVAAYHQRFVQALSTGAGAYASAEAAA

SEQ ID NO: 237590 - protein, 50 aa, Mycobacterium bovis
GADEVSARIAALFGGFGLEYQAISAQVAAYHQRFVQASSTGAGAYASAEA

SEQ ID NO: 237591 - protein, 23 aa, Mycobacterium bovis
GADGGAGGWLFGNGGNGGSGATG

SEQ ID NO: 237592 - protein, 21 aa, Mycobacterium bovis
GAGGAAGLWGSGGSGGQGGNG

SEQ ID NO: 237593 - protein, 24 aa, Mycobacterium bovis
GAGGAAGQLFSAGGAAGAVGVGGT

SEQ ID NO: 237594 - protein, 17 aa, Mycobacterium bovis
GAGGAGGWLSGNGGAGG

SEQ ID NO: 237595 - protein, 18 aa, Mycobacterium bovis
GAGGLIWGTAGTGGNGGF

SEQ ID NO: 237596 - protein, 19 aa, Mycobacterium bovis
GAGGLLYGSGGNGGSGLAG

SEQ ID NO: 237597 - protein, 27 aa, Mycobacterium bovis
GAGGRGALLLGAGGQGGLGGAGGQGGM

SEQ ID NO: 237598 - protein, 23 aa, Mycobacterium bovis
GAGGSGGWLYGNGGNGGIGGNAI

SEQ ID NO: 237599 - protein, 19 aa, Mycobacterium bovis
GARLYRKLTTTTVVAYFSE

SEQ ID NO: 237600 - protein, 23 aa, Mycobacterium bovis
GASGAGGWLLGTGGAGGAGGNGG

SEQ ID NO: 237601 - protein, 19 aa, Mycobacterium bovis
GASGWLMGNGGNGGNGGTG

SEQ ID NO: 237602 - protein, 20 aa, Mycobacterium bovis
GATGGTGFSLGACGAGGAGG

SEQ ID NO: 237603 - protein, 23 aa, Mycobacterium bovis
GATGSAGIGGAGGRGGDGGDGAS

SEQ ID NO: 237604 - protein, 26 aa, Mycobacterium bovis
GCQTYKWETFLTSELPGWLQANRHVK

SEQ ID NO: 237605 - protein, 26 aa, Mycobacterium bovis
GCQTYKWETLLTSELPQWLSANRAVK

SEQ ID NO: 237606 - protein, 30 aa, Mycobacterium bovis
GDGGDGASGLGLGLSGFDGGQGGQGGDGGS

SEQ ID NO: 237607 - protein, 29 aa, Mycobacterium bovis
GDGGEGATGLGLDLSGFAGGQGGQGGAGG

SEQ ID NO: 237608 - protein, 24 aa, Mycobacterium bovis
GDGGTGGRGGWLAGAGGAGGDGGI

SEQ ID NO: 237609 - protein, 21 aa, Mycobacterium bovis
GDGIALGLWAGVAVSDLEFIQ

SEQ ID NO: 237610 - protein, 32 aa, Mycobacterium bovis; identical to SEQ ID NO: 225059

SEQ ID NO: 237611 - protein, 21 aa, Mycobacterium bovis
GGAAGQLFSASGAAGNAGVGG

SEQ ID NO: 237612 - protein, 22 aa, Mycobacterium bovis
GGAGGAAGLWGSGGSGGQGGNG

SEQ ID NO: 237613 - protein, 25 aa, Mycobacterium bovis
GGAGGAGGLLFGNGGAGAAGAPGQA

SEQ ID NO: 237614 - protein, 26 aa, Mycobacterium bovis
GGAGGAGGWLFGVGGAGGVGGAGGGT

SEQ ID NO: 237615 - protein, 28 aa, Mycobacterium bovis
GGAGGRGALLLGAGGQGGLGGAGGQGGM

SEQ ID NO: 237616 - protein, 20 aa, Mycobacterium bovis
GGDAGLLYGNGGAGGTGGSG

SEQ ID NO: 237617 - protein, 21 aa, Mycobacterium bovis
GGDAGLLYGNGGAGGTGGSGG

SEQ ID NO: 237618 - protein, 30 aa, Mycobacterium bovis
GGHGGVGGDGGWLAPGGAGGAGGQGGAGGA

SEQ ID NO: 237619 - protein, 18 aa, Mycobacterium bovis
GGLGIYRLHSIFGVHEQP

SEQ ID NO: 237620 - protein, 24 aa, Mycobacterium bovis
GGLLRPQVLWDELLAECKAAPGGD

SEQ ID NO: 237621 - protein, 23 aa, Mycobacterium bovis
GGPGGAGGLISLLGGQGAGGDGG

SEQ ID NO: 237622 - protein, 18 aa, Mycobacterium bovis
GGRRPLITEAIRGEGAIL

SEQ ID NO: 237623 - protein, 25 aa, Mycobacterium bovis
GGVGGAGGLLFGYGGAGGAGGYSNI

SEQ ID NO: 237624 - protein, 25 aa, Mycobacterium bovis
GGVIDMSHEMAPTTRLKILQVAATV

SEQ ID NO: 237625 - protein, 18 aa, Mycobacterium bovis
GGWLIGNGGAGGSGAPGA

SEQ ID NO: 237626 - protein, 29 aa, Mycobacterium bovis
GHGGVGGDGGWLAPGGAGGAGGQGGAGGA

SEQ ID NO: 237627 - protein, 20 aa, Mycobacterium bovis
GNGGWLYGSGGNGGAGGAGP

SEQ ID NO: 237628 - protein, 18 aa, Mycobacterium bovis
GNPGFSGAGGLGGLSGDG

SEQ ID NO: 237629 - protein, 29 aa, Mycobacterium bovis
GQAGGPGGPAGLWGNGGPGGAGGSGGGTG

SEQ ID NO: 237630 - protein, 20 aa, Mycobacterium bovis
GQDGGLLFGNGGAGYNSAAT

SEQ ID NO: 237631 - protein, 31 aa, Mycobacterium bovis
GQLLVYGVDPLILRQAYPVRQAPYGLAGSRE

SEQ ID NO: 237632 - protein, 21 aa, Mycobacterium bovis
GRALSILNDPFRVGGLPATNG

SEQ ID NO: 237633 - protein, 19 aa, Mycobacterium bovis
GSAGLFGNGGAGGAGGAGG

SEQ ID NO: 237634 - protein, 20 aa, Mycobacterium bovis
GSAGLFGNGGAGGAGGAGGQ

SEQ ID NO: 237635 - protein, 21 aa, Mycobacterium bovis
GSLYHAGVKLDWMVATTLLTG

SEQ ID NO: 237636 - protein, 23 aa, Mycobacterium bovis
GSTFTLALPALIEAYHDDERPEQ

SEQ ID NO: 237637 - protein, 23 aa, Mycobacterium bovis
GTSIYNVSVLLDPNKGLANLLAN

SEQ ID NO: 237638 - protein, 22 aa, Mycobacterium bovis
GVGGTWHWNTYPGIAVDIPSFS

SEQ ID NO: 237639 - protein, 19 aa, Mycobacterium bovis
GWCGWVLFEKHQTDVAAGQ

SEQ ID NO: 237640 - protein, 18 aa, Mycobacterium bovis
GWGYPQPRSGQRARRATG

SEQ ID NO: 237641 - protein, 19 aa, Mycobacterium bovis
GYTFMGFAEDLPAVGSTVC

SEQ ID NO: 237642 - protein, 35 aa, Mycobacterium bovis
HAQAYQALSAQAALFHEQFVHAMTAGAGAYAGAEA

SEQ ID NO: 237643 - protein, 30 aa, Mycobacterium bovis
HGGAGGAGGRAWLWGTGGAGGAGAAAIGNA

SEQ ID NO: 237644 - protein, 18 aa, Mycobacterium bovis
HRFGRVHTYAKARKTSLR

SEQ ID NO: 237645 - protein, 20 aa, Mycobacterium bovis
HTVPLLGRRIAVIGTGSTGV

SEQ ID NO: 237646 - protein, 24 aa, Mycobacterium bovis
HVETLTGFKWLARADANLPGTLVY

SEQ ID NO: 237647 - protein, 28 aa, Mycobacterium bovis
IAFGYSGLPFWPQGKPYDAYFTDAGGIT

SEQ ID NO: 237648 - protein, 17 aa, Mycobacterium bovis
IARFRDAFASDLAAHHR

SEQ ID NO: 237649 - protein, 17 aa, Mycobacterium bovis
IAWLPATAQLAVLAAKK

SEQ ID NO: 237650 - protein, 18 aa, Mycobacterium bovis
IDAPAGELVFGPNPLPAP

SEQ ID NO: 237651 - protein, 19 aa, Mycobacterium bovis
IDAPAGELVFGPNPLPAPN

SEQ ID NO: 237652 - protein, 24 aa, Mycobacterium bovis
IDRSRIKVIMDKVNGRWLASKVEL

SEQ ID NO: 237653 - protein, 18 aa, Mycobacterium bovis
IEPQTSVLIGTQGGDGTP

SEQ ID NO: 237654 - protein, 28 aa, Mycobacterium bovis
IGATPPDMTLFLDPKQTPPQPLVSAVAQ

SEQ ID NO: 237655 - protein, 19 aa, Mycobacterium bovis
ILVVVIVGGFTVHRIRGFF

SEQ ID NO: 237656 - protein, 19 aa, Mycobacterium bovis
IMGEVVDRSIFMWTAAPHA

SEQ ID NO: 237657 - protein, 25 aa, Mycobacterium bovis
IPTVSGWRMLSGDETGWLLGDYILS

SEQ ID NO: 237658 - protein, 20 aa, Mycobacterium bovis
ITEPLGYDTTYTWSGSAVGH

SEQ ID NO: 237659 - protein, 18 aa, Mycobacterium bovis
IVGFISPTGRYLSLTQSN

SEQ ID NO: 237660 - protein, 23 aa, Mycobacterium bovis
KDGIPEVWPFAPAKHRAMLANLH

SEQ ID NO: 237661 - protein, 19 aa, Mycobacterium bovis
KIRSFADLTRPGLNVVVCQ

SEQ ID NO: 237662 - protein, 34 aa, Mycobacterium bovis
KLDWMVATTLLTGRRTWVPWTAVLVNVATRDCWE

SEQ ID NO: 237663 - protein, 18 aa, Mycobacterium bovis
KLREIDGLLPTLIRGQGT

SEQ ID NO: 237664 - protein, 28 aa, Mycobacterium bovis
KTTSVLAAALLFCGLLGPGTAPPATGGG

SEQ ID NO: 237665 - protein, 22 aa, Mycobacterium bovis
KVLQFAPGELKNLPGFQGSGDG

SEQ ID NO: 237666 - protein, 26 aa, Mycobacterium bovis
LAAAPLVTLYKQYVVRFGLGYREEVH

SEQ ID NO: 237667 - protein, 27 aa, Mycobacterium bovis
LAAAPLVTLYKQYVVRFGLGYREEVHP

SEQ ID NO: 237668 - protein, 17 aa, Mycobacterium bovis
LAALRETGFITYQPRDR

SEQ ID NO: 237669 - protein, 17 aa, Mycobacterium bovis
LAKLREIDGLLPTLIRG

SEQ ID NO: 237670 - protein, 20 aa, Mycobacterium bovis
LALAMGVVLGSGFFSDTLLS

SEQ ID NO: 237671 - protein, 19 aa, Mycobacterium bovis
LAPPPADLAPPAPADLAPP

SEQ ID NO: 237672 - protein, 18 aa, Mycobacterium bovis
LDIRTGHVALRVLHDGTA

SEQ ID NO: 237673 - protein, 17 aa, Mycobacterium bovis
LEAAPITPLPAPEALID

SEQ ID NO: 237674 - protein, 27 aa, Mycobacterium bovis
LELPTRYLGLVTAVEYGRRARLAVQAM

SEQ ID NO: 237675 - protein, 24 aa, Mycobacterium bovis
LGACLALWLSGCSSPKPDAEEQGV

SEQ ID NO: 237676 - protein, 28 aa, Mycobacterium bovis
LGAINAPTQLWLGRPLIGDGVHGAPGTG

SEQ ID NO: 237677 - protein, 35 aa, Mycobacterium bovis; identical to SEQ ID NO: 225280

SEQ ID NO: 237678 - protein, 26 aa, Mycobacterium bovis
LGVINAPTQTLVGRPLIGDGTHGAPG

SEQ ID NO: 237679 - protein, 21 aa, Mycobacterium bovis
LIVLAVPMPALPGMLAHIRKS

SEQ ID NO: 237680 - protein, 37 aa, Mycobacterium bovis
LLALICVLPIALSPWPARAFVMLLVALAVAVTVDTLL

SEQ ID NO: 237681 - protein, 17 aa, Mycobacterium bovis
LLASWVGAVPQVGLAAS

SEQ ID NO: 237682 - protein, 18 aa, Mycobacterium bovis
LLCNGGRRRFRGQVRDAW

SEQ ID NO: 237683 - protein, 19 aa, Mycobacterium bovis
LLLAVLLAVSGVAGCSADT

SEQ ID NO: 237684 - protein, 20 aa, Mycobacterium bovis
LNAALHRIALTQIRMTDSRG

SEQ ID NO: 237685 - protein, 38 aa, Mycobacterium bovis
LPGPLVATVFDLVFQPGKLPDSLADYLRGFIQERWIIR

SEQ ID NO: 237686 - protein, 19 aa, Mycobacterium bovis
LPSAIYHRFGRVHTYAKAR

SEQ ID NO: 237687 - protein, 27 aa, Mycobacterium bovis
LQLSALLPEWRTELPLRYLESVITQLS

SEQ ID NO: 237688 - protein, 19 aa, Mycobacterium bovis
LRQHAVSLAAVFLALAMGV

SEQ ID NO: 237689 - protein, 26 aa, Mycobacterium bovis
LSVQVTAFHVQFAQTLTNAGQLYAVV

SEQ ID NO: 237690 - protein, 22 aa, Mycobacterium bovis
LTPSTVICLLQPANGQLLTGSA

SEQ ID NO: 237691 - protein, 17 aa, Mycobacterium bovis
LVATNFFGINTIPIALN

SEQ ID NO: 237692 - protein, 20 aa, Mycobacterium bovis
LVDAPLPSWTHRTLMLSRED

SEQ ID NO: 237693 - protein, 22 aa, Mycobacterium bovis
LVRVLPPFLSRKHLPSRLAKLR

SEQ ID NO: 237694 - protein, 17 aa, Mycobacterium bovis
LWEALLRGDDLVGEIPA

SEQ ID NO: 237695 - protein, 28 aa, Mycobacterium bovis
MFQRTAQWVLPWPNPRYSKLARVFHRAF

SEQ ID NO: 237696 - protein, 18 aa, Mycobacterium bovis
NAATSIVGFISPTGRYLS

SEQ ID NO: 237697 - protein, 20 aa, Mycobacterium bovis
NAGLFGVGGTGGPGGPGGPG

SEQ ID NO: 237698 - protein, 36 aa, Mycobacterium bovis
NFFGINTIPIALTEMDYFIRMWNQAALAMEVYQAET

SEQ ID NO: 237699 - protein, 21 aa, Mycobacterium bovis
NGGFSFFDGNGGDGGTGGTLI

SEQ ID NO: 237700 - protein, 22 aa, Mycobacterium bovis
NGGFTTFLDAAGGAGGAGGAGG

SEQ ID NO: 237701 - protein, 20 aa, Mycobacterium bovis
NIEPQTSVLIGTQGGDGTPG

SEQ ID NO: 237702 - protein, 18 aa, Mycobacterium bovis
NLWLSEVFGAELIIPSYN

SEQ ID NO: 237703 - protein, 19 aa, Mycobacterium bovis
NPNGGAGGLLYGNGGNGFS

SEQ ID NO: 237704 - protein, 17 aa, Mycobacterium bovis
NRALVLAALAAAQGRGA

SEQ ID NO: 237705 - protein, 26 aa, Mycobacterium bovis
NRNAFVQLVLSNLFGQNAPAIAAAEA

SEQ ID NO: 237706 - protein, 35 aa, Mycobacterium bovis
NVEQQVLGLINAPTQALWGRPLIGNGADGTAANPN

SEQ ID NO: 237707 - protein, 25 aa, Mycobacterium bovis
NYSAVSLRLHPDIRLFTAIPEQRSS

SEQ ID NO: 237708 - protein, 25 aa, Mycobacterium bovis
PAACWRVRTVPPAPPPPAAATAAMA

SEQ ID NO: 237709 - protein, 28 aa, Mycobacterium bovis
PDSEAMLLAAIYVAALRSYGFAAHAETA

SEQ ID NO: 237710 - protein, 40 aa, Mycobacterium bovis
PDSSGLPLRAMVMVLLFLGVVFLLLGWQALGSSPNSEDDS

SEQ ID NO: 237711 - protein, 17 aa, Mycobacterium bovis
PEIPYYSATLWDPRERP

SEQ ID NO: 237712 - protein, 28 aa, Mycobacterium bovis
PGGFDCSGLVMWAFQQAGIALPHSSQAL

SEQ ID NO: 237713 - protein, 17 aa, Mycobacterium bovis
PGGLLFGNGGNGGSGGV

SEQ ID NO: 237714 - protein, 30 aa, Mycobacterium bovis
PGQAGGPGGPAGLWGNGGPGGAGGSGGGTG

SEQ ID NO: 237715 - protein, 18 aa, Mycobacterium bovis
PHIAMTAAMLRQAGVDID

SEQ ID NO: 237716 - protein, 17 aa, Mycobacterium bovis
PILALLALLALLALIVG

SEQ ID NO: 237717 - protein, 47 aa, Mycobacterium bovis
PLAHIALASGCCDLAGCVLAAWGWVVMSFVVAVPEALAAAASDVANI

SEQ ID NO: 237718 - protein, 17 aa, Mycobacterium bovis
PLFGSKAIDLCNPTDPI

SEQ ID NO: 237719 - protein, 17 aa, Mycobacterium bovis
PPVPASPGGNGGGGGAG

SEQ ID NO: 237720 - protein, 40 aa, Mycobacterium bovis
PTYASNFNNLYYPLHSSLVGQFVFPNFANPIQLICSAIQA

SEQ ID NO: 237721 - protein, 17 aa, Mycobacterium bovis
PVCVLGLGLIGGSIMRA

SEQ ID NO: 237722 - protein, 25 aa, Mycobacterium bovis
PYARSTPLFYYNKAAWQQAGLPDRG

SEQ ID NO: 237723 - protein, 21 aa, Mycobacterium bovis
QDARWFLLCTVDGATVTTADG

SEQ ID NO: 237724 - protein, 18 aa, Mycobacterium bovis
QDGLWLRIMNVPAALEAR

SEQ ID NO: 237725 - protein, 23 aa, Mycobacterium bovis
QPADHILAILRQLNAVVIHADSS

SEQ ID NO: 237726 - protein, 19 aa, Mycobacterium bovis
QQRLWRTRESLAEVLGVYG

SEQ ID NO: 237727 - protein, 25 aa, Mycobacterium bovis
QRDRAKMFALLWQSLRRQRQLLKRF

SEQ ID NO: 237728 - protein, 19 aa, Mycobacterium bovis
QRLQDIVKGGYRSANAAIV

SEQ ID NO: 237729 - protein, 29 aa, Mycobacterium bovis
QTVAIPGFPNFFMMLGPHSPVGNFPLTAV

SEQ ID NO: 237730 - protein, 19 aa, Mycobacterium bovis
QVGAPYAWGGAAPGGFDCS

SEQ ID NO: 237731 - protein, 19 aa, Mycobacterium bovis
RAGIELLAFGGRFVEIGKR

SEQ ID NO: 237732 - protein, 20 aa, Mycobacterium bovis
RASDLIDRYIQRAAGVRRCA

SEQ ID NO: 237733 - protein, 25 aa, Mycobacterium bovis
RDGAEWIHLVDLDAAFGRGSNHELL

SEQ ID NO: 237734 - protein, 30 aa, Mycobacterium bovis
RDPLTVFLVLIIVFSLVLAGLIGGELYARH

SEQ ID NO: 237735 - protein, 20 aa, Mycobacterium bovis
REHLGVRPPVEADWLLLVEL

SEQ ID NO: 237736 - protein, 24 aa, Mycobacterium bovis
RFNIKVIAGAGLFAAAIALSPDAA

SEQ ID NO: 237737 - protein, 29 aa, Mycobacterium bovis
RGDYLNVFTTFDLTLRRIGETFFTTAYFD

SEQ ID NO: 237738 - protein, 17 aa, Mycobacterium bovis
RGGLLAGQHANSGNGGG

SEQ ID NO: 237739 - protein, 28 aa, Mycobacterium bovis
RHHFSQYFVDYFITPLVAAVWSCGGADA

SEQ ID NO: 237740 - protein, 18 aa, Mycobacterium bovis
RLQDIVKGGYRSANAAIV

SEQ ID NO: 237741 - protein, 21 aa, Mycobacterium bovis
RLREDPPRRLAGFPATVTDIG

SEQ ID NO: 237742 - protein, 25 aa, Mycobacterium bovis
RPPVEADWLLLVELAADHDQTDRLA

SEQ ID NO: 237743 - protein, 20 aa, Mycobacterium bovis
RQRLQDIVKGGYRSANAAIV

SEQ ID NO: 237744 - protein, 24 aa, Mycobacterium bovis
RRRAELLVWLNPRAAHPEFQPRAS

SEQ ID NO: 237745 - protein, 28 aa, Mycobacterium bovis
RRRSAWRFSVPLVCLLAGLLLAATHGVS

SEQ ID NO: 237746 - protein, 17 aa, Mycobacterium bovis
RTLASVALILTGGGIVN

SEQ ID NO: 237747 - protein, 22 aa, Mycobacterium bovis
RVEVHLDRDFRVLDTKPADGDG

SEQ ID NO: 237748 - protein, 20 aa, Mycobacterium bovis
RVRDPRLRRALTPDYEPMCK

SEQ ID NO: 237749 - protein, 17 aa, Mycobacterium bovis
RYALHRRRRRSSAQLFL

SEQ ID NO: 237750 - protein, 27 aa, Mycobacterium bovis
RYPARYLFVFLDHHGMLSVFGSPTWRT

SEQ ID NO: 237751 - protein, 25 aa, Mycobacterium bovis
SAAAYVAAHAPYLAWLMRASETSAE

SEQ ID NO: 237752 - protein, 25 aa, Mycobacterium bovis
SAAIAALFSAHGRAYQVASAQAAAV

SEQ ID NO: 237753 - protein, 20 aa, Mycobacterium bovis
SAAVLVCDLVAALKGQGRSV

SEQ ID NO: 237754 - protein, 17 aa, Mycobacterium bovis
SAGYTFMGFAEDLPAVG

SEQ ID NO: 237755 - protein, 24 aa, Mycobacterium bovis
SAQAQAFHAQFVQALTSGGGAYAA

SEQ ID NO: 237756 - protein, 19 aa, Mycobacterium bovis
SAQVAAYHQRFVQASSTGA

SEQ ID NO: 237757 - protein, 23 aa, Mycobacterium bovis
SDNLPSCITKYIPLHTPAVVMSI

SEQ ID NO: 237758 - protein, 25 aa, Mycobacterium bovis
SFATYFNAFPASYWRRWTTCKSVVL

SEQ ID NO: 237759 - protein, 23 aa, Mycobacterium bovis
SGGANSPALYLLDGLRAQDDFSG

SEQ ID NO: 237760 - protein, 17 aa, Mycobacterium bovis
SLLASWVGAVPQVGLAA

SEQ ID NO: 237761 - protein, 23 aa, Mycobacterium bovis
SNPLANFAPGYPPTIEPAQPAVS

SEQ ID NO: 237762 - protein, 23 aa, Mycobacterium bovis
SPDTLRPIRRLACRRRRFISSSS

SEQ ID NO: 237763 - protein, 26 aa, Mycobacterium bovis
SRPLTRVYRALAVIGVLAASLLASWV

SEQ ID NO: 237764 - protein, 18 aa, Mycobacterium bovis
SSATWPEPISYTALDRGD

SEQ ID NO: 237765 - protein, 18 aa, Mycobacterium bovis
SSQFVSGLLLSAASFTDG

SEQ ID NO: 237766 - protein, 20 aa, Mycobacterium bovis
SSYFALIETQAHHIIRCLKR

SEQ ID NO: 237767 - protein, 26 aa, Mycobacterium bovis
SVPGYPNFFTVFGPYGYVGSSYFALI

SEQ ID NO: 237768 - protein, 19 aa, Mycobacterium bovis
SVVVAITLMLTAESVSIAT

SEQ ID NO: 237769 - protein, 23 aa, Mycobacterium bovis
TADAHCALWRALIGLDSMERISI

SEQ ID NO: 237770 - protein, 24 aa, Mycobacterium bovis
TAGAAGYWLATAGPAGPAASAATV

SEQ ID NO: 237771 - protein, 24 aa, Mycobacterium bovis
TAHTNLEFLSCFLGLMLHGAVPVP

SEQ ID NO: 237772 - protein, 19 aa, Mycobacterium bovis
TALHDQFVQALTGAGGSYA

SEQ ID NO: 237773 - protein, 20 aa, Mycobacterium bovis
TALHDQFVQALTGAGGSYAL

SEQ ID NO: 237774 - protein, 25 aa, Mycobacterium bovis
TGGAGGAGFSRALIVAGDNGGDGGN

SEQ ID NO: 237775 - protein, 28 aa, Mycobacterium bovis
TGGAGGPGGLIWGGGGAGGVGGAGGGTG

SEQ ID NO: 237776 - protein, 28 aa, Mycobacterium bovis
TGGAGGRAELLFGAGGAGGAGGAGTDGG

SEQ ID NO: 237777 - protein, 24 aa, Mycobacterium bovis
TGQNGGAGGILWGNGGNGGSGAPG

SEQ ID NO: 237778 - protein, 18 aa, Mycobacterium bovis
TLALTSSAGAYASAEATN

SEQ ID NO: 237779 - protein, 22 aa, Mycobacterium bovis
TLGVITALDLRLHPTPSHRVTA

SEQ ID NO: 237780 - protein, 18 aa, Mycobacterium bovis
TLPARTPAYRVPLPELPH

SEQ ID NO: 237781 - protein, 23 aa, Mycobacterium bovis
TLQSHRAWLFADAARHEMRDRWA

SEQ ID NO: 237782 - protein, 17 aa, Mycobacterium bovis
TNIFGYRQDPLKWHPNG

SEQ ID NO: 237783 - protein, 19 aa, Mycobacterium bovis
TRLGIYGKGGTVVFGRGVN

SEQ ID NO: 237784 - protein, 24 aa, Mycobacterium bovis
TRNRGREMLAFATAYRDAGVKPPR

SEQ ID NO: 237785 - protein, 18 aa, Mycobacterium bovis
TVAILAAGADEVSIAVAA

SEQ ID NO: 237786 - protein, 19 aa, Mycobacterium bovis
TYRFSVPDPGTYWAHPHVG

SEQ ID NO: 237787 - protein, 25 aa, Mycobacterium bovis
VAAQATALHDQFVQALTGAGGSYAL

SEQ ID NO: 237788 - protein, 18 aa, Mycobacterium bovis
VAFLTTGCIRWSTQSRPV

SEQ ID NO: 237789 - protein, 33 aa, Mycobacterium bovis; identical to SEQ ID NO: 225712

SEQ ID NO: 237790 - protein, 21 aa, Mycobacterium bovis
VDAALGWQRDGAEWIHLVDLD

SEQ ID NO: 237791 - protein, 23 aa, Mycobacterium bovis
VDASLLLCNGGRRRFRGQVRDAW

SEQ ID NO: 237792 - protein, 24 aa, Mycobacterium bovis
VDASLLLCNGGRRRFRGQVRDAWP

SEQ ID NO: 237793 - protein, 29 aa, Mycobacterium bovis
VEAPTGWPNILPDDFTILDGILAAYATVG

SEQ ID NO: 237794 - protein, 33 aa, Mycobacterium bovis
VFEKLASILGLVAAPLMLLGLSACGRSAGKTSE

SEQ ID NO: 237795 - protein, 21 aa, Mycobacterium bovis
VFLLAVLLAPVVLTSCTWRGI

SEQ ID NO: 237796 - protein, 19 aa, Mycobacterium bovis
VGGVAGLGGAGGAAGQLFS

SEQ ID NO: 237797 - protein, 21 aa, Mycobacterium bovis
VGKALYARRFTLPQALAAVRD

SEQ ID NO: 237798 - protein, 29 aa, Mycobacterium bovis
VKAPTGWPNILPDDFTILDGILAAYATVG

SEQ ID NO: 237799 - protein, 18 aa, Mycobacterium bovis
VLEVEFALDPSGRSAPLR

SEQ ID NO: 237800 - protein, 25 aa, Mycobacterium bovis
VLGVYGPPLKFDVSLPLSAISGFAR

SEQ ID NO: 237801 - protein, 17 aa, Mycobacterium bovis
VLTFDYLPQNAPEADAI

SEQ ID NO: 237802 - protein, 17 aa, Mycobacterium bovis
VLVAIVLFAAASLLFGR

SEQ ID NO: 237803 - protein, 22 aa, Mycobacterium bovis
VMSFVVAVPEALAAAASDVANI

SEQ ID NO: 237804 - protein, 24 aa, Mycobacterium bovis
VQRRFIGLLMLSVLVAGCSSNPLA

SEQ ID NO: 237805 - protein, 25 aa, Mycobacterium bovis
VQRRFIGLLMLSVLVAGCSSNPLAN

SEQ ID NO: 237806 - protein, 20 aa, Mycobacterium bovis
VSAALASLFSGHAVSYQQVA

SEQ ID NO: 237807 - protein, 35 aa, Mycobacterium bovis; identical to SEQ ID NO: 225762

SEQ ID NO: 237808 - protein, 21 aa, Mycobacterium bovis
VSNIAYTKKLWQAIRAQDVCG

SEQ ID NO: 237809 - protein, 20 aa, Mycobacterium bovis
VVGCILLAGLVGMCSFQLGG

SEQ ID NO: 237810 - protein, 23 aa, Mycobacterium bovis
VVNEPFQTLTGRPLIGNGANGTP

SEQ ID NO: 237811 - protein, 20 aa, Mycobacterium bovis
WPEPISYTALDRGDLQRAMS

SEQ ID NO: 237812 - protein, 18 aa, Mycobacterium bovis
WPVCGRGLSNATPREVLP

SEQ ID NO: 237813 - protein, 26 aa, Mycobacterium bovis
WQGDYPSMIGFLAPLFTAGAGSNDVG

SEQ ID NO: 237814 - protein, 33 aa, Mycobacterium bovis
YAAAEAAAVSPLLAPINAQFVAATGRPLIGNGA

SEQ ID NO: 237815 - protein, 44 aa, Mycobacterium bovis
YASAEAAAAEQIVLGVINAPTQALLGRPLIGDGANATTPGGAGG

SEQ ID NO: 237816 - protein, 44 aa, Mycobacterium bovis
YASAEATAAEQIVLGVINAPTQALLGRPLIGDGANATTPGGAGG

SEQ ID NO: 237817 - protein, 23 aa, Mycobacterium bovis
YHGWGFHEDGAASGLRAARRLGA

SEQ ID NO: 237818 - protein, 20 aa, Mycobacterium bovis
YITEALKRLPTYATTLGEVV

SEQ ID NO: 237819 - protein, 20 aa, Mycobacterium bovis
YLGGLQFTQSTWAAHGGGEF

SEQ ID NO: 237820 - protein, 25 aa, Mycobacterium bovis
YTDAAQPIWWVVRAIEFSKDFETFV

SEQ ID NO: 237821 - protein, 23 aa, Mycobacterium bovis
AGGRAELLFGAGGAGGAGGAGTD

SEQ ID NO: 237822 - protein, 25 aa, Mycobacterium bovis
GGAGGPGGLIWGGGGAGGVGGAGGG

SEQ ID NO: 237823 - protein, 25 aa, Mycobacterium bovis
GVGGDGGWLAPGGAGGAGGQGGAGG

SEQ ID NO: 237824 - protein, 35 aa, Mycobacterium bovis
AAEQIVLGVINAPTQALLGRPLIGDGANATTPGGA

SEQ ID NO: 237825 - protein, 19 aa, Mycobacterium bovis
AAFHDQFVRALAAGAGAYA

SEQ ID NO: 237826 - protein, 18 aa, Mycobacterium bovis
AAVSTSVLSALFLGAGAA

SEQ ID NO: 237827 - protein, 17 aa, Mycobacterium bovis
ACWPSWTPPPLMSRWSN

SEQ ID NO: 237828 - protein, 30 aa, Mycobacterium bovis
ADPYDAYLRLHLLSHRLVAPHGLNAGGLFG

SEQ ID NO: 237829 - protein, 23 aa, Mycobacterium bovis
AEESAFVLLALQAPVAGDLRAIV

SEQ ID NO: 237830 - protein, 18 aa, Mycobacterium bovis
AEYLRLLRRHNVAAALSG

SEQ ID NO: 237831 - protein, 21 aa, Mycobacterium bovis
AGGAAGWLYGSGGAGGAGGLN

SEQ ID NO: 237832 - protein, 20 aa, Mycobacterium bovis
AGGAGGILWGNGGAGGSGAP

SEQ ID NO: 237833 - protein, 23 aa, Mycobacterium bovis
AGGRAWDGLWDPTLPMIPSANIP

SEQ ID NO: 237834 - protein, 18 aa, Mycobacterium bovis
AITLWLGLVAQFGQMITG

SEQ ID NO: 237835 - protein, 20 aa, Mycobacterium bovis
ALFHEQFVQALTGAASAYAS

SEQ ID NO: 237836 - protein, 18 aa, Mycobacterium bovis
ALLVVALTERPDLLMAAT

SEQ ID NO: 237837 - protein, 17 aa, Mycobacterium bovis
ALSSWYVWAALGLYPST

SEQ ID NO: 237838 - protein, 18 aa, Mycobacterium bovis
ALTFPFAGGLGLMSNRAS

SEQ ID NO: 237839 - protein, 25 aa, Mycobacterium bovis
APAPPPFRLPLLFVNALGDNWIVGA

SEQ ID NO: 237840 - protein, 20 aa, Mycobacterium bovis
APTQALLGRPIIGNGANGLP

SEQ ID NO: 237841 - protein, 21 aa, Mycobacterium bovis
AQPLEWFCLFSSAAALVGSPG

SEQ ID NO: 237842 - protein, 24 aa, Mycobacterium bovis
AQSYLRNFLAAPPPQRAAMAAQLQ

SEQ ID NO: 237843 - protein, 25 aa, Mycobacterium bovis
ASAAKFIWFFRHPNPIRPVVSQRCD

SEQ ID NO: 237844 - protein, 17 aa, Mycobacterium bovis
ASGLPIALWSKPAQGIK

SEQ ID NO: 237845 - protein, 24 aa, Mycobacterium bovis
ASPAGWLFVSRWTAGGNSLHIRAG

SEQ ID NO: 237846 - protein, 17 aa, Mycobacterium bovis
AVFTRPFQAFWVELPAC

SEQ ID NO: 237847 - protein, 27 aa, Mycobacterium bovis
AVFTTPHRFLYDPLGFLRLLTSSGATH

SEQ ID NO: 237848 - protein, 20 aa, Mycobacterium bovis
AVGWLPYIGILAPQINFFYY

SEQ ID NO: 237849 - protein, 25 aa, Mycobacterium bovis
AVHYPWLPLRRLLLDHYPSIERIAS

SEQ ID NO: 237850 - protein, 21 aa, Mycobacterium bovis
AVLLLTPITVPAGYPGAVAPA

SEQ ID NO: 237851 - protein, 24 aa, Mycobacterium bovis
DAGPPQRWFVVWLGTANNPVDKGA

SEQ ID NO: 237852 - protein, 24 aa, Mycobacterium bovis
DDVHVAPRVIFLPGPAAALTSDDH

SEQ ID NO: 237853 - protein, 23 aa, Mycobacterium bovis
DEQPRLFYMHFWAENDAVALART

SEQ ID NO: 237854 - protein, 26 aa, Mycobacterium bovis
DEVSARIAALFGGFGLEYQAISAQVA

SEQ ID NO: 237855 - protein, 22 aa, Mycobacterium bovis
DEVSLAISALFGQHAQAYQALS

SEQ ID NO: 237856 - protein, 19 aa, Mycobacterium bovis
DGASGLGLGLSGFDGGQGG

SEQ ID NO: 237857 - protein, 18 aa, Mycobacterium bovis
DGTLGLSLLWVLRGWRRP

SEQ ID NO: 237858 - protein, 25 aa, Mycobacterium bovis
DQPALRPLLDLLPIAGGSGTLGERF

SEQ ID NO: 237859 - protein, 18 aa, Mycobacterium bovis
DRLRWWAGPWPDDERWWD

SEQ ID NO: 237860 - protein, 22 aa, Mycobacterium bovis
DRPNLFIKIPATKAGLPAISAV

SEQ ID NO: 237861 - protein, 29 aa, Mycobacterium bovis
DRRQVLQRLKYLPLAPFRISYAYTNFGVT

SEQ ID NO: 237862 - protein, 26 aa, Mycobacterium bovis
DRSLHRVVLLALLPLGLAAAPGRTTR

SEQ ID NO: 237863 - protein, 18 aa, Mycobacterium bovis
DTIVLRRSRPLQISLDGH

SEQ ID NO: 237864 - protein, 23 aa, Mycobacterium bovis
DTRLGLFPFRRNLSLYAVDLALL

SEQ ID NO: 237865 - protein, 17 aa, Mycobacterium bovis
DYALLAVPYLTLRELAK

SEQ ID NO: 237866 - protein, 24 aa, Mycobacterium bovis
EDQLFRFSRILDVQPRLAILLGDC

SEQ ID NO: 237867 - protein, 17 aa, Mycobacterium bovis
EIQLRLPVNGRWVLVVT

SEQ ID NO: 237868 - protein, 17 aa, Mycobacterium bovis
ELPLCALLTAWVRGQAR

SEQ ID NO: 237869 - protein, 18 aa, Mycobacterium bovis
ENPKCHLAWTTLAGIGRV

SEQ ID NO: 237870 - protein, 22 aa, Mycobacterium bovis
EPGRITVILALHDLINGGHVGH

SEQ ID NO: 237871 - protein, 31 aa, Mycobacterium bovis
EQQVLGLINAPTQALWGRPLIGNGADGTAAN

SEQ ID NO: 237872 - protein, 18 aa, Mycobacterium bovis
FAFFEIQLRLPVNGRWVL

SEQ ID NO: 237873 - protein, 17 aa, Mycobacterium bovis
FFKAMVVNLLPYQILQP

SEQ ID NO: 237874 - protein, 28 aa, Mycobacterium bovis
FGFAVIVYLVWRFIVPLVGRLMSARQDT

SEQ ID NO: 237875 - protein, 17 aa, Mycobacterium bovis
FGKYFTPEQARQLIAEQ

SEQ ID NO: 237876 - protein, 18 aa, Mycobacterium bovis
FHDMPVVPLWDYISVVGW

SEQ ID NO: 237877 - protein, 24 aa, Mycobacterium bovis
FNCLAPGMWPAWWLSNDDPGRSGE

SEQ ID NO: 237878 - protein, 20 aa, Mycobacterium bovis
FRHRTGNAVILVLMLVAATQ

SEQ ID NO: 237879 - protein, 20 aa, Mycobacterium bovis
FTRPFQAFWVELPACNNWVD

SEQ ID NO: 237880 - protein, 17 aa, Mycobacterium bovis
FVFRHRTGNAVILVLML

SEQ ID NO: 237881 - protein, 17 aa, Mycobacterium bovis
GAGFSRALIVAGDNGGD

SEQ ID NO: 237882 - protein, 25 aa, Mycobacterium bovis
GAGGRGALLLGAGGQGGLGGAGGQG

SEQ ID NO: 237883 - protein, 25 aa, Mycobacterium bovis
GAGTLLGLTVFGDNGGAGVLGDSTD

SEQ ID NO: 237884 - protein, 19 aa, Mycobacterium bovis
GARAALFHEQFVQALTGAA

SEQ ID NO: 237885 - protein, 19 aa, Mycobacterium bovis
GEFLRASLPPFWQTTNATQ

SEQ ID NO: 237886 - protein, 20 aa, Mycobacterium bovis
GFGVPWLYNYIGQPWKTQRT

SEQ ID NO: 237887 - protein, 26 aa, Mycobacterium bovis
GGAGGAGGWLFGVGGAGGVGGAGGGT

SEQ ID NO: 237888 - protein, 21 aa, Mycobacterium bovis
GHSMFPWLTLALVGNSTSSIL

SEQ ID NO: 237889 - protein, 18 aa, Mycobacterium bovis
GLPIALWSKPAQGIKQII

SEQ ID NO: 237890 - protein, 21 aa, Mycobacterium bovis
GQFALTYPRRLGFGLGSSVVS

SEQ ID NO: 237891 - protein, 30 aa, Mycobacterium bovis
GQGGGGGFSILLGLGGLGGLGSPGSIATGT

SEQ ID NO: 237892 - protein, 21 aa, Mycobacterium bovis
GSGGHALLWGAGGAGGNGGSG

SEQ ID NO: 237893 - protein, 23 aa, Mycobacterium bovis
GSTLLYPLFNLWGPAFHERYPNV

SEQ ID NO: 237894 - protein, 19 aa, Mycobacterium bovis
GVAIMIWTLMNARNSRDSL

SEQ ID NO: 237895 - protein, 25 aa, Mycobacterium bovis
GVGPITVLPIQILPTIPLNIHQTFS

SEQ ID NO: 237896 - protein, 17 aa, Mycobacterium bovis
HETMVIPPIVFLPSMTI

SEQ ID NO: 237897 - protein, 24 aa, Mycobacterium bovis
HSRQLLAAQIIWTLARADIRGPYV

SEQ ID NO: 237898 - protein, 19 aa, Mycobacterium bovis
HVGILPYPRNLDSLVLIAS

SEQ ID NO: 237899 - protein, 25 aa, Mycobacterium bovis
IARMLLIWAALAAVALVLVGCIRVV

SEQ ID NO: 237900 - protein, 23 aa, Mycobacterium bovis
IERLRKLWDVPALAFVGIGNGTQ

SEQ ID NO: 237901 - protein, 19 aa, Mycobacterium bovis
IIGRACWPSWTPPPLMSRW

SEQ ID NO: 237902 - protein, 17 aa, Mycobacterium bovis
IPEFPIHWTSTGGIGPI

SEQ ID NO: 237903 - protein, 25 aa, Mycobacterium bovis
ISTQVAAFHDRFAQTLSAAVGSYVS

SEQ ID NO: 237904 - protein, 18 aa, Mycobacterium bovis
ITMRPYLVGSLKGPDLAN

SEQ ID NO: 237905 - protein, 18 aa, Mycobacterium bovis
KAWFPLTKRWLGFEDAHI

SEQ ID NO: 237906 - protein, 24 aa, Mycobacterium bovis
KGIALYLNFDMLASPNPGYFTYDG

SEQ ID NO: 237907 - protein, 23 aa, Mycobacterium bovis
KTTMEALWWDRPFALAGVDIGAS

SEQ ID NO: 237908 - protein, 26 aa, Mycobacterium bovis
LAAINARFERIFGRPLIGDGANGGPG

SEQ ID NO: 237909 - protein, 19 aa, Mycobacterium bovis
LAPLTTLRVGPIARRVITC

SEQ ID NO: 237910 - protein, 17 aa, Mycobacterium bovis
LDAFAHWRRAQGLPATS

SEQ ID NO: 237911 - protein, 27 aa, Mycobacterium bovis
LFDQPLLALRIPWYVTVLDLGSAGAVY

SEQ ID NO: 237912 - protein, 19 aa, Mycobacterium bovis
LGAAALIVALTRPTNSGPA

SEQ ID NO: 237913 - protein, 19 aa, Mycobacterium bovis
LLCAMVLALAWLSAVAGCS

SEQ ID NO: 237914 - protein, 20 aa, Mycobacterium bovis
LLLVLAFAGGYAVAACKTVT

SEQ ID NO: 237915 - protein, 25 aa, Mycobacterium bovis
LNAINAPTLALLGRPLIGNGADGAA

SEQ ID NO: 237916 - protein, 26 aa, Mycobacterium bovis
LNAINAPTQTLFGRPLIGDGANGTAE

SEQ ID NO: 237917 - protein, 24 aa, Mycobacterium bovis
LRWSWLLSVLAAVGLGLATAPAQA

SEQ ID NO: 237918 - protein, 18 aa, Mycobacterium bovis
LSLLWVLRGWRRPDDVRV

SEQ ID NO: 237919 - protein, 21 aa, Mycobacterium bovis
LTAYLRALPADGWLRVLCTCV

SEQ ID NO: 237920 - protein, 17 aa, Mycobacterium bovis
LTTLFPPVRPRQWLEIR

SEQ ID NO: 237921 - protein, 25 aa, Mycobacterium bovis
LVLTLTLVAFWWWQRPRTNAVAADS

SEQ ID NO: 237922 - protein, 17 aa, Mycobacterium bovis
LWRGNFEGLFGLNVGIT

SEQ ID NO: 237923 - protein, 22 aa, Mycobacterium bovis
MERAGLLLPLGWDPRLPVMGQK

SEQ ID NO: 237924 - protein, 18 aa, Mycobacterium bovis
MKLDLLLTVPLDYYKKFM

SEQ ID NO: 237925 - protein, 23 aa, Mycobacterium bovis
MVVAAQPYLAWLTYTAESAAHAA

SEQ ID NO: 237926 - protein, 24 aa, Mycobacterium bovis
NAEQYLWWVPHNVAGLVTALGGRT

SEQ ID NO: 237927 - protein, 17 aa, Mycobacterium bovis
NFFYYLGEPIVQAVLFN

SEQ ID NO: 237928 - protein, 17 aa, Mycobacterium bovis
NLTAWAVGWLPYIGILA

SEQ ID NO: 237929 - protein, 17 aa, Mycobacterium bovis
NYRVLWQAAGPDTISGA

SEQ ID NO: 237930 - protein, 17 aa, Mycobacterium bovis
PEFLSAEIFQPLGLAMV

SEQ ID NO: 237931 - protein, 26 aa, Mycobacterium bovis
PLSSALLSFGLLLGGLPLAAPPLAGA

SEQ ID NO: 237932 - protein, 19 aa, Mycobacterium bovis
QAIELWKIVDRPNLFIKIP

SEQ ID NO: 237933 - protein, 18 aa, Mycobacterium bovis
QALQLELLNAINAPTLAL

SEQ ID NO: 237934 - protein, 21 aa, Mycobacterium bovis
QGLVLLVLALLLSSCGWRGIS

SEQ ID NO: 237935 - protein, 20 aa, Mycobacterium bovis
QLLLTFPFPNFGIKQAVRGD

SEQ ID NO: 237936 - protein, 29 aa, Mycobacterium bovis
QRLLDLINGPTQALLGRPLIGDGANGGPG

SEQ ID NO: 237937 - protein, 18 aa, Mycobacterium bovis
RALWIAALSFGLGGVAVA

SEQ ID NO: 237938 - protein, 20 aa, Mycobacterium bovis
RFHQQFVQALTASVGSYAAA

SEQ ID NO: 237939 - protein, 23 aa, Mycobacterium bovis
RGPDPLGVLYWQVPKGSTLDSTI

SEQ ID NO: 237940 - protein, 18 aa, Mycobacterium bovis
RHTPPHAWYIAFAPAQAP

SEQ ID NO: 237941 - protein, 21 aa, Mycobacterium bovis
RRRLLAVLIALALPGAAVALL

SEQ ID NO: 237942 - protein, 24 aa, Mycobacterium bovis
RSDPFVAILRFPFIPQAMREHYAE

SEQ ID NO: 237943 - protein, 18 aa, Mycobacterium bovis
RSFLLQLGGIRALGYSPE

SEQ ID NO: 237944 - protein, 24 aa, Mycobacterium bovis
SADPLLPPPPIPAPVSAPATVPPV

SEQ ID NO: 237945 - protein, 17 aa, Mycobacterium bovis
SAQATIFHDQFVQALTS

SEQ ID NO: 237946 - protein, 24 aa, Mycobacterium bovis
SGAATALIAIPTACSFSIGTSHSH

SEQ ID NO: 237947 - protein, 17 aa, Mycobacterium bovis
SGPRWLALLLQPLSGPP

SEQ ID NO: 237948 - protein, 21 aa, Mycobacterium bovis
SPQRWKYLTSGLLGLQRGSDA

SEQ ID NO: 237949 - protein, 21 aa, Mycobacterium bovis
SPTIDLPVPDDWRLLPESSRA

SEQ ID NO: 237950 - protein, 24 aa, Mycobacterium bovis
SRRLWTMLIFMLWHAIFVEHSVVP

SEQ ID NO: 237951 - protein, 17 aa, Mycobacterium bovis
TGGLLFGAGGNGGPGGS

SEQ ID NO: 237952 - protein, 28 aa, Mycobacterium bovis
TGSSSLVIPFWKIGWQNLGLPTGFDVVH

SEQ ID NO: 237953 - protein, 20 aa, Mycobacterium bovis
TIFHDQFVQALTSGGNLYAA

SEQ ID NO: 237954 - protein, 23 aa, Mycobacterium bovis
TLGFTIPGFTIPAAPLPLTIDID

SEQ ID NO: 237955 - protein, 17 aa, Mycobacterium bovis
TLRVGPIARRVITCTSA

SEQ ID NO: 237956 - protein, 18 aa, Mycobacterium bovis
TLYRKWLTVLGPAPAPPT

SEQ ID NO: 237957 - protein, 22 aa, Mycobacterium bovis
TPVVSKLPWFALRDPYVTGQVT

SEQ ID NO: 237958 - protein, 21 aa, Mycobacterium bovis
TSVLSALFLGAGAALLSACSS

SEQ ID NO: 237959 - protein, 20 aa, Mycobacterium bovis
TTNPPVEGAFYWLNNREVRW

SEQ ID NO: 237960 - protein, 19 aa, Mycobacterium bovis
TVAYRFSWHLPKDRIWTYD

SEQ ID NO: 237961 - protein, 17 aa, Mycobacterium bovis
TVKTTMEALWWDRPFAL

SEQ ID NO: 237962 - protein, 23 aa, Mycobacterium bovis
TVSGQLTLLVPFIDRVRARVDLR

SEQ ID NO: 237963 - protein, 18 aa, Mycobacterium bovis
TYVQLFVLIAAANDVRCD

SEQ ID NO: 237964 - protein, 17 aa, Mycobacterium bovis
VILVLMLVAATQLFFLQ

SEQ ID NO: 237965 - protein, 25 aa, Mycobacterium bovis
VLAEWFLRRFSLLDSLYMVPSVPII

SEQ ID NO: 237966 - protein, 31 aa, Mycobacterium bovis
VLNALNAPTQALLGRPLIGDGAAGAPGTGQA

SEQ ID NO: 237967 - protein, 21 aa, Mycobacterium bovis
VQDVWIWVRPYFDDRATAAAK

SEQ ID NO: 237968 - protein, 17 aa, Mycobacterium bovis
VQRTWPELIPLLQSGRL

SEQ ID NO: 237969 - protein, 17 aa, Mycobacterium bovis
VSQFFGKYFTPEQARQL

SEQ ID NO: 237970 - protein, 17 aa, Mycobacterium bovis
VVPLIVNLYAFGARDFD

SEQ ID NO: 237971 - protein, 20 aa, Mycobacterium bovis
VWTMSNPRWTCDYGLAVVPH

SEQ ID NO: 237972 - protein, 29 aa, Mycobacterium bovis
WAMRAAPTLAWPTWVWATSGSPTPAPTTS

SEQ ID NO: 237973 - protein, 17 aa, Mycobacterium bovis
WASWAFVGPNHRAYFGG

SEQ ID NO: 237974 - protein, 17 aa, Mycobacterium bovis
WIPLLILVVVAIAGFTV

SEQ ID NO: 237975 - protein, 18 aa, Mycobacterium bovis
WRFSVPLVCLLAGLLLAA

SEQ ID NO: 237976 - protein, 24 aa, Mycobacterium bovis
WRNGIWYTARLRPGPLRPAERRTA

SEQ ID NO: 237977 - protein, 24 aa, Mycobacterium bovis
YAEIGLLGFALIADALGGVDVCLK

SEQ ID NO: 237978 - protein, 19 aa, Mycobacterium bovis
YAELPYLFTDQYDLGMEYV

SEQ ID NO: 237979 - protein, 24 aa, Mycobacterium bovis
YGVDPLILRQAYPVRQAPYGLAGS

SEQ ID NO: 237980 - protein, 17 aa, Mycobacterium bovis
YLTSGLLGLQRGSDAGD

SEQ ID NO: 237981 - protein, 20 aa, Mycobacterium bovis
YLYAHLRLLWMCRERLLAEL

SEQ ID NO: 237982 - protein, 21 aa, Mycobacterium bovis
AAALPSWQQALRGLPGLGQVA

SEQ ID NO: 237983 - protein, 18 aa, Mycobacterium bovis
AAAPYAGWLAAAAARAAG

SEQ ID NO: 237984 - protein, 19 aa, Mycobacterium bovis
AAFHDRFAQTLSAAVGSYV

SEQ ID NO: 237985 - protein, 17 aa, Mycobacterium bovis
AAPALPVGLAVTAAVVA

SEQ ID NO: 237986 - protein, 21 aa, Mycobacterium bovis
AGGAGGLLFGNGGAGAAGAPG

SEQ ID NO: 237987 - protein, 23 aa, Mycobacterium bovis
AGGRAWLWGTGGAGGAGAAAAIG

SEQ ID NO: 237988 - protein, 17 aa, Mycobacterium bovis
AGQLFSAGGAAGAVGVG

SEQ ID NO: 237989 - protein, 42 aa, Mycobacterium bovis
ASPLQALEQQVLGAINAPTQLWLGRPLIGDGVHGAPGTGQPG

SEQ ID NO: 237990 - protein, 23 aa, Mycobacterium bovis
DFDPYQFLLIPLARITGIEDPAL

SEQ ID NO: 237991 - protein, 22 aa, Mycobacterium bovis
DLPQLPYLPLQVPQQLSLPADL

SEQ ID NO: 237992 - protein, 22 aa, Mycobacterium bovis
DRVTLFRAWYSRRNFGQLSGSV

SEQ ID NO: 237993 - protein, 20 aa, Mycobacterium bovis
DSMPALHMLPLADALGVLPV

SEQ ID NO: 237994 - protein, 19 aa, Mycobacterium bovis
FDCSGLVMWAFQQAGIALP

SEQ ID NO: 237995 - protein, 17 aa, Mycobacterium bovis
FVQLVLSNLFGQNAPAI

SEQ ID NO: 237996 - protein, 24 aa, Mycobacterium bovis
GAGGAGGWLFGVGGAGGVGGAGGG

SEQ ID NO: 237997 - protein, 18 aa, Mycobacterium bovis
GAGGLLWGNGGNGGAGDA

SEQ ID NO: 237998 - protein, 25 aa, Mycobacterium bovis
GGGALNQAGFFGTGGKGGNGGNGGA

SEQ ID NO: 237999 - protein, 17 aa, Mycobacterium bovis
GMINGGLGGFGGAGGGG

SEQ ID NO: 238000 - protein, 26 aa, Mycobacterium bovis
GTGQPGGAGGLLWGNGGNGGSGAAGQ

SEQ ID NO: 238001 - protein, 18 aa, Mycobacterium bovis
IARVIMRSAIGFFASFTV

SEQ ID NO: 238002 - protein, 27 aa, Mycobacterium bovis
LAAINAPTQTLLGRPLIGNGADGLPGQ

SEQ ID NO: 238003 - protein, 18 aa, Mycobacterium bovis
LFHEQFVHAMTAGAGAYA

SEQ ID NO: 238004 - protein, 17 aa, Mycobacterium bovis
LHMLPLADALGVLPVLA

SEQ ID NO: 238005 - protein, 27 aa, Mycobacterium bovis
LLNLINAPTQALLGRPLIGNGANGLPG

SEQ ID NO: 238006 - protein, 29 aa, Mycobacterium bovis
LNALNAPTQALLGRPLIGDGAAGAPGTGQ

SEQ ID NO: 238007 - protein, 21 aa, Mycobacterium bovis
LNGPFQALFGRPLIGDGANGA

SEQ ID NO: 238008 - protein, 18 aa, Mycobacterium bovis
LPAELLPADWPGAGLRAA

SEQ ID NO: 238009 - protein, 25 aa, Mycobacterium bovis
LRNPERVWGWYLWRHYLVANVEPND

SEQ ID NO: 238010 - protein, 20 aa, Mycobacterium bovis
LYVHSAPWALPALGLENVSH

SEQ ID NO: 238011 - protein, 17 aa, Mycobacterium bovis
MARFHQQFVQALTASVG

SEQ ID NO: 238012 - protein, 23 aa, Mycobacterium bovis
MNTGFLPFRFQPVYIDYSPSGIG

SEQ ID NO: 238013 - protein, 24 aa, Mycobacterium bovis
NAINAPTLALLGRPLIGDGTDAAP

SEQ ID NO: 238014 - protein, 17 aa, Mycobacterium bovis
NGGAGGLLWGNGGNGGA

SEQ ID NO: 238015 - protein, 23 aa, Mycobacterium bovis
NGGAGGNAWLFGAGGSGGAGTNG

SEQ ID NO: 238016 - protein, 35 aa, Mycobacterium bovis; identical to SEQ ID NO: 237706

SEQ ID NO: 238017 - protein, 19 aa, Mycobacterium bovis
PDMTLFLDLKQTPPQPLVS

SEQ ID NO: 238018 - protein, 23 aa, Mycobacterium bovis
PIMGTPWLTAFAQRSRFAEAFHA

SEQ ID NO: 238019 - protein, 19 aa, Mycobacterium bovis
PIPPIIHYGAIAYAPSGAS

SEQ ID NO: 238020 - protein, 19 aa, Mycobacterium bovis
PTEALLGRPLIGNGADGTA

SEQ ID NO: 238021 - protein, 27 aa, Mycobacterium bovis
QAGGPGGPAGLWGNGGPGGAGGSGGGT

SEQ ID NO: 238022 - protein, 19 aa, Mycobacterium bovis
QQADCFAGVYLWWVAEGKS

SEQ ID NO: 238023 - protein, 18 aa, Mycobacterium bovis
RFIGLLMLSVLVAGCSSN

SEQ ID NO: 238024 - protein, 22 aa, Mycobacterium bovis
SAQAAMFHEQFVRALAAGGNSY

SEQ ID NO: 238025 - protein, 25 aa, Mycobacterium bovis
SAQVAAYHQRFVQALSTGAGAYASA

SEQ ID NO: 238026 - protein, 26 aa, Mycobacterium bovis
SARVATFHEQFVRSLTAAGSAYATAE

SEQ ID NO: 238027 - protein, 21 aa, Mycobacterium bovis
TAAVVAPRRFTKTRSLVSGRS

SEQ ID NO: 238028 - protein, 17 aa, Mycobacterium bovis
TLALTSSAGAYASAEAT

SEQ ID NO: 238029 - protein, 23 aa, Mycobacterium bovis
TLMDSHPFTWLPLLSRVLGSAQL

SEQ ID NO: 238030 - protein, 24 aa, Mycobacterium bovis
VDVINAPFRSALGRPLIGNGANGK

SEQ ID NO: 238031 - protein, 25 aa, Mycobacterium bovis
VLLDDRWWFHFALIGVLTALDDLFG

SEQ ID NO: 238032 - protein, 22 aa, Mycobacterium bovis
VLRRLLRLCARYSAHPTVIFAS

SEQ ID NO: 238033 - protein, 25 aa, Mycobacterium bovis
VLVVLGACLALWLSGCSSPKPDAEE

SEQ ID NO: 238034 - protein, 26 aa, Mycobacterium bovis
VPEYIGNLLLYFQPDATVTMLDAVEL

SEQ ID NO: 238035 - protein, 17 aa, Mycobacterium bovis
VRSLTAAGSAYATAEAA

SEQ ID NO: 238036 - protein, 18 aa, Mycobacterium bovis
WQQALRGLPGLGQVASAI

SEQ ID NO: 238037 - protein, 33 aa, Mycobacterium bovis; identical to SEQ ID NO: 228289

SEQ ID NO: 238038 - protein, 17 aa, Mycobacterium bovis
AAHAPYLAWLMRASETS

SEQ ID NO: 238039 - protein, 26 aa, Mycobacterium bovis
AAINAPTQTLLGRPLIGNGADGLPGQ

SEQ ID NO: 238040 - protein, 20 aa, Mycobacterium bovis
AAYHQRFVQALSTGAGAYAS

SEQ ID NO: 238041 - protein, 34 aa, Mycobacterium bovis
AEQIVLGVINAPTQALLGRPLIGDGANATTPGGA

SEQ ID NO: 238042 - protein, 18 aa, Mycobacterium bovis
AFYAQFVQALSAGGGAYA

SEQ ID NO: 238043 - protein, 22 aa, Mycobacterium bovis
AGGAGGWLFGVGGAGGVGGAGG

SEQ ID NO: 238044 - protein, 22 aa, Mycobacterium bovis
AGGLLFGQRWQRRGWRVRSNRR

SEQ ID NO: 238045 - protein, 25 aa, Mycobacterium bovis
AGGPGGPAGLWGNGGPGGAGGSGGG

SEQ ID NO: 238046 - protein, 22 aa, Mycobacterium bovis
AGGRAWLWGTGGAGGAGAAAIG

SEQ ID NO: 238047 - protein, 23 aa, Mycobacterium bovis
AGGRGALLLGAGGQGGLGGAGGQ

SEQ ID NO: 238048 - protein, 24 aa, Mycobacterium bovis
AGGRGALLLGAGGQGGLGGAGGQG

SEQ ID NO: 238049 - protein, 24 aa, Mycobacterium bovis
APIMGTPWLTAFAQRSRFAEAFHA

SEQ ID NO: 238050 - protein, 24 aa, Mycobacterium bovis
AQVAAYHQRFVQALSTGAGAYASA

SEQ ID NO: 238051 - protein, 21 aa, Mycobacterium bovis
ARIAALFGGFGLEYQAISAQV

SEQ ID NO: 238052 - protein, 19 aa, Mycobacterium bovis
ARLTGMHWWGPASTSMLAM

SEQ ID NO: 238053 - protein, 17 aa, Mycobacterium bovis
ASFVFRHRTGNAVILVL

SEQ ID NO: 238054 - protein, 25 aa, Mycobacterium bovis
DEVSARIAALFGGFGLEYQAISAQV

SEQ ID NO: 238055 - protein, 18 aa, Mycobacterium bovis
DLPQLPYLPLQVPQQLSL

SEQ ID NO: 238056 - protein, 23 aa, Mycobacterium bovis
EAFQFYFELLLFDYPTHIVQIVE

SEQ ID NO: 238057 - protein, 17 aa, Mycobacterium bovis
EVSARIAALFGGFGLEY

SEQ ID NO: 238058 - protein, 23 aa, Mycobacterium bovis
FDCSGLVMWAFQQAGIALPHSSQ

SEQ ID NO: 238059 - protein, 17 aa, Mycobacterium bovis
FPNFFMMLGPHSPVGNF

SEQ ID NO: 238060 - protein, 23 aa, Mycobacterium bovis
GAGGPGGLIWGGGGAGGVGGAGG

SEQ ID NO: 238061 - protein, 21 aa, Mycobacterium bovis
GGRGALLLGAGGQGGLGGAGG

SEQ ID NO: 238062 - protein, 17 aa, Mycobacterium bovis
GLPFWPQGKPYDAYFTD

SEQ ID NO: 238063 - protein, 34 aa, Mycobacterium bovis; identical to SEQ ID NO: 165458

SEQ ID NO: 238064 - protein, 18 aa, Mycobacterium bovis
GRAELLFGAGGAGGAGGA

SEQ ID NO: 238065 - protein, 17 aa, Mycobacterium bovis
GTGGVLLGLDGFTAPAS

SEQ ID NO: 238066 - protein, 20 aa, Mycobacterium bovis
GTVLRFVPPLAALGSVPVTF

SEQ ID NO: 238067 - protein, 30 aa, Mycobacterium bovis
IVLGVINAPTQALLGRPLIGDGANATTPGG

SEQ ID NO: 238068 - protein, 26 aa, Mycobacterium bovis
LDVLNGPFQALFGRPLIGDGANGAPG

SEQ ID NO: 238069 - protein, 23 aa, Mycobacterium bovis
LEFIQFHPTMLFAGRAGGRRPLI

SEQ ID NO: 238070 - protein, 21 aa, Mycobacterium bovis
LGACLALWLSGCSSPKPDAEE

SEQ ID NO: 238071 - protein, 26 aa, Mycobacterium bovis
LGLINAPTQALWGRPLIGNGADGTAA

SEQ ID NO: 238072 - protein, 19 aa, Mycobacterium bovis
LLALICVLPIALSPWPARA

SEQ ID NO: 238073 - protein, 28 aa, Mycobacterium bovis
LLNAINAPTQALLGRPLIGDGAVGTASS

SEQ ID NO: 238074 - protein, 26 aa, Mycobacterium bovis
LNAINAPTQALLGRPLIGDGAVGTAS

SEQ ID NO: 238075 - protein, 27 aa, Mycobacterium bovis
LNAINAPTQALLGRPLIGDGAVGTASS

SEQ ID NO: 238076 - protein, 28 aa, Mycobacterium bovis
LNALNAPTQALLGRPLIGDGAAGAPGTG

SEQ ID NO: 238077 - protein, 17 aa, Mycobacterium bovis
LTGMHWWGPASTSMLAM

SEQ ID NO: 238078 - protein, 26 aa, Mycobacterium bovis
LVDVINAPFRSALGRPLIGNGANGKP

SEQ ID NO: 238079 - protein, 18 aa, Mycobacterium bovis
LVTLYKQYVVRFGLGYRE

SEQ ID NO: 238080 - protein, 18 aa, Mycobacterium bovis
NAINAPTLALLGRPLIGD

SEQ ID NO: 238081 - protein, 21 aa, Mycobacterium bovis
NAPTLALLGRPLIGDGTDAAP

SEQ ID NO: 238082 - protein, 22 aa, Mycobacterium bovis
NAPTQLWLGRPLIGDGVHGAPG

SEQ ID NO: 238083 - protein, 20 aa, Mycobacterium bovis
PIPPIIHYGAIAYAPSGASG

SEQ ID NO: 238084 - protein, 21 aa, Mycobacterium bovis
PLAHIALASGCCDLAGCVLAA

SEQ ID NO: 238085 - protein, 18 aa, Mycobacterium bovis
QADCFAGVYLWWVAEGKS

SEQ ID NO: 238086 - protein, 26 aa, Mycobacterium bovis
QAGGPGGPAGLWGNGGPGGAGGSGGG

SEQ ID NO: 238087 - protein, 19 aa, Mycobacterium bovis
QLPYLPLQVPQQLSLPADL

SEQ ID NO: 238088 - protein, 17 aa, Mycobacterium bovis
QVAAFHDRFAQTLSAAV

SEQ ID NO: 238089 - protein, 18 aa, Mycobacterium bovis
QWVLPWPNPRYSKLARVF

SEQ ID NO: 238090 - protein, 26 aa, Mycobacterium bovis
RDPLTVFLVLIIVFSLVLAGLIGGEL

SEQ ID NO: 238091 - protein, 25 aa, Mycobacterium bovis
SAQAALFHEQFVHAMTAGAGAYAGA

SEQ ID NO: 238092 - protein, 17 aa, Mycobacterium bovis
SFGVAPLLLWQVATRHF

SEQ ID NO: 238093 - protein, 36 aa, Mycobacterium bovis
SGCCDLAGCVLAAWGWVVMSFVVAVPEALAAAASDV

SEQ ID NO: 238094 - protein, 23 aa, Mycobacterium bovis
STQVAAFHDRFAQTLSAAVGSYV

SEQ ID NO: 238095 - protein, 25 aa, Mycobacterium bovis
TDSTPPPWVRPVPMAVWAATAARAV

SEQ ID NO: 238096 - protein, 27 aa, Mycobacterium bovis
TVFQRTPIWCFPKFDVPLPTAVRWAMR

SEQ ID NO: 238097 - protein, 20 aa, Mycobacterium bovis
VGGDGGWLAPGGAGGAGGQG

SEQ ID NO: 238098 - protein, 24 aa, Mycobacterium bovis
VGGVSGLLLGLDGFNAPASTSPLH

SEQ ID NO: 238099 - protein, 27 aa, Mycobacterium bovis
VLGVINAPTQALLGRPLIGDGANATTP

SEQ ID NO: 238100 - protein, 26 aa, Mycobacterium bovis
VLLDDRWWFHFALIGVLTALDDLFGQ

SEQ ID NO: 238101 - protein, 21 aa, Mycobacterium bovis
VLRRLLRLCARYSAHPTVIFA

SEQ ID NO: 238102 - protein, 19 aa, Mycobacterium bovis
VMSFVVAVPEALAAAASDV

SEQ ID NO: 238103 - protein, 5 aa, Mycobacterium
DMRNP

SEQ ID NO: 238104 - protein, 4 aa, Mycobacterium
LRPE

SEQ ID NO: 238105 - protein, 7 aa, Mycobacterium
SCPPPRH

SEQ ID NO: 238106 - protein, 5 aa, Mycobacterium
DLRNP

SEQ ID NO: 238107 - protein, 7 aa, Mycobacterium
PGKRAPT

SEQ ID NO: 238108 - protein, 11 aa, Mycobacterium
KLSGGQRKRAS

SEQ ID NO: 238109 - protein, 4 aa, Mycobacterium
PWGY

SEQ ID NO: 238110 - protein, 4 aa, Mycobacterium
SERP

SEQ ID NO: 238111 - protein, 4 aa, Mycobacterium
AGPL

SEQ ID NO: 238112 - protein, 7 aa, Mycobacterium
AGPTGVE

SEQ ID NO: 238113 - protein, 4 aa, Mycobacterium
GGSH

SEQ ID NO: 238114 - protein, 5 aa, Mycobacterium
EGMPR

SEQ ID NO: 238115 - protein, 10 aa, Mycobacterium
GGSGAGKTTL

SEQ ID NO: 238116 - protein, 7 aa, Mycobacterium
GGTGKVV

SEQ ID NO: 238117 - protein, 5 aa, Mycobacterium
PDGKA

SEQ ID NO: 238118 - protein, 4 aa, Mycobacterium
PEDP

SEQ ID NO: 238119 - protein, 6 aa, Mycobacterium
SPDGKA

SEQ ID NO: 238120 - protein, 7 aa, Mycobacterium
STAGWRD

SEQ ID NO: 238121 - protein, 9 aa, Mycobacterium
ADLSGAGAA

SEQ ID NO: 238122 - protein, 4 aa, Mycobacterium
DLRN

SEQ ID NO: 238123 - protein, 5 aa, Mycobacterium
DMRNS

SEQ ID NO: 238124 - protein, 5 aa, Mycobacterium
DPANG

SEQ ID NO: 238125 - protein, 4 aa, Mycobacterium
GAGT

SEQ ID NO: 238126 - protein, 5 aa, Mycobacterium
GTGTD

SEQ ID NO: 238127 - protein, 4 aa, Mycobacterium
HELR

SEQ ID NO: 238128 - protein, 4 aa, Mycobacterium
PATG

SEQ ID NO: 238129 - protein, 4 aa, Mycobacterium
QAAY

SEQ ID NO: 238130 - protein, 4 aa, Mycobacterium
RPRE

SEQ ID NO: 238131 - protein, 6 aa, Mycobacterium
RPRPAS

SEQ ID NO: 238132 - protein, 4 aa, Mycobacterium
SDRF

SEQ ID NO: 238133 - protein, 7 aa, Mycobacterium
TPGGAAD

SEQ ID NO: 238134 - protein, 4 aa, Mycobacterium
TSKL

SEQ ID NO: 238135 - protein, 4 aa, Mycobacterium
AGEA

SEQ ID NO: 238136 - protein, 6 aa, Mycobacterium
AGQSYF

SEQ ID NO: 238137 - protein, 4 aa, Mycobacterium
AGST

SEQ ID NO: 238138 - protein, 5 aa, Mycobacterium
AGSTA

SEQ ID NO: 238139 - protein, 4 aa, Mycobacterium
AGTD

SEQ ID NO: 238140 - protein, 8 aa, Mycobacterium
ARQPEAQG

SEQ ID NO: 238141 - protein, 4 aa, Mycobacterium
ARRR

SEQ ID NO: 238142 - protein, 10 aa, Mycobacterium
DHHANPTRRY

SEQ ID NO: 238143 - protein, 4 aa, Mycobacterium
DLPP

SEQ ID NO: 238144 - protein, 4 aa, Mycobacterium
DMRN

SEQ ID NO: 238145 - protein, 7 aa, Mycobacterium
EARSEHP

SEQ ID NO: 238146 - protein, 7 aa, Mycobacterium
EEPIDHT

SEQ ID NO: 238147 - protein, 9 aa, Mycobacterium
GADPDEANR

SEQ ID NO: 238148 - protein, 7 aa, Mycobacterium
GKSSNVG

SEQ ID NO: 238149 - protein, 8 aa, Mycobacterium
GPPGTGKT

SEQ ID NO: 238150 - protein, 9 aa, Mycobacterium
GPTGAGKTT

SEQ ID NO: 238151 - protein, 7 aa, Mycobacterium
GRDPKTD

SEQ ID NO: 238152 - protein, 7 aa, Mycobacterium
GSGKSQT

SEQ ID NO: 238153 - protein, 10 aa, Mycobacterium
GSTGSGKSSF

SEQ ID NO: 238154 - protein, 9 aa, Mycobacterium
GVNDAPALA

SEQ ID NO: 238155 - protein, 6 aa, Mycobacterium
IPGKSA

SEQ ID NO: 238156 - protein, 6 aa, Mycobacterium
KGGGLS

SEQ ID NO: 238157 - protein, 5 aa, Mycobacterium
LGPAG

SEQ ID NO: 238158 - protein, 7 aa, Mycobacterium
MEGPTPV

SEQ ID NO: 238159 - protein, 5 aa, Mycobacterium
NRPDI

SEQ ID NO: 238160 - protein, 6 aa, Mycobacterium
PARTPV

SEQ ID NO: 238161 - protein, 4 aa, Mycobacterium
PGTG

SEQ ID NO: 238162 - protein, 6 aa, Mycobacterium
PSSGSF

SEQ ID NO: 238163 - protein, 4 aa, Mycobacterium
PTDG

SEQ ID NO: 238164 - protein, 8 aa, Mycobacterium
PTSGLDPA

SEQ ID NO: 238165 - protein, 4 aa, Mycobacterium
PVNE

SEQ ID NO: 238166 - protein, 11 aa, Mycobacterium
QAQGGKAPVQR

SEQ ID NO: 238167 - protein, 5 aa, Mycobacterium
QRGNY

SEQ ID NO: 238168 - protein, 4 aa, Mycobacterium
RAAA

SEQ ID NO: 238169 - protein, 6 aa, Mycobacterium
RATRPD

SEQ ID NO: 238170 - protein, 5 aa, Mycobacterium
SRTIR

SEQ ID NO: 238171 - protein, 4 aa, Mycobacterium
TGGV

SEQ ID NO: 238172 - protein, 6 aa, Mycobacterium
TPAPYG

SEQ ID NO: 238173 - protein, 11 aa, Mycobacterium
VGATSLAGAAS

SEQ ID NO: 238174 - protein, 10 aa, Mycobacterium
VGPSEGSKAR

SEQ ID NO: 238175 - protein, 19 aa, Mycobacterium
VGRQRGAGLGGGHDEREQT

SEQ ID NO: 238176 - protein, 4 aa, Mycobacterium
VGTQ

SEQ ID NO: 238177 - protein, 10 aa, Mycobacterium
VQSSLSGSTV

SEQ ID NO: 238178 - protein, 9 aa, Mycobacterium
AAGGDPEAM

SEQ ID NO: 238179 - protein, 10 aa, Mycobacterium
AATTTPAGVG

SEQ ID NO: 238180 - protein, 5 aa, Mycobacterium
ADEQV

SEQ ID NO: 238181 - protein, 8 aa, Mycobacterium
AGAPEKAA

SEQ ID NO: 238182 - protein, 4 aa, Mycobacterium
AGTG

SEQ ID NO: 238183 - protein, 4 aa, Mycobacterium
ARDP

SEQ ID NO: 238184 - protein, 7 aa, Mycobacterium
ARHEPEA

SEQ ID NO: 238185 - protein, 11 aa, Mycobacterium
ASAAPTPGGVG

SEQ ID NO: 238186 - protein, 8 aa, Mycobacterium
ATGAGKGS

SEQ ID NO: 238187 - protein, 8 aa, Mycobacterium
ATGSGKSE

SEQ ID NO: 238188 - protein, 4 aa, Mycobacterium
ATGT

SEQ ID NO: 238189 - protein, 5 aa, Mycobacterium
AYPRT

SEQ ID NO: 238190 - protein, 5 aa, Mycobacterium
DHDQM

SEQ ID NO: 238191 - protein, 5 aa, Mycobacterium
DMTGA

SEQ ID NO: 238192 - protein, 6 aa, Mycobacterium
DSDPTK

SEQ ID NO: 238193 - protein, 10 aa, Mycobacterium
DTRGYKPVDT

SEQ ID NO: 238194 - protein, 7 aa, Mycobacterium
EAQNAAA

SEQ ID NO: 238195 - protein, 7 aa, Mycobacterium
EDGRTSV

SEQ ID NO: 238196 - protein, 4 aa, Mycobacterium
FGPT

SEQ ID NO: 238197 - protein, 6 aa, Mycobacterium
FSGPQI

SEQ ID NO: 238198 - protein, 4 aa, Mycobacterium
GAAA

SEQ ID NO: 238199 - protein, 4 aa, Mycobacterium
GDGV

SEQ ID NO: 238200 - protein, 5 aa, Mycobacterium
GDREA

SEQ ID NO: 238201 - protein, 12 aa, Mycobacterium
GDTGLDTGRPQS

SEQ ID NO: 238202 - protein, 10 aa, Mycobacterium
GGPKSGKSTA

SEQ ID NO: 238203 - protein, 8 aa, Mycobacterium
GGSAGGHL

SEQ ID NO: 238204 - protein, 4 aa, Mycobacterium
GGST

SEQ ID NO: 238205 - protein, 4 aa, Mycobacterium
GPAA

SEQ ID NO: 238206 - protein, 6 aa, Mycobacterium
GRTGGH

SEQ ID NO: 238207 - protein, 6 aa, Mycobacterium
GSFGGE

SEQ ID NO: 238208 - protein, 6 aa, Mycobacterium
HADTRV

SEQ ID NO: 238209 - protein, 7 aa, Mycobacterium
HDTGNAM

SEQ ID NO: 238210 - protein, 9 aa, Mycobacterium
IDNPDQRIQ

SEQ ID NO: 238211 - protein, 9 aa, Mycobacterium
IGAGATAQL

SEQ ID NO: 238212 - protein, 5 aa, Mycobacterium
KARAA

SEQ ID NO: 238213 - protein, 8 aa, Mycobacterium
KKDQLGEG

SEQ ID NO: 238214 - protein, 4 aa, Mycobacterium
KRPR

SEQ ID NO: 238215 - protein, 10 aa, Mycobacterium
KTGTLTANRP

SEQ ID NO: 238216 - protein, 6 aa, Mycobacterium
LRPGEE

SEQ ID NO: 238217 - protein, 9 aa, Mycobacterium
MGGHAAGEV

SEQ ID NO: 238218 - protein, 7 aa, Mycobacterium
MPPTGGL

SEQ ID NO: 238219 - protein, 8 aa, Mycobacterium
NDDRTGAA

SEQ ID NO: 238220 - protein, 4 aa, Mycobacterium
NPGA

SEQ ID NO: 238221 - protein, 4 aa, Mycobacterium
PDGK

SEQ ID NO: 238222 - protein, 5 aa, Mycobacterium
PPRVP

SEQ ID NO: 238223 - protein, 4 aa, Mycobacterium
PSVV

SEQ ID NO: 238224 - protein, 6 aa, Mycobacterium
PTANGD

SEQ ID NO: 238225 - protein, 7 aa, Mycobacterium
PTSGLDP

SEQ ID NO: 238226 - protein, 9 aa, Mycobacterium
QGAQLGAGP

SEQ ID NO: 238227 - protein, 5 aa, Mycobacterium
QRPSV

SEQ ID NO: 238228 - protein, 4 aa, Mycobacterium
RAGE

SEQ ID NO: 238229 - protein, 4 aa, Mycobacterium
RGEF

SEQ ID NO: 238230 - protein, 6 aa, Mycobacterium
RRGDDM

SEQ ID NO: 238231 - protein, 4 aa, Mycobacterium
RRPR

SEQ ID NO: 238232 - protein, 4 aa, Mycobacterium
RTSQ

SEQ ID NO: 238233 - protein, 7 aa, Mycobacterium
RTTTPYT

SEQ ID NO: 238234 - protein, 5 aa, Mycobacterium
SAAGT

SEQ ID NO: 238235 - protein, 4 aa, Mycobacterium
SGPT

SEQ ID NO: 238236 - protein, 4 aa, Mycobacterium
SLGG

SEQ ID NO: 238237 - protein, 6 aa, Mycobacterium
TARPGT

SEQ ID NO: 238238 - protein, 10 aa, Mycobacterium
TGCTRGPTVT

SEQ ID NO: 238239 - protein, 7 aa, Mycobacterium
TGTLSEN

SEQ ID NO: 238240 - protein, 9 aa, Mycobacterium
TRPQGTPIE

SEQ ID NO: 238241 - protein, 4 aa, Mycobacterium
TRRG

SEQ ID NO: 238242 - protein, 6 aa, Mycobacterium
TTTGTG

SEQ ID NO: 238243 - protein, 9 aa, Mycobacterium
VESGSEHPI

SEQ ID NO: 238244 - protein, 5 aa, Mycobacterium
VGADT

SEQ ID NO: 238245 - protein, 11 aa, Mycobacterium
VRRNPDHELRR

SEQ ID NO: 238246 - protein, 7 aa, Mycobacterium
VSLAGGG

SEQ ID NO: 238247 - protein, 6 aa, Mycobacterium
YGGTAG

SEQ ID NO: 238248 - protein, 8 aa, Mycobacterium
AAGPGEKA

SEQ ID NO: 238249 - protein, 4 aa, Mycobacterium
AAGS

SEQ ID NO: 238250 - protein, 5 aa, Mycobacterium
AARAG

SEQ ID NO: 238251 - protein, 10 aa, Mycobacterium
ADLSGAGTAF

SEQ ID NO: 238252 - protein, 4 aa, Mycobacterium
AEAG

SEQ ID NO: 238253 - protein, 6 aa, Mycobacterium
AEPGST

SEQ ID NO: 238254 - protein, 11 aa, Mycobacterium
AGKTGTAQQIN

SEQ ID NO: 238255 - protein, 9 aa, Mycobacterium
AGNTVDGTS

SEQ ID NO: 238256 - protein, 5 aa, Mycobacterium
ANLTG

SEQ ID NO: 238257 - protein, 8 aa, Mycobacterium
ANNEDSVY

SEQ ID NO: 238258 - protein, 9 aa, Mycobacterium
AQQARADET

SEQ ID NO: 238259 - protein, 7 aa, Mycobacterium
ASGSTYP

SEQ ID NO: 238260 - protein, 6 aa, Mycobacterium
ASQDPL

SEQ ID NO: 238261 - protein, 12 aa, Mycobacterium
ATADGADKSGLT

SEQ ID NO: 238262 - protein, 4 aa, Mycobacterium
ATGA

SEQ ID NO: 238263 - protein, 4 aa, Mycobacterium
ATGF

SEQ ID NO: 238264 - protein, 9 aa, Mycobacterium
AYPSGGGDY

SEQ ID NO: 238265 - protein, 5 aa, Mycobacterium
DAAAA

SEQ ID NO: 238266 - protein, 4 aa, Mycobacterium
DELA

SEQ ID NO: 238267 - protein, 10 aa, Mycobacterium
DGAPNLPSGY

SEQ ID NO: 238268 - protein, 7 aa, Mycobacterium
DNPLTAK

SEQ ID NO: 238269 - protein, 7 aa, Mycobacterium
DPDDPTP

SEQ ID NO: 238270 - protein, 13 aa, Mycobacterium
DPSRVRRSGGTGL

SEQ ID NO: 238271 - protein, 8 aa, Mycobacterium
DRGGRERH

SEQ ID NO: 238272 - protein, 8 aa, Mycobacterium
DRTATGEG

SEQ ID NO: 238273 - protein, 7 aa, Mycobacterium
EATPEDK

SEQ ID NO: 238274 - protein, 4 aa, Mycobacterium
EAVS

SEQ ID NO: 238275 - protein, 10 aa, Mycobacterium
EGDPATPEGI

SEQ ID NO: 238276 - protein, 8 aa, Mycobacterium
EIREGRSF

SEQ ID NO: 238277 - protein, 4 aa, Mycobacterium
ELRT

SEQ ID NO: 238278 - protein, 8 aa, Mycobacterium
ETNRAPFD

SEQ ID NO: 238279 - protein, 6 aa, Mycobacterium
EYGGDP

SEQ ID NO: 238280 - protein, 5 aa, Mycobacterium
FGSTS

SEQ ID NO: 238281 - protein, 6 aa, Mycobacterium
GAPTPI

SEQ ID NO: 238282 - protein, 5 aa, Mycobacterium
GDNAV

SEQ ID NO: 238283 - protein, 4 aa, Mycobacterium
GEVA

SEQ ID NO: 238284 - protein, 6 aa, Mycobacterium
GGGTAG

SEQ ID NO: 238285 - protein, 6 aa, Mycobacterium
GGPGFC

SEQ ID NO: 238286 - protein, 7 aa, Mycobacterium
GGSGSVV

SEQ ID NO: 238287 - protein, 7 aa, Mycobacterium
GGTGSVV

SEQ ID NO: 238288 - protein, 4 aa, Mycobacterium
GGTR

SEQ ID NO: 238289 - protein, 6 aa, Mycobacterium
GKEVPA

SEQ ID NO: 238290 - protein, 8 aa, Mycobacterium
GLSPAGEQ

SEQ ID NO: 238291 - protein, 4 aa, Mycobacterium
GPAG

SEQ ID NO: 238292 - protein, 4 aa, Mycobacterium
GPGD

SEQ ID NO: 238293 - protein, 5 aa, Mycobacterium
GPLSD

SEQ ID NO: 238294 - protein, 8 aa, Mycobacterium
GPQNMPKF

SEQ ID NO: 238295 - protein, 10 aa, Mycobacterium
GPSGAGKSTF

SEQ ID NO: 238296 - protein, 6 aa, Mycobacterium
GQGGTI

SEQ ID NO: 238297 - protein, 15 aa, Mycobacterium
GRIPSDKPPIKTPGE

SEQ ID NO: 238298 - protein, 8 aa, Mycobacterium
GRKQDNPA

SEQ ID NO: 238299 - protein, 4 aa, Mycobacterium
GRVG

SEQ ID NO: 238300 - protein, 6 aa, Mycobacterium
GSGPGF

SEQ ID NO: 238301 - protein, 8 aa, Mycobacterium
GSPMSNTT

SEQ ID NO: 238302 - protein, 8 aa, Mycobacterium
GSRQGVTR

SEQ ID NO: 238303 - protein, 5 aa, Mycobacterium
GTGGV

SEQ ID NO: 238304 - protein, 7 aa, Mycobacterium
GVNDAPA

SEQ ID NO: 238305 - protein, 10 aa, Mycobacterium
GVNDAPALAT

SEQ ID NO: 238306 - protein, 5 aa, Mycobacterium
HDMRN

SEQ ID NO: 238307 - protein, 7 aa, Mycobacterium
HDQTPLR

SEQ ID NO: 238308 - protein, 9 aa, Mycobacterium
HGTNDAQKT

SEQ ID NO: 238309 - protein, 8 aa, Mycobacterium
IGAGATAQ

SEQ ID NO: 238310 - protein, 6 aa, Mycobacterium
IGNGAR

SEQ ID NO: 238311 - protein, 6 aa, Mycobacterium
KGGMEL

SEQ ID NO: 238312 - protein, 7 aa, Mycobacterium
KHGGATR

SEQ ID NO: 238313 - protein, 5 aa, Mycobacterium
KKGLT

SEQ ID NO: 238314 - protein, 4 aa, Mycobacterium
LGGP

SEQ ID NO: 238315 - protein, 8 aa, Mycobacterium
LGTTPTGT

SEQ ID NO: 238316 - protein, 7 aa, Mycobacterium
LKQGKSQ

SEQ ID NO: 238317 - protein, 9 aa, Mycobacterium
LNAQTGNLS

SEQ ID NO: 238318 - protein, 6 aa, Mycobacterium
LSDAGR

SEQ ID NO: 238319 - protein, 4 aa, Mycobacterium
MSTS

SEQ ID NO: 238320 - protein, 9 aa, Mycobacterium
NAGPGTNGS

SEQ ID NO: 238321 - protein, 8 aa, Mycobacterium
NASGGPVG

SEQ ID NO: 238322 - protein, 9 aa, Mycobacterium
NPDERADEM

SEQ ID NO: 238323 - protein, 7 aa, Mycobacterium
NPGGSYT

SEQ ID NO: 238324 - protein, 12 aa, Mycobacterium
NTGTSAAKEAGN

SEQ ID NO: 238325 - protein, 5 aa, Mycobacterium
PDEND

SEQ ID NO: 238326 - protein, 6 aa, Mycobacterium
PGVGPV

SEQ ID NO: 238327 - protein, 4 aa, Mycobacterium
PKET

SEQ ID NO: 238328 - protein, 4 aa, Mycobacterium
PLGG

SEQ ID NO: 238329 - protein, 6 aa, Mycobacterium
PLTPPR

SEQ ID NO: 238330 - protein, 4 aa, Mycobacterium
PPDV

SEQ ID NO: 238331 - protein, 6 aa, Mycobacterium
PQWGPP

SEQ ID NO: 238332 - protein, 5 aa, Mycobacterium
PRPAS

SEQ ID NO: 238333 - protein, 6 aa, Mycobacterium
PSSSSH

SEQ ID NO: 238334 - protein, 5 aa, Mycobacterium
QGAAR

SEQ ID NO: 238335 - protein, 4 aa, Mycobacterium
QPSE

SEQ ID NO: 238336 - protein, 5 aa, Mycobacterium
QTPSA

SEQ ID NO: 238337 - protein, 5 aa, Mycobacterium
RGIGN

SEQ ID NO: 238338 - protein, 12 aa, Mycobacterium
RGSTASHSGSGL

SEQ ID NO: 238339 - protein, 7 aa, Mycobacterium
RHPGGAS

SEQ ID NO: 238340 - protein, 4 aa, Mycobacterium
RPRD

SEQ ID NO: 238341 - protein, 6 aa, Mycobacterium
RPRTLP

SEQ ID NO: 238342 - protein, 5 aa, Mycobacterium
RSERP

SEQ ID NO: 238343 - protein, 5 aa, Mycobacterium
RTQSR

SEQ ID NO: 238344 - protein, 6 aa, Mycobacterium
SDGSEI

SEQ ID NO: 238345 - protein, 6 aa, Mycobacterium
SDWADG

SEQ ID NO: 238346 - protein, 7 aa, Mycobacterium
SKSGKTT

SEQ ID NO: 238347 - protein, 7 aa, Mycobacterium
SPGEQQR

SEQ ID NO: 238348 - protein, 8 aa, Mycobacterium
SQGQSGST

SEQ ID NO: 238349 - protein, 9 aa, Mycobacterium
TAPSTRRDH

SEQ ID NO: 238350 - protein, 13 aa, Mycobacterium
TGDGTNDAPALAQ

SEQ ID NO: 238351 - protein, 5 aa, Mycobacterium
TGKAH

SEQ ID NO: 238352 - protein, 7 aa, Mycobacterium
TGKPLSP

SEQ ID NO: 238353 - protein, 5 aa, Mycobacterium
TGRGA

SEQ ID NO: 238354 - protein, 6 aa, Mycobacterium
TGTLTR

SEQ ID NO: 238355 - protein, 7 aa, Mycobacterium
TGTVTTG

SEQ ID NO: 238356 - protein, 4 aa, Mycobacterium
TGWG

SEQ ID NO: 238357 - protein, 4 aa, Mycobacterium
TPEY

SEQ ID NO: 238358 - protein, 6 aa, Mycobacterium
TQPMPG

SEQ ID NO: 238359 - protein, 6 aa, Mycobacterium
TRARRA

SEQ ID NO: 238360 - protein, 6 aa, Mycobacterium
TSSLTD

SEQ ID NO: 238361 - protein, 6 aa, Mycobacterium
VEAAGD

SEQ ID NO: 238362 - protein, 12 aa, Mycobacterium
VKGGPKGVGNAV

SEQ ID NO: 238363 - protein, 4 aa, Mycobacterium
VPES

SEQ ID NO: 238364 - protein, 6 aa, Mycobacterium
VPNTDR

SEQ ID NO: 238365 - protein, 9 aa, Mycobacterium
YGATSGQAL

SEQ ID NO: 238366 - protein, 6 aa, Mycobacterium
YGQTQP

SEQ ID NO: 238367 - protein, 8 aa, Mycobacterium
YGTEHGDP

SEQ ID NO: 238368 - protein, 8 aa, Mycobacterium
YRTNYNDR

SEQ ID NO: 238369 - protein, 4 aa, Mycobacterium
AAGA

SEQ ID NO: 238370 - protein, 4 aa, Mycobacterium
AAGR

SEQ ID NO: 238371 - protein, 4 aa, Mycobacterium
AAPE

SEQ ID NO: 238372 - protein, 6 aa, Mycobacterium
AAPTPV

SEQ ID NO: 238373 - protein, 5 aa, Mycobacterium
AARRA

SEQ ID NO: 238374 - protein, 4 aa, Mycobacterium
AASK

SEQ ID NO: 238375 - protein, 4 aa, Mycobacterium
AATT

SEQ ID NO: 238376 - protein, 5 aa, Mycobacterium
ACTAA

SEQ ID NO: 238377 - protein, 5 aa, Mycobacterium
ADEAG

SEQ ID NO: 238378 - protein, 10 aa, Mycobacterium
ADSGNSVTQT

SEQ ID NO: 238379 - protein, 7 aa, Mycobacterium
AEEASRR

SEQ ID NO: 238380 - protein, 4 aa, Mycobacterium
AENP

SEQ ID NO: 238381 - protein, 13 aa, Mycobacterium
AERERPKLGGEER

SEQ ID NO: 238382 - protein, 4 aa, Mycobacterium
AEYG

SEQ ID NO: 238383 - protein, 4 aa, Mycobacterium
AGGV

SEQ ID NO: 238384 - protein, 4 aa, Mycobacterium
AGKT

SEQ ID NO: 238385 - protein, 6 aa, Mycobacterium
AGRPVQ

SEQ ID NO: 238386 - protein, 4 aa, Mycobacterium
AGSV

SEQ ID NO: 238387 - protein, 4 aa, Mycobacterium
AGTR

SEQ ID NO: 238388 - protein, 4 aa, Mycobacterium
AGTS

SEQ ID NO: 238389 - protein, 11 aa, Mycobacterium
AGVRNAASIAG

SEQ ID NO: 238390 - protein, 4 aa, Mycobacterium
AHGT

SEQ ID NO: 238391 - protein, 5 aa, Mycobacterium
AKQNS

SEQ ID NO: 238392 - protein, 6 aa, Mycobacterium
AKSNEQ

SEQ ID NO: 238393 - protein, 6 aa, Mycobacterium
ALEPER

SEQ ID NO: 238394 - protein, 4 aa, Mycobacterium
ALGA

SEQ ID NO: 238395 - protein, 8 aa, Mycobacterium
ALLGGSPT

SEQ ID NO: 238396 - protein, 9 aa, Mycobacterium
ANRQKTPNE

SEQ ID NO: 238397 - protein, 5 aa, Mycobacterium
APAGA

SEQ ID NO: 238398 - protein, 5 aa, Mycobacterium
APGTD

SEQ ID NO: 238399 - protein, 5 aa, Mycobacterium
APSNE

SEQ ID NO: 238400 - protein, 6 aa, Mycobacterium
APSPLL

SEQ ID NO: 238401 - protein, 6 aa, Mycobacterium
AQLSQD

SEQ ID NO: 238402 - protein, 11 aa, Mycobacterium
ARGATASSEAA

SEQ ID NO: 238403 - protein, 5 aa, Mycobacterium
ARPGT

SEQ ID NO: 238404 - protein, 6 aa, Mycobacterium
ARTDGF

SEQ ID NO: 238405 - protein, 10 aa, Mycobacterium
ASAQPAAGPW

SEQ ID NO: 238406 - protein, 6 aa, Mycobacterium
ASPSVS

SEQ ID NO: 238407 - protein, 5 aa, Mycobacterium
ASRPE

SEQ ID NO: 238408 - protein, 6 aa, Mycobacterium
ATGEFE

SEQ ID NO: 238409 - protein, 5 aa, Mycobacterium
ATPEE

SEQ ID NO: 238410 - protein, 7 aa, Mycobacterium
ATVDAYD

SEQ ID NO: 238411 - protein, 16 aa, Mycobacterium
ATYRGGEAKTDAKDAR

SEQ ID NO: 238412 - protein, 9 aa, Mycobacterium
CKTGADANK

SEQ ID NO: 238413 - protein, 8 aa, Mycobacterium
DAAKNDDS

SEQ ID NO: 238414 - protein, 7 aa, Mycobacterium
DAAPVTQ

SEQ ID NO: 238415 - protein, 9 aa, Mycobacterium
DADGHAPGL

SEQ ID NO: 238416 - protein, 4 aa, Mycobacterium
DAPS

SEQ ID NO: 238417 - protein, 8 aa, Mycobacterium
DDARRDGD

SEQ ID NO: 238418 - protein, 9 aa, Mycobacterium
DEAEGGMGP

SEQ ID NO: 238419 - protein, 5 aa, Mycobacterium
DGFSG

SEQ ID NO: 238420 - protein, 5 aa, Mycobacterium
DGSHG

SEQ ID NO: 238421 - protein, 6 aa, Mycobacterium
DGTAKG

SEQ ID NO: 238422 - protein, 9 aa, Mycobacterium
DIDKNTSYR

SEQ ID NO: 238423 - protein, 5 aa, Mycobacterium
DLPGA

SEQ ID NO: 238424 - protein, 6 aa, Mycobacterium
DNPDFQ

SEQ ID NO: 238425 - protein, 4 aa, Mycobacterium
DPAN

SEQ ID NO: 238426 - protein, 6 aa, Mycobacterium
DPDEGF

SEQ ID NO: 238427 - protein, 5 aa, Mycobacterium
DPRKP

SEQ ID NO: 238428 - protein, 4 aa, Mycobacterium
DPRV

SEQ ID NO: 238429 - protein, 4 aa, Mycobacterium
DPSH

SEQ ID NO: 238430 - protein, 4 aa, Mycobacterium
DPTG

SEQ ID NO: 238431 - protein, 6 aa, Mycobacterium
DRAGSA

SEQ ID NO: 238432 - protein, 5 aa, Mycobacterium
DRFGP

SEQ ID NO: 238433 - protein, 5 aa, Mycobacterium
DRVGR

SEQ ID NO: 238434 - protein, 5 aa, Mycobacterium
DSKPL

SEQ ID NO: 238435 - protein, 4 aa, Mycobacterium
DTAT

SEQ ID NO: 238436 - protein, 5 aa, Mycobacterium
DTPVP

SEQ ID NO: 238437 - protein, 17 aa, Mycobacterium
DTRPEDYEGAEISDGAG

SEQ ID NO: 238438 - protein, 4 aa, Mycobacterium
EAEG

SEQ ID NO: 238439 - protein, 12 aa, Mycobacterium
EARQAGEDRETA

SEQ ID NO: 238440 - protein, 8 aa, Mycobacterium
EDRPGDKR

SEQ ID NO: 238441 - protein, 4 aa, Mycobacterium
EGDD

SEQ ID NO: 238442 - protein, 9 aa, Mycobacterium
EGDDCPDST

SEQ ID NO: 238443 - protein, 8 aa, Mycobacterium
EGYDTEAA

SEQ ID NO: 238444 - protein, 9 aa, Mycobacterium
EPGAPRLPE

SEQ ID NO: 238445 - protein, 7 aa, Mycobacterium
EQRREND

SEQ ID NO: 238446 - protein, 5 aa, Mycobacterium
ERGDL

SEQ ID NO: 238447 - protein, 4 aa, Mycobacterium
ERRD

SEQ ID NO: 238448 - protein, 6 aa, Mycobacterium
ESEASR

SEQ ID NO: 238449 - protein, 7 aa, Mycobacterium
ESRERQA

SEQ ID NO: 238450 - protein, 7 aa, Mycobacterium
FGPAPEG

SEQ ID NO: 238451 - protein, 4 aa, Mycobacterium
FGPR

SEQ ID NO: 238452 - protein, 14 aa, Mycobacterium
FKPESDDVRDSPAL

SEQ ID NO: 238453 - protein, 7 aa, Mycobacterium
FSTTPTT

SEQ ID NO: 238454 - protein, 4 aa, Mycobacterium
GAAL

SEQ ID NO: 238455 - protein, 9 aa, Mycobacterium
GAARTAGAD

SEQ ID NO: 238456 - protein, 9 aa, Mycobacterium
GAGIGDGIA

SEQ ID NO: 238457 - protein, 5 aa, Mycobacterium
GAGTD

SEQ ID NO: 238458 - protein, 7 aa, Mycobacterium
GAKPAAV

SEQ ID NO: 238459 - protein, 5 aa, Mycobacterium
GAPGS

SEQ ID NO: 238460 - protein, 6 aa, Mycobacterium
GAPGSF

SEQ ID NO: 238461 - protein, 12 aa, Mycobacterium
GASLGREGAPRQ

SEQ ID NO: 238462 - protein, 4 aa, Mycobacterium
GAYT

SEQ ID NO: 238463 - protein, 6 aa, Mycobacterium
GDIAPT

SEQ ID NO: 238464 - protein, 9 aa, Mycobacterium
GDNARTAAA

SEQ ID NO: 238465 - protein, 5 aa, Mycobacterium
GDPLS

SEQ ID NO: 238466 - protein, 18 aa, Mycobacterium
GDQYDAGRKVPPSQAKRG

SEQ ID NO: 238467 - protein, 5 aa, Mycobacterium
GDTIG

SEQ ID NO: 238468 - protein, 6 aa, Mycobacterium
GDTPAR

SEQ ID NO: 238469 - protein, 4 aa, Mycobacterium
GELT

SEQ ID NO: 238470 - protein, 7 aa, Mycobacterium
GENSTKY

SEQ ID NO: 238471 - protein, 4 aa, Mycobacterium
GGAP

SEQ ID NO: 238472 - protein, 4 aa, Mycobacterium
GGGD

SEQ ID NO: 238473 - protein, 5 aa, Mycobacterium
GGGTA

SEQ ID NO: 238474 - protein, 4 aa, Mycobacterium
GGNG

SEQ ID NO: 238475 - protein, 6 aa, Mycobacterium
GGTGKV

SEQ ID NO: 238476 - protein, 6 aa, Mycobacterium
GGTPGL

SEQ ID NO: 238477 - protein, 5 aa, Mycobacterium
GGTST

SEQ ID NO: 238478 - protein, 4 aa, Mycobacterium
GHEA

SEQ ID NO: 238479 - protein, 5 aa, Mycobacterium
GHEGS

SEQ ID NO: 238480 - protein, 5 aa, Mycobacterium
GHTHG

SEQ ID NO: 238481 - protein, 4 aa, Mycobacterium
GISG

SEQ ID NO: 238482 - protein, 7 aa, Mycobacterium
GKSPGGI

SEQ ID NO: 238483 - protein, 9 aa, Mycobacterium
GLASSSVGA

SEQ ID NO: 238484 - protein, 8 aa, Mycobacterium
GNANTDGT

SEQ ID NO: 238485 - protein, 6 aa, Mycobacterium
GPAATV

SEQ ID NO: 238486 - protein, 5 aa, Mycobacterium
GPATS

SEQ ID NO: 238487 - protein, 11 aa, Mycobacterium
GPDGQNPPDEV

SEQ ID NO: 238488 - protein, 4 aa, Mycobacterium
GPDY

SEQ ID NO: 238489 - protein, 5 aa, Mycobacterium
GPSPY

SEQ ID NO: 238490 - protein, 6 aa, Mycobacterium
GPTGIA

SEQ ID NO: 238491 - protein, 8 aa, Mycobacterium
GQAASPEQ

SEQ ID NO: 238492 - protein, 6 aa, Mycobacterium
GQRGAS

SEQ ID NO: 238493 - protein, 6 aa, Mycobacterium
GRIPGT

SEQ ID NO: 238494 - protein, 13 aa, Mycobacterium
GRIPGTAAGPSRR

SEQ ID NO: 238495 - protein, 6 aa, Mycobacterium
GRSDLS

SEQ ID NO: 238496 - protein, 5 aa, Mycobacterium
GRYTG

SEQ ID NO: 238497 - protein, 7 aa, Mycobacterium
GSGSVVT

SEQ ID NO: 238498 - protein, 10 aa, Mycobacterium
GSPTDAGTPI

SEQ ID NO: 238499 - protein, 7 aa, Mycobacterium
GSTGGVV

SEQ ID NO: 238500 - protein, 9 aa, Mycobacterium
GSTGSGKST

SEQ ID NO: 238501 - protein, 9 aa, Mycobacterium
GSTGTPKGV

SEQ ID NO: 238502 - protein, 8 aa, Mycobacterium
GSTNGTYL

SEQ ID NO: 238503 - protein, 4 aa, Mycobacterium
GTAT

SEQ ID NO: 238504 - protein, 4 aa, Mycobacterium
GTGI

SEQ ID NO: 238505 - protein, 4 aa, Mycobacterium
GTGT

SEQ ID NO: 238506 - protein, 4 aa, Mycobacterium
GTLT

SEQ ID NO: 238507 - protein, 11 aa, Mycobacterium
GTNPPANQTSA

SEQ ID NO: 238508 - protein, 5 aa, Mycobacterium
GTPGD

SEQ ID NO: 238509 - protein, 7 aa, Mycobacterium
GTQADYS

SEQ ID NO: 238510 - protein, 6 aa, Mycobacterium
GTRDFS

SEQ ID NO: 238511 - protein, 4 aa, Mycobacterium
GTTA

SEQ ID NO: 238512 - protein, 18 aa, Mycobacterium
GTTGTPKGANRSTPPTLA

SEQ ID NO: 238513 - protein, 8 aa, Mycobacterium
GVNDAPAL

SEQ ID NO: 238514 - protein, 8 aa, Mycobacterium
GVNKPSMP

SEQ ID NO: 238515 - protein, 6 aa, Mycobacterium
HAETRV

SEQ ID NO: 238516 - protein, 5 aa, Mycobacterium
HDPGQ

SEQ ID NO: 238517 - protein, 6 aa, Mycobacterium
HGESPT

SEQ ID NO: 238518 - protein, 5 aa, Mycobacterium
HPPIE

SEQ ID NO: 238519 - protein, 6 aa, Mycobacterium
IKGDAS

SEQ ID NO: 238520 - protein, 8 aa, Mycobacterium
INDAPALA

SEQ ID NO: 238521 - protein, 8 aa, Mycobacterium
ITPGGAAD

SEQ ID NO: 238522 - protein, 5 aa, Mycobacterium
ITPRE

SEQ ID NO: 238523 - protein, 4 aa, Mycobacterium
KGAP

SEQ ID NO: 238524 - protein, 8 aa, Mycobacterium
KGGPLPRG

SEQ ID NO: 238525 - protein, 4 aa, Mycobacterium
KGRS

SEQ ID NO: 238526 - protein, 8 aa, Mycobacterium
KKYGKDRQ

SEQ ID NO: 238527 - protein, 7 aa, Mycobacterium
KRGIDPE

SEQ ID NO: 238528 - protein, 12 aa, Mycobacterium
KSASVDDANLLK

SEQ ID NO: 238529 - protein, 8 aa, Mycobacterium
KTGTLTEN

SEQ ID NO: 238530 - protein, 5 aa, Mycobacterium
KWNNS

SEQ ID NO: 238531 - protein, 5 aa, Mycobacterium
LAPSG

SEQ ID NO: 238532 - protein, 11 aa, Mycobacterium
LDEGGDGPHGV

SEQ ID NO: 238533 - protein, 4 aa, Mycobacterium
LEPA

SEQ ID NO: 238534 - protein, 4 aa, Mycobacterium
LGAG

SEQ ID NO: 238535 - protein, 9 aa, Mycobacterium
LGEGPDDLA

SEQ ID NO: 238536 - protein, 8 aa, Mycobacterium
LGTTPSGT

SEQ ID NO: 238537 - protein, 6 aa, Mycobacterium
LNEGRG

SEQ ID NO: 238538 - protein, 4 aa, Mycobacterium
LPET

SEQ ID NO: 238539 - protein, 4 aa, Mycobacterium
LQEP

SEQ ID NO: 238540 - protein, 6 aa, Mycobacterium
LRAESA

SEQ ID NO: 238541 - protein, 7 aa, Mycobacterium
LRPEDKA

SEQ ID NO: 238542 - protein, 4 aa, Mycobacterium
LRRP

SEQ ID NO: 238543 - protein, 13 aa, Mycobacterium
LSEDGKGGPPNNG

SEQ ID NO: 238544 - protein, 5 aa, Mycobacterium
LSPTR

SEQ ID NO: 238545 - protein, 10 aa, Mycobacterium
LSTTLPGGPV

SEQ ID NO: 238546 - protein, 11 aa, Mycobacterium
LTQSKDQPELA

SEQ ID NO: 238547 - protein, 5 aa, Mycobacterium
LTRRS

SEQ ID NO: 238548 - protein, 8 aa, Mycobacterium
NAGVDGSV

SEQ ID NO: 238549 - protein, 6 aa, Mycobacterium
NESPCT

SEQ ID NO: 238550 - protein, 8 aa, Mycobacterium
NFSGGQRQ

SEQ ID NO: 238551 - protein, 5 aa, Mycobacterium
NGSPE

SEQ ID NO: 238552 - protein, 10 aa, Mycobacterium
NGTGKTTTVG

SEQ ID NO: 238553 - protein, 7 aa, Mycobacterium
NGTSTAN

SEQ ID NO: 238554 - protein, 4 aa, Mycobacterium
NPDA

SEQ ID NO: 238555 - protein, 6 aa, Mycobacterium
NPSRYQ

SEQ ID NO: 238556 - protein, 8 aa, Mycobacterium
NRQENRDR

SEQ ID NO: 238557 - protein, 6 aa, Mycobacterium
NTSDDG

SEQ ID NO: 238558 - protein, 4 aa, Mycobacterium
PAAA

SEQ ID NO: 238559 - protein, 7 aa, Mycobacterium
PAGSSTQ

SEQ ID NO: 238560 - protein, 6 aa, Mycobacterium
PDGKAA

SEQ ID NO: 238561 - protein, 6 aa, Mycobacterium
PDGKSA

SEQ ID NO: 238562 - protein, 6 aa, Mycobacterium
PDLGQT

SEQ ID NO: 238563 - protein, 5 aa, Mycobacterium
PDLPR

SEQ ID NO: 238564 - protein, 5 aa, Mycobacterium
PGAPE

SEQ ID NO: 238565 - protein, 7 aa, Mycobacterium
PGGKTAF

SEQ ID NO: 238566 - protein, 4 aa, Mycobacterium
PGGL

SEQ ID NO: 238567 - protein, 6 aa, Mycobacterium
PGGSQH

SEQ ID NO: 238568 - protein, 4 aa, Mycobacterium
PGKQ

SEQ ID NO: 238569 - protein, 4 aa, Mycobacterium
PGTR

SEQ ID NO: 238570 - protein, 11 aa, Mycobacterium
PGVGGHGQPHL

SEQ ID NO: 238571 - protein, 4 aa, Mycobacterium
PHGN

SEQ ID NO: 238572 - protein, 4 aa, Mycobacterium
PHPD

SEQ ID NO: 238573 - protein, 5 aa, Mycobacterium
PKPVT

SEQ ID NO: 238574 - protein, 8 aa, Mycobacterium
PKQAPNAV

SEQ ID NO: 238575 - protein, 5 aa, Mycobacterium
PPEAN

SEQ ID NO: 238576 - protein, 15 aa, Mycobacterium
PQNAEKARDLLARLA

SEQ ID NO: 238577 - protein, 4 aa, Mycobacterium
PRDR

SEQ ID NO: 238578 - protein, 11 aa, Mycobacterium
PRLAPGVPGGT

SEQ ID NO: 238579 - protein, 7 aa, Mycobacterium
PRNPTGK

SEQ ID NO: 238580 - protein, 4 aa, Mycobacterium
PTPA

SEQ ID NO: 238581 - protein, 10 aa, Mycobacterium
QFPGPGRTEH

SEQ ID NO: 238582 - protein, 4 aa, Mycobacterium
QGSA

SEQ ID NO: 238583 - protein, 6 aa, Mycobacterium
QKPGES

SEQ ID NO: 238584 - protein, 5 aa, Mycobacterium
QLGAE

SEQ ID NO: 238585 - protein, 7 aa, Mycobacterium
QPKKAAA

SEQ ID NO: 238586 - protein, 8 aa, Mycobacterium
QSNADEDK

SEQ ID NO: 238587 - protein, 4 aa, Mycobacterium
QTGA

SEQ ID NO: 238588 - protein, 13 aa, Mycobacterium
RAEASGLRGDGGI

SEQ ID NO: 238589 - protein, 7 aa, Mycobacterium
RDGSQTR

SEQ ID NO: 238590 - protein, 10 aa, Mycobacterium
RDNTDQFNTR

SEQ ID NO: 238591 - protein, 7 aa, Mycobacterium
RDSPTWS

SEQ ID NO: 238592 - protein, 10 aa, Mycobacterium
REARTAGRLQ

SEQ ID NO: 238593 - protein, 8 aa, Mycobacterium
RERASGTL

SEQ ID NO: 238594 - protein, 4 aa, Mycobacterium
RGEG

SEQ ID NO: 238595 - protein, 8 aa, Mycobacterium
RGGGPDNV

SEQ ID NO: 238596 - protein, 4 aa, Mycobacterium
RGPA

SEQ ID NO: 238597 - protein, 7 aa, Mycobacterium
RGPMPPH

SEQ ID NO: 238598 - protein, 12 aa, Mycobacterium
RGSTASRSGSGL

SEQ ID NO: 238599 - protein, 8 aa, Mycobacterium
RKKAAAAE

SEQ ID NO: 238600 - protein, 8 aa, Mycobacterium
RKPDGKDL

SEQ ID NO: 238601 - protein, 7 aa, Mycobacterium
RLASAGP

SEQ ID NO: 238602 - protein, 4 aa, Mycobacterium
RLPR

SEQ ID NO: 238603 - protein, 5 aa, Mycobacterium
RLPRR

SEQ ID NO: 238604 - protein, 5 aa, Mycobacterium
RPAPV

SEQ ID NO: 238605 - protein, 11 aa, Mycobacterium
RPDAYTAADKL

SEQ ID NO: 238606 - protein, 11 aa, Mycobacterium
RPKAIRQSGVS

SEQ ID NO: 238607 - protein, 8 aa, Mycobacterium
RPRDAPVR

SEQ ID NO: 238608 - protein, 5 aa, Mycobacterium
RQAET

SEQ ID NO: 238609 - protein, 6 aa, Mycobacterium
RQEAPT

SEQ ID NO: 238610 - protein, 8 aa, Mycobacterium
RQPDGGWG

SEQ ID NO: 238611 - protein, 12 aa, Mycobacterium
RQPKPHQYAQPV

SEQ ID NO: 238612 - protein, 8 aa, Mycobacterium
RREGDGRA

SEQ ID NO: 238613 - protein, 4 aa, Mycobacterium
RRRI

SEQ ID NO: 238614 - protein, 12 aa, Mycobacterium
RRVPERDPRTEV

SEQ ID NO: 238615 - protein, 4 aa, Mycobacterium
RSDR

SEQ ID NO: 238616 - protein, 13 aa, Mycobacterium
RTAGAAQAAGVPN

SEQ ID NO: 238617 - protein, 5 aa, Mycobacterium
RTRTI

SEQ ID NO: 238618 - protein, 7 aa, Mycobacterium
RVGTGNI

SEQ ID NO: 238619 - protein, 5 aa, Mycobacterium
RVTPD

SEQ ID NO: 238620 - protein, 10 aa, Mycobacterium
SAGPGPGPLH

SEQ ID NO: 238621 - protein, 8 aa, Mycobacterium
SAGPRRST

SEQ ID NO: 238622 - protein, 9 aa, Mycobacterium
SAHATSTTA

SEQ ID NO: 238623 - protein, 17 aa, Mycobacterium
SAITADLGSRTMREETD

SEQ ID NO: 238624 - protein, 4 aa, Mycobacterium
SAQV

SEQ ID NO: 238625 - protein, 4 aa, Mycobacterium
SAST

SEQ ID NO: 238626 - protein, 10 aa, Mycobacterium
SATTDEKLTQ

SEQ ID NO: 238627 - protein, 4 aa, Mycobacterium
SEPA

SEQ ID NO: 238628 - protein, 10 aa, Mycobacterium
SEPEGGSDVR

SEQ ID NO: 238629 - protein, 6 aa, Mycobacterium
SGAPRA

SEQ ID NO: 238630 - protein, 4 aa, Mycobacterium
SGEE

SEQ ID NO: 238631 - protein, 6 aa, Mycobacterium
SGVASA

SEQ ID NO: 238632 - protein, 16 aa, Mycobacterium
SLAADPGKAIEGTAYS

SEQ ID NO: 238633 - protein, 5 aa, Mycobacterium
SLPQT

SEQ ID NO: 238634 - protein, 4 aa, Mycobacterium
SMEP

SEQ ID NO: 238635 - protein, 10 aa, Mycobacterium
SNYDSDGYVG

SEQ ID NO: 238636 - protein, 5 aa, Mycobacterium
SPDGK

SEQ ID NO: 238637 - protein, 6 aa, Mycobacterium
SPGEQQ

SEQ ID NO: 238638 - protein, 6 aa, Mycobacterium
SRMRGQ

SEQ ID NO: 238639 - protein, 6 aa, Mycobacterium
SSDPRS

SEQ ID NO: 238640 - protein, 4 aa, Mycobacterium
SSLG

SEQ ID NO: 238641 - protein, 4 aa, Mycobacterium
SSRR

SEQ ID NO: 238642 - protein, 9 aa, Mycobacterium
STGGEYGGA

SEQ ID NO: 238643 - protein, 5 aa, Mycobacterium
STHKS

SEQ ID NO: 238644 - protein, 11 aa, Mycobacterium
STPEDPASARF

SEQ ID NO: 238645 - protein, 13 aa, Mycobacterium
TAAEESLKGTPLE

SEQ ID NO: 238646 - protein, 6 aa, Mycobacterium
TARRPL

SEQ ID NO: 238647 - protein, 6 aa, Mycobacterium
TDLPEG

SEQ ID NO: 238648 - protein, 14 aa, Mycobacterium
TDSSRARASGGTGL

SEQ ID NO: 238649 - protein, 10 aa, Mycobacterium
TEADNIDPQQ

SEQ ID NO: 238650 - protein, 5 aa, Mycobacterium
TEATA

SEQ ID NO: 238651 - protein, 5 aa, Mycobacterium
TERQV

SEQ ID NO: 238652 - protein, 6 aa, Mycobacterium
TGPAAL

SEQ ID NO: 238653 - protein, 8 aa, Mycobacterium
TGPKTAVR

SEQ ID NO: 238654 - protein, 6 aa, Mycobacterium
TGRGAQ

SEQ ID NO: 238655 - protein, 4 aa, Mycobacterium
TGRL

SEQ ID NO: 238656 - protein, 6 aa, Mycobacterium
TIESRA

SEQ ID NO: 238657 - protein, 5 aa, Mycobacterium
TPGPV

SEQ ID NO: 238658 - protein, 7 aa, Mycobacterium
TPSTRSL

SEQ ID NO: 238659 - protein, 6 aa, Mycobacterium
TPTPRM

SEQ ID NO: 238660 - protein, 4 aa, Mycobacterium
TRMS

SEQ ID NO: 238661 - protein, 9 aa, Mycobacterium
TSGSTGSPK

SEQ ID NO: 238662 - protein, 8 aa, Mycobacterium
TSTSPNQQ

SEQ ID NO: 238663 - protein, 8 aa, Mycobacterium
TSTTSGGL

SEQ ID NO: 238664 - protein, 4 aa, Mycobacterium
TTAS

SEQ ID NO: 238665 - protein, 8 aa, Mycobacterium
TTGSGKSE

SEQ ID NO: 238666 - protein, 4 aa, Mycobacterium
TTSR

SEQ ID NO: 238667 - protein, 4 aa, Mycobacterium
TVAE

SEQ ID NO: 238668 - protein, 10 aa, Mycobacterium
VAGPTDPYGV

SEQ ID NO: 238669 - protein, 7 aa, Mycobacterium
VDDPDTG

SEQ ID NO: 238670 - protein, 8 aa, Mycobacterium
VGAGATAE

SEQ ID NO: 238671 - protein, 11 aa, Mycobacterium
VGPSGSGKSTL

SEQ ID NO: 238672 - protein, 8 aa, Mycobacterium
VHSPGAGG

SEQ ID NO: 238673 - protein, 7 aa, Mycobacterium
VIPGDGD

SEQ ID NO: 238674 - protein, 6 aa, Mycobacterium
VNDAPA

SEQ ID NO: 238675 - protein, 8 aa, Mycobacterium
VNDAPALA

SEQ ID NO: 238676 - protein, 4 aa, Mycobacterium
VPGM

SEQ ID NO: 238677 - protein, 6 aa, Mycobacterium
VRPDQK

SEQ ID NO: 238678 - protein, 9 aa, Mycobacterium
VSTSARTIT

SEQ ID NO: 238679 - protein, 6 aa, Mycobacterium
YASTRH

SEQ ID NO: 238680 - protein, 6 aa, Mycobacterium
YGPRPA

SEQ ID NO: 238681 - protein, 6 aa, Mycobacterium
YGPTEA

SEQ ID NO: 238682 - protein, 4 aa, Mycobacterium
YPRE

SEQ ID NO: 238683 - protein, 6 aa, Mycobacterium
AAAAGL

SEQ ID NO: 238684 - protein, 9 aa, Mycobacterium
AAADAAHRA

SEQ ID NO: 238685 - protein, 7 aa, Mycobacterium
AAAGGAA

SEQ ID NO: 238686 - protein, 4 aa, Mycobacterium
AAAS

SEQ ID NO: 238687 - protein, 7 aa, Mycobacterium
AAASPEL

SEQ ID NO: 238688 - protein, 9 aa, Mycobacterium
AAEADSEHP

SEQ ID NO: 238689 - protein, 4 aa, Mycobacterium
AAER

SEQ ID NO: 238690 - protein, 6 aa, Mycobacterium
AAESLG

SEQ ID NO: 238691 - protein, 5 aa, Mycobacterium
AAESV

SEQ ID NO: 238692 - protein, 5 aa, Mycobacterium
AAGAE

SEQ ID NO: 238693 - protein, 4 aa, Mycobacterium
AAGG

SEQ ID NO: 238694 - protein, 6 aa, Mycobacterium
AAGGNI

SEQ ID NO: 238695 - protein, 8 aa, Mycobacterium
AAGKVPPA

SEQ ID NO: 238696 - protein, 4 aa, Mycobacterium
AAGM

SEQ ID NO: 238697 - protein, 4 aa, Mycobacterium
AAGP

SEQ ID NO: 238698 - protein, 8 aa, Mycobacterium
AAGSDVAL

SEQ ID NO: 238699 - protein, 6 aa, Mycobacterium
AAGVGT

SEQ ID NO: 238700 - protein, 9 aa, Mycobacterium
AANNNGSAF

SEQ ID NO: 238701 - protein, 4 aa, Mycobacterium
AAPG

SEQ ID NO: 238702 - protein, 7 aa, Mycobacterium
AAQSPAI

SEQ ID NO: 238703 - protein, 10 aa, Mycobacterium
AARHPSPNAG

SEQ ID NO: 238704 - protein, 6 aa, Mycobacterium
AASSFR

SEQ ID NO: 238705 - protein, 7 aa, Mycobacterium
AASSIAA

SEQ ID NO: 238706 - protein, 4 aa, Mycobacterium
AATI

SEQ ID NO: 238707 - protein, 4 aa, Mycobacterium
ACER

SEQ ID NO: 238708 - protein, 6 aa, Mycobacterium
ACPTDS

SEQ ID NO: 238709 - protein, 6 aa, Mycobacterium
ADEDTV

SEQ ID NO: 238710 - protein, 6 aa, Mycobacterium
ADGTRH

SEQ ID NO: 238711 - protein, 6 aa, Mycobacterium
ADHASP

SEQ ID NO: 238712 - protein, 5 aa, Mycobacterium
ADQNS

SEQ ID NO: 238713 - protein, 5 aa, Mycobacterium
ADRST

SEQ ID NO: 238714 - protein, 6 aa, Mycobacterium
ADVTGG

SEQ ID NO: 238715 - protein, 8 aa, Mycobacterium
AEPDPNAG

SEQ ID NO: 238716 - protein, 10 aa, Mycobacterium
AERDDPDGGA

SEQ ID NO: 238717 - protein, 6 aa, Mycobacterium
AERDGR

SEQ ID NO: 238718 - protein, 12 aa, Mycobacterium
AESGDDSREVIG

SEQ ID NO: 238719 - protein, 12 aa, Mycobacterium
AEYGATDAQLQS

SEQ ID NO: 238720 - protein, 8 aa, Mycobacterium
AFADPESE

SEQ ID NO: 238721 - protein, 4 aa, Mycobacterium
AGAS

SEQ ID NO: 238722 - protein, 7 aa, Mycobacterium
AGDHASV

SEQ ID NO: 238723 - protein, 9 aa, Mycobacterium
AGGSGKTTA

SEQ ID NO: 238724 - protein, 4 aa, Mycobacterium
AGGT

SEQ ID NO: 238725 - protein, 5 aa, Mycobacterium
AGITS

SEQ ID NO: 238726 - protein, 5 aa, Mycobacterium
AGKGA

SEQ ID NO: 238727 - protein, 6 aa, Mycobacterium
AGKGTH

SEQ ID NO: 238728 - protein, 4 aa, Mycobacterium
AGLG

SEQ ID NO: 238729 - protein, 4 aa, Mycobacterium
AGLS

SEQ ID NO: 238730 - protein, 6 aa, Mycobacterium
AGPARL

SEQ ID NO: 238731 - protein, 5 aa, Mycobacterium
AGPER

SEQ ID NO: 238732 - protein, 7 aa, Mycobacterium
AGPNPGH

SEQ ID NO: 238733 - protein, 5 aa, Mycobacterium
AGRRS

SEQ ID NO: 238734 - protein, 4 aa, Mycobacterium
AGSA

SEQ ID NO: 238735 - protein, 8 aa, Mycobacterium
AGSPASRA

SEQ ID NO: 238736 - protein, 15 aa, Mycobacterium
AGTDGSVTYDRGSDG

SEQ ID NO: 238737 - protein, 4 aa, Mycobacterium
AGVP

SEQ ID NO: 238738 - protein, 4 aa, Mycobacterium
AHQP

SEQ ID NO: 238739 - protein, 6 aa, Mycobacterium
AIGPGT

SEQ ID NO: 238740 - protein, 6 aa, Mycobacterium
AITGEN

SEQ ID NO: 238741 - protein, 6 aa, Mycobacterium
AKGLTR

SEQ ID NO: 238742 - protein, 9 aa, Mycobacterium
AKNAKVSTV

SEQ ID NO: 238743 - protein, 5 aa, Mycobacterium
AKQNN

SEQ ID NO: 238744 - protein, 7 aa, Mycobacterium
AKREKQK

SEQ ID NO: 238745 - protein, 7 aa, Mycobacterium
AKYPTGP

SEQ ID NO: 238746 - protein, 7 aa, Mycobacterium
ALRQGTE

SEQ ID NO: 238747 - protein, 11 aa, Mycobacterium
ANDPNQNGGYP

SEQ ID NO: 238748 - protein, 6 aa, Mycobacterium
ANMTGS

SEQ ID NO: 238749 - protein, 6 aa, Mycobacterium
ANPSYA

SEQ ID NO: 238750 - protein, 12 aa, Mycobacterium
ANREVGPGKEAY

SEQ ID NO: 238751 - protein, 7 aa, Mycobacterium
ANTATQH

SEQ ID NO: 238752 - protein, 4 aa, Mycobacterium
APDR

SEQ ID NO: 238753 - protein, 5 aa, Mycobacterium
APENL

SEQ ID NO: 238754 - protein, 5 aa, Mycobacterium
APGEN

SEQ ID NO: 238755 - protein, 6 aa, Mycobacterium
APGVGK

SEQ ID NO: 238756 - protein, 6 aa, Mycobacterium
APLDGG

SEQ ID NO: 238757 - protein, 5 aa, Mycobacterium
APLDP

SEQ ID NO: 238758 - protein, 5 aa, Mycobacterium
APTTS

SEQ ID NO: 238759 - protein, 4 aa, Mycobacterium
APYG

SEQ ID NO: 238760 - protein, 11 aa, Mycobacterium
AQERKGAGQRL

SEQ ID NO: 238761 - protein, 4 aa, Mycobacterium
AQHG

SEQ ID NO: 238762 - protein, 7 aa, Mycobacterium
AQTAQTV

SEQ ID NO: 238763 - protein, 11 aa, Mycobacterium
AQTKTTSTQRF

SEQ ID NO: 238764 - protein, 7 aa, Mycobacterium
AQTTSAL

SEQ ID NO: 238765 - protein, 7 aa, Mycobacterium
ARENGTV

SEQ ID NO: 238766 - protein, 10 aa, Mycobacterium
ARERGGGTRF

SEQ ID NO: 238767 - protein, 9 aa, Mycobacterium
ARKAARIGV

SEQ ID NO: 238768 - protein, 5 aa, Mycobacterium
ARPGN

SEQ ID NO: 238769 - protein, 10 aa, Mycobacterium
ARTDNSGWGD

SEQ ID NO: 238770 - protein, 11 aa, Mycobacterium
ARYTDPNTRSF

SEQ ID NO: 238771 - protein, 5 aa, Mycobacterium
ASEAP

SEQ ID NO: 238772 - protein, 7 aa, Mycobacterium
ASESAKV

SEQ ID NO: 238773 - protein, 9 aa, Mycobacterium
ASGGPEGVG

SEQ ID NO: 238774 - protein, 9 aa, Mycobacterium
ASGGPNCRG

SEQ ID NO: 238775 - protein, 5 aa, Mycobacterium
ASGLP

SEQ ID NO: 238776 - protein, 6 aa, Mycobacterium
ASGYAG

SEQ ID NO: 238777 - protein, 13 aa, Mycobacterium
ASPSISGRYPNLG

SEQ ID NO: 238778 - protein, 9 aa, Mycobacterium
ASSDPETYG

SEQ ID NO: 238779 - protein, 5 aa, Mycobacterium
ASSPA

SEQ ID NO: 238780 - protein, 11 aa, Mycobacterium
ASTAAASGPAI

SEQ ID NO: 238781 - protein, 5 aa, Mycobacterium
ASTDT

SEQ ID NO: 238782 - protein, 4 aa, Mycobacterium
ASWG

SEQ ID NO: 238783 - protein, 4 aa, Mycobacterium
ATAH

SEQ ID NO: 238784 - protein, 5 aa, Mycobacterium
ATDTT

SEQ ID NO: 238785 - protein, 5 aa, Mycobacterium
ATGAI

SEQ ID NO: 238786 - protein, 6 aa, Mycobacterium
ATGGVI

SEQ ID NO: 238787 - protein, 9 aa, Mycobacterium
ATGPPPPAL

SEQ ID NO: 238788 - protein, 4 aa, Mycobacterium
ATPE

SEQ ID NO: 238789 - protein, 4 aa, Mycobacterium
ATPG

SEQ ID NO: 238790 - protein, 4 aa, Mycobacterium
ATRA

SEQ ID NO: 238791 - protein, 5 aa, Mycobacterium
ATRAR

SEQ ID NO: 238792 - protein, 4 aa, Mycobacterium
ATRE

SEQ ID NO: 238793 - protein, 10 aa, Mycobacterium
ATSSVDTRTE

SEQ ID NO: 238794 - protein, 11 aa, Mycobacterium
AVAKGDAHKDD

SEQ ID NO: 238795 - protein, 6 aa, Mycobacterium
AVGADT

SEQ ID NO: 238796 - protein, 4 aa, Mycobacterium
AVPG

SEQ ID NO: 238797 - protein, 8 aa, Mycobacterium
AVRTSSNE

SEQ ID NO: 238798 - protein, 4 aa, Mycobacterium
AVTP

SEQ ID NO: 238799 - protein, 13 aa, Mycobacterium
AYEDRAKKTTKAV

SEQ ID NO: 238800 - protein, 4 aa, Mycobacterium
AYGP

SEQ ID NO: 238801 - protein, 9 aa, Mycobacterium
AYSGESTQG

SEQ ID NO: 238802 - protein, 7 aa, Mycobacterium
AYTTGKY

SEQ ID NO: 238803 - protein, 21 aa, Mycobacterium
CDPDSKAYYQRKRDEGKRPIP

SEQ ID NO: 238804 - protein, 6 aa, Mycobacterium
CPPPRH

SEQ ID NO: 238805 - protein, 4 aa, Mycobacterium
CTPA

SEQ ID NO: 238806 - protein, 9 aa, Mycobacterium
DAAKNDDSF

SEQ ID NO: 238807 - protein, 5 aa, Mycobacterium
DAEPA

SEQ ID NO: 238808 - protein, 8 aa, Mycobacterium
DAGIDPRT

SEQ ID NO: 238809 - protein, 13 aa, Mycobacterium
DASINHGNSGGPL

SEQ ID NO: 238810 - protein, 8 aa, Mycobacterium
DASNYNNT

SEQ ID NO: 238811 - protein, 6 aa, Mycobacterium
DATTQV

SEQ ID NO: 238812 - protein, 7 aa, Mycobacterium
DAVRRTS

SEQ ID NO: 238813 - protein, 6 aa, Mycobacterium
DDAETR

SEQ ID NO: 238814 - protein, 8 aa, Mycobacterium
DDDEPGGD

SEQ ID NO: 238815 - protein, 9 aa, Mycobacterium
DDDEPGGDL

SEQ ID NO: 238816 - protein, 5 aa, Mycobacterium
DDLGG

SEQ ID NO: 238817 - protein, 6 aa, Mycobacterium
DDPDSR

SEQ ID NO: 238818 - protein, 8 aa, Mycobacterium
DDRGCGQV

SEQ ID NO: 238819 - protein, 4 aa, Mycobacterium
DDTK

SEQ ID NO: 238820 - protein, 7 aa, Mycobacterium
DDYKAAG

SEQ ID NO: 238821 - protein, 5 aa, Mycobacterium
DEDLA

SEQ ID NO: 238822 - protein, 4 aa, Mycobacterium
DEER

SEQ ID NO: 238823 - protein, 6 aa, Mycobacterium
DELTPG

SEQ ID NO: 238824 - protein, 4 aa, Mycobacterium
DEMG

SEQ ID NO: 238825 - protein, 11 aa, Mycobacterium
DESAITGESAP

SEQ ID NO: 238826 - protein, 11 aa, Mycobacterium
DETNGYGAKNV

SEQ ID NO: 238827 - protein, 6 aa, Mycobacterium
DEYRGQ

SEQ ID NO: 238828 - protein, 4 aa, Mycobacterium
DGAN

SEQ ID NO: 238829 - protein, 6 aa, Mycobacterium
DGAPAV

SEQ ID NO: 238830 - protein, 7 aa, Mycobacterium
DGATSGI

SEQ ID NO: 238831 - protein, 5 aa, Mycobacterium
DGPDN

SEQ ID NO: 238832 - protein, 6 aa, Mycobacterium
DGRERL

SEQ ID NO: 238833 - protein, 6 aa, Mycobacterium
DGTKRQ

SEQ ID NO: 238834 - protein, 5 aa, Mycobacterium
DGTQE

SEQ ID NO: 238835 - protein, 6 aa, Mycobacterium
DHRERR

SEQ ID NO: 238836 - protein, 7 aa, Mycobacterium
DITRGQE

SEQ ID NO: 238837 - protein, 5 aa, Mycobacterium
DKEWG

SEQ ID NO: 238838 - protein, 8 aa, Mycobacterium
DLSGAGAA

SEQ ID NO: 238839 - protein, 5 aa, Mycobacterium
DMRNT

SEQ ID NO: 238840 - protein, 7 aa, Mycobacterium
DNHATAA

SEQ ID NO: 238841 - protein, 8 aa, Mycobacterium
DNPAQPYL

SEQ ID NO: 238842 - protein, 5 aa, Mycobacterium
DNPDF

SEQ ID NO: 238843 - protein, 9 aa, Mycobacterium
DNTGSPDAW

SEQ ID NO: 238844 - protein, 6 aa, Mycobacterium
DNTTRK

SEQ ID NO: 238845 - protein, 5 aa, Mycobacterium
DPDAE

SEQ ID NO: 238846 - protein, 4 aa, Mycobacterium
DPLG

SEQ ID NO: 238847 - protein, 12 aa, Mycobacterium
DPNPTASSYQPP

SEQ ID NO: 238848 - protein, 5 aa, Mycobacterium
DPPTL

SEQ ID NO: 238849 - protein, 6 aa, Mycobacterium
DPPWPE

SEQ ID NO: 238850 - protein, 4 aa, Mycobacterium
DPRI

SEQ ID NO: 238851 - protein, 8 aa, Mycobacterium
DPTSRSTH

SEQ ID NO: 238852 - protein, 4 aa, Mycobacterium
DQAE

SEQ ID NO: 238853 - protein, 7 aa, Mycobacterium
DQLSGGQ

SEQ ID NO: 238854 - protein, 6 aa, Mycobacterium
DQYSQL

SEQ ID NO: 238855 - protein, 15 aa, Mycobacterium
DRESELRPPVRSGFG

SEQ ID NO: 238856 - protein, 4 aa, Mycobacterium
DRFG

SEQ ID NO: 238857 - protein, 6 aa, Mycobacterium
DRGRTV

SEQ ID NO: 238858 - protein, 4 aa, Mycobacterium
DRIG

SEQ ID NO: 238859 - protein, 4 aa, Mycobacterium
DRLG

SEQ ID NO: 238860 - protein, 4 aa, Mycobacterium
DRPA

SEQ ID NO: 238861 - protein, 4 aa, Mycobacterium
DRVG

SEQ ID NO: 238862 - protein, 7 aa, Mycobacterium
DSDPQAG

SEQ ID NO: 238863 - protein, 6 aa, Mycobacterium
DSKPLD

SEQ ID NO: 238864 - protein, 5 aa, Mycobacterium
DSPAL

SEQ ID NO: 238865 - protein, 6 aa, Mycobacterium
DSSDID

SEQ ID NO: 238866 - protein, 10 aa, Mycobacterium
DSYPTAPAPV

SEQ ID NO: 238867 - protein, 9 aa, Mycobacterium
DTAARRVGT

SEQ ID NO: 238868 - protein, 4 aa, Mycobacterium
DTGL

SEQ ID NO: 238869 - protein, 10 aa, Mycobacterium
DTGTSFGGMG

SEQ ID NO: 238870 - protein, 17 aa, Mycobacterium
DTNAPNAFATGRNPRNA

SEQ ID NO: 238871 - protein, 6 aa, Mycobacterium
DTPRSA

SEQ ID NO: 238872 - protein, 6 aa, Mycobacterium
DTPVST

SEQ ID NO: 238873 - protein, 11 aa, Mycobacterium
DTRYSSSPTPL

SEQ ID NO: 238874 - protein, 7 aa, Mycobacterium
DTSGPGA

SEQ ID NO: 238875 - protein, 4 aa, Mycobacterium
DVPG

SEQ ID NO: 238876 - protein, 11 aa, Mycobacterium
EAAERVARTDD

SEQ ID NO: 238877 - protein, 6 aa, Mycobacterium
EAASEH

SEQ ID NO: 238878 - protein, 5 aa, Mycobacterium
EAEGE

SEQ ID NO: 238879 - protein, 8 aa, Mycobacterium
EAEGGMGP

SEQ ID NO: 238880 - protein, 4 aa, Mycobacterium
EAGS

SEQ ID NO: 238881 - protein, 7 aa, Mycobacterium
EAKADVK

SEQ ID NO: 238882 - protein, 11 aa, Mycobacterium
EARQAGEDRET

SEQ ID NO: 238883 - protein, 12 aa, Mycobacterium
EARRAGEDRESA

SEQ ID NO: 238884 - protein, 5 aa, Mycobacterium
EATQT

SEQ ID NO: 238885 - protein, 7 aa, Mycobacterium
EDEDAAE

SEQ ID NO: 238886 - protein, 7 aa, Mycobacterium
EDIDAGG

SEQ ID NO: 238887 - protein, 23 aa, Mycobacterium
EDPKFASSVRGGGFRAPTARRRL

SEQ ID NO: 238888 - protein, 7 aa, Mycobacterium
EEQSDHP

SEQ ID NO: 238889 - protein, 5 aa, Mycobacterium
EESAH

SEQ ID NO: 238890 - protein, 11 aa, Mycobacterium
EESTALNERIG

SEQ ID NO: 238891 - protein, 10 aa, Mycobacterium
EEVRDPARTI

SEQ ID NO: 238892 - protein, 4 aa, Mycobacterium
EGQA

SEQ ID NO: 238893 - protein, 5 aa, Mycobacterium
EIGAG

SEQ ID NO: 238894 - protein, 11 aa, Mycobacterium
EIGTPPYAGRR

SEQ ID NO: 238895 - protein, 7 aa, Mycobacterium
EKGRGRA

SEQ ID NO: 238896 - protein, 7 aa, Mycobacterium
EKKRTAR

SEQ ID NO: 238897 - protein, 8 aa, Mycobacterium
EKKSLADR

SEQ ID NO: 238898 - protein, 6 aa, Mycobacterium
EKRSLA

SEQ ID NO: 238899 - protein, 9 aa, Mycobacterium
ELAGGDPDT

SEQ ID NO: 238900 - protein, 5 aa, Mycobacterium
ELGAG

SEQ ID NO: 238901 - protein, 10 aa, Mycobacterium
ELPASGGLYP

SEQ ID NO: 238902 - protein, 5 aa, Mycobacterium
ELPGS

SEQ ID NO: 238903 - protein, 7 aa, Mycobacterium
ELRPEAA

SEQ ID NO: 238904 - protein, 7 aa, Mycobacterium
ENARHAG

SEQ ID NO: 238905 - protein, 8 aa, Mycobacterium
ENARQAGQ

SEQ ID NO: 238906 - protein, 6 aa, Mycobacterium
EPGRRQ

SEQ ID NO: 238907 - protein, 4 aa, Mycobacterium
EPLD

SEQ ID NO: 238908 - protein, 4 aa, Mycobacterium
EPLP

SEQ ID NO: 238909 - protein, 11 aa, Mycobacterium
EQARKGASQRL

SEQ ID NO: 238910 - protein, 6 aa, Mycobacterium
ERAARG

SEQ ID NO: 238911 - protein, 7 aa, Mycobacterium
ERPHPGA

SEQ ID NO: 238912 - protein, 7 aa, Mycobacterium
ERTGAAI

SEQ ID NO: 238913 - protein, 7 aa, Mycobacterium
ERTGAKI

SEQ ID NO: 238914 - protein, 5 aa, Mycobacterium
ERTGW

SEQ ID NO: 238915 - protein, 9 aa, Mycobacterium
ESALTGESL

SEQ ID NO: 238916 - protein, 12 aa, Mycobacterium
ESDGDGTTVESH

SEQ ID NO: 238917 - protein, 7 aa, Mycobacterium
ESGEGLA

SEQ ID NO: 238918 - protein, 7 aa, Mycobacterium
ESGFNDA

SEQ ID NO: 238919 - protein, 4 aa, Mycobacterium
ESPE

SEQ ID NO: 238920 - protein, 5 aa, Mycobacterium
ETGPE

SEQ ID NO: 238921 - protein, 5 aa, Mycobacterium
ETSLA

SEQ ID NO: 238922 - protein, 7 aa, Mycobacterium
ETVEGRG

SEQ ID NO: 238923 - protein, 4 aa, Mycobacterium
EVEH

SEQ ID NO: 238924 - protein, 7 aa, Mycobacterium
EVSEREG

SEQ ID NO: 238925 - protein, 5 aa, Mycobacterium
EVTSL

SEQ ID NO: 238926 - protein, 4 aa, Mycobacterium
EVVP

SEQ ID NO: 238927 - protein, 9 aa, Mycobacterium
FDASKNDDS

SEQ ID NO: 238928 - protein, 4 aa, Mycobacterium
FDPR

SEQ ID NO: 238929 - protein, 10 aa, Mycobacterium
FERGEGSMSK

SEQ ID NO: 238930 - protein, 4 aa, Mycobacterium
FGDR

SEQ ID NO: 238931 - protein, 5 aa, Mycobacterium
FGGGT

SEQ ID NO: 238932 - protein, 5 aa, Mycobacterium
FGSGY

SEQ ID NO: 238933 - protein, 9 aa, Mycobacterium
FPDGSPSYE

SEQ ID NO: 238934 - protein, 11 aa, Mycobacterium
FPKGPARNAAT

SEQ ID NO: 238935 - protein, 5 aa, Mycobacterium
FPSSN

SEQ ID NO: 238936 - protein, 8 aa, Mycobacterium
FQESTSTS

SEQ ID NO: 238937 - protein, 7 aa, Mycobacterium
FTPAQAT

SEQ ID NO: 238938 - protein, 8 aa, Mycobacterium
FTPAQATA

SEQ ID NO: 238939 - protein, 4 aa, Mycobacterium
GAAG

SEQ ID NO: 238940 - protein, 5 aa, Mycobacterium
GAAGS

SEQ ID NO: 238941 - protein, 4 aa, Mycobacterium
GAGA

SEQ ID NO: 238942 - protein, 17 aa, Mycobacterium
GALGGKTGYTDDAGQTF

SEQ ID NO: 238943 - protein, 9 aa, Mycobacterium
GARDANDYE

SEQ ID NO: 238944 - protein, 6 aa, Mycobacterium
GATGEF

SEQ ID NO: 238945 - protein, 7 aa, Mycobacterium
GATGPGV

SEQ ID NO: 238946 - protein, 6 aa, Mycobacterium
GATVNT

SEQ ID NO: 238947 - protein, 13 aa, Mycobacterium
GAWTTGNKRGQAH

SEQ ID NO: 238948 - protein, 6 aa, Mycobacterium
GDAGHQ

SEQ ID NO: 238949 - protein, 7 aa, Mycobacterium
GDAGSGA

SEQ ID NO: 238950 - protein, 7 aa, Mycobacterium
GDIAPPT

SEQ ID NO: 238951 - protein, 13 aa, Mycobacterium
GDPKGDGTGGPGY

SEQ ID NO: 238952 - protein, 6 aa, Mycobacterium
GDPPTL

SEQ ID NO: 238953 - protein, 6 aa, Mycobacterium
GDPTEG

SEQ ID NO: 238954 - protein, 7 aa, Mycobacterium
GDRYGRR

SEQ ID NO: 238955 - protein, 6 aa, Mycobacterium
GDTIGR

SEQ ID NO: 238956 - protein, 8 aa, Mycobacterium
GEPQNMPT

SEQ ID NO: 238957 - protein, 5 aa, Mycobacterium
GERLA

SEQ ID NO: 238958 - protein, 6 aa, Mycobacterium
GERVAT

SEQ ID NO: 238959 - protein, 6 aa, Mycobacterium
GESGMP

SEQ ID NO: 238960 - protein, 5 aa, Mycobacterium
GGAGH

SEQ ID NO: 238961 - protein, 4 aa, Mycobacterium
GGAH

SEQ ID NO: 238962 - protein, 6 aa, Mycobacterium
GGANAR

SEQ ID NO: 238963 - protein, 5 aa, Mycobacterium
GGANT

SEQ ID NO: 238964 - protein, 4 aa, Mycobacterium
GGCD

SEQ ID NO: 238965 - protein, 4 aa, Mycobacterium
GGDT

SEQ ID NO: 238966 - protein, 4 aa, Mycobacterium
GGGA

SEQ ID NO: 238967 - protein, 9 aa, Mycobacterium
GGLAGEPED

SEQ ID NO: 238968 - protein, 4 aa, Mycobacterium
GGLG

SEQ ID NO: 238969 - protein, 6 aa, Mycobacterium
GGLGPE

SEQ ID NO: 238970 - protein, 9 aa, Mycobacterium
GGNGSGKST

SEQ ID NO: 238971 - protein, 4 aa, Mycobacterium
GGRA

SEQ ID NO: 238972 - protein, 10 aa, Mycobacterium
GGSGAGKSTL

SEQ ID NO: 238973 - protein, 9 aa, Mycobacterium
GGSGGARDS

SEQ ID NO: 238974 - protein, 8 aa, Mycobacterium
GGSGTSIT

SEQ ID NO: 238975 - protein, 6 aa, Mycobacterium
GGSLSA

SEQ ID NO: 238976 - protein, 18 aa, Mycobacterium
GGSLTGPSRGVDQGAGTV

SEQ ID NO: 238977 - protein, 7 aa, Mycobacterium
GGTGGVV

SEQ ID NO: 238978 - protein, 5 aa, Mycobacterium
GHAHP

SEQ ID NO: 238979 - protein, 12 aa, Mycobacterium
GHSSSGGSHDIA

SEQ ID NO: 238980 - protein, 6 aa, Mycobacterium
GIGRGD

SEQ ID NO: 238981 - protein, 6 aa, Mycobacterium
GKLPDS

SEQ ID NO: 238982 - protein, 4 aa, Mycobacterium
GLGG

SEQ ID NO: 238983 - protein, 14 aa, Mycobacterium
GLGNGQPDTVPAAS

SEQ ID NO: 238984 - protein, 4 aa, Mycobacterium
GLPG

SEQ ID NO: 238985 - protein, 7 aa, Mycobacterium
GLPPGTY

SEQ ID NO: 238986 - protein, 4 aa, Mycobacterium
GLSP

SEQ ID NO: 238987 - protein, 9 aa, Mycobacterium
GLTDPEARV

SEQ ID NO: 238988 - protein, 4 aa, Mycobacterium
GMPR

SEQ ID NO: 238989 - protein, 5 aa, Mycobacterium
GNDAA

SEQ ID NO: 238990 - protein, 8 aa, Mycobacterium
GNGSGKST

SEQ ID NO: 238991 - protein, 12 aa, Mycobacterium
GNPQDSGKIRGQ

SEQ ID NO: 238992 - protein, 4 aa, Mycobacterium
GNQD

SEQ ID NO: 238993 - protein, 8 aa, Mycobacterium
GNVGSKER

SEQ ID NO: 238994 - protein, 4 aa, Mycobacterium
GPAI

SEQ ID NO: 238995 - protein, 5 aa, Mycobacterium
GPAMG

SEQ ID NO: 238996 - protein, 5 aa, Mycobacterium
GPATG

SEQ ID NO: 238997 - protein, 7 aa, Mycobacterium
GPLPVRQ

SEQ ID NO: 238998 - protein, 4 aa, Mycobacterium
GPLR

SEQ ID NO: 238999 - protein, 4 aa, Mycobacterium
GPPV

SEQ ID NO: 239000 - protein, 7 aa, Mycobacterium
GPRPPLR

SEQ ID NO: 239001 - protein, 4 aa, Mycobacterium
GPRY

SEQ ID NO: 239002 - protein, 4 aa, Mycobacterium
GPTE

SEQ ID NO: 239003 - protein, 5 aa, Mycobacterium
GPTGI

SEQ ID NO: 239004 - protein, 6 aa, Mycobacterium
GPVTNG

SEQ ID NO: 239005 - protein, 5 aa, Mycobacterium
GQGNK

SEQ ID NO: 239006 - protein, 5 aa, Mycobacterium
GQLGK

SEQ ID NO: 239007 - protein, 6 aa, Mycobacterium
GQTPGN

SEQ ID NO: 239008 - protein, 10 aa, Mycobacterium
GREPPPGLSA

SEQ ID NO: 239009 - protein, 6 aa, Mycobacterium
GRFDPR

SEQ ID NO: 239010 - protein, 13 aa, Mycobacterium
GRITAEEAHSHPQ

SEQ ID NO: 239011 - protein, 7 aa, Mycobacterium
GRRDPAL

SEQ ID NO: 239012 - protein, 8 aa, Mycobacterium
GRRVQGSA

SEQ ID NO: 239013 - protein, 4 aa, Mycobacterium
GSAA

SEQ ID NO: 239014 - protein, 18 aa, Mycobacterium
GSFTPRHASSSAQTPTPH

SEQ ID NO: 239015 - protein, 10 aa, Mycobacterium
GSGVGKPGAE

SEQ ID NO: 239016 - protein, 8 aa, Mycobacterium
GSHGSGEA

SEQ ID NO: 239017 - protein, 5 aa, Mycobacterium
GSHTG

SEQ ID NO: 239018 - protein, 6 aa, Mycobacterium
GSKVTY

SEQ ID NO: 239019 - protein, 6 aa, Mycobacterium
GSTGGV

SEQ ID NO: 239020 - protein, 4 aa, Mycobacterium
GSTL

SEQ ID NO: 239021 - protein, 7 aa, Mycobacterium
GTATTGR

SEQ ID NO: 239022 - protein, 12 aa, Mycobacterium
GTDQEEAAATLG

SEQ ID NO: 239023 - protein, 8 aa, Mycobacterium
GTIATDQR

SEQ ID NO: 239024 - protein, 7 aa, Mycobacterium
GTITLGN

SEQ ID NO: 239025 - protein, 5 aa, Mycobacterium
GTLTV

SEQ ID NO: 239026 - protein, 9 aa, Mycobacterium
GTPPYRADS

SEQ ID NO: 239027 - protein, 9 aa, Mycobacterium
GTSGSGKSE

SEQ ID NO: 239028 - protein, 8 aa, Mycobacterium
GTTIAGSA

SEQ ID NO: 239029 - protein, 8 aa, Mycobacterium
GTTIPGSA

SEQ ID NO: 239030 - protein, 7 aa, Mycobacterium
GVNDAAA

SEQ ID NO: 239031 - protein, 10 aa, Mycobacterium
GVNDAPAMAG

SEQ ID NO: 239032 - protein, 5 aa, Mycobacterium
GVPGV

SEQ ID NO: 239033 - protein, 9 aa, Mycobacterium
GWSSAGSDP

SEQ ID NO: 239034 - protein, 6 aa, Mycobacterium
GYGPTV

SEQ ID NO: 239035 - protein, 6 aa, Mycobacterium
GYRSDR

SEQ ID NO: 239036 - protein, 8 aa, Mycobacterium
GYTGGGHK

SEQ ID NO: 239037 - protein, 5 aa, Mycobacterium
HAAPG

SEQ ID NO: 239038 - protein, 6 aa, Mycobacterium
HDGAQQ

SEQ ID NO: 239039 - protein, 7 aa, Mycobacterium
HDQPPWT

SEQ ID NO: 239040 - protein, 5 aa, Mycobacterium
HGKEG

SEQ ID NO: 239041 - protein, 6 aa, Mycobacterium
HIGDSR

SEQ ID NO: 239042 - protein, 8 aa, Mycobacterium
HLPSKENG

SEQ ID NO: 239043 - protein, 5 aa, Mycobacterium
HNDPT

SEQ ID NO: 239044 - protein, 8 aa, Mycobacterium
HNGPRTDF

SEQ ID NO: 239045 - protein, 4 aa, Mycobacterium
HPPT

SEQ ID NO: 239046 - protein, 9 aa, Mycobacterium
HQRPKLERY

SEQ ID NO: 239047 - protein, 4 aa, Mycobacterium
HRTG

SEQ ID NO: 239048 - protein, 11 aa, Mycobacterium
HSDKEGATPTF

SEQ ID NO: 239049 - protein, 7 aa, Mycobacterium
HSPRNTW

SEQ ID NO: 239050 - protein, 8 aa, Mycobacterium
HSQAPAPV

SEQ ID NO: 239051 - protein, 4 aa, Mycobacterium
HTPE

SEQ ID NO: 239052 - protein, 5 aa, Mycobacterium
HWDSP

SEQ ID NO: 239053 - protein, 6 aa, Mycobacterium
IDGAGE

SEQ ID NO: 239054 - protein, 8 aa, Mycobacterium
IDNAGNAA

SEQ ID NO: 239055 - protein, 5 aa, Mycobacterium
IDNVQ

SEQ ID NO: 239056 - protein, 8 aa, Mycobacterium
IGGPPEQV

SEQ ID NO: 239057 - protein, 4 aa, Mycobacterium
IGPS

SEQ ID NO: 239058 - protein, 5 aa, Mycobacterium
IGRQG

SEQ ID NO: 239059 - protein, 5 aa, Mycobacterium
IHDGP

SEQ ID NO: 239060 - protein, 9 aa, Mycobacterium
IKTTDADIE

SEQ ID NO: 239061 - protein, 5 aa, Mycobacterium
INGTG

SEQ ID NO: 239062 - protein, 5 aa, Mycobacterium
IPPGA

SEQ ID NO: 239063 - protein, 17 aa, Mycobacterium
IRTGPGLRQQADQAQNA

SEQ ID NO: 239064 - protein, 6 aa, Mycobacterium
ITAAGA

SEQ ID NO: 239065 - protein, 13 aa, Mycobacterium
ITGGGAKAVGNAV

SEQ ID NO: 239066 - protein, 28 aa, Mycobacterium
KETMPTNPDNPKGAFTAARTAKDQGVPI

SEQ ID NO: 239067 - protein, 4 aa, Mycobacterium
KGAA

SEQ ID NO: 239068 - protein, 5 aa, Mycobacterium
KGAPQ

SEQ ID NO: 239069 - protein, 6 aa, Mycobacterium
KGEAGA

SEQ ID NO: 239070 - protein, 8 aa, Mycobacterium
KGEAGADS

SEQ ID NO: 239071 - protein, 8 aa, Mycobacterium
KGGPTQGA

SEQ ID NO: 239072 - protein, 8 aa, Mycobacterium
KGGSAVKP

SEQ ID NO: 239073 - protein, 8 aa, Mycobacterium
KGPHPATY

SEQ ID NO: 239074 - protein, 5 aa, Mycobacterium
KGRRR

SEQ ID NO: 239075 - protein, 6 aa, Mycobacterium
KGSPEV

SEQ ID NO: 239076 - protein, 13 aa, Mycobacterium
KKSVTEVAEELKA

SEQ ID NO: 239077 - protein, 7 aa, Mycobacterium
KLAEEAS

SEQ ID NO: 239078 - protein, 5 aa, Mycobacterium
KLAGG

SEQ ID NO: 239079 - protein, 6 aa, Mycobacterium
KLPPSI

SEQ ID NO: 239080 - protein, 8 aa, Mycobacterium
KPQGRNAR

SEQ ID NO: 239081 - protein, 8 aa, Mycobacterium
KPTSTVKD

SEQ ID NO: 239082 - protein, 13 aa, Mycobacterium
KRGIGEPKADRTR

SEQ ID NO: 239083 - protein, 8 aa, Mycobacterium
KRKLERQL

SEQ ID NO: 239084 - protein, 6 aa, Mycobacterium
KSAQVP

SEQ ID NO: 239085 - protein, 10 aa, Mycobacterium
KTGTLTRNQP

SEQ ID NO: 239086 - protein, 6 aa, Mycobacterium
LAASTM

SEQ ID NO: 239087 - protein, 11 aa, Mycobacterium
LAKDAAGDKWS

SEQ ID NO: 239088 - protein, 5 aa, Mycobacterium
LAPEA

SEQ ID NO: 239089 - protein, 11 aa, Mycobacterium
LARTDNSGWGD

SEQ ID NO: 239090 - protein, 6 aa, Mycobacterium
LDEPTD

SEQ ID NO: 239091 - protein, 12 aa, Mycobacterium
LDGDGAPREGAQ

SEQ ID NO: 239092 - protein, 7 aa, Mycobacterium
LDGRADQ

SEQ ID NO: 239093 - protein, 6 aa, Mycobacterium
LDPDDL

SEQ ID NO: 239094 - protein, 7 aa, Mycobacterium
LDRRPKG

SEQ ID NO: 239095 - protein, 4 aa, Mycobacterium
LEGR

SEQ ID NO: 239096 - protein, 5 aa, Mycobacterium
LESTR

SEQ ID NO: 239097 - protein, 9 aa, Mycobacterium
LGAASSSCS

SEQ ID NO: 239098 - protein, 5 aa, Mycobacterium
LGATA

SEQ ID NO: 239099 - protein, 5 aa, Mycobacterium
LGDET

SEQ ID NO: 239100 - protein, 8 aa, Mycobacterium
LGPGPRDG

SEQ ID NO: 239101 - protein, 4 aa, Mycobacterium
LGQG

SEQ ID NO: 239102 - protein, 6 aa, Mycobacterium
LGVQDG

SEQ ID NO: 239103 - protein, 4 aa, Mycobacterium
LGVS

SEQ ID NO: 239104 - protein, 5 aa, Mycobacterium
LGVSG

SEQ ID NO: 239105 - protein, 4 aa, Mycobacterium
LKPE

SEQ ID NO: 239106 - protein, 6 aa, Mycobacterium
LKPTEA

SEQ ID NO: 239107 - protein, 4 aa, Mycobacterium
LNPD

SEQ ID NO: 239108 - protein, 5 aa, Mycobacterium
LPAQA

SEQ ID NO: 239109 - protein, 5 aa, Mycobacterium
LPDHE

SEQ ID NO: 239110 - protein, 4 aa, Mycobacterium
LPED

SEQ ID NO: 239111 - protein, 12 aa, Mycobacterium
LPPDTTKEDREQ

SEQ ID NO: 239112 - protein, 9 aa, Mycobacterium
LQGGSTITQ

SEQ ID NO: 239113 - protein, 7 aa, Mycobacterium
LQPGGPV

SEQ ID NO: 239114 - protein, 8 aa, Mycobacterium
LRETNRER

SEQ ID NO: 239115 - protein, 5 aa, Mycobacterium
LSGGQ

SEQ ID NO: 239116 - protein, 10 aa, Mycobacterium
LSGGQRKRAS

SEQ ID NO: 239117 - protein, 7 aa, Mycobacterium
LSPRDDG

SEQ ID NO: 239118 - protein, 12 aa, Mycobacterium
LTPGRGFRNGPF

SEQ ID NO: 239119 - protein, 5 aa, Mycobacterium
LTSSN

SEQ ID NO: 239120 - protein, 6 aa, Mycobacterium
MADGEK

SEQ ID NO: 239121 - protein, 4 aa, Mycobacterium
MATS

SEQ ID NO: 239122 - protein, 13 aa, Mycobacterium
MRSGADDPDGASG

SEQ ID NO: 239123 - protein, 7 aa, Mycobacterium
NAAAGSI

SEQ ID NO: 239124 - protein, 7 aa, Mycobacterium
NAGGGNI

SEQ ID NO: 239125 - protein, 4 aa, Mycobacterium
NAGR

SEQ ID NO: 239126 - protein, 6 aa, Mycobacterium
NAYSGS

SEQ ID NO: 239127 - protein, 16 aa, Mycobacterium
NDAGGVATYAQAGQNY

SEQ ID NO: 239128 - protein, 4 aa, Mycobacterium
NDAQ

SEQ ID NO: 239129 - protein, 6 aa, Mycobacterium
NDPPPC

SEQ ID NO: 239130 - protein, 8 aa, Mycobacterium
NDSNTAAT

SEQ ID NO: 239131 - protein, 10 aa, Mycobacterium
NETPAPLRDA

SEQ ID NO: 239132 - protein, 5 aa, Mycobacterium
NGRFT

SEQ ID NO: 239133 - protein, 13 aa, Mycobacterium
NGTPDYGAPARLD

SEQ ID NO: 239134 - protein, 8 aa, Mycobacterium
NHSPDDIE

SEQ ID NO: 239135 - protein, 8 aa, Mycobacterium
NLGKDERH

SEQ ID NO: 239136 - protein, 8 aa, Mycobacterium
NNPTSSPY

SEQ ID NO: 239137 - protein, 7 aa, Mycobacterium
NPNRSLP

SEQ ID NO: 239138 - protein, 6 aa, Mycobacterium
NPPVSA

SEQ ID NO: 239139 - protein, 6 aa, Mycobacterium
NPTSRM

SEQ ID NO: 239140 - protein, 5 aa, Mycobacterium
NQLQS

SEQ ID NO: 239141 - protein, 4 aa, Mycobacterium
NQTD

SEQ ID NO: 239142 - protein, 4 aa, Mycobacterium
NSGA

SEQ ID NO: 239143 - protein, 4 aa, Mycobacterium
NSGF

SEQ ID NO: 239144 - protein, 9 aa, Mycobacterium
NSPGMGDDA

SEQ ID NO: 239145 - protein, 6 aa, Mycobacterium
NTGSVI

SEQ ID NO: 239146 - protein, 5 aa, Mycobacterium
NTPGW

SEQ ID NO: 239147 - protein, 7 aa, Mycobacterium
NTRSPLD

SEQ ID NO: 239148 - protein, 5 aa, Mycobacterium
NVPAR

SEQ ID NO: 239149 - protein, 4 aa, Mycobacterium
PAAF

SEQ ID NO: 239150 - protein, 4 aa, Mycobacterium
PAAI

SEQ ID NO: 239151 - protein, 4 aa, Mycobacterium
PAGS

SEQ ID NO: 239152 - protein, 5 aa, Mycobacterium
PALIG

SEQ ID NO: 239153 - protein, 4 aa, Mycobacterium
PALS

SEQ ID NO: 239154 - protein, 12 aa, Mycobacterium
PAPGDPTPSAPS

SEQ ID NO: 239155 - protein, 7 aa, Mycobacterium
PARTPVM

SEQ ID NO: 239156 - protein, 6 aa, Mycobacterium
PAVKTG

SEQ ID NO: 239157 - protein, 5 aa, Mycobacterium
PDDTT

SEQ ID NO: 239158 - protein, 4 aa, Mycobacterium
PDGH

SEQ ID NO: 239159 - protein, 4 aa, Mycobacterium
PDGV

SEQ ID NO: 239160 - protein, 6 aa, Mycobacterium
PDLPTT

SEQ ID NO: 239161 - protein, 8 aa, Mycobacterium
PEASPTLP

SEQ ID NO: 239162 - protein, 5 aa, Mycobacterium
PEESK

SEQ ID NO: 239163 - protein, 4 aa, Mycobacterium
PEGL

SEQ ID NO: 239164 - protein, 4 aa, Mycobacterium
PESR

SEQ ID NO: 239165 - protein, 8 aa, Mycobacterium
PETKGRQL

SEQ ID NO: 239166 - protein, 8 aa, Mycobacterium
PGDRPRGQ

SEQ ID NO: 239167 - protein, 13 aa, Mycobacterium
PGNDGNEARNLGQ

SEQ ID NO: 239168 - protein, 5 aa, Mycobacterium
PGPLR

SEQ ID NO: 239169 - protein, 7 aa, Mycobacterium
PGRPAPR

SEQ ID NO: 239170 - protein, 7 aa, Mycobacterium
PGSDPFS

SEQ ID NO: 239171 - protein, 8 aa, Mycobacterium
PHQRSGGA

SEQ ID NO: 239172 - protein, 8 aa, Mycobacterium
PIDGRADQ

SEQ ID NO: 239173 - protein, 4 aa, Mycobacterium
PLGR

SEQ ID NO: 239174 - protein, 11 aa, Mycobacterium
PLSGEGSDTDT

SEQ ID NO: 239175 - protein, 14 aa, Mycobacterium
PLSPDPGPPLTLQA

SEQ ID NO: 239176 - protein, 4 aa, Mycobacterium
PLST

SEQ ID NO: 239177 - protein, 7 aa, Mycobacterium
PLTPPET

SEQ ID NO: 239178 - protein, 5 aa, Mycobacterium
PPEDR

SEQ ID NO: 239179 - protein, 6 aa, Mycobacterium
PPGQPV

SEQ ID NO: 239180 - protein, 4 aa, Mycobacterium
PQPA

SEQ ID NO: 239181 - protein, 4 aa, Mycobacterium
PQTL

SEQ ID NO: 239182 - protein, 4 aa, Mycobacterium
PRDL

SEQ ID NO: 239183 - protein, 6 aa, Mycobacterium
PRPEAS

SEQ ID NO: 239184 - protein, 4 aa, Mycobacterium
PRTG

SEQ ID NO: 239185 - protein, 5 aa, Mycobacterium
PRTLG

SEQ ID NO: 239186 - protein, 8 aa, Mycobacterium
PSAPVAPR

SEQ ID NO: 239187 - protein, 4 aa, Mycobacterium
PSDG

SEQ ID NO: 239188 - protein, 4 aa, Mycobacterium
PSDR

SEQ ID NO: 239189 - protein, 4 aa, Mycobacterium
PSEG

SEQ ID NO: 239190 - protein, 6 aa, Mycobacterium
PSGGPL

SEQ ID NO: 239191 - protein, 8 aa, Mycobacterium
PSGQATSF

SEQ ID NO: 239192 - protein, 5 aa, Mycobacterium
PSPLP

SEQ ID NO: 239193 - protein, 6 aa, Mycobacterium
PTEQLD

SEQ ID NO: 239194 - protein, 4 aa, Mycobacterium
PTGN

SEQ ID NO: 239195 - protein, 4 aa, Mycobacterium
PTPG

SEQ ID NO: 239196 - protein, 4 aa, Mycobacterium
PTPT

SEQ ID NO: 239197 - protein, 6 aa, Mycobacterium
PTWSRP

SEQ ID NO: 239198 - protein, 5 aa, Mycobacterium
PTYSN

SEQ ID NO: 239199 - protein, 6 aa, Mycobacterium
PVNEAA

SEQ ID NO: 239200 - protein, 4 aa, Mycobacterium
PVTG

SEQ ID NO: 239201 - protein, 7 aa, Mycobacterium
QAADTGA

SEQ ID NO: 239202 - protein, 11 aa, Mycobacterium
QAERSRDPERR

SEQ ID NO: 239203 - protein, 4 aa, Mycobacterium
QALT

SEQ ID NO: 239204 - protein, 9 aa, Mycobacterium
QAQSSGSQV

SEQ ID NO: 239205 - protein, 12 aa, Mycobacterium
QDNKGTYEVGRP

SEQ ID NO: 239206 - protein, 8 aa, Mycobacterium
QDPAKDTL

SEQ ID NO: 239207 - protein, 9 aa, Mycobacterium
QDPAKDTLP

SEQ ID NO: 239208 - protein, 6 aa, Mycobacterium
QEGRGA

SEQ ID NO: 239209 - protein, 8 aa, Mycobacterium
QEKKRTAR

SEQ ID NO: 239210 - protein, 6 aa, Mycobacterium
QGAIQG

SEQ ID NO: 239211 - protein, 10 aa, Mycobacterium
QGELSTSDDH

SEQ ID NO: 239212 - protein, 7 aa, Mycobacterium
QGPTLSR

SEQ ID NO: 239213 - protein, 4 aa, Mycobacterium
QGSG

SEQ ID NO: 239214 - protein, 4 aa, Mycobacterium
QGSP

SEQ ID NO: 239215 - protein, 12 aa, Mycobacterium
QGVGSAIASPTG

SEQ ID NO: 239216 - protein, 6 aa, Mycobacterium
QHAEAN

SEQ ID NO: 239217 - protein, 4 aa, Mycobacterium
QHGI

SEQ ID NO: 239218 - protein, 5 aa, Mycobacterium
QIAQT

SEQ ID NO: 239219 - protein, 7 aa, Mycobacterium
QISGPQQ

SEQ ID NO: 239220 - protein, 9 aa, Mycobacterium
QKTKTREEV

SEQ ID NO: 239221 - protein, 5 aa, Mycobacterium
QNPDF

SEQ ID NO: 239222 - protein, 15 aa, Mycobacterium
QNSARTTAGSDNASG

SEQ ID NO: 239223 - protein, 8 aa, Mycobacterium
QPGKRAPT

SEQ ID NO: 239224 - protein, 5 aa, Mycobacterium
QPIAP

SEQ ID NO: 239225 - protein, 11 aa, Mycobacterium
QRQPVPVDDET

SEQ ID NO: 239226 - protein, 10 aa, Mycobacterium
QTKGASHTQQ

SEQ ID NO: 239227 - protein, 6 aa, Mycobacterium
QTPATA

SEQ ID NO: 239228 - protein, 5 aa, Mycobacterium
QTPDF

SEQ ID NO: 239229 - protein, 5 aa, Mycobacterium
QVPPA

SEQ ID NO: 239230 - protein, 6 aa, Mycobacterium
QVRSTR

SEQ ID NO: 239231 - protein, 5 aa, Mycobacterium
RAASA

SEQ ID NO: 239232 - protein, 14 aa, Mycobacterium
RADNALTGEDESAI

SEQ ID NO: 239233 - protein, 5 aa, Mycobacterium
RAGGS

SEQ ID NO: 239234 - protein, 5 aa, Mycobacterium
RAGTP

SEQ ID NO: 239235 - protein, 7 aa, Mycobacterium
RAQPHRR

SEQ ID NO: 239236 - protein, 14 aa, Mycobacterium
RAQSGGKWPPPPTE

SEQ ID NO: 239237 - protein, 7 aa, Mycobacterium
RARERDS

SEQ ID NO: 239238 - protein, 4 aa, Mycobacterium
RDGA

SEQ ID NO: 239239 - protein, 11 aa, Mycobacterium
RDGKATTLGAA

SEQ ID NO: 239240 - protein, 8 aa, Mycobacterium
RDKRDEVE

SEQ ID NO: 239241 - protein, 6 aa, Mycobacterium
RDLRNP

SEQ ID NO: 239242 - protein, 8 aa, Mycobacterium
RDPTSRRP

SEQ ID NO: 239243 - protein, 6 aa, Mycobacterium
RDQGPI

SEQ ID NO: 239244 - protein, 10 aa, Mycobacterium
REAEAERERR

SEQ ID NO: 239245 - protein, 7 aa, Mycobacterium
RECGRTT

SEQ ID NO: 239246 - protein, 9 aa, Mycobacterium
REDRPGDKR

SEQ ID NO: 239247 - protein, 8 aa, Mycobacterium
REEETRIS

SEQ ID NO: 239248 - protein, 4 aa, Mycobacterium
REGV

SEQ ID NO: 239249 - protein, 4 aa, Mycobacterium
REGY

SEQ ID NO: 239250 - protein, 4 aa, Mycobacterium
REPR

SEQ ID NO: 239251 - protein, 4 aa, Mycobacterium
RERE

SEQ ID NO: 239252 - protein, 6 aa, Mycobacterium
RFSPRQ

SEQ ID NO: 239253 - protein, 6 aa, Mycobacterium
RFTPTS

SEQ ID NO: 239254 - protein, 15 aa, Mycobacterium
RGDTSRSRKGGSTGL

SEQ ID NO: 239255 - protein, 5 aa, Mycobacterium
RGEDD

SEQ ID NO: 239256 - protein, 24 aa, Mycobacterium
RGELQASEELREAAETLSKSPASL

SEQ ID NO: 239257 - protein, 4 aa, Mycobacterium
RGKW

SEQ ID NO: 239258 - protein, 6 aa, Mycobacterium
RGRYQG

SEQ ID NO: 239259 - protein, 4 aa, Mycobacterium
RGSG

SEQ ID NO: 239260 - protein, 4 aa, Mycobacterium
RGSY

SEQ ID NO: 239261 - protein, 4 aa, Mycobacterium
RGTG

SEQ ID NO: 239262 - protein, 4 aa, Mycobacterium
RGVT

SEQ ID NO: 239263 - protein, 4 aa, Mycobacterium
RHPA

SEQ ID NO: 239264 - protein, 4 aa, Mycobacterium
RIGR

SEQ ID NO: 239265 - protein, 5 aa, Mycobacterium
RIGRK

SEQ ID NO: 239266 - protein, 5 aa, Mycobacterium
RKEDK

SEQ ID NO: 239267 - protein, 13 aa, Mycobacterium
RKEGQSGQAKMTQ

SEQ ID NO: 239268 - protein, 7 aa, Mycobacterium
RLDEGRL

SEQ ID NO: 239269 - protein, 5 aa, Mycobacterium
RLERG

SEQ ID NO: 239270 - protein, 5 aa, Mycobacterium
RLPRQ

SEQ ID NO: 239271 - protein, 5 aa, Mycobacterium
RLRGK

SEQ ID NO: 239272 - protein, 7 aa, Mycobacterium
RLTKEKR

SEQ ID NO: 239273 - protein, 9 aa, Mycobacterium
RMESTDSVG

SEQ ID NO: 239274 - protein, 4 aa, Mycobacterium
RPDL

SEQ ID NO: 239275 - protein, 8 aa, Mycobacterium
RPDNPQTL

SEQ ID NO: 239276 - protein, 4 aa, Mycobacterium
RPGA

SEQ ID NO: 239277 - protein, 8 aa, Mycobacterium
RPGAGDRV

SEQ ID NO: 239278 - protein, 5 aa, Mycobacterium
RPGIG

SEQ ID NO: 239279 - protein, 8 aa, Mycobacterium
RPGKPTAD

SEQ ID NO: 239280 - protein, 12 aa, Mycobacterium
RPGSAGSNSAAD

SEQ ID NO: 239281 - protein, 4 aa, Mycobacterium
RPGT

SEQ ID NO: 239282 - protein, 7 aa, Mycobacterium
RPLGSPI

SEQ ID NO: 239283 - protein, 7 aa, Mycobacterium
RPLPGAG

SEQ ID NO: 239284 - protein, 4 aa, Mycobacterium
RQGA

SEQ ID NO: 239285 - protein, 5 aa, Mycobacterium
RQPNL

SEQ ID NO: 239286 - protein, 10 aa, Mycobacterium
RQRARAEDRI

SEQ ID NO: 239287 - protein, 4 aa, Mycobacterium
RRGA

SEQ ID NO: 239288 - protein, 10 aa, Mycobacterium
RRGGTGDTVE

SEQ ID NO: 239289 - protein, 6 aa, Mycobacterium
RRGRSL

SEQ ID NO: 239290 - protein, 4 aa, Mycobacterium
RRRN

SEQ ID NO: 239291 - protein, 7 aa, Mycobacterium
RSGGAAR

SEQ ID NO: 239292 - protein, 6 aa, Mycobacterium
RSHAEG

SEQ ID NO: 239293 - protein, 9 aa, Mycobacterium
RSPQSPNGT

SEQ ID NO: 239294 - protein, 5 aa, Mycobacterium
RSREM

SEQ ID NO: 239295 - protein, 14 aa, Mycobacterium
RSREYQADESGAVL

SEQ ID NO: 239296 - protein, 18 aa, Mycobacterium
RSREYQADQSGAELTGDP

SEQ ID NO: 239297 - protein, 5 aa, Mycobacterium
RTERY

SEQ ID NO: 239298 - protein, 4 aa, Mycobacterium
RTGA

SEQ ID NO: 239299 - protein, 4 aa, Mycobacterium
RTGE

SEQ ID NO: 239300 - protein, 4 aa, Mycobacterium
RTGR

SEQ ID NO: 239301 - protein, 11 aa, Mycobacterium
RTPTPAPTPPS

SEQ ID NO: 239302 - protein, 6 aa, Mycobacterium
RTRPAS

SEQ ID NO: 239303 - protein, 8 aa, Mycobacterium
RTTGGFGQ

SEQ ID NO: 239304 - protein, 13 aa, Mycobacterium
RTWQPESPPNIAA

SEQ ID NO: 239305 - protein, 4 aa, Mycobacterium
RVGR

SEQ ID NO: 239306 - protein, 8 aa, Mycobacterium
RVGSDTQL

SEQ ID NO: 239307 - protein, 4 aa, Mycobacterium
RYSH

SEQ ID NO: 239308 - protein, 5 aa, Mycobacterium
SAAAE

SEQ ID NO: 239309 - protein, 4 aa, Mycobacterium
SAAG

SEQ ID NO: 239310 - protein, 8 aa, Mycobacterium
SAAGAASL

SEQ ID NO: 239311 - protein, 8 aa, Mycobacterium
SADPAKPI

SEQ ID NO: 239312 - protein, 7 aa, Mycobacterium
SAPTAVR

SEQ ID NO: 239313 - protein, 4 aa, Mycobacterium
SAQH

SEQ ID NO: 239314 - protein, 9 aa, Mycobacterium
SATDGASVA

SEQ ID NO: 239315 - protein, 5 aa, Mycobacterium
SDATV

SEQ ID NO: 239316 - protein, 4 aa, Mycobacterium
SEGA

SEQ ID NO: 239317 - protein, 6 aa, Mycobacterium
SEGSVR

SEQ ID NO: 239318 - protein, 4 aa, Mycobacterium
SERQ

SEQ ID NO: 239319 - protein, 5 aa, Mycobacterium
SFPSR

SEQ ID NO: 239320 - protein, 14 aa, Mycobacterium
SGAYRATKVGREAY

SEQ ID NO: 239321 - protein, 5 aa, Mycobacterium
SGEEI

SEQ ID NO: 239322 - protein, 6 aa, Mycobacterium
SGEWSK

SEQ ID NO: 239323 - protein, 15 aa, Mycobacterium
SGGPAGVGVATGNAV

SEQ ID NO: 239324 - protein, 8 aa, Mycobacterium
SGGPEGVG

SEQ ID NO: 239325 - protein, 6 aa, Mycobacterium
SGGRSN

SEQ ID NO: 239326 - protein, 6 aa, Mycobacterium
SGHPPG

SEQ ID NO: 239327 - protein, 7 aa, Mycobacterium
SGIGGEY

SEQ ID NO: 239328 - protein, 4 aa, Mycobacterium
SGLA

SEQ ID NO: 239329 - protein, 4 aa, Mycobacterium
SGPI

SEQ ID NO: 239330 - protein, 9 aa, Mycobacterium
SGRPLEREP

SEQ ID NO: 239331 - protein, 10 aa, Mycobacterium
SGSTGRPKGV

SEQ ID NO: 239332 - protein, 11 aa, Mycobacterium
SGTTGSGKSTL

SEQ ID NO: 239333 - protein, 9 aa, Mycobacterium
SGTTGVPKG

SEQ ID NO: 239334 - protein, 7 aa, Mycobacterium
SGTTPKL

SEQ ID NO: 239335 - protein, 5 aa, Mycobacterium
SGVAV

SEQ ID NO: 239336 - protein, 6 aa, Mycobacterium
SGVTTQ

SEQ ID NO: 239337 - protein, 7 aa, Mycobacterium
SHLEQAG

SEQ ID NO: 239338 - protein, 9 aa, Mycobacterium
SIGQAGSTI

SEQ ID NO: 239339 - protein, 8 aa, Mycobacterium
SIPPPEGK

SEQ ID NO: 239340 - protein, 6 aa, Mycobacterium
SISDPL

SEQ ID NO: 239341 - protein, 5 aa, Mycobacterium
SKAYF

SEQ ID NO: 239342 - protein, 4 aa, Mycobacterium
SKNP

SEQ ID NO: 239343 - protein, 6 aa, Mycobacterium
SLDGGG

SEQ ID NO: 239344 - protein, 6 aa, Mycobacterium
SLGEAA

SEQ ID NO: 239345 - protein, 5 aa, Mycobacterium
SNPDE

SEQ ID NO: 239346 - protein, 19 aa, Mycobacterium
SPAADPSTSVRGNRVNGAQ

SEQ ID NO: 239347 - protein, 5 aa, Mycobacterium
SPAAF

SEQ ID NO: 239348 - protein, 6 aa, Mycobacterium
SPAQRA

SEQ ID NO: 239349 - protein, 8 aa, Mycobacterium
SPDGKTAR

SEQ ID NO: 239350 - protein, 7 aa, Mycobacterium
SPDGSVA

SEQ ID NO: 239351 - protein, 4 aa, Mycobacterium
SPEQ

SEQ ID NO: 239352 - protein, 5 aa, Mycobacterium
SPEQK

SEQ ID NO: 239353 - protein, 20 aa, Mycobacterium
SPQGGGPVNAYPPSRPGEKN

SEQ ID NO: 239354 - protein, 9 aa, Mycobacterium
SPQIETTKA

SEQ ID NO: 239355 - protein, 8 aa, Mycobacterium
SPTDAAAV

SEQ ID NO: 239356 - protein, 6 aa, Mycobacterium
SQLPPQ

SEQ ID NO: 239357 - protein, 14 aa, Mycobacterium
SRAKQLSKDMPKTT

SEQ ID NO: 239358 - protein, 8 aa, Mycobacterium
SRTGGAPT

SEQ ID NO: 239359 - protein, 9 aa, Mycobacterium
SSEAQTVSA

SEQ ID NO: 239360 - protein, 8 aa, Mycobacterium
SSLNGKPV

SEQ ID NO: 239361 - protein, 5 aa, Mycobacterium
SSTDA

SEQ ID NO: 239362 - protein, 7 aa, Mycobacterium
SSWDGPA

SEQ ID NO: 239363 - protein, 4 aa, Mycobacterium
STAA

SEQ ID NO: 239364 - protein, 6 aa, Mycobacterium
STAAQA

SEQ ID NO: 239365 - protein, 6 aa, Mycobacterium
STGAVV

SEQ ID NO: 239366 - protein, 5 aa, Mycobacterium
STLDG

SEQ ID NO: 239367 - protein, 4 aa, Mycobacterium
STTR

SEQ ID NO: 239368 - protein, 16 aa, Mycobacterium
SVARQSPEAAANPQTA

SEQ ID NO: 239369 - protein, 8 aa, Mycobacterium
SYDPYSSD

SEQ ID NO: 239370 - protein, 8 aa, Mycobacterium
SYPTYAEA

SEQ ID NO: 239371 - protein, 4 aa, Mycobacterium
SYRK

SEQ ID NO: 239372 - protein, 4 aa, Mycobacterium
TAAA

SEQ ID NO: 239373 - protein, 4 aa, Mycobacterium
TAAS

SEQ ID NO: 239374 - protein, 4 aa, Mycobacterium
TADE

SEQ ID NO: 239375 - protein, 8 aa, Mycobacterium
TADSDDAE

SEQ ID NO: 239376 - protein, 12 aa, Mycobacterium
TAGKSLSDSASG

SEQ ID NO: 239377 - protein, 5 aa, Mycobacterium
TAGPG

SEQ ID NO: 239378 - protein, 7 aa, Mycobacterium
TAGQATA

SEQ ID NO: 239379 - protein, 4 aa, Mycobacterium
TALT

SEQ ID NO: 239380 - protein, 4 aa, Mycobacterium
TAQP

SEQ ID NO: 239381 - protein, 5 aa, Mycobacterium
TATGE

SEQ ID NO: 239382 - protein, 4 aa, Mycobacterium
TAVG

SEQ ID NO: 239383 - protein, 4 aa, Mycobacterium
TDGA

SEQ ID NO: 239384 - protein, 7 aa, Mycobacterium
TDTGGGV

SEQ ID NO: 239385 - protein, 5 aa, Mycobacterium
TEDIA

SEQ ID NO: 239386 - protein, 5 aa, Mycobacterium
TEHRS

SEQ ID NO: 239387 - protein, 4 aa, Mycobacterium
TEPA

SEQ ID NO: 239388 - protein, 9 aa, Mycobacterium
TGANGSGKT

SEQ ID NO: 239389 - protein, 4 aa, Mycobacterium
TGAT

SEQ ID NO: 239390 - protein, 11 aa, Mycobacterium
TGEAETPTGPL

SEQ ID NO: 239391 - protein, 9 aa, Mycobacterium
TGGPESETL

SEQ ID NO: 239392 - protein, 4 aa, Mycobacterium
TGKA

SEQ ID NO: 239393 - protein, 5 aa, Mycobacterium
TGPGL

SEQ ID NO: 239394 - protein, 6 aa, Mycobacterium
TGPHGG

SEQ ID NO: 239395 - protein, 6 aa, Mycobacterium
TGRGAD

SEQ ID NO: 239396 - protein, 8 aa, Mycobacterium
TGRPDNPH

SEQ ID NO: 239397 - protein, 14 aa, Mycobacterium
TGSSQFEEPTGSIA

SEQ ID NO: 239398 - protein, 10 aa, Mycobacterium
TGTLTEGRPR

SEQ ID NO: 239399 - protein, 8 aa, Mycobacterium
TNARGGPG

SEQ ID NO: 239400 - protein, 14 aa, Mycobacterium
TNNRAGNPVGSSYL

SEQ ID NO: 239401 - protein, 5 aa, Mycobacterium
TNPEH

SEQ ID NO: 239402 - protein, 5 aa, Mycobacterium
TPHRG

SEQ ID NO: 239403 - protein, 4 aa, Mycobacterium
TPTA

SEQ ID NO: 239404 - protein, 17 aa, Mycobacterium
TQPGRTYDVSSPDLPTV

SEQ ID NO: 239405 - protein, 11 aa, Mycobacterium
TRAGRSAFSPD

SEQ ID NO: 239406 - protein, 4 aa, Mycobacterium
TRAR

SEQ ID NO: 239407 - protein, 8 aa, Mycobacterium
TRARRDGD

SEQ ID NO: 239408 - protein, 4 aa, Mycobacterium
TRDS

SEQ ID NO: 239409 - protein, 4 aa, Mycobacterium
TRPG

SEQ ID NO: 239410 - protein, 5 aa, Mycobacterium
TRPLG

SEQ ID NO: 239411 - protein, 5 aa, Mycobacterium
TRPWN

SEQ ID NO: 239412 - protein, 8 aa, Mycobacterium
TRRGETEY

SEQ ID NO: 239413 - protein, 4 aa, Mycobacterium
TRRT

SEQ ID NO: 239414 - protein, 7 aa, Mycobacterium
TRTTNDV

SEQ ID NO: 239415 - protein, 13 aa, Mycobacterium
TSADYAATAAEHE

SEQ ID NO: 239416 - protein, 6 aa, Mycobacterium
TSALDE

SEQ ID NO: 239417 - protein, 10 aa, Mycobacterium
TSALDTENEA

SEQ ID NO: 239418 - protein, 5 aa, Mycobacterium
TSFNG

SEQ ID NO: 239419 - protein, 4 aa, Mycobacterium
TSGR

SEQ ID NO: 239420 - protein, 11 aa, Mycobacterium
TSGSTRTPAGV

SEQ ID NO: 239421 - protein, 5 aa, Mycobacterium
TSRRS

SEQ ID NO: 239422 - protein, 4 aa, Mycobacterium
TSRT

SEQ ID NO: 239423 - protein, 4 aa, Mycobacterium
TSSA

SEQ ID NO: 239424 - protein, 7 aa, Mycobacterium
TSTGVPS

SEQ ID NO: 239425 - protein, 4 aa, Mycobacterium
TTAA

SEQ ID NO: 239426 - protein, 4 aa, Mycobacterium
TTGR

SEQ ID NO: 239427 - protein, 7 aa, Mycobacterium
TTIPGSA

SEQ ID NO: 239428 - protein, 8 aa, Mycobacterium
TVKDDAAD

SEQ ID NO: 239429 - protein, 6 aa, Mycobacterium
TVPVGT

SEQ ID NO: 239430 - protein, 4 aa, Mycobacterium
VAGG

SEQ ID NO: 239431 - protein, 9 aa, Mycobacterium
VAPGGTGSG

SEQ ID NO: 239432 - protein, 6 aa, Mycobacterium
VAPGVA

SEQ ID NO: 239433 - protein, 4 aa, Mycobacterium
VDVT

SEQ ID NO: 239434 - protein, 6 aa, Mycobacterium
VEDNPG

SEQ ID NO: 239435 - protein, 7 aa, Mycobacterium
VETTSRP

SEQ ID NO: 239436 - protein, 5 aa, Mycobacterium
VGDPP

SEQ ID NO: 239437 - protein, 4 aa, Mycobacterium
VGGG

SEQ ID NO: 239438 - protein, 12 aa, Mycobacterium
VGGGPQGVGNAV

SEQ ID NO: 239439 - protein, 4 aa, Mycobacterium
VGMT

SEQ ID NO: 239440 - protein, 4 aa, Mycobacterium
VGPS

SEQ ID NO: 239441 - protein, 4 aa, Mycobacterium
VGSS

SEQ ID NO: 239442 - protein, 5 aa, Mycobacterium
VGSTQ

SEQ ID NO: 239443 - protein, 7 aa, Mycobacterium
VGTDNEQ

SEQ ID NO: 239444 - protein, 7 aa, Mycobacterium
VKAGPSS

SEQ ID NO: 239445 - protein, 7 aa, Mycobacterium
VKGGGSG

SEQ ID NO: 239446 - protein, 13 aa, Mycobacterium
VNDRQEEAGRSGV

SEQ ID NO: 239447 - protein, 10 aa, Mycobacterium
VNHDGRSNGL

SEQ ID NO: 239448 - protein, 7 aa, Mycobacterium
VPAPPGI

SEQ ID NO: 239449 - protein, 5 aa, Mycobacterium
VPEAQ

SEQ ID NO: 239450 - protein, 12 aa, Mycobacterium
VPEEDKGLRTRS

SEQ ID NO: 239451 - protein, 8 aa, Mycobacterium
VPGKTEVS

SEQ ID NO: 239452 - protein, 7 aa, Mycobacterium
VPPEGNR

SEQ ID NO: 239453 - protein, 4 aa, Mycobacterium
VPPQ

SEQ ID NO: 239454 - protein, 8 aa, Mycobacterium
VPVKPGRG

SEQ ID NO: 239455 - protein, 9 aa, Mycobacterium
VPVSGSSYS

SEQ ID NO: 239456 - protein, 6 aa, Mycobacterium
VQRQYP

SEQ ID NO: 239457 - protein, 6 aa, Mycobacterium
VRGEDD

SEQ ID NO: 239458 - protein, 8 aa, Mycobacterium
VRLPGEEV

SEQ ID NO: 239459 - protein, 6 aa, Mycobacterium
VRRGDD

SEQ ID NO: 239460 - protein, 4 aa, Mycobacterium
VRSE

SEQ ID NO: 239461 - protein, 4 aa, Mycobacterium
VRTE

SEQ ID NO: 239462 - protein, 5 aa, Mycobacterium
VSGTW

SEQ ID NO: 239463 - protein, 9 aa, Mycobacterium
VSNPDLAGR

SEQ ID NO: 239464 - protein, 6 aa, Mycobacterium
VSSRAG

SEQ ID NO: 239465 - protein, 7 aa, Mycobacterium
VSTPRSY

SEQ ID NO: 239466 - protein, 9 aa, Mycobacterium
VTGTKAPGD

SEQ ID NO: 239467 - protein, 6 aa, Mycobacterium
VTTSPL

SEQ ID NO: 239468 - protein, 8 aa, Mycobacterium
VYPNQPNV

SEQ ID NO: 239469 - protein, 4 aa, Mycobacterium
WRPG

SEQ ID NO: 239470 - protein, 9 aa, Mycobacterium
WTSRSSQIY

SEQ ID NO: 239471 - protein, 4 aa, Mycobacterium
YDPS

SEQ ID NO: 239472 - protein, 5 aa, Mycobacterium
YETPY

SEQ ID NO: 239473 - protein, 12 aa, Mycobacterium
YFTQGAPPSPLQ

SEQ ID NO: 239474 - protein, 4 aa, Mycobacterium
YGDR

SEQ ID NO: 239475 - protein, 5 aa, Mycobacterium
YGTGW

SEQ ID NO: 239476 - protein, 9 aa, Mycobacterium
YRVGPASGL

SEQ ID NO: 239477 - protein, 15 aa, Mycobacterium
YSNEAGQGTGPHAAA

SEQ ID NO: 239478 - protein, 10 aa, Mycobacterium
YTSPSSGTVT

SEQ ID NO: 239479 - protein, 4 aa, Mycobacterium
AAAA

SEQ ID NO: 239480 - protein, 9 aa, Mycobacterium
AAAAQTRRN

SEQ ID NO: 239481 - protein, 6 aa, Mycobacterium
AAADGL

SEQ ID NO: 239482 - protein, 4 aa, Mycobacterium
AAAE

SEQ ID NO: 239483 - protein, 14 aa, Mycobacterium
AAAERKPPQLGGEE

SEQ ID NO: 239484 - protein, 4 aa, Mycobacterium
AAAG

SEQ ID NO: 239485 - protein, 5 aa, Mycobacterium
AAAGA

SEQ ID NO: 239486 - protein, 5 aa, Mycobacterium
AAAGG

SEQ ID NO: 239487 - protein, 7 aa, Mycobacterium
AAAGRGV

SEQ ID NO: 239488 - protein, 8 aa, Mycobacterium
AAAGVSGP

SEQ ID NO: 239489 - protein, 5 aa, Mycobacterium
AAAKR

SEQ ID NO: 239490 - protein, 4 aa, Mycobacterium
AAAN

SEQ ID NO: 239491 - protein, 9 aa, Mycobacterium
AAAPADQRA

SEQ ID NO: 239492 - protein, 7 aa, Mycobacterium
AAAPGEK

SEQ ID NO: 239493 - protein, 7 aa, Mycobacterium
AAAPGRL

SEQ ID NO: 239494 - protein, 4 aa, Mycobacterium
AAAR

SEQ ID NO: 239495 - protein, 9 aa, Mycobacterium
AAARRHGRQ

SEQ ID NO: 239496 - protein, 8 aa, Mycobacterium
AAASSSAV

SEQ ID NO: 239497 - protein, 6 aa, Mycobacterium
AADGSI

SEQ ID NO: 239498 - protein, 10 aa, Mycobacterium
AADGTGWGEG

SEQ ID NO: 239499 - protein, 4 aa, Mycobacterium
AADT

SEQ ID NO: 239500 - protein, 10 aa, Mycobacterium
AAEQSSEHPL

SEQ ID NO: 239501 - protein, 9 aa, Mycobacterium
AAERPGHKY

SEQ ID NO: 239502 - protein, 9 aa, Mycobacterium
AAESALGQA

SEQ ID NO: 239503 - protein, 6 aa, Mycobacterium
AAESGF

SEQ ID NO: 239504 - protein, 16 aa, Mycobacterium
AAESSSPWNNAGTGHS

SEQ ID NO: 239505 - protein, 6 aa, Mycobacterium
AAGAAG

SEQ ID NO: 239506 - protein, 6 aa, Mycobacterium
AAGAGA

SEQ ID NO: 239507 - protein, 6 aa, Mycobacterium
AAGAGG

SEQ ID NO: 239508 - protein, 5 aa, Mycobacterium
AAGGA

SEQ ID NO: 239509 - protein, 8 aa, Mycobacterium
AAGHPGPG

SEQ ID NO: 239510 - protein, 6 aa, Mycobacterium
AAGRIQ

SEQ ID NO: 239511 - protein, 5 aa, Mycobacterium
AAGTK

SEQ ID NO: 239512 - protein, 7 aa, Mycobacterium
AAGYSRY

SEQ ID NO: 239513 - protein, 4 aa, Mycobacterium
AAHD

SEQ ID NO: 239514 - protein, 7 aa, Mycobacterium
AAHQAGV

SEQ ID NO: 239515 - protein, 7 aa, Mycobacterium
AAIDNAT

SEQ ID NO: 239516 - protein, 11 aa, Mycobacterium
AAINPGNSGGA

SEQ ID NO: 239517 - protein, 19 aa, Mycobacterium
AAKAGETGDIEDAPDVVPT

SEQ ID NO: 239518 - protein, 5 aa, Mycobacterium
AAKER

SEQ ID NO: 239519 - protein, 6 aa, Mycobacterium
AAKPST

SEQ ID NO: 239520 - protein, 13 aa, Mycobacterium
AALDGASHDERAR

SEQ ID NO: 239521 - protein, 11 aa, Mycobacterium
AALSNTALTAG

SEQ ID NO: 239522 - protein, 4 aa, Mycobacterium
AANA

SEQ ID NO: 239523 - protein, 9 aa, Mycobacterium
AANANGNVE

SEQ ID NO: 239524 - protein, 7 aa, Mycobacterium
AANGLRP

SEQ ID NO: 239525 - protein, 10 aa, Mycobacterium
AANPAAAKRI

SEQ ID NO: 239526 - protein, 25 aa, Mycobacterium
AAPAAQPAAAAPGVKEEKQPMSTGR

SEQ ID NO: 239527 - protein, 6 aa, Mycobacterium
AAPALT

SEQ ID NO: 239528 - protein, 4 aa, Mycobacterium
AAPD

SEQ ID NO: 239529 - protein, 6 aa, Mycobacterium
AAPDAI

SEQ ID NO: 239530 - protein, 7 aa, Mycobacterium
AAPLASD

SEQ ID NO: 239531 - protein, 6 aa, Mycobacterium
AAPSVS

SEQ ID NO: 239532 - protein, 4 aa, Mycobacterium
AAPT

SEQ ID NO: 239533 - protein, 8 aa, Mycobacterium
AAPTADQV

SEQ ID NO: 239534 - protein, 8 aa, Mycobacterium
AAQEAAKQ

SEQ ID NO: 239535 - protein, 7 aa, Mycobacterium
AAQGGAA

SEQ ID NO: 239536 - protein, 8 aa, Mycobacterium
AAQPPPLE

SEQ ID NO: 239537 - protein, 11 aa, Mycobacterium
AARDREHGGAG

SEQ ID NO: 239538 - protein, 5 aa, Mycobacterium
AARIG

SEQ ID NO: 239539 - protein, 9 aa, Mycobacterium
AARTDGATA

SEQ ID NO: 239540 - protein, 8 aa, Mycobacterium
AARTRGGY

SEQ ID NO: 239541 - protein, 4 aa, Mycobacterium
AARV

SEQ ID NO: 239542 - protein, 5 aa, Mycobacterium
AARVS

SEQ ID NO: 239543 - protein, 10 aa, Mycobacterium
AASANTASGR

SEQ ID NO: 239544 - protein, 6 aa, Mycobacterium
AASDGT

SEQ ID NO: 239545 - protein, 10 aa, Mycobacterium
AASDKTNAMG

SEQ ID NO: 239546 - protein, 4 aa, Mycobacterium
AASG

SEQ ID NO: 239547 - protein, 5 aa, Mycobacterium
AASRH

SEQ ID NO: 239548 - protein, 5 aa, Mycobacterium
AASTA

SEQ ID NO: 239549 - protein, 4 aa, Mycobacterium
AATA

SEQ ID NO: 239550 - protein, 13 aa, Mycobacterium
AATEAIKGTPLEG

SEQ ID NO: 239551 - protein, 5 aa, Mycobacterium
AATGW

SEQ ID NO: 239552 - protein, 5 aa, Mycobacterium
AATTG

SEQ ID NO: 239553 - protein, 5 aa, Mycobacterium
AAVEE

SEQ ID NO: 239554 - protein, 6 aa, Mycobacterium
AAVGTP

SEQ ID NO: 239555 - protein, 8 aa, Mycobacterium
AAVSAGQR

SEQ ID NO: 239556 - protein, 6 aa, Mycobacterium
ACPPEL

SEQ ID NO: 239557 - protein, 4 aa, Mycobacterium
ADAA

SEQ ID NO: 239558 - protein, 9 aa, Mycobacterium
ADARGDLMP

SEQ ID NO: 239559 - protein, 7 aa, Mycobacterium
ADDPTKV

SEQ ID NO: 239560 - protein, 5 aa, Mycobacterium
ADDST

SEQ ID NO: 239561 - protein, 7 aa, Mycobacterium
ADEASRR

SEQ ID NO: 239562 - protein, 9 aa, Mycobacterium
ADESSSALL

SEQ ID NO: 239563 - protein, 6 aa, Mycobacterium
ADEVSA

SEQ ID NO: 239564 - protein, 5 aa, Mycobacterium
ADGAR

SEQ ID NO: 239565 - protein, 10 aa, Mycobacterium
ADGGDATTCG

SEQ ID NO: 239566 - protein, 19 aa, Mycobacterium
ADKAGVGSAVNDTTRELGG

SEQ ID NO: 239567 - protein, 8 aa, Mycobacterium
ADKNSAAF

SEQ ID NO: 239568 - protein, 8 aa, Mycobacterium
ADPAPANR

SEQ ID NO: 239569 - protein, 8 aa, Mycobacterium
ADPDRSTW

SEQ ID NO: 239570 - protein, 8 aa, Mycobacterium
ADPGTALG

SEQ ID NO: 239571 - protein, 7 aa, Mycobacterium
ADQGPAL

SEQ ID NO: 239572 - protein, 6 aa, Mycobacterium
ADQGVA

SEQ ID NO: 239573 - protein, 4 aa, Mycobacterium
ADQL

SEQ ID NO: 239574 - protein, 5 aa, Mycobacterium
ADQRN

SEQ ID NO: 239575 - protein, 8 aa, Mycobacterium
ADSGERRV

SEQ ID NO: 239576 - protein, 4 aa, Mycobacterium
ADSR

SEQ ID NO: 239577 - protein, 8 aa, Mycobacterium
ADSTRTFE

SEQ ID NO: 239578 - protein, 5 aa, Mycobacterium
ADTKH

SEQ ID NO: 239579 - protein, 4 aa, Mycobacterium
ADTP

SEQ ID NO: 239580 - protein, 8 aa, Mycobacterium
ADTSVAGH

SEQ ID NO: 239581 - protein, 8 aa, Mycobacterium
ADTTGREA

SEQ ID NO: 239582 - protein, 5 aa, Mycobacterium
ADTTH

SEQ ID NO: 239583 - protein, 5 aa, Mycobacterium
ADVEE

SEQ ID NO: 239584 - protein, 5 aa, Mycobacterium
ADVGK

SEQ ID NO: 239585 - protein, 10 aa, Mycobacterium
ADVPPRDAAE

SEQ ID NO: 239586 - protein, 10 aa, Mycobacterium
ADVSGAGAAL

SEQ ID NO: 239587 - protein, 10 aa, Mycobacterium
ADYASKAADV

SEQ ID NO: 239588 - protein, 10 aa, Mycobacterium
AEAEAAEAEA

SEQ ID NO: 239589 - protein, 8 aa, Mycobacterium
AEAPRDAT

SEQ ID NO: 239590 - protein, 4 aa, Mycobacterium
AEAT

SEQ ID NO: 239591 - protein, 10 aa, Mycobacterium
AEEAGTAKPK

SEQ ID NO: 239592 - protein, 4 aa, Mycobacterium
AEEL

SEQ ID NO: 239593 - protein, 8 aa, Mycobacterium
AEGKQRPG

SEQ ID NO: 239594 - protein, 5 aa, Mycobacterium
AEGRR

SEQ ID NO: 239595 - protein, 5 aa, Mycobacterium
AEGSH

SEQ ID NO: 239596 - protein, 4 aa, Mycobacterium
AEHA

SEQ ID NO: 239597 - protein, 5 aa, Mycobacterium
AEHGA

SEQ ID NO: 239598 - protein, 5 aa, Mycobacterium
AEHGV

SEQ ID NO: 239599 - protein, 7 aa, Mycobacterium
AEPATGT

SEQ ID NO: 239600 - protein, 4 aa, Mycobacterium
AEPG

SEQ ID NO: 239601 - protein, 8 aa, Mycobacterium
AEPPPVRQ

SEQ ID NO: 239602 - protein, 4 aa, Mycobacterium
AEPR

SEQ ID NO: 239603 - protein, 10 aa, Mycobacterium
AEQGDPDGGA

SEQ ID NO: 239604 - protein, 8 aa, Mycobacterium
AEQGRTSA

SEQ ID NO: 239605 - protein, 13 aa, Mycobacterium
AEQSRKGASQRLA

SEQ ID NO: 239606 - protein, 6 aa, Mycobacterium
AERAAA

SEQ ID NO: 239607 - protein, 13 aa, Mycobacterium
AERDTGSLSGGEL

SEQ ID NO: 239608 - protein, 4 aa, Mycobacterium
AERR

SEQ ID NO: 239609 - protein, 7 aa, Mycobacterium
AERVART

SEQ ID NO: 239610 - protein, 7 aa, Mycobacterium
AESEGKF

SEQ ID NO: 239611 - protein, 10 aa, Mycobacterium
AESTAGPGAR

SEQ ID NO: 239612 - protein, 5 aa, Mycobacterium
AEVDG

SEQ ID NO: 239613 - protein, 12 aa, Mycobacterium
AFRKPKSRNAAT

SEQ ID NO: 239614 - protein, 18 aa, Mycobacterium
AFSGSPTDVRVTGPPATF

SEQ ID NO: 239615 - protein, 4 aa, Mycobacterium
AGAA

SEQ ID NO: 239616 - protein, 6 aa, Mycobacterium
AGADRA

SEQ ID NO: 239617 - protein, 5 aa, Mycobacterium
AGAEA

SEQ ID NO: 239618 - protein, 5 aa, Mycobacterium
AGAGE

SEQ ID NO: 239619 - protein, 5 aa, Mycobacterium
AGANT

SEQ ID NO: 239620 - protein, 4 aa, Mycobacterium
AGAP

SEQ ID NO: 239621 - protein, 10 aa, Mycobacterium
AGAPNLPSGY

SEQ ID NO: 239622 - protein, 6 aa, Mycobacterium
AGARPV

SEQ ID NO: 239623 - protein, 7 aa, Mycobacterium
AGARPVV

SEQ ID NO: 239624 - protein, 6 aa, Mycobacterium
AGASAA

SEQ ID NO: 239625 - protein, 5 aa, Mycobacterium
AGASF

SEQ ID NO: 239626 - protein, 6 aa, Mycobacterium
AGASFT

SEQ ID NO: 239627 - protein, 4 aa, Mycobacterium
AGAT

SEQ ID NO: 239628 - protein, 5 aa, Mycobacterium
AGATR

SEQ ID NO: 239629 - protein, 4 aa, Mycobacterium
AGAV

SEQ ID NO: 239630 - protein, 10 aa, Mycobacterium
AGDETSGGYN

SEQ ID NO: 239631 - protein, 7 aa, Mycobacterium
AGDPAPT

SEQ ID NO: 239632 - protein, 7 aa, Mycobacterium
AGDPGTI

SEQ ID NO: 239633 - protein, 6 aa, Mycobacterium
AGDSTL

SEQ ID NO: 239634 - protein, 15 aa, Mycobacterium
AGDVGVDTAATPDGG

SEQ ID NO: 239635 - protein, 6 aa, Mycobacterium
AGEGGA

SEQ ID NO: 239636 - protein, 4 aa, Mycobacterium
AGER

SEQ ID NO: 239637 - protein, 8 aa, Mycobacterium
AGESHAQA

SEQ ID NO: 239638 - protein, 4 aa, Mycobacterium
AGGA

SEQ ID NO: 239639 - protein, 8 aa, Mycobacterium
AGGEYGGG

SEQ ID NO: 239640 - protein, 4 aa, Mycobacterium
AGGG

SEQ ID NO: 239641 - protein, 9 aa, Mycobacterium
AGGGPVGVG

SEQ ID NO: 239642 - protein, 4 aa, Mycobacterium
AGGI

SEQ ID NO: 239643 - protein, 8 aa, Mycobacterium
AGGINPGN

SEQ ID NO: 239644 - protein, 4 aa, Mycobacterium
AGGL

SEQ ID NO: 239645 - protein, 4 aa, Mycobacterium
AGGM

SEQ ID NO: 239646 - protein, 6 aa, Mycobacterium
AGGNDI

SEQ ID NO: 239647 - protein, 4 aa, Mycobacterium
AGGP

SEQ ID NO: 239648 - protein, 5 aa, Mycobacterium
AGGPY

SEQ ID NO: 239649 - protein, 5 aa, Mycobacterium
AGGST

SEQ ID NO: 239650 - protein, 8 aa, Mycobacterium
AGGTSTAA

SEQ ID NO: 239651 - protein, 7 aa, Mycobacterium
AGGVNSA

SEQ ID NO: 239652 - protein, 4 aa, Mycobacterium
AGHG

SEQ ID NO: 239653 - protein, 6 aa, Mycobacterium
AGKPLT

SEQ ID NO: 239654 - protein, 8 aa, Mycobacterium
AGKTGKNF

SEQ ID NO: 239655 - protein, 4 aa, Mycobacterium
AGLA

SEQ ID NO: 239656 - protein, 11 aa, Mycobacterium
AGLGGAPKGRA

SEQ ID NO: 239657 - protein, 4 aa, Mycobacterium
AGLR

SEQ ID NO: 239658 - protein, 7 aa, Mycobacterium
AGNAGPP

SEQ ID NO: 239659 - protein, 8 aa, Mycobacterium
AGNDDPNL

SEQ ID NO: 239660 - protein, 4 aa, Mycobacterium
AGPA

SEQ ID NO: 239661 - protein, 8 aa, Mycobacterium
AGPNPGHT

SEQ ID NO: 239662 - protein, 4 aa, Mycobacterium
AGPP

SEQ ID NO: 239663 - protein, 5 aa, Mycobacterium
AGPRR

SEQ ID NO: 239664 - protein, 5 aa, Mycobacterium
AGPSA

SEQ ID NO: 239665 - protein, 6 aa, Mycobacterium
AGPTSD

SEQ ID NO: 239666 - protein, 6 aa, Mycobacterium
AGQQDR

SEQ ID NO: 239667 - protein, 4 aa, Mycobacterium
AGQR

SEQ ID NO: 239668 - protein, 4 aa, Mycobacterium
AGQV

SEQ ID NO: 239669 - protein, 4 aa, Mycobacterium
AGRA

SEQ ID NO: 239670 - protein, 8 aa, Mycobacterium
AGRAPVGT

SEQ ID NO: 239671 - protein, 6 aa, Mycobacterium
AGRDQA

SEQ ID NO: 239672 - protein, 4 aa, Mycobacterium
AGRR

SEQ ID NO: 239673 - protein, 6 aa, Mycobacterium
AGSPTS

SEQ ID NO: 239674 - protein, 7 aa, Mycobacterium
AGSTSQT

SEQ ID NO: 239675 - protein, 5 aa, Mycobacterium
AGSYR

SEQ ID NO: 239676 - protein, 4 aa, Mycobacterium
AGTA

SEQ ID NO: 239677 - protein, 5 aa, Mycobacterium
AGTAA

SEQ ID NO: 239678 - protein, 11 aa, Mycobacterium
AGTGSGGEPSV

SEQ ID NO: 239679 - protein, 7 aa, Mycobacterium
AGTPGMK

SEQ ID NO: 239680 - protein, 5 aa, Mycobacterium
AGTQD

SEQ ID NO: 239681 - protein, 5 aa, Mycobacterium
AGTRA

SEQ ID NO: 239682 - protein, 4 aa, Mycobacterium
AGYR

SEQ ID NO: 239683 - protein, 6 aa, Mycobacterium
AGYSRY

SEQ ID NO: 239684 - protein, 6 aa, Mycobacterium
AHDGKA

SEQ ID NO: 239685 - protein, 10 aa, Mycobacterium
AHGGPGGAPG

SEQ ID NO: 239686 - protein, 11 aa, Mycobacterium
AHNPPAGVDNK

SEQ ID NO: 239687 - protein, 7 aa, Mycobacterium
AHPFENP

SEQ ID NO: 239688 - protein, 4 aa, Mycobacterium
AHPR

SEQ ID NO: 239689 - protein, 4 aa, Mycobacterium
AHQR

SEQ ID NO: 239690 - protein, 6 aa, Mycobacterium
AHRTGA

SEQ ID NO: 239691 - protein, 8 aa, Mycobacterium
AIAATGPE

SEQ ID NO: 239692 - protein, 7 aa, Mycobacterium
AIGPSQA

SEQ ID NO: 239693 - protein, 10 aa, Mycobacterium
AIRARNSDVS

SEQ ID NO: 239694 - protein, 6 aa, Mycobacterium
AISGRS

SEQ ID NO: 239695 - protein, 4 aa, Mycobacterium
AIVG

SEQ ID NO: 239696 - protein, 9 aa, Mycobacterium
AKAEESSVS

SEQ ID NO: 239697 - protein, 7 aa, Mycobacterium
AKALGND

SEQ ID NO: 239698 - protein, 9 aa, Mycobacterium
AKDPADRYA

SEQ ID NO: 239699 - protein, 8 aa, Mycobacterium
AKDPKDRY

SEQ ID NO: 239700 - protein, 15 aa, Mycobacterium
AKGGPGGKPGCGSLP

SEQ ID NO: 239701 - protein, 7 aa, Mycobacterium
AKGLTRR

SEQ ID NO: 239702 - protein, 4 aa, Mycobacterium
AKIP

SEQ ID NO: 239703 - protein, 5 aa, Mycobacterium
AKITS

SEQ ID NO: 239704 - protein, 11 aa, Mycobacterium
AKMDGATPAQA

SEQ ID NO: 239705 - protein, 13 aa, Mycobacterium
AKNPDNRYQTAAE

SEQ ID NO: 239706 - protein, 15 aa, Mycobacterium
AKPKTPKDTGPQLDS

SEQ ID NO: 239707 - protein, 13 aa, Mycobacterium
AKRPEDRYASAGD

SEQ ID NO: 239708 - protein, 8 aa, Mycobacterium
AKRRAGAA

SEQ ID NO: 239709 - protein, 5 aa, Mycobacterium
AKSGL

SEQ ID NO: 239710 - protein, 6 aa, Mycobacterium
AKSGLS

SEQ ID NO: 239711 - protein, 8 aa, Mycobacterium
AKSQNALG

SEQ ID NO: 239712 - protein, 10 aa, Mycobacterium
AKTGSRGTPV

SEQ ID NO: 239713 - protein, 7 aa, Mycobacterium
ALAAAGS

SEQ ID NO: 239714 - protein, 5 aa, Mycobacterium
ALAAG

SEQ ID NO: 239715 - protein, 5 aa, Mycobacterium
ALAAS

SEQ ID NO: 239716 - protein, 9 aa, Mycobacterium
ALGDPADLA

SEQ ID NO: 239717 - protein, 5 aa, Mycobacterium
ALGPP

SEQ ID NO: 239718 - protein, 7 aa, Mycobacterium
ALGPSAA

SEQ ID NO: 239719 - protein, 4 aa, Mycobacterium
ALPA

SEQ ID NO: 239720 - protein, 10 aa, Mycobacterium
ALPAAGGGYT

SEQ ID NO: 239721 - protein, 17 aa, Mycobacterium
ALPGPFSPASASATVRG

SEQ ID NO: 239722 - protein, 14 aa, Mycobacterium
ALPGPFSPSSASVT

SEQ ID NO: 239723 - protein, 9 aa, Mycobacterium
ALPGSPPFG

SEQ ID NO: 239724 - protein, 7 aa, Mycobacterium
ALRADAA

SEQ ID NO: 239725 - protein, 7 aa, Mycobacterium
ALRGKNT

SEQ ID NO: 239726 - protein, 8 aa, Mycobacterium
ALSAPPPA

SEQ ID NO: 239727 - protein, 10 aa, Mycobacterium
ALSNPDQDHA

SEQ ID NO: 239728 - protein, 5 aa, Mycobacterium
ALTGE

SEQ ID NO: 239729 - protein, 6 aa, Mycobacterium
ALTTGT

SEQ ID NO: 239730 - protein, 5 aa, Mycobacterium
AMGAG

SEQ ID NO: 239731 - protein, 17 aa, Mycobacterium
ANAADDSSKTTGETAAI

SEQ ID NO: 239732 - protein, 6 aa, Mycobacterium
ANARGE

SEQ ID NO: 239733 - protein, 5 aa, Mycobacterium
ANDTY

SEQ ID NO: 239734 - protein, 5 aa, Mycobacterium
ANEAV

SEQ ID NO: 239735 - protein, 8 aa, Mycobacterium
ANEKGRAL

SEQ ID NO: 239736 - protein, 11 aa, Mycobacterium
ANGGNVEGTVK

SEQ ID NO: 239737 - protein, 5 aa, Mycobacterium
ANGNY

SEQ ID NO: 239738 - protein, 7 aa, Mycobacterium
ANKATTV

SEQ ID NO: 239739 - protein, 7 aa, Mycobacterium
ANPKATL

SEQ ID NO: 239740 - protein, 6 aa, Mycobacterium
ANRTTH

SEQ ID NO: 239741 - protein, 7 aa, Mycobacterium
ANSPDEE

SEQ ID NO: 239742 - protein, 7 aa, Mycobacterium
ANSSDDG

SEQ ID NO: 239743 - protein, 8 aa, Mycobacterium
ANSSDDGY

SEQ ID NO: 239744 - protein, 12 aa, Mycobacterium
ANSYGSTAPRVV

SEQ ID NO: 239745 - protein, 4 aa, Mycobacterium
ANVG

SEQ ID NO: 239746 - protein, 4 aa, Mycobacterium
APAA

SEQ ID NO: 239747 - protein, 9 aa, Mycobacterium
APAASRGAL

SEQ ID NO: 239748 - protein, 7 aa, Mycobacterium
APADDPR

SEQ ID NO: 239749 - protein, 8 aa, Mycobacterium
APAGPRSR

SEQ ID NO: 239750 - protein, 11 aa, Mycobacterium
APATNGGPQVH

SEQ ID NO: 239751 - protein, 7 aa, Mycobacterium
APDGTPL

SEQ ID NO: 239752 - protein, 6 aa, Mycobacterium
APDHKR

SEQ ID NO: 239753 - protein, 6 aa, Mycobacterium
APEEPV

SEQ ID NO: 239754 - protein, 10 aa, Mycobacterium
APFGNRSDNG

SEQ ID NO: 239755 - protein, 6 aa, Mycobacterium
APFQHS

SEQ ID NO: 239756 - protein, 7 aa, Mycobacterium
APGATPI

SEQ ID NO: 239757 - protein, 4 aa, Mycobacterium
APGL

SEQ ID NO: 239758 - protein, 7 aa, Mycobacterium
APGQPAG

SEQ ID NO: 239759 - protein, 13 aa, Mycobacterium
APGRNRASGEDIT

SEQ ID NO: 239760 - protein, 6 aa, Mycobacterium
APGTGY

SEQ ID NO: 239761 - protein, 5 aa, Mycobacterium
APGVG

SEQ ID NO: 239762 - protein, 5 aa, Mycobacterium
APGYT

SEQ ID NO: 239763 - protein, 5 aa, Mycobacterium
APIAG

SEQ ID NO: 239764 - protein, 5 aa, Mycobacterium
APLEE

SEQ ID NO: 239765 - protein, 5 aa, Mycobacterium
APLGL

SEQ ID NO: 239766 - protein, 6 aa, Mycobacterium
APPAQL

SEQ ID NO: 239767 - protein, 7 aa, Mycobacterium
APPDDAT

SEQ ID NO: 239768 - protein, 8 aa, Mycobacterium
APPSSDRA

SEQ ID NO: 239769 - protein, 5 aa, Mycobacterium
APPSV

SEQ ID NO: 239770 - protein, 4 aa, Mycobacterium
APPT

SEQ ID NO: 239771 - protein, 4 aa, Mycobacterium
APPV

SEQ ID NO: 239772 - protein, 5 aa, Mycobacterium
APQHL

SEQ ID NO: 239773 - protein, 5 aa, Mycobacterium
APQPR

SEQ ID NO: 239774 - protein, 4 aa, Mycobacterium
APSQ

SEQ ID NO: 239775 - protein, 9 aa, Mycobacterium
APSYEEQHR

SEQ ID NO: 239776 - protein, 5 aa, Mycobacterium
APYPQ

SEQ ID NO: 239777 - protein, 8 aa, Mycobacterium
AQAANGAP

SEQ ID NO: 239778 - protein, 7 aa, Mycobacterium
AQAEHPG

SEQ ID NO: 239779 - protein, 8 aa, Mycobacterium
AQASRAPI

SEQ ID NO: 239780 - protein, 8 aa, Mycobacterium
AQDPTTAT

SEQ ID NO: 239781 - protein, 4 aa, Mycobacterium
AQHT

SEQ ID NO: 239782 - protein, 7 aa, Mycobacterium
AQPQRVS

SEQ ID NO: 239783 - protein, 4 aa, Mycobacterium
AQPV

SEQ ID NO: 239784 - protein, 9 aa, Mycobacterium
AQQGAQQHA

SEQ ID NO: 239785 - protein, 4 aa, Mycobacterium
AQQP

SEQ ID NO: 239786 - protein, 5 aa, Mycobacterium
AQQSY

SEQ ID NO: 239787 - protein, 7 aa, Mycobacterium
AQQSYFG

SEQ ID NO: 239788 - protein, 17 aa, Mycobacterium
AQRGAGPDPANPEGQDV

SEQ ID NO: 239789 - protein, 6 aa, Mycobacterium
AQRPTA

SEQ ID NO: 239790 - protein, 4 aa, Mycobacterium
AQRR

SEQ ID NO: 239791 - protein, 13 aa, Mycobacterium
AQRTAEAQAKANE

SEQ ID NO: 239792 - protein, 5 aa, Mycobacterium
AQSNE

SEQ ID NO: 239793 - protein, 4 aa, Mycobacterium
AQSR

SEQ ID NO: 239794 - protein, 5 aa, Mycobacterium
AQTRR

SEQ ID NO: 239795 - protein, 5 aa, Mycobacterium
AQTSL

SEQ ID NO: 239796 - protein, 6 aa, Mycobacterium
AQVNSA

SEQ ID NO: 239797 - protein, 4 aa, Mycobacterium
ARAA

SEQ ID NO: 239798 - protein, 4 aa, Mycobacterium
ARAE

SEQ ID NO: 239799 - protein, 4 aa, Mycobacterium
ARAG

SEQ ID NO: 239800 - protein, 5 aa, Mycobacterium
ARAGD

SEQ ID NO: 239801 - protein, 5 aa, Mycobacterium
ARAPG

SEQ ID NO: 239802 - protein, 11 aa, Mycobacterium
ARDFATSGLES

SEQ ID NO: 239803 - protein, 6 aa, Mycobacterium
ARDKAG

SEQ ID NO: 239804 - protein, 10 aa, Mycobacterium
ARDRRPFQPP

SEQ ID NO: 239805 - protein, 8 aa, Mycobacterium
AREESPRT

SEQ ID NO: 239806 - protein, 8 aa, Mycobacterium
ARENGTVI

SEQ ID NO: 239807 - protein, 10 aa, Mycobacterium
AREQGGGTRF

SEQ ID NO: 239808 - protein, 4 aa, Mycobacterium
ARGP

SEQ ID NO: 239809 - protein, 13 aa, Mycobacterium
ARGPHAPDTLPTG

SEQ ID NO: 239810 - protein, 10 aa, Mycobacterium
ARGSDAARTA

SEQ ID NO: 239811 - protein, 8 aa, Mycobacterium
ARHASETR

SEQ ID NO: 239812 - protein, 4 aa, Mycobacterium
ARIG

SEQ ID NO: 239813 - protein, 4 aa, Mycobacterium
ARLT

SEQ ID NO: 239814 - protein, 11 aa, Mycobacterium
ARNPDKALESA

SEQ ID NO: 239815 - protein, 6 aa, Mycobacterium
ARPGLV

SEQ ID NO: 239816 - protein, 8 aa, Mycobacterium
ARPPLAGT

SEQ ID NO: 239817 - protein, 10 aa, Mycobacterium
ARQAGESRED

SEQ ID NO: 239818 - protein, 12 aa, Mycobacterium
ARRATTAGTPTE

SEQ ID NO: 239819 - protein, 4 aa, Mycobacterium
ARRE

SEQ ID NO: 239820 - protein, 12 aa, Mycobacterium
ARRGSSSPARTY

SEQ ID NO: 239821 - protein, 6 aa, Mycobacterium
ARRHPD

SEQ ID NO: 239822 - protein, 5 aa, Mycobacterium
ARRPA

SEQ ID NO: 239823 - protein, 4 aa, Mycobacterium
ARRS

SEQ ID NO: 239824 - protein, 10 aa, Mycobacterium
ARSGLSGAQV

SEQ ID NO: 239825 - protein, 5 aa, Mycobacterium
ARSNE

SEQ ID NO: 239826 - protein, 5 aa, Mycobacterium
ARSRP

SEQ ID NO: 239827 - protein, 7 aa, Mycobacterium
ARSSSPH

SEQ ID NO: 239828 - protein, 4 aa, Mycobacterium
ARTD

SEQ ID NO: 239829 - protein, 8 aa, Mycobacterium
ARTGPKGN

SEQ ID NO: 239830 - protein, 7 aa, Mycobacterium
ARTPGEL

SEQ ID NO: 239831 - protein, 5 aa, Mycobacterium
ARTPI

SEQ ID NO: 239832 - protein, 5 aa, Mycobacterium
ARTTV

SEQ ID NO: 239833 - protein, 5 aa, Mycobacterium
ASAGL

SEQ ID NO: 239834 - protein, 4 aa, Mycobacterium
ASAH

SEQ ID NO: 239835 - protein, 4 aa, Mycobacterium
ASAL

SEQ ID NO: 239836 - protein, 5 aa, Mycobacterium
ASASA

SEQ ID NO: 239837 - protein, 5 aa, Mycobacterium
ASATT

SEQ ID NO: 239838 - protein, 5 aa, Mycobacterium
ASDGK

SEQ ID NO: 239839 - protein, 4 aa, Mycobacterium
ASDR

SEQ ID NO: 239840 - protein, 7 aa, Mycobacterium
ASETERM

SEQ ID NO: 239841 - protein, 14 aa, Mycobacterium
ASGAFGGMPATGAI

SEQ ID NO: 239842 - protein, 8 aa, Mycobacterium
ASGESKSR

SEQ ID NO: 239843 - protein, 4 aa, Mycobacterium
ASGL

SEQ ID NO: 239844 - protein, 7 aa, Mycobacterium
ASGLTAT

SEQ ID NO: 239845 - protein, 13 aa, Mycobacterium
ASGRGGQAGDVAG

SEQ ID NO: 239846 - protein, 8 aa, Mycobacterium
ASGRRRTQ

SEQ ID NO: 239847 - protein, 12 aa, Mycobacterium
ASHENAAPNFGT

SEQ ID NO: 239848 - protein, 4 aa, Mycobacterium
ASIA

SEQ ID NO: 239849 - protein, 4 aa, Mycobacterium
ASIG

SEQ ID NO: 239850 - protein, 6 aa, Mycobacterium
ASIPGM

SEQ ID NO: 239851 - protein, 4 aa, Mycobacterium
ASMA

SEQ ID NO: 239852 - protein, 5 aa, Mycobacterium
ASPAA

SEQ ID NO: 239853 - protein, 9 aa, Mycobacterium
ASPANTVRG

SEQ ID NO: 239854 - protein, 13 aa, Mycobacterium
ASPGASDAASSYP

SEQ ID NO: 239855 - protein, 7 aa, Mycobacterium
ASPGFPD

SEQ ID NO: 239856 - protein, 4 aa, Mycobacterium
ASPN

SEQ ID NO: 239857 - protein, 4 aa, Mycobacterium
ASPR

SEQ ID NO: 239858 - protein, 7 aa, Mycobacterium
ASQPATL

SEQ ID NO: 239859 - protein, 7 aa, Mycobacterium
ASRDSLA

SEQ ID NO: 239860 - protein, 5 aa, Mycobacterium
ASRPD

SEQ ID NO: 239861 - protein, 7 aa, Mycobacterium
ASSAGVA

SEQ ID NO: 239862 - protein, 9 aa, Mycobacterium
ASSDPATYG

SEQ ID NO: 239863 - protein, 9 aa, Mycobacterium
ASSPRAGHS

SEQ ID NO: 239864 - protein, 13 aa, Mycobacterium
ASSSVSGRYPNLG

SEQ ID NO: 239865 - protein, 4 aa, Mycobacterium
ASTI

SEQ ID NO: 239866 - protein, 16 aa, Mycobacterium
ASTTAAGPISQNAYGA

SEQ ID NO: 239867 - protein, 16 aa, Mycobacterium
ASTTAAGPVSQNAYGA

SEQ ID NO: 239868 - protein, 6 aa, Mycobacterium
ATAATA

SEQ ID NO: 239869 - protein, 5 aa, Mycobacterium
ATAAV

SEQ ID NO: 239870 - protein, 8 aa, Mycobacterium
ATADDGSV

SEQ ID NO: 239871 - protein, 4 aa, Mycobacterium
ATAG

SEQ ID NO: 239872 - protein, 4 aa, Mycobacterium
ATAP

SEQ ID NO: 239873 - protein, 7 aa, Mycobacterium
ATAPAVD

SEQ ID NO: 239874 - protein, 14 aa, Mycobacterium
ATAPDAIDEANTAF

SEQ ID NO: 239875 - protein, 5 aa, Mycobacterium
ATAPG

SEQ ID NO: 239876 - protein, 6 aa, Mycobacterium
ATAPGE

SEQ ID NO: 239877 - protein, 6 aa, Mycobacterium
ATASGA

SEQ ID NO: 239878 - protein, 4 aa, Mycobacterium
ATAT

SEQ ID NO: 239879 - protein, 7 aa, Mycobacterium
ATATRNL

SEQ ID NO: 239880 - protein, 4 aa, Mycobacterium
ATDL

SEQ ID NO: 239881 - protein, 9 aa, Mycobacterium
ATDPRPEVA

SEQ ID NO: 239882 - protein, 6 aa, Mycobacterium
ATDRND

SEQ ID NO: 239883 - protein, 5 aa, Mycobacterium
ATERA

SEQ ID NO: 239884 - protein, 9 aa, Mycobacterium
ATGALKPKT

SEQ ID NO: 239885 - protein, 8 aa, Mycobacterium
ATGDDTAL

SEQ ID NO: 239886 - protein, 4 aa, Mycobacterium
ATGG

SEQ ID NO: 239887 - protein, 12 aa, Mycobacterium
ATGGEYGTSATY

SEQ ID NO: 239888 - protein, 4 aa, Mycobacterium
ATGN

SEQ ID NO: 239889 - protein, 5 aa, Mycobacterium
ATGPA

SEQ ID NO: 239890 - protein, 5 aa, Mycobacterium
ATGPG

SEQ ID NO: 239891 - protein, 8 aa, Mycobacterium
ATGSVATS

SEQ ID NO: 239892 - protein, 5 aa, Mycobacterium
ATGTP

SEQ ID NO: 239893 - protein, 6 aa, Mycobacterium
ATGTRD

SEQ ID NO: 239894 - protein, 5 aa, Mycobacterium
ATKPQ

SEQ ID NO: 239895 - protein, 5 aa, Mycobacterium
ATNPK

SEQ ID NO: 239896 - protein, 6 aa, Mycobacterium
ATPAGE

SEQ ID NO: 239897 - protein, 11 aa, Mycobacterium
ATPEDPASARF

SEQ ID NO: 239898 - protein, 12 aa, Mycobacterium
ATPEDPASSRFG

SEQ ID NO: 239899 - protein, 5 aa, Mycobacterium
ATPGV

SEQ ID NO: 239900 - protein, 4 aa, Mycobacterium
ATPL

SEQ ID NO: 239901 - protein, 8 aa, Mycobacterium
ATPQGTQV

SEQ ID NO: 239902 - protein, 6 aa, Mycobacterium
ATPSER

SEQ ID NO: 239903 - protein, 7 aa, Mycobacterium
ATRGRSL

SEQ ID NO: 239904 - protein, 4 aa, Mycobacterium
ATRL

SEQ ID NO: 239905 - protein, 4 aa, Mycobacterium
ATRP

SEQ ID NO: 239906 - protein, 6 aa, Mycobacterium
ATSAGV

SEQ ID NO: 239907 - protein, 8 aa, Mycobacterium
ATSATQSQ

SEQ ID NO: 239908 - protein, 6 aa, Mycobacterium
ATSSAR

SEQ ID NO: 239909 - protein, 9 aa, Mycobacterium
ATSSVDTRT

SEQ ID NO: 239910 - protein, 4 aa, Mycobacterium
ATTA

SEQ ID NO: 239911 - protein, 6 aa, Mycobacterium
ATTRSD

SEQ ID NO: 239912 - protein, 8 aa, Mycobacterium
ATTTSRPM

SEQ ID NO: 239913 - protein, 10 aa, Mycobacterium
ATVGAGATAE

SEQ ID NO: 239914 - protein, 5 aa, Mycobacterium
AVAAP

SEQ ID NO: 239915 - protein, 10 aa, Mycobacterium
AVAASKPANW

SEQ ID NO: 239916 - protein, 5 aa, Mycobacterium
AVADR

SEQ ID NO: 239917 - protein, 6 aa, Mycobacterium
AVADRT

SEQ ID NO: 239918 - protein, 4 aa, Mycobacterium
AVAT

SEQ ID NO: 239919 - protein, 6 aa, Mycobacterium
AVDSGH

SEQ ID NO: 239920 - protein, 4 aa, Mycobacterium
AVGA

SEQ ID NO: 239921 - protein, 4 aa, Mycobacterium
AVGP

SEQ ID NO: 239922 - protein, 14 aa, Mycobacterium
AVKATAAEIATRGG

SEQ ID NO: 239923 - protein, 7 aa, Mycobacterium
AVPASRT

SEQ ID NO: 239924 - protein, 5 aa, Mycobacterium
AVPPQ

SEQ ID NO: 239925 - protein, 5 aa, Mycobacterium
AVPTR

SEQ ID NO: 239926 - protein, 6 aa, Mycobacterium
AVRRTS

SEQ ID NO: 239927 - protein, 11 aa, Mycobacterium
AVSGSKTAMIP

SEQ ID NO: 239928 - protein, 8 aa, Mycobacterium
AVTPRASD

SEQ ID NO: 239929 - protein, 9 aa, Mycobacterium
AWQGPSAAS

SEQ ID NO: 239930 - protein, 13 aa, Mycobacterium
AYDDKAKKTTKAV

SEQ ID NO: 239931 - protein, 4 aa, Mycobacterium
AYDR

SEQ ID NO: 239932 - protein, 5 aa, Mycobacterium
AYEAL

SEQ ID NO: 239933 - protein, 10 aa, Mycobacterium
AYPSGGGDYE

SEQ ID NO: 239934 - protein, 8 aa, Mycobacterium
AYSDSYND

SEQ ID NO: 239935 - protein, 5 aa, Mycobacterium
AYTGG

SEQ ID NO: 239936 - protein, 8 aa, Mycobacterium
CDTQTDPD

SEQ ID NO: 239937 - protein, 4 aa, Mycobacterium
CGGS

SEQ ID NO: 239938 - protein, 14 aa, Mycobacterium
CGPPGQIGPAMGTT

SEQ ID NO: 239939 - protein, 7 aa, Mycobacterium
CGSGPLT

SEQ ID NO: 239940 - protein, 8 aa, Mycobacterium
CRTGADAN

SEQ ID NO: 239941 - protein, 4 aa, Mycobacterium
DAAA

SEQ ID NO: 239942 - protein, 8 aa, Mycobacterium
DAAERSYQ

SEQ ID NO: 239943 - protein, 5 aa, Mycobacterium
DAAKN

SEQ ID NO: 239944 - protein, 8 aa, Mycobacterium
DAAKNDDT

SEQ ID NO: 239945 - protein, 7 aa, Mycobacterium
DAARNDD

SEQ ID NO: 239946 - protein, 11 aa, Mycobacterium
DAARPNTSLAN

SEQ ID NO: 239947 - protein, 6 aa, Mycobacterium
DAASQR

SEQ ID NO: 239948 - protein, 9 aa, Mycobacterium
DADDPDERA

SEQ ID NO: 239949 - protein, 8 aa, Mycobacterium
DADGHAAG

SEQ ID NO: 239950 - protein, 6 aa, Mycobacterium
DADTKH

SEQ ID NO: 239951 - protein, 5 aa, Mycobacterium
DAEDY

SEQ ID NO: 239952 - protein, 18 aa, Mycobacterium
DAERTAAQEGLKQSSLSD

SEQ ID NO: 239953 - protein, 4 aa, Mycobacterium
DAGD

SEQ ID NO: 239954 - protein, 4 aa, Mycobacterium
DAGE

SEQ ID NO: 239955 - protein, 4 aa, Mycobacterium
DAGL

SEQ ID NO: 239956 - protein, 4 aa, Mycobacterium
DAGS

SEQ ID NO: 239957 - protein, 10 aa, Mycobacterium
DAGSADDLTQ

SEQ ID NO: 239958 - protein, 7 aa, Mycobacterium
DAMGPEG

SEQ ID NO: 239959 - protein, 7 aa, Mycobacterium
DAPPGMT

SEQ ID NO: 239960 - protein, 8 aa, Mycobacterium
DAPQEEGA

SEQ ID NO: 239961 - protein, 9 aa, Mycobacterium
DASKNDDSF

SEQ ID NO: 239962 - protein, 7 aa, Mycobacterium
DASPDFR

SEQ ID NO: 239963 - protein, 4 aa, Mycobacterium
DASQ

SEQ ID NO: 239964 - protein, 4 aa, Mycobacterium
DASR

SEQ ID NO: 239965 - protein, 8 aa, Mycobacterium
DASRNDDS

SEQ ID NO: 239966 - protein, 6 aa, Mycobacterium
DASRSG

SEQ ID NO: 239967 - protein, 5 aa, Mycobacterium
DASTG

SEQ ID NO: 239968 - protein, 6 aa, Mycobacterium
DATAQV

SEQ ID NO: 239969 - protein, 5 aa, Mycobacterium
DATAS

SEQ ID NO: 239970 - protein, 6 aa, Mycobacterium
DATGIR

SEQ ID NO: 239971 - protein, 8 aa, Mycobacterium
DATPELRG

SEQ ID NO: 239972 - protein, 4 aa, Mycobacterium
DAVE

SEQ ID NO: 239973 - protein, 7 aa, Mycobacterium
DAYRSYG

SEQ ID NO: 239974 - protein, 10 aa, Mycobacterium
DCTGPGPAAL

SEQ ID NO: 239975 - protein, 12 aa, Mycobacterium
DDAGDGSAWSAA

SEQ ID NO: 239976 - protein, 6 aa, Mycobacterium
DDDARN

SEQ ID NO: 239977 - protein, 5 aa, Mycobacterium
DDDSR

SEQ ID NO: 239978 - protein, 5 aa, Mycobacterium
DDEIS

SEQ ID NO: 239979 - protein, 6 aa, Mycobacterium
DDFDGT

SEQ ID NO: 239980 - protein, 5 aa, Mycobacterium
DDGEV

SEQ ID NO: 239981 - protein, 12 aa, Mycobacterium
DDGTGVPESERA

SEQ ID NO: 239982 - protein, 8 aa, Mycobacterium
DDKKSETA

SEQ ID NO: 239983 - protein, 6 aa, Mycobacterium
DDLRPS

SEQ ID NO: 239984 - protein, 7 aa, Mycobacterium
DDNPEAR

SEQ ID NO: 239985 - protein, 5 aa, Mycobacterium
DDNPN

SEQ ID NO: 239986 - protein, 6 aa, Mycobacterium
DDNSDT

SEQ ID NO: 239987 - protein, 9 aa, Mycobacterium
DDPGPGVAP

SEQ ID NO: 239988 - protein, 7 aa, Mycobacterium
DDPNLSE

SEQ ID NO: 239989 - protein, 4 aa, Mycobacterium
DDPR

SEQ ID NO: 239990 - protein, 7 aa, Mycobacterium
DDQGATS

SEQ ID NO: 239991 - protein, 5 aa, Mycobacterium
DDRGV

SEQ ID NO: 239992 - protein, 7 aa, Mycobacterium
DDRKQTA

SEQ ID NO: 239993 - protein, 5 aa, Mycobacterium
DDSMN

SEQ ID NO: 239994 - protein, 11 aa, Mycobacterium
DDTGKSVAEKL

SEQ ID NO: 239995 - protein, 5 aa, Mycobacterium
DEDTV

SEQ ID NO: 239996 - protein, 4 aa, Mycobacterium
DEGE

SEQ ID NO: 239997 - protein, 7 aa, Mycobacterium
DEGSAPA

SEQ ID NO: 239998 - protein, 6 aa, Mycobacterium
DELSRT

SEQ ID NO: 239999 - protein, 5 aa, Mycobacterium
DEMGD

SEQ ID NO: 240000 - protein, 6 aa, Mycobacterium
DEMQTS

SEQ ID NO: 240001 - protein, 4 aa, Mycobacterium
DEPR

SEQ ID NO: 240002 - protein, 5 aa, Mycobacterium
DEQPV

SEQ ID NO: 240003 - protein, 6 aa, Mycobacterium
DESPHG

SEQ ID NO: 240004 - protein, 6 aa, Mycobacterium
DESPHS

SEQ ID NO: 240005 - protein, 13 aa, Mycobacterium
DETNGYGAKNVKD

SEQ ID NO: 240006 - protein, 10 aa, Mycobacterium
DFADDSATSV

SEQ ID NO: 240007 - protein, 5 aa, Mycobacterium
DFKPG

SEQ ID NO: 240008 - protein, 9 aa, Mycobacterium
DFSGTGAAL

SEQ ID NO: 240009 - protein, 13 aa, Mycobacterium
DFSGTGAATASVT

SEQ ID NO: 240010 - protein, 5 aa, Mycobacterium
DGAAA

SEQ ID NO: 240011 - protein, 5 aa, Mycobacterium
DGAPK

SEQ ID NO: 240012 - protein, 5 aa, Mycobacterium
DGDED

SEQ ID NO: 240013 - protein, 5 aa, Mycobacterium
DGEER

SEQ ID NO: 240014 - protein, 4 aa, Mycobacterium
DGEV

SEQ ID NO: 240015 - protein, 6 aa, Mycobacterium
DGGAPR

SEQ ID NO: 240016 - protein, 7 aa, Mycobacterium
DGGTRPY

SEQ ID NO: 240017 - protein, 7 aa, Mycobacterium
DGIKESV

SEQ ID NO: 240018 - protein, 4 aa, Mycobacterium
DGLG

SEQ ID NO: 240019 - protein, 8 aa, Mycobacterium
DGLPQRSD

SEQ ID NO: 240020 - protein, 9 aa, Mycobacterium
DGPGTPEVL

SEQ ID NO: 240021 - protein, 8 aa, Mycobacterium
DGPLPPRR

SEQ ID NO: 240022 - protein, 17 aa, Mycobacterium
DGRENKPSNPSDPHDGV

SEQ ID NO: 240023 - protein, 5 aa, Mycobacterium
DGRIG

SEQ ID NO: 240024 - protein, 4 aa, Mycobacterium
DGRQ

SEQ ID NO: 240025 - protein, 7 aa, Mycobacterium
DGSHTDI

SEQ ID NO: 240026 - protein, 4 aa, Mycobacterium
DGSV

SEQ ID NO: 240027 - protein, 6 aa, Mycobacterium
DGTDAA

SEQ ID NO: 240028 - protein, 6 aa, Mycobacterium
DGTFTY

SEQ ID NO: 240029 - protein, 6 aa, Mycobacterium
DGTLPG

SEQ ID NO: 240030 - protein, 8 aa, Mycobacterium
DGTQSATT

SEQ ID NO: 240031 - protein, 10 aa, Mycobacterium
DGVARRGQLR

SEQ ID NO: 240032 - protein, 9 aa, Mycobacterium
DGVGISGDT

SEQ ID NO: 240033 - protein, 4 aa, Mycobacterium
DGVT

SEQ ID NO: 240034 - protein, 8 aa, Mycobacterium
DHAGTATA

SEQ ID NO: 240035 - protein, 8 aa, Mycobacterium
DHDNTTGV

SEQ ID NO: 240036 - protein, 5 aa, Mycobacterium
DHPGR

SEQ ID NO: 240037 - protein, 13 aa, Mycobacterium
DHQTAAGKEGPAL

SEQ ID NO: 240038 - protein, 5 aa, Mycobacterium
DHRAG

SEQ ID NO: 240039 - protein, 10 aa, Mycobacterium
DIPTDARSGK

SEQ ID NO: 240040 - protein, 7 aa, Mycobacterium
DIRGTYR

SEQ ID NO: 240041 - protein, 8 aa, Mycobacterium
DISGAGAA

SEQ ID NO: 240042 - protein, 9 aa, Mycobacterium
DKAKNDDSF

SEQ ID NO: 240043 - protein, 7 aa, Mycobacterium
DKDIQDA

SEQ ID NO: 240044 - protein, 5 aa, Mycobacterium
DKDLG

SEQ ID NO: 240045 - protein, 5 aa, Mycobacterium
DKGPQ

SEQ ID NO: 240046 - protein, 7 aa, Mycobacterium
DKLNSWG

SEQ ID NO: 240047 - protein, 12 aa, Mycobacterium
DKLSGGQRKRAS

SEQ ID NO: 240048 - protein, 5 aa, Mycobacterium
DKPGI

SEQ ID NO: 240049 - protein, 8 aa, Mycobacterium
DKRAAPKL

SEQ ID NO: 240050 - protein, 9 aa, Mycobacterium
DKTAGQATS

SEQ ID NO: 240051 - protein, 5 aa, Mycobacterium
DKTTL

SEQ ID NO: 240052 - protein, 14 aa, Mycobacterium
DLAETSGISSRKTD

SEQ ID NO: 240053 - protein, 8 aa, Mycobacterium
DLDPTLAR

SEQ ID NO: 240054 - protein, 7 aa, Mycobacterium
DLNPGGW

SEQ ID NO: 240055 - protein, 9 aa, Mycobacterium
DLPASTRDG

SEQ ID NO: 240056 - protein, 4 aa, Mycobacterium
DLQP

SEQ ID NO: 240057 - protein, 4 aa, Mycobacterium
DLRG

SEQ ID NO: 240058 - protein, 5 aa, Mycobacterium
DLRNS

SEQ ID NO: 240059 - protein, 6 aa, Mycobacterium
DLRPGR

SEQ ID NO: 240060 - protein, 7 aa, Mycobacterium
DLRTAGP

SEQ ID NO: 240061 - protein, 5 aa, Mycobacterium
DLRTP

SEQ ID NO: 240062 - protein, 7 aa, Mycobacterium
DNDDVKT

SEQ ID NO: 240063 - protein, 6 aa, Mycobacterium
DNEAVA

SEQ ID NO: 240064 - protein, 4 aa, Mycobacterium
DNGT

SEQ ID NO: 240065 - protein, 8 aa, Mycobacterium
DNHATAAA

SEQ ID NO: 240066 - protein, 6 aa, Mycobacterium
DNIDES

SEQ ID NO: 240067 - protein, 8 aa, Mycobacterium
DNPDQRIQ

SEQ ID NO: 240068 - protein, 6 aa, Mycobacterium
DNQRVA

SEQ ID NO: 240069 - protein, 6 aa, Mycobacterium
DNTPDG

SEQ ID NO: 240070 - protein, 9 aa, Mycobacterium
DNYPDGDLP

SEQ ID NO: 240071 - protein, 7 aa, Mycobacterium
DPAGGTG

SEQ ID NO: 240072 - protein, 4 aa, Mycobacterium
DPAI

SEQ ID NO: 240073 - protein, 11 aa, Mycobacterium
DPATNQPTDVP

SEQ ID NO: 240074 - protein, 4 aa, Mycobacterium
DPDA

SEQ ID NO: 240075 - protein, 9 aa, Mycobacterium
DPDGSKTEF

SEQ ID NO: 240076 - protein, 7 aa, Mycobacterium
DPEDMGA

SEQ ID NO: 240077 - protein, 7 aa, Mycobacterium
DPEDMRA

SEQ ID NO: 240078 - protein, 7 aa, Mycobacterium
DPERDSG

SEQ ID NO: 240079 - protein, 5 aa, Mycobacterium
DPETA

SEQ ID NO: 240080 - protein, 5 aa, Mycobacterium
DPGKV

SEQ ID NO: 240081 - protein, 4 aa, Mycobacterium
DPGL

SEQ ID NO: 240082 - protein, 10 aa, Mycobacterium
DPGPRRLPYP

SEQ ID NO: 240083 - protein, 9 aa, Mycobacterium
DPGPTDPPT

SEQ ID NO: 240084 - protein, 6 aa, Mycobacterium
DPGPVQ

SEQ ID NO: 240085 - protein, 12 aa, Mycobacterium
DPKGRHERTTTS

SEQ ID NO: 240086 - protein, 4 aa, Mycobacterium
DPLS

SEQ ID NO: 240087 - protein, 5 aa, Mycobacterium
DPPGC

SEQ ID NO: 240088 - protein, 6 aa, Mycobacterium
DPPYKT

SEQ ID NO: 240089 - protein, 4 aa, Mycobacterium
DPQG

SEQ ID NO: 240090 - protein, 8 aa, Mycobacterium
DPQVNEPL

SEQ ID NO: 240091 - protein, 6 aa, Mycobacterium
DPRDSN

SEQ ID NO: 240092 - protein, 11 aa, Mycobacterium
DPRRQDAAGNA

SEQ ID NO: 240093 - protein, 7 aa, Mycobacterium
DPRSTTT

SEQ ID NO: 240094 - protein, 5 aa, Mycobacterium
DPRVT

SEQ ID NO: 240095 - protein, 5 aa, Mycobacterium
DPTVA

SEQ ID NO: 240096 - protein, 5 aa, Mycobacterium
DPWGY

SEQ ID NO: 240097 - protein, 7 aa, Mycobacterium
DPWPEDV

SEQ ID NO: 240098 - protein, 4 aa, Mycobacterium
DQDE

SEQ ID NO: 240099 - protein, 6 aa, Mycobacterium
DQGGSS

SEQ ID NO: 240100 - protein, 5 aa, Mycobacterium
DQIDP

SEQ ID NO: 240101 - protein, 7 aa, Mycobacterium
DQITSRP

SEQ ID NO: 240102 - protein, 9 aa, Mycobacterium
DQKFTPADM

SEQ ID NO: 240103 - protein, 5 aa, Mycobacterium
DQLGT

SEQ ID NO: 240104 - protein, 12 aa, Mycobacterium
DQLTGEYRGGPA

SEQ ID NO: 240105 - protein, 6 aa, Mycobacterium
DQPGAE

SEQ ID NO: 240106 - protein, 6 aa, Mycobacterium
DQQGRD

SEQ ID NO: 240107 - protein, 4 aa, Mycobacterium
DRAA

SEQ ID NO: 240108 - protein, 6 aa, Mycobacterium
DRAADP

SEQ ID NO: 240109 - protein, 5 aa, Mycobacterium
DRAAL

SEQ ID NO: 240110 - protein, 8 aa, Mycobacterium
DRAEPTRE

SEQ ID NO: 240111 - protein, 6 aa, Mycobacterium
DRASAY

SEQ ID NO: 240112 - protein, 7 aa, Mycobacterium
DRGAGVP

SEQ ID NO: 240113 - protein, 7 aa, Mycobacterium
DRGETDG

SEQ ID NO: 240114 - protein, 13 aa, Mycobacterium
DRGNGRVLKLAQG

SEQ ID NO: 240115 - protein, 6 aa, Mycobacterium
DRGNNR

SEQ ID NO: 240116 - protein, 6 aa, Mycobacterium
DRIGGA

SEQ ID NO: 240117 - protein, 9 aa, Mycobacterium
DRPDPSDDR

SEQ ID NO: 240118 - protein, 5 aa, Mycobacterium
DRPFE

SEQ ID NO: 240119 - protein, 5 aa, Mycobacterium
DRPGV

SEQ ID NO: 240120 - protein, 7 aa, Mycobacterium
DRPLTPA

SEQ ID NO: 240121 - protein, 7 aa, Mycobacterium
DRPPMPP

SEQ ID NO: 240122 - protein, 4 aa, Mycobacterium
DRPT

SEQ ID NO: 240123 - protein, 4 aa, Mycobacterium
DRPV

SEQ ID NO: 240124 - protein, 6 aa, Mycobacterium
DRRKGG

SEQ ID NO: 240125 - protein, 6 aa, Mycobacterium
DRSRAL

SEQ ID NO: 240126 - protein, 7 aa, Mycobacterium
DRTATGE

SEQ ID NO: 240127 - protein, 7 aa, Mycobacterium
DRVGGGR

SEQ ID NO: 240128 - protein, 4 aa, Mycobacterium
DRVS

SEQ ID NO: 240129 - protein, 7 aa, Mycobacterium
DSAAGDI

SEQ ID NO: 240130 - protein, 8 aa, Mycobacterium
DSASTDIN

SEQ ID NO: 240131 - protein, 8 aa, Mycobacterium
DSKPGTEW

SEQ ID NO: 240132 - protein, 4 aa, Mycobacterium
DSMP

SEQ ID NO: 240133 - protein, 8 aa, Mycobacterium
DSNKVDEN

SEQ ID NO: 240134 - protein, 7 aa, Mycobacterium
DSNRDEI

SEQ ID NO: 240135 - protein, 4 aa, Mycobacterium
DSTV

SEQ ID NO: 240136 - protein, 9 aa, Mycobacterium
DTARPSARP

SEQ ID NO: 240137 - protein, 11 aa, Mycobacterium
DTDHDDDGDNA

SEQ ID NO: 240138 - protein, 7 aa, Mycobacterium
DTDPKRA

SEQ ID NO: 240139 - protein, 6 aa, Mycobacterium
DTDRDR

SEQ ID NO: 240140 - protein, 11 aa, Mycobacterium
DTEGEGGRKTV

SEQ ID NO: 240141 - protein, 5 aa, Mycobacterium
DTKHV

SEQ ID NO: 240142 - protein, 6 aa, Mycobacterium
DTPAEQ

SEQ ID NO: 240143 - protein, 7 aa, Mycobacterium
DTPPRGL

SEQ ID NO: 240144 - protein, 8 aa, Mycobacterium
DTPRPTAQ

SEQ ID NO: 240145 - protein, 4 aa, Mycobacterium
DTRA

SEQ ID NO: 240146 - protein, 6 aa, Mycobacterium
DTREVR

SEQ ID NO: 240147 - protein, 5 aa, Mycobacterium
DTRRP

SEQ ID NO: 240148 - protein, 9 aa, Mycobacterium
DTRYSTSPT

SEQ ID NO: 240149 - protein, 16 aa, Mycobacterium
DTVNPAAAEDPGSPIA

SEQ ID NO: 240150 - protein, 6 aa, Mycobacterium
DTYRGP

SEQ ID NO: 240151 - protein, 6 aa, Mycobacterium
DVARGG

SEQ ID NO: 240152 - protein, 13 aa, Mycobacterium
DVEPTERGAEATM

SEQ ID NO: 240153 - protein, 5 aa, Mycobacterium
DVPGM

SEQ ID NO: 240154 - protein, 15 aa, Mycobacterium
DVTNPAARNDASSPI

SEQ ID NO: 240155 - protein, 15 aa, Mycobacterium
DVTNPAARNDPSSPI

SEQ ID NO: 240156 - protein, 11 aa, Mycobacterium
DYEKQQKAGID

SEQ ID NO: 240157 - protein, 4 aa, Mycobacterium
DYGG

SEQ ID NO: 240158 - protein, 4 aa, Mycobacterium
EAAA

SEQ ID NO: 240159 - protein, 6 aa, Mycobacterium
EAAKQF

SEQ ID NO: 240160 - protein, 9 aa, Mycobacterium
EAANNPSQF

SEQ ID NO: 240161 - protein, 9 aa, Mycobacterium
EAASATEVQ

SEQ ID NO: 240162 - protein, 4 aa, Mycobacterium
EAAT

SEQ ID NO: 240163 - protein, 8 aa, Mycobacterium
EAATRERR

SEQ ID NO: 240164 - protein, 9 aa, Mycobacterium
EAATRTGGL

SEQ ID NO: 240165 - protein, 4 aa, Mycobacterium
EADA

SEQ ID NO: 240166 - protein, 6 aa, Mycobacterium
EADTEH

SEQ ID NO: 240167 - protein, 4 aa, Mycobacterium
EAEN

SEQ ID NO: 240168 - protein, 10 aa, Mycobacterium
EAEPELEGMG

SEQ ID NO: 240169 - protein, 4 aa, Mycobacterium
EAGI

SEQ ID NO: 240170 - protein, 7 aa, Mycobacterium
EAGPKRV

SEQ ID NO: 240171 - protein, 7 aa, Mycobacterium
EAGPRRL

SEQ ID NO: 240172 - protein, 9 aa, Mycobacterium
EAHGDPGNW

SEQ ID NO: 240173 - protein, 6 aa, Mycobacterium
EAPPEL

SEQ ID NO: 240174 - protein, 5 aa, Mycobacterium
EAPPL

SEQ ID NO: 240175 - protein, 11 aa, Mycobacterium
EAQHDRAPIQT

SEQ ID NO: 240176 - protein, 14 aa, Mycobacterium
EAQNSSSRAQRLAD

SEQ ID NO: 240177 - protein, 4 aa, Mycobacterium
EAQR

SEQ ID NO: 240178 - protein, 6 aa, Mycobacterium
EARAGD

SEQ ID NO: 240179 - protein, 11 aa, Mycobacterium
EARGLGEDREK

SEQ ID NO: 240180 - protein, 9 aa, Mycobacterium
EARNAGRLQ

SEQ ID NO: 240181 - protein, 11 aa, Mycobacterium
EARSAGQDRES

SEQ ID NO: 240182 - protein, 8 aa, Mycobacterium
EARSGVDH

SEQ ID NO: 240183 - protein, 9 aa, Mycobacterium
EASGGAAGQ

SEQ ID NO: 240184 - protein, 4 aa, Mycobacterium
EATQ

SEQ ID NO: 240185 - protein, 16 aa, Mycobacterium
EATVRRDGTETTIAPT

SEQ ID NO: 240186 - protein, 14 aa, Mycobacterium
EAVTGAGLTGHRDG

SEQ ID NO: 240187 - protein, 5 aa, Mycobacterium
EDDGR

SEQ ID NO: 240188 - protein, 4 aa, Mycobacterium
EDGR

SEQ ID NO: 240189 - protein, 14 aa, Mycobacterium
EDNRTYDLSGQAGP

SEQ ID NO: 240190 - protein, 5 aa, Mycobacterium
EDPDR

SEQ ID NO: 240191 - protein, 5 aa, Mycobacterium
EDQPW

SEQ ID NO: 240192 - protein, 4 aa, Mycobacterium
EDRT

SEQ ID NO: 240193 - protein, 4 aa, Mycobacterium
EDSR

SEQ ID NO: 240194 - protein, 16 aa, Mycobacterium
EDTQRTNRYRATRNRV

SEQ ID NO: 240195 - protein, 16 aa, Mycobacterium
EEAPEPDPDELPATGA

SEQ ID NO: 240196 - protein, 6 aa, Mycobacterium
EELEET

SEQ ID NO: 240197 - protein, 6 aa, Mycobacterium
EENTHG

SEQ ID NO: 240198 - protein, 7 aa, Mycobacterium
EERPGAV

SEQ ID NO: 240199 - protein, 7 aa, Mycobacterium
EETAAAY

SEQ ID NO: 240200 - protein, 11 aa, Mycobacterium
EETKHPQRDVP

SEQ ID NO: 240201 - protein, 8 aa, Mycobacterium
EFGGGRGA

SEQ ID NO: 240202 - protein, 4 aa, Mycobacterium
EFPG

SEQ ID NO: 240203 - protein, 4 aa, Mycobacterium
EGAG

SEQ ID NO: 240204 - protein, 9 aa, Mycobacterium
EGESETGAV

SEQ ID NO: 240205 - protein, 4 aa, Mycobacterium
EGGP

SEQ ID NO: 240206 - protein, 4 aa, Mycobacterium
EGIR

SEQ ID NO: 240207 - protein, 9 aa, Mycobacterium
EGLRGHGDD

SEQ ID NO: 240208 - protein, 8 aa, Mycobacterium
EGNPEGPT

SEQ ID NO: 240209 - protein, 4 aa, Mycobacterium
EGRG

SEQ ID NO: 240210 - protein, 8 aa, Mycobacterium
EGSAGQAS

SEQ ID NO: 240211 - protein, 7 aa, Mycobacterium
EGSPGLT

SEQ ID NO: 240212 - protein, 5 aa, Mycobacterium
EGSPL

SEQ ID NO: 240213 - protein, 5 aa, Mycobacterium
EGTDA

SEQ ID NO: 240214 - protein, 6 aa, Mycobacterium
EGTDAA

SEQ ID NO: 240215 - protein, 5 aa, Mycobacterium
EGTQR

SEQ ID NO: 240216 - protein, 11 aa, Mycobacterium
EGTRSPDGRLY

SEQ ID NO: 240217 - protein, 4 aa, Mycobacterium
EGVV

SEQ ID NO: 240218 - protein, 9 aa, Mycobacterium
EGYDTETAV

SEQ ID NO: 240219 - protein, 6 aa, Mycobacterium
EHGGLS

SEQ ID NO: 240220 - protein, 4 aa, Mycobacterium
EHGI

SEQ ID NO: 240221 - protein, 7 aa, Mycobacterium
EHRSARV

SEQ ID NO: 240222 - protein, 7 aa, Mycobacterium
EHSTPDQ

SEQ ID NO: 240223 - protein, 4 aa, Mycobacterium
EIAP

SEQ ID NO: 240224 - protein, 7 aa, Mycobacterium
EIRSRKP

SEQ ID NO: 240225 - protein, 5 aa, Mycobacterium
EITRD

SEQ ID NO: 240226 - protein, 13 aa, Mycobacterium
EKHRERGADLPPL

SEQ ID NO: 240227 - protein, 9 aa, Mycobacterium
EKPGPRPGA

SEQ ID NO: 240228 - protein, 7 aa, Mycobacterium
EKPTMTN

SEQ ID NO: 240229 - protein, 6 aa, Mycobacterium
EKRAPL

SEQ ID NO: 240230 - protein, 5 aa, Mycobacterium
EKREQ

SEQ ID NO: 240231 - protein, 4 aa, Mycobacterium
EKVD

SEQ ID NO: 240232 - protein, 20 aa, Mycobacterium
EKVRSGAITAPLGSQREYRP

SEQ ID NO: 240233 - protein, 5 aa, Mycobacterium
ELAPN

SEQ ID NO: 240234 - protein, 16 aa, Mycobacterium
ELHGGTAALQTSPLGG

SEQ ID NO: 240235 - protein, 21 aa, Mycobacterium
ELKDERTSNGVNAQTFCLVKS

SEQ ID NO: 240236 - protein, 7 aa, Mycobacterium
ELRDPRH

SEQ ID NO: 240237 - protein, 7 aa, Mycobacterium
ELRPEAP

SEQ ID NO: 240238 - protein, 7 aa, Mycobacterium
ELRPEAT

SEQ ID NO: 240239 - protein, 6 aa, Mycobacterium
ENDSGG

SEQ ID NO: 240240 - protein, 9 aa, Mycobacterium
ENDTVGGRP

SEQ ID NO: 240241 - protein, 9 aa, Mycobacterium
ENKAPPGVK

SEQ ID NO: 240242 - protein, 4 aa, Mycobacterium
ENPL

SEQ ID NO: 240243 - protein, 8 aa, Mycobacterium
ENSHPQQA

SEQ ID NO: 240244 - protein, 5 aa, Mycobacterium
ENTHG

SEQ ID NO: 240245 - protein, 6 aa, Mycobacterium
ENTPDG

SEQ ID NO: 240246 - protein, 5 aa, Mycobacterium
ENVYP

SEQ ID NO: 240247 - protein, 14 aa, Mycobacterium
EPAEELRSARSPQE

SEQ ID NO: 240248 - protein, 6 aa, Mycobacterium
EPDSNA

SEQ ID NO: 240249 - protein, 5 aa, Mycobacterium
EPEPP

SEQ ID NO: 240250 - protein, 8 aa, Mycobacterium
EPERENGR

SEQ ID NO: 240251 - protein, 4 aa, Mycobacterium
EPET

SEQ ID NO: 240252 - protein, 6 aa, Mycobacterium
EPGDRL

SEQ ID NO: 240253 - protein, 6 aa, Mycobacterium
EPGERL

SEQ ID NO: 240254 - protein, 4 aa, Mycobacterium
EPLG

SEQ ID NO: 240255 - protein, 7 aa, Mycobacterium
EPPFVGD

SEQ ID NO: 240256 - protein, 5 aa, Mycobacterium
EPPRV

SEQ ID NO: 240257 - protein, 4 aa, Mycobacterium
EPPT

SEQ ID NO: 240258 - protein, 9 aa, Mycobacterium
EPPYKGGPV

SEQ ID NO: 240259 - protein, 9 aa, Mycobacterium
EPTSGLDPA

SEQ ID NO: 240260 - protein, 14 aa, Mycobacterium
EPTTGAVSDIEQAT

SEQ ID NO: 240261 - protein, 15 aa, Mycobacterium
EPTTGAVSDIEQATK

SEQ ID NO: 240262 - protein, 5 aa, Mycobacterium
EQDMR

SEQ ID NO: 240263 - protein, 4 aa, Mycobacterium
EQGN

SEQ ID NO: 240264 - protein, 4 aa, Mycobacterium
EQGT

SEQ ID NO: 240265 - protein, 8 aa, Mycobacterium
EQPLGDEA

SEQ ID NO: 240266 - protein, 6 aa, Mycobacterium
EQRHAN

SEQ ID NO: 240267 - protein, 5 aa, Mycobacterium
EQRPA

SEQ ID NO: 240268 - protein, 10 aa, Mycobacterium
EQRRQNVPPD

SEQ ID NO: 240269 - protein, 11 aa, Mycobacterium
EQSRKGAAQRL

SEQ ID NO: 240270 - protein, 5 aa, Mycobacterium
EQTTA

SEQ ID NO: 240271 - protein, 5 aa, Mycobacterium
ERAAR

SEQ ID NO: 240272 - protein, 17 aa, Mycobacterium
ERAARAVEAAAQQDKFE

SEQ ID NO: 240273 - protein, 7 aa, Mycobacterium
ERAARPD

SEQ ID NO: 240274 - protein, 8 aa, Mycobacterium
ERAPEELR

SEQ ID NO: 240275 - protein, 10 aa, Mycobacterium
ERERSGKGQV

SEQ ID NO: 240276 - protein, 4 aa, Mycobacterium
ERGE

SEQ ID NO: 240277 - protein, 4 aa, Mycobacterium
ERGF

SEQ ID NO: 240278 - protein, 5 aa, Mycobacterium
ERGGR

SEQ ID NO: 240279 - protein, 5 aa, Mycobacterium
ERGRY

SEQ ID NO: 240280 - protein, 4 aa, Mycobacterium
ERGT

SEQ ID NO: 240281 - protein, 11 aa, Mycobacterium
ERGTELGGQER

SEQ ID NO: 240282 - protein, 6 aa, Mycobacterium
ERGTGG

SEQ ID NO: 240283 - protein, 5 aa, Mycobacterium
ERGTH

SEQ ID NO: 240284 - protein, 9 aa, Mycobacterium
ERHERSTHA

SEQ ID NO: 240285 - protein, 4 aa, Mycobacterium
ERIA

SEQ ID NO: 240286 - protein, 13 aa, Mycobacterium
ERIPPSIGLARRP

SEQ ID NO: 240287 - protein, 4 aa, Mycobacterium
ERIR

SEQ ID NO: 240288 - protein, 9 aa, Mycobacterium
ERNNPDGSV

SEQ ID NO: 240289 - protein, 7 aa, Mycobacterium
ERPDSGG

SEQ ID NO: 240290 - protein, 10 aa, Mycobacterium
ERRAKQAKTR

SEQ ID NO: 240291 - protein, 5 aa, Mycobacterium
ERRPL

SEQ ID NO: 240292 - protein, 6 aa, Mycobacterium
ERSRQG

SEQ ID NO: 240293 - protein, 4 aa, Mycobacterium
ESAG

SEQ ID NO: 240294 - protein, 10 aa, Mycobacterium
ESAITGESAP

SEQ ID NO: 240295 - protein, 14 aa, Mycobacterium
ESDGDGTTPESQEK

SEQ ID NO: 240296 - protein, 6 aa, Mycobacterium
ESDSDS

SEQ ID NO: 240297 - protein, 4 aa, Mycobacterium
ESEA

SEQ ID NO: 240298 - protein, 8 aa, Mycobacterium
ESGKEHKG

SEQ ID NO: 240299 - protein, 11 aa, Mycobacterium
ESKSDQEGMQG

SEQ ID NO: 240300 - protein, 7 aa, Mycobacterium
ESLSEEQ

SEQ ID NO: 240301 - protein, 5 aa, Mycobacterium
ESMEP

SEQ ID NO: 240302 - protein, 7 aa, Mycobacterium
ESMRARP

SEQ ID NO: 240303 - protein, 13 aa, Mycobacterium
ESPEGQASSLESI

SEQ ID NO: 240304 - protein, 12 aa, Mycobacterium
ESPQGLAAEASS

SEQ ID NO: 240305 - protein, 4 aa, Mycobacterium
ESRL

SEQ ID NO: 240306 - protein, 6 aa, Mycobacterium
ESSPAH

SEQ ID NO: 240307 - protein, 7 aa, Mycobacterium
ESVQSTL

SEQ ID NO: 240308 - protein, 7 aa, Mycobacterium
ESVSSGP

SEQ ID NO: 240309 - protein, 5 aa, Mycobacterium
ETARF

SEQ ID NO: 240310 - protein, 13 aa, Mycobacterium
ETCNGDSARRSGN

SEQ ID NO: 240311 - protein, 4 aa, Mycobacterium
ETGA

SEQ ID NO: 240312 - protein, 6 aa, Mycobacterium
ETGSPY

SEQ ID NO: 240313 - protein, 7 aa, Mycobacterium
ETGTTVA

SEQ ID NO: 240314 - protein, 8 aa, Mycobacterium
ETLGTSDE

SEQ ID NO: 240315 - protein, 16 aa, Mycobacterium
ETQSEWGEQQTPADSR

SEQ ID NO: 240316 - protein, 7 aa, Mycobacterium
ETRSEHP

SEQ ID NO: 240317 - protein, 9 aa, Mycobacterium
ETSPPGIRG

SEQ ID NO: 240318 - protein, 6 aa, Mycobacterium
ETYSQR

SEQ ID NO: 240319 - protein, 11 aa, Mycobacterium
EVADTAPSPVG

SEQ ID NO: 240320 - protein, 6 aa, Mycobacterium
EVAPGK

SEQ ID NO: 240321 - protein, 8 aa, Mycobacterium
EVEDHPDD

SEQ ID NO: 240322 - protein, 6 aa, Mycobacterium
EVPPDA

SEQ ID NO: 240323 - protein, 6 aa, Mycobacterium
EVRPEA

SEQ ID NO: 240324 - protein, 4 aa, Mycobacterium
EVRR

SEQ ID NO: 240325 - protein, 4 aa, Mycobacterium
EVTA

SEQ ID NO: 240326 - protein, 9 aa, Mycobacterium
EVTHPAKQG

SEQ ID NO: 240327 - protein, 15 aa, Mycobacterium
FAPGGPTAAVPPGSW

SEQ ID NO: 240328 - protein, 8 aa, Mycobacterium
FAQPPPDW

SEQ ID NO: 240329 - protein, 6 aa, Mycobacterium
FDAARS

SEQ ID NO: 240330 - protein, 6 aa, Mycobacterium
FDASKN

SEQ ID NO: 240331 - protein, 8 aa, Mycobacterium
FDPPEHTR

SEQ ID NO: 240332 - protein, 6 aa, Mycobacterium
FDSDSS

SEQ ID NO: 240333 - protein, 4 aa, Mycobacterium
FEGP

SEQ ID NO: 240334 - protein, 4 aa, Mycobacterium
FEQR

SEQ ID NO: 240335 - protein, 9 aa, Mycobacterium
FGAPDGPAD

SEQ ID NO: 240336 - protein, 10 aa, Mycobacterium
FGEGDYDGTE

SEQ ID NO: 240337 - protein, 8 aa, Mycobacterium
FGEQGSKT

SEQ ID NO: 240338 - protein, 10 aa, Mycobacterium
FGGEGTTTTA

SEQ ID NO: 240339 - protein, 13 aa, Mycobacterium
FGGEPGPVPNDGF

SEQ ID NO: 240340 - protein, 4 aa, Mycobacterium
FGGG

SEQ ID NO: 240341 - protein, 5 aa, Mycobacterium
FGGGN

SEQ ID NO: 240342 - protein, 4 aa, Mycobacterium
FGGQ

SEQ ID NO: 240343 - protein, 8 aa, Mycobacterium
FGKPSGYL

SEQ ID NO: 240344 - protein, 8 aa, Mycobacterium
FGNTGGDI

SEQ ID NO: 240345 - protein, 5 aa, Mycobacterium
FGPSR

SEQ ID NO: 240346 - protein, 8 aa, Mycobacterium
FGQAQNQA

SEQ ID NO: 240347 - protein, 4 aa, Mycobacterium
FGQG

SEQ ID NO: 240348 - protein, 6 aa, Mycobacterium
FGQSGQ

SEQ ID NO: 240349 - protein, 8 aa, Mycobacterium
FGQSQNQA

SEQ ID NO: 240350 - protein, 9 aa, Mycobacterium
FGSSGGPFA

SEQ ID NO: 240351 - protein, 4 aa, Mycobacterium
FGST

SEQ ID NO: 240352 - protein, 6 aa, Mycobacterium
FHDPPW

SEQ ID NO: 240353 - protein, 8 aa, Mycobacterium
FKESDSDS

SEQ ID NO: 240354 - protein, 10 aa, Mycobacterium
FNGSPATEPI

SEQ ID NO: 240355 - protein, 8 aa, Mycobacterium
FPDNTESR

SEQ ID NO: 240356 - protein, 19 aa, Mycobacterium
FPEVGSERQDLRQYPGGSL

SEQ ID NO: 240357 - protein, 4 aa, Mycobacterium
FPGK

SEQ ID NO: 240358 - protein, 8 aa, Mycobacterium
FPKGPARN

SEQ ID NO: 240359 - protein, 4 aa, Mycobacterium
FPPA

SEQ ID NO: 240360 - protein, 4 aa, Mycobacterium
FPPY

SEQ ID NO: 240361 - protein, 5 aa, Mycobacterium
FSGGS

SEQ ID NO: 240362 - protein, 8 aa, Mycobacterium
FSGRSSAR

SEQ ID NO: 240363 - protein, 5 aa, Mycobacterium
FSPDG

SEQ ID NO: 240364 - protein, 7 aa, Mycobacterium
FSPDGRR

SEQ ID NO: 240365 - protein, 10 aa, Mycobacterium
FSSGSAALTG

SEQ ID NO: 240366 - protein, 5 aa, Mycobacterium
FTGER

SEQ ID NO: 240367 - protein, 5 aa, Mycobacterium
FTGTG

SEQ ID NO: 240368 - protein, 10 aa, Mycobacterium
FTPNGIPADV

SEQ ID NO: 240369 - protein, 12 aa, Mycobacterium
FTTDPGAKPDGV

SEQ ID NO: 240370 - protein, 5 aa, Mycobacterium
GAAAL

SEQ ID NO: 240371 - protein, 4 aa, Mycobacterium
GAAE

SEQ ID NO: 240372 - protein, 7 aa, Mycobacterium
GAAEGVS

SEQ ID NO: 240373 - protein, 16 aa, Mycobacterium
GAAGGALAALASRRQS

SEQ ID NO: 240374 - protein, 16 aa, Mycobacterium
GAAGGALAAVASRRQS

SEQ ID NO: 240375 - protein, 20 aa, Mycobacterium
GAAGGPAAVESTDNLWLTRP

SEQ ID NO: 240376 - protein, 7 aa, Mycobacterium
GAATTTA

SEQ ID NO: 240377 - protein, 4 aa, Mycobacterium
GADT

SEQ ID NO: 240378 - protein, 5 aa, Mycobacterium
GAEAI

SEQ ID NO: 240379 - protein, 7 aa, Mycobacterium
GAEANSP

SEQ ID NO: 240380 - protein, 18 aa, Mycobacterium
GAEANSPVMDKNGGGPLG

SEQ ID NO: 240381 - protein, 18 aa, Mycobacterium
GAEANSPVMDNNGGGPLG

SEQ ID NO: 240382 - protein, 8 aa, Mycobacterium
GAEFGAGP

SEQ ID NO: 240383 - protein, 8 aa, Mycobacterium
GAEFGGGP

SEQ ID NO: 240384 - protein, 4 aa, Mycobacterium
GAEG

SEQ ID NO: 240385 - protein, 5 aa, Mycobacterium
GAETD

SEQ ID NO: 240386 - protein, 4 aa, Mycobacterium
GAFG

SEQ ID NO: 240387 - protein, 9 aa, Mycobacterium
GAGAGLPDF

SEQ ID NO: 240388 - protein, 4 aa, Mycobacterium
GAGF

SEQ ID NO: 240389 - protein, 9 aa, Mycobacterium
GAGSGIGRE

SEQ ID NO: 240390 - protein, 9 aa, Mycobacterium
GAGSTRQHD

SEQ ID NO: 240391 - protein, 8 aa, Mycobacterium
GAKPNGEL

SEQ ID NO: 240392 - protein, 5 aa, Mycobacterium
GALDD

SEQ ID NO: 240393 - protein, 4 aa, Mycobacterium
GALE

SEQ ID NO: 240394 - protein, 11 aa, Mycobacterium
GALGDPADLAG

SEQ ID NO: 240395 - protein, 9 aa, Mycobacterium
GALKANASS

SEQ ID NO: 240396 - protein, 4 aa, Mycobacterium
GALT

SEQ ID NO: 240397 - protein, 8 aa, Mycobacterium
GANNTDSV

SEQ ID NO: 240398 - protein, 4 aa, Mycobacterium
GAPF

SEQ ID NO: 240399 - protein, 6 aa, Mycobacterium
GAPLGL

SEQ ID NO: 240400 - protein, 8 aa, Mycobacterium
GAPPKGLT

SEQ ID NO: 240401 - protein, 4 aa, Mycobacterium
GAPQ

SEQ ID NO: 240402 - protein, 7 aa, Mycobacterium
GAPVPQR

SEQ ID NO: 240403 - protein, 8 aa, Mycobacterium
GARDAGAD

SEQ ID NO: 240404 - protein, 8 aa, Mycobacterium
GARDAGAE

SEQ ID NO: 240405 - protein, 5 aa, Mycobacterium
GARGE

SEQ ID NO: 240406 - protein, 5 aa, Mycobacterium
GARGQ

SEQ ID NO: 240407 - protein, 12 aa, Mycobacterium
GARKPHKSTVQK

SEQ ID NO: 240408 - protein, 4 aa, Mycobacterium
GARP

SEQ ID NO: 240409 - protein, 5 aa, Mycobacterium
GARTR

SEQ ID NO: 240410 - protein, 5 aa, Mycobacterium
GASAA

SEQ ID NO: 240411 - protein, 6 aa, Mycobacterium
GASPAW

SEQ ID NO: 240412 - protein, 5 aa, Mycobacterium
GATAG

SEQ ID NO: 240413 - protein, 9 aa, Mycobacterium
GATDAARAA

SEQ ID NO: 240414 - protein, 4 aa, Mycobacterium
GATE

SEQ ID NO: 240415 - protein, 5 aa, Mycobacterium
GATGE

SEQ ID NO: 240416 - protein, 10 aa, Mycobacterium
GATLPHANAG

SEQ ID NO: 240417 - protein, 4 aa, Mycobacterium
GATP

SEQ ID NO: 240418 - protein, 7 aa, Mycobacterium
GATQTAP

SEQ ID NO: 240419 - protein, 8 aa, Mycobacterium
GATTPAHG

SEQ ID NO: 240420 - protein, 7 aa, Mycobacterium
GATTPRL

SEQ ID NO: 240421 - protein, 7 aa, Mycobacterium
GATVEQA

SEQ ID NO: 240422 - protein, 7 aa, Mycobacterium
GATVNTD

SEQ ID NO: 240423 - protein, 5 aa, Mycobacterium
GAVTT

SEQ ID NO: 240424 - protein, 14 aa, Mycobacterium
GCPQPEKTQPTTQT

SEQ ID NO: 240425 - protein, 6 aa, Mycobacterium
GDATKA

SEQ ID NO: 240426 - protein, 5 aa, Mycobacterium
GDDEA

SEQ ID NO: 240427 - protein, 5 aa, Mycobacterium
GDDPM

SEQ ID NO: 240428 - protein, 4 aa, Mycobacterium
GDFG

SEQ ID NO: 240429 - protein, 4 aa, Mycobacterium
GDGD

SEQ ID NO: 240430 - protein, 5 aa, Mycobacterium
GDGLA

SEQ ID NO: 240431 - protein, 19 aa, Mycobacterium
GDGPRAATTAGPVDQVPNS

SEQ ID NO: 240432 - protein, 6 aa, Mycobacterium
GDGVGG

SEQ ID NO: 240433 - protein, 11 aa, Mycobacterium
GDGVNDAPALR

SEQ ID NO: 240434 - protein, 6 aa, Mycobacterium
GDKVPA

SEQ ID NO: 240435 - protein, 7 aa, Mycobacterium
GDNGYSL

SEQ ID NO: 240436 - protein, 9 aa, Mycobacterium
GDNLAHPKA

SEQ ID NO: 240437 - protein, 4 aa, Mycobacterium
GDPA

SEQ ID NO: 240438 - protein, 7 aa, Mycobacterium
GDPASVE

SEQ ID NO: 240439 - protein, 9 aa, Mycobacterium
GDPATSAGI

SEQ ID NO: 240440 - protein, 6 aa, Mycobacterium
GDPDAS

SEQ ID NO: 240441 - protein, 5 aa, Mycobacterium
GDPKV

SEQ ID NO: 240442 - protein, 8 aa, Mycobacterium
GDPMSPEG

SEQ ID NO: 240443 - protein, 9 aa, Mycobacterium
GDPMSPEGI

SEQ ID NO: 240444 - protein, 8 aa, Mycobacterium
GDPTAGTI

SEQ ID NO: 240445 - protein, 4 aa, Mycobacterium
GDRE

SEQ ID NO: 240446 - protein, 6 aa, Mycobacterium
GDRVPA

SEQ ID NO: 240447 - protein, 12 aa, Mycobacterium
GDSPNKSGYPGP

SEQ ID NO: 240448 - protein, 5 aa, Mycobacterium
GDVPA

SEQ ID NO: 240449 - protein, 10 aa, Mycobacterium
GEAGSTPAAH

SEQ ID NO: 240450 - protein, 10 aa, Mycobacterium
GEAQAQRKEP

SEQ ID NO: 240451 - protein, 12 aa, Mycobacterium
GEDIAKTGNPVV

SEQ ID NO: 240452 - protein, 13 aa, Mycobacterium
GEESKDPTKVPGR

SEQ ID NO: 240453 - protein, 6 aa, Mycobacterium
GEGGTL

SEQ ID NO: 240454 - protein, 10 aa, Mycobacterium
GEGQDLQSED

SEQ ID NO: 240455 - protein, 5 aa, Mycobacterium
GEGRA

SEQ ID NO: 240456 - protein, 6 aa, Mycobacterium
GEGVSA

SEQ ID NO: 240457 - protein, 7 aa, Mycobacterium
GEHGGLS

SEQ ID NO: 240458 - protein, 10 aa, Mycobacterium
GEKSPSGVSS

SEQ ID NO: 240459 - protein, 6 aa, Mycobacterium
GELGAD

SEQ ID NO: 240460 - protein, 6 aa, Mycobacterium
GELGAN

SEQ ID NO: 240461 - protein, 5 aa, Mycobacterium
GEMNR

SEQ ID NO: 240462 - protein, 12 aa, Mycobacterium
GENDMDHPKRTS

SEQ ID NO: 240463 - protein, 8 aa, Mycobacterium
GENGDGAL

SEQ ID NO: 240464 - protein, 6 aa, Mycobacterium
GEPDDG

SEQ ID NO: 240465 - protein, 4 aa, Mycobacterium
GEPG

SEQ ID NO: 240466 - protein, 12 aa, Mycobacterium
GEPHGRGRPEDA

SEQ ID NO: 240467 - protein, 4 aa, Mycobacterium
GEPI

SEQ ID NO: 240468 - protein, 10 aa, Mycobacterium
GEPPFTGDSP

SEQ ID NO: 240469 - protein, 4 aa, Mycobacterium
GEPV

SEQ ID NO: 240470 - protein, 8 aa, Mycobacterium
GEQAAAAA

SEQ ID NO: 240471 - protein, 17 aa, Mycobacterium
GERAATDGTIRSGQTSL

SEQ ID NO: 240472 - protein, 7 aa, Mycobacterium
GERIPAD

SEQ ID NO: 240473 - protein, 5 aa, Mycobacterium
GEVPA

SEQ ID NO: 240474 - protein, 4 aa, Mycobacterium
GEWG

SEQ ID NO: 240475 - protein, 4 aa, Mycobacterium
GFGP

SEQ ID NO: 240476 - protein, 8 aa, Mycobacterium
GFTAGTPV

SEQ ID NO: 240477 - protein, 4 aa, Mycobacterium
GGAA

SEQ ID NO: 240478 - protein, 8 aa, Mycobacterium
GGADAQAL

SEQ ID NO: 240479 - protein, 8 aa, Mycobacterium
GGAFNNDT

SEQ ID NO: 240480 - protein, 12 aa, Mycobacterium
GGAGLGLRSGGP

SEQ ID NO: 240481 - protein, 4 aa, Mycobacterium
GGAT

SEQ ID NO: 240482 - protein, 5 aa, Mycobacterium
GGATA

SEQ ID NO: 240483 - protein, 6 aa, Mycobacterium
GGATAR

SEQ ID NO: 240484 - protein, 4 aa, Mycobacterium
GGDQ

SEQ ID NO: 240485 - protein, 8 aa, Mycobacterium
GGEEWAGT

SEQ ID NO: 240486 - protein, 5 aa, Mycobacterium
GGGAR

SEQ ID NO: 240487 - protein, 9 aa, Mycobacterium
GGGDEPPPA

SEQ ID NO: 240488 - protein, 9 aa, Mycobacterium
GGGDTPPPA

SEQ ID NO: 240489 - protein, 5 aa, Mycobacterium
GGGGL

SEQ ID NO: 240490 - protein, 7 aa, Mycobacterium
GGGPDNV

SEQ ID NO: 240491 - protein, 7 aa, Mycobacterium
GGGPQGW

SEQ ID NO: 240492 - protein, 11 aa, Mycobacterium
GGGQRDPQTPM

SEQ ID NO: 240493 - protein, 4 aa, Mycobacterium
GGGT

SEQ ID NO: 240494 - protein, 12 aa, Mycobacterium
GGHRSEGGRRGV

SEQ ID NO: 240495 - protein, 7 aa, Mycobacterium
GGITPGN

SEQ ID NO: 240496 - protein, 13 aa, Mycobacterium
GGKAGFPPDGRAG

SEQ ID NO: 240497 - protein, 4 aa, Mycobacterium
GGLA

SEQ ID NO: 240498 - protein, 4 aa, Mycobacterium
GGPA

SEQ ID NO: 240499 - protein, 5 aa, Mycobacterium
GGPAD

SEQ ID NO: 240500 - protein, 4 aa, Mycobacterium
GGPE

SEQ ID NO: 240501 - protein, 5 aa, Mycobacterium
GGPGS

SEQ ID NO: 240502 - protein, 4 aa, Mycobacterium
GGPH

SEQ ID NO: 240503 - protein, 4 aa, Mycobacterium
GGPL

SEQ ID NO: 240504 - protein, 4 aa, Mycobacterium
GGPP

SEQ ID NO: 240505 - protein, 8 aa, Mycobacterium
GGPQAVAD

SEQ ID NO: 240506 - protein, 4 aa, Mycobacterium
GGPT

SEQ ID NO: 240507 - protein, 6 aa, Mycobacterium
GGPTQY

SEQ ID NO: 240508 - protein, 4 aa, Mycobacterium
GGQA

SEQ ID NO: 240509 - protein, 5 aa, Mycobacterium
GGQEK

SEQ ID NO: 240510 - protein, 4 aa, Mycobacterium
GGQI

SEQ ID NO: 240511 - protein, 11 aa, Mycobacterium
GGQQQMSRPKL

SEQ ID NO: 240512 - protein, 4 aa, Mycobacterium
GGRG

SEQ ID NO: 240513 - protein, 6 aa, Mycobacterium
GGRSVS

SEQ ID NO: 240514 - protein, 5 aa, Mycobacterium
GGSHV

SEQ ID NO: 240515 - protein, 9 aa, Mycobacterium
GGSKPYGYA

SEQ ID NO: 240516 - protein, 9 aa, Mycobacterium
GGSPGASTA

SEQ ID NO: 240517 - protein, 6 aa, Mycobacterium
GGSTGS

SEQ ID NO: 240518 - protein, 5 aa, Mycobacterium
GGSTT

SEQ ID NO: 240519 - protein, 4 aa, Mycobacterium
GGSV

SEQ ID NO: 240520 - protein, 4 aa, Mycobacterium
GGTG

SEQ ID NO: 240521 - protein, 4 aa, Mycobacterium
GGTL

SEQ ID NO: 240522 - protein, 4 aa, Mycobacterium
GGVA

SEQ ID NO: 240523 - protein, 7 aa, Mycobacterium
GGVPENF

SEQ ID NO: 240524 - protein, 4 aa, Mycobacterium
GGWP

SEQ ID NO: 240525 - protein, 5 aa, Mycobacterium
GGYAT

SEQ ID NO: 240526 - protein, 6 aa, Mycobacterium
GGYQAR

SEQ ID NO: 240527 - protein, 10 aa, Mycobacterium
GHDATAASDV

SEQ ID NO: 240528 - protein, 11 aa, Mycobacterium
GHDPDDGVGGD

SEQ ID NO: 240529 - protein, 12 aa, Mycobacterium
GHGTGTTLGDPI

SEQ ID NO: 240530 - protein, 7 aa, Mycobacterium
GHKKESL

SEQ ID NO: 240531 - protein, 4 aa, Mycobacterium
GHQA

SEQ ID NO: 240532 - protein, 5 aa, Mycobacterium
GHRAR

SEQ ID NO: 240533 - protein, 15 aa, Mycobacterium
GIGPARLEKLRALVR

SEQ ID NO: 240534 - protein, 6 aa, Mycobacterium
GIGQAG

SEQ ID NO: 240535 - protein, 10 aa, Mycobacterium
GIRDGDERQP

SEQ ID NO: 240536 - protein, 5 aa, Mycobacterium
GISAA

SEQ ID NO: 240537 - protein, 5 aa, Mycobacterium
GISTG

SEQ ID NO: 240538 - protein, 8 aa, Mycobacterium
GKEANGSR

SEQ ID NO: 240539 - protein, 10 aa, Mycobacterium
GKEEDEPEQR

SEQ ID NO: 240540 - protein, 15 aa, Mycobacterium
GKEQQRTKAALESAR

SEQ ID NO: 240541 - protein, 5 aa, Mycobacterium
GKFPY

SEQ ID NO: 240542 - protein, 8 aa, Mycobacterium
GKIGPSQA

SEQ ID NO: 240543 - protein, 9 aa, Mycobacterium
GKKLDEPYL

SEQ ID NO: 240544 - protein, 6 aa, Mycobacterium
GKPETF

SEQ ID NO: 240545 - protein, 9 aa, Mycobacterium
GKPKTPRGF

SEQ ID NO: 240546 - protein, 27 aa, Mycobacterium
GKRAATPRECRDPKPYVPAGTNPWYGD

SEQ ID NO: 240547 - protein, 7 aa, Mycobacterium
GKSKSTA

SEQ ID NO: 240548 - protein, 7 aa, Mycobacterium
GKVAAAP

SEQ ID NO: 240549 - protein, 12 aa, Mycobacterium
GKVAAENATSNW

SEQ ID NO: 240550 - protein, 9 aa, Mycobacterium
GKVAGGVSQ

SEQ ID NO: 240551 - protein, 5 aa, Mycobacterium
GKYTG

SEQ ID NO: 240552 - protein, 7 aa, Mycobacterium
GLDEASN

SEQ ID NO: 240553 - protein, 5 aa, Mycobacterium
GLGAG

SEQ ID NO: 240554 - protein, 6 aa, Mycobacterium
GLGGGN

SEQ ID NO: 240555 - protein, 9 aa, Mycobacterium
GLGGGNYAA

SEQ ID NO: 240556 - protein, 12 aa, Mycobacterium
GLPHRSATRSFA

SEQ ID NO: 240557 - protein, 6 aa, Mycobacterium
GLPRGG

SEQ ID NO: 240558 - protein, 7 aa, Mycobacterium
GLPTGSS

SEQ ID NO: 240559 - protein, 6 aa, Mycobacterium
GLQTGS

SEQ ID NO: 240560 - protein, 6 aa, Mycobacterium
GLRPRY

SEQ ID NO: 240561 - protein, 4 aa, Mycobacterium
GLTA

SEQ ID NO: 240562 - protein, 4 aa, Mycobacterium
GLTG

SEQ ID NO: 240563 - protein, 10 aa, Mycobacterium
GLTGPKTAVR

SEQ ID NO: 240564 - protein, 5 aa, Mycobacterium
GLTGS

SEQ ID NO: 240565 - protein, 8 aa, Mycobacterium
GMSATGPQ

SEQ ID NO: 240566 - protein, 6 aa, Mycobacterium
GMTPRA

SEQ ID NO: 240567 - protein, 5 aa, Mycobacterium
GNATG

SEQ ID NO: 240568 - protein, 7 aa, Mycobacterium
GNGPRTD

SEQ ID NO: 240569 - protein, 6 aa, Mycobacterium
GNLGGP

SEQ ID NO: 240570 - protein, 10 aa, Mycobacterium
GNNPAAQTTE

SEQ ID NO: 240571 - protein, 6 aa, Mycobacterium
GNPRYA

SEQ ID NO: 240572 - protein, 12 aa, Mycobacterium
GNQGEPLANESV

SEQ ID NO: 240573 - protein, 12 aa, Mycobacterium
GNQGSTLGNESV

SEQ ID NO: 240574 - protein, 7 aa, Mycobacterium
GNRETPA

SEQ ID NO: 240575 - protein, 5 aa, Mycobacterium
GNRPR

SEQ ID NO: 240576 - protein, 6 aa, Mycobacterium
GNTAAN

SEQ ID NO: 240577 - protein, 6 aa, Mycobacterium
GNTRDA

SEQ ID NO: 240578 - protein, 4 aa, Mycobacterium
GNVP

SEQ ID NO: 240579 - protein, 7 aa, Mycobacterium
GPAAAGT

SEQ ID NO: 240580 - protein, 5 aa, Mycobacterium
GPAIG

SEQ ID NO: 240581 - protein, 4 aa, Mycobacterium
GPDD

SEQ ID NO: 240582 - protein, 5 aa, Mycobacterium
GPDIY

SEQ ID NO: 240583 - protein, 4 aa, Mycobacterium
GPEA

SEQ ID NO: 240584 - protein, 14 aa, Mycobacterium
GPEKTVPPERVRTC

SEQ ID NO: 240585 - protein, 8 aa, Mycobacterium
GPGAGLAG

SEQ ID NO: 240586 - protein, 4 aa, Mycobacterium
GPGF

SEQ ID NO: 240587 - protein, 5 aa, Mycobacterium
GPGGA

SEQ ID NO: 240588 - protein, 7 aa, Mycobacterium
GPGGAGL

SEQ ID NO: 240589 - protein, 5 aa, Mycobacterium
GPGRY

SEQ ID NO: 240590 - protein, 4 aa, Mycobacterium
GPGT

SEQ ID NO: 240591 - protein, 8 aa, Mycobacterium
GPGTPEVL

SEQ ID NO: 240592 - protein, 4 aa, Mycobacterium
GPIP

SEQ ID NO: 240593 - protein, 4 aa, Mycobacterium
GPLG

SEQ ID NO: 240594 - protein, 10 aa, Mycobacterium
GPLSSIGDGL

SEQ ID NO: 240595 - protein, 7 aa, Mycobacterium
GPLTPKD

SEQ ID NO: 240596 - protein, 6 aa, Mycobacterium
GPPGLR

SEQ ID NO: 240597 - protein, 6 aa, Mycobacterium
GPPGTV

SEQ ID NO: 240598 - protein, 5 aa, Mycobacterium
GPPIA

SEQ ID NO: 240599 - protein, 4 aa, Mycobacterium
GPPL

SEQ ID NO: 240600 - protein, 5 aa, Mycobacterium
GPPPV

SEQ ID NO: 240601 - protein, 33 aa, Mycobacterium
GPQGSWSPGNMGPSGPWGPGQWQPPTTTPTTPR

SEQ ID NO: 240602 - protein, 4 aa, Mycobacterium
GPRP

SEQ ID NO: 240603 - protein, 8 aa, Mycobacterium
GPRPPLSR

SEQ ID NO: 240604 - protein, 5 aa, Mycobacterium
GPRRH

SEQ ID NO: 240605 - protein, 4 aa, Mycobacterium
GPSA

SEQ ID NO: 240606 - protein, 9 aa, Mycobacterium
GPSGAGKST

SEQ ID NO: 240607 - protein, 4 aa, Mycobacterium
GPTG

SEQ ID NO: 240608 - protein, 6 aa, Mycobacterium
GPTLSR

SEQ ID NO: 240609 - protein, 6 aa, Mycobacterium
GPTNDV

SEQ ID NO: 240610 - protein, 5 aa, Mycobacterium
GPTPA

SEQ ID NO: 240611 - protein, 11 aa, Mycobacterium
GPTPEQPKGPF

SEQ ID NO: 240612 - protein, 8 aa, Mycobacterium
GPVDDHGH

SEQ ID NO: 240613 - protein, 11 aa, Mycobacterium
GPVTEREPVPP

SEQ ID NO: 240614 - protein, 7 aa, Mycobacterium
GPVTSEF

SEQ ID NO: 240615 - protein, 5 aa, Mycobacterium
GPYPI

SEQ ID NO: 240616 - protein, 9 aa, Mycobacterium
GPYTGPSAD

SEQ ID NO: 240617 - protein, 8 aa, Mycobacterium
GQASPTHM

SEQ ID NO: 240618 - protein, 8 aa, Mycobacterium
GQASSTHM

SEQ ID NO: 240619 - protein, 6 aa, Mycobacterium
GQASYQ

SEQ ID NO: 240620 - protein, 5 aa, Mycobacterium
GQFTG

SEQ ID NO: 240621 - protein, 6 aa, Mycobacterium
GQGGTL

SEQ ID NO: 240622 - protein, 8 aa, Mycobacterium
GQLAGTSF

SEQ ID NO: 240623 - protein, 7 aa, Mycobacterium
GQNSLPQ

SEQ ID NO: 240624 - protein, 6 aa, Mycobacterium
GQPFDP

SEQ ID NO: 240625 - protein, 6 aa, Mycobacterium
GQPFKP

SEQ ID NO: 240626 - protein, 4 aa, Mycobacterium
GQPL

SEQ ID NO: 240627 - protein, 4 aa, Mycobacterium
GQRP

SEQ ID NO: 240628 - protein, 6 aa, Mycobacterium
GQRRGV

SEQ ID NO: 240629 - protein, 4 aa, Mycobacterium
GQRS

SEQ ID NO: 240630 - protein, 5 aa, Mycobacterium
GQSKG

SEQ ID NO: 240631 - protein, 7 aa, Mycobacterium
GQVNGPK

SEQ ID NO: 240632 - protein, 5 aa, Mycobacterium
GQVSA

SEQ ID NO: 240633 - protein, 6 aa, Mycobacterium
GRANDN

SEQ ID NO: 240634 - protein, 6 aa, Mycobacterium
GRASQM

SEQ ID NO: 240635 - protein, 5 aa, Mycobacterium
GRDGE

SEQ ID NO: 240636 - protein, 6 aa, Mycobacterium
GRDGGD

SEQ ID NO: 240637 - protein, 7 aa, Mycobacterium
GRDNQNR

SEQ ID NO: 240638 - protein, 4 aa, Mycobacterium
GREA

SEQ ID NO: 240639 - protein, 4 aa, Mycobacterium
GRGA

SEQ ID NO: 240640 - protein, 4 aa, Mycobacterium
GRGE

SEQ ID NO: 240641 - protein, 4 aa, Mycobacterium
GRGG

SEQ ID NO: 240642 - protein, 15 aa, Mycobacterium
GRGLQDRLTATAVVR

SEQ ID NO: 240643 - protein, 4 aa, Mycobacterium
GRGV

SEQ ID NO: 240644 - protein, 6 aa, Mycobacterium
GRHNDT

SEQ ID NO: 240645 - protein, 5 aa, Mycobacterium
GRIPD

SEQ ID NO: 240646 - protein, 5 aa, Mycobacterium
GRIPG

SEQ ID NO: 240647 - protein, 13 aa, Mycobacterium
GRITREEAHSHPQ

SEQ ID NO: 240648 - protein, 8 aa, Mycobacterium
GRKQDSPA

SEQ ID NO: 240649 - protein, 11 aa, Mycobacterium
GRLPAQSSQLY

SEQ ID NO: 240650 - protein, 4 aa, Mycobacterium
GRPA

SEQ ID NO: 240651 - protein, 8 aa, Mycobacterium
GRPAPTDG

SEQ ID NO: 240652 - protein, 5 aa, Mycobacterium
GRPIA

SEQ ID NO: 240653 - protein, 6 aa, Mycobacterium
GRPNGV

SEQ ID NO: 240654 - protein, 6 aa, Mycobacterium
GRPTDH

SEQ ID NO: 240655 - protein, 6 aa, Mycobacterium
GRQRGE

SEQ ID NO: 240656 - protein, 4 aa, Mycobacterium
GRRA

SEQ ID NO: 240657 - protein, 9 aa, Mycobacterium
GRSGAGKTT

SEQ ID NO: 240658 - protein, 5 aa, Mycobacterium
GRSGR

SEQ ID NO: 240659 - protein, 5 aa, Mycobacterium
GRSQM

SEQ ID NO: 240660 - protein, 9 aa, Mycobacterium
GRTAPTQLA

SEQ ID NO: 240661 - protein, 5 aa, Mycobacterium
GRTGR

SEQ ID NO: 240662 - protein, 5 aa, Mycobacterium
GRTGT

SEQ ID NO: 240663 - protein, 16 aa, Mycobacterium
GRTPPPPATREPLPAE

SEQ ID NO: 240664 - protein, 15 aa, Mycobacterium
GRVPSDKPPIKTPGE

SEQ ID NO: 240665 - protein, 4 aa, Mycobacterium
GSAN

SEQ ID NO: 240666 - protein, 4 aa, Mycobacterium
GSAT

SEQ ID NO: 240667 - protein, 8 aa, Mycobacterium
GSAVGPAL

SEQ ID NO: 240668 - protein, 5 aa, Mycobacterium
GSDSK

SEQ ID NO: 240669 - protein, 4 aa, Mycobacterium
GSED

SEQ ID NO: 240670 - protein, 7 aa, Mycobacterium
GSFANDT

SEQ ID NO: 240671 - protein, 6 aa, Mycobacterium
GSFNYG

SEQ ID NO: 240672 - protein, 6 aa, Mycobacterium
GSGDDD

SEQ ID NO: 240673 - protein, 4 aa, Mycobacterium
GSGE

SEQ ID NO: 240674 - protein, 8 aa, Mycobacterium
GSGGSTGS

SEQ ID NO: 240675 - protein, 5 aa, Mycobacterium
GSGNV

SEQ ID NO: 240676 - protein, 6 aa, Mycobacterium
GSGPLT

SEQ ID NO: 240677 - protein, 9 aa, Mycobacterium
GSGSSASRA

SEQ ID NO: 240678 - protein, 4 aa, Mycobacterium
GSGV

SEQ ID NO: 240679 - protein, 4 aa, Mycobacterium
GSKD

SEQ ID NO: 240680 - protein, 6 aa, Mycobacterium
GSLNGT

SEQ ID NO: 240681 - protein, 4 aa, Mycobacterium
GSNG

SEQ ID NO: 240682 - protein, 4 aa, Mycobacterium
GSPE

SEQ ID NO: 240683 - protein, 6 aa, Mycobacterium
GSPEAA

SEQ ID NO: 240684 - protein, 8 aa, Mycobacterium
GSPPYRGD

SEQ ID NO: 240685 - protein, 4 aa, Mycobacterium
GSPT

SEQ ID NO: 240686 - protein, 10 aa, Mycobacterium
GSPTDAGTPV

SEQ ID NO: 240687 - protein, 6 aa, Mycobacterium
GSRSEM

SEQ ID NO: 240688 - protein, 10 aa, Mycobacterium
GSSCGPTDHI

SEQ ID NO: 240689 - protein, 5 aa, Mycobacterium
GSSGA

SEQ ID NO: 240690 - protein, 4 aa, Mycobacterium
GSST

SEQ ID NO: 240691 - protein, 7 aa, Mycobacterium
GSSTGGI

SEQ ID NO: 240692 - protein, 5 aa, Mycobacterium
GSSVA

SEQ ID NO: 240693 - protein, 5 aa, Mycobacterium
GSTFA

SEQ ID NO: 240694 - protein, 7 aa, Mycobacterium
GSTGGVI

SEQ ID NO: 240695 - protein, 4 aa, Mycobacterium
GSVS

SEQ ID NO: 240696 - protein, 4 aa, Mycobacterium
GSVT

SEQ ID NO: 240697 - protein, 4 aa, Mycobacterium
GTAA

SEQ ID NO: 240698 - protein, 17 aa, Mycobacterium
GTATRTGWWSPGPIRIK

SEQ ID NO: 240699 - protein, 8 aa, Mycobacterium
GTATTGRL

SEQ ID NO: 240700 - protein, 12 aa, Mycobacterium
GTDQEQAAATLG

SEQ ID NO: 240701 - protein, 6 aa, Mycobacterium
GTEPST

SEQ ID NO: 240702 - protein, 5 aa, Mycobacterium
GTGKV

SEQ ID NO: 240703 - protein, 6 aa, Mycobacterium
GTGKVV

SEQ ID NO: 240704 - protein, 4 aa, Mycobacterium
GTGM

SEQ ID NO: 240705 - protein, 6 aa, Mycobacterium
GTGMAG

SEQ ID NO: 240706 - protein, 9 aa, Mycobacterium
GTGQPIGAP

SEQ ID NO: 240707 - protein, 8 aa, Mycobacterium
GTGRGRPS

SEQ ID NO: 240708 - protein, 5 aa, Mycobacterium
GTGSG

SEQ ID NO: 240709 - protein, 4 aa, Mycobacterium
GTIT

SEQ ID NO: 240710 - protein, 8 aa, Mycobacterium
GTKGKTAV

SEQ ID NO: 240711 - protein, 4 aa, Mycobacterium
GTLD

SEQ ID NO: 240712 - protein, 6 aa, Mycobacterium
GTLSTL

SEQ ID NO: 240713 - protein, 6 aa, Mycobacterium
GTLTMG

SEQ ID NO: 240714 - protein, 8 aa, Mycobacterium
GTPALEQD

SEQ ID NO: 240715 - protein, 12 aa, Mycobacterium
GTPDYGAPARLD

SEQ ID NO: 240716 - protein, 4 aa, Mycobacterium
GTPF

SEQ ID NO: 240717 - protein, 4 aa, Mycobacterium
GTPG

SEQ ID NO: 240718 - protein, 11 aa, Mycobacterium
GTPQKKGEYGA

SEQ ID NO: 240719 - protein, 5 aa, Mycobacterium
GTPQL

SEQ ID NO: 240720 - protein, 4 aa, Mycobacterium
GTPV

SEQ ID NO: 240721 - protein, 4 aa, Mycobacterium
GTRP

SEQ ID NO: 240722 - protein, 5 aa, Mycobacterium
GTRPI

SEQ ID NO: 240723 - protein, 10 aa, Mycobacterium
GTTGAGKTTI

SEQ ID NO: 240724 - protein, 8 aa, Mycobacterium
GTTGVPKG

SEQ ID NO: 240725 - protein, 6 aa, Mycobacterium
GTTQRL

SEQ ID NO: 240726 - protein, 7 aa, Mycobacterium
GTVTPAA

SEQ ID NO: 240727 - protein, 4 aa, Mycobacterium
GVAG

SEQ ID NO: 240728 - protein, 4 aa, Mycobacterium
GVAP

SEQ ID NO: 240729 - protein, 4 aa, Mycobacterium
GVGD

SEQ ID NO: 240730 - protein, 7 aa, Mycobacterium
GVKGGDG

SEQ ID NO: 240731 - protein, 6 aa, Mycobacterium
GVNDAA

SEQ ID NO: 240732 - protein, 15 aa, Mycobacterium
GVNGSPRVPAEPGGD

SEQ ID NO: 240733 - protein, 15 aa, Mycobacterium
GVPAFQKPKSRNAAT

SEQ ID NO: 240734 - protein, 8 aa, Mycobacterium
GVRGNAAD

SEQ ID NO: 240735 - protein, 9 aa, Mycobacterium
GVRSYDADG

SEQ ID NO: 240736 - protein, 17 aa, Mycobacterium
GVSAGAAAVRKTASGTP

SEQ ID NO: 240737 - protein, 6 aa, Mycobacterium
GVSPTQ

SEQ ID NO: 240738 - protein, 5 aa, Mycobacterium
GVSTG

SEQ ID NO: 240739 - protein, 5 aa, Mycobacterium
GVTGF

SEQ ID NO: 240740 - protein, 7 aa, Mycobacterium
GVTPNPR

SEQ ID NO: 240741 - protein, 11 aa, Mycobacterium
GVTRPTGARLD

SEQ ID NO: 240742 - protein, 7 aa, Mycobacterium
GVTSGQA

SEQ ID NO: 240743 - protein, 4 aa, Mycobacterium
GWAA

SEQ ID NO: 240744 - protein, 7 aa, Mycobacterium
GYAGHSA

SEQ ID NO: 240745 - protein, 6 aa, Mycobacterium
GYDEDD

SEQ ID NO: 240746 - protein, 5 aa, Mycobacterium
GYEPE

SEQ ID NO: 240747 - protein, 6 aa, Mycobacterium
GYEPED

SEQ ID NO: 240748 - protein, 4 aa, Mycobacterium
GYGT

SEQ ID NO: 240749 - protein, 7 aa, Mycobacterium
GYKTDYD

SEQ ID NO: 240750 - protein, 11 aa, Mycobacterium
GYYGSDSAGTF

SEQ ID NO: 240751 - protein, 5 aa, Mycobacterium
HADKP

SEQ ID NO: 240752 - protein, 4 aa, Mycobacterium
HAHP

SEQ ID NO: 240753 - protein, 10 aa, Mycobacterium
HAPKPDPSIG

SEQ ID NO: 240754 - protein, 6 aa, Mycobacterium
HDASGW

SEQ ID NO: 240755 - protein, 4 aa, Mycobacterium
HDEL

SEQ ID NO: 240756 - protein, 4 aa, Mycobacterium
HDGP

SEQ ID NO: 240757 - protein, 4 aa, Mycobacterium
HEGG

SEQ ID NO: 240758 - protein, 4 aa, Mycobacterium
HEIR

SEQ ID NO: 240759 - protein, 5 aa, Mycobacterium
HEPTR

SEQ ID NO: 240760 - protein, 5 aa, Mycobacterium
HFQPS

SEQ ID NO: 240761 - protein, 6 aa, Mycobacterium
HGAGAA

SEQ ID NO: 240762 - protein, 8 aa, Mycobacterium
HGATPSER

SEQ ID NO: 240763 - protein, 10 aa, Mycobacterium
HGDHPGYELE

SEQ ID NO: 240764 - protein, 4 aa, Mycobacterium
HGDR

SEQ ID NO: 240765 - protein, 5 aa, Mycobacterium
HGPIG

SEQ ID NO: 240766 - protein, 5 aa, Mycobacterium
HGREG

SEQ ID NO: 240767 - protein, 8 aa, Mycobacterium
HGSSAQRQ

SEQ ID NO: 240768 - protein, 10 aa, Mycobacterium
HGTDSVPGKI

SEQ ID NO: 240769 - protein, 6 aa, Mycobacterium
HGTGTV

SEQ ID NO: 240770 - protein, 6 aa, Mycobacterium
HLEQAG

SEQ ID NO: 240771 - protein, 7 aa, Mycobacterium
HPDKTAP

SEQ ID NO: 240772 - protein, 5 aa, Mycobacterium
HPDSE

SEQ ID NO: 240773 - protein, 6 aa, Mycobacterium
HPERDK

SEQ ID NO: 240774 - protein, 7 aa, Mycobacterium
HPGTGGA

SEQ ID NO: 240775 - protein, 7 aa, Mycobacterium
HPPPNGA

SEQ ID NO: 240776 - protein, 6 aa, Mycobacterium
HPQSPR

SEQ ID NO: 240777 - protein, 9 aa, Mycobacterium
HPTPGCPQT

SEQ ID NO: 240778 - protein, 4 aa, Mycobacterium
HPVT

SEQ ID NO: 240779 - protein, 4 aa, Mycobacterium
HQAG

SEQ ID NO: 240780 - protein, 5 aa, Mycobacterium
HRGSA

SEQ ID NO: 240781 - protein, 4 aa, Mycobacterium
HRRS

SEQ ID NO: 240782 - protein, 6 aa, Mycobacterium
HSDTEV

SEQ ID NO: 240783 - protein, 6 aa, Mycobacterium
HSDVSG

SEQ ID NO: 240784 - protein, 6 aa, Mycobacterium
HSPEPR

SEQ ID NO: 240785 - protein, 6 aa, Mycobacterium
HSPGAG

SEQ ID NO: 240786 - protein, 7 aa, Mycobacterium
HSPGAGG

SEQ ID NO: 240787 - protein, 9 aa, Mycobacterium
HTAKASRDL

SEQ ID NO: 240788 - protein, 10 aa, Mycobacterium
HTEVKDNRRN

SEQ ID NO: 240789 - protein, 4 aa, Mycobacterium
HTPG

SEQ ID NO: 240790 - protein, 7 aa, Mycobacterium
HTPTTSE

SEQ ID NO: 240791 - protein, 7 aa, Mycobacterium
HVAGPDH

SEQ ID NO: 240792 - protein, 4 aa, Mycobacterium
IAGD

SEQ ID NO: 240793 - protein, 12 aa, Mycobacterium
IAGSRPELAGQG

SEQ ID NO: 240794 - protein, 6 aa, Mycobacterium
IAPEKT

SEQ ID NO: 240795 - protein, 10 aa, Mycobacterium
IAPNQDAQAD

SEQ ID NO: 240796 - protein, 9 aa, Mycobacterium
IASGGTSTV

SEQ ID NO: 240797 - protein, 8 aa, Mycobacterium
IDAAPRGP

SEQ ID NO: 240798 - protein, 6 aa, Mycobacterium
IDGASR

SEQ ID NO: 240799 - protein, 5 aa, Mycobacterium
IDHPG

SEQ ID NO: 240800 - protein, 8 aa, Mycobacterium
IDKNTSYR

SEQ ID NO: 240801 - protein, 12 aa, Mycobacterium
IDTAKGSMAGPV

SEQ ID NO: 240802 - protein, 7 aa, Mycobacterium
IEPAGDK

SEQ ID NO: 240803 - protein, 7 aa, Mycobacterium
IEPPEGR

SEQ ID NO: 240804 - protein, 7 aa, Mycobacterium
IGDQPAV

SEQ ID NO: 240805 - protein, 5 aa, Mycobacterium
IGEQG

SEQ ID NO: 240806 - protein, 10 aa, Mycobacterium
IGGPRRKGRI

SEQ ID NO: 240807 - protein, 14 aa, Mycobacterium
IGGSPLQVSGPAAG

SEQ ID NO: 240808 - protein, 6 aa, Mycobacterium
IGNGST

SEQ ID NO: 240809 - protein, 4 aa, Mycobacterium
IGPA

SEQ ID NO: 240810 - protein, 6 aa, Mycobacterium
IGPGPH

SEQ ID NO: 240811 - protein, 7 aa, Mycobacterium
IGPGPHA

SEQ ID NO: 240812 - protein, 6 aa, Mycobacterium
IGQNGL

SEQ ID NO: 240813 - protein, 16 aa, Mycobacterium
IGSGGSGGREGPTAQI

SEQ ID NO: 240814 - protein, 7 aa, Mycobacterium
IGSGPTA

SEQ ID NO: 240815 - protein, 20 aa, Mycobacterium
IGSGYGGYSEDHKYFGRHQT

SEQ ID NO: 240816 - protein, 10 aa, Mycobacterium
IGTGGSGGLF

SEQ ID NO: 240817 - protein, 6 aa, Mycobacterium
IGTSPF

SEQ ID NO: 240818 - protein, 5 aa, Mycobacterium
IHKQT

SEQ ID NO: 240819 - protein, 8 aa, Mycobacterium
IHSPGAGG

SEQ ID NO: 240820 - protein, 6 aa, Mycobacterium
INGAGA

SEQ ID NO: 240821 - protein, 13 aa, Mycobacterium
IPAPSGAAIATTA

SEQ ID NO: 240822 - protein, 8 aa, Mycobacterium
IPDATKAA

SEQ ID NO: 240823 - protein, 8 aa, Mycobacterium
IPDTTPGV

SEQ ID NO: 240824 - protein, 6 aa, Mycobacterium
IPEGRQ

SEQ ID NO: 240825 - protein, 11 aa, Mycobacterium
IPGGAEDSIKR

SEQ ID NO: 240826 - protein, 9 aa, Mycobacterium
IPGPEPTSV

SEQ ID NO: 240827 - protein, 12 aa, Mycobacterium
IPGQNSGGPNNG

SEQ ID NO: 240828 - protein, 4 aa, Mycobacterium
IPPQ

SEQ ID NO: 240829 - protein, 6 aa, Mycobacterium
IPPSGM

SEQ ID NO: 240830 - protein, 6 aa, Mycobacterium
IPPSGV

SEQ ID NO: 240831 - protein, 17 aa, Mycobacterium
IPSSRPRTSPADAFAPT

SEQ ID NO: 240832 - protein, 15 aa, Mycobacterium
IPTPYGGPTLPIEPP

SEQ ID NO: 240833 - protein, 13 aa, Mycobacterium
IQPSEVGKTFPDN

SEQ ID NO: 240834 - protein, 5 aa, Mycobacterium
IQRAP

SEQ ID NO: 240835 - protein, 4 aa, Mycobacterium
IQRT

SEQ ID NO: 240836 - protein, 11 aa, Mycobacterium
IQSGPRIPQSQ

SEQ ID NO: 240837 - protein, 4 aa, Mycobacterium
IREQ

SEQ ID NO: 240838 - protein, 17 aa, Mycobacterium
IRESGGDRSAVTGGTTV

SEQ ID NO: 240839 - protein, 7 aa, Mycobacterium
IRPDARE

SEQ ID NO: 240840 - protein, 5 aa, Mycobacterium
IRSNN

SEQ ID NO: 240841 - protein, 10 aa, Mycobacterium
IRSPADTTLR

SEQ ID NO: 240842 - protein, 5 aa, Mycobacterium
IRTGA

SEQ ID NO: 240843 - protein, 7 aa, Mycobacterium
ISDRNGY

SEQ ID NO: 240844 - protein, 11 aa, Mycobacterium
ISEQEKKITAY

SEQ ID NO: 240845 - protein, 17 aa, Mycobacterium
ISGGVQAAPLPPEPQLA

SEQ ID NO: 240846 - protein, 4 aa, Mycobacterium
ISGR

SEQ ID NO: 240847 - protein, 9 aa, Mycobacterium
ISGTSPLNT

SEQ ID NO: 240848 - protein, 6 aa, Mycobacterium
ISNDPN

SEQ ID NO: 240849 - protein, 5 aa, Mycobacterium
ISPDD

SEQ ID NO: 240850 - protein, 8 aa, Mycobacterium
ISPTPRPA

SEQ ID NO: 240851 - protein, 7 aa, Mycobacterium
ISTATDA

SEQ ID NO: 240852 - protein, 4 aa, Mycobacterium
ITAG

SEQ ID NO: 240853 - protein, 16 aa, Mycobacterium
ITGESVPVEAGPGDEV

SEQ ID NO: 240854 - protein, 8 aa, Mycobacterium
ITGSSPVR

SEQ ID NO: 240855 - protein, 9 aa, Mycobacterium
ITGTSPLNT

SEQ ID NO: 240856 - protein, 8 aa, Mycobacterium
ITNKESGV

SEQ ID NO: 240857 - protein, 6 aa, Mycobacterium
ITPPKG

SEQ ID NO: 240858 - protein, 4 aa, Mycobacterium
ITPS

SEQ ID NO: 240859 - protein, 9 aa, Mycobacterium
ITPSATAVG

SEQ ID NO: 240860 - protein, 11 aa, Mycobacterium
ITRPDGKPIKH

SEQ ID NO: 240861 - protein, 10 aa, Mycobacterium
ITRPEGTPIQ

SEQ ID NO: 240862 - protein, 7 aa, Mycobacterium
IYSPGAG

SEQ ID NO: 240863 - protein, 5 aa, Mycobacterium
KAETE

SEQ ID NO: 240864 - protein, 6 aa, Mycobacterium
KAGGAT

SEQ ID NO: 240865 - protein, 8 aa, Mycobacterium
KAGTDYAD

SEQ ID NO: 240866 - protein, 8 aa, Mycobacterium
KARTRGGY

SEQ ID NO: 240867 - protein, 10 aa, Mycobacterium
KAVRSPAKDT

SEQ ID NO: 240868 - protein, 5 aa, Mycobacterium
KDGAK

SEQ ID NO: 240869 - protein, 7 aa, Mycobacterium
KDPDLGT

SEQ ID NO: 240870 - protein, 9 aa, Mycobacterium
KDPHGRHRP

SEQ ID NO: 240871 - protein, 6 aa, Mycobacterium
KDPNPE

SEQ ID NO: 240872 - protein, 8 aa, Mycobacterium
KDTPPPGL

SEQ ID NO: 240873 - protein, 4 aa, Mycobacterium
KEAI

SEQ ID NO: 240874 - protein, 9 aa, Mycobacterium
KEETGAGLN

SEQ ID NO: 240875 - protein, 12 aa, Mycobacterium
KENSNDVAAGRR

SEQ ID NO: 240876 - protein, 5 aa, Mycobacterium
KERAV

SEQ ID NO: 240877 - protein, 6 aa, Mycobacterium
KESRDR

SEQ ID NO: 240878 - protein, 6 aa, Mycobacterium
KEYDSD

SEQ ID NO: 240879 - protein, 7 aa, Mycobacterium
KFGQSGQ

SEQ ID NO: 240880 - protein, 8 aa, Mycobacterium
KGDDDDTI

SEQ ID NO: 240881 - protein, 7 aa, Mycobacterium
KGGDDLP

SEQ ID NO: 240882 - protein, 14 aa, Mycobacterium
KGGENDAQKYASTL

SEQ ID NO: 240883 - protein, 7 aa, Mycobacterium
KGGLGPA

SEQ ID NO: 240884 - protein, 6 aa, Mycobacterium
KGKTGL

SEQ ID NO: 240885 - protein, 6 aa, Mycobacterium
KGQNAE

SEQ ID NO: 240886 - protein, 7 aa, Mycobacterium
KGTPLED

SEQ ID NO: 240887 - protein, 7 aa, Mycobacterium
KGTPLEG

SEQ ID NO: 240888 - protein, 7 aa, Mycobacterium
KGTPLEN

SEQ ID NO: 240889 - protein, 6 aa, Mycobacterium
KGTPWE

SEQ ID NO: 240890 - protein, 4 aa, Mycobacterium
KGYV

SEQ ID NO: 240891 - protein, 13 aa, Mycobacterium
KHGRPFRRRNPRP

SEQ ID NO: 240892 - protein, 4 aa, Mycobacterium
KHPG

SEQ ID NO: 240893 - protein, 6 aa, Mycobacterium
KHYQSS

SEQ ID NO: 240894 - protein, 8 aa, Mycobacterium
KIPGDPEV

SEQ ID NO: 240895 - protein, 9 aa, Mycobacterium
KKATDTELP

SEQ ID NO: 240896 - protein, 9 aa, Mycobacterium
KKKPIRPVA

SEQ ID NO: 240897 - protein, 7 aa, Mycobacterium
KKPTGGI

SEQ ID NO: 240898 - protein, 9 aa, Mycobacterium
KKYGKDRQR

SEQ ID NO: 240899 - protein, 10 aa, Mycobacterium
KLPDAARSLG

SEQ ID NO: 240900 - protein, 10 aa, Mycobacterium
KLSGGQRKRA

SEQ ID NO: 240901 - protein, 5 aa, Mycobacterium
KMPAD

SEQ ID NO: 240902 - protein, 6 aa, Mycobacterium
KNDPNL

SEQ ID NO: 240903 - protein, 5 aa, Mycobacterium
KNDSL

SEQ ID NO: 240904 - protein, 9 aa, Mycobacterium
KNKPIRPVA

SEQ ID NO: 240905 - protein, 6 aa, Mycobacterium
KNPDFQ

SEQ ID NO: 240906 - protein, 5 aa, Mycobacterium
KNRDI

SEQ ID NO: 240907 - protein, 11 aa, Mycobacterium
KNTKTSRENRQ

SEQ ID NO: 240908 - protein, 6 aa, Mycobacterium
KPAGKF

SEQ ID NO: 240909 - protein, 7 aa, Mycobacterium
KPELGTP

SEQ ID NO: 240910 - protein, 6 aa, Mycobacterium
KPGMAT

SEQ ID NO: 240911 - protein, 4 aa, Mycobacterium
KPIR

SEQ ID NO: 240912 - protein, 5 aa, Mycobacterium
KPLPI

SEQ ID NO: 240913 - protein, 12 aa, Mycobacterium
KPNAAQKESEYI

SEQ ID NO: 240914 - protein, 5 aa, Mycobacterium
KPPGL

SEQ ID NO: 240915 - protein, 6 aa, Mycobacterium
KPPGLA

SEQ ID NO: 240916 - protein, 6 aa, Mycobacterium
KPPVIK

SEQ ID NO: 240917 - protein, 4 aa, Mycobacterium
KPPW

SEQ ID NO: 240918 - protein, 5 aa, Mycobacterium
KPRRD

SEQ ID NO: 240919 - protein, 9 aa, Mycobacterium
KPSAATAAK

SEQ ID NO: 240920 - protein, 7 aa, Mycobacterium
KPSSPMS

SEQ ID NO: 240921 - protein, 6 aa, Mycobacterium
KPVERP

SEQ ID NO: 240922 - protein, 6 aa, Mycobacterium
KPVRPR

SEQ ID NO: 240923 - protein, 6 aa, Mycobacterium
KPYAPT

SEQ ID NO: 240924 - protein, 6 aa, Mycobacterium
KQDEVE

SEQ ID NO: 240925 - protein, 8 aa, Mycobacterium
KQRGKTTT

SEQ ID NO: 240926 - protein, 5 aa, Mycobacterium
KQSDA

SEQ ID NO: 240927 - protein, 10 aa, Mycobacterium
KQYSSGGGAV

SEQ ID NO: 240928 - protein, 6 aa, Mycobacterium
KREGGQ

SEQ ID NO: 240929 - protein, 6 aa, Mycobacterium
KRGAWT

SEQ ID NO: 240930 - protein, 5 aa, Mycobacterium
KRKLE

SEQ ID NO: 240931 - protein, 4 aa, Mycobacterium
KRNA

SEQ ID NO: 240932 - protein, 10 aa, Mycobacterium
KRSKRQAGAA

SEQ ID NO: 240933 - protein, 9 aa, Mycobacterium
KSDGPTSVA

SEQ ID NO: 240934 - protein, 17 aa, Mycobacterium
KSFSSDADGYTRSEGGG

SEQ ID NO: 240935 - protein, 8 aa, Mycobacterium
KSLESYTS

SEQ ID NO: 240936 - protein, 8 aa, Mycobacterium
KSLTADGG

SEQ ID NO: 240937 - protein, 6 aa, Mycobacterium
KSPDFA

SEQ ID NO: 240938 - protein, 4 aa, Mycobacterium
KSST

SEQ ID NO: 240939 - protein, 5 aa, Mycobacterium
KSYPY

SEQ ID NO: 240940 - protein, 9 aa, Mycobacterium
KTGTLTANR

SEQ ID NO: 240941 - protein, 7 aa, Mycobacterium
KTGTLTE

SEQ ID NO: 240942 - protein, 9 aa, Mycobacterium
KTGTLTENG

SEQ ID NO: 240943 - protein, 9 aa, Mycobacterium
KTGTLTESG

SEQ ID NO: 240944 - protein, 7 aa, Mycobacterium
KTGTLTQ

SEQ ID NO: 240945 - protein, 7 aa, Mycobacterium
KTGTLTR

SEQ ID NO: 240946 - protein, 4 aa, Mycobacterium
KVGD

SEQ ID NO: 240947 - protein, 6 aa, Mycobacterium
KVPANA

SEQ ID NO: 240948 - protein, 6 aa, Mycobacterium
KVTSST

SEQ ID NO: 240949 - protein, 5 aa, Mycobacterium
KYPSG

SEQ ID NO: 240950 - protein, 5 aa, Mycobacterium
KYPTG

SEQ ID NO: 240951 - protein, 6 aa, Mycobacterium
LAAEAS

SEQ ID NO: 240952 - protein, 7 aa, Mycobacterium
LAAKPST

SEQ ID NO: 240953 - protein, 8 aa, Mycobacterium
LAATRPPA

SEQ ID NO: 240954 - protein, 6 aa, Mycobacterium
LADTGR

SEQ ID NO: 240955 - protein, 6 aa, Mycobacterium
LAEEAS

SEQ ID NO: 240956 - protein, 6 aa, Mycobacterium
LAEGKT

SEQ ID NO: 240957 - protein, 9 aa, Mycobacterium
LAGNDDPKL

SEQ ID NO: 240958 - protein, 7 aa, Mycobacterium
LAGPHGN

SEQ ID NO: 240959 - protein, 7 aa, Mycobacterium
LAKTSDR

SEQ ID NO: 240960 - protein, 5 aa, Mycobacterium
LANGS

SEQ ID NO: 240961 - protein, 8 aa, Mycobacterium
LANPKSWT

SEQ ID NO: 240962 - protein, 4 aa, Mycobacterium
LAPG

SEQ ID NO: 240963 - protein, 5 aa, Mycobacterium
LAPPT

SEQ ID NO: 240964 - protein, 5 aa, Mycobacterium
LAPSP

SEQ ID NO: 240965 - protein, 4 aa, Mycobacterium
LAQS

SEQ ID NO: 240966 - protein, 5 aa, Mycobacterium
LARGG

SEQ ID NO: 240967 - protein, 5 aa, Mycobacterium
LASGP

SEQ ID NO: 240968 - protein, 6 aa, Mycobacterium
LASNGV

SEQ ID NO: 240969 - protein, 8 aa, Mycobacterium
LASTSVGA

SEQ ID NO: 240970 - protein, 8 aa, Mycobacterium
LATGAAAG

SEQ ID NO: 240971 - protein, 5 aa, Mycobacterium
LDDEG

SEQ ID NO: 240972 - protein, 6 aa, Mycobacterium
LDDEGQ

SEQ ID NO: 240973 - protein, 12 aa, Mycobacterium
LDDSTPETPAQR

SEQ ID NO: 240974 - protein, 6 aa, Mycobacterium
LDGAGR

SEQ ID NO: 240975 - protein, 10 aa, Mycobacterium
LDPDTSRSAR

SEQ ID NO: 240976 - protein, 10 aa, Mycobacterium
LDPETSRSAR

SEQ ID NO: 240977 - protein, 5 aa, Mycobacterium
LDPQN

SEQ ID NO: 240978 - protein, 4 aa, Mycobacterium
LDRA

SEQ ID NO: 240979 - protein, 6 aa, Mycobacterium
LDSRGG

SEQ ID NO: 240980 - protein, 9 aa, Mycobacterium
LEPKRTQRI

SEQ ID NO: 240981 - protein, 7 aa, Mycobacterium
LEQAGRT

SEQ ID NO: 240982 - protein, 12 aa, Mycobacterium
LERGTELGGQER

SEQ ID NO: 240983 - protein, 8 aa, Mycobacterium
LERPEDQA

SEQ ID NO: 240984 - protein, 18 aa, Mycobacterium
LESNPKAKETTKQRKRDM

SEQ ID NO: 240985 - protein, 6 aa, Mycobacterium
LESYTS

SEQ ID NO: 240986 - protein, 4 aa, Mycobacterium
LGAD

SEQ ID NO: 240987 - protein, 6 aa, Mycobacterium
LGARPS

SEQ ID NO: 240988 - protein, 7 aa, Mycobacterium
LGASPTR

SEQ ID NO: 240989 - protein, 5 aa, Mycobacterium
LGATR

SEQ ID NO: 240990 - protein, 4 aa, Mycobacterium
LGDE

SEQ ID NO: 240991 - protein, 7 aa, Mycobacterium
LGDPADG

SEQ ID NO: 240992 - protein, 6 aa, Mycobacterium
LGEREA

SEQ ID NO: 240993 - protein, 5 aa, Mycobacterium
LGESA

SEQ ID NO: 240994 - protein, 6 aa, Mycobacterium
LGGGNF

SEQ ID NO: 240995 - protein, 23 aa, Mycobacterium
LGGRDTRVATPSGLDGPGMSTSA

SEQ ID NO: 240996 - protein, 6 aa, Mycobacterium
LGGSPT

SEQ ID NO: 240997 - protein, 6 aa, Mycobacterium
LGHPAG

SEQ ID NO: 240998 - protein, 17 aa, Mycobacterium
LGPDGGWQGSAARAYGA

SEQ ID NO: 240999 - protein, 4 aa, Mycobacterium
LGPP

SEQ ID NO: 241000 - protein, 4 aa, Mycobacterium
LGPV

SEQ ID NO: 241001 - protein, 12 aa, Mycobacterium
LGSAGAPGSGSF

SEQ ID NO: 241002 - protein, 10 aa, Mycobacterium
LGSAGAPGTG

SEQ ID NO: 241003 - protein, 5 aa, Mycobacterium
LGSPA

SEQ ID NO: 241004 - protein, 9 aa, Mycobacterium
LGTNGGGFY

SEQ ID NO: 241005 - protein, 4 aa, Mycobacterium
LGTP

SEQ ID NO: 241006 - protein, 6 aa, Mycobacterium
LGTRAG

SEQ ID NO: 241007 - protein, 10 aa, Mycobacterium
LGTTPNGTLN

SEQ ID NO: 241008 - protein, 6 aa, Mycobacterium
LHSAGP

SEQ ID NO: 241009 - protein, 5 aa, Mycobacterium
LHSPR

SEQ ID NO: 241010 - protein, 7 aa, Mycobacterium
LKEPRES

SEQ ID NO: 241011 - protein, 7 aa, Mycobacterium
LKGESKM

SEQ ID NO: 241012 - protein, 5 aa, Mycobacterium
LNGGG

SEQ ID NO: 241013 - protein, 12 aa, Mycobacterium
LNPETQRALAPA

SEQ ID NO: 241014 - protein, 8 aa, Mycobacterium
LNRTTGDI

SEQ ID NO: 241015 - protein, 5 aa, Mycobacterium
LNTPA

SEQ ID NO: 241016 - protein, 5 aa, Mycobacterium
LPADG

SEQ ID NO: 241017 - protein, 4 aa, Mycobacterium
LPAG

SEQ ID NO: 241018 - protein, 5 aa, Mycobacterium
LPASG

SEQ ID NO: 241019 - protein, 17 aa, Mycobacterium
LPASTLGQQPTNVRAAP

SEQ ID NO: 241020 - protein, 5 aa, Mycobacterium
LPATG

SEQ ID NO: 241021 - protein, 7 aa, Mycobacterium
LPDAPTA

SEQ ID NO: 241022 - protein, 12 aa, Mycobacterium
LPDATPDDDIRG

SEQ ID NO: 241023 - protein, 5 aa, Mycobacterium
LPDPH

SEQ ID NO: 241024 - protein, 4 aa, Mycobacterium
LPDS

SEQ ID NO: 241025 - protein, 4 aa, Mycobacterium
LPEN

SEQ ID NO: 241026 - protein, 6 aa, Mycobacterium
LPEREP

SEQ ID NO: 241027 - protein, 5 aa, Mycobacterium
LPETS

SEQ ID NO: 241028 - protein, 5 aa, Mycobacterium
LPETV

SEQ ID NO: 241029 - protein, 9 aa, Mycobacterium
LPGKQFEAG

SEQ ID NO: 241030 - protein, 4 aa, Mycobacterium
LPGP

SEQ ID NO: 241031 - protein, 4 aa, Mycobacterium
LPGS

SEQ ID NO: 241032 - protein, 5 aa, Mycobacterium
LPGTY

SEQ ID NO: 241033 - protein, 10 aa, Mycobacterium
LPKTPPRTAA

SEQ ID NO: 241034 - protein, 12 aa, Mycobacterium
LPPDTSKEDRAQ

SEQ ID NO: 241035 - protein, 12 aa, Mycobacterium
LPPDTTKDDRAQ

SEQ ID NO: 241036 - protein, 5 aa, Mycobacterium
LPPEG

SEQ ID NO: 241037 - protein, 6 aa, Mycobacterium
LPPGFG

SEQ ID NO: 241038 - protein, 6 aa, Mycobacterium
LPPGTS

SEQ ID NO: 241039 - protein, 5 aa, Mycobacterium
LPPGV

SEQ ID NO: 241040 - protein, 4 aa, Mycobacterium
LPPM

SEQ ID NO: 241041 - protein, 7 aa, Mycobacterium
LPQPPQD

SEQ ID NO: 241042 - protein, 4 aa, Mycobacterium
LPQT

SEQ ID NO: 241043 - protein, 7 aa, Mycobacterium
LPRDGKA

SEQ ID NO: 241044 - protein, 10 aa, Mycobacterium
LPRSASARQV

SEQ ID NO: 241045 - protein, 4 aa, Mycobacterium
LPTG

SEQ ID NO: 241046 - protein, 11 aa, Mycobacterium
LPTRTSGKVDR

SEQ ID NO: 241047 - protein, 7 aa, Mycobacterium
LPTTDQA

SEQ ID NO: 241048 - protein, 5 aa, Mycobacterium
LQPDN

SEQ ID NO: 241049 - protein, 7 aa, Mycobacterium
LQRTGGL

SEQ ID NO: 241050 - protein, 5 aa, Mycobacterium
LRAES

SEQ ID NO: 241051 - protein, 6 aa, Mycobacterium
LRDNPK

SEQ ID NO: 241052 - protein, 4 aa, Mycobacterium
LREG

SEQ ID NO: 241053 - protein, 7 aa, Mycobacterium
LRETNRE

SEQ ID NO: 241054 - protein, 5 aa, Mycobacterium
LRGET

SEQ ID NO: 241055 - protein, 8 aa, Mycobacterium
LRPEGQIA

SEQ ID NO: 241056 - protein, 12 aa, Mycobacterium
LRPNAGDKAQTI

SEQ ID NO: 241057 - protein, 8 aa, Mycobacterium
LRQQGAGR

SEQ ID NO: 241058 - protein, 4 aa, Mycobacterium
LRRN

SEQ ID NO: 241059 - protein, 5 aa, Mycobacterium
LRTSR

SEQ ID NO: 241060 - protein, 12 aa, Mycobacterium
LSAAAAANTKHD

SEQ ID NO: 241061 - protein, 6 aa, Mycobacterium
LSARDR

SEQ ID NO: 241062 - protein, 4 aa, Mycobacterium
LSAS

SEQ ID NO: 241063 - protein, 5 aa, Mycobacterium
LSDAG

SEQ ID NO: 241064 - protein, 7 aa, Mycobacterium
LSDAPPN

SEQ ID NO: 241065 - protein, 7 aa, Mycobacterium
LSDAPPS

SEQ ID NO: 241066 - protein, 6 aa, Mycobacterium
LSDGNT

SEQ ID NO: 241067 - protein, 7 aa, Mycobacterium
LSDPSDP

SEQ ID NO: 241068 - protein, 8 aa, Mycobacterium
LSDPVSDE

SEQ ID NO: 241069 - protein, 9 aa, Mycobacterium
LSDPVSDET

SEQ ID NO: 241070 - protein, 10 aa, Mycobacterium
LSGEGSDTDT

SEQ ID NO: 241071 - protein, 8 aa, Mycobacterium
LSGGQRQR

SEQ ID NO: 241072 - protein, 16 aa, Mycobacterium
LSGTDGSVTYDRGSDG

SEQ ID NO: 241073 - protein, 7 aa, Mycobacterium
LSGTTGL

SEQ ID NO: 241074 - protein, 13 aa, Mycobacterium
LSNTSAADAAQAM

SEQ ID NO: 241075 - protein, 7 aa, Mycobacterium
LSPAGEQ

SEQ ID NO: 241076 - protein, 7 aa, Mycobacterium
LSPDGKT

SEQ ID NO: 241077 - protein, 16 aa, Mycobacterium
LSPEQARGDAVDARSD

SEQ ID NO: 241078 - protein, 16 aa, Mycobacterium
LSPEQARGETVDARSD

SEQ ID NO: 241079 - protein, 4 aa, Mycobacterium
LSPG

SEQ ID NO: 241080 - protein, 7 aa, Mycobacterium
LSPGEQQ

SEQ ID NO: 241081 - protein, 12 aa, Mycobacterium
LSPTAAAAEAAT

SEQ ID NO: 241082 - protein, 7 aa, Mycobacterium
LSREPRE

SEQ ID NO: 241083 - protein, 9 aa, Mycobacterium
LSRPGGSHK

SEQ ID NO: 241084 - protein, 9 aa, Mycobacterium
LSSDGTTVL

SEQ ID NO: 241085 - protein, 6 aa, Mycobacterium
LSYSDA

SEQ ID NO: 241086 - protein, 13 aa, Mycobacterium
LTAAGSQSHDQKA

SEQ ID NO: 241087 - protein, 6 aa, Mycobacterium
LTDGRD

SEQ ID NO: 241088 - protein, 4 aa, Mycobacterium
LTGD

SEQ ID NO: 241089 - protein, 4 aa, Mycobacterium
LTGG

SEQ ID NO: 241090 - protein, 4 aa, Mycobacterium
LTGR

SEQ ID NO: 241091 - protein, 13 aa, Mycobacterium
LTGTIGEDQKRAE

SEQ ID NO: 241092 - protein, 7 aa, Mycobacterium
LTKTTGD

SEQ ID NO: 241093 - protein, 5 aa, Mycobacterium
LTPAT

SEQ ID NO: 241094 - protein, 10 aa, Mycobacterium
LTPDGQPSKF

SEQ ID NO: 241095 - protein, 4 aa, Mycobacterium
LTPG

SEQ ID NO: 241096 - protein, 12 aa, Mycobacterium
LTPNDPQFQPGF

SEQ ID NO: 241097 - protein, 10 aa, Mycobacterium
LTPPTTRKGT

SEQ ID NO: 241098 - protein, 4 aa, Mycobacterium
LTPT

SEQ ID NO: 241099 - protein, 6 aa, Mycobacterium
LTQITK

SEQ ID NO: 241100 - protein, 14 aa, Mycobacterium
LTRQDSSELPPTTE

SEQ ID NO: 241101 - protein, 10 aa, Mycobacterium
LTSLTDSEAD

SEQ ID NO: 241102 - protein, 6 aa, Mycobacterium
LTTKDE

SEQ ID NO: 241103 - protein, 6 aa, Mycobacterium
LTTPTA

SEQ ID NO: 241104 - protein, 5 aa, Mycobacterium
LYPGD

SEQ ID NO: 241105 - protein, 8 aa, Mycobacterium
MAGQNEDD

SEQ ID NO: 241106 - protein, 7 aa, Mycobacterium
MAGVPGS

SEQ ID NO: 241107 - protein, 9 aa, Mycobacterium
MAPDDAQSV

SEQ ID NO: 241108 - protein, 6 aa, Mycobacterium
MGTGTD

SEQ ID NO: 241109 - protein, 4 aa, Mycobacterium
MGTT

SEQ ID NO: 241110 - protein, 5 aa, Mycobacterium
MPKTT

SEQ ID NO: 241111 - protein, 5 aa, Mycobacterium
MPLGN

SEQ ID NO: 241112 - protein, 7 aa, Mycobacterium
MQGQPGV

SEQ ID NO: 241113 - protein, 9 aa, Mycobacterium
MQGQQVGPI

SEQ ID NO: 241114 - protein, 4 aa, Mycobacterium
MRRS

SEQ ID NO: 241115 - protein, 5 aa, Mycobacterium
MSNAT

SEQ ID NO: 241116 - protein, 8 aa, Mycobacterium
MSPQDAPA

SEQ ID NO: 241117 - protein, 7 aa, Mycobacterium
MSSGYAG

SEQ ID NO: 241118 - protein, 6 aa, Mycobacterium
MTQRGG

SEQ ID NO: 241119 - protein, 5 aa, Mycobacterium
NAAET

SEQ ID NO: 241120 - protein, 5 aa, Mycobacterium
NAAPD

SEQ ID NO: 241121 - protein, 9 aa, Mycobacterium
NAGPDTNSS

SEQ ID NO: 241122 - protein, 15 aa, Mycobacterium
NAGPGNTKPVTVEPS

SEQ ID NO: 241123 - protein, 6 aa, Mycobacterium
NAGTLQ

SEQ ID NO: 241124 - protein, 6 aa, Mycobacterium
NAKQGV

SEQ ID NO: 241125 - protein, 6 aa, Mycobacterium
NANYPQ

SEQ ID NO: 241126 - protein, 8 aa, Mycobacterium
NAPSEGEI

SEQ ID NO: 241127 - protein, 8 aa, Mycobacterium
NASGGSVG

SEQ ID NO: 241128 - protein, 5 aa, Mycobacterium
NASQR

SEQ ID NO: 241129 - protein, 9 aa, Mycobacterium
NASVAGGGT

SEQ ID NO: 241130 - protein, 8 aa, Mycobacterium
NATPGKDE

SEQ ID NO: 241131 - protein, 5 aa, Mycobacterium
NCGAS

SEQ ID NO: 241132 - protein, 4 aa, Mycobacterium
NDAA

SEQ ID NO: 241133 - protein, 7 aa, Mycobacterium
NDAAQLD

SEQ ID NO: 241134 - protein, 16 aa, Mycobacterium
NDAGGVATYAQAGQDY

SEQ ID NO: 241135 - protein, 5 aa, Mycobacterium
NDGNN

SEQ ID NO: 241136 - protein, 6 aa, Mycobacterium
NDGQIG

SEQ ID NO: 241137 - protein, 6 aa, Mycobacterium
NDGQRP

SEQ ID NO: 241138 - protein, 18 aa, Mycobacterium
NDLPEESRASGFGRSEST

SEQ ID NO: 241139 - protein, 6 aa, Mycobacterium
NDPDAA

SEQ ID NO: 241140 - protein, 9 aa, Mycobacterium
NDPMTPEGM

SEQ ID NO: 241141 - protein, 4 aa, Mycobacterium
NDRI

SEQ ID NO: 241142 - protein, 9 aa, Mycobacterium
NDRKERLDR

SEQ ID NO: 241143 - protein, 8 aa, Mycobacterium
NDTADEVD

SEQ ID NO: 241144 - protein, 4 aa, Mycobacterium
NEVT

SEQ ID NO: 241145 - protein, 5 aa, Mycobacterium
NGDPV

SEQ ID NO: 241146 - protein, 10 aa, Mycobacterium
NGEETRSLDS

SEQ ID NO: 241147 - protein, 7 aa, Mycobacterium
NGEGEVP

SEQ ID NO: 241148 - protein, 7 aa, Mycobacterium
NGEIGDK

SEQ ID NO: 241149 - protein, 10 aa, Mycobacterium
NGEPPEAPKV

SEQ ID NO: 241150 - protein, 4 aa, Mycobacterium
NGGA

SEQ ID NO: 241151 - protein, 7 aa, Mycobacterium
NGGANSR

SEQ ID NO: 241152 - protein, 5 aa, Mycobacterium
NGGAV

SEQ ID NO: 241153 - protein, 5 aa, Mycobacterium
NGGGA

SEQ ID NO: 241154 - protein, 5 aa, Mycobacterium
NGGGW

SEQ ID NO: 241155 - protein, 9 aa, Mycobacterium
NGGSSLTGV

SEQ ID NO: 241156 - protein, 11 aa, Mycobacterium
NGIKGSDAGTL

SEQ ID NO: 241157 - protein, 10 aa, Mycobacterium
NGIRPLETDG

SEQ ID NO: 241158 - protein, 7 aa, Mycobacterium
NGNITDD

SEQ ID NO: 241159 - protein, 6 aa, Mycobacterium
NGPGIP

SEQ ID NO: 241160 - protein, 4 aa, Mycobacterium
NGPV

SEQ ID NO: 241161 - protein, 7 aa, Mycobacterium
NGSATPF

SEQ ID NO: 241162 - protein, 7 aa, Mycobacterium
NGSGKST

SEQ ID NO: 241163 - protein, 7 aa, Mycobacterium
NGSGPEL

SEQ ID NO: 241164 - protein, 18 aa, Mycobacterium
NGSGPKFTAPMSKNGVPY

SEQ ID NO: 241165 - protein, 23 aa, Mycobacterium
NGTIGAPAVTRRRRRRRGDSDAV

SEQ ID NO: 241166 - protein, 4 aa, Mycobacterium
NGVG

SEQ ID NO: 241167 - protein, 4 aa, Mycobacterium
NGWP

SEQ ID NO: 241168 - protein, 5 aa, Mycobacterium
NHNGR

SEQ ID NO: 241169 - protein, 7 aa, Mycobacterium
NHYPQDI

SEQ ID NO: 241170 - protein, 9 aa, Mycobacterium
NIGNPDGPA

SEQ ID NO: 241171 - protein, 13 aa, Mycobacterium
NKMAKAGRAAQAL

SEQ ID NO: 241172 - protein, 6 aa, Mycobacterium
NKQNQD

SEQ ID NO: 241173 - protein, 5 aa, Mycobacterium
NKRIA

SEQ ID NO: 241174 - protein, 8 aa, Mycobacterium
NLGHTEAA

SEQ ID NO: 241175 - protein, 6 aa, Mycobacterium
NLGPTA

SEQ ID NO: 241176 - protein, 8 aa, Mycobacterium
NLGPTAGL

SEQ ID NO: 241177 - protein, 8 aa, Mycobacterium
NLNAGKVD

SEQ ID NO: 241178 - protein, 8 aa, Mycobacterium
NLPGKSQT

SEQ ID NO: 241179 - protein, 6 aa, Mycobacterium
NLTAQR

SEQ ID NO: 241180 - protein, 6 aa, Mycobacterium
NNDESR

SEQ ID NO: 241181 - protein, 5 aa, Mycobacterium
NNGRT

SEQ ID NO: 241182 - protein, 5 aa, Mycobacterium
NNLPF

SEQ ID NO: 241183 - protein, 5 aa, Mycobacterium
NNNVE

SEQ ID NO: 241184 - protein, 9 aa, Mycobacterium
NNPQPGTDY

SEQ ID NO: 241185 - protein, 10 aa, Mycobacterium
NNRSGGGVRV

SEQ ID NO: 241186 - protein, 5 aa, Mycobacterium
NNSPV

SEQ ID NO: 241187 - protein, 11 aa, Mycobacterium
NNTSGSSAELV

SEQ ID NO: 241188 - protein, 11 aa, Mycobacterium
NNTSGSSGELV

SEQ ID NO: 241189 - protein, 6 aa, Mycobacterium
NPAADL

SEQ ID NO: 241190 - protein, 4 aa, Mycobacterium
NPAF

SEQ ID NO: 241191 - protein, 10 aa, Mycobacterium
NPDGRAARRT

SEQ ID NO: 241192 - protein, 6 aa, Mycobacterium
NPEQHA

SEQ ID NO: 241193 - protein, 7 aa, Mycobacterium
NPEQHKD

SEQ ID NO: 241194 - protein, 6 aa, Mycobacterium
NPESRE

SEQ ID NO: 241195 - protein, 8 aa, Mycobacterium
NPGHPRQL

SEQ ID NO: 241196 - protein, 7 aa, Mycobacterium
NPIGPGD

SEQ ID NO: 241197 - protein, 8 aa, Mycobacterium
NPPNDTPL

SEQ ID NO: 241198 - protein, 9 aa, Mycobacterium
NPPNDTPLR

SEQ ID NO: 241199 - protein, 4 aa, Mycobacterium
NPPT

SEQ ID NO: 241200 - protein, 6 aa, Mycobacterium
NPQDVN

SEQ ID NO: 241201 - protein, 8 aa, Mycobacterium
NPQPDGKQ

SEQ ID NO: 241202 - protein, 14 aa, Mycobacterium
NPRNRRSRTNPDAT

SEQ ID NO: 241203 - protein, 5 aa, Mycobacterium
NPVGG

SEQ ID NO: 241204 - protein, 15 aa, Mycobacterium
NPWRGPPVPYDTPVT

SEQ ID NO: 241205 - protein, 4 aa, Mycobacterium
NQAA

SEQ ID NO: 241206 - protein, 10 aa, Mycobacterium
NQGEALANES

SEQ ID NO: 241207 - protein, 6 aa, Mycobacterium
NQPGGL

SEQ ID NO: 241208 - protein, 5 aa, Mycobacterium
NQPPP

SEQ ID NO: 241209 - protein, 6 aa, Mycobacterium
NQSTAL

SEQ ID NO: 241210 - protein, 9 aa, Mycobacterium
NQTTRSLNE

SEQ ID NO: 241211 - protein, 4 aa, Mycobacterium
NRPL

SEQ ID NO: 241212 - protein, 4 aa, Mycobacterium
NRRR

SEQ ID NO: 241213 - protein, 6 aa, Mycobacterium
NRSSLN

SEQ ID NO: 241214 - protein, 11 aa, Mycobacterium
NRTHSADSRAH

SEQ ID NO: 241215 - protein, 7 aa, Mycobacterium
NRTTGDI

SEQ ID NO: 241216 - protein, 10 aa, Mycobacterium
NSADGITATA

SEQ ID NO: 241217 - protein, 4 aa, Mycobacterium
NSDG

SEQ ID NO: 241218 - protein, 6 aa, Mycobacterium
NSDGSM

SEQ ID NO: 241219 - protein, 4 aa, Mycobacterium
NSDS

SEQ ID NO: 241220 - protein, 6 aa, Mycobacterium
NSHDEP

SEQ ID NO: 241221 - protein, 4 aa, Mycobacterium
NSLA

SEQ ID NO: 241222 - protein, 6 aa, Mycobacterium
NSPDEE

SEQ ID NO: 241223 - protein, 8 aa, Mycobacterium
NSRAPDCG

SEQ ID NO: 241224 - protein, 4 aa, Mycobacterium
NSRE

SEQ ID NO: 241225 - protein, 6 aa, Mycobacterium
NSSDDG

SEQ ID NO: 241226 - protein, 7 aa, Mycobacterium
NSSRDYA

SEQ ID NO: 241227 - protein, 7 aa, Mycobacterium
NSTGSFK

SEQ ID NO: 241228 - protein, 7 aa, Mycobacterium
NSWGETL

SEQ ID NO: 241229 - protein, 6 aa, Mycobacterium
NTADDG

SEQ ID NO: 241230 - protein, 18 aa, Mycobacterium
NTFDPSQDIGRQGDKQLG

SEQ ID NO: 241231 - protein, 6 aa, Mycobacterium
NTGPHG

SEQ ID NO: 241232 - protein, 5 aa, Mycobacterium
NTGSV

SEQ ID NO: 241233 - protein, 4 aa, Mycobacterium
NTPA

SEQ ID NO: 241234 - protein, 5 aa, Mycobacterium
NTPAD

SEQ ID NO: 241235 - protein, 14 aa, Mycobacterium
NTPADWTRAGNAVK

SEQ ID NO: 241236 - protein, 10 aa, Mycobacterium
NTSVNPARST

SEQ ID NO: 241237 - protein, 12 aa, Mycobacterium
NVGDGLPQKSDV

SEQ ID NO: 241238 - protein, 4 aa, Mycobacterium
PAAG

SEQ ID NO: 241239 - protein, 10 aa, Mycobacterium
PAAKNNFEQG

SEQ ID NO: 241240 - protein, 4 aa, Mycobacterium
PAAL

SEQ ID NO: 241241 - protein, 10 aa, Mycobacterium
PAANGVATAR

SEQ ID NO: 241242 - protein, 4 aa, Mycobacterium
PAAV

SEQ ID NO: 241243 - protein, 7 aa, Mycobacterium
PADEQHA

SEQ ID NO: 241244 - protein, 4 aa, Mycobacterium
PAEA

SEQ ID NO: 241245 - protein, 4 aa, Mycobacterium
PAEL

SEQ ID NO: 241246 - protein, 7 aa, Mycobacterium
PAGGAEL

SEQ ID NO: 241247 - protein, 5 aa, Mycobacterium
PAGGW

SEQ ID NO: 241248 - protein, 5 aa, Mycobacterium
PAGKA

SEQ ID NO: 241249 - protein, 7 aa, Mycobacterium
PAGLTAP

SEQ ID NO: 241250 - protein, 8 aa, Mycobacterium
PAGPASQW

SEQ ID NO: 241251 - protein, 6 aa, Mycobacterium
PAGRGP

SEQ ID NO: 241252 - protein, 7 aa, Mycobacterium
PAGSANL

SEQ ID NO: 241253 - protein, 10 aa, Mycobacterium
PAGSGPTPIQ

SEQ ID NO: 241254 - protein, 4 aa, Mycobacterium
PAIS

SEQ ID NO: 241255 - protein, 10 aa, Mycobacterium
PALESTRATL

SEQ ID NO: 241256 - protein, 4 aa, Mycobacterium
PALG

SEQ ID NO: 241257 - protein, 4 aa, Mycobacterium
PAMT

SEQ ID NO: 241258 - protein, 7 aa, Mycobacterium
PAPASAL

SEQ ID NO: 241259 - protein, 12 aa, Mycobacterium
PAPRNSAQHRSA

SEQ ID NO: 241260 - protein, 5 aa, Mycobacterium
PARPV

SEQ ID NO: 241261 - protein, 8 aa, Mycobacterium
PASEDAAL

SEQ ID NO: 241262 - protein, 5 aa, Mycobacterium
PATGG

SEQ ID NO: 241263 - protein, 9 aa, Mycobacterium
PATTPAGGL

SEQ ID NO: 241264 - protein, 9 aa, Mycobacterium
PATTSNEYE

SEQ ID NO: 241265 - protein, 4 aa, Mycobacterium
PAVE

SEQ ID NO: 241266 - protein, 4 aa, Mycobacterium
PDAA

SEQ ID NO: 241267 - protein, 5 aa, Mycobacterium
PDAHH

SEQ ID NO: 241268 - protein, 4 aa, Mycobacterium
PDAL

SEQ ID NO: 241269 - protein, 4 aa, Mycobacterium
PDAN

SEQ ID NO: 241270 - protein, 5 aa, Mycobacterium
PDAQT

SEQ ID NO: 241271 - protein, 10 aa, Mycobacterium
PDEAEKVDGD

SEQ ID NO: 241272 - protein, 8 aa, Mycobacterium
PDERTGER

SEQ ID NO: 241273 - protein, 5 aa, Mycobacterium
PDGAE

SEQ ID NO: 241274 - protein, 5 aa, Mycobacterium
PDGHG

SEQ ID NO: 241275 - protein, 6 aa, Mycobacterium
PDGKGA

SEQ ID NO: 241276 - protein, 4 aa, Mycobacterium
PDGL

SEQ ID NO: 241277 - protein, 4 aa, Mycobacterium
PDGN

SEQ ID NO: 241278 - protein, 9 aa, Mycobacterium
PDGQTRTST

SEQ ID NO: 241279 - protein, 4 aa, Mycobacterium
PDGR

SEQ ID NO: 241280 - protein, 7 aa, Mycobacterium
PDGSYSE

SEQ ID NO: 241281 - protein, 5 aa, Mycobacterium
PDGTA

SEQ ID NO: 241282 - protein, 7 aa, Mycobacterium
PDNEYTA

SEQ ID NO: 241283 - protein, 7 aa, Mycobacterium
PDPDTPV

SEQ ID NO: 241284 - protein, 8 aa, Mycobacterium
PDPTPQPL

SEQ ID NO: 241285 - protein, 6 aa, Mycobacterium
PDQIST

SEQ ID NO: 241286 - protein, 4 aa, Mycobacterium
PDQV

SEQ ID NO: 241287 - protein, 4 aa, Mycobacterium
PDTG

SEQ ID NO: 241288 - protein, 11 aa, Mycobacterium
PEATGHGTDEA

SEQ ID NO: 241289 - protein, 4 aa, Mycobacterium
PEDV

SEQ ID NO: 241290 - protein, 4 aa, Mycobacterium
PEEA

SEQ ID NO: 241291 - protein, 9 aa, Mycobacterium
PEKPGAQVA

SEQ ID NO: 241292 - protein, 4 aa, Mycobacterium
PENK

SEQ ID NO: 241293 - protein, 15 aa, Mycobacterium
PERDIPPVSADDGMA

SEQ ID NO: 241294 - protein, 4 aa, Mycobacterium
PESP

SEQ ID NO: 241295 - protein, 9 aa, Mycobacterium
PFTSDQDSM

SEQ ID NO: 241296 - protein, 6 aa, Mycobacterium
PGAPER

SEQ ID NO: 241297 - protein, 8 aa, Mycobacterium
PGAPPPGA

SEQ ID NO: 241298 - protein, 5 aa, Mycobacterium
PGARD

SEQ ID NO: 241299 - protein, 5 aa, Mycobacterium
PGATP

SEQ ID NO: 241300 - protein, 13 aa, Mycobacterium
PGAVPQDFDTPTE

SEQ ID NO: 241301 - protein, 4 aa, Mycobacterium
PGDA

SEQ ID NO: 241302 - protein, 7 aa, Mycobacterium
PGEKIPV

SEQ ID NO: 241303 - protein, 11 aa, Mycobacterium
PGGGNFTATPA

SEQ ID NO: 241304 - protein, 12 aa, Mycobacterium
PGGGNFTATPAR

SEQ ID NO: 241305 - protein, 14 aa, Mycobacterium
PGGKTAFCGPPDQV

SEQ ID NO: 241306 - protein, 10 aa, Mycobacterium
PGGSVPADGR

SEQ ID NO: 241307 - protein, 4 aa, Mycobacterium
PGIG

SEQ ID NO: 241308 - protein, 9 aa, Mycobacterium
PGINDPTTA

SEQ ID NO: 241309 - protein, 5 aa, Mycobacterium
PGLGG

SEQ ID NO: 241310 - protein, 8 aa, Mycobacterium
PGLGGNRP

SEQ ID NO: 241311 - protein, 12 aa, Mycobacterium
PGMRYKSGGPFA

SEQ ID NO: 241312 - protein, 5 aa, Mycobacterium
PGNGR

SEQ ID NO: 241313 - protein, 6 aa, Mycobacterium
PGPGTV

SEQ ID NO: 241314 - protein, 5 aa, Mycobacterium
PGQRF

SEQ ID NO: 241315 - protein, 4 aa, Mycobacterium
PGRT

SEQ ID NO: 241316 - protein, 7 aa, Mycobacterium
PGSKVTY

SEQ ID NO: 241317 - protein, 4 aa, Mycobacterium
PGTA

SEQ ID NO: 241318 - protein, 5 aa, Mycobacterium
PGTPV

SEQ ID NO: 241319 - protein, 4 aa, Mycobacterium
PGVA

SEQ ID NO: 241320 - protein, 5 aa, Mycobacterium
PGVAR

SEQ ID NO: 241321 - protein, 4 aa, Mycobacterium
PGVG

SEQ ID NO: 241322 - protein, 9 aa, Mycobacterium
PHAKYTGET

SEQ ID NO: 241323 - protein, 6 aa, Mycobacterium
PHPGPV

SEQ ID NO: 241324 - protein, 4 aa, Mycobacterium
PHTR

SEQ ID NO: 241325 - protein, 9 aa, Mycobacterium
PHTTPAPPI

SEQ ID NO: 241326 - protein, 4 aa, Mycobacterium
PIER

SEQ ID NO: 241327 - protein, 6 aa, Mycobacterium
PIPTPR

SEQ ID NO: 241328 - protein, 4 aa, Mycobacterium
PKAG

SEQ ID NO: 241329 - protein, 20 aa, Mycobacterium
PKGPLPNAGKMRGVQRTVRR

SEQ ID NO: 241330 - protein, 4 aa, Mycobacterium
PKHS

SEQ ID NO: 241331 - protein, 7 aa, Mycobacterium
PKPDAGH

SEQ ID NO: 241332 - protein, 9 aa, Mycobacterium
PKQAPKAVD

SEQ ID NO: 241333 - protein, 7 aa, Mycobacterium
PKTAPHG

SEQ ID NO: 241334 - protein, 6 aa, Mycobacterium
PKTPEF

SEQ ID NO: 241335 - protein, 6 aa, Mycobacterium
PLGDGE

SEQ ID NO: 241336 - protein, 7 aa, Mycobacterium
PLGTPLD

SEQ ID NO: 241337 - protein, 4 aa, Mycobacterium
PLPG

SEQ ID NO: 241338 - protein, 5 aa, Mycobacterium
PLPGA

SEQ ID NO: 241339 - protein, 10 aa, Mycobacterium
PLPNGTGNGL

SEQ ID NO: 241340 - protein, 9 aa, Mycobacterium
PLPPEPQLA

SEQ ID NO: 241341 - protein, 4 aa, Mycobacterium
PLSG

SEQ ID NO: 241342 - protein, 12 aa, Mycobacterium
PLSGDGSDTDTV

SEQ ID NO: 241343 - protein, 21 aa, Mycobacterium
PLSGDTQMSYNASRAEGTRAT

SEQ ID NO: 241344 - protein, 11 aa, Mycobacterium
PLSPSDAPSVT

SEQ ID NO: 241345 - protein, 15 aa, Mycobacterium
PLTGAGAQSNDGKAA

SEQ ID NO: 241346 - protein, 7 aa, Mycobacterium
PLTPPQT

SEQ ID NO: 241347 - protein, 4 aa, Mycobacterium
PLYS

SEQ ID NO: 241348 - protein, 4 aa, Mycobacterium
PNAP

SEQ ID NO: 241349 - protein, 4 aa, Mycobacterium
PNGA

SEQ ID NO: 241350 - protein, 4 aa, Mycobacterium
PNGR

SEQ ID NO: 241351 - protein, 6 aa, Mycobacterium
PNGSPE

SEQ ID NO: 241352 - protein, 5 aa, Mycobacterium
PNLSP

SEQ ID NO: 241353 - protein, 5 aa, Mycobacterium
PNLSS

SEQ ID NO: 241354 - protein, 8 aa, Mycobacterium
PNNERAYP

SEQ ID NO: 241355 - protein, 8 aa, Mycobacterium
PNPTGDQQ

SEQ ID NO: 241356 - protein, 9 aa, Mycobacterium
PNQPGTDYD

SEQ ID NO: 241357 - protein, 14 aa, Mycobacterium
PNRAESERNADRAP

SEQ ID NO: 241358 - protein, 7 aa, Mycobacterium
PPAAVAT

SEQ ID NO: 241359 - protein, 4 aa, Mycobacterium
PPAP

SEQ ID NO: 241360 - protein, 4 aa, Mycobacterium
PPAT

SEQ ID NO: 241361 - protein, 5 aa, Mycobacterium
PPDAV

SEQ ID NO: 241362 - protein, 6 aa, Mycobacterium
PPEGNR

SEQ ID NO: 241363 - protein, 6 aa, Mycobacterium
PPEHTR

SEQ ID NO: 241364 - protein, 4 aa, Mycobacterium
PPEV

SEQ ID NO: 241365 - protein, 4 aa, Mycobacterium
PPGA

SEQ ID NO: 241366 - protein, 12 aa, Mycobacterium
PPGDRMPPGAQS

SEQ ID NO: 241367 - protein, 6 aa, Mycobacterium
PPGSAI

SEQ ID NO: 241368 - protein, 4 aa, Mycobacterium
PPGV

SEQ ID NO: 241369 - protein, 4 aa, Mycobacterium
PPIE

SEQ ID NO: 241370 - protein, 9 aa, Mycobacterium
PPKGLSQEE

SEQ ID NO: 241371 - protein, 6 aa, Mycobacterium
PPNASP

SEQ ID NO: 241372 - protein, 4 aa, Mycobacterium
PPNW

SEQ ID NO: 241373 - protein, 5 aa, Mycobacterium
PPPDV

SEQ ID NO: 241374 - protein, 4 aa, Mycobacterium
PPQG

SEQ ID NO: 241375 - protein, 6 aa, Mycobacterium
PPQHTR

SEQ ID NO: 241376 - protein, 7 aa, Mycobacterium
PPQPSGV

SEQ ID NO: 241377 - protein, 4 aa, Mycobacterium
PPRR

SEQ ID NO: 241378 - protein, 8 aa, Mycobacterium
PPRTPDRP

SEQ ID NO: 241379 - protein, 4 aa, Mycobacterium
PPSR

SEQ ID NO: 241380 - protein, 5 aa, Mycobacterium
PPSWN

SEQ ID NO: 241381 - protein, 6 aa, Mycobacterium
PPVPDD

SEQ ID NO: 241382 - protein, 9 aa, Mycobacterium
PQDYPGARA

SEQ ID NO: 241383 - protein, 7 aa, Mycobacterium
PQHPSTH

SEQ ID NO: 241384 - protein, 5 aa, Mycobacterium
PQLGP

SEQ ID NO: 241385 - protein, 6 aa, Mycobacterium
PQPGRH

SEQ ID NO: 241386 - protein, 4 aa, Mycobacterium
PQPV

SEQ ID NO: 241387 - protein, 5 aa, Mycobacterium
PQRPR

SEQ ID NO: 241388 - protein, 12 aa, Mycobacterium
PQSARADISADG

SEQ ID NO: 241389 - protein, 4 aa, Mycobacterium
PQSY

SEQ ID NO: 241390 - protein, 6 aa, Mycobacterium
PQTARA

SEQ ID NO: 241391 - protein, 7 aa, Mycobacterium
PQTRSTR

SEQ ID NO: 241392 - protein, 8 aa, Mycobacterium
PRAHRSAE

SEQ ID NO: 241393 - protein, 4 aa, Mycobacterium
PRDV

SEQ ID NO: 241394 - protein, 9 aa, Mycobacterium
PRGSGEGRL

SEQ ID NO: 241395 - protein, 7 aa, Mycobacterium
PRPRPTG

SEQ ID NO: 241396 - protein, 6 aa, Mycobacterium
PRPTEV

SEQ ID NO: 241397 - protein, 4 aa, Mycobacterium
PRPV

SEQ ID NO: 241398 - protein, 14 aa, Mycobacterium
PRQPWSTIWPSLRR

SEQ ID NO: 241399 - protein, 4 aa, Mycobacterium
PRQR

SEQ ID NO: 241400 - protein, 12 aa, Mycobacterium
PRSAEEQEREPE

SEQ ID NO: 241401 - protein, 9 aa, Mycobacterium
PRTDSPPYL

SEQ ID NO: 241402 - protein, 7 aa, Mycobacterium
PRTRNPV

SEQ ID NO: 241403 - protein, 4 aa, Mycobacterium
PRVT

SEQ ID NO: 241404 - protein, 8 aa, Mycobacterium
PSAATAAK

SEQ ID NO: 241405 - protein, 5 aa, Mycobacterium
PSDGF

SEQ ID NO: 241406 - protein, 6 aa, Mycobacterium
PSDGFQ

SEQ ID NO: 241407 - protein, 7 aa, Mycobacterium
PSEETAV

SEQ ID NO: 241408 - protein, 4 aa, Mycobacterium
PSFA

SEQ ID NO: 241409 - protein, 5 aa, Mycobacterium
PSHGA

SEQ ID NO: 241410 - protein, 5 aa, Mycobacterium
PSIAD

SEQ ID NO: 241411 - protein, 4 aa, Mycobacterium
PSLR

SEQ ID NO: 241412 - protein, 4 aa, Mycobacterium
PSPL

SEQ ID NO: 241413 - protein, 7 aa, Mycobacterium
PSQSSAR

SEQ ID NO: 241414 - protein, 4 aa, Mycobacterium
PSTF

SEQ ID NO: 241415 - protein, 4 aa, Mycobacterium
PSTL

SEQ ID NO: 241416 - protein, 4 aa, Mycobacterium
PSTP

SEQ ID NO: 241417 - protein, 5 aa, Mycobacterium
PSVPD

SEQ ID NO: 241418 - protein, 8 aa, Mycobacterium
PTAATAAK

SEQ ID NO: 241419 - protein, 4 aa, Mycobacterium
PTAL

SEQ ID NO: 241420 - protein, 6 aa, Mycobacterium
PTATSG

SEQ ID NO: 241421 - protein, 8 aa, Mycobacterium
PTDMRTSK

SEQ ID NO: 241422 - protein, 4 aa, Mycobacterium
PTDP

SEQ ID NO: 241423 - protein, 5 aa, Mycobacterium
PTNAT

SEQ ID NO: 241424 - protein, 18 aa, Mycobacterium
PTPAGPEIRDANSSNGTF

SEQ ID NO: 241425 - protein, 4 aa, Mycobacterium
PTPL

SEQ ID NO: 241426 - protein, 6 aa, Mycobacterium
PTPPLG

SEQ ID NO: 241427 - protein, 8 aa, Mycobacterium
PTPQHQAT

SEQ ID NO: 241428 - protein, 8 aa, Mycobacterium
PTPRGSYG

SEQ ID NO: 241429 - protein, 7 aa, Mycobacterium
PTRAAAR

SEQ ID NO: 241430 - protein, 7 aa, Mycobacterium
PTSPAQK

SEQ ID NO: 241431 - protein, 6 aa, Mycobacterium
PTTDPG

SEQ ID NO: 241432 - protein, 8 aa, Mycobacterium
PTTGLDPA

SEQ ID NO: 241433 - protein, 5 aa, Mycobacterium
PTTNE

SEQ ID NO: 241434 - protein, 4 aa, Mycobacterium
PTYS

SEQ ID NO: 241435 - protein, 4 aa, Mycobacterium
PVAG

SEQ ID NO: 241436 - protein, 5 aa, Mycobacterium
PVGGA

SEQ ID NO: 241437 - protein, 5 aa, Mycobacterium
PVNEA

SEQ ID NO: 241438 - protein, 4 aa, Mycobacterium
PVPA

SEQ ID NO: 241439 - protein, 21 aa, Mycobacterium
PVSRDSRKRTGRLHTPKRYSR

SEQ ID NO: 241440 - protein, 13 aa, Mycobacterium
PVTASQAVSQDGK

SEQ ID NO: 241441 - protein, 4 aa, Mycobacterium
PVTV

SEQ ID NO: 241442 - protein, 7 aa, Mycobacterium
PWPHSDA

SEQ ID NO: 241443 - protein, 4 aa, Mycobacterium
PWPP

SEQ ID NO: 241444 - protein, 4 aa, Mycobacterium
PWPS

SEQ ID NO: 241445 - protein, 6 aa, Mycobacterium
PWYGDP

SEQ ID NO: 241446 - protein, 4 aa, Mycobacterium
PYPG

SEQ ID NO: 241447 - protein, 7 aa, Mycobacterium
PYQPNTE

SEQ ID NO: 241448 - protein, 21 aa, Mycobacterium
PYSRGGEKPDGRLYPEDQPDR

SEQ ID NO: 241449 - protein, 12 aa, Mycobacterium
QAAGGAVNGADT

SEQ ID NO: 241450 - protein, 4 aa, Mycobacterium
QAAP

SEQ ID NO: 241451 - protein, 9 aa, Mycobacterium
QAAPALAEA

SEQ ID NO: 241452 - protein, 5 aa, Mycobacterium
QADAD

SEQ ID NO: 241453 - protein, 11 aa, Mycobacterium
QADEWPPPPTE

SEQ ID NO: 241454 - protein, 6 aa, Mycobacterium
QAEEFG

SEQ ID NO: 241455 - protein, 11 aa, Mycobacterium
QAERSSDPVRR

SEQ ID NO: 241456 - protein, 7 aa, Mycobacterium
QALDGLG

SEQ ID NO: 241457 - protein, 5 aa, Mycobacterium
QALGA

SEQ ID NO: 241458 - protein, 7 aa, Mycobacterium
QAPPSKA

SEQ ID NO: 241459 - protein, 4 aa, Mycobacterium
QASE

SEQ ID NO: 241460 - protein, 5 aa, Mycobacterium
QASPL

SEQ ID NO: 241461 - protein, 16 aa, Mycobacterium
QASSLRDNARAEGRKV

SEQ ID NO: 241462 - protein, 5 aa, Mycobacterium
QAYDD

SEQ ID NO: 241463 - protein, 9 aa, Mycobacterium
QDATTTFEQ

SEQ ID NO: 241464 - protein, 6 aa, Mycobacterium
QDEQDP

SEQ ID NO: 241465 - protein, 6 aa, Mycobacterium
QDPNAG

SEQ ID NO: 241466 - protein, 8 aa, Mycobacterium
QDPPARRR

SEQ ID NO: 241467 - protein, 6 aa, Mycobacterium
QDSPIA

SEQ ID NO: 241468 - protein, 8 aa, Mycobacterium
QDSPIGVR

SEQ ID NO: 241469 - protein, 9 aa, Mycobacterium
QEDGGIRSA

SEQ ID NO: 241470 - protein, 5 aa, Mycobacterium
QEEAG

SEQ ID NO: 241471 - protein, 8 aa, Mycobacterium
QEPLGPDA

SEQ ID NO: 241472 - protein, 8 aa, Mycobacterium
QFGGSDTR

SEQ ID NO: 241473 - protein, 6 aa, Mycobacterium
QFGRQN

SEQ ID NO: 241474 - protein, 11 aa, Mycobacterium
QFPGPGRTETN

SEQ ID NO: 241475 - protein, 6 aa, Mycobacterium
QGALEG

SEQ ID NO: 241476 - protein, 4 aa, Mycobacterium
QGDG

SEQ ID NO: 241477 - protein, 6 aa, Mycobacterium
QGDTPL

SEQ ID NO: 241478 - protein, 4 aa, Mycobacterium
QGGA

SEQ ID NO: 241479 - protein, 5 aa, Mycobacterium
QGPEG

SEQ ID NO: 241480 - protein, 6 aa, Mycobacterium
QGPSPV

SEQ ID NO: 241481 - protein, 7 aa, Mycobacterium
QGQSGST

SEQ ID NO: 241482 - protein, 9 aa, Mycobacterium
QGSGNGQQL

SEQ ID NO: 241483 - protein, 10 aa, Mycobacterium
QGSGNGQQLP

SEQ ID NO: 241484 - protein, 6 aa, Mycobacterium
QGTEFD

SEQ ID NO: 241485 - protein, 5 aa, Mycobacterium
QGTNT

SEQ ID NO: 241486 - protein, 9 aa, Mycobacterium
QGVPDRGPS

SEQ ID NO: 241487 - protein, 8 aa, Mycobacterium
QIESQQRN

SEQ ID NO: 241488 - protein, 8 aa, Mycobacterium
QIGANADG

SEQ ID NO: 241489 - protein, 8 aa, Mycobacterium
QIPGTGFG

SEQ ID NO: 241490 - protein, 6 aa, Mycobacterium
QIPTND

SEQ ID NO: 241491 - protein, 20 aa, Mycobacterium
QKGLQDQQKEAQKNSSAMGK

SEQ ID NO: 241492 - protein, 5 aa, Mycobacterium
QLATN

SEQ ID NO: 241493 - protein, 7 aa, Mycobacterium
QLKSGSA

SEQ ID NO: 241494 - protein, 10 aa, Mycobacterium
QLNQQRAQTS

SEQ ID NO: 241495 - protein, 5 aa, Mycobacterium
QLPGV

SEQ ID NO: 241496 - protein, 11 aa, Mycobacterium
QLPPLPRGTTA

SEQ ID NO: 241497 - protein, 5 aa, Mycobacterium
QLPTG

SEQ ID NO: 241498 - protein, 10 aa, Mycobacterium
QLQGAPGDIN

SEQ ID NO: 241499 - protein, 8 aa, Mycobacterium
QNGVDETP

SEQ ID NO: 241500 - protein, 5 aa, Mycobacterium
QNNDM

SEQ ID NO: 241501 - protein, 7 aa, Mycobacterium
QNPGRYQ

SEQ ID NO: 241502 - protein, 14 aa, Mycobacterium
QNSPGQPPSQAAPA

SEQ ID NO: 241503 - protein, 9 aa, Mycobacterium
QNTSTAGVG

SEQ ID NO: 241504 - protein, 7 aa, Mycobacterium
QNTTRDA

SEQ ID NO: 241505 - protein, 8 aa, Mycobacterium
QNVPGCGA

SEQ ID NO: 241506 - protein, 18 aa, Mycobacterium
QNYDDRQYQPAGAPANLG

SEQ ID NO: 241507 - protein, 4 aa, Mycobacterium
QPAV

SEQ ID NO: 241508 - protein, 5 aa, Mycobacterium
QPAYE

SEQ ID NO: 241509 - protein, 6 aa, Mycobacterium
QPDQPA

SEQ ID NO: 241510 - protein, 4 aa, Mycobacterium
QPGE

SEQ ID NO: 241511 - protein, 14 aa, Mycobacterium
QPHVAPGDARRGIF

SEQ ID NO: 241512 - protein, 6 aa, Mycobacterium
QPPGHP

SEQ ID NO: 241513 - protein, 7 aa, Mycobacterium
QPPQPSL

SEQ ID NO: 241514 - protein, 6 aa, Mycobacterium
QPTPRM

SEQ ID NO: 241515 - protein, 4 aa, Mycobacterium
QPVA

SEQ ID NO: 241516 - protein, 5 aa, Mycobacterium
QQAGA

SEQ ID NO: 241517 - protein, 4 aa, Mycobacterium
QQEA

SEQ ID NO: 241518 - protein, 7 aa, Mycobacterium
QQGGAQV

SEQ ID NO: 241519 - protein, 8 aa, Mycobacterium
QQMGPGPN

SEQ ID NO: 241520 - protein, 9 aa, Mycobacterium
QQPLGPDAH

SEQ ID NO: 241521 - protein, 5 aa, Mycobacterium
QQTGV

SEQ ID NO: 241522 - protein, 5 aa, Mycobacterium
QRDGL

SEQ ID NO: 241523 - protein, 6 aa, Mycobacterium
QRDPKV

SEQ ID NO: 241524 - protein, 5 aa, Mycobacterium
QRELD

SEQ ID NO: 241525 - protein, 4 aa, Mycobacterium
QRLG

SEQ ID NO: 241526 - protein, 5 aa, Mycobacterium
QRPVI

SEQ ID NO: 241527 - protein, 4 aa, Mycobacterium
QRQG

SEQ ID NO: 241528 - protein, 4 aa, Mycobacterium
QRRA

SEQ ID NO: 241529 - protein, 6 aa, Mycobacterium
QRWPNL

SEQ ID NO: 241530 - protein, 4 aa, Mycobacterium
QSDE

SEQ ID NO: 241531 - protein, 4 aa, Mycobacterium
QSEA

SEQ ID NO: 241532 - protein, 6 aa, Mycobacterium
QSGADS

SEQ ID NO: 241533 - protein, 9 aa, Mycobacterium
QSGNLTGGG

SEQ ID NO: 241534 - protein, 13 aa, Mycobacterium
QSIADTDEPDTRL

SEQ ID NO: 241535 - protein, 10 aa, Mycobacterium
QSLPDAKSAL

SEQ ID NO: 241536 - protein, 6 aa, Mycobacterium
QSNDDD

SEQ ID NO: 241537 - protein, 6 aa, Mycobacterium
QSNGTY

SEQ ID NO: 241538 - protein, 5 aa, Mycobacterium
QSNSM

SEQ ID NO: 241539 - protein, 13 aa, Mycobacterium
QSPQGMAAESSSA

SEQ ID NO: 241540 - protein, 7 aa, Mycobacterium
QSRIEGT

SEQ ID NO: 241541 - protein, 6 aa, Mycobacterium
QSSLPE

SEQ ID NO: 241542 - protein, 5 aa, Mycobacterium
QSSRL

SEQ ID NO: 241543 - protein, 6 aa, Mycobacterium
QSTGTY

SEQ ID NO: 241544 - protein, 11 aa, Mycobacterium
QSVDPGQLEAS

SEQ ID NO: 241545 - protein, 12 aa, Mycobacterium
QSVPPDTRNGLA

SEQ ID NO: 241546 - protein, 7 aa, Mycobacterium
QTARRAH

SEQ ID NO: 241547 - protein, 4 aa, Mycobacterium
QTAT

SEQ ID NO: 241548 - protein, 5 aa, Mycobacterium
QTEPW

SEQ ID NO: 241549 - protein, 22 aa, Mycobacterium
QTGGNGDTLKDTDGSRPGPQAA

SEQ ID NO: 241550 - protein, 6 aa, Mycobacterium
QTLNTE

SEQ ID NO: 241551 - protein, 4 aa, Mycobacterium
QTPS

SEQ ID NO: 241552 - protein, 4 aa, Mycobacterium
QTQA

SEQ ID NO: 241553 - protein, 6 aa, Mycobacterium
QTSTLT

SEQ ID NO: 241554 - protein, 4 aa, Mycobacterium
QTSV

SEQ ID NO: 241555 - protein, 4 aa, Mycobacterium
QTTA

SEQ ID NO: 241556 - protein, 12 aa, Mycobacterium
QVTTETNGDYGR

SEQ ID NO: 241557 - protein, 10 aa, Mycobacterium
RAAEDRAAGR

SEQ ID NO: 241558 - protein, 6 aa, Mycobacterium
RAATRR

SEQ ID NO: 241559 - protein, 8 aa, Mycobacterium
RADPGRAG

SEQ ID NO: 241560 - protein, 9 aa, Mycobacterium
RADPGRAGA

SEQ ID NO: 241561 - protein, 7 aa, Mycobacterium
RADRAAD

SEQ ID NO: 241562 - protein, 4 aa, Mycobacterium
RADY

SEQ ID NO: 241563 - protein, 9 aa, Mycobacterium
RAEEESGAA

SEQ ID NO: 241564 - protein, 8 aa, Mycobacterium
RAEIGSGI

SEQ ID NO: 241565 - protein, 8 aa, Mycobacterium
RAEPGLGT

SEQ ID NO: 241566 - protein, 5 aa, Mycobacterium
RAEQR

SEQ ID NO: 241567 - protein, 4 aa, Mycobacterium
RAGA

SEQ ID NO: 241568 - protein, 15 aa, Mycobacterium
RAGAASAVTSTSRQV

SEQ ID NO: 241569 - protein, 4 aa, Mycobacterium
RAGD

SEQ ID NO: 241570 - protein, 4 aa, Mycobacterium
RAGN

SEQ ID NO: 241571 - protein, 4 aa, Mycobacterium
RAGP

SEQ ID NO: 241572 - protein, 4 aa, Mycobacterium
RAGR

SEQ ID NO: 241573 - protein, 8 aa, Mycobacterium
RAGRDDKV

SEQ ID NO: 241574 - protein, 8 aa, Mycobacterium
RAGRDDRV

SEQ ID NO: 241575 - protein, 7 aa, Mycobacterium
RAGRTTA

SEQ ID NO: 241576 - protein, 4 aa, Mycobacterium
RAGT

SEQ ID NO: 241577 - protein, 8 aa, Mycobacterium
RAHSNPST

SEQ ID NO: 241578 - protein, 9 aa, Mycobacterium
RAKAGTGEA

SEQ ID NO: 241579 - protein, 10 aa, Mycobacterium
RAKSKAGSAL

SEQ ID NO: 241580 - protein, 9 aa, Mycobacterium
RAPHSTEIR

SEQ ID NO: 241581 - protein, 5 aa, Mycobacterium
RAQRR

SEQ ID NO: 241582 - protein, 6 aa, Mycobacterium
RARAGA

SEQ ID NO: 241583 - protein, 6 aa, Mycobacterium
RASDRV

SEQ ID NO: 241584 - protein, 9 aa, Mycobacterium
RATGKTREA

SEQ ID NO: 241585 - protein, 7 aa, Mycobacterium
RATGSGH

SEQ ID NO: 241586 - protein, 5 aa, Mycobacterium
RATRL

SEQ ID NO: 241587 - protein, 7 aa, Mycobacterium
RCDQPVK

SEQ ID NO: 241588 - protein, 5 aa, Mycobacterium
RDDNS

SEQ ID NO: 241589 - protein, 20 aa, Mycobacterium
RDEESESKKREADVERDDAE

SEQ ID NO: 241590 - protein, 7 aa, Mycobacterium
RDEGQVK

SEQ ID NO: 241591 - protein, 11 aa, Mycobacterium
RDEHDDATPDV

SEQ ID NO: 241592 - protein, 14 aa, Mycobacterium
RDGDQLKMSKVEFV

SEQ ID NO: 241593 - protein, 8 aa, Mycobacterium
RDGPRRRR

SEQ ID NO: 241594 - protein, 4 aa, Mycobacterium
RDGR

SEQ ID NO: 241595 - protein, 10 aa, Mycobacterium
RDGRPTTFGA

SEQ ID NO: 241596 - protein, 4 aa, Mycobacterium
RDGS

SEQ ID NO: 241597 - protein, 5 aa, Mycobacterium
RDGST

SEQ ID NO: 241598 - protein, 4 aa, Mycobacterium
RDLP

SEQ ID NO: 241599 - protein, 8 aa, Mycobacterium
RDLTDEER

SEQ ID NO: 241600 - protein, 7 aa, Mycobacterium
RDNGQVK

SEQ ID NO: 241601 - protein, 10 aa, Mycobacterium
RDNTDTFNTR

SEQ ID NO: 241602 - protein, 7 aa, Mycobacterium
RDPAPVT

SEQ ID NO: 241603 - protein, 5 aa, Mycobacterium
RDPAT

SEQ ID NO: 241604 - protein, 5 aa, Mycobacterium
RDPGA

SEQ ID NO: 241605 - protein, 9 aa, Mycobacterium
RDPHGRHRP

SEQ ID NO: 241606 - protein, 7 aa, Mycobacterium
RDQETGI

SEQ ID NO: 241607 - protein, 4 aa, Mycobacterium
RDQL

SEQ ID NO: 241608 - protein, 7 aa, Mycobacterium
RDREVRR

SEQ ID NO: 241609 - protein, 6 aa, Mycobacterium
RDRGPV

SEQ ID NO: 241610 - protein, 4 aa, Mycobacterium
RDRV

SEQ ID NO: 241611 - protein, 10 aa, Mycobacterium
READTAGRLT

SEQ ID NO: 241612 - protein, 4 aa, Mycobacterium
REAT

SEQ ID NO: 241613 - protein, 5 aa, Mycobacterium
REEDL

SEQ ID NO: 241614 - protein, 5 aa, Mycobacterium
REGDD

SEQ ID NO: 241615 - protein, 4 aa, Mycobacterium
RELM

SEQ ID NO: 241616 - protein, 6 aa, Mycobacterium
REPRRQ

SEQ ID NO: 241617 - protein, 8 aa, Mycobacterium
RERGMSTA

SEQ ID NO: 241618 - protein, 4 aa, Mycobacterium
RETT

SEQ ID NO: 241619 - protein, 5 aa, Mycobacterium
RFTPR

SEQ ID NO: 241620 - protein, 11 aa, Mycobacterium
RGAEGADPASV

SEQ ID NO: 241621 - protein, 6 aa, Mycobacterium
RGAGQT

SEQ ID NO: 241622 - protein, 8 aa, Mycobacterium
RGAPWSTR

SEQ ID NO: 241623 - protein, 6 aa, Mycobacterium
RGATEA

SEQ ID NO: 241624 - protein, 10 aa, Mycobacterium
RGDLDRERAQ

SEQ ID NO: 241625 - protein, 6 aa, Mycobacterium
RGDREA

SEQ ID NO: 241626 - protein, 5 aa, Mycobacterium
RGEAA

SEQ ID NO: 241627 - protein, 13 aa, Mycobacterium
RGEPWPPPVPEPA

SEQ ID NO: 241628 - protein, 9 aa, Mycobacterium
RGFSGPQNG

SEQ ID NO: 241629 - protein, 5 aa, Mycobacterium
RGGLE

SEQ ID NO: 241630 - protein, 11 aa, Mycobacterium
RGGSKGLGTAV

SEQ ID NO: 241631 - protein, 7 aa, Mycobacterium
RGKGTAA

SEQ ID NO: 241632 - protein, 9 aa, Mycobacterium
RGLQQTAPE

SEQ ID NO: 241633 - protein, 4 aa, Mycobacterium
RGPL

SEQ ID NO: 241634 - protein, 8 aa, Mycobacterium
RGPRLTPG

SEQ ID NO: 241635 - protein, 9 aa, Mycobacterium
RGPSATAGY

SEQ ID NO: 241636 - protein, 9 aa, Mycobacterium
RGRPADRPA

SEQ ID NO: 241637 - protein, 4 aa, Mycobacterium
RGRY

SEQ ID NO: 241638 - protein, 6 aa, Mycobacterium
RGSGSI

SEQ ID NO: 241639 - protein, 6 aa, Mycobacterium
RGSSGN

SEQ ID NO: 241640 - protein, 9 aa, Mycobacterium
RGTERTDHD

SEQ ID NO: 241641 - protein, 5 aa, Mycobacterium
RGTGG

SEQ ID NO: 241642 - protein, 6 aa, Mycobacterium
RGTPLR

SEQ ID NO: 241643 - protein, 4 aa, Mycobacterium
RGVP

SEQ ID NO: 241644 - protein, 5 aa, Mycobacterium
RGVPA

SEQ ID NO: 241645 - protein, 4 aa, Mycobacterium
RHLP

SEQ ID NO: 241646 - protein, 8 aa, Mycobacterium
RIASKSSA

SEQ ID NO: 241647 - protein, 4 aa, Mycobacterium
RKED

SEQ ID NO: 241648 - protein, 4 aa, Mycobacterium
RKEG

SEQ ID NO: 241649 - protein, 12 aa, Mycobacterium
RKEGQSGQAKMT

SEQ ID NO: 241650 - protein, 4 aa, Mycobacterium
RKGF

SEQ ID NO: 241651 - protein, 8 aa, Mycobacterium
RKGRGTPT

SEQ ID NO: 241652 - protein, 4 aa, Mycobacterium
RKGY

SEQ ID NO: 241653 - protein, 6 aa, Mycobacterium
RKLQTR

SEQ ID NO: 241654 - protein, 6 aa, Mycobacterium
RKMRTR

SEQ ID NO: 241655 - protein, 8 aa, Mycobacterium
RKPELGTP

SEQ ID NO: 241656 - protein, 7 aa, Mycobacterium
RKRFGDT

SEQ ID NO: 241657 - protein, 5 aa, Mycobacterium
RKTAE

SEQ ID NO: 241658 - protein, 4 aa, Mycobacterium
RKTG

SEQ ID NO: 241659 - protein, 10 aa, Mycobacterium
RLADRDDPRR

SEQ ID NO: 241660 - protein, 12 aa, Mycobacterium
RLATGTANQPTW

SEQ ID NO: 241661 - protein, 8 aa, Mycobacterium
RLDGERPQ

SEQ ID NO: 241662 - protein, 5 aa, Mycobacterium
RLGGS

SEQ ID NO: 241663 - protein, 5 aa, Mycobacterium
RLGPA

SEQ ID NO: 241664 - protein, 7 aa, Mycobacterium
RLGPEGT

SEQ ID NO: 241665 - protein, 16 aa, Mycobacterium
RLGRREPDVYGDTTHE

SEQ ID NO: 241666 - protein, 12 aa, Mycobacterium
RLPGDMNTPDET

SEQ ID NO: 241667 - protein, 5 aa, Mycobacterium
RLPRE

SEQ ID NO: 241668 - protein, 8 aa, Mycobacterium
RLSKPPRR

SEQ ID NO: 241669 - protein, 8 aa, Mycobacterium
RLSQRGSE

SEQ ID NO: 241670 - protein, 4 aa, Mycobacterium
RLTG

SEQ ID NO: 241671 - protein, 9 aa, Mycobacterium
RLTPSGALT

SEQ ID NO: 241672 - protein, 4 aa, Mycobacterium
RMPA

SEQ ID NO: 241673 - protein, 15 aa, Mycobacterium
RNGITVKDSDGTIRR

SEQ ID NO: 241674 - protein, 15 aa, Mycobacterium
RNGITVKDSDGTVRR

SEQ ID NO: 241675 - protein, 6 aa, Mycobacterium
RNGPRK

SEQ ID NO: 241676 - protein, 4 aa, Mycobacterium
RNPL

SEQ ID NO: 241677 - protein, 18 aa, Mycobacterium
RNPPPRRPGTDEERADTD

SEQ ID NO: 241678 - protein, 7 aa, Mycobacterium
RNPQPVT

SEQ ID NO: 241679 - protein, 9 aa, Mycobacterium
RNRDPGSPE

SEQ ID NO: 241680 - protein, 17 aa, Mycobacterium
RNTDRIGTATLNTNQNI

SEQ ID NO: 241681 - protein, 6 aa, Mycobacterium
RNVTTE

SEQ ID NO: 241682 - protein, 4 aa, Mycobacterium
RPAS

SEQ ID NO: 241683 - protein, 5 aa, Mycobacterium
RPDAY

SEQ ID NO: 241684 - protein, 9 aa, Mycobacterium
RPDGKPIKH

SEQ ID NO: 241685 - protein, 5 aa, Mycobacterium
RPDLE

SEQ ID NO: 241686 - protein, 6 aa, Mycobacterium
RPDLER

SEQ ID NO: 241687 - protein, 4 aa, Mycobacterium
RPDV

SEQ ID NO: 241688 - protein, 5 aa, Mycobacterium
RPEDK

SEQ ID NO: 241689 - protein, 5 aa, Mycobacterium
RPEDP

SEQ ID NO: 241690 - protein, 11 aa, Mycobacterium
RPEDTDPDNEV

SEQ ID NO: 241691 - protein, 5 aa, Mycobacterium
RPERD

SEQ ID NO: 241692 - protein, 7 aa, Mycobacterium
RPESTQS

SEQ ID NO: 241693 - protein, 11 aa, Mycobacterium
RPFPARMGPKG

SEQ ID NO: 241694 - protein, 4 aa, Mycobacterium
RPGG

SEQ ID NO: 241695 - protein, 6 aa, Mycobacterium
RPGGRV

SEQ ID NO: 241696 - protein, 5 aa, Mycobacterium
RPLGE

SEQ ID NO: 241697 - protein, 7 aa, Mycobacterium
RPLGGPI

SEQ ID NO: 241698 - protein, 10 aa, Mycobacterium
RPLGPPIQDG

SEQ ID NO: 241699 - protein, 4 aa, Mycobacterium
RPLP

SEQ ID NO: 241700 - protein, 7 aa, Mycobacterium
RPNPGIG

SEQ ID NO: 241701 - protein, 4 aa, Mycobacterium
RPVA

SEQ ID NO: 241702 - protein, 6 aa, Mycobacterium
RQAPRT

SEQ ID NO: 241703 - protein, 13 aa, Mycobacterium
RQGEDIDTRYHPS

SEQ ID NO: 241704 - protein, 7 aa, Mycobacterium
RQGQESF

SEQ ID NO: 241705 - protein, 11 aa, Mycobacterium
RQGTTGSSIGK

SEQ ID NO: 241706 - protein, 7 aa, Mycobacterium
RQKKAMQ

SEQ ID NO: 241707 - protein, 6 aa, Mycobacterium
RQKRAM

SEQ ID NO: 241708 - protein, 14 aa, Mycobacterium
RQNESGDSLETARP

SEQ ID NO: 241709 - protein, 5 aa, Mycobacterium
RQRGE

SEQ ID NO: 241710 - protein, 6 aa, Mycobacterium
RQRPAS

SEQ ID NO: 241711 - protein, 7 aa, Mycobacterium
RQSDNEA

SEQ ID NO: 241712 - protein, 14 aa, Mycobacterium
RQTESGDSLDTARP

SEQ ID NO: 241713 - protein, 4 aa, Mycobacterium
RQTL

SEQ ID NO: 241714 - protein, 5 aa, Mycobacterium
RQTLA

SEQ ID NO: 241715 - protein, 8 aa, Mycobacterium
RQVARGGA

SEQ ID NO: 241716 - protein, 9 aa, Mycobacterium
RRAGRDSAR

SEQ ID NO: 241717 - protein, 9 aa, Mycobacterium
RRASARAAR

SEQ ID NO: 241718 - protein, 5 aa, Mycobacterium
RRDYA

SEQ ID NO: 241719 - protein, 6 aa, Mycobacterium
RREFKP

SEQ ID NO: 241720 - protein, 4 aa, Mycobacterium
RRGL

SEQ ID NO: 241721 - protein, 14 aa, Mycobacterium
RRGLGRRRKSWAKS

SEQ ID NO: 241722 - protein, 7 aa, Mycobacterium
RRGPGKS

SEQ ID NO: 241723 - protein, 8 aa, Mycobacterium
RRGRGDER

SEQ ID NO: 241724 - protein, 8 aa, Mycobacterium
RRGRGTPT

SEQ ID NO: 241725 - protein, 7 aa, Mycobacterium
RRGRSLG

SEQ ID NO: 241726 - protein, 4 aa, Mycobacterium
RRHT

SEQ ID NO: 241727 - protein, 5 aa, Mycobacterium
RRLTG

SEQ ID NO: 241728 - protein, 7 aa, Mycobacterium
RRNARSR

SEQ ID NO: 241729 - protein, 4 aa, Mycobacterium
RRNG

SEQ ID NO: 241730 - protein, 8 aa, Mycobacterium
RRNHGRSR

SEQ ID NO: 241731 - protein, 4 aa, Mycobacterium
RRPG

SEQ ID NO: 241732 - protein, 4 aa, Mycobacterium
RRPL

SEQ ID NO: 241733 - protein, 6 aa, Mycobacterium
RRQQAG

SEQ ID NO: 241734 - protein, 5 aa, Mycobacterium
RRQTL

SEQ ID NO: 241735 - protein, 6 aa, Mycobacterium
RRRATD

SEQ ID NO: 241736 - protein, 6 aa, Mycobacterium
RRRDDE

SEQ ID NO: 241737 - protein, 6 aa, Mycobacterium
RRREDE

SEQ ID NO: 241738 - protein, 5 aa, Mycobacterium
RRREQ

SEQ ID NO: 241739 - protein, 4 aa, Mycobacterium
RRRP

SEQ ID NO: 241740 - protein, 5 aa, Mycobacterium
RRRQA

SEQ ID NO: 241741 - protein, 4 aa, Mycobacterium
RRRR

SEQ ID NO: 241742 - protein, 7 aa, Mycobacterium
RRSARSR

SEQ ID NO: 241743 - protein, 6 aa, Mycobacterium
RRSRSL

SEQ ID NO: 241744 - protein, 4 aa, Mycobacterium
RRSS

SEQ ID NO: 241745 - protein, 5 aa, Mycobacterium
RRSSR

SEQ ID NO: 241746 - protein, 7 aa, Mycobacterium
RRVEPAR

SEQ ID NO: 241747 - protein, 5 aa, Mycobacterium
RSADG

SEQ ID NO: 241748 - protein, 4 aa, Mycobacterium
RSDE

SEQ ID NO: 241749 - protein, 10 aa, Mycobacterium
RSEASKHRQA

SEQ ID NO: 241750 - protein, 4 aa, Mycobacterium
RSGG

SEQ ID NO: 241751 - protein, 6 aa, Mycobacterium
RSGSLA

SEQ ID NO: 241752 - protein, 6 aa, Mycobacterium
RSHDEG

SEQ ID NO: 241753 - protein, 5 aa, Mycobacterium
RSHEH

SEQ ID NO: 241754 - protein, 5 aa, Mycobacterium
RSITG

SEQ ID NO: 241755 - protein, 8 aa, Mycobacterium
RSLNESKV

SEQ ID NO: 241756 - protein, 4 aa, Mycobacterium
RSPR

SEQ ID NO: 241757 - protein, 5 aa, Mycobacterium
RSREE

SEQ ID NO: 241758 - protein, 4 aa, Mycobacterium
RSRV

SEQ ID NO: 241759 - protein, 7 aa, Mycobacterium
RSSTRAG

SEQ ID NO: 241760 - protein, 6 aa, Mycobacterium
RSTNDV

SEQ ID NO: 241761 - protein, 6 aa, Mycobacterium
RSVSTD

SEQ ID NO: 241762 - protein, 5 aa, Mycobacterium
RTAAD

SEQ ID NO: 241763 - protein, 5 aa, Mycobacterium
RTAAN

SEQ ID NO: 241764 - protein, 8 aa, Mycobacterium
RTASGRYE

SEQ ID NO: 241765 - protein, 5 aa, Mycobacterium
RTDRG

SEQ ID NO: 241766 - protein, 6 aa, Mycobacterium
RTEPSF

SEQ ID NO: 241767 - protein, 7 aa, Mycobacterium
RTEYGGD

SEQ ID NO: 241768 - protein, 4 aa, Mycobacterium
RTGD

SEQ ID NO: 241769 - protein, 8 aa, Mycobacterium
RTGSTNGY

SEQ ID NO: 241770 - protein, 4 aa, Mycobacterium
RTGV

SEQ ID NO: 241771 - protein, 6 aa, Mycobacterium
RTPAGD

SEQ ID NO: 241772 - protein, 8 aa, Mycobacterium
RTPFTGDS

SEQ ID NO: 241773 - protein, 4 aa, Mycobacterium
RTPW

SEQ ID NO: 241774 - protein, 4 aa, Mycobacterium
RTQS

SEQ ID NO: 241775 - protein, 5 aa, Mycobacterium
RTRRG

SEQ ID NO: 241776 - protein, 7 aa, Mycobacterium
RTRTGEL

SEQ ID NO: 241777 - protein, 4 aa, Mycobacterium
RTTA

SEQ ID NO: 241778 - protein, 5 aa, Mycobacterium
RTTDK

SEQ ID NO: 241779 - protein, 6 aa, Mycobacterium
RTTVDE

SEQ ID NO: 241780 - protein, 6 aa, Mycobacterium
RVDAAG

SEQ ID NO: 241781 - protein, 4 aa, Mycobacterium
RVER

SEQ ID NO: 241782 - protein, 7 aa, Mycobacterium
RVRPGTP

SEQ ID NO: 241783 - protein, 5 aa, Mycobacterium
RVSGY

SEQ ID NO: 241784 - protein, 5 aa, Mycobacterium
RYAGD

SEQ ID NO: 241785 - protein, 6 aa, Mycobacterium
RYAGDE

SEQ ID NO: 241786 - protein, 4 aa, Mycobacterium
RYGR

SEQ ID NO: 241787 - protein, 6 aa, Mycobacterium
RYTPEA

SEQ ID NO: 241788 - protein, 6 aa, Mycobacterium
SAAAAE

SEQ ID NO: 241789 - protein, 5 aa, Mycobacterium
SAAAG

SEQ ID NO: 241790 - protein, 8 aa, Mycobacterium
SAAASGGG

SEQ ID NO: 241791 - protein, 7 aa, Mycobacterium
SAAAYTT

SEQ ID NO: 241792 - protein, 8 aa, Mycobacterium
SAATRGAS

SEQ ID NO: 241793 - protein, 4 aa, Mycobacterium
SADG

SEQ ID NO: 241794 - protein, 6 aa, Mycobacterium
SADRVR

SEQ ID NO: 241795 - protein, 5 aa, Mycobacterium
SAEQQ

SEQ ID NO: 241796 - protein, 12 aa, Mycobacterium
SAESLKETLRGQ

SEQ ID NO: 241797 - protein, 4 aa, Mycobacterium
SAGA

SEQ ID NO: 241798 - protein, 6 aa, Mycobacterium
SAGGRY

SEQ ID NO: 241799 - protein, 25 aa, Mycobacterium
SAGHGGDPMGDGMGGHTAGAGMPGG

SEQ ID NO: 241800 - protein, 4 aa, Mycobacterium
SAGM

SEQ ID NO: 241801 - protein, 9 aa, Mycobacterium
SAGPGPGAL

SEQ ID NO: 241802 - protein, 5 aa, Mycobacterium
SAGST

SEQ ID NO: 241803 - protein, 5 aa, Mycobacterium
SAGTA

SEQ ID NO: 241804 - protein, 13 aa, Mycobacterium
SAGVDDAKEYNSV

SEQ ID NO: 241805 - protein, 4 aa, Mycobacterium
SAIG

SEQ ID NO: 241806 - protein, 5 aa, Mycobacterium
SAITA

SEQ ID NO: 241807 - protein, 7 aa, Mycobacterium
SAKGSVA

SEQ ID NO: 241808 - protein, 7 aa, Mycobacterium
SALAANG

SEQ ID NO: 241809 - protein, 9 aa, Mycobacterium
SALAANGTA

SEQ ID NO: 241810 - protein, 4 aa, Mycobacterium
SALD

SEQ ID NO: 241811 - protein, 7 aa, Mycobacterium
SALTGES

SEQ ID NO: 241812 - protein, 6 aa, Mycobacterium
SAMSAT

SEQ ID NO: 241813 - protein, 11 aa, Mycobacterium
SANDATCASAP

SEQ ID NO: 241814 - protein, 14 aa, Mycobacterium
SAPASAARLTERSK

SEQ ID NO: 241815 - protein, 7 aa, Mycobacterium
SAPLPTG

SEQ ID NO: 241816 - protein, 8 aa, Mycobacterium
SARAGAYR

SEQ ID NO: 241817 - protein, 4 aa, Mycobacterium
SARQ

SEQ ID NO: 241818 - protein, 9 aa, Mycobacterium
SARQASETR

SEQ ID NO: 241819 - protein, 4 aa, Mycobacterium
SARS

SEQ ID NO: 241820 - protein, 4 aa, Mycobacterium
SASA

SEQ ID NO: 241821 - protein, 7 aa, Mycobacterium
SASSALE

SEQ ID NO: 241822 - protein, 7 aa, Mycobacterium
SASTADL

SEQ ID NO: 241823 - protein, 6 aa, Mycobacterium
SASTVN

SEQ ID NO: 241824 - protein, 5 aa, Mycobacterium
SATAG

SEQ ID NO: 241825 - protein, 9 aa, Mycobacterium
SATEGPNVA

SEQ ID NO: 241826 - protein, 7 aa, Mycobacterium
SATESGL

SEQ ID NO: 241827 - protein, 7 aa, Mycobacterium
SATTSGL

SEQ ID NO: 241828 - protein, 4 aa, Mycobacterium
SAVG

SEQ ID NO: 241829 - protein, 8 aa, Mycobacterium
SCNSAGGR

SEQ ID NO: 241830 - protein, 9 aa, Mycobacterium
SDDGGPERF

SEQ ID NO: 241831 - protein, 5 aa, Mycobacterium
SDERK

SEQ ID NO: 241832 - protein, 18 aa, Mycobacterium
SDGAENVPLDPNAPQGAF

SEQ ID NO: 241833 - protein, 8 aa, Mycobacterium
SDPDGSGY

SEQ ID NO: 241834 - protein, 7 aa, Mycobacterium
SDPHTGQ

SEQ ID NO: 241835 - protein, 5 aa, Mycobacterium
SDPRG

SEQ ID NO: 241836 - protein, 6 aa, Mycobacterium
SDPSNL

SEQ ID NO: 241837 - protein, 6 aa, Mycobacterium
SDRGAV

SEQ ID NO: 241838 - protein, 4 aa, Mycobacterium
SDVA

SEQ ID NO: 241839 - protein, 5 aa, Mycobacterium
SDYGG

SEQ ID NO: 241840 - protein, 7 aa, Mycobacterium
SEEPQVP

SEQ ID NO: 241841 - protein, 5 aa, Mycobacterium
SEIHS

SEQ ID NO: 241842 - protein, 5 aa, Mycobacterium
SELSL

SEQ ID NO: 241843 - protein, 10 aa, Mycobacterium
SEPAKTSPAW

SEQ ID NO: 241844 - protein, 9 aa, Mycobacterium
SEPDPEARP

SEQ ID NO: 241845 - protein, 16 aa, Mycobacterium
SEPRLQPPNGYKDTTV

SEQ ID NO: 241846 - protein, 5 aa, Mycobacterium
SESAQ

SEQ ID NO: 241847 - protein, 6 aa, Mycobacterium
SESHMR

SEQ ID NO: 241848 - protein, 12 aa, Mycobacterium
SETVAGATETER

SEQ ID NO: 241849 - protein, 4 aa, Mycobacterium
SETY

SEQ ID NO: 241850 - protein, 8 aa, Mycobacterium
SEVEQTAA

SEQ ID NO: 241851 - protein, 7 aa, Mycobacterium
SFPSEKA

SEQ ID NO: 241852 - protein, 4 aa, Mycobacterium
SGAS

SEQ ID NO: 241853 - protein, 8 aa, Mycobacterium
SGCGPRPT

SEQ ID NO: 241854 - protein, 20 aa, Mycobacterium
SGDDPSLASAKVDDTKPFDP

SEQ ID NO: 241855 - protein, 6 aa, Mycobacterium
SGDPTV

SEQ ID NO: 241856 - protein, 4 aa, Mycobacterium
SGGA

SEQ ID NO: 241857 - protein, 7 aa, Mycobacterium
SGGLGSP

SEQ ID NO: 241858 - protein, 4 aa, Mycobacterium
SGGM

SEQ ID NO: 241859 - protein, 7 aa, Mycobacterium
SGGPVGV

SEQ ID NO: 241860 - protein, 4 aa, Mycobacterium
SGGR

SEQ ID NO: 241861 - protein, 4 aa, Mycobacterium
SGIP

SEQ ID NO: 241862 - protein, 13 aa, Mycobacterium
SGITQPGRRVPDD

SEQ ID NO: 241863 - protein, 4 aa, Mycobacterium
SGLG

SEQ ID NO: 241864 - protein, 10 aa, Mycobacterium
SGLGKPGGEV

SEQ ID NO: 241865 - protein, 5 aa, Mycobacterium
SGLND

SEQ ID NO: 241866 - protein, 5 aa, Mycobacterium
SGMPR

SEQ ID NO: 241867 - protein, 8 aa, Mycobacterium
SGNLTGGG

SEQ ID NO: 241868 - protein, 4 aa, Mycobacterium
SGNP

SEQ ID NO: 241869 - protein, 6 aa, Mycobacterium
SGNVDA

SEQ ID NO: 241870 - protein, 4 aa, Mycobacterium
SGPD

SEQ ID NO: 241871 - protein, 10 aa, Mycobacterium
SGPLPGQTDR

SEQ ID NO: 241872 - protein, 8 aa, Mycobacterium
SGPTPPGL

SEQ ID NO: 241873 - protein, 6 aa, Mycobacterium
SGQPAL

SEQ ID NO: 241874 - protein, 5 aa, Mycobacterium
SGQRS

SEQ ID NO: 241875 - protein, 6 aa, Mycobacterium
SGRAAA

SEQ ID NO: 241876 - protein, 9 aa, Mycobacterium
SGRHHPSAT

SEQ ID NO: 241877 - protein, 5 aa, Mycobacterium
SGSAA

SEQ ID NO: 241878 - protein, 8 aa, Mycobacterium
SGSGGVGN

SEQ ID NO: 241879 - protein, 7 aa, Mycobacterium
SGSGSSY

SEQ ID NO: 241880 - protein, 4 aa, Mycobacterium
SGSL

SEQ ID NO: 241881 - protein, 6 aa, Mycobacterium
SGSPAL

SEQ ID NO: 241882 - protein, 8 aa, Mycobacterium
SGSPQPGI

SEQ ID NO: 241883 - protein, 9 aa, Mycobacterium
SGSTRTPAG

SEQ ID NO: 241884 - protein, 10 aa, Mycobacterium
SGSTSAPKGV

SEQ ID NO: 241885 - protein, 4 aa, Mycobacterium
SGTE

SEQ ID NO: 241886 - protein, 8 aa, Mycobacterium
SGTEIDTG

SEQ ID NO: 241887 - protein, 5 aa, Mycobacterium
SGTSF

SEQ ID NO: 241888 - protein, 10 aa, Mycobacterium
SGTTGTPKGV

SEQ ID NO: 241889 - protein, 7 aa, Mycobacterium
SGTTPKM

SEQ ID NO: 241890 - protein, 6 aa, Mycobacterium
SGVGAA

SEQ ID NO: 241891 - protein, 8 aa, Mycobacterium
SGVTGASA

SEQ ID NO: 241892 - protein, 9 aa, Mycobacterium
SHNGGPRAG

SEQ ID NO: 241893 - protein, 10 aa, Mycobacterium
SIGNRSSPLA

SEQ ID NO: 241894 - protein, 15 aa, Mycobacterium
SIGRARDIDPGHRRD

SEQ ID NO: 241895 - protein, 9 aa, Mycobacterium
SIPSPGVNY

SEQ ID NO: 241896 - protein, 6 aa, Mycobacterium
SITPGG

SEQ ID NO: 241897 - protein, 8 aa, Mycobacterium
SKETRPEV

SEQ ID NO: 241898 - protein, 6 aa, Mycobacterium
SKGKRI

SEQ ID NO: 241899 - protein, 5 aa, Mycobacterium
SKGPV

SEQ ID NO: 241900 - protein, 11 aa, Mycobacterium
SKHETSRAGNT

SEQ ID NO: 241901 - protein, 9 aa, Mycobacterium
SKPGQTIPG

SEQ ID NO: 241902 - protein, 6 aa, Mycobacterium
SKSPVA

SEQ ID NO: 241903 - protein, 7 aa, Mycobacterium
SKTATRT

SEQ ID NO: 241904 - protein, 5 aa, Mycobacterium
SKTGE

SEQ ID NO: 241905 - protein, 4 aa, Mycobacterium
SLAA

SEQ ID NO: 241906 - protein, 6 aa, Mycobacterium
SLAGTA

SEQ ID NO: 241907 - protein, 6 aa, Mycobacterium
SLDGPN

SEQ ID NO: 241908 - protein, 5 aa, Mycobacterium
SLGAS

SEQ ID NO: 241909 - protein, 8 aa, Mycobacterium
SLGGPVSS

SEQ ID NO: 241910 - protein, 7 aa, Mycobacterium
SLNAGKV

SEQ ID NO: 241911 - protein, 4 aa, Mycobacterium
SLNT

SEQ ID NO: 241912 - protein, 6 aa, Mycobacterium
SLQTGG

SEQ ID NO: 241913 - protein, 6 aa, Mycobacterium
SLRDER

SEQ ID NO: 241914 - protein, 12 aa, Mycobacterium
SLRRTDKQKDSG

SEQ ID NO: 241915 - protein, 11 aa, Mycobacterium
SLRSGKAGTDA

SEQ ID NO: 241916 - protein, 8 aa, Mycobacterium
SLSDRYGR

SEQ ID NO: 241917 - protein, 8 aa, Mycobacterium
SLSEQNGA

SEQ ID NO: 241918 - protein, 7 aa, Mycobacterium
SLTPAQR

SEQ ID NO: 241919 - protein, 11 aa, Mycobacterium
SMRATDVQPNR

SEQ ID NO: 241920 - protein, 9 aa, Mycobacterium
SMSPDDAPS

SEQ ID NO: 241921 - protein, 5 aa, Mycobacterium
SMTDD

SEQ ID NO: 241922 - protein, 4 aa, Mycobacterium
SNGD

SEQ ID NO: 241923 - protein, 7 aa, Mycobacterium
SNPPPRL

SEQ ID NO: 241924 - protein, 7 aa, Mycobacterium
SNRPATD

SEQ ID NO: 241925 - protein, 4 aa, Mycobacterium
SPAD

SEQ ID NO: 241926 - protein, 7 aa, Mycobacterium
SPAGATF

SEQ ID NO: 241927 - protein, 5 aa, Mycobacterium
SPDGH

SEQ ID NO: 241928 - protein, 15 aa, Mycobacterium
SPDGHTLASGSDDAT

SEQ ID NO: 241929 - protein, 6 aa, Mycobacterium
SPDGRI

SEQ ID NO: 241930 - protein, 6 aa, Mycobacterium
SPDGTA

SEQ ID NO: 241931 - protein, 7 aa, Mycobacterium
SPDPGSL

SEQ ID NO: 241932 - protein, 5 aa, Mycobacterium
SPEDK

SEQ ID NO: 241933 - protein, 5 aa, Mycobacterium
SPEEA

SEQ ID NO: 241934 - protein, 4 aa, Mycobacterium
SPEL

SEQ ID NO: 241935 - protein, 7 aa, Mycobacterium
SPFEPGS

SEQ ID NO: 241936 - protein, 5 aa, Mycobacterium
SPGDR

SEQ ID NO: 241937 - protein, 9 aa, Mycobacterium
SPGDRPRGQ

SEQ ID NO: 241938 - protein, 8 aa, Mycobacterium
SPKDAEGI

SEQ ID NO: 241939 - protein, 9 aa, Mycobacterium
SPKKSWEGL

SEQ ID NO: 241940 - protein, 5 aa, Mycobacterium
SPPTL

SEQ ID NO: 241941 - protein, 4 aa, Mycobacterium
SPRI

SEQ ID NO: 241942 - protein, 6 aa, Mycobacterium
SPRNTW

SEQ ID NO: 241943 - protein, 11 aa, Mycobacterium
SPSEADKMDPQ

SEQ ID NO: 241944 - protein, 5 aa, Mycobacterium
SPTQS

SEQ ID NO: 241945 - protein, 9 aa, Mycobacterium
SPTTLPDSS

SEQ ID NO: 241946 - protein, 4 aa, Mycobacterium
SPTV

SEQ ID NO: 241947 - protein, 10 aa, Mycobacterium
SPVTGQPKKA

SEQ ID NO: 241948 - protein, 8 aa, Mycobacterium
SQDYGIET

SEQ ID NO: 241949 - protein, 6 aa, Mycobacterium
SQEFTE

SEQ ID NO: 241950 - protein, 4 aa, Mycobacterium
SQFG

SEQ ID NO: 241951 - protein, 4 aa, Mycobacterium
SQGE

SEQ ID NO: 241952 - protein, 4 aa, Mycobacterium
SQGS

SEQ ID NO: 241953 - protein, 10 aa, Mycobacterium
SQLASGAQAL

SEQ ID NO: 241954 - protein, 6 aa, Mycobacterium
SRAGAA

SEQ ID NO: 241955 - protein, 4 aa, Mycobacterium
SRAI

SEQ ID NO: 241956 - protein, 7 aa, Mycobacterium
SRARTAS

SEQ ID NO: 241957 - protein, 4 aa, Mycobacterium
SRAV

SEQ ID NO: 241958 - protein, 4 aa, Mycobacterium
SRDA

SEQ ID NO: 241959 - protein, 8 aa, Mycobacterium
SRETDRVR

SEQ ID NO: 241960 - protein, 6 aa, Mycobacterium
SRIGPK

SEQ ID NO: 241961 - protein, 7 aa, Mycobacterium
SRISGQA

SEQ ID NO: 241962 - protein, 6 aa, Mycobacterium
SRLDPA

SEQ ID NO: 241963 - protein, 5 aa, Mycobacterium
SRMGA

SEQ ID NO: 241964 - protein, 6 aa, Mycobacterium
SRQRGE

SEQ ID NO: 241965 - protein, 8 aa, Mycobacterium
SRRNHGRS

SEQ ID NO: 241966 - protein, 5 aa, Mycobacterium
SRRSR

SEQ ID NO: 241967 - protein, 6 aa, Mycobacterium
SRSGNT

SEQ ID NO: 241968 - protein, 4 aa, Mycobacterium
SSAV

SEQ ID NO: 241969 - protein, 9 aa, Mycobacterium
SSGPGPGPL

SEQ ID NO: 241970 - protein, 6 aa, Mycobacterium
SSGTHY

SEQ ID NO: 241971 - protein, 11 aa, Mycobacterium
SSLADETPEGR

SEQ ID NO: 241972 - protein, 5 aa, Mycobacterium
SSLTD

SEQ ID NO: 241973 - protein, 8 aa, Mycobacterium
SSPFEPGS

SEQ ID NO: 241974 - protein, 6 aa, Mycobacterium
SSPLTV

SEQ ID NO: 241975 - protein, 7 aa, Mycobacterium
SSPPPEL

SEQ ID NO: 241976 - protein, 5 aa, Mycobacterium
SSPTG

SEQ ID NO: 241977 - protein, 5 aa, Mycobacterium
SSQAF

SEQ ID NO: 241978 - protein, 7 aa, Mycobacterium
SSRGPEY

SEQ ID NO: 241979 - protein, 10 aa, Mycobacterium
SSRIQGPAAE

SEQ ID NO: 241980 - protein, 6 aa, Mycobacterium
SSRWPG

SEQ ID NO: 241981 - protein, 24 aa, Mycobacterium
SSSIDQAPVTGESVPVDKSPVPDV

SEQ ID NO: 241982 - protein, 5 aa, Mycobacterium
SSSSH

SEQ ID NO: 241983 - protein, 4 aa, Mycobacterium
SSTH

SEQ ID NO: 241984 - protein, 5 aa, Mycobacterium
SSTLT

SEQ ID NO: 241985 - protein, 5 aa, Mycobacterium
SSVRA

SEQ ID NO: 241986 - protein, 7 aa, Mycobacterium
SSYPDAP

SEQ ID NO: 241987 - protein, 6 aa, Mycobacterium
STAAAA

SEQ ID NO: 241988 - protein, 9 aa, Mycobacterium
STAAEMAET

SEQ ID NO: 241989 - protein, 6 aa, Mycobacterium
STALPA

SEQ ID NO: 241990 - protein, 7 aa, Mycobacterium
STDRYPP

SEQ ID NO: 241991 - protein, 4 aa, Mycobacterium
STEE

SEQ ID NO: 241992 - protein, 5 aa, Mycobacterium
STEER

SEQ ID NO: 241993 - protein, 4 aa, Mycobacterium
STEG

SEQ ID NO: 241994 - protein, 5 aa, Mycobacterium
STGAG

SEQ ID NO: 241995 - protein, 6 aa, Mycobacterium
STGGEY

SEQ ID NO: 241996 - protein, 11 aa, Mycobacterium
STGPEQREVPD

SEQ ID NO: 241997 - protein, 4 aa, Mycobacterium
STGR

SEQ ID NO: 241998 - protein, 11 aa, Mycobacterium
STGTLQDYGPD

SEQ ID NO: 241999 - protein, 4 aa, Mycobacterium
STLG

SEQ ID NO: 242000 - protein, 13 aa, Mycobacterium
STNVNAGAKSRAS

SEQ ID NO: 242001 - protein, 9 aa, Mycobacterium
STPQTAGRI

SEQ ID NO: 242002 - protein, 6 aa, Mycobacterium
STPTAI

SEQ ID NO: 242003 - protein, 8 aa, Mycobacterium
STQRDTER

SEQ ID NO: 242004 - protein, 8 aa, Mycobacterium
STRDEYRY

SEQ ID NO: 242005 - protein, 4 aa, Mycobacterium
STRQ

SEQ ID NO: 242006 - protein, 9 aa, Mycobacterium
STRQASETR

SEQ ID NO: 242007 - protein, 15 aa, Mycobacterium
STRSVSNAIASGAQV

SEQ ID NO: 242008 - protein, 7 aa, Mycobacterium
STSALDE

SEQ ID NO: 242009 - protein, 8 aa, Mycobacterium
STSARTIT

SEQ ID NO: 242010 - protein, 9 aa, Mycobacterium
STSKNARLN

SEQ ID NO: 242011 - protein, 9 aa, Mycobacterium
STTAEDNSL

SEQ ID NO: 242012 - protein, 6 aa, Mycobacterium
STTGYG

SEQ ID NO: 242013 - protein, 6 aa, Mycobacterium
STTQTW

SEQ ID NO: 242014 - protein, 5 aa, Mycobacterium
STTYA

SEQ ID NO: 242015 - protein, 9 aa, Mycobacterium
SVDPGQLEA

SEQ ID NO: 242016 - protein, 6 aa, Mycobacterium
SVEEVT

SEQ ID NO: 242017 - protein, 5 aa, Mycobacterium
SVPAE

SEQ ID NO: 242018 - protein, 5 aa, Mycobacterium
SVQPA

SEQ ID NO: 242019 - protein, 12 aa, Mycobacterium
SVRRTDKQKDTG

SEQ ID NO: 242020 - protein, 4 aa, Mycobacterium
SVSG

SEQ ID NO: 242021 - protein, 9 aa, Mycobacterium
SVSGPSQDQ

SEQ ID NO: 242022 - protein, 9 aa, Mycobacterium
SVTARRQDA

SEQ ID NO: 242023 - protein, 13 aa, Mycobacterium
SYGENTLAATATS

SEQ ID NO: 242024 - protein, 6 aa, Mycobacterium
SYSQLG

SEQ ID NO: 242025 - protein, 4 aa, Mycobacterium
SYTY

SEQ ID NO: 242026 - protein, 4 aa, Mycobacterium
TAAD

SEQ ID NO: 242027 - protein, 11 aa, Mycobacterium
TAAGAQSVDGK

SEQ ID NO: 242028 - protein, 13 aa, Mycobacterium
TAAGSQSPDGKAA

SEQ ID NO: 242029 - protein, 13 aa, Mycobacterium
TAAGSQSSDGKAA

SEQ ID NO: 242030 - protein, 4 aa, Mycobacterium
TAAI

SEQ ID NO: 242031 - protein, 5 aa, Mycobacterium
TAATA

SEQ ID NO: 242032 - protein, 5 aa, Mycobacterium
TADAD

SEQ ID NO: 242033 - protein, 8 aa, Mycobacterium
TADGSAAL

SEQ ID NO: 242034 - protein, 8 aa, Mycobacterium
TADPQSRT

SEQ ID NO: 242035 - protein, 6 aa, Mycobacterium
TADPQY

SEQ ID NO: 242036 - protein, 4 aa, Mycobacterium
TADR

SEQ ID NO: 242037 - protein, 5 aa, Mycobacterium
TAENP

SEQ ID NO: 242038 - protein, 4 aa, Mycobacterium
TAGA

SEQ ID NO: 242039 - protein, 13 aa, Mycobacterium
TAGAAAGALAAAA

SEQ ID NO: 242040 - protein, 9 aa, Mycobacterium
TAGFGGGNF

SEQ ID NO: 242041 - protein, 8 aa, Mycobacterium
TAGGGSDI

SEQ ID NO: 242042 - protein, 13 aa, Mycobacterium
TAGKSLSDSASGL

SEQ ID NO: 242043 - protein, 10 aa, Mycobacterium
TAGNQVRDAK

SEQ ID NO: 242044 - protein, 5 aa, Mycobacterium
TAGSP

SEQ ID NO: 242045 - protein, 10 aa, Mycobacterium
TAHESADSMD

SEQ ID NO: 242046 - protein, 8 aa, Mycobacterium
TAHHPPAG

SEQ ID NO: 242047 - protein, 7 aa, Mycobacterium
TAKEARR

SEQ ID NO: 242048 - protein, 4 aa, Mycobacterium
TAKN

SEQ ID NO: 242049 - protein, 4 aa, Mycobacterium
TAPA

SEQ ID NO: 242050 - protein, 10 aa, Mycobacterium
TAPKQGKDAN

SEQ ID NO: 242051 - protein, 5 aa, Mycobacterium
TAPVP

SEQ ID NO: 242052 - protein, 6 aa, Mycobacterium
TAPVRA

SEQ ID NO: 242053 - protein, 9 aa, Mycobacterium
TAQAVGGLG

SEQ ID NO: 242054 - protein, 11 aa, Mycobacterium
TAQESADSMDS

SEQ ID NO: 242055 - protein, 13 aa, Mycobacterium
TAQNDPSTVRGAR

SEQ ID NO: 242056 - protein, 17 aa, Mycobacterium
TAQRSTNLATATAVGAP

SEQ ID NO: 242057 - protein, 10 aa, Mycobacterium
TAQSVGGLGP

SEQ ID NO: 242058 - protein, 9 aa, Mycobacterium
TARHPGGGV

SEQ ID NO: 242059 - protein, 5 aa, Mycobacterium
TARPG

SEQ ID NO: 242060 - protein, 7 aa, Mycobacterium
TARPGTL

SEQ ID NO: 242061 - protein, 9 aa, Mycobacterium
TARPGTTTA

SEQ ID NO: 242062 - protein, 5 aa, Mycobacterium
TARRP

SEQ ID NO: 242063 - protein, 6 aa, Mycobacterium
TASDYL

SEQ ID NO: 242064 - protein, 12 aa, Mycobacterium
TASGGPAGVGEA

SEQ ID NO: 242065 - protein, 6 aa, Mycobacterium
TATRQA

SEQ ID NO: 242066 - protein, 57 aa, Mycobacterium
TCSRAGVTASPSRSTIRGATATPWSGPPAARRRGTTSPSCRVSGRSVRRSSCTTRTW

SEQ ID NO: 242067 - protein, 6 aa, Mycobacterium
TDADRR

SEQ ID NO: 242068 - protein, 5 aa, Mycobacterium
TDGAV

SEQ ID NO: 242069 - protein, 10 aa, Mycobacterium
TDGLTDCDGH

SEQ ID NO: 242070 - protein, 4 aa, Mycobacterium
TDHK

SEQ ID NO: 242071 - protein, 5 aa, Mycobacterium
TDLPE

SEQ ID NO: 242072 - protein, 4 aa, Mycobacterium
TDND

SEQ ID NO: 242073 - protein, 5 aa, Mycobacterium
TDPLG

SEQ ID NO: 242074 - protein, 6 aa, Mycobacterium
TDQYRS

SEQ ID NO: 242075 - protein, 4 aa, Mycobacterium
TDRA

SEQ ID NO: 242076 - protein, 10 aa, Mycobacterium
TDRAEEKAEK

SEQ ID NO: 242077 - protein, 4 aa, Mycobacterium
TDRD

SEQ ID NO: 242078 - protein, 5 aa, Mycobacterium
TDSAR

SEQ ID NO: 242079 - protein, 8 aa, Mycobacterium
TDTASAMG

SEQ ID NO: 242080 - protein, 7 aa, Mycobacterium
TDTDNNR

SEQ ID NO: 242081 - protein, 10 aa, Mycobacterium
TEAATRTGGL

SEQ ID NO: 242082 - protein, 8 aa, Mycobacterium
TEASGTVE

SEQ ID NO: 242083 - protein, 5 aa, Mycobacterium
TEDIG

SEQ ID NO: 242084 - protein, 10 aa, Mycobacterium
TEERQPGGYG

SEQ ID NO: 242085 - protein, 5 aa, Mycobacterium
TEFGG

SEQ ID NO: 242086 - protein, 5 aa, Mycobacterium
TEGNF

SEQ ID NO: 242087 - protein, 4 aa, Mycobacterium
TEND

SEQ ID NO: 242088 - protein, 12 aa, Mycobacterium
TEPDSGSDAFGG

SEQ ID NO: 242089 - protein, 5 aa, Mycobacterium
TEPGR

SEQ ID NO: 242090 - protein, 4 aa, Mycobacterium
TEQE

SEQ ID NO: 242091 - protein, 8 aa, Mycobacterium
TEQVTNTL

SEQ ID NO: 242092 - protein, 6 aa, Mycobacterium
TERSPL

SEQ ID NO: 242093 - protein, 4 aa, Mycobacterium
TERW

SEQ ID NO: 242094 - protein, 7 aa, Mycobacterium
TETADEW

SEQ ID NO: 242095 - protein, 4 aa, Mycobacterium
TETT

SEQ ID NO: 242096 - protein, 4 aa, Mycobacterium
TGAD

SEQ ID NO: 242097 - protein, 7 aa, Mycobacterium
TGAETEL

SEQ ID NO: 242098 - protein, 4 aa, Mycobacterium
TGAG

SEQ ID NO: 242099 - protein, 10 aa, Mycobacterium
TGAGSGIGRE

SEQ ID NO: 242100 - protein, 7 aa, Mycobacterium
TGALRDR

SEQ ID NO: 242101 - protein, 5 aa, Mycobacterium
TGDGL

SEQ ID NO: 242102 - protein, 6 aa, Mycobacterium
TGDGLR

SEQ ID NO: 242103 - protein, 5 aa, Mycobacterium
TGEFE

SEQ ID NO: 242104 - protein, 5 aa, Mycobacterium
TGEQV

SEQ ID NO: 242105 - protein, 7 aa, Mycobacterium
TGESKGR

SEQ ID NO: 242106 - protein, 10 aa, Mycobacterium
TGESRPVARG

SEQ ID NO: 242107 - protein, 15 aa, Mycobacterium
TGESVPVEAGPGDEV

SEQ ID NO: 242108 - protein, 9 aa, Mycobacterium
TGETADRAR

SEQ ID NO: 242109 - protein, 4 aa, Mycobacterium
TGGG

SEQ ID NO: 242110 - protein, 9 aa, Mycobacterium
TGGGVSPSM

SEQ ID NO: 242111 - protein, 4 aa, Mycobacterium
TGGM

SEQ ID NO: 242112 - protein, 7 aa, Mycobacterium
TGGPAFG

SEQ ID NO: 242113 - protein, 5 aa, Mycobacterium
TGGQT

SEQ ID NO: 242114 - protein, 4 aa, Mycobacterium
TGGW

SEQ ID NO: 242115 - protein, 7 aa, Mycobacterium
TGKGARA

SEQ ID NO: 242116 - protein, 14 aa, Mycobacterium
TGLPGGSLDQAESQ

SEQ ID NO: 242117 - protein, 11 aa, Mycobacterium
TGNDPGAKTTE

SEQ ID NO: 242118 - protein, 5 aa, Mycobacterium
TGNSV

SEQ ID NO: 242119 - protein, 8 aa, Mycobacterium
TGPAGATF

SEQ ID NO: 242120 - protein, 9 aa, Mycobacterium
TGPAPPGLS

SEQ ID NO: 242121 - protein, 7 aa, Mycobacterium
TGPGATI

SEQ ID NO: 242122 - protein, 6 aa, Mycobacterium
TGPGDL

SEQ ID NO: 242123 - protein, 5 aa, Mycobacterium
TGPLP

SEQ ID NO: 242124 - protein, 9 aa, Mycobacterium
TGPQNMPKF

SEQ ID NO: 242125 - protein, 10 aa, Mycobacterium
TGPSGSGKTT

SEQ ID NO: 242126 - protein, 4 aa, Mycobacterium
TGRF

SEQ ID NO: 242127 - protein, 6 aa, Mycobacterium
TGTDTL

SEQ ID NO: 242128 - protein, 7 aa, Mycobacterium
TGTERGL

SEQ ID NO: 242129 - protein, 7 aa, Mycobacterium
TGTGTVD

SEQ ID NO: 242130 - protein, 4 aa, Mycobacterium
TGTL

SEQ ID NO: 242131 - protein, 5 aa, Mycobacterium
TGTLT

SEQ ID NO: 242132 - protein, 6 aa, Mycobacterium
TGTLTE

SEQ ID NO: 242133 - protein, 11 aa, Mycobacterium
TGTLTKGEPTV

SEQ ID NO: 242134 - protein, 4 aa, Mycobacterium
TGYT

SEQ ID NO: 242135 - protein, 6 aa, Mycobacterium
THARNP

SEQ ID NO: 242136 - protein, 4 aa, Mycobacterium
THPT

SEQ ID NO: 242137 - protein, 5 aa, Mycobacterium
THTPE

SEQ ID NO: 242138 - protein, 8 aa, Mycobacterium
TIEPRPSD

SEQ ID NO: 242139 - protein, 7 aa, Mycobacterium
TIGGGGK

SEQ ID NO: 242140 - protein, 14 aa, Mycobacterium
TIPTTEKPPPPQTV

SEQ ID NO: 242141 - protein, 10 aa, Mycobacterium
TISAAASRTL

SEQ ID NO: 242142 - protein, 6 aa, Mycobacterium
TITPGG

SEQ ID NO: 242143 - protein, 8 aa, Mycobacterium
TKAATRRY

SEQ ID NO: 242144 - protein, 8 aa, Mycobacterium
TKEALASA

SEQ ID NO: 242145 - protein, 8 aa, Mycobacterium
TKHTADSV

SEQ ID NO: 242146 - protein, 7 aa, Mycobacterium
TKNSSTL

SEQ ID NO: 242147 - protein, 7 aa, Mycobacterium
TKPGEVA

SEQ ID NO: 242148 - protein, 5 aa, Mycobacterium
TKPGN

SEQ ID NO: 242149 - protein, 6 aa, Mycobacterium
TKRQTL

SEQ ID NO: 242150 - protein, 12 aa, Mycobacterium
TLGGEAKTPKAA

SEQ ID NO: 242151 - protein, 9 aa, Mycobacterium
TLGGRTLTP

SEQ ID NO: 242152 - protein, 6 aa, Mycobacterium
TLGNGG

SEQ ID NO: 242153 - protein, 8 aa, Mycobacterium
TLGPGGSF

SEQ ID NO: 242154 - protein, 5 aa, Mycobacterium
TLNTQ

SEQ ID NO: 242155 - protein, 4 aa, Mycobacterium
TLTP

SEQ ID NO: 242156 - protein, 6 aa, Mycobacterium
TLTPQT

SEQ ID NO: 242157 - protein, 12 aa, Mycobacterium
TMPDANPQDDIR

SEQ ID NO: 242158 - protein, 6 aa, Mycobacterium
TNDPQV

SEQ ID NO: 242159 - protein, 4 aa, Mycobacterium
TNGP

SEQ ID NO: 242160 - protein, 7 aa, Mycobacterium
TNNNPYP

SEQ ID NO: 242161 - protein, 6 aa, Mycobacterium
TNPAAL

SEQ ID NO: 242162 - protein, 9 aa, Mycobacterium
TNPRAGTLG

SEQ ID NO: 242163 - protein, 10 aa, Mycobacterium
TNSAGNHHPW

SEQ ID NO: 242164 - protein, 8 aa, Mycobacterium
TNSRKAPT

SEQ ID NO: 242165 - protein, 14 aa, Mycobacterium
TNSYGLDQPPRLGA

SEQ ID NO: 242166 - protein, 4 aa, Mycobacterium
TPAA

SEQ ID NO: 242167 - protein, 6 aa, Mycobacterium
TPAEGF

SEQ ID NO: 242168 - protein, 4 aa, Mycobacterium
TPAG

SEQ ID NO: 242169 - protein, 7 aa, Mycobacterium
TPALEQD

SEQ ID NO: 242170 - protein, 6 aa, Mycobacterium
TPAQAT

SEQ ID NO: 242171 - protein, 8 aa, Mycobacterium
TPASSQVA

SEQ ID NO: 242172 - protein, 6 aa, Mycobacterium
TPEKDG

SEQ ID NO: 242173 - protein, 4 aa, Mycobacterium
TPEL

SEQ ID NO: 242174 - protein, 8 aa, Mycobacterium
TPGESSSV

SEQ ID NO: 242175 - protein, 4 aa, Mycobacterium
TPGT

SEQ ID NO: 242176 - protein, 11 aa, Mycobacterium
TPGTERRTSTM

SEQ ID NO: 242177 - protein, 4 aa, Mycobacterium
TPGV

SEQ ID NO: 242178 - protein, 4 aa, Mycobacterium
TPHE

SEQ ID NO: 242179 - protein, 5 aa, Mycobacterium
TPLAG

SEQ ID NO: 242180 - protein, 4 aa, Mycobacterium
TPLQ

SEQ ID NO: 242181 - protein, 4 aa, Mycobacterium
TPPL

SEQ ID NO: 242182 - protein, 5 aa, Mycobacterium
TPPPV

SEQ ID NO: 242183 - protein, 4 aa, Mycobacterium
TPQR

SEQ ID NO: 242184 - protein, 5 aa, Mycobacterium
TPRPQ

SEQ ID NO: 242185 - protein, 5 aa, Mycobacterium
TPSAH

SEQ ID NO: 242186 - protein, 6 aa, Mycobacterium
TPTARG

SEQ ID NO: 242187 - protein, 4 aa, Mycobacterium
TPTQ

SEQ ID NO: 242188 - protein, 6 aa, Mycobacterium
TPTYRD

SEQ ID NO: 242189 - protein, 8 aa, Mycobacterium
TQEGADGW

SEQ ID NO: 242190 - protein, 12 aa, Mycobacterium
TQLAESRPPQEV

SEQ ID NO: 242191 - protein, 6 aa, Mycobacterium
TQRPTA

SEQ ID NO: 242192 - protein, 4 aa, Mycobacterium
TQSI

SEQ ID NO: 242193 - protein, 14 aa, Mycobacterium
TQSYGSSLNNPTGM

SEQ ID NO: 242194 - protein, 5 aa, Mycobacterium
TQTGI

SEQ ID NO: 242195 - protein, 10 aa, Mycobacterium
TRASSGLTDE

SEQ ID NO: 242196 - protein, 4 aa, Mycobacterium
TREP

SEQ ID NO: 242197 - protein, 12 aa, Mycobacterium
TRGGKPFTGAGY

SEQ ID NO: 242198 - protein, 4 aa, Mycobacterium
TRIE

SEQ ID NO: 242199 - protein, 6 aa, Mycobacterium
TRKDST

SEQ ID NO: 242200 - protein, 10 aa, Mycobacterium
TRPDGTTQPL

SEQ ID NO: 242201 - protein, 9 aa, Mycobacterium
TRPNGRPLE

SEQ ID NO: 242202 - protein, 4 aa, Mycobacterium
TRRR

SEQ ID NO: 242203 - protein, 4 aa, Mycobacterium
TRTG

SEQ ID NO: 242204 - protein, 5 aa, Mycobacterium
TRTGE

SEQ ID NO: 242205 - protein, 5 aa, Mycobacterium
TRTGL

SEQ ID NO: 242206 - protein, 14 aa, Mycobacterium
TRTLQKPDSTIPPD

SEQ ID NO: 242207 - protein, 4 aa, Mycobacterium
TRVP

SEQ ID NO: 242208 - protein, 6 aa, Mycobacterium
TSAAAG

SEQ ID NO: 242209 - protein, 7 aa, Mycobacterium
TSAAAGL

SEQ ID NO: 242210 - protein, 5 aa, Mycobacterium
TSAAG

SEQ ID NO: 242211 - protein, 4 aa, Mycobacterium
TSAF

SEQ ID NO: 242212 - protein, 12 aa, Mycobacterium
TSASGSSGGELV

SEQ ID NO: 242213 - protein, 5 aa, Mycobacterium
TSERS

SEQ ID NO: 242214 - protein, 7 aa, Mycobacterium
TSGALGT

SEQ ID NO: 242215 - protein, 7 aa, Mycobacterium
TSGENRA

SEQ ID NO: 242216 - protein, 5 aa, Mycobacterium
TSGLP

SEQ ID NO: 242217 - protein, 6 aa, Mycobacterium
TSGRLT

SEQ ID NO: 242218 - protein, 11 aa, Mycobacterium
TSGSTGQPKGV

SEQ ID NO: 242219 - protein, 4 aa, Mycobacterium
TSLA

SEQ ID NO: 242220 - protein, 9 aa, Mycobacterium
TSLGGSNGL

SEQ ID NO: 242221 - protein, 8 aa, Mycobacterium
TSPDGSVA

SEQ ID NO: 242222 - protein, 7 aa, Mycobacterium
TSQPPAD

SEQ ID NO: 242223 - protein, 4 aa, Mycobacterium
TSQR

SEQ ID NO: 242224 - protein, 4 aa, Mycobacterium
TSRA

SEQ ID NO: 242225 - protein, 6 aa, Mycobacterium
TSRAPW

SEQ ID NO: 242226 - protein, 5 aa, Mycobacterium
TSSAG

SEQ ID NO: 242227 - protein, 7 aa, Mycobacterium
TSSLDIP

SEQ ID NO: 242228 - protein, 8 aa, Mycobacterium
TSSSESAL

SEQ ID NO: 242229 - protein, 9 aa, Mycobacterium
TSTASLAPV

SEQ ID NO: 242230 - protein, 14 aa, Mycobacterium
TSVSPLTRPHRSIP

SEQ ID NO: 242231 - protein, 4 aa, Mycobacterium
TTAG

SEQ ID NO: 242232 - protein, 6 aa, Mycobacterium
TTAPSV

SEQ ID NO: 242233 - protein, 7 aa, Mycobacterium
TTAPYGP

SEQ ID NO: 242234 - protein, 10 aa, Mycobacterium
TTARAMPGSG

SEQ ID NO: 242235 - protein, 4 aa, Mycobacterium
TTEM

SEQ ID NO: 242236 - protein, 5 aa, Mycobacterium
TTEQA

SEQ ID NO: 242237 - protein, 9 aa, Mycobacterium
TTHPADGTI

SEQ ID NO: 242238 - protein, 7 aa, Mycobacterium
TTPDVTP

SEQ ID NO: 242239 - protein, 4 aa, Mycobacterium
TTPL

SEQ ID NO: 242240 - protein, 8 aa, Mycobacterium
TTQTTQVT

SEQ ID NO: 242241 - protein, 4 aa, Mycobacterium
TTRG

SEQ ID NO: 242242 - protein, 8 aa, Mycobacterium
TTRPLAGE

SEQ ID NO: 242243 - protein, 13 aa, Mycobacterium
TTSTTKPDTPLTR

SEQ ID NO: 242244 - protein, 10 aa, Mycobacterium
TTVSGRPAEV

SEQ ID NO: 242245 - protein, 5 aa, Mycobacterium
TVAPT

SEQ ID NO: 242246 - protein, 6 aa, Mycobacterium
TVGGGA

SEQ ID NO: 242247 - protein, 5 aa, Mycobacterium
TVGMS

SEQ ID NO: 242248 - protein, 5 aa, Mycobacterium
TVGSN

SEQ ID NO: 242249 - protein, 6 aa, Mycobacterium
TVKGDA

SEQ ID NO: 242250 - protein, 4 aa, Mycobacterium
TVPA

SEQ ID NO: 242251 - protein, 11 aa, Mycobacterium
TVPGGQPPGTS

SEQ ID NO: 242252 - protein, 5 aa, Mycobacterium
TVPQA

SEQ ID NO: 242253 - protein, 6 aa, Mycobacterium
TVQPGA

SEQ ID NO: 242254 - protein, 9 aa, Mycobacterium
TVRAGGSAM

SEQ ID NO: 242255 - protein, 10 aa, Mycobacterium
TVSPDDRVSG

SEQ ID NO: 242256 - protein, 4 aa, Mycobacterium
TVTA

SEQ ID NO: 242257 - protein, 5 aa, Mycobacterium
TVTGD

SEQ ID NO: 242258 - protein, 8 aa, Mycobacterium
TWPPPPVQ

SEQ ID NO: 242259 - protein, 7 aa, Mycobacterium
VAASTPV

SEQ ID NO: 242260 - protein, 5 aa, Mycobacterium
VAEGG

SEQ ID NO: 242261 - protein, 4 aa, Mycobacterium
VAGR

SEQ ID NO: 242262 - protein, 6 aa, Mycobacterium
VANGSR

SEQ ID NO: 242263 - protein, 5 aa, Mycobacterium
VAPRR

SEQ ID NO: 242264 - protein, 7 aa, Mycobacterium
VAPTDPV

SEQ ID NO: 242265 - protein, 4 aa, Mycobacterium
VARR

SEQ ID NO: 242266 - protein, 4 aa, Mycobacterium
VASA

SEQ ID NO: 242267 - protein, 4 aa, Mycobacterium
VASQ

SEQ ID NO: 242268 - protein, 6 aa, Mycobacterium
VATGGF

SEQ ID NO: 242269 - protein, 13 aa, Mycobacterium
VATSHDVDPDGAV

SEQ ID NO: 242270 - protein, 6 aa, Mycobacterium
VDGARD

SEQ ID NO: 242271 - protein, 6 aa, Mycobacterium
VDKPPA

SEQ ID NO: 242272 - protein, 10 aa, Mycobacterium
VDPNGVPGPR

SEQ ID NO: 242273 - protein, 4 aa, Mycobacterium
VDQA

SEQ ID NO: 242274 - protein, 5 aa, Mycobacterium
VDSGH

SEQ ID NO: 242275 - protein, 5 aa, Mycobacterium
VDSQG

SEQ ID NO: 242276 - protein, 10 aa, Mycobacterium
VEADREHPTK

SEQ ID NO: 242277 - protein, 7 aa, Mycobacterium
VEATPAT

SEQ ID NO: 242278 - protein, 7 aa, Mycobacterium
VEDAPEV

SEQ ID NO: 242279 - protein, 6 aa, Mycobacterium
VEEGRG

SEQ ID NO: 242280 - protein, 7 aa, Mycobacterium
VEGISQP

SEQ ID NO: 242281 - protein, 8 aa, Mycobacterium
VEGKGVQG

SEQ ID NO: 242282 - protein, 4 aa, Mycobacterium
VEPA

SEQ ID NO: 242283 - protein, 6 aa, Mycobacterium
VEQGDL

SEQ ID NO: 242284 - protein, 10 aa, Mycobacterium
VEQGDSGGPL

SEQ ID NO: 242285 - protein, 10 aa, Mycobacterium
VEQGNSGGPL

SEQ ID NO: 242286 - protein, 7 aa, Mycobacterium
VESTPAT

SEQ ID NO: 242287 - protein, 6 aa, Mycobacterium
VETGSN

SEQ ID NO: 242288 - protein, 4 aa, Mycobacterium
VETT

SEQ ID NO: 242289 - protein, 7 aa, Mycobacterium
VGAENRY

SEQ ID NO: 242290 - protein, 5 aa, Mycobacterium
VGANE

SEQ ID NO: 242291 - protein, 4 aa, Mycobacterium
VGDA

SEQ ID NO: 242292 - protein, 5 aa, Mycobacterium
VGDRV

SEQ ID NO: 242293 - protein, 8 aa, Mycobacterium
VGGPRRKS

SEQ ID NO: 242294 - protein, 8 aa, Mycobacterium
VGGSGPLT

SEQ ID NO: 242295 - protein, 5 aa, Mycobacterium
VGGTT

SEQ ID NO: 242296 - protein, 10 aa, Mycobacterium
VGKSPAQVAT

SEQ ID NO: 242297 - protein, 11 aa, Mycobacterium
VGKSPDSIDES

SEQ ID NO: 242298 - protein, 4 aa, Mycobacterium
VGMS

SEQ ID NO: 242299 - protein, 6 aa, Mycobacterium
VGNQTT

SEQ ID NO: 242300 - protein, 5 aa, Mycobacterium
VGPGQ

SEQ ID NO: 242301 - protein, 6 aa, Mycobacterium
VGPPTT

SEQ ID NO: 242302 - protein, 5 aa, Mycobacterium
VGPTQ

SEQ ID NO: 242303 - protein, 5 aa, Mycobacterium
VGRAD

SEQ ID NO: 242304 - protein, 10 aa, Mycobacterium
VGSKGTAKVT

SEQ ID NO: 242305 - protein, 4 aa, Mycobacterium
VGSR

SEQ ID NO: 242306 - protein, 10 aa, Mycobacterium
VGSTGSGKST

SEQ ID NO: 242307 - protein, 8 aa, Mycobacterium
VGTEGDDA

SEQ ID NO: 242308 - protein, 8 aa, Mycobacterium
VGTPSQLS

SEQ ID NO: 242309 - protein, 15 aa, Mycobacterium
VKAGERKDVDPDIGD

SEQ ID NO: 242310 - protein, 12 aa, Mycobacterium
VKAGSPAQKGGI

SEQ ID NO: 242311 - protein, 9 aa, Mycobacterium
VKPTSAQAI

SEQ ID NO: 242312 - protein, 8 aa, Mycobacterium
VKSNSDIT

SEQ ID NO: 242313 - protein, 6 aa, Mycobacterium
VKSQGD

SEQ ID NO: 242314 - protein, 5 aa, Mycobacterium
VKYTP

SEQ ID NO: 242315 - protein, 4 aa, Mycobacterium
VNDR

SEQ ID NO: 242316 - protein, 4 aa, Mycobacterium
VNEG

SEQ ID NO: 242317 - protein, 4 aa, Mycobacterium
VNGS

SEQ ID NO: 242318 - protein, 9 aa, Mycobacterium
VNRDSVDAV

SEQ ID NO: 242319 - protein, 4 aa, Mycobacterium
VPAG

SEQ ID NO: 242320 - protein, 10 aa, Mycobacterium
VPAGPAAPGI

SEQ ID NO: 242321 - protein, 8 aa, Mycobacterium
VPAPPGIK

SEQ ID NO: 242322 - protein, 8 aa, Mycobacterium
VPAPPGVK

SEQ ID NO: 242323 - protein, 9 aa, Mycobacterium
VPATPYPEG

SEQ ID NO: 242324 - protein, 6 aa, Mycobacterium
VPEAGP

SEQ ID NO: 242325 - protein, 6 aa, Mycobacterium
VPEAQA

SEQ ID NO: 242326 - protein, 7 aa, Mycobacterium
VPGDTGF

SEQ ID NO: 242327 - protein, 8 aa, Mycobacterium
VPGETEVS

SEQ ID NO: 242328 - protein, 4 aa, Mycobacterium
VPGH

SEQ ID NO: 242329 - protein, 9 aa, Mycobacterium
VPGPAGRSV

SEQ ID NO: 242330 - protein, 7 aa, Mycobacterium
VPGRGTV

SEQ ID NO: 242331 - protein, 7 aa, Mycobacterium
VPGVARG

SEQ ID NO: 242332 - protein, 4 aa, Mycobacterium
VPPG

SEQ ID NO: 242333 - protein, 7 aa, Mycobacterium
VPPPPGI

SEQ ID NO: 242334 - protein, 8 aa, Mycobacterium
VPPPSPGT

SEQ ID NO: 242335 - protein, 8 aa, Mycobacterium
VPRPRPDH

SEQ ID NO: 242336 - protein, 5 aa, Mycobacterium
VPSAG

SEQ ID NO: 242337 - protein, 7 aa, Mycobacterium
VPTARTI

SEQ ID NO: 242338 - protein, 4 aa, Mycobacterium
VPVA

SEQ ID NO: 242339 - protein, 8 aa, Mycobacterium
VPVSGSTY

SEQ ID NO: 242340 - protein, 7 aa, Mycobacterium
VQHAPDS

SEQ ID NO: 242341 - protein, 5 aa, Mycobacterium
VQNTT

SEQ ID NO: 242342 - protein, 6 aa, Mycobacterium
VQQGPG

SEQ ID NO: 242343 - protein, 4 aa, Mycobacterium
VQQT

SEQ ID NO: 242344 - protein, 8 aa, Mycobacterium
VRETQDRW

SEQ ID NO: 242345 - protein, 4 aa, Mycobacterium
VRGE

SEQ ID NO: 242346 - protein, 12 aa, Mycobacterium
VRGGSKGLGTAV

SEQ ID NO: 242347 - protein, 7 aa, Mycobacterium
VRPDARE

SEQ ID NO: 242348 - protein, 7 aa, Mycobacterium
VRPDQKR

SEQ ID NO: 242349 - protein, 8 aa, Mycobacterium
VRPDRDGW

SEQ ID NO: 242350 - protein, 4 aa, Mycobacterium
VRRG

SEQ ID NO: 242351 - protein, 7 aa, Mycobacterium
VRTPDGR

SEQ ID NO: 242352 - protein, 8 aa, Mycobacterium
VSAASDGT

SEQ ID NO: 242353 - protein, 4 aa, Mycobacterium
VSDD

SEQ ID NO: 242354 - protein, 11 aa, Mycobacterium
VSENAGAKPQT

SEQ ID NO: 242355 - protein, 4 aa, Mycobacterium
VSGD

SEQ ID NO: 242356 - protein, 4 aa, Mycobacterium
VSGG

SEQ ID NO: 242357 - protein, 4 aa, Mycobacterium
VSGR

SEQ ID NO: 242358 - protein, 13 aa, Mycobacterium
VSGRGSSAARGAA

SEQ ID NO: 242359 - protein, 10 aa, Mycobacterium
VSGSGTATAV

SEQ ID NO: 242360 - protein, 8 aa, Mycobacterium
VSRSGATI

SEQ ID NO: 242361 - protein, 9 aa, Mycobacterium
VSRSGSTIS

SEQ ID NO: 242362 - protein, 9 aa, Mycobacterium
VSRSTNDVE

SEQ ID NO: 242363 - protein, 9 aa, Mycobacterium
VSRTGGAPT

SEQ ID NO: 242364 - protein, 9 aa, Mycobacterium
VSSEPGDNY

SEQ ID NO: 242365 - protein, 9 aa, Mycobacterium
VSSPDLAGR

SEQ ID NO: 242366 - protein, 7 aa, Mycobacterium
VSTGTET

SEQ ID NO: 242367 - protein, 8 aa, Mycobacterium
VSTPRSYL

SEQ ID NO: 242368 - protein, 8 aa, Mycobacterium
VTAAGATA

SEQ ID NO: 242369 - protein, 7 aa, Mycobacterium
VTAPTGT

SEQ ID NO: 242370 - protein, 10 aa, Mycobacterium
VTDEVNEGIS

SEQ ID NO: 242371 - protein, 14 aa, Mycobacterium
VTGGQVSANNAIKT

SEQ ID NO: 242372 - protein, 10 aa, Mycobacterium
VTGPSGSGKT

SEQ ID NO: 242373 - protein, 7 aa, Mycobacterium
VTPATDV

SEQ ID NO: 242374 - protein, 5 aa, Mycobacterium
VTPHP

SEQ ID NO: 242375 - protein, 11 aa, Mycobacterium
VTQPGTSNPKA

SEQ ID NO: 242376 - protein, 5 aa, Mycobacterium
VTQTD

SEQ ID NO: 242377 - protein, 12 aa, Mycobacterium
VTSKPDVPGGRG

SEQ ID NO: 242378 - protein, 20 aa, Mycobacterium
VTSNEDTVESQVNAARDERD

SEQ ID NO: 242379 - protein, 4 aa, Mycobacterium
VTSP

SEQ ID NO: 242380 - protein, 9 aa, Mycobacterium
VTTASSAGA

SEQ ID NO: 242381 - protein, 11 aa, Mycobacterium
VTTEYNGDYGR

SEQ ID NO: 242382 - protein, 6 aa, Mycobacterium
VTVDQD

SEQ ID NO: 242383 - protein, 8 aa, Mycobacterium
VTVRAGGA

SEQ ID NO: 242384 - protein, 6 aa, Mycobacterium
VVEDGT

SEQ ID NO: 242385 - protein, 7 aa, Mycobacterium
VYSPGRG

SEQ ID NO: 242386 - protein, 7 aa, Mycobacterium
WGEPGKG

SEQ ID NO: 242387 - protein, 7 aa, Mycobacterium
WGEPGQG

SEQ ID NO: 242388 - protein, 4 aa, Mycobacterium
WGHG

SEQ ID NO: 242389 - protein, 5 aa, Mycobacterium
WGHGT

SEQ ID NO: 242390 - protein, 12 aa, Mycobacterium
WGQDGPLARTAG

SEQ ID NO: 242391 - protein, 17 aa, Mycobacterium
WHEPATDTTDPIAEEAR

SEQ ID NO: 242392 - protein, 8 aa, Mycobacterium
WNDDGSAD

SEQ ID NO: 242393 - protein, 5 aa, Mycobacterium
WPGDT

SEQ ID NO: 242394 - protein, 9 aa, Mycobacterium
WPQNGQLNS

SEQ ID NO: 242395 - protein, 17 aa, Mycobacterium
WPSPTPSQPTTNLTTST

SEQ ID NO: 242396 - protein, 15 aa, Mycobacterium
WPVEGTKAEKRAERG

SEQ ID NO: 242397 - protein, 9 aa, Mycobacterium
WRDTETERG

SEQ ID NO: 242398 - protein, 9 aa, Mycobacterium
WRDTQTERG

SEQ ID NO: 242399 - protein, 7 aa, Mycobacterium
WSPTAAV

SEQ ID NO: 242400 - protein, 8 aa, Mycobacterium
WTPPPVQA

SEQ ID NO: 242401 - protein, 4 aa, Mycobacterium
YAAY

SEQ ID NO: 242402 - protein, 4 aa, Mycobacterium
YADR

SEQ ID NO: 242403 - protein, 15 aa, Mycobacterium
YASDGKGDGVADPQN

SEQ ID NO: 242404 - protein, 15 aa, Mycobacterium
YATEKATVTVPDGYD

SEQ ID NO: 242405 - protein, 4 aa, Mycobacterium
YDPR

SEQ ID NO: 242406 - protein, 6 aa, Mycobacterium
YDSDST

SEQ ID NO: 242407 - protein, 6 aa, Mycobacterium
YEREST

SEQ ID NO: 242408 - protein, 5 aa, Mycobacterium
YERSE

SEQ ID NO: 242409 - protein, 5 aa, Mycobacterium
YERSQ

SEQ ID NO: 242410 - protein, 6 aa, Mycobacterium
YGEPQL

SEQ ID NO: 242411 - protein, 4 aa, Mycobacterium
YGET

SEQ ID NO: 242412 - protein, 10 aa, Mycobacterium
YGGSAAPLSV

SEQ ID NO: 242413 - protein, 6 aa, Mycobacterium
YGGTST

SEQ ID NO: 242414 - protein, 6 aa, Mycobacterium
YGPDKV

SEQ ID NO: 242415 - protein, 6 aa, Mycobacterium
YGPPER

SEQ ID NO: 242416 - protein, 7 aa, Mycobacterium
YKAGESP

SEQ ID NO: 242417 - protein, 5 aa, Mycobacterium
YKDQA

SEQ ID NO: 242418 - protein, 5 aa, Mycobacterium
YKEDM

SEQ ID NO: 242419 - protein, 12 aa, Mycobacterium
YKPSHVSAGSQP

SEQ ID NO: 242420 - protein, 12 aa, Mycobacterium
YKPSQVSAGSQP

SEQ ID NO: 242421 - protein, 4 aa, Mycobacterium
YKTS

SEQ ID NO: 242422 - protein, 7 aa, Mycobacterium
YNDPATL

SEQ ID NO: 242423 - protein, 8 aa, Mycobacterium
YNRGAEYG

SEQ ID NO: 242424 - protein, 8 aa, Mycobacterium
YPANPPAL

SEQ ID NO: 242425 - protein, 6 aa, Mycobacterium
YPDTAR

SEQ ID NO: 242426 - protein, 4 aa, Mycobacterium
YPGD

SEQ ID NO: 242427 - protein, 4 aa, Mycobacterium
YPGP

SEQ ID NO: 242428 - protein, 7 aa, Mycobacterium
YPQAAGA

SEQ ID NO: 242429 - protein, 4 aa, Mycobacterium
YPRT

SEQ ID NO: 242430 - protein, 7 aa, Mycobacterium
YPTYAEA

SEQ ID NO: 242431 - protein, 13 aa, Mycobacterium
YQPGSDTAAGTVA

SEQ ID NO: 242432 - protein, 18 aa, Mycobacterium
YRGNDNKTRTEEVDAERA

SEQ ID NO: 242433 - protein, 5 aa, Mycobacterium
YRQLG

SEQ ID NO: 242434 - protein, 8 aa, Mycobacterium
YRREPRNQ

SEQ ID NO: 242435 - protein, 4 aa, Mycobacterium
YSGD

SEQ ID NO: 242436 - protein, 7 aa, Mycobacterium
YSGGEQR

SEQ ID NO: 242437 - protein, 4 aa, Mycobacterium
YSGL

SEQ ID NO: 242438 - protein, 7 aa, Mycobacterium
YSRKDST

SEQ ID NO: 242439 - protein, 5 aa, Mycobacterium
YSTPY

SEQ ID NO: 242440 - protein, 5 aa, Mycobacterium
YTPGQ

SEQ ID NO: 242441 - protein, 9 aa, Mycobacterium
YTPSSASKL

SEQ ID NO: 242442 - protein, 9 aa, Mycobacterium
YTTGKYPQG

SEQ ID NO: 242443 - protein, 8 aa, Mycobacterium
YTTTTTGA

SEQ ID NO: 242444 - protein, 10 aa, Mycobacterium
YYGSDSAGTF

SEQ ID NO: 242445 - protein, 5 aa, Mycobacterium
AAAAA

SEQ ID NO: 242446 - protein, 23 aa, Mycobacterium
AAAAAGAERGGLPSHDRVGPSAL

SEQ ID NO: 242447 - protein, 11 aa, Mycobacterium
AAAAAGGRRGL

SEQ ID NO: 242448 - protein, 8 aa, Mycobacterium
AAAAAGTG

SEQ ID NO: 242449 - protein, 7 aa, Mycobacterium
AAAAAGV

SEQ ID NO: 242450 - protein, 11 aa, Mycobacterium
AAAAARWTGPA

SEQ ID NO: 242451 - protein, 27 aa, Mycobacterium
AAAAASTLAPFDSPPTVGSGQHDPAVA

SEQ ID NO: 242452 - protein, 7 aa, Mycobacterium
AAAAATA

SEQ ID NO: 242453 - protein, 8 aa, Mycobacterium
AAAAATGA

SEQ ID NO: 242454 - protein, 10 aa, Mycobacterium
AAAAATQRGI

SEQ ID NO: 242455 - protein, 6 aa, Mycobacterium
AAAADL

SEQ ID NO: 242456 - protein, 7 aa, Mycobacterium
AAAADRV

SEQ ID NO: 242457 - protein, 10 aa, Mycobacterium
AAAAEDQSFE

SEQ ID NO: 242458 - protein, 7 aa, Mycobacterium
AAAAEGA

SEQ ID NO: 242459 - protein, 8 aa, Mycobacterium
AAAAEPPL

SEQ ID NO: 242460 - protein, 26 aa, Mycobacterium
AAAAESAEAGAAPTTEQKLADRYGKR

SEQ ID NO: 242461 - protein, 5 aa, Mycobacterium
AAAAG

SEQ ID NO: 242462 - protein, 7 aa, Mycobacterium
AAAAGAG

SEQ ID NO: 242463 - protein, 27 aa, Mycobacterium
AAAAGEAPPSKPTPPQVPGRPPTPTRQ

SEQ ID NO: 242464 - protein, 10 aa, Mycobacterium
AAAAGGAAAA

SEQ ID NO: 242465 - protein, 17 aa, Mycobacterium
AAAAGPDADRYTTPTVK

SEQ ID NO: 242466 - protein, 9 aa, Mycobacterium
AAAAGPVGR

SEQ ID NO: 242467 - protein, 7 aa, Mycobacterium
AAAAGRD

SEQ ID NO: 242468 - protein, 67 aa, Mycobacterium
AAAAPAAGSPPSGPSAVAGPPRGVAPSGPAGPSGPIPRPPAAGQPGWQQASGPIPASQPTPSPPYYQ

SEQ ID NO: 242469 - protein, 15 aa, Mycobacterium
AAAAPAGEPATAGLG

SEQ ID NO: 242470 - protein, 11 aa, Mycobacterium
AAAAPGPAPGQ

SEQ ID NO: 242471 - protein, 9 aa, Mycobacterium
AAAAPGVSH

SEQ ID NO: 242472 - protein, 10 aa, Mycobacterium
AAAAPPEGID

SEQ ID NO: 242473 - protein, 8 aa, Mycobacterium
AAAAPTQA

SEQ ID NO: 242474 - protein, 6 aa, Mycobacterium
AAAAPY

SEQ ID NO: 242475 - protein, 13 aa, Mycobacterium
AAAAQPAPAADPC

SEQ ID NO: 242476 - protein, 14 aa, Mycobacterium
AAAAQRLPSGDLDT

SEQ ID NO: 242477 - protein, 12 aa, Mycobacterium
AAAAQSSDGKAA

SEQ ID NO: 242478 - protein, 8 aa, Mycobacterium
AAAAREAG

SEQ ID NO: 242479 - protein, 5 aa, Mycobacterium
AAAAS

SEQ ID NO: 242480 - protein, 16 aa, Mycobacterium
AAAASGRVPANARALQ

SEQ ID NO: 242481 - protein, 6 aa, Mycobacterium
AAAASM

SEQ ID NO: 242482 - protein, 6 aa, Mycobacterium
AAAAST

SEQ ID NO: 242483 - protein, 9 aa, Mycobacterium
AAAATAATA

SEQ ID NO: 242484 - protein, 13 aa, Mycobacterium
AAAATARSAPPGL

SEQ ID NO: 242485 - protein, 8 aa, Mycobacterium
AAAATGAD

SEQ ID NO: 242486 - protein, 11 aa, Mycobacterium
AAAATNASTMS

SEQ ID NO: 242487 - protein, 6 aa, Mycobacterium
AAAAVG

SEQ ID NO: 242488 - protein, 7 aa, Mycobacterium
AAAAYAA

SEQ ID NO: 242489 - protein, 6 aa, Mycobacterium
AAAAYE

SEQ ID NO: 242490 - protein, 5 aa, Mycobacterium
AAADA

SEQ ID NO: 242491 - protein, 9 aa, Mycobacterium
AAADAGRSL

SEQ ID NO: 242492 - protein, 7 aa, Mycobacterium
AAADARP

SEQ ID NO: 242493 - protein, 5 aa, Mycobacterium
AAADD

SEQ ID NO: 242494 - protein, 10 aa, Mycobacterium
AAADDGSAGV

SEQ ID NO: 242495 - protein, 8 aa, Mycobacterium
AAADERRR

SEQ ID NO: 242496 - protein, 8 aa, Mycobacterium
AAADGDEL

SEQ ID NO: 242497 - protein, 7 aa, Mycobacterium
AAADPDA

SEQ ID NO: 242498 - protein, 9 aa, Mycobacterium
AAADPDGVH

SEQ ID NO: 242499 - protein, 20 aa, Mycobacterium
AAADPGDSGAATTESWGSQG

SEQ ID NO: 242500 - protein, 7 aa, Mycobacterium
AAADQRA

SEQ ID NO: 242501 - protein, 29 aa, Mycobacterium
AAADSDGETARTDAVASTTEATDDADDAE

SEQ ID NO: 242502 - protein, 5 aa, Mycobacterium
AAADT

SEQ ID NO: 242503 - protein, 17 aa, Mycobacterium
AAADTPPAQQPIFAQQV

SEQ ID NO: 242504 - protein, 9 aa, Mycobacterium
AAADTVAVD

SEQ ID NO: 242505 - protein, 6 aa, Mycobacterium
AAAEAA

SEQ ID NO: 242506 - protein, 6 aa, Mycobacterium
AAAEAE

SEQ ID NO: 242507 - protein, 23 aa, Mycobacterium
AAAEAKRRAGQAEADARKAAADA

SEQ ID NO: 242508 - protein, 11 aa, Mycobacterium
AAAEALGPGAL

SEQ ID NO: 242509 - protein, 16 aa, Mycobacterium
AAAEAQDTPVQSRTDH

SEQ ID NO: 242510 - protein, 8 aa, Mycobacterium
AAAEDRPA

SEQ ID NO: 242511 - protein, 6 aa, Mycobacterium
AAAEEP

SEQ ID NO: 242512 - protein, 15 aa, Mycobacterium
AAAEEVGTLPTPEGF

SEQ ID NO: 242513 - protein, 10 aa, Mycobacterium
AAAEGGAELG

SEQ ID NO: 242514 - protein, 10 aa, Mycobacterium
AAAEGVGEQS

SEQ ID NO: 242515 - protein, 5 aa, Mycobacterium
AAAEI

SEQ ID NO: 242516 - protein, 8 aa, Mycobacterium
AAAEKGGW

SEQ ID NO: 242517 - protein, 8 aa, Mycobacterium
AAAEPDAA

SEQ ID NO: 242518 - protein, 6 aa, Mycobacterium
AAAEPL

SEQ ID NO: 242519 - protein, 14 aa, Mycobacterium
AAAEQQQPELGGEE

SEQ ID NO: 242520 - protein, 9 aa, Mycobacterium
AAAERSGEA

SEQ ID NO: 242521 - protein, 11 aa, Mycobacterium
AAAERTRGGRR

SEQ ID NO: 242522 - protein, 9 aa, Mycobacterium
AAAESGASA

SEQ ID NO: 242523 - protein, 6 aa, Mycobacterium
AAAESS

SEQ ID NO: 242524 - protein, 13 aa, Mycobacterium
AAAETADPTRTLP

SEQ ID NO: 242525 - protein, 7 aa, Mycobacterium
AAAEVRD

SEQ ID NO: 242526 - protein, 9 aa, Mycobacterium
AAAGAGSTM

SEQ ID NO: 242527 - protein, 8 aa, Mycobacterium
AAAGANPI

SEQ ID NO: 242528 - protein, 7 aa, Mycobacterium
AAAGANV

SEQ ID NO: 242529 - protein, 9 aa, Mycobacterium
AAAGAPTSA

SEQ ID NO: 242530 - protein, 7 aa, Mycobacterium
AAAGARA

SEQ ID NO: 242531 - protein, 10 aa, Mycobacterium
AAAGATPAAA

SEQ ID NO: 242532 - protein, 11 aa, Mycobacterium
AAAGDAPPSVG

SEQ ID NO: 242533 - protein, 10 aa, Mycobacterium
AAAGDLGGKL

SEQ ID NO: 242534 - protein, 6 aa, Mycobacterium
AAAGEA

SEQ ID NO: 242535 - protein, 6 aa, Mycobacterium
AAAGEQ

SEQ ID NO: 242536 - protein, 12 aa, Mycobacterium
AAAGESGGPVAE

SEQ ID NO: 242537 - protein, 10 aa, Mycobacterium
AAAGGGALPL

SEQ ID NO: 242538 - protein, 8 aa, Mycobacterium
AAAGGGRG

SEQ ID NO: 242539 - protein, 10 aa, Mycobacterium
AAAGGTTSLA

SEQ ID NO: 242540 - protein, 5 aa, Mycobacterium
AAAGI

SEQ ID NO: 242541 - protein, 17 aa, Mycobacterium
AAAGPAQPGPQAPGNAQ

SEQ ID NO: 242542 - protein, 19 aa, Mycobacterium
AAAGPGTARLPDPEAPVRT

SEQ ID NO: 242543 - protein, 8 aa, Mycobacterium
AAAGPVGR

SEQ ID NO: 242544 - protein, 25 aa, Mycobacterium
AAAGQRPGHRPRGATPGQALTCDFC

SEQ ID NO: 242545 - protein, 14 aa, Mycobacterium
AAAGRTNGANGHHH

SEQ ID NO: 242546 - protein, 9 aa, Mycobacterium
AAAGSAGTE

SEQ ID NO: 242547 - protein, 16 aa, Mycobacterium
AAAGSGSIASPPRTSD

SEQ ID NO: 242548 - protein, 7 aa, Mycobacterium
AAAGSPH

SEQ ID NO: 242549 - protein, 8 aa, Mycobacterium
AAAGTAAG

SEQ ID NO: 242550 - protein, 8 aa, Mycobacterium
AAAGTAVA

SEQ ID NO: 242551 - protein, 12 aa, Mycobacterium
AAAGTRRAASIA

SEQ ID NO: 242552 - protein, 5 aa, Mycobacterium
AAAGV

SEQ ID NO: 242553 - protein, 6 aa, Mycobacterium
AAAHGN

SEQ ID NO: 242554 - protein, 8 aa, Mycobacterium
AAAHGPAS

SEQ ID NO: 242555 - protein, 11 aa, Mycobacterium
AAAHYGKQNPA

SEQ ID NO: 242556 - protein, 8 aa, Mycobacterium
AAAKDRAD

SEQ ID NO: 242557 - protein, 14 aa, Mycobacterium
AAAKDRAESQGKTA

SEQ ID NO: 242558 - protein, 7 aa, Mycobacterium
AAAKDSS

SEQ ID NO: 242559 - protein, 12 aa, Mycobacterium
AAAKPDAARAAG

SEQ ID NO: 242560 - protein, 7 aa, Mycobacterium
AAAKPGE

SEQ ID NO: 242561 - protein, 9 aa, Mycobacterium
AAAKSAGWS

SEQ ID NO: 242562 - protein, 19 aa, Mycobacterium
AAAKTKKSGPAPVPQVCVG

SEQ ID NO: 242563 - protein, 4 aa, Mycobacterium
AAAL

SEQ ID NO: 242564 - protein, 6 aa, Mycobacterium
AAALEA

SEQ ID NO: 242565 - protein, 9 aa, Mycobacterium
AAANADVTE

SEQ ID NO: 242566 - protein, 9 aa, Mycobacterium
AAANARTGL

SEQ ID NO: 242567 - protein, 9 aa, Mycobacterium
AAANDGKLR

SEQ ID NO: 242568 - protein, 9 aa, Mycobacterium
AAANEEPEL

SEQ ID NO: 242569 - protein, 6 aa, Mycobacterium
AAANQS

SEQ ID NO: 242570 - protein, 10 aa, Mycobacterium
AAANQTSAAM

SEQ ID NO: 242571 - protein, 5 aa, Mycobacterium
AAANS

SEQ ID NO: 242572 - protein, 10 aa, Mycobacterium
AAANSGGNVE

SEQ ID NO: 242573 - protein, 4 aa, Mycobacterium
AAAP

SEQ ID NO: 242574 - protein, 5 aa, Mycobacterium
AAAPA

SEQ ID NO: 242575 - protein, 8 aa, Mycobacterium
AAAPAAGT

SEQ ID NO: 242576 - protein, 7 aa, Mycobacterium
AAAPAAV

SEQ ID NO: 242577 - protein, 17 aa, Mycobacterium
AAAPACAGSCAGCTQSC

SEQ ID NO: 242578 - protein, 7 aa, Mycobacterium
AAAPAGV

SEQ ID NO: 242579 - protein, 20 aa, Mycobacterium
AAAPAQPQPPTDLGAPAHTS

SEQ ID NO: 242580 - protein, 14 aa, Mycobacterium
AAAPARPWNPGPVL

SEQ ID NO: 242581 - protein, 8 aa, Mycobacterium
AAAPAVPA

SEQ ID NO: 242582 - protein, 7 aa, Mycobacterium
AAAPDPA

SEQ ID NO: 242583 - protein, 7 aa, Mycobacterium
AAAPEPV

SEQ ID NO: 242584 - protein, 7 aa, Mycobacterium
AAAPESE

SEQ ID NO: 242585 - protein, 7 aa, Mycobacterium
AAAPGEN

SEQ ID NO: 242586 - protein, 9 aa, Mycobacterium
AAAPGENLT

SEQ ID NO: 242587 - protein, 9 aa, Mycobacterium
AAAPGGGIY

SEQ ID NO: 242588 - protein, 7 aa, Mycobacterium
AAAPGVA

SEQ ID NO: 242589 - protein, 10 aa, Mycobacterium
AAAPHANPAP

SEQ ID NO: 242590 - protein, 9 aa, Mycobacterium
AAAPHPSSV

SEQ ID NO: 242591 - protein, 32 aa, Mycobacterium
AAAPHTGAIPSVGPSRGFGGGPFSAPTPGEAL

SEQ ID NO: 242592 - protein, 17 aa, Mycobacterium
AAAPKAEAVRSNGSGLT

SEQ ID NO: 242593 - protein, 15 aa, Mycobacterium
AAAPPAVKGADTVND

SEQ ID NO: 242594 - protein, 11 aa, Mycobacterium
AAAPPGGLGSP

SEQ ID NO: 242595 - protein, 11 aa, Mycobacterium
AAAPPGGVGSP

SEQ ID NO: 242596 - protein, 12 aa, Mycobacterium
AAAPPGPVGSPQ

SEQ ID NO: 242597 - protein, 9 aa, Mycobacterium
AAAPPLGTR

SEQ ID NO: 242598 - protein, 12 aa, Mycobacterium
AAAPQPAPAPPI

SEQ ID NO: 242599 - protein, 6 aa, Mycobacterium
AAAPQT

SEQ ID NO: 242600 - protein, 14 aa, Mycobacterium
AAAPRSSGSDGNIA

SEQ ID NO: 242601 - protein, 5 aa, Mycobacterium
AAAPS

SEQ ID NO: 242602 - protein, 6 aa, Mycobacterium
AAAPSV

SEQ ID NO: 242603 - protein, 6 aa, Mycobacterium
AAAPTA

SEQ ID NO: 242604 - protein, 14 aa, Mycobacterium
AAAPVQPQVATNEP

SEQ ID NO: 242605 - protein, 11 aa, Mycobacterium
AAAPVRRGLGG

SEQ ID NO: 242606 - protein, 9 aa, Mycobacterium
AAAPVSAPA

SEQ ID NO: 242607 - protein, 4 aa, Mycobacterium
AAAQ

SEQ ID NO: 242608 - protein, 15 aa, Mycobacterium
AAAQALEAGPPPRRF

SEQ ID NO: 242609 - protein, 11 aa, Mycobacterium
AAAQALGPGAL

SEQ ID NO: 242610 - protein, 12 aa, Mycobacterium
AAAQALGPGALG

SEQ ID NO: 242611 - protein, 13 aa, Mycobacterium
AAAQALGPGALGP

SEQ ID NO: 242612 - protein, 25 aa, Mycobacterium
AAAQAQDKPVESRTDHGLPVRTPGA

SEQ ID NO: 242613 - protein, 8 aa, Mycobacterium
AAAQARDQ

SEQ ID NO: 242614 - protein, 8 aa, Mycobacterium
AAAQAYAA

SEQ ID NO: 242615 - protein, 21 aa, Mycobacterium
AAAQGEARSGSDRPDTKAHTE

SEQ ID NO: 242616 - protein, 19 aa, Mycobacterium
AAAQHSGSLQRTSPVKAGQ

SEQ ID NO: 242617 - protein, 13 aa, Mycobacterium
AAAQPGAPPAPLP

SEQ ID NO: 242618 - protein, 10 aa, Mycobacterium
AAAQPPSKLT

SEQ ID NO: 242619 - protein, 10 aa, Mycobacterium
AAARARGDNA

SEQ ID NO: 242620 - protein, 10 aa, Mycobacterium
AAARARGDST

SEQ ID NO: 242621 - protein, 6 aa, Mycobacterium
AAARAV

SEQ ID NO: 242622 - protein, 14 aa, Mycobacterium
AAARDAGPRPRTGH

SEQ ID NO: 242623 - protein, 7 aa, Mycobacterium
AAARDEV

SEQ ID NO: 242624 - protein, 16 aa, Mycobacterium
AAARDTADSNTRNQYQ

SEQ ID NO: 242625 - protein, 7 aa, Mycobacterium
AAAREAL

SEQ ID NO: 242626 - protein, 35 aa, Mycobacterium
AAARETAAQAKSTVDSAPPPIPGPAPEQGRQSPNL

SEQ ID NO: 242627 - protein, 8 aa, Mycobacterium
AAAREYEG

SEQ ID NO: 242628 - protein, 13 aa, Mycobacterium
AAARGGSPRPRTG

SEQ ID NO: 242629 - protein, 7 aa, Mycobacterium
AAARPAA

SEQ ID NO: 242630 - protein, 15 aa, Mycobacterium
AAARPNEPSSTTTRK

SEQ ID NO: 242631 - protein, 7 aa, Mycobacterium
AAARPRL

SEQ ID NO: 242632 - protein, 20 aa, Mycobacterium
AAARQADSVREHAARRGLSA

SEQ ID NO: 242633 - protein, 23 aa, Mycobacterium
AAARTDPSQPPGTYTSARGRFGD

SEQ ID NO: 242634 - protein, 12 aa, Mycobacterium
AAARTEGTDAHV

SEQ ID NO: 242635 - protein, 13 aa, Mycobacterium
AAARTTDGSGEAY

SEQ ID NO: 242636 - protein, 19 aa, Mycobacterium
AAARYTRKHGHPAKNNYGS

SEQ ID NO: 242637 - protein, 6 aa, Mycobacterium
AAASAA

SEQ ID NO: 242638 - protein, 7 aa, Mycobacterium
AAASALL

SEQ ID NO: 242639 - protein, 15 aa, Mycobacterium
AAASAPADAPPTAGI

SEQ ID NO: 242640 - protein, 12 aa, Mycobacterium
AAASAPAPHDGD

SEQ ID NO: 242641 - protein, 31 aa, Mycobacterium
AAASDRVARTGGFAGTGHRQTTTAASGLTTL

SEQ ID NO: 242642 - protein, 68 aa, Mycobacterium
AAASGAGADAADAETKPPAMKTATAEPREKKAATGEDAPKKKVPGAKKKTAAAKKAAARKIAGARKRP

SEQ ID NO: 242643 - protein, 13 aa, Mycobacterium
AAASGGWGTSGGR

SEQ ID NO: 242644 - protein, 13 aa, Mycobacterium
AAASGLDNPYQAG

SEQ ID NO: 242645 - protein, 13 aa, Mycobacterium
AAASGSGHESTHR

SEQ ID NO: 242646 - protein, 7 aa, Mycobacterium
AAASGTA

SEQ ID NO: 242647 - protein, 6 aa, Mycobacterium
AAASLC

SEQ ID NO: 242648 - protein, 18 aa, Mycobacterium
AAASNDLNEGNKQSASSA

SEQ ID NO: 242649 - protein, 6 aa, Mycobacterium
AAASPF

SEQ ID NO: 242650 - protein, 7 aa, Mycobacterium
AAASPRR

SEQ ID NO: 242651 - protein, 11 aa, Mycobacterium
AAASSANSGVF

SEQ ID NO: 242652 - protein, 7 aa, Mycobacterium
AAASSAS

SEQ ID NO: 242653 - protein, 16 aa, Mycobacterium
AAASSPVGSNARTTKL

SEQ ID NO: 242654 - protein, 6 aa, Mycobacterium
AAASTV

SEQ ID NO: 242655 - protein, 8 aa, Mycobacterium
AAASVASG

SEQ ID NO: 242656 - protein, 10 aa, Mycobacterium
AAASVGDDRI

SEQ ID NO: 242657 - protein, 31 aa, Mycobacterium
AAASVGDDRIQKEATGRVNPESWTHGSSEQR

SEQ ID NO: 242658 - protein, 31 aa, Mycobacterium
AAASVGDDRIQKQATGRVNSESWTHGSAEQR

SEQ ID NO: 242659 - protein, 32 aa, Mycobacterium
AAASVGDDRIQQQVNGRTNPETWTHGSSSQRQ

SEQ ID NO: 242660 - protein, 20 aa, Mycobacterium
AAASVGDDRIQQSATGRVNP

SEQ ID NO: 242661 - protein, 8 aa, Mycobacterium
AAASVGKV

SEQ ID NO: 242662 - protein, 4 aa, Mycobacterium
AAAT

SEQ ID NO: 242663 - protein, 5 aa, Mycobacterium
AAATA

SEQ ID NO: 242664 - protein, 7 aa, Mycobacterium
AAATAAA

SEQ ID NO: 242665 - protein, 8 aa, Mycobacterium
AAATAGRS

SEQ ID NO: 242666 - protein, 9 aa, Mycobacterium
AAATAVDGQ

SEQ ID NO: 242667 - protein, 21 aa, Mycobacterium
AAATDRSGAQIAPGTTLSPQD

SEQ ID NO: 242668 - protein, 10 aa, Mycobacterium
AAATEPASAT

SEQ ID NO: 242669 - protein, 33 aa, Mycobacterium
AAATEPKVSPPKAAAAPAGRNGGGQGPPRGPRE

SEQ ID NO: 242670 - protein, 7 aa, Mycobacterium
AAATGAV

SEQ ID NO: 242671 - protein, 17 aa, Mycobacterium
AAATGPAADKYTTATVT

SEQ ID NO: 242672 - protein, 13 aa, Mycobacterium
AAATGRPRPAAGA

SEQ ID NO: 242673 - protein, 9 aa, Mycobacterium
AAATPDNYK

SEQ ID NO: 242674 - protein, 12 aa, Mycobacterium
AAATSAGASQSA

SEQ ID NO: 242675 - protein, 7 aa, Mycobacterium
AAATSVQ

SEQ ID NO: 242676 - protein, 11 aa, Mycobacterium
AAATTAAEAGK

SEQ ID NO: 242677 - protein, 7 aa, Mycobacterium
AAATTGS

SEQ ID NO: 242678 - protein, 8 aa, Mycobacterium
AAATTGYT

SEQ ID NO: 242679 - protein, 9 aa, Mycobacterium
AAATVPADP

SEQ ID NO: 242680 - protein, 6 aa, Mycobacterium
AAATVR

SEQ ID NO: 242681 - protein, 31 aa, Mycobacterium
AAAVGDDRIQETATGRVNPESWTHGSSEQRQ

SEQ ID NO: 242682 - protein, 14 aa, Mycobacterium
AAAVGTTAAAAGGG

SEQ ID NO: 242683 - protein, 12 aa, Mycobacterium
AAAVPDRPKVSH

SEQ ID NO: 242684 - protein, 6 aa, Mycobacterium
AAAYGA

SEQ ID NO: 242685 - protein, 8 aa, Mycobacterium
AACNSASG

SEQ ID NO: 242686 - protein, 7 aa, Mycobacterium
AADAAHR

SEQ ID NO: 242687 - protein, 15 aa, Mycobacterium
AADAARARGAPAAAA

SEQ ID NO: 242688 - protein, 5 aa, Mycobacterium
AADAD

SEQ ID NO: 242689 - protein, 7 aa, Mycobacterium
AADADVA

SEQ ID NO: 242690 - protein, 18 aa, Mycobacterium
AADAGPTTPTHPGAGQQA

SEQ ID NO: 242691 - protein, 10 aa, Mycobacterium
AADAGQKAGV

SEQ ID NO: 242692 - protein, 14 aa, Mycobacterium
AADAGTAPPPGGAA

SEQ ID NO: 242693 - protein, 21 aa, Mycobacterium
AADAGVEELRTGDISRQRPDG

SEQ ID NO: 242694 - protein, 9 aa, Mycobacterium
AADAKAGRR

SEQ ID NO: 242695 - protein, 9 aa, Mycobacterium
AADAKTDPA

SEQ ID NO: 242696 - protein, 7 aa, Mycobacterium
AADAPDR

SEQ ID NO: 242697 - protein, 7 aa, Mycobacterium
AADAPNQ

SEQ ID NO: 242698 - protein, 8 aa, Mycobacterium
AADAPPGW

SEQ ID NO: 242699 - protein, 10 aa, Mycobacterium
AADASAARAL

SEQ ID NO: 242700 - protein, 8 aa, Mycobacterium
AADATALE

SEQ ID NO: 242701 - protein, 16 aa, Mycobacterium
AADAVAPGARRAPVQI

SEQ ID NO: 242702 - protein, 5 aa, Mycobacterium
AADDA

SEQ ID NO: 242703 - protein, 10 aa, Mycobacterium
AADDRPNASM

SEQ ID NO: 242704 - protein, 20 aa, Mycobacterium
AADEELRGAKIERRNGFHAV

SEQ ID NO: 242705 - protein, 7 aa, Mycobacterium
AADEERK

SEQ ID NO: 242706 - protein, 15 aa, Mycobacterium
AADEHADLPDTHRDS

SEQ ID NO: 242707 - protein, 24 aa, Mycobacterium
AADEPESGYRQGADGQGGPPDHPT

SEQ ID NO: 242708 - protein, 10 aa, Mycobacterium
AADERVGTGT

SEQ ID NO: 242709 - protein, 21 aa, Mycobacterium
AADESDEAAGPEVPTASSARP

SEQ ID NO: 242710 - protein, 10 aa, Mycobacterium
AADGAGSALG

SEQ ID NO: 242711 - protein, 15 aa, Mycobacterium
AADGALRPVDSAGAE

SEQ ID NO: 242712 - protein, 32 aa, Mycobacterium
AADGARDQSASVRDASPATKSAGNVSGHRRTV

SEQ ID NO: 242713 - protein, 17 aa, Mycobacterium
AADGARGRTTGSGFGTR

SEQ ID NO: 242714 - protein, 30 aa, Mycobacterium
AADGGAPQVAPAKPVSVPPAPQPRNTTPRN

SEQ ID NO: 242715 - protein, 8 aa, Mycobacterium
AADGKSGR

SEQ ID NO: 242716 - protein, 13 aa, Mycobacterium
AADGLDASVTSSK

SEQ ID NO: 242717 - protein, 14 aa, Mycobacterium
AADGLNKSPRPSGG

SEQ ID NO: 242718 - protein, 14 aa, Mycobacterium
AADGLNTSPGSSGR

SEQ ID NO: 242719 - protein, 9 aa, Mycobacterium
AADGNSAIS

SEQ ID NO: 242720 - protein, 7 aa, Mycobacterium
AADGPAL

SEQ ID NO: 242721 - protein, 7 aa, Mycobacterium
AADGQNV

SEQ ID NO: 242722 - protein, 8 aa, Mycobacterium
AADGSGAL

SEQ ID NO: 242723 - protein, 14 aa, Mycobacterium
AADGSMRPSSDPRA

SEQ ID NO: 242724 - protein, 9 aa, Mycobacterium
AADGTAAAD

SEQ ID NO: 242725 - protein, 9 aa, Mycobacterium
AADGTASSF

SEQ ID NO: 242726 - protein, 7 aa, Mycobacterium
AADGTLT

SEQ ID NO: 242727 - protein, 12 aa, Mycobacterium
AADGTPPAPGNA

SEQ ID NO: 242728 - protein, 15 aa, Mycobacterium
AADGTRTEEPRPDGV

SEQ ID NO: 242729 - protein, 14 aa, Mycobacterium
AADGTRTEEPRPEG

SEQ ID NO: 242730 - protein, 9 aa, Mycobacterium
AADLEGQGR

SEQ ID NO: 242731 - protein, 5 aa, Mycobacterium
AADLK

SEQ ID NO: 242732 - protein, 12 aa, Mycobacterium
AADLSDAQRTRL

SEQ ID NO: 242733 - protein, 8 aa, Mycobacterium
AADNGPGA

SEQ ID NO: 242734 - protein, 12 aa, Mycobacterium
AADNPDTGQTDF

SEQ ID NO: 242735 - protein, 30 aa, Mycobacterium
AADNPNAARVEGSGSAAPDAPSGNVGWGTR

SEQ ID NO: 242736 - protein, 17 aa, Mycobacterium
AADNSVSMNPAGAPSLQ

SEQ ID NO: 242737 - protein, 9 aa, Mycobacterium
AADPAAARR

SEQ ID NO: 242738 - protein, 8 aa, Mycobacterium
AADPAGPA

SEQ ID NO: 242739 - protein, 6 aa, Mycobacterium
AADPDF

SEQ ID NO: 242740 - protein, 8 aa, Mycobacterium
AADPDNTA

SEQ ID NO: 242741 - protein, 8 aa, Mycobacterium
AADPGEHT

SEQ ID NO: 242742 - protein, 9 aa, Mycobacterium
AADPGLTQG

SEQ ID NO: 242743 - protein, 11 aa, Mycobacterium
AADPGPATMSR

SEQ ID NO: 242744 - protein, 11 aa, Mycobacterium
AADPGRRRPRH

SEQ ID NO: 242745 - protein, 7 aa, Mycobacterium
AADPGRW

SEQ ID NO: 242746 - protein, 7 aa, Mycobacterium
AADPISS

SEQ ID NO: 242747 - protein, 7 aa, Mycobacterium
AADPNLG

SEQ ID NO: 242748 - protein, 16 aa, Mycobacterium
AADPPPTDRDPEPVPH

SEQ ID NO: 242749 - protein, 7 aa, Mycobacterium
AADPRLR

SEQ ID NO: 242750 - protein, 9 aa, Mycobacterium
AADPRPNAS

SEQ ID NO: 242751 - protein, 10 aa, Mycobacterium
AADPRPNASV

SEQ ID NO: 242752 - protein, 10 aa, Mycobacterium
AADPSATELA

SEQ ID NO: 242753 - protein, 13 aa, Mycobacterium
AADPSKGTAATDI

SEQ ID NO: 242754 - protein, 11 aa, Mycobacterium
AADPSTGSFAD

SEQ ID NO: 242755 - protein, 7 aa, Mycobacterium
AADPTTC

SEQ ID NO: 242756 - protein, 8 aa, Mycobacterium
AADPVGAR

SEQ ID NO: 242757 - protein, 18 aa, Mycobacterium
AADQPAPAPASAQTPAPR

SEQ ID NO: 242758 - protein, 11 aa, Mycobacterium
AADRAADSNAL

SEQ ID NO: 242759 - protein, 7 aa, Mycobacterium
AADRAKA

SEQ ID NO: 242760 - protein, 8 aa, Mycobacterium
AADRDPLT

SEQ ID NO: 242761 - protein, 20 aa, Mycobacterium
AADRERHASVAPDGDGHADV

SEQ ID NO: 242762 - protein, 6 aa, Mycobacterium
AADRKR

SEQ ID NO: 242763 - protein, 21 aa, Mycobacterium
AADRKTATNGHANGSSGPKKL

SEQ ID NO: 242764 - protein, 12 aa, Mycobacterium
AADRPDAGRRAG

SEQ ID NO: 242765 - protein, 6 aa, Mycobacterium
AADRRE

SEQ ID NO: 242766 - protein, 15 aa, Mycobacterium
AADRRNRDLTWAHDA

SEQ ID NO: 242767 - protein, 8 aa, Mycobacterium
AADRSRAL

SEQ ID NO: 242768 - protein, 7 aa, Mycobacterium
AADRYAQ

SEQ ID NO: 242769 - protein, 6 aa, Mycobacterium
AADSDA

SEQ ID NO: 242770 - protein, 8 aa, Mycobacterium
AADSERAP

SEQ ID NO: 242771 - protein, 6 aa, Mycobacterium
AADSGA

SEQ ID NO: 242772 - protein, 9 aa, Mycobacterium
AADSGTVTS

SEQ ID NO: 242773 - protein, 15 aa, Mycobacterium
AADSKSDGFSGIAPE

SEQ ID NO: 242774 - protein, 15 aa, Mycobacterium
AADSSAEGFSGVAPE

SEQ ID NO: 242775 - protein, 6 aa, Mycobacterium
AADSSL

SEQ ID NO: 242776 - protein, 6 aa, Mycobacterium
AADTAG

SEQ ID NO: 242777 - protein, 5 aa, Mycobacterium
AADTG

SEQ ID NO: 242778 - protein, 9 aa, Mycobacterium
AADTGSPSL

SEQ ID NO: 242779 - protein, 7 aa, Mycobacterium
AADTGTA

SEQ ID NO: 242780 - protein, 5 aa, Mycobacterium
AADTT

SEQ ID NO: 242781 - protein, 4 aa, Mycobacterium
AADV

SEQ ID NO: 242782 - protein, 7 aa, Mycobacterium
AADYATL

SEQ ID NO: 242783 - protein, 10 aa, Mycobacterium
AAEAADPPTQ

SEQ ID NO: 242784 - protein, 11 aa, Mycobacterium
AAEAADPSHTL

SEQ ID NO: 242785 - protein, 7 aa, Mycobacterium
AAEAAHR

SEQ ID NO: 242786 - protein, 17 aa, Mycobacterium
AAEAATEEAAARRTSLT

SEQ ID NO: 242787 - protein, 10 aa, Mycobacterium
AAEAATRSVD

SEQ ID NO: 242788 - protein, 12 aa, Mycobacterium
AAEAEGTAEQTK

SEQ ID NO: 242789 - protein, 5 aa, Mycobacterium
AAEAG

SEQ ID NO: 242790 - protein, 23 aa, Mycobacterium
AAEANRPTEQPVNGPQSPVPGKA

SEQ ID NO: 242791 - protein, 11 aa, Mycobacterium
AAEAPAAPRYE

SEQ ID NO: 242792 - protein, 7 aa, Mycobacterium
AAEARAG

SEQ ID NO: 242793 - protein, 36 aa, Mycobacterium
AAEARARRKSLSGPKLSRAERRAERTASRARMSERR

SEQ ID NO: 242794 - protein, 5 aa, Mycobacterium
AAEAT

SEQ ID NO: 242795 - protein, 22 aa, Mycobacterium
AAEATDADEGDGEPAEPASDDL

SEQ ID NO: 242796 - protein, 7 aa, Mycobacterium
AAEATGE

SEQ ID NO: 242797 - protein, 7 aa, Mycobacterium
AAEAVGA

SEQ ID NO: 242798 - protein, 8 aa, Mycobacterium
AAEDADVD

SEQ ID NO: 242799 - protein, 43 aa, Mycobacterium
AAEDAESASGGSAPESSTAPAVSEDQDGEGVAEEDDTAAYDEA

SEQ ID NO: 242800 - protein, 8 aa, Mycobacterium
AAEDTSGA

SEQ ID NO: 242801 - protein, 6 aa, Mycobacterium
AAEEAI

SEQ ID NO: 242802 - protein, 8 aa, Mycobacterium
AAEEDRDR

SEQ ID NO: 242803 - protein, 9 aa, Mycobacterium
AAEEGTEVT

SEQ ID NO: 242804 - protein, 14 aa, Mycobacterium
AAEEPDAPETEESP

SEQ ID NO: 242805 - protein, 10 aa, Mycobacterium
AAEEPDTALA

SEQ ID NO: 242806 - protein, 10 aa, Mycobacterium
AAEEPETALA

SEQ ID NO: 242807 - protein, 9 aa, Mycobacterium
AAEERGDPV

SEQ ID NO: 242808 - protein, 8 aa, Mycobacterium
AAEGANGT

SEQ ID NO: 242809 - protein, 7 aa, Mycobacterium
AAEGGAA

SEQ ID NO: 242810 - protein, 6 aa, Mycobacterium
AAEGNE

SEQ ID NO: 242811 - protein, 14 aa, Mycobacterium
AAEGRAGYGMPGDH

SEQ ID NO: 242812 - protein, 15 aa, Mycobacterium
AAEGRRRDAEASRDE

SEQ ID NO: 242813 - protein, 8 aa, Mycobacterium
AAEGRTRD

SEQ ID NO: 242814 - protein, 7 aa, Mycobacterium
AAEGSAV

SEQ ID NO: 242815 - protein, 7 aa, Mycobacterium
AAEGVNP

SEQ ID NO: 242816 - protein, 4 aa, Mycobacterium
AAEH

SEQ ID NO: 242817 - protein, 16 aa, Mycobacterium
AAEHRQTADGYAAQEN

SEQ ID NO: 242818 - protein, 9 aa, Mycobacterium
AAELEEQGR

SEQ ID NO: 242819 - protein, 5 aa, Mycobacterium
AAELG

SEQ ID NO: 242820 - protein, 5 aa, Mycobacterium
AAELR

SEQ ID NO: 242821 - protein, 13 aa, Mycobacterium
AAEMPTPSDSAQL

SEQ ID NO: 242822 - protein, 8 aa, Mycobacterium
AAENGMGP

SEQ ID NO: 242823 - protein, 13 aa, Mycobacterium
AAENPDAPAIDDG

SEQ ID NO: 242824 - protein, 16 aa, Mycobacterium
AAEPAEETGPSTARRR

SEQ ID NO: 242825 - protein, 7 aa, Mycobacterium
AAEPELG

SEQ ID NO: 242826 - protein, 10 aa, Mycobacterium
AAEPEPTAAE

SEQ ID NO: 242827 - protein, 9 aa, Mycobacterium
AAEPGVTAA

SEQ ID NO: 242828 - protein, 8 aa, Mycobacterium
AAEPGYQE

SEQ ID NO: 242829 - protein, 5 aa, Mycobacterium
AAEPL

SEQ ID NO: 242830 - protein, 11 aa, Mycobacterium
AAEPNAVPGPR

SEQ ID NO: 242831 - protein, 23 aa, Mycobacterium
AAEPSRERHQAPPVYSSSRRRRF

SEQ ID NO: 242832 - protein, 7 aa, Mycobacterium
AAEPTPV

SEQ ID NO: 242833 - protein, 38 aa, Mycobacterium
AAEPTSAQATSTAPPRPVGSTPTKHSYDDTHPDQPEVA

SEQ ID NO: 242834 - protein, 17 aa, Mycobacterium
AAEPVPPVPIGAAPPSR

SEQ ID NO: 242835 - protein, 5 aa, Mycobacterium
AAEPY

SEQ ID NO: 242836 - protein, 12 aa, Mycobacterium
AAEQRAVPGEGA

SEQ ID NO: 242837 - protein, 12 aa, Mycobacterium
AAEQSRASNPSD

SEQ ID NO: 242838 - protein, 8 aa, Mycobacterium
AAEQTRPQ

SEQ ID NO: 242839 - protein, 6 aa, Mycobacterium
AAEQVG

SEQ ID NO: 242840 - protein, 17 aa, Mycobacterium
AAERAPRASREAAENEL

SEQ ID NO: 242841 - protein, 12 aa, Mycobacterium
AAERARNDRGTI

SEQ ID NO: 242842 - protein, 13 aa, Mycobacterium
AAERARNDRSAVA

SEQ ID NO: 242843 - protein, 19 aa, Mycobacterium
AAERARSDVNAARAQQRLP

SEQ ID NO: 242844 - protein, 5 aa, Mycobacterium
AAERE

SEQ ID NO: 242845 - protein, 14 aa, Mycobacterium
AAERERPKLGGEDR

SEQ ID NO: 242846 - protein, 8 aa, Mycobacterium
AAERPESG

SEQ ID NO: 242847 - protein, 9 aa, Mycobacterium
AAERPGHRY

SEQ ID NO: 242848 - protein, 10 aa, Mycobacterium
AAERPGHSYS

SEQ ID NO: 242849 - protein, 5 aa, Mycobacterium
AAERR

SEQ ID NO: 242850 - protein, 6 aa, Mycobacterium
AAERRE

SEQ ID NO: 242851 - protein, 55 aa, Mycobacterium
AAERRGVGDDDEDSPSGGPAGSPSATAGSNGRKPAPAGPTVTDGPTRSDGDTAVA

SEQ ID NO: 242852 - protein, 6 aa, Mycobacterium
AAERSY

SEQ ID NO: 242853 - protein, 11 aa, Mycobacterium
AAERVKATGYE

SEQ ID NO: 242854 - protein, 8 aa, Mycobacterium
AAERVKST

SEQ ID NO: 242855 - protein, 8 aa, Mycobacterium
AAESALGQ

SEQ ID NO: 242856 - protein, 9 aa, Mycobacterium
AAESALSQA

SEQ ID NO: 242857 - protein, 15 aa, Mycobacterium
AAESATSGVGAETAS

SEQ ID NO: 242858 - protein, 22 aa, Mycobacterium
AAESDLQSPGPRIPPADFGPTD

SEQ ID NO: 242859 - protein, 12 aa, Mycobacterium
AAESGDPQAPTT

SEQ ID NO: 242860 - protein, 6 aa, Mycobacterium
AAESGV

SEQ ID NO: 242861 - protein, 16 aa, Mycobacterium
AAESKDPAKAISQATN

SEQ ID NO: 242862 - protein, 5 aa, Mycobacterium
AAESL

SEQ ID NO: 242863 - protein, 13 aa, Mycobacterium
AAESPATDAGGPG

SEQ ID NO: 242864 - protein, 8 aa, Mycobacterium
AAESPSLT

SEQ ID NO: 242865 - protein, 15 aa, Mycobacterium
AAESQDPERAVAKAA

SEQ ID NO: 242866 - protein, 9 aa, Mycobacterium
AAESQGKTA

SEQ ID NO: 242867 - protein, 5 aa, Mycobacterium
AAESR

SEQ ID NO: 242868 - protein, 8 aa, Mycobacterium
AAESRAAA

SEQ ID NO: 242869 - protein, 15 aa, Mycobacterium
AAESSDPERAVAKAA

SEQ ID NO: 242870 - protein, 15 aa, Mycobacterium
AAESSSPWNNAGTGH

SEQ ID NO: 242871 - protein, 4 aa, Mycobacterium
AAET

SEQ ID NO: 242872 - protein, 16 aa, Mycobacterium
AAETAADQSGAERNAL

SEQ ID NO: 242873 - protein, 33 aa, Mycobacterium
AAETAGPATPEGPPQVGRVPEPRHAAPAAEPEP

SEQ ID NO: 242874 - protein, 9 aa, Mycobacterium
AAETDSEHP

SEQ ID NO: 242875 - protein, 8 aa, Mycobacterium
AAETPHTR

SEQ ID NO: 242876 - protein, 13 aa, Mycobacterium
AAETPTAPPPRRR

SEQ ID NO: 242877 - protein, 10 aa, Mycobacterium
AAETPTPGGL

SEQ ID NO: 242878 - protein, 4 aa, Mycobacterium
AAEV

SEQ ID NO: 242879 - protein, 5 aa, Mycobacterium
AAEWS

SEQ ID NO: 242880 - protein, 8 aa, Mycobacterium
AAFAGAAS

SEQ ID NO: 242881 - protein, 8 aa, Mycobacterium
AAFGGTAP

SEQ ID NO: 242882 - protein, 10 aa, Mycobacterium
AAFGSASSAT

SEQ ID NO: 242883 - protein, 18 aa, Mycobacterium
AAFSPAHPTPEEQDLHRK

SEQ ID NO: 242884 - protein, 7 aa, Mycobacterium
AAGAADA

SEQ ID NO: 242885 - protein, 15 aa, Mycobacterium
AAGAAGVVVDSILQL

SEQ ID NO: 242886 - protein, 6 aa, Mycobacterium
AAGAAS

SEQ ID NO: 242887 - protein, 6 aa, Mycobacterium
AAGAEA

SEQ ID NO: 242888 - protein, 6 aa, Mycobacterium
AAGAER

SEQ ID NO: 242889 - protein, 8 aa, Mycobacterium
AAGAERVA

SEQ ID NO: 242890 - protein, 30 aa, Mycobacterium
AAGAETQDRSSGRRRRARHYGSDEGQGDIG

SEQ ID NO: 242891 - protein, 18 aa, Mycobacterium
AAGAGAFAGRATAAQAPD

SEQ ID NO: 242892 - protein, 9 aa, Mycobacterium
AAGAGLPDF

SEQ ID NO: 242893 - protein, 7 aa, Mycobacterium
AAGAGPA

SEQ ID NO: 242894 - protein, 6 aa, Mycobacterium
AAGAGS

SEQ ID NO: 242895 - protein, 34 aa, Mycobacterium
AAGAGSGRIARPVPRPPRIAKPGPRIAGPESATS

SEQ ID NO: 242896 - protein, 6 aa, Mycobacterium
AAGAHH

SEQ ID NO: 242897 - protein, 5 aa, Mycobacterium
AAGAK

SEQ ID NO: 242898 - protein, 5 aa, Mycobacterium
AAGAL

SEQ ID NO: 242899 - protein, 5 aa, Mycobacterium
AAGAP

SEQ ID NO: 242900 - protein, 7 aa, Mycobacterium
AAGAPAG

SEQ ID NO: 242901 - protein, 9 aa, Mycobacterium
AAGAPNTLG

SEQ ID NO: 242902 - protein, 10 aa, Mycobacterium
AAGAQKVASD

SEQ ID NO: 242903 - protein, 11 aa, Mycobacterium
AAGAQSADAKG

SEQ ID NO: 242904 - protein, 12 aa, Mycobacterium
AAGAQSADAKGA

SEQ ID NO: 242905 - protein, 12 aa, Mycobacterium
AAGAQSADAKSA

SEQ ID NO: 242906 - protein, 11 aa, Mycobacterium
AAGAQSADGKS

SEQ ID NO: 242907 - protein, 11 aa, Mycobacterium
AAGAQSDDGKA

SEQ ID NO: 242908 - protein, 11 aa, Mycobacterium
AAGAQSPDGKA

SEQ ID NO: 242909 - protein, 12 aa, Mycobacterium
AAGAQSSDAKGA

SEQ ID NO: 242910 - protein, 5 aa, Mycobacterium
AAGAR

SEQ ID NO: 242911 - protein, 19 aa, Mycobacterium
AAGARAPLVPGSAPPRDLE

SEQ ID NO: 242912 - protein, 16 aa, Mycobacterium
AAGARSGPVPEGDAHT

SEQ ID NO: 242913 - protein, 10 aa, Mycobacterium
AAGASRPDAI

SEQ ID NO: 242914 - protein, 6 aa, Mycobacterium
AAGASS

SEQ ID NO: 242915 - protein, 6 aa, Mycobacterium
AAGATA

SEQ ID NO: 242916 - protein, 25 aa, Mycobacterium
AAGATAQTLRRRRSASALGTNSPSG

SEQ ID NO: 242917 - protein, 10 aa, Mycobacterium
AAGATTSTEL

SEQ ID NO: 242918 - protein, 13 aa, Mycobacterium
AAGAVQAKKEQLA

SEQ ID NO: 242919 - protein, 5 aa, Mycobacterium
AAGAY

SEQ ID NO: 242920 - protein, 6 aa, Mycobacterium
AAGAYA

SEQ ID NO: 242921 - protein, 8 aa, Mycobacterium
AAGDAEYR

SEQ ID NO: 242922 - protein, 8 aa, Mycobacterium
AAGDAPDR

SEQ ID NO: 242923 - protein, 9 aa, Mycobacterium
AAGDEETSM

SEQ ID NO: 242924 - protein, 6 aa, Mycobacterium
AAGDEV

SEQ ID NO: 242925 - protein, 11 aa, Mycobacterium
AAGDGEAVGKA

SEQ ID NO: 242926 - protein, 24 aa, Mycobacterium
AAGDGPDPALEPGHDVTPQRRARS

SEQ ID NO: 242927 - protein, 11 aa, Mycobacterium
AAGDGQPPGPR

SEQ ID NO: 242928 - protein, 7 aa, Mycobacterium
AAGDGSP

SEQ ID NO: 242929 - protein, 13 aa, Mycobacterium
AAGDNRVTARPVV

SEQ ID NO: 242930 - protein, 12 aa, Mycobacterium
AAGDNTAAETFG

SEQ ID NO: 242931 - protein, 11 aa, Mycobacterium
AAGDPERRAGL

SEQ ID NO: 242932 - protein, 21 aa, Mycobacterium
AAGDPGAKTTATIAGGKTSPF

SEQ ID NO: 242933 - protein, 9 aa, Mycobacterium
AAGDPTAGI

SEQ ID NO: 242934 - protein, 10 aa, Mycobacterium
AAGEAAEPEK

SEQ ID NO: 242935 - protein, 13 aa, Mycobacterium
AAGEAGAAAATTA

SEQ ID NO: 242936 - protein, 7 aa, Mycobacterium
AAGEAPT

SEQ ID NO: 242937 - protein, 19 aa, Mycobacterium
AAGEDKPGKRLTAGGGRRR

SEQ ID NO: 242938 - protein, 9 aa, Mycobacterium
AAGEDREAA

SEQ ID NO: 242939 - protein, 10 aa, Mycobacterium
AAGEDRETAY

SEQ ID NO: 242940 - protein, 20 aa, Mycobacterium
AAGEESRTIDRGSTPVDDGF

SEQ ID NO: 242941 - protein, 9 aa, Mycobacterium
AAGEGAYSD

SEQ ID NO: 242942 - protein, 8 aa, Mycobacterium
AAGENRPG

SEQ ID NO: 242943 - protein, 6 aa, Mycobacterium
AAGEQD

SEQ ID NO: 242944 - protein, 7 aa, Mycobacterium
AAGEQLR

SEQ ID NO: 242945 - protein, 9 aa, Mycobacterium
AAGESHSQA

SEQ ID NO: 242946 - protein, 9 aa, Mycobacterium
AAGESTPAL

SEQ ID NO: 242947 - protein, 11 aa, Mycobacterium
AAGETAEPEKV

SEQ ID NO: 242948 - protein, 17 aa, Mycobacterium
AAGETGDIEDAPDVVPT

SEQ ID NO: 242949 - protein, 10 aa, Mycobacterium
AAGETTGPVV

SEQ ID NO: 242950 - protein, 13 aa, Mycobacterium
AAGFSAKDRDRVN

SEQ ID NO: 242951 - protein, 19 aa, Mycobacterium
AAGGAGSEKGEGGGGRTAK

SEQ ID NO: 242952 - protein, 7 aa, Mycobacterium
AAGGAPA

SEQ ID NO: 242953 - protein, 11 aa, Mycobacterium
AAGGAVSTQAG

SEQ ID NO: 242954 - protein, 9 aa, Mycobacterium
AAGGDAEAM

SEQ ID NO: 242955 - protein, 10 aa, Mycobacterium
AAGGDTVADD

SEQ ID NO: 242956 - protein, 11 aa, Mycobacterium
AAGGGAPDQGP

SEQ ID NO: 242957 - protein, 13 aa, Mycobacterium
AAGGGARPAPTGR

SEQ ID NO: 242958 - protein, 9 aa, Mycobacterium
AAGGGPFAA

SEQ ID NO: 242959 - protein, 7 aa, Mycobacterium
AAGGHTL

SEQ ID NO: 242960 - protein, 12 aa, Mycobacterium
AAGGNTAAQNFG

SEQ ID NO: 242961 - protein, 6 aa, Mycobacterium
AAGGNV

SEQ ID NO: 242962 - protein, 8 aa, Mycobacterium
AAGGPAAS

SEQ ID NO: 242963 - protein, 15 aa, Mycobacterium
AAGGPGQLGSMAGQQ

SEQ ID NO: 242964 - protein, 11 aa, Mycobacterium
AAGGPPGERTL

SEQ ID NO: 242965 - protein, 8 aa, Mycobacterium
AAGGPSQQ

SEQ ID NO: 242966 - protein, 7 aa, Mycobacterium
AAGGPST

SEQ ID NO: 242967 - protein, 7 aa, Mycobacterium
AAGGPTT

SEQ ID NO: 242968 - protein, 6 aa, Mycobacterium
AAGGQQ

SEQ ID NO: 242969 - protein, 14 aa, Mycobacterium
AAGGQQDPNSESAY

SEQ ID NO: 242970 - protein, 9 aa, Mycobacterium
AAGGRNLSA

SEQ ID NO: 242971 - protein, 7 aa, Mycobacterium
AAGGSHG

SEQ ID NO: 242972 - protein, 6 aa, Mycobacterium
AAGGSP

SEQ ID NO: 242973 - protein, 5 aa, Mycobacterium
AAGGT

SEQ ID NO: 242974 - protein, 33 aa, Mycobacterium
AAGGTADEAGEPGEAPAPPTRSESLARAAERGL

SEQ ID NO: 242975 - protein, 7 aa, Mycobacterium
AAGGVAG

SEQ ID NO: 242976 - protein, 12 aa, Mycobacterium
AAGGVPQDEGAK

SEQ ID NO: 242977 - protein, 6 aa, Mycobacterium
AAGGWA

SEQ ID NO: 242978 - protein, 9 aa, Mycobacterium
AAGHPGPGL

SEQ ID NO: 242979 - protein, 6 aa, Mycobacterium
AAGHSQ

SEQ ID NO: 242980 - protein, 5 aa, Mycobacterium
AAGIG

SEQ ID NO: 242981 - protein, 11 aa, Mycobacterium
AAGIGGAGVPD

SEQ ID NO: 242982 - protein, 4 aa, Mycobacterium
AAGK

SEQ ID NO: 242983 - protein, 5 aa, Mycobacterium
AAGKD

SEQ ID NO: 242984 - protein, 8 aa, Mycobacterium
AAGKGREI

SEQ ID NO: 242985 - protein, 17 aa, Mycobacterium
AAGKNNSAALPDDAPTM

SEQ ID NO: 242986 - protein, 8 aa, Mycobacterium
AAGKQAPN

SEQ ID NO: 242987 - protein, 10 aa, Mycobacterium
AAGKSDPPGL

SEQ ID NO: 242988 - protein, 9 aa, Mycobacterium
AAGKSRGTR

SEQ ID NO: 242989 - protein, 4 aa, Mycobacterium
AAGL

SEQ ID NO: 242990 - protein, 5 aa, Mycobacterium
AAGLE

SEQ ID NO: 242991 - protein, 5 aa, Mycobacterium
AAGLG

SEQ ID NO: 242992 - protein, 7 aa, Mycobacterium
AAGLPRE

SEQ ID NO: 242993 - protein, 5 aa, Mycobacterium
AAGLS

SEQ ID NO: 242994 - protein, 6 aa, Mycobacterium
AAGLSP

SEQ ID NO: 242995 - protein, 6 aa, Mycobacterium
AAGLSR

SEQ ID NO: 242996 - protein, 7 aa, Mycobacterium
AAGLTRT

SEQ ID NO: 242997 - protein, 11 aa, Mycobacterium
AAGMGTGTETY

SEQ ID NO: 242998 - protein, 11 aa, Mycobacterium
AAGNAPQSRPH

SEQ ID NO: 242999 - protein, 7 aa, Mycobacterium
AAGNPDL

SEQ ID NO: 243000 - protein, 5 aa, Mycobacterium
AAGNR

SEQ ID NO: 243001 - protein, 18 aa, Mycobacterium
AAGPAEDLRSGGRPATQR

SEQ ID NO: 243002 - protein, 13 aa, Mycobacterium
AAGPALSPAHATL

SEQ ID NO: 243003 - protein, 7 aa, Mycobacterium
AAGPALT

SEQ ID NO: 243004 - protein, 11 aa, Mycobacterium
AAGPANAGAPG

SEQ ID NO: 243005 - protein, 17 aa, Mycobacterium
AAGPAQTRQISEDGRVG

SEQ ID NO: 243006 - protein, 13 aa, Mycobacterium
AAGPDADNLPRSQ

SEQ ID NO: 243007 - protein, 10 aa, Mycobacterium
AAGPDSAGRE

SEQ ID NO: 243008 - protein, 5 aa, Mycobacterium
AAGPF

SEQ ID NO: 243009 - protein, 6 aa, Mycobacterium
AAGPGH

SEQ ID NO: 243010 - protein, 9 aa, Mycobacterium
AAGPGKPLL

SEQ ID NO: 243011 - protein, 8 aa, Mycobacterium
AAGPGSIA

SEQ ID NO: 243012 - protein, 10 aa, Mycobacterium
AAGPGTPDRG

SEQ ID NO: 243013 - protein, 5 aa, Mycobacterium
AAGPL

SEQ ID NO: 243014 - protein, 6 aa, Mycobacterium
AAGPQL

SEQ ID NO: 243015 - protein, 10 aa, Mycobacterium
AAGPQSAGGR

SEQ ID NO: 243016 - protein, 9 aa, Mycobacterium
AAGPSGPIT

SEQ ID NO: 243017 - protein, 9 aa, Mycobacterium
AAGPSPTAV

SEQ ID NO: 243018 - protein, 39 aa, Mycobacterium
AAGPTSAQATSTAPPRPAGPTPTKHSYDDTHTGQQPEVA

SEQ ID NO: 243019 - protein, 8 aa, Mycobacterium
AAGQATGA

SEQ ID NO: 243020 - protein, 9 aa, Mycobacterium
AAGQPGPGV

SEQ ID NO: 243021 - protein, 10 aa, Mycobacterium
AAGQPGPTVL

SEQ ID NO: 243022 - protein, 7 aa, Mycobacterium
AAGQPTF

SEQ ID NO: 243023 - protein, 14 aa, Mycobacterium
AAGQSAAGTTTHAR

SEQ ID NO: 243024 - protein, 14 aa, Mycobacterium
AAGQSGPRAAGAAA

SEQ ID NO: 243025 - protein, 6 aa, Mycobacterium
AAGQSL

SEQ ID NO: 243026 - protein, 7 aa, Mycobacterium
AAGRADA

SEQ ID NO: 243027 - protein, 7 aa, Mycobacterium
AAGRADG

SEQ ID NO: 243028 - protein, 25 aa, Mycobacterium
AAGRALSGSETKAKKQEAARKAAER

SEQ ID NO: 243029 - protein, 7 aa, Mycobacterium
AAGRASL

SEQ ID NO: 243030 - protein, 9 aa, Mycobacterium
AAGREPRKR

SEQ ID NO: 243031 - protein, 6 aa, Mycobacterium
AAGRLS

SEQ ID NO: 243032 - protein, 11 aa, Mycobacterium
AAGRPGGPPTV

SEQ ID NO: 243033 - protein, 7 aa, Mycobacterium
AAGRPLP

SEQ ID NO: 243034 - protein, 6 aa, Mycobacterium
AAGRPS

SEQ ID NO: 243035 - protein, 7 aa, Mycobacterium
AAGRSRY

SEQ ID NO: 243036 - protein, 5 aa, Mycobacterium
AAGSA

SEQ ID NO: 243037 - protein, 6 aa, Mycobacterium
AAGSAA

SEQ ID NO: 243038 - protein, 7 aa, Mycobacterium
AAGSAAD

SEQ ID NO: 243039 - protein, 8 aa, Mycobacterium
AAGSAGSY

SEQ ID NO: 243040 - protein, 27 aa, Mycobacterium
AAGSAQIGERSGDLTTLADGATTLADS

SEQ ID NO: 243041 - protein, 7 aa, Mycobacterium
AAGSATD

SEQ ID NO: 243042 - protein, 34 aa, Mycobacterium
AAGSGGLDSFTPQASAVPGSAAEHEAERAGAAQT

SEQ ID NO: 243043 - protein, 9 aa, Mycobacterium
AAGSGPTIG

SEQ ID NO: 243044 - protein, 6 aa, Mycobacterium
AAGSHA

SEQ ID NO: 243045 - protein, 8 aa, Mycobacterium
AAGSLAGA

SEQ ID NO: 243046 - protein, 8 aa, Mycobacterium
AAGSNDQK

SEQ ID NO: 243047 - protein, 14 aa, Mycobacterium
AAGSPDAYTPGSFT

SEQ ID NO: 243048 - protein, 27 aa, Mycobacterium
AAGSPRPPRAGRHAAAETVEDDSEDEV

SEQ ID NO: 243049 - protein, 8 aa, Mycobacterium
AAGSQTAA

SEQ ID NO: 243050 - protein, 6 aa, Mycobacterium
AAGSRS

SEQ ID NO: 243051 - protein, 5 aa, Mycobacterium
AAGST

SEQ ID NO: 243052 - protein, 17 aa, Mycobacterium
AAGSTAGAISEACRIVM

SEQ ID NO: 243053 - protein, 5 aa, Mycobacterium
AAGSV

SEQ ID NO: 243054 - protein, 4 aa, Mycobacterium
AAGT

SEQ ID NO: 243055 - protein, 14 aa, Mycobacterium
AAGTAGRSMASDTS

SEQ ID NO: 243056 - protein, 6 aa, Mycobacterium
AAGTDR

SEQ ID NO: 243057 - protein, 9 aa, Mycobacterium
AAGTDYADL

SEQ ID NO: 243058 - protein, 9 aa, Mycobacterium
AAGTEPAID

SEQ ID NO: 243059 - protein, 5 aa, Mycobacterium
AAGTG

SEQ ID NO: 243060 - protein, 15 aa, Mycobacterium
AAGTGGGYGPEGVNG

SEQ ID NO: 243061 - protein, 15 aa, Mycobacterium
AAGTGGRSYRADANV

SEQ ID NO: 243062 - protein, 9 aa, Mycobacterium
AAGTGPTIG

SEQ ID NO: 243063 - protein, 7 aa, Mycobacterium
AAGTGSA

SEQ ID NO: 243064 - protein, 6 aa, Mycobacterium
AAGTGV

SEQ ID NO: 243065 - protein, 13 aa, Mycobacterium
AAGTHQASAAKEG

SEQ ID NO: 243066 - protein, 14 aa, Mycobacterium
AAGTLPPDKRPQVS

SEQ ID NO: 243067 - protein, 15 aa, Mycobacterium
AAGTLPSEKKPQVGG

SEQ ID NO: 243068 - protein, 8 aa, Mycobacterium
AAGTPPEV

SEQ ID NO: 243069 - protein, 22 aa, Mycobacterium
AAGTRLASSVASGRTRSRIDAG

SEQ ID NO: 243070 - protein, 15 aa, Mycobacterium
AAGTRSVEAGSGSGV

SEQ ID NO: 243071 - protein, 6 aa, Mycobacterium
AAGTSL

SEQ ID NO: 243072 - protein, 8 aa, Mycobacterium
AAGTSPEV

SEQ ID NO: 243073 - protein, 13 aa, Mycobacterium
AAGTTPPKPATTR

SEQ ID NO: 243074 - protein, 5 aa, Mycobacterium
AAGTV

SEQ ID NO: 243075 - protein, 12 aa, Mycobacterium
AAGTYSRHAGTP

SEQ ID NO: 243076 - protein, 4 aa, Mycobacterium
AAGV

SEQ ID NO: 243077 - protein, 8 aa, Mycobacterium
AAGVEPRE

SEQ ID NO: 243078 - protein, 9 aa, Mycobacterium
AAGVGRRPK

SEQ ID NO: 243079 - protein, 13 aa, Mycobacterium
AAGVPPAVPGPPS

SEQ ID NO: 243080 - protein, 12 aa, Mycobacterium
AAGVQSKDGKAA

SEQ ID NO: 243081 - protein, 5 aa, Mycobacterium
AAGVT

SEQ ID NO: 243082 - protein, 7 aa, Mycobacterium
AAGYEGI

SEQ ID NO: 243083 - protein, 10 aa, Mycobacterium
AAHASEHKSL

SEQ ID NO: 243084 - protein, 19 aa, Mycobacterium
AAHASETVAAEHRSQRDTA

SEQ ID NO: 243085 - protein, 11 aa, Mycobacterium
AAHDGAGPTVG

SEQ ID NO: 243086 - protein, 11 aa, Mycobacterium
AAHDGLSAAAA

SEQ ID NO: 243087 - protein, 8 aa, Mycobacterium
AAHDPGNG

SEQ ID NO: 243088 - protein, 10 aa, Mycobacterium
AAHERKKGED

SEQ ID NO: 243089 - protein, 11 aa, Mycobacterium
AAHERKKGEDL

SEQ ID NO: 243090 - protein, 7 aa, Mycobacterium
AAHGEPN

SEQ ID NO: 243091 - protein, 12 aa, Mycobacterium
AAHGGPTGVANS

SEQ ID NO: 243092 - protein, 6 aa, Mycobacterium
AAHGGT

SEQ ID NO: 243093 - protein, 6 aa, Mycobacterium
AAHGMG

SEQ ID NO: 243094 - protein, 4 aa, Mycobacterium
AAHK

SEQ ID NO: 243095 - protein, 7 aa, Mycobacterium
AAHPAPD

SEQ ID NO: 243096 - protein, 8 aa, Mycobacterium
AAHPDGAV

SEQ ID NO: 243097 - protein, 15 aa, Mycobacterium
AAHPGPLGPPLQGHS

SEQ ID NO: 243098 - protein, 11 aa, Mycobacterium
AAHQAAEHGGH

SEQ ID NO: 243099 - protein, 4 aa, Mycobacterium
AAHR

SEQ ID NO: 243100 - protein, 28 aa, Mycobacterium
AAHRGEDMESHARGKGEAPAGADRSDPA

SEQ ID NO: 243101 - protein, 9 aa, Mycobacterium
AAHSNGVTH

SEQ ID NO: 243102 - protein, 7 aa, Mycobacterium
AAHSREH

SEQ ID NO: 243103 - protein, 5 aa, Mycobacterium
AAHTD

SEQ ID NO: 243104 - protein, 6 aa, Mycobacterium
AAHTDE

SEQ ID NO: 243105 - protein, 7 aa, Mycobacterium
AAHTDSA

SEQ ID NO: 243106 - protein, 21 aa, Mycobacterium
AAHTEPPEPPGPYPSARGRFD

SEQ ID NO: 243107 - protein, 7 aa, Mycobacterium
AAHTSPD

SEQ ID NO: 243108 - protein, 8 aa, Mycobacterium
AAHTTGVT

SEQ ID NO: 243109 - protein, 10 aa, Mycobacterium
AAHYGKQAPE

SEQ ID NO: 243110 - protein, 5 aa, Mycobacterium
AAIGG

SEQ ID NO: 243111 - protein, 14 aa, Mycobacterium
AAIGQRDGVDGTRP

SEQ ID NO: 243112 - protein, 4 aa, Mycobacterium
AAIP

SEQ ID NO: 243113 - protein, 16 aa, Mycobacterium
AAIPATAKSAALGRQL

SEQ ID NO: 243114 - protein, 21 aa, Mycobacterium
AAIPRGATGKVDTARLRELLQ

SEQ ID NO: 243115 - protein, 20 aa, Mycobacterium
AAKAAAKAARKEASKQRRSQ

SEQ ID NO: 243116 - protein, 19 aa, Mycobacterium
AAKAAASAARKAAARQRRT

SEQ ID NO: 243117 - protein, 19 aa, Mycobacterium
AAKAEAKAARKAAARERRT

SEQ ID NO: 243118 - protein, 19 aa, Mycobacterium
AAKAEAKARRKAESKARRA

SEQ ID NO: 243119 - protein, 8 aa, Mycobacterium
AAKAGEFS

SEQ ID NO: 243120 - protein, 8 aa, Mycobacterium
AAKAGLNQ

SEQ ID NO: 243121 - protein, 8 aa, Mycobacterium
AAKATQTW

SEQ ID NO: 243122 - protein, 9 aa, Mycobacterium
AAKDGAAGF

SEQ ID NO: 243123 - protein, 11 aa, Mycobacterium
AAKDGAAGYDQ

SEQ ID NO: 243124 - protein, 6 aa, Mycobacterium
AAKDST

SEQ ID NO: 243125 - protein, 17 aa, Mycobacterium
AAKEAGEQKESKATPAL

SEQ ID NO: 243126 - protein, 10 aa, Mycobacterium
AAKEAGKQFA

SEQ ID NO: 243127 - protein, 14 aa, Mycobacterium
AAKEAIKGTPLEGS

SEQ ID NO: 243128 - protein, 12 aa, Mycobacterium
AAKEPKPTGKPN

SEQ ID NO: 243129 - protein, 15 aa, Mycobacterium
AAKEPPAPIGNPAGL

SEQ ID NO: 243130 - protein, 14 aa, Mycobacterium
AAKERLSSETATAV

SEQ ID NO: 243131 - protein, 7 aa, Mycobacterium
AAKGKTP

SEQ ID NO: 243132 - protein, 22 aa, Mycobacterium
AAKHDEAVGRGEAEPFVRMGLT

SEQ ID NO: 243133 - protein, 5 aa, Mycobacterium
AAKHG

SEQ ID NO: 243134 - protein, 9 aa, Mycobacterium
AAKHSRAAA

SEQ ID NO: 243135 - protein, 6 aa, Mycobacterium
AAKIPG

SEQ ID NO: 243136 - protein, 8 aa, Mycobacterium
AAKKSLAR

SEQ ID NO: 243137 - protein, 7 aa, Mycobacterium
AAKPAID

SEQ ID NO: 243138 - protein, 7 aa, Mycobacterium
AAKPGGP

SEQ ID NO: 243139 - protein, 11 aa, Mycobacterium
AAKPNYPAGYT

SEQ ID NO: 243140 - protein, 12 aa, Mycobacterium
AAKPYTEAAERQ

SEQ ID NO: 243141 - protein, 7 aa, Mycobacterium
AAKQRSA

SEQ ID NO: 243142 - protein, 4 aa, Mycobacterium
AAKR

SEQ ID NO: 243143 - protein, 15 aa, Mycobacterium
AAKRAREARRASQEA

SEQ ID NO: 243144 - protein, 13 aa, Mycobacterium
AAKRITRGEIQRG

SEQ ID NO: 243145 - protein, 64 aa, Mycobacterium
AAKRPGAKKAAPAAEASAAPAAAPAPAKGLGLAGGAKRPGAKKAAAPAAEAPAAPASDAPPVKG

SEQ ID NO: 243146 - protein, 15 aa, Mycobacterium
AAKRSREAGRASREA

SEQ ID NO: 243147 - protein, 5 aa, Mycobacterium
AAKSA

SEQ ID NO: 243148 - protein, 19 aa, Mycobacterium
AAKSATAASLHETAATAYT

SEQ ID NO: 243149 - protein, 10 aa, Mycobacterium
AAKSKPVNNT

SEQ ID NO: 243150 - protein, 9 aa, Mycobacterium
AAKSRYNSL

SEQ ID NO: 243151 - protein, 7 aa, Mycobacterium
AAKTGFR

SEQ ID NO: 243152 - protein, 6 aa, Mycobacterium
AAKTGT

SEQ ID NO: 243153 - protein, 12 aa, Mycobacterium
AAKTKEAAQATG

SEQ ID NO: 243154 - protein, 14 aa, Mycobacterium
AALAATPTSAPAPS

SEQ ID NO: 243155 - protein, 11 aa, Mycobacterium
AALADPAAAPR

SEQ ID NO: 243156 - protein, 8 aa, Mycobacterium
AALASANT

SEQ ID NO: 243157 - protein, 13 aa, Mycobacterium
AALATAPKAMRTS

SEQ ID NO: 243158 - protein, 11 aa, Mycobacterium
AALDDPDNPNV

SEQ ID NO: 243159 - protein, 5 aa, Mycobacterium
AALDP

SEQ ID NO: 243160 - protein, 6 aa, Mycobacterium
AALEGL

SEQ ID NO: 243161 - protein, 20 aa, Mycobacterium
AALESSPLGGARLVLRLPGP

SEQ ID NO: 243162 - protein, 6 aa, Mycobacterium
AALGDT

SEQ ID NO: 243163 - protein, 9 aa, Mycobacterium
AALGSAAAA

SEQ ID NO: 243164 - protein, 6 aa, Mycobacterium
AALGSV

SEQ ID NO: 243165 - protein, 5 aa, Mycobacterium
AALGT

SEQ ID NO: 243166 - protein, 6 aa, Mycobacterium
AALHDP

SEQ ID NO: 243167 - protein, 4 aa, Mycobacterium
AALP

SEQ ID NO: 243168 - protein, 8 aa, Mycobacterium
AALPAESR

SEQ ID NO: 243169 - protein, 10 aa, Mycobacterium
AALPGNTSGL

SEQ ID NO: 243170 - protein, 8 aa, Mycobacterium
AALPGPAG

SEQ ID NO: 243171 - protein, 5 aa, Mycobacterium
AALPQ

SEQ ID NO: 243172 - protein, 11 aa, Mycobacterium
AALPSGVESNI

SEQ ID NO: 243173 - protein, 6 aa, Mycobacterium
AALQGG

SEQ ID NO: 243174 - protein, 4 aa, Mycobacterium
AALS

SEQ ID NO: 243175 - protein, 6 aa, Mycobacterium
AALSEG

SEQ ID NO: 243176 - protein, 10 aa, Mycobacterium
AALSGGERQR

SEQ ID NO: 243177 - protein, 8 aa, Mycobacterium
AALSGTPA

SEQ ID NO: 243178 - protein, 13 aa, Mycobacterium
AALSTGSPSAPPV

SEQ ID NO: 243179 - protein, 4 aa, Mycobacterium
AALT

SEQ ID NO: 243180 - protein, 6 aa, Mycobacterium
AALTGA

SEQ ID NO: 243181 - protein, 9 aa, Mycobacterium
AALTGAEAP

SEQ ID NO: 243182 - protein, 15 aa, Mycobacterium
AALTGDATLTRAPDT

SEQ ID NO: 243183 - protein, 7 aa, Mycobacterium
AALTGSP

SEQ ID NO: 243184 - protein, 6 aa, Mycobacterium
AALTGT

SEQ ID NO: 243185 - protein, 8 aa, Mycobacterium
AALTGTPA

SEQ ID NO: 243186 - protein, 10 aa, Mycobacterium
AAMSGSGSGI

SEQ ID NO: 243187 - protein, 11 aa, Mycobacterium
AAMTENSTAMG

SEQ ID NO: 243188 - protein, 8 aa, Mycobacterium
AANAAAAA

SEQ ID NO: 243189 - protein, 88 aa, Mycobacterium
AANAPAPGAKPKRLPKAASGGGDGSVAEPVSDADAEGGVKKTDSADQSPEGKSEKEPRTPAGKPPQTGRNNAPAGRTPRPGARPKKRK

SEQ ID NO: 243190 - protein, 76 aa, Mycobacterium
AANAPAPGAKPKRNPKAGQPGGNGSPAAGEGEPDTDAPDTGTDTTEPQADKPSAGGQNGGAANRTPRPGARPKRRK

SEQ ID NO: 243191 - protein, 77 aa, Mycobacterium
AANAPAPGAKPNRMKKAQPGGQAGAEGEAGSATELTGESSGTSEPTTDSGATGASGTSGTTPTNRTPKPGARPKKRK

SEQ ID NO: 243192 - protein, 13 aa, Mycobacterium
AANDADPAGTAAV

SEQ ID NO: 243193 - protein, 15 aa, Mycobacterium
AANDFAAKQAQAWPK

SEQ ID NO: 243194 - protein, 7 aa, Mycobacterium
AANEAVK

SEQ ID NO: 243195 - protein, 7 aa, Mycobacterium
AANEPGA

SEQ ID NO: 243196 - protein, 8 aa, Mycobacterium
AANERGVS

SEQ ID NO: 243197 - protein, 7 aa, Mycobacterium
AANGATA

SEQ ID NO: 243198 - protein, 11 aa, Mycobacterium
AANGDTAPQPH

SEQ ID NO: 243199 - protein, 11 aa, Mycobacterium
AANGDTEGKDK

SEQ ID NO: 243200 - protein, 13 aa, Mycobacterium
AANGLDASPGSSG

SEQ ID NO: 243201 - protein, 14 aa, Mycobacterium
AANGLNKSPSSSGR

SEQ ID NO: 243202 - protein, 8 aa, Mycobacterium
AANMASGA

SEQ ID NO: 243203 - protein, 8 aa, Mycobacterium
AANNGDAP

SEQ ID NO: 243204 - protein, 17 aa, Mycobacterium
AANNNGSAFAGLGANTD

SEQ ID NO: 243205 - protein, 8 aa, Mycobacterium
AANNPSQF

SEQ ID NO: 243206 - protein, 8 aa, Mycobacterium
AANPAGAK

SEQ ID NO: 243207 - protein, 7 aa, Mycobacterium
AANPGLD

SEQ ID NO: 243208 - protein, 9 aa, Mycobacterium
AANPGSTAA

SEQ ID NO: 243209 - protein, 10 aa, Mycobacterium
AANPPPPGRA

SEQ ID NO: 243210 - protein, 10 aa, Mycobacterium
AANPRPVPEA

SEQ ID NO: 243211 - protein, 9 aa, Mycobacterium
AANPSTGSF

SEQ ID NO: 243212 - protein, 10 aa, Mycobacterium
AANPSTGSFA

SEQ ID NO: 243213 - protein, 7 aa, Mycobacterium
AANPTTC

SEQ ID NO: 243214 - protein, 18 aa, Mycobacterium
AANPYANPYAGDTSARPA

SEQ ID NO: 243215 - protein, 6 aa, Mycobacterium
AANQTL

SEQ ID NO: 243216 - protein, 36 aa, Mycobacterium
AANREAEKRNGTNGAPSNGAPAPAGPTQPDYGAPAG

SEQ ID NO: 243217 - protein, 11 aa, Mycobacterium
AANRGRRRSSA

SEQ ID NO: 243218 - protein, 7 aa, Mycobacterium
AANRPSD

SEQ ID NO: 243219 - protein, 15 aa, Mycobacterium
AANRQPATGATDDTP

SEQ ID NO: 243220 - protein, 5 aa, Mycobacterium
AANRY

SEQ ID NO: 243221 - protein, 16 aa, Mycobacterium
AANSGTLSSSPMSARR

SEQ ID NO: 243222 - protein, 31 aa, Mycobacterium
AANSNSPSSLSDTTELTSPTTLKTGSNTISV

SEQ ID NO: 243223 - protein, 10 aa, Mycobacterium
AANTSVPQKV

SEQ ID NO: 243224 - protein, 9 aa, Mycobacterium
AANVSSGAQ

SEQ ID NO: 243225 - protein, 4 aa, Mycobacterium
AAPA

SEQ ID NO: 243226 - protein, 7 aa, Mycobacterium
AAPAAAD

SEQ ID NO: 243227 - protein, 7 aa, Mycobacterium
AAPAAAR

SEQ ID NO: 243228 - protein, 24 aa, Mycobacterium
AAPAAAVAATPVEPKPAKKPMTTA

SEQ ID NO: 243229 - protein, 23 aa, Mycobacterium
AAPAADQDHEDDSAEPGEGEDRQ

SEQ ID NO: 243230 - protein, 10 aa, Mycobacterium
AAPAATRNRW

SEQ ID NO: 243231 - protein, 8 aa, Mycobacterium
AAPADGPA

SEQ ID NO: 243232 - protein, 16 aa, Mycobacterium
AAPAEARPEHTPTAPT

SEQ ID NO: 243233 - protein, 8 aa, Mycobacterium
AAPAERSV

SEQ ID NO: 243234 - protein, 6 aa, Mycobacterium
AAPAGT

SEQ ID NO: 243235 - protein, 10 aa, Mycobacterium
AAPAHGPHPL

SEQ ID NO: 243236 - protein, 5 aa, Mycobacterium
AAPAL

SEQ ID NO: 243237 - protein, 16 aa, Mycobacterium
AAPANGAAPPPAVPRR

SEQ ID NO: 243238 - protein, 18 aa, Mycobacterium
AAPANGAGPPPAAPRRPV

SEQ ID NO: 243239 - protein, 16 aa, Mycobacterium
AAPANGALPPPAVPRR

SEQ ID NO: 243240 - protein, 45 aa, Mycobacterium
AAPANPADRPAPKPAGVGAPAAPPPVPANPAPPPPTPKPPPPSTV

SEQ ID NO: 243241 - protein, 15 aa, Mycobacterium
AAPAPAEREPAPQKA

SEQ ID NO: 243242 - protein, 10 aa, Mycobacterium
AAPAPGAGID

SEQ ID NO: 243243 - protein, 7 aa, Mycobacterium
AAPAPGL

SEQ ID NO: 243244 - protein, 34 aa, Mycobacterium
AAPAPPRPFAPSPPQHTPAPAPAPMRPASDRESG

SEQ ID NO: 243245 - protein, 6 aa, Mycobacterium
AAPAPV

SEQ ID NO: 243246 - protein, 8 aa, Mycobacterium
AAPAVGSQ

SEQ ID NO: 243247 - protein, 6 aa, Mycobacterium
AAPAVS

SEQ ID NO: 243248 - protein, 20 aa, Mycobacterium
AAPDEKQGVASAVNDATREI

SEQ ID NO: 243249 - protein, 20 aa, Mycobacterium
AAPDEKQGVASAVNDTTREI

SEQ ID NO: 243250 - protein, 10 aa, Mycobacterium
AAPDLGEPRI

SEQ ID NO: 243251 - protein, 23 aa, Mycobacterium
AAPDMSETAQGTSANADITPRRL

SEQ ID NO: 243252 - protein, 17 aa, Mycobacterium
AAPDPPANARPEPKQMS

SEQ ID NO: 243253 - protein, 12 aa, Mycobacterium
AAPDQAAPHGRH

SEQ ID NO: 243254 - protein, 12 aa, Mycobacterium
AAPDSAAFTPKK

SEQ ID NO: 243255 - protein, 9 aa, Mycobacterium
AAPDSADEQ

SEQ ID NO: 243256 - protein, 12 aa, Mycobacterium
AAPDVARAGGRE

SEQ ID NO: 243257 - protein, 8 aa, Mycobacterium
AAPDVGDP

SEQ ID NO: 243258 - protein, 8 aa, Mycobacterium
AAPELPER

SEQ ID NO: 243259 - protein, 10 aa, Mycobacterium
AAPEPTTAQR

SEQ ID NO: 243260 - protein, 7 aa, Mycobacterium
AAPEPWA

SEQ ID NO: 243261 - protein, 5 aa, Mycobacterium
AAPER

SEQ ID NO: 243262 - protein, 6 aa, Mycobacterium
AAPESA

SEQ ID NO: 243263 - protein, 5 aa, Mycobacterium
AAPEV

SEQ ID NO: 243264 - protein, 4 aa, Mycobacterium
AAPF

SEQ ID NO: 243265 - protein, 6 aa, Mycobacterium
AAPGAA

SEQ ID NO: 243266 - protein, 7 aa, Mycobacterium
AAPGAVE

SEQ ID NO: 243267 - protein, 25 aa, Mycobacterium
AAPGDRPGEDQPENPEEPAQRDDFG

SEQ ID NO: 243268 - protein, 6 aa, Mycobacterium
AAPGES

SEQ ID NO: 243269 - protein, 6 aa, Mycobacterium
AAPGFP

SEQ ID NO: 243270 - protein, 8 aa, Mycobacterium
AAPGGGIA

SEQ ID NO: 243271 - protein, 16 aa, Mycobacterium
AAPGGGSPSAAPKLSD

SEQ ID NO: 243272 - protein, 6 aa, Mycobacterium
AAPGGL

SEQ ID NO: 243273 - protein, 8 aa, Mycobacterium
AAPGHDGD

SEQ ID NO: 243274 - protein, 6 aa, Mycobacterium
AAPGKS

SEQ ID NO: 243275 - protein, 26 aa, Mycobacterium
AAPGPVPAAALSPGDRPIRRPTQHVE

SEQ ID NO: 243276 - protein, 7 aa, Mycobacterium
AAPGRDA

SEQ ID NO: 243277 - protein, 8 aa, Mycobacterium
AAPGREVP

SEQ ID NO: 243278 - protein, 18 aa, Mycobacterium
AAPGRTANELARDAGTAL

SEQ ID NO: 243279 - protein, 7 aa, Mycobacterium
AAPGVDR

SEQ ID NO: 243280 - protein, 6 aa, Mycobacterium
AAPGVE

SEQ ID NO: 243281 - protein, 7 aa, Mycobacterium
AAPHADD

SEQ ID NO: 243282 - protein, 10 aa, Mycobacterium
AAPHKRPKTA

SEQ ID NO: 243283 - protein, 7 aa, Mycobacterium
AAPHTAP

SEQ ID NO: 243284 - protein, 4 aa, Mycobacterium
AAPI

SEQ ID NO: 243285 - protein, 16 aa, Mycobacterium
AAPIQTEIDLTKEGTL

SEQ ID NO: 243286 - protein, 5 aa, Mycobacterium
AAPIS

SEQ ID NO: 243287 - protein, 11 aa, Mycobacterium
AAPITDAQRTR

SEQ ID NO: 243288 - protein, 6 aa, Mycobacterium
AAPKRL

SEQ ID NO: 243289 - protein, 6 aa, Mycobacterium
AAPLAS

SEQ ID NO: 243290 - protein, 8 aa, Mycobacterium
AAPLASDT

SEQ ID NO: 243291 - protein, 16 aa, Mycobacterium
AAPLASDTLSTANSSL

SEQ ID NO: 243292 - protein, 8 aa, Mycobacterium
AAPLGNGL

SEQ ID NO: 243293 - protein, 6 aa, Mycobacterium
AAPLGY

SEQ ID NO: 243294 - protein, 12 aa, Mycobacterium
AAPLPAAAEVPV

SEQ ID NO: 243295 - protein, 5 aa, Mycobacterium
AAPLS

SEQ ID NO: 243296 - protein, 6 aa, Mycobacterium
AAPLSK

SEQ ID NO: 243297 - protein, 6 aa, Mycobacterium
AAPNGA

SEQ ID NO: 243298 - protein, 6 aa, Mycobacterium
AAPNLN

SEQ ID NO: 243299 - protein, 8 aa, Mycobacterium
AAPNPAAI

SEQ ID NO: 243300 - protein, 7 aa, Mycobacterium
AAPNPRT

SEQ ID NO: 243301 - protein, 8 aa, Mycobacterium
AAPPAESV

SEQ ID NO: 243302 - protein, 7 aa, Mycobacterium
AAPPAIG

SEQ ID NO: 243303 - protein, 8 aa, Mycobacterium
AAPPARVA

SEQ ID NO: 243304 - protein, 13 aa, Mycobacterium
AAPPAVGTHRPDL

SEQ ID NO: 243305 - protein, 14 aa, Mycobacterium
AAPPDRAFAVCLNL

SEQ ID NO: 243306 - protein, 14 aa, Mycobacterium
AAPPDRSFAVCLNR

SEQ ID NO: 243307 - protein, 14 aa, Mycobacterium
AAPPEGGDRPEVST

SEQ ID NO: 243308 - protein, 8 aa, Mycobacterium
AAPPGRRA

SEQ ID NO: 243309 - protein, 5 aa, Mycobacterium
AAPPL

SEQ ID NO: 243310 - protein, 6 aa, Mycobacterium
AAPPPA

SEQ ID NO: 243311 - protein, 10 aa, Mycobacterium
AAPPPGSGLK

SEQ ID NO: 243312 - protein, 42 aa, Mycobacterium
AAPPPQAPPAPPTPPTPPVPPTPPQPPKQTSDTSPSGPGPHS

SEQ ID NO: 243313 - protein, 7 aa, Mycobacterium
AAPPRQR

SEQ ID NO: 243314 - protein, 8 aa, Mycobacterium
AAPPRRRG

SEQ ID NO: 243315 - protein, 9 aa, Mycobacterium
AAPPSGPMP

SEQ ID NO: 243316 - protein, 6 aa, Mycobacterium
AAPPSW

SEQ ID NO: 243317 - protein, 13 aa, Mycobacterium
AAPPTGADTGTPL

SEQ ID NO: 243318 - protein, 7 aa, Mycobacterium
AAPPTMP

SEQ ID NO: 243319 - protein, 6 aa, Mycobacterium
AAPQAF

SEQ ID NO: 243320 - protein, 9 aa, Mycobacterium
AAPQAGDDE

SEQ ID NO: 243321 - protein, 16 aa, Mycobacterium
AAPQAPLAAPVPGTAG

SEQ ID NO: 243322 - protein, 9 aa, Mycobacterium
AAPQLGPSR

SEQ ID NO: 243323 - protein, 19 aa, Mycobacterium
AAPQRAQYTDGPADEHPPY

SEQ ID NO: 243324 - protein, 7 aa, Mycobacterium
AAPQRRR

SEQ ID NO: 243325 - protein, 8 aa, Mycobacterium
AAPQTTRA

SEQ ID NO: 243326 - protein, 5 aa, Mycobacterium
AAPRA

SEQ ID NO: 243327 - protein, 7 aa, Mycobacterium
AAPRAPE

SEQ ID NO: 243328 - protein, 9 aa, Mycobacterium
AAPRATPQD

SEQ ID NO: 243329 - protein, 24 aa, Mycobacterium
AAPRPTADSPPAEDAGDGSAWSAA

SEQ ID NO: 243330 - protein, 10 aa, Mycobacterium
AAPRRGAGTA

SEQ ID NO: 243331 - protein, 5 aa, Mycobacterium
AAPRS

SEQ ID NO: 243332 - protein, 6 aa, Mycobacterium
AAPRSV

SEQ ID NO: 243333 - protein, 5 aa, Mycobacterium
AAPRT

SEQ ID NO: 243334 - protein, 6 aa, Mycobacterium
AAPRTM

SEQ ID NO: 243335 - protein, 13 aa, Mycobacterium
AAPRVSDAGQPDI

SEQ ID NO: 243336 - protein, 16 aa, Mycobacterium
AAPRVSTAVGQPDIGP

SEQ ID NO: 243337 - protein, 5 aa, Mycobacterium
AAPSG

SEQ ID NO: 243338 - protein, 7 aa, Mycobacterium
AAPSGAR

SEQ ID NO: 243339 - protein, 12 aa, Mycobacterium
AAPSGEDATESV

SEQ ID NO: 243340 - protein, 6 aa, Mycobacterium
AAPSLN

SEQ ID NO: 243341 - protein, 13 aa, Mycobacterium
AAPSLRRARRAAE

SEQ ID NO: 243342 - protein, 13 aa, Mycobacterium
AAPSLRRTGRAAS

SEQ ID NO: 243343 - protein, 5 aa, Mycobacterium
AAPSM

SEQ ID NO: 243344 - protein, 14 aa, Mycobacterium
AAPSNLGQAAADRH

SEQ ID NO: 243345 - protein, 9 aa, Mycobacterium
AAPSNRGRA

SEQ ID NO: 243346 - protein, 10 aa, Mycobacterium
AAPSPRTRRP

SEQ ID NO: 243347 - protein, 33 aa, Mycobacterium
AAPSPSANDAALSAKGGRPENPSPPRTPRQRLG

SEQ ID NO: 243348 - protein, 81 aa, Mycobacterium
AAPSSAPEPTATASPTPEPTAEPEPTQEPGPTQAPQPSAEPTASPEPTVSPISDPEPTAQLEPEPEPEPAPETSTPPVEPA

SEQ ID NO: 243349 - protein, 18 aa, Mycobacterium
AAPSSFGGNVGPVGSVQE

SEQ ID NO: 243350 - protein, 6 aa, Mycobacterium
AAPSTA

SEQ ID NO: 243351 - protein, 9 aa, Mycobacterium
AAPSTGQAT

SEQ ID NO: 243352 - protein, 5 aa, Mycobacterium
AAPTA

SEQ ID NO: 243353 - protein, 8 aa, Mycobacterium
AAPTAAIT

SEQ ID NO: 243354 - protein, 11 aa, Mycobacterium
AAPTAANDPLY

SEQ ID NO: 243355 - protein, 26 aa, Mycobacterium
AAPTPPAQAAKALKSVKPPPRRQPNR

SEQ ID NO: 243356 - protein, 11 aa, Mycobacterium
AAPTPTPPPAS

SEQ ID NO: 243357 - protein, 11 aa, Mycobacterium
AAPTSQPASDL

SEQ ID NO: 243358 - protein, 6 aa, Mycobacterium
AAPTTA

SEQ ID NO: 243359 - protein, 7 aa, Mycobacterium
AAPTTGY

SEQ ID NO: 243360 - protein, 5 aa, Mycobacterium
AAPTV

SEQ ID NO: 243361 - protein, 9 aa, Mycobacterium
AAPVAAPRN

SEQ ID NO: 243362 - protein, 10 aa, Mycobacterium
AAPVASDRPR

SEQ ID NO: 243363 - protein, 5 aa, Mycobacterium
AAPVR

SEQ ID NO: 243364 - protein, 8 aa, Mycobacterium
AAPVSPRV

SEQ ID NO: 243365 - protein, 10 aa, Mycobacterium
AAPWGDASPG

SEQ ID NO: 243366 - protein, 4 aa, Mycobacterium
AAPY

SEQ ID NO: 243367 - protein, 6 aa, Mycobacterium
AAPYNC

SEQ ID NO: 243368 - protein, 4 aa, Mycobacterium
AAQA

SEQ ID NO: 243369 - protein, 8 aa, Mycobacterium
AAQAATQS

SEQ ID NO: 243370 - protein, 11 aa, Mycobacterium
AAQAEQTAMQA

SEQ ID NO: 243371 - protein, 10 aa, Mycobacterium
AAQAGAEQLA

SEQ ID NO: 243372 - protein, 8 aa, Mycobacterium
AAQAGAQS

SEQ ID NO: 243373 - protein, 7 aa, Mycobacterium
AAQAGAS

SEQ ID NO: 243374 - protein, 8 aa, Mycobacterium
AAQAGTQD

SEQ ID NO: 243375 - protein, 7 aa, Mycobacterium
AAQALTA

SEQ ID NO: 243376 - protein, 12 aa, Mycobacterium
AAQANPGDPAAM

SEQ ID NO: 243377 - protein, 13 aa, Mycobacterium
AAQAPPLKKARNV

SEQ ID NO: 243378 - protein, 10 aa, Mycobacterium
AAQAQERRAE

SEQ ID NO: 243379 - protein, 11 aa, Mycobacterium
AAQAQGALAGV

SEQ ID NO: 243380 - protein, 15 aa, Mycobacterium
AAQARAESVQAATAG

SEQ ID NO: 243381 - protein, 8 aa, Mycobacterium
AAQARPLA

SEQ ID NO: 243382 - protein, 14 aa, Mycobacterium
AAQARSVRKDPDRI

SEQ ID NO: 243383 - protein, 6 aa, Mycobacterium
AAQASA

SEQ ID NO: 243384 - protein, 14 aa, Mycobacterium
AAQASSVPGSEPER

SEQ ID NO: 243385 - protein, 8 aa, Mycobacterium
AAQATDVD

SEQ ID NO: 243386 - protein, 14 aa, Mycobacterium
AAQAVPAPQIARFM

SEQ ID NO: 243387 - protein, 8 aa, Mycobacterium
AAQAVRAG

SEQ ID NO: 243388 - protein, 11 aa, Mycobacterium
AAQDAAANSLS

SEQ ID NO: 243389 - protein, 20 aa, Mycobacterium
AAQDAPVDRHTEEGLPMRTP

SEQ ID NO: 243390 - protein, 18 aa, Mycobacterium
AAQDRAAAPAAWSAAAPT

SEQ ID NO: 243391 - protein, 12 aa, Mycobacterium
AAQDTGTKDPSI

SEQ ID NO: 243392 - protein, 6 aa, Mycobacterium
AAQEAG

SEQ ID NO: 243393 - protein, 8 aa, Mycobacterium
AAQEESRA

SEQ ID NO: 243394 - protein, 7 aa, Mycobacterium
AAQEGRN

SEQ ID NO: 243395 - protein, 5 aa, Mycobacterium
AAQEL

SEQ ID NO: 243396 - protein, 13 aa, Mycobacterium
AAQEVPAGEGMSG

SEQ ID NO: 243397 - protein, 4 aa, Mycobacterium
AAQG

SEQ ID NO: 243398 - protein, 17 aa, Mycobacterium
AAQGAGRLHDRGRNVAA

SEQ ID NO: 243399 - protein, 12 aa, Mycobacterium
AAQGAQPNTTLA

SEQ ID NO: 243400 - protein, 13 aa, Mycobacterium
AAQGGSGRGSGSR

SEQ ID NO: 243401 - protein, 13 aa, Mycobacterium
AAQGLAGSGGGSV

SEQ ID NO: 243402 - protein, 8 aa, Mycobacterium
AAQGNDAI

SEQ ID NO: 243403 - protein, 6 aa, Mycobacterium
AAQGST

SEQ ID NO: 243404 - protein, 7 aa, Mycobacterium
AAQGVND

SEQ ID NO: 243405 - protein, 5 aa, Mycobacterium
AAQGW

SEQ ID NO: 243406 - protein, 16 aa, Mycobacterium
AAQHRATAESYAAEGD

SEQ ID NO: 243407 - protein, 5 aa, Mycobacterium
AAQLG

SEQ ID NO: 243408 - protein, 7 aa, Mycobacterium
AAQLSDP

SEQ ID NO: 243409 - protein, 11 aa, Mycobacterium
AAQLSPSARVT

SEQ ID NO: 243410 - protein, 7 aa, Mycobacterium
AAQNDDL

SEQ ID NO: 243411 - protein, 13 aa, Mycobacterium
AAQPDSTLANRGY

SEQ ID NO: 243412 - protein, 6 aa, Mycobacterium
AAQPGA

SEQ ID NO: 243413 - protein, 6 aa, Mycobacterium
AAQPGG

SEQ ID NO: 243414 - protein, 6 aa, Mycobacterium
AAQPGT

SEQ ID NO: 243415 - protein, 49 aa, Mycobacterium
AAQPPGLEQHAKSNGELAAGAKDAAAQAKSAVDRANDPLSRDQEPASNN

SEQ ID NO: 243416 - protein, 9 aa, Mycobacterium
AAQPPNRIR

SEQ ID NO: 243417 - protein, 9 aa, Mycobacterium
AAQPPPAEL

SEQ ID NO: 243418 - protein, 5 aa, Mycobacterium
AAQPR

SEQ ID NO: 243419 - protein, 10 aa, Mycobacterium
AAQPSRRDYT

SEQ ID NO: 243420 - protein, 17 aa, Mycobacterium
AAQQDPAPKKVRTGPNW

SEQ ID NO: 243421 - protein, 11 aa, Mycobacterium
AAQQDTVAKGH

SEQ ID NO: 243422 - protein, 5 aa, Mycobacterium
AAQQG

SEQ ID NO: 243423 - protein, 18 aa, Mycobacterium
AAQRAADKKHNDDQAAVD

SEQ ID NO: 243424 - protein, 9 aa, Mycobacterium
AAQRGETGV

SEQ ID NO: 243425 - protein, 36 aa, Mycobacterium
AAQRNAPQGVPQPAGQPTPQPAAAAPYAAPSMSTAQ

SEQ ID NO: 243426 - protein, 8 aa, Mycobacterium
AAQRPGPR

SEQ ID NO: 243427 - protein, 17 aa, Mycobacterium
AAQRQKRAKGSGGSFTS

SEQ ID NO: 243428 - protein, 6 aa, Mycobacterium
AAQRRE

SEQ ID NO: 243429 - protein, 11 aa, Mycobacterium
AAQRRNGLKPA

SEQ ID NO: 243430 - protein, 11 aa, Mycobacterium
AAQRRNGLKPD

SEQ ID NO: 243431 - protein, 6 aa, Mycobacterium
AAQRTG

SEQ ID NO: 243432 - protein, 9 aa, Mycobacterium
AAQSETTKS

SEQ ID NO: 243433 - protein, 8 aa, Mycobacterium
AAQSGAQW

SEQ ID NO: 243434 - protein, 10 aa, Mycobacterium
AAQSGKADVQ

SEQ ID NO: 243435 - protein, 6 aa, Mycobacterium
AAQSLG

SEQ ID NO: 243436 - protein, 8 aa, Mycobacterium
AAQSPDRL

SEQ ID NO: 243437 - protein, 7 aa, Mycobacterium
AAQSSDS

SEQ ID NO: 243438 - protein, 10 aa, Mycobacterium
AAQSSESSRS

SEQ ID NO: 243439 - protein, 8 aa, Mycobacterium
AAQSTGHA

SEQ ID NO: 243440 - protein, 24 aa, Mycobacterium
AAQSVAERAPVEAGSSRRRGGGRA

SEQ ID NO: 243441 - protein, 15 aa, Mycobacterium
AAQSYRSTNPTEAIA

SEQ ID NO: 243442 - protein, 35 aa, Mycobacterium
AAQTAPADKPAPGARPVRPTSSRTGRPSGKRTPRN

SEQ ID NO: 243443 - protein, 12 aa, Mycobacterium
AAQTGGAPLAGA

SEQ ID NO: 243444 - protein, 13 aa, Mycobacterium
AAQTGGAPLPGAA

SEQ ID NO: 243445 - protein, 14 aa, Mycobacterium
AAQTGGAPLSGASA

SEQ ID NO: 243446 - protein, 42 aa, Mycobacterium
AAQTKTAVAAGSGGLDSFTPQASAVPGSDAEREAQRAGAAQT

SEQ ID NO: 243447 - protein, 5 aa, Mycobacterium
AAQTN

SEQ ID NO: 243448 - protein, 14 aa, Mycobacterium
AAQTPEEIRSILMG

SEQ ID NO: 243449 - protein, 27 aa, Mycobacterium
AAQTPRPDRSTGPDAPAAVKPAAPPVL

SEQ ID NO: 243450 - protein, 6 aa, Mycobacterium
AAQTSL

SEQ ID NO: 243451 - protein, 8 aa, Mycobacterium
AAQTSPHR

SEQ ID NO: 243452 - protein, 4 aa, Mycobacterium
AAQV

SEQ ID NO: 243453 - protein, 4 aa, Mycobacterium
AARA

SEQ ID NO: 243454 - protein, 11 aa, Mycobacterium
AARAAAPALAR

SEQ ID NO: 243455 - protein, 9 aa, Mycobacterium
AARAASRQG

SEQ ID NO: 243456 - protein, 9 aa, Mycobacterium
AARAATDNA

SEQ ID NO: 243457 - protein, 10 aa, Mycobacterium
AARAATDSAV

SEQ ID NO: 243458 - protein, 15 aa, Mycobacterium
AARADRTLEDQSSAF

SEQ ID NO: 243459 - protein, 14 aa, Mycobacterium
AARAERDRAELDAD

SEQ ID NO: 243460 - protein, 19 aa, Mycobacterium
AARAGETGDIEDAPDVVPT

SEQ ID NO: 243461 - protein, 8 aa, Mycobacterium
AARAGLPA

SEQ ID NO: 243462 - protein, 9 aa, Mycobacterium
AARAMPGSG

SEQ ID NO: 243463 - protein, 6 aa, Mycobacterium
AARAPD

SEQ ID NO: 243464 - protein, 14 aa, Mycobacterium
AARAPGKSILGRSG

SEQ ID NO: 243465 - protein, 19 aa, Mycobacterium
AARAQAQAARKAAAKERRA

SEQ ID NO: 243466 - protein, 19 aa, Mycobacterium
AARAQAQAARKAAARERRT

SEQ ID NO: 243467 - protein, 13 aa, Mycobacterium
AARAQRERAELDA

SEQ ID NO: 243468 - protein, 6 aa, Mycobacterium
AARARA

SEQ ID NO: 243469 - protein, 7 aa, Mycobacterium
AARARAE

SEQ ID NO: 243470 - protein, 9 aa, Mycobacterium
AARARARAA

SEQ ID NO: 243471 - protein, 9 aa, Mycobacterium
AARASEAAA

SEQ ID NO: 243472 - protein, 16 aa, Mycobacterium
AARASSLADETPEGRS

SEQ ID NO: 243473 - protein, 20 aa, Mycobacterium
AARATGNSGPDKWGDSGDAG

SEQ ID NO: 243474 - protein, 7 aa, Mycobacterium
AARDAGL

SEQ ID NO: 243475 - protein, 14 aa, Mycobacterium
AARDAQKKGDFAAY

SEQ ID NO: 243476 - protein, 11 aa, Mycobacterium
AARDGDPNPLT

SEQ ID NO: 243477 - protein, 5 aa, Mycobacterium
AARDH

SEQ ID NO: 243478 - protein, 11 aa, Mycobacterium
AARDKQDTNLN

SEQ ID NO: 243479 - protein, 7 aa, Mycobacterium
AARDRAQ

SEQ ID NO: 243480 - protein, 20 aa, Mycobacterium
AARDRGIPTELEGSASLPSR

SEQ ID NO: 243481 - protein, 12 aa, Mycobacterium
AARDRKGQGSAE

SEQ ID NO: 243482 - protein, 11 aa, Mycobacterium
AARDRQAPDLD

SEQ ID NO: 243483 - protein, 11 aa, Mycobacterium
AARDRQHGGAG

SEQ ID NO: 243484 - protein, 12 aa, Mycobacterium
AAREALKGTPMA

SEQ ID NO: 243485 - protein, 9 aa, Mycobacterium
AAREARRRG

SEQ ID NO: 243486 - protein, 10 aa, Mycobacterium
AAREATPNTG

SEQ ID NO: 243487 - protein, 6 aa, Mycobacterium
AAREEA

SEQ ID NO: 243488 - protein, 6 aa, Mycobacterium
AAREEF

SEQ ID NO: 243489 - protein, 13 aa, Mycobacterium
AAREERRGPTMTK

SEQ ID NO: 243490 - protein, 5 aa, Mycobacterium
AAREG

SEQ ID NO: 243491 - protein, 6 aa, Mycobacterium
AAREGT

SEQ ID NO: 243492 - protein, 5 aa, Mycobacterium
AAREK

SEQ ID NO: 243493 - protein, 5 aa, Mycobacterium
AAREQ

SEQ ID NO: 243494 - protein, 15 aa, Mycobacterium
AAREQAEKGIAGSME

SEQ ID NO: 243495 - protein, 13 aa, Mycobacterium
AAREQSAGGDSQV

SEQ ID NO: 243496 - protein, 5 aa, Mycobacterium
AARET

SEQ ID NO: 243497 - protein, 4 aa, Mycobacterium
AARG

SEQ ID NO: 243498 - protein, 12 aa, Mycobacterium
AARGAPDHPLER

SEQ ID NO: 243499 - protein, 13 aa, Mycobacterium
AARGAPDHPLERA

SEQ ID NO: 243500 - protein, 13 aa, Mycobacterium
AARGAPDQPLERA

SEQ ID NO: 243501 - protein, 9 aa, Mycobacterium
AARGEAADA

SEQ ID NO: 243502 - protein, 6 aa, Mycobacterium
AARGGA

SEQ ID NO: 243503 - protein, 8 aa, Mycobacterium
AARGGERG

SEQ ID NO: 243504 - protein, 11 aa, Mycobacterium
AARGGLTEPQL

SEQ ID NO: 243505 - protein, 8 aa, Mycobacterium
AARGGQRG

SEQ ID NO: 243506 - protein, 6 aa, Mycobacterium
AARGHA

SEQ ID NO: 243507 - protein, 13 aa, Mycobacterium
AARGKESTNDADA

SEQ ID NO: 243508 - protein, 13 aa, Mycobacterium
AARGLGARPRTGH

SEQ ID NO: 243509 - protein, 12 aa, Mycobacterium
AARGLRPRPRTG

SEQ ID NO: 243510 - protein, 13 aa, Mycobacterium
AARGLRSRPSTGH

SEQ ID NO: 243511 - protein, 7 aa, Mycobacterium
AARGNAR

SEQ ID NO: 243512 - protein, 8 aa, Mycobacterium
AARGNDRA

SEQ ID NO: 243513 - protein, 12 aa, Mycobacterium
AARGPADDSATK

SEQ ID NO: 243514 - protein, 11 aa, Mycobacterium
AARGPADTSAT

SEQ ID NO: 243515 - protein, 12 aa, Mycobacterium
AARGPGDSSATV

SEQ ID NO: 243516 - protein, 15 aa, Mycobacterium
AARGPHTADATPSGP

SEQ ID NO: 243517 - protein, 11 aa, Mycobacterium
AARGRGGHDDV

SEQ ID NO: 243518 - protein, 19 aa, Mycobacterium
AARGSTQPHNGGGHAHATD

SEQ ID NO: 243519 - protein, 6 aa, Mycobacterium
AARGVR

SEQ ID NO: 243520 - protein, 20 aa, Mycobacterium
AARHAAPESTDIDDDEHDDR

SEQ ID NO: 243521 - protein, 6 aa, Mycobacterium
AARHGA

SEQ ID NO: 243522 - protein, 7 aa, Mycobacterium
AARHHGR

SEQ ID NO: 243523 - protein, 4 aa, Mycobacterium
AARI

SEQ ID NO: 243524 - protein, 6 aa, Mycobacterium
AARIGV

SEQ ID NO: 243525 - protein, 11 aa, Mycobacterium
AARITSSPARA

SEQ ID NO: 243526 - protein, 12 aa, Mycobacterium
AARKAASKQRRS

SEQ ID NO: 243527 - protein, 4 aa, Mycobacterium
AARL

SEQ ID NO: 243528 - protein, 19 aa, Mycobacterium
AARNAAKEYLGATQQEADT

SEQ ID NO: 243529 - protein, 10 aa, Mycobacterium
AARNATRTVT

SEQ ID NO: 243530 - protein, 5 aa, Mycobacterium
AARNH

SEQ ID NO: 243531 - protein, 4 aa, Mycobacterium
AARP

SEQ ID NO: 243532 - protein, 6 aa, Mycobacterium
AARPAA

SEQ ID NO: 243533 - protein, 19 aa, Mycobacterium
AARPATPSPAQAHAANDES

SEQ ID NO: 243534 - protein, 5 aa, Mycobacterium
AARPE

SEQ ID NO: 243535 - protein, 6 aa, Mycobacterium
AARPGL

SEQ ID NO: 243536 - protein, 5 aa, Mycobacterium
AARPL

SEQ ID NO: 243537 - protein, 7 aa, Mycobacterium
AARPRHD

SEQ ID NO: 243538 - protein, 14 aa, Mycobacterium
AARPSFRTAQASAT

SEQ ID NO: 243539 - protein, 10 aa, Mycobacterium
AARPTAPPVS

SEQ ID NO: 243540 - protein, 20 aa, Mycobacterium
AARPTGLPSATQSAPAAQPE

SEQ ID NO: 243541 - protein, 7 aa, Mycobacterium
AARPTSG

SEQ ID NO: 243542 - protein, 15 aa, Mycobacterium
AARQALSAGDQERAA

SEQ ID NO: 243543 - protein, 8 aa, Mycobacterium
AARQDPAS

SEQ ID NO: 243544 - protein, 5 aa, Mycobacterium
AARQG

SEQ ID NO: 243545 - protein, 8 aa, Mycobacterium
AARQGRIQ

SEQ ID NO: 243546 - protein, 8 aa, Mycobacterium
AARQSGQT

SEQ ID NO: 243547 - protein, 8 aa, Mycobacterium
AARQVDGD

SEQ ID NO: 243548 - protein, 10 aa, Mycobacterium
AARRAAPERR

SEQ ID NO: 243549 - protein, 6 aa, Mycobacterium
AARRAG

SEQ ID NO: 243550 - protein, 7 aa, Mycobacterium
AARRDPA

SEQ ID NO: 243551 - protein, 9 aa, Mycobacterium
AARREAKRK

SEQ ID NO: 243552 - protein, 8 aa, Mycobacterium
AARRGART

SEQ ID NO: 243553 - protein, 11 aa, Mycobacterium
AARRNAESLGE

SEQ ID NO: 243554 - protein, 7 aa, Mycobacterium
AARRNRN

SEQ ID NO: 243555 - protein, 8 aa, Mycobacterium
AARRSYPA

SEQ ID NO: 243556 - protein, 16 aa, Mycobacterium
AARRVRASNLDDNIDT

SEQ ID NO: 243557 - protein, 9 aa, Mycobacterium
AARSARKGR

SEQ ID NO: 243558 - protein, 7 aa, Mycobacterium
AARSGVS

SEQ ID NO: 243559 - protein, 6 aa, Mycobacterium
AARSHL

SEQ ID NO: 243560 - protein, 6 aa, Mycobacterium
AARSLG

SEQ ID NO: 243561 - protein, 8 aa, Mycobacterium
AARSNNRW

SEQ ID NO: 243562 - protein, 7 aa, Mycobacterium
AARSQRY

SEQ ID NO: 243563 - protein, 27 aa, Mycobacterium
AARSTAVNESGMAAESAATRAAGGRYA

SEQ ID NO: 243564 - protein, 17 aa, Mycobacterium
AARSVQDYATQSSRDID

SEQ ID NO: 243565 - protein, 10 aa, Mycobacterium
AARTAERTVS

SEQ ID NO: 243566 - protein, 9 aa, Mycobacterium
AARTATDSA

SEQ ID NO: 243567 - protein, 8 aa, Mycobacterium
AARTDGAN

SEQ ID NO: 243568 - protein, 9 aa, Mycobacterium
AARTDGANA

SEQ ID NO: 243569 - protein, 6 aa, Mycobacterium
AARTGP

SEQ ID NO: 243570 - protein, 5 aa, Mycobacterium
AARTI

SEQ ID NO: 243571 - protein, 9 aa, Mycobacterium
AARTPPEKI

SEQ ID NO: 243572 - protein, 7 aa, Mycobacterium
AARTTAS

SEQ ID NO: 243573 - protein, 8 aa, Mycobacterium
AARTTGVT

SEQ ID NO: 243574 - protein, 8 aa, Mycobacterium
AARVDGAT

SEQ ID NO: 243575 - protein, 5 aa, Mycobacterium
AARYE

SEQ ID NO: 243576 - protein, 12 aa, Mycobacterium
AARYRSEPQRGP

SEQ ID NO: 243577 - protein, 4 aa, Mycobacterium
AASA

SEQ ID NO: 243578 - protein, 8 aa, Mycobacterium
AASAAAAA

SEQ ID NO: 243579 - protein, 15 aa, Mycobacterium
AASAAGAAPPHSAAD

SEQ ID NO: 243580 - protein, 7 aa, Mycobacterium
AASAAPV

SEQ ID NO: 243581 - protein, 25 aa, Mycobacterium
AASAGLGAVPSNLNPPLAAAPGDKA

SEQ ID NO: 243582 - protein, 7 aa, Mycobacterium
AASAGQL

SEQ ID NO: 243583 - protein, 5 aa, Mycobacterium
AASAI

SEQ ID NO: 243584 - protein, 10 aa, Mycobacterium
AASAPAPAAE

SEQ ID NO: 243585 - protein, 7 aa, Mycobacterium
AASAPNG

SEQ ID NO: 243586 - protein, 7 aa, Mycobacterium
AASAPRW

SEQ ID NO: 243587 - protein, 10 aa, Mycobacterium
AASASSADAA

SEQ ID NO: 243588 - protein, 6 aa, Mycobacterium
AASATG

SEQ ID NO: 243589 - protein, 9 aa, Mycobacterium
AASDAASPR

SEQ ID NO: 243590 - protein, 8 aa, Mycobacterium
AASDDLRG

SEQ ID NO: 243591 - protein, 7 aa, Mycobacterium
AASDEEY

SEQ ID NO: 243592 - protein, 6 aa, Mycobacterium
AASDGK

SEQ ID NO: 243593 - protein, 7 aa, Mycobacterium
AASDPSI

SEQ ID NO: 243594 - protein, 6 aa, Mycobacterium
AASDRR

SEQ ID NO: 243595 - protein, 10 aa, Mycobacterium
AASDSGAGAR

SEQ ID NO: 243596 - protein, 79 aa, Mycobacterium
AASDVAGGPDAAPRRTGPKGRPTPKRNEARRNAKKGPVAPAPMTSAEARARRKSLAGPKLSREERRAEKTANRARMSER

SEQ ID NO: 243597 - protein, 16 aa, Mycobacterium
AASEASAEQARSSEDR

SEQ ID NO: 243598 - protein, 5 aa, Mycobacterium
AASEY

SEQ ID NO: 243599 - protein, 7 aa, Mycobacterium
AASGAAA

SEQ ID NO: 243600 - protein, 10 aa, Mycobacterium
AASGAAGGVT

SEQ ID NO: 243601 - protein, 8 aa, Mycobacterium
AASGATLN

SEQ ID NO: 243602 - protein, 9 aa, Mycobacterium
AASGDGPVF

SEQ ID NO: 243603 - protein, 8 aa, Mycobacterium
AASGFTKP

SEQ ID NO: 243604 - protein, 12 aa, Mycobacterium
AASGFTSEPALG

SEQ ID NO: 243605 - protein, 8 aa, Mycobacterium
AASGGAGD

SEQ ID NO: 243606 - protein, 5 aa, Mycobacterium
AASGH

SEQ ID NO: 243607 - protein, 6 aa, Mycobacterium
AASGLA

SEQ ID NO: 243608 - protein, 7 aa, Mycobacterium
AASGLDR

SEQ ID NO: 243609 - protein, 8 aa, Mycobacterium
AASGQRLV

SEQ ID NO: 243610 - protein, 26 aa, Mycobacterium
AASGTAFTAEAAGSLGRASGAADESA

SEQ ID NO: 243611 - protein, 8 aa, Mycobacterium
AASGTGPV

SEQ ID NO: 243612 - protein, 6 aa, Mycobacterium
AASGTL

SEQ ID NO: 243613 - protein, 16 aa, Mycobacterium
AASGTSGAITDDAGAL

SEQ ID NO: 243614 - protein, 5 aa, Mycobacterium
AASGV

SEQ ID NO: 243615 - protein, 14 aa, Mycobacterium
AASGVRPPRAEVGQ

SEQ ID NO: 243616 - protein, 11 aa, Mycobacterium
AASHYGRQSPE

SEQ ID NO: 243617 - protein, 4 aa, Mycobacterium
AASI

SEQ ID NO: 243618 - protein, 9 aa, Mycobacterium
AASISGELR

SEQ ID NO: 243619 - protein, 7 aa, Mycobacterium
AASITTR

SEQ ID NO: 243620 - protein, 8 aa, Mycobacterium
AASKLSPL

SEQ ID NO: 243621 - protein, 14 aa, Mycobacterium
AASKPAPRPAAPTT

SEQ ID NO: 243622 - protein, 11 aa, Mycobacterium
AASKSYCGSPA

SEQ ID NO: 243623 - protein, 13 aa, Mycobacterium
AASKSYSGSPAWN

SEQ ID NO: 243624 - protein, 7 aa, Mycobacterium
AASLSEG

SEQ ID NO: 243625 - protein, 6 aa, Mycobacterium
AASLST

SEQ ID NO: 243626 - protein, 4 aa, Mycobacterium
AASM

SEQ ID NO: 243627 - protein, 10 aa, Mycobacterium
AASMSGELRS

SEQ ID NO: 243628 - protein, 4 aa, Mycobacterium
AASN

SEQ ID NO: 243629 - protein, 9 aa, Mycobacterium
AASNRNPAA

SEQ ID NO: 243630 - protein, 9 aa, Mycobacterium
AASNTSEAM

SEQ ID NO: 243631 - protein, 8 aa, Mycobacterium
AASPAQRA

SEQ ID NO: 243632 - protein, 31 aa, Mycobacterium
AASPEQGPPPSPTQPVAQHPPPPRPMPPVPA

SEQ ID NO: 243633 - protein, 6 aa, Mycobacterium
AASPGR

SEQ ID NO: 243634 - protein, 8 aa, Mycobacterium
AASPIGDA

SEQ ID NO: 243635 - protein, 5 aa, Mycobacterium
AASPL

SEQ ID NO: 243636 - protein, 6 aa, Mycobacterium
AASPLP

SEQ ID NO: 243637 - protein, 9 aa, Mycobacterium
AASPTAMGS

SEQ ID NO: 243638 - protein, 17 aa, Mycobacterium
AASPTAMGSALETGADA

SEQ ID NO: 243639 - protein, 6 aa, Mycobacterium
AASPVT

SEQ ID NO: 243640 - protein, 4 aa, Mycobacterium
AASQ

SEQ ID NO: 243641 - protein, 5 aa, Mycobacterium
AASRA

SEQ ID NO: 243642 - protein, 9 aa, Mycobacterium
AASRLESSG

SEQ ID NO: 243643 - protein, 6 aa, Mycobacterium
AASRPL

SEQ ID NO: 243644 - protein, 13 aa, Mycobacterium
AASRPPVQSLASG

SEQ ID NO: 243645 - protein, 5 aa, Mycobacterium
AASRR

SEQ ID NO: 243646 - protein, 7 aa, Mycobacterium
AASRRAS

SEQ ID NO: 243647 - protein, 8 aa, Mycobacterium
AASRSDPN

SEQ ID NO: 243648 - protein, 17 aa, Mycobacterium
AASRSVPLSPQNSESYQ

SEQ ID NO: 243649 - protein, 7 aa, Mycobacterium
AASSALA

SEQ ID NO: 243650 - protein, 11 aa, Mycobacterium
AASSANSGIYS

SEQ ID NO: 243651 - protein, 10 aa, Mycobacterium
AASSANSGVF

SEQ ID NO: 243652 - protein, 8 aa, Mycobacterium
AASSEGMR

SEQ ID NO: 243653 - protein, 6 aa, Mycobacterium
AASSFK

SEQ ID NO: 243654 - protein, 7 aa, Mycobacterium
AASSFKR

SEQ ID NO: 243655 - protein, 7 aa, Mycobacterium
AASSGAD

SEQ ID NO: 243656 - protein, 6 aa, Mycobacterium
AASSGT

SEQ ID NO: 243657 - protein, 6 aa, Mycobacterium
AASSIA

SEQ ID NO: 243658 - protein, 10 aa, Mycobacterium
AASSNSASGR

SEQ ID NO: 243659 - protein, 9 aa, Mycobacterium
AASSNTASA

SEQ ID NO: 243660 - protein, 12 aa, Mycobacterium
AASSSAPASLND

SEQ ID NO: 243661 - protein, 7 aa, Mycobacterium
AASSSAV

SEQ ID NO: 243662 - protein, 8 aa, Mycobacterium
AASSSHST

SEQ ID NO: 243663 - protein, 6 aa, Mycobacterium
AASSTV

SEQ ID NO: 243664 - protein, 4 aa, Mycobacterium
AAST

SEQ ID NO: 243665 - protein, 11 aa, Mycobacterium
AASTAQRSGIK

SEQ ID NO: 243666 - protein, 5 aa, Mycobacterium
AASTL

SEQ ID NO: 243667 - protein, 8 aa, Mycobacterium
AASTPVIG

SEQ ID NO: 243668 - protein, 8 aa, Mycobacterium
AASTTAKR

SEQ ID NO: 243669 - protein, 9 aa, Mycobacterium
AASTTSTTV

SEQ ID NO: 243670 - protein, 5 aa, Mycobacterium
AASTV

SEQ ID NO: 243671 - protein, 7 aa, Mycobacterium
AASYQGN

SEQ ID NO: 243672 - protein, 5 aa, Mycobacterium
AATAA

SEQ ID NO: 243673 - protein, 14 aa, Mycobacterium
AATAADGAVAVASS

SEQ ID NO: 243674 - protein, 10 aa, Mycobacterium
AATAATSRAT

SEQ ID NO: 243675 - protein, 5 aa, Mycobacterium
AATAG

SEQ ID NO: 243676 - protein, 6 aa, Mycobacterium
AATAGA

SEQ ID NO: 243677 - protein, 9 aa, Mycobacterium
AATAGAGPI

SEQ ID NO: 243678 - protein, 7 aa, Mycobacterium
AATAGLS

SEQ ID NO: 243679 - protein, 20 aa, Mycobacterium
AATAGVPARSVPAETAGAVS

SEQ ID NO: 243680 - protein, 19 aa, Mycobacterium
AATAKQEGNQWKISNLLQM

SEQ ID NO: 243681 - protein, 6 aa, Mycobacterium
AATANP

SEQ ID NO: 243682 - protein, 6 aa, Mycobacterium
AATAPS

SEQ ID NO: 243683 - protein, 104 aa, Mycobacterium
AATARAPHDPTHPSAPEAARPSRSGGPARTELGSAQSGPSSAGTKEIQTRASQPSDPPTTRLTAPGAPPARGSSNPAPPAQTRPTTPAPPAPAPPPAPSAGQTR

SEQ ID NO: 243684 - protein, 6 aa, Mycobacterium
AATART

SEQ ID NO: 243685 - protein, 11 aa, Mycobacterium
AATASDPQTQR

SEQ ID NO: 243686 - protein, 10 aa, Mycobacterium
AATASEFNDQ

SEQ ID NO: 243687 - protein, 12 aa, Mycobacterium
AATASHGTGSAL

SEQ ID NO: 243688 - protein, 9 aa, Mycobacterium
AATASSALA

SEQ ID NO: 243689 - protein, 5 aa, Mycobacterium
AATAT

SEQ ID NO: 243690 - protein, 19 aa, Mycobacterium
AATATQEGNQWKISNLQQV

SEQ ID NO: 243691 - protein, 12 aa, Mycobacterium
AATATRRRKDPT

SEQ ID NO: 243692 - protein, 6 aa, Mycobacterium
AATDAE

SEQ ID NO: 243693 - protein, 7 aa, Mycobacterium
AATDDAV

SEQ ID NO: 243694 - protein, 9 aa, Mycobacterium
AATDDHLRT

SEQ ID NO: 243695 - protein, 9 aa, Mycobacterium
AATDEKLTQ

SEQ ID NO: 243696 - protein, 9 aa, Mycobacterium
AATDESLTE

SEQ ID NO: 243697 - protein, 11 aa, Mycobacterium
AATDGPPPSLS

SEQ ID NO: 243698 - protein, 6 aa, Mycobacterium
AATDGT

SEQ ID NO: 243699 - protein, 6 aa, Mycobacterium
AATDHR

SEQ ID NO: 243700 - protein, 6 aa, Mycobacterium
AATDNR

SEQ ID NO: 243701 - protein, 8 aa, Mycobacterium
AATDPGLT

SEQ ID NO: 243702 - protein, 8 aa, Mycobacterium
AATDSLQG

SEQ ID NO: 243703 - protein, 8 aa, Mycobacterium
AATDSRRA

SEQ ID NO: 243704 - protein, 12 aa, Mycobacterium
AATDYDRSTVEE

SEQ ID NO: 243705 - protein, 13 aa, Mycobacterium
AATEEIERARTTV

SEQ ID NO: 243706 - protein, 13 aa, Mycobacterium
AATEEVERARNTV

SEQ ID NO: 243707 - protein, 9 aa, Mycobacterium
AATEGRRTE

SEQ ID NO: 243708 - protein, 8 aa, Mycobacterium
AATEGSGA

SEQ ID NO: 243709 - protein, 7 aa, Mycobacterium
AATEGVE

SEQ ID NO: 243710 - protein, 4 aa, Mycobacterium
AATG

SEQ ID NO: 243711 - protein, 10 aa, Mycobacterium
AATGAPAPSV

SEQ ID NO: 243712 - protein, 8 aa, Mycobacterium
AATGEESV

SEQ ID NO: 243713 - protein, 10 aa, Mycobacterium
AATGEPGCAT

SEQ ID NO: 243714 - protein, 13 aa, Mycobacterium
AATGGAPNRERGH

SEQ ID NO: 243715 - protein, 11 aa, Mycobacterium
AATGGPPPSVS

SEQ ID NO: 243716 - protein, 10 aa, Mycobacterium
AATGGRPLPE

SEQ ID NO: 243717 - protein, 6 aa, Mycobacterium
AATGHA

SEQ ID NO: 243718 - protein, 10 aa, Mycobacterium
AATGINATPT

SEQ ID NO: 243719 - protein, 6 aa, Mycobacterium
AATGKV

SEQ ID NO: 243720 - protein, 5 aa, Mycobacterium
AATGL

SEQ ID NO: 243721 - protein, 7 aa, Mycobacterium
AATGNAR

SEQ ID NO: 243722 - protein, 7 aa, Mycobacterium
AATGPGV

SEQ ID NO: 243723 - protein, 7 aa, Mycobacterium
AATGPMR

SEQ ID NO: 243724 - protein, 12 aa, Mycobacterium
AATGSATTLTPF

SEQ ID NO: 243725 - protein, 11 aa, Mycobacterium
AATGSNPTVPT

SEQ ID NO: 243726 - protein, 9 aa, Mycobacterium
AATGSSNSI

SEQ ID NO: 243727 - protein, 26 aa, Mycobacterium
AATGTGVQAPAPTDLSQLTANGIPCV

SEQ ID NO: 243728 - protein, 7 aa, Mycobacterium
AATGTPA

SEQ ID NO: 243729 - protein, 27 aa, Mycobacterium
AATGVRPTSGSADPSAAGDRRPPCSAE

SEQ ID NO: 243730 - protein, 12 aa, Mycobacterium
AATGVSAPPAAM

SEQ ID NO: 243731 - protein, 14 aa, Mycobacterium
AATGYRAPEGEYET

SEQ ID NO: 243732 - protein, 7 aa, Mycobacterium
AATKEGV

SEQ ID NO: 243733 - protein, 5 aa, Mycobacterium
AATKV

SEQ ID NO: 243734 - protein, 5 aa, Mycobacterium
AATLP

SEQ ID NO: 243735 - protein, 12 aa, Mycobacterium
AATLPGATAPRI

SEQ ID NO: 243736 - protein, 4 aa, Mycobacterium
AATM

SEQ ID NO: 243737 - protein, 7 aa, Mycobacterium
AATNHRR

SEQ ID NO: 243738 - protein, 9 aa, Mycobacterium
AATNNRNGA

SEQ ID NO: 243739 - protein, 9 aa, Mycobacterium
AATNNRRGT

SEQ ID NO: 243740 - protein, 14 aa, Mycobacterium
AATNSGDEPAAAEI

SEQ ID NO: 243741 - protein, 10 aa, Mycobacterium
AATNTPRRAF

SEQ ID NO: 243742 - protein, 4 aa, Mycobacterium
AATP

SEQ ID NO: 243743 - protein, 14 aa, Mycobacterium
AATPAASTASGKRS

SEQ ID NO: 243744 - protein, 7 aa, Mycobacterium
AATPAGA

SEQ ID NO: 243745 - protein, 6 aa, Mycobacterium
AATPAI

SEQ ID NO: 243746 - protein, 16 aa, Mycobacterium
AATPARQPPLPPPPTL

SEQ ID NO: 243747 - protein, 7 aa, Mycobacterium
AATPDSV

SEQ ID NO: 243748 - protein, 7 aa, Mycobacterium
AATPEQV

SEQ ID NO: 243749 - protein, 8 aa, Mycobacterium
AATPGDAK

SEQ ID NO: 243750 - protein, 13 aa, Mycobacterium
AATPLTAPGAGDL

SEQ ID NO: 243751 - protein, 8 aa, Mycobacterium
AATPPQWP

SEQ ID NO: 243752 - protein, 7 aa, Mycobacterium
AATPQRL

SEQ ID NO: 243753 - protein, 8 aa, Mycobacterium
AATPSQLS

SEQ ID NO: 243754 - protein, 5 aa, Mycobacterium
AATPT

SEQ ID NO: 243755 - protein, 8 aa, Mycobacterium
AATPYPGT

SEQ ID NO: 243756 - protein, 12 aa, Mycobacterium
AATQSQPPLAPN

SEQ ID NO: 243757 - protein, 8 aa, Mycobacterium
AATRAGGL

SEQ ID NO: 243758 - protein, 13 aa, Mycobacterium
AATRARDEQRRRS

SEQ ID NO: 243759 - protein, 15 aa, Mycobacterium
AATRARQARRASREA

SEQ ID NO: 243760 - protein, 6 aa, Mycobacterium
AATRDL

SEQ ID NO: 243761 - protein, 14 aa, Mycobacterium
AATRDPAGRYADAG

SEQ ID NO: 243762 - protein, 6 aa, Mycobacterium
AATREL

SEQ ID NO: 243763 - protein, 6 aa, Mycobacterium
AATRPA

SEQ ID NO: 243764 - protein, 6 aa, Mycobacterium
AATRQG

SEQ ID NO: 243765 - protein, 16 aa, Mycobacterium
AATRSVPISPTNSDSY

SEQ ID NO: 243766 - protein, 16 aa, Mycobacterium
AATRSVPLSPTDSQAY

SEQ ID NO: 243767 - protein, 4 aa, Mycobacterium
AATS

SEQ ID NO: 243768 - protein, 30 aa, Mycobacterium
AATSAGPDAGSVGLSRKPVGGVGGDERAGL

SEQ ID NO: 243769 - protein, 10 aa, Mycobacterium
AATSDENRPL

SEQ ID NO: 243770 - protein, 16 aa, Mycobacterium
AATSGAAVVIETMLHA

SEQ ID NO: 243771 - protein, 10 aa, Mycobacterium
AATSGDGAVR

SEQ ID NO: 243772 - protein, 12 aa, Mycobacterium
AATSPAPPRPTV

SEQ ID NO: 243773 - protein, 9 aa, Mycobacterium
AATSPLSKL

SEQ ID NO: 243774 - protein, 16 aa, Mycobacterium
AATSQTTTSTTEPGAT

SEQ ID NO: 243775 - protein, 5 aa, Mycobacterium
AATSR

SEQ ID NO: 243776 - protein, 13 aa, Mycobacterium
AATSRLRAASRQS

SEQ ID NO: 243777 - protein, 6 aa, Mycobacterium
AATSWG

SEQ ID NO: 243778 - protein, 8 aa, Mycobacterium
AATTASAR

SEQ ID NO: 243779 - protein, 6 aa, Mycobacterium
AATTGI

SEQ ID NO: 243780 - protein, 7 aa, Mycobacterium
AATTGNP

SEQ ID NO: 243781 - protein, 8 aa, Mycobacterium
AATTIGAT

SEQ ID NO: 243782 - protein, 18 aa, Mycobacterium
AATTSGGAGTRAKDINRQ

SEQ ID NO: 243783 - protein, 5 aa, Mycobacterium
AATTT

SEQ ID NO: 243784 - protein, 8 aa, Mycobacterium
AATTTARE

SEQ ID NO: 243785 - protein, 8 aa, Mycobacterium
AATTTSRE

SEQ ID NO: 243786 - protein, 5 aa, Mycobacterium
AATVA

SEQ ID NO: 243787 - protein, 20 aa, Mycobacterium
AATYGGHNPSADDHGNHHHP

SEQ ID NO: 243788 - protein, 12 aa, Mycobacterium
AATYKDISEGST

SEQ ID NO: 243789 - protein, 12 aa, Mycobacterium
AATYKDMSDGAR

SEQ ID NO: 243790 - protein, 5 aa, Mycobacterium
AATYR

SEQ ID NO: 243791 - protein, 8 aa, Mycobacterium
AAVAGRPG

SEQ ID NO: 243792 - protein, 19 aa, Mycobacterium
AAVAPGPAHPAAPDSWAQV

SEQ ID NO: 243793 - protein, 6 aa, Mycobacterium
AAVATS

SEQ ID NO: 243794 - protein, 4 aa, Mycobacterium
AAVD

SEQ ID NO: 243795 - protein, 12 aa, Mycobacterium
AAVDPQAPARAL

SEQ ID NO: 243796 - protein, 25 aa, Mycobacterium
AAVEHGAKTASRCEEPAIPAALTGK

SEQ ID NO: 243797 - protein, 11 aa, Mycobacterium
AAVEPGSSGRV

SEQ ID NO: 243798 - protein, 5 aa, Mycobacterium
AAVGG

SEQ ID NO: 243799 - protein, 6 aa, Mycobacterium
AAVGGA

SEQ ID NO: 243800 - protein, 13 aa, Mycobacterium
AAVGGSAAQRRAA

SEQ ID NO: 243801 - protein, 6 aa, Mycobacterium
AAVGPA

SEQ ID NO: 243802 - protein, 12 aa, Mycobacterium
AAVGTTVAAAGG

SEQ ID NO: 243803 - protein, 10 aa, Mycobacterium
AAVNDPPTPL

SEQ ID NO: 243804 - protein, 9 aa, Mycobacterium
AAVNPGDLT

SEQ ID NO: 243805 - protein, 9 aa, Mycobacterium
AAVPAGDAA

SEQ ID NO: 243806 - protein, 10 aa, Mycobacterium
AAVPGPMGAP

SEQ ID NO: 243807 - protein, 16 aa, Mycobacterium
AAVPGSRRQWERDPHD

SEQ ID NO: 243808 - protein, 13 aa, Mycobacterium
AAVPNGGKLPPTV

SEQ ID NO: 243809 - protein, 13 aa, Mycobacterium
AAVPPDTTGPEVP

SEQ ID NO: 243810 - protein, 7 aa, Mycobacterium
AAVPPNA

SEQ ID NO: 243811 - protein, 21 aa, Mycobacterium
AAVPTAQAEPNAEANSAGNCP

SEQ ID NO: 243812 - protein, 6 aa, Mycobacterium
AAVPTT

SEQ ID NO: 243813 - protein, 4 aa, Mycobacterium
AAVR

SEQ ID NO: 243814 - protein, 14 aa, Mycobacterium
AAVRNRKAGQAAGV

SEQ ID NO: 243815 - protein, 8 aa, Mycobacterium
AAVRSRGA

SEQ ID NO: 243816 - protein, 9 aa, Mycobacterium
AAVSAQPNH

SEQ ID NO: 243817 - protein, 19 aa, Mycobacterium
AAVTEDDAADDGSLPPDDV

SEQ ID NO: 243818 - protein, 6 aa, Mycobacterium
AAVTGA

SEQ ID NO: 243819 - protein, 11 aa, Mycobacterium
AAVTGAHAPLT

SEQ ID NO: 243820 - protein, 6 aa, Mycobacterium
AAVTTT

SEQ ID NO: 243821 - protein, 10 aa, Mycobacterium
AAVYGSGLPS

SEQ ID NO: 243822 - protein, 6 aa, Mycobacterium
AAWADA

SEQ ID NO: 243823 - protein, 11 aa, Mycobacterium
AAWEGPSAQSY

SEQ ID NO: 243824 - protein, 4 aa, Mycobacterium
AAWG

SEQ ID NO: 243825 - protein, 11 aa, Mycobacterium
AAWQGPSAQSY

SEQ ID NO: 243826 - protein, 7 aa, Mycobacterium
AAYAAPE

SEQ ID NO: 243827 - protein, 9 aa, Mycobacterium
AAYAGENAA

SEQ ID NO: 243828 - protein, 4 aa, Mycobacterium
AAYD

SEQ ID NO: 243829 - protein, 12 aa, Mycobacterium
AAYEGLKGTSLA

SEQ ID NO: 243830 - protein, 10 aa, Mycobacterium
AAYERRSGED

SEQ ID NO: 243831 - protein, 6 aa, Mycobacterium
AAYGKP

SEQ ID NO: 243832 - protein, 8 aa, Mycobacterium
AAYGPKAP

SEQ ID NO: 243833 - protein, 5 aa, Mycobacterium
AAYPQ

SEQ ID NO: 243834 - protein, 4 aa, Mycobacterium
AAYR

SEQ ID NO: 243835 - protein, 6 aa, Mycobacterium
AAYSDD

SEQ ID NO: 243836 - protein, 8 aa, Mycobacterium
ACANQGPG

SEQ ID NO: 243837 - protein, 7 aa, Mycobacterium
ACAPGAS

SEQ ID NO: 243838 - protein, 8 aa, Mycobacterium
ACAPGSSH

SEQ ID NO: 243839 - protein, 10 aa, Mycobacterium
ACDGNEPATV

SEQ ID NO: 243840 - protein, 6 aa, Mycobacterium
ACEPEV

SEQ ID NO: 243841 - protein, 7 aa, Mycobacterium
ACGKSSA

SEQ ID NO: 243842 - protein, 7 aa, Mycobacterium
ACGKTAT

SEQ ID NO: 243843 - protein, 8 aa, Mycobacterium
ACGSPSVG

SEQ ID NO: 243844 - protein, 4 aa, Mycobacterium
ACPD

SEQ ID NO: 243845 - protein, 4 aa, Mycobacterium
ACPG

SEQ ID NO: 243846 - protein, 7 aa, Mycobacterium
ACPGNGD

SEQ ID NO: 243847 - protein, 4 aa, Mycobacterium
ACPP

SEQ ID NO: 243848 - protein, 6 aa, Mycobacterium
ACPPDL

SEQ ID NO: 243849 - protein, 7 aa, Mycobacterium
ACPPGSS

SEQ ID NO: 243850 - protein, 5 aa, Mycobacterium
ACPPS

SEQ ID NO: 243851 - protein, 4 aa, Mycobacterium
ACPT

SEQ ID NO: 243852 - protein, 5 aa, Mycobacterium
ACPTN

SEQ ID NO: 243853 - protein, 30 aa, Mycobacterium
ACSSATSKAVNRSGIAAESTATKAAAGQYA

SEQ ID NO: 243854 - protein, 13 aa, Mycobacterium
ACTPPARRAVTAR

SEQ ID NO: 243855 - protein, 8 aa, Mycobacterium
ADAAADDL

SEQ ID NO: 243856 - protein, 7 aa, Mycobacterium
ADAADHQ

SEQ ID NO: 243857 - protein, 15 aa, Mycobacterium
ADAAEERSADVTGPT

SEQ ID NO: 243858 - protein, 8 aa, Mycobacterium
ADAAFEAG

SEQ ID NO: 243859 - protein, 7 aa, Mycobacterium
ADAAGAA

SEQ ID NO: 243860 - protein, 6 aa, Mycobacterium
ADAAGD

SEQ ID NO: 243861 - protein, 14 aa, Mycobacterium
ADAAHSAQPNTSLA

SEQ ID NO: 243862 - protein, 7 aa, Mycobacterium
ADAAPAQ

SEQ ID NO: 243863 - protein, 33 aa, Mycobacterium
ADAARASEVGSAQPGGQPYSPGQAGPPPPPPWT

SEQ ID NO: 243864 - protein, 10 aa, Mycobacterium
ADAARSGVPV

SEQ ID NO: 243865 - protein, 15 aa, Mycobacterium
ADAATSTPVQRQDGV

SEQ ID NO: 243866 - protein, 6 aa, Mycobacterium
ADAATT

SEQ ID NO: 243867 - protein, 9 aa, Mycobacterium
ADADGHAAG

SEQ ID NO: 243868 - protein, 9 aa, Mycobacterium
ADADMPRSA

SEQ ID NO: 243869 - protein, 12 aa, Mycobacterium
ADAEEPAGPPRK

SEQ ID NO: 243870 - protein, 7 aa, Mycobacterium
ADAEQTR

SEQ ID NO: 243871 - protein, 7 aa, Mycobacterium
ADAERTK

SEQ ID NO: 243872 - protein, 18 aa, Mycobacterium
ADAGADPASAPDPPADVT

SEQ ID NO: 243873 - protein, 6 aa, Mycobacterium
ADAGEP

SEQ ID NO: 243874 - protein, 6 aa, Mycobacterium
ADAGID

SEQ ID NO: 243875 - protein, 5 aa, Mycobacterium
ADAGL

SEQ ID NO: 243876 - protein, 10 aa, Mycobacterium
ADAGNPVTQT

SEQ ID NO: 243877 - protein, 8 aa, Mycobacterium
ADAGPMEI

SEQ ID NO: 243878 - protein, 6 aa, Mycobacterium
ADAGQP

SEQ ID NO: 243879 - protein, 14 aa, Mycobacterium
ADAGRAAEELIRTW

SEQ ID NO: 243880 - protein, 8 aa, Mycobacterium
ADAGRGLG

SEQ ID NO: 243881 - protein, 25 aa, Mycobacterium
ADAGRQVESGADGIAGNLASAGHGA

SEQ ID NO: 243882 - protein, 7 aa, Mycobacterium
ADAGTPQ

SEQ ID NO: 243883 - protein, 7 aa, Mycobacterium
ADAHGQV

SEQ ID NO: 243884 - protein, 14 aa, Mycobacterium
ADAIANPDPDRRGD

SEQ ID NO: 243885 - protein, 13 aa, Mycobacterium
ADAIANPDPDRRR

SEQ ID NO: 243886 - protein, 10 aa, Mycobacterium
ADAIKGTPFE

SEQ ID NO: 243887 - protein, 21 aa, Mycobacterium
ADAKAESEKVTEEAKQDSERI

SEQ ID NO: 243888 - protein, 6 aa, Mycobacterium
ADAKDP

SEQ ID NO: 243889 - protein, 23 aa, Mycobacterium
ADALTERGKVTPMGEAHDTQARR

SEQ ID NO: 243890 - protein, 4 aa, Mycobacterium
ADAM

SEQ ID NO: 243891 - protein, 7 aa, Mycobacterium
ADANTNA

SEQ ID NO: 243892 - protein, 4 aa, Mycobacterium
ADAP

SEQ ID NO: 243893 - protein, 9 aa, Mycobacterium
ADAPADQRV

SEQ ID NO: 243894 - protein, 8 aa, Mycobacterium
ADAPPDEA

SEQ ID NO: 243895 - protein, 16 aa, Mycobacterium
ADAPSASEESGPPRGV

SEQ ID NO: 243896 - protein, 18 aa, Mycobacterium
ADAPSQAPDDARAMIDSM

SEQ ID NO: 243897 - protein, 7 aa, Mycobacterium
ADAPVQS

SEQ ID NO: 243898 - protein, 7 aa, Mycobacterium
ADAPVSA

SEQ ID NO: 243899 - protein, 4 aa, Mycobacterium
ADAQ

SEQ ID NO: 243900 - protein, 5 aa, Mycobacterium
ADAQP

SEQ ID NO: 243901 - protein, 12 aa, Mycobacterium
ADAQPSAHIVTG

SEQ ID NO: 243902 - protein, 7 aa, Mycobacterium
ADARAAI

SEQ ID NO: 243903 - protein, 32 aa, Mycobacterium
ADARDDLGALPPERRASAALPVGGGGAAEAAV

SEQ ID NO: 243904 - protein, 32 aa, Mycobacterium
ADARDDLGALPTGGGSSDAVPVGAGGASESPQ

SEQ ID NO: 243905 - protein, 8 aa, Mycobacterium
ADARPSTS

SEQ ID NO: 243906 - protein, 5 aa, Mycobacterium
ADARR

SEQ ID NO: 243907 - protein, 39 aa, Mycobacterium
ADARRPTSASSRKKAPEPDTAEAPAVTATPQEKPRPQWR

SEQ ID NO: 243908 - protein, 8 aa, Mycobacterium
ADARTAIG

SEQ ID NO: 243909 - protein, 9 aa, Mycobacterium
ADASAGQAR

SEQ ID NO: 243910 - protein, 10 aa, Mycobacterium
ADASDNAAAP

SEQ ID NO: 243911 - protein, 6 aa, Mycobacterium
ADASEP

SEQ ID NO: 243912 - protein, 8 aa, Mycobacterium
ADASGADQ

SEQ ID NO: 243913 - protein, 10 aa, Mycobacterium
ADASGAENMA

SEQ ID NO: 243914 - protein, 9 aa, Mycobacterium
ADASGAGAA

SEQ ID NO: 243915 - protein, 8 aa, Mycobacterium
ADASGFKH

SEQ ID NO: 243916 - protein, 7 aa, Mycobacterium
ADASGFR

SEQ ID NO: 243917 - protein, 12 aa, Mycobacterium
ADASPEEHVPAG

SEQ ID NO: 243918 - protein, 4 aa, Mycobacterium
ADAT

SEQ ID NO: 243919 - protein, 6 aa, Mycobacterium
ADATDE

SEQ ID NO: 243920 - protein, 28 aa, Mycobacterium
ADATEESEEPRTKLQNRRPTGKGSHRMR

SEQ ID NO: 243921 - protein, 6 aa, Mycobacterium
ADATGE

SEQ ID NO: 243922 - protein, 7 aa, Mycobacterium
ADATGES

SEQ ID NO: 243923 - protein, 14 aa, Mycobacterium
ADATGPSDHSPKPD

SEQ ID NO: 243924 - protein, 7 aa, Mycobacterium
ADATRER

SEQ ID NO: 243925 - protein, 8 aa, Mycobacterium
ADATTDEV

SEQ ID NO: 243926 - protein, 28 aa, Mycobacterium
ADAVESETTADGGENPAEGESAEGPRMR

SEQ ID NO: 243927 - protein, 16 aa, Mycobacterium
ADAVTAGGQVAESAGH

SEQ ID NO: 243928 - protein, 7 aa, Mycobacterium
ADCPQTR

SEQ ID NO: 243929 - protein, 8 aa, Mycobacterium
ADDAEGQR

SEQ ID NO: 243930 - protein, 7 aa, Mycobacterium
ADDAPDK

SEQ ID NO: 243931 - protein, 8 aa, Mycobacterium
ADDAPKAL

SEQ ID NO: 243932 - protein, 66 aa, Mycobacterium
ADDAPTGEIPAAGAQTEERTSAVATAEREGPTETMPTEESPTETIAKTEDDPKTEVIPSAREEPKK

SEQ ID NO: 243933 - protein, 9 aa, Mycobacterium
ADDARPNAS

SEQ ID NO: 243934 - protein, 8 aa, Mycobacterium
ADDARRRL

SEQ ID NO: 243935 - protein, 15 aa, Mycobacterium
ADDATAPAGHLGKEY

SEQ ID NO: 243936 - protein, 7 aa, Mycobacterium
ADDDFST

SEQ ID NO: 243937 - protein, 10 aa, Mycobacterium
ADDDFSTTER

SEQ ID NO: 243938 - protein, 7 aa, Mycobacterium
ADDDGVT

SEQ ID NO: 243939 - protein, 10 aa, Mycobacterium
ADDDITTASE

SEQ ID NO: 243940 - protein, 9 aa, Mycobacterium
ADDDLTTGT

SEQ ID NO: 243941 - protein, 5 aa, Mycobacterium
ADDDM

SEQ ID NO: 243942 - protein, 6 aa, Mycobacterium
ADDDQA

SEQ ID NO: 243943 - protein, 8 aa, Mycobacterium
ADDDSITS

SEQ ID NO: 243944 - protein, 12 aa, Mycobacterium
ADDDTSQDRSPF

SEQ ID NO: 243945 - protein, 15 aa, Mycobacterium
ADDDVQTDRLRRAPA

SEQ ID NO: 243946 - protein, 5 aa, Mycobacterium
ADDEF

SEQ ID NO: 243947 - protein, 8 aa, Mycobacterium
ADDEPAAA

SEQ ID NO: 243948 - protein, 17 aa, Mycobacterium
ADDEPAAASAHATAARD

SEQ ID NO: 243949 - protein, 10 aa, Mycobacterium
ADDEQAVAQG

SEQ ID NO: 243950 - protein, 22 aa, Mycobacterium
ADDETDEVEGQDAAEAAAPRGR

SEQ ID NO: 243951 - protein, 7 aa, Mycobacterium
ADDETVA

SEQ ID NO: 243952 - protein, 12 aa, Mycobacterium
ADDFHRQVATPA

SEQ ID NO: 243953 - protein, 6 aa, Mycobacterium
ADDGAA

SEQ ID NO: 243954 - protein, 7 aa, Mycobacterium
ADDGAGG

SEQ ID NO: 243955 - protein, 6 aa, Mycobacterium
ADDGLP

SEQ ID NO: 243956 - protein, 5 aa, Mycobacterium
ADDGR

SEQ ID NO: 243957 - protein, 7 aa, Mycobacterium
ADDGTPL

SEQ ID NO: 243958 - protein, 6 aa, Mycobacterium
ADDIGR

SEQ ID NO: 243959 - protein, 21 aa, Mycobacterium
ADDISVGPGLSSAPARRRRGT

SEQ ID NO: 243960 - protein, 14 aa, Mycobacterium
ADDKPTAGESRGIR

SEQ ID NO: 243961 - protein, 6 aa, Mycobacterium
ADDMSK

SEQ ID NO: 243962 - protein, 7 aa, Mycobacterium
ADDNSIH

SEQ ID NO: 243963 - protein, 9 aa, Mycobacterium
ADDNSITSL

SEQ ID NO: 243964 - protein, 9 aa, Mycobacterium
ADDPAEANR

SEQ ID NO: 243965 - protein, 7 aa, Mycobacterium
ADDPATV

SEQ ID NO: 243966 - protein, 11 aa, Mycobacterium
ADDPDGAQSRY

SEQ ID NO: 243967 - protein, 9 aa, Mycobacterium
ADDPEGAQA

SEQ ID NO: 243968 - protein, 7 aa, Mycobacterium
ADDPNVD

SEQ ID NO: 243969 - protein, 18 aa, Mycobacterium
ADDPPHGPKKTSRAGRDL

SEQ ID NO: 243970 - protein, 9 aa, Mycobacterium
ADDPRPNAS

SEQ ID NO: 243971 - protein, 6 aa, Mycobacterium
ADDPTP

SEQ ID NO: 243972 - protein, 7 aa, Mycobacterium
ADDPTRV

SEQ ID NO: 243973 - protein, 9 aa, Mycobacterium
ADDRAHAAQ

SEQ ID NO: 243974 - protein, 6 aa, Mycobacterium
ADDRDA

SEQ ID NO: 243975 - protein, 6 aa, Mycobacterium
ADDREL

SEQ ID NO: 243976 - protein, 10 aa, Mycobacterium
ADDRKMDRPA

SEQ ID NO: 243977 - protein, 5 aa, Mycobacterium
ADDRP

SEQ ID NO: 243978 - protein, 4 aa, Mycobacterium
ADDS

SEQ ID NO: 243979 - protein, 8 aa, Mycobacterium
ADDSGNRA

SEQ ID NO: 243980 - protein, 10 aa, Mycobacterium
ADDSPTGEMP

SEQ ID NO: 243981 - protein, 8 aa, Mycobacterium
ADDSPTLE

SEQ ID NO: 243982 - protein, 7 aa, Mycobacterium
ADDTDPR

SEQ ID NO: 243983 - protein, 9 aa, Mycobacterium
ADDTGADVA

SEQ ID NO: 243984 - protein, 10 aa, Mycobacterium
ADDVDQARDD

SEQ ID NO: 243985 - protein, 7 aa, Mycobacterium
ADDVPNQ

SEQ ID NO: 243986 - protein, 12 aa, Mycobacterium
ADDVPVTGASAR

SEQ ID NO: 243987 - protein, 12 aa, Mycobacterium
ADEAADGVSSGR

SEQ ID NO: 243988 - protein, 11 aa, Mycobacterium
ADEADTRAHSA

SEQ ID NO: 243989 - protein, 5 aa, Mycobacterium
ADEAL

SEQ ID NO: 243990 - protein, 8 aa, Mycobacterium
ADEAPDAV

SEQ ID NO: 243991 - protein, 6 aa, Mycobacterium
ADEAQL

SEQ ID NO: 243992 - protein, 6 aa, Mycobacterium
ADEARA

SEQ ID NO: 243993 - protein, 10 aa, Mycobacterium
ADEASGLTAT

SEQ ID NO: 243994 - protein, 4 aa, Mycobacterium
ADED

SEQ ID NO: 243995 - protein, 9 aa, Mycobacterium
ADEDKSALL

SEQ ID NO: 243996 - protein, 9 aa, Mycobacterium
ADEDRTRSE

SEQ ID NO: 243997 - protein, 8 aa, Mycobacterium
ADEEDTPD

SEQ ID NO: 243998 - protein, 42 aa, Mycobacterium
ADEEPYADEDAFADGAGDEYPEFPPRRSGPSSAEPPAASPSL

SEQ ID NO: 243999 - protein, 32 aa, Mycobacterium
ADEGDGESGGDAENADDQADERARARKEREAR

SEQ ID NO: 244000 - protein, 5 aa, Mycobacterium
ADEGL

SEQ ID NO: 244001 - protein, 19 aa, Mycobacterium
ADEGPTATCPDGKRDGSVY

SEQ ID NO: 244002 - protein, 10 aa, Mycobacterium
ADEGRLPSSL

SEQ ID NO: 244003 - protein, 30 aa, Mycobacterium
ADEGTDPRTKASPSAAQVAPGASLAGQPNT

SEQ ID NO: 244004 - protein, 5 aa, Mycobacterium
ADEHL

SEQ ID NO: 244005 - protein, 6 aa, Mycobacterium
ADEHTR

SEQ ID NO: 244006 - protein, 11 aa, Mycobacterium
ADEKSVTKTEK

SEQ ID NO: 244007 - protein, 7 aa, Mycobacterium
ADELGGG

SEQ ID NO: 244008 - protein, 6 aa, Mycobacterium
ADELRG

SEQ ID NO: 244009 - protein, 5 aa, Mycobacterium
ADELT

SEQ ID NO: 244010 - protein, 4 aa, Mycobacterium
ADEM

SEQ ID NO: 244011 - protein, 7 aa, Mycobacterium
ADEPPWG

SEQ ID NO: 244012 - protein, 11 aa, Mycobacterium
ADEPRQRRAAR

SEQ ID NO: 244013 - protein, 9 aa, Mycobacterium
ADEPSGPSA

SEQ ID NO: 244014 - protein, 5 aa, Mycobacterium
ADEPV

SEQ ID NO: 244015 - protein, 19 aa, Mycobacterium
ADEPVQEPPKKASRAGRDL

SEQ ID NO: 244016 - protein, 6 aa, Mycobacterium
ADEQGM

SEQ ID NO: 244017 - protein, 7 aa, Mycobacterium
ADEQGRA

SEQ ID NO: 244018 - protein, 14 aa, Mycobacterium
ADEQGWTEADQGSY

SEQ ID NO: 244019 - protein, 9 aa, Mycobacterium
ADEQPSHST

SEQ ID NO: 244020 - protein, 6 aa, Mycobacterium
ADEREA

SEQ ID NO: 244021 - protein, 8 aa, Mycobacterium
ADERGLTV

SEQ ID NO: 244022 - protein, 9 aa, Mycobacterium
ADERRNREV

SEQ ID NO: 244023 - protein, 4 aa, Mycobacterium
ADES

SEQ ID NO: 244024 - protein, 5 aa, Mycobacterium
ADESA

SEQ ID NO: 244025 - protein, 11 aa, Mycobacterium
ADESAAGSSSI

SEQ ID NO: 244026 - protein, 7 aa, Mycobacterium
ADESASA

SEQ ID NO: 244027 - protein, 8 aa, Mycobacterium
ADESGRRR

SEQ ID NO: 244028 - protein, 8 aa, Mycobacterium
ADESNSAL

SEQ ID NO: 244029 - protein, 8 aa, Mycobacterium
ADESQSAL

SEQ ID NO: 244030 - protein, 6 aa, Mycobacterium
ADESSA

SEQ ID NO: 244031 - protein, 5 aa, Mycobacterium
ADEST

SEQ ID NO: 244032 - protein, 8 aa, Mycobacterium
ADETDGPV

SEQ ID NO: 244033 - protein, 7 aa, Mycobacterium
ADETGSI

SEQ ID NO: 244034 - protein, 24 aa, Mycobacterium
ADETPTGEIHAPRSESQATAPTAV

SEQ ID NO: 244035 - protein, 6 aa, Mycobacterium
ADETPV

SEQ ID NO: 244036 - protein, 8 aa, Mycobacterium
ADETYDGD

SEQ ID NO: 244037 - protein, 10 aa, Mycobacterium
ADEVAEADRW

SEQ ID NO: 244038 - protein, 12 aa, Mycobacterium
ADEYGNEIPRTD

SEQ ID NO: 244039 - protein, 108 aa, Mycobacterium
ADEYGTEYDPEYGDEYGAEYRGGYRGGFGSEYDTDYSDDYSDDSPRDEYGYSTASGHAPRRRGRDDLSVDDEDAETTKLSAAGGTPPPPPRSRRSRSADGDSEWTGSH

SEQ ID NO: 244040 - protein, 7 aa, Mycobacterium
ADEYPGV

SEQ ID NO: 244041 - protein, 4 aa, Mycobacterium
ADFA

SEQ ID NO: 244042 - protein, 12 aa, Mycobacterium
ADFARPQDPWEQ

SEQ ID NO: 244043 - protein, 4 aa, Mycobacterium
ADGA

SEQ ID NO: 244044 - protein, 5 aa, Mycobacterium
ADGAA

SEQ ID NO: 244045 - protein, 9 aa, Mycobacterium
ADGAAGRVY

SEQ ID NO: 244046 - protein, 20 aa, Mycobacterium
ADGAAPAPIARTVVRQPAAR

SEQ ID NO: 244047 - protein, 14 aa, Mycobacterium
ADGAARKRRMTPDD

SEQ ID NO: 244048 - protein, 6 aa, Mycobacterium
ADGADW

SEQ ID NO: 244049 - protein, 8 aa, Mycobacterium
ADGAEAMS

SEQ ID NO: 244050 - protein, 9 aa, Mycobacterium
ADGAGARTH

SEQ ID NO: 244051 - protein, 15 aa, Mycobacterium
ADGAGSRPGQRLPES

SEQ ID NO: 244052 - protein, 9 aa, Mycobacterium
ADGAGSRTV

SEQ ID NO: 244053 - protein, 9 aa, Mycobacterium
ADGALGQVD

SEQ ID NO: 244054 - protein, 11 aa, Mycobacterium
ADGALSQVDPG

SEQ ID NO: 244055 - protein, 11 aa, Mycobacterium
ADGAPAAAGEL

SEQ ID NO: 244056 - protein, 10 aa, Mycobacterium
ADGAPGAGVV

SEQ ID NO: 244057 - protein, 10 aa, Mycobacterium
ADGAPLPDGE

SEQ ID NO: 244058 - protein, 17 aa, Mycobacterium
ADGAPQHTGPDFGKASP

SEQ ID NO: 244059 - protein, 29 aa, Mycobacterium
ADGAQQLADGNAAANDGAQRLASGADALT

SEQ ID NO: 244060 - protein, 7 aa, Mycobacterium
ADGAVTK

SEQ ID NO: 244061 - protein, 7 aa, Mycobacterium
ADGDATA

SEQ ID NO: 244062 - protein, 10 aa, Mycobacterium
ADGDDDSGRT

SEQ ID NO: 244063 - protein, 5 aa, Mycobacterium
ADGDP

SEQ ID NO: 244064 - protein, 8 aa, Mycobacterium
ADGDSAFP

SEQ ID NO: 244065 - protein, 6 aa, Mycobacterium
ADGDVT

SEQ ID NO: 244066 - protein, 4 aa, Mycobacterium
ADGE

SEQ ID NO: 244067 - protein, 5 aa, Mycobacterium
ADGEK

SEQ ID NO: 244068 - protein, 10 aa, Mycobacterium
ADGELASAAP

SEQ ID NO: 244069 - protein, 6 aa, Mycobacterium
ADGEMK

SEQ ID NO: 244070 - protein, 9 aa, Mycobacterium
ADGENAPDE

SEQ ID NO: 244071 - protein, 7 aa, Mycobacterium
ADGESQN

SEQ ID NO: 244072 - protein, 15 aa, Mycobacterium
ADGFAGKGKQLNSTL

SEQ ID NO: 244073 - protein, 9 aa, Mycobacterium
ADGFTAPGP

SEQ ID NO: 244074 - protein, 7 aa, Mycobacterium
ADGGAPR

SEQ ID NO: 244075 - protein, 15 aa, Mycobacterium
ADGGAQGPQASAVGT

SEQ ID NO: 244076 - protein, 6 aa, Mycobacterium
ADGGDA

SEQ ID NO: 244077 - protein, 8 aa, Mycobacterium
ADGGDAVS

SEQ ID NO: 244078 - protein, 9 aa, Mycobacterium
ADGGDPVSC

SEQ ID NO: 244079 - protein, 6 aa, Mycobacterium
ADGGGA

SEQ ID NO: 244080 - protein, 8 aa, Mycobacterium
ADGGGGSI

SEQ ID NO: 244081 - protein, 6 aa, Mycobacterium
ADGGPV

SEQ ID NO: 244082 - protein, 9 aa, Mycobacterium
ADGGRANAI

SEQ ID NO: 244083 - protein, 11 aa, Mycobacterium
ADGGRRSAGIE

SEQ ID NO: 244084 - protein, 11 aa, Mycobacterium
ADGGRRSTNLE

SEQ ID NO: 244085 - protein, 14 aa, Mycobacterium
ADGGSHSEPGSGRA

SEQ ID NO: 244086 - protein, 12 aa, Mycobacterium
ADGGTITAPDTQ

SEQ ID NO: 244087 - protein, 5 aa, Mycobacterium
ADGGY

SEQ ID NO: 244088 - protein, 4 aa, Mycobacterium
ADGH

SEQ ID NO: 244089 - protein, 7 aa, Mycobacterium
ADGHGPA

SEQ ID NO: 244090 - protein, 8 aa, Mycobacterium
ADGISRED

SEQ ID NO: 244091 - protein, 4 aa, Mycobacterium
ADGK

SEQ ID NO: 244092 - protein, 20 aa, Mycobacterium
ADGKPIDFENPPDDAEFGRG

SEQ ID NO: 244093 - protein, 15 aa, Mycobacterium
ADGKPVDFENPPDDA

SEQ ID NO: 244094 - protein, 22 aa, Mycobacterium
ADGKSAALDDLPAAARADLTTA

SEQ ID NO: 244095 - protein, 14 aa, Mycobacterium
ADGKTDASDEAPEV

SEQ ID NO: 244096 - protein, 8 aa, Mycobacterium
ADGKTIGS

SEQ ID NO: 244097 - protein, 7 aa, Mycobacterium
ADGKTWS

SEQ ID NO: 244098 - protein, 12 aa, Mycobacterium
ADGKWLISSFDP

SEQ ID NO: 244099 - protein, 12 aa, Mycobacterium
ADGNASSGPGAR

SEQ ID NO: 244100 - protein, 14 aa, Mycobacterium
ADGNSYSRAKLGTS

SEQ ID NO: 244101 - protein, 10 aa, Mycobacterium
ADGPAPALTV

SEQ ID NO: 244102 - protein, 6 aa, Mycobacterium
ADGPAV

SEQ ID NO: 244103 - protein, 6 aa, Mycobacterium
ADGPAW

SEQ ID NO: 244104 - protein, 12 aa, Mycobacterium
ADGPISGERSVL

SEQ ID NO: 244105 - protein, 8 aa, Mycobacterium
ADGPPERP

SEQ ID NO: 244106 - protein, 11 aa, Mycobacterium
ADGPRGPAVAA

SEQ ID NO: 244107 - protein, 6 aa, Mycobacterium
ADGPSV

SEQ ID NO: 244108 - protein, 4 aa, Mycobacterium
ADGQ

SEQ ID NO: 244109 - protein, 14 aa, Mycobacterium
ADGQADSGDDAPDV

SEQ ID NO: 244110 - protein, 15 aa, Mycobacterium
ADGQATVQEREAGAP

SEQ ID NO: 244111 - protein, 5 aa, Mycobacterium
ADGQN

SEQ ID NO: 244112 - protein, 9 aa, Mycobacterium
ADGQPFTTS

SEQ ID NO: 244113 - protein, 6 aa, Mycobacterium
ADGQPV

SEQ ID NO: 244114 - protein, 5 aa, Mycobacterium
ADGQR

SEQ ID NO: 244115 - protein, 10 aa, Mycobacterium
ADGQRSTAAA

SEQ ID NO: 244116 - protein, 6 aa, Mycobacterium
ADGQTV

SEQ ID NO: 244117 - protein, 5 aa, Mycobacterium
ADGQV

SEQ ID NO: 244118 - protein, 7 aa, Mycobacterium
ADGQVSP

SEQ ID NO: 244119 - protein, 7 aa, Mycobacterium
ADGRDGI

SEQ ID NO: 244120 - protein, 8 aa, Mycobacterium
ADGRDSGW

SEQ ID NO: 244121 - protein, 5 aa, Mycobacterium
ADGRG

SEQ ID NO: 244122 - protein, 6 aa, Mycobacterium
ADGRGI

SEQ ID NO: 244123 - protein, 6 aa, Mycobacterium
ADGRRH

SEQ ID NO: 244124 - protein, 4 aa, Mycobacterium
ADGS

SEQ ID NO: 244125 - protein, 8 aa, Mycobacterium
ADGSGGMG

SEQ ID NO: 244126 - protein, 5 aa, Mycobacterium
ADGSI

SEQ ID NO: 244127 - protein, 6 aa, Mycobacterium
ADGSIE

SEQ ID NO: 244128 - protein, 5 aa, Mycobacterium
ADGSK

SEQ ID NO: 244129 - protein, 20 aa, Mycobacterium
ADGSLATAGSAVSPAELGGP

SEQ ID NO: 244130 - protein, 8 aa, Mycobacterium
ADGSPSYE

SEQ ID NO: 244131 - protein, 12 aa, Mycobacterium
ADGSQPEVEKRN

SEQ ID NO: 244132 - protein, 11 aa, Mycobacterium
ADGSRREDAAA

SEQ ID NO: 244133 - protein, 11 aa, Mycobacterium
ADGSRSSADRP

SEQ ID NO: 244134 - protein, 8 aa, Mycobacterium
ADGSSHRG

SEQ ID NO: 244135 - protein, 5 aa, Mycobacterium
ADGSV

SEQ ID NO: 244136 - protein, 5 aa, Mycobacterium
ADGTA

SEQ ID NO: 244137 - protein, 7 aa, Mycobacterium
ADGTAAQ

SEQ ID NO: 244138 - protein, 6 aa, Mycobacterium
ADGTKY

SEQ ID NO: 244139 - protein, 6 aa, Mycobacterium
ADGTLE

SEQ ID NO: 244140 - protein, 5 aa, Mycobacterium
ADGTR

SEQ ID NO: 244141 - protein, 13 aa, Mycobacterium
ADGTTDIRDAQAA

SEQ ID NO: 244142 - protein, 6 aa, Mycobacterium
ADGTVT

SEQ ID NO: 244143 - protein, 5 aa, Mycobacterium
ADGVA

SEQ ID NO: 244144 - protein, 7 aa, Mycobacterium
ADGVEDA

SEQ ID NO: 244145 - protein, 6 aa, Mycobacterium
ADGVGG

SEQ ID NO: 244146 - protein, 5 aa, Mycobacterium
ADGYD

SEQ ID NO: 244147 - protein, 13 aa, Mycobacterium
ADHDDQGEHAVQD

SEQ ID NO: 244148 - protein, 6 aa, Mycobacterium
ADHDQM

SEQ ID NO: 244149 - protein, 4 aa, Mycobacterium
ADHE

SEQ ID NO: 244150 - protein, 18 aa, Mycobacterium
ADHEDQPQQSASLSTEAA

SEQ ID NO: 244151 - protein, 9 aa, Mycobacterium
ADHEPTPLQ

SEQ ID NO: 244152 - protein, 5 aa, Mycobacterium
ADHGL

SEQ ID NO: 244153 - protein, 10 aa, Mycobacterium
ADHGPSLKST

SEQ ID NO: 244154 - protein, 7 aa, Mycobacterium
ADHGTGS

SEQ ID NO: 244155 - protein, 6 aa, Mycobacterium
ADHPDQ

SEQ ID NO: 244156 - protein, 6 aa, Mycobacterium
ADHPEW

SEQ ID NO: 244157 - protein, 22 aa, Mycobacterium
ADHPNAAEQHRHGSEPPTEMSS

SEQ ID NO: 244158 - protein, 6 aa, Mycobacterium
ADHRGD

SEQ ID NO: 244159 - protein, 12 aa, Mycobacterium
ADHSPGPTSAAT

SEQ ID NO: 244160 - protein, 39 aa, Mycobacterium
ADHTSTDVPLPPPPPPEDPSAPPPPDDASPAASVDPITG

SEQ ID NO: 244161 - protein, 5 aa, Mycobacterium
ADIAE

SEQ ID NO: 244162 - protein, 9 aa, Mycobacterium
ADIETTSRQ

SEQ ID NO: 244163 - protein, 5 aa, Mycobacterium
ADIGK

SEQ ID NO: 244164 - protein, 10 aa, Mycobacterium
ADIKNPGSVV

SEQ ID NO: 244165 - protein, 4 aa, Mycobacterium
ADIN

SEQ ID NO: 244166 - protein, 8 aa, Mycobacterium
ADIRTAQP

SEQ ID NO: 244167 - protein, 23 aa, Mycobacterium
ADISGPGAYPQHRRSSDCTGRVS

SEQ ID NO: 244168 - protein, 9 aa, Mycobacterium
ADITTASES

SEQ ID NO: 244169 - protein, 10 aa, Mycobacterium
ADKARKRGFR

SEQ ID NO: 244170 - protein, 6 aa, Mycobacterium
ADKDHV

SEQ ID NO: 244171 - protein, 7 aa, Mycobacterium
ADKDMGE

SEQ ID NO: 244172 - protein, 15 aa, Mycobacterium
ADKEADSAAKNAWNS

SEQ ID NO: 244173 - protein, 9 aa, Mycobacterium
ADKEGPNLD

SEQ ID NO: 244174 - protein, 6 aa, Mycobacterium
ADKEYR

SEQ ID NO: 244175 - protein, 6 aa, Mycobacterium
ADKITS

SEQ ID NO: 244176 - protein, 8 aa, Mycobacterium
ADKLDERG

SEQ ID NO: 244177 - protein, 5 aa, Mycobacterium
ADKMG

SEQ ID NO: 244178 - protein, 18 aa, Mycobacterium
ADKNSAANERFDPQSGTW

SEQ ID NO: 244179 - protein, 10 aa, Mycobacterium
ADKPISGTSY

SEQ ID NO: 244180 - protein, 7 aa, Mycobacterium
ADKPLDP

SEQ ID NO: 244181 - protein, 5 aa, Mycobacterium
ADKQH

SEQ ID NO: 244182 - protein, 7 aa, Mycobacterium
ADKRPGA

SEQ ID NO: 244183 - protein, 23 aa, Mycobacterium
ADKRTVTAEVSPPSVSQPVKQEG

SEQ ID NO: 244184 - protein, 7 aa, Mycobacterium
ADKSREL

SEQ ID NO: 244185 - protein, 7 aa, Mycobacterium
ADKVNTV

SEQ ID NO: 244186 - protein, 4 aa, Mycobacterium
ADLA

SEQ ID NO: 244187 - protein, 19 aa, Mycobacterium
ADLAPPPGTQIGPDGNLTA

SEQ ID NO: 244188 - protein, 8 aa, Mycobacterium
ADLEERGR

SEQ ID NO: 244189 - protein, 9 aa, Mycobacterium
ADLGPAGNR

SEQ ID NO: 244190 - protein, 13 aa, Mycobacterium
ADLGSRTMREETD

SEQ ID NO: 244191 - protein, 4 aa, Mycobacterium
ADLK

SEQ ID NO: 244192 - protein, 8 aa, Mycobacterium
ADLNGQPA

SEQ ID NO: 244193 - protein, 6 aa, Mycobacterium
ADLPDG

SEQ ID NO: 244194 - protein, 8 aa, Mycobacterium
ADLPEASR

SEQ ID NO: 244195 - protein, 8 aa, Mycobacterium
ADLPEDEQ

SEQ ID NO: 244196 - protein, 9 aa, Mycobacterium
ADLPEEGLP

SEQ ID NO: 244197 - protein, 8 aa, Mycobacterium
ADLPEPQL

SEQ ID NO: 244198 - protein, 15 aa, Mycobacterium
ADLQPPRGTVVGPNG

SEQ ID NO: 244199 - protein, 10 aa, Mycobacterium
ADLRAQAAGQ

SEQ ID NO: 244200 - protein, 9 aa, Mycobacterium
ADLRPGPDQ

SEQ ID NO: 244201 - protein, 10 aa, Mycobacterium
ADLRQAPETV

SEQ ID NO: 244202 - protein, 6 aa, Mycobacterium
ADLRQP

SEQ ID NO: 244203 - protein, 11 aa, Mycobacterium
ADLSDAQRSRL

SEQ ID NO: 244204 - protein, 10 aa, Mycobacterium
ADLSEEQRTR

SEQ ID NO: 244205 - protein, 10 aa, Mycobacterium
ADLSGAATAF

SEQ ID NO: 244206 - protein, 5 aa, Mycobacterium
ADLST

SEQ ID NO: 244207 - protein, 7 aa, Mycobacterium
ADLTGRP

SEQ ID NO: 244208 - protein, 8 aa, Mycobacterium
ADLTGRPQ

SEQ ID NO: 244209 - protein, 5 aa, Mycobacterium
ADLTP

SEQ ID NO: 244210 - protein, 21 aa, Mycobacterium
ADLTTQLAGRDEAEAAAAAEQ

SEQ ID NO: 244211 - protein, 5 aa, Mycobacterium
ADMPD

SEQ ID NO: 244212 - protein, 9 aa, Mycobacterium
ADMSRTGDK

SEQ ID NO: 244213 - protein, 37 aa, Mycobacterium
ADMTDDDADVDEPESATPDAAASEPKIVRASRSESAQ

SEQ ID NO: 244214 - protein, 6 aa, Mycobacterium
ADMTSG

SEQ ID NO: 244215 - protein, 6 aa, Mycobacterium
ADNADT

SEQ ID NO: 244216 - protein, 20 aa, Mycobacterium
ADNAQGGGSRPSRGSAQSQL

SEQ ID NO: 244217 - protein, 6 aa, Mycobacterium
ADNAVR

SEQ ID NO: 244218 - protein, 7 aa, Mycobacterium
ADNDQTV

SEQ ID NO: 244219 - protein, 6 aa, Mycobacterium
ADNDYR

SEQ ID NO: 244220 - protein, 6 aa, Mycobacterium
ADNESM

SEQ ID NO: 244221 - protein, 14 aa, Mycobacterium
ADNGPENGAGAQPH

SEQ ID NO: 244222 - protein, 7 aa, Mycobacterium
ADNGPGA

SEQ ID NO: 244223 - protein, 8 aa, Mycobacterium
ADNIDPQQ

SEQ ID NO: 244224 - protein, 10 aa, Mycobacterium
ADNKQEISTG

SEQ ID NO: 244225 - protein, 25 aa, Mycobacterium
ADNLRAEQKSASKAIGKASPDERPA

SEQ ID NO: 244226 - protein, 7 aa, Mycobacterium
ADNNETV

SEQ ID NO: 244227 - protein, 5 aa, Mycobacterium
ADNPD

SEQ ID NO: 244228 - protein, 13 aa, Mycobacterium
ADNPGPNDPATRA

SEQ ID NO: 244229 - protein, 10 aa, Mycobacterium
ADNPRWAPTA

SEQ ID NO: 244230 - protein, 8 aa, Mycobacterium
ADNRDEYD

SEQ ID NO: 244231 - protein, 13 aa, Mycobacterium
ADNRTVRTNESGG

SEQ ID NO: 244232 - protein, 7 aa, Mycobacterium
ADNSDNM

SEQ ID NO: 244233 - protein, 12 aa, Mycobacterium
ADNSRLNGTGTG

SEQ ID NO: 244234 - protein, 6 aa, Mycobacterium
ADNTAR

SEQ ID NO: 244235 - protein, 10 aa, Mycobacterium
ADNTASPSVK

SEQ ID NO: 244236 - protein, 5 aa, Mycobacterium
ADNTI

SEQ ID NO: 244237 - protein, 14 aa, Mycobacterium
ADNVKSAQIDDREQ

SEQ ID NO: 244238 - protein, 6 aa, Mycobacterium
ADNVTS

SEQ ID NO: 244239 - protein, 4 aa, Mycobacterium
ADPA

SEQ ID NO: 244240 - protein, 12 aa, Mycobacterium
ADPAAGQTPDSA

SEQ ID NO: 244241 - protein, 19 aa, Mycobacterium
ADPAAGRGYGEPYQTPDGT

SEQ ID NO: 244242 - protein, 20 aa, Mycobacterium
ADPAAHQRRKRAGPVAETRS

SEQ ID NO: 244243 - protein, 8 aa, Mycobacterium
ADPAALAQ

SEQ ID NO: 244244 - protein, 11 aa, Mycobacterium
ADPAAPTVSRR

SEQ ID NO: 244245 - protein, 6 aa, Mycobacterium
ADPAEQ

SEQ ID NO: 244246 - protein, 7 aa, Mycobacterium
ADPAERE

SEQ ID NO: 244247 - protein, 5 aa, Mycobacterium
ADPAF

SEQ ID NO: 244248 - protein, 6 aa, Mycobacterium
ADPAGP

SEQ ID NO: 244249 - protein, 8 aa, Mycobacterium
ADPAGVTD

SEQ ID NO: 244250 - protein, 10 aa, Mycobacterium
ADPAKAAGLD

SEQ ID NO: 244251 - protein, 9 aa, Mycobacterium
ADPANGVEA

SEQ ID NO: 244252 - protein, 8 aa, Mycobacterium
ADPANRGA

SEQ ID NO: 244253 - protein, 7 aa, Mycobacterium
ADPANRV

SEQ ID NO: 244254 - protein, 9 aa, Mycobacterium
ADPAPQGTD

SEQ ID NO: 244255 - protein, 22 aa, Mycobacterium
ADPAQAVSTSAAAPTPAPPVLG

SEQ ID NO: 244256 - protein, 24 aa, Mycobacterium
ADPARAWANPDAGERNSTQNPVGG

SEQ ID NO: 244257 - protein, 9 aa, Mycobacterium
ADPASDEAF

SEQ ID NO: 244258 - protein, 10 aa, Mycobacterium
ADPASEDAAL

SEQ ID NO: 244259 - protein, 5 aa, Mycobacterium
ADPAT

SEQ ID NO: 244260 - protein, 9 aa, Mycobacterium
ADPATPAGI

SEQ ID NO: 244261 - protein, 9 aa, Mycobacterium
ADPATPKGI

SEQ ID NO: 244262 - protein, 6 aa, Mycobacterium
ADPAVS

SEQ ID NO: 244263 - protein, 4 aa, Mycobacterium
ADPD

SEQ ID NO: 244264 - protein, 8 aa, Mycobacterium
ADPDAEQT

SEQ ID NO: 244265 - protein, 8 aa, Mycobacterium
ADPDASIE

SEQ ID NO: 244266 - protein, 6 aa, Mycobacterium
ADPDAV

SEQ ID NO: 244267 - protein, 29 aa, Mycobacterium
ADPDCRPAANPAAVEAESADEGPDDDPNS

SEQ ID NO: 244268 - protein, 7 aa, Mycobacterium
ADPDDDI

SEQ ID NO: 244269 - protein, 7 aa, Mycobacterium
ADPDEAK

SEQ ID NO: 244270 - protein, 8 aa, Mycobacterium
ADPDEANR

SEQ ID NO: 244271 - protein, 7 aa, Mycobacterium
ADPDGGL

SEQ ID NO: 244272 - protein, 7 aa, Mycobacterium
ADPDGPW

SEQ ID NO: 244273 - protein, 8 aa, Mycobacterium
ADPDGTGY

SEQ ID NO: 244274 - protein, 7 aa, Mycobacterium
ADPDIAR

SEQ ID NO: 244275 - protein, 7 aa, Mycobacterium
ADPDIPG

SEQ ID NO: 244276 - protein, 7 aa, Mycobacterium
ADPDRAT

SEQ ID NO: 244277 - protein, 8 aa, Mycobacterium
ADPDRKTW

SEQ ID NO: 244278 - protein, 7 aa, Mycobacterium
ADPDRPL

SEQ ID NO: 244279 - protein, 8 aa, Mycobacterium
ADPDSIDR

SEQ ID NO: 244280 - protein, 12 aa, Mycobacterium
ADPDTVPVTSDE

SEQ ID NO: 244281 - protein, 4 aa, Mycobacterium
ADPE

SEQ ID NO: 244282 - protein, 8 aa, Mycobacterium
ADPEGAGY

SEQ ID NO: 244283 - protein, 8 aa, Mycobacterium
ADPEGSGF

SEQ ID NO: 244284 - protein, 7 aa, Mycobacterium
ADPELAR

SEQ ID NO: 244285 - protein, 9 aa, Mycobacterium
ADPELDGMG

SEQ ID NO: 244286 - protein, 6 aa, Mycobacterium
ADPELP

SEQ ID NO: 244287 - protein, 13 aa, Mycobacterium
ADPEPDAAAAQPW

SEQ ID NO: 244288 - protein, 4 aa, Mycobacterium
ADPG

SEQ ID NO: 244289 - protein, 10 aa, Mycobacterium
ADPGGSGGRR

SEQ ID NO: 244290 - protein, 5 aa, Mycobacterium
ADPGL

SEQ ID NO: 244291 - protein, 12 aa, Mycobacterium
ADPGPAAPAKTS

SEQ ID NO: 244292 - protein, 9 aa, Mycobacterium
ADPGQQSAT

SEQ ID NO: 244293 - protein, 6 aa, Mycobacterium
ADPGRA

SEQ ID NO: 244294 - protein, 6 aa, Mycobacterium
ADPGRV

SEQ ID NO: 244295 - protein, 7 aa, Mycobacterium
ADPGSAL

SEQ ID NO: 244296 - protein, 8 aa, Mycobacterium
ADPGSDEA

SEQ ID NO: 244297 - protein, 99 aa, Mycobacterium
ADPGSETSGQDSGNTGSTADTGSEPSGSGSVETDPAETDPAETDPDETGSDETDPDETGGGVTDEEPDELPVRTPDDEERSDPVPVRSGGSTARINGRY

SEQ ID NO: 244298 - protein, 20 aa, Mycobacterium
ADPGSGGDLSDVSKERIPRS

SEQ ID NO: 244299 - protein, 7 aa, Mycobacterium
ADPGTAL

SEQ ID NO: 244300 - protein, 10 aa, Mycobacterium
ADPGTKNESI

SEQ ID NO: 244301 - protein, 6 aa, Mycobacterium
ADPGVP

SEQ ID NO: 244302 - protein, 4 aa, Mycobacterium
ADPH

SEQ ID NO: 244303 - protein, 9 aa, Mycobacterium
ADPHAEQGW

SEQ ID NO: 244304 - protein, 65 aa, Mycobacterium
ADPHGSEHNPPGYPPPPSYGAPPPGYGAPPPPPPGYGPPPGYGAPPPPPPGYGPPPGYGAPPKRP

SEQ ID NO: 244305 - protein, 4 aa, Mycobacterium
ADPI

SEQ ID NO: 244306 - protein, 6 aa, Mycobacterium
ADPISK

SEQ ID NO: 244307 - protein, 7 aa, Mycobacterium
ADPKNRV

SEQ ID NO: 244308 - protein, 10 aa, Mycobacterium
ADPKPGDGAM

SEQ ID NO: 244309 - protein, 8 aa, Mycobacterium
ADPKVPGG

SEQ ID NO: 244310 - protein, 10 aa, Mycobacterium
ADPLPPTPRR

SEQ ID NO: 244311 - protein, 11 aa, Mycobacterium
ADPLPSTPRRN

SEQ ID NO: 244312 - protein, 7 aa, Mycobacterium
ADPNEGM

SEQ ID NO: 244313 - protein, 5 aa, Mycobacterium
ADPNF

SEQ ID NO: 244314 - protein, 13 aa, Mycobacterium
ADPNGDGSDEPGS

SEQ ID NO: 244315 - protein, 7 aa, Mycobacterium
ADPNGPW

SEQ ID NO: 244316 - protein, 20 aa, Mycobacterium
ADPPAAPQTTDSISPGTARE

SEQ ID NO: 244317 - protein, 10 aa, Mycobacterium
ADPPDSYPTD

SEQ ID NO: 244318 - protein, 17 aa, Mycobacterium
ADPPGRYPTGPLPQGLS

SEQ ID NO: 244319 - protein, 13 aa, Mycobacterium
ADPPRDDSAATIA

SEQ ID NO: 244320 - protein, 9 aa, Mycobacterium
ADPQAAHQS

SEQ ID NO: 244321 - protein, 9 aa, Mycobacterium
ADPQAQSAT

SEQ ID NO: 244322 - protein, 105 aa, Mycobacterium
ADPQGGDHSTSGYPPPPPPPGYGTTPPPPGYGAPPPPPPGYGAPPPGYGAPPPPPPGYGPPPGGYSAPGYNAPPPPPGYGPPGAPAPGYPPQPGFGGQPKSGFNV

SEQ ID NO: 244323 - protein, 114 aa, Mycobacterium
ADPQGGDQSTPGYPPPPNYGTPPPPPPPGYGAPPAGPPGYGAPPPPPGYGTPPPPPGYGTPPPPPPPGYGQAPGGYAPPGYNPPPPPPPGYGPPPAGYPAQPGFGGPAKPPFSV

SEQ ID NO: 244324 - protein, 10 aa, Mycobacterium
ADPQPATMSR

SEQ ID NO: 244325 - protein, 10 aa, Mycobacterium
ADPQPSDEHD

SEQ ID NO: 244326 - protein, 9 aa, Mycobacterium
ADPQQPRGV

SEQ ID NO: 244327 - protein, 7 aa, Mycobacterium
ADPQSGL

SEQ ID NO: 244328 - protein, 8 aa, Mycobacterium
ADPQSNPV

SEQ ID NO: 244329 - protein, 8 aa, Mycobacterium
ADPQSSVP

SEQ ID NO: 244330 - protein, 12 aa, Mycobacterium
ADPRAEQSWGSY

SEQ ID NO: 244331 - protein, 9 aa, Mycobacterium
ADPRDAAAR

SEQ ID NO: 244332 - protein, 8 aa, Mycobacterium
ADPRELGP

SEQ ID NO: 244333 - protein, 5 aa, Mycobacterium
ADPRH

SEQ ID NO: 244334 - protein, 6 aa, Mycobacterium
ADPRHV

SEQ ID NO: 244335 - protein, 4 aa, Mycobacterium
ADPS

SEQ ID NO: 244336 - protein, 8 aa, Mycobacterium
ADPSALAR

SEQ ID NO: 244337 - protein, 10 aa, Mycobacterium
ADPSAQSATV

SEQ ID NO: 244338 - protein, 6 aa, Mycobacterium
ADPSDA

SEQ ID NO: 244339 - protein, 5 aa, Mycobacterium
ADPSH

SEQ ID NO: 244340 - protein, 9 aa, Mycobacterium
ADPSQPAHE

SEQ ID NO: 244341 - protein, 25 aa, Mycobacterium
ADPSQPAHERGAALPPGPRYGPTPA

SEQ ID NO: 244342 - protein, 12 aa, Mycobacterium
ADPSQRARNSLR

SEQ ID NO: 244343 - protein, 6 aa, Mycobacterium
ADPTDP

SEQ ID NO: 244344 - protein, 9 aa, Mycobacterium
ADPTGRSLY

SEQ ID NO: 244345 - protein, 7 aa, Mycobacterium
ADPTLPR

SEQ ID NO: 244346 - protein, 5 aa, Mycobacterium
ADPTN

SEQ ID NO: 244347 - protein, 6 aa, Mycobacterium
ADPTRI

SEQ ID NO: 244348 - protein, 6 aa, Mycobacterium
ADPTRL

SEQ ID NO: 244349 - protein, 6 aa, Mycobacterium
ADPTRV

SEQ ID NO: 244350 - protein, 5 aa, Mycobacterium
ADPTT

SEQ ID NO: 244351 - protein, 13 aa, Mycobacterium
ADPTYADPSQSML

SEQ ID NO: 244352 - protein, 11 aa, Mycobacterium
ADPVDGTPRSE

SEQ ID NO: 244353 - protein, 6 aa, Mycobacterium
ADPVER

SEQ ID NO: 244354 - protein, 8 aa, Mycobacterium
ADPVGGWR

SEQ ID NO: 244355 - protein, 12 aa, Mycobacterium
ADPVRSPRGDRG

SEQ ID NO: 244356 - protein, 19 aa, Mycobacterium
ADPVTDPEPSGADAQPERR

SEQ ID NO: 244357 - protein, 19 aa, Mycobacterium
ADPYPAGPYPGDVRGHGDY

SEQ ID NO: 244358 - protein, 18 aa, Mycobacterium
ADPYTSQQYPDQQQRGVS

SEQ ID NO: 244359 - protein, 8 aa, Mycobacterium
ADQAPDAV

SEQ ID NO: 244360 - protein, 7 aa, Mycobacterium
ADQAPEA

SEQ ID NO: 244361 - protein, 8 aa, Mycobacterium
ADQAPEAV

SEQ ID NO: 244362 - protein, 11 aa, Mycobacterium
ADQARDQLETG

SEQ ID NO: 244363 - protein, 7 aa, Mycobacterium
ADQARRR

SEQ ID NO: 244364 - protein, 11 aa, Mycobacterium
ADQATDSKFTA

SEQ ID NO: 244365 - protein, 5 aa, Mycobacterium
ADQEA

SEQ ID NO: 244366 - protein, 4 aa, Mycobacterium
ADQG

SEQ ID NO: 244367 - protein, 6 aa, Mycobacterium
ADQGAG

SEQ ID NO: 244368 - protein, 7 aa, Mycobacterium
ADQLADQ

SEQ ID NO: 244369 - protein, 7 aa, Mycobacterium
ADQLDER

SEQ ID NO: 244370 - protein, 5 aa, Mycobacterium
ADQMT

SEQ ID NO: 244371 - protein, 7 aa, Mycobacterium
ADQNGRD

SEQ ID NO: 244372 - protein, 14 aa, Mycobacterium
ADQNVAGAAPPDPW

SEQ ID NO: 244373 - protein, 33 aa, Mycobacterium
ADQPGGGRHSEVGYPGSAEPSAVEPPSGRGYAD

SEQ ID NO: 244374 - protein, 23 aa, Mycobacterium
ADQPLAHRSPRPQPSRGMERAPG

SEQ ID NO: 244375 - protein, 9 aa, Mycobacterium
ADQPPVTPA

SEQ ID NO: 244376 - protein, 11 aa, Mycobacterium
ADQQASTRQQA

SEQ ID NO: 244377 - protein, 4 aa, Mycobacterium
ADQR

SEQ ID NO: 244378 - protein, 20 aa, Mycobacterium
ADQRAGGLLGPGAQHPAEAR

SEQ ID NO: 244379 - protein, 6 aa, Mycobacterium
ADQRAT

SEQ ID NO: 244380 - protein, 8 aa, Mycobacterium
ADQRGNEA

SEQ ID NO: 244381 - protein, 6 aa, Mycobacterium
ADQRRD

SEQ ID NO: 244382 - protein, 5 aa, Mycobacterium
ADQSA

SEQ ID NO: 244383 - protein, 9 aa, Mycobacterium
ADQSGEPRD

SEQ ID NO: 244384 - protein, 8 aa, Mycobacterium
ADQSPADK

SEQ ID NO: 244385 - protein, 9 aa, Mycobacterium
ADQSPADKF

SEQ ID NO: 244386 - protein, 18 aa, Mycobacterium
ADQSRHDAAHAATAAAER

SEQ ID NO: 244387 - protein, 22 aa, Mycobacterium
ADQTASSQRGTPKSAAKERRLP

SEQ ID NO: 244388 - protein, 5 aa, Mycobacterium
ADQTG

SEQ ID NO: 244389 - protein, 16 aa, Mycobacterium
ADQTREYATREDPTRW

SEQ ID NO: 244390 - protein, 20 aa, Mycobacterium
ADQTRVGEAGTALSGGERQR

SEQ ID NO: 244391 - protein, 7 aa, Mycobacterium
ADQTTAY

SEQ ID NO: 244392 - protein, 38 aa, Mycobacterium
ADQVTKDDDNAGAAAGATTAEHAPVDDASRSLQRRQRV

SEQ ID NO: 244393 - protein, 9 aa, Mycobacterium
ADRAETGRQ

SEQ ID NO: 244394 - protein, 8 aa, Mycobacterium
ADRAGSET

SEQ ID NO: 244395 - protein, 9 aa, Mycobacterium
ADRAGTVRF

SEQ ID NO: 244396 - protein, 6 aa, Mycobacterium
ADRANW

SEQ ID NO: 244397 - protein, 8 aa, Mycobacterium
ADRARTPL

SEQ ID NO: 244398 - protein, 6 aa, Mycobacterium
ADRAST

SEQ ID NO: 244399 - protein, 13 aa, Mycobacterium
ADRATGVAGLPQR

SEQ ID NO: 244400 - protein, 4 aa, Mycobacterium
ADRD

SEQ ID NO: 244401 - protein, 13 aa, Mycobacterium
ADRDAGHGNGPPM

SEQ ID NO: 244402 - protein, 11 aa, Mycobacterium
ADRDAIEADTG

SEQ ID NO: 244403 - protein, 7 aa, Mycobacterium
ADRDDAI

SEQ ID NO: 244404 - protein, 6 aa, Mycobacterium
ADRDPE

SEQ ID NO: 244405 - protein, 7 aa, Mycobacterium
ADRDPIA

SEQ ID NO: 244406 - protein, 7 aa, Mycobacterium
ADRDPLT

SEQ ID NO: 244407 - protein, 5 aa, Mycobacterium
ADRDS

SEQ ID NO: 244408 - protein, 6 aa, Mycobacterium
ADRDSG

SEQ ID NO: 244409 - protein, 8 aa, Mycobacterium
ADRDTGAL

SEQ ID NO: 244410 - protein, 10 aa, Mycobacterium
ADREPPGSVP

SEQ ID NO: 244411 - protein, 4 aa, Mycobacterium
ADRG

SEQ ID NO: 244412 - protein, 7 aa, Mycobacterium
ADRGAGA

SEQ ID NO: 244413 - protein, 8 aa, Mycobacterium
ADRGGRPW

SEQ ID NO: 244414 - protein, 10 aa, Mycobacterium
ADRGHSQNTA

SEQ ID NO: 244415 - protein, 6 aa, Mycobacterium
ADRGRT

SEQ ID NO: 244416 - protein, 5 aa, Mycobacterium
ADRGS

SEQ ID NO: 244417 - protein, 5 aa, Mycobacterium
ADRIG

SEQ ID NO: 244418 - protein, 6 aa, Mycobacterium
ADRIGP

SEQ ID NO: 244419 - protein, 14 aa, Mycobacterium
ADRIPAPIGLSRRS

SEQ ID NO: 244420 - protein, 9 aa, Mycobacterium
ADRITASGL

SEQ ID NO: 244421 - protein, 5 aa, Mycobacterium
ADRLN

SEQ ID NO: 244422 - protein, 12 aa, Mycobacterium
ADRNHGKDRPGA

SEQ ID NO: 244423 - protein, 8 aa, Mycobacterium
ADRNPEQV

SEQ ID NO: 244424 - protein, 5 aa, Mycobacterium
ADRNS

SEQ ID NO: 244425 - protein, 6 aa, Mycobacterium
ADRNSF

SEQ ID NO: 244426 - protein, 25 aa, Mycobacterium
ADRPAAVDPDTDAPSNDDDDAVVQP

SEQ ID NO: 244427 - protein, 7 aa, Mycobacterium
ADRPDSR

SEQ ID NO: 244428 - protein, 22 aa, Mycobacterium
ADRPEDTDVAAAAADASGLPGA

SEQ ID NO: 244429 - protein, 5 aa, Mycobacterium
ADRPG

SEQ ID NO: 244430 - protein, 10 aa, Mycobacterium
ADRPGPGRGT

SEQ ID NO: 244431 - protein, 9 aa, Mycobacterium
ADRPGTGEP

SEQ ID NO: 244432 - protein, 6 aa, Mycobacterium
ADRPGV

SEQ ID NO: 244433 - protein, 8 aa, Mycobacterium
ADRPPAAA

SEQ ID NO: 244434 - protein, 12 aa, Mycobacterium
ADRPPAPWQPLT

SEQ ID NO: 244435 - protein, 7 aa, Mycobacterium
ADRPRPV

SEQ ID NO: 244436 - protein, 18 aa, Mycobacterium
ADRPTHEGPIASVEALDF

SEQ ID NO: 244437 - protein, 5 aa, Mycobacterium
ADRPW

SEQ ID NO: 244438 - protein, 9 aa, Mycobacterium
ADRQKTPNE

SEQ ID NO: 244439 - protein, 4 aa, Mycobacterium
ADRR

SEQ ID NO: 244440 - protein, 8 aa, Mycobacterium
ADRRGRGS

SEQ ID NO: 244441 - protein, 75 aa, Mycobacterium
ADRRRGKRQPGVARGSAEAPPRKRRPSREPQRPLRSAPQTGPIPRQKTEPARPKTASQAKARAKARKAKAPKVVR

SEQ ID NO: 244442 - protein, 30 aa, Mycobacterium
ADRRTGGNGHGNGAAGPRKRVAGRTSRNGI

SEQ ID NO: 244443 - protein, 6 aa, Mycobacterium
ADRSAA

SEQ ID NO: 244444 - protein, 7 aa, Mycobacterium
ADRSEAA

SEQ ID NO: 244445 - protein, 8 aa, Mycobacterium
ADRSGGAE

SEQ ID NO: 244446 - protein, 132 aa, Mycobacterium
ADRSNRRGPSAETADDGRRKGSAVSDKPTSDSPSGPDSTAPPSGPNSTAPPSGPNSTAPPSGPNSTAPPSADDFQPDVPDSYQPDPAADDSATTALPAQGVPTQSPSKSPTETPTEAVKRPRADYSNDPTRE

SEQ ID NO: 244447 - protein, 14 aa, Mycobacterium
ADRSQGPEDLPEAV

SEQ ID NO: 244448 - protein, 7 aa, Mycobacterium
ADRSRLG

SEQ ID NO: 244449 - protein, 7 aa, Mycobacterium
ADRSTAA

SEQ ID NO: 244450 - protein, 10 aa, Mycobacterium
ADRSTARSPF

SEQ ID NO: 244451 - protein, 6 aa, Mycobacterium
ADRSTS

SEQ ID NO: 244452 - protein, 4 aa, Mycobacterium
ADRT

SEQ ID NO: 244453 - protein, 13 aa, Mycobacterium
ADRTPEDNRAEVT

SEQ ID NO: 244454 - protein, 9 aa, Mycobacterium
ADRTSIPTD

SEQ ID NO: 244455 - protein, 5 aa, Mycobacterium
ADRTT

SEQ ID NO: 244456 - protein, 4 aa, Mycobacterium
ADRV

SEQ ID NO: 244457 - protein, 11 aa, Mycobacterium
ADRVAKSPLRE

SEQ ID NO: 244458 - protein, 9 aa, Mycobacterium
ADRVGPVGT

SEQ ID NO: 244459 - protein, 4 aa, Mycobacterium
ADRY

SEQ ID NO: 244460 - protein, 5 aa, Mycobacterium
ADSAA

SEQ ID NO: 244461 - protein, 19 aa, Mycobacterium
ADSAATAAAHQAAATAYTG

SEQ ID NO: 244462 - protein, 11 aa, Mycobacterium
ADSAGERQPGL

SEQ ID NO: 244463 - protein, 17 aa, Mycobacterium
ADSAPGGVEGEDRRTTI

SEQ ID NO: 244464 - protein, 10 aa, Mycobacterium
ADSASAGADV

SEQ ID NO: 244465 - protein, 5 aa, Mycobacterium
ADSAT

SEQ ID NO: 244466 - protein, 8 aa, Mycobacterium
ADSATKEF

SEQ ID NO: 244467 - protein, 13 aa, Mycobacterium
ADSDQAVKSALSS

SEQ ID NO: 244468 - protein, 8 aa, Mycobacterium
ADSDQQTW

SEQ ID NO: 244469 - protein, 6 aa, Mycobacterium
ADSDRA

SEQ ID NO: 244470 - protein, 7 aa, Mycobacterium
ADSEDQR

SEQ ID NO: 244471 - protein, 10 aa, Mycobacterium
ADSENPPDSA

SEQ ID NO: 244472 - protein, 6 aa, Mycobacterium
ADSGAH

SEQ ID NO: 244473 - protein, 7 aa, Mycobacterium
ADSGAQR

SEQ ID NO: 244474 - protein, 8 aa, Mycobacterium
ADSGDRGV

SEQ ID NO: 244475 - protein, 8 aa, Mycobacterium
ADSGDRKL

SEQ ID NO: 244476 - protein, 8 aa, Mycobacterium
ADSGDRKV

SEQ ID NO: 244477 - protein, 8 aa, Mycobacterium
ADSGLAPA

SEQ ID NO: 244478 - protein, 8 aa, Mycobacterium
ADSGNDIA

SEQ ID NO: 244479 - protein, 10 aa, Mycobacterium
ADSGQITGTH

SEQ ID NO: 244480 - protein, 14 aa, Mycobacterium
ADSGVSAGAMPRSP

SEQ ID NO: 244481 - protein, 6 aa, Mycobacterium
ADSIRT

SEQ ID NO: 244482 - protein, 8 aa, Mycobacterium
ADSLEAEA

SEQ ID NO: 244483 - protein, 13 aa, Mycobacterium
ADSPNSPAQHPVY

SEQ ID NO: 244484 - protein, 7 aa, Mycobacterium
ADSPRVL

SEQ ID NO: 244485 - protein, 15 aa, Mycobacterium
ADSPSTAEAIESGHA

SEQ ID NO: 244486 - protein, 5 aa, Mycobacterium
ADSPT

SEQ ID NO: 244487 - protein, 5 aa, Mycobacterium
ADSQF

SEQ ID NO: 244488 - protein, 13 aa, Mycobacterium
ADSQGPAAARNTG

SEQ ID NO: 244489 - protein, 7 aa, Mycobacterium
ADSQSRE

SEQ ID NO: 244490 - protein, 6 aa, Mycobacterium
ADSRAA

SEQ ID NO: 244491 - protein, 15 aa, Mycobacterium
ADSRSAKETAAESLK

SEQ ID NO: 244492 - protein, 9 aa, Mycobacterium
ADSSPKAPR

SEQ ID NO: 244493 - protein, 8 aa, Mycobacterium
ADSSRNLD

SEQ ID NO: 244494 - protein, 8 aa, Mycobacterium
ADSTAALG

SEQ ID NO: 244495 - protein, 8 aa, Mycobacterium
ADSTATGE

SEQ ID NO: 244496 - protein, 8 aa, Mycobacterium
ADSTATGQ

SEQ ID NO: 244497 - protein, 8 aa, Mycobacterium
ADSTRSQW

SEQ ID NO: 244498 - protein, 7 aa, Mycobacterium
ADSVAGS

SEQ ID NO: 244499 - protein, 15 aa, Mycobacterium
ADSVEKDLEAARSRL

SEQ ID NO: 244500 - protein, 5 aa, Mycobacterium
ADSWP

SEQ ID NO: 244501 - protein, 15 aa, Mycobacterium
ADSYTAAYTAPGGPD

SEQ ID NO: 244502 - protein, 5 aa, Mycobacterium
ADTAA

SEQ ID NO: 244503 - protein, 10 aa, Mycobacterium
ADTAAAGGFD

SEQ ID NO: 244504 - protein, 6 aa, Mycobacterium
ADTADG

SEQ ID NO: 244505 - protein, 11 aa, Mycobacterium
ADTADTQPAID

SEQ ID NO: 244506 - protein, 17 aa, Mycobacterium
ADTAEKATEEIHRDESR

SEQ ID NO: 244507 - protein, 23 aa, Mycobacterium
ADTAGSPATASARGWSTSTASGI

SEQ ID NO: 244508 - protein, 5 aa, Mycobacterium
ADTAH

SEQ ID NO: 244509 - protein, 7 aa, Mycobacterium
ADTAIEV

SEQ ID NO: 244510 - protein, 8 aa, Mycobacterium
ADTAPSPL

SEQ ID NO: 244511 - protein, 10 aa, Mycobacterium
ADTAQATAAE

SEQ ID NO: 244512 - protein, 7 aa, Mycobacterium
ADTATPL

SEQ ID NO: 244513 - protein, 8 aa, Mycobacterium
ADTAVEAG

SEQ ID NO: 244514 - protein, 4 aa, Mycobacterium
ADTD

SEQ ID NO: 244515 - protein, 10 aa, Mycobacterium
ADTDEPETKL

SEQ ID NO: 244516 - protein, 10 aa, Mycobacterium
ADTDTMAGPL

SEQ ID NO: 244517 - protein, 4 aa, Mycobacterium
ADTE

SEQ ID NO: 244518 - protein, 5 aa, Mycobacterium
ADTEH

SEQ ID NO: 244519 - protein, 7 aa, Mycobacterium
ADTEHVE

SEQ ID NO: 244520 - protein, 12 aa, Mycobacterium
ADTFDGNGDTFR

SEQ ID NO: 244521 - protein, 4 aa, Mycobacterium
ADTG

SEQ ID NO: 244522 - protein, 9 aa, Mycobacterium
ADTGDGVPA

SEQ ID NO: 244523 - protein, 6 aa, Mycobacterium
ADTGDV

SEQ ID NO: 244524 - protein, 5 aa, Mycobacterium
ADTGE

SEQ ID NO: 244525 - protein, 7 aa, Mycobacterium
ADTGEGG

SEQ ID NO: 244526 - protein, 23 aa, Mycobacterium
ADTGETTAVPKRSRQYAGAATTL

SEQ ID NO: 244527 - protein, 7 aa, Mycobacterium
ADTGGLN

SEQ ID NO: 244528 - protein, 5 aa, Mycobacterium
ADTGI

SEQ ID NO: 244529 - protein, 10 aa, Mycobacterium
ADTGNSVTQT

SEQ ID NO: 244530 - protein, 5 aa, Mycobacterium
ADTGP

SEQ ID NO: 244531 - protein, 9 aa, Mycobacterium
ADTGPAATF

SEQ ID NO: 244532 - protein, 9 aa, Mycobacterium
ADTGQPIGQ

SEQ ID NO: 244533 - protein, 5 aa, Mycobacterium
ADTGR

SEQ ID NO: 244534 - protein, 4 aa, Mycobacterium
ADTH

SEQ ID NO: 244535 - protein, 4 aa, Mycobacterium
ADTI

SEQ ID NO: 244536 - protein, 5 aa, Mycobacterium
ADTIG

SEQ ID NO: 244537 - protein, 7 aa, Mycobacterium
ADTITST

SEQ ID NO: 244538 - protein, 6 aa, Mycobacterium
ADTKHV

SEQ ID NO: 244539 - protein, 4 aa, Mycobacterium
ADTL

SEQ ID NO: 244540 - protein, 9 aa, Mycobacterium
ADTLEGRPE

SEQ ID NO: 244541 - protein, 5 aa, Mycobacterium
ADTNA

SEQ ID NO: 244542 - protein, 5 aa, Mycobacterium
ADTPA

SEQ ID NO: 244543 - protein, 9 aa, Mycobacterium
ADTPANVGY

SEQ ID NO: 244544 - protein, 7 aa, Mycobacterium
ADTPDCG

SEQ ID NO: 244545 - protein, 8 aa, Mycobacterium
ADTPDKPM

SEQ ID NO: 244546 - protein, 12 aa, Mycobacterium
ADTPHRAGATAD

SEQ ID NO: 244547 - protein, 11 aa, Mycobacterium
ADTPPVDDLDP

SEQ ID NO: 244548 - protein, 7 aa, Mycobacterium
ADTPRPA

SEQ ID NO: 244549 - protein, 7 aa, Mycobacterium
ADTQPAA

SEQ ID NO: 244550 - protein, 14 aa, Mycobacterium
ADTQQQAAQTYPSW

SEQ ID NO: 244551 - protein, 12 aa, Mycobacterium
ADTQTSSGSPTA

SEQ ID NO: 244552 - protein, 4 aa, Mycobacterium
ADTR

SEQ ID NO: 244553 - protein, 7 aa, Mycobacterium
ADTRADQ

SEQ ID NO: 244554 - protein, 7 aa, Mycobacterium
ADTRDNG

SEQ ID NO: 244555 - protein, 5 aa, Mycobacterium
ADTRH

SEQ ID NO: 244556 - protein, 5 aa, Mycobacterium
ADTRS

SEQ ID NO: 244557 - protein, 6 aa, Mycobacterium
ADTRST

SEQ ID NO: 244558 - protein, 15 aa, Mycobacterium
ADTRTVAPAAGPWTP

SEQ ID NO: 244559 - protein, 4 aa, Mycobacterium
ADTS

SEQ ID NO: 244560 - protein, 6 aa, Mycobacterium
ADTSPS

SEQ ID NO: 244561 - protein, 10 aa, Mycobacterium
ADTSRAGRVG

SEQ ID NO: 244562 - protein, 9 aa, Mycobacterium
ADTTKPPEL

SEQ ID NO: 244563 - protein, 15 aa, Mycobacterium
ADTVRAGRLDERRRR

SEQ ID NO: 244564 - protein, 4 aa, Mycobacterium
ADVA

SEQ ID NO: 244565 - protein, 6 aa, Mycobacterium
ADVAES

SEQ ID NO: 244566 - protein, 7 aa, Mycobacterium
ADVAGRA

SEQ ID NO: 244567 - protein, 6 aa, Mycobacterium
ADVDDS

SEQ ID NO: 244568 - protein, 8 aa, Mycobacterium
ADVDEGRL

SEQ ID NO: 244569 - protein, 8 aa, Mycobacterium
ADVDPRSS

SEQ ID NO: 244570 - protein, 6 aa, Mycobacterium
ADVDQS

SEQ ID NO: 244571 - protein, 6 aa, Mycobacterium
ADVEGS

SEQ ID NO: 244572 - protein, 7 aa, Mycobacterium
ADVEPGQ

SEQ ID NO: 244573 - protein, 21 aa, Mycobacterium
ADVETEKKTDAEAKAERKEKI

SEQ ID NO: 244574 - protein, 4 aa, Mycobacterium
ADVG

SEQ ID NO: 244575 - protein, 6 aa, Mycobacterium
ADVGDL

SEQ ID NO: 244576 - protein, 14 aa, Mycobacterium
ADVGRAKAQSARES

SEQ ID NO: 244577 - protein, 26 aa, Mycobacterium
ADVPTAMGPAVDAPTALGPAAPPVAG

SEQ ID NO: 244578 - protein, 6 aa, Mycobacterium
ADVRAD

SEQ ID NO: 244579 - protein, 19 aa, Mycobacterium
ADVRAQPVTPTQSDTVPGR

SEQ ID NO: 244580 - protein, 9 aa, Mycobacterium
ADVSGAGAA

SEQ ID NO: 244581 - protein, 12 aa, Mycobacterium
ADVSGQPEEQAE

SEQ ID NO: 244582 - protein, 4 aa, Mycobacterium
ADVT

SEQ ID NO: 244583 - protein, 6 aa, Mycobacterium
ADVTPE

SEQ ID NO: 244584 - protein, 6 aa, Mycobacterium
ADVTQR

SEQ ID NO: 244585 - protein, 6 aa, Mycobacterium
ADVTTG

SEQ ID NO: 244586 - protein, 4 aa, Mycobacterium
ADVY

SEQ ID NO: 244587 - protein, 12 aa, Mycobacterium
ADWDESTNSVVP

SEQ ID NO: 244588 - protein, 6 aa, Mycobacterium
ADWPRY

SEQ ID NO: 244589 - protein, 13 aa, Mycobacterium
ADWQPSAEKEVDA

SEQ ID NO: 244590 - protein, 6 aa, Mycobacterium
ADYATV

SEQ ID NO: 244591 - protein, 8 aa, Mycobacterium
ADYDANRA

SEQ ID NO: 244592 - protein, 22 aa, Mycobacterium
ADYGEPPGSAQRQSTASARGAG

SEQ ID NO: 244593 - protein, 8 aa, Mycobacterium
ADYGGDPD

SEQ ID NO: 244594 - protein, 4 aa, Mycobacterium
ADYI

SEQ ID NO: 244595 - protein, 30 aa, Mycobacterium
ADYPDAEADYTDYTDAVPEVAEAETADDAA

SEQ ID NO: 244596 - protein, 6 aa, Mycobacterium
ADYRIG

SEQ ID NO: 244597 - protein, 7 aa, Mycobacterium
ADYSPTV

SEQ ID NO: 244598 - protein, 4 aa, Mycobacterium
AEAA

SEQ ID NO: 244599 - protein, 14 aa, Mycobacterium
AEAAAEQRFGSAAR

SEQ ID NO: 244600 - protein, 8 aa, Mycobacterium
AEAAASRA

SEQ ID NO: 244601 - protein, 16 aa, Mycobacterium
AEAAATPAGPANTGRL

SEQ ID NO: 244602 - protein, 10 aa, Mycobacterium
AEAADTGRTL

SEQ ID NO: 244603 - protein, 11 aa, Mycobacterium
AEAAEEGGKQN

SEQ ID NO: 244604 - protein, 7 aa, Mycobacterium
AEAAEID

SEQ ID NO: 244605 - protein, 8 aa, Mycobacterium
AEAAHGEQ

SEQ ID NO: 244606 - protein, 6 aa, Mycobacterium
AEAAHR

SEQ ID NO: 244607 - protein, 10 aa, Mycobacterium
AEAASARRSD

SEQ ID NO: 244608 - protein, 7 aa, Mycobacterium
AEAASRA

SEQ ID NO: 244609 - protein, 10 aa, Mycobacterium
AEAATANAAT

SEQ ID NO: 244610 - protein, 7 aa, Mycobacterium
AEAATPA

SEQ ID NO: 244611 - protein, 18 aa, Mycobacterium
AEADAYAADTMERAEQLG

SEQ ID NO: 244612 - protein, 10 aa, Mycobacterium
AEADGKKEVA

SEQ ID NO: 244613 - protein, 6 aa, Mycobacterium
AEADGQ

SEQ ID NO: 244614 - protein, 19 aa, Mycobacterium
AEADGSGRGTPVGAQAGSR

SEQ ID NO: 244615 - protein, 10 aa, Mycobacterium
AEADGSKMTR

SEQ ID NO: 244616 - protein, 9 aa, Mycobacterium
AEADGTKAK

SEQ ID NO: 244617 - protein, 8 aa, Mycobacterium
AEADQNDM

SEQ ID NO: 244618 - protein, 8 aa, Mycobacterium
AEADSEHP

SEQ ID NO: 244619 - protein, 39 aa, Mycobacterium
AEAEAAEAESAAAAARERASRLRQQAGAAAADPAPDRPR

SEQ ID NO: 244620 - protein, 6 aa, Mycobacterium
AEAEAM

SEQ ID NO: 244621 - protein, 62 aa, Mycobacterium
AEAEEAEAGEDEPKEAEEVAEAEGSEAEDKTVQAIDGGQTGVDDAGEADAEPDDDSTAAEPE

SEQ ID NO: 244622 - protein, 9 aa, Mycobacterium
AEAERQGRM

SEQ ID NO: 244623 - protein, 26 aa, Mycobacterium
AEAEVPGSGRAGPHRHRAEAGTSDPL

SEQ ID NO: 244624 - protein, 5 aa, Mycobacterium
AEAGA

SEQ ID NO: 244625 - protein, 9 aa, Mycobacterium
AEAGDEPRR

SEQ ID NO: 244626 - protein, 12 aa, Mycobacterium
AEAGDSKAQASA

SEQ ID NO: 244627 - protein, 10 aa, Mycobacterium
AEAGERTQVT

SEQ ID NO: 244628 - protein, 8 aa, Mycobacterium
AEAGKKRA

SEQ ID NO: 244629 - protein, 7 aa, Mycobacterium
AEAGPAR

SEQ ID NO: 244630 - protein, 25 aa, Mycobacterium
AEAGRQIENGSQGIAGNLESAGHGA

SEQ ID NO: 244631 - protein, 10 aa, Mycobacterium
AEAGTAGAAA

SEQ ID NO: 244632 - protein, 7 aa, Mycobacterium
AEAGYGS

SEQ ID NO: 244633 - protein, 11 aa, Mycobacterium
AEAHEAANNAK

SEQ ID NO: 244634 - protein, 7 aa, Mycobacterium
AEAHLGD

SEQ ID NO: 244635 - protein, 4 aa, Mycobacterium
AEAI

SEQ ID NO: 244636 - protein, 5 aa, Mycobacterium
AEAIS

SEQ ID NO: 244637 - protein, 9 aa, Mycobacterium
AEAISSRAL

SEQ ID NO: 244638 - protein, 6 aa, Mycobacterium
AEAKTN

SEQ ID NO: 244639 - protein, 7 aa, Mycobacterium
AEAKTNV

SEQ ID NO: 244640 - protein, 9 aa, Mycobacterium
AEAKTTGRQ

SEQ ID NO: 244641 - protein, 5 aa, Mycobacterium
AEALT

SEQ ID NO: 244642 - protein, 6 aa, Mycobacterium
AEAMRR

SEQ ID NO: 244643 - protein, 4 aa, Mycobacterium
AEAP

SEQ ID NO: 244644 - protein, 38 aa, Mycobacterium
AEAPAEVEAEEPEAAPAEEAAPAEAKAGTATETKPVTG

SEQ ID NO: 244645 - protein, 15 aa, Mycobacterium
AEAPAPGAMQSTDTY

SEQ ID NO: 244646 - protein, 8 aa, Mycobacterium
AEAPDARG

SEQ ID NO: 244647 - protein, 18 aa, Mycobacterium
AEAPGGRADGGRAREVGT

SEQ ID NO: 244648 - protein, 10 aa, Mycobacterium
AEAPSNIGYR

SEQ ID NO: 244649 - protein, 10 aa, Mycobacterium
AEAPSSVTAA

SEQ ID NO: 244650 - protein, 8 aa, Mycobacterium
AEAPTSVP

SEQ ID NO: 244651 - protein, 5 aa, Mycobacterium
AEAQR

SEQ ID NO: 244652 - protein, 13 aa, Mycobacterium
AEAQSSGETDPLG

SEQ ID NO: 244653 - protein, 4 aa, Mycobacterium
AEAR

SEQ ID NO: 244654 - protein, 7 aa, Mycobacterium
AEARPAR

SEQ ID NO: 244655 - protein, 7 aa, Mycobacterium
AEARTGT

SEQ ID NO: 244656 - protein, 11 aa, Mycobacterium
AEASGLRGDGG

SEQ ID NO: 244657 - protein, 15 aa, Mycobacterium
AEASLAGAQINSNAP

SEQ ID NO: 244658 - protein, 5 aa, Mycobacterium
AEAST

SEQ ID NO: 244659 - protein, 6 aa, Mycobacterium
AEATAL

SEQ ID NO: 244660 - protein, 7 aa, Mycobacterium
AEATATA

SEQ ID NO: 244661 - protein, 8 aa, Mycobacterium
AEATGEAI

SEQ ID NO: 244662 - protein, 22 aa, Mycobacterium
AEATQRRARDGANRLPAARRPS

SEQ ID NO: 244663 - protein, 12 aa, Mycobacterium
AEAVPDDVPGRG

SEQ ID NO: 244664 - protein, 7 aa, Mycobacterium
AEAVQAR

SEQ ID NO: 244665 - protein, 14 aa, Mycobacterium
AEAVSRQAGRFNPA

SEQ ID NO: 244666 - protein, 10 aa, Mycobacterium
AEDAAAWRDG

SEQ ID NO: 244667 - protein, 8 aa, Mycobacterium
AEDAEPRT

SEQ ID NO: 244668 - protein, 11 aa, Mycobacterium
AEDAIDPPRSL

SEQ ID NO: 244669 - protein, 10 aa, Mycobacterium
AEDAPREATP

SEQ ID NO: 244670 - protein, 10 aa, Mycobacterium
AEDARNPRRS

SEQ ID NO: 244671 - protein, 7 aa, Mycobacterium
AEDATPR

SEQ ID NO: 244672 - protein, 21 aa, Mycobacterium
AEDEDAESTEAEDEEPNKPLS

SEQ ID NO: 244673 - protein, 8 aa, Mycobacterium
AEDETGRA

SEQ ID NO: 244674 - protein, 8 aa, Mycobacterium
AEDETTGV

SEQ ID NO: 244675 - protein, 9 aa, Mycobacterium
AEDETYNGS

SEQ ID NO: 244676 - protein, 10 aa, Mycobacterium
AEDGDEFSGA

SEQ ID NO: 244677 - protein, 7 aa, Mycobacterium
AEDGHTA

SEQ ID NO: 244678 - protein, 9 aa, Mycobacterium
AEDGTGELA

SEQ ID NO: 244679 - protein, 7 aa, Mycobacterium
AEDIDTR

SEQ ID NO: 244680 - protein, 11 aa, Mycobacterium
AEDLRAQAAGQ

SEQ ID NO: 244681 - protein, 7 aa, Mycobacterium
AEDPETD

SEQ ID NO: 244682 - protein, 16 aa, Mycobacterium
AEDPNGSGDKSDAGRR

SEQ ID NO: 244683 - protein, 10 aa, Mycobacterium
AEDPTPEDEV

SEQ ID NO: 244684 - protein, 9 aa, Mycobacterium
AEDPTTPGA

SEQ ID NO: 244685 - protein, 8 aa, Mycobacterium
AEDQNNDV

SEQ ID NO: 244686 - protein, 9 aa, Mycobacterium
AEDRDPIGT

SEQ ID NO: 244687 - protein, 20 aa, Mycobacterium
AEDREADSINGGARAAYGSG

SEQ ID NO: 244688 - protein, 5 aa, Mycobacterium
AEDTA

SEQ ID NO: 244689 - protein, 6 aa, Mycobacterium
AEDTAG

SEQ ID NO: 244690 - protein, 5 aa, Mycobacterium
AEDTQ

SEQ ID NO: 244691 - protein, 5 aa, Mycobacterium
AEDTR

SEQ ID NO: 244692 - protein, 7 aa, Mycobacterium
AEDTRKR

SEQ ID NO: 244693 - protein, 7 aa, Mycobacterium
AEDTTGT

SEQ ID NO: 244694 - protein, 6 aa, Mycobacterium
AEDTVR

SEQ ID NO: 244695 - protein, 8 aa, Mycobacterium
AEDYSDAV

SEQ ID NO: 244696 - protein, 15 aa, Mycobacterium
AEEAAASLGASGPKI

SEQ ID NO: 244697 - protein, 11 aa, Mycobacterium
AEEAEEPERNM

SEQ ID NO: 244698 - protein, 6 aa, Mycobacterium
AEEAEI

SEQ ID NO: 244699 - protein, 5 aa, Mycobacterium
AEEAG

SEQ ID NO: 244700 - protein, 12 aa, Mycobacterium
AEEAREPAKNIP

SEQ ID NO: 244701 - protein, 10 aa, Mycobacterium
AEEARNPRRT

SEQ ID NO: 244702 - protein, 6 aa, Mycobacterium
AEEASR

SEQ ID NO: 244703 - protein, 8 aa, Mycobacterium
AEEASRAE

SEQ ID NO: 244704 - protein, 9 aa, Mycobacterium
AEEASRTEA

SEQ ID NO: 244705 - protein, 20 aa, Mycobacterium
AEEDALSAAEHAEQAEQRAT

SEQ ID NO: 244706 - protein, 7 aa, Mycobacterium
AEEDEPV

SEQ ID NO: 244707 - protein, 16 aa, Mycobacterium
AEEDRRRADAEGQNKG

SEQ ID NO: 244708 - protein, 18 aa, Mycobacterium
AEEDTKASDRESARRSVA

SEQ ID NO: 244709 - protein, 6 aa, Mycobacterium
AEEESV

SEQ ID NO: 244710 - protein, 18 aa, Mycobacterium
AEEEVAPVAENDEVTSTF

SEQ ID NO: 244711 - protein, 5 aa, Mycobacterium
AEEFG

SEQ ID NO: 244712 - protein, 5 aa, Mycobacterium
AEEFS

SEQ ID NO: 244713 - protein, 8 aa, Mycobacterium
AEEGGGTS

SEQ ID NO: 244714 - protein, 10 aa, Mycobacterium
AEEIRNPSKV

SEQ ID NO: 244715 - protein, 6 aa, Mycobacterium
AEEKID

SEQ ID NO: 244716 - protein, 6 aa, Mycobacterium
AEEKIE

SEQ ID NO: 244717 - protein, 7 aa, Mycobacterium
AEEKVDA

SEQ ID NO: 244718 - protein, 5 aa, Mycobacterium
AEEMS

SEQ ID NO: 244719 - protein, 4 aa, Mycobacterium
AEEP

SEQ ID NO: 244720 - protein, 5 aa, Mycobacterium
AEEPL

SEQ ID NO: 244721 - protein, 47 aa, Mycobacterium
AEEPNPGSAETQTTGKAAKKKTAKTVKAVERTADPVIGEGDDDSGPG

SEQ ID NO: 244722 - protein, 6 aa, Mycobacterium
AEERAA

SEQ ID NO: 244723 - protein, 9 aa, Mycobacterium
AEERETAAR

SEQ ID NO: 244724 - protein, 7 aa, Mycobacterium
AEERGLT

SEQ ID NO: 244725 - protein, 8 aa, Mycobacterium
AEERPDGT

SEQ ID NO: 244726 - protein, 10 aa, Mycobacterium
AEERQPGGYG

SEQ ID NO: 244727 - protein, 10 aa, Mycobacterium
AEERSPGGYG

SEQ ID NO: 244728 - protein, 9 aa, Mycobacterium
AEESKNPKK

SEQ ID NO: 244729 - protein, 12 aa, Mycobacterium
AEESLKGSPLED

SEQ ID NO: 244730 - protein, 9 aa, Mycobacterium
AEESPEPAL

SEQ ID NO: 244731 - protein, 8 aa, Mycobacterium
AEESSGVR

SEQ ID NO: 244732 - protein, 5 aa, Mycobacterium
AEESV

SEQ ID NO: 244733 - protein, 13 aa, Mycobacterium
AEETADPARNVPR

SEQ ID NO: 244734 - protein, 24 aa, Mycobacterium
AEEVAAQAKSTVEAAPNPVSGPVP

SEQ ID NO: 244735 - protein, 20 aa, Mycobacterium
AEEYRNEFPDAPESSDSATT

SEQ ID NO: 244736 - protein, 4 aa, Mycobacterium
AEFD

SEQ ID NO: 244737 - protein, 8 aa, Mycobacterium
AEFGDTPA

SEQ ID NO: 244738 - protein, 7 aa, Mycobacterium
AEFPRSG

SEQ ID NO: 244739 - protein, 5 aa, Mycobacterium
AEGAA

SEQ ID NO: 244740 - protein, 10 aa, Mycobacterium
AEGAAPVSDR

SEQ ID NO: 244741 - protein, 39 aa, Mycobacterium
AEGAEMPAGPAGSEPAPEAAQTARATPRSEAAPDAYADS

SEQ ID NO: 244742 - protein, 7 aa, Mycobacterium
AEGAERS

SEQ ID NO: 244743 - protein, 20 aa, Mycobacterium
AEGASARAKSGEDAAELRKE

SEQ ID NO: 244744 - protein, 6 aa, Mycobacterium
AEGAVP

SEQ ID NO: 244745 - protein, 4 aa, Mycobacterium
AEGD

SEQ ID NO: 244746 - protein, 11 aa, Mycobacterium
AEGDEAHSDAI

SEQ ID NO: 244747 - protein, 6 aa, Mycobacterium
AEGDLA

SEQ ID NO: 244748 - protein, 6 aa, Mycobacterium
AEGDRV

SEQ ID NO: 244749 - protein, 15 aa, Mycobacterium
AEGDSSVTQSDPADL

SEQ ID NO: 244750 - protein, 4 aa, Mycobacterium
AEGG

SEQ ID NO: 244751 - protein, 10 aa, Mycobacterium
AEGGADHRGR

SEQ ID NO: 244752 - protein, 7 aa, Mycobacterium
AEGGEVT

SEQ ID NO: 244753 - protein, 10 aa, Mycobacterium
AEGGPDARGR

SEQ ID NO: 244754 - protein, 9 aa, Mycobacterium
AEGGPDHRG

SEQ ID NO: 244755 - protein, 10 aa, Mycobacterium
AEGGPDHRGR

SEQ ID NO: 244756 - protein, 10 aa, Mycobacterium
AEGGPDPRGR

SEQ ID NO: 244757 - protein, 9 aa, Mycobacterium
AEGGPPSRA

SEQ ID NO: 244758 - protein, 26 aa, Mycobacterium
AEGGQDTSADSAPVRQTESQQATDAR

SEQ ID NO: 244759 - protein, 15 aa, Mycobacterium
AEGGRATADTAPRRL

SEQ ID NO: 244760 - protein, 9 aa, Mycobacterium
AEGGRDHRG

SEQ ID NO: 244761 - protein, 10 aa, Mycobacterium
AEGGTDHRGR

SEQ ID NO: 244762 - protein, 5 aa, Mycobacterium
AEGGW

SEQ ID NO: 244763 - protein, 7 aa, Mycobacterium
AEGKEGV

SEQ ID NO: 244764 - protein, 6 aa, Mycobacterium
AEGKHS

SEQ ID NO: 244765 - protein, 8 aa, Mycobacterium
AEGKQRPN

SEQ ID NO: 244766 - protein, 10 aa, Mycobacterium
AEGKTHPSVI

SEQ ID NO: 244767 - protein, 8 aa, Mycobacterium
AEGLGTRL

SEQ ID NO: 244768 - protein, 11 aa, Mycobacterium
AEGLRAEAAGQ

SEQ ID NO: 244769 - protein, 7 aa, Mycobacterium
AEGLSET

SEQ ID NO: 244770 - protein, 19 aa, Mycobacterium
AEGNRGAGSPAAQPPPPQS

SEQ ID NO: 244771 - protein, 12 aa, Mycobacterium
AEGPNRLPAPRR

SEQ ID NO: 244772 - protein, 19 aa, Mycobacterium
AEGPRETVDATQTTPRPVG

SEQ ID NO: 244773 - protein, 8 aa, Mycobacterium
AEGPTEEQ

SEQ ID NO: 244774 - protein, 6 aa, Mycobacterium
AEGQKL

SEQ ID NO: 244775 - protein, 7 aa, Mycobacterium
AEGQPFT

SEQ ID NO: 244776 - protein, 8 aa, Mycobacterium
AEGRADVA

SEQ ID NO: 244777 - protein, 18 aa, Mycobacterium
AEGRRGPGGFRHGSAGDI

SEQ ID NO: 244778 - protein, 9 aa, Mycobacterium
AEGRRGPSV

SEQ ID NO: 244779 - protein, 5 aa, Mycobacterium
AEGRT

SEQ ID NO: 244780 - protein, 8 aa, Mycobacterium
AEGSGAAL

SEQ ID NO: 244781 - protein, 6 aa, Mycobacterium
AEGSGY

SEQ ID NO: 244782 - protein, 10 aa, Mycobacterium
AEGSPGQSVI

SEQ ID NO: 244783 - protein, 6 aa, Mycobacterium
AEGTKR

SEQ ID NO: 244784 - protein, 10 aa, Mycobacterium
AEGTTHGAEK

SEQ ID NO: 244785 - protein, 9 aa, Mycobacterium
AEGYSRDPL

SEQ ID NO: 244786 - protein, 12 aa, Mycobacterium
AEHAAAEEERDL

SEQ ID NO: 244787 - protein, 22 aa, Mycobacterium
AEHAGDASVPAPAARAAGIADS

SEQ ID NO: 244788 - protein, 6 aa, Mycobacterium
AEHEAH

SEQ ID NO: 244789 - protein, 7 aa, Mycobacterium
AEHEDDE

SEQ ID NO: 244790 - protein, 20 aa, Mycobacterium
AEHEPGEVRRTAAGAGGLPP

SEQ ID NO: 244791 - protein, 4 aa, Mycobacterium
AEHK

SEQ ID NO: 244792 - protein, 24 aa, Mycobacterium
AEHPAAGPEHESGGVAVQPPPRGN

SEQ ID NO: 244793 - protein, 7 aa, Mycobacterium
AEHPDVA

SEQ ID NO: 244794 - protein, 8 aa, Mycobacterium
AEHPSEHP

SEQ ID NO: 244795 - protein, 5 aa, Mycobacterium
AEHRD

SEQ ID NO: 244796 - protein, 13 aa, Mycobacterium
AEHSTSSLSGGEL

SEQ ID NO: 244797 - protein, 6 aa, Mycobacterium
AEHTRV

SEQ ID NO: 244798 - protein, 4 aa, Mycobacterium
AEIA

SEQ ID NO: 244799 - protein, 7 aa, Mycobacterium
AEIADGS

SEQ ID NO: 244800 - protein, 16 aa, Mycobacterium
AEIGPGHPTTSQQEQT

SEQ ID NO: 244801 - protein, 7 aa, Mycobacterium
AEIGQGV

SEQ ID NO: 244802 - protein, 6 aa, Mycobacterium
AEIQPY

SEQ ID NO: 244803 - protein, 5 aa, Mycobacterium
AEISE

SEQ ID NO: 244804 - protein, 43 aa, Mycobacterium
AEKADAAPQAKDEPESPSSSPTVAEAPTDASTGEPAAAPVQVP

SEQ ID NO: 244805 - protein, 40 aa, Mycobacterium
AEKAGASEAAATAGGHAAAAAAEGAGATAAEGAAAAAAPE

SEQ ID NO: 244806 - protein, 8 aa, Mycobacterium
AEKARRHG

SEQ ID NO: 244807 - protein, 5 aa, Mycobacterium
AEKDF

SEQ ID NO: 244808 - protein, 10 aa, Mycobacterium
AEKELSPQQQ

SEQ ID NO: 244809 - protein, 57 aa, Mycobacterium
AEKERPEEETAEQTVEAAEEPELTEPAEEATSSDDVTPEAEETPEESPEPDPEPART

SEQ ID NO: 244810 - protein, 13 aa, Mycobacterium
AEKHEQREATPLV

SEQ ID NO: 244811 - protein, 43 aa, Mycobacterium
AEKNGGEPDELDDPWRDPGAAAALGTPAVAPSTSRSALGYGGK

SEQ ID NO: 244812 - protein, 16 aa, Mycobacterium
AEKPIRAGGATRSGAV

SEQ ID NO: 244813 - protein, 13 aa, Mycobacterium
AEKRGQDPEPYRR

SEQ ID NO: 244814 - protein, 8 aa, Mycobacterium
AEKRRREG

SEQ ID NO: 244815 - protein, 7 aa, Mycobacterium
AEKSPFD

SEQ ID NO: 244816 - protein, 13 aa, Mycobacterium
AEKTPPDRRAEVS

SEQ ID NO: 244817 - protein, 77 aa, Mycobacterium
AELAEAKKQAAEETAAAVPAEAEPEATASVATEAPDAEVDATEAADDAETVGAEESVAEAEADASADTAQPARRRRR

SEQ ID NO: 244818 - protein, 14 aa, Mycobacterium
AELAGPAGAPQPHL

SEQ ID NO: 244819 - protein, 31 aa, Mycobacterium
AELATQAQYSAQQEVQSAQRYYGNGYGGYSV

SEQ ID NO: 244820 - protein, 8 aa, Mycobacterium
AELDAGPE

SEQ ID NO: 244821 - protein, 8 aa, Mycobacterium
AELDGPGT

SEQ ID NO: 244822 - protein, 8 aa, Mycobacterium
AELEEQGR

SEQ ID NO: 244823 - protein, 8 aa, Mycobacterium
AELERGRQ

SEQ ID NO: 244824 - protein, 4 aa, Mycobacterium
AELG

SEQ ID NO: 244825 - protein, 7 aa, Mycobacterium
AELGAEG

SEQ ID NO: 244826 - protein, 12 aa, Mycobacterium
AELGAGATVGPA

SEQ ID NO: 244827 - protein, 6 aa, Mycobacterium
AELGEQ

SEQ ID NO: 244828 - protein, 6 aa, Mycobacterium
AELGGQ

SEQ ID NO: 244829 - protein, 10 aa, Mycobacterium
AELGSGEAPA

SEQ ID NO: 244830 - protein, 8 aa, Mycobacterium
AELGSGSL

SEQ ID NO: 244831 - protein, 12 aa, Mycobacterium
AELKGRSPAERA

SEQ ID NO: 244832 - protein, 10 aa, Mycobacterium
AELKTADAVP

SEQ ID NO: 244833 - protein, 6 aa, Mycobacterium
AELNQR

SEQ ID NO: 244834 - protein, 9 aa, Mycobacterium
AELPAGPGA

SEQ ID NO: 244835 - protein, 8 aa, Mycobacterium
AELPGNQK

SEQ ID NO: 244836 - protein, 22 aa, Mycobacterium
AELPGVSEVPNPTQRPPQPDRP

SEQ ID NO: 244837 - protein, 7 aa, Mycobacterium
AELPPTT

SEQ ID NO: 244838 - protein, 8 aa, Mycobacterium
AELPSATG

SEQ ID NO: 244839 - protein, 11 aa, Mycobacterium
AELSDAQRTRL

SEQ ID NO: 244840 - protein, 6 aa, Mycobacterium
AELSDP

SEQ ID NO: 244841 - protein, 6 aa, Mycobacterium
AELSGA

SEQ ID NO: 244842 - protein, 6 aa, Mycobacterium
AELSGQ

SEQ ID NO: 244843 - protein, 5 aa, Mycobacterium
AELTA

SEQ ID NO: 244844 - protein, 8 aa, Mycobacterium
AELTGDPL

SEQ ID NO: 244845 - protein, 21 aa, Mycobacterium
AELTPADRKTYTKKAKAERVK

SEQ ID NO: 244846 - protein, 9 aa, Mycobacterium
AENAGVKPQ

SEQ ID NO: 244847 - protein, 10 aa, Mycobacterium
AENAGVKPQT

SEQ ID NO: 244848 - protein, 6 aa, Mycobacterium
AENAHL

SEQ ID NO: 244849 - protein, 9 aa, Mycobacterium
AENASATRA

SEQ ID NO: 244850 - protein, 5 aa, Mycobacterium
AENAY

SEQ ID NO: 244851 - protein, 15 aa, Mycobacterium
AENGDGGEAGSGAAA

SEQ ID NO: 244852 - protein, 8 aa, Mycobacterium
AENMESRP

SEQ ID NO: 244853 - protein, 16 aa, Mycobacterium
AENMPAQRRRAAHTAI

SEQ ID NO: 244854 - protein, 6 aa, Mycobacterium
AENNAT

SEQ ID NO: 244855 - protein, 7 aa, Mycobacterium
AENPEPG

SEQ ID NO: 244856 - protein, 6 aa, Mycobacterium
AENPEQ

SEQ ID NO: 244857 - protein, 9 aa, Mycobacterium
AENPGNEQR

SEQ ID NO: 244858 - protein, 4 aa, Mycobacterium
AENT

SEQ ID NO: 244859 - protein, 17 aa, Mycobacterium
AENYGGTGDYKAGTATF

SEQ ID NO: 244860 - protein, 4 aa, Mycobacterium
AEPA

SEQ ID NO: 244861 - protein, 8 aa, Mycobacterium
AEPAEPTV

SEQ ID NO: 244862 - protein, 11 aa, Mycobacterium
AEPAQSRRQPR

SEQ ID NO: 244863 - protein, 5 aa, Mycobacterium
AEPAR

SEQ ID NO: 244864 - protein, 7 aa, Mycobacterium
AEPARGT

SEQ ID NO: 244865 - protein, 24 aa, Mycobacterium
AEPARPSPPEPEPVAAEPAAEEPA

SEQ ID NO: 244866 - protein, 94 aa, Mycobacterium
AEPARRSERTSGRSRATTTKPKAGGKRGTAREAKRTPVDAQPRGRKTTRDARPQRSAPRTTPISRPVDAPARPKSATQAKARAKARKAKAPKVV

SEQ ID NO: 244867 - protein, 9 aa, Mycobacterium
AEPASDEAF

SEQ ID NO: 244868 - protein, 8 aa, Mycobacterium
AEPATGSV

SEQ ID NO: 244869 - protein, 12 aa, Mycobacterium
AEPAVRAGSVVV

SEQ ID NO: 244870 - protein, 4 aa, Mycobacterium
AEPD

SEQ ID NO: 244871 - protein, 20 aa, Mycobacterium
AEPDDRERRDAEEDRGREEV

SEQ ID NO: 244872 - protein, 6 aa, Mycobacterium
AEPDEL

SEQ ID NO: 244873 - protein, 6 aa, Mycobacterium
AEPDGM

SEQ ID NO: 244874 - protein, 21 aa, Mycobacterium
AEPDPALSNDDDRPARPKRRA

SEQ ID NO: 244875 - protein, 12 aa, Mycobacterium
AEPDRPADSSAT

SEQ ID NO: 244876 - protein, 7 aa, Mycobacterium
AEPDTAV

SEQ ID NO: 244877 - protein, 5 aa, Mycobacterium
AEPDV

SEQ ID NO: 244878 - protein, 9 aa, Mycobacterium
AEPEHGSID

SEQ ID NO: 244879 - protein, 9 aa, Mycobacterium
AEPELDGMG

SEQ ID NO: 244880 - protein, 7 aa, Mycobacterium
AEPGENY

SEQ ID NO: 244881 - protein, 6 aa, Mycobacterium
AEPGHV

SEQ ID NO: 244882 - protein, 12 aa, Mycobacterium
AEPGPGSPARVA

SEQ ID NO: 244883 - protein, 13 aa, Mycobacterium
AEPGPRKRKPAAM

SEQ ID NO: 244884 - protein, 6 aa, Mycobacterium
AEPGQT

SEQ ID NO: 244885 - protein, 9 aa, Mycobacterium
AEPGRDPRA

SEQ ID NO: 244886 - protein, 6 aa, Mycobacterium
AEPGTT

SEQ ID NO: 244887 - protein, 6 aa, Mycobacterium
AEPGVS

SEQ ID NO: 244888 - protein, 5 aa, Mycobacterium
AEPHD

SEQ ID NO: 244889 - protein, 8 aa, Mycobacterium
AEPHPPEH

SEQ ID NO: 244890 - protein, 5 aa, Mycobacterium
AEPHR

SEQ ID NO: 244891 - protein, 12 aa, Mycobacterium
AEPHSAEARKIS

SEQ ID NO: 244892 - protein, 5 aa, Mycobacterium
AEPKD

SEQ ID NO: 244893 - protein, 10 aa, Mycobacterium
AEPKPPAAAA

SEQ ID NO: 244894 - protein, 7 aa, Mycobacterium
AEPNTGA

SEQ ID NO: 244895 - protein, 4 aa, Mycobacterium
AEPQ

SEQ ID NO: 244896 - protein, 9 aa, Mycobacterium
AEPQPDRSL

SEQ ID NO: 244897 - protein, 6 aa, Mycobacterium
AEPQPV

SEQ ID NO: 244898 - protein, 5 aa, Mycobacterium
AEPRA

SEQ ID NO: 244899 - protein, 8 aa, Mycobacterium
AEPRDVRQ

SEQ ID NO: 244900 - protein, 8 aa, Mycobacterium
AEPRPVRQ

SEQ ID NO: 244901 - protein, 12 aa, Mycobacterium
AEPSGGNRMDSG

SEQ ID NO: 244902 - protein, 6 aa, Mycobacterium
AEPSRA

SEQ ID NO: 244903 - protein, 10 aa, Mycobacterium
AEPSYEEQHR

SEQ ID NO: 244904 - protein, 4 aa, Mycobacterium
AEPT

SEQ ID NO: 244905 - protein, 12 aa, Mycobacterium
AEPTDDSTAKTR

SEQ ID NO: 244906 - protein, 17 aa, Mycobacterium
AEPTNPRDESIRRSEHH

SEQ ID NO: 244907 - protein, 56 aa, Mycobacterium
AEPVPGAEAETEKLPTQRPELPADPATPTAESPPPPSASTEPPPESGPPEPPPAER

SEQ ID NO: 244908 - protein, 31 aa, Mycobacterium
AEPVRRDEGRPEGFRRPPPAGRNGRQASNFQ

SEQ ID NO: 244909 - protein, 44 aa, Mycobacterium
AEQAAAAAPANGVPPAPAGPHGHLPNGQGGQPVPPGVNYGAPAG

SEQ ID NO: 244910 - protein, 9 aa, Mycobacterium
AEQAAAQDN

SEQ ID NO: 244911 - protein, 18 aa, Mycobacterium
AEQADTEAERIKSQGAQQ

SEQ ID NO: 244912 - protein, 14 aa, Mycobacterium
AEQAKAQSDAREHG

SEQ ID NO: 244913 - protein, 8 aa, Mycobacterium
AEQATNFP

SEQ ID NO: 244914 - protein, 10 aa, Mycobacterium
AEQDDPDGGA

SEQ ID NO: 244915 - protein, 6 aa, Mycobacterium
AEQDNR

SEQ ID NO: 244916 - protein, 15 aa, Mycobacterium
AEQERREAAKRDQRT

SEQ ID NO: 244917 - protein, 20 aa, Mycobacterium
AEQGALAAAEQAEKAEQRAA

SEQ ID NO: 244918 - protein, 7 aa, Mycobacterium
AEQGKAR

SEQ ID NO: 244919 - protein, 9 aa, Mycobacterium
AEQGKSSAV

SEQ ID NO: 244920 - protein, 7 aa, Mycobacterium
AEQGRAA

SEQ ID NO: 244921 - protein, 12 aa, Mycobacterium
AEQIPDPVGLTV

SEQ ID NO: 244922 - protein, 10 aa, Mycobacterium
AEQLATKTGV

SEQ ID NO: 244923 - protein, 11 aa, Mycobacterium
AEQNPDSDETK

SEQ ID NO: 244924 - protein, 7 aa, Mycobacterium
AEQPADV

SEQ ID NO: 244925 - protein, 26 aa, Mycobacterium
AEQPATSAPYTAPRPAPARAAERNAD

SEQ ID NO: 244926 - protein, 7 aa, Mycobacterium
AEQPPDV

SEQ ID NO: 244927 - protein, 5 aa, Mycobacterium
AEQPQ

SEQ ID NO: 244928 - protein, 4 aa, Mycobacterium
AEQQ

SEQ ID NO: 244929 - protein, 17 aa, Mycobacterium
AEQQAPGSQPAGSQASI

SEQ ID NO: 244930 - protein, 7 aa, Mycobacterium
AEQRATA

SEQ ID NO: 244931 - protein, 8 aa, Mycobacterium
AEQRGGAT

SEQ ID NO: 244932 - protein, 6 aa, Mycobacterium
AEQRQE

SEQ ID NO: 244933 - protein, 6 aa, Mycobacterium
AEQRQR

SEQ ID NO: 244934 - protein, 9 aa, Mycobacterium
AEQSPADKV

SEQ ID NO: 244935 - protein, 11 aa, Mycobacterium
AEQSSVELDRA

SEQ ID NO: 244936 - protein, 18 aa, Mycobacterium
AEQTREIEAGDEAPDVEV

SEQ ID NO: 244937 - protein, 16 aa, Mycobacterium
AEQTRSIDAGDEAPRV

SEQ ID NO: 244938 - protein, 13 aa, Mycobacterium
AEQYDGGGLAGEP

SEQ ID NO: 244939 - protein, 14 aa, Mycobacterium
AERAAAAHTADGHT

SEQ ID NO: 244940 - protein, 6 aa, Mycobacterium
AERADA

SEQ ID NO: 244941 - protein, 12 aa, Mycobacterium
AERADRLDRQIE

SEQ ID NO: 244942 - protein, 10 aa, Mycobacterium
AERANPQRVA

SEQ ID NO: 244943 - protein, 10 aa, Mycobacterium
AERANPRRVA

SEQ ID NO: 244944 - protein, 9 aa, Mycobacterium
AERATEDAE

SEQ ID NO: 244945 - protein, 9 aa, Mycobacterium
AERDGQIED

SEQ ID NO: 244946 - protein, 11 aa, Mycobacterium
AERDGQSEEVE

SEQ ID NO: 244947 - protein, 6 aa, Mycobacterium
AERDYT

SEQ ID NO: 244948 - protein, 4 aa, Mycobacterium
AERE

SEQ ID NO: 244949 - protein, 11 aa, Mycobacterium
AEREDADGGEA

SEQ ID NO: 244950 - protein, 8 aa, Mycobacterium
AEREDPGG

SEQ ID NO: 244951 - protein, 21 aa, Mycobacterium
AEREGPRELRSPDGPRQLPPG

SEQ ID NO: 244952 - protein, 13 aa, Mycobacterium
AEREKPKLGGEER

SEQ ID NO: 244953 - protein, 6 aa, Mycobacterium
AEREPV

SEQ ID NO: 244954 - protein, 13 aa, Mycobacterium
AERETGSLSGGEL

SEQ ID NO: 244955 - protein, 12 aa, Mycobacterium
AERGAHGVIAVG

SEQ ID NO: 244956 - protein, 7 aa, Mycobacterium
AERGEEA

SEQ ID NO: 244957 - protein, 5 aa, Mycobacterium
AERGH

SEQ ID NO: 244958 - protein, 8 aa, Mycobacterium
AERGKAQF

SEQ ID NO: 244959 - protein, 7 aa, Mycobacterium
AERGTHD

SEQ ID NO: 244960 - protein, 9 aa, Mycobacterium
AERGVGAES

SEQ ID NO: 244961 - protein, 4 aa, Mycobacterium
AERH

SEQ ID NO: 244962 - protein, 8 aa, Mycobacterium
AERHPDTE

SEQ ID NO: 244963 - protein, 14 aa, Mycobacterium
AERIPAPIGLARRA

SEQ ID NO: 244964 - protein, 7 aa, Mycobacterium
AERIPAS

SEQ ID NO: 244965 - protein, 11 aa, Mycobacterium
AERMTTQGGRQ

SEQ ID NO: 244966 - protein, 26 aa, Mycobacterium
AERPAIESATRRAPQHGAGDTSGDVP

SEQ ID NO: 244967 - protein, 26 aa, Mycobacterium
AERPALEAPRHPQPGWPPDPRGGIDD

SEQ ID NO: 244968 - protein, 8 aa, Mycobacterium
AERPDRTQ

SEQ ID NO: 244969 - protein, 7 aa, Mycobacterium
AERPRHA

SEQ ID NO: 244970 - protein, 14 aa, Mycobacterium
AERPVRDDALDDRR

SEQ ID NO: 244971 - protein, 13 aa, Mycobacterium
AERQPPKLGGEER

SEQ ID NO: 244972 - protein, 5 aa, Mycobacterium
AERQR

SEQ ID NO: 244973 - protein, 7 aa, Mycobacterium
AERQTRD

SEQ ID NO: 244974 - protein, 8 aa, Mycobacterium
AERRQVGA

SEQ ID NO: 244975 - protein, 30 aa, Mycobacterium
AERRRGSHAAATGPQRIPDREPRPGGAPTE

SEQ ID NO: 244976 - protein, 4 aa, Mycobacterium
AERS

SEQ ID NO: 244977 - protein, 6 aa, Mycobacterium
AERSAA

SEQ ID NO: 244978 - protein, 12 aa, Mycobacterium
AERSAAAQATRA

SEQ ID NO: 244979 - protein, 5 aa, Mycobacterium
AERSG

SEQ ID NO: 244980 - protein, 11 aa, Mycobacterium
AERSLRDPLTG

SEQ ID NO: 244981 - protein, 4 aa, Mycobacterium
AERT

SEQ ID NO: 244982 - protein, 16 aa, Mycobacterium
AERTAAQEALKQSSLA

SEQ ID NO: 244983 - protein, 9 aa, Mycobacterium
AERTAAQEG

SEQ ID NO: 244984 - protein, 5 aa, Mycobacterium
AERTG

SEQ ID NO: 244985 - protein, 14 aa, Mycobacterium
AERTGDVAAPLTAK

SEQ ID NO: 244986 - protein, 8 aa, Mycobacterium
AERTPTGK

SEQ ID NO: 244987 - protein, 5 aa, Mycobacterium
AERTQ

SEQ ID NO: 244988 - protein, 5 aa, Mycobacterium
AERTT

SEQ ID NO: 244989 - protein, 9 aa, Mycobacterium
AERVARTDD

SEQ ID NO: 244990 - protein, 9 aa, Mycobacterium
AERVASETA

SEQ ID NO: 244991 - protein, 6 aa, Mycobacterium
AERVGD

SEQ ID NO: 244992 - protein, 7 aa, Mycobacterium
AERVQPA

SEQ ID NO: 244993 - protein, 15 aa, Mycobacterium
AESAEAAKKLADADA

SEQ ID NO: 244994 - protein, 15 aa, Mycobacterium
AESAEPAKSVARATT

SEQ ID NO: 244995 - protein, 10 aa, Mycobacterium
AESAEPERAV

SEQ ID NO: 244996 - protein, 10 aa, Mycobacterium
AESAKSTLPA

SEQ ID NO: 244997 - protein, 8 aa, Mycobacterium
AESALGQA

SEQ ID NO: 244998 - protein, 12 aa, Mycobacterium
AESALPPELPGT

SEQ ID NO: 244999 - protein, 7 aa, Mycobacterium
AESARSK

SEQ ID NO: 245000 - protein, 15 aa, Mycobacterium
AESATDERDPDAEHA

SEQ ID NO: 245001 - protein, 16 aa, Mycobacterium
AESDTARTESVQAAKD

SEQ ID NO: 245002 - protein, 7 aa, Mycobacterium
AESEDQL

SEQ ID NO: 245003 - protein, 43 aa, Mycobacterium
AESEDTATEPESDEVTGPSGEKPSDKPSDEKPAATVTSPNQRR

SEQ ID NO: 245004 - protein, 7 aa, Mycobacterium
AESEGRF

SEQ ID NO: 245005 - protein, 11 aa, Mycobacterium
AESEPEAGPEK

SEQ ID NO: 245006 - protein, 22 aa, Mycobacterium
AESERDDEPADAHPKRPRERAR

SEQ ID NO: 245007 - protein, 7 aa, Mycobacterium
AESERGA

SEQ ID NO: 245008 - protein, 16 aa, Mycobacterium
AESERSALTDPHTRQR

SEQ ID NO: 245009 - protein, 5 aa, Mycobacterium
AESFP

SEQ ID NO: 245010 - protein, 22 aa, Mycobacterium
AESGAAGYQSPSDTGGDVTANK

SEQ ID NO: 245011 - protein, 14 aa, Mycobacterium
AESGAPPAAGESPK

SEQ ID NO: 245012 - protein, 6 aa, Mycobacterium
AESGAQ

SEQ ID NO: 245013 - protein, 8 aa, Mycobacterium
AESGDAAM

SEQ ID NO: 245014 - protein, 17 aa, Mycobacterium
AESGESGIYVQVADAGL

SEQ ID NO: 245015 - protein, 5 aa, Mycobacterium
AESGG

SEQ ID NO: 245016 - protein, 9 aa, Mycobacterium
AESGGAIGE

SEQ ID NO: 245017 - protein, 6 aa, Mycobacterium
AESGNR

SEQ ID NO: 245018 - protein, 7 aa, Mycobacterium
AESGTPI

SEQ ID NO: 245019 - protein, 7 aa, Mycobacterium
AESGTPL

SEQ ID NO: 245020 - protein, 4 aa, Mycobacterium
AESI

SEQ ID NO: 245021 - protein, 14 aa, Mycobacterium
AESIPESIGLTRRV

SEQ ID NO: 245022 - protein, 4 aa, Mycobacterium
AESL

SEQ ID NO: 245023 - protein, 12 aa, Mycobacterium
AESLAETTGADQ

SEQ ID NO: 245024 - protein, 5 aa, Mycobacterium
AESLG

SEQ ID NO: 245025 - protein, 12 aa, Mycobacterium
AESLPRRSDHPN

SEQ ID NO: 245026 - protein, 4 aa, Mycobacterium
AESM

SEQ ID NO: 245027 - protein, 7 aa, Mycobacterium
AESPGEW

SEQ ID NO: 245028 - protein, 8 aa, Mycobacterium
AESPTRIA

SEQ ID NO: 245029 - protein, 7 aa, Mycobacterium
AESPVEQ

SEQ ID NO: 245030 - protein, 7 aa, Mycobacterium
AESQRTT

SEQ ID NO: 245031 - protein, 13 aa, Mycobacterium
AESRAKRSAGSAL

SEQ ID NO: 245032 - protein, 5 aa, Mycobacterium
AESRD

SEQ ID NO: 245033 - protein, 8 aa, Mycobacterium
AESRDPEL

SEQ ID NO: 245034 - protein, 7 aa, Mycobacterium
AESRDPH

SEQ ID NO: 245035 - protein, 15 aa, Mycobacterium
AESRDPQRAIQRATN

SEQ ID NO: 245036 - protein, 17 aa, Mycobacterium
AESRTTSIDARSVSPAD

SEQ ID NO: 245037 - protein, 4 aa, Mycobacterium
AESS

SEQ ID NO: 245038 - protein, 4 aa, Mycobacterium
AEST

SEQ ID NO: 245039 - protein, 10 aa, Mycobacterium
AESTARSHGR

SEQ ID NO: 245040 - protein, 8 aa, Mycobacterium
AESTEPTV

SEQ ID NO: 245041 - protein, 16 aa, Mycobacterium
AESTQVARNSLTRNAG

SEQ ID NO: 245042 - protein, 5 aa, Mycobacterium
AESTV

SEQ ID NO: 245043 - protein, 4 aa, Mycobacterium
AESV

SEQ ID NO: 245044 - protein, 17 aa, Mycobacterium
AESVDRGTSGRPPEVPS

SEQ ID NO: 245045 - protein, 11 aa, Mycobacterium
AESVEQRSDQR

SEQ ID NO: 245046 - protein, 12 aa, Mycobacterium
AESYNKSAGPIG

SEQ ID NO: 245047 - protein, 25 aa, Mycobacterium
AETAAAPEPTPAAVADGQSHLPADL

SEQ ID NO: 245048 - protein, 6 aa, Mycobacterium
AETADE

SEQ ID NO: 245049 - protein, 10 aa, Mycobacterium
AETAEASRRG

SEQ ID NO: 245050 - protein, 77 aa, Mycobacterium
AETAESDEAREPVETDATESEEPSEPEEPDAPEAVEAPEALDENADETRAEPAAPAAVATAPVEPEKGRLRRWLRRN

SEQ ID NO: 245051 - protein, 14 aa, Mycobacterium
AETAPTTNPATTSA

SEQ ID NO: 245052 - protein, 8 aa, Mycobacterium
AETAQGKL

SEQ ID NO: 245053 - protein, 6 aa, Mycobacterium
AETASA

SEQ ID NO: 245054 - protein, 8 aa, Mycobacterium
AETASNRI

SEQ ID NO: 245055 - protein, 5 aa, Mycobacterium
AETAW

SEQ ID NO: 245056 - protein, 7 aa, Mycobacterium
AETCPDG

SEQ ID NO: 245057 - protein, 75 aa, Mycobacterium
AETDATAKTGGTAVRSRRPRVEEAAARTRHGRHESPTRRRPTRDSEPVSRRASSIGTPWEDERPMRTERRPARRL

SEQ ID NO: 245058 - protein, 7 aa, Mycobacterium
AETDDPV

SEQ ID NO: 245059 - protein, 14 aa, Mycobacterium
AETDSENRAATAAQ

SEQ ID NO: 245060 - protein, 12 aa, Mycobacterium
AETDYARRARTA

SEQ ID NO: 245061 - protein, 5 aa, Mycobacterium
AETGE

SEQ ID NO: 245062 - protein, 9 aa, Mycobacterium
AETGEPTRI

SEQ ID NO: 245063 - protein, 9 aa, Mycobacterium
AETGHPIGD

SEQ ID NO: 245064 - protein, 5 aa, Mycobacterium
AETGP

SEQ ID NO: 245065 - protein, 21 aa, Mycobacterium
AETGQPSGLPAANRAPDGRPV

SEQ ID NO: 245066 - protein, 6 aa, Mycobacterium
AETGRP

SEQ ID NO: 245067 - protein, 5 aa, Mycobacterium
AETGY

SEQ ID NO: 245068 - protein, 4 aa, Mycobacterium
AETH

SEQ ID NO: 245069 - protein, 12 aa, Mycobacterium
AETKRRTAEQLG

SEQ ID NO: 245070 - protein, 36 aa, Mycobacterium
AETLTGADKDVDAEALTDADAETEAAGLGSVDGDEV

SEQ ID NO: 245071 - protein, 16 aa, Mycobacterium
AETPAPRSHDSDDHAV

SEQ ID NO: 245072 - protein, 8 aa, Mycobacterium
AETPDPEY

SEQ ID NO: 245073 - protein, 20 aa, Mycobacterium
AETPNHSGPPPPPAGGGTGI

SEQ ID NO: 245074 - protein, 6 aa, Mycobacterium
AETPRD

SEQ ID NO: 245075 - protein, 7 aa, Mycobacterium
AETQDRW

SEQ ID NO: 245076 - protein, 14 aa, Mycobacterium
AETRDATGGPVPSS

SEQ ID NO: 245077 - protein, 5 aa, Mycobacterium
AETRI

SEQ ID NO: 245078 - protein, 7 aa, Mycobacterium
AETRPGL

SEQ ID NO: 245079 - protein, 6 aa, Mycobacterium
AETRRR

SEQ ID NO: 245080 - protein, 16 aa, Mycobacterium
AETRTYRDAKSGTEVR

SEQ ID NO: 245081 - protein, 43 aa, Mycobacterium
AETSAPSATSAPTTQNTDATADAGDTTTDTTGTDDSSGSGSTT

SEQ ID NO: 245082 - protein, 21 aa, Mycobacterium
AETSNTHTDVAGESPEPPQRS

SEQ ID NO: 245083 - protein, 123 aa, Mycobacterium
AETSSGSSSSSSSGSSSSSGSSGTSGSSSSSSSGSSGSSGSSGSADQHLPAQSTDTQQAPQSTDPAQQNTFNPPPPDAPAPPADQAAPAPAPAPAPAPEQAPPPPGPVDVPPPPGAPVPPPPG

SEQ ID NO: 245084 - protein, 8 aa, Mycobacterium
AETSTITD

SEQ ID NO: 245085 - protein, 18 aa, Mycobacterium
AETTGPVRPKIYRPPGDS

SEQ ID NO: 245086 - protein, 6 aa, Mycobacterium
AETTVG

SEQ ID NO: 245087 - protein, 14 aa, Mycobacterium
AETVQASAPDESQH

SEQ ID NO: 245088 - protein, 19 aa, Mycobacterium
AEVAPPDTRTGTSSPGEHV

SEQ ID NO: 245089 - protein, 9 aa, Mycobacterium
AEVAPTAQA

SEQ ID NO: 245090 - protein, 16 aa, Mycobacterium
AEVARTAKSAALGRQL

SEQ ID NO: 245091 - protein, 4 aa, Mycobacterium
AEVD

SEQ ID NO: 245092 - protein, 9 aa, Mycobacterium
AEVEETPEV

SEQ ID NO: 245093 - protein, 8 aa, Mycobacterium
AEVGDGPA

SEQ ID NO: 245094 - protein, 12 aa, Mycobacterium
AEVGGLGNSNFD

SEQ ID NO: 245095 - protein, 6 aa, Mycobacterium
AEVGGT

SEQ ID NO: 245096 - protein, 5 aa, Mycobacterium
AEVGV

SEQ ID NO: 245097 - protein, 16 aa, Mycobacterium
AEVKRQTGADQIKPQT

SEQ ID NO: 245098 - protein, 6 aa, Mycobacterium
AEVNAA

SEQ ID NO: 245099 - protein, 5 aa, Mycobacterium
AEVNG

SEQ ID NO: 245100 - protein, 4 aa, Mycobacterium
AEVP

SEQ ID NO: 245101 - protein, 17 aa, Mycobacterium
AEVPDEAAKTWPGSGPM

SEQ ID NO: 245102 - protein, 22 aa, Mycobacterium
AEVPGTSEIPNPTQRPPQPDRP

SEQ ID NO: 245103 - protein, 15 aa, Mycobacterium
AEVPRTAKSAALGRQ

SEQ ID NO: 245104 - protein, 5 aa, Mycobacterium
AEVPS

SEQ ID NO: 245105 - protein, 9 aa, Mycobacterium
AEVSGTGYV

SEQ ID NO: 245106 - protein, 10 aa, Mycobacterium
AEVSHPAKQG

SEQ ID NO: 245107 - protein, 10 aa, Mycobacterium
AEVTGGPAFG

SEQ ID NO: 245108 - protein, 7 aa, Mycobacterium
AEVTGND

SEQ ID NO: 245109 - protein, 9 aa, Mycobacterium
AEYASAAAE

SEQ ID NO: 245110 - protein, 9 aa, Mycobacterium
AEYEPSAPI

SEQ ID NO: 245111 - protein, 20 aa, Mycobacterium
AEYQESDQLVRSESAKHRQA

SEQ ID NO: 245112 - protein, 5 aa, Mycobacterium
AEYQK

SEQ ID NO: 245113 - protein, 11 aa, Mycobacterium
AEYQRRYPETA

SEQ ID NO: 245114 - protein, 5 aa, Mycobacterium
AEYRR

SEQ ID NO: 245115 - protein, 5 aa, Mycobacterium
AEYSS

SEQ ID NO: 245116 - protein, 7 aa, Mycobacterium
AEYTTAA

SEQ ID NO: 245117 - protein, 9 aa, Mycobacterium
AFADPESEY

SEQ ID NO: 245118 - protein, 46 aa, Mycobacterium
AFAPDTVAAEPPEGEPAASSRAPVVKRSKTPKRRENRAKKRRSRRR

SEQ ID NO: 245119 - protein, 18 aa, Mycobacterium
AFAPPSPGPVGKPPARRN

SEQ ID NO: 245120 - protein, 4 aa, Mycobacterium
AFAS

SEQ ID NO: 245121 - protein, 8 aa, Mycobacterium
AFDEPGSD

SEQ ID NO: 245122 - protein, 9 aa, Mycobacterium
AFDPGPPQW

SEQ ID NO: 245123 - protein, 4 aa, Mycobacterium
AFEP

SEQ ID NO: 245124 - protein, 13 aa, Mycobacterium
AFGDGQISTEEHR

SEQ ID NO: 245125 - protein, 11 aa, Mycobacterium
AFGEQQGARVT

SEQ ID NO: 245126 - protein, 10 aa, Mycobacterium
AFGGAGATTA

SEQ ID NO: 245127 - protein, 5 aa, Mycobacterium
AFPEG

SEQ ID NO: 245128 - protein, 14 aa, Mycobacterium
AFPGATPRSSSGNR

SEQ ID NO: 245129 - protein, 5 aa, Mycobacterium
AFPGI

SEQ ID NO: 245130 - protein, 8 aa, Mycobacterium
AFPGTGTN

SEQ ID NO: 245131 - protein, 8 aa, Mycobacterium
AFPPGEES

SEQ ID NO: 245132 - protein, 22 aa, Mycobacterium
AFPPPPPPRPPRPGPPPDATAT

SEQ ID NO: 245133 - protein, 8 aa, Mycobacterium
AFPQEGGP

SEQ ID NO: 245134 - protein, 6 aa, Mycobacterium
AFPSSN

SEQ ID NO: 245135 - protein, 5 aa, Mycobacterium
AFSGA

SEQ ID NO: 245136 - protein, 7 aa, Mycobacterium
AFSPAAS

SEQ ID NO: 245137 - protein, 7 aa, Mycobacterium
AFSPGGG

SEQ ID NO: 245138 - protein, 5 aa, Mycobacterium
AFSPR

SEQ ID NO: 245139 - protein, 18 aa, Mycobacterium
AFSQGSAAPNGNGSPVDQ

SEQ ID NO: 245140 - protein, 20 aa, Mycobacterium
AFSSGSAGPAQGGNGANVDQ

SEQ ID NO: 245141 - protein, 7 aa, Mycobacterium
AFSSTRG

SEQ ID NO: 245142 - protein, 10 aa, Mycobacterium
AFTDNPAQPV

SEQ ID NO: 245143 - protein, 6 aa, Mycobacterium
AFTGAA

SEQ ID NO: 245144 - protein, 9 aa, Mycobacterium
AFTGDPADA

SEQ ID NO: 245145 - protein, 8 aa, Mycobacterium
AFTGGGGL

SEQ ID NO: 245146 - protein, 8 aa, Mycobacterium
AFTPNARN

SEQ ID NO: 245147 - protein, 6 aa, Mycobacterium
AFTPTD

SEQ ID NO: 245148 - protein, 7 aa, Mycobacterium
AFTPTDK

SEQ ID NO: 245149 - protein, 8 aa, Mycobacterium
AFTPVSPR

SEQ ID NO: 245150 - protein, 11 aa, Mycobacterium
AFTSTSSADGF

SEQ ID NO: 245151 - protein, 7 aa, Mycobacterium
AFVSPDG

SEQ ID NO: 245152 - protein, 13 aa, Mycobacterium
AGAAAAAVPATAA

SEQ ID NO: 245153 - protein, 7 aa, Mycobacterium
AGAAAAR

SEQ ID NO: 245154 - protein, 6 aa, Mycobacterium
AGAAAG

SEQ ID NO: 245155 - protein, 7 aa, Mycobacterium
AGAAAGI

SEQ ID NO: 245156 - protein, 10 aa, Mycobacterium
AGAAAPADLG

SEQ ID NO: 245157 - protein, 7 aa, Mycobacterium
AGAAASA

SEQ ID NO: 245158 - protein, 9 aa, Mycobacterium
AGAAATAAT

SEQ ID NO: 245159 - protein, 10 aa, Mycobacterium
AGAADGFSKT

SEQ ID NO: 245160 - protein, 12 aa, Mycobacterium
AGAADGTTWSEG

SEQ ID NO: 245161 - protein, 9 aa, Mycobacterium
AGAAESGPI

SEQ ID NO: 245162 - protein, 5 aa, Mycobacterium
AGAAG

SEQ ID NO: 245163 - protein, 19 aa, Mycobacterium
AGAAGSAGSVGAADSASLV

SEQ ID NO: 245164 - protein, 11 aa, Mycobacterium
AGAAGSGTVTH

SEQ ID NO: 245165 - protein, 11 aa, Mycobacterium
AGAAGTGATSL

SEQ ID NO: 245166 - protein, 8 aa, Mycobacterium
AGAAGTVP

SEQ ID NO: 245167 - protein, 5 aa, Mycobacterium
AGAAL

SEQ ID NO: 245168 - protein, 6 aa, Mycobacterium
AGAAPE

SEQ ID NO: 245169 - protein, 5 aa, Mycobacterium
AGAAS

SEQ ID NO: 245170 - protein, 6 aa, Mycobacterium
AGAASA

SEQ ID NO: 245171 - protein, 20 aa, Mycobacterium
AGAASASKLADTGAEDSAGL

SEQ ID NO: 245172 - protein, 6 aa, Mycobacterium
AGAASL

SEQ ID NO: 245173 - protein, 5 aa, Mycobacterium
AGAAT

SEQ ID NO: 245174 - protein, 12 aa, Mycobacterium
AGAATAKANPGQ

SEQ ID NO: 245175 - protein, 17 aa, Mycobacterium
AGAATPVVAGTPSTGSQ

SEQ ID NO: 245176 - protein, 13 aa, Mycobacterium
AGAATQKTISESH

SEQ ID NO: 245177 - protein, 7 aa, Mycobacterium
AGAATRL

SEQ ID NO: 245178 - protein, 13 aa, Mycobacterium
AGAATTGAARTHR

SEQ ID NO: 245179 - protein, 8 aa, Mycobacterium
AGADGANA

SEQ ID NO: 245180 - protein, 8 aa, Mycobacterium
AGADGPGR

SEQ ID NO: 245181 - protein, 10 aa, Mycobacterium
AGADGPRSRA

SEQ ID NO: 245182 - protein, 7 aa, Mycobacterium
AGADGRI

SEQ ID NO: 245183 - protein, 5 aa, Mycobacterium
AGADI

SEQ ID NO: 245184 - protein, 9 aa, Mycobacterium
AGADLAESA

SEQ ID NO: 245185 - protein, 14 aa, Mycobacterium
AGADPEADAERRRA

SEQ ID NO: 245186 - protein, 11 aa, Mycobacterium
AGADPQADAAR

SEQ ID NO: 245187 - protein, 11 aa, Mycobacterium
AGADPQADAER

SEQ ID NO: 245188 - protein, 10 aa, Mycobacterium
AGADPQRRRE

SEQ ID NO: 245189 - protein, 6 aa, Mycobacterium
AGADPY

SEQ ID NO: 245190 - protein, 14 aa, Mycobacterium
AGADRELESQTEAF

SEQ ID NO: 245191 - protein, 5 aa, Mycobacterium
AGADS

SEQ ID NO: 245192 - protein, 8 aa, Mycobacterium
AGADSTDR

SEQ ID NO: 245193 - protein, 8 aa, Mycobacterium
AGADSTGR

SEQ ID NO: 245194 - protein, 14 aa, Mycobacterium
AGADTAADAERRRG

SEQ ID NO: 245195 - protein, 13 aa, Mycobacterium
AGADTPDRSAAVS

SEQ ID NO: 245196 - protein, 8 aa, Mycobacterium
AGAEAPGV

SEQ ID NO: 245197 - protein, 8 aa, Mycobacterium
AGAEATMS

SEQ ID NO: 245198 - protein, 8 aa, Mycobacterium
AGAEAYRA

SEQ ID NO: 245199 - protein, 14 aa, Mycobacterium
AGAEAYTGAEAANR

SEQ ID NO: 245200 - protein, 6 aa, Mycobacterium
AGAEFA

SEQ ID NO: 245201 - protein, 7 aa, Mycobacterium
AGAEGGA

SEQ ID NO: 245202 - protein, 19 aa, Mycobacterium
AGAEPESGSRVSRAETAEL

SEQ ID NO: 245203 - protein, 8 aa, Mycobacterium
AGAEPGVD

SEQ ID NO: 245204 - protein, 9 aa, Mycobacterium
AGAEPIPEP

SEQ ID NO: 245205 - protein, 11 aa, Mycobacterium
AGAEPLAAAGT

SEQ ID NO: 245206 - protein, 9 aa, Mycobacterium
AGAEPQPQP

SEQ ID NO: 245207 - protein, 8 aa, Mycobacterium
AGAEPRVT

SEQ ID NO: 245208 - protein, 8 aa, Mycobacterium
AGAEPTAL

SEQ ID NO: 245209 - protein, 7 aa, Mycobacterium
AGAEQSL

SEQ ID NO: 245210 - protein, 7 aa, Mycobacterium
AGAERDA

SEQ ID NO: 245211 - protein, 7 aa, Mycobacterium
AGAESGS

SEQ ID NO: 245212 - protein, 9 aa, Mycobacterium
AGAFSPATG

SEQ ID NO: 245213 - protein, 7 aa, Mycobacterium
AGAGAAA

SEQ ID NO: 245214 - protein, 8 aa, Mycobacterium
AGAGAASV

SEQ ID NO: 245215 - protein, 11 aa, Mycobacterium
AGAGAGGEPAV

SEQ ID NO: 245216 - protein, 9 aa, Mycobacterium
AGAGAGQPL

SEQ ID NO: 245217 - protein, 14 aa, Mycobacterium
AGAGAIGDHTAPRR

SEQ ID NO: 245218 - protein, 8 aa, Mycobacterium
AGAGAQGP

SEQ ID NO: 245219 - protein, 9 aa, Mycobacterium
AGAGEGLAA

SEQ ID NO: 245220 - protein, 7 aa, Mycobacterium
AGAGERV

SEQ ID NO: 245221 - protein, 7 aa, Mycobacterium
AGAGFGR

SEQ ID NO: 245222 - protein, 7 aa, Mycobacterium
AGAGFPD

SEQ ID NO: 245223 - protein, 9 aa, Mycobacterium
AGAGGAANR

SEQ ID NO: 245224 - protein, 57 aa, Mycobacterium
AGAGGAGGAGGNGGNGGDGVHGTTATTAGEAGGAGGNGGDGGAGGQGGDGGAGGRGP

SEQ ID NO: 245225 - protein, 7 aa, Mycobacterium
AGAGGAL

SEQ ID NO: 245226 - protein, 10 aa, Mycobacterium
AGAGKGPTVA

SEQ ID NO: 245227 - protein, 6 aa, Mycobacterium
AGAGMT

SEQ ID NO: 245228 - protein, 6 aa, Mycobacterium
AGAGNL

SEQ ID NO: 245229 - protein, 8 aa, Mycobacterium
AGAGPAPL

SEQ ID NO: 245230 - protein, 11 aa, Mycobacterium
AGAGPGGRPVR

SEQ ID NO: 245231 - protein, 14 aa, Mycobacterium
AGAGPTPESPSYVD

SEQ ID NO: 245232 - protein, 11 aa, Mycobacterium
AGAGSGGEPTI

SEQ ID NO: 245233 - protein, 13 aa, Mycobacterium
AGAGSGVYNTTRQ

SEQ ID NO: 245234 - protein, 14 aa, Mycobacterium
AGAGSIASPGSTAG

SEQ ID NO: 245235 - protein, 8 aa, Mycobacterium
AGAGSREL

SEQ ID NO: 245236 - protein, 11 aa, Mycobacterium
AGAGVDAATAS

SEQ ID NO: 245237 - protein, 17 aa, Mycobacterium
AGAHAPTVAEGTALTEN

SEQ ID NO: 245238 - protein, 9 aa, Mycobacterium
AGAHLSAGP

SEQ ID NO: 245239 - protein, 26 aa, Mycobacterium
AGAIPPPDVDPAATPPSGAAGPVAPM

SEQ ID NO: 245240 - protein, 5 aa, Mycobacterium
AGAKH

SEQ ID NO: 245241 - protein, 41 aa, Mycobacterium
AGAKRPGAKKAAPAPGAEATAPAEEPSTTPAAETPPAAPVK

SEQ ID NO: 245242 - protein, 36 aa, Mycobacterium
AGAKRPGAKKAAPAPGVEKETATEPEAAPAAPAKGL

SEQ ID NO: 245243 - protein, 51 aa, Mycobacterium
AGAKRPGAKKSTTAAAPAPAAPAEQQPEAEPEAEPTAPADADAAPPATPVK

SEQ ID NO: 245244 - protein, 45 aa, Mycobacterium
AGAKRPGAKKTAAAPAEKPAAAETEAPAPAETAAPAEPAKPEPPV

SEQ ID NO: 245245 - protein, 47 aa, Mycobacterium
AGAKRPGAKKTAPAAPAAPAPEAAAVPSESEAPTATETSAVAEPPVK

SEQ ID NO: 245246 - protein, 14 aa, Mycobacterium
AGALDAAGESEVQT

SEQ ID NO: 245247 - protein, 8 aa, Mycobacterium
AGALSAGR

SEQ ID NO: 245248 - protein, 6 aa, Mycobacterium
AGALSG

SEQ ID NO: 245249 - protein, 9 aa, Mycobacterium
AGALSGRIG

SEQ ID NO: 245250 - protein, 7 aa, Mycobacterium
AGALSGV

SEQ ID NO: 245251 - protein, 16 aa, Mycobacterium
AGAMSDKEVADGRPSL

SEQ ID NO: 245252 - protein, 6 aa, Mycobacterium
AGANNR

SEQ ID NO: 245253 - protein, 10 aa, Mycobacterium
AGANVAPAEV

SEQ ID NO: 245254 - protein, 11 aa, Mycobacterium
AGANVSADEVE

SEQ ID NO: 245255 - protein, 10 aa, Mycobacterium
AGANVSPAEV

SEQ ID NO: 245256 - protein, 6 aa, Mycobacterium
AGANVT

SEQ ID NO: 245257 - protein, 5 aa, Mycobacterium
AGAPA

SEQ ID NO: 245258 - protein, 10 aa, Mycobacterium
AGAPAPAGDL

SEQ ID NO: 245259 - protein, 8 aa, Mycobacterium
AGAPASAL

SEQ ID NO: 245260 - protein, 6 aa, Mycobacterium
AGAPAT

SEQ ID NO: 245261 - protein, 9 aa, Mycobacterium
AGAPAWRDK

SEQ ID NO: 245262 - protein, 6 aa, Mycobacterium
AGAPDE

SEQ ID NO: 245263 - protein, 8 aa, Mycobacterium
AGAPDKAA

SEQ ID NO: 245264 - protein, 5 aa, Mycobacterium
AGAPG

SEQ ID NO: 245265 - protein, 10 aa, Mycobacterium
AGAPGGPANQ

SEQ ID NO: 245266 - protein, 7 aa, Mycobacterium
AGAPGLP

SEQ ID NO: 245267 - protein, 7 aa, Mycobacterium
AGAPLDT

SEQ ID NO: 245268 - protein, 10 aa, Mycobacterium
AGAPPAAERH

SEQ ID NO: 245269 - protein, 7 aa, Mycobacterium
AGAPPEV

SEQ ID NO: 245270 - protein, 11 aa, Mycobacterium
AGAPRSGKSTV

SEQ ID NO: 245271 - protein, 10 aa, Mycobacterium
AGAPSNIGYR

SEQ ID NO: 245272 - protein, 17 aa, Mycobacterium
AGAPSPVPRAGARPARQ

SEQ ID NO: 245273 - protein, 6 aa, Mycobacterium
AGAPTL

SEQ ID NO: 245274 - protein, 12 aa, Mycobacterium
AGAPTTSPSALT

SEQ ID NO: 245275 - protein, 4 aa, Mycobacterium
AGAQ

SEQ ID NO: 245276 - protein, 12 aa, Mycobacterium
AGAQDAAANSLS

SEQ ID NO: 245277 - protein, 10 aa, Mycobacterium
AGAQQISAGD

SEQ ID NO: 245278 - protein, 6 aa, Mycobacterium
AGAQTQ

SEQ ID NO: 245279 - protein, 8 aa, Mycobacterium
AGARDKNQ

SEQ ID NO: 245280 - protein, 11 aa, Mycobacterium
AGARERTGELP

SEQ ID NO: 245281 - protein, 7 aa, Mycobacterium
AGARGRA

SEQ ID NO: 245282 - protein, 25 aa, Mycobacterium
AGARPKRPRPEASATSPRDKSPKGR

SEQ ID NO: 245283 - protein, 10 aa, Mycobacterium
AGARPVVQDP

SEQ ID NO: 245284 - protein, 65 aa, Mycobacterium
AGARSLPADPPRGPGHPPPRPARAEPAPPQPVPPSKPTESVTQQLPTASATQRIATPPPAPSTFE

SEQ ID NO: 245285 - protein, 6 aa, Mycobacterium
AGARSS

SEQ ID NO: 245286 - protein, 5 aa, Mycobacterium
AGASA

SEQ ID NO: 245287 - protein, 6 aa, Mycobacterium
AGASAG

SEQ ID NO: 245288 - protein, 6 aa, Mycobacterium
AGASAN

SEQ ID NO: 245289 - protein, 8 aa, Mycobacterium
AGASDYVT

SEQ ID NO: 245290 - protein, 5 aa, Mycobacterium
AGASG

SEQ ID NO: 245291 - protein, 7 aa, Mycobacterium
AGASGAE

SEQ ID NO: 245292 - protein, 29 aa, Mycobacterium
AGASGGGDGDGDGDGDDGGGGAPRARASA

SEQ ID NO: 245293 - protein, 7 aa, Mycobacterium
AGASGSR

SEQ ID NO: 245294 - protein, 5 aa, Mycobacterium
AGASH

SEQ ID NO: 245295 - protein, 7 aa, Mycobacterium
AGASHAS

SEQ ID NO: 245296 - protein, 8 aa, Mycobacterium
AGASLAQT

SEQ ID NO: 245297 - protein, 5 aa, Mycobacterium
AGASS

SEQ ID NO: 245298 - protein, 6 aa, Mycobacterium
AGASSI

SEQ ID NO: 245299 - protein, 7 aa, Mycobacterium
AGASSID

SEQ ID NO: 245300 - protein, 5 aa, Mycobacterium
AGAST

SEQ ID NO: 245301 - protein, 14 aa, Mycobacterium
AGASVLPPSTFGPG

SEQ ID NO: 245302 - protein, 5 aa, Mycobacterium
AGATA

SEQ ID NO: 245303 - protein, 8 aa, Mycobacterium
AGATAAST

SEQ ID NO: 245304 - protein, 21 aa, Mycobacterium
AGATGQRSEQGFAARKNSGLL

SEQ ID NO: 245305 - protein, 7 aa, Mycobacterium
AGATNTF

SEQ ID NO: 245306 - protein, 6 aa, Mycobacterium
AGATVN

SEQ ID NO: 245307 - protein, 5 aa, Mycobacterium
AGAVG

SEQ ID NO: 245308 - protein, 8 aa, Mycobacterium
AGAVGGAA

SEQ ID NO: 245309 - protein, 15 aa, Mycobacterium
AGAVGGFGLSRLRFR

SEQ ID NO: 245310 - protein, 26 aa, Mycobacterium
AGAVSPPQVDPQIAPPPGTAGPAQPM

SEQ ID NO: 245311 - protein, 5 aa, Mycobacterium
AGAVT

SEQ ID NO: 245312 - protein, 16 aa, Mycobacterium
AGAVTGATEASAEPAR

SEQ ID NO: 245313 - protein, 4 aa, Mycobacterium
AGAY

SEQ ID NO: 245314 - protein, 7 aa, Mycobacterium
AGCDPDE

SEQ ID NO: 245315 - protein, 12 aa, Mycobacterium
AGCEQGTASASA

SEQ ID NO: 245316 - protein, 11 aa, Mycobacterium
AGCPSTGTPDL

SEQ ID NO: 245317 - protein, 13 aa, Mycobacterium
AGDADGTAPLAPL

SEQ ID NO: 245318 - protein, 6 aa, Mycobacterium
AGDAPF

SEQ ID NO: 245319 - protein, 14 aa, Mycobacterium
AGDAPTASDVTAVP

SEQ ID NO: 245320 - protein, 9 aa, Mycobacterium
AGDAQGIAN

SEQ ID NO: 245321 - protein, 10 aa, Mycobacterium
AGDARSGAKV

SEQ ID NO: 245322 - protein, 12 aa, Mycobacterium
AGDASEQAAAGY

SEQ ID NO: 245323 - protein, 6 aa, Mycobacterium
AGDAYQ

SEQ ID NO: 245324 - protein, 5 aa, Mycobacterium
AGDDE

SEQ ID NO: 245325 - protein, 8 aa, Mycobacterium
AGDDGGRL

SEQ ID NO: 245326 - protein, 8 aa, Mycobacterium
AGDDPTTI

SEQ ID NO: 245327 - protein, 7 aa, Mycobacterium
AGDDRVQ

SEQ ID NO: 245328 - protein, 5 aa, Mycobacterium
AGDDV

SEQ ID NO: 245329 - protein, 11 aa, Mycobacterium
AGDEDGKVTTT

SEQ ID NO: 245330 - protein, 9 aa, Mycobacterium
AGDEDYGNH

SEQ ID NO: 245331 - protein, 6 aa, Mycobacterium
AGDETA

SEQ ID NO: 245332 - protein, 11 aa, Mycobacterium
AGDETARDGRR

SEQ ID NO: 245333 - protein, 29 aa, Mycobacterium
AGDGAAPAEGPGNGSAAPGHDAGARPAHV

SEQ ID NO: 245334 - protein, 7 aa, Mycobacterium
AGDGGKI

SEQ ID NO: 245335 - protein, 7 aa, Mycobacterium
AGDGMSD

SEQ ID NO: 245336 - protein, 12 aa, Mycobacterium
AGDGSKKDCKQN

SEQ ID NO: 245337 - protein, 13 aa, Mycobacterium
AGDGTADDKLPGA

SEQ ID NO: 245338 - protein, 6 aa, Mycobacterium
AGDHAE

SEQ ID NO: 245339 - protein, 6 aa, Mycobacterium
AGDHAS

SEQ ID NO: 245340 - protein, 4 aa, Mycobacterium
AGDI

SEQ ID NO: 245341 - protein, 6 aa, Mycobacterium
AGDIDT

SEQ ID NO: 245342 - protein, 7 aa, Mycobacterium
AGDIGGK

SEQ ID NO: 245343 - protein, 8 aa, Mycobacterium
AGDKRRGF

SEQ ID NO: 245344 - protein, 10 aa, Mycobacterium
AGDKTAPLGP

SEQ ID NO: 245345 - protein, 11 aa, Mycobacterium
AGDKTAPLGPG

SEQ ID NO: 245346 - protein, 6 aa, Mycobacterium
AGDLGS

SEQ ID NO: 245347 - protein, 7 aa, Mycobacterium
AGDLGYR

SEQ ID NO: 245348 - protein, 7 aa, Mycobacterium
AGDNGAS

SEQ ID NO: 245349 - protein, 8 aa, Mycobacterium
AGDPASVP

SEQ ID NO: 245350 - protein, 10 aa, Mycobacterium
AGDPDDGAAM

SEQ ID NO: 245351 - protein, 6 aa, Mycobacterium
AGDPDE

SEQ ID NO: 245352 - protein, 10 aa, Mycobacterium
AGDPDGAKAR

SEQ ID NO: 245353 - protein, 9 aa, Mycobacterium
AGDPEAAAA

SEQ ID NO: 245354 - protein, 11 aa, Mycobacterium
AGDPGAADDRF

SEQ ID NO: 245355 - protein, 11 aa, Mycobacterium
AGDPGADDDRF

SEQ ID NO: 245356 - protein, 11 aa, Mycobacterium
AGDPKLIDGAG

SEQ ID NO: 245357 - protein, 8 aa, Mycobacterium
AGDPPIAS

SEQ ID NO: 245358 - protein, 11 aa, Mycobacterium
AGDPSADGREL

SEQ ID NO: 245359 - protein, 6 aa, Mycobacterium
AGDPSV

SEQ ID NO: 245360 - protein, 15 aa, Mycobacterium
AGDPTAGHSRGSPQG

SEQ ID NO: 245361 - protein, 33 aa, Mycobacterium
AGDPTLPGFDGRSGQDEMAAAQADPSPPNADRG

SEQ ID NO: 245362 - protein, 5 aa, Mycobacterium
AGDPV

SEQ ID NO: 245363 - protein, 5 aa, Mycobacterium
AGDQA

SEQ ID NO: 245364 - protein, 7 aa, Mycobacterium
AGDQAPK

SEQ ID NO: 245365 - protein, 11 aa, Mycobacterium
AGDQGSTLGNK

SEQ ID NO: 245366 - protein, 14 aa, Mycobacterium
AGDQGTTLANESVD

SEQ ID NO: 245367 - protein, 12 aa, Mycobacterium
AGDQPSGAAAKQ

SEQ ID NO: 245368 - protein, 17 aa, Mycobacterium
AGDQRDSANSANRGPDS

SEQ ID NO: 245369 - protein, 17 aa, Mycobacterium
AGDQRGPASATKSGPDS

SEQ ID NO: 245370 - protein, 10 aa, Mycobacterium
AGDQSPKTTV

SEQ ID NO: 245371 - protein, 5 aa, Mycobacterium
AGDQT

SEQ ID NO: 245372 - protein, 4 aa, Mycobacterium
AGDR

SEQ ID NO: 245373 - protein, 5 aa, Mycobacterium
AGDRK

SEQ ID NO: 245374 - protein, 6 aa, Mycobacterium
AGDRLG

SEQ ID NO: 245375 - protein, 12 aa, Mycobacterium
AGDRNAAVEEGV

SEQ ID NO: 245376 - protein, 41 aa, Mycobacterium
AGDRPGATNGTGPGGDSGALSSNSTRATGHITDSGDVPPWQ

SEQ ID NO: 245377 - protein, 31 aa, Mycobacterium
AGDRRRERDATVTPEAERDATVTPALATTTA

SEQ ID NO: 245378 - protein, 10 aa, Mycobacterium
AGDRRRGRKP

SEQ ID NO: 245379 - protein, 11 aa, Mycobacterium
AGDRTSAVAEG

SEQ ID NO: 245380 - protein, 6 aa, Mycobacterium
AGDSAA

SEQ ID NO: 245381 - protein, 32 aa, Mycobacterium
AGDSKSARLSAEKYAAPATRRSNALRDDADGA

SEQ ID NO: 245382 - protein, 13 aa, Mycobacterium
AGDSSKKDCKQNP

SEQ ID NO: 245383 - protein, 13 aa, Mycobacterium
AGDSTDAAPDPTV

SEQ ID NO: 245384 - protein, 5 aa, Mycobacterium
AGDSV

SEQ ID NO: 245385 - protein, 4 aa, Mycobacterium
AGDT

SEQ ID NO: 245386 - protein, 10 aa, Mycobacterium
AGDTAAPLGP

SEQ ID NO: 245387 - protein, 27 aa, Mycobacterium
AGDTEGSTGCGENPLNDPARPADPRNW

SEQ ID NO: 245388 - protein, 27 aa, Mycobacterium
AGDTNKKDCKQNPPHDPLQPNDPRNWS

SEQ ID NO: 245389 - protein, 12 aa, Mycobacterium
AGDTRQYKPARV

SEQ ID NO: 245390 - protein, 26 aa, Mycobacterium
AGDTSKKDCKQNPPHDPLQPNDPRNW

SEQ ID NO: 245391 - protein, 6 aa, Mycobacterium
AGDTTK

SEQ ID NO: 245392 - protein, 8 aa, Mycobacterium
AGDTTKAA

SEQ ID NO: 245393 - protein, 7 aa, Mycobacterium
AGDVGTD

SEQ ID NO: 245394 - protein, 15 aa, Mycobacterium
AGDVGVDSATTPDGG

SEQ ID NO: 245395 - protein, 6 aa, Mycobacterium
AGDVTG

SEQ ID NO: 245396 - protein, 10 aa, Mycobacterium
AGEAENPKVT

SEQ ID NO: 245397 - protein, 11 aa, Mycobacterium
AGEAKAHMSTR

SEQ ID NO: 245398 - protein, 12 aa, Mycobacterium
AGEAKDPARTIP

SEQ ID NO: 245399 - protein, 8 aa, Mycobacterium
AGEAPGAA

SEQ ID NO: 245400 - protein, 6 aa, Mycobacterium
AGEAPK

SEQ ID NO: 245401 - protein, 16 aa, Mycobacterium
AGEAPTGKNGRPKMSA

SEQ ID NO: 245402 - protein, 11 aa, Mycobacterium
AGEASAEAAVE

SEQ ID NO: 245403 - protein, 5 aa, Mycobacterium
AGEAT

SEQ ID NO: 245404 - protein, 5 aa, Mycobacterium
AGEAV

SEQ ID NO: 245405 - protein, 9 aa, Mycobacterium
AGEAVSSGE

SEQ ID NO: 245406 - protein, 6 aa, Mycobacterium
AGEDEA

SEQ ID NO: 245407 - protein, 10 aa, Mycobacterium
AGEDGGPAVP

SEQ ID NO: 245408 - protein, 6 aa, Mycobacterium
AGEDGK

SEQ ID NO: 245409 - protein, 15 aa, Mycobacterium
AGEDHSKTGNAVQSA

SEQ ID NO: 245410 - protein, 15 aa, Mycobacterium
AGEDHSKTGNPVQSA

SEQ ID NO: 245411 - protein, 7 aa, Mycobacterium
AGEDTPG

SEQ ID NO: 245412 - protein, 16 aa, Mycobacterium
AGEDVAKTGNPVQSSQ

SEQ ID NO: 245413 - protein, 13 aa, Mycobacterium
AGEEARGGGTTSD

SEQ ID NO: 245414 - protein, 12 aa, Mycobacterium
AGEEIPQTKEEI

SEQ ID NO: 245415 - protein, 13 aa, Mycobacterium
AGEEIPQTKEEIR

SEQ ID NO: 245416 - protein, 12 aa, Mycobacterium
AGEEVPQTKEEI

SEQ ID NO: 245417 - protein, 7 aa, Mycobacterium
AGEGPEP

SEQ ID NO: 245418 - protein, 7 aa, Mycobacterium
AGEGQPR

SEQ ID NO: 245419 - protein, 6 aa, Mycobacterium
AGEGTG

SEQ ID NO: 245420 - protein, 7 aa, Mycobacterium
AGEGVTD

SEQ ID NO: 245421 - protein, 4 aa, Mycobacterium
AGEI

SEQ ID NO: 245422 - protein, 4 aa, Mycobacterium
AGEL

SEQ ID NO: 245423 - protein, 15 aa, Mycobacterium
AGELAEETRNPRRVA

SEQ ID NO: 245424 - protein, 6 aa, Mycobacterium
AGELST

SEQ ID NO: 245425 - protein, 6 aa, Mycobacterium
AGEMNR

SEQ ID NO: 245426 - protein, 8 aa, Mycobacterium
AGENDRGD

SEQ ID NO: 245427 - protein, 7 aa, Mycobacterium
AGENRSR

SEQ ID NO: 245428 - protein, 7 aa, Mycobacterium
AGEPALA

SEQ ID NO: 245429 - protein, 6 aa, Mycobacterium
AGEPAP

SEQ ID NO: 245430 - protein, 7 aa, Mycobacterium
AGEPDLA

SEQ ID NO: 245431 - protein, 7 aa, Mycobacterium
AGEPGAG

SEQ ID NO: 245432 - protein, 6 aa, Mycobacterium
AGEPGM

SEQ ID NO: 245433 - protein, 6 aa, Mycobacterium
AGEPKL

SEQ ID NO: 245434 - protein, 10 aa, Mycobacterium
AGEPSFGPSG

SEQ ID NO: 245435 - protein, 5 aa, Mycobacterium
AGEPT

SEQ ID NO: 245436 - protein, 7 aa, Mycobacterium
AGEPTVA

SEQ ID NO: 245437 - protein, 28 aa, Mycobacterium
AGEQAAKAERESAKSAADAKSAAEQAAA

SEQ ID NO: 245438 - protein, 8 aa, Mycobacterium
AGEQAQQA

SEQ ID NO: 245439 - protein, 9 aa, Mycobacterium
AGEQATDRV

SEQ ID NO: 245440 - protein, 14 aa, Mycobacterium
AGEQDDLAAGDERE

SEQ ID NO: 245441 - protein, 6 aa, Mycobacterium
AGEQDR

SEQ ID NO: 245442 - protein, 7 aa, Mycobacterium
AGEQERA

SEQ ID NO: 245443 - protein, 13 aa, Mycobacterium
AGEQGLTTAGSTL

SEQ ID NO: 245444 - protein, 7 aa, Mycobacterium
AGEQQSR

SEQ ID NO: 245445 - protein, 8 aa, Mycobacterium
AGEQVYPN

SEQ ID NO: 245446 - protein, 9 aa, Mycobacterium
AGERAPALP

SEQ ID NO: 245447 - protein, 6 aa, Mycobacterium
AGERDR

SEQ ID NO: 245448 - protein, 13 aa, Mycobacterium
AGERHLRSADNSA

SEQ ID NO: 245449 - protein, 7 aa, Mycobacterium
AGESHAS

SEQ ID NO: 245450 - protein, 7 aa, Mycobacterium
AGESKAL

SEQ ID NO: 245451 - protein, 8 aa, Mycobacterium
AGESTAQA

SEQ ID NO: 245452 - protein, 6 aa, Mycobacterium
AGESVD

SEQ ID NO: 245453 - protein, 10 aa, Mycobacterium
AGETAAPVGP

SEQ ID NO: 245454 - protein, 8 aa, Mycobacterium
AGETANPH

SEQ ID NO: 245455 - protein, 6 aa, Mycobacterium
AGETAR

SEQ ID NO: 245456 - protein, 18 aa, Mycobacterium
AGETDLPSPYGPPRTEAR

SEQ ID NO: 245457 - protein, 10 aa, Mycobacterium
AGETENPDKV

SEQ ID NO: 245458 - protein, 7 aa, Mycobacterium
AGETQAH

SEQ ID NO: 245459 - protein, 6 aa, Mycobacterium
AGETTR

SEQ ID NO: 245460 - protein, 13 aa, Mycobacterium
AGETTTLTRPDEL

SEQ ID NO: 245461 - protein, 6 aa, Mycobacterium
AGETVS

SEQ ID NO: 245462 - protein, 4 aa, Mycobacterium
AGEV

SEQ ID NO: 245463 - protein, 11 aa, Mycobacterium
AGEVEAPDTVP

SEQ ID NO: 245464 - protein, 6 aa, Mycobacterium
AGEVGG

SEQ ID NO: 245465 - protein, 7 aa, Mycobacterium
AGEVPGQ

SEQ ID NO: 245466 - protein, 5 aa, Mycobacterium
AGEVQ

SEQ ID NO: 245467 - protein, 4 aa, Mycobacterium
AGFG

SEQ ID NO: 245468 - protein, 5 aa, Mycobacterium
AGFGR

SEQ ID NO: 245469 - protein, 10 aa, Mycobacterium
AGFGRTPYRP

SEQ ID NO: 245470 - protein, 11 aa, Mycobacterium
AGFNGGTGGST

SEQ ID NO: 245471 - protein, 11 aa, Mycobacterium
AGFSARDEDRV

SEQ ID NO: 245472 - protein, 10 aa, Mycobacterium
AGFSARDTDR

SEQ ID NO: 245473 - protein, 6 aa, Mycobacterium
AGFSHH

SEQ ID NO: 245474 - protein, 9 aa, Mycobacterium
AGFSPRDHD

SEQ ID NO: 245475 - protein, 4 aa, Mycobacterium
AGFT

SEQ ID NO: 245476 - protein, 9 aa, Mycobacterium
AGFTDNAAT

SEQ ID NO: 245477 - protein, 10 aa, Mycobacterium
AGFTSSPAVG

SEQ ID NO: 245478 - protein, 21 aa, Mycobacterium
AGGAAGPLGAKKGAPYPIGGD

SEQ ID NO: 245479 - protein, 7 aa, Mycobacterium
AGGAAQP

SEQ ID NO: 245480 - protein, 7 aa, Mycobacterium
AGGADRF

SEQ ID NO: 245481 - protein, 14 aa, Mycobacterium
AGGAEQMSTSGNPL

SEQ ID NO: 245482 - protein, 6 aa, Mycobacterium
AGGAET

SEQ ID NO: 245483 - protein, 7 aa, Mycobacterium
AGGAGQP

SEQ ID NO: 245484 - protein, 7 aa, Mycobacterium
AGGAGRV

SEQ ID NO: 245485 - protein, 5 aa, Mycobacterium
AGGAI

SEQ ID NO: 245486 - protein, 11 aa, Mycobacterium
AGGAKGVGTAV

SEQ ID NO: 245487 - protein, 35 aa, Mycobacterium
AGGAKRPGAKKAAPAEGAAKAPAEEAAKAPAKGLG

SEQ ID NO: 245488 - protein, 91 aa, Mycobacterium
AGGAKRPGAKKAAPAVEAAPAADAPAKAEPEAKGLGIAGGAKRPGAKKASGTVVQPPNVDPDKAEAGTESAGTADSDRGLDDAPKPEPEVK

SEQ ID NO: 245489 - protein, 41 aa, Mycobacterium
AGGAKRPGAKKTAAAAPAEKPAATEAPEASATPAAPAAPVK

SEQ ID NO: 245490 - protein, 7 aa, Mycobacterium
AGGALGE

SEQ ID NO: 245491 - protein, 10 aa, Mycobacterium
AGGAPDGADM

SEQ ID NO: 245492 - protein, 11 aa, Mycobacterium
AGGARDKLGDL

SEQ ID NO: 245493 - protein, 9 aa, Mycobacterium
AGGASAGQV

SEQ ID NO: 245494 - protein, 7 aa, Mycobacterium
AGGATEH

SEQ ID NO: 245495 - protein, 21 aa, Mycobacterium
AGGATGPLGARKGAQYPIGGD

SEQ ID NO: 245496 - protein, 10 aa, Mycobacterium
AGGAVTTESG

SEQ ID NO: 245497 - protein, 5 aa, Mycobacterium
AGGCA

SEQ ID NO: 245498 - protein, 16 aa, Mycobacterium
AGGDEGLTDADRHRRK

SEQ ID NO: 245499 - protein, 10 aa, Mycobacterium
AGGDFTDSGH

SEQ ID NO: 245500 - protein, 10 aa, Mycobacterium
AGGDIKSLSD

SEQ ID NO: 245501 - protein, 6 aa, Mycobacterium
AGGDRR

SEQ ID NO: 245502 - protein, 13 aa, Mycobacterium
AGGDTDPAQTAAV

SEQ ID NO: 245503 - protein, 10 aa, Mycobacterium
AGGDTGLTDA

SEQ ID NO: 245504 - protein, 4 aa, Mycobacterium
AGGE

SEQ ID NO: 245505 - protein, 18 aa, Mycobacterium
AGGEDTAQKYAQKYADEL

SEQ ID NO: 245506 - protein, 10 aa, Mycobacterium
AGGEELPPPL

SEQ ID NO: 245507 - protein, 7 aa, Mycobacterium
AGGEGTL

SEQ ID NO: 245508 - protein, 5 aa, Mycobacterium
AGGEI

SEQ ID NO: 245509 - protein, 6 aa, Mycobacterium
AGGEIA

SEQ ID NO: 245510 - protein, 7 aa, Mycobacterium
AGGEYGS

SEQ ID NO: 245511 - protein, 17 aa, Mycobacterium
AGGFQDPTSESSKATDI

SEQ ID NO: 245512 - protein, 5 aa, Mycobacterium
AGGGA

SEQ ID NO: 245513 - protein, 17 aa, Mycobacterium
AGGGAGRDGGVPGRRRA

SEQ ID NO: 245514 - protein, 12 aa, Mycobacterium
AGGGAKAVGNAV

SEQ ID NO: 245515 - protein, 17 aa, Mycobacterium
AGGGGLTPSDITPARLS

SEQ ID NO: 245516 - protein, 33 aa, Mycobacterium
AGGGGNGVSRVPTGGTTGRAPNLAPVPTAPSNR

SEQ ID NO: 245517 - protein, 9 aa, Mycobacterium
AGGGGSQTD

SEQ ID NO: 245518 - protein, 7 aa, Mycobacterium
AGGGGTL

SEQ ID NO: 245519 - protein, 8 aa, Mycobacterium
AGGGIDPR

SEQ ID NO: 245520 - protein, 9 aa, Mycobacterium
AGGGIDPRR

SEQ ID NO: 245521 - protein, 6 aa, Mycobacterium
AGGGKP

SEQ ID NO: 245522 - protein, 6 aa, Mycobacterium
AGGGNI

SEQ ID NO: 245523 - protein, 10 aa, Mycobacterium
AGGGPAEAGE

SEQ ID NO: 245524 - protein, 10 aa, Mycobacterium
AGGGPEGVGM

SEQ ID NO: 245525 - protein, 15 aa, Mycobacterium
AGGGPGQLGSMAGQQ

SEQ ID NO: 245526 - protein, 8 aa, Mycobacterium
AGGGPVGV

SEQ ID NO: 245527 - protein, 8 aa, Mycobacterium
AGGGSEVS

SEQ ID NO: 245528 - protein, 10 aa, Mycobacterium
AGGGTEDAAG

SEQ ID NO: 245529 - protein, 6 aa, Mycobacterium
AGGISA

SEQ ID NO: 245530 - protein, 4 aa, Mycobacterium
AGGK

SEQ ID NO: 245531 - protein, 13 aa, Mycobacterium
AGGKLSDRFGGGR

SEQ ID NO: 245532 - protein, 9 aa, Mycobacterium
AGGKMSPER

SEQ ID NO: 245533 - protein, 13 aa, Mycobacterium
AGGKRSSSATLGT

SEQ ID NO: 245534 - protein, 5 aa, Mycobacterium
AGGLA

SEQ ID NO: 245535 - protein, 11 aa, Mycobacterium
AGGLAQGNDVT

SEQ ID NO: 245536 - protein, 7 aa, Mycobacterium
AGGLDPG

SEQ ID NO: 245537 - protein, 9 aa, Mycobacterium
AGGLNTGAT

SEQ ID NO: 245538 - protein, 6 aa, Mycobacterium
AGGNDL

SEQ ID NO: 245539 - protein, 5 aa, Mycobacterium
AGGNI

SEQ ID NO: 245540 - protein, 15 aa, Mycobacterium
AGGNRDSAPDSRHGK

SEQ ID NO: 245541 - protein, 14 aa, Mycobacterium
AGGPADGDAPAART

SEQ ID NO: 245542 - protein, 5 aa, Mycobacterium
AGGPD

SEQ ID NO: 245543 - protein, 16 aa, Mycobacterium
AGGPDEGVRAARPPEV

SEQ ID NO: 245544 - protein, 8 aa, Mycobacterium
AGGPEGVG

SEQ ID NO: 245545 - protein, 7 aa, Mycobacterium
AGGPGLP

SEQ ID NO: 245546 - protein, 6 aa, Mycobacterium
AGGPNE

SEQ ID NO: 245547 - protein, 21 aa, Mycobacterium
AGGPNGPLGAKQGGQTPIGGD

SEQ ID NO: 245548 - protein, 7 aa, Mycobacterium
AGGPPDA

SEQ ID NO: 245549 - protein, 12 aa, Mycobacterium
AGGPPVLEGPAS

SEQ ID NO: 245550 - protein, 8 aa, Mycobacterium
AGGPQGRT

SEQ ID NO: 245551 - protein, 6 aa, Mycobacterium
AGGPTA

SEQ ID NO: 245552 - protein, 6 aa, Mycobacterium
AGGPVG

SEQ ID NO: 245553 - protein, 4 aa, Mycobacterium
AGGQ

SEQ ID NO: 245554 - protein, 17 aa, Mycobacterium
AGGQGDSASPANRDPDS

SEQ ID NO: 245555 - protein, 6 aa, Mycobacterium
AGGQLG

SEQ ID NO: 245556 - protein, 9 aa, Mycobacterium
AGGQNAKQL

SEQ ID NO: 245557 - protein, 9 aa, Mycobacterium
AGGQSAGQV

SEQ ID NO: 245558 - protein, 6 aa, Mycobacterium
AGGQVA

SEQ ID NO: 245559 - protein, 7 aa, Mycobacterium
AGGREVA

SEQ ID NO: 245560 - protein, 6 aa, Mycobacterium
AGGRIT

SEQ ID NO: 245561 - protein, 8 aa, Mycobacterium
AGGRKGEI

SEQ ID NO: 245562 - protein, 9 aa, Mycobacterium
AGGRLDPDR

SEQ ID NO: 245563 - protein, 7 aa, Mycobacterium
AGGRSTG

SEQ ID NO: 245564 - protein, 7 aa, Mycobacterium
AGGRTRS

SEQ ID NO: 245565 - protein, 7 aa, Mycobacterium
AGGRTYA

SEQ ID NO: 245566 - protein, 5 aa, Mycobacterium
AGGSA

SEQ ID NO: 245567 - protein, 11 aa, Mycobacterium
AGGSATQRRSM

SEQ ID NO: 245568 - protein, 18 aa, Mycobacterium
AGGSGGGGKKVPEINADR

SEQ ID NO: 245569 - protein, 17 aa, Mycobacterium
AGGSGGGSKKVPEINAD

SEQ ID NO: 245570 - protein, 7 aa, Mycobacterium
AGGSHSE

SEQ ID NO: 245571 - protein, 11 aa, Mycobacterium
AGGSKGVGTAV

SEQ ID NO: 245572 - protein, 14 aa, Mycobacterium
AGGSPLGALRAWRR

SEQ ID NO: 245573 - protein, 8 aa, Mycobacterium
AGGSPQHA

SEQ ID NO: 245574 - protein, 5 aa, Mycobacterium
AGGSQ

SEQ ID NO: 245575 - protein, 16 aa, Mycobacterium
AGGSRPLADEPGTPEW

SEQ ID NO: 245576 - protein, 8 aa, Mycobacterium
AGGSSQAT

SEQ ID NO: 245577 - protein, 8 aa, Mycobacterium
AGGSTGRK

SEQ ID NO: 245578 - protein, 8 aa, Mycobacterium
AGGSTQTP

SEQ ID NO: 245579 - protein, 17 aa, Mycobacterium
AGGSVARQTGVSLEDTA

SEQ ID NO: 245580 - protein, 5 aa, Mycobacterium
AGGTA

SEQ ID NO: 245581 - protein, 6 aa, Mycobacterium
AGGTAA

SEQ ID NO: 245582 - protein, 7 aa, Mycobacterium
AGGTERM

SEQ ID NO: 245583 - protein, 9 aa, Mycobacterium
AGGTGSIAN

SEQ ID NO: 245584 - protein, 12 aa, Mycobacterium
AGGTKQPEAVTK

SEQ ID NO: 245585 - protein, 5 aa, Mycobacterium
AGGTP

SEQ ID NO: 245586 - protein, 14 aa, Mycobacterium
AGGTRADSRRVSSV

SEQ ID NO: 245587 - protein, 7 aa, Mycobacterium
AGGTSDV

SEQ ID NO: 245588 - protein, 6 aa, Mycobacterium
AGGTSI

SEQ ID NO: 245589 - protein, 8 aa, Mycobacterium
AGGTSTAT

SEQ ID NO: 245590 - protein, 9 aa, Mycobacterium
AGGTSTATT

SEQ ID NO: 245591 - protein, 6 aa, Mycobacterium
AGGTSV

SEQ ID NO: 245592 - protein, 7 aa, Mycobacterium
AGGTSVT

SEQ ID NO: 245593 - protein, 6 aa, Mycobacterium
AGGTTV

SEQ ID NO: 245594 - protein, 12 aa, Mycobacterium
AGGTVPSPSVDA

SEQ ID NO: 245595 - protein, 24 aa, Mycobacterium
AGGVEGGGPDGKPALDVELKSVAL

SEQ ID NO: 245596 - protein, 6 aa, Mycobacterium
AGGVGA

SEQ ID NO: 245597 - protein, 6 aa, Mycobacterium
AGGVGG

SEQ ID NO: 245598 - protein, 6 aa, Mycobacterium
AGGVGQ

SEQ ID NO: 245599 - protein, 11 aa, Mycobacterium
AGGVPSDEGGK

SEQ ID NO: 245600 - protein, 11 aa, Mycobacterium
AGGVPTDEGGK

SEQ ID NO: 245601 - protein, 11 aa, Mycobacterium
AGHAARAAGTY

SEQ ID NO: 245602 - protein, 14 aa, Mycobacterium
AGHAEASDGDDGTE

SEQ ID NO: 245603 - protein, 16 aa, Mycobacterium
AGHAPAVAAPKSPTAL

SEQ ID NO: 245604 - protein, 15 aa, Mycobacterium
AGHARPCRADGSVGT

SEQ ID NO: 245605 - protein, 5 aa, Mycobacterium
AGHDA

SEQ ID NO: 245606 - protein, 14 aa, Mycobacterium
AGHDDDESRATRER

SEQ ID NO: 245607 - protein, 13 aa, Mycobacterium
AGHDDPSGRQPVA

SEQ ID NO: 245608 - protein, 7 aa, Mycobacterium
AGHDEGE

SEQ ID NO: 245609 - protein, 8 aa, Mycobacterium
AGHDLDST

SEQ ID NO: 245610 - protein, 4 aa, Mycobacterium
AGHE

SEQ ID NO: 245611 - protein, 8 aa, Mycobacterium
AGHGPGAN

SEQ ID NO: 245612 - protein, 7 aa, Mycobacterium
AGHGPPA

SEQ ID NO: 245613 - protein, 9 aa, Mycobacterium
AGHHDKARR

SEQ ID NO: 245614 - protein, 10 aa, Mycobacterium
AGHHEAPDKP

SEQ ID NO: 245615 - protein, 5 aa, Mycobacterium
AGHID

SEQ ID NO: 245616 - protein, 9 aa, Mycobacterium
AGHKANVPL

SEQ ID NO: 245617 - protein, 6 aa, Mycobacterium
AGHKGR

SEQ ID NO: 245618 - protein, 5 aa, Mycobacterium
AGHPD

SEQ ID NO: 245619 - protein, 5 aa, Mycobacterium
AGHPN

SEQ ID NO: 245620 - protein, 5 aa, Mycobacterium
AGHPS

SEQ ID NO: 245621 - protein, 4 aa, Mycobacterium
AGHR

SEQ ID NO: 245622 - protein, 6 aa, Mycobacterium
AGHRAN

SEQ ID NO: 245623 - protein, 6 aa, Mycobacterium
AGHRAQ

SEQ ID NO: 245624 - protein, 6 aa, Mycobacterium
AGHRTA

SEQ ID NO: 245625 - protein, 11 aa, Mycobacterium
AGHRVSGAADS

SEQ ID NO: 245626 - protein, 9 aa, Mycobacterium
AGHSDHSPD

SEQ ID NO: 245627 - protein, 4 aa, Mycobacterium
AGHT

SEQ ID NO: 245628 - protein, 123 aa, Mycobacterium
AGHTGTSWPTQAPTGGGWQQPYTQPPRTQYPQTTGTQQRYPSAPQHGYPNGPQTGYPSGPQRGYPSGPQTGYPTNGPAGAPQSYQSQPVRTPPPAPANSSQAPTTMGPAAAPRGGAEPASNLA

SEQ ID NO: 245629 - protein, 6 aa, Mycobacterium
AGHTNS

SEQ ID NO: 245630 - protein, 4 aa, Mycobacterium
AGIA

SEQ ID NO: 245631 - protein, 5 aa, Mycobacterium
AGIDP

SEQ ID NO: 245632 - protein, 7 aa, Mycobacterium
AGIDPRN

SEQ ID NO: 245633 - protein, 7 aa, Mycobacterium
AGIDQPA

SEQ ID NO: 245634 - protein, 10 aa, Mycobacterium
AGIEEGARTG

SEQ ID NO: 245635 - protein, 11 aa, Mycobacterium
AGIEEGARTGL

SEQ ID NO: 245636 - protein, 5 aa, Mycobacterium
AGIEQ

SEQ ID NO: 245637 - protein, 4 aa, Mycobacterium
AGIG

SEQ ID NO: 245638 - protein, 21 aa, Mycobacterium
AGIKQADEQLQKTPGSTSAHT

SEQ ID NO: 245639 - protein, 6 aa, Mycobacterium
AGIRQT

SEQ ID NO: 245640 - protein, 20 aa, Mycobacterium
AGISEEDHANPGAAGSPNDV

SEQ ID NO: 245641 - protein, 10 aa, Mycobacterium
AGISTQEHTP

SEQ ID NO: 245642 - protein, 7 aa, Mycobacterium
AGITESA

SEQ ID NO: 245643 - protein, 11 aa, Mycobacterium
AGITGDGKSAY

SEQ ID NO: 245644 - protein, 8 aa, Mycobacterium
AGKAYSRH

SEQ ID NO: 245645 - protein, 7 aa, Mycobacterium
AGKDSFP

SEQ ID NO: 245646 - protein, 4 aa, Mycobacterium
AGKE

SEQ ID NO: 245647 - protein, 7 aa, Mycobacterium
AGKESFP

SEQ ID NO: 245648 - protein, 6 aa, Mycobacterium
AGKGSV

SEQ ID NO: 245649 - protein, 11 aa, Mycobacterium
AGKGTRPPRGS

SEQ ID NO: 245650 - protein, 8 aa, Mycobacterium
AGKLGGSN

SEQ ID NO: 245651 - protein, 12 aa, Mycobacterium
AGKLNNKPDAPT

SEQ ID NO: 245652 - protein, 16 aa, Mycobacterium
AGKLPIAGTAAAGDPA

SEQ ID NO: 245653 - protein, 8 aa, Mycobacterium
AGKPFGPD

SEQ ID NO: 245654 - protein, 10 aa, Mycobacterium
AGKPLSHNGS

SEQ ID NO: 245655 - protein, 5 aa, Mycobacterium
AGKPN

SEQ ID NO: 245656 - protein, 10 aa, Mycobacterium
AGKPQRSTKT

SEQ ID NO: 245657 - protein, 6 aa, Mycobacterium
AGKQGE

SEQ ID NO: 245658 - protein, 8 aa, Mycobacterium
AGKQLREA

SEQ ID NO: 245659 - protein, 9 aa, Mycobacterium
AGKRPEDRT

SEQ ID NO: 245660 - protein, 7 aa, Mycobacterium
AGKSDGH

SEQ ID NO: 245661 - protein, 10 aa, Mycobacterium
AGKSGDRTAA

SEQ ID NO: 245662 - protein, 11 aa, Mycobacterium
AGKSLSDSASG

SEQ ID NO: 245663 - protein, 8 aa, Mycobacterium
AGKTNAEA

SEQ ID NO: 245664 - protein, 9 aa, Mycobacterium
AGKVDPRSD

SEQ ID NO: 245665 - protein, 13 aa, Mycobacterium
AGKVSASSGAGNT

SEQ ID NO: 245666 - protein, 4 aa, Mycobacterium
AGKY

SEQ ID NO: 245667 - protein, 17 aa, Mycobacterium
AGLAAQQGAGVAAGAPT

SEQ ID NO: 245668 - protein, 10 aa, Mycobacterium
AGLAGARASA

SEQ ID NO: 245669 - protein, 11 aa, Mycobacterium
AGLAGPQKNGK

SEQ ID NO: 245670 - protein, 9 aa, Mycobacterium
AGLAPASAE

SEQ ID NO: 245671 - protein, 7 aa, Mycobacterium
AGLAPPV

SEQ ID NO: 245672 - protein, 18 aa, Mycobacterium
AGLASGSSYATASAVTGT

SEQ ID NO: 245673 - protein, 11 aa, Mycobacterium
AGLASPAMPAR

SEQ ID NO: 245674 - protein, 8 aa, Mycobacterium
AGLDGPAA

SEQ ID NO: 245675 - protein, 13 aa, Mycobacterium
AGLDHDRETVSHP

SEQ ID NO: 245676 - protein, 5 aa, Mycobacterium
AGLDR

SEQ ID NO: 245677 - protein, 8 aa, Mycobacterium
AGLDRPGR

SEQ ID NO: 245678 - protein, 11 aa, Mycobacterium
AGLGAASTLHD

SEQ ID NO: 245679 - protein, 14 aa, Mycobacterium
AGLGAGSSYATASA

SEQ ID NO: 245680 - protein, 5 aa, Mycobacterium
AGLGE

SEQ ID NO: 245681 - protein, 9 aa, Mycobacterium
AGLGNTGED

SEQ ID NO: 245682 - protein, 5 aa, Mycobacterium
AGLGT

SEQ ID NO: 245683 - protein, 4 aa, Mycobacterium
AGLP

SEQ ID NO: 245684 - protein, 16 aa, Mycobacterium
AGLPDDKAPTAETPDV

SEQ ID NO: 245685 - protein, 9 aa, Mycobacterium
AGLPDGVPQ

SEQ ID NO: 245686 - protein, 8 aa, Mycobacterium
AGLPGDPR

SEQ ID NO: 245687 - protein, 5 aa, Mycobacterium
AGLPN

SEQ ID NO: 245688 - protein, 7 aa, Mycobacterium
AGLPPDT

SEQ ID NO: 245689 - protein, 7 aa, Mycobacterium
AGLPPGV

SEQ ID NO: 245690 - protein, 6 aa, Mycobacterium
AGLPRA

SEQ ID NO: 245691 - protein, 8 aa, Mycobacterium
AGLPSDLG

SEQ ID NO: 245692 - protein, 9 aa, Mycobacterium
AGLPTGSLD

SEQ ID NO: 245693 - protein, 6 aa, Mycobacterium
AGLQPD

SEQ ID NO: 245694 - protein, 11 aa, Mycobacterium
AGLQQASERLR

SEQ ID NO: 245695 - protein, 10 aa, Mycobacterium
AGLRSDSRTT

SEQ ID NO: 245696 - protein, 5 aa, Mycobacterium
AGLSA

SEQ ID NO: 245697 - protein, 5 aa, Mycobacterium
AGLSD

SEQ ID NO: 245698 - protein, 17 aa, Mycobacterium
AGLSDGFTANGIPANVS

SEQ ID NO: 245699 - protein, 5 aa, Mycobacterium
AGLSE

SEQ ID NO: 245700 - protein, 11 aa, Mycobacterium
AGLSESEIDDI

SEQ ID NO: 245701 - protein, 15 aa, Mycobacterium
AGLSGRRSLSPDRNI

SEQ ID NO: 245702 - protein, 6 aa, Mycobacterium
AGLSPE

SEQ ID NO: 245703 - protein, 5 aa, Mycobacterium
AGLSR

SEQ ID NO: 245704 - protein, 12 aa, Mycobacterium
AGLSRGDQLTRY

SEQ ID NO: 245705 - protein, 8 aa, Mycobacterium
AGLSRRDM

SEQ ID NO: 245706 - protein, 4 aa, Mycobacterium
AGLT

SEQ ID NO: 245707 - protein, 7 aa, Mycobacterium
AGLTATG

SEQ ID NO: 245708 - protein, 7 aa, Mycobacterium
AGLTGAD

SEQ ID NO: 245709 - protein, 13 aa, Mycobacterium
AGLTGERSLRPDR

SEQ ID NO: 245710 - protein, 11 aa, Mycobacterium
AGLTGGGNAGK

SEQ ID NO: 245711 - protein, 11 aa, Mycobacterium
AGLTGPQNTGK

SEQ ID NO: 245712 - protein, 12 aa, Mycobacterium
AGLTKGGSYATA

SEQ ID NO: 245713 - protein, 7 aa, Mycobacterium
AGLTKPD

SEQ ID NO: 245714 - protein, 8 aa, Mycobacterium
AGLTPDQL

SEQ ID NO: 245715 - protein, 6 aa, Mycobacterium
AGLTPG

SEQ ID NO: 245716 - protein, 15 aa, Mycobacterium
AGLTRPGPGGANGHE

SEQ ID NO: 245717 - protein, 8 aa, Mycobacterium
AGLTTSDL

SEQ ID NO: 245718 - protein, 5 aa, Mycobacterium
AGMAA

SEQ ID NO: 245719 - protein, 15 aa, Mycobacterium
AGMAPKAKSGYPATP

SEQ ID NO: 245720 - protein, 25 aa, Mycobacterium
AGMGATATADVPAYAATGRGTGPLG

SEQ ID NO: 245721 - protein, 5 aa, Mycobacterium
AGMHR

SEQ ID NO: 245722 - protein, 5 aa, Mycobacterium
AGMSE

SEQ ID NO: 245723 - protein, 12 aa, Mycobacterium
AGMTSLKAGGGA

SEQ ID NO: 245724 - protein, 6 aa, Mycobacterium
AGNAIT

SEQ ID NO: 245725 - protein, 8 aa, Mycobacterium
AGNAPEGL

SEQ ID NO: 245726 - protein, 12 aa, Mycobacterium
AGNAPSGGAAHA

SEQ ID NO: 245727 - protein, 8 aa, Mycobacterium
AGNASTAR

SEQ ID NO: 245728 - protein, 13 aa, Mycobacterium
AGNATRCAAAGRR

SEQ ID NO: 245729 - protein, 15 aa, Mycobacterium
AGNDGEAGCDNNPMY

SEQ ID NO: 245730 - protein, 14 aa, Mycobacterium
AGNDGEAGCNNNPM

SEQ ID NO: 245731 - protein, 25 aa, Mycobacterium
AGNDGEAGCNNNPTYDPLEPSDPRD

SEQ ID NO: 245732 - protein, 14 aa, Mycobacterium
AGNDSGDASATTRM

SEQ ID NO: 245733 - protein, 6 aa, Mycobacterium
AGNDTA

SEQ ID NO: 245734 - protein, 13 aa, Mycobacterium
AGNEDAKQTTSAS

SEQ ID NO: 245735 - protein, 4 aa, Mycobacterium
AGNG

SEQ ID NO: 245736 - protein, 10 aa, Mycobacterium
AGNGADSDNM

SEQ ID NO: 245737 - protein, 7 aa, Mycobacterium
AGNGAGF

SEQ ID NO: 245738 - protein, 6 aa, Mycobacterium
AGNGDA

SEQ ID NO: 245739 - protein, 41 aa, Mycobacterium
AGNGGAGANGGNGATTTESGASGAAGIAGGRGGNGGNGGSV

SEQ ID NO: 245740 - protein, 7 aa, Mycobacterium
AGNGLDS

SEQ ID NO: 245741 - protein, 7 aa, Mycobacterium
AGNGMSD

SEQ ID NO: 245742 - protein, 5 aa, Mycobacterium
AGNGS

SEQ ID NO: 245743 - protein, 13 aa, Mycobacterium
AGNGYSSRAGGAG

SEQ ID NO: 245744 - protein, 10 aa, Mycobacterium
AGNMADEPGY

SEQ ID NO: 245745 - protein, 31 aa, Mycobacterium
AGNNRGGVSTGAACESNPLPSGTPGDPRNWN

SEQ ID NO: 245746 - protein, 12 aa, Mycobacterium
AGNPGADQDQLG

SEQ ID NO: 245747 - protein, 9 aa, Mycobacterium
AGNPIGGPV

SEQ ID NO: 245748 - protein, 8 aa, Mycobacterium
AGNPSWPG

SEQ ID NO: 245749 - protein, 5 aa, Mycobacterium
AGNPT

SEQ ID NO: 245750 - protein, 6 aa, Mycobacterium
AGNPTF

SEQ ID NO: 245751 - protein, 9 aa, Mycobacterium
AGNQARDAA

SEQ ID NO: 245752 - protein, 13 aa, Mycobacterium
AGNQGEALANESV

SEQ ID NO: 245753 - protein, 13 aa, Mycobacterium
AGNQGESLANESV

SEQ ID NO: 245754 - protein, 10 aa, Mycobacterium
AGNQGESLSY

SEQ ID NO: 245755 - protein, 14 aa, Mycobacterium
AGNQGQALANKSVE

SEQ ID NO: 245756 - protein, 13 aa, Mycobacterium
AGNQGSALANEGV

SEQ ID NO: 245757 - protein, 5 aa, Mycobacterium
AGNQP

SEQ ID NO: 245758 - protein, 28 aa, Mycobacterium
AGNQPPAAAAKPVAVPPAPAPRDTTPRT

SEQ ID NO: 245759 - protein, 16 aa, Mycobacterium
AGNRNDPMQRDCGQNP

SEQ ID NO: 245760 - protein, 33 aa, Mycobacterium
AGNSGAAGSGGGGSSCDSNPLTDLSRPDDPRNW

SEQ ID NO: 245761 - protein, 21 aa, Mycobacterium
AGNSGAGGSGSGGTCESNPLT

SEQ ID NO: 245762 - protein, 33 aa, Mycobacterium
AGNSGPTGSFAGGTSCESNPLTDLSRPNDPRNW

SEQ ID NO: 245763 - protein, 14 aa, Mycobacterium
AGNSSPGDIKDDTR

SEQ ID NO: 245764 - protein, 4 aa, Mycobacterium
AGNT

SEQ ID NO: 245765 - protein, 25 aa, Mycobacterium
AGNTGENCAQNPPPDPAVPADPRGW

SEQ ID NO: 245766 - protein, 18 aa, Mycobacterium
AGNTGGAAQCPPQRPDAT

SEQ ID NO: 245767 - protein, 33 aa, Mycobacterium
AGNTGPTGSVAGGTSCESNPLTDLSRPDDPRNW

SEQ ID NO: 245768 - protein, 7 aa, Mycobacterium
AGNTSAG

SEQ ID NO: 245769 - protein, 27 aa, Mycobacterium
AGNTSGGSANCQQNPLTGSGADPRNWS

SEQ ID NO: 245770 - protein, 10 aa, Mycobacterium
AGNTVDGTNL

SEQ ID NO: 245771 - protein, 7 aa, Mycobacterium
AGNVDGP

SEQ ID NO: 245772 - protein, 8 aa, Mycobacterium
AGNVDTAR

SEQ ID NO: 245773 - protein, 5 aa, Mycobacterium
AGPAA

SEQ ID NO: 245774 - protein, 6 aa, Mycobacterium
AGPAAG

SEQ ID NO: 245775 - protein, 6 aa, Mycobacterium
AGPAAN

SEQ ID NO: 245776 - protein, 14 aa, Mycobacterium
AGPADYANIPPTRF

SEQ ID NO: 245777 - protein, 14 aa, Mycobacterium
AGPAEAAPADPRSV

SEQ ID NO: 245778 - protein, 6 aa, Mycobacterium
AGPAFA

SEQ ID NO: 245779 - protein, 6 aa, Mycobacterium
AGPAGL

SEQ ID NO: 245780 - protein, 8 aa, Mycobacterium
AGPAHPLT

SEQ ID NO: 245781 - protein, 5 aa, Mycobacterium
AGPAI

SEQ ID NO: 245782 - protein, 9 aa, Mycobacterium
AGPALSRGD

SEQ ID NO: 245783 - protein, 25 aa, Mycobacterium
AGPAPATAAPVPAEADGADGTDGVP

SEQ ID NO: 245784 - protein, 6 aa, Mycobacterium
AGPARR

SEQ ID NO: 245785 - protein, 7 aa, Mycobacterium
AGPARTG

SEQ ID NO: 245786 - protein, 6 aa, Mycobacterium
AGPATI

SEQ ID NO: 245787 - protein, 5 aa, Mycobacterium
AGPAV

SEQ ID NO: 245788 - protein, 6 aa, Mycobacterium
AGPAVS

SEQ ID NO: 245789 - protein, 13 aa, Mycobacterium
AGPDGTPELRAGS

SEQ ID NO: 245790 - protein, 7 aa, Mycobacterium
AGPDRTA

SEQ ID NO: 245791 - protein, 4 aa, Mycobacterium
AGPE

SEQ ID NO: 245792 - protein, 12 aa, Mycobacterium
AGPEADRRPVTG

SEQ ID NO: 245793 - protein, 7 aa, Mycobacterium
AGPEDAP

SEQ ID NO: 245794 - protein, 6 aa, Mycobacterium
AGPEGP

SEQ ID NO: 245795 - protein, 16 aa, Mycobacterium
AGPEGVGAAPADAPQV

SEQ ID NO: 245796 - protein, 14 aa, Mycobacterium
AGPEGVNGEFDTPI

SEQ ID NO: 245797 - protein, 20 aa, Mycobacterium
AGPELSRRGASIARDAVAGS

SEQ ID NO: 245798 - protein, 6 aa, Mycobacterium
AGPEST

SEQ ID NO: 245799 - protein, 5 aa, Mycobacterium
AGPET

SEQ ID NO: 245800 - protein, 12 aa, Mycobacterium
AGPFPPKRAEEL

SEQ ID NO: 245801 - protein, 5 aa, Mycobacterium
AGPGA

SEQ ID NO: 245802 - protein, 9 aa, Mycobacterium
AGPGCGPTV

SEQ ID NO: 245803 - protein, 17 aa, Mycobacterium
AGPGELPTPPPPPPVPA

SEQ ID NO: 245804 - protein, 11 aa, Mycobacterium
AGPGERAKAVG

SEQ ID NO: 245805 - protein, 6 aa, Mycobacterium
AGPGGI

SEQ ID NO: 245806 - protein, 7 aa, Mycobacterium
AGPGGRA

SEQ ID NO: 245807 - protein, 7 aa, Mycobacterium
AGPGGVE

SEQ ID NO: 245808 - protein, 5 aa, Mycobacterium
AGPGH

SEQ ID NO: 245809 - protein, 5 aa, Mycobacterium
AGPGL

SEQ ID NO: 245810 - protein, 14 aa, Mycobacterium
AGPGLREPGLPPGV

SEQ ID NO: 245811 - protein, 17 aa, Mycobacterium
AGPGQQPGYPPPFPPPY

SEQ ID NO: 245812 - protein, 6 aa, Mycobacterium
AGPGRE

SEQ ID NO: 245813 - protein, 24 aa, Mycobacterium
AGPGTPGPTVAPAPAPAASEDDGL

SEQ ID NO: 245814 - protein, 12 aa, Mycobacterium
AGPGYSSTNPVT

SEQ ID NO: 245815 - protein, 14 aa, Mycobacterium
AGPHAGDKSPSRTV

SEQ ID NO: 245816 - protein, 14 aa, Mycobacterium
AGPHAGDKSPTRTV

SEQ ID NO: 245817 - protein, 14 aa, Mycobacterium
AGPHAGDRSATRTV

SEQ ID NO: 245818 - protein, 14 aa, Mycobacterium
AGPHAGDRSPTRTV

SEQ ID NO: 245819 - protein, 5 aa, Mycobacterium
AGPHS

SEQ ID NO: 245820 - protein, 4 aa, Mycobacterium
AGPI

SEQ ID NO: 245821 - protein, 6 aa, Mycobacterium
AGPIRD

SEQ ID NO: 245822 - protein, 7 aa, Mycobacterium
AGPIRDS

SEQ ID NO: 245823 - protein, 14 aa, Mycobacterium
AGPKDLERNPATVG

SEQ ID NO: 245824 - protein, 9 aa, Mycobacterium
AGPKGELQG

SEQ ID NO: 245825 - protein, 6 aa, Mycobacterium
AGPKRL

SEQ ID NO: 245826 - protein, 11 aa, Mycobacterium
AGPLPDQTDQV

SEQ ID NO: 245827 - protein, 7 aa, Mycobacterium
AGPLPNE

SEQ ID NO: 245828 - protein, 9 aa, Mycobacterium
AGPLPNQAD

SEQ ID NO: 245829 - protein, 8 aa, Mycobacterium
AGPLPQER

SEQ ID NO: 245830 - protein, 5 aa, Mycobacterium
AGPNA

SEQ ID NO: 245831 - protein, 10 aa, Mycobacterium
AGPPATEGMT

SEQ ID NO: 245832 - protein, 15 aa, Mycobacterium
AGPPATGANDPCAAS

SEQ ID NO: 245833 - protein, 7 aa, Mycobacterium
AGPPDQV

SEQ ID NO: 245834 - protein, 15 aa, Mycobacterium
AGPPGPPGPPPGPPP

SEQ ID NO: 245835 - protein, 5 aa, Mycobacterium
AGPPI

SEQ ID NO: 245836 - protein, 10 aa, Mycobacterium
AGPPPTGPDG

SEQ ID NO: 245837 - protein, 14 aa, Mycobacterium
AGPPPTGRNVEPYA

SEQ ID NO: 245838 - protein, 13 aa, Mycobacterium
AGPPQPSPLGPPL

SEQ ID NO: 245839 - protein, 6 aa, Mycobacterium
AGPPTV

SEQ ID NO: 245840 - protein, 4 aa, Mycobacterium
AGPQ

SEQ ID NO: 245841 - protein, 11 aa, Mycobacterium
AGPQAATSQVA

SEQ ID NO: 245842 - protein, 14 aa, Mycobacterium
AGPQGVNGEFDTPI

SEQ ID NO: 245843 - protein, 9 aa, Mycobacterium
AGPRAESRG

SEQ ID NO: 245844 - protein, 10 aa, Mycobacterium
AGPRAETRTA

SEQ ID NO: 245845 - protein, 8 aa, Mycobacterium
AGPRKHPY

SEQ ID NO: 245846 - protein, 44 aa, Mycobacterium
AGPRPPHDPTHPSTPESSQRGSARPEIGPAQSGPSSAGTKQIPI

SEQ ID NO: 245847 - protein, 7 aa, Mycobacterium
AGPRQHP

SEQ ID NO: 245848 - protein, 7 aa, Mycobacterium
AGPRRHP

SEQ ID NO: 245849 - protein, 4 aa, Mycobacterium
AGPS

SEQ ID NO: 245850 - protein, 6 aa, Mycobacterium
AGPSAN

SEQ ID NO: 245851 - protein, 12 aa, Mycobacterium
AGPSCTTAPETR

SEQ ID NO: 245852 - protein, 9 aa, Mycobacterium
AGPSPARSS

SEQ ID NO: 245853 - protein, 7 aa, Mycobacterium
AGPSRFN

SEQ ID NO: 245854 - protein, 8 aa, Mycobacterium
AGPSRFNK

SEQ ID NO: 245855 - protein, 12 aa, Mycobacterium
AGPSTMPQSPHG

SEQ ID NO: 245856 - protein, 6 aa, Mycobacterium
AGPSVS

SEQ ID NO: 245857 - protein, 4 aa, Mycobacterium
AGPT

SEQ ID NO: 245858 - protein, 12 aa, Mycobacterium
AGPTAETRSAQK

SEQ ID NO: 245859 - protein, 6 aa, Mycobacterium
AGPTAN

SEQ ID NO: 245860 - protein, 8 aa, Mycobacterium
AGPTGELQ

SEQ ID NO: 245861 - protein, 7 aa, Mycobacterium
AGPTGGP

SEQ ID NO: 245862 - protein, 7 aa, Mycobacterium
AGPTGQI

SEQ ID NO: 245863 - protein, 5 aa, Mycobacterium
AGPTP

SEQ ID NO: 245864 - protein, 6 aa, Mycobacterium
AGPTPL

SEQ ID NO: 245865 - protein, 9 aa, Mycobacterium
AGPTQTYPS

SEQ ID NO: 245866 - protein, 9 aa, Mycobacterium
AGPTSESAA

SEQ ID NO: 245867 - protein, 5 aa, Mycobacterium
AGPTV

SEQ ID NO: 245868 - protein, 6 aa, Mycobacterium
AGPVDA

SEQ ID NO: 245869 - protein, 5 aa, Mycobacterium
AGPVN

SEQ ID NO: 245870 - protein, 5 aa, Mycobacterium
AGPVP

SEQ ID NO: 245871 - protein, 9 aa, Mycobacterium
AGPVPDQTD

SEQ ID NO: 245872 - protein, 12 aa, Mycobacterium
AGPVRGGQGGKD

SEQ ID NO: 245873 - protein, 10 aa, Mycobacterium
AGPVRTGRVG

SEQ ID NO: 245874 - protein, 4 aa, Mycobacterium
AGPW

SEQ ID NO: 245875 - protein, 10 aa, Mycobacterium
AGPWQGPSAA

SEQ ID NO: 245876 - protein, 9 aa, Mycobacterium
AGQAAGGEI

SEQ ID NO: 245877 - protein, 7 aa, Mycobacterium
AGQAGGG

SEQ ID NO: 245878 - protein, 7 aa, Mycobacterium
AGQATDE

SEQ ID NO: 245879 - protein, 7 aa, Mycobacterium
AGQDEDD

SEQ ID NO: 245880 - protein, 13 aa, Mycobacterium
AGQDVAKTGDPVL

SEQ ID NO: 245881 - protein, 13 aa, Mycobacterium
AGQDVAKTGNPVL

SEQ ID NO: 245882 - protein, 9 aa, Mycobacterium
AGQEGPRSR

SEQ ID NO: 245883 - protein, 8 aa, Mycobacterium
AGQGALAS

SEQ ID NO: 245884 - protein, 7 aa, Mycobacterium
AGQGALT

SEQ ID NO: 245885 - protein, 6 aa, Mycobacterium
AGQGAY

SEQ ID NO: 245886 - protein, 7 aa, Mycobacterium
AGQGEPC

SEQ ID NO: 245887 - protein, 12 aa, Mycobacterium
AGQGGSQQKNPA

SEQ ID NO: 245888 - protein, 10 aa, Mycobacterium
AGQGLSERLA

SEQ ID NO: 245889 - protein, 8 aa, Mycobacterium
AGQGPGSL

SEQ ID NO: 245890 - protein, 9 aa, Mycobacterium
AGQHDQARR

SEQ ID NO: 245891 - protein, 4 aa, Mycobacterium
AGQI

SEQ ID NO: 245892 - protein, 7 aa, Mycobacterium
AGQINES

SEQ ID NO: 245893 - protein, 6 aa, Mycobacterium
AGQIPP

SEQ ID NO: 245894 - protein, 8 aa, Mycobacterium
AGQKCSAA

SEQ ID NO: 245895 - protein, 22 aa, Mycobacterium
AGQKVELPNRSGPVSTEIAGTP

SEQ ID NO: 245896 - protein, 4 aa, Mycobacterium
AGQL

SEQ ID NO: 245897 - protein, 5 aa, Mycobacterium
AGQNY

SEQ ID NO: 245898 - protein, 5 aa, Mycobacterium
AGQPG

SEQ ID NO: 245899 - protein, 10 aa, Mycobacterium
AGQPGADGFA

SEQ ID NO: 245900 - protein, 14 aa, Mycobacterium
AGQPGDDGFSGVAP

SEQ ID NO: 245901 - protein, 15 aa, Mycobacterium
AGQPGPDGFSGVAPE

SEQ ID NO: 245902 - protein, 17 aa, Mycobacterium
AGQPSAGPAKPRPDDID

SEQ ID NO: 245903 - protein, 12 aa, Mycobacterium
AGQPTSDPNLTY

SEQ ID NO: 245904 - protein, 4 aa, Mycobacterium
AGQQ

SEQ ID NO: 245905 - protein, 8 aa, Mycobacterium
AGQQYHDS

SEQ ID NO: 245906 - protein, 11 aa, Mycobacterium
AGQRGTTARIT

SEQ ID NO: 245907 - protein, 11 aa, Mycobacterium
AGQRGTTSRIT

SEQ ID NO: 245908 - protein, 12 aa, Mycobacterium
AGQRGTTSRITA

SEQ ID NO: 245909 - protein, 5 aa, Mycobacterium
AGQRV

SEQ ID NO: 245910 - protein, 8 aa, Mycobacterium
AGQSAASV

SEQ ID NO: 245911 - protein, 7 aa, Mycobacterium
AGQSPGL

SEQ ID NO: 245912 - protein, 13 aa, Mycobacterium
AGQSPRTVAVSPD

SEQ ID NO: 245913 - protein, 5 aa, Mycobacterium
AGQTL

SEQ ID NO: 245914 - protein, 20 aa, Mycobacterium
AGQTPAGSTGSKGPGAPGRV

SEQ ID NO: 245915 - protein, 10 aa, Mycobacterium
AGQTSTDNRS

SEQ ID NO: 245916 - protein, 5 aa, Mycobacterium
AGQVD

SEQ ID NO: 245917 - protein, 7 aa, Mycobacterium
AGQVGNS

SEQ ID NO: 245918 - protein, 9 aa, Mycobacterium
AGQVQATNF

SEQ ID NO: 245919 - protein, 8 aa, Mycobacterium
AGQVQATR

SEQ ID NO: 245920 - protein, 11 aa, Mycobacterium
AGRAADSGRIS

SEQ ID NO: 245921 - protein, 9 aa, Mycobacterium
AGRAARQGR

SEQ ID NO: 245922 - protein, 8 aa, Mycobacterium
AGRADEQV

SEQ ID NO: 245923 - protein, 7 aa, Mycobacterium
AGRAESR

SEQ ID NO: 245924 - protein, 17 aa, Mycobacterium
AGRAGAGARSDEDAALG

SEQ ID NO: 245925 - protein, 14 aa, Mycobacterium
AGRAGHSPAGQAAK

SEQ ID NO: 245926 - protein, 7 aa, Mycobacterium
AGRAGYG

SEQ ID NO: 245927 - protein, 7 aa, Mycobacterium
AGRAGYS

SEQ ID NO: 245928 - protein, 10 aa, Mycobacterium
AGRAQAAGRR

SEQ ID NO: 245929 - protein, 9 aa, Mycobacterium
AGRARPDTA

SEQ ID NO: 245930 - protein, 5 aa, Mycobacterium
AGRAV

SEQ ID NO: 245931 - protein, 15 aa, Mycobacterium
AGRCAEPTEEEVRAT

SEQ ID NO: 245932 - protein, 4 aa, Mycobacterium
AGRD

SEQ ID NO: 245933 - protein, 6 aa, Mycobacterium
AGRDAF

SEQ ID NO: 245934 - protein, 12 aa, Mycobacterium
AGRDANQIRGPK

SEQ ID NO: 245935 - protein, 8 aa, Mycobacterium
AGRDGHAP

SEQ ID NO: 245936 - protein, 9 aa, Mycobacterium
AGRDGRAPW

SEQ ID NO: 245937 - protein, 16 aa, Mycobacterium
AGRDQTATAGEIPTAT

SEQ ID NO: 245938 - protein, 25 aa, Mycobacterium
AGRDRTPTTPPTSSAKRDAGAGQIA

SEQ ID NO: 245939 - protein, 11 aa, Mycobacterium
AGRDVAADAVP

SEQ ID NO: 245940 - protein, 20 aa, Mycobacterium
AGREDQGATGTLTETSARAA

SEQ ID NO: 245941 - protein, 16 aa, Mycobacterium
AGREPEDAADAAMATS

SEQ ID NO: 245942 - protein, 8 aa, Mycobacterium
AGRERSGG

SEQ ID NO: 245943 - protein, 9 aa, Mycobacterium
AGRESDENV

SEQ ID NO: 245944 - protein, 4 aa, Mycobacterium
AGRG

SEQ ID NO: 245945 - protein, 5 aa, Mycobacterium
AGRGA

SEQ ID NO: 245946 - protein, 7 aa, Mycobacterium
AGRGAPA

SEQ ID NO: 245947 - protein, 14 aa, Mycobacterium
AGRGASDQPVERAN

SEQ ID NO: 245948 - protein, 7 aa, Mycobacterium
AGRGEPD

SEQ ID NO: 245949 - protein, 9 aa, Mycobacterium
AGRGRDDRS

SEQ ID NO: 245950 - protein, 11 aa, Mycobacterium
AGRGRDHGGAG

SEQ ID NO: 245951 - protein, 9 aa, Mycobacterium
AGRGREDNS

SEQ ID NO: 245952 - protein, 9 aa, Mycobacterium
AGRGREDNT

SEQ ID NO: 245953 - protein, 8 aa, Mycobacterium
AGRGVPAL

SEQ ID NO: 245954 - protein, 5 aa, Mycobacterium
AGRGW

SEQ ID NO: 245955 - protein, 15 aa, Mycobacterium
AGRIGGGAPRPAPVS

SEQ ID NO: 245956 - protein, 13 aa, Mycobacterium
AGRIKPLTGNQAR

SEQ ID NO: 245957 - protein, 11 aa, Mycobacterium
AGRLSDAGRRA

SEQ ID NO: 245958 - protein, 5 aa, Mycobacterium
AGRLT

SEQ ID NO: 245959 - protein, 8 aa, Mycobacterium
AGRNRDDH

SEQ ID NO: 245960 - protein, 9 aa, Mycobacterium
AGRNTEDRS

SEQ ID NO: 245961 - protein, 9 aa, Mycobacterium
AGRNTEDRT

SEQ ID NO: 245962 - protein, 21 aa, Mycobacterium
AGRPATGPAPVTSPAAATELP

SEQ ID NO: 245963 - protein, 10 aa, Mycobacterium
AGRPATPSDD

SEQ ID NO: 245964 - protein, 15 aa, Mycobacterium
AGRPDEPPPNVPGTP

SEQ ID NO: 245965 - protein, 6 aa, Mycobacterium
AGRPGA

SEQ ID NO: 245966 - protein, 61 aa, Mycobacterium
AGRPGDPPPDVPGTPVPLPTQAPPGARTENLAPAGPVPPPSTFAPGLPPGPPAPPGPGNQL

SEQ ID NO: 245967 - protein, 79 aa, Mycobacterium
AGRPGEAPPNVPGTPVPLPAQAPPGARTENLQPAGPTPHRRRSRPGLRRDRPRRRDPASNCRHRSSTPAARGAAASREV

SEQ ID NO: 245968 - protein, 7 aa, Mycobacterium
AGRPISS

SEQ ID NO: 245969 - protein, 8 aa, Mycobacterium
AGRPLERD

SEQ ID NO: 245970 - protein, 6 aa, Mycobacterium
AGRPPL

SEQ ID NO: 245971 - protein, 10 aa, Mycobacterium
AGRPPQTESM

SEQ ID NO: 245972 - protein, 6 aa, Mycobacterium
AGRPQM

SEQ ID NO: 245973 - protein, 7 aa, Mycobacterium
AGRPRTV

SEQ ID NO: 245974 - protein, 12 aa, Mycobacterium
AGRQDPAANTLR

SEQ ID NO: 245975 - protein, 8 aa, Mycobacterium
AGRQGRHD

SEQ ID NO: 245976 - protein, 8 aa, Mycobacterium
AGRQGSHR

SEQ ID NO: 245977 - protein, 8 aa, Mycobacterium
AGRQTIDG

SEQ ID NO: 245978 - protein, 5 aa, Mycobacterium
AGRRA

SEQ ID NO: 245979 - protein, 9 aa, Mycobacterium
AGRRDDSRY

SEQ ID NO: 245980 - protein, 8 aa, Mycobacterium
AGRRDTDL

SEQ ID NO: 245981 - protein, 7 aa, Mycobacterium
AGRRGKA

SEQ ID NO: 245982 - protein, 16 aa, Mycobacterium
AGRRPPISMIPSFPGS

SEQ ID NO: 245983 - protein, 66 aa, Mycobacterium
AGRRPPRPNAAPSIGRAAPAAVPPAIQNRPPAEATGRAPAQTSRTRTTGSHHRSAPPARRTFSSGQ

SEQ ID NO: 245984 - protein, 66 aa, Mycobacterium
AGRRPPRPNQAPTISRATPAAIPPATQVRPAVGAPSRVAPPTSRTRQPTGSHRPPPPRRGTFSPGQ

SEQ ID NO: 245985 - protein, 66 aa, Mycobacterium
AGRRPPRPNQAPTLGRAAPAAVPSAAQARASADLTGRAPVTAARARPTATAAHRTPPPRRTFSSGQ

SEQ ID NO: 245986 - protein, 63 aa, Mycobacterium
AGRRPPRPSQSPPAGRAAPAAIPSSAPARIAPAPTTRTTTPRRTRPATGGHRPPPARRTFSSG

SEQ ID NO: 245987 - protein, 12 aa, Mycobacterium
AGRRRQTGGHLD

SEQ ID NO: 245988 - protein, 9 aa, Mycobacterium
AGRRVQGSA

SEQ ID NO: 245989 - protein, 16 aa, Mycobacterium
AGRSALDTSAITGESV

SEQ ID NO: 245990 - protein, 5 aa, Mycobacterium
AGRSE

SEQ ID NO: 245991 - protein, 7 aa, Mycobacterium
AGRSEPE

SEQ ID NO: 245992 - protein, 10 aa, Mycobacterium
AGRSGSDPAA

SEQ ID NO: 245993 - protein, 7 aa, Mycobacterium
AGRSGSF

SEQ ID NO: 245994 - protein, 8 aa, Mycobacterium
AGRSPDRL

SEQ ID NO: 245995 - protein, 8 aa, Mycobacterium
AGRSSERL

SEQ ID NO: 245996 - protein, 8 aa, Mycobacterium
AGRSVAAY

SEQ ID NO: 245997 - protein, 15 aa, Mycobacterium
AGRTDVGGLGQAGAA

SEQ ID NO: 245998 - protein, 6 aa, Mycobacterium
AGRTEP

SEQ ID NO: 245999 - protein, 10 aa, Mycobacterium
AGRTGAPGPR

SEQ ID NO: 246000 - protein, 7 aa, Mycobacterium
AGRTGLT

SEQ ID NO: 246001 - protein, 8 aa, Mycobacterium
AGRTPKGR

SEQ ID NO: 246002 - protein, 16 aa, Mycobacterium
AGRTPSGALAAGGPTT

SEQ ID NO: 246003 - protein, 16 aa, Mycobacterium
AGRTPTEKVGMQERRD

SEQ ID NO: 246004 - protein, 5 aa, Mycobacterium
AGRTV

SEQ ID NO: 246005 - protein, 4 aa, Mycobacterium
AGRV

SEQ ID NO: 246006 - protein, 8 aa, Mycobacterium
AGRVPEAK

SEQ ID NO: 246007 - protein, 8 aa, Mycobacterium
AGSAAGPL

SEQ ID NO: 246008 - protein, 10 aa, Mycobacterium
AGSAATAAAL

SEQ ID NO: 246009 - protein, 10 aa, Mycobacterium
AGSAEAAEAA

SEQ ID NO: 246010 - protein, 13 aa, Mycobacterium
AGSAENSSNDQPV

SEQ ID NO: 246011 - protein, 5 aa, Mycobacterium
AGSAG

SEQ ID NO: 246012 - protein, 6 aa, Mycobacterium
AGSAGT

SEQ ID NO: 246013 - protein, 7 aa, Mycobacterium
AGSALDT

SEQ ID NO: 246014 - protein, 9 aa, Mycobacterium
AGSAPLTQQ

SEQ ID NO: 246015 - protein, 16 aa, Mycobacterium
AGSATPASLSDTTALT

SEQ ID NO: 246016 - protein, 21 aa, Mycobacterium
AGSATQGKATGAGLESISGTT

SEQ ID NO: 246017 - protein, 13 aa, Mycobacterium
AGSATSANGLAGS

SEQ ID NO: 246018 - protein, 14 aa, Mycobacterium
AGSATSSNGAAGST

SEQ ID NO: 246019 - protein, 14 aa, Mycobacterium
AGSATSSNGSAGTT

SEQ ID NO: 246020 - protein, 13 aa, Mycobacterium
AGSATSSNGTAAT

SEQ ID NO: 246021 - protein, 13 aa, Mycobacterium
AGSATSSNGVAGT

SEQ ID NO: 246022 - protein, 11 aa, Mycobacterium
AGSCSQAPVPV

SEQ ID NO: 246023 - protein, 5 aa, Mycobacterium
AGSDA

SEQ ID NO: 246024 - protein, 40 aa, Mycobacterium
AGSDGATPRRSRRRRAAEPDPEPEFEAQAEPAPKPTPEPE

SEQ ID NO: 246025 - protein, 7 aa, Mycobacterium
AGSDKEA

SEQ ID NO: 246026 - protein, 13 aa, Mycobacterium
AGSDNRPREDATD

SEQ ID NO: 246027 - protein, 9 aa, Mycobacterium
AGSDPNNLG

SEQ ID NO: 246028 - protein, 8 aa, Mycobacterium
AGSDQAAV

SEQ ID NO: 246029 - protein, 7 aa, Mycobacterium
AGSESSA

SEQ ID NO: 246030 - protein, 8 aa, Mycobacterium
AGSESSDR

SEQ ID NO: 246031 - protein, 6 aa, Mycobacterium
AGSESV

SEQ ID NO: 246032 - protein, 6 aa, Mycobacterium
AGSETV

SEQ ID NO: 246033 - protein, 8 aa, Mycobacterium
AGSFGADA

SEQ ID NO: 246034 - protein, 6 aa, Mycobacterium
AGSFGE

SEQ ID NO: 246035 - protein, 6 aa, Mycobacterium
AGSGAS

SEQ ID NO: 246036 - protein, 5 aa, Mycobacterium
AGSGG

SEQ ID NO: 246037 - protein, 9 aa, Mycobacterium
AGSGGGALT

SEQ ID NO: 246038 - protein, 13 aa, Mycobacterium
AGSGGGSATTTYA

SEQ ID NO: 246039 - protein, 8 aa, Mycobacterium
AGSGGPAE

SEQ ID NO: 246040 - protein, 6 aa, Mycobacterium
AGSGIG

SEQ ID NO: 246041 - protein, 9 aa, Mycobacterium
AGSGPGDAL

SEQ ID NO: 246042 - protein, 7 aa, Mycobacterium
AGSGQLG

SEQ ID NO: 246043 - protein, 6 aa, Mycobacterium
AGSGRE

SEQ ID NO: 246044 - protein, 7 aa, Mycobacterium
AGSGRLG

SEQ ID NO: 246045 - protein, 5 aa, Mycobacterium
AGSGS

SEQ ID NO: 246046 - protein, 8 aa, Mycobacterium
AGSGSADV

SEQ ID NO: 246047 - protein, 7 aa, Mycobacterium
AGSGSDV

SEQ ID NO: 246048 - protein, 8 aa, Mycobacterium
AGSGVEPD

SEQ ID NO: 246049 - protein, 6 aa, Mycobacterium
AGSGWT

SEQ ID NO: 246050 - protein, 11 aa, Mycobacterium
AGSGYDQGSAT

SEQ ID NO: 246051 - protein, 6 aa, Mycobacterium
AGSGYS

SEQ ID NO: 246052 - protein, 8 aa, Mycobacterium
AGSHGPAV

SEQ ID NO: 246053 - protein, 7 aa, Mycobacterium
AGSIAAP

SEQ ID NO: 246054 - protein, 6 aa, Mycobacterium
AGSIAE

SEQ ID NO: 246055 - protein, 9 aa, Mycobacterium
AGSIAEEVH

SEQ ID NO: 246056 - protein, 5 aa, Mycobacterium
AGSIR

SEQ ID NO: 246057 - protein, 7 aa, Mycobacterium
AGSKPGQ

SEQ ID NO: 246058 - protein, 5 aa, Mycobacterium
AGSKR

SEQ ID NO: 246059 - protein, 10 aa, Mycobacterium
AGSKTQTELP

SEQ ID NO: 246060 - protein, 7 aa, Mycobacterium
AGSKTQV

SEQ ID NO: 246061 - protein, 8 aa, Mycobacterium
AGSLAGAV

SEQ ID NO: 246062 - protein, 7 aa, Mycobacterium
AGSLETQ

SEQ ID NO: 246063 - protein, 6 aa, Mycobacterium
AGSNMQ

SEQ ID NO: 246064 - protein, 7 aa, Mycobacterium
AGSNNQV

SEQ ID NO: 246065 - protein, 6 aa, Mycobacterium
AGSNRQ

SEQ ID NO: 246066 - protein, 13 aa, Mycobacterium
AGSPDDPGYEQRQ

SEQ ID NO: 246067 - protein, 8 aa, Mycobacterium
AGSPDDRG

SEQ ID NO: 246068 - protein, 6 aa, Mycobacterium
AGSPGL

SEQ ID NO: 246069 - protein, 10 aa, Mycobacterium
AGSPLDTSDY

SEQ ID NO: 246070 - protein, 7 aa, Mycobacterium
AGSPQGL

SEQ ID NO: 246071 - protein, 6 aa, Mycobacterium
AGSPRA

SEQ ID NO: 246072 - protein, 25 aa, Mycobacterium
AGSPRMSMSPPAAPNLHSSRQSASR

SEQ ID NO: 246073 - protein, 8 aa, Mycobacterium
AGSPVQRS

SEQ ID NO: 246074 - protein, 4 aa, Mycobacterium
AGSQ

SEQ ID NO: 246075 - protein, 7 aa, Mycobacterium
AGSQDPV

SEQ ID NO: 246076 - protein, 13 aa, Mycobacterium
AGSQGGASGDESV

SEQ ID NO: 246077 - protein, 13 aa, Mycobacterium
AGSQIPKERTASA

SEQ ID NO: 246078 - protein, 5 aa, Mycobacterium
AGSQS

SEQ ID NO: 246079 - protein, 11 aa, Mycobacterium
AGSQSADGKSA

SEQ ID NO: 246080 - protein, 9 aa, Mycobacterium
AGSRAGRPA

SEQ ID NO: 246081 - protein, 9 aa, Mycobacterium
AGSRGPIDE

SEQ ID NO: 246082 - protein, 7 aa, Mycobacterium
AGSRLDD

SEQ ID NO: 246083 - protein, 9 aa, Mycobacterium
AGSRLGYQE

SEQ ID NO: 246084 - protein, 10 aa, Mycobacterium
AGSRLGYQES

SEQ ID NO: 246085 - protein, 5 aa, Mycobacterium
AGSRP

SEQ ID NO: 246086 - protein, 8 aa, Mycobacterium
AGSRRIAG

SEQ ID NO: 246087 - protein, 17 aa, Mycobacterium
AGSRTARRRQRTAGQLP

SEQ ID NO: 246088 - protein, 4 aa, Mycobacterium
AGSS

SEQ ID NO: 246089 - protein, 6 aa, Mycobacterium
AGSSAV

SEQ ID NO: 246090 - protein, 9 aa, Mycobacterium
AGSSDDGYQ

SEQ ID NO: 246091 - protein, 6 aa, Mycobacterium
AGSSGL

SEQ ID NO: 246092 - protein, 43 aa, Mycobacterium
AGSSGPAREGPATQTAPGGSAAMDAAGPAPEFGPPQAPPTVEK

SEQ ID NO: 246093 - protein, 9 aa, Mycobacterium
AGSSLTEDD

SEQ ID NO: 246094 - protein, 21 aa, Mycobacterium
AGSSTKQGKHDELAGGTQVLH

SEQ ID NO: 246095 - protein, 21 aa, Mycobacterium
AGSTARSVGRARELEPGHRRD

SEQ ID NO: 246096 - protein, 8 aa, Mycobacterium
AGSTARTR

SEQ ID NO: 246097 - protein, 12 aa, Mycobacterium
AGSTDGQLTGAQ

SEQ ID NO: 246098 - protein, 7 aa, Mycobacterium
AGSTDPT

SEQ ID NO: 246099 - protein, 5 aa, Mycobacterium
AGSTG

SEQ ID NO: 246100 - protein, 5 aa, Mycobacterium
AGSTL

SEQ ID NO: 246101 - protein, 12 aa, Mycobacterium
AGSTQARESLQA

SEQ ID NO: 246102 - protein, 7 aa, Mycobacterium
AGSTTPA

SEQ ID NO: 246103 - protein, 5 aa, Mycobacterium
AGSTV

SEQ ID NO: 246104 - protein, 6 aa, Mycobacterium
AGSTVN

SEQ ID NO: 246105 - protein, 14 aa, Mycobacterium
AGSVAAAASAGGVG

SEQ ID NO: 246106 - protein, 16 aa, Mycobacterium
AGSVGAAKRPVPGGYS

SEQ ID NO: 246107 - protein, 12 aa, Mycobacterium
AGSWEGPSSEQY

SEQ ID NO: 246108 - protein, 5 aa, Mycobacterium
AGSWQ

SEQ ID NO: 246109 - protein, 9 aa, Mycobacterium
AGSWQGPSA

SEQ ID NO: 246110 - protein, 15 aa, Mycobacterium
AGSYAAIEAANTSSA

SEQ ID NO: 246111 - protein, 8 aa, Mycobacterium
AGSYRAGS

SEQ ID NO: 246112 - protein, 11 aa, Mycobacterium
AGTAAKGTAVD

SEQ ID NO: 246113 - protein, 15 aa, Mycobacterium
AGTAEQGAGVQAGGL

SEQ ID NO: 246114 - protein, 6 aa, Mycobacterium
AGTAGE

SEQ ID NO: 246115 - protein, 13 aa, Mycobacterium
AGTAGRTPLGQGR

SEQ ID NO: 246116 - protein, 14 aa, Mycobacterium
AGTAGTASGSRLAR

SEQ ID NO: 246117 - protein, 9 aa, Mycobacterium
AGTAGTPAF

SEQ ID NO: 246118 - protein, 7 aa, Mycobacterium
AGTAHGS

SEQ ID NO: 246119 - protein, 12 aa, Mycobacterium
AGTAIGPRIETG

SEQ ID NO: 246120 - protein, 8 aa, Mycobacterium
AGTANPVT

SEQ ID NO: 246121 - protein, 11 aa, Mycobacterium
AGTAPQQSIAQ

SEQ ID NO: 246122 - protein, 15 aa, Mycobacterium
AGTAPSSAVPSASGM

SEQ ID NO: 246123 - protein, 6 aa, Mycobacterium
AGTARA

SEQ ID NO: 246124 - protein, 6 aa, Mycobacterium
AGTART

SEQ ID NO: 246125 - protein, 13 aa, Mycobacterium
AGTDAGGDFTDAG

SEQ ID NO: 246126 - protein, 10 aa, Mycobacterium
AGTDDGSPGV

SEQ ID NO: 246127 - protein, 6 aa, Mycobacterium
AGTDDV

SEQ ID NO: 246128 - protein, 14 aa, Mycobacterium
AGTDGSVTYDRGSD

SEQ ID NO: 246129 - protein, 7 aa, Mycobacterium
AGTDPAI

SEQ ID NO: 246130 - protein, 5 aa, Mycobacterium
AGTDR

SEQ ID NO: 246131 - protein, 10 aa, Mycobacterium
AGTEGANSAF

SEQ ID NO: 246132 - protein, 7 aa, Mycobacterium
AGTEGTV

SEQ ID NO: 246133 - protein, 11 aa, Mycobacterium
AGTEKIRSGDY

SEQ ID NO: 246134 - protein, 11 aa, Mycobacterium
AGTEKISGGDY

SEQ ID NO: 246135 - protein, 12 aa, Mycobacterium
AGTELGDRREGR

SEQ ID NO: 246136 - protein, 10 aa, Mycobacterium
AGTERISAGD

SEQ ID NO: 246137 - protein, 12 aa, Mycobacterium
AGTERVAAGDYS

SEQ ID NO: 246138 - protein, 11 aa, Mycobacterium
AGTGAAAAAGS

SEQ ID NO: 246139 - protein, 7 aa, Mycobacterium
AGTGAGR

SEQ ID NO: 246140 - protein, 12 aa, Mycobacterium
AGTGAPGTADLG

SEQ ID NO: 246141 - protein, 28 aa, Mycobacterium
AGTGFDDAGGDAPLGGGRRGRGSAGTSL

SEQ ID NO: 246142 - protein, 9 aa, Mycobacterium
AGTGGEPQL

SEQ ID NO: 246143 - protein, 15 aa, Mycobacterium
AGTGGPAEVQEEVRE

SEQ ID NO: 246144 - protein, 7 aa, Mycobacterium
AGTGGVV

SEQ ID NO: 246145 - protein, 12 aa, Mycobacterium
AGTGLSGGERQR

SEQ ID NO: 246146 - protein, 5 aa, Mycobacterium
AGTGP

SEQ ID NO: 246147 - protein, 6 aa, Mycobacterium
AGTGRA

SEQ ID NO: 246148 - protein, 9 aa, Mycobacterium
AGTGSPLDQ

SEQ ID NO: 246149 - protein, 10 aa, Mycobacterium
AGTGSPRGAG

SEQ ID NO: 246150 - protein, 8 aa, Mycobacterium
AGTGVDGN

SEQ ID NO: 246151 - protein, 4 aa, Mycobacterium
AGTH

SEQ ID NO: 246152 - protein, 14 aa, Mycobacterium
AGTIEAERRRREAA

SEQ ID NO: 246153 - protein, 8 aa, Mycobacterium
AGTKRKPV

SEQ ID NO: 246154 - protein, 4 aa, Mycobacterium
AGTL

SEQ ID NO: 246155 - protein, 7 aa, Mycobacterium
AGTLADN

SEQ ID NO: 246156 - protein, 5 aa, Mycobacterium
AGTLG

SEQ ID NO: 246157 - protein, 5 aa, Mycobacterium
AGTLQ

SEQ ID NO: 246158 - protein, 8 aa, Mycobacterium
AGTLSDPR

SEQ ID NO: 246159 - protein, 20 aa, Mycobacterium
AGTLSRGAKTGGKPRRRHGV

SEQ ID NO: 246160 - protein, 5 aa, Mycobacterium
AGTLT

SEQ ID NO: 246161 - protein, 4 aa, Mycobacterium
AGTM

SEQ ID NO: 246162 - protein, 13 aa, Mycobacterium
AGTMGTAEGQNAY

SEQ ID NO: 246163 - protein, 5 aa, Mycobacterium
AGTNV

SEQ ID NO: 246164 - protein, 4 aa, Mycobacterium
AGTP

SEQ ID NO: 246165 - protein, 10 aa, Mycobacterium
AGTPAAETER

SEQ ID NO: 246166 - protein, 6 aa, Mycobacterium
AGTPAF

SEQ ID NO: 246167 - protein, 5 aa, Mycobacterium
AGTPD

SEQ ID NO: 246168 - protein, 8 aa, Mycobacterium
AGTPESGV

SEQ ID NO: 246169 - protein, 5 aa, Mycobacterium
AGTPH

SEQ ID NO: 246170 - protein, 8 aa, Mycobacterium
AGTPKNIP

SEQ ID NO: 246171 - protein, 8 aa, Mycobacterium
AGTPLGGP

SEQ ID NO: 246172 - protein, 9 aa, Mycobacterium
AGTPLGGPI

SEQ ID NO: 246173 - protein, 7 aa, Mycobacterium
AGTPPDV

SEQ ID NO: 246174 - protein, 15 aa, Mycobacterium
AGTPQTIPGGPVASQ

SEQ ID NO: 246175 - protein, 9 aa, Mycobacterium
AGTPRTDAD

SEQ ID NO: 246176 - protein, 8 aa, Mycobacterium
AGTQAPGI

SEQ ID NO: 246177 - protein, 5 aa, Mycobacterium
AGTQG

SEQ ID NO: 246178 - protein, 6 aa, Mycobacterium
AGTQGL

SEQ ID NO: 246179 - protein, 7 aa, Mycobacterium
AGTQGSY

SEQ ID NO: 246180 - protein, 11 aa, Mycobacterium
AGTQKISSGDY

SEQ ID NO: 246181 - protein, 5 aa, Mycobacterium
AGTQL

SEQ ID NO: 246182 - protein, 6 aa, Mycobacterium
AGTQSL

SEQ ID NO: 246183 - protein, 5 aa, Mycobacterium
AGTRG

SEQ ID NO: 246184 - protein, 8 aa, Mycobacterium
AGTRPAKG

SEQ ID NO: 246185 - protein, 16 aa, Mycobacterium
AGTRRTVAAGTAVAGA

SEQ ID NO: 246186 - protein, 6 aa, Mycobacterium
AGTSAD

SEQ ID NO: 246187 - protein, 7 aa, Mycobacterium
AGTSDVG

SEQ ID NO: 246188 - protein, 7 aa, Mycobacterium
AGTSNQS

SEQ ID NO: 246189 - protein, 12 aa, Mycobacterium
AGTSPKTTATAA

SEQ ID NO: 246190 - protein, 6 aa, Mycobacterium
AGTSQG

SEQ ID NO: 246191 - protein, 5 aa, Mycobacterium
AGTST

SEQ ID NO: 246192 - protein, 11 aa, Mycobacterium
AGTSTALAGAA

SEQ ID NO: 246193 - protein, 6 aa, Mycobacterium
AGTSTD

SEQ ID NO: 246194 - protein, 6 aa, Mycobacterium
AGTSTT

SEQ ID NO: 246195 - protein, 8 aa, Mycobacterium
AGTSVVTT

SEQ ID NO: 246196 - protein, 22 aa, Mycobacterium
AGTTARESGPPAGALGNPRGRF

SEQ ID NO: 246197 - protein, 20 aa, Mycobacterium
AGTTGEKSEQGFAARKNSGL

SEQ ID NO: 246198 - protein, 10 aa, Mycobacterium
AGTTGSGKTT

SEQ ID NO: 246199 - protein, 12 aa, Mycobacterium
AGTTHEETESFR

SEQ ID NO: 246200 - protein, 6 aa, Mycobacterium
AGTTLG

SEQ ID NO: 246201 - protein, 30 aa, Mycobacterium
AGTTNTRSPIRTQATDIGTERTSSTPADDL

SEQ ID NO: 246202 - protein, 8 aa, Mycobacterium
AGTTPTYA

SEQ ID NO: 246203 - protein, 15 aa, Mycobacterium
AGTTTAETVTSHRSE

SEQ ID NO: 246204 - protein, 6 aa, Mycobacterium
AGTVQY

SEQ ID NO: 246205 - protein, 8 aa, Mycobacterium
AGTWDGPS

SEQ ID NO: 246206 - protein, 9 aa, Mycobacterium
AGTYAPQAS

SEQ ID NO: 246207 - protein, 8 aa, Mycobacterium
AGVAAPRP

SEQ ID NO: 246208 - protein, 23 aa, Mycobacterium
AGVADGGDDGPPAEPVTITEASL

SEQ ID NO: 246209 - protein, 7 aa, Mycobacterium
AGVATRY

SEQ ID NO: 246210 - protein, 5 aa, Mycobacterium
AGVDG

SEQ ID NO: 246211 - protein, 4 aa, Mycobacterium
AGVE

SEQ ID NO: 246212 - protein, 5 aa, Mycobacterium
AGVEA

SEQ ID NO: 246213 - protein, 6 aa, Mycobacterium
AGVGEY

SEQ ID NO: 246214 - protein, 8 aa, Mycobacterium
AGVGGGNF

SEQ ID NO: 246215 - protein, 9 aa, Mycobacterium
AGVGGGNFA

SEQ ID NO: 246216 - protein, 6 aa, Mycobacterium
AGVGGT

SEQ ID NO: 246217 - protein, 6 aa, Mycobacterium
AGVGRP

SEQ ID NO: 246218 - protein, 7 aa, Mycobacterium
AGVGSRA

SEQ ID NO: 246219 - protein, 18 aa, Mycobacterium
AGVPADAAAQARDSLPKA

SEQ ID NO: 246220 - protein, 7 aa, Mycobacterium
AGVPALT

SEQ ID NO: 246221 - protein, 17 aa, Mycobacterium
AGVPGSRRQWERDPHDP

SEQ ID NO: 246222 - protein, 5 aa, Mycobacterium
AGVPN

SEQ ID NO: 246223 - protein, 25 aa, Mycobacterium
AGVPQAPAAPPPSAGPPTDPGQPSV

SEQ ID NO: 246224 - protein, 6 aa, Mycobacterium
AGVPQR

SEQ ID NO: 246225 - protein, 8 aa, Mycobacterium
AGVQPGRN

SEQ ID NO: 246226 - protein, 11 aa, Mycobacterium
AGVQSGDGKAA

SEQ ID NO: 246227 - protein, 11 aa, Mycobacterium
AGVQSTDGKAA

SEQ ID NO: 246228 - protein, 5 aa, Mycobacterium
AGVRR

SEQ ID NO: 246229 - protein, 7 aa, Mycobacterium
AGVRSGA

SEQ ID NO: 246230 - protein, 9 aa, Mycobacterium
AGVSTDSDM

SEQ ID NO: 246231 - protein, 4 aa, Mycobacterium
AGVT

SEQ ID NO: 246232 - protein, 6 aa, Mycobacterium
AGVTAG

SEQ ID NO: 246233 - protein, 4 aa, Mycobacterium
AGWE

SEQ ID NO: 246234 - protein, 4 aa, Mycobacterium
AGWP

SEQ ID NO: 246235 - protein, 29 aa, Mycobacterium
AGWQANSGGRGGIQGGRVDPSTGQRLNAA

SEQ ID NO: 246236 - protein, 8 aa, Mycobacterium
AGWTPDDD

SEQ ID NO: 246237 - protein, 4 aa, Mycobacterium
AGYA

SEQ ID NO: 246238 - protein, 5 aa, Mycobacterium
AGYAA

SEQ ID NO: 246239 - protein, 28 aa, Mycobacterium
AGYAAAVPQSQATDSGLNGRPDDPTASL

SEQ ID NO: 246240 - protein, 19 aa, Mycobacterium
AGYAGRAETIAAEAATRHA

SEQ ID NO: 246241 - protein, 4 aa, Mycobacterium
AGYG

SEQ ID NO: 246242 - protein, 5 aa, Mycobacterium
AGYGG

SEQ ID NO: 246243 - protein, 5 aa, Mycobacterium
AGYGP

SEQ ID NO: 246244 - protein, 8 aa, Mycobacterium
AGYGPRAP

SEQ ID NO: 246245 - protein, 12 aa, Mycobacterium
AGYLKSNADNLT

SEQ ID NO: 246246 - protein, 6 aa, Mycobacterium
AGYNDG

SEQ ID NO: 246247 - protein, 10 aa, Mycobacterium
AGYPKENAGG

SEQ ID NO: 246248 - protein, 10 aa, Mycobacterium
AGYPPAAVSD

SEQ ID NO: 246249 - protein, 12 aa, Mycobacterium
AGYQLPTTAGDL

SEQ ID NO: 246250 - protein, 29 aa, Mycobacterium
AGYQPDEDHVGAEAGRADAATDVHAGPGR

SEQ ID NO: 246251 - protein, 31 aa, Mycobacterium
AGYSGRALAGGRPSAAKTGTNQLGDTGENRD

SEQ ID NO: 246252 - protein, 5 aa, Mycobacterium
AGYSR

SEQ ID NO: 246253 - protein, 5 aa, Mycobacterium
AGYSS

SEQ ID NO: 246254 - protein, 11 aa, Mycobacterium
AGYTDADEATA

SEQ ID NO: 246255 - protein, 12 aa, Mycobacterium
AHAAAHAGARVA

SEQ ID NO: 246256 - protein, 6 aa, Mycobacterium
AHAAGG

SEQ ID NO: 246257 - protein, 8 aa, Mycobacterium
AHADEQRT

SEQ ID NO: 246258 - protein, 11 aa, Mycobacterium
AHAERVAGETA

SEQ ID NO: 246259 - protein, 7 aa, Mycobacterium
AHAGADA

SEQ ID NO: 246260 - protein, 9 aa, Mycobacterium
AHAGSSSRW

SEQ ID NO: 246261 - protein, 39 aa, Mycobacterium
AHANGASTLAAQAQSLANDDVRAAQRSYTSHHGGGGADM

SEQ ID NO: 246262 - protein, 18 aa, Mycobacterium
AHAPAAAAAGPSAGARPT

SEQ ID NO: 246263 - protein, 5 aa, Mycobacterium
AHAPR

SEQ ID NO: 246264 - protein, 4 aa, Mycobacterium
AHAQ

SEQ ID NO: 246265 - protein, 6 aa, Mycobacterium
AHASPS

SEQ ID NO: 246266 - protein, 6 aa, Mycobacterium
AHASPV

SEQ ID NO: 246267 - protein, 6 aa, Mycobacterium
AHATAA

SEQ ID NO: 246268 - protein, 8 aa, Mycobacterium
AHATSTTA

SEQ ID NO: 246269 - protein, 6 aa, Mycobacterium
AHATTP

SEQ ID NO: 246270 - protein, 10 aa, Mycobacterium
AHDADRSYPN

SEQ ID NO: 246271 - protein, 7 aa, Mycobacterium
AHDATRV

SEQ ID NO: 246272 - protein, 7 aa, Mycobacterium
AHDEAKN

SEQ ID NO: 246273 - protein, 8 aa, Mycobacterium
AHDEPARV

SEQ ID NO: 246274 - protein, 7 aa, Mycobacterium
AHDETNT

SEQ ID NO: 246275 - protein, 6 aa, Mycobacterium
AHDGGA

SEQ ID NO: 246276 - protein, 8 aa, Mycobacterium
AHDGPAAP

SEQ ID NO: 246277 - protein, 10 aa, Mycobacterium
AHDPGLTQSG

SEQ ID NO: 246278 - protein, 15 aa, Mycobacterium
AHDSAERANDAQHEP

SEQ ID NO: 246279 - protein, 9 aa, Mycobacterium
AHDVTDDSV

SEQ ID NO: 246280 - protein, 7 aa, Mycobacterium
AHEAGGG

SEQ ID NO: 246281 - protein, 11 aa, Mycobacterium
AHEALKGTPMA

SEQ ID NO: 246282 - protein, 8 aa, Mycobacterium
AHEATGGE

SEQ ID NO: 246283 - protein, 11 aa, Mycobacterium
AHEAVKGTPLA

SEQ ID NO: 246284 - protein, 5 aa, Mycobacterium
AHEHT

SEQ ID NO: 246285 - protein, 11 aa, Mycobacterium
AHENAAPNFGT

SEQ ID NO: 246286 - protein, 5 aa, Mycobacterium
AHGDG

SEQ ID NO: 246287 - protein, 7 aa, Mycobacterium
AHGDTRT

SEQ ID NO: 246288 - protein, 8 aa, Mycobacterium
AHGDTSTA

SEQ ID NO: 246289 - protein, 8 aa, Mycobacterium
AHGGAPRV

SEQ ID NO: 246290 - protein, 8 aa, Mycobacterium
AHGGGAGS

SEQ ID NO: 246291 - protein, 11 aa, Mycobacterium
AHGGPAGVGEA

SEQ ID NO: 246292 - protein, 11 aa, Mycobacterium
AHGGPGGKPGC

SEQ ID NO: 246293 - protein, 6 aa, Mycobacterium
AHGGTV

SEQ ID NO: 246294 - protein, 8 aa, Mycobacterium
AHGKAREA

SEQ ID NO: 246295 - protein, 8 aa, Mycobacterium
AHGKTREA

SEQ ID NO: 246296 - protein, 13 aa, Mycobacterium
AHGPDELSSHTPR

SEQ ID NO: 246297 - protein, 17 aa, Mycobacterium
AHGPGVRPHPGAEPVAP

SEQ ID NO: 246298 - protein, 4 aa, Mycobacterium
AHGR

SEQ ID NO: 246299 - protein, 5 aa, Mycobacterium
AHGSG

SEQ ID NO: 246300 - protein, 7 aa, Mycobacterium
AHGSTSV

SEQ ID NO: 246301 - protein, 6 aa, Mycobacterium
AHGVET

SEQ ID NO: 246302 - protein, 7 aa, Mycobacterium
AHGVGEK

SEQ ID NO: 246303 - protein, 4 aa, Mycobacterium
AHHP

SEQ ID NO: 246304 - protein, 9 aa, Mycobacterium
AHKVSQDDA

SEQ ID NO: 246305 - protein, 9 aa, Mycobacterium
AHKVSQEDS

SEQ ID NO: 246306 - protein, 5 aa, Mycobacterium
AHNAG

SEQ ID NO: 246307 - protein, 29 aa, Mycobacterium
AHNGADRPNVHADNTATTSGNRPEDDEDL

SEQ ID NO: 246308 - protein, 11 aa, Mycobacterium
AHNGARDPSNV

SEQ ID NO: 246309 - protein, 11 aa, Mycobacterium
AHNPPSGVDNR

SEQ ID NO: 246310 - protein, 52 aa, Mycobacterium
AHNVENGLAGATPKQSASPEKPASPPVPQPGPTNPGSATTQIPAPEAPTPSV

SEQ ID NO: 246311 - protein, 9 aa, Mycobacterium
AHPAAGPAE

SEQ ID NO: 246312 - protein, 5 aa, Mycobacterium
AHPAQ

SEQ ID NO: 246313 - protein, 6 aa, Mycobacterium
AHPDLD

SEQ ID NO: 246314 - protein, 10 aa, Mycobacterium
AHPESPSPVS

SEQ ID NO: 246315 - protein, 9 aa, Mycobacterium
AHPFENPTG

SEQ ID NO: 246316 - protein, 12 aa, Mycobacterium
AHPGANPRPAAP

SEQ ID NO: 246317 - protein, 22 aa, Mycobacterium
AHPGASTPQPRTYEQKAGHASR

SEQ ID NO: 246318 - protein, 7 aa, Mycobacterium
AHPGSGG

SEQ ID NO: 246319 - protein, 8 aa, Mycobacterium
AHPGSGGA

SEQ ID NO: 246320 - protein, 7 aa, Mycobacterium
AHPHAGT

SEQ ID NO: 246321 - protein, 8 aa, Mycobacterium
AHPNTTAT

SEQ ID NO: 246322 - protein, 9 aa, Mycobacterium
AHPPPGVER

SEQ ID NO: 246323 - protein, 13 aa, Mycobacterium
AHPPQSRGVPALT

SEQ ID NO: 246324 - protein, 8 aa, Mycobacterium
AHPPRPDV

SEQ ID NO: 246325 - protein, 6 aa, Mycobacterium
AHPRHR

SEQ ID NO: 246326 - protein, 12 aa, Mycobacterium
AHPRPAGGPSHH

SEQ ID NO: 246327 - protein, 12 aa, Mycobacterium
AHPRPAGGPSHR

SEQ ID NO: 246328 - protein, 11 aa, Mycobacterium
AHPRPASGPSH

SEQ ID NO: 246329 - protein, 12 aa, Mycobacterium
AHPRPASGPSYR

SEQ ID NO: 246330 - protein, 7 aa, Mycobacterium
AHPRPEE

SEQ ID NO: 246331 - protein, 7 aa, Mycobacterium
AHPRRTW

SEQ ID NO: 246332 - protein, 9 aa, Mycobacterium
AHPRSGPAD

SEQ ID NO: 246333 - protein, 16 aa, Mycobacterium
AHPRTTLGGTAATAPA

SEQ ID NO: 246334 - protein, 7 aa, Mycobacterium
AHPSGDD

SEQ ID NO: 246335 - protein, 7 aa, Mycobacterium
AHPTAAE

SEQ ID NO: 246336 - protein, 6 aa, Mycobacterium
AHPTGD

SEQ ID NO: 246337 - protein, 4 aa, Mycobacterium
AHQA

SEQ ID NO: 246338 - protein, 15 aa, Mycobacterium
AHQAPLGTTLSADRR

SEQ ID NO: 246339 - protein, 9 aa, Mycobacterium
AHQASEQRQ

SEQ ID NO: 246340 - protein, 12 aa, Mycobacterium
AHQASPTTTGDS

SEQ ID NO: 246341 - protein, 28 aa, Mycobacterium
AHQEAPDSAPEHAAQPVAQQAPAHPVPP

SEQ ID NO: 246342 - protein, 9 aa, Mycobacterium
AHQGRSPLE

SEQ ID NO: 246343 - protein, 24 aa, Mycobacterium
AHQPTSPKDEDTGGAKTKSTPRYN

SEQ ID NO: 246344 - protein, 11 aa, Mycobacterium
AHQRGAASGVR

SEQ ID NO: 246345 - protein, 4 aa, Mycobacterium
AHQS

SEQ ID NO: 246346 - protein, 5 aa, Mycobacterium
AHQSA

SEQ ID NO: 246347 - protein, 5 aa, Mycobacterium
AHQSG

SEQ ID NO: 246348 - protein, 10 aa, Mycobacterium
AHRAAAPNRV

SEQ ID NO: 246349 - protein, 5 aa, Mycobacterium
AHRAG

SEQ ID NO: 246350 - protein, 13 aa, Mycobacterium
AHRAGTAAPLPEP

SEQ ID NO: 246351 - protein, 27 aa, Mycobacterium
AHRASSAGGPETNSATTETTDTLEAAR

SEQ ID NO: 246352 - protein, 8 aa, Mycobacterium
AHRGQTGV

SEQ ID NO: 246353 - protein, 4 aa, Mycobacterium
AHRI

SEQ ID NO: 246354 - protein, 13 aa, Mycobacterium
AHRPEPGNLATVL

SEQ ID NO: 246355 - protein, 11 aa, Mycobacterium
AHRSSAGLSQR

SEQ ID NO: 246356 - protein, 6 aa, Mycobacterium
AHRTGT

SEQ ID NO: 246357 - protein, 17 aa, Mycobacterium
AHRYTPTAITRGQAAAR

SEQ ID NO: 246358 - protein, 7 aa, Mycobacterium
AHSDKVT

SEQ ID NO: 246359 - protein, 4 aa, Mycobacterium
AHSL

SEQ ID NO: 246360 - protein, 4 aa, Mycobacterium
AHSP

SEQ ID NO: 246361 - protein, 16 aa, Mycobacterium
AHSPAADDPSPEPAAV

SEQ ID NO: 246362 - protein, 9 aa, Mycobacterium
AHSPRYGRA

SEQ ID NO: 246363 - protein, 11 aa, Mycobacterium
AHTDAPAAGSA

SEQ ID NO: 246364 - protein, 24 aa, Mycobacterium
AHTEPPQPLGTEANPATARGRFGD

SEQ ID NO: 246365 - protein, 4 aa, Mycobacterium
AHTG

SEQ ID NO: 246366 - protein, 6 aa, Mycobacterium
AHTGES

SEQ ID NO: 246367 - protein, 7 aa, Mycobacterium
AHTGLPT

SEQ ID NO: 246368 - protein, 9 aa, Mycobacterium
AHTPDGGSV

SEQ ID NO: 246369 - protein, 10 aa, Mycobacterium
AHTSAGPGAG

SEQ ID NO: 246370 - protein, 6 aa, Mycobacterium
AHTTSH

SEQ ID NO: 246371 - protein, 5 aa, Mycobacterium
AHTWN

SEQ ID NO: 246372 - protein, 4 aa, Mycobacterium
AHWP

SEQ ID NO: 246373 - protein, 8 aa, Mycobacterium
AIAAGAAA

SEQ ID NO: 246374 - protein, 14 aa, Mycobacterium
AIAAPRHSAPPRPR

SEQ ID NO: 246375 - protein, 29 aa, Mycobacterium
AIAAPSNGTATAAPEAPVEEAGAETLTDS

SEQ ID NO: 246376 - protein, 6 aa, Mycobacterium
AIAASN

SEQ ID NO: 246377 - protein, 13 aa, Mycobacterium
AIADGDDPQRRLP

SEQ ID NO: 246378 - protein, 5 aa, Mycobacterium
AIADP

SEQ ID NO: 246379 - protein, 5 aa, Mycobacterium
AIADR

SEQ ID NO: 246380 - protein, 5 aa, Mycobacterium
AIAGA

SEQ ID NO: 246381 - protein, 15 aa, Mycobacterium
AIAGAAHDNPPPDDT

SEQ ID NO: 246382 - protein, 12 aa, Mycobacterium
AIAGARARGDNT

SEQ ID NO: 246383 - protein, 17 aa, Mycobacterium
AIAGSEPVLTSGSDVDL

SEQ ID NO: 246384 - protein, 5 aa, Mycobacterium
AIAPA

SEQ ID NO: 246385 - protein, 15 aa, Mycobacterium
AIAPQPAPAAAELLG

SEQ ID NO: 246386 - protein, 7 aa, Mycobacterium
AIAPSGD

SEQ ID NO: 246387 - protein, 7 aa, Mycobacterium
AIAPSTD

SEQ ID NO: 246388 - protein, 9 aa, Mycobacterium
AIASAGAAL

SEQ ID NO: 246389 - protein, 7 aa, Mycobacterium
AIASGQL

SEQ ID NO: 246390 - protein, 20 aa, Mycobacterium
AIASGQLDRRVPERDPRTEV

SEQ ID NO: 246391 - protein, 14 aa, Mycobacterium
AIASGYTDGMATAP

SEQ ID NO: 246392 - protein, 9 aa, Mycobacterium
AIASPDSYS

SEQ ID NO: 246393 - protein, 7 aa, Mycobacterium
AIASPTG

SEQ ID NO: 246394 - protein, 11 aa, Mycobacterium
AIATAAEEIGA

SEQ ID NO: 246395 - protein, 6 aa, Mycobacterium
AIDDGT

SEQ ID NO: 246396 - protein, 6 aa, Mycobacterium
AIDGAS

SEQ ID NO: 246397 - protein, 17 aa, Mycobacterium
AIDRRPSDALSGPRPDD

SEQ ID NO: 246398 - protein, 6 aa, Mycobacterium
AIDRTG

SEQ ID NO: 246399 - protein, 7 aa, Mycobacterium
AIDSSKP

SEQ ID NO: 246400 - protein, 12 aa, Mycobacterium
AIEEGSSLSGDV

SEQ ID NO: 246401 - protein, 14 aa, Mycobacterium
AIEESARTLGSSPA

SEQ ID NO: 246402 - protein, 12 aa, Mycobacterium
AIEGASEDERAR

SEQ ID NO: 246403 - protein, 7 aa, Mycobacterium
AIEKAGP

SEQ ID NO: 246404 - protein, 9 aa, Mycobacterium
AIENTTPPT

SEQ ID NO: 246405 - protein, 11 aa, Mycobacterium
AIESSSKGGNG

SEQ ID NO: 246406 - protein, 4 aa, Mycobacterium
AIGA

SEQ ID NO: 246407 - protein, 9 aa, Mycobacterium
AIGDDAEPI

SEQ ID NO: 246408 - protein, 5 aa, Mycobacterium
AIGGI

SEQ ID NO: 246409 - protein, 9 aa, Mycobacterium
AIGGPRDGR

SEQ ID NO: 246410 - protein, 9 aa, Mycobacterium
AIGKVPDER

SEQ ID NO: 246411 - protein, 5 aa, Mycobacterium
AIGPA

SEQ ID NO: 246412 - protein, 7 aa, Mycobacterium
AIGPSQE

SEQ ID NO: 246413 - protein, 5 aa, Mycobacterium
AIGTG

SEQ ID NO: 246414 - protein, 5 aa, Mycobacterium
AIKNN

SEQ ID NO: 246415 - protein, 9 aa, Mycobacterium
AIKPDQTLN

SEQ ID NO: 246416 - protein, 12 aa, Mycobacterium
AIKTQTAVPPLP

SEQ ID NO: 246417 - protein, 11 aa, Mycobacterium
AINAQSNPDEV

SEQ ID NO: 246418 - protein, 12 aa, Mycobacterium
AINAQSSPDEVQ

SEQ ID NO: 246419 - protein, 6 aa, Mycobacterium
AINDPY

SEQ ID NO: 246420 - protein, 6 aa, Mycobacterium
AINGAT

SEQ ID NO: 246421 - protein, 7 aa, Mycobacterium
AINGGGA

SEQ ID NO: 246422 - protein, 12 aa, Mycobacterium
AINPSTSATQAP

SEQ ID NO: 246423 - protein, 18 aa, Mycobacterium
AINQDGASNGLTAPNGLA

SEQ ID NO: 246424 - protein, 20 aa, Mycobacterium
AINQDGASNGLTAPNGPAQQ

SEQ ID NO: 246425 - protein, 9 aa, Mycobacterium
AINSPGAGA

SEQ ID NO: 246426 - protein, 7 aa, Mycobacterium
AIPADAT

SEQ ID NO: 246427 - protein, 7 aa, Mycobacterium
AIPADEP

SEQ ID NO: 246428 - protein, 6 aa, Mycobacterium
AIPAPA

SEQ ID NO: 246429 - protein, 15 aa, Mycobacterium
AIPATTAAGEPFPER

SEQ ID NO: 246430 - protein, 9 aa, Mycobacterium
AIPDPEPDH

SEQ ID NO: 246431 - protein, 7 aa, Mycobacterium
AIPDSAT

SEQ ID NO: 246432 - protein, 11 aa, Mycobacterium
AIPDTVSDDQV

SEQ ID NO: 246433 - protein, 16 aa, Mycobacterium
AIPGDAPAIGDHRPLT

SEQ ID NO: 246434 - protein, 8 aa, Mycobacterium
AIPGEGKN

SEQ ID NO: 246435 - protein, 21 aa, Mycobacterium
AIPGGNTQITGQFTADSAKEL

SEQ ID NO: 246436 - protein, 23 aa, Mycobacterium
AIPGPAGMTAPDVGTPPSGARPR

SEQ ID NO: 246437 - protein, 4 aa, Mycobacterium
AIPP

SEQ ID NO: 246438 - protein, 6 aa, Mycobacterium
AIPPDA

SEQ ID NO: 246439 - protein, 14 aa, Mycobacterium
AIPPDETGPDQPME

SEQ ID NO: 246440 - protein, 6 aa, Mycobacterium
AIPPNA

SEQ ID NO: 246441 - protein, 13 aa, Mycobacterium
AIPPPPPIPHGYR

SEQ ID NO: 246442 - protein, 7 aa, Mycobacterium
AIPPQEL

SEQ ID NO: 246443 - protein, 31 aa, Mycobacterium
AIPPTQQPPAILSPGGEARSDQSDVPGSPDQ

SEQ ID NO: 246444 - protein, 9 aa, Mycobacterium
AIPQQSRTS

SEQ ID NO: 246445 - protein, 5 aa, Mycobacterium
AIPRD

SEQ ID NO: 246446 - protein, 13 aa, Mycobacterium
AIPRPSAARPGIP

SEQ ID NO: 246447 - protein, 24 aa, Mycobacterium
AIPRTTSGKLARRACQTEYLAGMY

SEQ ID NO: 246448 - protein, 14 aa, Mycobacterium
AIPRYDSKAPDQSA

SEQ ID NO: 246449 - protein, 4 aa, Mycobacterium
AIPT

SEQ ID NO: 246450 - protein, 6 aa, Mycobacterium
AIPTQA

SEQ ID NO: 246451 - protein, 8 aa, Mycobacterium
AIPTQSRT

SEQ ID NO: 246452 - protein, 7 aa, Mycobacterium
AIQGGRY

SEQ ID NO: 246453 - protein, 6 aa, Mycobacterium
AIQRGD

SEQ ID NO: 246454 - protein, 5 aa, Mycobacterium
AIQTT

SEQ ID NO: 246455 - protein, 10 aa, Mycobacterium
AIRDDARAAL

SEQ ID NO: 246456 - protein, 6 aa, Mycobacterium
AIRDDT

SEQ ID NO: 246457 - protein, 4 aa, Mycobacterium
AIRG

SEQ ID NO: 246458 - protein, 7 aa, Mycobacterium
AIRQAGP

SEQ ID NO: 246459 - protein, 6 aa, Mycobacterium
AISASG

SEQ ID NO: 246460 - protein, 9 aa, Mycobacterium
AISGSDRPV

SEQ ID NO: 246461 - protein, 7 aa, Mycobacterium
AISPAGD

SEQ ID NO: 246462 - protein, 7 aa, Mycobacterium
AISPPEV

SEQ ID NO: 246463 - protein, 8 aa, Mycobacterium
AISSGGPE

SEQ ID NO: 246464 - protein, 6 aa, Mycobacterium
AISTGT

SEQ ID NO: 246465 - protein, 7 aa, Mycobacterium
AISTPGR

SEQ ID NO: 246466 - protein, 10 aa, Mycobacterium
AITASGRAAA

SEQ ID NO: 246467 - protein, 13 aa, Mycobacterium
AITGNPDDPRYPY

SEQ ID NO: 246468 - protein, 8 aa, Mycobacterium
AITHGPRP

SEQ ID NO: 246469 - protein, 11 aa, Mycobacterium
AITPPSRPKDI

SEQ ID NO: 246470 - protein, 14 aa, Mycobacterium
AIYSPQSGEFLGPD

SEQ ID NO: 246471 - protein, 7 aa, Mycobacterium
AKAAHGA

SEQ ID NO: 246472 - protein, 7 aa, Mycobacterium
AKAAPGD

SEQ ID NO: 246473 - protein, 16 aa, Mycobacterium
AKAAQGVRTTGIARFM

SEQ ID NO: 246474 - protein, 6 aa, Mycobacterium
AKAARA

SEQ ID NO: 246475 - protein, 8 aa, Mycobacterium
AKAARRRG

SEQ ID NO: 246476 - protein, 15 aa, Mycobacterium
AKADGGNKVVITAEA

SEQ ID NO: 246477 - protein, 9 aa, Mycobacterium
AKADLPSGA

SEQ ID NO: 246478 - protein, 5 aa, Mycobacterium
AKADS

SEQ ID NO: 246479 - protein, 8 aa, Mycobacterium
AKADSWGR

SEQ ID NO: 246480 - protein, 8 aa, Mycobacterium
AKADYEEA

SEQ ID NO: 246481 - protein, 8 aa, Mycobacterium
AKAEESSV

SEQ ID NO: 246482 - protein, 14 aa, Mycobacterium
AKAEQDAAALRGTP

SEQ ID NO: 246483 - protein, 7 aa, Mycobacterium
AKAERGR

SEQ ID NO: 246484 - protein, 7 aa, Mycobacterium
AKAGLDG

SEQ ID NO: 246485 - protein, 14 aa, Mycobacterium
AKAGLSSAPATQRR

SEQ ID NO: 246486 - protein, 6 aa, Mycobacterium
AKAKLE

SEQ ID NO: 246487 - protein, 12 aa, Mycobacterium
AKALADRPRPPT

SEQ ID NO: 246488 - protein, 7 aa, Mycobacterium
AKALKKA

SEQ ID NO: 246489 - protein, 6 aa, Mycobacterium
AKALRG

SEQ ID NO: 246490 - protein, 10 aa, Mycobacterium
AKALSGELSR

SEQ ID NO: 246491 - protein, 6 aa, Mycobacterium
AKAPCT

SEQ ID NO: 246492 - protein, 7 aa, Mycobacterium
AKAPGDT

SEQ ID NO: 246493 - protein, 9 aa, Mycobacterium
AKAPTNEHA

SEQ ID NO: 246494 - protein, 7 aa, Mycobacterium
AKAPVRE

SEQ ID NO: 246495 - protein, 10 aa, Mycobacterium
AKAQDSAANA

SEQ ID NO: 246496 - protein, 8 aa, Mycobacterium
AKAQSTAG

SEQ ID NO: 246497 - protein, 7 aa, Mycobacterium
AKAQVRS

SEQ ID NO: 246498 - protein, 9 aa, Mycobacterium
AKAQVRSGE

SEQ ID NO: 246499 - protein, 16 aa, Mycobacterium
AKASLAAAHADSNAPL

SEQ ID NO: 246500 - protein, 14 aa, Mycobacterium
AKATLRSVDTAPES

SEQ ID NO: 246501 - protein, 8 aa, Mycobacterium
AKATRKLD

SEQ ID NO: 246502 - protein, 7 aa, Mycobacterium
AKATTAS

SEQ ID NO: 246503 - protein, 10 aa, Mycobacterium
AKAVSGQQTG

SEQ ID NO: 246504 - protein, 12 aa, Mycobacterium
AKAVSKASPELG

SEQ ID NO: 246505 - protein, 8 aa, Mycobacterium
AKCRDSAS

SEQ ID NO: 246506 - protein, 10 aa, Mycobacterium
AKDAAGDKWS

SEQ ID NO: 246507 - protein, 8 aa, Mycobacterium
AKDAKDRF

SEQ ID NO: 246508 - protein, 11 aa, Mycobacterium
AKDASGAKNAS

SEQ ID NO: 246509 - protein, 10 aa, Mycobacterium
AKDASGAKNV

SEQ ID NO: 246510 - protein, 9 aa, Mycobacterium
AKDATGAKW

SEQ ID NO: 246511 - protein, 7 aa, Mycobacterium
AKDDPDN

SEQ ID NO: 246512 - protein, 5 aa, Mycobacterium
AKDDV

SEQ ID NO: 246513 - protein, 8 aa, Mycobacterium
AKDEDAVR

SEQ ID NO: 246514 - protein, 7 aa, Mycobacterium
AKDEGVP

SEQ ID NO: 246515 - protein, 6 aa, Mycobacterium
AKDFDG

SEQ ID NO: 246516 - protein, 10 aa, Mycobacterium
AKDGKQFSGA

SEQ ID NO: 246517 - protein, 9 aa, Mycobacterium
AKDGVTAGQ

SEQ ID NO: 246518 - protein, 7 aa, Mycobacterium
AKDLSGK

SEQ ID NO: 246519 - protein, 8 aa, Mycobacterium
AKDNGNLD

SEQ ID NO: 246520 - protein, 10 aa, Mycobacterium
AKDPAARFQT

SEQ ID NO: 246521 - protein, 14 aa, Mycobacterium
AKDPAARYATAGEL

SEQ ID NO: 246522 - protein, 10 aa, Mycobacterium
AKDPAERYPT

SEQ ID NO: 246523 - protein, 12 aa, Mycobacterium
AKDPDQRYPTAR

SEQ ID NO: 246524 - protein, 9 aa, Mycobacterium
AKDPETREK

SEQ ID NO: 246525 - protein, 13 aa, Mycobacterium
AKDPGDRYQTAGE

SEQ ID NO: 246526 - protein, 10 aa, Mycobacterium
AKDPHARHRP

SEQ ID NO: 246527 - protein, 10 aa, Mycobacterium
AKDPNQRYPT

SEQ ID NO: 246528 - protein, 8 aa, Mycobacterium
AKDPRDRY

SEQ ID NO: 246529 - protein, 8 aa, Mycobacterium
AKDPSHRF

SEQ ID NO: 246530 - protein, 9 aa, Mycobacterium
AKDPTTPGA

SEQ ID NO: 246531 - protein, 5 aa, Mycobacterium
AKDPV

SEQ ID NO: 246532 - protein, 8 aa, Mycobacterium
AKDPVEGT

SEQ ID NO: 246533 - protein, 8 aa, Mycobacterium
AKDTAAGP

SEQ ID NO: 246534 - protein, 8 aa, Mycobacterium
AKEAGAQR

SEQ ID NO: 246535 - protein, 12 aa, Mycobacterium
AKEAIKGTPLDE

SEQ ID NO: 246536 - protein, 6 aa, Mycobacterium
AKEDVQ

SEQ ID NO: 246537 - protein, 5 aa, Mycobacterium
AKEFG

SEQ ID NO: 246538 - protein, 7 aa, Mycobacterium
AKEFGRS

SEQ ID NO: 246539 - protein, 7 aa, Mycobacterium
AKEHPMK

SEQ ID NO: 246540 - protein, 19 aa, Mycobacterium
AKELGGDAGAAAAELARTG

SEQ ID NO: 246541 - protein, 6 aa, Mycobacterium
AKELPG

SEQ ID NO: 246542 - protein, 8 aa, Mycobacterium
AKEPAKRF

SEQ ID NO: 246543 - protein, 11 aa, Mycobacterium
AKEPDDRYQSA

SEQ ID NO: 246544 - protein, 23 aa, Mycobacterium
AKEPGEPDASSPFGPSPVPDTGF

SEQ ID NO: 246545 - protein, 11 aa, Mycobacterium
AKEQARALPDG

SEQ ID NO: 246546 - protein, 7 aa, Mycobacterium
AKEQLRA

SEQ ID NO: 246547 - protein, 8 aa, Mycobacterium
AKEQLRSL

SEQ ID NO: 246548 - protein, 7 aa, Mycobacterium
AKEQLSA

SEQ ID NO: 246549 - protein, 8 aa, Mycobacterium
AKEQLSTA

SEQ ID NO: 246550 - protein, 22 aa, Mycobacterium
AKEQLSTATTAAVAGGSLSRTE

SEQ ID NO: 246551 - protein, 4 aa, Mycobacterium
AKES

SEQ ID NO: 246552 - protein, 10 aa, Mycobacterium
AKETDEQTLR

SEQ ID NO: 246553 - protein, 6 aa, Mycobacterium
AKETLE

SEQ ID NO: 246554 - protein, 6 aa, Mycobacterium
AKEVGG

SEQ ID NO: 246555 - protein, 24 aa, Mycobacterium
AKFDPDSIKPDGKTCRTNPWPYPI

SEQ ID NO: 246556 - protein, 15 aa, Mycobacterium
AKFSPKTSGGDPTLA

SEQ ID NO: 246557 - protein, 19 aa, Mycobacterium
AKFTSSSQGREYDLTGQAG

SEQ ID NO: 246558 - protein, 7 aa, Mycobacterium
AKGAEAT

SEQ ID NO: 246559 - protein, 4 aa, Mycobacterium
AKGF

SEQ ID NO: 246560 - protein, 12 aa, Mycobacterium
AKGFSSSPAVGV

SEQ ID NO: 246561 - protein, 10 aa, Mycobacterium
AKGGDAQSCG

SEQ ID NO: 246562 - protein, 11 aa, Mycobacterium
AKGGNGKSCGI

SEQ ID NO: 246563 - protein, 13 aa, Mycobacterium
AKGGPGGKPGCGS

SEQ ID NO: 246564 - protein, 14 aa, Mycobacterium
AKGGPGGKPGCGSL

SEQ ID NO: 246565 - protein, 22 aa, Mycobacterium
AKGGPGGKPSCGSLPDPSKNYP

SEQ ID NO: 246566 - protein, 7 aa, Mycobacterium
AKGGSTL

SEQ ID NO: 246567 - protein, 6 aa, Mycobacterium
AKGISE

SEQ ID NO: 246568 - protein, 16 aa, Mycobacterium
AKGKEARGTGNAAATV

SEQ ID NO: 246569 - protein, 16 aa, Mycobacterium
AKGKESRGTGNAAATV

SEQ ID NO: 246570 - protein, 16 aa, Mycobacterium
AKGKETRGTGNAAATV

SEQ ID NO: 246571 - protein, 17 aa, Mycobacterium
AKGKETRGTGNAAATVT

SEQ ID NO: 246572 - protein, 7 aa, Mycobacterium
AKGKGGV

SEQ ID NO: 246573 - protein, 7 aa, Mycobacterium
AKGKHDI

SEQ ID NO: 246574 - protein, 5 aa, Mycobacterium
AKGLG

SEQ ID NO: 246575 - protein, 30 aa, Mycobacterium
AKGPEVTDRPSDSAASSDAVSGTDLPRPVA

SEQ ID NO: 246576 - protein, 8 aa, Mycobacterium
AKGPGDAL

SEQ ID NO: 246577 - protein, 11 aa, Mycobacterium
AKGPGVNPFGD

SEQ ID NO: 246578 - protein, 5 aa, Mycobacterium
AKGPS

SEQ ID NO: 246579 - protein, 24 aa, Mycobacterium
AKGPSVTDRPSDSTASSSSASDID

SEQ ID NO: 246580 - protein, 4 aa, Mycobacterium
AKGQ

SEQ ID NO: 246581 - protein, 6 aa, Mycobacterium
AKGQCK

SEQ ID NO: 246582 - protein, 8 aa, Mycobacterium
AKGQSRNV

SEQ ID NO: 246583 - protein, 6 aa, Mycobacterium
AKGSLR

SEQ ID NO: 246584 - protein, 10 aa, Mycobacterium
AKGTRPPHGT

SEQ ID NO: 246585 - protein, 4 aa, Mycobacterium
AKHE

SEQ ID NO: 246586 - protein, 7 aa, Mycobacterium
AKHGPTA

SEQ ID NO: 246587 - protein, 14 aa, Mycobacterium
AKHPREAAGGRRPA

SEQ ID NO: 246588 - protein, 8 aa, Mycobacterium
AKHSGQSD

SEQ ID NO: 246589 - protein, 6 aa, Mycobacterium
AKIPTK

SEQ ID NO: 246590 - protein, 9 aa, Mycobacterium
AKKAPLRQT

SEQ ID NO: 246591 - protein, 10 aa, Mycobacterium
AKKGGTPQSC

SEQ ID NO: 246592 - protein, 13 aa, Mycobacterium
AKKLDTDTWEDGV

SEQ ID NO: 246593 - protein, 10 aa, Mycobacterium
AKKLPAASIS

SEQ ID NO: 246594 - protein, 15 aa, Mycobacterium
AKKPADRYASAGDLA

SEQ ID NO: 246595 - protein, 7 aa, Mycobacterium
AKKPAER

SEQ ID NO: 246596 - protein, 45 aa, Mycobacterium
AKKPAKRYQSAGELAEAAKRALSAPVRRGSSRHAARPAAKRPRKG

SEQ ID NO: 246597 - protein, 17 aa, Mycobacterium
AKKPEERYASAGDLARA

SEQ ID NO: 246598 - protein, 13 aa, Mycobacterium
AKKPQDRYASAGD

SEQ ID NO: 246599 - protein, 11 aa, Mycobacterium
AKKRHRTELEA

SEQ ID NO: 246600 - protein, 5 aa, Mycobacterium
AKLAD

SEQ ID NO: 246601 - protein, 6 aa, Mycobacterium
AKLADT

SEQ ID NO: 246602 - protein, 29 aa, Mycobacterium
AKLDESSNKTLERSTGDFKQKYSESSTTL

SEQ ID NO: 246603 - protein, 6 aa, Mycobacterium
AKLDTL

SEQ ID NO: 246604 - protein, 7 aa, Mycobacterium
AKLGDEA

SEQ ID NO: 246605 - protein, 6 aa, Mycobacterium
AKLNET

SEQ ID NO: 246606 - protein, 6 aa, Mycobacterium
AKLNRP

SEQ ID NO: 246607 - protein, 7 aa, Mycobacterium
AKLNSTL

SEQ ID NO: 246608 - protein, 6 aa, Mycobacterium
AKLSDT

SEQ ID NO: 246609 - protein, 7 aa, Mycobacterium
AKLTNTA

SEQ ID NO: 246610 - protein, 11 aa, Mycobacterium
AKMDGASPAQA

SEQ ID NO: 246611 - protein, 10 aa, Mycobacterium
AKMDGATPAQ

SEQ ID NO: 246612 - protein, 11 aa, Mycobacterium
AKMDGATPGQA

SEQ ID NO: 246613 - protein, 8 aa, Mycobacterium
AKNAKVST

SEQ ID NO: 246614 - protein, 33 aa, Mycobacterium
AKNAPRPADDDTAGPPPGADLGRQTDPTPRGRY

SEQ ID NO: 246615 - protein, 22 aa, Mycobacterium
AKNAPRPADDDTASPPSGADLG

SEQ ID NO: 246616 - protein, 33 aa, Mycobacterium
AKNAPRPAGDDTAGPPPGADLGRQTDPTPRGRY

SEQ ID NO: 246617 - protein, 19 aa, Mycobacterium
AKNAPRPGGDDTAGPPMGA

SEQ ID NO: 246618 - protein, 32 aa, Mycobacterium
AKNAPRPGGDDTAGPPPGADLGRRTDPTPRGR

SEQ ID NO: 246619 - protein, 9 aa, Mycobacterium
AKNDNSASY

SEQ ID NO: 246620 - protein, 8 aa, Mycobacterium
AKNEPGNV

SEQ ID NO: 246621 - protein, 28 aa, Mycobacterium
AKNGIKPGARGAGDGEPAQEVKIIDLQL

SEQ ID NO: 246622 - protein, 8 aa, Mycobacterium
AKNPADRF

SEQ ID NO: 246623 - protein, 9 aa, Mycobacterium
AKNPADRYE

SEQ ID NO: 246624 - protein, 8 aa, Mycobacterium
AKNPDDRF

SEQ ID NO: 246625 - protein, 11 aa, Mycobacterium
AKNPDNRYQTA

SEQ ID NO: 246626 - protein, 14 aa, Mycobacterium
AKNPDNRYQTAAEM

SEQ ID NO: 246627 - protein, 11 aa, Mycobacterium
AKNPENRYQTA

SEQ ID NO: 246628 - protein, 13 aa, Mycobacterium
AKNPENRYQTAAE

SEQ ID NO: 246629 - protein, 10 aa, Mycobacterium
AKNPRDRYET

SEQ ID NO: 246630 - protein, 42 aa, Mycobacterium
AKNPTERYATAGELARAAAAAASAAPVAEPVPPVTPPSTRQF

SEQ ID NO: 246631 - protein, 12 aa, Mycobacterium
AKPAAAESRDAD

SEQ ID NO: 246632 - protein, 9 aa, Mycobacterium
AKPAKSRLL

SEQ ID NO: 246633 - protein, 7 aa, Mycobacterium
AKPATSC

SEQ ID NO: 246634 - protein, 7 aa, Mycobacterium
AKPDIAP

SEQ ID NO: 246635 - protein, 7 aa, Mycobacterium
AKPDKMR

SEQ ID NO: 246636 - protein, 11 aa, Mycobacterium
AKPDSSAPKVE

SEQ ID NO: 246637 - protein, 20 aa, Mycobacterium
AKPDVPRYTAPGFDANKTEM

SEQ ID NO: 246638 - protein, 8 aa, Mycobacterium
AKPDYPNS

SEQ ID NO: 246639 - protein, 8 aa, Mycobacterium
AKPDYPTS

SEQ ID NO: 246640 - protein, 19 aa, Mycobacterium
AKPEPGAIDRSGGYTASAG

SEQ ID NO: 246641 - protein, 11 aa, Mycobacterium
AKPEQPETRND

SEQ ID NO: 246642 - protein, 6 aa, Mycobacterium
AKPFPV

SEQ ID NO: 246643 - protein, 6 aa, Mycobacterium
AKPGAG

SEQ ID NO: 246644 - protein, 23 aa, Mycobacterium
AKPGDTASALLPPDAKTAAATSR

SEQ ID NO: 246645 - protein, 6 aa, Mycobacterium
AKPGNW

SEQ ID NO: 246646 - protein, 7 aa, Mycobacterium
AKPIDQA

SEQ ID NO: 246647 - protein, 15 aa, Mycobacterium
AKPKNNKDAGPQLDS

SEQ ID NO: 246648 - protein, 15 aa, Mycobacterium
AKPKNNKDTGPQLDS

SEQ ID NO: 246649 - protein, 13 aa, Mycobacterium
AKPLPTRGRSQSR

SEQ ID NO: 246650 - protein, 12 aa, Mycobacterium
AKPLSRDGAQQP

SEQ ID NO: 246651 - protein, 9 aa, Mycobacterium
AKPPGTTVY

SEQ ID NO: 246652 - protein, 25 aa, Mycobacterium
AKPPPPVSDADKPADLGAPARSSTW

SEQ ID NO: 246653 - protein, 6 aa, Mycobacterium
AKPRLL

SEQ ID NO: 246654 - protein, 8 aa, Mycobacterium
AKPRSSDF

SEQ ID NO: 246655 - protein, 13 aa, Mycobacterium
AKPSDADDKGPQL

SEQ ID NO: 246656 - protein, 20 aa, Mycobacterium
AKPSGGRKRGEAARSGPPPP

SEQ ID NO: 246657 - protein, 7 aa, Mycobacterium
AKPTGEL

SEQ ID NO: 246658 - protein, 8 aa, Mycobacterium
AKPTPISQ

SEQ ID NO: 246659 - protein, 14 aa, Mycobacterium
AKPTVRRQSGTRAV

SEQ ID NO: 246660 - protein, 12 aa, Mycobacterium
AKPVAGDVPSDA

SEQ ID NO: 246661 - protein, 6 aa, Mycobacterium
AKPVGD

SEQ ID NO: 246662 - protein, 8 aa, Mycobacterium
AKPVGGDA

SEQ ID NO: 246663 - protein, 9 aa, Mycobacterium
AKPVGGDAL

SEQ ID NO: 246664 - protein, 5 aa, Mycobacterium
AKPVR

SEQ ID NO: 246665 - protein, 6 aa, Mycobacterium
AKPVRP

SEQ ID NO: 246666 - protein, 4 aa, Mycobacterium
AKPY

SEQ ID NO: 246667 - protein, 6 aa, Mycobacterium
AKPYPG

SEQ ID NO: 246668 - protein, 6 aa, Mycobacterium
AKQAVT

SEQ ID NO: 246669 - protein, 14 aa, Mycobacterium
AKQGDAIDSRYHPS

SEQ ID NO: 246670 - protein, 9 aa, Mycobacterium
AKQKALKTT

SEQ ID NO: 246671 - protein, 12 aa, Mycobacterium
AKQPDDRYPSAG

SEQ ID NO: 246672 - protein, 13 aa, Mycobacterium
AKQPGDRYASAGD

SEQ ID NO: 246673 - protein, 7 aa, Mycobacterium
AKQPNER

SEQ ID NO: 246674 - protein, 15 aa, Mycobacterium
AKQRLSASTATTLPA

SEQ ID NO: 246675 - protein, 4 aa, Mycobacterium
AKQT

SEQ ID NO: 246676 - protein, 6 aa, Mycobacterium
AKQTTA

SEQ ID NO: 246677 - protein, 4 aa, Mycobacterium
AKQY

SEQ ID NO: 246678 - protein, 6 aa, Mycobacterium
AKRASV

SEQ ID NO: 246679 - protein, 17 aa, Mycobacterium
AKRDAYGRFPRDASPDD

SEQ ID NO: 246680 - protein, 7 aa, Mycobacterium
AKREKEK

SEQ ID NO: 246681 - protein, 4 aa, Mycobacterium
AKRF

SEQ ID NO: 246682 - protein, 4 aa, Mycobacterium
AKRG

SEQ ID NO: 246683 - protein, 7 aa, Mycobacterium
AKRGGID

SEQ ID NO: 246684 - protein, 5 aa, Mycobacterium
AKRGR

SEQ ID NO: 246685 - protein, 10 aa, Mycobacterium
AKRIGASRGA

SEQ ID NO: 246686 - protein, 10 aa, Mycobacterium
AKRKAEAGFD

SEQ ID NO: 246687 - protein, 6 aa, Mycobacterium
AKRLRP

SEQ ID NO: 246688 - protein, 10 aa, Mycobacterium
AKRPAFETYG

SEQ ID NO: 246689 - protein, 5 aa, Mycobacterium
AKRPD

SEQ ID NO: 246690 - protein, 13 aa, Mycobacterium
AKRPEDRFASAGE

SEQ ID NO: 246691 - protein, 31 aa, Mycobacterium
AKRPEDRFASAGELADAATDALTRAEQDQAA

SEQ ID NO: 246692 - protein, 15 aa, Mycobacterium
AKRPEDRYASAGDFA

SEQ ID NO: 246693 - protein, 13 aa, Mycobacterium
AKRPEERYRTAGE

SEQ ID NO: 246694 - protein, 22 aa, Mycobacterium
AKRPGRRANGSTDPADTREYSE

SEQ ID NO: 246695 - protein, 6 aa, Mycobacterium
AKRPNV

SEQ ID NO: 246696 - protein, 4 aa, Mycobacterium
AKRS

SEQ ID NO: 246697 - protein, 19 aa, Mycobacterium
AKRSGGNQALIRRVSPLFQ

SEQ ID NO: 246698 - protein, 7 aa, Mycobacterium
AKRTKHA

SEQ ID NO: 246699 - protein, 9 aa, Mycobacterium
AKSAAHPAN

SEQ ID NO: 246700 - protein, 5 aa, Mycobacterium
AKSAE

SEQ ID NO: 246701 - protein, 10 aa, Mycobacterium
AKSAEGRGLR

SEQ ID NO: 246702 - protein, 6 aa, Mycobacterium
AKSANL

SEQ ID NO: 246703 - protein, 10 aa, Mycobacterium
AKSDKRPEDF

SEQ ID NO: 246704 - protein, 9 aa, Mycobacterium
AKSGRQTTY

SEQ ID NO: 246705 - protein, 7 aa, Mycobacterium
AKSGYEI

SEQ ID NO: 246706 - protein, 9 aa, Mycobacterium
AKSHASPAG

SEQ ID NO: 246707 - protein, 9 aa, Mycobacterium
AKSKAGGAL

SEQ ID NO: 246708 - protein, 10 aa, Mycobacterium
AKSKRRASAA

SEQ ID NO: 246709 - protein, 13 aa, Mycobacterium
AKSKTEGSQGSGV

SEQ ID NO: 246710 - protein, 7 aa, Mycobacterium
AKSMGSN

SEQ ID NO: 246711 - protein, 17 aa, Mycobacterium
AKSNLEAARGHAQAAKE

SEQ ID NO: 246712 - protein, 8 aa, Mycobacterium
AKSPADRY

SEQ ID NO: 246713 - protein, 10 aa, Mycobacterium
AKSPDTPQTL

SEQ ID NO: 246714 - protein, 8 aa, Mycobacterium
AKSPEAAR

SEQ ID NO: 246715 - protein, 8 aa, Mycobacterium
AKSPGKHT

SEQ ID NO: 246716 - protein, 10 aa, Mycobacterium
AKSPGKLGQV

SEQ ID NO: 246717 - protein, 8 aa, Mycobacterium
AKSPGRET

SEQ ID NO: 246718 - protein, 8 aa, Mycobacterium
AKSPGTHT

SEQ ID NO: 246719 - protein, 8 aa, Mycobacterium
AKSQNAFG

SEQ ID NO: 246720 - protein, 8 aa, Mycobacterium
AKSQNTLG

SEQ ID NO: 246721 - protein, 4 aa, Mycobacterium
AKSR

SEQ ID NO: 246722 - protein, 8 aa, Mycobacterium
AKSSGDDV

SEQ ID NO: 246723 - protein, 11 aa, Mycobacterium
AKSSGRSGAEA

SEQ ID NO: 246724 - protein, 6 aa, Mycobacterium
AKSSTL

SEQ ID NO: 246725 - protein, 7 aa, Mycobacterium
AKSVATE

SEQ ID NO: 246726 - protein, 7 aa, Mycobacterium
AKSYATQ

SEQ ID NO: 246727 - protein, 9 aa, Mycobacterium
AKTAAAVSA

SEQ ID NO: 246728 - protein, 5 aa, Mycobacterium
AKTAD

SEQ ID NO: 246729 - protein, 134 aa, Mycobacterium
AKTASPAANPFGNQYQPQQSYYTPAQQQPQQQLPKQGQGQSYGQAQGYGQQQGYGQQQPAQGYGQSGAQAAPGYGQQQSAPAAPPSYGGYGQQQPQSAPPTPPQGFSSSGFTPPSSQPAQQAASSQPTQQYPTF

SEQ ID NO: 246730 - protein, 8 aa, Mycobacterium
AKTDGDGS

SEQ ID NO: 246731 - protein, 44 aa, Mycobacterium
AKTDVKARAHDKATETKERVAEKAHTAQAATRDALTDDRGAVKP

SEQ ID NO: 246732 - protein, 6 aa, Mycobacterium
AKTKQM

SEQ ID NO: 246733 - protein, 7 aa, Mycobacterium
AKTLKRA

SEQ ID NO: 246734 - protein, 9 aa, Mycobacterium
AKTLKRANA

SEQ ID NO: 246735 - protein, 13 aa, Mycobacterium
AKTPADRYQSAGE

SEQ ID NO: 246736 - protein, 13 aa, Mycobacterium
AKTPAVNYPAEPT

SEQ ID NO: 246737 - protein, 8 aa, Mycobacterium
AKTPGRHT

SEQ ID NO: 246738 - protein, 9 aa, Mycobacterium
AKTSDDDMA

SEQ ID NO: 246739 - protein, 6 aa, Mycobacterium
AKTSEQ

SEQ ID NO: 246740 - protein, 6 aa, Mycobacterium
AKTSER

SEQ ID NO: 246741 - protein, 38 aa, Mycobacterium
AKTSQGNQPGVAKPERPVDDSEGSGAGGGAEGAGGGVA

SEQ ID NO: 246742 - protein, 13 aa, Mycobacterium
AKTTAAATAPNSS

SEQ ID NO: 246743 - protein, 6 aa, Mycobacterium
AKTTGR

SEQ ID NO: 246744 - protein, 6 aa, Mycobacterium
AKVAAT

SEQ ID NO: 246745 - protein, 8 aa, Mycobacterium
AKVGDGRT

SEQ ID NO: 246746 - protein, 25 aa, Mycobacterium
AKVPNQERSARARRTRQPAPQNGLR

SEQ ID NO: 246747 - protein, 7 aa, Mycobacterium
AKVPQRA

SEQ ID NO: 246748 - protein, 21 aa, Mycobacterium
AKVQESIDRGEWEQAKNQLTD

SEQ ID NO: 246749 - protein, 33 aa, Mycobacterium
AKVSGDLNGVADRARTLTEDTGPVLDSQAQTTD

SEQ ID NO: 246750 - protein, 13 aa, Mycobacterium
AKVSTMSKSTAQN

SEQ ID NO: 246751 - protein, 7 aa, Mycobacterium
AKWGESP

SEQ ID NO: 246752 - protein, 9 aa, Mycobacterium
AKWSPPGGG

SEQ ID NO: 246753 - protein, 9 aa, Mycobacterium
AKWSPPGGH

SEQ ID NO: 246754 - protein, 9 aa, Mycobacterium
AKWSPPGGR

SEQ ID NO: 246755 - protein, 10 aa, Mycobacterium
AKWSPPGGRV

SEQ ID NO: 246756 - protein, 10 aa, Mycobacterium
AKWSPSGTAV

SEQ ID NO: 246757 - protein, 11 aa, Mycobacterium
AKYGPASYASR

SEQ ID NO: 246758 - protein, 6 aa, Mycobacterium
AKYGPT

SEQ ID NO: 246759 - protein, 7 aa, Mycobacterium
AKYPQGP

SEQ ID NO: 246760 - protein, 9 aa, Mycobacterium
AKYSKSTTD

SEQ ID NO: 246761 - protein, 12 aa, Mycobacterium
ALAAEQEEAGHS

SEQ ID NO: 246762 - protein, 12 aa, Mycobacterium
ALAASSADLTRR

SEQ ID NO: 246763 - protein, 12 aa, Mycobacterium
ALAATTPTQPSP

SEQ ID NO: 246764 - protein, 5 aa, Mycobacterium
ALADA

SEQ ID NO: 246765 - protein, 7 aa, Mycobacterium
ALADAAN

SEQ ID NO: 246766 - protein, 33 aa, Mycobacterium
ALADEAKTAADQVKKISETVAKSRDKEADAAGK

SEQ ID NO: 246767 - protein, 9 aa, Mycobacterium
ALADPSYQQ

SEQ ID NO: 246768 - protein, 11 aa, Mycobacterium
ALADRDPAGAC

SEQ ID NO: 246769 - protein, 9 aa, Mycobacterium
ALAGEPGLA

SEQ ID NO: 246770 - protein, 6 aa, Mycobacterium
ALAGGG

SEQ ID NO: 246771 - protein, 7 aa, Mycobacterium
ALAGGSP

SEQ ID NO: 246772 - protein, 6 aa, Mycobacterium
ALAGIG

SEQ ID NO: 246773 - protein, 7 aa, Mycobacterium
ALAGPAL

SEQ ID NO: 246774 - protein, 11 aa, Mycobacterium
ALAGPGAAASV

SEQ ID NO: 246775 - protein, 8 aa, Mycobacterium
ALAGSSRW

SEQ ID NO: 246776 - protein, 9 aa, Mycobacterium
ALAPGDAPT

SEQ ID NO: 246777 - protein, 8 aa, Mycobacterium
ALAPGGRP

SEQ ID NO: 246778 - protein, 53 aa, Mycobacterium
ALAPKTETATTPKTETATSPHTSTAPGATAETPTAGTTHPEHESSAEEPKVPG

SEQ ID NO: 246779 - protein, 7 aa, Mycobacterium
ALAPNGV

SEQ ID NO: 246780 - protein, 8 aa, Mycobacterium
ALAPPSGS

SEQ ID NO: 246781 - protein, 8 aa, Mycobacterium
ALAPRANA

SEQ ID NO: 246782 - protein, 6 aa, Mycobacterium
ALAPRG

SEQ ID NO: 246783 - protein, 9 aa, Mycobacterium
ALAPSGSDL

SEQ ID NO: 246784 - protein, 6 aa, Mycobacterium
ALAPTT

SEQ ID NO: 246785 - protein, 9 aa, Mycobacterium
ALAQANDQL

SEQ ID NO: 246786 - protein, 4 aa, Mycobacterium
ALAS

SEQ ID NO: 246787 - protein, 7 aa, Mycobacterium
ALASANA

SEQ ID NO: 246788 - protein, 8 aa, Mycobacterium
ALASANAP

SEQ ID NO: 246789 - protein, 12 aa, Mycobacterium
ALASAQEPDFEA

SEQ ID NO: 246790 - protein, 6 aa, Mycobacterium
ALASAS

SEQ ID NO: 246791 - protein, 12 aa, Mycobacterium
ALASASAPAFEA

SEQ ID NO: 246792 - protein, 13 aa, Mycobacterium
ALASATAPALEAS

SEQ ID NO: 246793 - protein, 6 aa, Mycobacterium
ALASGT

SEQ ID NO: 246794 - protein, 20 aa, Mycobacterium
ALASSGERDGQSVGDATPIE

SEQ ID NO: 246795 - protein, 12 aa, Mycobacterium
ALASTPDNRFES

SEQ ID NO: 246796 - protein, 4 aa, Mycobacterium
ALAT

SEQ ID NO: 246797 - protein, 15 aa, Mycobacterium
ALATAGARRRAEREK

SEQ ID NO: 246798 - protein, 12 aa, Mycobacterium
ALATPDQDRATD

SEQ ID NO: 246799 - protein, 31 aa, Mycobacterium
ALDAEKDGGQADEADDPWRDPGAAAALGTPA

SEQ ID NO: 246800 - protein, 12 aa, Mycobacterium
ALDAGQTLIAPV

SEQ ID NO: 246801 - protein, 16 aa, Mycobacterium
ALDASYGDRPSATSTA

SEQ ID NO: 246802 - protein, 11 aa, Mycobacterium
ALDDDGEGEGH

SEQ ID NO: 246803 - protein, 10 aa, Mycobacterium
ALDGQPNPVA

SEQ ID NO: 246804 - protein, 8 aa, Mycobacterium
ALDGSTVR

SEQ ID NO: 246805 - protein, 18 aa, Mycobacterium
ALDPGSGGLRRKSRRKGR

SEQ ID NO: 246806 - protein, 18 aa, Mycobacterium
ALDPNSGDIVDPNGQYGD

SEQ ID NO: 246807 - protein, 7 aa, Mycobacterium
ALDRPGT

SEQ ID NO: 246808 - protein, 7 aa, Mycobacterium
ALDSPEI

SEQ ID NO: 246809 - protein, 12 aa, Mycobacterium
ALDSPPSGPLQR

SEQ ID NO: 246810 - protein, 54 aa, Mycobacterium
ALDSRDRRRRDGDRRREGDQRRGSGPPPPPPGPPRHGGGGPTGGDGPSGPPRSL

SEQ ID NO: 246811 - protein, 10 aa, Mycobacterium
ALDSTTPGIV

SEQ ID NO: 246812 - protein, 7 aa, Mycobacterium
ALDTETT

SEQ ID NO: 246813 - protein, 47 aa, Mycobacterium
ALEAEKDGAEPDELDDPWRDPSAAAALGTPAVAPSGPRGPQGYGGKL

SEQ ID NO: 246814 - protein, 7 aa, Mycobacterium
ALEAQRA

SEQ ID NO: 246815 - protein, 5 aa, Mycobacterium
ALEES

SEQ ID NO: 246816 - protein, 12 aa, Mycobacterium
ALEGGEAPNEPG

SEQ ID NO: 246817 - protein, 9 aa, Mycobacterium
ALEGGPHQV

SEQ ID NO: 246818 - protein, 6 aa, Mycobacterium
ALEGQQ

SEQ ID NO: 246819 - protein, 8 aa, Mycobacterium
ALEGSTLK

SEQ ID NO: 246820 - protein, 5 aa, Mycobacterium
ALENL

SEQ ID NO: 246821 - protein, 5 aa, Mycobacterium
ALEPE

SEQ ID NO: 246822 - protein, 8 aa, Mycobacterium
ALEPEPQG

SEQ ID NO: 246823 - protein, 8 aa, Mycobacterium
ALEPPRAA

SEQ ID NO: 246824 - protein, 6 aa, Mycobacterium
ALEPQR

SEQ ID NO: 246825 - protein, 4 aa, Mycobacterium
ALEQ

SEQ ID NO: 246826 - protein, 41 aa, Mycobacterium
ALERDEDGGRGHEPPPPPGTPGRPGGSSRPPQRRRKRKSNG

SEQ ID NO: 246827 - protein, 10 aa, Mycobacterium
ALERSAPSLS

SEQ ID NO: 246828 - protein, 4 aa, Mycobacterium
ALES

SEQ ID NO: 246829 - protein, 9 aa, Mycobacterium
ALESRSEHP

SEQ ID NO: 246830 - protein, 6 aa, Mycobacterium
ALESTA

SEQ ID NO: 246831 - protein, 4 aa, Mycobacterium
ALET

SEQ ID NO: 246832 - protein, 8 aa, Mycobacterium
ALETGGPA

SEQ ID NO: 246833 - protein, 9 aa, Mycobacterium
ALETPAPQA

SEQ ID NO: 246834 - protein, 6 aa, Mycobacterium
ALETSA

SEQ ID NO: 246835 - protein, 11 aa, Mycobacterium
ALGADLAERSL

SEQ ID NO: 246836 - protein, 5 aa, Mycobacterium
ALGAG

SEQ ID NO: 246837 - protein, 6 aa, Mycobacterium
ALGAPK

SEQ ID NO: 246838 - protein, 8 aa, Mycobacterium
ALGASRGQ

SEQ ID NO: 246839 - protein, 9 aa, Mycobacterium
ALGATSDTL

SEQ ID NO: 246840 - protein, 22 aa, Mycobacterium
ALGDETAEGFRPNGIPSDLSAD

SEQ ID NO: 246841 - protein, 5 aa, Mycobacterium
ALGDN

SEQ ID NO: 246842 - protein, 4 aa, Mycobacterium
ALGE

SEQ ID NO: 246843 - protein, 6 aa, Mycobacterium
ALGEPE

SEQ ID NO: 246844 - protein, 9 aa, Mycobacterium
ALGGNGYSL

SEQ ID NO: 246845 - protein, 11 aa, Mycobacterium
ALGGPADSDLG

SEQ ID NO: 246846 - protein, 7 aa, Mycobacterium
ALGGQPR

SEQ ID NO: 246847 - protein, 8 aa, Mycobacterium
ALGGRPGV

SEQ ID NO: 246848 - protein, 17 aa, Mycobacterium
ALGGTDPTGFSPNGVPD

SEQ ID NO: 246849 - protein, 15 aa, Mycobacterium
ALGGTHQGNVDEPMP

SEQ ID NO: 246850 - protein, 7 aa, Mycobacterium
ALGHPAG

SEQ ID NO: 246851 - protein, 7 aa, Mycobacterium
ALGLGTP

SEQ ID NO: 246852 - protein, 9 aa, Mycobacterium
ALGNAPTGA

SEQ ID NO: 246853 - protein, 7 aa, Mycobacterium
ALGPADA

SEQ ID NO: 246854 - protein, 10 aa, Mycobacterium
ALGPDDTRRA

SEQ ID NO: 246855 - protein, 19 aa, Mycobacterium
ALGPDGGWRGNAAQAYGAR

SEQ ID NO: 246856 - protein, 18 aa, Mycobacterium
ALGPPEGAAGKDTAQDEW

SEQ ID NO: 246857 - protein, 6 aa, Mycobacterium
ALGPPL

SEQ ID NO: 246858 - protein, 7 aa, Mycobacterium
ALGPRAA

SEQ ID NO: 246859 - protein, 9 aa, Mycobacterium
ALGPSGSDL

SEQ ID NO: 246860 - protein, 7 aa, Mycobacterium
ALGPTAA

SEQ ID NO: 246861 - protein, 7 aa, Mycobacterium
ALGPTSH

SEQ ID NO: 246862 - protein, 7 aa, Mycobacterium
ALGRDRT

SEQ ID NO: 246863 - protein, 11 aa, Mycobacterium
ALGRPPGGWDA

SEQ ID NO: 246864 - protein, 10 aa, Mycobacterium
ALGSDTTAHI

SEQ ID NO: 246865 - protein, 6 aa, Mycobacterium
ALGTAA

SEQ ID NO: 246866 - protein, 11 aa, Mycobacterium
ALGTGNTGRQL

SEQ ID NO: 246867 - protein, 8 aa, Mycobacterium
ALKGTPLE

SEQ ID NO: 246868 - protein, 18 aa, Mycobacterium
ALKGTQNETFPKPTEIGG

SEQ ID NO: 246869 - protein, 11 aa, Mycobacterium
ALKRAPKGTEV

SEQ ID NO: 246870 - protein, 11 aa, Mycobacterium
ALMGGDANHRV

SEQ ID NO: 246871 - protein, 9 aa, Mycobacterium
ALNDGGDGV

SEQ ID NO: 246872 - protein, 28 aa, Mycobacterium
ALNDGGDGYIPGAAAGEDDVMTGHPEDR

SEQ ID NO: 246873 - protein, 9 aa, Mycobacterium
ALNGQGDKF

SEQ ID NO: 246874 - protein, 8 aa, Mycobacterium
ALNGRNKA

SEQ ID NO: 246875 - protein, 8 aa, Mycobacterium
ALNGSGYE

SEQ ID NO: 246876 - protein, 6 aa, Mycobacterium
ALNNDD

SEQ ID NO: 246877 - protein, 7 aa, Mycobacterium
ALNNPRT

SEQ ID NO: 246878 - protein, 10 aa, Mycobacterium
ALNPATDGGD

SEQ ID NO: 246879 - protein, 6 aa, Mycobacterium
ALNPPE

SEQ ID NO: 246880 - protein, 7 aa, Mycobacterium
ALNPPER

SEQ ID NO: 246881 - protein, 10 aa, Mycobacterium
ALNRPTPDRV

SEQ ID NO: 246882 - protein, 12 aa, Mycobacterium
ALNSASEDVPVS

SEQ ID NO: 246883 - protein, 6 aa, Mycobacterium
ALNSNT

SEQ ID NO: 246884 - protein, 5 aa, Mycobacterium
ALNTE

SEQ ID NO: 246885 - protein, 6 aa, Mycobacterium
ALPAAA

SEQ ID NO: 246886 - protein, 9 aa, Mycobacterium
ALPAAGGGY

SEQ ID NO: 246887 - protein, 10 aa, Mycobacterium
ALPAAPADGP

SEQ ID NO: 246888 - protein, 5 aa, Mycobacterium
ALPAE

SEQ ID NO: 246889 - protein, 26 aa, Mycobacterium
ALPAKGTAAAAAAERAATKTAEPEPV

SEQ ID NO: 246890 - protein, 13 aa, Mycobacterium
ALPAPPGVNTDTN

SEQ ID NO: 246891 - protein, 6 aa, Mycobacterium
ALPAPR

SEQ ID NO: 246892 - protein, 5 aa, Mycobacterium
ALPAR

SEQ ID NO: 246893 - protein, 14 aa, Mycobacterium
ALPARKPEASPTTV

SEQ ID NO: 246894 - protein, 12 aa, Mycobacterium
ALPDDVRRDGAG

SEQ ID NO: 246895 - protein, 6 aa, Mycobacterium
ALPDGK

SEQ ID NO: 246896 - protein, 9 aa, Mycobacterium
ALPDPGETV

SEQ ID NO: 246897 - protein, 5 aa, Mycobacterium
ALPED

SEQ ID NO: 246898 - protein, 6 aa, Mycobacterium
ALPEGS

SEQ ID NO: 246899 - protein, 9 aa, Mycobacterium
ALPENNNQA

SEQ ID NO: 246900 - protein, 19 aa, Mycobacterium
ALPEPPNPPDVEPADPTAA

SEQ ID NO: 246901 - protein, 20 aa, Mycobacterium
ALPEQDSAAPVPTERGTPAA

SEQ ID NO: 246902 - protein, 7 aa, Mycobacterium
ALPEREP

SEQ ID NO: 246903 - protein, 4 aa, Mycobacterium
ALPG

SEQ ID NO: 246904 - protein, 5 aa, Mycobacterium
ALPGD

SEQ ID NO: 246905 - protein, 7 aa, Mycobacterium
ALPGEQA

SEQ ID NO: 246906 - protein, 12 aa, Mycobacterium
ALPGHGPSASHA

SEQ ID NO: 246907 - protein, 8 aa, Mycobacterium
ALPGPARL

SEQ ID NO: 246908 - protein, 10 aa, Mycobacterium
ALPGREGPVP

SEQ ID NO: 246909 - protein, 7 aa, Mycobacterium
ALPGRGV

SEQ ID NO: 246910 - protein, 10 aa, Mycobacterium
ALPGRPETRH

SEQ ID NO: 246911 - protein, 6 aa, Mycobacterium
ALPGSD

SEQ ID NO: 246912 - protein, 8 aa, Mycobacterium
ALPGSPPI

SEQ ID NO: 246913 - protein, 7 aa, Mycobacterium
ALPGVSG

SEQ ID NO: 246914 - protein, 5 aa, Mycobacterium
ALPKK

SEQ ID NO: 246915 - protein, 14 aa, Mycobacterium
ALPKTTSGKISRSA

SEQ ID NO: 246916 - protein, 7 aa, Mycobacterium
ALPNGTV

SEQ ID NO: 246917 - protein, 5 aa, Mycobacterium
ALPPA

SEQ ID NO: 246918 - protein, 15 aa, Mycobacterium
ALPPAPAPENTTPRT

SEQ ID NO: 246919 - protein, 12 aa, Mycobacterium
ALPPARSGAPSD

SEQ ID NO: 246920 - protein, 78 aa, Mycobacterium
ALPPCPPPAPKTPPPPAPTAAGRTPTTTSGTPTTTPSKPSPTTSAGPGASTTPTTTSTPAPAPLPAPPQEPGVTCRTV

SEQ ID NO: 246921 - protein, 18 aa, Mycobacterium
ALPPDTKPGRPVSADGGS

SEQ ID NO: 246922 - protein, 5 aa, Mycobacterium
ALPPE

SEQ ID NO: 246923 - protein, 6 aa, Mycobacterium
ALPPGR

SEQ ID NO: 246924 - protein, 9 aa, Mycobacterium
ALPPGTATV

SEQ ID NO: 246925 - protein, 16 aa, Mycobacterium
ALPPPPPQPGTNCRAV

SEQ ID NO: 246926 - protein, 15 aa, Mycobacterium
ALPPSQSLAQSGIRD

SEQ ID NO: 246927 - protein, 7 aa, Mycobacterium
ALPPTEP

SEQ ID NO: 246928 - protein, 6 aa, Mycobacterium
ALPPTS

SEQ ID NO: 246929 - protein, 16 aa, Mycobacterium
ALPPVETPGPTEEMRQ

SEQ ID NO: 246930 - protein, 4 aa, Mycobacterium
ALPQ

SEQ ID NO: 246931 - protein, 6 aa, Mycobacterium
ALPQGT

SEQ ID NO: 246932 - protein, 7 aa, Mycobacterium
ALPQPCA

SEQ ID NO: 246933 - protein, 19 aa, Mycobacterium
ALPQRRPNAVAAATPAGAA

SEQ ID NO: 246934 - protein, 6 aa, Mycobacterium
ALPQRT

SEQ ID NO: 246935 - protein, 5 aa, Mycobacterium
ALPQS

SEQ ID NO: 246936 - protein, 5 aa, Mycobacterium
ALPRD

SEQ ID NO: 246937 - protein, 16 aa, Mycobacterium
ALPRGPASPPAPAVRT

SEQ ID NO: 246938 - protein, 9 aa, Mycobacterium
ALPRRPKPA

SEQ ID NO: 246939 - protein, 8 aa, Mycobacterium
ALPRSTNS

SEQ ID NO: 246940 - protein, 16 aa, Mycobacterium
ALPRTPAGRKRLGQRP

SEQ ID NO: 246941 - protein, 7 aa, Mycobacterium
ALPSDVT

SEQ ID NO: 246942 - protein, 8 aa, Mycobacterium
ALPSPGVN

SEQ ID NO: 246943 - protein, 9 aa, Mycobacterium
ALPSPGVNY

SEQ ID NO: 246944 - protein, 5 aa, Mycobacterium
ALPSV

SEQ ID NO: 246945 - protein, 10 aa, Mycobacterium
ALPTAGGGYT

SEQ ID NO: 246946 - protein, 18 aa, Mycobacterium
ALPTTAPGPTSIPGRARA

SEQ ID NO: 246947 - protein, 38 aa, Mycobacterium
ALPVGASDSAAEDVDEEPAEDDVDTEAVAKHDDEDRYE

SEQ ID NO: 246948 - protein, 7 aa, Mycobacterium
ALPVPES

SEQ ID NO: 246949 - protein, 9 aa, Mycobacterium
ALQEPSTGK

SEQ ID NO: 246950 - protein, 9 aa, Mycobacterium
ALQSPTASA

SEQ ID NO: 246951 - protein, 10 aa, Mycobacterium
ALRDDTQAGL

SEQ ID NO: 246952 - protein, 7 aa, Mycobacterium
ALRDNSV

SEQ ID NO: 246953 - protein, 13 aa, Mycobacterium
ALRGDTADQTTEA

SEQ ID NO: 246954 - protein, 8 aa, Mycobacterium
ALRNTGAA

SEQ ID NO: 246955 - protein, 4 aa, Mycobacterium
ALRP

SEQ ID NO: 246956 - protein, 6 aa, Mycobacterium
ALRPGS

SEQ ID NO: 246957 - protein, 5 aa, Mycobacterium
ALRPL

SEQ ID NO: 246958 - protein, 15 aa, Mycobacterium
ALRPRSLPPGVRRRL

SEQ ID NO: 246959 - protein, 5 aa, Mycobacterium
ALRPY

SEQ ID NO: 246960 - protein, 9 aa, Mycobacterium
ALRRKGTRL

SEQ ID NO: 246961 - protein, 4 aa, Mycobacterium
ALRS

SEQ ID NO: 246962 - protein, 5 aa, Mycobacterium
ALRSN

SEQ ID NO: 246963 - protein, 6 aa, Mycobacterium
ALRSTE

SEQ ID NO: 246964 - protein, 10 aa, Mycobacterium
ALRTPDAGQG

SEQ ID NO: 246965 - protein, 7 aa, Mycobacterium
ALSADGR

SEQ ID NO: 246966 - protein, 10 aa, Mycobacterium
ALSAKDRAEQ

SEQ ID NO: 246967 - protein, 32 aa, Mycobacterium
ALSAQDRAEQQFPKTVPPEQARAENQTTGPNG

SEQ ID NO: 246968 - protein, 9 aa, Mycobacterium
ALSDAASAV

SEQ ID NO: 246969 - protein, 9 aa, Mycobacterium
ALSDPATGA

SEQ ID NO: 246970 - protein, 10 aa, Mycobacterium
ALSDPDQDHA

SEQ ID NO: 246971 - protein, 26 aa, Mycobacterium
ALSDTGDELAAGAEGGALQPLDDSGH

SEQ ID NO: 246972 - protein, 8 aa, Mycobacterium
ALSGTASA

SEQ ID NO: 246973 - protein, 11 aa, Mycobacterium
ALSHPDQDRAA

SEQ ID NO: 246974 - protein, 14 aa, Mycobacterium
ALSNPDKDDDPAKN

SEQ ID NO: 246975 - protein, 8 aa, Mycobacterium
ALSPQEAA

SEQ ID NO: 246976 - protein, 32 aa, Mycobacterium
ALSPSDRATQEFPQTVPPDQARAENQTTGPNG

SEQ ID NO: 246977 - protein, 6 aa, Mycobacterium
ALSPTG

SEQ ID NO: 246978 - protein, 8 aa, Mycobacterium
ALSQPRSD

SEQ ID NO: 246979 - protein, 9 aa, Mycobacterium
ALSQRQADL

SEQ ID NO: 246980 - protein, 11 aa, Mycobacterium
ALSSPSVGRLE

SEQ ID NO: 246981 - protein, 9 aa, Mycobacterium
ALSSTAYAP

SEQ ID NO: 246982 - protein, 8 aa, Mycobacterium
ALSTADAR

SEQ ID NO: 246983 - protein, 7 aa, Mycobacterium
ALSTEGI

SEQ ID NO: 246984 - protein, 11 aa, Mycobacterium
ALSTPASKIAT

SEQ ID NO: 246985 - protein, 11 aa, Mycobacterium
ALSTPDQNQAE

SEQ ID NO: 246986 - protein, 7 aa, Mycobacterium
ALSTPRH

SEQ ID NO: 246987 - protein, 5 aa, Mycobacterium
ALSTQ

SEQ ID NO: 246988 - protein, 6 aa, Mycobacterium
ALSTRG

SEQ ID NO: 246989 - protein, 15 aa, Mycobacterium
ALTADQSTSGDKGVK

SEQ ID NO: 246990 - protein, 18 aa, Mycobacterium
ALTAESPAASGAAPTKAV

SEQ ID NO: 246991 - protein, 12 aa, Mycobacterium
ALTAPAAADPRV

SEQ ID NO: 246992 - protein, 7 aa, Mycobacterium
ALTASSA

SEQ ID NO: 246993 - protein, 4 aa, Mycobacterium
ALTD

SEQ ID NO: 246994 - protein, 14 aa, Mycobacterium
ALTEQTKQMGRGLS

SEQ ID NO: 246995 - protein, 12 aa, Mycobacterium
ALTGAGAGGFAA

SEQ ID NO: 246996 - protein, 6 aa, Mycobacterium
ALTGEP

SEQ ID NO: 246997 - protein, 8 aa, Mycobacterium
ALTGESAA

SEQ ID NO: 246998 - protein, 17 aa, Mycobacterium
ALTGSVGSDEDSVRTEA

SEQ ID NO: 246999 - protein, 7 aa, Mycobacterium
ALTNGPA

SEQ ID NO: 247000 - protein, 9 aa, Mycobacterium
ALTPEPIPA

SEQ ID NO: 247001 - protein, 9 aa, Mycobacterium
ALTPGSPVG

SEQ ID NO: 247002 - protein, 12 aa, Mycobacterium
ALTPNDPQFQPG

SEQ ID NO: 247003 - protein, 19 aa, Mycobacterium
ALTPNDPQFQPGFEDADTR

SEQ ID NO: 247004 - protein, 6 aa, Mycobacterium
ALTPRN

SEQ ID NO: 247005 - protein, 16 aa, Mycobacterium
ALTPRRPFPARVGPKG

SEQ ID NO: 247006 - protein, 6 aa, Mycobacterium
ALTSLG

SEQ ID NO: 247007 - protein, 44 aa, Mycobacterium
ALTTPAPQPRVRPKPPIPYPGDAHAHPDTRGQPQIAPRSPPQHV

SEQ ID NO: 247008 - protein, 7 aa, Mycobacterium
ALTTRSR

SEQ ID NO: 247009 - protein, 12 aa, Mycobacterium
ALTTSEQRKATT

SEQ ID NO: 247010 - protein, 6 aa, Mycobacterium
ALYPGD

SEQ ID NO: 247011 - protein, 6 aa, Mycobacterium
AMADST

SEQ ID NO: 247012 - protein, 4 aa, Mycobacterium
AMAG

SEQ ID NO: 247013 - protein, 10 aa, Mycobacterium
AMAGSGASGY

SEQ ID NO: 247014 - protein, 12 aa, Mycobacterium
AMAGSGTDFATA

SEQ ID NO: 247015 - protein, 10 aa, Mycobacterium
AMANTGPHGL

SEQ ID NO: 247016 - protein, 13 aa, Mycobacterium
AMAQPEVDANNAI

SEQ ID NO: 247017 - protein, 11 aa, Mycobacterium
AMARSSRSSHG

SEQ ID NO: 247018 - protein, 10 aa, Mycobacterium
AMDKAAKTWN

SEQ ID NO: 247019 - protein, 11 aa, Mycobacterium
AMEHNTDPHTP

SEQ ID NO: 247020 - protein, 16 aa, Mycobacterium
AMEPASTSAAGGTGSM

SEQ ID NO: 247021 - protein, 9 aa, Mycobacterium
AMEQSRNRL

SEQ ID NO: 247022 - protein, 18 aa, Mycobacterium
AMETAAPDQTHHNGGEQD

SEQ ID NO: 247023 - protein, 6 aa, Mycobacterium
AMGPEG

SEQ ID NO: 247024 - protein, 8 aa, Mycobacterium
AMGSATNW

SEQ ID NO: 247025 - protein, 8 aa, Mycobacterium
AMGSTPTN

SEQ ID NO: 247026 - protein, 39 aa, Mycobacterium
AMGTQRGDQTGDAKEVEAQRHPAAQTPVRATRGSWRAQA

SEQ ID NO: 247027 - protein, 23 aa, Mycobacterium
AMGTRRGDEPEGSESVAPTVAPE

SEQ ID NO: 247028 - protein, 14 aa, Mycobacterium
AMGVSGPKHARPGG

SEQ ID NO: 247029 - protein, 12 aa, Mycobacterium
AMKGDGKGAGPL

SEQ ID NO: 247030 - protein, 7 aa, Mycobacterium
AMKGDRQ

SEQ ID NO: 247031 - protein, 20 aa, Mycobacterium
AMNQEGSASKLAAAQNQGLP

SEQ ID NO: 247032 - protein, 6 aa, Mycobacterium
AMNSTG

SEQ ID NO: 247033 - protein, 6 aa, Mycobacterium
AMNTGR

SEQ ID NO: 247034 - protein, 7 aa, Mycobacterium
AMPDNQA

SEQ ID NO: 247035 - protein, 20 aa, Mycobacterium
AMPETTPESPTPSARKSPTL

SEQ ID NO: 247036 - protein, 42 aa, Mycobacterium
AMPETTPTMPTPSTRTSPPRIPAPVPPTGGSPTPTESTGPAA

SEQ ID NO: 247037 - protein, 4 aa, Mycobacterium
AMPP

SEQ ID NO: 247038 - protein, 19 aa, Mycobacterium
AMPPGSGSTPEAALPPGLR

SEQ ID NO: 247039 - protein, 9 aa, Mycobacterium
AMPPPVEGA

SEQ ID NO: 247040 - protein, 12 aa, Mycobacterium
AMPQFGPRQLGP

SEQ ID NO: 247041 - protein, 7 aa, Mycobacterium
AMPSRQK

SEQ ID NO: 247042 - protein, 7 aa, Mycobacterium
AMQNQGY

SEQ ID NO: 247043 - protein, 4 aa, Mycobacterium
AMQR

SEQ ID NO: 247044 - protein, 9 aa, Mycobacterium
AMRERSELA

SEQ ID NO: 247045 - protein, 5 aa, Mycobacterium
AMRPE

SEQ ID NO: 247046 - protein, 6 aa, Mycobacterium
AMRPSY

SEQ ID NO: 247047 - protein, 7 aa, Mycobacterium
AMRSRRN

SEQ ID NO: 247048 - protein, 6 aa, Mycobacterium
AMRSTS

SEQ ID NO: 247049 - protein, 4 aa, Mycobacterium
AMRT

SEQ ID NO: 247050 - protein, 9 aa, Mycobacterium
AMSADSPVT

SEQ ID NO: 247051 - protein, 7 aa, Mycobacterium
AMSPEGI

SEQ ID NO: 247052 - protein, 7 aa, Mycobacterium
AMSPPER

SEQ ID NO: 247053 - protein, 7 aa, Mycobacterium
AMTATSA

SEQ ID NO: 247054 - protein, 5 aa, Mycobacterium
AMTDD

SEQ ID NO: 247055 - protein, 23 aa, Mycobacterium
AMTGPPSGAGEAERAPAAVRQRV

SEQ ID NO: 247056 - protein, 5 aa, Mycobacterium
AMTPR

SEQ ID NO: 247057 - protein, 4 aa, Mycobacterium
AMTS

SEQ ID NO: 247058 - protein, 5 aa, Mycobacterium
AMVSP

SEQ ID NO: 247059 - protein, 7 aa, Mycobacterium
ANAAAAA

SEQ ID NO: 247060 - protein, 7 aa, Mycobacterium
ANAAATA

SEQ ID NO: 247061 - protein, 8 aa, Mycobacterium
ANAAATAW

SEQ ID NO: 247062 - protein, 7 aa, Mycobacterium
ANAAERR

SEQ ID NO: 247063 - protein, 36 aa, Mycobacterium
ANAASTLAANAQSLANSDVQAAQRAYTRQGGNNTGA

SEQ ID NO: 247064 - protein, 34 aa, Mycobacterium
ANAASTLAAQAQSLANADVQSAQRAYARGGGSDM

SEQ ID NO: 247065 - protein, 4 aa, Mycobacterium
ANAG

SEQ ID NO: 247066 - protein, 5 aa, Mycobacterium
ANAGA

SEQ ID NO: 247067 - protein, 7 aa, Mycobacterium
ANAGGLG

SEQ ID NO: 247068 - protein, 12 aa, Mycobacterium
ANAGIAGGSAIG

SEQ ID NO: 247069 - protein, 7 aa, Mycobacterium
ANAGYAA

SEQ ID NO: 247070 - protein, 16 aa, Mycobacterium
ANAKRLNDDASAITDP

SEQ ID NO: 247071 - protein, 8 aa, Mycobacterium
ANAPEVPG

SEQ ID NO: 247072 - protein, 8 aa, Mycobacterium
ANAPTTRL

SEQ ID NO: 247073 - protein, 8 aa, Mycobacterium
ANAQGRAL

SEQ ID NO: 247074 - protein, 8 aa, Mycobacterium
ANASDPVA

SEQ ID NO: 247075 - protein, 5 aa, Mycobacterium
ANASP

SEQ ID NO: 247076 - protein, 8 aa, Mycobacterium
ANASREYQ

SEQ ID NO: 247077 - protein, 6 aa, Mycobacterium
ANATAD

SEQ ID NO: 247078 - protein, 9 aa, Mycobacterium
ANATGTGNA

SEQ ID NO: 247079 - protein, 12 aa, Mycobacterium
ANATSGLNQQAG

SEQ ID NO: 247080 - protein, 6 aa, Mycobacterium
ANCPSD

SEQ ID NO: 247081 - protein, 16 aa, Mycobacterium
ANDAIAAATGRTPNLY

SEQ ID NO: 247082 - protein, 10 aa, Mycobacterium
ANDDAAKNLG

SEQ ID NO: 247083 - protein, 11 aa, Mycobacterium
ANDEGRTMTDR

SEQ ID NO: 247084 - protein, 5 aa, Mycobacterium
ANDGT

SEQ ID NO: 247085 - protein, 9 aa, Mycobacterium
ANDHDGEPY

SEQ ID NO: 247086 - protein, 8 aa, Mycobacterium
ANDKGRAL

SEQ ID NO: 247087 - protein, 8 aa, Mycobacterium
ANDNSASM

SEQ ID NO: 247088 - protein, 7 aa, Mycobacterium
ANDPAPA

SEQ ID NO: 247089 - protein, 10 aa, Mycobacterium
ANDPDGSRER

SEQ ID NO: 247090 - protein, 21 aa, Mycobacterium
ANDPEATTSSALRAALSMLGK

SEQ ID NO: 247091 - protein, 13 aa, Mycobacterium
ANDPHPGCSTPAT

SEQ ID NO: 247092 - protein, 6 aa, Mycobacterium
ANDQEA

SEQ ID NO: 247093 - protein, 11 aa, Mycobacterium
ANDQTQNETGY

SEQ ID NO: 247094 - protein, 8 aa, Mycobacterium
ANDRAYDD

SEQ ID NO: 247095 - protein, 6 aa, Mycobacterium
ANDTGW

SEQ ID NO: 247096 - protein, 6 aa, Mycobacterium
ANDTKL

SEQ ID NO: 247097 - protein, 9 aa, Mycobacterium
ANDYPGARA

SEQ ID NO: 247098 - protein, 8 aa, Mycobacterium
ANEGGGAA

SEQ ID NO: 247099 - protein, 6 aa, Mycobacterium
ANELSG

SEQ ID NO: 247100 - protein, 8 aa, Mycobacterium
ANENRDNL

SEQ ID NO: 247101 - protein, 10 aa, Mycobacterium
ANEPPPPGIP

SEQ ID NO: 247102 - protein, 7 aa, Mycobacterium
ANEQARA

SEQ ID NO: 247103 - protein, 6 aa, Mycobacterium
ANESTV

SEQ ID NO: 247104 - protein, 5 aa, Mycobacterium
ANESV

SEQ ID NO: 247105 - protein, 7 aa, Mycobacterium
ANFPQTS

SEQ ID NO: 247106 - protein, 16 aa, Mycobacterium
ANGAPVPETVGSTVGS

SEQ ID NO: 247107 - protein, 8 aa, Mycobacterium
ANGASVSR

SEQ ID NO: 247108 - protein, 9 aa, Mycobacterium
ANGATPNQY

SEQ ID NO: 247109 - protein, 6 aa, Mycobacterium
ANGEEF

SEQ ID NO: 247110 - protein, 8 aa, Mycobacterium
ANGEGRHD

SEQ ID NO: 247111 - protein, 10 aa, Mycobacterium
ANGEPARLPS

SEQ ID NO: 247112 - protein, 7 aa, Mycobacterium
ANGEPTS

SEQ ID NO: 247113 - protein, 9 aa, Mycobacterium
ANGETAKHA

SEQ ID NO: 247114 - protein, 15 aa, Mycobacterium
ANGEVSSPGPAPLAQ

SEQ ID NO: 247115 - protein, 7 aa, Mycobacterium
ANGGDNI

SEQ ID NO: 247116 - protein, 7 aa, Mycobacterium
ANGGDNV

SEQ ID NO: 247117 - protein, 7 aa, Mycobacterium
ANGGEVD

SEQ ID NO: 247118 - protein, 9 aa, Mycobacterium
ANGGGPQVI

SEQ ID NO: 247119 - protein, 16 aa, Mycobacterium
ANGGGPTVVRNPDGSL

SEQ ID NO: 247120 - protein, 18 aa, Mycobacterium
ANGGGPVVPRDENGEIAS

SEQ ID NO: 247121 - protein, 12 aa, Mycobacterium
ANGGNVEGTVKD

SEQ ID NO: 247122 - protein, 9 aa, Mycobacterium
ANGGPESAT

SEQ ID NO: 247123 - protein, 9 aa, Mycobacterium
ANGGPETAT

SEQ ID NO: 247124 - protein, 9 aa, Mycobacterium
ANGGPETGT

SEQ ID NO: 247125 - protein, 10 aa, Mycobacterium
ANGGSAPLPR

SEQ ID NO: 247126 - protein, 9 aa, Mycobacterium
ANGGSQSVV

SEQ ID NO: 247127 - protein, 10 aa, Mycobacterium
ANGGSSLTGV

SEQ ID NO: 247128 - protein, 7 aa, Mycobacterium
ANGKADM

SEQ ID NO: 247129 - protein, 7 aa, Mycobacterium
ANGKAKL

SEQ ID NO: 247130 - protein, 7 aa, Mycobacterium
ANGLRRG

SEQ ID NO: 247131 - protein, 6 aa, Mycobacterium
ANGMGA

SEQ ID NO: 247132 - protein, 8 aa, Mycobacterium
ANGPRSEA

SEQ ID NO: 247133 - protein, 8 aa, Mycobacterium
ANGPSIDR

SEQ ID NO: 247134 - protein, 13 aa, Mycobacterium
ANGQAGQAGEVSA

SEQ ID NO: 247135 - protein, 9 aa, Mycobacterium
ANGQPVGYG

SEQ ID NO: 247136 - protein, 5 aa, Mycobacterium
ANGRR

SEQ ID NO: 247137 - protein, 6 aa, Mycobacterium
ANGSDL

SEQ ID NO: 247138 - protein, 8 aa, Mycobacterium
ANGSGKTT

SEQ ID NO: 247139 - protein, 8 aa, Mycobacterium
ANGSQRAV

SEQ ID NO: 247140 - protein, 15 aa, Mycobacterium
ANGSVISPGPAPLDQ

SEQ ID NO: 247141 - protein, 10 aa, Mycobacterium
ANGTSTAAGK

SEQ ID NO: 247142 - protein, 7 aa, Mycobacterium
ANGVEDA

SEQ ID NO: 247143 - protein, 6 aa, Mycobacterium
ANGVRP

SEQ ID NO: 247144 - protein, 4 aa, Mycobacterium
ANGW

SEQ ID NO: 247145 - protein, 12 aa, Mycobacterium
ANGYGEHSPGGY

SEQ ID NO: 247146 - protein, 9 aa, Mycobacterium
ANGYGNSKW

SEQ ID NO: 247147 - protein, 6 aa, Mycobacterium
ANHDPL

SEQ ID NO: 247148 - protein, 12 aa, Mycobacterium
ANHQSAQDDPMP

SEQ ID NO: 247149 - protein, 4 aa, Mycobacterium
ANHR

SEQ ID NO: 247150 - protein, 8 aa, Mycobacterium
ANHTRAHT

SEQ ID NO: 247151 - protein, 7 aa, Mycobacterium
ANIDPLD

SEQ ID NO: 247152 - protein, 5 aa, Mycobacterium
ANIEG

SEQ ID NO: 247153 - protein, 17 aa, Mycobacterium
ANIGPAAPASSPPPSWG

SEQ ID NO: 247154 - protein, 13 aa, Mycobacterium
ANIKAGAKTRAST

SEQ ID NO: 247155 - protein, 11 aa, Mycobacterium
ANIPRGPTGKV

SEQ ID NO: 247156 - protein, 4 aa, Mycobacterium
ANIT

SEQ ID NO: 247157 - protein, 6 aa, Mycobacterium
ANKPFQ

SEQ ID NO: 247158 - protein, 13 aa, Mycobacterium
ANKSAIATAPDTD

SEQ ID NO: 247159 - protein, 11 aa, Mycobacterium
ANLGQTDADGR

SEQ ID NO: 247160 - protein, 5 aa, Mycobacterium
ANLRD

SEQ ID NO: 247161 - protein, 10 aa, Mycobacterium
ANLSGELSGK

SEQ ID NO: 247162 - protein, 11 aa, Mycobacterium
ANLSRGKRSAA

SEQ ID NO: 247163 - protein, 12 aa, Mycobacterium
ANLTAASAQAGR

SEQ ID NO: 247164 - protein, 6 aa, Mycobacterium
ANLTGG

SEQ ID NO: 247165 - protein, 7 aa, Mycobacterium
ANMPTPR

SEQ ID NO: 247166 - protein, 8 aa, Mycobacterium
ANMTSPPA

SEQ ID NO: 247167 - protein, 14 aa, Mycobacterium
ANNANPLTTFGGKI

SEQ ID NO: 247168 - protein, 13 aa, Mycobacterium
ANNATFNKTMSEQ

SEQ ID NO: 247169 - protein, 5 aa, Mycobacterium
ANNGK

SEQ ID NO: 247170 - protein, 7 aa, Mycobacterium
ANNGSEV

SEQ ID NO: 247171 - protein, 8 aa, Mycobacterium
ANNPGVPD

SEQ ID NO: 247172 - protein, 6 aa, Mycobacterium
ANNPYL

SEQ ID NO: 247173 - protein, 6 aa, Mycobacterium
ANPAAL

SEQ ID NO: 247174 - protein, 7 aa, Mycobacterium
ANPAGVS

SEQ ID NO: 247175 - protein, 12 aa, Mycobacterium
ANPAMGAGDRAA

SEQ ID NO: 247176 - protein, 10 aa, Mycobacterium
ANPASTSRHD

SEQ ID NO: 247177 - protein, 6 aa, Mycobacterium
ANPDIA

SEQ ID NO: 247178 - protein, 5 aa, Mycobacterium
ANPDP

SEQ ID NO: 247179 - protein, 7 aa, Mycobacterium
ANPEAAR

SEQ ID NO: 247180 - protein, 7 aa, Mycobacterium
ANPGIPA

SEQ ID NO: 247181 - protein, 6 aa, Mycobacterium
ANPGLE

SEQ ID NO: 247182 - protein, 12 aa, Mycobacterium
ANPGPTDPATKA

SEQ ID NO: 247183 - protein, 7 aa, Mycobacterium
ANPHGAT

SEQ ID NO: 247184 - protein, 15 aa, Mycobacterium
ANPIAAARFGRLTEL

SEQ ID NO: 247185 - protein, 15 aa, Mycobacterium
ANPIASARLSRLNEL

SEQ ID NO: 247186 - protein, 6 aa, Mycobacterium
ANPITA

SEQ ID NO: 247187 - protein, 8 aa, Mycobacterium
ANPKGWTH

SEQ ID NO: 247188 - protein, 6 aa, Mycobacterium
ANPLAQ

SEQ ID NO: 247189 - protein, 7 aa, Mycobacterium
ANPMQYG

SEQ ID NO: 247190 - protein, 15 aa, Mycobacterium
ANPPAASAEGTIKER

SEQ ID NO: 247191 - protein, 8 aa, Mycobacterium
ANPPANLN

SEQ ID NO: 247192 - protein, 13 aa, Mycobacterium
ANPPAVTKPPAMD

SEQ ID NO: 247193 - protein, 7 aa, Mycobacterium
ANPPPKL

SEQ ID NO: 247194 - protein, 12 aa, Mycobacterium
ANPPVITQSDGT

SEQ ID NO: 247195 - protein, 7 aa, Mycobacterium
ANPQAPY

SEQ ID NO: 247196 - protein, 23 aa, Mycobacterium
ANPQQPAAPPADGAPGPDAPGAG

SEQ ID NO: 247197 - protein, 6 aa, Mycobacterium
ANPRAH

SEQ ID NO: 247198 - protein, 7 aa, Mycobacterium
ANPRATL

SEQ ID NO: 247199 - protein, 7 aa, Mycobacterium
ANPRRLA

SEQ ID NO: 247200 - protein, 8 aa, Mycobacterium
ANPSAPGE

SEQ ID NO: 247201 - protein, 5 aa, Mycobacterium
ANPSC

SEQ ID NO: 247202 - protein, 5 aa, Mycobacterium
ANPSE

SEQ ID NO: 247203 - protein, 6 aa, Mycobacterium
ANPSLA

SEQ ID NO: 247204 - protein, 12 aa, Mycobacterium
ANPSPSRRKRRD

SEQ ID NO: 247205 - protein, 11 aa, Mycobacterium
ANPSTGSFADY

SEQ ID NO: 247206 - protein, 13 aa, Mycobacterium
ANPSTGSFADYSR

SEQ ID NO: 247207 - protein, 15 aa, Mycobacterium
ANPSTGSFADYSRNA

SEQ ID NO: 247208 - protein, 8 aa, Mycobacterium
ANPSTPRG

SEQ ID NO: 247209 - protein, 6 aa, Mycobacterium
ANPTAP

SEQ ID NO: 247210 - protein, 7 aa, Mycobacterium
ANPTTPR

SEQ ID NO: 247211 - protein, 17 aa, Mycobacterium
ANPVDGGRGEKAPIRSA

SEQ ID NO: 247212 - protein, 7 aa, Mycobacterium
ANPYRGS

SEQ ID NO: 247213 - protein, 27 aa, Mycobacterium
ANQAPQNPAPQTQQPQGPQNPFASSGT

SEQ ID NO: 247214 - protein, 9 aa, Mycobacterium
ANQDKAFGT

SEQ ID NO: 247215 - protein, 10 aa, Mycobacterium
ANQGAGLSST

SEQ ID NO: 247216 - protein, 4 aa, Mycobacterium
ANQK

SEQ ID NO: 247217 - protein, 4 aa, Mycobacterium
ANQL

SEQ ID NO: 247218 - protein, 7 aa, Mycobacterium
ANQQSER

SEQ ID NO: 247219 - protein, 5 aa, Mycobacterium
ANQRP

SEQ ID NO: 247220 - protein, 5 aa, Mycobacterium
ANQSA

SEQ ID NO: 247221 - protein, 6 aa, Mycobacterium
ANQSTV

SEQ ID NO: 247222 - protein, 13 aa, Mycobacterium
ANQTLSDSALEAG

SEQ ID NO: 247223 - protein, 11 aa, Mycobacterium
ANQTTRSLNES

SEQ ID NO: 247224 - protein, 4 aa, Mycobacterium
ANQV

SEQ ID NO: 247225 - protein, 15 aa, Mycobacterium
ANRASTLAAQAQTLA

SEQ ID NO: 247226 - protein, 6 aa, Mycobacterium
ANRATG

SEQ ID NO: 247227 - protein, 9 aa, Mycobacterium
ANRDGRDAY

SEQ ID NO: 247228 - protein, 19 aa, Mycobacterium
ANRDNVKQAVGSGNTTLKT

SEQ ID NO: 247229 - protein, 9 aa, Mycobacterium
ANRDPGSPE

SEQ ID NO: 247230 - protein, 7 aa, Mycobacterium
ANRDPLT

SEQ ID NO: 247231 - protein, 16 aa, Mycobacterium
ANRDPNKGTGPACPRT

SEQ ID NO: 247232 - protein, 11 aa, Mycobacterium
ANRDPRQYDDP

SEQ ID NO: 247233 - protein, 14 aa, Mycobacterium
ANREDPTVRETSNP

SEQ ID NO: 247234 - protein, 11 aa, Mycobacterium
ANREVGPGKEA

SEQ ID NO: 247235 - protein, 11 aa, Mycobacterium
ANREVGPGQEA

SEQ ID NO: 247236 - protein, 9 aa, Mycobacterium
ANRLGSTEY

SEQ ID NO: 247237 - protein, 6 aa, Mycobacterium
ANRNGR

SEQ ID NO: 247238 - protein, 28 aa, Mycobacterium
ANRNQPSSVTEPLPGAGELGAQAASPVR

SEQ ID NO: 247239 - protein, 18 aa, Mycobacterium
ANRPTHEGPIATVEALDF

SEQ ID NO: 247240 - protein, 18 aa, Mycobacterium
ANRPTHEGPVATVEALDF

SEQ ID NO: 247241 - protein, 5 aa, Mycobacterium
ANRRD

SEQ ID NO: 247242 - protein, 14 aa, Mycobacterium
ANRRDFDPDELESD

SEQ ID NO: 247243 - protein, 8 aa, Mycobacterium
ANRSPAKL

SEQ ID NO: 247244 - protein, 7 aa, Mycobacterium
ANRSSLN

SEQ ID NO: 247245 - protein, 25 aa, Mycobacterium
ANRSSNQTGSTPDDAGDGSAWSAAN

SEQ ID NO: 247246 - protein, 11 aa, Mycobacterium
ANRTGAAQAAA

SEQ ID NO: 247247 - protein, 6 aa, Mycobacterium
ANRYPE

SEQ ID NO: 247248 - protein, 4 aa, Mycobacterium
ANSA

SEQ ID NO: 247249 - protein, 17 aa, Mycobacterium
ANSAAMAGQQQTAAAAY

SEQ ID NO: 247250 - protein, 10 aa, Mycobacterium
ANSDAPHADA

SEQ ID NO: 247251 - protein, 10 aa, Mycobacterium
ANSDQLPPKP

SEQ ID NO: 247252 - protein, 4 aa, Mycobacterium
ANSG

SEQ ID NO: 247253 - protein, 11 aa, Mycobacterium
ANSGNGGHGGH

SEQ ID NO: 247254 - protein, 8 aa, Mycobacterium
ANSHPHEA

SEQ ID NO: 247255 - protein, 5 aa, Mycobacterium
ANSIR

SEQ ID NO: 247256 - protein, 9 aa, Mycobacterium
ANSKVGERV

SEQ ID NO: 247257 - protein, 6 aa, Mycobacterium
ANSNEQ

SEQ ID NO: 247258 - protein, 9 aa, Mycobacterium
ANSNTQAEL

SEQ ID NO: 247259 - protein, 11 aa, Mycobacterium
ANSPAAAAGIE

SEQ ID NO: 247260 - protein, 9 aa, Mycobacterium
ANSRAAERF

SEQ ID NO: 247261 - protein, 8 aa, Mycobacterium
ANSRIPGD

SEQ ID NO: 247262 - protein, 6 aa, Mycobacterium
ANSSGL

SEQ ID NO: 247263 - protein, 5 aa, Mycobacterium
ANSSP

SEQ ID NO: 247264 - protein, 7 aa, Mycobacterium
ANSTDRP

SEQ ID NO: 247265 - protein, 12 aa, Mycobacterium
ANSTGAGAPSGV

SEQ ID NO: 247266 - protein, 8 aa, Mycobacterium
ANTAEDTV

SEQ ID NO: 247267 - protein, 9 aa, Mycobacterium
ANTALASTA

SEQ ID NO: 247268 - protein, 4 aa, Mycobacterium
ANTD

SEQ ID NO: 247269 - protein, 8 aa, Mycobacterium
ANTDPLTG

SEQ ID NO: 247270 - protein, 20 aa, Mycobacterium
ANTDSKGDCPDGKRNDSSYL

SEQ ID NO: 247271 - protein, 9 aa, Mycobacterium
ANTDSKSPI

SEQ ID NO: 247272 - protein, 5 aa, Mycobacterium
ANTGA

SEQ ID NO: 247273 - protein, 5 aa, Mycobacterium
ANTGN

SEQ ID NO: 247274 - protein, 6 aa, Mycobacterium
ANTHQV

SEQ ID NO: 247275 - protein, 7 aa, Mycobacterium
ANTNYPQ

SEQ ID NO: 247276 - protein, 6 aa, Mycobacterium
ANTPEV

SEQ ID NO: 247277 - protein, 7 aa, Mycobacterium
ANTPNGG

SEQ ID NO: 247278 - protein, 7 aa, Mycobacterium
ANTPRDA

SEQ ID NO: 247279 - protein, 6 aa, Mycobacterium
ANTPTN

SEQ ID NO: 247280 - protein, 4 aa, Mycobacterium
ANTS

SEQ ID NO: 247281 - protein, 7 aa, Mycobacterium
ANTSDDG

SEQ ID NO: 247282 - protein, 4 aa, Mycobacterium
ANTT

SEQ ID NO: 247283 - protein, 46 aa, Mycobacterium
ANTYTEVAEPAAVTTHTGPPPHGRSGGTGGSADLPEPDQNVEDARA

SEQ ID NO: 247284 - protein, 10 aa, Mycobacterium
ANVAAGARTR

SEQ ID NO: 247285 - protein, 7 aa, Mycobacterium
ANVGGEI

SEQ ID NO: 247286 - protein, 13 aa, Mycobacterium
ANVQAGAKSRAST

SEQ ID NO: 247287 - protein, 10 aa, Mycobacterium
ANVSDEHSSL

SEQ ID NO: 247288 - protein, 10 aa, Mycobacterium
ANWTGPDGLA

SEQ ID NO: 247289 - protein, 7 aa, Mycobacterium
ANWTGSA

SEQ ID NO: 247290 - protein, 11 aa, Mycobacterium
ANYAAAATPVI

SEQ ID NO: 247291 - protein, 11 aa, Mycobacterium
ANYTGEEDVNG

SEQ ID NO: 247292 - protein, 21 aa, Mycobacterium
APAAAAAPAAPAAAFAPQPVT

SEQ ID NO: 247293 - protein, 17 aa, Mycobacterium
APAAAAAQAAELPPDRQ

SEQ ID NO: 247294 - protein, 8 aa, Mycobacterium
APAAAAGA

SEQ ID NO: 247295 - protein, 11 aa, Mycobacterium
APAAGGPLRGE

SEQ ID NO: 247296 - protein, 7 aa, Mycobacterium
APAAGPA

SEQ ID NO: 247297 - protein, 9 aa, Mycobacterium
APAAGRGAL

SEQ ID NO: 247298 - protein, 11 aa, Mycobacterium
APAAKPPRRER

SEQ ID NO: 247299 - protein, 19 aa, Mycobacterium
APAALDAASPAAQSPPALT

SEQ ID NO: 247300 - protein, 9 aa, Mycobacterium
APAANGRPN

SEQ ID NO: 247301 - protein, 8 aa, Mycobacterium
APAAPPVA

SEQ ID NO: 247302 - protein, 15 aa, Mycobacterium
APAAQQKKVKTKATV

SEQ ID NO: 247303 - protein, 8 aa, Mycobacterium
APAAREAQ

SEQ ID NO: 247304 - protein, 7 aa, Mycobacterium
APAARGA

SEQ ID NO: 247305 - protein, 21 aa, Mycobacterium
APAARTPSTQDDGTPDAQRTA

SEQ ID NO: 247306 - protein, 10 aa, Mycobacterium
APAASAEPPL

SEQ ID NO: 247307 - protein, 18 aa, Mycobacterium
APAASRDVKYAKEIPAGN

SEQ ID NO: 247308 - protein, 8 aa, Mycobacterium
APAATDDE

SEQ ID NO: 247309 - protein, 20 aa, Mycobacterium
APADAALPTTATGQHSPGEH

SEQ ID NO: 247310 - protein, 6 aa, Mycobacterium
APADEA

SEQ ID NO: 247311 - protein, 10 aa, Mycobacterium
APADGTDSIG

SEQ ID NO: 247312 - protein, 12 aa, Mycobacterium
APADPADSEHLD

SEQ ID NO: 247313 - protein, 9 aa, Mycobacterium
APADPVERR

SEQ ID NO: 247314 - protein, 7 aa, Mycobacterium
APADQRA

SEQ ID NO: 247315 - protein, 6 aa, Mycobacterium
APADRR

SEQ ID NO: 247316 - protein, 8 aa, Mycobacterium
APAEFDDG

SEQ ID NO: 247317 - protein, 8 aa, Mycobacterium
APAEGRDA

SEQ ID NO: 247318 - protein, 7 aa, Mycobacterium
APAEGRL

SEQ ID NO: 247319 - protein, 14 aa, Mycobacterium
APAEPESGATVSAK

SEQ ID NO: 247320 - protein, 5 aa, Mycobacterium
APAEQ

SEQ ID NO: 247321 - protein, 16 aa, Mycobacterium
APAEQTAERTGPSANA

SEQ ID NO: 247322 - protein, 9 aa, Mycobacterium
APAERRGRY

SEQ ID NO: 247323 - protein, 6 aa, Mycobacterium
APAETV

SEQ ID NO: 247324 - protein, 5 aa, Mycobacterium
APAFD

SEQ ID NO: 247325 - protein, 4 aa, Mycobacterium
APAG

SEQ ID NO: 247326 - protein, 7 aa, Mycobacterium
APAGAGA

SEQ ID NO: 247327 - protein, 6 aa, Mycobacterium
APAGAI

SEQ ID NO: 247328 - protein, 24 aa, Mycobacterium
APAGAQTDQCSPPGEQSASALPTN

SEQ ID NO: 247329 - protein, 10 aa, Mycobacterium
APAGASESDV

SEQ ID NO: 247330 - protein, 5 aa, Mycobacterium
APAGI

SEQ ID NO: 247331 - protein, 40 aa, Mycobacterium
APAGLDSARALPKDLTESRPTPQEDRDTTSSVEPLTSVDT

SEQ ID NO: 247332 - protein, 39 aa, Mycobacterium
APAGQPTTMGSSVSTAEATGAAEPAAGGGGQTASGPLDL

SEQ ID NO: 247333 - protein, 13 aa, Mycobacterium
APAGRSRDFRGSA

SEQ ID NO: 247334 - protein, 8 aa, Mycobacterium
APAGTPKC

SEQ ID NO: 247335 - protein, 9 aa, Mycobacterium
APAHEPPAA

SEQ ID NO: 247336 - protein, 9 aa, Mycobacterium
APAHGTGPI

SEQ ID NO: 247337 - protein, 7 aa, Mycobacterium
APAHTSA

SEQ ID NO: 247338 - protein, 13 aa, Mycobacterium
APAISPKKSWEGL

SEQ ID NO: 247339 - protein, 17 aa, Mycobacterium
APAITSPPDRKRPAYGI

SEQ ID NO: 247340 - protein, 8 aa, Mycobacterium
APAKDPWK

SEQ ID NO: 247341 - protein, 4 aa, Mycobacterium
APAL

SEQ ID NO: 247342 - protein, 6 aa, Mycobacterium
APALQA

SEQ ID NO: 247343 - protein, 22 aa, Mycobacterium
APANEPRTARTFGGPAPDLPSA

SEQ ID NO: 247344 - protein, 8 aa, Mycobacterium
APANGGQL

SEQ ID NO: 247345 - protein, 6 aa, Mycobacterium
APANLG

SEQ ID NO: 247346 - protein, 13 aa, Mycobacterium
APANQGQEAANRH

SEQ ID NO: 247347 - protein, 7 aa, Mycobacterium
APANRRG

SEQ ID NO: 247348 - protein, 8 aa, Mycobacterium
APAPAASV

SEQ ID NO: 247349 - protein, 30 aa, Mycobacterium
APAPAPAAPAPAPAPVAPPPAPAPIPAAPP

SEQ ID NO: 247350 - protein, 26 aa, Mycobacterium
APAPAPGQPAPSDAELEHGDEASDQR

SEQ ID NO: 247351 - protein, 10 aa, Mycobacterium
APAPAPSGDV

SEQ ID NO: 247352 - protein, 10 aa, Mycobacterium
APAPARPRRQ

SEQ ID NO: 247353 - protein, 7 aa, Mycobacterium
APAPDPA

SEQ ID NO: 247354 - protein, 22 aa, Mycobacterium
APAPDPERSGGEQPGHSGEAVD

SEQ ID NO: 247355 - protein, 19 aa, Mycobacterium
APAPEAVPDSESNKGEPSL

SEQ ID NO: 247356 - protein, 7 aa, Mycobacterium
APAPGDV

SEQ ID NO: 247357 - protein, 17 aa, Mycobacterium
APAPGQTFGPDGPLGGV

SEQ ID NO: 247358 - protein, 5 aa, Mycobacterium
APAPL

SEQ ID NO: 247359 - protein, 22 aa, Mycobacterium
APAPNPHGGPPIAGTTLSPQHV

SEQ ID NO: 247360 - protein, 5 aa, Mycobacterium
APAPR

SEQ ID NO: 247361 - protein, 11 aa, Mycobacterium
APAPRGRQPAI

SEQ ID NO: 247362 - protein, 7 aa, Mycobacterium
APAPSEV

SEQ ID NO: 247363 - protein, 13 aa, Mycobacterium
APAPTPGPRTKVK

SEQ ID NO: 247364 - protein, 6 aa, Mycobacterium
APAPYR

SEQ ID NO: 247365 - protein, 4 aa, Mycobacterium
APAQ

SEQ ID NO: 247366 - protein, 15 aa, Mycobacterium
APAQLEAKPAGKAQK

SEQ ID NO: 247367 - protein, 9 aa, Mycobacterium
APARPGYRT

SEQ ID NO: 247368 - protein, 9 aa, Mycobacterium
APARPTDAQ

SEQ ID NO: 247369 - protein, 4 aa, Mycobacterium
APAS

SEQ ID NO: 247370 - protein, 7 aa, Mycobacterium
APASAAE

SEQ ID NO: 247371 - protein, 18 aa, Mycobacterium
APASDFAATGEGREHGPN

SEQ ID NO: 247372 - protein, 5 aa, Mycobacterium
APASG

SEQ ID NO: 247373 - protein, 15 aa, Mycobacterium
APASGQGRAFGTYGS

SEQ ID NO: 247374 - protein, 13 aa, Mycobacterium
APASPAGTRAIPD

SEQ ID NO: 247375 - protein, 5 aa, Mycobacterium
APASR

SEQ ID NO: 247376 - protein, 11 aa, Mycobacterium
APASSDVSPGT

SEQ ID NO: 247377 - protein, 6 aa, Mycobacterium
APASTA

SEQ ID NO: 247378 - protein, 7 aa, Mycobacterium
APASTND

SEQ ID NO: 247379 - protein, 6 aa, Mycobacterium
APASVA

SEQ ID NO: 247380 - protein, 14 aa, Mycobacterium
APASWGAPEETDTT

SEQ ID NO: 247381 - protein, 17 aa, Mycobacterium
APATADPEHLEPAEGIA

SEQ ID NO: 247382 - protein, 15 aa, Mycobacterium
APATASGKPTGSALP

SEQ ID NO: 247383 - protein, 6 aa, Mycobacterium
APATAV

SEQ ID NO: 247384 - protein, 7 aa, Mycobacterium
APATDDR

SEQ ID NO: 247385 - protein, 14 aa, Mycobacterium
APATDSPAAASPVS

SEQ ID NO: 247386 - protein, 12 aa, Mycobacterium
APATGSGKSTGA

SEQ ID NO: 247387 - protein, 6 aa, Mycobacterium
APATLA

SEQ ID NO: 247388 - protein, 6 aa, Mycobacterium
APATPV

SEQ ID NO: 247389 - protein, 9 aa, Mycobacterium
APATRGKTL

SEQ ID NO: 247390 - protein, 4 aa, Mycobacterium
APAV

SEQ ID NO: 247391 - protein, 8 aa, Mycobacterium
APAVPAGS

SEQ ID NO: 247392 - protein, 18 aa, Mycobacterium
APAVPLAPGRRKTATPVP

SEQ ID NO: 247393 - protein, 14 aa, Mycobacterium
APAVRTPGKKRFTR

SEQ ID NO: 247394 - protein, 11 aa, Mycobacterium
APAVSNDNQFS

SEQ ID NO: 247395 - protein, 5 aa, Mycobacterium
APAWT

SEQ ID NO: 247396 - protein, 108 aa, Mycobacterium
APAYTPPAEYPQYQQPAEQAYPQQYPQQPGYGQPGQYAQPGQYAQPGQYGQPGQYAQPGQYAQPGQYGQPGQYAQPGQYGQPGQYGQPGQYPQQYPPYDQQPAKKRPV

SEQ ID NO: 247397 - protein, 12 aa, Mycobacterium
APCAGAGSNPVS

SEQ ID NO: 247398 - protein, 12 aa, Mycobacterium
APCAGGGSNPAS

SEQ ID NO: 247399 - protein, 7 aa, Mycobacterium
APDAALA

SEQ ID NO: 247400 - protein, 7 aa, Mycobacterium
APDAIPA

SEQ ID NO: 247401 - protein, 5 aa, Mycobacterium
APDAQ

SEQ ID NO: 247402 - protein, 5 aa, Mycobacterium
APDDA

SEQ ID NO: 247403 - protein, 5 aa, Mycobacterium
APDDR

SEQ ID NO: 247404 - protein, 14 aa, Mycobacterium
APDDVDEDGADPEA

SEQ ID NO: 247405 - protein, 4 aa, Mycobacterium
APDG

SEQ ID NO: 247406 - protein, 8 aa, Mycobacterium
APDGGELA

SEQ ID NO: 247407 - protein, 8 aa, Mycobacterium
APDGGQAR

SEQ ID NO: 247408 - protein, 6 aa, Mycobacterium
APDGGR

SEQ ID NO: 247409 - protein, 14 aa, Mycobacterium
APDGGWQGSAARAY

SEQ ID NO: 247410 - protein, 11 aa, Mycobacterium
APDGKTVNDAA

SEQ ID NO: 247411 - protein, 12 aa, Mycobacterium
APDGKTVNDPAW

SEQ ID NO: 247412 - protein, 5 aa, Mycobacterium
APDGR

SEQ ID NO: 247413 - protein, 6 aa, Mycobacterium
APDGRI

SEQ ID NO: 247414 - protein, 6 aa, Mycobacterium
APDGSF

SEQ ID NO: 247415 - protein, 10 aa, Mycobacterium
APDGTTLTDP

SEQ ID NO: 247416 - protein, 7 aa, Mycobacterium
APDGVTG

SEQ ID NO: 247417 - protein, 19 aa, Mycobacterium
APDHAAPSTTTRRRIGKPA

SEQ ID NO: 247418 - protein, 6 aa, Mycobacterium
APDHPA

SEQ ID NO: 247419 - protein, 5 aa, Mycobacterium
APDIA

SEQ ID NO: 247420 - protein, 14 aa, Mycobacterium
APDIAREPTQPRRE

SEQ ID NO: 247421 - protein, 8 aa, Mycobacterium
APDIGPAP

SEQ ID NO: 247422 - protein, 5 aa, Mycobacterium
APDKK

SEQ ID NO: 247423 - protein, 11 aa, Mycobacterium
APDLAPRAPAR

SEQ ID NO: 247424 - protein, 7 aa, Mycobacterium
APDLRAD

SEQ ID NO: 247425 - protein, 7 aa, Mycobacterium
APDLRRR

SEQ ID NO: 247426 - protein, 26 aa, Mycobacterium
APDNPDTSVRQATEHMTATQGQSFTR

SEQ ID NO: 247427 - protein, 24 aa, Mycobacterium
APDPAPPRPPSHPPVPPRDPSNLA

SEQ ID NO: 247428 - protein, 14 aa, Mycobacterium
APDPATLPALDPDA

SEQ ID NO: 247429 - protein, 14 aa, Mycobacterium
APDPEQLGPPPRPP

SEQ ID NO: 247430 - protein, 9 aa, Mycobacterium
APDPRPSAV

SEQ ID NO: 247431 - protein, 27 aa, Mycobacterium
APDPSLAPAKSDTAADRLANNAAAGAI

SEQ ID NO: 247432 - protein, 14 aa, Mycobacterium
APDPTGASAFSGIA

SEQ ID NO: 247433 - protein, 20 aa, Mycobacterium
APDPTPAEDTDVAPAAASPV

SEQ ID NO: 247434 - protein, 6 aa, Mycobacterium
APDPVV

SEQ ID NO: 247435 - protein, 4 aa, Mycobacterium
APDQ

SEQ ID NO: 247436 - protein, 11 aa, Mycobacterium
APDQADSLSTD

SEQ ID NO: 247437 - protein, 6 aa, Mycobacterium
APDQHT

SEQ ID NO: 247438 - protein, 5 aa, Mycobacterium
APDRF

SEQ ID NO: 247439 - protein, 11 aa, Mycobacterium
APDRPQQRPEF

SEQ ID NO: 247440 - protein, 5 aa, Mycobacterium
APDSE

SEQ ID NO: 247441 - protein, 12 aa, Mycobacterium
APDSHGLTPSNA

SEQ ID NO: 247442 - protein, 8 aa, Mycobacterium
APDSTSPV

SEQ ID NO: 247443 - protein, 8 aa, Mycobacterium
APDTADAG

SEQ ID NO: 247444 - protein, 12 aa, Mycobacterium
APDTPPVPGDVS

SEQ ID NO: 247445 - protein, 11 aa, Mycobacterium
APDTTDPTVSA

SEQ ID NO: 247446 - protein, 8 aa, Mycobacterium
APDTTSPV

SEQ ID NO: 247447 - protein, 6 aa, Mycobacterium
APDTVG

SEQ ID NO: 247448 - protein, 4 aa, Mycobacterium
APDV

SEQ ID NO: 247449 - protein, 6 aa, Mycobacterium
APDVAA

SEQ ID NO: 247450 - protein, 8 aa, Mycobacterium
APDVDGNN

SEQ ID NO: 247451 - protein, 5 aa, Mycobacterium
APDVQ

SEQ ID NO: 247452 - protein, 14 aa, Mycobacterium
APEAAASDSPSAVP

SEQ ID NO: 247453 - protein, 8 aa, Mycobacterium
APEAEWRD

SEQ ID NO: 247454 - protein, 11 aa, Mycobacterium
APEAPSTARQT

SEQ ID NO: 247455 - protein, 5 aa, Mycobacterium
APEAR

SEQ ID NO: 247456 - protein, 5 aa, Mycobacterium
APECA

SEQ ID NO: 247457 - protein, 6 aa, Mycobacterium
APEDYH

SEQ ID NO: 247458 - protein, 5 aa, Mycobacterium
APEEV

SEQ ID NO: 247459 - protein, 15 aa, Mycobacterium
APEEVAPQEVSSDAR

SEQ ID NO: 247460 - protein, 4 aa, Mycobacterium
APEF

SEQ ID NO: 247461 - protein, 6 aa, Mycobacterium
APEGAE

SEQ ID NO: 247462 - protein, 12 aa, Mycobacterium
APEGKTVDDPAF

SEQ ID NO: 247463 - protein, 24 aa, Mycobacterium
APEHGPGMPEVSDGRAPSKPDEVA

SEQ ID NO: 247464 - protein, 23 aa, Mycobacterium
APEHPSAERLSASTPIRAQGVTT

SEQ ID NO: 247465 - protein, 4 aa, Mycobacterium
APEI

SEQ ID NO: 247466 - protein, 9 aa, Mycobacterium
APEKPKLPG

SEQ ID NO: 247467 - protein, 8 aa, Mycobacterium
APEKVGSA

SEQ ID NO: 247468 - protein, 4 aa, Mycobacterium
APEL

SEQ ID NO: 247469 - protein, 13 aa, Mycobacterium
APELSDADAGTAL

SEQ ID NO: 247470 - protein, 14 aa, Mycobacterium
APEPGEAGGTGAEQ

SEQ ID NO: 247471 - protein, 25 aa, Mycobacterium
APEPGPELPPEPDTSDISDNNPEQR

SEQ ID NO: 247472 - protein, 10 aa, Mycobacterium
APEPGTTPRT

SEQ ID NO: 247473 - protein, 12 aa, Mycobacterium
APEPPASADPTE

SEQ ID NO: 247474 - protein, 17 aa, Mycobacterium
APEPVGEADSDALEGAH

SEQ ID NO: 247475 - protein, 4 aa, Mycobacterium
APEQ

SEQ ID NO: 247476 - protein, 16 aa, Mycobacterium
APEQLTGKPLDGRADQ

SEQ ID NO: 247477 - protein, 16 aa, Mycobacterium
APEQLTGSNIDGRADQ

SEQ ID NO: 247478 - protein, 4 aa, Mycobacterium
APER

SEQ ID NO: 247479 - protein, 12 aa, Mycobacterium
APERADKRGTVG

SEQ ID NO: 247480 - protein, 6 aa, Mycobacterium
APERRA

SEQ ID NO: 247481 - protein, 10 aa, Mycobacterium
APERRGSTTV

SEQ ID NO: 247482 - protein, 10 aa, Mycobacterium
APERRRAATD

SEQ ID NO: 247483 - protein, 8 aa, Mycobacterium
APERTAEA

SEQ ID NO: 247484 - protein, 6 aa, Mycobacterium
APESAS

SEQ ID NO: 247485 - protein, 5 aa, Mycobacterium
APESL

SEQ ID NO: 247486 - protein, 8 aa, Mycobacterium
APESLDQD

SEQ ID NO: 247487 - protein, 7 aa, Mycobacterium
APESPAI

SEQ ID NO: 247488 - protein, 8 aa, Mycobacterium
APESPAIN

SEQ ID NO: 247489 - protein, 8 aa, Mycobacterium
APESRRGF

SEQ ID NO: 247490 - protein, 11 aa, Mycobacterium
APESSRHLSEE

SEQ ID NO: 247491 - protein, 6 aa, Mycobacterium
APESTF

SEQ ID NO: 247492 - protein, 14 aa, Mycobacterium
APESTGGAEQDPVT

SEQ ID NO: 247493 - protein, 9 aa, Mycobacterium
APETAQGKL

SEQ ID NO: 247494 - protein, 8 aa, Mycobacterium
APETEWRD

SEQ ID NO: 247495 - protein, 10 aa, Mycobacterium
APETKGRELE

SEQ ID NO: 247496 - protein, 5 aa, Mycobacterium
APETL

SEQ ID NO: 247497 - protein, 29 aa, Mycobacterium
APETSERDLDNVERASDSAPEPSEPVTKT

SEQ ID NO: 247498 - protein, 7 aa, Mycobacterium
APETWRG

SEQ ID NO: 247499 - protein, 18 aa, Mycobacterium
APEVEPPEPEFSEPEFPE

SEQ ID NO: 247500 - protein, 5 aa, Mycobacterium
APEVG

SEQ ID NO: 247501 - protein, 18 aa, Mycobacterium
APEVGTPEENPNAAGPGL

SEQ ID NO: 247502 - protein, 20 aa, Mycobacterium
APEVRAESTSPAPRPAPKLK

SEQ ID NO: 247503 - protein, 28 aa, Mycobacterium
APEVTPPVTETAPVEAPPAAPGATPSAI

SEQ ID NO: 247504 - protein, 14 aa, Mycobacterium
APFDDAAPGSGARR

SEQ ID NO: 247505 - protein, 14 aa, Mycobacterium
APFGARRPARLPPG

SEQ ID NO: 247506 - protein, 6 aa, Mycobacterium
APFPDA

SEQ ID NO: 247507 - protein, 13 aa, Mycobacterium
APFPGDSGQDDYA

SEQ ID NO: 247508 - protein, 8 aa, Mycobacterium
APFPTGNE

SEQ ID NO: 247509 - protein, 6 aa, Mycobacterium
APFQHT

SEQ ID NO: 247510 - protein, 6 aa, Mycobacterium
APFSSA

SEQ ID NO: 247511 - protein, 10 aa, Mycobacterium
APGAAEGLKR

SEQ ID NO: 247512 - protein, 6 aa, Mycobacterium
APGAAG

SEQ ID NO: 247513 - protein, 6 aa, Mycobacterium
APGAAP

SEQ ID NO: 247514 - protein, 5 aa, Mycobacterium
APGAD

SEQ ID NO: 247515 - protein, 20 aa, Mycobacterium
APGADGATGPGLEETADRPA

SEQ ID NO: 247516 - protein, 10 aa, Mycobacterium
APGADTIRPE

SEQ ID NO: 247517 - protein, 7 aa, Mycobacterium
APGAGRP

SEQ ID NO: 247518 - protein, 9 aa, Mycobacterium
APGAHPHEA

SEQ ID NO: 247519 - protein, 6 aa, Mycobacterium
APGAIR

SEQ ID NO: 247520 - protein, 5 aa, Mycobacterium
APGAL

SEQ ID NO: 247521 - protein, 8 aa, Mycobacterium
APGAPPLP

SEQ ID NO: 247522 - protein, 10 aa, Mycobacterium
APGAQYGGSF

SEQ ID NO: 247523 - protein, 11 aa, Mycobacterium
APGAQYGGSLT

SEQ ID NO: 247524 - protein, 6 aa, Mycobacterium
APGARC

SEQ ID NO: 247525 - protein, 12 aa, Mycobacterium
APGARCDQPVKP

SEQ ID NO: 247526 - protein, 11 aa, Mycobacterium
APGARCDQSVR

SEQ ID NO: 247527 - protein, 10 aa, Mycobacterium
APGASAATNA

SEQ ID NO: 247528 - protein, 14 aa, Mycobacterium
APGASENALAAPQA

SEQ ID NO: 247529 - protein, 17 aa, Mycobacterium
APGASSAPPPPPGRPSA

SEQ ID NO: 247530 - protein, 17 aa, Mycobacterium
APGASSAPTPPAGQPSA

SEQ ID NO: 247531 - protein, 6 aa, Mycobacterium
APGATG

SEQ ID NO: 247532 - protein, 17 aa, Mycobacterium
APGATSAPQPPAGQPSA

SEQ ID NO: 247533 - protein, 5 aa, Mycobacterium
APGAV

SEQ ID NO: 247534 - protein, 6 aa, Mycobacterium
APGAYD

SEQ ID NO: 247535 - protein, 30 aa, Mycobacterium
APGAYGSTAAPTEVGVDPDRHSGDRRGTQD

SEQ ID NO: 247536 - protein, 13 aa, Mycobacterium
APGDDGYSDDLPP

SEQ ID NO: 247537 - protein, 7 aa, Mycobacterium
APGDGRP

SEQ ID NO: 247538 - protein, 10 aa, Mycobacterium
APGDGTAGPW

SEQ ID NO: 247539 - protein, 11 aa, Mycobacterium
APGDPTPSAPS

SEQ ID NO: 247540 - protein, 37 aa, Mycobacterium
APGEDITSVSNDAAGGLANGTLNGEQQYDPLSGTGYA

SEQ ID NO: 247541 - protein, 5 aa, Mycobacterium
APGEL

SEQ ID NO: 247542 - protein, 5 aa, Mycobacterium
APGEQ

SEQ ID NO: 247543 - protein, 7 aa, Mycobacterium
APGEQVT

SEQ ID NO: 247544 - protein, 5 aa, Mycobacterium
APGER

SEQ ID NO: 247545 - protein, 6 aa, Mycobacterium
APGETL

SEQ ID NO: 247546 - protein, 14 aa, Mycobacterium
APGEVSAPQTAGAG

SEQ ID NO: 247547 - protein, 8 aa, Mycobacterium
APGFDAKE

SEQ ID NO: 247548 - protein, 9 aa, Mycobacterium
APGFDAKET

SEQ ID NO: 247549 - protein, 11 aa, Mycobacterium
APGFDAKETTI

SEQ ID NO: 247550 - protein, 6 aa, Mycobacterium
APGFGS

SEQ ID NO: 247551 - protein, 7 aa, Mycobacterium
APGGAAD

SEQ ID NO: 247552 - protein, 7 aa, Mycobacterium
APGGADS

SEQ ID NO: 247553 - protein, 6 aa, Mycobacterium
APGGAV

SEQ ID NO: 247554 - protein, 8 aa, Mycobacterium
APGGERMY

SEQ ID NO: 247555 - protein, 7 aa, Mycobacterium
APGGGKP

SEQ ID NO: 247556 - protein, 13 aa, Mycobacterium
APGGHPTTLPNPG

SEQ ID NO: 247557 - protein, 8 aa, Mycobacterium
APGGPADF

SEQ ID NO: 247558 - protein, 8 aa, Mycobacterium
APGGPPLP

SEQ ID NO: 247559 - protein, 20 aa, Mycobacterium
APGGPREPEQPTDAAATPRV

SEQ ID NO: 247560 - protein, 5 aa, Mycobacterium
APGGQ

SEQ ID NO: 247561 - protein, 7 aa, Mycobacterium
APGGRGL

SEQ ID NO: 247562 - protein, 11 aa, Mycobacterium
APGGTIDGDEA

SEQ ID NO: 247563 - protein, 14 aa, Mycobacterium
APGGTNSEQARRVG

SEQ ID NO: 247564 - protein, 14 aa, Mycobacterium
APGGTNSEQARTVG

SEQ ID NO: 247565 - protein, 7 aa, Mycobacterium
APGGVGT

SEQ ID NO: 247566 - protein, 9 aa, Mycobacterium
APGGVTNKA

SEQ ID NO: 247567 - protein, 5 aa, Mycobacterium
APGHE

SEQ ID NO: 247568 - protein, 12 aa, Mycobacterium
APGHPSHPAASG

SEQ ID NO: 247569 - protein, 24 aa, Mycobacterium
APGIAGGAEIAGRDPADPPERFGQ

SEQ ID NO: 247570 - protein, 5 aa, Mycobacterium
APGIG

SEQ ID NO: 247571 - protein, 6 aa, Mycobacterium
APGIGA

SEQ ID NO: 247572 - protein, 5 aa, Mycobacterium
APGLP

SEQ ID NO: 247573 - protein, 7 aa, Mycobacterium
APGLSEA

SEQ ID NO: 247574 - protein, 9 aa, Mycobacterium
APGNSGVTT

SEQ ID NO: 247575 - protein, 5 aa, Mycobacterium
APGPA

SEQ ID NO: 247576 - protein, 6 aa, Mycobacterium
APGPAH

SEQ ID NO: 247577 - protein, 6 aa, Mycobacterium
APGPDL

SEQ ID NO: 247578 - protein, 8 aa, Mycobacterium
APGPGLEH

SEQ ID NO: 247579 - protein, 19 aa, Mycobacterium
APGPHAAASDPTAPLTGTG

SEQ ID NO: 247580 - protein, 7 aa, Mycobacterium
APGPQMQ

SEQ ID NO: 247581 - protein, 11 aa, Mycobacterium
APGPQSPRDSH

SEQ ID NO: 247582 - protein, 6 aa, Mycobacterium
APGPVD

SEQ ID NO: 247583 - protein, 8 aa, Mycobacterium
APGQAART

SEQ ID NO: 247584 - protein, 18 aa, Mycobacterium
APGQEDIEVGSGVDADEL

SEQ ID NO: 247585 - protein, 6 aa, Mycobacterium
APGQSI

SEQ ID NO: 247586 - protein, 5 aa, Mycobacterium
APGRA

SEQ ID NO: 247587 - protein, 9 aa, Mycobacterium
APGRDATET

SEQ ID NO: 247588 - protein, 8 aa, Mycobacterium
APGRHPEN

SEQ ID NO: 247589 - protein, 6 aa, Mycobacterium
APGRPS

SEQ ID NO: 247590 - protein, 7 aa, Mycobacterium
APGRPTN

SEQ ID NO: 247591 - protein, 15 aa, Mycobacterium
APGRRSGRSQPELPE

SEQ ID NO: 247592 - protein, 7 aa, Mycobacterium
APGRRTD

SEQ ID NO: 247593 - protein, 18 aa, Mycobacterium
APGRVNADGLERAERSAD

SEQ ID NO: 247594 - protein, 7 aa, Mycobacterium
APGSDHE

SEQ ID NO: 247595 - protein, 6 aa, Mycobacterium
APGSKI

SEQ ID NO: 247596 - protein, 6 aa, Mycobacterium
APGSKL

SEQ ID NO: 247597 - protein, 5 aa, Mycobacterium
APGSR

SEQ ID NO: 247598 - protein, 15 aa, Mycobacterium
APGSTIPVERTEPSF

SEQ ID NO: 247599 - protein, 16 aa, Mycobacterium
APGSYDEANPTQQLPP

SEQ ID NO: 247600 - protein, 4 aa, Mycobacterium
APGT

SEQ ID NO: 247601 - protein, 34 aa, Mycobacterium
APGTDGGLKSGEYQPQPANAFDGNGNAVSGSITQ

SEQ ID NO: 247602 - protein, 15 aa, Mycobacterium
APGTDIESLSPRDDG

SEQ ID NO: 247603 - protein, 7 aa, Mycobacterium
APGTDRG

SEQ ID NO: 247604 - protein, 7 aa, Mycobacterium
APGTERA

SEQ ID NO: 247605 - protein, 5 aa, Mycobacterium
APGTG

SEQ ID NO: 247606 - protein, 8 aa, Mycobacterium
APGTGRLR

SEQ ID NO: 247607 - protein, 6 aa, Mycobacterium
APGTLE

SEQ ID NO: 247608 - protein, 9 aa, Mycobacterium
APGTPAPQV

SEQ ID NO: 247609 - protein, 13 aa, Mycobacterium
APGTPPGAIGPLT

SEQ ID NO: 247610 - protein, 12 aa, Mycobacterium
APGTPPVPGDVS

SEQ ID NO: 247611 - protein, 6 aa, Mycobacterium
APGVDT

SEQ ID NO: 247612 - protein, 7 aa, Mycobacterium
APGVGKT

SEQ ID NO: 247613 - protein, 6 aa, Mycobacterium
APGVNR

SEQ ID NO: 247614 - protein, 20 aa, Mycobacterium
APGVSAGPAATGTSRVTSAA

SEQ ID NO: 247615 - protein, 14 aa, Mycobacterium
APGVTPPKVAPDAD

SEQ ID NO: 247616 - protein, 5 aa, Mycobacterium
APGWP

SEQ ID NO: 247617 - protein, 4 aa, Mycobacterium
APGY

SEQ ID NO: 247618 - protein, 12 aa, Mycobacterium
APGYSRDNPVSN

SEQ ID NO: 247619 - protein, 9 aa, Mycobacterium
APHADAPAN

SEQ ID NO: 247620 - protein, 10 aa, Mycobacterium
APHDHPPPDD

SEQ ID NO: 247621 - protein, 7 aa, Mycobacterium
APHDQRV

SEQ ID NO: 247622 - protein, 6 aa, Mycobacterium
APHERG

SEQ ID NO: 247623 - protein, 11 aa, Mycobacterium
APHGAAAPVNH

SEQ ID NO: 247624 - protein, 9 aa, Mycobacterium
APHGEEGTA

SEQ ID NO: 247625 - protein, 11 aa, Mycobacterium
APHGLKPTALN

SEQ ID NO: 247626 - protein, 6 aa, Mycobacterium
APHGPI

SEQ ID NO: 247627 - protein, 11 aa, Mycobacterium
APHPEADTRPR

SEQ ID NO: 247628 - protein, 4 aa, Mycobacterium
APHR

SEQ ID NO: 247629 - protein, 5 aa, Mycobacterium
APHSQ

SEQ ID NO: 247630 - protein, 9 aa, Mycobacterium
APHTPPAPA

SEQ ID NO: 247631 - protein, 6 aa, Mycobacterium
APIAGG

SEQ ID NO: 247632 - protein, 5 aa, Mycobacterium
APIDS

SEQ ID NO: 247633 - protein, 8 aa, Mycobacterium
APIKTESR

SEQ ID NO: 247634 - protein, 20 aa, Mycobacterium
APIKTESRIDVPKSGQRVPA

SEQ ID NO: 247635 - protein, 13 aa, Mycobacterium
APIPADAAARSAS

SEQ ID NO: 247636 - protein, 9 aa, Mycobacterium
APIPAPTRA

SEQ ID NO: 247637 - protein, 7 aa, Mycobacterium
APIPEGD

SEQ ID NO: 247638 - protein, 5 aa, Mycobacterium
APIPG

SEQ ID NO: 247639 - protein, 11 aa, Mycobacterium
APISGKGHFDQ

SEQ ID NO: 247640 - protein, 9 aa, Mycobacterium
APISSSTVS

SEQ ID NO: 247641 - protein, 6 aa, Mycobacterium
APITES

SEQ ID NO: 247642 - protein, 15 aa, Mycobacterium
APKANTPQAQPERTA

SEQ ID NO: 247643 - protein, 11 aa, Mycobacterium
APKAPAGTPMD

SEQ ID NO: 247644 - protein, 9 aa, Mycobacterium
APKASAAVG

SEQ ID NO: 247645 - protein, 26 aa, Mycobacterium
APKATFPGHPAKPGERDDHPAYEMTN

SEQ ID NO: 247646 - protein, 18 aa, Mycobacterium
APKDDDRTQEKKPAPDLT

SEQ ID NO: 247647 - protein, 7 aa, Mycobacterium
APKERNV

SEQ ID NO: 247648 - protein, 5 aa, Mycobacterium
APKGI

SEQ ID NO: 247649 - protein, 27 aa, Mycobacterium
APKGPDGKPSIDAISDSDVSETWGSQI

SEQ ID NO: 247650 - protein, 14 aa, Mycobacterium
APKGRLPGRRATET

SEQ ID NO: 247651 - protein, 8 aa, Mycobacterium
APKGRQIR

SEQ ID NO: 247652 - protein, 5 aa, Mycobacterium
APKPG

SEQ ID NO: 247653 - protein, 8 aa, Mycobacterium
APKQPSRM

SEQ ID NO: 247654 - protein, 7 aa, Mycobacterium
APKQPTR

SEQ ID NO: 247655 - protein, 4 aa, Mycobacterium
APKR

SEQ ID NO: 247656 - protein, 12 aa, Mycobacterium
APKRGSDGSPHM

SEQ ID NO: 247657 - protein, 8 aa, Mycobacterium
APKRPKDI

SEQ ID NO: 247658 - protein, 8 aa, Mycobacterium
APKRPPKW

SEQ ID NO: 247659 - protein, 7 aa, Mycobacterium
APKRPSR

SEQ ID NO: 247660 - protein, 8 aa, Mycobacterium
APKRPSTW

SEQ ID NO: 247661 - protein, 6 aa, Mycobacterium
APKVAG

SEQ ID NO: 247662 - protein, 21 aa, Mycobacterium
APKVDPGVPPPSGSPGPVQPM

SEQ ID NO: 247663 - protein, 17 aa, Mycobacterium
APLAAGSGAAPIGAPVS

SEQ ID NO: 247664 - protein, 5 aa, Mycobacterium
APLAE

SEQ ID NO: 247665 - protein, 7 aa, Mycobacterium
APLAGAP

SEQ ID NO: 247666 - protein, 6 aa, Mycobacterium
APLAGT

SEQ ID NO: 247667 - protein, 25 aa, Mycobacterium
APLAPNRASADDRDLPSRNDPMSSA

SEQ ID NO: 247668 - protein, 5 aa, Mycobacterium
APLDA

SEQ ID NO: 247669 - protein, 12 aa, Mycobacterium
APLDDSADEARR

SEQ ID NO: 247670 - protein, 9 aa, Mycobacterium
APLETRRRP

SEQ ID NO: 247671 - protein, 5 aa, Mycobacterium
APLFS

SEQ ID NO: 247672 - protein, 56 aa, Mycobacterium
APLGDMTSREPVAPGGDDADVPPAAPDEADWSDGPDRPDGPDRQDGPDASHPPEHL

SEQ ID NO: 247673 - protein, 6 aa, Mycobacterium
APLGRD

SEQ ID NO: 247674 - protein, 5 aa, Mycobacterium
APLLP

SEQ ID NO: 247675 - protein, 4 aa, Mycobacterium
APLN

SEQ ID NO: 247676 - protein, 11 aa, Mycobacterium
APLPAEGGGAE

SEQ ID NO: 247677 - protein, 13 aa, Mycobacterium
APLPDGGEPEHPA

SEQ ID NO: 247678 - protein, 12 aa, Mycobacterium
APLPDGRDKAQH

SEQ ID NO: 247679 - protein, 22 aa, Mycobacterium
APLPGRPRAAPGPYRLPPPRPL

SEQ ID NO: 247680 - protein, 6 aa, Mycobacterium
APLPKR

SEQ ID NO: 247681 - protein, 6 aa, Mycobacterium
APLPPD

SEQ ID NO: 247682 - protein, 7 aa, Mycobacterium
APLPPDE

SEQ ID NO: 247683 - protein, 14 aa, Mycobacterium
APLPQGALGRTGKL

SEQ ID NO: 247684 - protein, 5 aa, Mycobacterium
APLPR

SEQ ID NO: 247685 - protein, 7 aa, Mycobacterium
APLPTQR

SEQ ID NO: 247686 - protein, 32 aa, Mycobacterium
APLPTSSAPEPSAAPSPRAAAPASPSLPAETV

SEQ ID NO: 247687 - protein, 5 aa, Mycobacterium
APLPW

SEQ ID NO: 247688 - protein, 14 aa, Mycobacterium
APLPYAEPATTQIS

SEQ ID NO: 247689 - protein, 8 aa, Mycobacterium
APLQSGSP

SEQ ID NO: 247690 - protein, 6 aa, Mycobacterium
APLREP

SEQ ID NO: 247691 - protein, 5 aa, Mycobacterium
APLRT

SEQ ID NO: 247692 - protein, 7 aa, Mycobacterium
APLSGQS

SEQ ID NO: 247693 - protein, 11 aa, Mycobacterium
APLSIGDDGMR

SEQ ID NO: 247694 - protein, 13 aa, Mycobacterium
APLSKPPAPTGQF

SEQ ID NO: 247695 - protein, 8 aa, Mycobacterium
APLSPGSD

SEQ ID NO: 247696 - protein, 6 aa, Mycobacterium
APLSRD

SEQ ID NO: 247697 - protein, 7 aa, Mycobacterium
APLSTIG

SEQ ID NO: 247698 - protein, 8 aa, Mycobacterium
APLTDGGP

SEQ ID NO: 247699 - protein, 6 aa, Mycobacterium
APLTES

SEQ ID NO: 247700 - protein, 5 aa, Mycobacterium
APLTS

SEQ ID NO: 247701 - protein, 6 aa, Mycobacterium
APLTTL

SEQ ID NO: 247702 - protein, 4 aa, Mycobacterium
APLY

SEQ ID NO: 247703 - protein, 12 aa, Mycobacterium
APLYSQASNTQL

SEQ ID NO: 247704 - protein, 12 aa, Mycobacterium
APLYTQASETQL

SEQ ID NO: 247705 - protein, 4 aa, Mycobacterium
APMP

SEQ ID NO: 247706 - protein, 5 aa, Mycobacterium
APMTQ

SEQ ID NO: 247707 - protein, 5 aa, Mycobacterium
APNAG

SEQ ID NO: 247708 - protein, 9 aa, Mycobacterium
APNDAPSTL

SEQ ID NO: 247709 - protein, 4 aa, Mycobacterium
APNG

SEQ ID NO: 247710 - protein, 7 aa, Mycobacterium
APNGMSD

SEQ ID NO: 247711 - protein, 4 aa, Mycobacterium
APNI

SEQ ID NO: 247712 - protein, 15 aa, Mycobacterium
APNKQAKVTNNTEVT

SEQ ID NO: 247713 - protein, 5 aa, Mycobacterium
APNNA

SEQ ID NO: 247714 - protein, 6 aa, Mycobacterium
APNPAA

SEQ ID NO: 247715 - protein, 7 aa, Mycobacterium
APNPAAQ

SEQ ID NO: 247716 - protein, 46 aa, Mycobacterium
APNPASNGVAAPVTAGPRPEAVETTPPPSGQPSDVPASAGPTGKPW

SEQ ID NO: 247717 - protein, 9 aa, Mycobacterium
APNPDAQEA

SEQ ID NO: 247718 - protein, 6 aa, Mycobacterium
APNPIP

SEQ ID NO: 247719 - protein, 8 aa, Mycobacterium
APNQDAQA

SEQ ID NO: 247720 - protein, 5 aa, Mycobacterium
APNQS

SEQ ID NO: 247721 - protein, 10 aa, Mycobacterium
APNRSHSNET

SEQ ID NO: 247722 - protein, 5 aa, Mycobacterium
APNSA

SEQ ID NO: 247723 - protein, 8 aa, Mycobacterium
APNSDNPV

SEQ ID NO: 247724 - protein, 5 aa, Mycobacterium
APNSM

SEQ ID NO: 247725 - protein, 8 aa, Mycobacterium
APNTPGHE

SEQ ID NO: 247726 - protein, 12 aa, Mycobacterium
APNTPPLPGDVS

SEQ ID NO: 247727 - protein, 11 aa, Mycobacterium
APNTPPVPEDV

SEQ ID NO: 247728 - protein, 7 aa, Mycobacterium
APNTTTR

SEQ ID NO: 247729 - protein, 16 aa, Mycobacterium
APNVPANGVGGGEGFA

SEQ ID NO: 247730 - protein, 4 aa, Mycobacterium
APPA

SEQ ID NO: 247731 - protein, 13 aa, Mycobacterium
APPAAGSAPGQLA

SEQ ID NO: 247732 - protein, 30 aa, Mycobacterium
APPADRAGAATQDMPVPRPAGYSKQRSTSV

SEQ ID NO: 247733 - protein, 11 aa, Mycobacterium
APPAEDGHDEY

SEQ ID NO: 247734 - protein, 8 aa, Mycobacterium
APPAGAVE

SEQ ID NO: 247735 - protein, 7 aa, Mycobacterium
APPAGRR

SEQ ID NO: 247736 - protein, 14 aa, Mycobacterium
APPAGWTPQDTERI

SEQ ID NO: 247737 - protein, 9 aa, Mycobacterium
APPANGGRY

SEQ ID NO: 247738 - protein, 7 aa, Mycobacterium
APPAPEW

SEQ ID NO: 247739 - protein, 10 aa, Mycobacterium
APPAPPAAPG

SEQ ID NO: 247740 - protein, 14 aa, Mycobacterium
APPAPPHPPSPDQS

SEQ ID NO: 247741 - protein, 14 aa, Mycobacterium
APPAPSPEDTGPRR

SEQ ID NO: 247742 - protein, 13 aa, Mycobacterium
APPAQTGGTAVTA

SEQ ID NO: 247743 - protein, 7 aa, Mycobacterium
APPARRG

SEQ ID NO: 247744 - protein, 8 aa, Mycobacterium
APPASKKA

SEQ ID NO: 247745 - protein, 13 aa, Mycobacterium
APPATVDAHSEHG

SEQ ID NO: 247746 - protein, 8 aa, Mycobacterium
APPAVRTD

SEQ ID NO: 247747 - protein, 7 aa, Mycobacterium
APPAWRT

SEQ ID NO: 247748 - protein, 6 aa, Mycobacterium
APPDAR

SEQ ID NO: 247749 - protein, 11 aa, Mycobacterium
APPDAVSATAV

SEQ ID NO: 247750 - protein, 12 aa, Mycobacterium
APPDGWTPEDTE

SEQ ID NO: 247751 - protein, 6 aa, Mycobacterium
APPDRL

SEQ ID NO: 247752 - protein, 4 aa, Mycobacterium
APPE

SEQ ID NO: 247753 - protein, 5 aa, Mycobacterium
APPEI

SEQ ID NO: 247754 - protein, 5 aa, Mycobacterium
APPEL

SEQ ID NO: 247755 - protein, 6 aa, Mycobacterium
APPELA

SEQ ID NO: 247756 - protein, 11 aa, Mycobacterium
APPEVPRATPV

SEQ ID NO: 247757 - protein, 15 aa, Mycobacterium
APPFDRPGAGARRGA

SEQ ID NO: 247758 - protein, 8 aa, Mycobacterium
APPFQDSN

SEQ ID NO: 247759 - protein, 8 aa, Mycobacterium
APPFSHSN

SEQ ID NO: 247760 - protein, 23 aa, Mycobacterium
APPGAAMPTVTESPGATTTVNND

SEQ ID NO: 247761 - protein, 57 aa, Mycobacterium
APPGAPAAPPPMPPHPPAPPSPARPPSQSSPTPPTPELPAASAPAASEGEEQPKSRG

SEQ ID NO: 247762 - protein, 6 aa, Mycobacterium
APPGDR

SEQ ID NO: 247763 - protein, 9 aa, Mycobacterium
APPGGEHRR

SEQ ID NO: 247764 - protein, 16 aa, Mycobacterium
APPGGTPPPGSPPPPL

SEQ ID NO: 247765 - protein, 6 aa, Mycobacterium
APPGMN

SEQ ID NO: 247766 - protein, 6 aa, Mycobacterium
APPGMT

SEQ ID NO: 247767 - protein, 12 aa, Mycobacterium
APPGVPGPRGIE

SEQ ID NO: 247768 - protein, 5 aa, Mycobacterium
APPHD

SEQ ID NO: 247769 - protein, 5 aa, Mycobacterium
APPHI

SEQ ID NO: 247770 - protein, 6 aa, Mycobacterium
APPHPS

SEQ ID NO: 247771 - protein, 5 aa, Mycobacterium
APPHQ

SEQ ID NO: 247772 - protein, 5 aa, Mycobacterium
APPHT

SEQ ID NO: 247773 - protein, 5 aa, Mycobacterium
APPIQ

SEQ ID NO: 247774 - protein, 8 aa, Mycobacterium
APPKRKGI

SEQ ID NO: 247775 - protein, 6 aa, Mycobacterium
APPKRR

SEQ ID NO: 247776 - protein, 6 aa, Mycobacterium
APPLAS

SEQ ID NO: 247777 - protein, 4 aa, Mycobacterium
APPP

SEQ ID NO: 247778 - protein, 5 aa, Mycobacterium
APPPA

SEQ ID NO: 247779 - protein, 7 aa, Mycobacterium
APPPEDS

SEQ ID NO: 247780 - protein, 13 aa, Mycobacterium
APPPGDPNKPVAP

SEQ ID NO: 247781 - protein, 8 aa, Mycobacterium
APPPGLGP

SEQ ID NO: 247782 - protein, 24 aa, Mycobacterium
APPPGPGALRGPMPGGPPPMPVPP

SEQ ID NO: 247783 - protein, 5 aa, Mycobacterium
APPPL

SEQ ID NO: 247784 - protein, 5 aa, Mycobacterium
APPPP

SEQ ID NO: 247785 - protein, 17 aa, Mycobacterium
APPPPGPAFRTQQEAPV

SEQ ID NO: 247786 - protein, 13 aa, Mycobacterium
APPPPIGERRPEL

SEQ ID NO: 247787 - protein, 10 aa, Mycobacterium
APPPPPGAPA

SEQ ID NO: 247788 - protein, 15 aa, Mycobacterium
APPPPPGAPPADNPP

SEQ ID NO: 247789 - protein, 11 aa, Mycobacterium
APPPPPGTPPQ

SEQ ID NO: 247790 - protein, 8 aa, Mycobacterium
APPPPVTE

SEQ ID NO: 247791 - protein, 19 aa, Mycobacterium
APPPQAAPPPQVAAPEPKI

SEQ ID NO: 247792 - protein, 15 aa, Mycobacterium
APPPTPSDEKSAGVQ

SEQ ID NO: 247793 - protein, 13 aa, Mycobacterium
APPPTPSRPDSAG

SEQ ID NO: 247794 - protein, 21 aa, Mycobacterium
APPQESNDATGGTTESGISDG

SEQ ID NO: 247795 - protein, 8 aa, Mycobacterium
APPQETSV

SEQ ID NO: 247796 - protein, 11 aa, Mycobacterium
APPQPPVHPGP

SEQ ID NO: 247797 - protein, 6 aa, Mycobacterium
APPQSM

SEQ ID NO: 247798 - protein, 4 aa, Mycobacterium
APPR

SEQ ID NO: 247799 - protein, 16 aa, Mycobacterium
APPREPAVESATSGDD

SEQ ID NO: 247800 - protein, 36 aa, Mycobacterium
APPRGLDVSPQAVAAAKGAPATRANPADPPKPPKQI

SEQ ID NO: 247801 - protein, 17 aa, Mycobacterium
APPRHTERREAGGISGA

SEQ ID NO: 247802 - protein, 7 aa, Mycobacterium
APPRPSI

SEQ ID NO: 247803 - protein, 8 aa, Mycobacterium
APPRRRDR

SEQ ID NO: 247804 - protein, 8 aa, Mycobacterium
APPSSERA

SEQ ID NO: 247805 - protein, 10 aa, Mycobacterium
APPTAAPAPV

SEQ ID NO: 247806 - protein, 10 aa, Mycobacterium
APPTADSPPL

SEQ ID NO: 247807 - protein, 7 aa, Mycobacterium
APPTEIA

SEQ ID NO: 247808 - protein, 13 aa, Mycobacterium
APPTGPPVRSGAD

SEQ ID NO: 247809 - protein, 9 aa, Mycobacterium
APPTGTAAS

SEQ ID NO: 247810 - protein, 7 aa, Mycobacterium
APPTLSP

SEQ ID NO: 247811 - protein, 5 aa, Mycobacterium
APPTM

SEQ ID NO: 247812 - protein, 11 aa, Mycobacterium
APPTPPAPTHT

SEQ ID NO: 247813 - protein, 9 aa, Mycobacterium
APPTTESPA

SEQ ID NO: 247814 - protein, 13 aa, Mycobacterium
APPTTQPSPPAAK

SEQ ID NO: 247815 - protein, 67 aa, Mycobacterium
APPVPGTANSALPVTPPPGVNQSPLAPVAPKPGSPPPPPPAPGPLPAEAAPASFGGNVGPVGSEQER

SEQ ID NO: 247816 - protein, 6 aa, Mycobacterium
APPVQA

SEQ ID NO: 247817 - protein, 4 aa, Mycobacterium
APPW

SEQ ID NO: 247818 - protein, 6 aa, Mycobacterium
APPYQH

SEQ ID NO: 247819 - protein, 8 aa, Mycobacterium
APPYRADS

SEQ ID NO: 247820 - protein, 10 aa, Mycobacterium
APQAAPAPPI

SEQ ID NO: 247821 - protein, 10 aa, Mycobacterium
APQAAQGTVE

SEQ ID NO: 247822 - protein, 6 aa, Mycobacterium
APQAIA

SEQ ID NO: 247823 - protein, 45 aa, Mycobacterium
APQAPSPPNTGPPPPSAPAPAPPEAPTPDAPQAPAPSPPQSGDHP

SEQ ID NO: 247824 - protein, 6 aa, Mycobacterium
APQAVA

SEQ ID NO: 247825 - protein, 24 aa, Mycobacterium
APQDGEVDDTQPARAVETDGQNPA

SEQ ID NO: 247826 - protein, 9 aa, Mycobacterium
APQDKGPWG

SEQ ID NO: 247827 - protein, 8 aa, Mycobacterium
APQDSPLA

SEQ ID NO: 247828 - protein, 6 aa, Mycobacterium
APQDSV

SEQ ID NO: 247829 - protein, 5 aa, Mycobacterium
APQEA

SEQ ID NO: 247830 - protein, 6 aa, Mycobacterium
APQEFA

SEQ ID NO: 247831 - protein, 4 aa, Mycobacterium
APQF

SEQ ID NO: 247832 - protein, 8 aa, Mycobacterium
APQGAFGA

SEQ ID NO: 247833 - protein, 28 aa, Mycobacterium
APQGCFTGNDDPDPQRRDIREQAQARLD

SEQ ID NO: 247834 - protein, 27 aa, Mycobacterium
APQGISPMPRPMPATPAFPPPAGPPPV

SEQ ID NO: 247835 - protein, 5 aa, Mycobacterium
APQGL

SEQ ID NO: 247836 - protein, 13 aa, Mycobacterium
APQGLRNAARMRV

SEQ ID NO: 247837 - protein, 14 aa, Mycobacterium
APQGRTGDVCCYTF

SEQ ID NO: 247838 - protein, 15 aa, Mycobacterium
APQGSTGLTKTGATA

SEQ ID NO: 247839 - protein, 6 aa, Mycobacterium
APQGSW

SEQ ID NO: 247840 - protein, 6 aa, Mycobacterium
APQKTR

SEQ ID NO: 247841 - protein, 5 aa, Mycobacterium
APQLD

SEQ ID NO: 247842 - protein, 4 aa, Mycobacterium
APQM

SEQ ID NO: 247843 - protein, 5 aa, Mycobacterium
APQPA

SEQ ID NO: 247844 - protein, 8 aa, Mycobacterium
APQPAVSA

SEQ ID NO: 247845 - protein, 17 aa, Mycobacterium
APQPGTDAAMPTKGDPW

SEQ ID NO: 247846 - protein, 6 aa, Mycobacterium
APQPIA

SEQ ID NO: 247847 - protein, 26 aa, Mycobacterium
APQPPGPLPAPGPALAPPPEAPPAQG

SEQ ID NO: 247848 - protein, 8 aa, Mycobacterium
APQPQLAA

SEQ ID NO: 247849 - protein, 17 aa, Mycobacterium
APQQAGYQPGPPPGPAP

SEQ ID NO: 247850 - protein, 5 aa, Mycobacterium
APQQV

SEQ ID NO: 247851 - protein, 6 aa, Mycobacterium
APQRPR

SEQ ID NO: 247852 - protein, 6 aa, Mycobacterium
APQRPS

SEQ ID NO: 247853 - protein, 6 aa, Mycobacterium
APQRRR

SEQ ID NO: 247854 - protein, 12 aa, Mycobacterium
APQRRSERREAL

SEQ ID NO: 247855 - protein, 26 aa, Mycobacterium
APQSAVPAKPVAVPPAPKPKDTTPRN

SEQ ID NO: 247856 - protein, 8 aa, Mycobacterium
APQSPNGT

SEQ ID NO: 247857 - protein, 9 aa, Mycobacterium
APQSREAAA

SEQ ID NO: 247858 - protein, 23 aa, Mycobacterium
APQTASPPAGLESSGTDRASRKS

SEQ ID NO: 247859 - protein, 5 aa, Mycobacterium
APQTI

SEQ ID NO: 247860 - protein, 4 aa, Mycobacterium
APQV

SEQ ID NO: 247861 - protein, 15 aa, Mycobacterium
APQVGDGADAGGATL

SEQ ID NO: 247862 - protein, 7 aa, Mycobacterium
APQYTDK

SEQ ID NO: 247863 - protein, 5 aa, Mycobacterium
APRAA

SEQ ID NO: 247864 - protein, 15 aa, Mycobacterium
APRAASADAGPGYAE

SEQ ID NO: 247865 - protein, 10 aa, Mycobacterium
APRAEPGLGT

SEQ ID NO: 247866 - protein, 9 aa, Mycobacterium
APRAETGLG

SEQ ID NO: 247867 - protein, 22 aa, Mycobacterium
APRAPIKTESRIDVPKDGQRVP

SEQ ID NO: 247868 - protein, 5 aa, Mycobacterium
APRAQ

SEQ ID NO: 247869 - protein, 6 aa, Mycobacterium
APRDAT

SEQ ID NO: 247870 - protein, 11 aa, Mycobacterium
APRDAVDSGAC

SEQ ID NO: 247871 - protein, 19 aa, Mycobacterium
APRDGGRLDPASTSPDGTH

SEQ ID NO: 247872 - protein, 11 aa, Mycobacterium
APRDGRTPRNL

SEQ ID NO: 247873 - protein, 5 aa, Mycobacterium
APRDV

SEQ ID NO: 247874 - protein, 14 aa, Mycobacterium
APRDVGGTAVYDLQ

SEQ ID NO: 247875 - protein, 11 aa, Mycobacterium
APREAVDSGAC

SEQ ID NO: 247876 - protein, 14 aa, Mycobacterium
APRERGPEPSVPRD

SEQ ID NO: 247877 - protein, 15 aa, Mycobacterium
APRERSAEPSTPQDD

SEQ ID NO: 247878 - protein, 9 aa, Mycobacterium
APRKSAEIG

SEQ ID NO: 247879 - protein, 5 aa, Mycobacterium
APRNQ

SEQ ID NO: 247880 - protein, 7 aa, Mycobacterium
APRPAVA

SEQ ID NO: 247881 - protein, 8 aa, Mycobacterium
APRPDASF

SEQ ID NO: 247882 - protein, 11 aa, Mycobacterium
APRPDASYADI

SEQ ID NO: 247883 - protein, 9 aa, Mycobacterium
APRPDATVS

SEQ ID NO: 247884 - protein, 7 aa, Mycobacterium
APRPGGM

SEQ ID NO: 247885 - protein, 19 aa, Mycobacterium
APRPGGRMDPDSTSPEGAR

SEQ ID NO: 247886 - protein, 19 aa, Mycobacterium
APRPGGTMDPESTSGSGAR

SEQ ID NO: 247887 - protein, 24 aa, Mycobacterium
APRPGRARVGDYSDDYSDNYSDNY

SEQ ID NO: 247888 - protein, 12 aa, Mycobacterium
APRPKVERGASL

SEQ ID NO: 247889 - protein, 23 aa, Mycobacterium
APRPLEPSTLDNPRIVEDMRHGY

SEQ ID NO: 247890 - protein, 7 aa, Mycobacterium
APRPPLG

SEQ ID NO: 247891 - protein, 7 aa, Mycobacterium
APRPQLT

SEQ ID NO: 247892 - protein, 12 aa, Mycobacterium
APRPQVERGASI

SEQ ID NO: 247893 - protein, 12 aa, Mycobacterium
APRPQVERGTPV

SEQ ID NO: 247894 - protein, 12 aa, Mycobacterium
APRPQVKHGASV

SEQ ID NO: 247895 - protein, 15 aa, Mycobacterium
APRPRTGPAEVAAPA

SEQ ID NO: 247896 - protein, 6 aa, Mycobacterium
APRPTV

SEQ ID NO: 247897 - protein, 50 aa, Mycobacterium
APRPVDRPPVDPASQRAFGRPSGVSGSFQGADKYRDQGEYTPRVGPPDPV

SEQ ID NO: 247898 - protein, 23 aa, Mycobacterium
APRPVEPSTLDNPRIVEDMRHGY

SEQ ID NO: 247899 - protein, 8 aa, Mycobacterium
APRPWQGP

SEQ ID NO: 247900 - protein, 15 aa, Mycobacterium
APRQRSEQSSSHPAG

SEQ ID NO: 247901 - protein, 4 aa, Mycobacterium
APRR

SEQ ID NO: 247902 - protein, 15 aa, Mycobacterium
APRRAAEPVGVAVGC

SEQ ID NO: 247903 - protein, 7 aa, Mycobacterium
APRRASA

SEQ ID NO: 247904 - protein, 6 aa, Mycobacterium
APRRPR

SEQ ID NO: 247905 - protein, 8 aa, Mycobacterium
APRSARAA

SEQ ID NO: 247906 - protein, 7 aa, Mycobacterium
APRSASI

SEQ ID NO: 247907 - protein, 15 aa, Mycobacterium
APRSERRSSPEPAPE

SEQ ID NO: 247908 - protein, 6 aa, Mycobacterium
APRSGI

SEQ ID NO: 247909 - protein, 8 aa, Mycobacterium
APRSTTAR

SEQ ID NO: 247910 - protein, 29 aa, Mycobacterium
APRTAAERARQATVQAAPPKTDAEWSGET

SEQ ID NO: 247911 - protein, 13 aa, Mycobacterium
APRTGQGPQGVPV

SEQ ID NO: 247912 - protein, 14 aa, Mycobacterium
APRTMAAPPGSPVP

SEQ ID NO: 247913 - protein, 8 aa, Mycobacterium
APRTRSNL

SEQ ID NO: 247914 - protein, 8 aa, Mycobacterium
APRYPGEP

SEQ ID NO: 247915 - protein, 8 aa, Mycobacterium
APSAAASD

SEQ ID NO: 247916 - protein, 5 aa, Mycobacterium
APSAG

SEQ ID NO: 247917 - protein, 9 aa, Mycobacterium
APSAKDSDW

SEQ ID NO: 247918 - protein, 10 aa, Mycobacterium
APSAPETPAV

SEQ ID NO: 247919 - protein, 16 aa, Mycobacterium
APSAPSAITPPAVDPD

SEQ ID NO: 247920 - protein, 6 aa, Mycobacterium
APSAQD

SEQ ID NO: 247921 - protein, 15 aa, Mycobacterium
APSAQTGTTAQTAAD

SEQ ID NO: 247922 - protein, 10 aa, Mycobacterium
APSARAHPRT

SEQ ID NO: 247923 - protein, 16 aa, Mycobacterium
APSASTGSTAQSAADY

SEQ ID NO: 247924 - protein, 6 aa, Mycobacterium
APSAVT

SEQ ID NO: 247925 - protein, 4 aa, Mycobacterium
APSD

SEQ ID NO: 247926 - protein, 12 aa, Mycobacterium
APSDDAPGTDPV

SEQ ID NO: 247927 - protein, 6 aa, Mycobacterium
APSDYK

SEQ ID NO: 247928 - protein, 7 aa, Mycobacterium
APSEDAR

SEQ ID NO: 247929 - protein, 15 aa, Mycobacterium
APSELAGNGDPPDAH

SEQ ID NO: 247930 - protein, 6 aa, Mycobacterium
APSESA

SEQ ID NO: 247931 - protein, 4 aa, Mycobacterium
APSG

SEQ ID NO: 247932 - protein, 6 aa, Mycobacterium
APSGEP

SEQ ID NO: 247933 - protein, 5 aa, Mycobacterium
APSGH

SEQ ID NO: 247934 - protein, 12 aa, Mycobacterium
APSGLAAGGAAA

SEQ ID NO: 247935 - protein, 8 aa, Mycobacterium
APSGLAIG

SEQ ID NO: 247936 - protein, 22 aa, Mycobacterium
APSGPAPAQGWDQRPAARPPAG

SEQ ID NO: 247937 - protein, 6 aa, Mycobacterium
APSGPV

SEQ ID NO: 247938 - protein, 12 aa, Mycobacterium
APSGTASSLPAT

SEQ ID NO: 247939 - protein, 7 aa, Mycobacterium
APSGTTV

SEQ ID NO: 247940 - protein, 10 aa, Mycobacterium
APSLDQDALP

SEQ ID NO: 247941 - protein, 5 aa, Mycobacterium
APSLQ

SEQ ID NO: 247942 - protein, 5 aa, Mycobacterium
APSMA

SEQ ID NO: 247943 - protein, 6 aa, Mycobacterium
APSNET

SEQ ID NO: 247944 - protein, 6 aa, Mycobacterium
APSNIG

SEQ ID NO: 247945 - protein, 8 aa, Mycobacterium
APSNRSLG

SEQ ID NO: 247946 - protein, 5 aa, Mycobacterium
APSPA

SEQ ID NO: 247947 - protein, 15 aa, Mycobacterium
APSPAGPEEDQAPSA

SEQ ID NO: 247948 - protein, 6 aa, Mycobacterium
APSPDT

SEQ ID NO: 247949 - protein, 11 aa, Mycobacterium
APSPKTTAPVV

SEQ ID NO: 247950 - protein, 5 aa, Mycobacterium
APSPL

SEQ ID NO: 247951 - protein, 6 aa, Mycobacterium
APSPML

SEQ ID NO: 247952 - protein, 12 aa, Mycobacterium
APSPVRGAPPEE

SEQ ID NO: 247953 - protein, 8 aa, Mycobacterium
APSQERLP

SEQ ID NO: 247954 - protein, 19 aa, Mycobacterium
APSQESSIKSFNPGEQVTT

SEQ ID NO: 247955 - protein, 8 aa, Mycobacterium
APSRNGGD

SEQ ID NO: 247956 - protein, 8 aa, Mycobacterium
APSRNGSD

SEQ ID NO: 247957 - protein, 7 aa, Mycobacterium
APSRNRT

SEQ ID NO: 247958 - protein, 5 aa, Mycobacterium
APSSL

SEQ ID NO: 247959 - protein, 22 aa, Mycobacterium
APSSLGQGVSNRHASSALHPSD

SEQ ID NO: 247960 - protein, 8 aa, Mycobacterium
APSSRIDN

SEQ ID NO: 247961 - protein, 9 aa, Mycobacterium
APSSSFPSG

SEQ ID NO: 247962 - protein, 20 aa, Mycobacterium
APSSTTPAPEGQDSAIPYTA

SEQ ID NO: 247963 - protein, 4 aa, Mycobacterium
APST

SEQ ID NO: 247964 - protein, 12 aa, Mycobacterium
APSTGPDNRAPQ

SEQ ID NO: 247965 - protein, 18 aa, Mycobacterium
APSTRGATFGSGDPARRV

SEQ ID NO: 247966 - protein, 9 aa, Mycobacterium
APSTTRPTF

SEQ ID NO: 247967 - protein, 4 aa, Mycobacterium
APSV

SEQ ID NO: 247968 - protein, 6 aa, Mycobacterium
APSVAT

SEQ ID NO: 247969 - protein, 46 aa, Mycobacterium
APSVNNGMNPAPADKLPPGGTPPPISDPLQRPGSGTVQCNGQQPNP

SEQ ID NO: 247970 - protein, 6 aa, Mycobacterium
APSVPG

SEQ ID NO: 247971 - protein, 5 aa, Mycobacterium
APSVS

SEQ ID NO: 247972 - protein, 16 aa, Mycobacterium
APSVTNPPPAALAATT

SEQ ID NO: 247973 - protein, 5 aa, Mycobacterium
APSYE

SEQ ID NO: 247974 - protein, 18 aa, Mycobacterium
APSYGQAEEAEPELPGVT

SEQ ID NO: 247975 - protein, 9 aa, Mycobacterium
APTAASDRL

SEQ ID NO: 247976 - protein, 6 aa, Mycobacterium
APTADQ

SEQ ID NO: 247977 - protein, 11 aa, Mycobacterium
APTADRVQSRL

SEQ ID NO: 247978 - protein, 17 aa, Mycobacterium
APTAEHDLAEPDRGAPT

SEQ ID NO: 247979 - protein, 12 aa, Mycobacterium
APTAGGHGSRTE

SEQ ID NO: 247980 - protein, 5 aa, Mycobacterium
APTAI

SEQ ID NO: 247981 - protein, 27 aa, Mycobacterium
APTAPTATPACTDEQPTPRSNTDRAQL

SEQ ID NO: 247982 - protein, 6 aa, Mycobacterium
APTATP

SEQ ID NO: 247983 - protein, 6 aa, Mycobacterium
APTAVG

SEQ ID NO: 247984 - protein, 6 aa, Mycobacterium
APTAVV

SEQ ID NO: 247985 - protein, 6 aa, Mycobacterium
APTDAR

SEQ ID NO: 247986 - protein, 9 aa, Mycobacterium
APTDRDCSP

SEQ ID NO: 247987 - protein, 4 aa, Mycobacterium
APTE

SEQ ID NO: 247988 - protein, 14 aa, Mycobacterium
APTEAPKEPKFERR

SEQ ID NO: 247989 - protein, 17 aa, Mycobacterium
APTEEQARAFDSTASVI

SEQ ID NO: 247990 - protein, 7 aa, Mycobacterium
APTEGRL

SEQ ID NO: 247991 - protein, 5 aa, Mycobacterium
APTEL

SEQ ID NO: 247992 - protein, 6 aa, Mycobacterium
APTEPK

SEQ ID NO: 247993 - protein, 46 aa, Mycobacterium
APTFGRDQHGYGRTHGSAGRGPVGCGGARPSVRRSAAASGGGAHED

SEQ ID NO: 247994 - protein, 4 aa, Mycobacterium
APTG

SEQ ID NO: 247995 - protein, 6 aa, Mycobacterium
APTGGM

SEQ ID NO: 247996 - protein, 6 aa, Mycobacterium
APTGKL

SEQ ID NO: 247997 - protein, 24 aa, Mycobacterium
APTGPGAGPVPDYDAPAGLQADAD

SEQ ID NO: 247998 - protein, 15 aa, Mycobacterium
APTGRAQDWLWRRRR

SEQ ID NO: 247999 - protein, 12 aa, Mycobacterium
APTIATAPASVS

SEQ ID NO: 248000 - protein, 6 aa, Mycobacterium
APTKPE

SEQ ID NO: 248001 - protein, 11 aa, Mycobacterium
APTKQSSVPRR

SEQ ID NO: 248002 - protein, 5 aa, Mycobacterium
APTLA

SEQ ID NO: 248003 - protein, 11 aa, Mycobacterium
APTLRAQAAGQ

SEQ ID NO: 248004 - protein, 11 aa, Mycobacterium
APTLRAQAASQ

SEQ ID NO: 248005 - protein, 5 aa, Mycobacterium
APTLT

SEQ ID NO: 248006 - protein, 7 aa, Mycobacterium
APTPPLG

SEQ ID NO: 248007 - protein, 7 aa, Mycobacterium
APTPRPA

SEQ ID NO: 248008 - protein, 7 aa, Mycobacterium
APTPSLD

SEQ ID NO: 248009 - protein, 21 aa, Mycobacterium
APTPSRPTQHAATARPDLPRA

SEQ ID NO: 248010 - protein, 4 aa, Mycobacterium
APTQ

SEQ ID NO: 248011 - protein, 5 aa, Mycobacterium
APTQR

SEQ ID NO: 248012 - protein, 17 aa, Mycobacterium
APTQTLPAAAPLSAPEL

SEQ ID NO: 248013 - protein, 9 aa, Mycobacterium
APTRERPAG

SEQ ID NO: 248014 - protein, 8 aa, Mycobacterium
APTRGATT

SEQ ID NO: 248015 - protein, 6 aa, Mycobacterium
APTRGW

SEQ ID NO: 248016 - protein, 6 aa, Mycobacterium
APTRHS

SEQ ID NO: 248017 - protein, 6 aa, Mycobacterium
APTRKR

SEQ ID NO: 248018 - protein, 4 aa, Mycobacterium
APTS

SEQ ID NO: 248019 - protein, 12 aa, Mycobacterium
APTSAGDPSGTV

SEQ ID NO: 248020 - protein, 9 aa, Mycobacterium
APTSDDGYN

SEQ ID NO: 248021 - protein, 12 aa, Mycobacterium
APTSGWTNGRTT

SEQ ID NO: 248022 - protein, 36 aa, Mycobacterium
APTSQIPAQPVAATATPTTSMPASQHPESMRAPRRR

SEQ ID NO: 248023 - protein, 7 aa, Mycobacterium
APTSSAL

SEQ ID NO: 248024 - protein, 13 aa, Mycobacterium
APTTGASINPART

SEQ ID NO: 248025 - protein, 6 aa, Mycobacterium
APTTGP

SEQ ID NO: 248026 - protein, 13 aa, Mycobacterium
APTTKTLQSEKFQ

SEQ ID NO: 248027 - protein, 7 aa, Mycobacterium
APTTRRD

SEQ ID NO: 248028 - protein, 9 aa, Mycobacterium
APTTTDPTV

SEQ ID NO: 248029 - protein, 4 aa, Mycobacterium
APTV

SEQ ID NO: 248030 - protein, 17 aa, Mycobacterium
APTVEPTPQGTAAWRGA

SEQ ID NO: 248031 - protein, 6 aa, Mycobacterium
APTYGA

SEQ ID NO: 248032 - protein, 4 aa, Mycobacterium
APVA

SEQ ID NO: 248033 - protein, 17 aa, Mycobacterium
APVAANPQPKIQDALTP

SEQ ID NO: 248034 - protein, 6 aa, Mycobacterium
APVADA

SEQ ID NO: 248035 - protein, 5 aa, Mycobacterium
APVAQ

SEQ ID NO: 248036 - protein, 6 aa, Mycobacterium
APVDAA

SEQ ID NO: 248037 - protein, 11 aa, Mycobacterium
APVDGEATSIE

SEQ ID NO: 248038 - protein, 9 aa, Mycobacterium
APVDPGQQR

SEQ ID NO: 248039 - protein, 12 aa, Mycobacterium
APVDRPDTEGVT

SEQ ID NO: 248040 - protein, 9 aa, Mycobacterium
APVEGTPYR

SEQ ID NO: 248041 - protein, 10 aa, Mycobacterium
APVGATRQDW

SEQ ID NO: 248042 - protein, 7 aa, Mycobacterium
APVGDRS

SEQ ID NO: 248043 - protein, 9 aa, Mycobacterium
APVGSAPAV

SEQ ID NO: 248044 - protein, 4 aa, Mycobacterium
APVM

SEQ ID NO: 248045 - protein, 5 aa, Mycobacterium
APVNA

SEQ ID NO: 248046 - protein, 11 aa, Mycobacterium
APVNDDTAGAL

SEQ ID NO: 248047 - protein, 6 aa, Mycobacterium
APVPAH

SEQ ID NO: 248048 - protein, 7 aa, Mycobacterium
APVPAPA

SEQ ID NO: 248049 - protein, 5 aa, Mycobacterium
APVPG

SEQ ID NO: 248050 - protein, 6 aa, Mycobacterium
APVPGV

SEQ ID NO: 248051 - protein, 15 aa, Mycobacterium
APVPRQQPKAPAPRV

SEQ ID NO: 248052 - protein, 6 aa, Mycobacterium
APVPRR

SEQ ID NO: 248053 - protein, 30 aa, Mycobacterium
APVPSSSDEAGPVSAANAVADRPATEAPGT

SEQ ID NO: 248054 - protein, 50 aa, Mycobacterium
APVPTRTVTETSTPAQTTVTETATTTPPTTTTTTTAPPTTSTTVETSTSV

SEQ ID NO: 248055 - protein, 12 aa, Mycobacterium
APVQAPPRRPTI

SEQ ID NO: 248056 - protein, 21 aa, Mycobacterium
APVRDDDAQGHPRSGDPGKTQ

SEQ ID NO: 248057 - protein, 11 aa, Mycobacterium
APVRGPATDSL

SEQ ID NO: 248058 - protein, 26 aa, Mycobacterium
APVRQRSHDRPASLDNPRSPRRRAGI

SEQ ID NO: 248059 - protein, 11 aa, Mycobacterium
APVRSGRRGPE

SEQ ID NO: 248060 - protein, 4 aa, Mycobacterium
APVS

SEQ ID NO: 248061 - protein, 7 aa, Mycobacterium
APVSEQV

SEQ ID NO: 248062 - protein, 18 aa, Mycobacterium
APVSSAHATRIATDPAAN

SEQ ID NO: 248063 - protein, 4 aa, Mycobacterium
APVT

SEQ ID NO: 248064 - protein, 24 aa, Mycobacterium
APVTDGPVAEAPAEETDAETLSDS

SEQ ID NO: 248065 - protein, 6 aa, Mycobacterium
APVTGA

SEQ ID NO: 248066 - protein, 6 aa, Mycobacterium
APVTMP

SEQ ID NO: 248067 - protein, 9 aa, Mycobacterium
APVTPETDK

SEQ ID NO: 248068 - protein, 6 aa, Mycobacterium
APVTRS

SEQ ID NO: 248069 - protein, 9 aa, Mycobacterium
APWAGDGRL

SEQ ID NO: 248070 - protein, 8 aa, Mycobacterium
APWDAQPG

SEQ ID NO: 248071 - protein, 12 aa, Mycobacterium
APWDSADPAAPH

SEQ ID NO: 248072 - protein, 17 aa, Mycobacterium
APWGTQDPAGDRRGTQD

SEQ ID NO: 248073 - protein, 12 aa, Mycobacterium
APWTPPAGLPRR

SEQ ID NO: 248074 - protein, 19 aa, Mycobacterium
APYGPGSARADADGTGPQG

SEQ ID NO: 248075 - protein, 7 aa, Mycobacterium
APYGPLG

SEQ ID NO: 248076 - protein, 23 aa, Mycobacterium
APYTRRGERADGSLYPEDQPSRV

SEQ ID NO: 248077 - protein, 11 aa, Mycobacterium
AQAAAATTTAK

SEQ ID NO: 248078 - protein, 16 aa, Mycobacterium
AQAAASTITAAEDPDI

SEQ ID NO: 248079 - protein, 6 aa, Mycobacterium
AQAAGG

SEQ ID NO: 248080 - protein, 6 aa, Mycobacterium
AQAAGL

SEQ ID NO: 248081 - protein, 11 aa, Mycobacterium
AQAAGSATNCA

SEQ ID NO: 248082 - protein, 8 aa, Mycobacterium
AQAAHGEQ

SEQ ID NO: 248083 - protein, 7 aa, Mycobacterium
AQAANGA

SEQ ID NO: 248084 - protein, 32 aa, Mycobacterium
AQAAPAPRFSRTPAPTPGKPPQGSTSIEDIGW

SEQ ID NO: 248085 - protein, 9 aa, Mycobacterium
AQAAQQRAA

SEQ ID NO: 248086 - protein, 9 aa, Mycobacterium
AQAARRSCL

SEQ ID NO: 248087 - protein, 5 aa, Mycobacterium
AQAAT

SEQ ID NO: 248088 - protein, 6 aa, Mycobacterium
AQAATL

SEQ ID NO: 248089 - protein, 7 aa, Mycobacterium
AQADPKK

SEQ ID NO: 248090 - protein, 8 aa, Mycobacterium
AQADQAAV

SEQ ID NO: 248091 - protein, 21 aa, Mycobacterium
AQADSRPPARSQGPRREPVAP

SEQ ID NO: 248092 - protein, 9 aa, Mycobacterium
AQADSWGGL

SEQ ID NO: 248093 - protein, 8 aa, Mycobacterium
AQADTLSA

SEQ ID NO: 248094 - protein, 8 aa, Mycobacterium
AQADYEEA

SEQ ID NO: 248095 - protein, 14 aa, Mycobacterium
AQAEAARDMLAKLA

SEQ ID NO: 248096 - protein, 8 aa, Mycobacterium
AQAEAVRA

SEQ ID NO: 248097 - protein, 6 aa, Mycobacterium
AQAELS

SEQ ID NO: 248098 - protein, 7 aa, Mycobacterium
AQAENPG

SEQ ID NO: 248099 - protein, 6 aa, Mycobacterium
AQAEPA

SEQ ID NO: 248100 - protein, 8 aa, Mycobacterium
AQAESLGN

SEQ ID NO: 248101 - protein, 4 aa, Mycobacterium
AQAG

SEQ ID NO: 248102 - protein, 5 aa, Mycobacterium
AQAGS

SEQ ID NO: 248103 - protein, 12 aa, Mycobacterium
AQAGSDEDDEGF

SEQ ID NO: 248104 - protein, 18 aa, Mycobacterium
AQAGTDTSGLGDPPPHLP

SEQ ID NO: 248105 - protein, 17 aa, Mycobacterium
AQAGVEAERIKSQGGRQ

SEQ ID NO: 248106 - protein, 8 aa, Mycobacterium
AQAHESAN

SEQ ID NO: 248107 - protein, 10 aa, Mycobacterium
AQAIPPPSVD

SEQ ID NO: 248108 - protein, 6 aa, Mycobacterium
AQALTG

SEQ ID NO: 248109 - protein, 7 aa, Mycobacterium
AQALTGL

SEQ ID NO: 248110 - protein, 10 aa, Mycobacterium
AQALTGLGEN

SEQ ID NO: 248111 - protein, 8 aa, Mycobacterium
AQANESVD

SEQ ID NO: 248112 - protein, 12 aa, Mycobacterium
AQANNASLASCT

SEQ ID NO: 248113 - protein, 7 aa, Mycobacterium
AQAPRPA

SEQ ID NO: 248114 - protein, 81 aa, Mycobacterium
AQAPSNQSTTAPEMPPNNQHLPGQQPVVTQPQQPPQPQQAPQQQPPAPQAPPPPADNGAPPANPAPEAPPPPAPPAEPPPG

SEQ ID NO: 248115 - protein, 27 aa, Mycobacterium
AQAPTPGPPPPAPTAPPVSDAALGGGM

SEQ ID NO: 248116 - protein, 12 aa, Mycobacterium
AQAQAAESGMAL

SEQ ID NO: 248117 - protein, 18 aa, Mycobacterium
AQAQATESGSALDSSNSV

SEQ ID NO: 248118 - protein, 11 aa, Mycobacterium
AQAQKADAQRL

SEQ ID NO: 248119 - protein, 11 aa, Mycobacterium
AQAQKAGAQRL

SEQ ID NO: 248120 - protein, 10 aa, Mycobacterium
AQAQKARAQR

SEQ ID NO: 248121 - protein, 35 aa, Mycobacterium
AQAQLGSALPDNSWQGSASYAYASQNTALQNRGQA

SEQ ID NO: 248122 - protein, 10 aa, Mycobacterium
AQAQQAAEKA

SEQ ID NO: 248123 - protein, 7 aa, Mycobacterium
AQARDAR

SEQ ID NO: 248124 - protein, 5 aa, Mycobacterium
AQARE

SEQ ID NO: 248125 - protein, 14 aa, Mycobacterium
AQARKNGAKPRSRL

SEQ ID NO: 248126 - protein, 10 aa, Mycobacterium
AQARNDGVAE

SEQ ID NO: 248127 - protein, 9 aa, Mycobacterium
AQASADSDR

SEQ ID NO: 248128 - protein, 8 aa, Mycobacterium
AQASGGDY

SEQ ID NO: 248129 - protein, 34 aa, Mycobacterium
AQASRAAAEAAPKNGGNGANGAHAPGPDYGAPAG

SEQ ID NO: 248130 - protein, 9 aa, Mycobacterium
AQASRYAAD

SEQ ID NO: 248131 - protein, 5 aa, Mycobacterium
AQAST

SEQ ID NO: 248132 - protein, 14 aa, Mycobacterium
AQASTSRAQRVADT

SEQ ID NO: 248133 - protein, 4 aa, Mycobacterium
AQAT

SEQ ID NO: 248134 - protein, 7 aa, Mycobacterium
AQATGEF

SEQ ID NO: 248135 - protein, 7 aa, Mycobacterium
AQATSGW

SEQ ID NO: 248136 - protein, 8 aa, Mycobacterium
AQAVGGLG

SEQ ID NO: 248137 - protein, 9 aa, Mycobacterium
AQCPDLGPN

SEQ ID NO: 248138 - protein, 5 aa, Mycobacterium
AQDAD

SEQ ID NO: 248139 - protein, 11 aa, Mycobacterium
AQDATNEETPT

SEQ ID NO: 248140 - protein, 12 aa, Mycobacterium
AQDDKKPAPART

SEQ ID NO: 248141 - protein, 8 aa, Mycobacterium
AQDDPAQV

SEQ ID NO: 248142 - protein, 10 aa, Mycobacterium
AQDGKSAADQ

SEQ ID NO: 248143 - protein, 10 aa, Mycobacterium
AQDGKTAAEQ

SEQ ID NO: 248144 - protein, 9 aa, Mycobacterium
AQDGRAAAA

SEQ ID NO: 248145 - protein, 9 aa, Mycobacterium
AQDGRAAAD

SEQ ID NO: 248146 - protein, 9 aa, Mycobacterium
AQDGRTAAD

SEQ ID NO: 248147 - protein, 18 aa, Mycobacterium
AQDKDAPTSAQGQGEDVG

SEQ ID NO: 248148 - protein, 17 aa, Mycobacterium
AQDKDTPGSAQAQGGDV

SEQ ID NO: 248149 - protein, 8 aa, Mycobacterium
AQDNTTVP

SEQ ID NO: 248150 - protein, 9 aa, Mycobacterium
AQDPDNPEL

SEQ ID NO: 248151 - protein, 6 aa, Mycobacterium
AQDPEL

SEQ ID NO: 248152 - protein, 9 aa, Mycobacterium
AQDPGTGAI

SEQ ID NO: 248153 - protein, 5 aa, Mycobacterium
AQDPL

SEQ ID NO: 248154 - protein, 16 aa, Mycobacterium
AQDPVATVPPGAPLPT

SEQ ID NO: 248155 - protein, 7 aa, Mycobacterium
AQDQAGH

SEQ ID NO: 248156 - protein, 6 aa, Mycobacterium
AQDQPD

SEQ ID NO: 248157 - protein, 7 aa, Mycobacterium
AQDQTGH

SEQ ID NO: 248158 - protein, 4 aa, Mycobacterium
AQDR

SEQ ID NO: 248159 - protein, 7 aa, Mycobacterium
AQDRQHR

SEQ ID NO: 248160 - protein, 15 aa, Mycobacterium
AQDRVKQAQSVVDQS

SEQ ID NO: 248161 - protein, 8 aa, Mycobacterium
AQDSSTAG

SEQ ID NO: 248162 - protein, 8 aa, Mycobacterium
AQDSTTAT

SEQ ID NO: 248163 - protein, 11 aa, Mycobacterium
AQDTRQGVGAG

SEQ ID NO: 248164 - protein, 4 aa, Mycobacterium
AQDV

SEQ ID NO: 248165 - protein, 10 aa, Mycobacterium
AQEAAEGVAA

SEQ ID NO: 248166 - protein, 10 aa, Mycobacterium
AQEAAEPTKP

SEQ ID NO: 248167 - protein, 5 aa, Mycobacterium
AQEDF

SEQ ID NO: 248168 - protein, 10 aa, Mycobacterium
AQEEAEPTRP

SEQ ID NO: 248169 - protein, 12 aa, Mycobacterium
AQEERAAAERRA

SEQ ID NO: 248170 - protein, 13 aa, Mycobacterium
AQEGVGPEPTEGG

SEQ ID NO: 248171 - protein, 4 aa, Mycobacterium
AQEH

SEQ ID NO: 248172 - protein, 11 aa, Mycobacterium
AQEKSETAHGN

SEQ ID NO: 248173 - protein, 9 aa, Mycobacterium
AQENATAMG

SEQ ID NO: 248174 - protein, 16 aa, Mycobacterium
AQEPEPQPGARPAKET

SEQ ID NO: 248175 - protein, 19 aa, Mycobacterium
AQEPRVQRPDPQPQTPNET

SEQ ID NO: 248176 - protein, 11 aa, Mycobacterium
AQEQANAERLN

SEQ ID NO: 248177 - protein, 7 aa, Mycobacterium
AQEQQTT

SEQ ID NO: 248178 - protein, 5 aa, Mycobacterium
AQEQR

SEQ ID NO: 248179 - protein, 5 aa, Mycobacterium
AQETL

SEQ ID NO: 248180 - protein, 6 aa, Mycobacterium
AQETLA

SEQ ID NO: 248181 - protein, 6 aa, Mycobacterium
AQEVAA

SEQ ID NO: 248182 - protein, 25 aa, Mycobacterium
AQFDRASTVDVGSLGDATEELIRSW

SEQ ID NO: 248183 - protein, 10 aa, Mycobacterium
AQGAADAKER

SEQ ID NO: 248184 - protein, 6 aa, Mycobacterium
AQGAGS

SEQ ID NO: 248185 - protein, 7 aa, Mycobacterium
AQGAGSE

SEQ ID NO: 248186 - protein, 7 aa, Mycobacterium
AQGAGSI

SEQ ID NO: 248187 - protein, 8 aa, Mycobacterium
AQGARNGD

SEQ ID NO: 248188 - protein, 13 aa, Mycobacterium
AQGATAAGLDPVS

SEQ ID NO: 248189 - protein, 6 aa, Mycobacterium
AQGAVT

SEQ ID NO: 248190 - protein, 4 aa, Mycobacterium
AQGD

SEQ ID NO: 248191 - protein, 5 aa, Mycobacterium
AQGDF

SEQ ID NO: 248192 - protein, 5 aa, Mycobacterium
AQGDG

SEQ ID NO: 248193 - protein, 8 aa, Mycobacterium
AQGDGSRI

SEQ ID NO: 248194 - protein, 8 aa, Mycobacterium
AQGDSDSI

SEQ ID NO: 248195 - protein, 6 aa, Mycobacterium
AQGDTA

SEQ ID NO: 248196 - protein, 5 aa, Mycobacterium
AQGGA

SEQ ID NO: 248197 - protein, 10 aa, Mycobacterium
AQGGKEFGRD

SEQ ID NO: 248198 - protein, 7 aa, Mycobacterium
AQGGTTL

SEQ ID NO: 248199 - protein, 5 aa, Mycobacterium
AQGLG

SEQ ID NO: 248200 - protein, 5 aa, Mycobacterium
AQGNG

SEQ ID NO: 248201 - protein, 8 aa, Mycobacterium
AQGNGDQI

SEQ ID NO: 248202 - protein, 8 aa, Mycobacterium
AQGNGDSL

SEQ ID NO: 248203 - protein, 8 aa, Mycobacterium
AQGNSDQI

SEQ ID NO: 248204 - protein, 9 aa, Mycobacterium
AQGPDGAYT

SEQ ID NO: 248205 - protein, 15 aa, Mycobacterium
AQGPEDYANIPPTRF

SEQ ID NO: 248206 - protein, 21 aa, Mycobacterium
AQGPNVTTVAPPKFAEDNDSA

SEQ ID NO: 248207 - protein, 7 aa, Mycobacterium
AQGPQLG

SEQ ID NO: 248208 - protein, 6 aa, Mycobacterium
AQGPQM

SEQ ID NO: 248209 - protein, 6 aa, Mycobacterium
AQGPRM

SEQ ID NO: 248210 - protein, 5 aa, Mycobacterium
AQGPS

SEQ ID NO: 248211 - protein, 8 aa, Mycobacterium
AQGPTTLE

SEQ ID NO: 248212 - protein, 6 aa, Mycobacterium
AQGPTV

SEQ ID NO: 248213 - protein, 9 aa, Mycobacterium
AQGRDAGGH

SEQ ID NO: 248214 - protein, 13 aa, Mycobacterium
AQGRPVAGDAAPI

SEQ ID NO: 248215 - protein, 6 aa, Mycobacterium
AQGRQL

SEQ ID NO: 248216 - protein, 9 aa, Mycobacterium
AQGSGKTTA

SEQ ID NO: 248217 - protein, 7 aa, Mycobacterium
AQGSGRR

SEQ ID NO: 248218 - protein, 9 aa, Mycobacterium
AQGSRPAGL

SEQ ID NO: 248219 - protein, 6 aa, Mycobacterium
AQGSTV

SEQ ID NO: 248220 - protein, 6 aa, Mycobacterium
AQGTDG

SEQ ID NO: 248221 - protein, 10 aa, Mycobacterium
AQGTGDTTSC

SEQ ID NO: 248222 - protein, 18 aa, Mycobacterium
AQGTKATSTSADSAGATG

SEQ ID NO: 248223 - protein, 11 aa, Mycobacterium
AQGTTPSHESV

SEQ ID NO: 248224 - protein, 11 aa, Mycobacterium
AQGVRAERTEA

SEQ ID NO: 248225 - protein, 9 aa, Mycobacterium
AQGVSEPRD

SEQ ID NO: 248226 - protein, 10 aa, Mycobacterium
AQHAKTNDAE

SEQ ID NO: 248227 - protein, 7 aa, Mycobacterium
AQHANAH

SEQ ID NO: 248228 - protein, 8 aa, Mycobacterium
AQHDDPIG

SEQ ID NO: 248229 - protein, 5 aa, Mycobacterium
AQHDG

SEQ ID NO: 248230 - protein, 8 aa, Mycobacterium
AQHGGVTA

SEQ ID NO: 248231 - protein, 15 aa, Mycobacterium
AQHRATAEDFAAQGD

SEQ ID NO: 248232 - protein, 15 aa, Mycobacterium
AQHRATAQGYAADGN

SEQ ID NO: 248233 - protein, 5 aa, Mycobacterium
AQHST

SEQ ID NO: 248234 - protein, 5 aa, Mycobacterium
AQHTT

SEQ ID NO: 248235 - protein, 5 aa, Mycobacterium
AQIDV

SEQ ID NO: 248236 - protein, 10 aa, Mycobacterium
AQINGPNDLY

SEQ ID NO: 248237 - protein, 8 aa, Mycobacterium
AQISDQSG

SEQ ID NO: 248238 - protein, 7 aa, Mycobacterium
AQKAGQP

SEQ ID NO: 248239 - protein, 13 aa, Mycobacterium
AQKAPKTWKDMLP

SEQ ID NO: 248240 - protein, 10 aa, Mycobacterium
AQKAQQDHTM

SEQ ID NO: 248241 - protein, 10 aa, Mycobacterium
AQKARNGDVG

SEQ ID NO: 248242 - protein, 10 aa, Mycobacterium
AQKGGNGDVG

SEQ ID NO: 248243 - protein, 13 aa, Mycobacterium
AQKPNAARAGNQV

SEQ ID NO: 248244 - protein, 5 aa, Mycobacterium
AQKRQ

SEQ ID NO: 248245 - protein, 9 aa, Mycobacterium
AQKRREQGF

SEQ ID NO: 248246 - protein, 16 aa, Mycobacterium
AQKSATSGKMATCSTL

SEQ ID NO: 248247 - protein, 16 aa, Mycobacterium
AQKSVYKKAEGQTGAA

SEQ ID NO: 248248 - protein, 16 aa, Mycobacterium
AQKSVYRKAEGQTGAA

SEQ ID NO: 248249 - protein, 25 aa, Mycobacterium
AQLAGDGGPGTRSRRNEPVPPAAPL

SEQ ID NO: 248250 - protein, 12 aa, Mycobacterium
AQLGRDGGLRGR

SEQ ID NO: 248251 - protein, 8 aa, Mycobacterium
AQLKKGDY

SEQ ID NO: 248252 - protein, 6 aa, Mycobacterium
AQLPGT

SEQ ID NO: 248253 - protein, 8 aa, Mycobacterium
AQLPPAKP

SEQ ID NO: 248254 - protein, 6 aa, Mycobacterium
AQLQAP

SEQ ID NO: 248255 - protein, 4 aa, Mycobacterium
AQLS

SEQ ID NO: 248256 - protein, 10 aa, Mycobacterium
AQLSPSARFA

SEQ ID NO: 248257 - protein, 11 aa, Mycobacterium
AQLSPSARVAR

SEQ ID NO: 248258 - protein, 14 aa, Mycobacterium
AQLSSLADETPEGR

SEQ ID NO: 248259 - protein, 14 aa, Mycobacterium
AQLTNQLGERDQAI

SEQ ID NO: 248260 - protein, 14 aa, Mycobacterium
AQLTTQLGERDQAI

SEQ ID NO: 248261 - protein, 10 aa, Mycobacterium
AQMAPDRAEA

SEQ ID NO: 248262 - protein, 10 aa, Mycobacterium
AQMDGATPYQ

SEQ ID NO: 248263 - protein, 9 aa, Mycobacterium
AQMDSDPDH

SEQ ID NO: 248264 - protein, 5 aa, Mycobacterium
AQNAA

SEQ ID NO: 248265 - protein, 14 aa, Mycobacterium
AQNATAAGLDATAR

SEQ ID NO: 248266 - protein, 14 aa, Mycobacterium
AQNATAAGLDPAAR

SEQ ID NO: 248267 - protein, 14 aa, Mycobacterium
AQNATAAGLDPTAR

SEQ ID NO: 248268 - protein, 12 aa, Mycobacterium
AQNATAAGLDPV

SEQ ID NO: 248269 - protein, 8 aa, Mycobacterium
AQNATRIS

SEQ ID NO: 248270 - protein, 26 aa, Mycobacterium
AQNPAKYFSPGQTITNSTVPKRIGPT

SEQ ID NO: 248271 - protein, 16 aa, Mycobacterium
AQNPARPQAPTVSPDH

SEQ ID NO: 248272 - protein, 6 aa, Mycobacterium
AQNPSH

SEQ ID NO: 248273 - protein, 21 aa, Mycobacterium
AQNQDTGAPVAPAEPKSTLSQ

SEQ ID NO: 248274 - protein, 6 aa, Mycobacterium
AQNRDF

SEQ ID NO: 248275 - protein, 7 aa, Mycobacterium
AQNRGHL

SEQ ID NO: 248276 - protein, 11 aa, Mycobacterium
AQNSKAPGQRF

SEQ ID NO: 248277 - protein, 4 aa, Mycobacterium
AQPA

SEQ ID NO: 248278 - protein, 37 aa, Mycobacterium
AQPADGKTPLPPPRQARRPETVPTTEAPPPPPPPQTV

SEQ ID NO: 248279 - protein, 17 aa, Mycobacterium
AQPAGQPEQAAPQQSDT

SEQ ID NO: 248280 - protein, 12 aa, Mycobacterium
AQPAPATPQWDQ

SEQ ID NO: 248281 - protein, 5 aa, Mycobacterium
AQPAV

SEQ ID NO: 248282 - protein, 12 aa, Mycobacterium
AQPDAANDPIYS

SEQ ID NO: 248283 - protein, 12 aa, Mycobacterium
AQPDTGPDNGVA

SEQ ID NO: 248284 - protein, 35 aa, Mycobacterium
AQPDTPQADKLATARDAAVQAAGEAKSNGTADPLG

SEQ ID NO: 248285 - protein, 15 aa, Mycobacterium
AQPDTTRAFGDSDPI

SEQ ID NO: 248286 - protein, 5 aa, Mycobacterium
AQPEL

SEQ ID NO: 248287 - protein, 12 aa, Mycobacterium
AQPEPPPSEQIQ

SEQ ID NO: 248288 - protein, 7 aa, Mycobacterium
AQPGGAA

SEQ ID NO: 248289 - protein, 13 aa, Mycobacterium
AQPGPDGFSGIAP

SEQ ID NO: 248290 - protein, 6 aa, Mycobacterium
AQPGRH

SEQ ID NO: 248291 - protein, 7 aa, Mycobacterium
AQPGTHD

SEQ ID NO: 248292 - protein, 15 aa, Mycobacterium
AQPGTTRAVGDSDPI

SEQ ID NO: 248293 - protein, 6 aa, Mycobacterium
AQPGVT

SEQ ID NO: 248294 - protein, 50 aa, Mycobacterium
AQPHEPEPYQQPVSSGTHWRPQPEPHVAQPPVPGHEQQFPAAAEPTQQPY

SEQ ID NO: 248295 - protein, 7 aa, Mycobacterium
AQPHRRS

SEQ ID NO: 248296 - protein, 9 aa, Mycobacterium
AQPITTGTH

SEQ ID NO: 248297 - protein, 5 aa, Mycobacterium
AQPKA

SEQ ID NO: 248298 - protein, 12 aa, Mycobacterium
AQPKLADNSLTE

SEQ ID NO: 248299 - protein, 21 aa, Mycobacterium
AQPKPAPPVQAQPKIQPPRPV

SEQ ID NO: 248300 - protein, 8 aa, Mycobacterium
AQPLEPDP

SEQ ID NO: 248301 - protein, 5 aa, Mycobacterium
AQPLG

SEQ ID NO: 248302 - protein, 9 aa, Mycobacterium
AQPLGDEAH

SEQ ID NO: 248303 - protein, 7 aa, Mycobacterium
AQPNSPV

SEQ ID NO: 248304 - protein, 4 aa, Mycobacterium
AQPP

SEQ ID NO: 248305 - protein, 25 aa, Mycobacterium
AQPPAYQAYPPVGYPQPPYPQYPQT

SEQ ID NO: 248306 - protein, 7 aa, Mycobacterium
AQPPEPE

SEQ ID NO: 248307 - protein, 16 aa, Mycobacterium
AQPPGSPCYFPFCLPG

SEQ ID NO: 248308 - protein, 6 aa, Mycobacterium
AQPPLP

SEQ ID NO: 248309 - protein, 129 aa, Mycobacterium
AQPPTEDGQPPAGAPGAPGAPGGAPGAPGLPGLPGLSGLPGMPGAPGAPGAPQEAPPGMPVPGEAPGGEAPAPPAGEQPAPQPRPYPLEPAPTPGEPTPAPAPEPAPGENPPAAPAPGADGDKADLAQR

SEQ ID NO: 248310 - protein, 10 aa, Mycobacterium
AQPQLAAQPA

SEQ ID NO: 248311 - protein, 10 aa, Mycobacterium
AQPQQVKDAP

SEQ ID NO: 248312 - protein, 7 aa, Mycobacterium
AQPQRVD

SEQ ID NO: 248313 - protein, 9 aa, Mycobacterium
AQPQRVDGA

SEQ ID NO: 248314 - protein, 9 aa, Mycobacterium
AQPRAGVTT

SEQ ID NO: 248315 - protein, 5 aa, Mycobacterium
AQPRL

SEQ ID NO: 248316 - protein, 11 aa, Mycobacterium
AQPRNPNRKTG

SEQ ID NO: 248317 - protein, 10 aa, Mycobacterium
AQPRSDLGAA

SEQ ID NO: 248318 - protein, 14 aa, Mycobacterium
AQPRSTRTQKAGAS

SEQ ID NO: 248319 - protein, 4 aa, Mycobacterium
AQPS

SEQ ID NO: 248320 - protein, 15 aa, Mycobacterium
AQPSITGAIADDDKH

SEQ ID NO: 248321 - protein, 7 aa, Mycobacterium
AQPSREV

SEQ ID NO: 248322 - protein, 12 aa, Mycobacterium
AQPTAANDPLYA

SEQ ID NO: 248323 - protein, 12 aa, Mycobacterium
AQPTAANDPVYA

SEQ ID NO: 248324 - protein, 12 aa, Mycobacterium
AQPTSQTPDEAA

SEQ ID NO: 248325 - protein, 12 aa, Mycobacterium
AQPVGASKENAR

SEQ ID NO: 248326 - protein, 6 aa, Mycobacterium
AQPVPV

SEQ ID NO: 248327 - protein, 6 aa, Mycobacterium
AQPVSA

SEQ ID NO: 248328 - protein, 15 aa, Mycobacterium
AQQAEDEEDAVLPSR

SEQ ID NO: 248329 - protein, 27 aa, Mycobacterium
AQQAPAAQPASAGGPAPVVTPPQPSIA

SEQ ID NO: 248330 - protein, 10 aa, Mycobacterium
AQQAPSGERT

SEQ ID NO: 248331 - protein, 6 aa, Mycobacterium
AQQARA

SEQ ID NO: 248332 - protein, 8 aa, Mycobacterium
AQQARADE

SEQ ID NO: 248333 - protein, 11 aa, Mycobacterium
AQQARAGTSSM

SEQ ID NO: 248334 - protein, 17 aa, Mycobacterium
AQQARIQEQAASDERRR

SEQ ID NO: 248335 - protein, 16 aa, Mycobacterium
AQQDPTGPTGGGVRTE

SEQ ID NO: 248336 - protein, 4 aa, Mycobacterium
AQQG

SEQ ID NO: 248337 - protein, 16 aa, Mycobacterium
AQQGAKGAGGNGVRTE

SEQ ID NO: 248338 - protein, 16 aa, Mycobacterium
AQQGAQGAGGNGVRTE

SEQ ID NO: 248339 - protein, 8 aa, Mycobacterium
AQQGAQQH

SEQ ID NO: 248340 - protein, 23 aa, Mycobacterium
AQQGGRAPVDAEDRSALQHQERV

SEQ ID NO: 248341 - protein, 7 aa, Mycobacterium
AQQGREL

SEQ ID NO: 248342 - protein, 10 aa, Mycobacterium
AQQGTQQHAS

SEQ ID NO: 248343 - protein, 5 aa, Mycobacterium
AQQIT

SEQ ID NO: 248344 - protein, 8 aa, Mycobacterium
AQQPEGHR

SEQ ID NO: 248345 - protein, 14 aa, Mycobacterium
AQQPGQTLPVGPAE

SEQ ID NO: 248346 - protein, 45 aa, Mycobacterium
AQQPRPPVRHPTRELTREPGSWAAPVSEARPDAEPEGYEQQPVSG

SEQ ID NO: 248347 - protein, 15 aa, Mycobacterium
AQQPSWSKELTYEAT

SEQ ID NO: 248348 - protein, 18 aa, Mycobacterium
AQQQAELQSEQRFGSAAR

SEQ ID NO: 248349 - protein, 4 aa, Mycobacterium
AQQR

SEQ ID NO: 248350 - protein, 27 aa, Mycobacterium
AQQSGGAYQNVSASNSPELAAAIARFI

SEQ ID NO: 248351 - protein, 9 aa, Mycobacterium
AQQTPADKV

SEQ ID NO: 248352 - protein, 16 aa, Mycobacterium
AQQTRSIDAGDEAPRV

SEQ ID NO: 248353 - protein, 8 aa, Mycobacterium
AQQVTEDE

SEQ ID NO: 248354 - protein, 4 aa, Mycobacterium
AQRA

SEQ ID NO: 248355 - protein, 8 aa, Mycobacterium
AQRADARL

SEQ ID NO: 248356 - protein, 8 aa, Mycobacterium
AQRAGEQV

SEQ ID NO: 248357 - protein, 14 aa, Mycobacterium
AQRAQDGAEQLRQE

SEQ ID NO: 248358 - protein, 12 aa, Mycobacterium
AQRASSAVEPSH

SEQ ID NO: 248359 - protein, 5 aa, Mycobacterium
AQRAT

SEQ ID NO: 248360 - protein, 8 aa, Mycobacterium
AQRATLGD

SEQ ID NO: 248361 - protein, 14 aa, Mycobacterium
AQRATTNSLQAAQD

SEQ ID NO: 248362 - protein, 6 aa, Mycobacterium
AQRDGL

SEQ ID NO: 248363 - protein, 16 aa, Mycobacterium
AQRDPEGATGAGVRTE

SEQ ID NO: 248364 - protein, 6 aa, Mycobacterium
AQRDPL

SEQ ID NO: 248365 - protein, 23 aa, Mycobacterium
AQRDPLAEGSGRIRSDRRDRDRW

SEQ ID NO: 248366 - protein, 22 aa, Mycobacterium
AQRDPLAEHPGRVRSNRDEHRR

SEQ ID NO: 248367 - protein, 23 aa, Mycobacterium
AQRDPLGQAAGRPRVDRDRPRQW

SEQ ID NO: 248368 - protein, 22 aa, Mycobacterium
AQRDPVAVDSGRVRSNRDDHQR

SEQ ID NO: 248369 - protein, 14 aa, Mycobacterium
AQREDRDTSEDTGV

SEQ ID NO: 248370 - protein, 10 aa, Mycobacterium
AQRELADEAD

SEQ ID NO: 248371 - protein, 14 aa, Mycobacterium
AQRERAAAYSAAAR

SEQ ID NO: 248372 - protein, 4 aa, Mycobacterium
AQRG

SEQ ID NO: 248373 - protein, 11 aa, Mycobacterium
AQRGDAPAGLQ

SEQ ID NO: 248374 - protein, 7 aa, Mycobacterium
AQRGPNR

SEQ ID NO: 248375 - protein, 9 aa, Mycobacterium
AQRHRDSGA

SEQ ID NO: 248376 - protein, 12 aa, Mycobacterium
AQRNAAAAAVGS

SEQ ID NO: 248377 - protein, 12 aa, Mycobacterium
AQRNAATAAVGS

SEQ ID NO: 248378 - protein, 7 aa, Mycobacterium
AQRNPTL

SEQ ID NO: 248379 - protein, 25 aa, Mycobacterium
AQRPALEPRRRPQPGWPPGPGGDIV

SEQ ID NO: 248380 - protein, 6 aa, Mycobacterium
AQRPVQ

SEQ ID NO: 248381 - protein, 13 aa, Mycobacterium
AQRREEQQRAEQF

SEQ ID NO: 248382 - protein, 22 aa, Mycobacterium
AQRSAGRGRAARRELDRSRRET

SEQ ID NO: 248383 - protein, 13 aa, Mycobacterium
AQRSGDEDESKRR

SEQ ID NO: 248384 - protein, 9 aa, Mycobacterium
AQRSGYPAE

SEQ ID NO: 248385 - protein, 8 aa, Mycobacterium
AQRSTGAY

SEQ ID NO: 248386 - protein, 15 aa, Mycobacterium
AQRTGGLTQNPTQSL

SEQ ID NO: 248387 - protein, 6 aa, Mycobacterium
AQRTSA

SEQ ID NO: 248388 - protein, 6 aa, Mycobacterium
AQRVNQ

SEQ ID NO: 248389 - protein, 24 aa, Mycobacterium
AQRYEDSVSSLPRATAVSESPLGI

SEQ ID NO: 248390 - protein, 8 aa, Mycobacterium
AQSAADGE

SEQ ID NO: 248391 - protein, 9 aa, Mycobacterium
AQSAENDQH

SEQ ID NO: 248392 - protein, 5 aa, Mycobacterium
AQSAF

SEQ ID NO: 248393 - protein, 17 aa, Mycobacterium
AQSAGPPDLSPPTQIGV

SEQ ID NO: 248394 - protein, 8 aa, Mycobacterium
AQSAGTQV

SEQ ID NO: 248395 - protein, 15 aa, Mycobacterium
AQSAISGATTAGVAD

SEQ ID NO: 248396 - protein, 13 aa, Mycobacterium
AQSAPATARRPAL

SEQ ID NO: 248397 - protein, 9 aa, Mycobacterium
AQSAQQDQR

SEQ ID NO: 248398 - protein, 6 aa, Mycobacterium
AQSAVG

SEQ ID NO: 248399 - protein, 25 aa, Mycobacterium
AQSDAEAERQKGAAEADARKAAADA

SEQ ID NO: 248400 - protein, 11 aa, Mycobacterium
AQSDSAGPNID

SEQ ID NO: 248401 - protein, 4 aa, Mycobacterium
AQSE

SEQ ID NO: 248402 - protein, 6 aa, Mycobacterium
AQSELD

SEQ ID NO: 248403 - protein, 13 aa, Mycobacterium
AQSGGNWPPEPTE

SEQ ID NO: 248404 - protein, 6 aa, Mycobacterium
AQSGLE

SEQ ID NO: 248405 - protein, 19 aa, Mycobacterium
AQSGPAGPPVQVSDDGQAA

SEQ ID NO: 248406 - protein, 8 aa, Mycobacterium
AQSGPMAA

SEQ ID NO: 248407 - protein, 12 aa, Mycobacterium
AQSLANSDVTAA

SEQ ID NO: 248408 - protein, 4 aa, Mycobacterium
AQSN

SEQ ID NO: 248409 - protein, 9 aa, Mycobacterium
AQSNPDDVN

SEQ ID NO: 248410 - protein, 16 aa, Mycobacterium
AQSPNLEDLHDWWLEF

SEQ ID NO: 248411 - protein, 9 aa, Mycobacterium
AQSPSIADP

SEQ ID NO: 248412 - protein, 4 aa, Mycobacterium
AQSQ

SEQ ID NO: 248413 - protein, 5 aa, Mycobacterium
AQSQD

SEQ ID NO: 248414 - protein, 6 aa, Mycobacterium
AQSQHT

SEQ ID NO: 248415 - protein, 8 aa, Mycobacterium
AQSQHTDH

SEQ ID NO: 248416 - protein, 5 aa, Mycobacterium
AQSQR

SEQ ID NO: 248417 - protein, 6 aa, Mycobacterium
AQSQRA

SEQ ID NO: 248418 - protein, 17 aa, Mycobacterium
AQSRHDATHAATAAAER

SEQ ID NO: 248419 - protein, 6 aa, Mycobacterium
AQSRPA

SEQ ID NO: 248420 - protein, 8 aa, Mycobacterium
AQSRPAKL

SEQ ID NO: 248421 - protein, 5 aa, Mycobacterium
AQSRR

SEQ ID NO: 248422 - protein, 8 aa, Mycobacterium
AQSRTLAR

SEQ ID NO: 248423 - protein, 8 aa, Mycobacterium
AQSSAPGW

SEQ ID NO: 248424 - protein, 11 aa, Mycobacterium
AQSSDDGYNTT

SEQ ID NO: 248425 - protein, 6 aa, Mycobacterium
AQSSGS

SEQ ID NO: 248426 - protein, 24 aa, Mycobacterium
AQSSGTAATATDRDHTEQEQPPAG

SEQ ID NO: 248427 - protein, 9 aa, Mycobacterium
AQSSRDPEF

SEQ ID NO: 248428 - protein, 8 aa, Mycobacterium
AQSTAIPR

SEQ ID NO: 248429 - protein, 6 aa, Mycobacterium
AQSTPV

SEQ ID NO: 248430 - protein, 8 aa, Mycobacterium
AQSTRSGI

SEQ ID NO: 248431 - protein, 9 aa, Mycobacterium
AQSTRTATQ

SEQ ID NO: 248432 - protein, 5 aa, Mycobacterium
AQSTV

SEQ ID NO: 248433 - protein, 8 aa, Mycobacterium
AQTAGGGK

SEQ ID NO: 248434 - protein, 5 aa, Mycobacterium
AQTAL

SEQ ID NO: 248435 - protein, 8 aa, Mycobacterium
AQTARRAH

SEQ ID NO: 248436 - protein, 8 aa, Mycobacterium
AQTASGGK

SEQ ID NO: 248437 - protein, 5 aa, Mycobacterium
AQTDA

SEQ ID NO: 248438 - protein, 24 aa, Mycobacterium
AQTEAENAQADQAGPLANARAQKD

SEQ ID NO: 248439 - protein, 26 aa, Mycobacterium
AQTEAENAQADQAGPLAQARAEKDVG

SEQ ID NO: 248440 - protein, 7 aa, Mycobacterium
AQTEHPG

SEQ ID NO: 248441 - protein, 17 aa, Mycobacterium
AQTEPSARGMTAPNRPP

SEQ ID NO: 248442 - protein, 5 aa, Mycobacterium
AQTER

SEQ ID NO: 248443 - protein, 4 aa, Mycobacterium
AQTG

SEQ ID NO: 248444 - protein, 8 aa, Mycobacterium
AQTGEETG

SEQ ID NO: 248445 - protein, 11 aa, Mycobacterium
AQTGGIPEAAA

SEQ ID NO: 248446 - protein, 16 aa, Mycobacterium
AQTGTAAGTALMFAAI

SEQ ID NO: 248447 - protein, 6 aa, Mycobacterium
AQTGTD

SEQ ID NO: 248448 - protein, 9 aa, Mycobacterium
AQTNRDSVD

SEQ ID NO: 248449 - protein, 7 aa, Mycobacterium
AQTNTRV

SEQ ID NO: 248450 - protein, 28 aa, Mycobacterium
AQTPEQLPAQVDSSGTVATDETERGGPL

SEQ ID NO: 248451 - protein, 6 aa, Mycobacterium
AQTPIN

SEQ ID NO: 248452 - protein, 9 aa, Mycobacterium
AQTSGSLSS

SEQ ID NO: 248453 - protein, 8 aa, Mycobacterium
AQTSGTLN

SEQ ID NO: 248454 - protein, 23 aa, Mycobacterium
AQTTNRAIGRNGAADRAPDGVTP

SEQ ID NO: 248455 - protein, 7 aa, Mycobacterium
AQTTTTT

SEQ ID NO: 248456 - protein, 20 aa, Mycobacterium
AQTVGTGTAELPAATGEPHL

SEQ ID NO: 248457 - protein, 72 aa, Mycobacterium
AQTVTSASTPSATQPATGAEAGTTLAAASTGPSTAPAPPAAPAPAVPVQTPAAAPAPAVTAPAPAVTAPPNL

SEQ ID NO: 248458 - protein, 5 aa, Mycobacterium
AQVAG

SEQ ID NO: 248459 - protein, 16 aa, Mycobacterium
AQVAPSAKSAALGRQL

SEQ ID NO: 248460 - protein, 12 aa, Mycobacterium
AQVDAGKAAEIQ

SEQ ID NO: 248461 - protein, 5 aa, Mycobacterium
AQVDG

SEQ ID NO: 248462 - protein, 5 aa, Mycobacterium
AQVDL

SEQ ID NO: 248463 - protein, 24 aa, Mycobacterium
AQVDSPKPAGDVVGTNPPAGTTVP

SEQ ID NO: 248464 - protein, 12 aa, Mycobacterium
AQVDSTRPAGEV

SEQ ID NO: 248465 - protein, 9 aa, Mycobacterium
AQVDVSGGL

SEQ ID NO: 248466 - protein, 5 aa, Mycobacterium
AQVGV

SEQ ID NO: 248467 - protein, 4 aa, Mycobacterium
AQVP

SEQ ID NO: 248468 - protein, 6 aa, Mycobacterium
AQVPSR

SEQ ID NO: 248469 - protein, 12 aa, Mycobacterium
AQVSAGQAAEIQ

SEQ ID NO: 248470 - protein, 42 aa, Mycobacterium
AQVSASPHGRQPTRELPREPENHNEPPGADFDDESDEYEYEP

SEQ ID NO: 248471 - protein, 10 aa, Mycobacterium
AQVTGGPAFG

SEQ ID NO: 248472 - protein, 9 aa, Mycobacterium
AQYADTAEE

SEQ ID NO: 248473 - protein, 7 aa, Mycobacterium
AQYPGQY

SEQ ID NO: 248474 - protein, 11 aa, Mycobacterium
AQYSESSRGQL

SEQ ID NO: 248475 - protein, 5 aa, Mycobacterium
ARAAA

SEQ ID NO: 248476 - protein, 11 aa, Mycobacterium
ARAAAARDREM

SEQ ID NO: 248477 - protein, 15 aa, Mycobacterium
ARAAETAHMSPTQAS

SEQ ID NO: 248478 - protein, 9 aa, Mycobacterium
ARAAETAWS

SEQ ID NO: 248479 - protein, 9 aa, Mycobacterium
ARAAETAWT

SEQ ID NO: 248480 - protein, 12 aa, Mycobacterium
ARAAGDAGSPMS

SEQ ID NO: 248481 - protein, 15 aa, Mycobacterium
ARAAGDEADDTDVDR

SEQ ID NO: 248482 - protein, 8 aa, Mycobacterium
ARAAGDPV

SEQ ID NO: 248483 - protein, 7 aa, Mycobacterium
ARAAGSV

SEQ ID NO: 248484 - protein, 12 aa, Mycobacterium
ARAAGTLDQGLD

SEQ ID NO: 248485 - protein, 9 aa, Mycobacterium
ARAAKAEGV

SEQ ID NO: 248486 - protein, 10 aa, Mycobacterium
ARAAKGQGVQ

SEQ ID NO: 248487 - protein, 18 aa, Mycobacterium
ARAALAGEEPKGGHTAAH

SEQ ID NO: 248488 - protein, 8 aa, Mycobacterium
ARAAPAAA

SEQ ID NO: 248489 - protein, 9 aa, Mycobacterium
ARAAPTPAL

SEQ ID NO: 248490 - protein, 5 aa, Mycobacterium
ARAAQ

SEQ ID NO: 248491 - protein, 8 aa, Mycobacterium
ARAARQGR

SEQ ID NO: 248492 - protein, 18 aa, Mycobacterium
ARAASGQNDALQRGSYPD

SEQ ID NO: 248493 - protein, 8 aa, Mycobacterium
ARADADND

SEQ ID NO: 248494 - protein, 8 aa, Mycobacterium
ARADDSGL

SEQ ID NO: 248495 - protein, 5 aa, Mycobacterium
ARADG

SEQ ID NO: 248496 - protein, 8 aa, Mycobacterium
ARADGADA

SEQ ID NO: 248497 - protein, 13 aa, Mycobacterium
ARADLDDASDKGV

SEQ ID NO: 248498 - protein, 16 aa, Mycobacterium
ARADMPSSPASLPADE

SEQ ID NO: 248499 - protein, 8 aa, Mycobacterium
ARADPDLP

SEQ ID NO: 248500 - protein, 13 aa, Mycobacterium
ARADTKPQPWQPD

SEQ ID NO: 248501 - protein, 11 aa, Mycobacterium
ARAEAGGSTAV

SEQ ID NO: 248502 - protein, 5 aa, Mycobacterium
ARAEE

SEQ ID NO: 248503 - protein, 7 aa, Mycobacterium
ARAENSL

SEQ ID NO: 248504 - protein, 8 aa, Mycobacterium
ARAEPAPK

SEQ ID NO: 248505 - protein, 6 aa, Mycobacterium
ARAEPP

SEQ ID NO: 248506 - protein, 9 aa, Mycobacterium
ARAEPRAAV

SEQ ID NO: 248507 - protein, 7 aa, Mycobacterium
ARAEREH

SEQ ID NO: 248508 - protein, 6 aa, Mycobacterium
ARAEYE

SEQ ID NO: 248509 - protein, 5 aa, Mycobacterium
ARAGA

SEQ ID NO: 248510 - protein, 13 aa, Mycobacterium
ARAGAQPNPVDTT

SEQ ID NO: 248511 - protein, 5 aa, Mycobacterium
ARAGE

SEQ ID NO: 248512 - protein, 7 aa, Mycobacterium
ARAGGKR

SEQ ID NO: 248513 - protein, 6 aa, Mycobacterium
ARAGHA

SEQ ID NO: 248514 - protein, 5 aa, Mycobacterium
ARAGK

SEQ ID NO: 248515 - protein, 16 aa, Mycobacterium
ARAGPPSAATGSADGS

SEQ ID NO: 248516 - protein, 12 aa, Mycobacterium
ARAGRGPGGASV

SEQ ID NO: 248517 - protein, 15 aa, Mycobacterium
ARAGRPAAHGPVLVA

SEQ ID NO: 248518 - protein, 8 aa, Mycobacterium
ARAGRTSV

SEQ ID NO: 248519 - protein, 8 aa, Mycobacterium
ARAGSAEQ

SEQ ID NO: 248520 - protein, 9 aa, Mycobacterium
ARAGSGDIA

SEQ ID NO: 248521 - protein, 8 aa, Mycobacterium
ARAGSSAR

SEQ ID NO: 248522 - protein, 14 aa, Mycobacterium
ARAHRNDPQGATSE

SEQ ID NO: 248523 - protein, 4 aa, Mycobacterium
ARAK

SEQ ID NO: 248524 - protein, 14 aa, Mycobacterium
ARAKASAEAQGKTA

SEQ ID NO: 248525 - protein, 9 aa, Mycobacterium
ARAKGGSPT

SEQ ID NO: 248526 - protein, 7 aa, Mycobacterium
ARAKRGP

SEQ ID NO: 248527 - protein, 5 aa, Mycobacterium
ARALR

SEQ ID NO: 248528 - protein, 10 aa, Mycobacterium
ARAMGADKEA

SEQ ID NO: 248529 - protein, 8 aa, Mycobacterium
ARAMPGSG

SEQ ID NO: 248530 - protein, 4 aa, Mycobacterium
ARAN

SEQ ID NO: 248531 - protein, 11 aa, Mycobacterium
ARAPARGVDNQ

SEQ ID NO: 248532 - protein, 6 aa, Mycobacterium
ARAPAT

SEQ ID NO: 248533 - protein, 8 aa, Mycobacterium
ARAPGGGI

SEQ ID NO: 248534 - protein, 7 aa, Mycobacterium
ARAPGTR

SEQ ID NO: 248535 - protein, 11 aa, Mycobacterium
ARAPHPAPPQL

SEQ ID NO: 248536 - protein, 13 aa, Mycobacterium
ARAPHSAAAHSGG

SEQ ID NO: 248537 - protein, 12 aa, Mycobacterium
ARAPHSADIPQA

SEQ ID NO: 248538 - protein, 44 aa, Mycobacterium
ARAPRPAPADRLAPPKRQQNGSARAQRHRRDPDDTAGYGRHSSG

SEQ ID NO: 248539 - protein, 13 aa, Mycobacterium
ARAPRSADIPKTG

SEQ ID NO: 248540 - protein, 8 aa, Mycobacterium
ARAPYKPE

SEQ ID NO: 248541 - protein, 8 aa, Mycobacterium
ARAQAAER

SEQ ID NO: 248542 - protein, 9 aa, Mycobacterium
ARAQAGWPA

SEQ ID NO: 248543 - protein, 7 aa, Mycobacterium
ARAQAKG

SEQ ID NO: 248544 - protein, 15 aa, Mycobacterium
ARAQARQSVKAATDD

SEQ ID NO: 248545 - protein, 14 aa, Mycobacterium
ARAQEVRKAVDAGE

SEQ ID NO: 248546 - protein, 10 aa, Mycobacterium
ARAQGESRGE

SEQ ID NO: 248547 - protein, 7 aa, Mycobacterium
ARAQGIN

SEQ ID NO: 248548 - protein, 24 aa, Mycobacterium
ARAQKRASDAQSAIDKSSKPIRNQ

SEQ ID NO: 248549 - protein, 10 aa, Mycobacterium
ARARAAREHA

SEQ ID NO: 248550 - protein, 8 aa, Mycobacterium
ARARARAA

SEQ ID NO: 248551 - protein, 9 aa, Mycobacterium
ARARARAAQ

SEQ ID NO: 248552 - protein, 8 aa, Mycobacterium
ARARGGGT

SEQ ID NO: 248553 - protein, 10 aa, Mycobacterium
ARARGGGTRF

SEQ ID NO: 248554 - protein, 6 aa, Mycobacterium
ARARGI

SEQ ID NO: 248555 - protein, 9 aa, Mycobacterium
ARARQASNL

SEQ ID NO: 248556 - protein, 8 aa, Mycobacterium
ARARRDAP

SEQ ID NO: 248557 - protein, 8 aa, Mycobacterium
ARASAPGA

SEQ ID NO: 248558 - protein, 63 aa, Mycobacterium
ARASEAARLEADRNANGGNGSHGGQASGKGAPHGPTQPDYGAPAGWRAPGWPPQAQQPQQQPN

SEQ ID NO: 248559 - protein, 16 aa, Mycobacterium
ARASGSGNHGADGIDP

SEQ ID NO: 248560 - protein, 12 aa, Mycobacterium
ARASPWRRSPLA

SEQ ID NO: 248561 - protein, 50 aa, Mycobacterium
ARASQAAAAAGADADRNNNGGNGSQGAQGAPDRPGVPHGPTQPDYGAPAG

SEQ ID NO: 248562 - protein, 7 aa, Mycobacterium
ARASQLP

SEQ ID NO: 248563 - protein, 6 aa, Mycobacterium
ARASRR

SEQ ID NO: 248564 - protein, 8 aa, Mycobacterium
ARASRRAD

SEQ ID NO: 248565 - protein, 18 aa, Mycobacterium
ARASTQPHDGQGHAHATD

SEQ ID NO: 248566 - protein, 8 aa, Mycobacterium
ARASVTKA

SEQ ID NO: 248567 - protein, 7 aa, Mycobacterium
ARATDVD

SEQ ID NO: 248568 - protein, 5 aa, Mycobacterium
ARATE

SEQ ID NO: 248569 - protein, 6 aa, Mycobacterium
ARATEV

SEQ ID NO: 248570 - protein, 18 aa, Mycobacterium
ARATGALPPGTDPGAAAD

SEQ ID NO: 248571 - protein, 9 aa, Mycobacterium
ARATGAPAV

SEQ ID NO: 248572 - protein, 10 aa, Mycobacterium
ARATGAPPVP

SEQ ID NO: 248573 - protein, 5 aa, Mycobacterium
ARATR

SEQ ID NO: 248574 - protein, 8 aa, Mycobacterium
ARATRDRE

SEQ ID NO: 248575 - protein, 24 aa, Mycobacterium
ARATSSRPAAVPAPNPSPARQVPA

SEQ ID NO: 248576 - protein, 17 aa, Mycobacterium
ARATTQPHDGQGHAHAT

SEQ ID NO: 248577 - protein, 4 aa, Mycobacterium
ARAV

SEQ ID NO: 248578 - protein, 11 aa, Mycobacterium
ARAVGESREDA

SEQ ID NO: 248579 - protein, 14 aa, Mycobacterium
ARAVQPGGGIRSAP

SEQ ID NO: 248580 - protein, 12 aa, Mycobacterium
ARCDPGNPPAAV

SEQ ID NO: 248581 - protein, 11 aa, Mycobacterium
ARDAAATTQVD

SEQ ID NO: 248582 - protein, 12 aa, Mycobacterium
ARDAARSVKTYP

SEQ ID NO: 248583 - protein, 9 aa, Mycobacterium
ARDAPDAGR

SEQ ID NO: 248584 - protein, 9 aa, Mycobacterium
ARDARDATH

SEQ ID NO: 248585 - protein, 11 aa, Mycobacterium
ARDARQGVGAG

SEQ ID NO: 248586 - protein, 9 aa, Mycobacterium
ARDDAGRAQ

SEQ ID NO: 248587 - protein, 11 aa, Mycobacterium
ARDDGAGELAD

SEQ ID NO: 248588 - protein, 9 aa, Mycobacterium
ARDDGTLGK

SEQ ID NO: 248589 - protein, 7 aa, Mycobacterium
ARDEGVP

SEQ ID NO: 248590 - protein, 9 aa, Mycobacterium
ARDEQPDTN

SEQ ID NO: 248591 - protein, 7 aa, Mycobacterium
ARDEQPF

SEQ ID NO: 248592 - protein, 8 aa, Mycobacterium
ARDEQPHT

SEQ ID NO: 248593 - protein, 9 aa, Mycobacterium
ARDETERAA

SEQ ID NO: 248594 - protein, 4 aa, Mycobacterium
ARDF

SEQ ID NO: 248595 - protein, 9 aa, Mycobacterium
ARDFATSGL

SEQ ID NO: 248596 - protein, 10 aa, Mycobacterium
ARDFATSGLE

SEQ ID NO: 248597 - protein, 9 aa, Mycobacterium
ARDGEKFSG

SEQ ID NO: 248598 - protein, 15 aa, Mycobacterium
ARDGGGLVATFRAPI

SEQ ID NO: 248599 - protein, 9 aa, Mycobacterium
ARDGHSDYG

SEQ ID NO: 248600 - protein, 24 aa, Mycobacterium
ARDGSAQLAAGTRQLSTAVTTATD

SEQ ID NO: 248601 - protein, 6 aa, Mycobacterium
ARDGYP

SEQ ID NO: 248602 - protein, 8 aa, Mycobacterium
ARDPAERY

SEQ ID NO: 248603 - protein, 8 aa, Mycobacterium
ARDPAGRF

SEQ ID NO: 248604 - protein, 5 aa, Mycobacterium
ARDPE

SEQ ID NO: 248605 - protein, 6 aa, Mycobacterium
ARDPEA

SEQ ID NO: 248606 - protein, 8 aa, Mycobacterium
ARDPGERY

SEQ ID NO: 248607 - protein, 10 aa, Mycobacterium
ARDPHGRHRP

SEQ ID NO: 248608 - protein, 8 aa, Mycobacterium
ARDQRPTP

SEQ ID NO: 248609 - protein, 15 aa, Mycobacterium
ARDQVAGAAGAPGCS

SEQ ID NO: 248610 - protein, 4 aa, Mycobacterium
ARDR

SEQ ID NO: 248611 - protein, 5 aa, Mycobacterium
ARDRP

SEQ ID NO: 248612 - protein, 10 aa, Mycobacterium
ARDRSGRGQH

SEQ ID NO: 248613 - protein, 10 aa, Mycobacterium
ARDRSHGGAG

SEQ ID NO: 248614 - protein, 5 aa, Mycobacterium
ARDRT

SEQ ID NO: 248615 - protein, 25 aa, Mycobacterium
ARDRTPGSEGAGAHRNQSRTDRDES

SEQ ID NO: 248616 - protein, 5 aa, Mycobacterium
ARDSA

SEQ ID NO: 248617 - protein, 9 aa, Mycobacterium
ARDSGNRYV

SEQ ID NO: 248618 - protein, 6 aa, Mycobacterium
ARDSLA

SEQ ID NO: 248619 - protein, 5 aa, Mycobacterium
ARDSN

SEQ ID NO: 248620 - protein, 12 aa, Mycobacterium
ARDTAPGVRETQ

SEQ ID NO: 248621 - protein, 8 aa, Mycobacterium
ARDTPLAE

SEQ ID NO: 248622 - protein, 9 aa, Mycobacterium
ARDTRQGVG

SEQ ID NO: 248623 - protein, 11 aa, Mycobacterium
ARDTRQGVGAG

SEQ ID NO: 248624 - protein, 5 aa, Mycobacterium
ARDYA

SEQ ID NO: 248625 - protein, 7 aa, Mycobacterium
AREAENQ

SEQ ID NO: 248626 - protein, 5 aa, Mycobacterium
AREAG

SEQ ID NO: 248627 - protein, 6 aa, Mycobacterium
AREAGR

SEQ ID NO: 248628 - protein, 11 aa, Mycobacterium
AREAGRAAARA

SEQ ID NO: 248629 - protein, 12 aa, Mycobacterium
AREAGRAAARES

SEQ ID NO: 248630 - protein, 7 aa, Mycobacterium
AREAGRM

SEQ ID NO: 248631 - protein, 19 aa, Mycobacterium
AREAVEGGRHSGSATLGTF

SEQ ID NO: 248632 - protein, 8 aa, Mycobacterium
AREDGRVD

SEQ ID NO: 248633 - protein, 16 aa, Mycobacterium
AREEPEDTGPVGPKSV

SEQ ID NO: 248634 - protein, 13 aa, Mycobacterium
AREEQSATGLPGG

SEQ ID NO: 248635 - protein, 4 aa, Mycobacterium
AREG

SEQ ID NO: 248636 - protein, 7 aa, Mycobacterium
AREGAAL

SEQ ID NO: 248637 - protein, 9 aa, Mycobacterium
AREGKRKGR

SEQ ID NO: 248638 - protein, 24 aa, Mycobacterium
AREGLGSVASANPEAPQDEEFAPQ

SEQ ID NO: 248639 - protein, 5 aa, Mycobacterium
AREGY

SEQ ID NO: 248640 - protein, 6 aa, Mycobacterium
ARELRE

SEQ ID NO: 248641 - protein, 4 aa, Mycobacterium
AREP

SEQ ID NO: 248642 - protein, 5 aa, Mycobacterium
AREPE

SEQ ID NO: 248643 - protein, 6 aa, Mycobacterium
AREPKF

SEQ ID NO: 248644 - protein, 5 aa, Mycobacterium
AREPV

SEQ ID NO: 248645 - protein, 14 aa, Mycobacterium
AREQADRGLAGSME

SEQ ID NO: 248646 - protein, 15 aa, Mycobacterium
AREQADRGVAGSMEG

SEQ ID NO: 248647 - protein, 13 aa, Mycobacterium
AREQAERGIAGSM

SEQ ID NO: 248648 - protein, 12 aa, Mycobacterium
AREQFRDRNDDV

SEQ ID NO: 248649 - protein, 4 aa, Mycobacterium
ARER

SEQ ID NO: 248650 - protein, 6 aa, Mycobacterium
ARERGL

SEQ ID NO: 248651 - protein, 20 aa, Mycobacterium
ARERIGEEAPTPAVGAHDHD

SEQ ID NO: 248652 - protein, 6 aa, Mycobacterium
ARERPT

SEQ ID NO: 248653 - protein, 14 aa, Mycobacterium
ARERRASAQVKTGR

SEQ ID NO: 248654 - protein, 8 aa, Mycobacterium
ARERREGQ

SEQ ID NO: 248655 - protein, 14 aa, Mycobacterium
ARERRGSSQVTTGR

SEQ ID NO: 248656 - protein, 8 aa, Mycobacterium
ARERYETK

SEQ ID NO: 248657 - protein, 7 aa, Mycobacterium
ARETAND

SEQ ID NO: 248658 - protein, 9 aa, Mycobacterium
ARFREGQKN

SEQ ID NO: 248659 - protein, 8 aa, Mycobacterium
ARFSSDTS

SEQ ID NO: 248660 - protein, 4 aa, Mycobacterium
ARGA

SEQ ID NO: 248661 - protein, 5 aa, Mycobacterium
ARGAA

SEQ ID NO: 248662 - protein, 7 aa, Mycobacterium
ARGAASD

SEQ ID NO: 248663 - protein, 6 aa, Mycobacterium
ARGAAV

SEQ ID NO: 248664 - protein, 9 aa, Mycobacterium
ARGAQPNTM

SEQ ID NO: 248665 - protein, 11 aa, Mycobacterium
ARGAQPNTTLA

SEQ ID NO: 248666 - protein, 30 aa, Mycobacterium
ARGASASKYQTPAARRSEAVSPVDKGQSER

SEQ ID NO: 248667 - protein, 8 aa, Mycobacterium
ARGASHST

SEQ ID NO: 248668 - protein, 12 aa, Mycobacterium
ARGATGSLAITG

SEQ ID NO: 248669 - protein, 26 aa, Mycobacterium
ARGAVAAQARRRLRGKNKAEAGGRRH

SEQ ID NO: 248670 - protein, 16 aa, Mycobacterium
ARGAVTPATRPPADRD

SEQ ID NO: 248671 - protein, 8 aa, Mycobacterium
ARGCPKPL

SEQ ID NO: 248672 - protein, 4 aa, Mycobacterium
ARGD

SEQ ID NO: 248673 - protein, 6 aa, Mycobacterium
ARGDAA

SEQ ID NO: 248674 - protein, 7 aa, Mycobacterium
ARGDGAD

SEQ ID NO: 248675 - protein, 9 aa, Mycobacterium
ARGDGSLDQ

SEQ ID NO: 248676 - protein, 7 aa, Mycobacterium
ARGDNGF

SEQ ID NO: 248677 - protein, 6 aa, Mycobacterium
ARGDTE

SEQ ID NO: 248678 - protein, 7 aa, Mycobacterium
ARGEAAA

SEQ ID NO: 248679 - protein, 31 aa, Mycobacterium
ARGEAATVSAGAGRDVRSADEATASSPQRLR

SEQ ID NO: 248680 - protein, 12 aa, Mycobacterium
ARGEATDLQPAT

SEQ ID NO: 248681 - protein, 12 aa, Mycobacterium
ARGEIPEVRGIA

SEQ ID NO: 248682 - protein, 7 aa, Mycobacterium
ARGGAAA

SEQ ID NO: 248683 - protein, 8 aa, Mycobacterium
ARGGDDAP

SEQ ID NO: 248684 - protein, 11 aa, Mycobacterium
ARGGPAGVGEA

SEQ ID NO: 248685 - protein, 7 aa, Mycobacterium
ARGGQDA

SEQ ID NO: 248686 - protein, 7 aa, Mycobacterium
ARGGYAD

SEQ ID NO: 248687 - protein, 9 aa, Mycobacterium
ARGKGNALY

SEQ ID NO: 248688 - protein, 11 aa, Mycobacterium
ARGLGQDRESA

SEQ ID NO: 248689 - protein, 17 aa, Mycobacterium
ARGPAPLEPSPGGGPDG

SEQ ID NO: 248690 - protein, 9 aa, Mycobacterium
ARGPGRRRQ

SEQ ID NO: 248691 - protein, 6 aa, Mycobacterium
ARGPIK

SEQ ID NO: 248692 - protein, 9 aa, Mycobacterium
ARGPIKTAS

SEQ ID NO: 248693 - protein, 25 aa, Mycobacterium
ARGRAETARYTRRPAAEAPTEASAM

SEQ ID NO: 248694 - protein, 6 aa, Mycobacterium
ARGRAV

SEQ ID NO: 248695 - protein, 5 aa, Mycobacterium
ARGRE

SEQ ID NO: 248696 - protein, 9 aa, Mycobacterium
ARGRRQNAV

SEQ ID NO: 248697 - protein, 14 aa, Mycobacterium
ARGSAGSDTDVPET

SEQ ID NO: 248698 - protein, 8 aa, Mycobacterium
ARGSDVSP

SEQ ID NO: 248699 - protein, 11 aa, Mycobacterium
ARGSISTNWPS

SEQ ID NO: 248700 - protein, 9 aa, Mycobacterium
ARGSKVDLP

SEQ ID NO: 248701 - protein, 7 aa, Mycobacterium
ARGSPGW

SEQ ID NO: 248702 - protein, 6 aa, Mycobacterium
ARGSRE

SEQ ID NO: 248703 - protein, 15 aa, Mycobacterium
ARGSTVSLGRPAGEA

SEQ ID NO: 248704 - protein, 4 aa, Mycobacterium
ARGT

SEQ ID NO: 248705 - protein, 7 aa, Mycobacterium
ARGTALA

SEQ ID NO: 248706 - protein, 6 aa, Mycobacterium
ARGTHT

SEQ ID NO: 248707 - protein, 6 aa, Mycobacterium
ARGTKP

SEQ ID NO: 248708 - protein, 8 aa, Mycobacterium
ARGTPGMA

SEQ ID NO: 248709 - protein, 8 aa, Mycobacterium
ARGTPLTQ

SEQ ID NO: 248710 - protein, 8 aa, Mycobacterium
ARGTPWAK

SEQ ID NO: 248711 - protein, 8 aa, Mycobacterium
ARGTSDAG

SEQ ID NO: 248712 - protein, 6 aa, Mycobacterium
ARGTTV

SEQ ID NO: 248713 - protein, 6 aa, Mycobacterium
ARGTVT

SEQ ID NO: 248714 - protein, 8 aa, Mycobacterium
ARGWTSDR

SEQ ID NO: 248715 - protein, 29 aa, Mycobacterium
ARGYGSANPIASNDTPEGRAKNRRVEIVV

SEQ ID NO: 248716 - protein, 55 aa, Mycobacterium
ARGYPPAGRPPPNQPYQQAPPPQAQPGPPPDQFPPPDQSEPPEQSDLDEEPKPWY

SEQ ID NO: 248717 - protein, 28 aa, Mycobacterium
ARHDAQRDAQQTPAQTPPTKQATASDTS

SEQ ID NO: 248718 - protein, 16 aa, Mycobacterium
ARHDDEGPTAELPRLS

SEQ ID NO: 248719 - protein, 4 aa, Mycobacterium
ARHE

SEQ ID NO: 248720 - protein, 7 aa, Mycobacterium
ARHEPDA

SEQ ID NO: 248721 - protein, 7 aa, Mycobacterium
ARHPAVQ

SEQ ID NO: 248722 - protein, 10 aa, Mycobacterium
ARHPNAPVST

SEQ ID NO: 248723 - protein, 6 aa, Mycobacterium
ARHPRK

SEQ ID NO: 248724 - protein, 7 aa, Mycobacterium
ARHPSPA

SEQ ID NO: 248725 - protein, 7 aa, Mycobacterium
ARHPSSV

SEQ ID NO: 248726 - protein, 10 aa, Mycobacterium
ARHRGQDREA

SEQ ID NO: 248727 - protein, 5 aa, Mycobacterium
ARHRS

SEQ ID NO: 248728 - protein, 7 aa, Mycobacterium
ARHRTAS

SEQ ID NO: 248729 - protein, 6 aa, Mycobacterium
ARHSGA

SEQ ID NO: 248730 - protein, 5 aa, Mycobacterium
ARHSP

SEQ ID NO: 248731 - protein, 7 aa, Mycobacterium
ARHSTGP

SEQ ID NO: 248732 - protein, 8 aa, Mycobacterium
ARIENDPS

SEQ ID NO: 248733 - protein, 5 aa, Mycobacterium
ARIGP

SEQ ID NO: 248734 - protein, 4 aa, Mycobacterium
ARIQ

SEQ ID NO: 248735 - protein, 14 aa, Mycobacterium
ARISRDAAATTQAD

SEQ ID NO: 248736 - protein, 6 aa, Mycobacterium
ARITDP

SEQ ID NO: 248737 - protein, 6 aa, Mycobacterium
ARKAGV

SEQ ID NO: 248738 - protein, 10 aa, Mycobacterium
ARKAQGPVQA

SEQ ID NO: 248739 - protein, 5 aa, Mycobacterium
ARKAT

SEQ ID NO: 248740 - protein, 8 aa, Mycobacterium
ARKPARSL

SEQ ID NO: 248741 - protein, 10 aa, Mycobacterium
ARKPGGWKNA

SEQ ID NO: 248742 - protein, 25 aa, Mycobacterium
ARKPIQTRPLPPGSIAGASTEVIQK

SEQ ID NO: 248743 - protein, 9 aa, Mycobacterium
ARKQDISNG

SEQ ID NO: 248744 - protein, 9 aa, Mycobacterium
ARKTRADSR

SEQ ID NO: 248745 - protein, 6 aa, Mycobacterium
ARLARR

SEQ ID NO: 248746 - protein, 16 aa, Mycobacterium
ARLASDLDATADTTRT

SEQ ID NO: 248747 - protein, 6 aa, Mycobacterium
ARLGAG

SEQ ID NO: 248748 - protein, 13 aa, Mycobacterium
ARLGSGAQRTSLP

SEQ ID NO: 248749 - protein, 12 aa, Mycobacterium
ARLGSGATVGKG

SEQ ID NO: 248750 - protein, 9 aa, Mycobacterium
ARLPDGGPV

SEQ ID NO: 248751 - protein, 12 aa, Mycobacterium
ARLPDGSESPLS

SEQ ID NO: 248752 - protein, 12 aa, Mycobacterium
ARLPDGSGSELS

SEQ ID NO: 248753 - protein, 7 aa, Mycobacterium
ARLPGPV

SEQ ID NO: 248754 - protein, 6 aa, Mycobacterium
ARLQSY

SEQ ID NO: 248755 - protein, 9 aa, Mycobacterium
ARLSPRGSD

SEQ ID NO: 248756 - protein, 11 aa, Mycobacterium
ARLSSGAAQAC

SEQ ID NO: 248757 - protein, 20 aa, Mycobacterium
ARLSSSPAGSALPDNGYHRQ

SEQ ID NO: 248758 - protein, 11 aa, Mycobacterium
ARMAEPKLGQP

SEQ ID NO: 248759 - protein, 6 aa, Mycobacterium
ARMTNR

SEQ ID NO: 248760 - protein, 10 aa, Mycobacterium
ARNADTTVGK

SEQ ID NO: 248761 - protein, 10 aa, Mycobacterium
ARNAGEDRDR

SEQ ID NO: 248762 - protein, 10 aa, Mycobacterium
ARNAGEDRET

SEQ ID NO: 248763 - protein, 9 aa, Mycobacterium
ARNAGLDRE

SEQ ID NO: 248764 - protein, 10 aa, Mycobacterium
ARNAGTSDIA

SEQ ID NO: 248765 - protein, 10 aa, Mycobacterium
ARNAGTSDLA

SEQ ID NO: 248766 - protein, 16 aa, Mycobacterium
ARNDPDAPQAKTTERQ

SEQ ID NO: 248767 - protein, 7 aa, Mycobacterium
ARNDRRR

SEQ ID NO: 248768 - protein, 9 aa, Mycobacterium
ARNEQLDAR

SEQ ID NO: 248769 - protein, 10 aa, Mycobacterium
ARNETEAQRL

SEQ ID NO: 248770 - protein, 5 aa, Mycobacterium
ARNGI

SEQ ID NO: 248771 - protein, 8 aa, Mycobacterium
ARNGQAGL

SEQ ID NO: 248772 - protein, 9 aa, Mycobacterium
ARNGSPPVN

SEQ ID NO: 248773 - protein, 6 aa, Mycobacterium
ARNGVD

SEQ ID NO: 248774 - protein, 7 aa, Mycobacterium
ARNHGPW

SEQ ID NO: 248775 - protein, 4 aa, Mycobacterium
ARNP

SEQ ID NO: 248776 - protein, 18 aa, Mycobacterium
ARNPDKALESTLTGGGLA

SEQ ID NO: 248777 - protein, 14 aa, Mycobacterium
ARNPDSKVTIGDTG

SEQ ID NO: 248778 - protein, 11 aa, Mycobacterium
ARNPEKALESA

SEQ ID NO: 248779 - protein, 17 aa, Mycobacterium
ARNPEKALESTLTGGGL

SEQ ID NO: 248780 - protein, 12 aa, Mycobacterium
ARNQNYSSRAGA

SEQ ID NO: 248781 - protein, 16 aa, Mycobacterium
ARNQQTPAVRDAAEQM

SEQ ID NO: 248782 - protein, 6 aa, Mycobacterium
ARNRPR

SEQ ID NO: 248783 - protein, 11 aa, Mycobacterium
ARNSPAAPTFA

SEQ ID NO: 248784 - protein, 5 aa, Mycobacterium
ARNTL

SEQ ID NO: 248785 - protein, 7 aa, Mycobacterium
ARPADLD

SEQ ID NO: 248786 - protein, 6 aa, Mycobacterium
ARPADV

SEQ ID NO: 248787 - protein, 8 aa, Mycobacterium
ARPAGGPL

SEQ ID NO: 248788 - protein, 8 aa, Mycobacterium
ARPALDGA

SEQ ID NO: 248789 - protein, 8 aa, Mycobacterium
ARPANGPL

SEQ ID NO: 248790 - protein, 8 aa, Mycobacterium
ARPAPGLT

SEQ ID NO: 248791 - protein, 20 aa, Mycobacterium
ARPAPPPDAGPTGPAAQGVS

SEQ ID NO: 248792 - protein, 6 aa, Mycobacterium
ARPARG

SEQ ID NO: 248793 - protein, 8 aa, Mycobacterium
ARPASGRM

SEQ ID NO: 248794 - protein, 7 aa, Mycobacterium
ARPASTI

SEQ ID NO: 248795 - protein, 7 aa, Mycobacterium
ARPATGR

SEQ ID NO: 248796 - protein, 13 aa, Mycobacterium
ARPATMSAPIPAS

SEQ ID NO: 248797 - protein, 4 aa, Mycobacterium
ARPD

SEQ ID NO: 248798 - protein, 26 aa, Mycobacterium
ARPDAGSAEEGPATSRLPLKPGARTV

SEQ ID NO: 248799 - protein, 16 aa, Mycobacterium
ARPDAPAGAAATQQET

SEQ ID NO: 248800 - protein, 8 aa, Mycobacterium
ARPDAPGD

SEQ ID NO: 248801 - protein, 6 aa, Mycobacterium
ARPDHR

SEQ ID NO: 248802 - protein, 6 aa, Mycobacterium
ARPDKM

SEQ ID NO: 248803 - protein, 7 aa, Mycobacterium
ARPDRRA

SEQ ID NO: 248804 - protein, 38 aa, Mycobacterium
ARPDSDAPRDTEGSGGCGQGQGGACGTASSGELNRREQ

SEQ ID NO: 248805 - protein, 10 aa, Mycobacterium
ARPDTAGSSR

SEQ ID NO: 248806 - protein, 6 aa, Mycobacterium
ARPEDL

SEQ ID NO: 248807 - protein, 10 aa, Mycobacterium
ARPEGSSKPP

SEQ ID NO: 248808 - protein, 10 aa, Mycobacterium
ARPEGSTKPP

SEQ ID NO: 248809 - protein, 7 aa, Mycobacterium
ARPERNR

SEQ ID NO: 248810 - protein, 5 aa, Mycobacterium
ARPGA

SEQ ID NO: 248811 - protein, 12 aa, Mycobacterium
ARPGARSAAAGT

SEQ ID NO: 248812 - protein, 10 aa, Mycobacterium
ARPGDDTADI

SEQ ID NO: 248813 - protein, 10 aa, Mycobacterium
ARPGDRPSRS

SEQ ID NO: 248814 - protein, 7 aa, Mycobacterium
ARPGEDD

SEQ ID NO: 248815 - protein, 8 aa, Mycobacterium
ARPGEGTR

SEQ ID NO: 248816 - protein, 15 aa, Mycobacterium
ARPGHTPTGSQEAAE

SEQ ID NO: 248817 - protein, 7 aa, Mycobacterium
ARPGIEP

SEQ ID NO: 248818 - protein, 5 aa, Mycobacterium
ARPGL

SEQ ID NO: 248819 - protein, 19 aa, Mycobacterium
ARPGNATVDARHAAGAAIS

SEQ ID NO: 248820 - protein, 5 aa, Mycobacterium
ARPGP

SEQ ID NO: 248821 - protein, 8 aa, Mycobacterium
ARPGPGAL

SEQ ID NO: 248822 - protein, 8 aa, Mycobacterium
ARPGPLQR

SEQ ID NO: 248823 - protein, 7 aa, Mycobacterium
ARPGRID

SEQ ID NO: 248824 - protein, 7 aa, Mycobacterium
ARPGTPL

SEQ ID NO: 248825 - protein, 6 aa, Mycobacterium
ARPGTT

SEQ ID NO: 248826 - protein, 5 aa, Mycobacterium
ARPGW

SEQ ID NO: 248827 - protein, 5 aa, Mycobacterium
ARPHA

SEQ ID NO: 248828 - protein, 5 aa, Mycobacterium
ARPHP

SEQ ID NO: 248829 - protein, 5 aa, Mycobacterium
ARPHT

SEQ ID NO: 248830 - protein, 5 aa, Mycobacterium
ARPKR

SEQ ID NO: 248831 - protein, 6 aa, Mycobacterium
ARPKRR

SEQ ID NO: 248832 - protein, 4 aa, Mycobacterium
ARPL

SEQ ID NO: 248833 - protein, 6 aa, Mycobacterium
ARPLTA

SEQ ID NO: 248834 - protein, 5 aa, Mycobacterium
ARPPA

SEQ ID NO: 248835 - protein, 13 aa, Mycobacterium
ARPPAPPGQPRDS

SEQ ID NO: 248836 - protein, 35 aa, Mycobacterium
ARPPAPQAPPPPRPPERSRPPVAPPAQPAPAPAQF

SEQ ID NO: 248837 - protein, 9 aa, Mycobacterium
ARPPARGVD

SEQ ID NO: 248838 - protein, 11 aa, Mycobacterium
ARPPARGVDNQ

SEQ ID NO: 248839 - protein, 27 aa, Mycobacterium
ARPPEDADDADAGTADVKDQVKQSNFG

SEQ ID NO: 248840 - protein, 7 aa, Mycobacterium
ARPPERP

SEQ ID NO: 248841 - protein, 7 aa, Mycobacterium
ARPPLDA

SEQ ID NO: 248842 - protein, 8 aa, Mycobacterium
ARPPLSGT

SEQ ID NO: 248843 - protein, 9 aa, Mycobacterium
ARPPLSGTV

SEQ ID NO: 248844 - protein, 15 aa, Mycobacterium
ARPPLTKTVQETDRA

SEQ ID NO: 248845 - protein, 8 aa, Mycobacterium
ARPPPPGV

SEQ ID NO: 248846 - protein, 7 aa, Mycobacterium
ARPPRPV

SEQ ID NO: 248847 - protein, 5 aa, Mycobacterium
ARPPV

SEQ ID NO: 248848 - protein, 6 aa, Mycobacterium
ARPPVD

SEQ ID NO: 248849 - protein, 13 aa, Mycobacterium
ARPQAAAADSRAL

SEQ ID NO: 248850 - protein, 7 aa, Mycobacterium
ARPQAPD

SEQ ID NO: 248851 - protein, 13 aa, Mycobacterium
ARPQPLTAPPEVA

SEQ ID NO: 248852 - protein, 4 aa, Mycobacterium
ARPR

SEQ ID NO: 248853 - protein, 9 aa, Mycobacterium
ARPRAGTES

SEQ ID NO: 248854 - protein, 7 aa, Mycobacterium
ARPRLRP

SEQ ID NO: 248855 - protein, 17 aa, Mycobacterium
ARPRPQQTDAEPAPRAQ

SEQ ID NO: 248856 - protein, 7 aa, Mycobacterium
ARPRPTG

SEQ ID NO: 248857 - protein, 8 aa, Mycobacterium
ARPRQPEQ

SEQ ID NO: 248858 - protein, 15 aa, Mycobacterium
ARPRRSGGRDTADAV

SEQ ID NO: 248859 - protein, 15 aa, Mycobacterium
ARPSEPRRDEAGAVA

SEQ ID NO: 248860 - protein, 4 aa, Mycobacterium
ARPV

SEQ ID NO: 248861 - protein, 6 aa, Mycobacterium
ARPVDP

SEQ ID NO: 248862 - protein, 6 aa, Mycobacterium
ARPVPA

SEQ ID NO: 248863 - protein, 12 aa, Mycobacterium
ARPVSSKATAAE

SEQ ID NO: 248864 - protein, 11 aa, Mycobacterium
ARPYPADSLEQ

SEQ ID NO: 248865 - protein, 9 aa, Mycobacterium
ARPYPAESL

SEQ ID NO: 248866 - protein, 12 aa, Mycobacterium
ARPYRTPGGIAT

SEQ ID NO: 248867 - protein, 4 aa, Mycobacterium
ARQA

SEQ ID NO: 248868 - protein, 12 aa, Mycobacterium
ARQAAPQHAAPH

SEQ ID NO: 248869 - protein, 8 aa, Mycobacterium
ARQAETAH

SEQ ID NO: 248870 - protein, 7 aa, Mycobacterium
ARQDPLA

SEQ ID NO: 248871 - protein, 8 aa, Mycobacterium
ARQDSDAP

SEQ ID NO: 248872 - protein, 12 aa, Mycobacterium
ARQDTEKQNRTT

SEQ ID NO: 248873 - protein, 8 aa, Mycobacterium
ARQEGSNR

SEQ ID NO: 248874 - protein, 14 aa, Mycobacterium
ARQENDELRQRADS

SEQ ID NO: 248875 - protein, 4 aa, Mycobacterium
ARQG

SEQ ID NO: 248876 - protein, 46 aa, Mycobacterium
ARQGDRSSRADTVEDRDAAVETVDADETDDDLVDEPDDHDAPRTMS

SEQ ID NO: 248877 - protein, 9 aa, Mycobacterium
ARQHTQPGA

SEQ ID NO: 248878 - protein, 10 aa, Mycobacterium
ARQKRSPIHP

SEQ ID NO: 248879 - protein, 5 aa, Mycobacterium
ARQLA

SEQ ID NO: 248880 - protein, 11 aa, Mycobacterium
ARQPSNGPVGG

SEQ ID NO: 248881 - protein, 13 aa, Mycobacterium
ARQQAEHDRAAAP

SEQ ID NO: 248882 - protein, 12 aa, Mycobacterium
ARQQSGDANPFP

SEQ ID NO: 248883 - protein, 12 aa, Mycobacterium
ARQQSGDGNPFP

SEQ ID NO: 248884 - protein, 8 aa, Mycobacterium
ARQQSPLT

SEQ ID NO: 248885 - protein, 10 aa, Mycobacterium
ARQRGGGTRF

SEQ ID NO: 248886 - protein, 9 aa, Mycobacterium
ARQRRTGQP

SEQ ID NO: 248887 - protein, 16 aa, Mycobacterium
ARQSPSAPADNSSDLA

SEQ ID NO: 248888 - protein, 7 aa, Mycobacterium
ARQTESS

SEQ ID NO: 248889 - protein, 5 aa, Mycobacterium
ARQTL

SEQ ID NO: 248890 - protein, 6 aa, Mycobacterium
ARRAAS

SEQ ID NO: 248891 - protein, 15 aa, Mycobacterium
ARRADAAADEANGAL

SEQ ID NO: 248892 - protein, 6 aa, Mycobacterium
ARRADK

SEQ ID NO: 248893 - protein, 11 aa, Mycobacterium
ARRADKVADEA

SEQ ID NO: 248894 - protein, 15 aa, Mycobacterium
ARRADSTAAEANSAL

SEQ ID NO: 248895 - protein, 9 aa, Mycobacterium
ARRAERSAD

SEQ ID NO: 248896 - protein, 13 aa, Mycobacterium
ARRAGEDRESAYY

SEQ ID NO: 248897 - protein, 6 aa, Mycobacterium
ARRAGL

SEQ ID NO: 248898 - protein, 6 aa, Mycobacterium
ARRAGR

SEQ ID NO: 248899 - protein, 14 aa, Mycobacterium
ARRAGRSAGAGPLT

SEQ ID NO: 248900 - protein, 6 aa, Mycobacterium
ARRARP

SEQ ID NO: 248901 - protein, 12 aa, Mycobacterium
ARRDGEENARDQ

SEQ ID NO: 248902 - protein, 8 aa, Mycobacterium
ARRDGVEH

SEQ ID NO: 248903 - protein, 6 aa, Mycobacterium
ARRDPD

SEQ ID NO: 248904 - protein, 6 aa, Mycobacterium
ARRDTL

SEQ ID NO: 248905 - protein, 6 aa, Mycobacterium
ARRDTV

SEQ ID NO: 248906 - protein, 8 aa, Mycobacterium
ARRDTVNQ

SEQ ID NO: 248907 - protein, 9 aa, Mycobacterium
ARREAKRRA

SEQ ID NO: 248908 - protein, 11 aa, Mycobacterium
ARREAKRRAVA

SEQ ID NO: 248909 - protein, 5 aa, Mycobacterium
ARREG

SEQ ID NO: 248910 - protein, 7 aa, Mycobacterium
ARREGVR

SEQ ID NO: 248911 - protein, 52 aa, Mycobacterium
ARREHADKLDPRRRTADQADPAVQNREDVNTQTGVTTHRDDTTHTVGPDTRT

SEQ ID NO: 248912 - protein, 8 aa, Mycobacterium
ARRETTRT

SEQ ID NO: 248913 - protein, 4 aa, Mycobacterium
ARRF

SEQ ID NO: 248914 - protein, 5 aa, Mycobacterium
ARRGA

SEQ ID NO: 248915 - protein, 13 aa, Mycobacterium
ARRGAPDQPLERA

SEQ ID NO: 248916 - protein, 17 aa, Mycobacterium
ARRGARGAQAGLENYFD

SEQ ID NO: 248917 - protein, 18 aa, Mycobacterium
ARRGARGAQAGLENYLDE

SEQ ID NO: 248918 - protein, 18 aa, Mycobacterium
ARRGARGAQAGLETYLDQ

SEQ ID NO: 248919 - protein, 8 aa, Mycobacterium
ARRGGQNP

SEQ ID NO: 248920 - protein, 12 aa, Mycobacterium
ARRGHRGAQRGL

SEQ ID NO: 248921 - protein, 19 aa, Mycobacterium
ARRGRDGNGAADGGGTDIR

SEQ ID NO: 248922 - protein, 9 aa, Mycobacterium
ARRGRTAAQ

SEQ ID NO: 248923 - protein, 25 aa, Mycobacterium
ARRHDKTDDSIGTGGPTPPRGGSSV

SEQ ID NO: 248924 - protein, 4 aa, Mycobacterium
ARRI

SEQ ID NO: 248925 - protein, 4 aa, Mycobacterium
ARRN

SEQ ID NO: 248926 - protein, 6 aa, Mycobacterium
ARRNPG

SEQ ID NO: 248927 - protein, 10 aa, Mycobacterium
ARRPALQDSV

SEQ ID NO: 248928 - protein, 7 aa, Mycobacterium
ARRPEAN

SEQ ID NO: 248929 - protein, 8 aa, Mycobacterium
ARRPGASR

SEQ ID NO: 248930 - protein, 6 aa, Mycobacterium
ARRPGG

SEQ ID NO: 248931 - protein, 9 aa, Mycobacterium
ARRPGRGQG

SEQ ID NO: 248932 - protein, 8 aa, Mycobacterium
ARRPLAGT

SEQ ID NO: 248933 - protein, 9 aa, Mycobacterium
ARRPPKPRI

SEQ ID NO: 248934 - protein, 15 aa, Mycobacterium
ARRPPQHRERWIGVR

SEQ ID NO: 248935 - protein, 6 aa, Mycobacterium
ARRPQT

SEQ ID NO: 248936 - protein, 34 aa, Mycobacterium
ARRQEKQSPAAALAPAPEAPPTVEDKLADRYGRR

SEQ ID NO: 248937 - protein, 6 aa, Mycobacterium
ARRQLA

SEQ ID NO: 248938 - protein, 6 aa, Mycobacterium
ARRQQG

SEQ ID NO: 248939 - protein, 6 aa, Mycobacterium
ARRRAD

SEQ ID NO: 248940 - protein, 8 aa, Mycobacterium
ARRRAPEV

SEQ ID NO: 248941 - protein, 9 aa, Mycobacterium
ARRRAPEVP

SEQ ID NO: 248942 - protein, 10 aa, Mycobacterium
ARRRAPEVPR

SEQ ID NO: 248943 - protein, 7 aa, Mycobacterium
ARRRDRR

SEQ ID NO: 248944 - protein, 9 aa, Mycobacterium
ARRREGGVT

SEQ ID NO: 248945 - protein, 35 aa, Mycobacterium
ARRREKERQAETAAPEAPAPPKTVEAKLADRYGRH

SEQ ID NO: 248946 - protein, 17 aa, Mycobacterium
ARRRERREPPPADEPMT

SEQ ID NO: 248947 - protein, 9 aa, Mycobacterium
ARRRGAVNE

SEQ ID NO: 248948 - protein, 8 aa, Mycobacterium
ARRRGEEY

SEQ ID NO: 248949 - protein, 11 aa, Mycobacterium
ARRRGKALSSL

SEQ ID NO: 248950 - protein, 8 aa, Mycobacterium
ARRRGREY

SEQ ID NO: 248951 - protein, 5 aa, Mycobacterium
ARRRP

SEQ ID NO: 248952 - protein, 5 aa, Mycobacterium
ARRRR

SEQ ID NO: 248953 - protein, 8 aa, Mycobacterium
ARRRRADA

SEQ ID NO: 248954 - protein, 11 aa, Mycobacterium
ARRRRARRAQH

SEQ ID NO: 248955 - protein, 23 aa, Mycobacterium
ARRRRRRRVSGADRPREARPASG

SEQ ID NO: 248956 - protein, 6 aa, Mycobacterium
ARRSAL

SEQ ID NO: 248957 - protein, 17 aa, Mycobacterium
ARRSHPRVSSLDDDGLR

SEQ ID NO: 248958 - protein, 9 aa, Mycobacterium
ARRSPTATT

SEQ ID NO: 248959 - protein, 11 aa, Mycobacterium
ARRSQRRGSKK

SEQ ID NO: 248960 - protein, 4 aa, Mycobacterium
ARRT

SEQ ID NO: 248961 - protein, 5 aa, Mycobacterium
ARRTK

SEQ ID NO: 248962 - protein, 6 aa, Mycobacterium
ARRTRG

SEQ ID NO: 248963 - protein, 14 aa, Mycobacterium
ARRTRRPAAAVSRT

SEQ ID NO: 248964 - protein, 6 aa, Mycobacterium
ARRTSR

SEQ ID NO: 248965 - protein, 7 aa, Mycobacterium
ARRVEDP

SEQ ID NO: 248966 - protein, 8 aa, Mycobacterium
ARRVEPAR

SEQ ID NO: 248967 - protein, 6 aa, Mycobacterium
ARRVPG

SEQ ID NO: 248968 - protein, 4 aa, Mycobacterium
ARSA

SEQ ID NO: 248969 - protein, 6 aa, Mycobacterium
ARSADR

SEQ ID NO: 248970 - protein, 27 aa, Mycobacterium
ARSAEDDAATGPISTRGLSKAERGHRP

SEQ ID NO: 248971 - protein, 8 aa, Mycobacterium
ARSAPDKR

SEQ ID NO: 248972 - protein, 8 aa, Mycobacterium
ARSASESA

SEQ ID NO: 248973 - protein, 9 aa, Mycobacterium
ARSASPALQ

SEQ ID NO: 248974 - protein, 8 aa, Mycobacterium
ARSASQSG

SEQ ID NO: 248975 - protein, 4 aa, Mycobacterium
ARSD

SEQ ID NO: 248976 - protein, 7 aa, Mycobacterium
ARSEGRC

SEQ ID NO: 248977 - protein, 8 aa, Mycobacterium
ARSEGRCG

SEQ ID NO: 248978 - protein, 6 aa, Mycobacterium
ARSEHP

SEQ ID NO: 248979 - protein, 7 aa, Mycobacterium
ARSEQTW

SEQ ID NO: 248980 - protein, 7 aa, Mycobacterium
ARSERWR

SEQ ID NO: 248981 - protein, 17 aa, Mycobacterium
ARSESAARRDARKTELA

SEQ ID NO: 248982 - protein, 5 aa, Mycobacterium
ARSEV

SEQ ID NO: 248983 - protein, 7 aa, Mycobacterium
ARSFTGA

SEQ ID NO: 248984 - protein, 4 aa, Mycobacterium
ARSG

SEQ ID NO: 248985 - protein, 11 aa, Mycobacterium
ARSGGALSSVS

SEQ ID NO: 248986 - protein, 16 aa, Mycobacterium
ARSGLAQAHAGSDAPM

SEQ ID NO: 248987 - protein, 5 aa, Mycobacterium
ARSGM

SEQ ID NO: 248988 - protein, 14 aa, Mycobacterium
ARSGRAEPARPGER

SEQ ID NO: 248989 - protein, 8 aa, Mycobacterium
ARSGSESV

SEQ ID NO: 248990 - protein, 8 aa, Mycobacterium
ARSGSREV

SEQ ID NO: 248991 - protein, 9 aa, Mycobacterium
ARSKGLPPP

SEQ ID NO: 248992 - protein, 8 aa, Mycobacterium
ARSKGLTP

SEQ ID NO: 248993 - protein, 9 aa, Mycobacterium
ARSLGGSGN

SEQ ID NO: 248994 - protein, 11 aa, Mycobacterium
ARSMRPRATRR

SEQ ID NO: 248995 - protein, 15 aa, Mycobacterium
ARSNRRMIEGGDEPD

SEQ ID NO: 248996 - protein, 6 aa, Mycobacterium
ARSPAR

SEQ ID NO: 248997 - protein, 10 aa, Mycobacterium
ARSPATDGGN

SEQ ID NO: 248998 - protein, 7 aa, Mycobacterium
ARSPERL

SEQ ID NO: 248999 - protein, 5 aa, Mycobacterium
ARSPG

SEQ ID NO: 249000 - protein, 13 aa, Mycobacterium
ARSPGFDGRPDRR

SEQ ID NO: 249001 - protein, 16 aa, Mycobacterium
ARSPGFEGRPDRGEVE

SEQ ID NO: 249002 - protein, 14 aa, Mycobacterium
ARSPGFEGRPDRRA

SEQ ID NO: 249003 - protein, 7 aa, Mycobacterium
ARSPQIP

SEQ ID NO: 249004 - protein, 6 aa, Mycobacterium
ARSPQY

SEQ ID NO: 249005 - protein, 6 aa, Mycobacterium
ARSPRI

SEQ ID NO: 249006 - protein, 8 aa, Mycobacterium
ARSPRIPL

SEQ ID NO: 249007 - protein, 6 aa, Mycobacterium
ARSPRL

SEQ ID NO: 249008 - protein, 8 aa, Mycobacterium
ARSPRTAG

SEQ ID NO: 249009 - protein, 6 aa, Mycobacterium
ARSPRV

SEQ ID NO: 249010 - protein, 9 aa, Mycobacterium
ARSQLQSQI

SEQ ID NO: 249011 - protein, 8 aa, Mycobacterium
ARSQNAIG

SEQ ID NO: 249012 - protein, 7 aa, Mycobacterium
ARSQQTT

SEQ ID NO: 249013 - protein, 8 aa, Mycobacterium
ARSRGKAL

SEQ ID NO: 249014 - protein, 8 aa, Mycobacterium
ARSRGKTL

SEQ ID NO: 249015 - protein, 18 aa, Mycobacterium
ARSRPQHVHPTPSSPAQA

SEQ ID NO: 249016 - protein, 7 aa, Mycobacterium
ARSRPVA

SEQ ID NO: 249017 - protein, 8 aa, Mycobacterium
ARSRTQTA

SEQ ID NO: 249018 - protein, 6 aa, Mycobacterium
ARSRVN

SEQ ID NO: 249019 - protein, 6 aa, Mycobacterium
ARSSAL

SEQ ID NO: 249020 - protein, 7 aa, Mycobacterium
ARSSALS

SEQ ID NO: 249021 - protein, 6 aa, Mycobacterium
ARSSAS

SEQ ID NO: 249022 - protein, 6 aa, Mycobacterium
ARSSDH

SEQ ID NO: 249023 - protein, 6 aa, Mycobacterium
ARSSDQ

SEQ ID NO: 249024 - protein, 6 aa, Mycobacterium
ARSSEQ

SEQ ID NO: 249025 - protein, 13 aa, Mycobacterium
ARSSGATAQAEAD

SEQ ID NO: 249026 - protein, 15 aa, Mycobacterium
ARSSPDFSRIIAGDG

SEQ ID NO: 249027 - protein, 11 aa, Mycobacterium
ARSSQPNTELA

SEQ ID NO: 249028 - protein, 5 aa, Mycobacterium
ARSSR

SEQ ID NO: 249029 - protein, 18 aa, Mycobacterium
ARSTDTSTDVPETPPVSP

SEQ ID NO: 249030 - protein, 7 aa, Mycobacterium
ARSTDYS

SEQ ID NO: 249031 - protein, 8 aa, Mycobacterium
ARSTGEPG

SEQ ID NO: 249032 - protein, 16 aa, Mycobacterium
ARSTNTVGGFTDAGAT

SEQ ID NO: 249033 - protein, 11 aa, Mycobacterium
ARSTSKASEAI

SEQ ID NO: 249034 - protein, 9 aa, Mycobacterium
ARSVAPGVR

SEQ ID NO: 249035 - protein, 10 aa, Mycobacterium
ARSVAPGVRS

SEQ ID NO: 249036 - protein, 7 aa, Mycobacterium
ARSVEGG

SEQ ID NO: 249037 - protein, 6 aa, Mycobacterium
ARSYDG

SEQ ID NO: 249038 - protein, 6 aa, Mycobacterium
ARTAAS

SEQ ID NO: 249039 - protein, 9 aa, Mycobacterium
ARTAGRPTA

SEQ ID NO: 249040 - protein, 10 aa, Mycobacterium
ARTAPADAMR

SEQ ID NO: 249041 - protein, 19 aa, Mycobacterium
ARTASGRSAPEQLTPVTAA

SEQ ID NO: 249042 - protein, 5 aa, Mycobacterium
ARTDA

SEQ ID NO: 249043 - protein, 15 aa, Mycobacterium
ARTDAGKATGSPAPL

SEQ ID NO: 249044 - protein, 8 aa, Mycobacterium
ARTDGDQT

SEQ ID NO: 249045 - protein, 5 aa, Mycobacterium
ARTET

SEQ ID NO: 249046 - protein, 17 aa, Mycobacterium
ARTEVKRQTGADQIESQ

SEQ ID NO: 249047 - protein, 13 aa, Mycobacterium
ARTFSTEPAGLAS

SEQ ID NO: 249048 - protein, 10 aa, Mycobacterium
ARTGAPLSAG

SEQ ID NO: 249049 - protein, 6 aa, Mycobacterium
ARTGDN

SEQ ID NO: 249050 - protein, 6 aa, Mycobacterium
ARTGEQ

SEQ ID NO: 249051 - protein, 6 aa, Mycobacterium
ARTGET

SEQ ID NO: 249052 - protein, 21 aa, Mycobacterium
ARTGLDPKRARRIARTSPHRR

SEQ ID NO: 249053 - protein, 7 aa, Mycobacterium
ARTGLTG

SEQ ID NO: 249054 - protein, 6 aa, Mycobacterium
ARTGPG

SEQ ID NO: 249055 - protein, 12 aa, Mycobacterium
ARTGQGSRGSQQ

SEQ ID NO: 249056 - protein, 21 aa, Mycobacterium
ARTGRRIGDPRLRAGAQDYAA

SEQ ID NO: 249057 - protein, 11 aa, Mycobacterium
ARTGSAPVTRS

SEQ ID NO: 249058 - protein, 10 aa, Mycobacterium
ARTGTDHRAE

SEQ ID NO: 249059 - protein, 16 aa, Mycobacterium
ARTGTEEESKAAIGDA

SEQ ID NO: 249060 - protein, 5 aa, Mycobacterium
ARTGY

SEQ ID NO: 249061 - protein, 10 aa, Mycobacterium
ARTIGGASDW

SEQ ID NO: 249062 - protein, 11 aa, Mycobacterium
ARTLPTDTDKL

SEQ ID NO: 249063 - protein, 16 aa, Mycobacterium
ARTNNRAGNPVGSSYL

SEQ ID NO: 249064 - protein, 14 aa, Mycobacterium
ARTNNRASNPVGAS

SEQ ID NO: 249065 - protein, 5 aa, Mycobacterium
ARTNP

SEQ ID NO: 249066 - protein, 8 aa, Mycobacterium
ARTPADRD

SEQ ID NO: 249067 - protein, 9 aa, Mycobacterium
ARTPDEQVS

SEQ ID NO: 249068 - protein, 14 aa, Mycobacterium
ARTPDGSAPSREAL

SEQ ID NO: 249069 - protein, 15 aa, Mycobacterium
ARTPDGSAPTRDALN

SEQ ID NO: 249070 - protein, 13 aa, Mycobacterium
ARTPDGSEPSRDA

SEQ ID NO: 249071 - protein, 16 aa, Mycobacterium
ARTPDGSKPTKEALTQ

SEQ ID NO: 249072 - protein, 14 aa, Mycobacterium
ARTPDGSRPSRDAL

SEQ ID NO: 249073 - protein, 14 aa, Mycobacterium
ARTPDGSRPSREAL

SEQ ID NO: 249074 - protein, 14 aa, Mycobacterium
ARTPDKALESALTA

SEQ ID NO: 249075 - protein, 6 aa, Mycobacterium
ARTPDR

SEQ ID NO: 249076 - protein, 6 aa, Mycobacterium
ARTPEA

SEQ ID NO: 249077 - protein, 10 aa, Mycobacterium
ARTPEDTAAL

SEQ ID NO: 249078 - protein, 8 aa, Mycobacterium
ARTPEETA

SEQ ID NO: 249079 - protein, 6 aa, Mycobacterium
ARTPKR

SEQ ID NO: 249080 - protein, 7 aa, Mycobacterium
ARTPQAE

SEQ ID NO: 249081 - protein, 17 aa, Mycobacterium
ARTPRRRSVMAPIVGGA

SEQ ID NO: 249082 - protein, 12 aa, Mycobacterium
ARTPRSSDVRNT

SEQ ID NO: 249083 - protein, 9 aa, Mycobacterium
ARTPSAPRS

SEQ ID NO: 249084 - protein, 4 aa, Mycobacterium
ARTR

SEQ ID NO: 249085 - protein, 10 aa, Mycobacterium
ARTRDHGGAG

SEQ ID NO: 249086 - protein, 7 aa, Mycobacterium
ARTRGGG

SEQ ID NO: 249087 - protein, 14 aa, Mycobacterium
ARTRQSMRPIPAGT

SEQ ID NO: 249088 - protein, 25 aa, Mycobacterium
ARTSSGPVSWPTPAGRQSGSPYSSN

SEQ ID NO: 249089 - protein, 8 aa, Mycobacterium
ARTSTGEA

SEQ ID NO: 249090 - protein, 4 aa, Mycobacterium
ARTT

SEQ ID NO: 249091 - protein, 5 aa, Mycobacterium
ARTTA

SEQ ID NO: 249092 - protein, 6 aa, Mycobacterium
ARTTAA

SEQ ID NO: 249093 - protein, 11 aa, Mycobacterium
ARTTAAATTST

SEQ ID NO: 249094 - protein, 10 aa, Mycobacterium
ARTTRPHAGE

SEQ ID NO: 249095 - protein, 18 aa, Mycobacterium
ARTTRPHAGETLKDTANI

SEQ ID NO: 249096 - protein, 19 aa, Mycobacterium
ARTTRQHAGETMKAGVNAP

SEQ ID NO: 249097 - protein, 5 aa, Mycobacterium
ARTVA

SEQ ID NO: 249098 - protein, 6 aa, Mycobacterium
ARTVPA

SEQ ID NO: 249099 - protein, 20 aa, Mycobacterium
ARTVRQPRTRFGGRQRSATP

SEQ ID NO: 249100 - protein, 7 aa, Mycobacterium
ARVDAAG

SEQ ID NO: 249101 - protein, 9 aa, Mycobacterium
ARVDGGPES

SEQ ID NO: 249102 - protein, 8 aa, Mycobacterium
ARVDGTSR

SEQ ID NO: 249103 - protein, 6 aa, Mycobacterium
ARVDHT

SEQ ID NO: 249104 - protein, 5 aa, Mycobacterium
ARVDR

SEQ ID NO: 249105 - protein, 13 aa, Mycobacterium
ARVEGDTPGQGPH

SEQ ID NO: 249106 - protein, 5 aa, Mycobacterium
ARVGN

SEQ ID NO: 249107 - protein, 6 aa, Mycobacterium
ARVGPR

SEQ ID NO: 249108 - protein, 7 aa, Mycobacterium
ARVGPRQ

SEQ ID NO: 249109 - protein, 10 aa, Mycobacterium
ARVQRGPKRE

SEQ ID NO: 249110 - protein, 4 aa, Mycobacterium
ARVR

SEQ ID NO: 249111 - protein, 10 aa, Mycobacterium
ARVRQTAGNS

SEQ ID NO: 249112 - protein, 5 aa, Mycobacterium
ARWSA

SEQ ID NO: 249113 - protein, 4 aa, Mycobacterium
ARYG

SEQ ID NO: 249114 - protein, 10 aa, Mycobacterium
ARYGGSTPGV

SEQ ID NO: 249115 - protein, 8 aa, Mycobacterium
ARYGPNAV

SEQ ID NO: 249116 - protein, 6 aa, Mycobacterium
ARYGRR

SEQ ID NO: 249117 - protein, 7 aa, Mycobacterium
ARYPDAA

SEQ ID NO: 249118 - protein, 7 aa, Mycobacterium
ARYPDQQ

SEQ ID NO: 249119 - protein, 6 aa, Mycobacterium
ARYPDR

SEQ ID NO: 249120 - protein, 7 aa, Mycobacterium
ARYPSRE

SEQ ID NO: 249121 - protein, 12 aa, Mycobacterium
ARYTDPNTRSFT

SEQ ID NO: 249122 - protein, 12 aa, Mycobacterium
ARYTDPSARSFA

SEQ ID NO: 249123 - protein, 4 aa, Mycobacterium
ASAA

SEQ ID NO: 249124 - protein, 6 aa, Mycobacterium
ASAAAA

SEQ ID NO: 249125 - protein, 13 aa, Mycobacterium
ASAAAEDAERIGA

SEQ ID NO: 249126 - protein, 13 aa, Mycobacterium
ASAAAEQAERIGA

SEQ ID NO: 249127 - protein, 8 aa, Mycobacterium
ASAAEQTR

SEQ ID NO: 249128 - protein, 5 aa, Mycobacterium
ASAAG

SEQ ID NO: 249129 - protein, 6 aa, Mycobacterium
ASAAGA

SEQ ID NO: 249130 - protein, 12 aa, Mycobacterium
ASAAMPARRTGP

SEQ ID NO: 249131 - protein, 5 aa, Mycobacterium
ASAAS

SEQ ID NO: 249132 - protein, 14 aa, Mycobacterium
ASAASEFSEPLPTG

SEQ ID NO: 249133 - protein, 15 aa, Mycobacterium
ASAASEFSEPLPTGA

SEQ ID NO: 249134 - protein, 11 aa, Mycobacterium
ASAATDVAQGN

SEQ ID NO: 249135 - protein, 12 aa, Mycobacterium
ASAATDVAQGNY

SEQ ID NO: 249136 - protein, 10 aa, Mycobacterium
ASAATKGPVI

SEQ ID NO: 249137 - protein, 8 aa, Mycobacterium
ASAATLGG

SEQ ID NO: 249138 - protein, 13 aa, Mycobacterium
ASAATQAAVGTSL

SEQ ID NO: 249139 - protein, 11 aa, Mycobacterium
ASAAYISPDGH

SEQ ID NO: 249140 - protein, 5 aa, Mycobacterium
ASADA

SEQ ID NO: 249141 - protein, 27 aa, Mycobacterium
ASADGGGSQAPQRSEWAGQSRTTVTTG

SEQ ID NO: 249142 - protein, 24 aa, Mycobacterium
ASADIGSAVPPGRPAPDSRTRATR

SEQ ID NO: 249143 - protein, 37 aa, Mycobacterium
ASADPCGPDGCGGGGNGQGSYGPDTGNFQPPQMPNQM

SEQ ID NO: 249144 - protein, 9 aa, Mycobacterium
ASADPGRKF

SEQ ID NO: 249145 - protein, 8 aa, Mycobacterium
ASADPPFR

SEQ ID NO: 249146 - protein, 7 aa, Mycobacterium
ASADRRG

SEQ ID NO: 249147 - protein, 5 aa, Mycobacterium
ASADT

SEQ ID NO: 249148 - protein, 22 aa, Mycobacterium
ASADTTQTPESGPDTGTGAITA

SEQ ID NO: 249149 - protein, 4 aa, Mycobacterium
ASAE

SEQ ID NO: 249150 - protein, 5 aa, Mycobacterium
ASAEE

SEQ ID NO: 249151 - protein, 7 aa, Mycobacterium
ASAEGAL

SEQ ID NO: 249152 - protein, 9 aa, Mycobacterium
ASAEKYYDP

SEQ ID NO: 249153 - protein, 11 aa, Mycobacterium
ASAETGPPVDH

SEQ ID NO: 249154 - protein, 33 aa, Mycobacterium
ASAFAPPSPQATSPAPSAPSPAPTGSPPSSPAI

SEQ ID NO: 249155 - protein, 4 aa, Mycobacterium
ASAG

SEQ ID NO: 249156 - protein, 10 aa, Mycobacterium
ASAGAPGDPL

SEQ ID NO: 249157 - protein, 10 aa, Mycobacterium
ASAGAPGDPV

SEQ ID NO: 249158 - protein, 7 aa, Mycobacterium
ASAGHYT

SEQ ID NO: 249159 - protein, 7 aa, Mycobacterium
ASAGPAV

SEQ ID NO: 249160 - protein, 10 aa, Mycobacterium
ASAGPGGGAT

SEQ ID NO: 249161 - protein, 7 aa, Mycobacterium
ASAGTVA

SEQ ID NO: 249162 - protein, 6 aa, Mycobacterium
ASAHAS

SEQ ID NO: 249163 - protein, 4 aa, Mycobacterium
ASAI

SEQ ID NO: 249164 - protein, 13 aa, Mycobacterium
ASAIAKASLDASI

SEQ ID NO: 249165 - protein, 7 aa, Mycobacterium
ASAIGNA

SEQ ID NO: 249166 - protein, 8 aa, Mycobacterium
ASAIGPGA

SEQ ID NO: 249167 - protein, 14 aa, Mycobacterium
ASAIRTPDDARHTY

SEQ ID NO: 249168 - protein, 7 aa, Mycobacterium
ASAITGG

SEQ ID NO: 249169 - protein, 14 aa, Mycobacterium
ASALAATAELERGA

SEQ ID NO: 249170 - protein, 9 aa, Mycobacterium
ASALERARS

SEQ ID NO: 249171 - protein, 6 aa, Mycobacterium
ASALGG

SEQ ID NO: 249172 - protein, 7 aa, Mycobacterium
ASAMGQA

SEQ ID NO: 249173 - protein, 6 aa, Mycobacterium
ASANAQ

SEQ ID NO: 249174 - protein, 7 aa, Mycobacterium
ASANDVY

SEQ ID NO: 249175 - protein, 6 aa, Mycobacterium
ASANGI

SEQ ID NO: 249176 - protein, 9 aa, Mycobacterium
ASANGSIAV

SEQ ID NO: 249177 - protein, 26 aa, Mycobacterium
ASANNEMNPDSAPPKTALRSGGPESL

SEQ ID NO: 249178 - protein, 26 aa, Mycobacterium
ASANNEMNPDTAPPRTPLRSGGPESL

SEQ ID NO: 249179 - protein, 8 aa, Mycobacterium
ASANPPVT

SEQ ID NO: 249180 - protein, 4 aa, Mycobacterium
ASAP

SEQ ID NO: 249181 - protein, 7 aa, Mycobacterium
ASAPAAA

SEQ ID NO: 249182 - protein, 10 aa, Mycobacterium
ASAPAKVSAA

SEQ ID NO: 249183 - protein, 6 aa, Mycobacterium
ASAPAL

SEQ ID NO: 249184 - protein, 8 aa, Mycobacterium
ASAPANIG

SEQ ID NO: 249185 - protein, 6 aa, Mycobacterium
ASAPEV

SEQ ID NO: 249186 - protein, 6 aa, Mycobacterium
ASAPGE

SEQ ID NO: 249187 - protein, 8 aa, Mycobacterium
ASAPGEKG

SEQ ID NO: 249188 - protein, 15 aa, Mycobacterium
ASAPGQPPQSGLARI

SEQ ID NO: 249189 - protein, 10 aa, Mycobacterium
ASAPHAPPAP

SEQ ID NO: 249190 - protein, 9 aa, Mycobacterium
ASAPNPASP

SEQ ID NO: 249191 - protein, 15 aa, Mycobacterium
ASAPPGAPPTAGSGA

SEQ ID NO: 249192 - protein, 12 aa, Mycobacterium
ASAPPGSVGSPQ

SEQ ID NO: 249193 - protein, 23 aa, Mycobacterium
ASAPPTAPTSAPRPSGRPSAGLD

SEQ ID NO: 249194 - protein, 12 aa, Mycobacterium
ASAPSNLGEAAA

SEQ ID NO: 249195 - protein, 6 aa, Mycobacterium
ASAPSV

SEQ ID NO: 249196 - protein, 14 aa, Mycobacterium
ASAPVQTASAQPMA

SEQ ID NO: 249197 - protein, 10 aa, Mycobacterium
ASAQITTAAE

SEQ ID NO: 249198 - protein, 4 aa, Mycobacterium
ASAR

SEQ ID NO: 249199 - protein, 12 aa, Mycobacterium
ASARGAEENRRG

SEQ ID NO: 249200 - protein, 6 aa, Mycobacterium
ASARQA

SEQ ID NO: 249201 - protein, 24 aa, Mycobacterium
ASARRHASELQSGVHGKAQSTLAD

SEQ ID NO: 249202 - protein, 10 aa, Mycobacterium
ASARTESMPG

SEQ ID NO: 249203 - protein, 11 aa, Mycobacterium
ASARVQPRAGE

SEQ ID NO: 249204 - protein, 11 aa, Mycobacterium
ASASAASGPAI

SEQ ID NO: 249205 - protein, 10 aa, Mycobacterium
ASASAGGALP

SEQ ID NO: 249206 - protein, 6 aa, Mycobacterium
ASASKA

SEQ ID NO: 249207 - protein, 6 aa, Mycobacterium
ASASSH

SEQ ID NO: 249208 - protein, 5 aa, Mycobacterium
ASAST

SEQ ID NO: 249209 - protein, 15 aa, Mycobacterium
ASATAAAGAVAPDGP

SEQ ID NO: 249210 - protein, 16 aa, Mycobacterium
ASATAEAAESTQAQPQ

SEQ ID NO: 249211 - protein, 7 aa, Mycobacterium
ASATANS

SEQ ID NO: 249212 - protein, 9 aa, Mycobacterium
ASATGAQAF

SEQ ID NO: 249213 - protein, 8 aa, Mycobacterium
ASATKAKT

SEQ ID NO: 249214 - protein, 8 aa, Mycobacterium
ASATKATT

SEQ ID NO: 249215 - protein, 14 aa, Mycobacterium
ASATPESDADAAIN

SEQ ID NO: 249216 - protein, 12 aa, Mycobacterium
ASATQSQPPLPA

SEQ ID NO: 249217 - protein, 6 aa, Mycobacterium
ASATRR

SEQ ID NO: 249218 - protein, 5 aa, Mycobacterium
ASATS

SEQ ID NO: 249219 - protein, 9 aa, Mycobacterium
ASATSALTI

SEQ ID NO: 249220 - protein, 7 aa, Mycobacterium
ASATTAS

SEQ ID NO: 249221 - protein, 7 aa, Mycobacterium
ASATVSG

SEQ ID NO: 249222 - protein, 7 aa, Mycobacterium
ASAVLGS

SEQ ID NO: 249223 - protein, 8 aa, Mycobacterium
ASAVNNAA

SEQ ID NO: 249224 - protein, 9 aa, Mycobacterium
ASAVTGGQA

SEQ ID NO: 249225 - protein, 28 aa, Mycobacterium
ASCNPPPQPAGSTVPPRLGEPVSRTEMT

SEQ ID NO: 249226 - protein, 19 aa, Mycobacterium
ASCNSKADSKADSDTEPET

SEQ ID NO: 249227 - protein, 4 aa, Mycobacterium
ASCS

SEQ ID NO: 249228 - protein, 6 aa, Mycobacterium
ASDAAL

SEQ ID NO: 249229 - protein, 10 aa, Mycobacterium
ASDAARAMRD

SEQ ID NO: 249230 - protein, 13 aa, Mycobacterium
ASDAAREAERIGA

SEQ ID NO: 249231 - protein, 8 aa, Mycobacterium
ASDAGPYL

SEQ ID NO: 249232 - protein, 7 aa, Mycobacterium
ASDAPLL

SEQ ID NO: 249233 - protein, 7 aa, Mycobacterium
ASDAPML

SEQ ID NO: 249234 - protein, 10 aa, Mycobacterium
ASDDARPNAS

SEQ ID NO: 249235 - protein, 36 aa, Mycobacterium
ASDDGTVTVAPAPRLSRTPARLRPAPASRGADTSAV

SEQ ID NO: 249236 - protein, 8 aa, Mycobacterium
ASDDTMAD

SEQ ID NO: 249237 - protein, 8 aa, Mycobacterium
ASDDTTVR

SEQ ID NO: 249238 - protein, 28 aa, Mycobacterium
ASDEAAPAADESVETSGSGETAAPKTTR

SEQ ID NO: 249239 - protein, 5 aa, Mycobacterium
ASDGF

SEQ ID NO: 249240 - protein, 18 aa, Mycobacterium
ASDGGATEDGSDGGGRTA

SEQ ID NO: 249241 - protein, 10 aa, Mycobacterium
ASDGQACENR

SEQ ID NO: 249242 - protein, 16 aa, Mycobacterium
ASDGTDTTDGRASGVR

SEQ ID NO: 249243 - protein, 8 aa, Mycobacterium
ASDGVPTR

SEQ ID NO: 249244 - protein, 8 aa, Mycobacterium
ASDHGAGA

SEQ ID NO: 249245 - protein, 13 aa, Mycobacterium
ASDIGNGRGPVDD

SEQ ID NO: 249246 - protein, 6 aa, Mycobacterium
ASDNGS

SEQ ID NO: 249247 - protein, 9 aa, Mycobacterium
ASDPDGDAL

SEQ ID NO: 249248 - protein, 7 aa, Mycobacterium
ASDPDLP

SEQ ID NO: 249249 - protein, 9 aa, Mycobacterium
ASDPPAWRD

SEQ ID NO: 249250 - protein, 6 aa, Mycobacterium
ASDPSA

SEQ ID NO: 249251 - protein, 9 aa, Mycobacterium
ASDPSITLT

SEQ ID NO: 249252 - protein, 15 aa, Mycobacterium
ASDQGAGLSGFAGTA

SEQ ID NO: 249253 - protein, 5 aa, Mycobacterium
ASDQL

SEQ ID NO: 249254 - protein, 6 aa, Mycobacterium
ASDQLA

SEQ ID NO: 249255 - protein, 5 aa, Mycobacterium
ASDQS

SEQ ID NO: 249256 - protein, 11 aa, Mycobacterium
ASDQTENETGY

SEQ ID NO: 249257 - protein, 5 aa, Mycobacterium
ASDRF

SEQ ID NO: 249258 - protein, 8 aa, Mycobacterium
ASDRNRRS

SEQ ID NO: 249259 - protein, 10 aa, Mycobacterium
ASDRPRPPTA

SEQ ID NO: 249260 - protein, 14 aa, Mycobacterium
ASDRTTTEVPAGEV

SEQ ID NO: 249261 - protein, 4 aa, Mycobacterium
ASDS

SEQ ID NO: 249262 - protein, 8 aa, Mycobacterium
ASDSAAEP

SEQ ID NO: 249263 - protein, 12 aa, Mycobacterium
ASDSGSARSSAI

SEQ ID NO: 249264 - protein, 10 aa, Mycobacterium
ASDSGTPGRV

SEQ ID NO: 249265 - protein, 11 aa, Mycobacterium
ASDSISSARRS

SEQ ID NO: 249266 - protein, 6 aa, Mycobacterium
ASDSTL

SEQ ID NO: 249267 - protein, 7 aa, Mycobacterium
ASDSVTR

SEQ ID NO: 249268 - protein, 7 aa, Mycobacterium
ASDTPCG

SEQ ID NO: 249269 - protein, 7 aa, Mycobacterium
ASDTPHR

SEQ ID NO: 249270 - protein, 6 aa, Mycobacterium
ASDVAG

SEQ ID NO: 249271 - protein, 6 aa, Mycobacterium
ASDVPT

SEQ ID NO: 249272 - protein, 11 aa, Mycobacterium
ASDYARAGEAI

SEQ ID NO: 249273 - protein, 36 aa, Mycobacterium
ASEAATDPASCGGCGSPPAVTSGTLSADEQSRRERR

SEQ ID NO: 249274 - protein, 11 aa, Mycobacterium
ASEAKAAEEQV

SEQ ID NO: 249275 - protein, 12 aa, Mycobacterium
ASEAQSTEARQA

SEQ ID NO: 249276 - protein, 8 aa, Mycobacterium
ASEASQTG

SEQ ID NO: 249277 - protein, 6 aa, Mycobacterium
ASEDEV

SEQ ID NO: 249278 - protein, 6 aa, Mycobacterium
ASEDFT

SEQ ID NO: 249279 - protein, 15 aa, Mycobacterium
ASEDSAEKARSSEER

SEQ ID NO: 249280 - protein, 5 aa, Mycobacterium
ASEDV

SEQ ID NO: 249281 - protein, 18 aa, Mycobacterium
ASEEATERHRRSQQGAKA

SEQ ID NO: 249282 - protein, 5 aa, Mycobacterium
ASEGA

SEQ ID NO: 249283 - protein, 7 aa, Mycobacterium
ASEGAPR

SEQ ID NO: 249284 - protein, 7 aa, Mycobacterium
ASEGEQA

SEQ ID NO: 249285 - protein, 12 aa, Mycobacterium
ASEGLDGQRPGR

SEQ ID NO: 249286 - protein, 8 aa, Mycobacterium
ASEGLPRT

SEQ ID NO: 249287 - protein, 5 aa, Mycobacterium
ASEGS

SEQ ID NO: 249288 - protein, 18 aa, Mycobacterium
ASEHDDKTVRQTSCTSGT

SEQ ID NO: 249289 - protein, 12 aa, Mycobacterium
ASEHMPPTRRRA

SEQ ID NO: 249290 - protein, 15 aa, Mycobacterium
ASELAEETRNPRRVA

SEQ ID NO: 249291 - protein, 55 aa, Mycobacterium
ASELGPCGAARTPNSDAAAPAEPQRPGATPDTSGTAEKPARSKTVTPPPSQATPA

SEQ ID NO: 249292 - protein, 16 aa, Mycobacterium
ASELTGSQCGCCERRA

SEQ ID NO: 249293 - protein, 10 aa, Mycobacterium
ASELTKRPTS

SEQ ID NO: 249294 - protein, 5 aa, Mycobacterium
ASEMG

SEQ ID NO: 249295 - protein, 9 aa, Mycobacterium
ASENLADAS

SEQ ID NO: 249296 - protein, 19 aa, Mycobacterium
ASEPAPVAADAAPAGEPAM

SEQ ID NO: 249297 - protein, 9 aa, Mycobacterium
ASEPGDNND

SEQ ID NO: 249298 - protein, 9 aa, Mycobacterium
ASEPLSQPP

SEQ ID NO: 249299 - protein, 7 aa, Mycobacterium
ASEPPAP

SEQ ID NO: 249300 - protein, 12 aa, Mycobacterium
ASEPPSGLEPGR

SEQ ID NO: 249301 - protein, 14 aa, Mycobacterium
ASEPSEDDKDAARA

SEQ ID NO: 249302 - protein, 7 aa, Mycobacterium
ASEQEGA

SEQ ID NO: 249303 - protein, 6 aa, Mycobacterium
ASEQER

SEQ ID NO: 249304 - protein, 7 aa, Mycobacterium
ASEQERA

SEQ ID NO: 249305 - protein, 20 aa, Mycobacterium
ASERRAQKAADAARRAETAT

SEQ ID NO: 249306 - protein, 36 aa, Mycobacterium
ASERTRLPSTPTPRQHDPSAPARPTPPPPAPPTAPV

SEQ ID NO: 249307 - protein, 5 aa, Mycobacterium
ASESA

SEQ ID NO: 249308 - protein, 11 aa, Mycobacterium
ASESLSAARRT

SEQ ID NO: 249309 - protein, 6 aa, Mycobacterium
ASESNT

SEQ ID NO: 249310 - protein, 7 aa, Mycobacterium
ASESREF

SEQ ID NO: 249311 - protein, 6 aa, Mycobacterium
ASESTT

SEQ ID NO: 249312 - protein, 6 aa, Mycobacterium
ASETER

SEQ ID NO: 249313 - protein, 8 aa, Mycobacterium
ASETPSFE

SEQ ID NO: 249314 - protein, 4 aa, Mycobacterium
ASEV

SEQ ID NO: 249315 - protein, 24 aa, Mycobacterium
ASEVDQATITGEPLPVDKTTGDEV

SEQ ID NO: 249316 - protein, 6 aa, Mycobacterium
ASEVED

SEQ ID NO: 249317 - protein, 6 aa, Mycobacterium
ASEVEE

SEQ ID NO: 249318 - protein, 4 aa, Mycobacterium
ASEY

SEQ ID NO: 249319 - protein, 10 aa, Mycobacterium
ASFAAGDAAT

SEQ ID NO: 249320 - protein, 21 aa, Mycobacterium
ASFAEADAAAEQPPGPPPADL

SEQ ID NO: 249321 - protein, 7 aa, Mycobacterium
ASFATSG

SEQ ID NO: 249322 - protein, 12 aa, Mycobacterium
ASFDKNTEDSFG

SEQ ID NO: 249323 - protein, 5 aa, Mycobacterium
ASFDP

SEQ ID NO: 249324 - protein, 5 aa, Mycobacterium
ASFGG

SEQ ID NO: 249325 - protein, 31 aa, Mycobacterium
ASFGPHNDTTRAGVQQPLQPERSGSPASLSS

SEQ ID NO: 249326 - protein, 6 aa, Mycobacterium
ASFPSG

SEQ ID NO: 249327 - protein, 4 aa, Mycobacterium
ASGA

SEQ ID NO: 249328 - protein, 5 aa, Mycobacterium
ASGAA

SEQ ID NO: 249329 - protein, 11 aa, Mycobacterium
ASGAAASGPAI

SEQ ID NO: 249330 - protein, 7 aa, Mycobacterium
ASGAARA

SEQ ID NO: 249331 - protein, 6 aa, Mycobacterium
ASGADQ

SEQ ID NO: 249332 - protein, 9 aa, Mycobacterium
ASGAGDSST

SEQ ID NO: 249333 - protein, 6 aa, Mycobacterium
ASGAGK

SEQ ID NO: 249334 - protein, 10 aa, Mycobacterium
ASGAKLTEMP

SEQ ID NO: 249335 - protein, 7 aa, Mycobacterium
ASGALKP

SEQ ID NO: 249336 - protein, 9 aa, Mycobacterium
ASGALKPKT

SEQ ID NO: 249337 - protein, 20 aa, Mycobacterium
ASGALTDQEYNSRRAQIIAE

SEQ ID NO: 249338 - protein, 8 aa, Mycobacterium
ASGARAAT

SEQ ID NO: 249339 - protein, 11 aa, Mycobacterium
ASGATASGWSA

SEQ ID NO: 249340 - protein, 11 aa, Mycobacterium
ASGAVRPPGAD

SEQ ID NO: 249341 - protein, 7 aa, Mycobacterium
ASGDGAV

SEQ ID NO: 249342 - protein, 5 aa, Mycobacterium
ASGDH

SEQ ID NO: 249343 - protein, 11 aa, Mycobacterium
ASGDLARTEDR

SEQ ID NO: 249344 - protein, 9 aa, Mycobacterium
ASGDLTQAS

SEQ ID NO: 249345 - protein, 9 aa, Mycobacterium
ASGDRGAAV

SEQ ID NO: 249346 - protein, 4 aa, Mycobacterium
ASGE

SEQ ID NO: 249347 - protein, 6 aa, Mycobacterium
ASGEEI

SEQ ID NO: 249348 - protein, 9 aa, Mycobacterium
ASGELPEPN

SEQ ID NO: 249349 - protein, 29 aa, Mycobacterium
ASGEPNGRPHVEPPPPGEGPCATPPSGNH

SEQ ID NO: 249350 - protein, 7 aa, Mycobacterium
ASGESGS

SEQ ID NO: 249351 - protein, 8 aa, Mycobacterium
ASGESKGK

SEQ ID NO: 249352 - protein, 8 aa, Mycobacterium
ASGESKSK

SEQ ID NO: 249353 - protein, 8 aa, Mycobacterium
ASGEYQPL

SEQ ID NO: 249354 - protein, 21 aa, Mycobacterium
ASGFEPIDETTRHPDFSGDQI

SEQ ID NO: 249355 - protein, 8 aa, Mycobacterium
ASGGADNT

SEQ ID NO: 249356 - protein, 6 aa, Mycobacterium
ASGGDG

SEQ ID NO: 249357 - protein, 5 aa, Mycobacterium
ASGGG

SEQ ID NO: 249358 - protein, 7 aa, Mycobacterium
ASGGGAA

SEQ ID NO: 249359 - protein, 13 aa, Mycobacterium
ASGGGDAENGSGS

SEQ ID NO: 249360 - protein, 11 aa, Mycobacterium
ASGGGGWGPVT

SEQ ID NO: 249361 - protein, 12 aa, Mycobacterium
ASGGGGWGPVTT

SEQ ID NO: 249362 - protein, 8 aa, Mycobacterium
ASGGGTDK

SEQ ID NO: 249363 - protein, 5 aa, Mycobacterium
ASGGL

SEQ ID NO: 249364 - protein, 19 aa, Mycobacterium
ASGGNAPGPRTDPLPRQPL

SEQ ID NO: 249365 - protein, 7 aa, Mycobacterium
ASGGNDN

SEQ ID NO: 249366 - protein, 7 aa, Mycobacterium
ASGGNDR

SEQ ID NO: 249367 - protein, 7 aa, Mycobacterium
ASGGNTL

SEQ ID NO: 249368 - protein, 21 aa, Mycobacterium
ASGGPNCRGLPDVPSKQYGGS

SEQ ID NO: 249369 - protein, 7 aa, Mycobacterium
ASGGRDL

SEQ ID NO: 249370 - protein, 9 aa, Mycobacterium
ASGGSVPAV

SEQ ID NO: 249371 - protein, 7 aa, Mycobacterium
ASGGTDV

SEQ ID NO: 249372 - protein, 8 aa, Mycobacterium
ASGGTSTV

SEQ ID NO: 249373 - protein, 6 aa, Mycobacterium
ASGGVQ

SEQ ID NO: 249374 - protein, 5 aa, Mycobacterium
ASGHR

SEQ ID NO: 249375 - protein, 8 aa, Mycobacterium
ASGHTRAP

SEQ ID NO: 249376 - protein, 8 aa, Mycobacterium
ASGITGAD

SEQ ID NO: 249377 - protein, 8 aa, Mycobacterium
ASGKELRG

SEQ ID NO: 249378 - protein, 19 aa, Mycobacterium
ASGKELSGLSANDYPGARA

SEQ ID NO: 249379 - protein, 13 aa, Mycobacterium
ASGKETRGNGTAA

SEQ ID NO: 249380 - protein, 11 aa, Mycobacterium
ASGLAGARATA

SEQ ID NO: 249381 - protein, 6 aa, Mycobacterium
ASGLGA

SEQ ID NO: 249382 - protein, 8 aa, Mycobacterium
ASGLGPPI

SEQ ID NO: 249383 - protein, 8 aa, Mycobacterium
ASGLGPPV

SEQ ID NO: 249384 - protein, 10 aa, Mycobacterium
ASGLNPGDFD

SEQ ID NO: 249385 - protein, 7 aa, Mycobacterium
ASGLRSG

SEQ ID NO: 249386 - protein, 5 aa, Mycobacterium
ASGLT

SEQ ID NO: 249387 - protein, 9 aa, Mycobacterium
ASGMSNRDV

SEQ ID NO: 249388 - protein, 5 aa, Mycobacterium
ASGNA

SEQ ID NO: 249389 - protein, 6 aa, Mycobacterium
ASGNPM

SEQ ID NO: 249390 - protein, 12 aa, Mycobacterium
ASGNVRSEDDAR

SEQ ID NO: 249391 - protein, 6 aa, Mycobacterium
ASGPAA

SEQ ID NO: 249392 - protein, 10 aa, Mycobacterium
ASGPEAAANP

SEQ ID NO: 249393 - protein, 6 aa, Mycobacterium
ASGPGD

SEQ ID NO: 249394 - protein, 9 aa, Mycobacterium
ASGPGPGAP

SEQ ID NO: 249395 - protein, 9 aa, Mycobacterium
ASGPPKSGF

SEQ ID NO: 249396 - protein, 8 aa, Mycobacterium
ASGPPLPP

SEQ ID NO: 249397 - protein, 8 aa, Mycobacterium
ASGPQRVS

SEQ ID NO: 249398 - protein, 7 aa, Mycobacterium
ASGPVDL

SEQ ID NO: 249399 - protein, 10 aa, Mycobacterium
ASGQAVAGNI

SEQ ID NO: 249400 - protein, 13 aa, Mycobacterium
ASGQGGQAGEIAS

SEQ ID NO: 249401 - protein, 12 aa, Mycobacterium
ASGQGGQAGEVA

SEQ ID NO: 249402 - protein, 11 aa, Mycobacterium
ASGQLAQAEDR

SEQ ID NO: 249403 - protein, 5 aa, Mycobacterium
ASGQR

SEQ ID NO: 249404 - protein, 7 aa, Mycobacterium
ASGQRMY

SEQ ID NO: 249405 - protein, 6 aa, Mycobacterium
ASGQVQ

SEQ ID NO: 249406 - protein, 13 aa, Mycobacterium
ASGRGGQAADVAG

SEQ ID NO: 249407 - protein, 12 aa, Mycobacterium
ASGRGGQAGDIA

SEQ ID NO: 249408 - protein, 9 aa, Mycobacterium
ASGRPTMGA

SEQ ID NO: 249409 - protein, 18 aa, Mycobacterium
ASGRRSVRERGGESSREL

SEQ ID NO: 249410 - protein, 9 aa, Mycobacterium
ASGRSRTQR

SEQ ID NO: 249411 - protein, 9 aa, Mycobacterium
ASGRSTVGT

SEQ ID NO: 249412 - protein, 14 aa, Mycobacterium
ASGRVSGDSSAPGV

SEQ ID NO: 249413 - protein, 9 aa, Mycobacterium
ASGRYGADS

SEQ ID NO: 249414 - protein, 13 aa, Mycobacterium
ASGSDYPQADSTL

SEQ ID NO: 249415 - protein, 8 aa, Mycobacterium
ASGSGDDT

SEQ ID NO: 249416 - protein, 9 aa, Mycobacterium
ASGSGGPQR

SEQ ID NO: 249417 - protein, 12 aa, Mycobacterium
ASGSPDGLDSAT

SEQ ID NO: 249418 - protein, 15 aa, Mycobacterium
ASGSPQVMGGTESIS

SEQ ID NO: 249419 - protein, 8 aa, Mycobacterium
ASGSQAFP

SEQ ID NO: 249420 - protein, 16 aa, Mycobacterium
ASGSRPPAAPRTTTGF

SEQ ID NO: 249421 - protein, 16 aa, Mycobacterium
ASGSSRNAPQEADEQA

SEQ ID NO: 249422 - protein, 10 aa, Mycobacterium
ASGSSVTLTD

SEQ ID NO: 249423 - protein, 6 aa, Mycobacterium
ASGSTY

SEQ ID NO: 249424 - protein, 4 aa, Mycobacterium
ASGT

SEQ ID NO: 249425 - protein, 6 aa, Mycobacterium
ASGTDA

SEQ ID NO: 249426 - protein, 9 aa, Mycobacterium
ASGTGNQAV

SEQ ID NO: 249427 - protein, 5 aa, Mycobacterium
ASGTP

SEQ ID NO: 249428 - protein, 7 aa, Mycobacterium
ASGTSAV

SEQ ID NO: 249429 - protein, 6 aa, Mycobacterium
ASGTTV

SEQ ID NO: 249430 - protein, 15 aa, Mycobacterium
ASGTYGPDEVYTETK

SEQ ID NO: 249431 - protein, 7 aa, Mycobacterium
ASGVSEA

SEQ ID NO: 249432 - protein, 8 aa, Mycobacterium
ASGVTGAD

SEQ ID NO: 249433 - protein, 15 aa, Mycobacterium
ASGYSISNDTTASAH

SEQ ID NO: 249434 - protein, 6 aa, Mycobacterium
ASHAGQ

SEQ ID NO: 249435 - protein, 8 aa, Mycobacterium
ASHEAPQL

SEQ ID NO: 249436 - protein, 11 aa, Mycobacterium
ASHGATDGRTV

SEQ ID NO: 249437 - protein, 10 aa, Mycobacterium
ASHKAAATSG

SEQ ID NO: 249438 - protein, 28 aa, Mycobacterium
ASHNGHKARVPENLTEPEREPVVTGVTT

SEQ ID NO: 249439 - protein, 4 aa, Mycobacterium
ASHP

SEQ ID NO: 249440 - protein, 4 aa, Mycobacterium
ASHQ

SEQ ID NO: 249441 - protein, 9 aa, Mycobacterium
ASHQGAGSL

SEQ ID NO: 249442 - protein, 7 aa, Mycobacterium
ASHRRST

SEQ ID NO: 249443 - protein, 11 aa, Mycobacterium
ASHSARAQLDE

SEQ ID NO: 249444 - protein, 4 aa, Mycobacterium
ASHT

SEQ ID NO: 249445 - protein, 5 aa, Mycobacterium
ASIAG

SEQ ID NO: 249446 - protein, 6 aa, Mycobacterium
ASIAGG

SEQ ID NO: 249447 - protein, 14 aa, Mycobacterium
ASIAPYDSYPTGDG

SEQ ID NO: 249448 - protein, 9 aa, Mycobacterium
ASIDKQDHA

SEQ ID NO: 249449 - protein, 6 aa, Mycobacterium
ASIEGA

SEQ ID NO: 249450 - protein, 7 aa, Mycobacterium
ASIGAEA

SEQ ID NO: 249451 - protein, 7 aa, Mycobacterium
ASINAPK

SEQ ID NO: 249452 - protein, 12 aa, Mycobacterium
ASINHGNSGGPL

SEQ ID NO: 249453 - protein, 5 aa, Mycobacterium
ASIPA

SEQ ID NO: 249454 - protein, 5 aa, Mycobacterium
ASIPG

SEQ ID NO: 249455 - protein, 9 aa, Mycobacterium
ASKATSAWQ

SEQ ID NO: 249456 - protein, 4 aa, Mycobacterium
ASKF

SEQ ID NO: 249457 - protein, 8 aa, Mycobacterium
ASKGTTTY

SEQ ID NO: 249458 - protein, 13 aa, Mycobacterium
ASKLVDPETGAEI

SEQ ID NO: 249459 - protein, 8 aa, Mycobacterium
ASKNERLN

SEQ ID NO: 249460 - protein, 6 aa, Mycobacterium
ASKPGD

SEQ ID NO: 249461 - protein, 7 aa, Mycobacterium
ASKPGMS

SEQ ID NO: 249462 - protein, 5 aa, Mycobacterium
ASKPQ

SEQ ID NO: 249463 - protein, 11 aa, Mycobacterium
ASKQRAEAETR

SEQ ID NO: 249464 - protein, 7 aa, Mycobacterium
ASKRMTP

SEQ ID NO: 249465 - protein, 7 aa, Mycobacterium
ASKSAPV

SEQ ID NO: 249466 - protein, 7 aa, Mycobacterium
ASKSSTV

SEQ ID NO: 249467 - protein, 14 aa, Mycobacterium
ASLAAANARLGAPR

SEQ ID NO: 249468 - protein, 14 aa, Mycobacterium
ASLAAANARLGAPS

SEQ ID NO: 249469 - protein, 7 aa, Mycobacterium
ASLAESL

SEQ ID NO: 249470 - protein, 5 aa, Mycobacterium
ASLAP

SEQ ID NO: 249471 - protein, 11 aa, Mycobacterium
ASLASTSDAPL

SEQ ID NO: 249472 - protein, 8 aa, Mycobacterium
ASLATAGE

SEQ ID NO: 249473 - protein, 8 aa, Mycobacterium
ASLATSGV

SEQ ID NO: 249474 - protein, 5 aa, Mycobacterium
ASLDA

SEQ ID NO: 249475 - protein, 26 aa, Mycobacterium
ASLDASLQDDLPEESRASGFGRSEST

SEQ ID NO: 249476 - protein, 12 aa, Mycobacterium
ASLDDESRRAAT

SEQ ID NO: 249477 - protein, 5 aa, Mycobacterium
ASLGA

SEQ ID NO: 249478 - protein, 7 aa, Mycobacterium
ASLGGAA

SEQ ID NO: 249479 - protein, 15 aa, Mycobacterium
ASLGGPENATASYQD

SEQ ID NO: 249480 - protein, 7 aa, Mycobacterium
ASLGQQV

SEQ ID NO: 249481 - protein, 6 aa, Mycobacterium
ASLPGD

SEQ ID NO: 249482 - protein, 6 aa, Mycobacterium
ASLPGG

SEQ ID NO: 249483 - protein, 24 aa, Mycobacterium
ASLPLASSDDDSEHAVDDPAGSSV

SEQ ID NO: 249484 - protein, 5 aa, Mycobacterium
ASLPR

SEQ ID NO: 249485 - protein, 6 aa, Mycobacterium
ASLPRG

SEQ ID NO: 249486 - protein, 5 aa, Mycobacterium
ASLQN

SEQ ID NO: 249487 - protein, 8 aa, Mycobacterium
ASLQPNDT

SEQ ID NO: 249488 - protein, 10 aa, Mycobacterium
ASLQSKQSQL

SEQ ID NO: 249489 - protein, 8 aa, Mycobacterium
ASLSDEPA

SEQ ID NO: 249490 - protein, 18 aa, Mycobacterium
ASLSGGQDSQGGGQAGSI

SEQ ID NO: 249491 - protein, 20 aa, Mycobacterium
ASLTASTTKFGAGAQGMQKS

SEQ ID NO: 249492 - protein, 16 aa, Mycobacterium
ASMGRSLSRAAPDIPA

SEQ ID NO: 249493 - protein, 4 aa, Mycobacterium
ASMP

SEQ ID NO: 249494 - protein, 12 aa, Mycobacterium
ASMRQRSSVEAP

SEQ ID NO: 249495 - protein, 7 aa, Mycobacterium
ASMSSDE

SEQ ID NO: 249496 - protein, 5 aa, Mycobacterium
ASMTN

SEQ ID NO: 249497 - protein, 7 aa, Mycobacterium
ASNARGE

SEQ ID NO: 249498 - protein, 4 aa, Mycobacterium
ASND

SEQ ID NO: 249499 - protein, 9 aa, Mycobacterium
ASNDEADEL

SEQ ID NO: 249500 - protein, 10 aa, Mycobacterium
ASNDRGRSLR

SEQ ID NO: 249501 - protein, 10 aa, Mycobacterium
ASNEAEGTVE

SEQ ID NO: 249502 - protein, 4 aa, Mycobacterium
ASNF

SEQ ID NO: 249503 - protein, 4 aa, Mycobacterium
ASNG

SEQ ID NO: 249504 - protein, 8 aa, Mycobacterium
ASNGKPAV

SEQ ID NO: 249505 - protein, 12 aa, Mycobacterium
ASNGVNAVRDDH

SEQ ID NO: 249506 - protein, 13 aa, Mycobacterium
ASNIDSADHLGAA

SEQ ID NO: 249507 - protein, 8 aa, Mycobacterium
ASNPVAVK

SEQ ID NO: 249508 - protein, 19 aa, Mycobacterium
ASNQPSPHPQAEATLPTGD

SEQ ID NO: 249509 - protein, 8 aa, Mycobacterium
ASNRSTPV

SEQ ID NO: 249510 - protein, 14 aa, Mycobacterium
ASNSLKTKSGGDEL

SEQ ID NO: 249511 - protein, 8 aa, Mycobacterium
ASNTRERY

SEQ ID NO: 249512 - protein, 4 aa, Mycobacterium
ASPA

SEQ ID NO: 249513 - protein, 21 aa, Mycobacterium
ASPAAADRNQCAPAGPKSAAV

SEQ ID NO: 249514 - protein, 9 aa, Mycobacterium
ASPAGPTQV

SEQ ID NO: 249515 - protein, 21 aa, Mycobacterium
ASPANTVRGVANDPNQNGGYP

SEQ ID NO: 249516 - protein, 8 aa, Mycobacterium
ASPAPAPV

SEQ ID NO: 249517 - protein, 9 aa, Mycobacterium
ASPARTAAA

SEQ ID NO: 249518 - protein, 7 aa, Mycobacterium
ASPATAA

SEQ ID NO: 249519 - protein, 10 aa, Mycobacterium
ASPATTAPVT

SEQ ID NO: 249520 - protein, 5 aa, Mycobacterium
ASPAW

SEQ ID NO: 249521 - protein, 12 aa, Mycobacterium
ASPDAADPGGFT

SEQ ID NO: 249522 - protein, 11 aa, Mycobacterium
ASPDARPNPVY

SEQ ID NO: 249523 - protein, 6 aa, Mycobacterium
ASPDEG

SEQ ID NO: 249524 - protein, 6 aa, Mycobacterium
ASPDFR

SEQ ID NO: 249525 - protein, 8 aa, Mycobacterium
ASPDPALA

SEQ ID NO: 249526 - protein, 10 aa, Mycobacterium
ASPDPALADN

SEQ ID NO: 249527 - protein, 10 aa, Mycobacterium
ASPDPALANN

SEQ ID NO: 249528 - protein, 9 aa, Mycobacterium
ASPDPELAR

SEQ ID NO: 249529 - protein, 9 aa, Mycobacterium
ASPDPGDRL

SEQ ID NO: 249530 - protein, 7 aa, Mycobacterium
ASPDQGG

SEQ ID NO: 249531 - protein, 8 aa, Mycobacterium
ASPEGPEI

SEQ ID NO: 249532 - protein, 5 aa, Mycobacterium
ASPEH

SEQ ID NO: 249533 - protein, 5 aa, Mycobacterium
ASPEQ

SEQ ID NO: 249534 - protein, 6 aa, Mycobacterium
ASPESY

SEQ ID NO: 249535 - protein, 4 aa, Mycobacterium
ASPF

SEQ ID NO: 249536 - protein, 8 aa, Mycobacterium
ASPFSTSG

SEQ ID NO: 249537 - protein, 7 aa, Mycobacterium
ASPGALT

SEQ ID NO: 249538 - protein, 9 aa, Mycobacterium
ASPGDYEAS

SEQ ID NO: 249539 - protein, 11 aa, Mycobacterium
ASPGGHAGHGE

SEQ ID NO: 249540 - protein, 7 aa, Mycobacterium
ASPGKWD

SEQ ID NO: 249541 - protein, 13 aa, Mycobacterium
ASPGNTDAASTYP

SEQ ID NO: 249542 - protein, 8 aa, Mycobacterium
ASPGPGNM

SEQ ID NO: 249543 - protein, 12 aa, Mycobacterium
ASPGQGDQSSYP

SEQ ID NO: 249544 - protein, 13 aa, Mycobacterium
ASPGSSDAASSYP

SEQ ID NO: 249545 - protein, 9 aa, Mycobacterium
ASPHLTDDP

SEQ ID NO: 249546 - protein, 9 aa, Mycobacterium
ASPHPGDGF

SEQ ID NO: 249547 - protein, 11 aa, Mycobacterium
ASPKAQKGAVS

SEQ ID NO: 249548 - protein, 8 aa, Mycobacterium
ASPKIPAD

SEQ ID NO: 249549 - protein, 9 aa, Mycobacterium
ASPKRAAVT

SEQ ID NO: 249550 - protein, 6 aa, Mycobacterium
ASPKTR

SEQ ID NO: 249551 - protein, 7 aa, Mycobacterium
ASPLESE

SEQ ID NO: 249552 - protein, 13 aa, Mycobacterium
ASPNDCPTGPRDT

SEQ ID NO: 249553 - protein, 9 aa, Mycobacterium
ASPNDPSTI

SEQ ID NO: 249554 - protein, 17 aa, Mycobacterium
ASPPAKVPSEDGRRIDY

SEQ ID NO: 249555 - protein, 6 aa, Mycobacterium
ASPPEI

SEQ ID NO: 249556 - protein, 17 aa, Mycobacterium
ASPPGGGTALHVTIPAR

SEQ ID NO: 249557 - protein, 28 aa, Mycobacterium
ASPPGGMPAQPGTPAKPAVPQSIPPRLG

SEQ ID NO: 249558 - protein, 16 aa, Mycobacterium
ASPPNPNGLPPTPGIP

SEQ ID NO: 249559 - protein, 21 aa, Mycobacterium
ASPPPEDNPPVQQQPNPYAEG

SEQ ID NO: 249560 - protein, 15 aa, Mycobacterium
ASPQCNADPACAAAR

SEQ ID NO: 249561 - protein, 5 aa, Mycobacterium
ASPQE

SEQ ID NO: 249562 - protein, 10 aa, Mycobacterium
ASPQSAPTRA

SEQ ID NO: 249563 - protein, 16 aa, Mycobacterium
ASPRKLSYTRGANSSI

SEQ ID NO: 249564 - protein, 17 aa, Mycobacterium
ASPRNGRTPRDQKQCDQ

SEQ ID NO: 249565 - protein, 18 aa, Mycobacterium
ASPRTGAGTASLTDGGQS

SEQ ID NO: 249566 - protein, 7 aa, Mycobacterium
ASPRTRR

SEQ ID NO: 249567 - protein, 9 aa, Mycobacterium
ASPSASRQI

SEQ ID NO: 249568 - protein, 7 aa, Mycobacterium
ASPSCGV

SEQ ID NO: 249569 - protein, 9 aa, Mycobacterium
ASPSGEDVP

SEQ ID NO: 249570 - protein, 7 aa, Mycobacterium
ASPSGLP

SEQ ID NO: 249571 - protein, 6 aa, Mycobacterium
ASPSIS

SEQ ID NO: 249572 - protein, 7 aa, Mycobacterium
ASPSRAR

SEQ ID NO: 249573 - protein, 20 aa, Mycobacterium
ASPSTAPTPAAAPPADLSGG

SEQ ID NO: 249574 - protein, 22 aa, Mycobacterium
ASPSTASPSAPTPVASTSQPDL

SEQ ID NO: 249575 - protein, 13 aa, Mycobacterium
ASPSVSGRYPNLG

SEQ ID NO: 249576 - protein, 13 aa, Mycobacterium
ASPSVSGRYPNMG

SEQ ID NO: 249577 - protein, 31 aa, Mycobacterium
ASPTAPERAQPTTETTAAPEGEARAIQKPRR

SEQ ID NO: 249578 - protein, 8 aa, Mycobacterium
ASPTHSTV

SEQ ID NO: 249579 - protein, 7 aa, Mycobacterium
ASPTSMQ

SEQ ID NO: 249580 - protein, 13 aa, Mycobacterium
ASPVAEDAERIGA

SEQ ID NO: 249581 - protein, 13 aa, Mycobacterium
ASPVAEEAERIGA

SEQ ID NO: 249582 - protein, 7 aa, Mycobacterium
ASPVPEG

SEQ ID NO: 249583 - protein, 7 aa, Mycobacterium
ASPVPPS

SEQ ID NO: 249584 - protein, 6 aa, Mycobacterium
ASPWAT

SEQ ID NO: 249585 - protein, 10 aa, Mycobacterium
ASPWATPPPT

SEQ ID NO: 249586 - protein, 6 aa, Mycobacterium
ASPYRG

SEQ ID NO: 249587 - protein, 6 aa, Mycobacterium
ASPYVT

SEQ ID NO: 249588 - protein, 6 aa, Mycobacterium
ASQAAQ

SEQ ID NO: 249589 - protein, 24 aa, Mycobacterium
ASQAPPSPVSQNPGPQNPFMSPGT

SEQ ID NO: 249590 - protein, 4 aa, Mycobacterium
ASQC

SEQ ID NO: 249591 - protein, 7 aa, Mycobacterium
ASQDPDA

SEQ ID NO: 249592 - protein, 5 aa, Mycobacterium
ASQEA

SEQ ID NO: 249593 - protein, 7 aa, Mycobacterium
ASQETNR

SEQ ID NO: 249594 - protein, 4 aa, Mycobacterium
ASQF

SEQ ID NO: 249595 - protein, 12 aa, Mycobacterium
ASQGSSDGEITT

SEQ ID NO: 249596 - protein, 8 aa, Mycobacterium
ASQHGGNA

SEQ ID NO: 249597 - protein, 6 aa, Mycobacterium
ASQPGR

SEQ ID NO: 249598 - protein, 7 aa, Mycobacterium
ASQPHFE

SEQ ID NO: 249599 - protein, 7 aa, Mycobacterium
ASQQANH

SEQ ID NO: 249600 - protein, 4 aa, Mycobacterium
ASQR

SEQ ID NO: 249601 - protein, 6 aa, Mycobacterium
ASQRMT

SEQ ID NO: 249602 - protein, 11 aa, Mycobacterium
ASQRSNPLSTP

SEQ ID NO: 249603 - protein, 7 aa, Mycobacterium
ASQTSAE

SEQ ID NO: 249604 - protein, 7 aa, Mycobacterium
ASQTSNR

SEQ ID NO: 249605 - protein, 19 aa, Mycobacterium
ASRAAAGEASVDGDQSATY

SEQ ID NO: 249606 - protein, 9 aa, Mycobacterium
ASRADEGRS

SEQ ID NO: 249607 - protein, 7 aa, Mycobacterium
ASRAEAL

SEQ ID NO: 249608 - protein, 8 aa, Mycobacterium
ASRAEDND

SEQ ID NO: 249609 - protein, 13 aa, Mycobacterium
ASRAGQNIDPNTE

SEQ ID NO: 249610 - protein, 10 aa, Mycobacterium
ASRDDGARRI

SEQ ID NO: 249611 - protein, 11 aa, Mycobacterium
ASRDGRSPDAL

SEQ ID NO: 249612 - protein, 10 aa, Mycobacterium
ASRDPEARRQ

SEQ ID NO: 249613 - protein, 11 aa, Mycobacterium
ASRDQADQDSE

SEQ ID NO: 249614 - protein, 5 aa, Mycobacterium
ASREA

SEQ ID NO: 249615 - protein, 8 aa, Mycobacterium
ASREGAPR

SEQ ID NO: 249616 - protein, 7 aa, Mycobacterium
ASREGGE

SEQ ID NO: 249617 - protein, 7 aa, Mycobacterium
ASRESLA

SEQ ID NO: 249618 - protein, 7 aa, Mycobacterium
ASRGHPR

SEQ ID NO: 249619 - protein, 14 aa, Mycobacterium
ASRGSKPGAKKPAA

SEQ ID NO: 249620 - protein, 6 aa, Mycobacterium
ASRGWR

SEQ ID NO: 249621 - protein, 6 aa, Mycobacterium
ASRHEG

SEQ ID NO: 249622 - protein, 8 aa, Mycobacterium
ASRHGRRA

SEQ ID NO: 249623 - protein, 10 aa, Mycobacterium
ASRHSPPGGQ

SEQ ID NO: 249624 - protein, 7 aa, Mycobacterium
ASRKGPV

SEQ ID NO: 249625 - protein, 5 aa, Mycobacterium
ASRLG

SEQ ID NO: 249626 - protein, 7 aa, Mycobacterium
ASRLTGR

SEQ ID NO: 249627 - protein, 4 aa, Mycobacterium
ASRP

SEQ ID NO: 249628 - protein, 8 aa, Mycobacterium
ASRPAGDV

SEQ ID NO: 249629 - protein, 23 aa, Mycobacterium
ASRPAGSVPDEATLANQAGAIGD

SEQ ID NO: 249630 - protein, 7 aa, Mycobacterium
ASRPASA

SEQ ID NO: 249631 - protein, 5 aa, Mycobacterium
ASRPG

SEQ ID NO: 249632 - protein, 8 aa, Mycobacterium
ASRPLGPR

SEQ ID NO: 249633 - protein, 12 aa, Mycobacterium
ASRPPIRSLTAG

SEQ ID NO: 249634 - protein, 10 aa, Mycobacterium
ASRPRGQTEA

SEQ ID NO: 249635 - protein, 10 aa, Mycobacterium
ASRPTNTRLT

SEQ ID NO: 249636 - protein, 26 aa, Mycobacterium
ASRQAENEPVANEERRQAELRQAEER

SEQ ID NO: 249637 - protein, 9 aa, Mycobacterium
ASRQKTPNE

SEQ ID NO: 249638 - protein, 5 aa, Mycobacterium
ASRRK

SEQ ID NO: 249639 - protein, 4 aa, Mycobacterium
ASRS

SEQ ID NO: 249640 - protein, 9 aa, Mycobacterium
ASRSENNDA

SEQ ID NO: 249641 - protein, 12 aa, Mycobacterium
ASRSGDLPPAVN

SEQ ID NO: 249642 - protein, 9 aa, Mycobacterium
ASRSGPGAV

SEQ ID NO: 249643 - protein, 7 aa, Mycobacterium
ASRSKNV

SEQ ID NO: 249644 - protein, 6 aa, Mycobacterium
ASRSLP

SEQ ID NO: 249645 - protein, 10 aa, Mycobacterium
ASRSPTTPAH

SEQ ID NO: 249646 - protein, 12 aa, Mycobacterium
ASRSRRTPARVR

SEQ ID NO: 249647 - protein, 9 aa, Mycobacterium
ASRTADGVA

SEQ ID NO: 249648 - protein, 7 aa, Mycobacterium
ASRTAVA

SEQ ID NO: 249649 - protein, 11 aa, Mycobacterium
ASRTEPRPTNV

SEQ ID NO: 249650 - protein, 7 aa, Mycobacterium
ASRTGAD

SEQ ID NO: 249651 - protein, 14 aa, Mycobacterium
ASRTPASENPEPLK

SEQ ID NO: 249652 - protein, 11 aa, Mycobacterium
ASRTPVNHNPD

SEQ ID NO: 249653 - protein, 7 aa, Mycobacterium
ASRTRDE

SEQ ID NO: 249654 - protein, 6 aa, Mycobacterium
ASRTSL

SEQ ID NO: 249655 - protein, 8 aa, Mycobacterium
ASRTSPAL

SEQ ID NO: 249656 - protein, 12 aa, Mycobacterium
ASRTYGTAADGE

SEQ ID NO: 249657 - protein, 7 aa, Mycobacterium
ASRVETS

SEQ ID NO: 249658 - protein, 6 aa, Mycobacterium
ASRVPG

SEQ ID NO: 249659 - protein, 6 aa, Mycobacterium
ASRWAP

SEQ ID NO: 249660 - protein, 19 aa, Mycobacterium
ASSADLARRAGQADPRAGL

SEQ ID NO: 249661 - protein, 12 aa, Mycobacterium
ASSADSEGGHAD

SEQ ID NO: 249662 - protein, 5 aa, Mycobacterium
ASSAG

SEQ ID NO: 249663 - protein, 6 aa, Mycobacterium
ASSASQ

SEQ ID NO: 249664 - protein, 7 aa, Mycobacterium
ASSAYGV

SEQ ID NO: 249665 - protein, 14 aa, Mycobacterium
ASSDDVRGHSASDF

SEQ ID NO: 249666 - protein, 9 aa, Mycobacterium
ASSDLGASD

SEQ ID NO: 249667 - protein, 11 aa, Mycobacterium
ASSDQAAAAGY

SEQ ID NO: 249668 - protein, 14 aa, Mycobacterium
ASSDSLDAAAQHET

SEQ ID NO: 249669 - protein, 10 aa, Mycobacterium
ASSERSPVTT

SEQ ID NO: 249670 - protein, 10 aa, Mycobacterium
ASSFKSAVGP

SEQ ID NO: 249671 - protein, 7 aa, Mycobacterium
ASSFTDA

SEQ ID NO: 249672 - protein, 22 aa, Mycobacterium
ASSGGRHHQPETAAGGDRSTAT

SEQ ID NO: 249673 - protein, 6 aa, Mycobacterium
ASSGTI

SEQ ID NO: 249674 - protein, 23 aa, Mycobacterium
ASSHTEATEEAGAYASARGQFND

SEQ ID NO: 249675 - protein, 4 aa, Mycobacterium
ASSI

SEQ ID NO: 249676 - protein, 5 aa, Mycobacterium
ASSIA

SEQ ID NO: 249677 - protein, 10 aa, Mycobacterium
ASSISGAAGG

SEQ ID NO: 249678 - protein, 9 aa, Mycobacterium
ASSKDAPGA

SEQ ID NO: 249679 - protein, 11 aa, Mycobacterium
ASSKGARSDRG

SEQ ID NO: 249680 - protein, 6 aa, Mycobacterium
ASSKTA

SEQ ID NO: 249681 - protein, 11 aa, Mycobacterium
ASSKVRTEADA

SEQ ID NO: 249682 - protein, 18 aa, Mycobacterium
ASSLGEETVEPRRTAPKA

SEQ ID NO: 249683 - protein, 51 aa, Mycobacterium
ASSLGTSGMPDTSDVGDATDALSGTATAVNGPGDVPKPTPPTPSQPSSASQ

SEQ ID NO: 249684 - protein, 88 aa, Mycobacterium
ASSLGTSGMPDTSGATDALSGTATAVNGPGDVPKPPTPPSVPSQSPSSVQALDSTTTRAPQQPPQPSNPSTPKTANQSSTSKPLSPLE

SEQ ID NO: 249685 - protein, 9 aa, Mycobacterium
ASSPATTEP

SEQ ID NO: 249686 - protein, 7 aa, Mycobacterium
ASSPDDL

SEQ ID NO: 249687 - protein, 36 aa, Mycobacterium
ASSPDHHTASSPRTPAPTSSTAPIDPGPPPQPPTVP

SEQ ID NO: 249688 - protein, 5 aa, Mycobacterium
ASSPI

SEQ ID NO: 249689 - protein, 18 aa, Mycobacterium
ASSPPARGRGVKAPRARR

SEQ ID NO: 249690 - protein, 5 aa, Mycobacterium
ASSQR

SEQ ID NO: 249691 - protein, 4 aa, Mycobacterium
ASSR

SEQ ID NO: 249692 - protein, 7 aa, Mycobacterium
ASSRAEV

SEQ ID NO: 249693 - protein, 8 aa, Mycobacterium
ASSRDGLA

SEQ ID NO: 249694 - protein, 32 aa, Mycobacterium
ASSRGDAESGSWAEDGEGLETHQGQPSLGQVP

SEQ ID NO: 249695 - protein, 7 aa, Mycobacterium
ASSRWST

SEQ ID NO: 249696 - protein, 7 aa, Mycobacterium
ASSSPYT

SEQ ID NO: 249697 - protein, 4 aa, Mycobacterium
ASST

SEQ ID NO: 249698 - protein, 5 aa, Mycobacterium
ASSTG

SEQ ID NO: 249699 - protein, 6 aa, Mycobacterium
ASSTPY

SEQ ID NO: 249700 - protein, 6 aa, Mycobacterium
ASSVAG

SEQ ID NO: 249701 - protein, 10 aa, Mycobacterium
ASSYGQTNGP

SEQ ID NO: 249702 - protein, 7 aa, Mycobacterium
ASSYMGK

SEQ ID NO: 249703 - protein, 13 aa, Mycobacterium
ASTAAEQAERIGA

SEQ ID NO: 249704 - protein, 11 aa, Mycobacterium
ASTADAATPYR

SEQ ID NO: 249705 - protein, 12 aa, Mycobacterium
ASTAETEDGPSL

SEQ ID NO: 249706 - protein, 9 aa, Mycobacterium
ASTAGDITG

SEQ ID NO: 249707 - protein, 8 aa, Mycobacterium
ASTAKTGD

SEQ ID NO: 249708 - protein, 18 aa, Mycobacterium
ASTAPDADSKPAAWLPSG

SEQ ID NO: 249709 - protein, 10 aa, Mycobacterium
ASTAQRSGIE

SEQ ID NO: 249710 - protein, 5 aa, Mycobacterium
ASTAS

SEQ ID NO: 249711 - protein, 24 aa, Mycobacterium
ASTATSASVGPAAARGSGGVSPGG

SEQ ID NO: 249712 - protein, 10 aa, Mycobacterium
ASTAVEPPAH

SEQ ID NO: 249713 - protein, 8 aa, Mycobacterium
ASTDEDLR

SEQ ID NO: 249714 - protein, 52 aa, Mycobacterium
ASTDGEPGSPSASTGAAAPAPDPFTTAEHTARPGGYDPRPFDPFDEGASCDD

SEQ ID NO: 249715 - protein, 10 aa, Mycobacterium
ASTDKAAAVQ

SEQ ID NO: 249716 - protein, 7 aa, Mycobacterium
ASTDLSQ

SEQ ID NO: 249717 - protein, 7 aa, Mycobacterium
ASTDSAA

SEQ ID NO: 249718 - protein, 9 aa, Mycobacterium
ASTENLGAT

SEQ ID NO: 249719 - protein, 6 aa, Mycobacterium
ASTERY

SEQ ID NO: 249720 - protein, 6 aa, Mycobacterium
ASTESG

SEQ ID NO: 249721 - protein, 8 aa, Mycobacterium
ASTETAAG

SEQ ID NO: 249722 - protein, 7 aa, Mycobacterium
ASTEVRG

SEQ ID NO: 249723 - protein, 6 aa, Mycobacterium
ASTGAA

SEQ ID NO: 249724 - protein, 6 aa, Mycobacterium
ASTGDM

SEQ ID NO: 249725 - protein, 13 aa, Mycobacterium
ASTGGKRDFTSEQ

SEQ ID NO: 249726 - protein, 7 aa, Mycobacterium
ASTGGQR

SEQ ID NO: 249727 - protein, 7 aa, Mycobacterium
ASTGHET

SEQ ID NO: 249728 - protein, 5 aa, Mycobacterium
ASTID

SEQ ID NO: 249729 - protein, 5 aa, Mycobacterium
ASTIG

SEQ ID NO: 249730 - protein, 16 aa, Mycobacterium
ASTITTDASAVSDQTR

SEQ ID NO: 249731 - protein, 8 aa, Mycobacterium
ASTKGKRL

SEQ ID NO: 249732 - protein, 13 aa, Mycobacterium
ASTKVDPDPDARV

SEQ ID NO: 249733 - protein, 4 aa, Mycobacterium
ASTL

SEQ ID NO: 249734 - protein, 4 aa, Mycobacterium
ASTM

SEQ ID NO: 249735 - protein, 12 aa, Mycobacterium
ASTNRRSPSSSS

SEQ ID NO: 249736 - protein, 4 aa, Mycobacterium
ASTP

SEQ ID NO: 249737 - protein, 10 aa, Mycobacterium
ASTPDSVKAR

SEQ ID NO: 249738 - protein, 9 aa, Mycobacterium
ASTPHDRDR

SEQ ID NO: 249739 - protein, 10 aa, Mycobacterium
ASTPHPATGD

SEQ ID NO: 249740 - protein, 5 aa, Mycobacterium
ASTPI

SEQ ID NO: 249741 - protein, 7 aa, Mycobacterium
ASTPSGP

SEQ ID NO: 249742 - protein, 6 aa, Mycobacterium
ASTPVL

SEQ ID NO: 249743 - protein, 12 aa, Mycobacterium
ASTQRGSLPATQ

SEQ ID NO: 249744 - protein, 5 aa, Mycobacterium
ASTRE

SEQ ID NO: 249745 - protein, 84 aa, Mycobacterium
ASTRRRKQDEQDLSDQQQPQGPDTQALAQDGAQLGQSLPGDIANTVSDSVNLGQSAGSAAQNFGSAAQAGASLASSAQSGAVNP

SEQ ID NO: 249746 - protein, 84 aa, Mycobacterium
ASTRRRKQDEQDSSDQQQPQGPDTQALAQDGAQLGQSLPGDIANTVSDSVNLGQSAGSAAQNFGSAAQAGASLASSAQSGAVNP

SEQ ID NO: 249747 - protein, 8 aa, Mycobacterium
ASTRTPAD

SEQ ID NO: 249748 - protein, 11 aa, Mycobacterium
ASTSHGPSGAL

SEQ ID NO: 249749 - protein, 6 aa, Mycobacterium
ASTSTM

SEQ ID NO: 249750 - protein, 4 aa, Mycobacterium
ASTT

SEQ ID NO: 249751 - protein, 16 aa, Mycobacterium
ASTTAAGPISQSSYGA

SEQ ID NO: 249752 - protein, 9 aa, Mycobacterium
ASTTGDITG

SEQ ID NO: 249753 - protein, 10 aa, Mycobacterium
ASTTGDITGP

SEQ ID NO: 249754 - protein, 14 aa, Mycobacterium
ASTTSATVSNNAQA

SEQ ID NO: 249755 - protein, 7 aa, Mycobacterium
ASTTSTT

SEQ ID NO: 249756 - protein, 11 aa, Mycobacterium
ASTTVQEGTGV

SEQ ID NO: 249757 - protein, 4 aa, Mycobacterium
ASTV

SEQ ID NO: 249758 - protein, 7 aa, Mycobacterium
ASTVGGV

SEQ ID NO: 249759 - protein, 5 aa, Mycobacterium
ASTVT

SEQ ID NO: 249760 - protein, 5 aa, Mycobacterium
ASVAP

SEQ ID NO: 249761 - protein, 17 aa, Mycobacterium
ASVARQSVEAAANPQTA

SEQ ID NO: 249762 - protein, 17 aa, Mycobacterium
ASVDDIGAAAGRATAKA

SEQ ID NO: 249763 - protein, 9 aa, Mycobacterium
ASVDETPRV

SEQ ID NO: 249764 - protein, 10 aa, Mycobacterium
ASVDGPEKAL

SEQ ID NO: 249765 - protein, 9 aa, Mycobacterium
ASVDSVDDQ

SEQ ID NO: 249766 - protein, 8 aa, Mycobacterium
ASVEESGA

SEQ ID NO: 249767 - protein, 8 aa, Mycobacterium
ASVEPAEL

SEQ ID NO: 249768 - protein, 12 aa, Mycobacterium
ASVERKDPSKPA

SEQ ID NO: 249769 - protein, 5 aa, Mycobacterium
ASVGS

SEQ ID NO: 249770 - protein, 7 aa, Mycobacterium
ASVGTPP

SEQ ID NO: 249771 - protein, 8 aa, Mycobacterium
ASVGTSPE

SEQ ID NO: 249772 - protein, 4 aa, Mycobacterium
ASVP

SEQ ID NO: 249773 - protein, 20 aa, Mycobacterium
ASVPAAERQTDNDVQGAGQK

SEQ ID NO: 249774 - protein, 15 aa, Mycobacterium
ASVPAGAPATQGTGA

SEQ ID NO: 249775 - protein, 10 aa, Mycobacterium
ASVPATSPAP

SEQ ID NO: 249776 - protein, 7 aa, Mycobacterium
ASVPDDQ

SEQ ID NO: 249777 - protein, 11 aa, Mycobacterium
ASVPDENTALQ

SEQ ID NO: 249778 - protein, 5 aa, Mycobacterium
ASVPE

SEQ ID NO: 249779 - protein, 17 aa, Mycobacterium
ASVPGSRRQWERDPHDP

SEQ ID NO: 249780 - protein, 6 aa, Mycobacterium
ASVPGV

SEQ ID NO: 249781 - protein, 14 aa, Mycobacterium
ASVPPGAPVPQGTA

SEQ ID NO: 249782 - protein, 6 aa, Mycobacterium
ASVPPH

SEQ ID NO: 249783 - protein, 7 aa, Mycobacterium
ASVREGS

SEQ ID NO: 249784 - protein, 31 aa, Mycobacterium
ASVRPGDSPELGAGAAGSLAATAPKLPANNV

SEQ ID NO: 249785 - protein, 7 aa, Mycobacterium
ASVSGAA

SEQ ID NO: 249786 - protein, 4 aa, Mycobacterium
ASVT

SEQ ID NO: 249787 - protein, 7 aa, Mycobacterium
ASVTSTP

SEQ ID NO: 249788 - protein, 15 aa, Mycobacterium
ASVTTSTAGAVGGAA

SEQ ID NO: 249789 - protein, 10 aa, Mycobacterium
ASWGPGGQLQ

SEQ ID NO: 249790 - protein, 9 aa, Mycobacterium
ASWSEPKGG

SEQ ID NO: 249791 - protein, 11 aa, Mycobacterium
ASYGGQDMTPA

SEQ ID NO: 249792 - protein, 4 aa, Mycobacterium
ASYI

SEQ ID NO: 249793 - protein, 7 aa, Mycobacterium
ASYNSQK

SEQ ID NO: 249794 - protein, 7 aa, Mycobacterium
ASYSRTA

SEQ ID NO: 249795 - protein, 5 aa, Mycobacterium
ASYTN

SEQ ID NO: 249796 - protein, 4 aa, Mycobacterium
ATAA

SEQ ID NO: 249797 - protein, 5 aa, Mycobacterium
ATAAA

SEQ ID NO: 249798 - protein, 11 aa, Mycobacterium
ATAAAASPSVR

SEQ ID NO: 249799 - protein, 14 aa, Mycobacterium
ATAAAGISGSTTVG

SEQ ID NO: 249800 - protein, 15 aa, Mycobacterium
ATAAAQDKAARAAAE

SEQ ID NO: 249801 - protein, 9 aa, Mycobacterium
ATAAAYGTE

SEQ ID NO: 249802 - protein, 5 aa, Mycobacterium
ATAAD

SEQ ID NO: 249803 - protein, 8 aa, Mycobacterium
ATAADNSL

SEQ ID NO: 249804 - protein, 8 aa, Mycobacterium
ATAADSTY

SEQ ID NO: 249805 - protein, 17 aa, Mycobacterium
ATAADTRAALDGGASGV

SEQ ID NO: 249806 - protein, 8 aa, Mycobacterium
ATAAGDAS

SEQ ID NO: 249807 - protein, 20 aa, Mycobacterium
ATAAGPAPQPTYAPNPQETQ

SEQ ID NO: 249808 - protein, 6 aa, Mycobacterium
ATAAGQ

SEQ ID NO: 249809 - protein, 6 aa, Mycobacterium
ATAAPE

SEQ ID NO: 249810 - protein, 12 aa, Mycobacterium
ATAAPPDPDNND

SEQ ID NO: 249811 - protein, 9 aa, Mycobacterium
ATAAPVSSP

SEQ ID NO: 249812 - protein, 6 aa, Mycobacterium
ATAAQE

SEQ ID NO: 249813 - protein, 10 aa, Mycobacterium
ATAAQPPAEL

SEQ ID NO: 249814 - protein, 23 aa, Mycobacterium
ATAAQPSGTVTSIRPPANPDDTT

SEQ ID NO: 249815 - protein, 6 aa, Mycobacterium
ATAARV

SEQ ID NO: 249816 - protein, 9 aa, Mycobacterium
ATAASSLSA

SEQ ID NO: 249817 - protein, 7 aa, Mycobacterium
ATAASSV

SEQ ID NO: 249818 - protein, 6 aa, Mycobacterium
ATAATG

SEQ ID NO: 249819 - protein, 7 aa, Mycobacterium
ATAATPK

SEQ ID NO: 249820 - protein, 14 aa, Mycobacterium
ATAATQDRPQPPID

SEQ ID NO: 249821 - protein, 54 aa, Mycobacterium
ATAATRRGSQQAGQQAAQQAGQQGAQQAAQQTTQGTQQATQQGTQKPVESGEQF

SEQ ID NO: 249822 - protein, 8 aa, Mycobacterium
ATAAWDGG

SEQ ID NO: 249823 - protein, 8 aa, Mycobacterium
ATADDTEA

SEQ ID NO: 249824 - protein, 9 aa, Mycobacterium
ATADDTEAL

SEQ ID NO: 249825 - protein, 15 aa, Mycobacterium
ATADGAAESAANSLQ

SEQ ID NO: 249826 - protein, 11 aa, Mycobacterium
ATADGADKSGL

SEQ ID NO: 249827 - protein, 10 aa, Mycobacterium
ATADPTVASG

SEQ ID NO: 249828 - protein, 13 aa, Mycobacterium
ATADRELEAQTEA

SEQ ID NO: 249829 - protein, 7 aa, Mycobacterium
ATADRRG

SEQ ID NO: 249830 - protein, 25 aa, Mycobacterium
ATAEAGSAHAAELEDAASAATAGRT

SEQ ID NO: 249831 - protein, 5 aa, Mycobacterium
ATAED

SEQ ID NO: 249832 - protein, 8 aa, Mycobacterium
ATAEDGSV

SEQ ID NO: 249833 - protein, 7 aa, Mycobacterium
ATAEDNS

SEQ ID NO: 249834 - protein, 7 aa, Mycobacterium
ATAEENL

SEQ ID NO: 249835 - protein, 8 aa, Mycobacterium
ATAEPTVV

SEQ ID NO: 249836 - protein, 8 aa, Mycobacterium
ATAESYNK

SEQ ID NO: 249837 - protein, 6 aa, Mycobacterium
ATAGAA

SEQ ID NO: 249838 - protein, 12 aa, Mycobacterium
ATAGAGISPVPT

SEQ ID NO: 249839 - protein, 13 aa, Mycobacterium
ATAGDEDGDRAGR

SEQ ID NO: 249840 - protein, 7 aa, Mycobacterium
ATAGDPA

SEQ ID NO: 249841 - protein, 5 aa, Mycobacterium
ATAGF

SEQ ID NO: 249842 - protein, 9 aa, Mycobacterium
ATAGGGASI

SEQ ID NO: 249843 - protein, 8 aa, Mycobacterium
ATAGGLAG

SEQ ID NO: 249844 - protein, 10 aa, Mycobacterium
ATAGGYRLSG

SEQ ID NO: 249845 - protein, 9 aa, Mycobacterium
ATAGQSGCV

SEQ ID NO: 249846 - protein, 6 aa, Mycobacterium
ATAGQT

SEQ ID NO: 249847 - protein, 8 aa, Mycobacterium
ATAGSTAL

SEQ ID NO: 249848 - protein, 10 aa, Mycobacterium
ATAGTPPPPL

SEQ ID NO: 249849 - protein, 11 aa, Mycobacterium
ATAGTQAFGPV

SEQ ID NO: 249850 - protein, 15 aa, Mycobacterium
ATAGVPGRAPTTERQ

SEQ ID NO: 249851 - protein, 6 aa, Mycobacterium
ATAIGG

SEQ ID NO: 249852 - protein, 5 aa, Mycobacterium
ATAIQ

SEQ ID NO: 249853 - protein, 8 aa, Mycobacterium
ATAKGLSR

SEQ ID NO: 249854 - protein, 9 aa, Mycobacterium
ATAKGLSRP

SEQ ID NO: 249855 - protein, 7 aa, Mycobacterium
ATALGTN

SEQ ID NO: 249856 - protein, 14 aa, Mycobacterium
ATALPSGNTQKPMD

SEQ ID NO: 249857 - protein, 11 aa, Mycobacterium
ATALPSGTTPM

SEQ ID NO: 249858 - protein, 15 aa, Mycobacterium
ATALSQAASAVADGN

SEQ ID NO: 249859 - protein, 6 aa, Mycobacterium
ATALTE

SEQ ID NO: 249860 - protein, 12 aa, Mycobacterium
ATALTGATPTRT

SEQ ID NO: 249861 - protein, 4 aa, Mycobacterium
ATAN

SEQ ID NO: 249862 - protein, 9 aa, Mycobacterium
ATANAATDV

SEQ ID NO: 249863 - protein, 5 aa, Mycobacterium
ATANG

SEQ ID NO: 249864 - protein, 8 aa, Mycobacterium
ATANGALA

SEQ ID NO: 249865 - protein, 24 aa, Mycobacterium
ATANGDGEDASGSRGAAEVGGATQ

SEQ ID NO: 249866 - protein, 6 aa, Mycobacterium
ATANLS

SEQ ID NO: 249867 - protein, 12 aa, Mycobacterium
ATAPAGPARPRR

SEQ ID NO: 249868 - protein, 6 aa, Mycobacterium
ATAPAV

SEQ ID NO: 249869 - protein, 10 aa, Mycobacterium
ATAPEGARVG

SEQ ID NO: 249870 - protein, 15 aa, Mycobacterium
ATAPGATDEASTAFS

SEQ ID NO: 249871 - protein, 6 aa, Mycobacterium
ATAPGV

SEQ ID NO: 249872 - protein, 15 aa, Mycobacterium
ATAPHREQYSDPEKP

SEQ ID NO: 249873 - protein, 5 aa, Mycobacterium
ATAPS

SEQ ID NO: 249874 - protein, 6 aa, Mycobacterium
ATAPSV

SEQ ID NO: 249875 - protein, 6 aa, Mycobacterium
ATAQPD

SEQ ID NO: 249876 - protein, 13 aa, Mycobacterium
ATAQPVATGARDA

SEQ ID NO: 249877 - protein, 5 aa, Mycobacterium
ATAQR

SEQ ID NO: 249878 - protein, 10 aa, Mycobacterium
ATAQSKENAG

SEQ ID NO: 249879 - protein, 13 aa, Mycobacterium
ATARAAPTTPDPA

SEQ ID NO: 249880 - protein, 8 aa, Mycobacterium
ATARDGTA

SEQ ID NO: 249881 - protein, 10 aa, Mycobacterium
ATARDPADRY

SEQ ID NO: 249882 - protein, 25 aa, Mycobacterium
ATARRQGQPVNRENHSTSVSENNAG

SEQ ID NO: 249883 - protein, 7 aa, Mycobacterium
ATARRRQ

SEQ ID NO: 249884 - protein, 5 aa, Mycobacterium
ATARS

SEQ ID NO: 249885 - protein, 14 aa, Mycobacterium
ATARYTDPSTRSFN

SEQ ID NO: 249886 - protein, 4 aa, Mycobacterium
ATAS

SEQ ID NO: 249887 - protein, 9 aa, Mycobacterium
ATASAEGET

SEQ ID NO: 249888 - protein, 11 aa, Mycobacterium
ATASGAENLSG

SEQ ID NO: 249889 - protein, 12 aa, Mycobacterium
ATASGQDEDEQL

SEQ ID NO: 249890 - protein, 12 aa, Mycobacterium
ATASHLSGETTF

SEQ ID NO: 249891 - protein, 17 aa, Mycobacterium
ATASPRSSASPAAEPDH

SEQ ID NO: 249892 - protein, 7 aa, Mycobacterium
ATASREP

SEQ ID NO: 249893 - protein, 7 aa, Mycobacterium
ATASRNL

SEQ ID NO: 249894 - protein, 8 aa, Mycobacterium
ATASSAAG

SEQ ID NO: 249895 - protein, 6 aa, Mycobacterium
ATASSR

SEQ ID NO: 249896 - protein, 6 aa, Mycobacterium
ATASTA

SEQ ID NO: 249897 - protein, 18 aa, Mycobacterium
ATASTDPRDRPVEPPAPA

SEQ ID NO: 249898 - protein, 5 aa, Mycobacterium
ATATA

SEQ ID NO: 249899 - protein, 8 aa, Mycobacterium
ATATDNSL

SEQ ID NO: 249900 - protein, 5 aa, Mycobacterium
ATATG

SEQ ID NO: 249901 - protein, 7 aa, Mycobacterium
ATATGAA

SEQ ID NO: 249902 - protein, 7 aa, Mycobacterium
ATATRDL

SEQ ID NO: 249903 - protein, 24 aa, Mycobacterium
ATATRHLPPDLAGAGSGVYNTTRQ

SEQ ID NO: 249904 - protein, 9 aa, Mycobacterium
ATATRNLPP

SEQ ID NO: 249905 - protein, 18 aa, Mycobacterium
ATATRNLPPGLAGAGSAV

SEQ ID NO: 249906 - protein, 21 aa, Mycobacterium
ATATRNLRPDQAGASSGVYNA

SEQ ID NO: 249907 - protein, 8 aa, Mycobacterium
ATATRSVR

SEQ ID NO: 249908 - protein, 6 aa, Mycobacterium
ATATST

SEQ ID NO: 249909 - protein, 5 aa, Mycobacterium
ATATT

SEQ ID NO: 249910 - protein, 7 aa, Mycobacterium
ATATVRS

SEQ ID NO: 249911 - protein, 4 aa, Mycobacterium
ATAV

SEQ ID NO: 249912 - protein, 12 aa, Mycobacterium
ATAVESENAARQ

SEQ ID NO: 249913 - protein, 13 aa, Mycobacterium
ATAVPGRDGAAAQ

SEQ ID NO: 249914 - protein, 7 aa, Mycobacterium
ATCQDAN

SEQ ID NO: 249915 - protein, 5 aa, Mycobacterium
ATCSR

SEQ ID NO: 249916 - protein, 18 aa, Mycobacterium
ATDARNVAADRSADVDDA

SEQ ID NO: 249917 - protein, 9 aa, Mycobacterium
ATDATGTVE

SEQ ID NO: 249918 - protein, 7 aa, Mycobacterium
ATDDDEF

SEQ ID NO: 249919 - protein, 7 aa, Mycobacterium
ATDDEAV

SEQ ID NO: 249920 - protein, 10 aa, Mycobacterium
ATDDGSPGVQ

SEQ ID NO: 249921 - protein, 6 aa, Mycobacterium
ATDDKK

SEQ ID NO: 249922 - protein, 10 aa, Mycobacterium
ATDDSELTDE

SEQ ID NO: 249923 - protein, 31 aa, Mycobacterium
ATDDSGYTQTPDRADPVPDGATGWHSITFAV

SEQ ID NO: 249924 - protein, 8 aa, Mycobacterium
ATDDTPHV

SEQ ID NO: 249925 - protein, 17 aa, Mycobacterium
ATDERTGLTGNGYTAPL

SEQ ID NO: 249926 - protein, 10 aa, Mycobacterium
ATDGSRTEIS

SEQ ID NO: 249927 - protein, 11 aa, Mycobacterium
ATDGTADGAAY

SEQ ID NO: 249928 - protein, 14 aa, Mycobacterium
ATDGVDKLSDDLQG

SEQ ID NO: 249929 - protein, 9 aa, Mycobacterium
ATDHAERKR

SEQ ID NO: 249930 - protein, 9 aa, Mycobacterium
ATDHDERER

SEQ ID NO: 249931 - protein, 6 aa, Mycobacterium
ATDHRR

SEQ ID NO: 249932 - protein, 13 aa, Mycobacterium
ATDKAERVRPRGR

SEQ ID NO: 249933 - protein, 9 aa, Mycobacterium
ATDLGTAVQ

SEQ ID NO: 249934 - protein, 22 aa, Mycobacterium
ATDNTGATQTADTAAPVPDGAT

SEQ ID NO: 249935 - protein, 31 aa, Mycobacterium
ATDNTGETQTPDLADPVPDGATGWHYVTFDV

SEQ ID NO: 249936 - protein, 7 aa, Mycobacterium
ATDPGQR

SEQ ID NO: 249937 - protein, 10 aa, Mycobacterium
ATDPKSFGST

SEQ ID NO: 249938 - protein, 6 aa, Mycobacterium
ATDPLG

SEQ ID NO: 249939 - protein, 9 aa, Mycobacterium
ATDPQRPPR

SEQ ID NO: 249940 - protein, 10 aa, Mycobacterium
ATDPSAPTTV

SEQ ID NO: 249941 - protein, 13 aa, Mycobacterium
ATDQHLTKTGTAV

SEQ ID NO: 249942 - protein, 6 aa, Mycobacterium
ATDQKL

SEQ ID NO: 249943 - protein, 7 aa, Mycobacterium
ATDRRSR

SEQ ID NO: 249944 - protein, 14 aa, Mycobacterium
ATDSDAPESGPSRR

SEQ ID NO: 249945 - protein, 19 aa, Mycobacterium
ATDSEEDPRAKHVDPPGPA

SEQ ID NO: 249946 - protein, 7 aa, Mycobacterium
ATDSSRV

SEQ ID NO: 249947 - protein, 9 aa, Mycobacterium
ATDTGPSTL

SEQ ID NO: 249948 - protein, 6 aa, Mycobacterium
ATDTPI

SEQ ID NO: 249949 - protein, 25 aa, Mycobacterium
ATDTSEPTADQAGASAPPKLNRIDD

SEQ ID NO: 249950 - protein, 4 aa, Mycobacterium
ATDV

SEQ ID NO: 249951 - protein, 9 aa, Mycobacterium
ATDVRARPA

SEQ ID NO: 249952 - protein, 4 aa, Mycobacterium
ATDW

SEQ ID NO: 249953 - protein, 7 aa, Mycobacterium
ATDWPRY

SEQ ID NO: 249954 - protein, 5 aa, Mycobacterium
ATDWS

SEQ ID NO: 249955 - protein, 4 aa, Mycobacterium
ATEA

SEQ ID NO: 249956 - protein, 11 aa, Mycobacterium
ATEAAASPLGE

SEQ ID NO: 249957 - protein, 11 aa, Mycobacterium
ATEAASKPIGE

SEQ ID NO: 249958 - protein, 5 aa, Mycobacterium
ATEAP

SEQ ID NO: 249959 - protein, 5 aa, Mycobacterium
ATEAQ

SEQ ID NO: 249960 - protein, 9 aa, Mycobacterium
ATEAQGRSV

SEQ ID NO: 249961 - protein, 14 aa, Mycobacterium
ATEATAAELGRRSL

SEQ ID NO: 249962 - protein, 11 aa, Mycobacterium
ATEDAETAARR

SEQ ID NO: 249963 - protein, 10 aa, Mycobacterium
ATEDGSTGDH

SEQ ID NO: 249964 - protein, 8 aa, Mycobacterium
ATEDRRTE

SEQ ID NO: 249965 - protein, 10 aa, Mycobacterium
ATEDSSPTRV

SEQ ID NO: 249966 - protein, 7 aa, Mycobacterium
ATEDTPH

SEQ ID NO: 249967 - protein, 11 aa, Mycobacterium
ATEGLKQTAPE

SEQ ID NO: 249968 - protein, 7 aa, Mycobacterium
ATEGRRA

SEQ ID NO: 249969 - protein, 6 aa, Mycobacterium
ATEHAQ

SEQ ID NO: 249970 - protein, 6 aa, Mycobacterium
ATEHPL

SEQ ID NO: 249971 - protein, 25 aa, Mycobacterium
ATEKITRPRPPVAQGGPLGASPPAV

SEQ ID NO: 249972 - protein, 14 aa, Mycobacterium
ATEKKRSKHPERFG

SEQ ID NO: 249973 - protein, 8 aa, Mycobacterium
ATEPAEPD

SEQ ID NO: 249974 - protein, 7 aa, Mycobacterium
ATEPAGR

SEQ ID NO: 249975 - protein, 6 aa, Mycobacterium
ATEPAR

SEQ ID NO: 249976 - protein, 5 aa, Mycobacterium
ATEPI

SEQ ID NO: 249977 - protein, 7 aa, Mycobacterium
ATEPQRA

SEQ ID NO: 249978 - protein, 14 aa, Mycobacterium
ATERATVTAPAGYD

SEQ ID NO: 249979 - protein, 10 aa, Mycobacterium
ATERETPSGV

SEQ ID NO: 249980 - protein, 6 aa, Mycobacterium
ATERRA

SEQ ID NO: 249981 - protein, 6 aa, Mycobacterium
ATESAL

SEQ ID NO: 249982 - protein, 5 aa, Mycobacterium
ATETK

SEQ ID NO: 249983 - protein, 4 aa, Mycobacterium
ATEW

SEQ ID NO: 249984 - protein, 4 aa, Mycobacterium
ATFG

SEQ ID NO: 249985 - protein, 14 aa, Mycobacterium
ATFPYRNDPDDKNI

SEQ ID NO: 249986 - protein, 5 aa, Mycobacterium
ATGAA

SEQ ID NO: 249987 - protein, 6 aa, Mycobacterium
ATGAAR

SEQ ID NO: 249988 - protein, 6 aa, Mycobacterium
ATGAAT

SEQ ID NO: 249989 - protein, 17 aa, Mycobacterium
ATGADRTPMNPKTNHAP

SEQ ID NO: 249990 - protein, 5 aa, Mycobacterium
ATGAG

SEQ ID NO: 249991 - protein, 13 aa, Mycobacterium
ATGAGSSAVNDSA

SEQ ID NO: 249992 - protein, 12 aa, Mycobacterium
ATGAHTPKEGTA

SEQ ID NO: 249993 - protein, 20 aa, Mycobacterium
ATGAISEAEYTAKRQQIIAD

SEQ ID NO: 249994 - protein, 14 aa, Mycobacterium
ATGAISSYDYRSES

SEQ ID NO: 249995 - protein, 6 aa, Mycobacterium
ATGALK

SEQ ID NO: 249996 - protein, 9 aa, Mycobacterium
ATGANPPVK

SEQ ID NO: 249997 - protein, 11 aa, Mycobacterium
ATGARSTANSV

SEQ ID NO: 249998 - protein, 8 aa, Mycobacterium
ATGASPAV

SEQ ID NO: 249999 - protein, 7 aa, Mycobacterium
ATGATAA

SEQ ID NO: 250000 - protein, 7 aa, Mycobacterium
ATGATRA

SEQ ID NO: 250001 - protein, 7 aa, Mycobacterium
ATGATSF

SEQ ID NO: 250002 - protein, 6 aa, Mycobacterium
ATGDAF

SEQ ID NO: 250003 - protein, 8 aa, Mycobacterium
ATGDAQSW

SEQ ID NO: 250004 - protein, 19 aa, Mycobacterium
ATGDDGRTGENPVDGDPPR

SEQ ID NO: 250005 - protein, 5 aa, Mycobacterium
ATGDF

SEQ ID NO: 250006 - protein, 14 aa, Mycobacterium
ATGDFAKQYEKNAN

SEQ ID NO: 250007 - protein, 20 aa, Mycobacterium
ATGDGLADRSPSDAALTGTS

SEQ ID NO: 250008 - protein, 6 aa, Mycobacterium
ATGDKI

SEQ ID NO: 250009 - protein, 7 aa, Mycobacterium
ATGDRFG

SEQ ID NO: 250010 - protein, 6 aa, Mycobacterium
ATGDVQ

SEQ ID NO: 250011 - protein, 4 aa, Mycobacterium
ATGE

SEQ ID NO: 250012 - protein, 6 aa, Mycobacterium
ATGEAV

SEQ ID NO: 250013 - protein, 18 aa, Mycobacterium
ATGEETAKSPASAPIDTV

SEQ ID NO: 250014 - protein, 14 aa, Mycobacterium
ATGEEVTSLSPVGD

SEQ ID NO: 250015 - protein, 5 aa, Mycobacterium
ATGEF

SEQ ID NO: 250016 - protein, 7 aa, Mycobacterium
ATGEFES

SEQ ID NO: 250017 - protein, 5 aa, Mycobacterium
ATGEG

SEQ ID NO: 250018 - protein, 9 aa, Mycobacterium
ATGEHARSK

SEQ ID NO: 250019 - protein, 5 aa, Mycobacterium
ATGER

SEQ ID NO: 250020 - protein, 7 aa, Mycobacterium
ATGETLE

SEQ ID NO: 250021 - protein, 5 aa, Mycobacterium
ATGFG

SEQ ID NO: 250022 - protein, 16 aa, Mycobacterium
ATGFGNSIEGNPGGGA

SEQ ID NO: 250023 - protein, 7 aa, Mycobacterium
ATGGADT

SEQ ID NO: 250024 - protein, 9 aa, Mycobacterium
ATGGGPSHG

SEQ ID NO: 250025 - protein, 7 aa, Mycobacterium
ATGGGTF

SEQ ID NO: 250026 - protein, 11 aa, Mycobacterium
ATGGHTLPAST

SEQ ID NO: 250027 - protein, 15 aa, Mycobacterium
ATGGPAGVGEAVGRS

SEQ ID NO: 250028 - protein, 8 aa, Mycobacterium
ATGGPVGV

SEQ ID NO: 250029 - protein, 6 aa, Mycobacterium
ATGGRD

SEQ ID NO: 250030 - protein, 5 aa, Mycobacterium
ATGGT

SEQ ID NO: 250031 - protein, 5 aa, Mycobacterium
ATGGV

SEQ ID NO: 250032 - protein, 13 aa, Mycobacterium
ATGGVDRATRRNL

SEQ ID NO: 250033 - protein, 7 aa, Mycobacterium
ATGGVPQ

SEQ ID NO: 250034 - protein, 7 aa, Mycobacterium
ATGHAHP

SEQ ID NO: 250035 - protein, 5 aa, Mycobacterium
ATGIR

SEQ ID NO: 250036 - protein, 12 aa, Mycobacterium
ATGKGDKGQAEQ

SEQ ID NO: 250037 - protein, 9 aa, Mycobacterium
ATGKPDRGL

SEQ ID NO: 250038 - protein, 14 aa, Mycobacterium
ATGKPVGAPLTGHT

SEQ ID NO: 250039 - protein, 11 aa, Mycobacterium
ATGKPVGRPMT

SEQ ID NO: 250040 - protein, 8 aa, Mycobacterium
ATGKRLPR

SEQ ID NO: 250041 - protein, 4 aa, Mycobacterium
ATGL

SEQ ID NO: 250042 - protein, 10 aa, Mycobacterium
ATGLAGPGNT

SEQ ID NO: 250043 - protein, 6 aa, Mycobacterium
ATGLPA

SEQ ID NO: 250044 - protein, 12 aa, Mycobacterium
ATGLPDPGPATT

SEQ ID NO: 250045 - protein, 12 aa, Mycobacterium
ATGLPDPGPVTS

SEQ ID NO: 250046 - protein, 12 aa, Mycobacterium
ATGLPNPGPVTT

SEQ ID NO: 250047 - protein, 5 aa, Mycobacterium
ATGLQ

SEQ ID NO: 250048 - protein, 6 aa, Mycobacterium
ATGNPV

SEQ ID NO: 250049 - protein, 7 aa, Mycobacterium
ATGNQLA

SEQ ID NO: 250050 - protein, 7 aa, Mycobacterium
ATGPAAP

SEQ ID NO: 250051 - protein, 8 aa, Mycobacterium
ATGPAAPV

SEQ ID NO: 250052 - protein, 10 aa, Mycobacterium
ATGPADRHDK

SEQ ID NO: 250053 - protein, 10 aa, Mycobacterium
ATGPAERHDK

SEQ ID NO: 250054 - protein, 7 aa, Mycobacterium
ATGPEDF

SEQ ID NO: 250055 - protein, 6 aa, Mycobacterium
ATGPGE

SEQ ID NO: 250056 - protein, 20 aa, Mycobacterium
ATGPRADELEEVNGRPAREP

SEQ ID NO: 250057 - protein, 8 aa, Mycobacterium
ATGPRRVS

SEQ ID NO: 250058 - protein, 11 aa, Mycobacterium
ATGPTDTSTAD

SEQ ID NO: 250059 - protein, 12 aa, Mycobacterium
ATGPTVDSSGQV

SEQ ID NO: 250060 - protein, 4 aa, Mycobacterium
ATGQ

SEQ ID NO: 250061 - protein, 17 aa, Mycobacterium
ATGQPIGAPLTGHTESV

SEQ ID NO: 250062 - protein, 14 aa, Mycobacterium
ATGQPIGQQTTGGS

SEQ ID NO: 250063 - protein, 13 aa, Mycobacterium
ATGQRQAKDPAAF

SEQ ID NO: 250064 - protein, 11 aa, Mycobacterium
ATGQRQSKDRV

SEQ ID NO: 250065 - protein, 8 aa, Mycobacterium
ATGQTQDP

SEQ ID NO: 250066 - protein, 8 aa, Mycobacterium
ATGQTQQP

SEQ ID NO: 250067 - protein, 4 aa, Mycobacterium
ATGR

SEQ ID NO: 250068 - protein, 10 aa, Mycobacterium
ATGRGRDDNS

SEQ ID NO: 250069 - protein, 10 aa, Mycobacterium
ATGRGREDHS

SEQ ID NO: 250070 - protein, 10 aa, Mycobacterium
ATGRGREDRT

SEQ ID NO: 250071 - protein, 6 aa, Mycobacterium
ATGRLK

SEQ ID NO: 250072 - protein, 9 aa, Mycobacterium
ATGRPGESP

SEQ ID NO: 250073 - protein, 11 aa, Mycobacterium
ATGRSTDGGVE

SEQ ID NO: 250074 - protein, 12 aa, Mycobacterium
ATGRVTSSRKVD

SEQ ID NO: 250075 - protein, 4 aa, Mycobacterium
ATGS

SEQ ID NO: 250076 - protein, 5 aa, Mycobacterium
ATGSG

SEQ ID NO: 250077 - protein, 9 aa, Mycobacterium
ATGSGKSEL

SEQ ID NO: 250078 - protein, 14 aa, Mycobacterium
ATGSGSWQGPSAAQ

SEQ ID NO: 250079 - protein, 20 aa, Mycobacterium
ATGSITDDEYAAKRAEIIAE

SEQ ID NO: 250080 - protein, 7 aa, Mycobacterium
ATGSTTL

SEQ ID NO: 250081 - protein, 7 aa, Mycobacterium
ATGSTVR

SEQ ID NO: 250082 - protein, 7 aa, Mycobacterium
ATGSWQS

SEQ ID NO: 250083 - protein, 12 aa, Mycobacterium
ATGTDDGSPGVQ

SEQ ID NO: 250084 - protein, 11 aa, Mycobacterium
ATGTDDGTSGV

SEQ ID NO: 250085 - protein, 8 aa, Mycobacterium
ATGTGLPS

SEQ ID NO: 250086 - protein, 8 aa, Mycobacterium
ATGTGTTS

SEQ ID NO: 250087 - protein, 5 aa, Mycobacterium
ATGTM

SEQ ID NO: 250088 - protein, 7 aa, Mycobacterium
ATGTPVA

SEQ ID NO: 250089 - protein, 8 aa, Mycobacterium
ATGTRRRA

SEQ ID NO: 250090 - protein, 6 aa, Mycobacterium
ATGTSL

SEQ ID NO: 250091 - protein, 7 aa, Mycobacterium
ATGTSLG

SEQ ID NO: 250092 - protein, 11 aa, Mycobacterium
ATGTSQAAADQ

SEQ ID NO: 250093 - protein, 7 aa, Mycobacterium
ATGTSWA

SEQ ID NO: 250094 - protein, 6 aa, Mycobacterium
ATGTTT

SEQ ID NO: 250095 - protein, 14 aa, Mycobacterium
ATGVANRNTKQDYN

SEQ ID NO: 250096 - protein, 6 aa, Mycobacterium
ATGVED

SEQ ID NO: 250097 - protein, 9 aa, Mycobacterium
ATGVSPADL

SEQ ID NO: 250098 - protein, 5 aa, Mycobacterium
ATGWP

SEQ ID NO: 250099 - protein, 6 aa, Mycobacterium
ATHAAE

SEQ ID NO: 250100 - protein, 5 aa, Mycobacterium
ATHAD

SEQ ID NO: 250101 - protein, 7 aa, Mycobacterium
ATHAETH

SEQ ID NO: 250102 - protein, 5 aa, Mycobacterium
ATHAG

SEQ ID NO: 250103 - protein, 26 aa, Mycobacterium
ATHASSRSSRHERRENRPVRERRADA

SEQ ID NO: 250104 - protein, 5 aa, Mycobacterium
ATHDE

SEQ ID NO: 250105 - protein, 7 aa, Mycobacterium
ATHDPAD

SEQ ID NO: 250106 - protein, 29 aa, Mycobacterium
ATHEGAADGQATASHNGAEEPSANSADVL

SEQ ID NO: 250107 - protein, 5 aa, Mycobacterium
ATHEQ

SEQ ID NO: 250108 - protein, 10 aa, Mycobacterium
ATHESAPRGL

SEQ ID NO: 250109 - protein, 7 aa, Mycobacterium
ATHSGAA

SEQ ID NO: 250110 - protein, 8 aa, Mycobacterium
ATHSPAPN

SEQ ID NO: 250111 - protein, 5 aa, Mycobacterium
ATIET

SEQ ID NO: 250112 - protein, 8 aa, Mycobacterium
ATIGAAAP

SEQ ID NO: 250113 - protein, 9 aa, Mycobacterium
ATIQAAGPA

SEQ ID NO: 250114 - protein, 5 aa, Mycobacterium
ATIRT

SEQ ID NO: 250115 - protein, 11 aa, Mycobacterium
ATISASARRTL

SEQ ID NO: 250116 - protein, 9 aa, Mycobacterium
ATISPAQQE

SEQ ID NO: 250117 - protein, 10 aa, Mycobacterium
ATISPAQQKA

SEQ ID NO: 250118 - protein, 8 aa, Mycobacterium
ATITPAQQ

SEQ ID NO: 250119 - protein, 14 aa, Mycobacterium
ATKAPPYNEPPSVV

SEQ ID NO: 250120 - protein, 16 aa, Mycobacterium
ATKDPYSEHIEPPGPA

SEQ ID NO: 250121 - protein, 9 aa, Mycobacterium
ATKDQAEPE

SEQ ID NO: 250122 - protein, 4 aa, Mycobacterium
ATKG

SEQ ID NO: 250123 - protein, 5 aa, Mycobacterium
ATKMP

SEQ ID NO: 250124 - protein, 9 aa, Mycobacterium
ATKRTEDSV

SEQ ID NO: 250125 - protein, 15 aa, Mycobacterium
ATKRTREARRASQEA

SEQ ID NO: 250126 - protein, 8 aa, Mycobacterium
ATKSAITA

SEQ ID NO: 250127 - protein, 6 aa, Mycobacterium
ATLATY

SEQ ID NO: 250128 - protein, 12 aa, Mycobacterium
ATLDAEARRAAS

SEQ ID NO: 250129 - protein, 12 aa, Mycobacterium
ATLDAESRRAAS

SEQ ID NO: 250130 - protein, 6 aa, Mycobacterium
ATLGSA

SEQ ID NO: 250131 - protein, 6 aa, Mycobacterium
ATLGTT

SEQ ID NO: 250132 - protein, 4 aa, Mycobacterium
ATLP

SEQ ID NO: 250133 - protein, 11 aa, Mycobacterium
ATLPDGSQTDV

SEQ ID NO: 250134 - protein, 6 aa, Mycobacterium
ATLPGG

SEQ ID NO: 250135 - protein, 20 aa, Mycobacterium
ATLQGIGKNSNSAAASGFSV

SEQ ID NO: 250136 - protein, 11 aa, Mycobacterium
ATLQGNQVRHP

SEQ ID NO: 250137 - protein, 5 aa, Mycobacterium
ATLST

SEQ ID NO: 250138 - protein, 16 aa, Mycobacterium
ATLTRRDETPAELDIA

SEQ ID NO: 250139 - protein, 40 aa, Mycobacterium
ATMDSPIDAPGTAEPAPSPSSQGAGPLGLTGTAASHDGAA

SEQ ID NO: 250140 - protein, 6 aa, Mycobacterium
ATMGTT

SEQ ID NO: 250141 - protein, 7 aa, Mycobacterium
ATMPDQQ

SEQ ID NO: 250142 - protein, 8 aa, Mycobacterium
ATMSAGPN

SEQ ID NO: 250143 - protein, 7 aa, Mycobacterium
ATNASTI

SEQ ID NO: 250144 - protein, 7 aa, Mycobacterium
ATNDKRN

SEQ ID NO: 250145 - protein, 6 aa, Mycobacterium
ATNDSY

SEQ ID NO: 250146 - protein, 9 aa, Mycobacterium
ATNGTGPEL

SEQ ID NO: 250147 - protein, 5 aa, Mycobacterium
ATNHQ

SEQ ID NO: 250148 - protein, 9 aa, Mycobacterium
ATNLTAGNE

SEQ ID NO: 250149 - protein, 11 aa, Mycobacterium
ATNPPAGQYSA

SEQ ID NO: 250150 - protein, 12 aa, Mycobacterium
ATNPPAPQCKHA

SEQ ID NO: 250151 - protein, 10 aa, Mycobacterium
ATNPQANQTA

SEQ ID NO: 250152 - protein, 6 aa, Mycobacterium
ATNSGF

SEQ ID NO: 250153 - protein, 5 aa, Mycobacterium
ATNTF

SEQ ID NO: 250154 - protein, 6 aa, Mycobacterium
ATNTRL

SEQ ID NO: 250155 - protein, 10 aa, Mycobacterium
ATPAAADAVA

SEQ ID NO: 250156 - protein, 6 aa, Mycobacterium
ATPAEL

SEQ ID NO: 250157 - protein, 11 aa, Mycobacterium
ATPAGAEHNYR

SEQ ID NO: 250158 - protein, 10 aa, Mycobacterium
ATPAGGDQRT

SEQ ID NO: 250159 - protein, 8 aa, Mycobacterium
ATPAGRPV

SEQ ID NO: 250160 - protein, 8 aa, Mycobacterium
ATPAPPGV

SEQ ID NO: 250161 - protein, 18 aa, Mycobacterium
ATPAPRTLGAVAAAGARG

SEQ ID NO: 250162 - protein, 7 aa, Mycobacterium
ATPASSA

SEQ ID NO: 250163 - protein, 6 aa, Mycobacterium
ATPDDL

SEQ ID NO: 250164 - protein, 11 aa, Mycobacterium
ATPDDPQSQPV

SEQ ID NO: 250165 - protein, 5 aa, Mycobacterium
ATPDE

SEQ ID NO: 250166 - protein, 5 aa, Mycobacterium
ATPDL

SEQ ID NO: 250167 - protein, 6 aa, Mycobacterium
ATPDRT

SEQ ID NO: 250168 - protein, 5 aa, Mycobacterium
ATPDS

SEQ ID NO: 250169 - protein, 13 aa, Mycobacterium
ATPDTDPAETTGT

SEQ ID NO: 250170 - protein, 10 aa, Mycobacterium
ATPEDPASAR

SEQ ID NO: 250171 - protein, 6 aa, Mycobacterium
ATPEDW

SEQ ID NO: 250172 - protein, 6 aa, Mycobacterium
ATPESA

SEQ ID NO: 250173 - protein, 6 aa, Mycobacterium
ATPETL

SEQ ID NO: 250174 - protein, 4 aa, Mycobacterium
ATPF

SEQ ID NO: 250175 - protein, 7 aa, Mycobacterium
ATPFTGD

SEQ ID NO: 250176 - protein, 6 aa, Mycobacterium
ATPGAH

SEQ ID NO: 250177 - protein, 15 aa, Mycobacterium
ATPGHPAGPRTDPLP

SEQ ID NO: 250178 - protein, 5 aa, Mycobacterium
ATPGI

SEQ ID NO: 250179 - protein, 10 aa, Mycobacterium
ATPGNAYPIT

SEQ ID NO: 250180 - protein, 18 aa, Mycobacterium
ATPGNDAQYSPKCRNMAN

SEQ ID NO: 250181 - protein, 19 aa, Mycobacterium
ATPGNKAKHTARCRNAGDG

SEQ ID NO: 250182 - protein, 18 aa, Mycobacterium
ATPGNKAQHTPKCRSMAN

SEQ ID NO: 250183 - protein, 18 aa, Mycobacterium
ATPGNQARHTPRCRSMAD

SEQ ID NO: 250184 - protein, 7 aa, Mycobacterium
ATPGNRA

SEQ ID NO: 250185 - protein, 28 aa, Mycobacterium
ATPGQDGTAQFGAPPKAAVPQSIPPRLG

SEQ ID NO: 250186 - protein, 10 aa, Mycobacterium
ATPGRDTGAL

SEQ ID NO: 250187 - protein, 7 aa, Mycobacterium
ATPGSDP

SEQ ID NO: 250188 - protein, 8 aa, Mycobacterium
ATPGSDPF

SEQ ID NO: 250189 - protein, 4 aa, Mycobacterium
ATPH

SEQ ID NO: 250190 - protein, 18 aa, Mycobacterium
ATPHKAKAGSSWLGSPPV

SEQ ID NO: 250191 - protein, 23 aa, Mycobacterium
ATPISTEAPITSDAQPADTAALR

SEQ ID NO: 250192 - protein, 12 aa, Mycobacterium
ATPKASRTAPEA

SEQ ID NO: 250193 - protein, 12 aa, Mycobacterium
ATPKASRTTPEA

SEQ ID NO: 250194 - protein, 16 aa, Mycobacterium
ATPKLTPELLRSVAVP

SEQ ID NO: 250195 - protein, 5 aa, Mycobacterium
ATPLA

SEQ ID NO: 250196 - protein, 7 aa, Mycobacterium
ATPLEPE

SEQ ID NO: 250197 - protein, 9 aa, Mycobacterium
ATPLRSGDE

SEQ ID NO: 250198 - protein, 5 aa, Mycobacterium
ATPMT

SEQ ID NO: 250199 - protein, 4 aa, Mycobacterium
ATPP

SEQ ID NO: 250200 - protein, 10 aa, Mycobacterium
ATPPAARATT

SEQ ID NO: 250201 - protein, 7 aa, Mycobacterium
ATPPAEL

SEQ ID NO: 250202 - protein, 8 aa, Mycobacterium
ATPPAGPL

SEQ ID NO: 250203 - protein, 8 aa, Mycobacterium
ATPPAPPV

SEQ ID NO: 250204 - protein, 15 aa, Mycobacterium
ATPPDGHVHEVVVRP

SEQ ID NO: 250205 - protein, 12 aa, Mycobacterium
ATPPEEAAPVPD

SEQ ID NO: 250206 - protein, 13 aa, Mycobacterium
ATPPGAPANPVYG

SEQ ID NO: 250207 - protein, 8 aa, Mycobacterium
ATPPGTKV

SEQ ID NO: 250208 - protein, 15 aa, Mycobacterium
ATPPHREQYSDPEKP

SEQ ID NO: 250209 - protein, 5 aa, Mycobacterium
ATPPK

SEQ ID NO: 250210 - protein, 12 aa, Mycobacterium
ATPPKAKRGSSW

SEQ ID NO: 250211 - protein, 16 aa, Mycobacterium
ATPPPKPSERRSAVPA

SEQ ID NO: 250212 - protein, 11 aa, Mycobacterium
ATPPPSSTVTT

SEQ ID NO: 250213 - protein, 12 aa, Mycobacterium
ATPPRTPPPLQF

SEQ ID NO: 250214 - protein, 5 aa, Mycobacterium
ATPPS

SEQ ID NO: 250215 - protein, 7 aa, Mycobacterium
ATPPTAL

SEQ ID NO: 250216 - protein, 8 aa, Mycobacterium
ATPQAKPA

SEQ ID NO: 250217 - protein, 6 aa, Mycobacterium
ATPQLR

SEQ ID NO: 250218 - protein, 5 aa, Mycobacterium
ATPQP

SEQ ID NO: 250219 - protein, 8 aa, Mycobacterium
ATPQPATV

SEQ ID NO: 250220 - protein, 6 aa, Mycobacterium
ATPQPM

SEQ ID NO: 250221 - protein, 5 aa, Mycobacterium
ATPRA

SEQ ID NO: 250222 - protein, 17 aa, Mycobacterium
ATPRKAKAGSSWLGSPP

SEQ ID NO: 250223 - protein, 6 aa, Mycobacterium
ATPSAA

SEQ ID NO: 250224 - protein, 5 aa, Mycobacterium
ATPSG

SEQ ID NO: 250225 - protein, 11 aa, Mycobacterium
ATPSPQPAPNL

SEQ ID NO: 250226 - protein, 6 aa, Mycobacterium
ATPSRL

SEQ ID NO: 250227 - protein, 7 aa, Mycobacterium
ATPSSPV

SEQ ID NO: 250228 - protein, 4 aa, Mycobacterium
ATPT

SEQ ID NO: 250229 - protein, 17 aa, Mycobacterium
ATPTAASSDRIEETDGD

SEQ ID NO: 250230 - protein, 14 aa, Mycobacterium
ATPTATDTADARTD

SEQ ID NO: 250231 - protein, 10 aa, Mycobacterium
ATPTGNPLGP

SEQ ID NO: 250232 - protein, 7 aa, Mycobacterium
ATPTRRT

SEQ ID NO: 250233 - protein, 9 aa, Mycobacterium
ATPTTPPKA

SEQ ID NO: 250234 - protein, 9 aa, Mycobacterium
ATPVDADAR

SEQ ID NO: 250235 - protein, 10 aa, Mycobacterium
ATPVPAPRNL

SEQ ID NO: 250236 - protein, 7 aa, Mycobacterium
ATPVPEL

SEQ ID NO: 250237 - protein, 18 aa, Mycobacterium
ATPVSTEETGTPQSADLT

SEQ ID NO: 250238 - protein, 8 aa, Mycobacterium
ATPVTEYP

SEQ ID NO: 250239 - protein, 7 aa, Mycobacterium
ATPVTYR

SEQ ID NO: 250240 - protein, 22 aa, Mycobacterium
ATPYQGPAEQNFHDDRDRYGTD

SEQ ID NO: 250241 - protein, 8 aa, Mycobacterium
ATPYRTEY

SEQ ID NO: 250242 - protein, 15 aa, Mycobacterium
ATQAADDFAAGHGGY

SEQ ID NO: 250243 - protein, 13 aa, Mycobacterium
ATQAPDTAAMTAA

SEQ ID NO: 250244 - protein, 14 aa, Mycobacterium
ATQAPDTNAMAASE

SEQ ID NO: 250245 - protein, 13 aa, Mycobacterium
ATQAPDTNAMTAA

SEQ ID NO: 250246 - protein, 14 aa, Mycobacterium
ATQAPDTSAMAASE

SEQ ID NO: 250247 - protein, 13 aa, Mycobacterium
ATQDDSGEQRIPK

SEQ ID NO: 250248 - protein, 5 aa, Mycobacterium
ATQDT

SEQ ID NO: 250249 - protein, 7 aa, Mycobacterium
ATQDVAD

SEQ ID NO: 250250 - protein, 10 aa, Mycobacterium
ATQEGSSNNW

SEQ ID NO: 250251 - protein, 4 aa, Mycobacterium
ATQF

SEQ ID NO: 250252 - protein, 4 aa, Mycobacterium
ATQG

SEQ ID NO: 250253 - protein, 9 aa, Mycobacterium
ATQGRGNKL

SEQ ID NO: 250254 - protein, 4 aa, Mycobacterium
ATQL

SEQ ID NO: 250255 - protein, 14 aa, Mycobacterium
ATQLSPTQDNYPDR

SEQ ID NO: 250256 - protein, 6 aa, Mycobacterium
ATQNST

SEQ ID NO: 250257 - protein, 8 aa, Mycobacterium
ATQPQPVA

SEQ ID NO: 250258 - protein, 27 aa, Mycobacterium
ATQPRRTPAPQAPALTPVQAPAPEVRP

SEQ ID NO: 250259 - protein, 23 aa, Mycobacterium
ATQQGQTIPYGTPEQAVTRGDLQ

SEQ ID NO: 250260 - protein, 6 aa, Mycobacterium
ATQQGV

SEQ ID NO: 250261 - protein, 6 aa, Mycobacterium
ATQQTA

SEQ ID NO: 250262 - protein, 4 aa, Mycobacterium
ATQR

SEQ ID NO: 250263 - protein, 7 aa, Mycobacterium
ATQRHPS

SEQ ID NO: 250264 - protein, 8 aa, Mycobacterium
ATQRSQCP

SEQ ID NO: 250265 - protein, 8 aa, Mycobacterium
ATQSEATV

SEQ ID NO: 250266 - protein, 17 aa, Mycobacterium
ATQSEVEEDRRVPLGQP

SEQ ID NO: 250267 - protein, 9 aa, Mycobacterium
ATQSQRDAM

SEQ ID NO: 250268 - protein, 4 aa, Mycobacterium
ATQY

SEQ ID NO: 250269 - protein, 15 aa, Mycobacterium
ATRAAARVQTTGGTA

SEQ ID NO: 250270 - protein, 9 aa, Mycobacterium
ATRAATPPA

SEQ ID NO: 250271 - protein, 7 aa, Mycobacterium
ATRAGDG

SEQ ID NO: 250272 - protein, 7 aa, Mycobacterium
ATRAGGL

SEQ ID NO: 250273 - protein, 23 aa, Mycobacterium
ATRAGPVRFGPSDSYRATDGRPI

SEQ ID NO: 250274 - protein, 7 aa, Mycobacterium
ATRAKPV

SEQ ID NO: 250275 - protein, 14 aa, Mycobacterium
ATRATRQARPVASV

SEQ ID NO: 250276 - protein, 5 aa, Mycobacterium
ATRAV

SEQ ID NO: 250277 - protein, 9 aa, Mycobacterium
ATRDAGSPE

SEQ ID NO: 250278 - protein, 10 aa, Mycobacterium
ATRDDDAEAL

SEQ ID NO: 250279 - protein, 7 aa, Mycobacterium
ATRDEPG

SEQ ID NO: 250280 - protein, 5 aa, Mycobacterium
ATRDH

SEQ ID NO: 250281 - protein, 21 aa, Mycobacterium
ATRDRAEAQLQEARADVVPRG

SEQ ID NO: 250282 - protein, 5 aa, Mycobacterium
ATRDS

SEQ ID NO: 250283 - protein, 6 aa, Mycobacterium
ATREGM

SEQ ID NO: 250284 - protein, 5 aa, Mycobacterium
ATREV

SEQ ID NO: 250285 - protein, 4 aa, Mycobacterium
ATRG

SEQ ID NO: 250286 - protein, 8 aa, Mycobacterium
ATRGAGWR

SEQ ID NO: 250287 - protein, 26 aa, Mycobacterium
ATRGPDGAPVPAGRVSPYDIGPTPSW

SEQ ID NO: 250288 - protein, 10 aa, Mycobacterium
ATRGPDGTLV

SEQ ID NO: 250289 - protein, 7 aa, Mycobacterium
ATRGRSV

SEQ ID NO: 250290 - protein, 7 aa, Mycobacterium
ATRGRTL

SEQ ID NO: 250291 - protein, 43 aa, Mycobacterium
ATRGTPQPPSLRHPGGTAPGPIPYPGAPPYGAQQYAPDGTPLY

SEQ ID NO: 250292 - protein, 13 aa, Mycobacterium
ATRLGGKEAGKSV

SEQ ID NO: 250293 - protein, 7 aa, Mycobacterium
ATRLGGS

SEQ ID NO: 250294 - protein, 5 aa, Mycobacterium
ATRLT

SEQ ID NO: 250295 - protein, 13 aa, Mycobacterium
ATRNHDEQDTDHV

SEQ ID NO: 250296 - protein, 7 aa, Mycobacterium
ATRNWDD

SEQ ID NO: 250297 - protein, 8 aa, Mycobacterium
ATRPGSHN

SEQ ID NO: 250298 - protein, 5 aa, Mycobacterium
ATRPL

SEQ ID NO: 250299 - protein, 10 aa, Mycobacterium
ATRPQADGPY

SEQ ID NO: 250300 - protein, 5 aa, Mycobacterium
ATRPS

SEQ ID NO: 250301 - protein, 15 aa, Mycobacterium
ATRPSAPDPGAVSDG

SEQ ID NO: 250302 - protein, 5 aa, Mycobacterium
ATRPT

SEQ ID NO: 250303 - protein, 6 aa, Mycobacterium
ATRQGA

SEQ ID NO: 250304 - protein, 29 aa, Mycobacterium
ATRRTGGTGARAAAARTPDRGSVRTVPAS

SEQ ID NO: 250305 - protein, 9 aa, Mycobacterium
ATRSAPHDV

SEQ ID NO: 250306 - protein, 6 aa, Mycobacterium
ATRSGD

SEQ ID NO: 250307 - protein, 8 aa, Mycobacterium
ATRSGKST

SEQ ID NO: 250308 - protein, 14 aa, Mycobacterium
ATRSGLWNPAPLRK

SEQ ID NO: 250309 - protein, 5 aa, Mycobacterium
ATRSV

SEQ ID NO: 250310 - protein, 4 aa, Mycobacterium
ATRT

SEQ ID NO: 250311 - protein, 4 aa, Mycobacterium
ATSA

SEQ ID NO: 250312 - protein, 5 aa, Mycobacterium
ATSAE

SEQ ID NO: 250313 - protein, 12 aa, Mycobacterium
ATSAGKKTGEAF

SEQ ID NO: 250314 - protein, 5 aa, Mycobacterium
ATSAL

SEQ ID NO: 250315 - protein, 12 aa, Mycobacterium
ATSASVQNRQEA

SEQ ID NO: 250316 - protein, 4 aa, Mycobacterium
ATSD

SEQ ID NO: 250317 - protein, 8 aa, Mycobacterium
ATSDAFDA

SEQ ID NO: 250318 - protein, 13 aa, Mycobacterium
ATSDREGSQGSGV

SEQ ID NO: 250319 - protein, 10 aa, Mycobacterium
ATSDSSPTRV

SEQ ID NO: 250320 - protein, 6 aa, Mycobacterium
ATSENI

SEQ ID NO: 250321 - protein, 8 aa, Mycobacterium
ATSENSTY

SEQ ID NO: 250322 - protein, 17 aa, Mycobacterium
ATSERVDVETTASTQIP

SEQ ID NO: 250323 - protein, 7 aa, Mycobacterium
ATSFPSG

SEQ ID NO: 250324 - protein, 8 aa, Mycobacterium
ATSGAVGE

SEQ ID NO: 250325 - protein, 8 aa, Mycobacterium
ATSGEGPF

SEQ ID NO: 250326 - protein, 9 aa, Mycobacterium
ATSGGGTDV

SEQ ID NO: 250327 - protein, 8 aa, Mycobacterium
ATSGGQSR

SEQ ID NO: 250328 - protein, 6 aa, Mycobacterium
ATSGLE

SEQ ID NO: 250329 - protein, 6 aa, Mycobacterium
ATSGRV

SEQ ID NO: 250330 - protein, 6 aa, Mycobacterium
ATSGSF

SEQ ID NO: 250331 - protein, 10 aa, Mycobacterium
ATSHDADSGV

SEQ ID NO: 250332 - protein, 8 aa, Mycobacterium
ATSKADAR

SEQ ID NO: 250333 - protein, 6 aa, Mycobacterium
ATSLAG

SEQ ID NO: 250334 - protein, 9 aa, Mycobacterium
ATSLASGGR

SEQ ID NO: 250335 - protein, 17 aa, Mycobacterium
ATSLSGRARRRGGGIDA

SEQ ID NO: 250336 - protein, 21 aa, Mycobacterium
ATSNGDADDTARGTADLGAAT

SEQ ID NO: 250337 - protein, 5 aa, Mycobacterium
ATSPD

SEQ ID NO: 250338 - protein, 9 aa, Mycobacterium
ATSPEPATE

SEQ ID NO: 250339 - protein, 7 aa, Mycobacterium
ATSPEPL

SEQ ID NO: 250340 - protein, 6 aa, Mycobacterium
ATSPGG

SEQ ID NO: 250341 - protein, 7 aa, Mycobacterium
ATSPGGV

SEQ ID NO: 250342 - protein, 7 aa, Mycobacterium
ATSPGRS

SEQ ID NO: 250343 - protein, 11 aa, Mycobacterium
ATSPSAVRSRA

SEQ ID NO: 250344 - protein, 7 aa, Mycobacterium
ATSPSTV

SEQ ID NO: 250345 - protein, 4 aa, Mycobacterium
ATSQ

SEQ ID NO: 250346 - protein, 10 aa, Mycobacterium
ATSQTPDEAA

SEQ ID NO: 250347 - protein, 4 aa, Mycobacterium
ATSR

SEQ ID NO: 250348 - protein, 8 aa, Mycobacterium
ATSRDGLA

SEQ ID NO: 250349 - protein, 7 aa, Mycobacterium
ATSRGPV

SEQ ID NO: 250350 - protein, 5 aa, Mycobacterium
ATSSA

SEQ ID NO: 250351 - protein, 15 aa, Mycobacterium
ATSSAHESLIPKRDS

SEQ ID NO: 250352 - protein, 13 aa, Mycobacterium
ATSSAKKAKAAVP

SEQ ID NO: 250353 - protein, 14 aa, Mycobacterium
ATSSAKKAKATVPL

SEQ ID NO: 250354 - protein, 7 aa, Mycobacterium
ATSSARL

SEQ ID NO: 250355 - protein, 9 aa, Mycobacterium
ATSSDDGYN

SEQ ID NO: 250356 - protein, 8 aa, Mycobacterium
ATSSVDTR

SEQ ID NO: 250357 - protein, 20 aa, Mycobacterium
ATSTDHAEGGAATGPRRPPR

SEQ ID NO: 250358 - protein, 12 aa, Mycobacterium
ATSTGVSAPSGV

SEQ ID NO: 250359 - protein, 17 aa, Mycobacterium
ATSTRVDSETTASTQIP

SEQ ID NO: 250360 - protein, 6 aa, Mycobacterium
ATSTTI

SEQ ID NO: 250361 - protein, 9 aa, Mycobacterium
ATSTTTAMK

SEQ ID NO: 250362 - protein, 12 aa, Mycobacterium
ATSTTVNDRQQA

SEQ ID NO: 250363 - protein, 12 aa, Mycobacterium
ATSVAEADATGR

SEQ ID NO: 250364 - protein, 5 aa, Mycobacterium
ATSVF

SEQ ID NO: 250365 - protein, 11 aa, Mycobacterium
ATTAAANGLTQ

SEQ ID NO: 250366 - protein, 15 aa, Mycobacterium
ATTAAGPISQTAYGA

SEQ ID NO: 250367 - protein, 10 aa, Mycobacterium
ATTAGAGQLD

SEQ ID NO: 250368 - protein, 6 aa, Mycobacterium
ATTAGV

SEQ ID NO: 250369 - protein, 5 aa, Mycobacterium
ATTAQ

SEQ ID NO: 250370 - protein, 21 aa, Mycobacterium
ATTAVEATGLSTLDGDAENRT

SEQ ID NO: 250371 - protein, 16 aa, Mycobacterium
ATTAWSAATNGSQAAA

SEQ ID NO: 250372 - protein, 4 aa, Mycobacterium
ATTD

SEQ ID NO: 250373 - protein, 5 aa, Mycobacterium
ATTDA

SEQ ID NO: 250374 - protein, 13 aa, Mycobacterium
ATTDADRGQATPW

SEQ ID NO: 250375 - protein, 7 aa, Mycobacterium
ATTDDPR

SEQ ID NO: 250376 - protein, 7 aa, Mycobacterium
ATTDGSP

SEQ ID NO: 250377 - protein, 5 aa, Mycobacterium
ATTDN

SEQ ID NO: 250378 - protein, 10 aa, Mycobacterium
ATTDTSPTRV

SEQ ID NO: 250379 - protein, 8 aa, Mycobacterium
ATTGDSVP

SEQ ID NO: 250380 - protein, 6 aa, Mycobacterium
ATTGEQ

SEQ ID NO: 250381 - protein, 8 aa, Mycobacterium
ATTGGGAA

SEQ ID NO: 250382 - protein, 10 aa, Mycobacterium
ATTGPTPRNV

SEQ ID NO: 250383 - protein, 21 aa, Mycobacterium
ATTGRSHQEREEGKPPSRRPP

SEQ ID NO: 250384 - protein, 23 aa, Mycobacterium
ATTGRTRKNRGGGEDARPQRTPP

SEQ ID NO: 250385 - protein, 6 aa, Mycobacterium
ATTGSH

SEQ ID NO: 250386 - protein, 5 aa, Mycobacterium
ATTGT

SEQ ID NO: 250387 - protein, 6 aa, Mycobacterium
ATTGTG

SEQ ID NO: 250388 - protein, 9 aa, Mycobacterium
ATTHGEAEN

SEQ ID NO: 250389 - protein, 8 aa, Mycobacterium
ATTHTRGD

SEQ ID NO: 250390 - protein, 5 aa, Mycobacterium
ATTIG

SEQ ID NO: 250391 - protein, 4 aa, Mycobacterium
ATTL

SEQ ID NO: 250392 - protein, 5 aa, Mycobacterium
ATTLG

SEQ ID NO: 250393 - protein, 11 aa, Mycobacterium
ATTLPRPDGAV

SEQ ID NO: 250394 - protein, 6 aa, Mycobacterium
ATTMTP

SEQ ID NO: 250395 - protein, 7 aa, Mycobacterium
ATTNGAL

SEQ ID NO: 250396 - protein, 4 aa, Mycobacterium
ATTP

SEQ ID NO: 250397 - protein, 5 aa, Mycobacterium
ATTPA

SEQ ID NO: 250398 - protein, 6 aa, Mycobacterium
ATTPGG

SEQ ID NO: 250399 - protein, 12 aa, Mycobacterium
ATTPSAYRRAFR

SEQ ID NO: 250400 - protein, 7 aa, Mycobacterium
ATTPTSA

SEQ ID NO: 250401 - protein, 61 aa, Mycobacterium
ATTPVTTKPSSPPVTTKPSTPPVTTPPVTTKPSTPPVTTPPVTTKPSTPPVTTPPTTTEHP

SEQ ID NO: 250402 - protein, 7 aa, Mycobacterium
ATTQHDT

SEQ ID NO: 250403 - protein, 5 aa, Mycobacterium
ATTQM

SEQ ID NO: 250404 - protein, 32 aa, Mycobacterium
ATTRGLNDQAKAQSDNATAEGDAFDRAKNDDT

SEQ ID NO: 250405 - protein, 11 aa, Mycobacterium
ATTRTTGDLAK

SEQ ID NO: 250406 - protein, 4 aa, Mycobacterium
ATTS

SEQ ID NO: 250407 - protein, 24 aa, Mycobacterium
ATTSCTDTIAPGDSAYDNAHAAED

SEQ ID NO: 250408 - protein, 11 aa, Mycobacterium
ATTSPTLPDAI

SEQ ID NO: 250409 - protein, 15 aa, Mycobacterium
ATTSQNASAVQAATQ

SEQ ID NO: 250410 - protein, 7 aa, Mycobacterium
ATTSSLP

SEQ ID NO: 250411 - protein, 4 aa, Mycobacterium
ATTT

SEQ ID NO: 250412 - protein, 7 aa, Mycobacterium
ATTTGTG

SEQ ID NO: 250413 - protein, 11 aa, Mycobacterium
ATTTQDETQSF

SEQ ID NO: 250414 - protein, 14 aa, Mycobacterium
ATTTTEGRRASTAD

SEQ ID NO: 250415 - protein, 5 aa, Mycobacterium
ATVAA

SEQ ID NO: 250416 - protein, 8 aa, Mycobacterium
ATVAETNN

SEQ ID NO: 250417 - protein, 9 aa, Mycobacterium
ATVAPGDKA

SEQ ID NO: 250418 - protein, 6 aa, Mycobacterium
ATVDAY

SEQ ID NO: 250419 - protein, 9 aa, Mycobacterium
ATVEEAQKR

SEQ ID NO: 250420 - protein, 7 aa, Mycobacterium
ATVEQAT

SEQ ID NO: 250421 - protein, 11 aa, Mycobacterium
ATVGAGATAEL

SEQ ID NO: 250422 - protein, 10 aa, Mycobacterium
ATVGAGATAQ

SEQ ID NO: 250423 - protein, 19 aa, Mycobacterium
ATVGGGELGEPPRVPMLPA

SEQ ID NO: 250424 - protein, 4 aa, Mycobacterium
ATVP

SEQ ID NO: 250425 - protein, 10 aa, Mycobacterium
ATVPAGPVTP

SEQ ID NO: 250426 - protein, 6 aa, Mycobacterium
ATVPDA

SEQ ID NO: 250427 - protein, 5 aa, Mycobacterium
ATVPG

SEQ ID NO: 250428 - protein, 6 aa, Mycobacterium
ATVPGI

SEQ ID NO: 250429 - protein, 20 aa, Mycobacterium
ATVPPEQAAAQNATTGPNGL

SEQ ID NO: 250430 - protein, 13 aa, Mycobacterium
ATVPPPPAGDNPL

SEQ ID NO: 250431 - protein, 8 aa, Mycobacterium
ATVPPTPA

SEQ ID NO: 250432 - protein, 5 aa, Mycobacterium
ATVPR

SEQ ID NO: 250433 - protein, 5 aa, Mycobacterium
ATVPT

SEQ ID NO: 250434 - protein, 10 aa, Mycobacterium
ATVQAQTRHQ

SEQ ID NO: 250435 - protein, 5 aa, Mycobacterium
ATVRQ

SEQ ID NO: 250436 - protein, 4 aa, Mycobacterium
ATVS

SEQ ID NO: 250437 - protein, 11 aa, Mycobacterium
ATVSEASKDYI

SEQ ID NO: 250438 - protein, 5 aa, Mycobacterium
ATVSQ

SEQ ID NO: 250439 - protein, 5 aa, Mycobacterium
ATVSR

SEQ ID NO: 250440 - protein, 4 aa, Mycobacterium
ATVT

SEQ ID NO: 250441 - protein, 5 aa, Mycobacterium
ATVTA

SEQ ID NO: 250442 - protein, 6 aa, Mycobacterium
ATVTGN

SEQ ID NO: 250443 - protein, 11 aa, Mycobacterium
ATWEGTSAQSY

SEQ ID NO: 250444 - protein, 10 aa, Mycobacterium
ATYAPDDEAL

SEQ ID NO: 250445 - protein, 9 aa, Mycobacterium
ATYAPDDRA

SEQ ID NO: 250446 - protein, 10 aa, Mycobacterium
ATYAPDEEDL

SEQ ID NO: 250447 - protein, 8 aa, Mycobacterium
ATYNDPAT

SEQ ID NO: 250448 - protein, 5 aa, Mycobacterium
ATYPD

SEQ ID NO: 250449 - protein, 6 aa, Mycobacterium
ATYPDA

SEQ ID NO: 250450 - protein, 4 aa, Mycobacterium
ATYR

SEQ ID NO: 250451 - protein, 7 aa, Mycobacterium
ATYSARD

SEQ ID NO: 250452 - protein, 9 aa, Mycobacterium
ATYSDKYDS

SEQ ID NO: 250453 - protein, 16 aa, Mycobacterium
AVAAGTATLDDGPAAA

SEQ ID NO: 250454 - protein, 13 aa, Mycobacterium
AVADSGSRPEPDA

SEQ ID NO: 250455 - protein, 7 aa, Mycobacterium
AVADSKQ

SEQ ID NO: 250456 - protein, 23 aa, Mycobacterium
AVAEGNSRKDDLAKLTGGADQLA

SEQ ID NO: 250457 - protein, 7 aa, Mycobacterium
AVAGEPY

SEQ ID NO: 250458 - protein, 7 aa, Mycobacterium
AVAGPPK

SEQ ID NO: 250459 - protein, 14 aa, Mycobacterium
AVAPASAEGRHKAG

SEQ ID NO: 250460 - protein, 8 aa, Mycobacterium
AVAPDSAP

SEQ ID NO: 250461 - protein, 5 aa, Mycobacterium
AVAPP

SEQ ID NO: 250462 - protein, 15 aa, Mycobacterium
AVAPSAKSAALGRQL

SEQ ID NO: 250463 - protein, 15 aa, Mycobacterium
AVAPSPPAVDGTDGS

SEQ ID NO: 250464 - protein, 10 aa, Mycobacterium
AVARSKPAAW

SEQ ID NO: 250465 - protein, 159 aa, Mycobacterium
AVASADTDETTSSDTSTDGAKADRADSAGSRGPAATKVGPPRFGAGAKKLRSGKFSDSLAGHSAAAGDESSKPEVGTDGAAASTGSTSKSRATTSRTTRKYAEPDRPRGHRAGSPSRSQRSAPDTDAAKDTTQTDSSASGPTPQAPTAGTTGKKPPASS

SEQ ID NO: 250466 - protein, 8 aa, Mycobacterium
AVASGRNR

SEQ ID NO: 250467 - protein, 5 aa, Mycobacterium
AVASN

SEQ ID NO: 250468 - protein, 7 aa, Mycobacterium
AVASPTA

SEQ ID NO: 250469 - protein, 7 aa, Mycobacterium
AVATAER

SEQ ID NO: 250470 - protein, 7 aa, Mycobacterium
AVATGPA

SEQ ID NO: 250471 - protein, 7 aa, Mycobacterium
AVDAEPD

SEQ ID NO: 250472 - protein, 7 aa, Mycobacterium
AVDDQGT

SEQ ID NO: 250473 - protein, 8 aa, Mycobacterium
AVDDRPER

SEQ ID NO: 250474 - protein, 11 aa, Mycobacterium
AVDEDSRTSEY

SEQ ID NO: 250475 - protein, 9 aa, Mycobacterium
AVDEQRRKQ

SEQ ID NO: 250476 - protein, 10 aa, Mycobacterium
AVDGGPEGNE

SEQ ID NO: 250477 - protein, 18 aa, Mycobacterium
AVDGNNATSWAPNGTAGS

SEQ ID NO: 250478 - protein, 10 aa, Mycobacterium
AVDKPDLEGA

SEQ ID NO: 250479 - protein, 14 aa, Mycobacterium
AVDLQNSSWLTRLT

SEQ ID NO: 250480 - protein, 7 aa, Mycobacterium
AVDPAGD

SEQ ID NO: 250481 - protein, 6 aa, Mycobacterium
AVDQSA

SEQ ID NO: 250482 - protein, 7 aa, Mycobacterium
AVDTEPD

SEQ ID NO: 250483 - protein, 9 aa, Mycobacterium
AVDTEQRRR

SEQ ID NO: 250484 - protein, 28 aa, Mycobacterium
AVDTGAAATHGPRDVTEATQEAATARLE

SEQ ID NO: 250485 - protein, 10 aa, Mycobacterium
AVDTPAEDGV

SEQ ID NO: 250486 - protein, 7 aa, Mycobacterium
AVDTSGN

SEQ ID NO: 250487 - protein, 8 aa, Mycobacterium
AVEATPAS

SEQ ID NO: 250488 - protein, 7 aa, Mycobacterium
AVEGDEP

SEQ ID NO: 250489 - protein, 6 aa, Mycobacterium
AVEGYT

SEQ ID NO: 250490 - protein, 4 aa, Mycobacterium
AVEK

SEQ ID NO: 250491 - protein, 5 aa, Mycobacterium
AVENS

SEQ ID NO: 250492 - protein, 8 aa, Mycobacterium
AVEPGGIR

SEQ ID NO: 250493 - protein, 8 aa, Mycobacterium
AVEPREGD

SEQ ID NO: 250494 - protein, 5 aa, Mycobacterium
AVEPS

SEQ ID NO: 250495 - protein, 7 aa, Mycobacterium
AVEPSTT

SEQ ID NO: 250496 - protein, 4 aa, Mycobacterium
AVES

SEQ ID NO: 250497 - protein, 12 aa, Mycobacterium
AVESGSQPSEGV

SEQ ID NO: 250498 - protein, 5 aa, Mycobacterium
AVESL

SEQ ID NO: 250499 - protein, 9 aa, Mycobacterium
AVESRRRGV

SEQ ID NO: 250500 - protein, 6 aa, Mycobacterium
AVGAGP

SEQ ID NO: 250501 - protein, 6 aa, Mycobacterium
AVGASD

SEQ ID NO: 250502 - protein, 10 aa, Mycobacterium
AVGASPALQP

SEQ ID NO: 250503 - protein, 4 aa, Mycobacterium
AVGD

SEQ ID NO: 250504 - protein, 8 aa, Mycobacterium
AVGDDVEP

SEQ ID NO: 250505 - protein, 7 aa, Mycobacterium
AVGETGG

SEQ ID NO: 250506 - protein, 4 aa, Mycobacterium
AVGG

SEQ ID NO: 250507 - protein, 6 aa, Mycobacterium
AVGGAT

SEQ ID NO: 250508 - protein, 11 aa, Mycobacterium
AVGGEKPVAPA

SEQ ID NO: 250509 - protein, 17 aa, Mycobacterium
AVGGELAATSAAPQPYL

SEQ ID NO: 250510 - protein, 6 aa, Mycobacterium
AVGGPA

SEQ ID NO: 250511 - protein, 10 aa, Mycobacterium
AVGGPRATGY

SEQ ID NO: 250512 - protein, 5 aa, Mycobacterium
AVGGQ

SEQ ID NO: 250513 - protein, 11 aa, Mycobacterium
AVGGSSLGAAG

SEQ ID NO: 250514 - protein, 4 aa, Mycobacterium
AVGL

SEQ ID NO: 250515 - protein, 9 aa, Mycobacterium
AVGNETNYA

SEQ ID NO: 250516 - protein, 7 aa, Mycobacterium
AVGNQTT

SEQ ID NO: 250517 - protein, 7 aa, Mycobacterium
AVGPEQR

SEQ ID NO: 250518 - protein, 5 aa, Mycobacterium
AVGPG

SEQ ID NO: 250519 - protein, 4 aa, Mycobacterium
AVGQ

SEQ ID NO: 250520 - protein, 78 aa, Mycobacterium
AVGQPAAGFAPPMPTPSTPAAQPAGWSPPTPPGSPVPTGAPQPTPWTGATGWGTGYPGTAGAPPWGQPPVQPSGGGGA

SEQ ID NO: 250521 - protein, 16 aa, Mycobacterium
AVGRPGVSDDSRRSRT

SEQ ID NO: 250522 - protein, 6 aa, Mycobacterium
AVGRRD

SEQ ID NO: 250523 - protein, 6 aa, Mycobacterium
AVGSSS

SEQ ID NO: 250524 - protein, 5 aa, Mycobacterium
AVGTG

SEQ ID NO: 250525 - protein, 6 aa, Mycobacterium
AVGTQI

SEQ ID NO: 250526 - protein, 6 aa, Mycobacterium
AVGTTI

SEQ ID NO: 250527 - protein, 5 aa, Mycobacterium
AVGYE

SEQ ID NO: 250528 - protein, 40 aa, Mycobacterium
AVHESSSRVHAEQAQGRRQVTATSVGDSHPRRDLESPTVT

SEQ ID NO: 250529 - protein, 35 aa, Mycobacterium
AVHGGAGSAAAPTERAPRPGGPAQPPAPPQREERE

SEQ ID NO: 250530 - protein, 19 aa, Mycobacterium
AVKGEPRNRGYPQPNSRSR

SEQ ID NO: 250531 - protein, 21 aa, Mycobacterium
AVKGGAEGPPTAPTTPGRPSV

SEQ ID NO: 250532 - protein, 7 aa, Mycobacterium
AVKGTPL

SEQ ID NO: 250533 - protein, 8 aa, Mycobacterium
AVKGTPLA

SEQ ID NO: 250534 - protein, 8 aa, Mycobacterium
AVKGTTLT

SEQ ID NO: 250535 - protein, 8 aa, Mycobacterium
AVKPGANV

SEQ ID NO: 250536 - protein, 20 aa, Mycobacterium
AVKPGTPQTTEERLADRYGR

SEQ ID NO: 250537 - protein, 8 aa, Mycobacterium
AVKPSYGL

SEQ ID NO: 250538 - protein, 7 aa, Mycobacterium
AVKPTPI

SEQ ID NO: 250539 - protein, 10 aa, Mycobacterium
AVKTDGDTSV

SEQ ID NO: 250540 - protein, 5 aa, Mycobacterium
AVLGS

SEQ ID NO: 250541 - protein, 10 aa, Mycobacterium
AVNDGSRRQN

SEQ ID NO: 250542 - protein, 8 aa, Mycobacterium
AVNGRGHK

SEQ ID NO: 250543 - protein, 9 aa, Mycobacterium
AVNGRGQKI

SEQ ID NO: 250544 - protein, 10 aa, Mycobacterium
AVNNETLPYG

SEQ ID NO: 250545 - protein, 11 aa, Mycobacterium
AVNNGTLPYGN

SEQ ID NO: 250546 - protein, 12 aa, Mycobacterium
AVNPQTGEEFTK

SEQ ID NO: 250547 - protein, 21 aa, Mycobacterium
AVNQDGASNGLATPNGPSQQR

SEQ ID NO: 250548 - protein, 20 aa, Mycobacterium
AVNQDGASNGLTAPNGPAQQ

SEQ ID NO: 250549 - protein, 20 aa, Mycobacterium
AVNQDGASNGLTAPNGPSQQ

SEQ ID NO: 250550 - protein, 11 aa, Mycobacterium
AVNQDGRSNGL

SEQ ID NO: 250551 - protein, 4 aa, Mycobacterium
AVPA

SEQ ID NO: 250552 - protein, 20 aa, Mycobacterium
AVPAGDTPRAVRRRPAKDVP

SEQ ID NO: 250553 - protein, 44 aa, Mycobacterium
AVPAPPGGAVPAAPSAFGGNASGGPSVATAAYDPNTGQYLSPDG

SEQ ID NO: 250554 - protein, 9 aa, Mycobacterium
AVPAQRPLA

SEQ ID NO: 250555 - protein, 9 aa, Mycobacterium
AVPARPGRG

SEQ ID NO: 250556 - protein, 20 aa, Mycobacterium
AVPATTPAPAIVTPGAEASV

SEQ ID NO: 250557 - protein, 4 aa, Mycobacterium
AVPD

SEQ ID NO: 250558 - protein, 5 aa, Mycobacterium
AVPDD

SEQ ID NO: 250559 - protein, 43 aa, Mycobacterium
AVPDDDEAVAVPEPAAQQEQGVDDPTETALQGPLPPDRGPETE

SEQ ID NO: 250560 - protein, 9 aa, Mycobacterium
AVPDDPDDF

SEQ ID NO: 250561 - protein, 10 aa, Mycobacterium
AVPDDSARGE

SEQ ID NO: 250562 - protein, 5 aa, Mycobacterium
AVPDE

SEQ ID NO: 250563 - protein, 13 aa, Mycobacterium
AVPDGDGEAQTAV

SEQ ID NO: 250564 - protein, 6 aa, Mycobacterium
AVPDPV

SEQ ID NO: 250565 - protein, 10 aa, Mycobacterium
AVPEDDKGLM

SEQ ID NO: 250566 - protein, 12 aa, Mycobacterium
AVPEPRAHYTGE

SEQ ID NO: 250567 - protein, 7 aa, Mycobacterium
AVPESEI

SEQ ID NO: 250568 - protein, 13 aa, Mycobacterium
AVPGDSVDTITAR

SEQ ID NO: 250569 - protein, 8 aa, Mycobacterium
AVPGPGGR

SEQ ID NO: 250570 - protein, 16 aa, Mycobacterium
AVPGQAPGVPGQLPPQ

SEQ ID NO: 250571 - protein, 16 aa, Mycobacterium
AVPGSRRQWERDPHDP

SEQ ID NO: 250572 - protein, 7 aa, Mycobacterium
AVPGSRT

SEQ ID NO: 250573 - protein, 21 aa, Mycobacterium
AVPGTAEDAAAEGTKVGVEEG

SEQ ID NO: 250574 - protein, 24 aa, Mycobacterium
AVPIGATGKVDNNGLRAMLAERGE

SEQ ID NO: 250575 - protein, 10 aa, Mycobacterium
AVPKPPVPRL

SEQ ID NO: 250576 - protein, 5 aa, Mycobacterium
AVPKR

SEQ ID NO: 250577 - protein, 6 aa, Mycobacterium
AVPNYG

SEQ ID NO: 250578 - protein, 11 aa, Mycobacterium
AVPPAVDPPLA

SEQ ID NO: 250579 - protein, 6 aa, Mycobacterium
AVPPDA

SEQ ID NO: 250580 - protein, 16 aa, Mycobacterium
AVPPDETGPDQPTEQR

SEQ ID NO: 250581 - protein, 6 aa, Mycobacterium
AVPPGR

SEQ ID NO: 250582 - protein, 44 aa, Mycobacterium
AVPPPPPPRRPPPPRPPAPRPPPPRPPAPRPPAPVAAAPRKPRR

SEQ ID NO: 250583 - protein, 12 aa, Mycobacterium
AVPPPPPVEPAP

SEQ ID NO: 250584 - protein, 13 aa, Mycobacterium
AVPPSASDGAAQN

SEQ ID NO: 250585 - protein, 10 aa, Mycobacterium
AVPPTPPAPS

SEQ ID NO: 250586 - protein, 10 aa, Mycobacterium
AVPPTTPAPP

SEQ ID NO: 250587 - protein, 8 aa, Mycobacterium
AVPQEGIQ

SEQ ID NO: 250588 - protein, 8 aa, Mycobacterium
AVPQPDST

SEQ ID NO: 250589 - protein, 6 aa, Mycobacterium
AVPQPT

SEQ ID NO: 250590 - protein, 4 aa, Mycobacterium
AVPR

SEQ ID NO: 250591 - protein, 5 aa, Mycobacterium
AVPRD

SEQ ID NO: 250592 - protein, 7 aa, Mycobacterium
AVPREPG

SEQ ID NO: 250593 - protein, 5 aa, Mycobacterium
AVPRT

SEQ ID NO: 250594 - protein, 8 aa, Mycobacterium
AVPSEPLP

SEQ ID NO: 250595 - protein, 7 aa, Mycobacterium
AVPSNGL

SEQ ID NO: 250596 - protein, 19 aa, Mycobacterium
AVPSNLDPSIGAASAENPI

SEQ ID NO: 250597 - protein, 7 aa, Mycobacterium
AVPTDNN

SEQ ID NO: 250598 - protein, 6 aa, Mycobacterium
AVPTRS

SEQ ID NO: 250599 - protein, 18 aa, Mycobacterium
AVQAGGDVPNMGTKQAYR

SEQ ID NO: 250600 - protein, 9 aa, Mycobacterium
AVQDSPRNA

SEQ ID NO: 250601 - protein, 7 aa, Mycobacterium
AVQGAAG

SEQ ID NO: 250602 - protein, 10 aa, Mycobacterium
AVQNTTPPTA

SEQ ID NO: 250603 - protein, 8 aa, Mycobacterium
AVQPPSER

SEQ ID NO: 250604 - protein, 6 aa, Mycobacterium
AVQQRQ

SEQ ID NO: 250605 - protein, 7 aa, Mycobacterium
AVQRPDG

SEQ ID NO: 250606 - protein, 6 aa, Mycobacterium
AVQSGD

SEQ ID NO: 250607 - protein, 8 aa, Mycobacterium
AVQTGGER

SEQ ID NO: 250608 - protein, 17 aa, Mycobacterium
AVRAAGRAPLARALVAC

SEQ ID NO: 250609 - protein, 9 aa, Mycobacterium
AVRAEAGRQ

SEQ ID NO: 250610 - protein, 10 aa, Mycobacterium
AVRAEGPTPL

SEQ ID NO: 250611 - protein, 11 aa, Mycobacterium
AVRAGGGQYAD

SEQ ID NO: 250612 - protein, 8 aa, Mycobacterium
AVRAGNAA

SEQ ID NO: 250613 - protein, 4 aa, Mycobacterium
AVRE

SEQ ID NO: 250614 - protein, 24 aa, Mycobacterium
AVRGHSAPVPRATAAACGGGHALV

SEQ ID NO: 250615 - protein, 4 aa, Mycobacterium
AVRP

SEQ ID NO: 250616 - protein, 13 aa, Mycobacterium
AVRPAANVASAGV

SEQ ID NO: 250617 - protein, 10 aa, Mycobacterium
AVRPDDGEAQ

SEQ ID NO: 250618 - protein, 8 aa, Mycobacterium
AVRPPRGW

SEQ ID NO: 250619 - protein, 14 aa, Mycobacterium
AVRPRGGTEYADWS

SEQ ID NO: 250620 - protein, 6 aa, Mycobacterium
AVRPSY

SEQ ID NO: 250621 - protein, 7 aa, Mycobacterium
AVRPSYG

SEQ ID NO: 250622 - protein, 13 aa, Mycobacterium
AVRQGSQAAEVPR

SEQ ID NO: 250623 - protein, 10 aa, Mycobacterium
AVRQTAEKFG

SEQ ID NO: 250624 - protein, 10 aa, Mycobacterium
AVRRTASSTP

SEQ ID NO: 250625 - protein, 7 aa, Mycobacterium
AVRSDDR

SEQ ID NO: 250626 - protein, 8 aa, Mycobacterium
AVRSGNAA

SEQ ID NO: 250627 - protein, 9 aa, Mycobacterium
AVRSGNSAI

SEQ ID NO: 250628 - protein, 8 aa, Mycobacterium
AVRSTTDR

SEQ ID NO: 250629 - protein, 10 aa, Mycobacterium
AVRTAGPTPL

SEQ ID NO: 250630 - protein, 7 aa, Mycobacterium
AVRTSEA

SEQ ID NO: 250631 - protein, 8 aa, Mycobacterium
AVRTSQAE

SEQ ID NO: 250632 - protein, 10 aa, Mycobacterium
AVSAATTRSD

SEQ ID NO: 250633 - protein, 7 aa, Mycobacterium
AVSAGQR

SEQ ID NO: 250634 - protein, 8 aa, Mycobacterium
AVSAPTGT

SEQ ID NO: 250635 - protein, 9 aa, Mycobacterium
AVSAPTGTF

SEQ ID NO: 250636 - protein, 8 aa, Mycobacterium
AVSATGPI

SEQ ID NO: 250637 - protein, 10 aa, Mycobacterium
AVSDDPVGAF

SEQ ID NO: 250638 - protein, 10 aa, Mycobacterium
AVSDDQGGTV

SEQ ID NO: 250639 - protein, 14 aa, Mycobacterium
AVSDPASQAPRVVS

SEQ ID NO: 250640 - protein, 9 aa, Mycobacterium
AVSEGGGRL

SEQ ID NO: 250641 - protein, 4 aa, Mycobacterium
AVSG

SEQ ID NO: 250642 - protein, 7 aa, Mycobacterium
AVSGPAN

SEQ ID NO: 250643 - protein, 8 aa, Mycobacterium
AVSPPRVD

SEQ ID NO: 250644 - protein, 19 aa, Mycobacterium
AVSQAASEAARAESGGCAP

SEQ ID NO: 250645 - protein, 12 aa, Mycobacterium
AVSSSPDPGAGV

SEQ ID NO: 250646 - protein, 5 aa, Mycobacterium
AVSSW

SEQ ID NO: 250647 - protein, 10 aa, Mycobacterium
AVSTDPQVEE

SEQ ID NO: 250648 - protein, 9 aa, Mycobacterium
AVSTGGGPL

SEQ ID NO: 250649 - protein, 6 aa, Mycobacterium
AVSTGH

SEQ ID NO: 250650 - protein, 8 aa, Mycobacterium
AVTAGRSA

SEQ ID NO: 250651 - protein, 8 aa, Mycobacterium
AVTARADE

SEQ ID NO: 250652 - protein, 16 aa, Mycobacterium
AVTASGSGLDPDISPA

SEQ ID NO: 250653 - protein, 14 aa, Mycobacterium
AVTASTELRTELTG

SEQ ID NO: 250654 - protein, 22 aa, Mycobacterium
AVTASTGLRTTLDGDTDQYQPA

SEQ ID NO: 250655 - protein, 5 aa, Mycobacterium
AVTDR

SEQ ID NO: 250656 - protein, 8 aa, Mycobacterium
AVTDYSRP

SEQ ID NO: 250657 - protein, 4 aa, Mycobacterium
AVTG

SEQ ID NO: 250658 - protein, 9 aa, Mycobacterium
AVTGDDVPQ

SEQ ID NO: 250659 - protein, 6 aa, Mycobacterium
AVTGKG

SEQ ID NO: 250660 - protein, 5 aa, Mycobacterium
AVTGP

SEQ ID NO: 250661 - protein, 8 aa, Mycobacterium
AVTGRGKG

SEQ ID NO: 250662 - protein, 19 aa, Mycobacterium
AVTGSTHSADQRVQTEAEA

SEQ ID NO: 250663 - protein, 13 aa, Mycobacterium
AVTNPHTGEVDPT

SEQ ID NO: 250664 - protein, 9 aa, Mycobacterium
AVTPGPRKV

SEQ ID NO: 250665 - protein, 11 aa, Mycobacterium
AVTPGRPTTTR

SEQ ID NO: 250666 - protein, 10 aa, Mycobacterium
AVTPHHGSQP

SEQ ID NO: 250667 - protein, 12 aa, Mycobacterium
AVTPPSKSVKPP

SEQ ID NO: 250668 - protein, 9 aa, Mycobacterium
AVTPSRPAA

SEQ ID NO: 250669 - protein, 5 aa, Mycobacterium
AVTRE

SEQ ID NO: 250670 - protein, 5 aa, Mycobacterium
AVTSD

SEQ ID NO: 250671 - protein, 22 aa, Mycobacterium
AVTSSSALRTSLDGSTDQYQPA

SEQ ID NO: 250672 - protein, 14 aa, Mycobacterium
AVTSSTQLRTDLSG

SEQ ID NO: 250673 - protein, 8 aa, Mycobacterium
AVTTADGS

SEQ ID NO: 250674 - protein, 14 aa, Mycobacterium
AVTTARTLNDQRHD

SEQ ID NO: 250675 - protein, 16 aa, Mycobacterium
AVTTARTLNEQRGNLD

SEQ ID NO: 250676 - protein, 7 aa, Mycobacterium
AVTTDAP

SEQ ID NO: 250677 - protein, 8 aa, Mycobacterium
AVTTGAGR

SEQ ID NO: 250678 - protein, 9 aa, Mycobacterium
AVTTNPAGA

SEQ ID NO: 250679 - protein, 11 aa, Mycobacterium
AVTTTGMSSEN

SEQ ID NO: 250680 - protein, 10 aa, Mycobacterium
AVTVSTPDCQ

SEQ ID NO: 250681 - protein, 21 aa, Mycobacterium
AVVGGSDAQARDAAAAAQRDR

SEQ ID NO: 250682 - protein, 6 aa, Mycobacterium
AVYGEG

SEQ ID NO: 250683 - protein, 27 aa, Mycobacterium
AVYGEKSSAPTADITGTDSAPDTDEPI

SEQ ID NO: 250684 - protein, 11 aa, Mycobacterium
AVYNGSSPALP

SEQ ID NO: 250685 - protein, 5 aa, Mycobacterium
AVYTQ

SEQ ID NO: 250686 - protein, 28 aa, Mycobacterium
AWAAPAAPPAGAPPPRAIPPPPPPPTVT

SEQ ID NO: 250687 - protein, 16 aa, Mycobacterium
AWAPAPPPASSAAADA

SEQ ID NO: 250688 - protein, 8 aa, Mycobacterium
AWDGSKGE

SEQ ID NO: 250689 - protein, 7 aa, Mycobacterium
AWDPQAE

SEQ ID NO: 250690 - protein, 9 aa, Mycobacterium
AWEGPSAQS

SEQ ID NO: 250691 - protein, 10 aa, Mycobacterium
AWEGPSAQSY

SEQ ID NO: 250692 - protein, 15 aa, Mycobacterium
AWEGTGGKAPGKEIA

SEQ ID NO: 250693 - protein, 11 aa, Mycobacterium
AWNPGEDAAPV

SEQ ID NO: 250694 - protein, 10 aa, Mycobacterium
AWPPAPVPEY

SEQ ID NO: 250695 - protein, 6 aa, Mycobacterium
AWPQGD

SEQ ID NO: 250696 - protein, 10 aa, Mycobacterium
AWQDADAPIP

SEQ ID NO: 250697 - protein, 14 aa, Mycobacterium
AWQPAQQGASYSKS

SEQ ID NO: 250698 - protein, 7 aa, Mycobacterium
AWRGPSS

SEQ ID NO: 250699 - protein, 5 aa, Mycobacterium
AWRPA

SEQ ID NO: 250700 - protein, 7 aa, Mycobacterium
AWRQSGD

SEQ ID NO: 250701 - protein, 15 aa, Mycobacterium
AWRSPADESDMDTPD

SEQ ID NO: 250702 - protein, 15 aa, Mycobacterium
AWRSPADTTTIDTPD

SEQ ID NO: 250703 - protein, 11 aa, Mycobacterium
AWTSPPAAASR

SEQ ID NO: 250704 - protein, 11 aa, Mycobacterium
AWTSSPQAAAQ

SEQ ID NO: 250705 - protein, 12 aa, Mycobacterium
AWTTGNKRGQAH

SEQ ID NO: 250706 - protein, 19 aa, Mycobacterium
AYAAPEQLTGADVDGRADQ

SEQ ID NO: 250707 - protein, 8 aa, Mycobacterium
AYADPESE

SEQ ID NO: 250708 - protein, 13 aa, Mycobacterium
AYAEPASDAPGVP

SEQ ID NO: 250709 - protein, 7 aa, Mycobacterium
AYAESAP

SEQ ID NO: 250710 - protein, 49 aa, Mycobacterium
AYAPEADQTAEEEPQDEPESKDPKSKDEATEEEAPKEPEASEAEAETEH

SEQ ID NO: 250711 - protein, 12 aa, Mycobacterium
AYAQSPAELSEA

SEQ ID NO: 250712 - protein, 6 aa, Mycobacterium
AYARAG

SEQ ID NO: 250713 - protein, 8 aa, Mycobacterium
AYARGDGT

SEQ ID NO: 250714 - protein, 17 aa, Mycobacterium
AYDAGYDEEFDGEPDES

SEQ ID NO: 250715 - protein, 12 aa, Mycobacterium
AYDDKAKKTTKA

SEQ ID NO: 250716 - protein, 5 aa, Mycobacterium
AYDDT

SEQ ID NO: 250717 - protein, 4 aa, Mycobacterium
AYDL

SEQ ID NO: 250718 - protein, 9 aa, Mycobacterium
AYDPAAKTW

SEQ ID NO: 250719 - protein, 11 aa, Mycobacterium
AYDPAAKTWTP

SEQ ID NO: 250720 - protein, 8 aa, Mycobacterium
AYDPTNSE

SEQ ID NO: 250721 - protein, 7 aa, Mycobacterium
AYEERTN

SEQ ID NO: 250722 - protein, 6 aa, Mycobacterium
AYENQD

SEQ ID NO: 250723 - protein, 4 aa, Mycobacterium
AYES

SEQ ID NO: 250724 - protein, 4 aa, Mycobacterium
AYET

SEQ ID NO: 250725 - protein, 4 aa, Mycobacterium
AYGA

SEQ ID NO: 250726 - protein, 10 aa, Mycobacterium
AYGAGGAGSA

SEQ ID NO: 250727 - protein, 6 aa, Mycobacterium
AYGAGP

SEQ ID NO: 250728 - protein, 10 aa, Mycobacterium
AYGASEAGSA

SEQ ID NO: 250729 - protein, 10 aa, Mycobacterium
AYGGGPEGRR

SEQ ID NO: 250730 - protein, 11 aa, Mycobacterium
AYGQASESRLR

SEQ ID NO: 250731 - protein, 6 aa, Mycobacterium
AYGRRG

SEQ ID NO: 250732 - protein, 7 aa, Mycobacterium
AYGTNRS

SEQ ID NO: 250733 - protein, 7 aa, Mycobacterium
AYNSSNQ

SEQ ID NO: 250734 - protein, 6 aa, Mycobacterium
AYNTSN

SEQ ID NO: 250735 - protein, 17 aa, Mycobacterium
AYPADGGAPQDAPDNVP

SEQ ID NO: 250736 - protein, 7 aa, Mycobacterium
AYPAEPV

SEQ ID NO: 250737 - protein, 6 aa, Mycobacterium
AYPDDP

SEQ ID NO: 250738 - protein, 6 aa, Mycobacterium
AYPDEP

SEQ ID NO: 250739 - protein, 5 aa, Mycobacterium
AYPDL

SEQ ID NO: 250740 - protein, 13 aa, Mycobacterium
AYPETRPASGVDG

SEQ ID NO: 250741 - protein, 7 aa, Mycobacterium
AYPGKMA

SEQ ID NO: 250742 - protein, 15 aa, Mycobacterium
AYPPPPDAPPDYRGP

SEQ ID NO: 250743 - protein, 16 aa, Mycobacterium
AYPPPPPGPPAPWPGY

SEQ ID NO: 250744 - protein, 4 aa, Mycobacterium
AYPQ

SEQ ID NO: 250745 - protein, 6 aa, Mycobacterium
AYPRSG

SEQ ID NO: 250746 - protein, 5 aa, Mycobacterium
AYPSG

SEQ ID NO: 250747 - protein, 21 aa, Mycobacterium
AYPTGESEAYSRAYSAPESEQ

SEQ ID NO: 250748 - protein, 6 aa, Mycobacterium
AYPTRT

SEQ ID NO: 250749 - protein, 10 aa, Mycobacterium
AYPVAEQDGS

SEQ ID NO: 250750 - protein, 12 aa, Mycobacterium
AYPVGQPPSHTV

SEQ ID NO: 250751 - protein, 12 aa, Mycobacterium
AYPVGSPPSHTI

SEQ ID NO: 250752 - protein, 11 aa, Mycobacterium
AYPVTERDGSI

SEQ ID NO: 250753 - protein, 6 aa, Mycobacterium
AYQAGG

SEQ ID NO: 250754 - protein, 4 aa, Mycobacterium
AYQP

SEQ ID NO: 250755 - protein, 4 aa, Mycobacterium
AYQS

SEQ ID NO: 250756 - protein, 6 aa, Mycobacterium
AYQSSA

SEQ ID NO: 250757 - protein, 7 aa, Mycobacterium
AYRASGP

SEQ ID NO: 250758 - protein, 12 aa, Mycobacterium
AYRAVGQPDRFT

SEQ ID NO: 250759 - protein, 10 aa, Mycobacterium
AYRDETGKHD

SEQ ID NO: 250760 - protein, 5 aa, Mycobacterium
AYRDR

SEQ ID NO: 250761 - protein, 5 aa, Mycobacterium
AYRRP

SEQ ID NO: 250762 - protein, 13 aa, Mycobacterium
AYRSGGPSTAPDQ

SEQ ID NO: 250763 - protein, 12 aa, Mycobacterium
AYSAPESEQFTS

SEQ ID NO: 250764 - protein, 7 aa, Mycobacterium
AYSDSVN

SEQ ID NO: 250765 - protein, 7 aa, Mycobacterium
AYSDSYN

SEQ ID NO: 250766 - protein, 9 aa, Mycobacterium
AYSGETTQG

SEQ ID NO: 250767 - protein, 10 aa, Mycobacterium
AYSGKSERNL

SEQ ID NO: 250768 - protein, 8 aa, Mycobacterium
AYSGTGGA

SEQ ID NO: 250769 - protein, 8 aa, Mycobacterium
AYSPAAGD

SEQ ID NO: 250770 - protein, 8 aa, Mycobacterium
AYSSAADE

SEQ ID NO: 250771 - protein, 8 aa, Mycobacterium
AYSTGKYT

SEQ ID NO: 250772 - protein, 6 aa, Mycobacterium
AYSTGN

SEQ ID NO: 250773 - protein, 13 aa, Mycobacterium
AYTGDEDPQTRAK

SEQ ID NO: 250774 - protein, 14 aa, Mycobacterium
AYTGDEDPQTSAKI

SEQ ID NO: 250775 - protein, 4 aa, Mycobacterium
AYTP

SEQ ID NO: 250776 - protein, 13 aa, Mycobacterium
AYTPAEDGLPRPW

SEQ ID NO: 250777 - protein, 22 aa, Mycobacterium
AYTPAPPAAPAESTDQLWLVRH

SEQ ID NO: 250778 - protein, 6 aa, Mycobacterium
AYTPEA

SEQ ID NO: 250779 - protein, 6 aa, Mycobacterium
AYTPHQ

SEQ ID NO: 250780 - protein, 9 aa, Mycobacterium
AYTTGRPHT

SEQ ID NO: 250781 - protein, 6 aa, Mycobacterium
CAAGNP

SEQ ID NO: 250782 - protein, 11 aa, Mycobacterium
CAAGSDAERAA

SEQ ID NO: 250783 - protein, 14 aa, Mycobacterium
CAAPRPDGTKPRRL

SEQ ID NO: 250784 - protein, 21 aa, Mycobacterium
CAAQPTPAVAAATSPSQADAD

SEQ ID NO: 250785 - protein, 8 aa, Mycobacterium
CAASRSDL

SEQ ID NO: 250786 - protein, 11 aa, Mycobacterium
CADGATVDQDQ

SEQ ID NO: 250787 - protein, 10 aa, Mycobacterium
CADPARRAAV

SEQ ID NO: 250788 - protein, 11 aa, Mycobacterium
CAEARTADADG

SEQ ID NO: 250789 - protein, 7 aa, Mycobacterium
CAEPDGE

SEQ ID NO: 250790 - protein, 8 aa, Mycobacterium
CAESPTGI

SEQ ID NO: 250791 - protein, 7 aa, Mycobacterium
CAETEPD

SEQ ID NO: 250792 - protein, 7 aa, Mycobacterium
CAGEAPA

SEQ ID NO: 250793 - protein, 8 aa, Mycobacterium
CAGPSRGC

SEQ ID NO: 250794 - protein, 11 aa, Mycobacterium
CAGQAPDRKPL

SEQ ID NO: 250795 - protein, 16 aa, Mycobacterium
CAKDGSCPLGNDPAKA

SEQ ID NO: 250796 - protein, 6 aa, Mycobacterium
CAPAGV

SEQ ID NO: 250797 - protein, 6 aa, Mycobacterium
CAPGAS

SEQ ID NO: 250798 - protein, 8 aa, Mycobacterium
CAPGRGPI

SEQ ID NO: 250799 - protein, 10 aa, Mycobacterium
CAPPGSLGAP

SEQ ID NO: 250800 - protein, 8 aa, Mycobacterium
CAPPGTLG

SEQ ID NO: 250801 - protein, 8 aa, Mycobacterium
CAPSQQAA

SEQ ID NO: 250802 - protein, 4 aa, Mycobacterium
CAQP

SEQ ID NO: 250803 - protein, 4 aa, Mycobacterium
CASR

SEQ ID NO: 250804 - protein, 15 aa, Mycobacterium
CATASPSATAPAADT

SEQ ID NO: 250805 - protein, 4 aa, Mycobacterium
CATG

SEQ ID NO: 250806 - protein, 6 aa, Mycobacterium
CATPGE

SEQ ID NO: 250807 - protein, 24 aa, Mycobacterium
CDDDSSSRTDRSSAAEEANAGFNG

SEQ ID NO: 250808 - protein, 5 aa, Mycobacterium
CDGAG

SEQ ID NO: 250809 - protein, 6 aa, Mycobacterium
CDGQQR

SEQ ID NO: 250810 - protein, 11 aa, Mycobacterium
CDHDDNEREPQ

SEQ ID NO: 250811 - protein, 7 aa, Mycobacterium
CDKQGGL

SEQ ID NO: 250812 - protein, 5 aa, Mycobacterium
CDPEQ

SEQ ID NO: 250813 - protein, 5 aa, Mycobacterium
CDRDD

SEQ ID NO: 250814 - protein, 21 aa, Mycobacterium
CDRPGDDSPHFTRKADEDTPV

SEQ ID NO: 250815 - protein, 9 aa, Mycobacterium
CDSDATPAA

SEQ ID NO: 250816 - protein, 5 aa, Mycobacterium
CDTAA

SEQ ID NO: 250817 - protein, 12 aa, Mycobacterium
CDTDPRTEVGRV

SEQ ID NO: 250818 - protein, 8 aa, Mycobacterium
CDTQTDPN

SEQ ID NO: 250819 - protein, 5 aa, Mycobacterium
CEAEG

SEQ ID NO: 250820 - protein, 6 aa, Mycobacterium
CEEPHA

SEQ ID NO: 250821 - protein, 7 aa, Mycobacterium
CEKPGGL

SEQ ID NO: 250822 - protein, 4 aa, Mycobacterium
CETA

SEQ ID NO: 250823 - protein, 11 aa, Mycobacterium
CEYPPREADTR

SEQ ID NO: 250824 - protein, 9 aa, Mycobacterium
CGAPRNAGT

SEQ ID NO: 250825 - protein, 15 aa, Mycobacterium
CGDTDTAANGEPPAV

SEQ ID NO: 250826 - protein, 6 aa, Mycobacterium
CGEGGD

SEQ ID NO: 250827 - protein, 7 aa, Mycobacterium
CGEPVDV

SEQ ID NO: 250828 - protein, 7 aa, Mycobacterium
CGGAADV

SEQ ID NO: 250829 - protein, 5 aa, Mycobacterium
CGGAN

SEQ ID NO: 250830 - protein, 6 aa, Mycobacterium
CGGANY

SEQ ID NO: 250831 - protein, 7 aa, Mycobacterium
CGGNNGT

SEQ ID NO: 250832 - protein, 14 aa, Mycobacterium
CGGPHPHWLRSLID

SEQ ID NO: 250833 - protein, 9 aa, Mycobacterium
CGGPQLEAG

SEQ ID NO: 250834 - protein, 5 aa, Mycobacterium
CGGST

SEQ ID NO: 250835 - protein, 4 aa, Mycobacterium
CGNG

SEQ ID NO: 250836 - protein, 7 aa, Mycobacterium
CGPAPAI

SEQ ID NO: 250837 - protein, 17 aa, Mycobacterium
CGPGTPRACPDGTRFDD

SEQ ID NO: 250838 - protein, 6 aa, Mycobacterium
CGPPER

SEQ ID NO: 250839 - protein, 6 aa, Mycobacterium
CGPPQR

SEQ ID NO: 250840 - protein, 13 aa, Mycobacterium
CGPPSQIGPAMGT

SEQ ID NO: 250841 - protein, 15 aa, Mycobacterium
CGPQRSTPPPAARPT

SEQ ID NO: 250842 - protein, 25 aa, Mycobacterium
CGRGRGQASSGPDEERTRGLGPGQI

SEQ ID NO: 250843 - protein, 39 aa, Mycobacterium
CGRHPKSSASTMPAPLASRPAKATPAPRTLADRETPQRR

SEQ ID NO: 250844 - protein, 8 aa, Mycobacterium
CGSPTRSE

SEQ ID NO: 250845 - protein, 6 aa, Mycobacterium
CGSSAR

SEQ ID NO: 250846 - protein, 15 aa, Mycobacterium
CGTTGTSVVGRSGGE

SEQ ID NO: 250847 - protein, 8 aa, Mycobacterium
CGTTRDGY

SEQ ID NO: 250848 - protein, 7 aa, Mycobacterium
CGTTRDN

SEQ ID NO: 250849 - protein, 5 aa, Mycobacterium
CHATR

SEQ ID NO: 250850 - protein, 10 aa, Mycobacterium
CHGDTRASTV

SEQ ID NO: 250851 - protein, 10 aa, Mycobacterium
CHTASTDRKS

SEQ ID NO: 250852 - protein, 12 aa, Mycobacterium
CKKNTDADGPTV

SEQ ID NO: 250853 - protein, 60 aa, Mycobacterium
CKPPTEPPSKPAPSSEPPAADPAPAADAAAVNPTGELAERDAATAELPAEPGSGEPTEHL

SEQ ID NO: 250854 - protein, 34 aa, Mycobacterium
CNDPPPASDPAAPKLGKQVAPSDMTDVTPAPLAE

SEQ ID NO: 250855 - protein, 15 aa, Mycobacterium
CNEESDDPGRTPGRA

SEQ ID NO: 250856 - protein, 14 aa, Mycobacterium
CNHGQNPTVKKGAT

SEQ ID NO: 250857 - protein, 14 aa, Mycobacterium
CNNGVNPTVKKGAT

SEQ ID NO: 250858 - protein, 21 aa, Mycobacterium
CNPATGKSRRRRRRTIDDRGY

SEQ ID NO: 250859 - protein, 10 aa, Mycobacterium
CNPRDAGNAL

SEQ ID NO: 250860 - protein, 10 aa, Mycobacterium
CNRPGQRSKV

SEQ ID NO: 250861 - protein, 9 aa, Mycobacterium
CPATPDRVH

SEQ ID NO: 250862 - protein, 21 aa, Mycobacterium
CPDPATVPTSPTARQLHVTPA

SEQ ID NO: 250863 - protein, 23 aa, Mycobacterium
CPDVPGKRAASPKECRSDEPYVP

SEQ ID NO: 250864 - protein, 7 aa, Mycobacterium
CPERPPR

SEQ ID NO: 250865 - protein, 11 aa, Mycobacterium
CPGEGPSPDGW

SEQ ID NO: 250866 - protein, 4 aa, Mycobacterium
CPHH

SEQ ID NO: 250867 - protein, 6 aa, Mycobacterium
CPKTDE

SEQ ID NO: 250868 - protein, 11 aa, Mycobacterium
CPLGPDPKAAV

SEQ ID NO: 250869 - protein, 4 aa, Mycobacterium
CPPE

SEQ ID NO: 250870 - protein, 29 aa, Mycobacterium
CPPSTSPPTPTPEQPQPGPGPTPTTSPPA

SEQ ID NO: 250871 - protein, 6 aa, Mycobacterium
CPQDPT

SEQ ID NO: 250872 - protein, 8 aa, Mycobacterium
CPRSDEPL

SEQ ID NO: 250873 - protein, 13 aa, Mycobacterium
CPRYGDVKGPSCF

SEQ ID NO: 250874 - protein, 6 aa, Mycobacterium
CPRYGE

SEQ ID NO: 250875 - protein, 68 aa, Mycobacterium
CPSPRATSPPGSPAPGSGTPESSVATPPAPSTPPTTAPSGPSTPAATTPTSGPATSSPVGPTTTSQTV

SEQ ID NO: 250876 - protein, 29 aa, Mycobacterium
CPSSTTPATPPPQLPQPGPGPAPSSPPPA

SEQ ID NO: 250877 - protein, 6 aa, Mycobacterium
CQGAPA

SEQ ID NO: 250878 - protein, 5 aa, Mycobacterium
CQPPL

SEQ ID NO: 250879 - protein, 7 aa, Mycobacterium
CRAGGPA

SEQ ID NO: 250880 - protein, 17 aa, Mycobacterium
CRDRPGVQPALAEQSPP

SEQ ID NO: 250881 - protein, 12 aa, Mycobacterium
CREAKERLSTDA

SEQ ID NO: 250882 - protein, 6 aa, Mycobacterium
CRGDAA

SEQ ID NO: 250883 - protein, 23 aa, Mycobacterium
CRHPAGKRHDPHTRSVSTPTPLP

SEQ ID NO: 250884 - protein, 13 aa, Mycobacterium
CRNAKEALSADTV

SEQ ID NO: 250885 - protein, 9 aa, Mycobacterium
CRPDGDNET

SEQ ID NO: 250886 - protein, 8 aa, Mycobacterium
CRPEGDNA

SEQ ID NO: 250887 - protein, 5 aa, Mycobacterium
CRPGS

SEQ ID NO: 250888 - protein, 44 aa, Mycobacterium
CRPPARGDRCAGGGPRPHGQRAGSRRRHRAAPSGRRTVRSGNGF

SEQ ID NO: 250889 - protein, 8 aa, Mycobacterium
CRSAQQKL

SEQ ID NO: 250890 - protein, 6 aa, Mycobacterium
CRSGED

SEQ ID NO: 250891 - protein, 11 aa, Mycobacterium
CRSSNPAVKIP

SEQ ID NO: 250892 - protein, 7 aa, Mycobacterium
CSDDELT

SEQ ID NO: 250893 - protein, 11 aa, Mycobacterium
CSDPKRSPCTN

SEQ ID NO: 250894 - protein, 7 aa, Mycobacterium
CSGAGKG

SEQ ID NO: 250895 - protein, 7 aa, Mycobacterium
CSGATAQ

SEQ ID NO: 250896 - protein, 4 aa, Mycobacterium
CSGV

SEQ ID NO: 250897 - protein, 8 aa, Mycobacterium
CSPTDASA

SEQ ID NO: 250898 - protein, 6 aa, Mycobacterium
CSSANS

SEQ ID NO: 250899 - protein, 14 aa, Mycobacterium
CSSGTPIRSEHSST

SEQ ID NO: 250900 - protein, 13 aa, Mycobacterium
CSYTPPADALPRP

SEQ ID NO: 250901 - protein, 4 aa, Mycobacterium
CTAA

SEQ ID NO: 250902 - protein, 5 aa, Mycobacterium
CTASG

SEQ ID NO: 250903 - protein, 4 aa, Mycobacterium
CTDD

SEQ ID NO: 250904 - protein, 7 aa, Mycobacterium
CTDEATV

SEQ ID NO: 250905 - protein, 6 aa, Mycobacterium
CTDPTA

SEQ ID NO: 250906 - protein, 4 aa, Mycobacterium
CTDR

SEQ ID NO: 250907 - protein, 7 aa, Mycobacterium
CTKQTDA

SEQ ID NO: 250908 - protein, 9 aa, Mycobacterium
CTPDEVDPN

SEQ ID NO: 250909 - protein, 11 aa, Mycobacterium
CTPGHATSHTR

SEQ ID NO: 250910 - protein, 13 aa, Mycobacterium
CTPSDVEGGPSGP

SEQ ID NO: 250911 - protein, 6 aa, Mycobacterium
CTRGTL

SEQ ID NO: 250912 - protein, 16 aa, Mycobacterium
CVAGPNGTTVPKDGSV

SEQ ID NO: 250913 - protein, 6 aa, Mycobacterium
CVGGKE

SEQ ID NO: 250914 - protein, 11 aa, Mycobacterium
CVGPGDAAASP

SEQ ID NO: 250915 - protein, 16 aa, Mycobacterium
CYDPDDPLAGNDDPNL

SEQ ID NO: 250916 - protein, 10 aa, Mycobacterium
CYGPRRPGTN

SEQ ID NO: 250917 - protein, 6 aa, Mycobacterium
DAAAAG

SEQ ID NO: 250918 - protein, 6 aa, Mycobacterium
DAAAAV

SEQ ID NO: 250919 - protein, 14 aa, Mycobacterium
DAAAHEAIKGTSLS

SEQ ID NO: 250920 - protein, 6 aa, Mycobacterium
DAAANQ

SEQ ID NO: 250921 - protein, 19 aa, Mycobacterium
DAAARAADGARAGAATDPL

SEQ ID NO: 250922 - protein, 17 aa, Mycobacterium
DAAARPGVAPTTPRDRG

SEQ ID NO: 250923 - protein, 9 aa, Mycobacterium
DAAASAVDE

SEQ ID NO: 250924 - protein, 6 aa, Mycobacterium
DAAATT

SEQ ID NO: 250925 - protein, 16 aa, Mycobacterium
DAADDSEAPSGPTRGR

SEQ ID NO: 250926 - protein, 10 aa, Mycobacterium
DAADGPLGPT

SEQ ID NO: 250927 - protein, 11 aa, Mycobacterium
DAADGTSEAVQ

SEQ ID NO: 250928 - protein, 4 aa, Mycobacterium
DAAE

SEQ ID NO: 250929 - protein, 7 aa, Mycobacterium
DAAEGAD

SEQ ID NO: 250930 - protein, 15 aa, Mycobacterium
DAAEKKVAGEIDPGA

SEQ ID NO: 250931 - protein, 5 aa, Mycobacterium
DAAEP

SEQ ID NO: 250932 - protein, 7 aa, Mycobacterium
DAAEPSM

SEQ ID NO: 250933 - protein, 7 aa, Mycobacterium
DAAERGW

SEQ ID NO: 250934 - protein, 7 aa, Mycobacterium
DAAERSY

SEQ ID NO: 250935 - protein, 11 aa, Mycobacterium
DAAERVARTDD

SEQ ID NO: 250936 - protein, 10 aa, Mycobacterium
DAAETGVATS

SEQ ID NO: 250937 - protein, 9 aa, Mycobacterium
DAAGADATL

SEQ ID NO: 250938 - protein, 9 aa, Mycobacterium
DAAGAGEQR

SEQ ID NO: 250939 - protein, 9 aa, Mycobacterium
DAAGARAER

SEQ ID NO: 250940 - protein, 8 aa, Mycobacterium
DAAGASPL

SEQ ID NO: 250941 - protein, 11 aa, Mycobacterium
DAAGDHPITGR

SEQ ID NO: 250942 - protein, 9 aa, Mycobacterium
DAAGEAERG

SEQ ID NO: 250943 - protein, 6 aa, Mycobacterium
DAAGEQ

SEQ ID NO: 250944 - protein, 6 aa, Mycobacterium
DAAGER

SEQ ID NO: 250945 - protein, 9 aa, Mycobacterium
DAAGGALDG

SEQ ID NO: 250946 - protein, 8 aa, Mycobacterium
DAAGTDAR

SEQ ID NO: 250947 - protein, 6 aa, Mycobacterium
DAAHPA

SEQ ID NO: 250948 - protein, 7 aa, Mycobacterium
DAAKNDD

SEQ ID NO: 250949 - protein, 9 aa, Mycobacterium
DAAKNPGKF

SEQ ID NO: 250950 - protein, 20 aa, Mycobacterium
DAALSGNIGNNGNHNRGGEY

SEQ ID NO: 250951 - protein, 7 aa, Mycobacterium
DAALTGA

SEQ ID NO: 250952 - protein, 4 aa, Mycobacterium
DAAN

SEQ ID NO: 250953 - protein, 8 aa, Mycobacterium
DAANHSAA

SEQ ID NO: 250954 - protein, 7 aa, Mycobacterium
DAANTTV

SEQ ID NO: 250955 - protein, 4 aa, Mycobacterium
DAAP

SEQ ID NO: 250956 - protein, 13 aa, Mycobacterium
DAAPALVGTSKSA

SEQ ID NO: 250957 - protein, 6 aa, Mycobacterium
DAAPDL

SEQ ID NO: 250958 - protein, 5 aa, Mycobacterium
DAAPG

SEQ ID NO: 250959 - protein, 8 aa, Mycobacterium
DAAPGHSA

SEQ ID NO: 250960 - protein, 13 aa, Mycobacterium
DAAPGSPADAPVD

SEQ ID NO: 250961 - protein, 15 aa, Mycobacterium
DAAPKFAAQTNNGYS

SEQ ID NO: 250962 - protein, 15 aa, Mycobacterium
DAAPKLAGALGGNGY

SEQ ID NO: 250963 - protein, 8 aa, Mycobacterium
DAAPPGVA

SEQ ID NO: 250964 - protein, 7 aa, Mycobacterium
DAAPPSG

SEQ ID NO: 250965 - protein, 6 aa, Mycobacterium
DAAPRT

SEQ ID NO: 250966 - protein, 15 aa, Mycobacterium
DAAPTDVKPATESVL

SEQ ID NO: 250967 - protein, 17 aa, Mycobacterium
DAAQAQSGAAAAGGSDP

SEQ ID NO: 250968 - protein, 8 aa, Mycobacterium
DAAQNDDS

SEQ ID NO: 250969 - protein, 8 aa, Mycobacterium
DAAQPGSE

SEQ ID NO: 250970 - protein, 7 aa, Mycobacterium
DAAQQIS

SEQ ID NO: 250971 - protein, 8 aa, Mycobacterium
DAAQQISR

SEQ ID NO: 250972 - protein, 11 aa, Mycobacterium
DAAQSIAGDEM

SEQ ID NO: 250973 - protein, 7 aa, Mycobacterium
DAAQTGV

SEQ ID NO: 250974 - protein, 9 aa, Mycobacterium
DAARAAGAE

SEQ ID NO: 250975 - protein, 7 aa, Mycobacterium
DAARAKL

SEQ ID NO: 250976 - protein, 7 aa, Mycobacterium
DAARASQ

SEQ ID NO: 250977 - protein, 7 aa, Mycobacterium
DAARDAQ

SEQ ID NO: 250978 - protein, 8 aa, Mycobacterium
DAARDDDS

SEQ ID NO: 250979 - protein, 11 aa, Mycobacterium
DAARGLPDAAQ

SEQ ID NO: 250980 - protein, 8 aa, Mycobacterium
DAARNDDS

SEQ ID NO: 250981 - protein, 9 aa, Mycobacterium
DAARPGRAL

SEQ ID NO: 250982 - protein, 10 aa, Mycobacterium
DAARPNTSLA

SEQ ID NO: 250983 - protein, 16 aa, Mycobacterium
DAARPPSGAHRTRDSL

SEQ ID NO: 250984 - protein, 7 aa, Mycobacterium
DAARPTI

SEQ ID NO: 250985 - protein, 8 aa, Mycobacterium
DAARQHGQ

SEQ ID NO: 250986 - protein, 6 aa, Mycobacterium
DAARRA

SEQ ID NO: 250987 - protein, 13 aa, Mycobacterium
DAARSGDNGLADS

SEQ ID NO: 250988 - protein, 9 aa, Mycobacterium
DAARVPRSD

SEQ ID NO: 250989 - protein, 4 aa, Mycobacterium
DAAS

SEQ ID NO: 250990 - protein, 6 aa, Mycobacterium
DAASAR

SEQ ID NO: 250991 - protein, 7 aa, Mycobacterium
DAASARA

SEQ ID NO: 250992 - protein, 8 aa, Mycobacterium
DAASFGLS

SEQ ID NO: 250993 - protein, 4 aa, Mycobacterium
DAAT

SEQ ID NO: 250994 - protein, 14 aa, Mycobacterium
DAATGPPQQPQQRV

SEQ ID NO: 250995 - protein, 20 aa, Mycobacterium
DAATGSGSEPAAESGAEPHA

SEQ ID NO: 250996 - protein, 18 aa, Mycobacterium
DAATGTYSLDGRFLAPGS

SEQ ID NO: 250997 - protein, 5 aa, Mycobacterium
DAATH

SEQ ID NO: 250998 - protein, 6 aa, Mycobacterium
DAATLD

SEQ ID NO: 250999 - protein, 8 aa, Mycobacterium
DAATMSAA

SEQ ID NO: 251000 - protein, 7 aa, Mycobacterium
DAATPID

SEQ ID NO: 251001 - protein, 5 aa, Mycobacterium
DAATS

SEQ ID NO: 251002 - protein, 7 aa, Mycobacterium
DAATSGP

SEQ ID NO: 251003 - protein, 11 aa, Mycobacterium
DAATSSSPGFI

SEQ ID NO: 251004 - protein, 12 aa, Mycobacterium
DAATTVKPAGRF

SEQ ID NO: 251005 - protein, 4 aa, Mycobacterium
DAAV

SEQ ID NO: 251006 - protein, 10 aa, Mycobacterium
DAAVSAAPAG

SEQ ID NO: 251007 - protein, 8 aa, Mycobacterium
DAAVSAPT

SEQ ID NO: 251008 - protein, 11 aa, Mycobacterium
DACSESRCPNL

SEQ ID NO: 251009 - protein, 4 aa, Mycobacterium
DADA

SEQ ID NO: 251010 - protein, 5 aa, Mycobacterium
DADAA

SEQ ID NO: 251011 - protein, 10 aa, Mycobacterium
DADAGDNIAA

SEQ ID NO: 251012 - protein, 6 aa, Mycobacterium
DADAGR

SEQ ID NO: 251013 - protein, 16 aa, Mycobacterium
DADAGRAKTVAATAQR

SEQ ID NO: 251014 - protein, 9 aa, Mycobacterium
DADASSSEI

SEQ ID NO: 251015 - protein, 16 aa, Mycobacterium
DADDERVRAAGRRGTQ

SEQ ID NO: 251016 - protein, 8 aa, Mycobacterium
DADDPDER

SEQ ID NO: 251017 - protein, 9 aa, Mycobacterium
DADDPQERA

SEQ ID NO: 251018 - protein, 10 aa, Mycobacterium
DADDQASVSV

SEQ ID NO: 251019 - protein, 29 aa, Mycobacterium
DADDVPDVAPPDEYVDDSAGSSVYGPRPQ

SEQ ID NO: 251020 - protein, 18 aa, Mycobacterium
DADEDTDQAAESGPERDW

SEQ ID NO: 251021 - protein, 7 aa, Mycobacterium
DADEGAE

SEQ ID NO: 251022 - protein, 10 aa, Mycobacterium
DADERDYPDR

SEQ ID NO: 251023 - protein, 9 aa, Mycobacterium
DADGAGRRS

SEQ ID NO: 251024 - protein, 9 aa, Mycobacterium
DADGDEGTY

SEQ ID NO: 251025 - protein, 7 aa, Mycobacterium
DADGEYH

SEQ ID NO: 251026 - protein, 8 aa, Mycobacterium
DADGGGFG

SEQ ID NO: 251027 - protein, 9 aa, Mycobacterium
DADGGTGVY

SEQ ID NO: 251028 - protein, 5 aa, Mycobacterium
DADGL

SEQ ID NO: 251029 - protein, 22 aa, Mycobacterium
DADGNRVRSRAITDEPAGLAKN

SEQ ID NO: 251030 - protein, 10 aa, Mycobacterium
DADGSNKNTA

SEQ ID NO: 251031 - protein, 8 aa, Mycobacterium
DADGSQRR

SEQ ID NO: 251032 - protein, 10 aa, Mycobacterium
DADIESPRDG

SEQ ID NO: 251033 - protein, 6 aa, Mycobacterium
DADKYE

SEQ ID NO: 251034 - protein, 11 aa, Mycobacterium
DADLAADREPL

SEQ ID NO: 251035 - protein, 5 aa, Mycobacterium
DADLG

SEQ ID NO: 251036 - protein, 19 aa, Mycobacterium
DADNDRLRAEPQVDYSPAG

SEQ ID NO: 251037 - protein, 8 aa, Mycobacterium
DADNGYQP

SEQ ID NO: 251038 - protein, 6 aa, Mycobacterium
DADPAT

SEQ ID NO: 251039 - protein, 18 aa, Mycobacterium
DADPDTDTADAGFDDRPL

SEQ ID NO: 251040 - protein, 8 aa, Mycobacterium
DADPGHGM

SEQ ID NO: 251041 - protein, 6 aa, Mycobacterium
DADQQT

SEQ ID NO: 251042 - protein, 4 aa, Mycobacterium
DADR

SEQ ID NO: 251043 - protein, 7 aa, Mycobacterium
DADRAGL

SEQ ID NO: 251044 - protein, 9 aa, Mycobacterium
DADRHRPAS

SEQ ID NO: 251045 - protein, 10 aa, Mycobacterium
DADRQPTFVP

SEQ ID NO: 251046 - protein, 9 aa, Mycobacterium
DADRSQDAR

SEQ ID NO: 251047 - protein, 24 aa, Mycobacterium
DADRSSMLSSNPGSGGPPRTDPLP

SEQ ID NO: 251048 - protein, 7 aa, Mycobacterium
DADRYLS

SEQ ID NO: 251049 - protein, 7 aa, Mycobacterium
DADSDAV

SEQ ID NO: 251050 - protein, 9 aa, Mycobacterium
DADSPRRMP

SEQ ID NO: 251051 - protein, 9 aa, Mycobacterium
DADTDRRVT

SEQ ID NO: 251052 - protein, 4 aa, Mycobacterium
DAEA

SEQ ID NO: 251053 - protein, 7 aa, Mycobacterium
DAEAAIS

SEQ ID NO: 251054 - protein, 7 aa, Mycobacterium
DAEADRA

SEQ ID NO: 251055 - protein, 16 aa, Mycobacterium
DAEAPDEEEDYELPGV

SEQ ID NO: 251056 - protein, 6 aa, Mycobacterium
DAEAQA

SEQ ID NO: 251057 - protein, 11 aa, Mycobacterium
DAEDASALEAS

SEQ ID NO: 251058 - protein, 21 aa, Mycobacterium
DAEDDDEPADGAGARGAQHPG

SEQ ID NO: 251059 - protein, 7 aa, Mycobacterium
DAEDRLR

SEQ ID NO: 251060 - protein, 10 aa, Mycobacterium
DAEDSEDLET

SEQ ID NO: 251061 - protein, 36 aa, Mycobacterium
DAEDSEKTKDSGAVEDSDDEDISLEPDEEENPKRIR

SEQ ID NO: 251062 - protein, 15 aa, Mycobacterium
DAEEAERQGDSAPLP

SEQ ID NO: 251063 - protein, 21 aa, Mycobacterium
DAEEGGHATADDADDGEPGDG

SEQ ID NO: 251064 - protein, 26 aa, Mycobacterium
DAEENSTDKTTPKDAKPATADDRPVD

SEQ ID NO: 251065 - protein, 4 aa, Mycobacterium
DAEG

SEQ ID NO: 251066 - protein, 7 aa, Mycobacterium
DAEGGTG

SEQ ID NO: 251067 - protein, 7 aa, Mycobacterium
DAEGRTD

SEQ ID NO: 251068 - protein, 8 aa, Mycobacterium
DAEHRSAR

SEQ ID NO: 251069 - protein, 7 aa, Mycobacterium
DAEMEQT

SEQ ID NO: 251070 - protein, 17 aa, Mycobacterium
DAENLRQQNAEYAAAAR

SEQ ID NO: 251071 - protein, 6 aa, Mycobacterium
DAENRR

SEQ ID NO: 251072 - protein, 6 aa, Mycobacterium
DAENSF

SEQ ID NO: 251073 - protein, 4 aa, Mycobacterium
DAEP

SEQ ID NO: 251074 - protein, 10 aa, Mycobacterium
DAEPAGTAAV

SEQ ID NO: 251075 - protein, 12 aa, Mycobacterium
DAEPDPIPGTKS

SEQ ID NO: 251076 - protein, 7 aa, Mycobacterium
DAEPNPG

SEQ ID NO: 251077 - protein, 34 aa, Mycobacterium
DAEQDEEPTDARDRQRAGTAPVHDDDPHGGHAER

SEQ ID NO: 251078 - protein, 4 aa, Mycobacterium
DAER

SEQ ID NO: 251079 - protein, 11 aa, Mycobacterium
DAERIGATDPL

SEQ ID NO: 251080 - protein, 7 aa, Mycobacterium
DAERPSM

SEQ ID NO: 251081 - protein, 9 aa, Mycobacterium
DAESAVSGA

SEQ ID NO: 251082 - protein, 13 aa, Mycobacterium
DAESELGKHRGQR

SEQ ID NO: 251083 - protein, 26 aa, Mycobacterium
DAESSGGDAQTAPSAPGDESPSPEAE

SEQ ID NO: 251084 - protein, 18 aa, Mycobacterium
DAETAATLADTPAHPLTA

SEQ ID NO: 251085 - protein, 7 aa, Mycobacterium
DAETGNA

SEQ ID NO: 251086 - protein, 12 aa, Mycobacterium
DAEVADDVSRPG

SEQ ID NO: 251087 - protein, 7 aa, Mycobacterium
DAEVGPA

SEQ ID NO: 251088 - protein, 7 aa, Mycobacterium
DAEVNQR

SEQ ID NO: 251089 - protein, 7 aa, Mycobacterium
DAEVSGR

SEQ ID NO: 251090 - protein, 6 aa, Mycobacterium
DAEVTG

SEQ ID NO: 251091 - protein, 86 aa, Mycobacterium
DAFERDEADDEFDDDREDDDFDTDEDLADRADVEADLEDDLEDDYEDDYEDDLDEETSGGAGAGTAAAGAAAAAAAAASTFGGPVP

SEQ ID NO: 251092 - protein, 6 aa, Mycobacterium
DAFNGT

SEQ ID NO: 251093 - protein, 10 aa, Mycobacterium
DAFQRASGTV

SEQ ID NO: 251094 - protein, 8 aa, Mycobacterium
DAFSDLPK

SEQ ID NO: 251095 - protein, 28 aa, Mycobacterium
DAFTPGPDKRAVAASKDNLPATQKDPSG

SEQ ID NO: 251096 - protein, 4 aa, Mycobacterium
DAGA

SEQ ID NO: 251097 - protein, 6 aa, Mycobacterium
DAGAEA

SEQ ID NO: 251098 - protein, 6 aa, Mycobacterium
DAGAGV

SEQ ID NO: 251099 - protein, 10 aa, Mycobacterium
DAGAPAHTSR

SEQ ID NO: 251100 - protein, 6 aa, Mycobacterium
DAGAQR

SEQ ID NO: 251101 - protein, 7 aa, Mycobacterium
DAGAQSV

SEQ ID NO: 251102 - protein, 7 aa, Mycobacterium
DAGARTA

SEQ ID NO: 251103 - protein, 8 aa, Mycobacterium
DAGARTAG

SEQ ID NO: 251104 - protein, 5 aa, Mycobacterium
DAGAV

SEQ ID NO: 251105 - protein, 6 aa, Mycobacterium
DAGDKS

SEQ ID NO: 251106 - protein, 7 aa, Mycobacterium
DAGDKSM

SEQ ID NO: 251107 - protein, 12 aa, Mycobacterium
DAGDLDVTEPAQ

SEQ ID NO: 251108 - protein, 11 aa, Mycobacterium
DAGDRLSWGGR

SEQ ID NO: 251109 - protein, 7 aa, Mycobacterium
DAGDRRV

SEQ ID NO: 251110 - protein, 10 aa, Mycobacterium
DAGEDRTVGS

SEQ ID NO: 251111 - protein, 8 aa, Mycobacterium
DAGERTDR

SEQ ID NO: 251112 - protein, 45 aa, Mycobacterium
DAGERTEPLHPANDPRVTEGAEPVAAQPLSEVPSASPRGQAREPF

SEQ ID NO: 251113 - protein, 5 aa, Mycobacterium
DAGFG

SEQ ID NO: 251114 - protein, 7 aa, Mycobacterium
DAGGGAD

SEQ ID NO: 251115 - protein, 9 aa, Mycobacterium
DAGGLGQNF

SEQ ID NO: 251116 - protein, 9 aa, Mycobacterium
DAGGRAWAE

SEQ ID NO: 251117 - protein, 6 aa, Mycobacterium
DAGGRK

SEQ ID NO: 251118 - protein, 20 aa, Mycobacterium
DAGGRVDSRSERSGASSPTV

SEQ ID NO: 251119 - protein, 7 aa, Mycobacterium
DAGHIED

SEQ ID NO: 251120 - protein, 9 aa, Mycobacterium
DAGKAYAHQ

SEQ ID NO: 251121 - protein, 22 aa, Mycobacterium
DAGLASTPARADHGGGAPARND

SEQ ID NO: 251122 - protein, 15 aa, Mycobacterium
DAGMGPATETYLAGP

SEQ ID NO: 251123 - protein, 4 aa, Mycobacterium
DAGN

SEQ ID NO: 251124 - protein, 9 aa, Mycobacterium
DAGNADDLA

SEQ ID NO: 251125 - protein, 11 aa, Mycobacterium
DAGNDQAAQER

SEQ ID NO: 251126 - protein, 7 aa, Mycobacterium
DAGNIDD

SEQ ID NO: 251127 - protein, 7 aa, Mycobacterium
DAGNKAT

SEQ ID NO: 251128 - protein, 5 aa, Mycobacterium
DAGNR

SEQ ID NO: 251129 - protein, 7 aa, Mycobacterium
DAGPAAG

SEQ ID NO: 251130 - protein, 8 aa, Mycobacterium
DAGPAPLP

SEQ ID NO: 251131 - protein, 12 aa, Mycobacterium
DAGPQPPTAPST

SEQ ID NO: 251132 - protein, 6 aa, Mycobacterium
DAGPRR

SEQ ID NO: 251133 - protein, 8 aa, Mycobacterium
DAGPRRST

SEQ ID NO: 251134 - protein, 6 aa, Mycobacterium
DAGPTT

SEQ ID NO: 251135 - protein, 15 aa, Mycobacterium
DAGQAHDASAGPDVE

SEQ ID NO: 251136 - protein, 14 aa, Mycobacterium
DAGQPPDDAGPRAE

SEQ ID NO: 251137 - protein, 7 aa, Mycobacterium
DAGQVPT

SEQ ID NO: 251138 - protein, 4 aa, Mycobacterium
DAGR

SEQ ID NO: 251139 - protein, 6 aa, Mycobacterium
DAGRAG

SEQ ID NO: 251140 - protein, 6 aa, Mycobacterium
DAGRGL

SEQ ID NO: 251141 - protein, 8 aa, Mycobacterium
DAGRGPDL

SEQ ID NO: 251142 - protein, 6 aa, Mycobacterium
DAGRGW

SEQ ID NO: 251143 - protein, 5 aa, Mycobacterium
DAGRT

SEQ ID NO: 251144 - protein, 7 aa, Mycobacterium
DAGRTGV

SEQ ID NO: 251145 - protein, 5 aa, Mycobacterium
DAGSA

SEQ ID NO: 251146 - protein, 7 aa, Mycobacterium
DAGSETE

SEQ ID NO: 251147 - protein, 26 aa, Mycobacterium
DAGSFGGDGPVPGAPEPRRRRQGEVN

SEQ ID NO: 251148 - protein, 8 aa, Mycobacterium
DAGSGADT

SEQ ID NO: 251149 - protein, 20 aa, Mycobacterium
DAGSPGGGAMPENSPGSPGL

SEQ ID NO: 251150 - protein, 6 aa, Mycobacterium
DAGSYI

SEQ ID NO: 251151 - protein, 7 aa, Mycobacterium
DAGTGTG

SEQ ID NO: 251152 - protein, 5 aa, Mycobacterium
DAGTL

SEQ ID NO: 251153 - protein, 8 aa, Mycobacterium
DAGTPLGG

SEQ ID NO: 251154 - protein, 7 aa, Mycobacterium
DAGTTQQ

SEQ ID NO: 251155 - protein, 9 aa, Mycobacterium
DAGVAPSQL

SEQ ID NO: 251156 - protein, 5 aa, Mycobacterium
DAGWR

SEQ ID NO: 251157 - protein, 10 aa, Mycobacterium
DAGYSRGLSA

SEQ ID NO: 251158 - protein, 10 aa, Mycobacterium
DAHAPGAVTP

SEQ ID NO: 251159 - protein, 4 aa, Mycobacterium
DAHD

SEQ ID NO: 251160 - protein, 18 aa, Mycobacterium
DAHDDAPTTVLSGPGRAP

SEQ ID NO: 251161 - protein, 4 aa, Mycobacterium
DAHG

SEQ ID NO: 251162 - protein, 7 aa, Mycobacterium
DAHGAGT

SEQ ID NO: 251163 - protein, 5 aa, Mycobacterium
DAHGT

SEQ ID NO: 251164 - protein, 6 aa, Mycobacterium
DAHQSG

SEQ ID NO: 251165 - protein, 7 aa, Mycobacterium
DAHRNNH

SEQ ID NO: 251166 - protein, 12 aa, Mycobacterium
DAHTSAAAATEG

SEQ ID NO: 251167 - protein, 20 aa, Mycobacterium
DAIAPTSSADRVPDTPRGLA

SEQ ID NO: 251168 - protein, 8 aa, Mycobacterium
DAIGRGDP

SEQ ID NO: 251169 - protein, 9 aa, Mycobacterium
DAIPETPLE

SEQ ID NO: 251170 - protein, 14 aa, Mycobacterium
DAISQDRTTTPVTP

SEQ ID NO: 251171 - protein, 9 aa, Mycobacterium
DAISRGESD

SEQ ID NO: 251172 - protein, 10 aa, Mycobacterium
DAKATAPERD

SEQ ID NO: 251173 - protein, 11 aa, Mycobacterium
DAKDPQATVPP

SEQ ID NO: 251174 - protein, 9 aa, Mycobacterium
DAKLPDSQV

SEQ ID NO: 251175 - protein, 6 aa, Mycobacterium
DAKQGI

SEQ ID NO: 251176 - protein, 8 aa, Mycobacterium
DAKTVDSV

SEQ ID NO: 251177 - protein, 14 aa, Mycobacterium
DAKVTTEATATAAA

SEQ ID NO: 251178 - protein, 4 aa, Mycobacterium
DALA

SEQ ID NO: 251179 - protein, 13 aa, Mycobacterium
DALAREAKDPYRA

SEQ ID NO: 251180 - protein, 8 aa, Mycobacterium
DALDGPGA

SEQ ID NO: 251181 - protein, 9 aa, Mycobacterium
DALDGSTIK

SEQ ID NO: 251182 - protein, 14 aa, Mycobacterium
DALDPASKTLRSGD

SEQ ID NO: 251183 - protein, 14 aa, Mycobacterium
DALDPGSGMLRAGA

SEQ ID NO: 251184 - protein, 14 aa, Mycobacterium
DALDPGSRTLRRGE

SEQ ID NO: 251185 - protein, 14 aa, Mycobacterium
DALDPGSTPVRGGA

SEQ ID NO: 251186 - protein, 13 aa, Mycobacterium
DALEGASDTERAR

SEQ ID NO: 251187 - protein, 15 aa, Mycobacterium
DALENSGADINVGGP

SEQ ID NO: 251188 - protein, 17 aa, Mycobacterium
DALERSAAEWEKKRRDE

SEQ ID NO: 251189 - protein, 7 aa, Mycobacterium
DALGDDA

SEQ ID NO: 251190 - protein, 7 aa, Mycobacterium
DALGERD

SEQ ID NO: 251191 - protein, 5 aa, Mycobacterium
DALGP

SEQ ID NO: 251192 - protein, 12 aa, Mycobacterium
DALGSSAKSVQG

SEQ ID NO: 251193 - protein, 13 aa, Mycobacterium
DALGSSAKSVQGA

SEQ ID NO: 251194 - protein, 5 aa, Mycobacterium
DALKD

SEQ ID NO: 251195 - protein, 4 aa, Mycobacterium
DALN

SEQ ID NO: 251196 - protein, 4 aa, Mycobacterium
DALP

SEQ ID NO: 251197 - protein, 22 aa, Mycobacterium
DALPAEPAQPAPEAFGNPAGRF

SEQ ID NO: 251198 - protein, 12 aa, Mycobacterium
DALPPEPEQDGY

SEQ ID NO: 251199 - protein, 7 aa, Mycobacterium
DALRGPR

SEQ ID NO: 251200 - protein, 11 aa, Mycobacterium
DALSDPDQDHA

SEQ ID NO: 251201 - protein, 9 aa, Mycobacterium
DALSESEGI

SEQ ID NO: 251202 - protein, 8 aa, Mycobacterium
DALSGSLS

SEQ ID NO: 251203 - protein, 13 aa, Mycobacterium
DALSTDGASDALK

SEQ ID NO: 251204 - protein, 9 aa, Mycobacterium
DALSTTSPR

SEQ ID NO: 251205 - protein, 4 aa, Mycobacterium
DALT

SEQ ID NO: 251206 - protein, 37 aa, Mycobacterium
DALTGADDDVDAETEAAVEGEAEAEELAAEADAEAQV

SEQ ID NO: 251207 - protein, 37 aa, Mycobacterium
DALTGADDDVDAETEAEVEGEAEAEELAAEADAEAQV

SEQ ID NO: 251208 - protein, 6 aa, Mycobacterium
DALTQH

SEQ ID NO: 251209 - protein, 6 aa, Mycobacterium
DAMQQS

SEQ ID NO: 251210 - protein, 5 aa, Mycobacterium
DAMST

SEQ ID NO: 251211 - protein, 8 aa, Mycobacterium
DANGQPMS

SEQ ID NO: 251212 - protein, 8 aa, Mycobacterium
DANKPSMA

SEQ ID NO: 251213 - protein, 12 aa, Mycobacterium
DANLSTLSGGAH

SEQ ID NO: 251214 - protein, 22 aa, Mycobacterium
DANPGAKLPAPVDAADTTPALS

SEQ ID NO: 251215 - protein, 11 aa, Mycobacterium
DANPSCSATRA

SEQ ID NO: 251216 - protein, 12 aa, Mycobacterium
DANYDGEEDVNG

SEQ ID NO: 251217 - protein, 12 aa, Mycobacterium
DANYDSQEDVNG

SEQ ID NO: 251218 - protein, 5 aa, Mycobacterium
DAPAD

SEQ ID NO: 251219 - protein, 20 aa, Mycobacterium
DAPADPAKLAAGASPAEAGF

SEQ ID NO: 251220 - protein, 25 aa, Mycobacterium
DAPAESSEAETEVLPGTDAEHEPAT

SEQ ID NO: 251221 - protein, 14 aa, Mycobacterium
DAPAGDSTDPIGPV

SEQ ID NO: 251222 - protein, 17 aa, Mycobacterium
DAPAGKGEQVDGRRGQL

SEQ ID NO: 251223 - protein, 7 aa, Mycobacterium
DAPAKPE

SEQ ID NO: 251224 - protein, 9 aa, Mycobacterium
DAPAPAAVP

SEQ ID NO: 251225 - protein, 6 aa, Mycobacterium
DAPARL

SEQ ID NO: 251226 - protein, 8 aa, Mycobacterium
DAPARPRS

SEQ ID NO: 251227 - protein, 5 aa, Mycobacterium
DAPAT

SEQ ID NO: 251228 - protein, 8 aa, Mycobacterium
DAPATAPD

SEQ ID NO: 251229 - protein, 24 aa, Mycobacterium
DAPATPERPSVPDIASPPLKTRTL

SEQ ID NO: 251230 - protein, 20 aa, Mycobacterium
DAPDATLADGPVVRGSEPSV

SEQ ID NO: 251231 - protein, 13 aa, Mycobacterium
DAPDEPPDAPIGP

SEQ ID NO: 251232 - protein, 19 aa, Mycobacterium
DAPDPALATSPVVNQTRSS

SEQ ID NO: 251233 - protein, 6 aa, Mycobacterium
DAPDRV

SEQ ID NO: 251234 - protein, 9 aa, Mycobacterium
DAPGAETIS

SEQ ID NO: 251235 - protein, 8 aa, Mycobacterium
DAPGDAGV

SEQ ID NO: 251236 - protein, 8 aa, Mycobacterium
DAPGIRGY

SEQ ID NO: 251237 - protein, 19 aa, Mycobacterium
DAPGPDARRTAPARPHGAD

SEQ ID NO: 251238 - protein, 16 aa, Mycobacterium
DAPGPLPGDGGKETWR

SEQ ID NO: 251239 - protein, 8 aa, Mycobacterium
DAPGQPAG

SEQ ID NO: 251240 - protein, 16 aa, Mycobacterium
DAPGSSQKNLENAEYT

SEQ ID NO: 251241 - protein, 5 aa, Mycobacterium
DAPKD

SEQ ID NO: 251242 - protein, 4 aa, Mycobacterium
DAPL

SEQ ID NO: 251243 - protein, 6 aa, Mycobacterium
DAPLTN

SEQ ID NO: 251244 - protein, 7 aa, Mycobacterium
DAPMGGA

SEQ ID NO: 251245 - protein, 7 aa, Mycobacterium
DAPNAVA

SEQ ID NO: 251246 - protein, 8 aa, Mycobacterium
DAPNDDAY

SEQ ID NO: 251247 - protein, 4 aa, Mycobacterium
DAPP

SEQ ID NO: 251248 - protein, 12 aa, Mycobacterium
DAPPADRTAPRD

SEQ ID NO: 251249 - protein, 33 aa, Mycobacterium
DAPPATGSPTRWDATPESPAELSTLPGEPSGCP

SEQ ID NO: 251250 - protein, 9 aa, Mycobacterium
DAPPDEIAP

SEQ ID NO: 251251 - protein, 15 aa, Mycobacterium
DAPPEDPLPGRGPQR

SEQ ID NO: 251252 - protein, 7 aa, Mycobacterium
DAPPGME

SEQ ID NO: 251253 - protein, 7 aa, Mycobacterium
DAPPGMS

SEQ ID NO: 251254 - protein, 12 aa, Mycobacterium
DAPPGSEKLRGN

SEQ ID NO: 251255 - protein, 7 aa, Mycobacterium
DAPPPGL

SEQ ID NO: 251256 - protein, 9 aa, Mycobacterium
DAPPTAPES

SEQ ID NO: 251257 - protein, 6 aa, Mycobacterium
DAPRGL

SEQ ID NO: 251258 - protein, 21 aa, Mycobacterium
DAPRKSRKVATDEELASPYRG

SEQ ID NO: 251259 - protein, 15 aa, Mycobacterium
DAPRNHGPDFGKASP

SEQ ID NO: 251260 - protein, 15 aa, Mycobacterium
DAPRNTGPDFGKASP

SEQ ID NO: 251261 - protein, 6 aa, Mycobacterium
DAPRSA

SEQ ID NO: 251262 - protein, 6 aa, Mycobacterium
DAPRSR

SEQ ID NO: 251263 - protein, 7 aa, Mycobacterium
DAPSGPI

SEQ ID NO: 251264 - protein, 20 aa, Mycobacterium
DAPSGSGAAEDEEPELPGVT

SEQ ID NO: 251265 - protein, 5 aa, Mycobacterium
DAPSQ

SEQ ID NO: 251266 - protein, 6 aa, Mycobacterium
DAPSRL

SEQ ID NO: 251267 - protein, 6 aa, Mycobacterium
DAPSSK

SEQ ID NO: 251268 - protein, 10 aa, Mycobacterium
DAPSSVTAKK

SEQ ID NO: 251269 - protein, 9 aa, Mycobacterium
DAPSSVTAQ

SEQ ID NO: 251270 - protein, 10 aa, Mycobacterium
DAPSTAPDSL

SEQ ID NO: 251271 - protein, 16 aa, Mycobacterium
DAPTKLKTAGINGSTV

SEQ ID NO: 251272 - protein, 16 aa, Mycobacterium
DAPTKLSTPGINGSTV

SEQ ID NO: 251273 - protein, 10 aa, Mycobacterium
DAPTSAPDSL

SEQ ID NO: 251274 - protein, 7 aa, Mycobacterium
DAPVNAA

SEQ ID NO: 251275 - protein, 17 aa, Mycobacterium
DAPVPGLDGVPRSDWPP

SEQ ID NO: 251276 - protein, 11 aa, Mycobacterium
DAQAAEKDKQL

SEQ ID NO: 251277 - protein, 34 aa, Mycobacterium
DAQANGSADAAGAKDLTAREQAAREAGRKAQIDT

SEQ ID NO: 251278 - protein, 10 aa, Mycobacterium
DAQANKSDMT

SEQ ID NO: 251279 - protein, 8 aa, Mycobacterium
DAQAYTNV

SEQ ID NO: 251280 - protein, 8 aa, Mycobacterium
DAQGATSY

SEQ ID NO: 251281 - protein, 8 aa, Mycobacterium
DAQGIANN

SEQ ID NO: 251282 - protein, 9 aa, Mycobacterium
DAQHGAIAP

SEQ ID NO: 251283 - protein, 5 aa, Mycobacterium
DAQHR

SEQ ID NO: 251284 - protein, 12 aa, Mycobacterium
DAQNGKAQAQRL

SEQ ID NO: 251285 - protein, 10 aa, Mycobacterium
DAQNGKASVQ

SEQ ID NO: 251286 - protein, 7 aa, Mycobacterium
DAQPARL

SEQ ID NO: 251287 - protein, 18 aa, Mycobacterium
DAQPEDAATAPGHPTGYP

SEQ ID NO: 251288 - protein, 19 aa, Mycobacterium
DAQPGADRPPGSESVTTKL

SEQ ID NO: 251289 - protein, 26 aa, Mycobacterium
DAQPGAPLPAPTSSADTTPQTRLTPE

SEQ ID NO: 251290 - protein, 11 aa, Mycobacterium
DAQPNSELSDA

SEQ ID NO: 251291 - protein, 16 aa, Mycobacterium
DAQQQPERHTAVAPIR

SEQ ID NO: 251292 - protein, 7 aa, Mycobacterium
DAQRNGH

SEQ ID NO: 251293 - protein, 13 aa, Mycobacterium
DAQSGKAQAQRLA

SEQ ID NO: 251294 - protein, 9 aa, Mycobacterium
DAQSIAPKR

SEQ ID NO: 251295 - protein, 4 aa, Mycobacterium
DAQT

SEQ ID NO: 251296 - protein, 9 aa, Mycobacterium
DAQTGAAIA

SEQ ID NO: 251297 - protein, 9 aa, Mycobacterium
DAQTGKAQV

SEQ ID NO: 251298 - protein, 5 aa, Mycobacterium
DAQTL

SEQ ID NO: 251299 - protein, 7 aa, Mycobacterium
DAQVPGR

SEQ ID NO: 251300 - protein, 7 aa, Mycobacterium
DAQVPSR

SEQ ID NO: 251301 - protein, 9 aa, Mycobacterium
DARAAGEPV

SEQ ID NO: 251302 - protein, 5 aa, Mycobacterium
DARAD

SEQ ID NO: 251303 - protein, 18 aa, Mycobacterium
DARAEVKRQTGADQIKTQ

SEQ ID NO: 251304 - protein, 5 aa, Mycobacterium
DARAG

SEQ ID NO: 251305 - protein, 16 aa, Mycobacterium
DARAGAVTSAQTERHR

SEQ ID NO: 251306 - protein, 7 aa, Mycobacterium
DARDSNV

SEQ ID NO: 251307 - protein, 5 aa, Mycobacterium
DARDV

SEQ ID NO: 251308 - protein, 16 aa, Mycobacterium
DAREGAVSSAQTERHR

SEQ ID NO: 251309 - protein, 14 aa, Mycobacterium
DARESKKHHPKPKG

SEQ ID NO: 251310 - protein, 20 aa, Mycobacterium
DARGDGGVDTAGGAELGNRH

SEQ ID NO: 251311 - protein, 8 aa, Mycobacterium
DARGRARK

SEQ ID NO: 251312 - protein, 6 aa, Mycobacterium
DARGRK

SEQ ID NO: 251313 - protein, 11 aa, Mycobacterium
DARGTRKPQYS

SEQ ID NO: 251314 - protein, 7 aa, Mycobacterium
DARPAQL

SEQ ID NO: 251315 - protein, 6 aa, Mycobacterium
DARPGD

SEQ ID NO: 251316 - protein, 8 aa, Mycobacterium
DARPGDTL

SEQ ID NO: 251317 - protein, 7 aa, Mycobacterium
DARPGTL

SEQ ID NO: 251318 - protein, 7 aa, Mycobacterium
DARPNAS

SEQ ID NO: 251319 - protein, 18 aa, Mycobacterium
DARQIQNGTGASGAVDGY

SEQ ID NO: 251320 - protein, 15 aa, Mycobacterium
DARQSSYAPGQSLDT

SEQ ID NO: 251321 - protein, 8 aa, Mycobacterium
DARRAREL

SEQ ID NO: 251322 - protein, 7 aa, Mycobacterium
DARRDGD

SEQ ID NO: 251323 - protein, 7 aa, Mycobacterium
DARRGRE

SEQ ID NO: 251324 - protein, 5 aa, Mycobacterium
DARRR

SEQ ID NO: 251325 - protein, 18 aa, Mycobacterium
DARSQHNAQAAASRTPVE

SEQ ID NO: 251326 - protein, 7 aa, Mycobacterium
DARTEAA

SEQ ID NO: 251327 - protein, 6 aa, Mycobacterium
DARTEE

SEQ ID NO: 251328 - protein, 12 aa, Mycobacterium
DARTQTAPRRRR

SEQ ID NO: 251329 - protein, 5 aa, Mycobacterium
DARTS

SEQ ID NO: 251330 - protein, 4 aa, Mycobacterium
DARV

SEQ ID NO: 251331 - protein, 6 aa, Mycobacterium
DARVDD

SEQ ID NO: 251332 - protein, 44 aa, Mycobacterium
DARVPPSDGSGQQNKLEGDLDTGESVGAPGKEPDFGVDPAMGPV

SEQ ID NO: 251333 - protein, 5 aa, Mycobacterium
DARYS

SEQ ID NO: 251334 - protein, 20 aa, Mycobacterium
DASATRDRVASRLGDAAVQP

SEQ ID NO: 251335 - protein, 7 aa, Mycobacterium
DASDDRG

SEQ ID NO: 251336 - protein, 7 aa, Mycobacterium
DASDPQM

SEQ ID NO: 251337 - protein, 7 aa, Mycobacterium
DASEAQL

SEQ ID NO: 251338 - protein, 7 aa, Mycobacterium
DASETQL

SEQ ID NO: 251339 - protein, 14 aa, Mycobacterium
DASGAALDKSMSGP

SEQ ID NO: 251340 - protein, 14 aa, Mycobacterium
DASGAPLDKSMSGP

SEQ ID NO: 251341 - protein, 16 aa, Mycobacterium
DASGGDTGPLGPRTGE

SEQ ID NO: 251342 - protein, 8 aa, Mycobacterium
DASGHTTE

SEQ ID NO: 251343 - protein, 6 aa, Mycobacterium
DASGRD

SEQ ID NO: 251344 - protein, 6 aa, Mycobacterium
DASGRM

SEQ ID NO: 251345 - protein, 7 aa, Mycobacterium
DASGRTV

SEQ ID NO: 251346 - protein, 5 aa, Mycobacterium
DASGV

SEQ ID NO: 251347 - protein, 11 aa, Mycobacterium
DASHKAAATSG

SEQ ID NO: 251348 - protein, 6 aa, Mycobacterium
DASKAD

SEQ ID NO: 251349 - protein, 5 aa, Mycobacterium
DASKN

SEQ ID NO: 251350 - protein, 7 aa, Mycobacterium
DASKNDD

SEQ ID NO: 251351 - protein, 8 aa, Mycobacterium
DASKNDDS

SEQ ID NO: 251352 - protein, 7 aa, Mycobacterium
DASKQAR

SEQ ID NO: 251353 - protein, 6 aa, Mycobacterium
DASPDL

SEQ ID NO: 251354 - protein, 21 aa, Mycobacterium
DASRDTDLPDELDALPGYEGS

SEQ ID NO: 251355 - protein, 9 aa, Mycobacterium
DASRPPNAA

SEQ ID NO: 251356 - protein, 12 aa, Mycobacterium
DASRQTGLAGRS

SEQ ID NO: 251357 - protein, 37 aa, Mycobacterium
DASRRTPEPMRREEGRSEGSRRPPLGGRNGQQATKYQ

SEQ ID NO: 251358 - protein, 7 aa, Mycobacterium
DASSPDL

SEQ ID NO: 251359 - protein, 9 aa, Mycobacterium
DASSPSTLN

SEQ ID NO: 251360 - protein, 9 aa, Mycobacterium
DASTAALGG

SEQ ID NO: 251361 - protein, 6 aa, Mycobacterium
DASTAV

SEQ ID NO: 251362 - protein, 6 aa, Mycobacterium
DASTGI

SEQ ID NO: 251363 - protein, 5 aa, Mycobacterium
DATAL

SEQ ID NO: 251364 - protein, 22 aa, Mycobacterium
DATATKGSTIDPTVAESSAAAS

SEQ ID NO: 251365 - protein, 4 aa, Mycobacterium
DATC

SEQ ID NO: 251366 - protein, 6 aa, Mycobacterium
DATDTE

SEQ ID NO: 251367 - protein, 10 aa, Mycobacterium
DATEATTPQR

SEQ ID NO: 251368 - protein, 5 aa, Mycobacterium
DATER

SEQ ID NO: 251369 - protein, 6 aa, Mycobacterium
DATESM

SEQ ID NO: 251370 - protein, 9 aa, Mycobacterium
DATESVTKA

SEQ ID NO: 251371 - protein, 14 aa, Mycobacterium
DATGAALDKSMSGP

SEQ ID NO: 251372 - protein, 12 aa, Mycobacterium
DATGAPLDGSVA

SEQ ID NO: 251373 - protein, 6 aa, Mycobacterium
DATGKV

SEQ ID NO: 251374 - protein, 12 aa, Mycobacterium
DATGLTATGATV

SEQ ID NO: 251375 - protein, 7 aa, Mycobacterium
DATIGSR

SEQ ID NO: 251376 - protein, 8 aa, Mycobacterium
DATIPQPI

SEQ ID NO: 251377 - protein, 5 aa, Mycobacterium
DATKT

SEQ ID NO: 251378 - protein, 4 aa, Mycobacterium
DATL

SEQ ID NO: 251379 - protein, 9 aa, Mycobacterium
DATNGYQPI

SEQ ID NO: 251380 - protein, 4 aa, Mycobacterium
DATP

SEQ ID NO: 251381 - protein, 10 aa, Mycobacterium
DATPARRDPV

SEQ ID NO: 251382 - protein, 17 aa, Mycobacterium
DATPLDPQRSLDDSRVY

SEQ ID NO: 251383 - protein, 5 aa, Mycobacterium
DATPQ

SEQ ID NO: 251384 - protein, 7 aa, Mycobacterium
DATPQLR

SEQ ID NO: 251385 - protein, 8 aa, Mycobacterium
DATPQLRG

SEQ ID NO: 251386 - protein, 5 aa, Mycobacterium
DATPS

SEQ ID NO: 251387 - protein, 8 aa, Mycobacterium
DATQGTSL

SEQ ID NO: 251388 - protein, 18 aa, Mycobacterium
DATQPADPDLLTKAHTGT

SEQ ID NO: 251389 - protein, 6 aa, Mycobacterium
DATQYQ

SEQ ID NO: 251390 - protein, 4 aa, Mycobacterium
DATR

SEQ ID NO: 251391 - protein, 7 aa, Mycobacterium
DATRHRD

SEQ ID NO: 251392 - protein, 10 aa, Mycobacterium
DATRNPHSPV

SEQ ID NO: 251393 - protein, 8 aa, Mycobacterium
DATRQRER

SEQ ID NO: 251394 - protein, 7 aa, Mycobacterium
DATSASG

SEQ ID NO: 251395 - protein, 4 aa, Mycobacterium
DATT

SEQ ID NO: 251396 - protein, 5 aa, Mycobacterium
DATTD

SEQ ID NO: 251397 - protein, 5 aa, Mycobacterium
DATTF

SEQ ID NO: 251398 - protein, 5 aa, Mycobacterium
DATTL

SEQ ID NO: 251399 - protein, 12 aa, Mycobacterium
DATTNESTGEVT

SEQ ID NO: 251400 - protein, 8 aa, Mycobacterium
DATTPYPG

SEQ ID NO: 251401 - protein, 6 aa, Mycobacterium
DATTQM

SEQ ID NO: 251402 - protein, 7 aa, Mycobacterium
DATTSNQ

SEQ ID NO: 251403 - protein, 7 aa, Mycobacterium
DATVGAR

SEQ ID NO: 251404 - protein, 44 aa, Mycobacterium
DATVGTAEAERDAQIQSAQARQAGAIAQAEADTAIATATQKRDV

SEQ ID NO: 251405 - protein, 7 aa, Mycobacterium
DATVNGR

SEQ ID NO: 251406 - protein, 8 aa, Mycobacterium
DATVQQTE

SEQ ID NO: 251407 - protein, 5 aa, Mycobacterium
DAVAA

SEQ ID NO: 251408 - protein, 6 aa, Mycobacterium
DAVAGQ

SEQ ID NO: 251409 - protein, 9 aa, Mycobacterium
DAVATSSDL

SEQ ID NO: 251410 - protein, 11 aa, Mycobacterium
DAVDKPDLQGA

SEQ ID NO: 251411 - protein, 21 aa, Mycobacterium
DAVERPERPIPSGDVSPAAAL

SEQ ID NO: 251412 - protein, 12 aa, Mycobacterium
DAVESTPAPPGV

SEQ ID NO: 251413 - protein, 10 aa, Mycobacterium
DAVKGTPLEN

SEQ ID NO: 251414 - protein, 8 aa, Mycobacterium
DAVPADGR

SEQ ID NO: 251415 - protein, 10 aa, Mycobacterium
DAVPASAAQI

SEQ ID NO: 251416 - protein, 23 aa, Mycobacterium
DAVPAVSQASASLQQSRATRAAL

SEQ ID NO: 251417 - protein, 8 aa, Mycobacterium
DAVPDSRT

SEQ ID NO: 251418 - protein, 16 aa, Mycobacterium
DAVRASQQARGEDPSL

SEQ ID NO: 251419 - protein, 5 aa, Mycobacterium
DAVRN

SEQ ID NO: 251420 - protein, 11 aa, Mycobacterium
DAVRSDDRGNH

SEQ ID NO: 251421 - protein, 14 aa, Mycobacterium
DAVTESAGEANTEL

SEQ ID NO: 251422 - protein, 20 aa, Mycobacterium
DAVTGDTPASPQPDPDGPPR

SEQ ID NO: 251423 - protein, 7 aa, Mycobacterium
DAVTSPL

SEQ ID NO: 251424 - protein, 7 aa, Mycobacterium
DAVTSQV

SEQ ID NO: 251425 - protein, 10 aa, Mycobacterium
DAYADAGRRL

SEQ ID NO: 251426 - protein, 5 aa, Mycobacterium
DAYND

SEQ ID NO: 251427 - protein, 7 aa, Mycobacterium
DAYRTYT

SEQ ID NO: 251428 - protein, 8 aa, Mycobacterium
DAYSAAGQ

SEQ ID NO: 251429 - protein, 5 aa, Mycobacterium
DAYSD

SEQ ID NO: 251430 - protein, 10 aa, Mycobacterium
DAYSGSTIGR

SEQ ID NO: 251431 - protein, 14 aa, Mycobacterium
DAYTAAYTAPGGPD

SEQ ID NO: 251432 - protein, 12 aa, Mycobacterium
DAYTRNDGFPGQ

SEQ ID NO: 251433 - protein, 4 aa, Mycobacterium
DAYV

SEQ ID NO: 251434 - protein, 6 aa, Mycobacterium
DCHNTR

SEQ ID NO: 251435 - protein, 13 aa, Mycobacterium
DCPFSTSASENLQ

SEQ ID NO: 251436 - protein, 5 aa, Mycobacterium
DCPQY

SEQ ID NO: 251437 - protein, 8 aa, Mycobacterium
DCPQYGEL

SEQ ID NO: 251438 - protein, 4 aa, Mycobacterium
DCPR

SEQ ID NO: 251439 - protein, 7 aa, Mycobacterium
DCPRYGD

SEQ ID NO: 251440 - protein, 7 aa, Mycobacterium
DCRDDEL

SEQ ID NO: 251441 - protein, 8 aa, Mycobacterium
DCRPATTV

SEQ ID NO: 251442 - protein, 4 aa, Mycobacterium
DDAA

SEQ ID NO: 251443 - protein, 9 aa, Mycobacterium
DDAAARKYG

SEQ ID NO: 251444 - protein, 12 aa, Mycobacterium
DDAAARVHGPPT

SEQ ID NO: 251445 - protein, 10 aa, Mycobacterium
DDAADGHAAP

SEQ ID NO: 251446 - protein, 12 aa, Mycobacterium
DDAAGGLGVNPE

SEQ ID NO: 251447 - protein, 5 aa, Mycobacterium
DDAAL

SEQ ID NO: 251448 - protein, 20 aa, Mycobacterium
DDAASLTRAERRAVRRQDRA

SEQ ID NO: 251449 - protein, 14 aa, Mycobacterium
DDAASNTGRATSHP

SEQ ID NO: 251450 - protein, 15 aa, Mycobacterium
DDAAVARATDNGDTF

SEQ ID NO: 251451 - protein, 9 aa, Mycobacterium
DDADAQVTA

SEQ ID NO: 251452 - protein, 21 aa, Mycobacterium
DDADLTPADRRTYTKKVKAER

SEQ ID NO: 251453 - protein, 8 aa, Mycobacterium
DDADPEEL

SEQ ID NO: 251454 - protein, 10 aa, Mycobacterium
DDADQPSVVE

SEQ ID NO: 251455 - protein, 8 aa, Mycobacterium
DDADRPTW

SEQ ID NO: 251456 - protein, 13 aa, Mycobacterium
DDADTGPVPVPTQ

SEQ ID NO: 251457 - protein, 10 aa, Mycobacterium
DDAEDRDSGA

SEQ ID NO: 251458 - protein, 7 aa, Mycobacterium
DDAEGQR

SEQ ID NO: 251459 - protein, 31 aa, Mycobacterium
DDAEPFAGGEYGPGFDEYDDADGTEAIPSRL

SEQ ID NO: 251460 - protein, 7 aa, Mycobacterium
DDAEPTS

SEQ ID NO: 251461 - protein, 7 aa, Mycobacterium
DDAETRE

SEQ ID NO: 251462 - protein, 10 aa, Mycobacterium
DDAGIDTSGA

SEQ ID NO: 251463 - protein, 27 aa, Mycobacterium
DDAGQQADRHRDAGAYQPQPGKDQGAV

SEQ ID NO: 251464 - protein, 17 aa, Mycobacterium
DDAGRNRPIGNRGSATS

SEQ ID NO: 251465 - protein, 5 aa, Mycobacterium
DDAHA

SEQ ID NO: 251466 - protein, 7 aa, Mycobacterium
DDAHKPA

SEQ ID NO: 251467 - protein, 9 aa, Mycobacterium
DDAKNDDSF

SEQ ID NO: 251468 - protein, 7 aa, Mycobacterium
DDANQRQ

SEQ ID NO: 251469 - protein, 7 aa, Mycobacterium
DDAPLYD

SEQ ID NO: 251470 - protein, 7 aa, Mycobacterium
DDAPNVL

SEQ ID NO: 251471 - protein, 8 aa, Mycobacterium
DDAPPQGL

SEQ ID NO: 251472 - protein, 5 aa, Mycobacterium
DDAPR

SEQ ID NO: 251473 - protein, 6 aa, Mycobacterium
DDAPRT

SEQ ID NO: 251474 - protein, 10 aa, Mycobacterium
DDAQRSGDGY

SEQ ID NO: 251475 - protein, 6 aa, Mycobacterium
DDARRK

SEQ ID NO: 251476 - protein, 8 aa, Mycobacterium
DDARSRVR

SEQ ID NO: 251477 - protein, 15 aa, Mycobacterium
DDATAAGSGVRGHGA

SEQ ID NO: 251478 - protein, 5 aa, Mycobacterium
DDATN

SEQ ID NO: 251479 - protein, 6 aa, Mycobacterium
DDATSL

SEQ ID NO: 251480 - protein, 4 aa, Mycobacterium
DDAV

SEQ ID NO: 251481 - protein, 4 aa, Mycobacterium
DDCT

SEQ ID NO: 251482 - protein, 5 aa, Mycobacterium
DDDAA

SEQ ID NO: 251483 - protein, 8 aa, Mycobacterium
DDDAARDL

SEQ ID NO: 251484 - protein, 8 aa, Mycobacterium
DDDAVAAA

SEQ ID NO: 251485 - protein, 22 aa, Mycobacterium
DDDDAEDRTTIDRTARSGAPTA

SEQ ID NO: 251486 - protein, 13 aa, Mycobacterium
DDDDAEHGATDTI

SEQ ID NO: 251487 - protein, 9 aa, Mycobacterium
DDDDEDDIT

SEQ ID NO: 251488 - protein, 9 aa, Mycobacterium
DDDDERAEW

SEQ ID NO: 251489 - protein, 46 aa, Mycobacterium
DDDDEYYDDSYDGDESYDGDDYYDEDHDGDDDRDHDDRADDFSDGY

SEQ ID NO: 251490 - protein, 13 aa, Mycobacterium
DDDDLDKDARDKI

SEQ ID NO: 251491 - protein, 7 aa, Mycobacterium
DDDDTGF

SEQ ID NO: 251492 - protein, 89 aa, Mycobacterium
DDDEDPRTAGQATAEPVAGEAAPEQRTDDQPASPYWSQPEPRWPKSPSQPKKAPGPERSAYPRPLSHGEAGETNGAGQSGAEGMNPDPL

SEQ ID NO: 251493 - protein, 9 aa, Mycobacterium
DDDERTQLD

SEQ ID NO: 251494 - protein, 4 aa, Mycobacterium
DDDF

SEQ ID NO: 251495 - protein, 7 aa, Mycobacterium
DDDGAPR

SEQ ID NO: 251496 - protein, 5 aa, Mycobacterium
DDDGD

SEQ ID NO: 251497 - protein, 4 aa, Mycobacterium
DDDH

SEQ ID NO: 251498 - protein, 12 aa, Mycobacterium
DDDIKSYEDLRG

SEQ ID NO: 251499 - protein, 6 aa, Mycobacterium
DDDLAP

SEQ ID NO: 251500 - protein, 6 aa, Mycobacterium
DDDLSP

SEQ ID NO: 251501 - protein, 4 aa, Mycobacterium
DDDP

SEQ ID NO: 251502 - protein, 9 aa, Mycobacterium
DDDPAVSIR

SEQ ID NO: 251503 - protein, 7 aa, Mycobacterium
DDDPETV

SEQ ID NO: 251504 - protein, 10 aa, Mycobacterium
DDDPNAPPSK

SEQ ID NO: 251505 - protein, 9 aa, Mycobacterium
DDDPRDQGW

SEQ ID NO: 251506 - protein, 28 aa, Mycobacterium
DDDPRRAGRDYDSRYHDAPSAAGGEKVT

SEQ ID NO: 251507 - protein, 11 aa, Mycobacterium
DDDPVRTGGER

SEQ ID NO: 251508 - protein, 5 aa, Mycobacterium
DDDQA

SEQ ID NO: 251509 - protein, 11 aa, Mycobacterium
DDDQARAQPLG

SEQ ID NO: 251510 - protein, 9 aa, Mycobacterium
DDDQHHPAS

SEQ ID NO: 251511 - protein, 25 aa, Mycobacterium
DDDRDDDLDGDETDAVGEAESPTRK

SEQ ID NO: 251512 - protein, 22 aa, Mycobacterium
DDDSAPQTSRRQRERDTSLEET

SEQ ID NO: 251513 - protein, 9 aa, Mycobacterium
DDDSAPSET

SEQ ID NO: 251514 - protein, 10 aa, Mycobacterium
DDDSDESALR

SEQ ID NO: 251515 - protein, 38 aa, Mycobacterium
DDDSDSDSEIADTGERPAATEPEPGEPEPEVAAGSAVP

SEQ ID NO: 251516 - protein, 13 aa, Mycobacterium
DDDSEGRYLWRSG

SEQ ID NO: 251517 - protein, 7 aa, Mycobacterium
DDDSRER

SEQ ID NO: 251518 - protein, 6 aa, Mycobacterium
DDDTAS

SEQ ID NO: 251519 - protein, 7 aa, Mycobacterium
DDDTESM

SEQ ID NO: 251520 - protein, 9 aa, Mycobacterium
DDEADYKIR

SEQ ID NO: 251521 - protein, 7 aa, Mycobacterium
DDEANYK

SEQ ID NO: 251522 - protein, 6 aa, Mycobacterium
DDEAPR

SEQ ID NO: 251523 - protein, 14 aa, Mycobacterium
DDEATRPDALPAPR

SEQ ID NO: 251524 - protein, 7 aa, Mycobacterium
DDEDEAV

SEQ ID NO: 251525 - protein, 16 aa, Mycobacterium
DDEDEYQDDDRGDDEF

SEQ ID NO: 251526 - protein, 30 aa, Mycobacterium
DDEDLADDDLADEDGADDMAASDEGRLTKD

SEQ ID NO: 251527 - protein, 6 aa, Mycobacterium
DDEDLE

SEQ ID NO: 251528 - protein, 7 aa, Mycobacterium
DDEDPEF

SEQ ID NO: 251529 - protein, 9 aa, Mycobacterium
DDEEPTAGA

SEQ ID NO: 251530 - protein, 15 aa, Mycobacterium
DDEHDTDTEADVVAD

SEQ ID NO: 251531 - protein, 4 aa, Mycobacterium
DDEI

SEQ ID NO: 251532 - protein, 5 aa, Mycobacterium
DDEIE

SEQ ID NO: 251533 - protein, 5 aa, Mycobacterium
DDEKT

SEQ ID NO: 251534 - protein, 5 aa, Mycobacterium
DDEMT

SEQ ID NO: 251535 - protein, 4 aa, Mycobacterium
DDER

SEQ ID NO: 251536 - protein, 9 aa, Mycobacterium
DDERAGRVA

SEQ ID NO: 251537 - protein, 8 aa, Mycobacterium
DDERAGVG

SEQ ID NO: 251538 - protein, 5 aa, Mycobacterium
DDERM

SEQ ID NO: 251539 - protein, 11 aa, Mycobacterium
DDERSSAPLNE

SEQ ID NO: 251540 - protein, 8 aa, Mycobacterium
DDESAARV

SEQ ID NO: 251541 - protein, 10 aa, Mycobacterium
DDEVDSDRPL

SEQ ID NO: 251542 - protein, 5 aa, Mycobacterium
DDEVG

SEQ ID NO: 251543 - protein, 8 aa, Mycobacterium
DDEVGRRL

SEQ ID NO: 251544 - protein, 5 aa, Mycobacterium
DDEVT

SEQ ID NO: 251545 - protein, 4 aa, Mycobacterium
DDFD

SEQ ID NO: 251546 - protein, 5 aa, Mycobacterium
DDFDG

SEQ ID NO: 251547 - protein, 5 aa, Mycobacterium
DDFKR

SEQ ID NO: 251548 - protein, 7 aa, Mycobacterium
DDFSDDD

SEQ ID NO: 251549 - protein, 4 aa, Mycobacterium
DDGA

SEQ ID NO: 251550 - protein, 7 aa, Mycobacterium
DDGAAPG

SEQ ID NO: 251551 - protein, 8 aa, Mycobacterium
DDGAEVGA

SEQ ID NO: 251552 - protein, 5 aa, Mycobacterium
DDGAG

SEQ ID NO: 251553 - protein, 7 aa, Mycobacterium
DDGAGFD

SEQ ID NO: 251554 - protein, 14 aa, Mycobacterium
DDGAGGADSGKGSG

SEQ ID NO: 251555 - protein, 6 aa, Mycobacterium
DDGAPL

SEQ ID NO: 251556 - protein, 11 aa, Mycobacterium
DDGDDDALPAG

SEQ ID NO: 251557 - protein, 18 aa, Mycobacterium
DDGEGDAAGRHRHRTTQS

SEQ ID NO: 251558 - protein, 7 aa, Mycobacterium
DDGEGIA

SEQ ID NO: 251559 - protein, 9 aa, Mycobacterium
DDGENQRTV

SEQ ID NO: 251560 - protein, 6 aa, Mycobacterium
DDGGAA

SEQ ID NO: 251561 - protein, 10 aa, Mycobacterium
DDGGPGPGAV

SEQ ID NO: 251562 - protein, 4 aa, Mycobacterium
DDGI

SEQ ID NO: 251563 - protein, 9 aa, Mycobacterium
DDGKAAIST

SEQ ID NO: 251564 - protein, 11 aa, Mycobacterium
DDGKARDGLDT

SEQ ID NO: 251565 - protein, 6 aa, Mycobacterium
DDGKDW

SEQ ID NO: 251566 - protein, 5 aa, Mycobacterium
DDGLA

SEQ ID NO: 251567 - protein, 14 aa, Mycobacterium
DDGLSHQATTGAAD

SEQ ID NO: 251568 - protein, 10 aa, Mycobacterium
DDGPAGSGAV

SEQ ID NO: 251569 - protein, 8 aa, Mycobacterium
DDGPGIDP

SEQ ID NO: 251570 - protein, 12 aa, Mycobacterium
DDGPGIPAGQQN

SEQ ID NO: 251571 - protein, 12 aa, Mycobacterium
DDGPGLPEADRE

SEQ ID NO: 251572 - protein, 6 aa, Mycobacterium
DDGPLR

SEQ ID NO: 251573 - protein, 6 aa, Mycobacterium
DDGPMP

SEQ ID NO: 251574 - protein, 5 aa, Mycobacterium
DDGPT

SEQ ID NO: 251575 - protein, 15 aa, Mycobacterium
DDGPVGDSDADRRNR

SEQ ID NO: 251576 - protein, 8 aa, Mycobacterium
DDGPWEQA

SEQ ID NO: 251577 - protein, 7 aa, Mycobacterium
DDGQTVG

SEQ ID NO: 251578 - protein, 5 aa, Mycobacterium
DDGRD

SEQ ID NO: 251579 - protein, 9 aa, Mycobacterium
DDGRGGAHI

SEQ ID NO: 251580 - protein, 9 aa, Mycobacterium
DDGRGGVLE

SEQ ID NO: 251581 - protein, 4 aa, Mycobacterium
DDGS

SEQ ID NO: 251582 - protein, 5 aa, Mycobacterium
DDGSL

SEQ ID NO: 251583 - protein, 7 aa, Mycobacterium
DDGSPEV

SEQ ID NO: 251584 - protein, 5 aa, Mycobacterium
DDGTA

SEQ ID NO: 251585 - protein, 6 aa, Mycobacterium
DDGTFS

SEQ ID NO: 251586 - protein, 4 aa, Mycobacterium
DDGV

SEQ ID NO: 251587 - protein, 7 aa, Mycobacterium
DDGVEDA

SEQ ID NO: 251588 - protein, 5 aa, Mycobacterium
DDGVG

SEQ ID NO: 251589 - protein, 9 aa, Mycobacterium
DDGVRDGPA

SEQ ID NO: 251590 - protein, 20 aa, Mycobacterium
DDHDDHPAAHAPAGLRAGPR

SEQ ID NO: 251591 - protein, 14 aa, Mycobacterium
DDHEADRAEEVKAE

SEQ ID NO: 251592 - protein, 5 aa, Mycobacterium
DDHGH

SEQ ID NO: 251593 - protein, 27 aa, Mycobacterium
DDHKGTTSASPSSSAPGSPSATGLPPV

SEQ ID NO: 251594 - protein, 6 aa, Mycobacterium
DDHPLR

SEQ ID NO: 251595 - protein, 6 aa, Mycobacterium
DDHSMQ

SEQ ID NO: 251596 - protein, 7 aa, Mycobacterium
DDHSSAR

SEQ ID NO: 251597 - protein, 4 aa, Mycobacterium
DDIA

SEQ ID NO: 251598 - protein, 4 aa, Mycobacterium
DDID

SEQ ID NO: 251599 - protein, 5 aa, Mycobacterium
DDIDT

SEQ ID NO: 251600 - protein, 5 aa, Mycobacterium
DDINT

SEQ ID NO: 251601 - protein, 7 aa, Mycobacterium
DDIPATT

SEQ ID NO: 251602 - protein, 8 aa, Mycobacterium
DDKHQVTE

SEQ ID NO: 251603 - protein, 40 aa, Mycobacterium
DDKKDTTPAENTATVAQAPAAAPTKEVPETTATINTPVRD

SEQ ID NO: 251604 - protein, 10 aa, Mycobacterium
DDKLGDSAHQ

SEQ ID NO: 251605 - protein, 7 aa, Mycobacterium
DDKPRTL

SEQ ID NO: 251606 - protein, 7 aa, Mycobacterium
DDLANGL

SEQ ID NO: 251607 - protein, 5 aa, Mycobacterium
DDLAQ

SEQ ID NO: 251608 - protein, 28 aa, Mycobacterium
DDLDAAETLARQQDGDGHGAEPRPETRR

SEQ ID NO: 251609 - protein, 5 aa, Mycobacterium
DDLDG

SEQ ID NO: 251610 - protein, 4 aa, Mycobacterium
DDLE

SEQ ID NO: 251611 - protein, 5 aa, Mycobacterium
DDLER

SEQ ID NO: 251612 - protein, 9 aa, Mycobacterium
DDLPAQEGF

SEQ ID NO: 251613 - protein, 5 aa, Mycobacterium
DDLQP

SEQ ID NO: 251614 - protein, 7 aa, Mycobacterium
DDLQTSI

SEQ ID NO: 251615 - protein, 7 aa, Mycobacterium
DDLRPSA

SEQ ID NO: 251616 - protein, 7 aa, Mycobacterium
DDLTPDH

SEQ ID NO: 251617 - protein, 14 aa, Mycobacterium
DDLTRGPNGQVTGT

SEQ ID NO: 251618 - protein, 21 aa, Mycobacterium
DDMATTDSDAAQGGDRSTDRV

SEQ ID NO: 251619 - protein, 12 aa, Mycobacterium
DDMPTAEIPRQS

SEQ ID NO: 251620 - protein, 11 aa, Mycobacterium
DDMTRGAGKPV

SEQ ID NO: 251621 - protein, 7 aa, Mycobacterium
DDNARGQ

SEQ ID NO: 251622 - protein, 8 aa, Mycobacterium
DDNDPASV

SEQ ID NO: 251623 - protein, 4 aa, Mycobacterium
DDNG

SEQ ID NO: 251624 - protein, 12 aa, Mycobacterium
DDNGKEKPQGEV

SEQ ID NO: 251625 - protein, 11 aa, Mycobacterium
DDNGKELPQGE

SEQ ID NO: 251626 - protein, 16 aa, Mycobacterium
DDNGKVLSDGPAPLAQ

SEQ ID NO: 251627 - protein, 11 aa, Mycobacterium
DDNGSGIPEAE

SEQ ID NO: 251628 - protein, 11 aa, Mycobacterium
DDNGSGVPEAE

SEQ ID NO: 251629 - protein, 12 aa, Mycobacterium
DDNGSGVPEAER

SEQ ID NO: 251630 - protein, 13 aa, Mycobacterium
DDNGSGVPEEERA

SEQ ID NO: 251631 - protein, 6 aa, Mycobacterium
DDNKHW

SEQ ID NO: 251632 - protein, 8 aa, Mycobacterium
DDNNTGGR

SEQ ID NO: 251633 - protein, 9 aa, Mycobacterium
DDNPRTVTP

SEQ ID NO: 251634 - protein, 8 aa, Mycobacterium
DDNSPTFN

SEQ ID NO: 251635 - protein, 6 aa, Mycobacterium
DDNTAL

SEQ ID NO: 251636 - protein, 12 aa, Mycobacterium
DDNTPETPDQRR

SEQ ID NO: 251637 - protein, 4 aa, Mycobacterium
DDPA

SEQ ID NO: 251638 - protein, 7 aa, Mycobacterium
DDPAAAV

SEQ ID NO: 251639 - protein, 7 aa, Mycobacterium
DDPAAHQ

SEQ ID NO: 251640 - protein, 11 aa, Mycobacterium
DDPAESSSAAA

SEQ ID NO: 251641 - protein, 7 aa, Mycobacterium
DDPAPYA

SEQ ID NO: 251642 - protein, 11 aa, Mycobacterium
DDPASGVADTL

SEQ ID NO: 251643 - protein, 16 aa, Mycobacterium
DDPATQLTGAPPGYQQ

SEQ ID NO: 251644 - protein, 7 aa, Mycobacterium
DDPATSL

SEQ ID NO: 251645 - protein, 17 aa, Mycobacterium
DDPAVRGDGSQPQPRLS

SEQ ID NO: 251646 - protein, 7 aa, Mycobacterium
DDPAVSI

SEQ ID NO: 251647 - protein, 7 aa, Mycobacterium
DDPAWYS

SEQ ID NO: 251648 - protein, 5 aa, Mycobacterium
DDPDA

SEQ ID NO: 251649 - protein, 15 aa, Mycobacterium
DDPDEPAAPPATDLT

SEQ ID NO: 251650 - protein, 6 aa, Mycobacterium
DDPDES

SEQ ID NO: 251651 - protein, 9 aa, Mycobacterium
DDPDPKLAQ

SEQ ID NO: 251652 - protein, 6 aa, Mycobacterium
DDPDRR

SEQ ID NO: 251653 - protein, 7 aa, Mycobacterium
DDPEDPD

SEQ ID NO: 251654 - protein, 16 aa, Mycobacterium
DDPETQLTGAPPGYQQ

SEQ ID NO: 251655 - protein, 10 aa, Mycobacterium
DDPGPTDPAT

SEQ ID NO: 251656 - protein, 6 aa, Mycobacterium
DDPGSI

SEQ ID NO: 251657 - protein, 12 aa, Mycobacterium
DDPHGPTHRTTG

SEQ ID NO: 251658 - protein, 5 aa, Mycobacterium
DDPHL

SEQ ID NO: 251659 - protein, 6 aa, Mycobacterium
DDPHQS

SEQ ID NO: 251660 - protein, 5 aa, Mycobacterium
DDPKW

SEQ ID NO: 251661 - protein, 8 aa, Mycobacterium
DDPLGERA

SEQ ID NO: 251662 - protein, 49 aa, Mycobacterium
DDPLPGEKNPDNTPVPGTPESTTNTAQAPQSTSPAPQPAHAAPAPGSAE

SEQ ID NO: 251663 - protein, 8 aa, Mycobacterium
DDPLPGEL

SEQ ID NO: 251664 - protein, 9 aa, Mycobacterium
DDPLSPAGI

SEQ ID NO: 251665 - protein, 8 aa, Mycobacterium
DDPMTPEG

SEQ ID NO: 251666 - protein, 13 aa, Mycobacterium
DDPNAPTGSQPPY

SEQ ID NO: 251667 - protein, 11 aa, Mycobacterium
DDPNPARPPSD

SEQ ID NO: 251668 - protein, 4 aa, Mycobacterium
DDPP

SEQ ID NO: 251669 - protein, 6 aa, Mycobacterium
DDPPAC

SEQ ID NO: 251670 - protein, 9 aa, Mycobacterium
DDPQAATPW

SEQ ID NO: 251671 - protein, 19 aa, Mycobacterium
DDPQEAPDGYPIKADTKTG

SEQ ID NO: 251672 - protein, 9 aa, Mycobacterium
DDPRAATPW

SEQ ID NO: 251673 - protein, 6 aa, Mycobacterium
DDPRDW

SEQ ID NO: 251674 - protein, 16 aa, Mycobacterium
DDPRPFTSNNRRRIPR

SEQ ID NO: 251675 - protein, 6 aa, Mycobacterium
DDPRSP

SEQ ID NO: 251676 - protein, 9 aa, Mycobacterium
DDPSNQRLE

SEQ ID NO: 251677 - protein, 10 aa, Mycobacterium
DDPSRQDQAR

SEQ ID NO: 251678 - protein, 7 aa, Mycobacterium
DDPSSTL

SEQ ID NO: 251679 - protein, 6 aa, Mycobacterium
DDPSSV

SEQ ID NO: 251680 - protein, 8 aa, Mycobacterium
DDPTGGIY

SEQ ID NO: 251681 - protein, 35 aa, Mycobacterium
DDPTPCSPAPDDTLDVGTDKGAGGAGADSEDPEVV

SEQ ID NO: 251682 - protein, 9 aa, Mycobacterium
DDPTSSARE

SEQ ID NO: 251683 - protein, 4 aa, Mycobacterium
DDPV

SEQ ID NO: 251684 - protein, 28 aa, Mycobacterium
DDPVAEEQAMEEQDEGLVNAEPDDVEAR

SEQ ID NO: 251685 - protein, 16 aa, Mycobacterium
DDPVTQSPSHTEEFAN

SEQ ID NO: 251686 - protein, 8 aa, Mycobacterium
DDPYAGED

SEQ ID NO: 251687 - protein, 6 aa, Mycobacterium
DDPYRF

SEQ ID NO: 251688 - protein, 11 aa, Mycobacterium
DDQAERRRANR

SEQ ID NO: 251689 - protein, 8 aa, Mycobacterium
DDQASGHP

SEQ ID NO: 251690 - protein, 7 aa, Mycobacterium
DDQDPNL

SEQ ID NO: 251691 - protein, 13 aa, Mycobacterium
DDQGATADGDGAA

SEQ ID NO: 251692 - protein, 13 aa, Mycobacterium
DDQGATAKGDDAT

SEQ ID NO: 251693 - protein, 17 aa, Mycobacterium
DDQGRMTGYDLKYPNGG

SEQ ID NO: 251694 - protein, 8 aa, Mycobacterium
DDQPAERK

SEQ ID NO: 251695 - protein, 32 aa, Mycobacterium
DDQPGRSATDEDDRVDAAPDADAVELEGQEPA

SEQ ID NO: 251696 - protein, 49 aa, Mycobacterium
DDQRPAGAHDQRRQQQQDQADRGNPQVPQDDRGEHRARADERDRHEDQL

SEQ ID NO: 251697 - protein, 15 aa, Mycobacterium
DDQRWNSRERGETEL

SEQ ID NO: 251698 - protein, 10 aa, Mycobacterium
DDQSGLPTAD

SEQ ID NO: 251699 - protein, 7 aa, Mycobacterium
DDQSPNL

SEQ ID NO: 251700 - protein, 55 aa, Mycobacterium
DDQTSNLATPRPSTTTSSAPPVQDEITTTTPPPVEPPPPPPPSEEAPPPPPPETV

SEQ ID NO: 251701 - protein, 7 aa, Mycobacterium
DDQVKVG

SEQ ID NO: 251702 - protein, 8 aa, Mycobacterium
DDQVKVGG

SEQ ID NO: 251703 - protein, 6 aa, Mycobacterium
DDRASA

SEQ ID NO: 251704 - protein, 15 aa, Mycobacterium
DDRAYQPADAPAKLG

SEQ ID NO: 251705 - protein, 17 aa, Mycobacterium
DDRAYQPAGAPANQGFA

SEQ ID NO: 251706 - protein, 4 aa, Mycobacterium
DDRD

SEQ ID NO: 251707 - protein, 8 aa, Mycobacterium
DDRDAAKE

SEQ ID NO: 251708 - protein, 6 aa, Mycobacterium
DDRDDV

SEQ ID NO: 251709 - protein, 7 aa, Mycobacterium
DDRDNTR

SEQ ID NO: 251710 - protein, 10 aa, Mycobacterium
DDRGPNRGLQ

SEQ ID NO: 251711 - protein, 6 aa, Mycobacterium
DDRGVT

SEQ ID NO: 251712 - protein, 6 aa, Mycobacterium
DDRIGS

SEQ ID NO: 251713 - protein, 9 aa, Mycobacterium
DDRITSNAS

SEQ ID NO: 251714 - protein, 15 aa, Mycobacterium
DDRKAVDAAAPSSVG

SEQ ID NO: 251715 - protein, 15 aa, Mycobacterium
DDRKGQPDTTASNQG

SEQ ID NO: 251716 - protein, 8 aa, Mycobacterium
DDRKQTAA

SEQ ID NO: 251717 - protein, 8 aa, Mycobacterium
DDRPGGGS

SEQ ID NO: 251718 - protein, 6 aa, Mycobacterium
DDRPRT

SEQ ID NO: 251719 - protein, 7 aa, Mycobacterium
DDRPRTL

SEQ ID NO: 251720 - protein, 15 aa, Mycobacterium
DDRQGQPATTASNEG

SEQ ID NO: 251721 - protein, 8 aa, Mycobacterium
DDRRDADV

SEQ ID NO: 251722 - protein, 8 aa, Mycobacterium
DDRRDGDV

SEQ ID NO: 251723 - protein, 8 aa, Mycobacterium
DDRRDNDV

SEQ ID NO: 251724 - protein, 16 aa, Mycobacterium
DDRRGQPATTASNEGY

SEQ ID NO: 251725 - protein, 5 aa, Mycobacterium
DDRSL

SEQ ID NO: 251726 - protein, 8 aa, Mycobacterium
DDRTGLTG

SEQ ID NO: 251727 - protein, 5 aa, Mycobacterium
DDRTL

SEQ ID NO: 251728 - protein, 9 aa, Mycobacterium
DDRTPGLTT

SEQ ID NO: 251729 - protein, 8 aa, Mycobacterium
DDRTQEKA

SEQ ID NO: 251730 - protein, 8 aa, Mycobacterium
DDSARAGR

SEQ ID NO: 251731 - protein, 4 aa, Mycobacterium
DDSD

SEQ ID NO: 251732 - protein, 8 aa, Mycobacterium
DDSDQNST

SEQ ID NO: 251733 - protein, 5 aa, Mycobacterium
DDSEH

SEQ ID NO: 251734 - protein, 18 aa, Mycobacterium
DDSGEATPEPDEPESTQA

SEQ ID NO: 251735 - protein, 7 aa, Mycobacterium
DDSGELT

SEQ ID NO: 251736 - protein, 27 aa, Mycobacterium
DDSGEVAEVSKTGYAKEMGADYKAREA

SEQ ID NO: 251737 - protein, 27 aa, Mycobacterium
DDSGEVAEVSKTGYAKEMGEDYKAREA

SEQ ID NO: 251738 - protein, 7 aa, Mycobacterium
DDSGMST

SEQ ID NO: 251739 - protein, 17 aa, Mycobacterium
DDSGRMSGYDLKYPDGG

SEQ ID NO: 251740 - protein, 12 aa, Mycobacterium
DDSIDKSDLADA

SEQ ID NO: 251741 - protein, 6 aa, Mycobacterium
DDSKND

SEQ ID NO: 251742 - protein, 5 aa, Mycobacterium
DDSLG

SEQ ID NO: 251743 - protein, 6 aa, Mycobacterium
DDSLGE

SEQ ID NO: 251744 - protein, 7 aa, Mycobacterium
DDSPTLG

SEQ ID NO: 251745 - protein, 8 aa, Mycobacterium
DDSRQSLG

SEQ ID NO: 251746 - protein, 8 aa, Mycobacterium
DDSSVTAS

SEQ ID NO: 251747 - protein, 4 aa, Mycobacterium
DDST

SEQ ID NO: 251748 - protein, 11 aa, Mycobacterium
DDSTDNATAMG

SEQ ID NO: 251749 - protein, 9 aa, Mycobacterium
DDSTRAEEA

SEQ ID NO: 251750 - protein, 5 aa, Mycobacterium
DDSVD

SEQ ID NO: 251751 - protein, 11 aa, Mycobacterium
DDSVPETPAQR

SEQ ID NO: 251752 - protein, 5 aa, Mycobacterium
DDSWQ

SEQ ID NO: 251753 - protein, 7 aa, Mycobacterium
DDTAEVA

SEQ ID NO: 251754 - protein, 8 aa, Mycobacterium
DDTAGLTA

SEQ ID NO: 251755 - protein, 7 aa, Mycobacterium
DDTAPAF

SEQ ID NO: 251756 - protein, 18 aa, Mycobacterium
DDTATGPPPRPAGTQARK

SEQ ID NO: 251757 - protein, 5 aa, Mycobacterium
DDTAV

SEQ ID NO: 251758 - protein, 9 aa, Mycobacterium
DDTDPKRAE

SEQ ID NO: 251759 - protein, 11 aa, Mycobacterium
DDTETDTATLR

SEQ ID NO: 251760 - protein, 7 aa, Mycobacterium
DDTETET

SEQ ID NO: 251761 - protein, 19 aa, Mycobacterium
DDTFEKATGTLAPRAAVPT

SEQ ID NO: 251762 - protein, 14 aa, Mycobacterium
DDTGAAASSTGLSA

SEQ ID NO: 251763 - protein, 8 aa, Mycobacterium
DDTGKAVA

SEQ ID NO: 251764 - protein, 17 aa, Mycobacterium
DDTGRMTGYDLKYPDGG

SEQ ID NO: 251765 - protein, 24 aa, Mycobacterium
DDTHTGGTVQKPRGFGDESPPTAI

SEQ ID NO: 251766 - protein, 15 aa, Mycobacterium
DDTNHQVAATPPRTA

SEQ ID NO: 251767 - protein, 16 aa, Mycobacterium
DDTPDHDYTPFPPTDA

SEQ ID NO: 251768 - protein, 5 aa, Mycobacterium
DDTQT

SEQ ID NO: 251769 - protein, 7 aa, Mycobacterium
DDTRPTV

SEQ ID NO: 251770 - protein, 6 aa, Mycobacterium
DDTSAR

SEQ ID NO: 251771 - protein, 5 aa, Mycobacterium
DDTVG

SEQ ID NO: 251772 - protein, 6 aa, Mycobacterium
DDTWRR

SEQ ID NO: 251773 - protein, 7 aa, Mycobacterium
DDVADKY

SEQ ID NO: 251774 - protein, 32 aa, Mycobacterium
DDVAPGLDDAEPEPEPRDEHDEPSRPATGSRI

SEQ ID NO: 251775 - protein, 5 aa, Mycobacterium
DDVDD

SEQ ID NO: 251776 - protein, 7 aa, Mycobacterium
DDVDGAR

SEQ ID NO: 251777 - protein, 6 aa, Mycobacterium
DDVDGS

SEQ ID NO: 251778 - protein, 11 aa, Mycobacterium
DDVERDARPGT

SEQ ID NO: 251779 - protein, 4 aa, Mycobacterium
DDVN

SEQ ID NO: 251780 - protein, 4 aa, Mycobacterium
DDVP

SEQ ID NO: 251781 - protein, 35 aa, Mycobacterium
DDVPDDEASPIGPAESIDAPTAVPAPSRVVVDDES

SEQ ID NO: 251782 - protein, 11 aa, Mycobacterium
DDVPRGGTGKV

SEQ ID NO: 251783 - protein, 5 aa, Mycobacterium
DDVPS

SEQ ID NO: 251784 - protein, 6 aa, Mycobacterium
DDVRAG

SEQ ID NO: 251785 - protein, 10 aa, Mycobacterium
DDVRLTEGTT

SEQ ID NO: 251786 - protein, 9 aa, Mycobacterium
DDVSATRDI

SEQ ID NO: 251787 - protein, 6 aa, Mycobacterium
DDVSEL

SEQ ID NO: 251788 - protein, 8 aa, Mycobacterium
DDVSRELS

SEQ ID NO: 251789 - protein, 9 aa, Mycobacterium
DDVTDFAPG

SEQ ID NO: 251790 - protein, 7 aa, Mycobacterium
DDVTDNA

SEQ ID NO: 251791 - protein, 7 aa, Mycobacterium
DDVTRAD

SEQ ID NO: 251792 - protein, 4 aa, Mycobacterium
DDVY

SEQ ID NO: 251793 - protein, 5 aa, Mycobacterium
DDYAG

SEQ ID NO: 251794 - protein, 7 aa, Mycobacterium
DDYDGGR

SEQ ID NO: 251795 - protein, 5 aa, Mycobacterium
DDYGL

SEQ ID NO: 251796 - protein, 7 aa, Mycobacterium
DDYKEAG

SEQ ID NO: 251797 - protein, 8 aa, Mycobacterium
DDYPNSLQ

SEQ ID NO: 251798 - protein, 8 aa, Mycobacterium
DDYPSSVT

SEQ ID NO: 251799 - protein, 8 aa, Mycobacterium
DEAAATLG

SEQ ID NO: 251800 - protein, 13 aa, Mycobacterium
DEAADAEDEHGAP

SEQ ID NO: 251801 - protein, 13 aa, Mycobacterium
DEAAEAEAPEVGE

SEQ ID NO: 251802 - protein, 6 aa, Mycobacterium
DEAANQ

SEQ ID NO: 251803 - protein, 7 aa, Mycobacterium
DEAAQGD

SEQ ID NO: 251804 - protein, 5 aa, Mycobacterium
DEACD

SEQ ID NO: 251805 - protein, 10 aa, Mycobacterium
DEADAADRTV

SEQ ID NO: 251806 - protein, 8 aa, Mycobacterium
DEAEFSGT

SEQ ID NO: 251807 - protein, 11 aa, Mycobacterium
DEAENAQASAA

SEQ ID NO: 251808 - protein, 8 aa, Mycobacterium
DEAGANTL

SEQ ID NO: 251809 - protein, 13 aa, Mycobacterium
DEAGATSSDRRDR

SEQ ID NO: 251810 - protein, 21 aa, Mycobacterium
DEAGDEAGDEADEAVEEPEPV

SEQ ID NO: 251811 - protein, 12 aa, Mycobacterium
DEAKDPDRTVPR

SEQ ID NO: 251812 - protein, 5 aa, Mycobacterium
DEAKN

SEQ ID NO: 251813 - protein, 15 aa, Mycobacterium
DEAKNETQAETKAVA

SEQ ID NO: 251814 - protein, 4 aa, Mycobacterium
DEAR

SEQ ID NO: 251815 - protein, 13 aa, Mycobacterium
DEARDPERTIPRA

SEQ ID NO: 251816 - protein, 27 aa, Mycobacterium
DEARPESVPAADAPAATPATSRPKQQW

SEQ ID NO: 251817 - protein, 7 aa, Mycobacterium
DEASAQA

SEQ ID NO: 251818 - protein, 6 aa, Mycobacterium
DEASNR

SEQ ID NO: 251819 - protein, 25 aa, Mycobacterium
DEASSIEEPEPIPTPSAPGGSHDDI

SEQ ID NO: 251820 - protein, 7 aa, Mycobacterium
DEASSVQ

SEQ ID NO: 251821 - protein, 5 aa, Mycobacterium
DEATG

SEQ ID NO: 251822 - protein, 5 aa, Mycobacterium
DEATH

SEQ ID NO: 251823 - protein, 7 aa, Mycobacterium
DEATQQA

SEQ ID NO: 251824 - protein, 4 aa, Mycobacterium
DEAV

SEQ ID NO: 251825 - protein, 27 aa, Mycobacterium
DEAVGDAHGHGGHGSSEFSVGGGASGT

SEQ ID NO: 251826 - protein, 5 aa, Mycobacterium
DEAVP

SEQ ID NO: 251827 - protein, 10 aa, Mycobacterium
DEAYGRDRTS

SEQ ID NO: 251828 - protein, 8 aa, Mycobacterium
DECTVPPT

SEQ ID NO: 251829 - protein, 17 aa, Mycobacterium
DEDAHAEGADARPAEGR

SEQ ID NO: 251830 - protein, 20 aa, Mycobacterium
DEDEATGIDETEHAETAYEL

SEQ ID NO: 251831 - protein, 33 aa, Mycobacterium
DEDEDEDDIPKPDASRDTDAPDELDALPGFEGS

SEQ ID NO: 251832 - protein, 5 aa, Mycobacterium
DEDGR

SEQ ID NO: 251833 - protein, 5 aa, Mycobacterium
DEDIR

SEQ ID NO: 251834 - protein, 10 aa, Mycobacterium
DEDLEGQADD

SEQ ID NO: 251835 - protein, 7 aa, Mycobacterium
DEDNEVD

SEQ ID NO: 251836 - protein, 5 aa, Mycobacterium
DEDNT

SEQ ID NO: 251837 - protein, 7 aa, Mycobacterium
DEDPDVE

SEQ ID NO: 251838 - protein, 7 aa, Mycobacterium
DEDQPTQ

SEQ ID NO: 251839 - protein, 9 aa, Mycobacterium
DEDRITRSR

SEQ ID NO: 251840 - protein, 15 aa, Mycobacterium
DEDRRRAQQTKADTE

SEQ ID NO: 251841 - protein, 8 aa, Mycobacterium
DEDRRSRE

SEQ ID NO: 251842 - protein, 15 aa, Mycobacterium
DEDSGPVDEGVGPVA

SEQ ID NO: 251843 - protein, 25 aa, Mycobacterium
DEDVGGSHGGHGSSEFSVGGGASGT

SEQ ID NO: 251844 - protein, 14 aa, Mycobacterium
DEDVGHEHGGHGGH

SEQ ID NO: 251845 - protein, 7 aa, Mycobacterium
DEDVTDL

SEQ ID NO: 251846 - protein, 6 aa, Mycobacterium
DEEAER

SEQ ID NO: 251847 - protein, 11 aa, Mycobacterium
DEEARAVPDNQ

SEQ ID NO: 251848 - protein, 6 aa, Mycobacterium
DEEEDY

SEQ ID NO: 251849 - protein, 9 aa, Mycobacterium
DEEGAANVS

SEQ ID NO: 251850 - protein, 5 aa, Mycobacterium
DEEGE

SEQ ID NO: 251851 - protein, 21 aa, Mycobacterium
DEEGRPLSQGNQGQASTSVAG

SEQ ID NO: 251852 - protein, 20 aa, Mycobacterium
DEEIDGSLSTRLSAAALHLP

SEQ ID NO: 251853 - protein, 5 aa, Mycobacterium
DEEKD

SEQ ID NO: 251854 - protein, 16 aa, Mycobacterium
DEEPAAYATTGGGNGY

SEQ ID NO: 251855 - protein, 14 aa, Mycobacterium
DEEPVAAPPAGNRT

SEQ ID NO: 251856 - protein, 5 aa, Mycobacterium
DEEQD

SEQ ID NO: 251857 - protein, 8 aa, Mycobacterium
DEEQTDAL

SEQ ID NO: 251858 - protein, 9 aa, Mycobacterium
DEERHGSVR

SEQ ID NO: 251859 - protein, 5 aa, Mycobacterium
DEERV

SEQ ID NO: 251860 - protein, 21 aa, Mycobacterium
DEETGIDELTDEARALTVGSD

SEQ ID NO: 251861 - protein, 18 aa, Mycobacterium
DEETPDPLAAATAPTGSV

SEQ ID NO: 251862 - protein, 14 aa, Mycobacterium
DEETPSDPATGDRT

SEQ ID NO: 251863 - protein, 13 aa, Mycobacterium
DEEVSGDKPRNAE

SEQ ID NO: 251864 - protein, 4 aa, Mycobacterium
DEGA

SEQ ID NO: 251865 - protein, 20 aa, Mycobacterium
DEGAGRAPDSRNSTFSAPDN

SEQ ID NO: 251866 - protein, 9 aa, Mycobacterium
DEGDQPHDV

SEQ ID NO: 251867 - protein, 16 aa, Mycobacterium
DEGGQIADKMVAKVKG

SEQ ID NO: 251868 - protein, 10 aa, Mycobacterium
DEGGVYPGEM

SEQ ID NO: 251869 - protein, 4 aa, Mycobacterium
DEGH

SEQ ID NO: 251870 - protein, 6 aa, Mycobacterium
DEGKTF

SEQ ID NO: 251871 - protein, 8 aa, Mycobacterium
DEGPAALG

SEQ ID NO: 251872 - protein, 11 aa, Mycobacterium
DEGPGIPRGAE

SEQ ID NO: 251873 - protein, 20 aa, Mycobacterium
DEGPGRAPESRNSTFSAPDN

SEQ ID NO: 251874 - protein, 5 aa, Mycobacterium
DEGPL

SEQ ID NO: 251875 - protein, 6 aa, Mycobacterium
DEGRQE

SEQ ID NO: 251876 - protein, 8 aa, Mycobacterium
DEGSAPGI

SEQ ID NO: 251877 - protein, 21 aa, Mycobacterium
DEGSDPTRDPTDRPRGSDTEG

SEQ ID NO: 251878 - protein, 5 aa, Mycobacterium
DEGSR

SEQ ID NO: 251879 - protein, 6 aa, Mycobacterium
DEHANA

SEQ ID NO: 251880 - protein, 6 aa, Mycobacterium
DEHASL

SEQ ID NO: 251881 - protein, 11 aa, Mycobacterium
DEHDRSPLRTT

SEQ ID NO: 251882 - protein, 65 aa, Mycobacterium
DEHGGAHRRSGEQETARRHRADAAAQPQWAPPPPPQQHPQQPPQPPQQPPPPMPPPPQTPPPGPQ

SEQ ID NO: 251883 - protein, 9 aa, Mycobacterium
DEHGKQLPA

SEQ ID NO: 251884 - protein, 8 aa, Mycobacterium
DEHGNDGA

SEQ ID NO: 251885 - protein, 8 aa, Mycobacterium
DEHGQTTE

SEQ ID NO: 251886 - protein, 14 aa, Mycobacterium
DEHTPAEARGHAGG

SEQ ID NO: 251887 - protein, 6 aa, Mycobacterium
DEIASD

SEQ ID NO: 251888 - protein, 4 aa, Mycobacterium
DEID

SEQ ID NO: 251889 - protein, 4 aa, Mycobacterium
DEIG

SEQ ID NO: 251890 - protein, 7 aa, Mycobacterium
DEIPEPN

SEQ ID NO: 251891 - protein, 5 aa, Mycobacterium
DEIPG

SEQ ID NO: 251892 - protein, 6 aa, Mycobacterium
DEIPNG

SEQ ID NO: 251893 - protein, 4 aa, Mycobacterium
DEIS

SEQ ID NO: 251894 - protein, 9 aa, Mycobacterium
DEISERDYQ

SEQ ID NO: 251895 - protein, 13 aa, Mycobacterium
DEISESATKSEAV

SEQ ID NO: 251896 - protein, 4 aa, Mycobacterium
DEIT

SEQ ID NO: 251897 - protein, 11 aa, Mycobacterium
DEKFRTGSRAL

SEQ ID NO: 251898 - protein, 9 aa, Mycobacterium
DEKFTPKNM

SEQ ID NO: 251899 - protein, 8 aa, Mycobacterium
DEKGQSRL

SEQ ID NO: 251900 - protein, 9 aa, Mycobacterium
DEKKRQRAA

SEQ ID NO: 251901 - protein, 6 aa, Mycobacterium
DEKPYR

SEQ ID NO: 251902 - protein, 37 aa, Mycobacterium
DEKRATANGEVAETVKTADEKLTQQGSAAQSELQSSV

SEQ ID NO: 251903 - protein, 21 aa, Mycobacterium
DEKRGEAPTAAVTAPEATRSR

SEQ ID NO: 251904 - protein, 8 aa, Mycobacterium
DEKSELSD

SEQ ID NO: 251905 - protein, 6 aa, Mycobacterium
DELAAR

SEQ ID NO: 251906 - protein, 9 aa, Mycobacterium
DELAASSGP

SEQ ID NO: 251907 - protein, 25 aa, Mycobacterium
DELDAAETLARQRDGEAGPPGPDTR

SEQ ID NO: 251908 - protein, 12 aa, Mycobacterium
DELDDDTERTCE

SEQ ID NO: 251909 - protein, 14 aa, Mycobacterium
DELDDEDEEESTGV

SEQ ID NO: 251910 - protein, 11 aa, Mycobacterium
DELDDGSEREC

SEQ ID NO: 251911 - protein, 17 aa, Mycobacterium
DELDEDDEVDEDEGSPL

SEQ ID NO: 251912 - protein, 7 aa, Mycobacterium
DELDERT

SEQ ID NO: 251913 - protein, 21 aa, Mycobacterium
DELDPNSAPPNTALRSGGPQS

SEQ ID NO: 251914 - protein, 7 aa, Mycobacterium
DELGARG

SEQ ID NO: 251915 - protein, 11 aa, Mycobacterium
DELGDSGPARD

SEQ ID NO: 251916 - protein, 10 aa, Mycobacterium
DELGGSTAAR

SEQ ID NO: 251917 - protein, 5 aa, Mycobacterium
DELGR

SEQ ID NO: 251918 - protein, 14 aa, Mycobacterium
DELGSASNAGTQVR

SEQ ID NO: 251919 - protein, 6 aa, Mycobacterium
DELNDA

SEQ ID NO: 251920 - protein, 11 aa, Mycobacterium
DELPGLRPGTG

SEQ ID NO: 251921 - protein, 9 aa, Mycobacterium
DELPNYPEY

SEQ ID NO: 251922 - protein, 12 aa, Mycobacterium
DELQSGSNPGAI

SEQ ID NO: 251923 - protein, 4 aa, Mycobacterium
DELR

SEQ ID NO: 251924 - protein, 6 aa, Mycobacterium
DELSRQ

SEQ ID NO: 251925 - protein, 16 aa, Mycobacterium
DELTDRTSAVQVNTDE

SEQ ID NO: 251926 - protein, 6 aa, Mycobacterium
DEMGKT

SEQ ID NO: 251927 - protein, 8 aa, Mycobacterium
DEMSQNST

SEQ ID NO: 251928 - protein, 5 aa, Mycobacterium
DEMSR

SEQ ID NO: 251929 - protein, 10 aa, Mycobacterium
DENADRSDRL

SEQ ID NO: 251930 - protein, 8 aa, Mycobacterium
DENEAAGL

SEQ ID NO: 251931 - protein, 7 aa, Mycobacterium
DENGQPH

SEQ ID NO: 251932 - protein, 7 aa, Mycobacterium
DENGVTA

SEQ ID NO: 251933 - protein, 7 aa, Mycobacterium
DENLNRA

SEQ ID NO: 251934 - protein, 14 aa, Mycobacterium
DENPDAVDTTPTPI

SEQ ID NO: 251935 - protein, 4 aa, Mycobacterium
DENR

SEQ ID NO: 251936 - protein, 17 aa, Mycobacterium
DEPAESPAAAAPPRSLA

SEQ ID NO: 251937 - protein, 7 aa, Mycobacterium
DEPDDGA

SEQ ID NO: 251938 - protein, 64 aa, Mycobacterium
DEPDPAGDSSAELEPFGDTDDEPDDALAGGELEPVSESGQIEPVDPAQESEAYSRAYSAPESEQ

SEQ ID NO: 251939 - protein, 16 aa, Mycobacterium
DEPDQPSDGTGANGRD

SEQ ID NO: 251940 - protein, 26 aa, Mycobacterium
DEPEGEPEPAAAEEAEPAETIEPDED

SEQ ID NO: 251941 - protein, 6 aa, Mycobacterium
DEPEGV

SEQ ID NO: 251942 - protein, 50 aa, Mycobacterium
DEPEVATEVEAPQAEADEAVAEGSEGDADEPEAEPKADEAEAEESEAEEL

SEQ ID NO: 251943 - protein, 8 aa, Mycobacterium
DEPEVTPE

SEQ ID NO: 251944 - protein, 10 aa, Mycobacterium
DEPGINGSTV

SEQ ID NO: 251945 - protein, 5 aa, Mycobacterium
DEPGL

SEQ ID NO: 251946 - protein, 23 aa, Mycobacterium
DEPGSARIQPPGSQIGSDRTESA

SEQ ID NO: 251947 - protein, 7 aa, Mycobacterium
DEPLGAD

SEQ ID NO: 251948 - protein, 6 aa, Mycobacterium
DEPLGD

SEQ ID NO: 251949 - protein, 9 aa, Mycobacterium
DEPPAGNRA

SEQ ID NO: 251950 - protein, 15 aa, Mycobacterium
DEPPENGKPSGRKFR

SEQ ID NO: 251951 - protein, 25 aa, Mycobacterium
DEPPEPAETDDDAGAPVAPRSPRDL

SEQ ID NO: 251952 - protein, 6 aa, Mycobacterium
DEPPWV

SEQ ID NO: 251953 - protein, 13 aa, Mycobacterium
DEPRNTGPEFGKA

SEQ ID NO: 251954 - protein, 5 aa, Mycobacterium
DEPSA

SEQ ID NO: 251955 - protein, 9 aa, Mycobacterium
DEPSAEDDL

SEQ ID NO: 251956 - protein, 9 aa, Mycobacterium
DEPSKRVDW

SEQ ID NO: 251957 - protein, 32 aa, Mycobacterium
DEPSQPEDVDVSGDDGVSLTGEAESDSAPQRE

SEQ ID NO: 251958 - protein, 7 aa, Mycobacterium
DEPTAST

SEQ ID NO: 251959 - protein, 54 aa, Mycobacterium
DEPTLGSDGSEGTHDSATDATDATESDGSAPAAPASSGATATTVKAKHDTATQA

SEQ ID NO: 251960 - protein, 9 aa, Mycobacterium
DEPTPEQPA

SEQ ID NO: 251961 - protein, 23 aa, Mycobacterium
DEPTPTTTAPPAKASPPPTATRT

SEQ ID NO: 251962 - protein, 4 aa, Mycobacterium
DEPV

SEQ ID NO: 251963 - protein, 5 aa, Mycobacterium
DEPVD

SEQ ID NO: 251964 - protein, 12 aa, Mycobacterium
DEPVGGSDDELP

SEQ ID NO: 251965 - protein, 13 aa, Mycobacterium
DEQAAAGKHGGSM

SEQ ID NO: 251966 - protein, 8 aa, Mycobacterium
DEQDKDIR

SEQ ID NO: 251967 - protein, 6 aa, Mycobacterium
DEQDNL

SEQ ID NO: 251968 - protein, 5 aa, Mycobacterium
DEQFG

SEQ ID NO: 251969 - protein, 19 aa, Mycobacterium
DEQGFQSRSGSAGASTANN

SEQ ID NO: 251970 - protein, 5 aa, Mycobacterium
DEQGR

SEQ ID NO: 251971 - protein, 4 aa, Mycobacterium
DEQI

SEQ ID NO: 251972 - protein, 5 aa, Mycobacterium
DEQLR

SEQ ID NO: 251973 - protein, 8 aa, Mycobacterium
DEQNGRAE

SEQ ID NO: 251974 - protein, 16 aa, Mycobacterium
DEQPAATGRPKASSRA

SEQ ID NO: 251975 - protein, 7 aa, Mycobacterium
DEQPDRL

SEQ ID NO: 251976 - protein, 16 aa, Mycobacterium
DEQPPPGAVKAPPGAR

SEQ ID NO: 251977 - protein, 16 aa, Mycobacterium
DEQPPPGAVKAPPSAR

SEQ ID NO: 251978 - protein, 4 aa, Mycobacterium
DEQQ

SEQ ID NO: 251979 - protein, 8 aa, Mycobacterium
DEQRKEND

SEQ ID NO: 251980 - protein, 8 aa, Mycobacterium
DEQTARRA

SEQ ID NO: 251981 - protein, 8 aa, Mycobacterium
DEQTEDVT

SEQ ID NO: 251982 - protein, 4 aa, Mycobacterium
DEQV

SEQ ID NO: 251983 - protein, 7 aa, Mycobacterium
DERAERA

SEQ ID NO: 251984 - protein, 5 aa, Mycobacterium
DERAQ

SEQ ID NO: 251985 - protein, 7 aa, Mycobacterium
DERDGQA

SEQ ID NO: 251986 - protein, 8 aa, Mycobacterium
DERENDKL

SEQ ID NO: 251987 - protein, 4 aa, Mycobacterium
DERG

SEQ ID NO: 251988 - protein, 6 aa, Mycobacterium
DERGIY

SEQ ID NO: 251989 - protein, 8 aa, Mycobacterium
DERGQLTA

SEQ ID NO: 251990 - protein, 5 aa, Mycobacterium
DERGR

SEQ ID NO: 251991 - protein, 9 aa, Mycobacterium
DERGRIPTA

SEQ ID NO: 251992 - protein, 8 aa, Mycobacterium
DERGRMPT

SEQ ID NO: 251993 - protein, 6 aa, Mycobacterium
DERKAD

SEQ ID NO: 251994 - protein, 4 aa, Mycobacterium
DERN

SEQ ID NO: 251995 - protein, 7 aa, Mycobacterium
DERPDAT

SEQ ID NO: 251996 - protein, 5 aa, Mycobacterium
DERPG

SEQ ID NO: 251997 - protein, 8 aa, Mycobacterium
DERPGAAR

SEQ ID NO: 251998 - protein, 7 aa, Mycobacterium
DERPGAV

SEQ ID NO: 251999 - protein, 6 aa, Mycobacterium
DERPNA

SEQ ID NO: 252000 - protein, 21 aa, Mycobacterium
DERPPVPPRRRQDRYDAWDYD

SEQ ID NO: 252001 - protein, 7 aa, Mycobacterium
DERQTTG

SEQ ID NO: 252002 - protein, 7 aa, Mycobacterium
DERRARE

SEQ ID NO: 252003 - protein, 6 aa, Mycobacterium
DERRGI

SEQ ID NO: 252004 - protein, 20 aa, Mycobacterium
DERRRKDRADLQARLRGDDP

SEQ ID NO: 252005 - protein, 5 aa, Mycobacterium
DERSE

SEQ ID NO: 252006 - protein, 8 aa, Mycobacterium
DERSGLGE

SEQ ID NO: 252007 - protein, 5 aa, Mycobacterium
DERSR

SEQ ID NO: 252008 - protein, 7 aa, Mycobacterium
DERTEDV

SEQ ID NO: 252009 - protein, 9 aa, Mycobacterium
DERVKERNR

SEQ ID NO: 252010 - protein, 19 aa, Mycobacterium
DESADRTEGDETSAPPARR

SEQ ID NO: 252011 - protein, 6 aa, Mycobacterium
DESANR

SEQ ID NO: 252012 - protein, 5 aa, Mycobacterium
DESDA

SEQ ID NO: 252013 - protein, 20 aa, Mycobacterium
DESDQPESRRGSFGKPAPGF

SEQ ID NO: 252014 - protein, 30 aa, Mycobacterium
DESDSPEEGTEPQQPAAARSSRKPARDERD

SEQ ID NO: 252015 - protein, 23 aa, Mycobacterium
DESGDPLRDENGRVKKVKKGEPG

SEQ ID NO: 252016 - protein, 17 aa, Mycobacterium
DESGPQTYRYRPGHDLP

SEQ ID NO: 252017 - protein, 13 aa, Mycobacterium
DESHADPPSRRQA

SEQ ID NO: 252018 - protein, 11 aa, Mycobacterium
DESKKNGTYPD

SEQ ID NO: 252019 - protein, 4 aa, Mycobacterium
DESN

SEQ ID NO: 252020 - protein, 6 aa, Mycobacterium
DESNSG

SEQ ID NO: 252021 - protein, 9 aa, Mycobacterium
DESPDGIRS

SEQ ID NO: 252022 - protein, 22 aa, Mycobacterium
DESPDYENQDKGEQESGGEQFE

SEQ ID NO: 252023 - protein, 7 aa, Mycobacterium
DESPHSV

SEQ ID NO: 252024 - protein, 8 aa, Mycobacterium
DESRPAKL

SEQ ID NO: 252025 - protein, 8 aa, Mycobacterium
DESSATRL

SEQ ID NO: 252026 - protein, 10 aa, Mycobacterium
DESSLTGESL

SEQ ID NO: 252027 - protein, 6 aa, Mycobacterium
DESTDA

SEQ ID NO: 252028 - protein, 11 aa, Mycobacterium
DESTENSTAMG

SEQ ID NO: 252029 - protein, 9 aa, Mycobacterium
DESTKNSTL

SEQ ID NO: 252030 - protein, 7 aa, Mycobacterium
DESTPAL

SEQ ID NO: 252031 - protein, 8 aa, Mycobacterium
DESTSAAV

SEQ ID NO: 252032 - protein, 6 aa, Mycobacterium
DESVRA

SEQ ID NO: 252033 - protein, 5 aa, Mycobacterium
DESVS

SEQ ID NO: 252034 - protein, 7 aa, Mycobacterium
DETAAQV

SEQ ID NO: 252035 - protein, 14 aa, Mycobacterium
DETARGPHTPDPRA

SEQ ID NO: 252036 - protein, 5 aa, Mycobacterium
DETAT

SEQ ID NO: 252037 - protein, 4 aa, Mycobacterium
DETG

SEQ ID NO: 252038 - protein, 7 aa, Mycobacterium
DETGATV

SEQ ID NO: 252039 - protein, 17 aa, Mycobacterium
DETGRMTGYDLKYPDGG

SEQ ID NO: 252040 - protein, 4 aa, Mycobacterium
DETI

SEQ ID NO: 252041 - protein, 10 aa, Mycobacterium
DETPADVPYP

SEQ ID NO: 252042 - protein, 10 aa, Mycobacterium
DETPGPMRDA

SEQ ID NO: 252043 - protein, 10 aa, Mycobacterium
DETPSEARST

SEQ ID NO: 252044 - protein, 7 aa, Mycobacterium
DETPWGP

SEQ ID NO: 252045 - protein, 8 aa, Mycobacterium
DETQAYED

SEQ ID NO: 252046 - protein, 62 aa, Mycobacterium
DETQVDEQATQQIDTETDETDETGDGTDTVSTEDVAESEDESADDPETEDSRDVEPRPRKRR

SEQ ID NO: 252047 - protein, 17 aa, Mycobacterium
DETRESWPSTYKVRDRK

SEQ ID NO: 252048 - protein, 5 aa, Mycobacterium
DETSL

SEQ ID NO: 252049 - protein, 8 aa, Mycobacterium
DETTGQMG

SEQ ID NO: 252050 - protein, 36 aa, Mycobacterium
DEVAPSAPVSDPGVPAPTGDGAPRPQQPQQPSDDNI

SEQ ID NO: 252051 - protein, 14 aa, Mycobacterium
DEVARRRGEAPPAV

SEQ ID NO: 252052 - protein, 13 aa, Mycobacterium
DEVEKPAPARRPG

SEQ ID NO: 252053 - protein, 12 aa, Mycobacterium
DEVESAEVGGQV

SEQ ID NO: 252054 - protein, 7 aa, Mycobacterium
DEVFEPD

SEQ ID NO: 252055 - protein, 15 aa, Mycobacterium
DEVGGSFGAAGRDDM

SEQ ID NO: 252056 - protein, 5 aa, Mycobacterium
DEVGK

SEQ ID NO: 252057 - protein, 22 aa, Mycobacterium
DEVPEGEETVDYPEEAPHEGVH

SEQ ID NO: 252058 - protein, 13 aa, Mycobacterium
DEVPGSTRWQGNP

SEQ ID NO: 252059 - protein, 8 aa, Mycobacterium
DEVPPDVA

SEQ ID NO: 252060 - protein, 11 aa, Mycobacterium
DEVPPSTRWQG

SEQ ID NO: 252061 - protein, 13 aa, Mycobacterium
DEVPSSTRWQGNP

SEQ ID NO: 252062 - protein, 7 aa, Mycobacterium
DEVPSTG

SEQ ID NO: 252063 - protein, 16 aa, Mycobacterium
DEVTDAGDSEDAEERN

SEQ ID NO: 252064 - protein, 10 aa, Mycobacterium
DEVTESVANA

SEQ ID NO: 252065 - protein, 6 aa, Mycobacterium
DEWPAT

SEQ ID NO: 252066 - protein, 4 aa, Mycobacterium
DEYA

SEQ ID NO: 252067 - protein, 6 aa, Mycobacterium
DEYADD

SEQ ID NO: 252068 - protein, 7 aa, Mycobacterium
DEYAKEY

SEQ ID NO: 252069 - protein, 7 aa, Mycobacterium
DEYDEAE

SEQ ID NO: 252070 - protein, 13 aa, Mycobacterium
DEYDEAETAPVEA

SEQ ID NO: 252071 - protein, 14 aa, Mycobacterium
DEYDQAETAPIEDL

SEQ ID NO: 252072 - protein, 14 aa, Mycobacterium
DEYDQAETAPVEEL

SEQ ID NO: 252073 - protein, 9 aa, Mycobacterium
DEYDTDEVA

SEQ ID NO: 252074 - protein, 12 aa, Mycobacterium
DEYDTDEVAPVD

SEQ ID NO: 252075 - protein, 11 aa, Mycobacterium
DEYDYDDDDSV

SEQ ID NO: 252076 - protein, 15 aa, Mycobacterium
DEYQGPTEATTARPE

SEQ ID NO: 252077 - protein, 6 aa, Mycobacterium
DEYRAD

SEQ ID NO: 252078 - protein, 5 aa, Mycobacterium
DEYRQ

SEQ ID NO: 252079 - protein, 5 aa, Mycobacterium
DEYRY

SEQ ID NO: 252080 - protein, 11 aa, Mycobacterium
DFAGDDADTVE

SEQ ID NO: 252081 - protein, 4 aa, Mycobacterium
DFAT

SEQ ID NO: 252082 - protein, 7 aa, Mycobacterium
DFDESAV

SEQ ID NO: 252083 - protein, 9 aa, Mycobacterium
DFDKSRSDD

SEQ ID NO: 252084 - protein, 5 aa, Mycobacterium
DFDPT

SEQ ID NO: 252085 - protein, 6 aa, Mycobacterium
DFDPTE

SEQ ID NO: 252086 - protein, 8 aa, Mycobacterium
DFDRSRSD

SEQ ID NO: 252087 - protein, 9 aa, Mycobacterium
DFDSTDRDR

SEQ ID NO: 252088 - protein, 10 aa, Mycobacterium
DFEASTAKES

SEQ ID NO: 252089 - protein, 12 aa, Mycobacterium
DFERRNPADVDE

SEQ ID NO: 252090 - protein, 7 aa, Mycobacterium
DFGGDPE

SEQ ID NO: 252091 - protein, 6 aa, Mycobacterium
DFGGTW

SEQ ID NO: 252092 - protein, 4 aa, Mycobacterium
DFGN

SEQ ID NO: 252093 - protein, 5 aa, Mycobacterium
DFGPE

SEQ ID NO: 252094 - protein, 4 aa, Mycobacterium
DFGT

SEQ ID NO: 252095 - protein, 9 aa, Mycobacterium
DFGTDSAST

SEQ ID NO: 252096 - protein, 6 aa, Mycobacterium
DFGTGP

SEQ ID NO: 252097 - protein, 17 aa, Mycobacterium
DFGTGPLPDRPRKEAAT

SEQ ID NO: 252098 - protein, 4 aa, Mycobacterium
DFGY

SEQ ID NO: 252099 - protein, 10 aa, Mycobacterium
DFHPDDVDNS

SEQ ID NO: 252100 - protein, 6 aa, Mycobacterium
DFPDGP

SEQ ID NO: 252101 - protein, 5 aa, Mycobacterium
DFPEP

SEQ ID NO: 252102 - protein, 9 aa, Mycobacterium
DFPGGDQAP

SEQ ID NO: 252103 - protein, 7 aa, Mycobacterium
DFPGQAE

SEQ ID NO: 252104 - protein, 19 aa, Mycobacterium
DFREGTKAFQQRRAAKFTD

SEQ ID NO: 252105 - protein, 7 aa, Mycobacterium
DFRGPRG

SEQ ID NO: 252106 - protein, 20 aa, Mycobacterium
DFRGSDTDKGGASNEPDEAA

SEQ ID NO: 252107 - protein, 6 aa, Mycobacterium
DFSDGY

SEQ ID NO: 252108 - protein, 4 aa, Mycobacterium
DFSE

SEQ ID NO: 252109 - protein, 6 aa, Mycobacterium
DFSEPT

SEQ ID NO: 252110 - protein, 5 aa, Mycobacterium
DFSGT

SEQ ID NO: 252111 - protein, 10 aa, Mycobacterium
DFSGTGAAIG

SEQ ID NO: 252112 - protein, 10 aa, Mycobacterium
DFSTRGKRFD

SEQ ID NO: 252113 - protein, 5 aa, Mycobacterium
DFSTT

SEQ ID NO: 252114 - protein, 6 aa, Mycobacterium
DGAAEH

SEQ ID NO: 252115 - protein, 7 aa, Mycobacterium
DGAAERT

SEQ ID NO: 252116 - protein, 7 aa, Mycobacterium
DGAAESV

SEQ ID NO: 252117 - protein, 17 aa, Mycobacterium
DGAAGDATSDCAGRDEL

SEQ ID NO: 252118 - protein, 8 aa, Mycobacterium
DGAAGSTL

SEQ ID NO: 252119 - protein, 9 aa, Mycobacterium
DGAAPGFPG

SEQ ID NO: 252120 - protein, 7 aa, Mycobacterium
DGAAPSE

SEQ ID NO: 252121 - protein, 39 aa, Mycobacterium
DGAAYGDRGISPDLTAGPVQPPPPPFPPPPPPPYPPAPY

SEQ ID NO: 252122 - protein, 24 aa, Mycobacterium
DGADEARKRAMESKPEGKDEHGEE

SEQ ID NO: 252123 - protein, 10 aa, Mycobacterium
DGADGTTKLP

SEQ ID NO: 252124 - protein, 9 aa, Mycobacterium
DGADKSGLT

SEQ ID NO: 252125 - protein, 9 aa, Mycobacterium
DGADLDEDT

SEQ ID NO: 252126 - protein, 6 aa, Mycobacterium
DGADMQ

SEQ ID NO: 252127 - protein, 9 aa, Mycobacterium
DGADPQLGT

SEQ ID NO: 252128 - protein, 8 aa, Mycobacterium
DGADSDTV

SEQ ID NO: 252129 - protein, 7 aa, Mycobacterium
DGADVPL

SEQ ID NO: 252130 - protein, 15 aa, Mycobacterium
DGAEAAKLAGEGMSG

SEQ ID NO: 252131 - protein, 19 aa, Mycobacterium
DGAEHTRGSAGSWTQSASP

SEQ ID NO: 252132 - protein, 19 aa, Mycobacterium
DGAELGPDDIDAAAEARHR

SEQ ID NO: 252133 - protein, 6 aa, Mycobacterium
DGAEPE

SEQ ID NO: 252134 - protein, 19 aa, Mycobacterium
DGAEPEQGTVRTAPSGRKP

SEQ ID NO: 252135 - protein, 6 aa, Mycobacterium
DGAERV

SEQ ID NO: 252136 - protein, 8 aa, Mycobacterium
DGAETEIP

SEQ ID NO: 252137 - protein, 4 aa, Mycobacterium
DGAG

SEQ ID NO: 252138 - protein, 21 aa, Mycobacterium
DGAGAGTDKGTDKGTGKGHVG

SEQ ID NO: 252139 - protein, 19 aa, Mycobacterium
DGAGARRVQPTGSGADENT

SEQ ID NO: 252140 - protein, 13 aa, Mycobacterium
DGAGDTFSTPQRV

SEQ ID NO: 252141 - protein, 14 aa, Mycobacterium
DGAGKPAHETRPTG

SEQ ID NO: 252142 - protein, 17 aa, Mycobacterium
DGAGTTGGVGPTGINGS

SEQ ID NO: 252143 - protein, 5 aa, Mycobacterium
DGAHG

SEQ ID NO: 252144 - protein, 6 aa, Mycobacterium
DGAHTP

SEQ ID NO: 252145 - protein, 10 aa, Mycobacterium
DGALAQADTK

SEQ ID NO: 252146 - protein, 21 aa, Mycobacterium
DGALDGTAKETFPKPGPIGGY

SEQ ID NO: 252147 - protein, 7 aa, Mycobacterium
DGALPAA

SEQ ID NO: 252148 - protein, 6 aa, Mycobacterium
DGALPD

SEQ ID NO: 252149 - protein, 6 aa, Mycobacterium
DGALPG

SEQ ID NO: 252150 - protein, 5 aa, Mycobacterium
DGALR

SEQ ID NO: 252151 - protein, 7 aa, Mycobacterium
DGANDAA

SEQ ID NO: 252152 - protein, 8 aa, Mycobacterium
DGANDAAA

SEQ ID NO: 252153 - protein, 9 aa, Mycobacterium
DGANDAAAI

SEQ ID NO: 252154 - protein, 10 aa, Mycobacterium
DGANGSRALP

SEQ ID NO: 252155 - protein, 9 aa, Mycobacterium
DGANPRAHA

SEQ ID NO: 252156 - protein, 15 aa, Mycobacterium
DGANRLPAAKRPSVG

SEQ ID NO: 252157 - protein, 6 aa, Mycobacterium
DGANSD

SEQ ID NO: 252158 - protein, 9 aa, Mycobacterium
DGANTPNWK

SEQ ID NO: 252159 - protein, 20 aa, Mycobacterium
DGAPAPASAGPVELEGQEPA

SEQ ID NO: 252160 - protein, 9 aa, Mycobacterium
DGAPAPSEE

SEQ ID NO: 252161 - protein, 7 aa, Mycobacterium
DGAPGSF

SEQ ID NO: 252162 - protein, 6 aa, Mycobacterium
DGAPQV

SEQ ID NO: 252163 - protein, 17 aa, Mycobacterium
DGAPRHLPDGYQTYDRA

SEQ ID NO: 252164 - protein, 9 aa, Mycobacterium
DGAPRTVPA

SEQ ID NO: 252165 - protein, 16 aa, Mycobacterium
DGAPSPSIRNGTRIPE

SEQ ID NO: 252166 - protein, 8 aa, Mycobacterium
DGAPSSGD

SEQ ID NO: 252167 - protein, 8 aa, Mycobacterium
DGAQNDDS

SEQ ID NO: 252168 - protein, 5 aa, Mycobacterium
DGAQQ

SEQ ID NO: 252169 - protein, 14 aa, Mycobacterium
DGAQQLNSGAQALN

SEQ ID NO: 252170 - protein, 4 aa, Mycobacterium
DGAR

SEQ ID NO: 252171 - protein, 9 aa, Mycobacterium
DGARDDPSE

SEQ ID NO: 252172 - protein, 6 aa, Mycobacterium
DGARDY

SEQ ID NO: 252173 - protein, 5 aa, Mycobacterium
DGARI

SEQ ID NO: 252174 - protein, 5 aa, Mycobacterium
DGARK

SEQ ID NO: 252175 - protein, 10 aa, Mycobacterium
DGARKRAAEM

SEQ ID NO: 252176 - protein, 7 aa, Mycobacterium
DGARKRV

SEQ ID NO: 252177 - protein, 10 aa, Mycobacterium
DGARKRVGEM

SEQ ID NO: 252178 - protein, 7 aa, Mycobacterium
DGARTDT

SEQ ID NO: 252179 - protein, 4 aa, Mycobacterium
DGAS

SEQ ID NO: 252180 - protein, 6 aa, Mycobacterium
DGASAV

SEQ ID NO: 252181 - protein, 5 aa, Mycobacterium
DGASE

SEQ ID NO: 252182 - protein, 6 aa, Mycobacterium
DGASGE

SEQ ID NO: 252183 - protein, 8 aa, Mycobacterium
DGASGSFP

SEQ ID NO: 252184 - protein, 5 aa, Mycobacterium
DGASK

SEQ ID NO: 252185 - protein, 10 aa, Mycobacterium
DGASPQQLAE

SEQ ID NO: 252186 - protein, 6 aa, Mycobacterium
DGASWP

SEQ ID NO: 252187 - protein, 7 aa, Mycobacterium
DGATEPV

SEQ ID NO: 252188 - protein, 5 aa, Mycobacterium
DGATG

SEQ ID NO: 252189 - protein, 7 aa, Mycobacterium
DGATGNF

SEQ ID NO: 252190 - protein, 6 aa, Mycobacterium
DGATVN

SEQ ID NO: 252191 - protein, 63 aa, Mycobacterium
DGATYGDPNISPDTTAGPAVPALPGPPPLIPPGGHQGPHGPPPPPPPPPGGPPPGPPPDATAT

SEQ ID NO: 252192 - protein, 33 aa, Mycobacterium
DGATYGDRGISPDTVAGPTAPPPPFAPPPPWAS

SEQ ID NO: 252193 - protein, 7 aa, Mycobacterium
DGATYPA

SEQ ID NO: 252194 - protein, 12 aa, Mycobacterium
DGAVVGRSVLIA

SEQ ID NO: 252195 - protein, 4 aa, Mycobacterium
DGCG

SEQ ID NO: 252196 - protein, 13 aa, Mycobacterium
DGDAASASAKEPL

SEQ ID NO: 252197 - protein, 7 aa, Mycobacterium
DGDAGQF

SEQ ID NO: 252198 - protein, 9 aa, Mycobacterium
DGDAPEISI

SEQ ID NO: 252199 - protein, 15 aa, Mycobacterium
DGDEGSGGEGSGGAL

SEQ ID NO: 252200 - protein, 7 aa, Mycobacterium
DGDELTH

SEQ ID NO: 252201 - protein, 5 aa, Mycobacterium
DGDFS

SEQ ID NO: 252202 - protein, 10 aa, Mycobacterium
DGDGEQWPVP

SEQ ID NO: 252203 - protein, 6 aa, Mycobacterium
DGDGVA

SEQ ID NO: 252204 - protein, 7 aa, Mycobacterium
DGDHGER

SEQ ID NO: 252205 - protein, 4 aa, Mycobacterium
DGDI

SEQ ID NO: 252206 - protein, 9 aa, Mycobacterium
DGDPDKARE

SEQ ID NO: 252207 - protein, 9 aa, Mycobacterium
DGDPTTAYS

SEQ ID NO: 252208 - protein, 9 aa, Mycobacterium
DGDQHHRGG

SEQ ID NO: 252209 - protein, 8 aa, Mycobacterium
DGDRASRE

SEQ ID NO: 252210 - protein, 7 aa, Mycobacterium
DGDRATA

SEQ ID NO: 252211 - protein, 5 aa, Mycobacterium
DGDRT

SEQ ID NO: 252212 - protein, 23 aa, Mycobacterium
DGDSLDGDSPAEGTATPAPSVTV

SEQ ID NO: 252213 - protein, 9 aa, Mycobacterium
DGDSLTGQV

SEQ ID NO: 252214 - protein, 13 aa, Mycobacterium
DGDSNSPTYNTHQ

SEQ ID NO: 252215 - protein, 7 aa, Mycobacterium
DGDSPVH

SEQ ID NO: 252216 - protein, 9 aa, Mycobacterium
DGDSTTAIG

SEQ ID NO: 252217 - protein, 13 aa, Mycobacterium
DGDSTTAIGQTLQ

SEQ ID NO: 252218 - protein, 17 aa, Mycobacterium
DGDSTTSWETDTYNDPV

SEQ ID NO: 252219 - protein, 8 aa, Mycobacterium
DGDTPKPR

SEQ ID NO: 252220 - protein, 7 aa, Mycobacterium
DGDTTKP

SEQ ID NO: 252221 - protein, 4 aa, Mycobacterium
DGDV

SEQ ID NO: 252222 - protein, 28 aa, Mycobacterium
DGDVDAARDTADALAEQASDVRGRLDEG

SEQ ID NO: 252223 - protein, 5 aa, Mycobacterium
DGDVE

SEQ ID NO: 252224 - protein, 5 aa, Mycobacterium
DGDVR

SEQ ID NO: 252225 - protein, 4 aa, Mycobacterium
DGEA

SEQ ID NO: 252226 - protein, 8 aa, Mycobacterium
DGEASASP

SEQ ID NO: 252227 - protein, 6 aa, Mycobacterium
DGEDDY

SEQ ID NO: 252228 - protein, 7 aa, Mycobacterium
DGEDRDD

SEQ ID NO: 252229 - protein, 5 aa, Mycobacterium
DGEEA

SEQ ID NO: 252230 - protein, 9 aa, Mycobacterium
DGEEPPPPR

SEQ ID NO: 252231 - protein, 7 aa, Mycobacterium
DGEFGRD

SEQ ID NO: 252232 - protein, 10 aa, Mycobacterium
DGEIGPGRGR

SEQ ID NO: 252233 - protein, 5 aa, Mycobacterium
DGEKP

SEQ ID NO: 252234 - protein, 10 aa, Mycobacterium
DGELDEPSVA

SEQ ID NO: 252235 - protein, 7 aa, Mycobacterium
DGENVYP

SEQ ID NO: 252236 - protein, 4 aa, Mycobacterium
DGEP

SEQ ID NO: 252237 - protein, 9 aa, Mycobacterium
DGEPAPGTS

SEQ ID NO: 252238 - protein, 8 aa, Mycobacterium
DGEPPGLL

SEQ ID NO: 252239 - protein, 6 aa, Mycobacterium
DGEPRA

SEQ ID NO: 252240 - protein, 7 aa, Mycobacterium
DGEPVSA

SEQ ID NO: 252241 - protein, 6 aa, Mycobacterium
DGEQAG

SEQ ID NO: 252242 - protein, 5 aa, Mycobacterium
DGEQL

SEQ ID NO: 252243 - protein, 7 aa, Mycobacterium
DGEQPDE

SEQ ID NO: 252244 - protein, 5 aa, Mycobacterium
DGERE

SEQ ID NO: 252245 - protein, 9 aa, Mycobacterium
DGERSAEQV

SEQ ID NO: 252246 - protein, 13 aa, Mycobacterium
DGETDDFSTPERL

SEQ ID NO: 252247 - protein, 4 aa, Mycobacterium
DGFA

SEQ ID NO: 252248 - protein, 10 aa, Mycobacterium
DGFDQSDDPL

SEQ ID NO: 252249 - protein, 22 aa, Mycobacterium
DGGAANGGRAASPAGAAPSTSV

SEQ ID NO: 252250 - protein, 15 aa, Mycobacterium
DGGAASATLASAHNG

SEQ ID NO: 252251 - protein, 13 aa, Mycobacterium
DGGAASPEHSQTI

SEQ ID NO: 252252 - protein, 17 aa, Mycobacterium
DGGAGVDAADRAPRDPE

SEQ ID NO: 252253 - protein, 13 aa, Mycobacterium
DGGASTPAHSQTV

SEQ ID NO: 252254 - protein, 7 aa, Mycobacterium
DGGDRAR

SEQ ID NO: 252255 - protein, 11 aa, Mycobacterium
DGGEAGEPEEI

SEQ ID NO: 252256 - protein, 17 aa, Mycobacterium
DGGEGDQPGRHRHRTAQ

SEQ ID NO: 252257 - protein, 9 aa, Mycobacterium
DGGEQPGAA

SEQ ID NO: 252258 - protein, 15 aa, Mycobacterium
DGGEVDADKVAADTP

SEQ ID NO: 252259 - protein, 4 aa, Mycobacterium
DGGF

SEQ ID NO: 252260 - protein, 7 aa, Mycobacterium
DGGHEHA

SEQ ID NO: 252261 - protein, 24 aa, Mycobacterium
DGGKNSGNRLAPRPISRPPVDPAS

SEQ ID NO: 252262 - protein, 7 aa, Mycobacterium
DGGKRAR

SEQ ID NO: 252263 - protein, 4 aa, Mycobacterium
DGGL

SEQ ID NO: 252264 - protein, 5 aa, Mycobacterium
DGGNN

SEQ ID NO: 252265 - protein, 6 aa, Mycobacterium
DGGNNR

SEQ ID NO: 252266 - protein, 6 aa, Mycobacterium
DGGPAL

SEQ ID NO: 252267 - protein, 8 aa, Mycobacterium
DGGPEGVG

SEQ ID NO: 252268 - protein, 5 aa, Mycobacterium
DGGPT

SEQ ID NO: 252269 - protein, 7 aa, Mycobacterium
DGGPTAG

SEQ ID NO: 252270 - protein, 5 aa, Mycobacterium
DGGRD

SEQ ID NO: 252271 - protein, 11 aa, Mycobacterium
DGGRRHPRSRV

SEQ ID NO: 252272 - protein, 13 aa, Mycobacterium
DGGRSDHGGPDET

SEQ ID NO: 252273 - protein, 9 aa, Mycobacterium
DGGRSFTGG

SEQ ID NO: 252274 - protein, 5 aa, Mycobacterium
DGGRY

SEQ ID NO: 252275 - protein, 10 aa, Mycobacterium
DGGSGFPPYG

SEQ ID NO: 252276 - protein, 5 aa, Mycobacterium
DGGSL

SEQ ID NO: 252277 - protein, 6 aa, Mycobacterium
DGGSPV

SEQ ID NO: 252278 - protein, 7 aa, Mycobacterium
DGGTGAM

SEQ ID NO: 252279 - protein, 6 aa, Mycobacterium
DGGTGI

SEQ ID NO: 252280 - protein, 9 aa, Mycobacterium
DGGTGPGEL

SEQ ID NO: 252281 - protein, 7 aa, Mycobacterium
DGGTGYT

SEQ ID NO: 252282 - protein, 15 aa, Mycobacterium
DGGVPSPRPELPRTP

SEQ ID NO: 252283 - protein, 7 aa, Mycobacterium
DGGVSSG

SEQ ID NO: 252284 - protein, 4 aa, Mycobacterium
DGGW

SEQ ID NO: 252285 - protein, 19 aa, Mycobacterium
DGGWDGPGPIGPMGRPGRD

SEQ ID NO: 252286 - protein, 5 aa, Mycobacterium
DGGWQ

SEQ ID NO: 252287 - protein, 16 aa, Mycobacterium
DGGWQPAELGASYSNE

SEQ ID NO: 252288 - protein, 16 aa, Mycobacterium
DGGWQPAEQGASYSNE

SEQ ID NO: 252289 - protein, 6 aa, Mycobacterium
DGGYDA

SEQ ID NO: 252290 - protein, 11 aa, Mycobacterium
DGHATSLGAAS

SEQ ID NO: 252291 - protein, 11 aa, Mycobacterium
DGHATSVGAAS

SEQ ID NO: 252292 - protein, 6 aa, Mycobacterium
DGHDPG

SEQ ID NO: 252293 - protein, 9 aa, Mycobacterium
DGHEHTVPS

SEQ ID NO: 252294 - protein, 6 aa, Mycobacterium
DGHEIS

SEQ ID NO: 252295 - protein, 4 aa, Mycobacterium
DGHG

SEQ ID NO: 252296 - protein, 7 aa, Mycobacterium
DGHHSPA

SEQ ID NO: 252297 - protein, 13 aa, Mycobacterium
DGHPARASAASVG

SEQ ID NO: 252298 - protein, 11 aa, Mycobacterium
DGHPTSVGAAS

SEQ ID NO: 252299 - protein, 8 aa, Mycobacterium
DGHPVSGS

SEQ ID NO: 252300 - protein, 6 aa, Mycobacterium
DGHSTG

SEQ ID NO: 252301 - protein, 8 aa, Mycobacterium
DGHTEPRL

SEQ ID NO: 252302 - protein, 6 aa, Mycobacterium
DGHTHL

SEQ ID NO: 252303 - protein, 9 aa, Mycobacterium
DGHTTAPAG

SEQ ID NO: 252304 - protein, 14 aa, Mycobacterium
DGHVTGVGAASGAI

SEQ ID NO: 252305 - protein, 4 aa, Mycobacterium
DGIA

SEQ ID NO: 252306 - protein, 8 aa, Mycobacterium
DGIDATAR

SEQ ID NO: 252307 - protein, 6 aa, Mycobacterium
DGIEGI

SEQ ID NO: 252308 - protein, 6 aa, Mycobacterium
DGIESL

SEQ ID NO: 252309 - protein, 13 aa, Mycobacterium
DGIGGAKPRKGTG

SEQ ID NO: 252310 - protein, 16 aa, Mycobacterium
DGIGPARLDKLRDLVR

SEQ ID NO: 252311 - protein, 16 aa, Mycobacterium
DGIGPARLEKLRSLVR

SEQ ID NO: 252312 - protein, 16 aa, Mycobacterium
DGIGPSRLDKLRDFVV

SEQ ID NO: 252313 - protein, 5 aa, Mycobacterium
DGILP

SEQ ID NO: 252314 - protein, 7 aa, Mycobacterium
DGIPSGT

SEQ ID NO: 252315 - protein, 10 aa, Mycobacterium
DGITSSQVES

SEQ ID NO: 252316 - protein, 4 aa, Mycobacterium
DGKA

SEQ ID NO: 252317 - protein, 5 aa, Mycobacterium
DGKAA

SEQ ID NO: 252318 - protein, 7 aa, Mycobacterium
DGKADQY

SEQ ID NO: 252319 - protein, 10 aa, Mycobacterium
DGKALGVKGT

SEQ ID NO: 252320 - protein, 10 aa, Mycobacterium
DGKALGVQGT

SEQ ID NO: 252321 - protein, 8 aa, Mycobacterium
DGKASPGT

SEQ ID NO: 252322 - protein, 8 aa, Mycobacterium
DGKEFDGK

SEQ ID NO: 252323 - protein, 18 aa, Mycobacterium
DGKGGARIESDANATGLR

SEQ ID NO: 252324 - protein, 10 aa, Mycobacterium
DGKIGPGTET

SEQ ID NO: 252325 - protein, 19 aa, Mycobacterium
DGKPIDFENPPDDATFGRG

SEQ ID NO: 252326 - protein, 8 aa, Mycobacterium
DGKPPSRA

SEQ ID NO: 252327 - protein, 6 aa, Mycobacterium
DGKPQS

SEQ ID NO: 252328 - protein, 7 aa, Mycobacterium
DGKPVGP

SEQ ID NO: 252329 - protein, 6 aa, Mycobacterium
DGKPVS

SEQ ID NO: 252330 - protein, 14 aa, Mycobacterium
DGKTCRFNPWPYPI

SEQ ID NO: 252331 - protein, 6 aa, Mycobacterium
DGKTWS

SEQ ID NO: 252332 - protein, 13 aa, Mycobacterium
DGLAGKGKEINTT

SEQ ID NO: 252333 - protein, 5 aa, Mycobacterium
DGLEP

SEQ ID NO: 252334 - protein, 9 aa, Mycobacterium
DGLGDPRAV

SEQ ID NO: 252335 - protein, 8 aa, Mycobacterium
DGLGQGTA

SEQ ID NO: 252336 - protein, 8 aa, Mycobacterium
DGLKPGDR

SEQ ID NO: 252337 - protein, 9 aa, Mycobacterium
DGLPAGSDV

SEQ ID NO: 252338 - protein, 7 aa, Mycobacterium
DGLPERA

SEQ ID NO: 252339 - protein, 6 aa, Mycobacterium
DGLPLG

SEQ ID NO: 252340 - protein, 9 aa, Mycobacterium
DGLPPRSDV

SEQ ID NO: 252341 - protein, 9 aa, Mycobacterium
DGLPQKSDV

SEQ ID NO: 252342 - protein, 15 aa, Mycobacterium
DGLPRRASGRIERDA

SEQ ID NO: 252343 - protein, 17 aa, Mycobacterium
DGLRGKGEALGEATTDL

SEQ ID NO: 252344 - protein, 21 aa, Mycobacterium
DGLRSAPAIAPAPERKRAATD

SEQ ID NO: 252345 - protein, 6 aa, Mycobacterium
DGLSGD

SEQ ID NO: 252346 - protein, 19 aa, Mycobacterium
DGLSKTGKYANTGTHWAPD

SEQ ID NO: 252347 - protein, 8 aa, Mycobacterium
DGLTLPAG

SEQ ID NO: 252348 - protein, 7 aa, Mycobacterium
DGLTPAE

SEQ ID NO: 252349 - protein, 9 aa, Mycobacterium
DGLTPEGRV

SEQ ID NO: 252350 - protein, 9 aa, Mycobacterium
DGLTPGSAE

SEQ ID NO: 252351 - protein, 10 aa, Mycobacterium
DGLTPGSPQL

SEQ ID NO: 252352 - protein, 10 aa, Mycobacterium
DGLTPQRGNH

SEQ ID NO: 252353 - protein, 8 aa, Mycobacterium
DGMTHNAR

SEQ ID NO: 252354 - protein, 5 aa, Mycobacterium
DGNNV

SEQ ID NO: 252355 - protein, 6 aa, Mycobacterium
DGNPAG

SEQ ID NO: 252356 - protein, 20 aa, Mycobacterium
DGNPVNALQGEDGPIPISGT

SEQ ID NO: 252357 - protein, 29 aa, Mycobacterium
DGNSAGREPALADTASTTGPVEAPTGAVP

SEQ ID NO: 252358 - protein, 14 aa, Mycobacterium
DGNSITVPAPSGPH

SEQ ID NO: 252359 - protein, 9 aa, Mycobacterium
DGNSRQASF

SEQ ID NO: 252360 - protein, 7 aa, Mycobacterium
DGNTERG

SEQ ID NO: 252361 - protein, 7 aa, Mycobacterium
DGNVDPE

SEQ ID NO: 252362 - protein, 4 aa, Mycobacterium
DGPA

SEQ ID NO: 252363 - protein, 17 aa, Mycobacterium
DGPAPAPPVDSSGAAAA

SEQ ID NO: 252364 - protein, 7 aa, Mycobacterium
DGPDGLS

SEQ ID NO: 252365 - protein, 6 aa, Mycobacterium
DGPDPV

SEQ ID NO: 252366 - protein, 12 aa, Mycobacterium
DGPDSGADGGWE

SEQ ID NO: 252367 - protein, 9 aa, Mycobacterium
DGPEAGTEV

SEQ ID NO: 252368 - protein, 7 aa, Mycobacterium
DGPERPR

SEQ ID NO: 252369 - protein, 8 aa, Mycobacterium
DGPGIPAR

SEQ ID NO: 252370 - protein, 8 aa, Mycobacterium
DGPGLSKE

SEQ ID NO: 252371 - protein, 39 aa, Mycobacterium
DGPGPADERDEQPGTVDDDTPAPSTERDSTENPSPATDL

SEQ ID NO: 252372 - protein, 7 aa, Mycobacterium
DGPGPYT

SEQ ID NO: 252373 - protein, 23 aa, Mycobacterium
DGPGSPKRLPAGGQIPVSRTAPA

SEQ ID NO: 252374 - protein, 14 aa, Mycobacterium
DGPGSTKTLPAGSQ

SEQ ID NO: 252375 - protein, 8 aa, Mycobacterium
DGPGSTKV

SEQ ID NO: 252376 - protein, 17 aa, Mycobacterium
DGPGSTKVLPAGGEIPL

SEQ ID NO: 252377 - protein, 8 aa, Mycobacterium
DGPGTPEV

SEQ ID NO: 252378 - protein, 7 aa, Mycobacterium
DGPIAPR

SEQ ID NO: 252379 - protein, 7 aa, Mycobacterium
DGPLAAP

SEQ ID NO: 252380 - protein, 6 aa, Mycobacterium
DGPLTE

SEQ ID NO: 252381 - protein, 7 aa, Mycobacterium
DGPMAPT

SEQ ID NO: 252382 - protein, 8 aa, Mycobacterium
DGPMPPQR

SEQ ID NO: 252383 - protein, 10 aa, Mycobacterium
DGPPHSPSAL

SEQ ID NO: 252384 - protein, 20 aa, Mycobacterium
DGPPPSAPVELEGQEAAALG

SEQ ID NO: 252385 - protein, 19 aa, Mycobacterium
DGPPSRYRSEPQREHLVSA

SEQ ID NO: 252386 - protein, 6 aa, Mycobacterium
DGPPTL

SEQ ID NO: 252387 - protein, 7 aa, Mycobacterium
DGPPTPG

SEQ ID NO: 252388 - protein, 9 aa, Mycobacterium
DGPQRPFDE

SEQ ID NO: 252389 - protein, 5 aa, Mycobacterium
DGPRR

SEQ ID NO: 252390 - protein, 7 aa, Mycobacterium
DGPRSAA

SEQ ID NO: 252391 - protein, 5 aa, Mycobacterium
DGPSK

SEQ ID NO: 252392 - protein, 7 aa, Mycobacterium
DGPSPFD

SEQ ID NO: 252393 - protein, 7 aa, Mycobacterium
DGPSPFT

SEQ ID NO: 252394 - protein, 9 aa, Mycobacterium
DGPSPGRDE

SEQ ID NO: 252395 - protein, 5 aa, Mycobacterium
DGPSW

SEQ ID NO: 252396 - protein, 6 aa, Mycobacterium
DGPTAL

SEQ ID NO: 252397 - protein, 7 aa, Mycobacterium
DGPTGQF

SEQ ID NO: 252398 - protein, 7 aa, Mycobacterium
DGPTPFT

SEQ ID NO: 252399 - protein, 8 aa, Mycobacterium
DGPTPREV

SEQ ID NO: 252400 - protein, 13 aa, Mycobacterium
DGPTPVAVGPGGA

SEQ ID NO: 252401 - protein, 13 aa, Mycobacterium
DGPVNPAAGGTKR

SEQ ID NO: 252402 - protein, 5 aa, Mycobacterium
DGPYD

SEQ ID NO: 252403 - protein, 9 aa, Mycobacterium
DGQDEATLQ

SEQ ID NO: 252404 - protein, 7 aa, Mycobacterium
DGQDPDM

SEQ ID NO: 252405 - protein, 8 aa, Mycobacterium
DGQDPDMR

SEQ ID NO: 252406 - protein, 7 aa, Mycobacterium
DGQDPEM

SEQ ID NO: 252407 - protein, 9 aa, Mycobacterium
DGQDYSRET

SEQ ID NO: 252408 - protein, 4 aa, Mycobacterium
DGQE

SEQ ID NO: 252409 - protein, 6 aa, Mycobacterium
DGQETG

SEQ ID NO: 252410 - protein, 6 aa, Mycobacterium
DGQEYT

SEQ ID NO: 252411 - protein, 17 aa, Mycobacterium
DGQGNPVKPGDLAGTAT

SEQ ID NO: 252412 - protein, 9 aa, Mycobacterium
DGQGRSQTE

SEQ ID NO: 252413 - protein, 13 aa, Mycobacterium
DGQHGSVPLSGTG

SEQ ID NO: 252414 - protein, 7 aa, Mycobacterium
DGQKRLK

SEQ ID NO: 252415 - protein, 8 aa, Mycobacterium
DGQKSDIP

SEQ ID NO: 252416 - protein, 6 aa, Mycobacterium
DGQPLT

SEQ ID NO: 252417 - protein, 6 aa, Mycobacterium
DGQQHR

SEQ ID NO: 252418 - protein, 12 aa, Mycobacterium
DGQRAERAAADE

SEQ ID NO: 252419 - protein, 6 aa, Mycobacterium
DGQRDI

SEQ ID NO: 252420 - protein, 8 aa, Mycobacterium
DGQRLPAS

SEQ ID NO: 252421 - protein, 6 aa, Mycobacterium
DGQRPL

SEQ ID NO: 252422 - protein, 15 aa, Mycobacterium
DGQSINIGKPDGPRI

SEQ ID NO: 252423 - protein, 9 aa, Mycobacterium
DGQSRFAST

SEQ ID NO: 252424 - protein, 15 aa, Mycobacterium
DGQSSIADDLGEAAR

SEQ ID NO: 252425 - protein, 8 aa, Mycobacterium
DGQSTVGR

SEQ ID NO: 252426 - protein, 13 aa, Mycobacterium
DGQSVNIGNPDGP

SEQ ID NO: 252427 - protein, 4 aa, Mycobacterium
DGQT

SEQ ID NO: 252428 - protein, 7 aa, Mycobacterium
DGQTATD

SEQ ID NO: 252429 - protein, 6 aa, Mycobacterium
DGQTFR

SEQ ID NO: 252430 - protein, 23 aa, Mycobacterium
DGQTITKGTVPAEIGPALDTANR

SEQ ID NO: 252431 - protein, 22 aa, Mycobacterium
DGQTRRPEKRVAQDSATSAAAD

SEQ ID NO: 252432 - protein, 8 aa, Mycobacterium
DGQTRTST

SEQ ID NO: 252433 - protein, 4 aa, Mycobacterium
DGQV

SEQ ID NO: 252434 - protein, 12 aa, Mycobacterium
DGQVKSNSDVTL

SEQ ID NO: 252435 - protein, 8 aa, Mycobacterium
DGQVRTST

SEQ ID NO: 252436 - protein, 5 aa, Mycobacterium
DGRAA

SEQ ID NO: 252437 - protein, 16 aa, Mycobacterium
DGRADAKANPDPDRRA

SEQ ID NO: 252438 - protein, 7 aa, Mycobacterium
DGRADDS

SEQ ID NO: 252439 - protein, 6 aa, Mycobacterium
DGRADQ

SEQ ID NO: 252440 - protein, 10 aa, Mycobacterium
DGRAKAVPAA

SEQ ID NO: 252441 - protein, 4 aa, Mycobacterium
DGRD

SEQ ID NO: 252442 - protein, 4 aa, Mycobacterium
DGRG

SEQ ID NO: 252443 - protein, 10 aa, Mycobacterium
DGRGARRPTR

SEQ ID NO: 252444 - protein, 16 aa, Mycobacterium
DGRGDAQRNPDPDRRE

SEQ ID NO: 252445 - protein, 7 aa, Mycobacterium
DGRGFDP

SEQ ID NO: 252446 - protein, 11 aa, Mycobacterium
DGRGGADIQPG

SEQ ID NO: 252447 - protein, 20 aa, Mycobacterium
DGRGGARVVDGDDTVDATGL

SEQ ID NO: 252448 - protein, 13 aa, Mycobacterium
DGRGGATIQPGRG

SEQ ID NO: 252449 - protein, 7 aa, Mycobacterium
DGRGPAL

SEQ ID NO: 252450 - protein, 6 aa, Mycobacterium
DGRLTP

SEQ ID NO: 252451 - protein, 5 aa, Mycobacterium
DGRNG

SEQ ID NO: 252452 - protein, 6 aa, Mycobacterium
DGRPAG

SEQ ID NO: 252453 - protein, 7 aa, Mycobacterium
DGRPAPY

SEQ ID NO: 252454 - protein, 7 aa, Mycobacterium
DGRPATT

SEQ ID NO: 252455 - protein, 5 aa, Mycobacterium
DGRPR

SEQ ID NO: 252456 - protein, 8 aa, Mycobacterium
DGRPRRAG

SEQ ID NO: 252457 - protein, 25 aa, Mycobacterium
DGRPRYRTSRVPTAADLRSALEPLL

SEQ ID NO: 252458 - protein, 6 aa, Mycobacterium
DGRPTE

SEQ ID NO: 252459 - protein, 6 aa, Mycobacterium
DGRPVT

SEQ ID NO: 252460 - protein, 13 aa, Mycobacterium
DGRQLKMSKVEFV

SEQ ID NO: 252461 - protein, 8 aa, Mycobacterium
DGRRADTS

SEQ ID NO: 252462 - protein, 5 aa, Mycobacterium
DGRRH

SEQ ID NO: 252463 - protein, 6 aa, Mycobacterium
DGRRPM

SEQ ID NO: 252464 - protein, 15 aa, Mycobacterium
DGRRQVAGGSGVRRG

SEQ ID NO: 252465 - protein, 11 aa, Mycobacterium
DGRRTEEAAAQ

SEQ ID NO: 252466 - protein, 10 aa, Mycobacterium
DGRSAELSGA

SEQ ID NO: 252467 - protein, 17 aa, Mycobacterium
DGRSDARRNPDPDRRDD

SEQ ID NO: 252468 - protein, 8 aa, Mycobacterium
DGRSRTRW

SEQ ID NO: 252469 - protein, 5 aa, Mycobacterium
DGRTA

SEQ ID NO: 252470 - protein, 7 aa, Mycobacterium
DGRTDDT

SEQ ID NO: 252471 - protein, 6 aa, Mycobacterium
DGSADS

SEQ ID NO: 252472 - protein, 7 aa, Mycobacterium
DGSAGPF

SEQ ID NO: 252473 - protein, 8 aa, Mycobacterium
DGSAGPFG

SEQ ID NO: 252474 - protein, 21 aa, Mycobacterium
DGSAGSTGAARTGATNPRRPA

SEQ ID NO: 252475 - protein, 7 aa, Mycobacterium
DGSAHRA

SEQ ID NO: 252476 - protein, 8 aa, Mycobacterium
DGSAHRGE

SEQ ID NO: 252477 - protein, 10 aa, Mycobacterium
DGSAHSGAAI

SEQ ID NO: 252478 - protein, 8 aa, Mycobacterium
DGSAPDIT

SEQ ID NO: 252479 - protein, 28 aa, Mycobacterium
DGSAPDVSELQQRRDDAELEESRARLPE

SEQ ID NO: 252480 - protein, 10 aa, Mycobacterium
DGSAPDVSGL

SEQ ID NO: 252481 - protein, 28 aa, Mycobacterium
DGSAPDVSGLQRRQESADEEEARSRLPE

SEQ ID NO: 252482 - protein, 6 aa, Mycobacterium
DGSAQI

SEQ ID NO: 252483 - protein, 30 aa, Mycobacterium
DGSARRRQTRRASTSWQPEPVRPAAAAAAA

SEQ ID NO: 252484 - protein, 7 aa, Mycobacterium
DGSDDGL

SEQ ID NO: 252485 - protein, 8 aa, Mycobacterium
DGSDGVID

SEQ ID NO: 252486 - protein, 5 aa, Mycobacterium
DGSDY

SEQ ID NO: 252487 - protein, 10 aa, Mycobacterium
DGSEADFREA

SEQ ID NO: 252488 - protein, 4 aa, Mycobacterium
DGSF

SEQ ID NO: 252489 - protein, 7 aa, Mycobacterium
DGSGGMG

SEQ ID NO: 252490 - protein, 7 aa, Mycobacterium
DGSGPIP

SEQ ID NO: 252491 - protein, 9 aa, Mycobacterium
DGSGPMPEL

SEQ ID NO: 252492 - protein, 7 aa, Mycobacterium
DGSGQPI

SEQ ID NO: 252493 - protein, 6 aa, Mycobacterium
DGSGRD

SEQ ID NO: 252494 - protein, 8 aa, Mycobacterium
DGSGTYDY

SEQ ID NO: 252495 - protein, 6 aa, Mycobacterium
DGSGYE

SEQ ID NO: 252496 - protein, 4 aa, Mycobacterium
DGSH

SEQ ID NO: 252497 - protein, 6 aa, Mycobacterium
DGSHAE

SEQ ID NO: 252498 - protein, 4 aa, Mycobacterium
DGSI

SEQ ID NO: 252499 - protein, 7 aa, Mycobacterium
DGSIPEG

SEQ ID NO: 252500 - protein, 5 aa, Mycobacterium
DGSLD

SEQ ID NO: 252501 - protein, 8 aa, Mycobacterium
DGSNDAAA

SEQ ID NO: 252502 - protein, 9 aa, Mycobacterium
DGSNDAAAI

SEQ ID NO: 252503 - protein, 9 aa, Mycobacterium
DGSPDGSLD

SEQ ID NO: 252504 - protein, 8 aa, Mycobacterium
DGSPDRGW

SEQ ID NO: 252505 - protein, 8 aa, Mycobacterium
DGSPEGAA

SEQ ID NO: 252506 - protein, 7 aa, Mycobacterium
DGSPESE

SEQ ID NO: 252507 - protein, 7 aa, Mycobacterium
DGSPEVA

SEQ ID NO: 252508 - protein, 7 aa, Mycobacterium
DGSPGLT

SEQ ID NO: 252509 - protein, 7 aa, Mycobacterium
DGSPGSK

SEQ ID NO: 252510 - protein, 9 aa, Mycobacterium
DGSPGSQAA

SEQ ID NO: 252511 - protein, 19 aa, Mycobacterium
DGSPRELPEGYQTYDREGA

SEQ ID NO: 252512 - protein, 7 aa, Mycobacterium
DGSPTSE

SEQ ID NO: 252513 - protein, 8 aa, Mycobacterium
DGSQHRGE

SEQ ID NO: 252514 - protein, 7 aa, Mycobacterium
DGSQPAY

SEQ ID NO: 252515 - protein, 4 aa, Mycobacterium
DGSR

SEQ ID NO: 252516 - protein, 8 aa, Mycobacterium
DGSRIGAG

SEQ ID NO: 252517 - protein, 6 aa, Mycobacterium
DGSRLG

SEQ ID NO: 252518 - protein, 7 aa, Mycobacterium
DGSRSQI

SEQ ID NO: 252519 - protein, 7 aa, Mycobacterium
DGSSAVD

SEQ ID NO: 252520 - protein, 29 aa, Mycobacterium
DGSSCTGNSGYSDIGPDTDVTVKNGKGEI

SEQ ID NO: 252521 - protein, 7 aa, Mycobacterium
DGSSDSI

SEQ ID NO: 252522 - protein, 8 aa, Mycobacterium
DGSSGPFG

SEQ ID NO: 252523 - protein, 10 aa, Mycobacterium
DGSSRPVNEA

SEQ ID NO: 252524 - protein, 10 aa, Mycobacterium
DGSSVKQQVP

SEQ ID NO: 252525 - protein, 6 aa, Mycobacterium
DGSTGE

SEQ ID NO: 252526 - protein, 7 aa, Mycobacterium
DGSTGEF

SEQ ID NO: 252527 - protein, 8 aa, Mycobacterium
DGSTGPFG

SEQ ID NO: 252528 - protein, 7 aa, Mycobacterium
DGSTGTF

SEQ ID NO: 252529 - protein, 8 aa, Mycobacterium
DGSTHRGE

SEQ ID NO: 252530 - protein, 5 aa, Mycobacterium
DGSTM

SEQ ID NO: 252531 - protein, 6 aa, Mycobacterium
DGSTMH

SEQ ID NO: 252532 - protein, 8 aa, Mycobacterium
DGSTPELL

SEQ ID NO: 252533 - protein, 7 aa, Mycobacterium
DGSTSGI

SEQ ID NO: 252534 - protein, 24 aa, Mycobacterium
DGSVADEPAPAAGPAPRPAKPRLL

SEQ ID NO: 252535 - protein, 6 aa, Mycobacterium
DGSVST

SEQ ID NO: 252536 - protein, 9 aa, Mycobacterium
DGTADERGL

SEQ ID NO: 252537 - protein, 15 aa, Mycobacterium
DGTCSRCGRAESSVS

SEQ ID NO: 252538 - protein, 5 aa, Mycobacterium
DGTDA

SEQ ID NO: 252539 - protein, 7 aa, Mycobacterium
DGTDAGR

SEQ ID NO: 252540 - protein, 4 aa, Mycobacterium
DGTF

SEQ ID NO: 252541 - protein, 8 aa, Mycobacterium
DGTFSPEI

SEQ ID NO: 252542 - protein, 6 aa, Mycobacterium
DGTGPF

SEQ ID NO: 252543 - protein, 8 aa, Mycobacterium
DGTGPIPA

SEQ ID NO: 252544 - protein, 8 aa, Mycobacterium
DGTGPIPE

SEQ ID NO: 252545 - protein, 10 aa, Mycobacterium
DGTGPIPEIG

SEQ ID NO: 252546 - protein, 9 aa, Mycobacterium
DGTGPIPEL

SEQ ID NO: 252547 - protein, 9 aa, Mycobacterium
DGTGPLPAL

SEQ ID NO: 252548 - protein, 9 aa, Mycobacterium
DGTGPMPEL

SEQ ID NO: 252549 - protein, 8 aa, Mycobacterium
DGTGSATT

SEQ ID NO: 252550 - protein, 6 aa, Mycobacterium
DGTGTR

SEQ ID NO: 252551 - protein, 6 aa, Mycobacterium
DGTHST

SEQ ID NO: 252552 - protein, 5 aa, Mycobacterium
DGTKY

SEQ ID NO: 252553 - protein, 6 aa, Mycobacterium
DGTLPE

SEQ ID NO: 252554 - protein, 4 aa, Mycobacterium
DGTM

SEQ ID NO: 252555 - protein, 8 aa, Mycobacterium
DGTPAQEV

SEQ ID NO: 252556 - protein, 9 aa, Mycobacterium
DGTPKAGAV

SEQ ID NO: 252557 - protein, 6 aa, Mycobacterium
DGTPLR

SEQ ID NO: 252558 - protein, 9 aa, Mycobacterium
DGTPRQASF

SEQ ID NO: 252559 - protein, 6 aa, Mycobacterium
DGTPVT

SEQ ID NO: 252560 - protein, 5 aa, Mycobacterium
DGTQD

SEQ ID NO: 252561 - protein, 17 aa, Mycobacterium
DGTQEFSVEETKDETRG

SEQ ID NO: 252562 - protein, 7 aa, Mycobacterium
DGTQPAY

SEQ ID NO: 252563 - protein, 5 aa, Mycobacterium
DGTRD

SEQ ID NO: 252564 - protein, 9 aa, Mycobacterium
DGTRHQGEA

SEQ ID NO: 252565 - protein, 8 aa, Mycobacterium
DGTRLSRR

SEQ ID NO: 252566 - protein, 6 aa, Mycobacterium
DGTRSV

SEQ ID NO: 252567 - protein, 9 aa, Mycobacterium
DGTSGLEAA

SEQ ID NO: 252568 - protein, 8 aa, Mycobacterium
DGTSGPLR

SEQ ID NO: 252569 - protein, 10 aa, Mycobacterium
DGTSRKGDFA

SEQ ID NO: 252570 - protein, 10 aa, Mycobacterium
DGTSTGSGTT

SEQ ID NO: 252571 - protein, 6 aa, Mycobacterium
DGTTGE

SEQ ID NO: 252572 - protein, 5 aa, Mycobacterium
DGTTM

SEQ ID NO: 252573 - protein, 6 aa, Mycobacterium
DGTTMT

SEQ ID NO: 252574 - protein, 7 aa, Mycobacterium
DGTTSPT

SEQ ID NO: 252575 - protein, 6 aa, Mycobacterium
DGTTVT

SEQ ID NO: 252576 - protein, 7 aa, Mycobacterium
DGTTYTA

SEQ ID NO: 252577 - protein, 10 aa, Mycobacterium
DGTVTPDDVQ

SEQ ID NO: 252578 - protein, 11 aa, Mycobacterium
DGVATKAHDDV

SEQ ID NO: 252579 - protein, 4 aa, Mycobacterium
DGVD

SEQ ID NO: 252580 - protein, 6 aa, Mycobacterium
DGVDAA

SEQ ID NO: 252581 - protein, 10 aa, Mycobacterium
DGVDSNGMSS

SEQ ID NO: 252582 - protein, 13 aa, Mycobacterium
DGVDTTTFGGDEG

SEQ ID NO: 252583 - protein, 23 aa, Mycobacterium
DGVESGTLEVRPGKGLRVYSFTY

SEQ ID NO: 252584 - protein, 13 aa, Mycobacterium
DGVESLGAPQVAG

SEQ ID NO: 252585 - protein, 4 aa, Mycobacterium
DGVG

SEQ ID NO: 252586 - protein, 21 aa, Mycobacterium
DGVGAAREAMDSAGGHAGHGE

SEQ ID NO: 252587 - protein, 14 aa, Mycobacterium
DGVGGAVAGGGSGL

SEQ ID NO: 252588 - protein, 8 aa, Mycobacterium
DGVGIPEG

SEQ ID NO: 252589 - protein, 5 aa, Mycobacterium
DGVGV

SEQ ID NO: 252590 - protein, 9 aa, Mycobacterium
DGVGVPEAE

SEQ ID NO: 252591 - protein, 9 aa, Mycobacterium
DGVGVSGET

SEQ ID NO: 252592 - protein, 8 aa, Mycobacterium
DGVNDAAA

SEQ ID NO: 252593 - protein, 8 aa, Mycobacterium
DGVNDAPA

SEQ ID NO: 252594 - protein, 14 aa, Mycobacterium
DGVNDAPALKQADA

SEQ ID NO: 252595 - protein, 11 aa, Mycobacterium
DGVNDAPALRQ

SEQ ID NO: 252596 - protein, 6 aa, Mycobacterium
DGVNSA

SEQ ID NO: 252597 - protein, 6 aa, Mycobacterium
DGVNSE

SEQ ID NO: 252598 - protein, 13 aa, Mycobacterium
DGVPPGATPLPDG

SEQ ID NO: 252599 - protein, 6 aa, Mycobacterium
DGVPPQ

SEQ ID NO: 252600 - protein, 7 aa, Mycobacterium
DGVPSDE

SEQ ID NO: 252601 - protein, 6 aa, Mycobacterium
DGVPVD

SEQ ID NO: 252602 - protein, 4 aa, Mycobacterium
DGVR

SEQ ID NO: 252603 - protein, 18 aa, Mycobacterium
DGVRGQGERIGRATTDAN

SEQ ID NO: 252604 - protein, 5 aa, Mycobacterium
DGVRV

SEQ ID NO: 252605 - protein, 5 aa, Mycobacterium
DGVSA

SEQ ID NO: 252606 - protein, 7 aa, Mycobacterium
DGVSGGE

SEQ ID NO: 252607 - protein, 6 aa, Mycobacterium
DGVSTG

SEQ ID NO: 252608 - protein, 11 aa, Mycobacterium
DGVTAAGDPVG

SEQ ID NO: 252609 - protein, 5 aa, Mycobacterium
DGVTV

SEQ ID NO: 252610 - protein, 6 aa, Mycobacterium
DGVTVE

SEQ ID NO: 252611 - protein, 14 aa, Mycobacterium
DGVVDTARSRAIGS

SEQ ID NO: 252612 - protein, 11 aa, Mycobacterium
DGWRDTESERG

SEQ ID NO: 252613 - protein, 9 aa, Mycobacterium
DGWSNTGGA

SEQ ID NO: 252614 - protein, 7 aa, Mycobacterium
DGWTAGT

SEQ ID NO: 252615 - protein, 6 aa, Mycobacterium
DGWTDT

SEQ ID NO: 252616 - protein, 14 aa, Mycobacterium
DGYAAASADTRDDV

SEQ ID NO: 252617 - protein, 17 aa, Mycobacterium
DGYADDTDAVPDASRIT

SEQ ID NO: 252618 - protein, 17 aa, Mycobacterium
DGYAGLAASAARDSRLQ

SEQ ID NO: 252619 - protein, 18 aa, Mycobacterium
DGYDTDVAKRGGRLSAGQ

SEQ ID NO: 252620 - protein, 18 aa, Mycobacterium
DGYDTRINDGGTNISAGE

SEQ ID NO: 252621 - protein, 18 aa, Mycobacterium
DGYETRVSGGGGNISAGE

SEQ ID NO: 252622 - protein, 4 aa, Mycobacterium
DGYF

SEQ ID NO: 252623 - protein, 5 aa, Mycobacterium
DGYGL

SEQ ID NO: 252624 - protein, 6 aa, Mycobacterium
DGYGPV

SEQ ID NO: 252625 - protein, 11 aa, Mycobacterium
DGYRDSQENPL

SEQ ID NO: 252626 - protein, 13 aa, Mycobacterium
DGYTDKKESEKKL

SEQ ID NO: 252627 - protein, 11 aa, Mycobacterium
DGYTPDNPVAN

SEQ ID NO: 252628 - protein, 9 aa, Mycobacterium
DHAATAREI

SEQ ID NO: 252629 - protein, 6 aa, Mycobacterium
DHAEAN

SEQ ID NO: 252630 - protein, 10 aa, Mycobacterium
DHAGADDEHG

SEQ ID NO: 252631 - protein, 10 aa, Mycobacterium
DHAGTAASIA

SEQ ID NO: 252632 - protein, 6 aa, Mycobacterium
DHANPG

SEQ ID NO: 252633 - protein, 13 aa, Mycobacterium
DHAPGEPHAQPSG

SEQ ID NO: 252634 - protein, 8 aa, Mycobacterium
DHDLRTPA

SEQ ID NO: 252635 - protein, 5 aa, Mycobacterium
DHDNN

SEQ ID NO: 252636 - protein, 6 aa, Mycobacterium
DHDPDG

SEQ ID NO: 252637 - protein, 9 aa, Mycobacterium
DHEAAAAKE

SEQ ID NO: 252638 - protein, 8 aa, Mycobacterium
DHEESTLP

SEQ ID NO: 252639 - protein, 12 aa, Mycobacterium
DHGDQLAGGTAH

SEQ ID NO: 252640 - protein, 8 aa, Mycobacterium
DHGGGGGF

SEQ ID NO: 252641 - protein, 4 aa, Mycobacterium
DHGH

SEQ ID NO: 252642 - protein, 26 aa, Mycobacterium
DHGNVRGSDTGGNPHGTGEREPDDAA

SEQ ID NO: 252643 - protein, 11 aa, Mycobacterium
DHGPGANDESV

SEQ ID NO: 252644 - protein, 11 aa, Mycobacterium
DHGQAQGEPTK

SEQ ID NO: 252645 - protein, 11 aa, Mycobacterium
DHGTHAPGGEH

SEQ ID NO: 252646 - protein, 5 aa, Mycobacterium
DHHAN

SEQ ID NO: 252647 - protein, 6 aa, Mycobacterium
DHHANP

SEQ ID NO: 252648 - protein, 8 aa, Mycobacterium
DHHANPHR

SEQ ID NO: 252649 - protein, 12 aa, Mycobacterium
DHHDASRHAQRR

SEQ ID NO: 252650 - protein, 12 aa, Mycobacterium
DHHSRDAALGGT

SEQ ID NO: 252651 - protein, 5 aa, Mycobacterium
DHKGR

SEQ ID NO: 252652 - protein, 7 aa, Mycobacterium
DHNPAER

SEQ ID NO: 252653 - protein, 10 aa, Mycobacterium
DHPANSSIGG

SEQ ID NO: 252654 - protein, 8 aa, Mycobacterium
DHPARTTV

SEQ ID NO: 252655 - protein, 8 aa, Mycobacterium
DHPATATA

SEQ ID NO: 252656 - protein, 12 aa, Mycobacterium
DHPATATATAQE

SEQ ID NO: 252657 - protein, 4 aa, Mycobacterium
DHPD

SEQ ID NO: 252658 - protein, 10 aa, Mycobacterium
DHPDAPGRVT

SEQ ID NO: 252659 - protein, 9 aa, Mycobacterium
DHPDGAAAA

SEQ ID NO: 252660 - protein, 8 aa, Mycobacterium
DHPDSAGY

SEQ ID NO: 252661 - protein, 5 aa, Mycobacterium
DHPGD

SEQ ID NO: 252662 - protein, 5 aa, Mycobacterium
DHPGL

SEQ ID NO: 252663 - protein, 4 aa, Mycobacterium
DHPI

SEQ ID NO: 252664 - protein, 7 aa, Mycobacterium
DHPRAAA

SEQ ID NO: 252665 - protein, 12 aa, Mycobacterium
DHPRAPRKPRGI

SEQ ID NO: 252666 - protein, 10 aa, Mycobacterium
DHPSAPGDVT

SEQ ID NO: 252667 - protein, 7 aa, Mycobacterium
DHQDVDS

SEQ ID NO: 252668 - protein, 11 aa, Mycobacterium
DHQGAARGQPD

SEQ ID NO: 252669 - protein, 7 aa, Mycobacterium
DHQHGAG

SEQ ID NO: 252670 - protein, 6 aa, Mycobacterium
DHQRNR

SEQ ID NO: 252671 - protein, 11 aa, Mycobacterium
DHQTEAAEQIA

SEQ ID NO: 252672 - protein, 12 aa, Mycobacterium
DHQTEAAEQVSS

SEQ ID NO: 252673 - protein, 6 aa, Mycobacterium
DHRARE

SEQ ID NO: 252674 - protein, 7 aa, Mycobacterium
DHRGGDE

SEQ ID NO: 252675 - protein, 7 aa, Mycobacterium
DHRGGEE

SEQ ID NO: 252676 - protein, 5 aa, Mycobacterium
DHRPF

SEQ ID NO: 252677 - protein, 5 aa, Mycobacterium
DHRPK

SEQ ID NO: 252678 - protein, 8 aa, Mycobacterium
DHRSAHPN

SEQ ID NO: 252679 - protein, 15 aa, Mycobacterium
DHRSGDDGDASHARA

SEQ ID NO: 252680 - protein, 10 aa, Mycobacterium
DHSDASALRD

SEQ ID NO: 252681 - protein, 8 aa, Mycobacterium
DHSPPPPR

SEQ ID NO: 252682 - protein, 24 aa, Mycobacterium
DHSRPASGTSRQRRGKGSGGSFTS

SEQ ID NO: 252683 - protein, 5 aa, Mycobacterium
DHTDA

SEQ ID NO: 252684 - protein, 5 aa, Mycobacterium
DHTGD

SEQ ID NO: 252685 - protein, 6 aa, Mycobacterium
DHTGET

SEQ ID NO: 252686 - protein, 47 aa, Mycobacterium
DHTNVASSEEAPATPGPTAIAGDKPDTDVATTEVDESGDRQSSTPAK

SEQ ID NO: 252687 - protein, 13 aa, Mycobacterium
DHTPTGPQDPVTA

SEQ ID NO: 252688 - protein, 7 aa, Mycobacterium
DHTRTPT

SEQ ID NO: 252689 - protein, 6 aa, Mycobacterium
DHVPES

SEQ ID NO: 252690 - protein, 19 aa, Mycobacterium
DHVTDTTGVLTDSGRAAVS

SEQ ID NO: 252691 - protein, 8 aa, Mycobacterium
DHYSGKNR

SEQ ID NO: 252692 - protein, 11 aa, Mycobacterium
DIAAGDNTAAE

SEQ ID NO: 252693 - protein, 5 aa, Mycobacterium
DIAPK

SEQ ID NO: 252694 - protein, 6 aa, Mycobacterium
DIAPPT

SEQ ID NO: 252695 - protein, 6 aa, Mycobacterium
DIAPSR

SEQ ID NO: 252696 - protein, 11 aa, Mycobacterium
DIATQTSATQA

SEQ ID NO: 252697 - protein, 5 aa, Mycobacterium
DIATR

SEQ ID NO: 252698 - protein, 6 aa, Mycobacterium
DIDGQH

SEQ ID NO: 252699 - protein, 6 aa, Mycobacterium
DIDGTH

SEQ ID NO: 252700 - protein, 8 aa, Mycobacterium
DIDKNTSY

SEQ ID NO: 252701 - protein, 11 aa, Mycobacterium
DIDPDADGATM

SEQ ID NO: 252702 - protein, 9 aa, Mycobacterium
DIDPGASLE

SEQ ID NO: 252703 - protein, 7 aa, Mycobacterium
DIDPNAT

SEQ ID NO: 252704 - protein, 4 aa, Mycobacterium
DIDQ

SEQ ID NO: 252705 - protein, 10 aa, Mycobacterium
DIDQAGAAGV

SEQ ID NO: 252706 - protein, 7 aa, Mycobacterium
DIDQPTY

SEQ ID NO: 252707 - protein, 8 aa, Mycobacterium
DIDTRTVR

SEQ ID NO: 252708 - protein, 6 aa, Mycobacterium
DIEQAT

SEQ ID NO: 252709 - protein, 11 aa, Mycobacterium
DIGNGRGPVDE

SEQ ID NO: 252710 - protein, 8 aa, Mycobacterium
DIGPPEDR

SEQ ID NO: 252711 - protein, 13 aa, Mycobacterium
DIGRAPRNHGRRC

SEQ ID NO: 252712 - protein, 11 aa, Mycobacterium
DIGSDSDMEDR

SEQ ID NO: 252713 - protein, 4 aa, Mycobacterium
DIKG

SEQ ID NO: 252714 - protein, 7 aa, Mycobacterium
DIKKAEK

SEQ ID NO: 252715 - protein, 6 aa, Mycobacterium
DIKPFN

SEQ ID NO: 252716 - protein, 7 aa, Mycobacterium
DIKPGIH

SEQ ID NO: 252717 - protein, 6 aa, Mycobacterium
DIPDPL

SEQ ID NO: 252718 - protein, 5 aa, Mycobacterium
DIPER

SEQ ID NO: 252719 - protein, 7 aa, Mycobacterium
DIPETAT

SEQ ID NO: 252720 - protein, 5 aa, Mycobacterium
DIPGR

SEQ ID NO: 252721 - protein, 9 aa, Mycobacterium
DIPGTPPET

SEQ ID NO: 252722 - protein, 12 aa, Mycobacterium
DIPLPSKPVGTS

SEQ ID NO: 252723 - protein, 6 aa, Mycobacterium
DIPPGQ

SEQ ID NO: 252724 - protein, 5 aa, Mycobacterium
DIPSD

SEQ ID NO: 252725 - protein, 13 aa, Mycobacterium
DIPSDEELEPVTG

SEQ ID NO: 252726 - protein, 11 aa, Mycobacterium
DIPTDAESGKI

SEQ ID NO: 252727 - protein, 9 aa, Mycobacterium
DIPTDAQSH

SEQ ID NO: 252728 - protein, 10 aa, Mycobacterium
DIPTDAQTGK

SEQ ID NO: 252729 - protein, 10 aa, Mycobacterium
DIPTDRESGK

SEQ ID NO: 252730 - protein, 7 aa, Mycobacterium
DIPTDTV

SEQ ID NO: 252731 - protein, 15 aa, Mycobacterium
DIQQENSDPTANDNQ

SEQ ID NO: 252732 - protein, 7 aa, Mycobacterium
DIRDAQE

SEQ ID NO: 252733 - protein, 4 aa, Mycobacterium
DIRN

SEQ ID NO: 252734 - protein, 5 aa, Mycobacterium
DIRNP

SEQ ID NO: 252735 - protein, 10 aa, Mycobacterium
DIRPESADTV

SEQ ID NO: 252736 - protein, 6 aa, Mycobacterium
DISAQA

SEQ ID NO: 252737 - protein, 9 aa, Mycobacterium
DISKRGRTQ

SEQ ID NO: 252738 - protein, 9 aa, Mycobacterium
DISPEQRDR

SEQ ID NO: 252739 - protein, 6 aa, Mycobacterium
DISSET

SEQ ID NO: 252740 - protein, 6 aa, Mycobacterium
DISSTT

SEQ ID NO: 252741 - protein, 19 aa, Mycobacterium
DITERKKAEHALAESEERF

SEQ ID NO: 252742 - protein, 7 aa, Mycobacterium
DITRGTN

SEQ ID NO: 252743 - protein, 6 aa, Mycobacterium
DITTDT

SEQ ID NO: 252744 - protein, 6 aa, Mycobacterium
DITTES

SEQ ID NO: 252745 - protein, 23 aa, Mycobacterium
DITTGDRGRRLRPSRADTELGRA

SEQ ID NO: 252746 - protein, 6 aa, Mycobacterium
DIYSQP

SEQ ID NO: 252747 - protein, 6 aa, Mycobacterium
DKAAAT

SEQ ID NO: 252748 - protein, 8 aa, Mycobacterium
DKAASTWN

SEQ ID NO: 252749 - protein, 29 aa, Mycobacterium
DKADDEQDLAAATASMESMKGKKSSVSSQ

SEQ ID NO: 252750 - protein, 7 aa, Mycobacterium
DKAFTTQ

SEQ ID NO: 252751 - protein, 6 aa, Mycobacterium
DKAHPT

SEQ ID NO: 252752 - protein, 7 aa, Mycobacterium
DKAIERD

SEQ ID NO: 252753 - protein, 4 aa, Mycobacterium
DKAN

SEQ ID NO: 252754 - protein, 7 aa, Mycobacterium
DKAPPRW

SEQ ID NO: 252755 - protein, 8 aa, Mycobacterium
DKAPRTID

SEQ ID NO: 252756 - protein, 19 aa, Mycobacterium
DKAQSEQNTVRSEHRSFQG

SEQ ID NO: 252757 - protein, 7 aa, Mycobacterium
DKAQTGV

SEQ ID NO: 252758 - protein, 9 aa, Mycobacterium
DKARARAKS

SEQ ID NO: 252759 - protein, 7 aa, Mycobacterium
DKATASF

SEQ ID NO: 252760 - protein, 10 aa, Mycobacterium
DKDAATTKKR

SEQ ID NO: 252761 - protein, 9 aa, Mycobacterium
DKDDPRCDG

SEQ ID NO: 252762 - protein, 6 aa, Mycobacterium
DKDEEL

SEQ ID NO: 252763 - protein, 10 aa, Mycobacterium
DKDGDKFSTA

SEQ ID NO: 252764 - protein, 28 aa, Mycobacterium
DKDGGGDTTASAATSSEAAEPAADGQLP

SEQ ID NO: 252765 - protein, 8 aa, Mycobacterium
DKDGRPFR

SEQ ID NO: 252766 - protein, 7 aa, Mycobacterium
DKDIADA

SEQ ID NO: 252767 - protein, 7 aa, Mycobacterium
DKDIPGR

SEQ ID NO: 252768 - protein, 8 aa, Mycobacterium
DKDKPEGL

SEQ ID NO: 252769 - protein, 5 aa, Mycobacterium
DKDKY

SEQ ID NO: 252770 - protein, 5 aa, Mycobacterium
DKDNI

SEQ ID NO: 252771 - protein, 15 aa, Mycobacterium
DKDPAADLEPGTTPY

SEQ ID NO: 252772 - protein, 8 aa, Mycobacterium
DKDRIDTA

SEQ ID NO: 252773 - protein, 5 aa, Mycobacterium
DKDRV

SEQ ID NO: 252774 - protein, 15 aa, Mycobacterium
DKEAEARGVSRGPAL

SEQ ID NO: 252775 - protein, 7 aa, Mycobacterium
DKELGDA

SEQ ID NO: 252776 - protein, 10 aa, Mycobacterium
DKELNEESNF

SEQ ID NO: 252777 - protein, 10 aa, Mycobacterium
DKETDPAAAE

SEQ ID NO: 252778 - protein, 4 aa, Mycobacterium
DKFP

SEQ ID NO: 252779 - protein, 5 aa, Mycobacterium
DKFPR

SEQ ID NO: 252780 - protein, 17 aa, Mycobacterium
DKFSARSSGGDPSVERA

SEQ ID NO: 252781 - protein, 9 aa, Mycobacterium
DKGATHRAV

SEQ ID NO: 252782 - protein, 9 aa, Mycobacterium
DKGATVSGQ

SEQ ID NO: 252783 - protein, 5 aa, Mycobacterium
DKGER

SEQ ID NO: 252784 - protein, 12 aa, Mycobacterium
DKGLGPADEATY

SEQ ID NO: 252785 - protein, 10 aa, Mycobacterium
DKGPGMPAED

SEQ ID NO: 252786 - protein, 12 aa, Mycobacterium
DKGPGMSEQDAS

SEQ ID NO: 252787 - protein, 12 aa, Mycobacterium
DKGPGMTEQDAS

SEQ ID NO: 252788 - protein, 9 aa, Mycobacterium
DKGPITSGI

SEQ ID NO: 252789 - protein, 11 aa, Mycobacterium
DKGQYGESLGT

SEQ ID NO: 252790 - protein, 7 aa, Mycobacterium
DKGRAVE

SEQ ID NO: 252791 - protein, 5 aa, Mycobacterium
DKGRP

SEQ ID NO: 252792 - protein, 8 aa, Mycobacterium
DKGTEMTS

SEQ ID NO: 252793 - protein, 7 aa, Mycobacterium
DKHGDPV

SEQ ID NO: 252794 - protein, 5 aa, Mycobacterium
DKHNG

SEQ ID NO: 252795 - protein, 5 aa, Mycobacterium
DKHSR

SEQ ID NO: 252796 - protein, 7 aa, Mycobacterium
DKIAEST

SEQ ID NO: 252797 - protein, 5 aa, Mycobacterium
DKIPV

SEQ ID NO: 252798 - protein, 8 aa, Mycobacterium
DKKAAPKL

SEQ ID NO: 252799 - protein, 11 aa, Mycobacterium
DKKALPAPEYS

SEQ ID NO: 252800 - protein, 41 aa, Mycobacterium
DKKGGRARPNPSPAAETAAPEATKAPEAAAPSETRSYLRSN

SEQ ID NO: 252801 - protein, 14 aa, Mycobacterium
DKKMRTEEVDAERA

SEQ ID NO: 252802 - protein, 9 aa, Mycobacterium
DKKNPGAAE

SEQ ID NO: 252803 - protein, 7 aa, Mycobacterium
DKKPAEL

SEQ ID NO: 252804 - protein, 7 aa, Mycobacterium
DKKPDLS

SEQ ID NO: 252805 - protein, 8 aa, Mycobacterium
DKKPDPKL

SEQ ID NO: 252806 - protein, 8 aa, Mycobacterium
DKKPEPKL

SEQ ID NO: 252807 - protein, 7 aa, Mycobacterium
DKKSERR

SEQ ID NO: 252808 - protein, 16 aa, Mycobacterium
DKLASSAKPASSSKPI

SEQ ID NO: 252809 - protein, 7 aa, Mycobacterium
DKLGDAA

SEQ ID NO: 252810 - protein, 9 aa, Mycobacterium
DKLGDSAHE

SEQ ID NO: 252811 - protein, 14 aa, Mycobacterium
DKLGSASNAGTQVR

SEQ ID NO: 252812 - protein, 16 aa, Mycobacterium
DKLPAGEARPSPGGTP

SEQ ID NO: 252813 - protein, 25 aa, Mycobacterium
DKLSAAAAAYEGTDGEQAHRLIRTM

SEQ ID NO: 252814 - protein, 10 aa, Mycobacterium
DKLSDDDSAK

SEQ ID NO: 252815 - protein, 5 aa, Mycobacterium
DKNKY

SEQ ID NO: 252816 - protein, 9 aa, Mycobacterium
DKNNPGATE

SEQ ID NO: 252817 - protein, 66 aa, Mycobacterium
DKNVASDAADSAVDEQNGPAAEDRPRTTPPKGRPTPKRSEAAKRRGPVAPAPLTAAEARARRKEMR

SEQ ID NO: 252818 - protein, 8 aa, Mycobacterium
DKPAANRR

SEQ ID NO: 252819 - protein, 5 aa, Mycobacterium
DKPAG

SEQ ID NO: 252820 - protein, 8 aa, Mycobacterium
DKPALTAA

SEQ ID NO: 252821 - protein, 9 aa, Mycobacterium
DKPASGQKI

SEQ ID NO: 252822 - protein, 8 aa, Mycobacterium
DKPASSAT

SEQ ID NO: 252823 - protein, 15 aa, Mycobacterium
DKPDWRPSSCSNPDA

SEQ ID NO: 252824 - protein, 5 aa, Mycobacterium
DKPGF

SEQ ID NO: 252825 - protein, 8 aa, Mycobacterium
DKPGGMQT

SEQ ID NO: 252826 - protein, 10 aa, Mycobacterium
DKPGGPQAGL

SEQ ID NO: 252827 - protein, 31 aa, Mycobacterium
DKPGGTQKGLKDLQQGASRLAGGSREVAGGV

SEQ ID NO: 252828 - protein, 9 aa, Mycobacterium
DKPGPYSTT

SEQ ID NO: 252829 - protein, 7 aa, Mycobacterium
DKPGSAA

SEQ ID NO: 252830 - protein, 5 aa, Mycobacterium
DKPGV

SEQ ID NO: 252831 - protein, 10 aa, Mycobacterium
DKPKQRRAAR

SEQ ID NO: 252832 - protein, 7 aa, Mycobacterium
DKPLDDA

SEQ ID NO: 252833 - protein, 7 aa, Mycobacterium
DKPLGAD

SEQ ID NO: 252834 - protein, 8 aa, Mycobacterium
DKPLGAEA

SEQ ID NO: 252835 - protein, 8 aa, Mycobacterium
DKPLGDDA

SEQ ID NO: 252836 - protein, 7 aa, Mycobacterium
DKPLGDE

SEQ ID NO: 252837 - protein, 8 aa, Mycobacterium
DKPLGDEA

SEQ ID NO: 252838 - protein, 8 aa, Mycobacterium
DKPLGEEA

SEQ ID NO: 252839 - protein, 10 aa, Mycobacterium
DKPRQQRAAR

SEQ ID NO: 252840 - protein, 6 aa, Mycobacterium
DKPRTL

SEQ ID NO: 252841 - protein, 9 aa, Mycobacterium
DKPSAGTGA

SEQ ID NO: 252842 - protein, 9 aa, Mycobacterium
DKPTSGSGA

SEQ ID NO: 252843 - protein, 9 aa, Mycobacterium
DKPTSGTGA

SEQ ID NO: 252844 - protein, 7 aa, Mycobacterium
DKPVNAI

SEQ ID NO: 252845 - protein, 4 aa, Mycobacterium
DKPY

SEQ ID NO: 252846 - protein, 13 aa, Mycobacterium
DKPYLTPDDLEQG

SEQ ID NO: 252847 - protein, 4 aa, Mycobacterium
DKQF

SEQ ID NO: 252848 - protein, 10 aa, Mycobacterium
DKQGNRLGRG

SEQ ID NO: 252849 - protein, 8 aa, Mycobacterium
DKQKDLNT

SEQ ID NO: 252850 - protein, 8 aa, Mycobacterium
DKQLGDEA

SEQ ID NO: 252851 - protein, 8 aa, Mycobacterium
DKQPKPKL

SEQ ID NO: 252852 - protein, 11 aa, Mycobacterium
DKQQVAGAGPI

SEQ ID NO: 252853 - protein, 7 aa, Mycobacterium
DKQTGVA

SEQ ID NO: 252854 - protein, 5 aa, Mycobacterium
DKRAA

SEQ ID NO: 252855 - protein, 6 aa, Mycobacterium
DKRGPG

SEQ ID NO: 252856 - protein, 7 aa, Mycobacterium
DKRGPGK

SEQ ID NO: 252857 - protein, 14 aa, Mycobacterium
DKRGSVGRANPGAQ

SEQ ID NO: 252858 - protein, 6 aa, Mycobacterium
DKRGTL

SEQ ID NO: 252859 - protein, 43 aa, Mycobacterium
DKRKAKREAAQQLSDDEASTLDAPEAIDAPEPIGPAERFDNRG

SEQ ID NO: 252860 - protein, 7 aa, Mycobacterium
DKRKGGV

SEQ ID NO: 252861 - protein, 13 aa, Mycobacterium
DKRPDQRADTMST

SEQ ID NO: 252862 - protein, 7 aa, Mycobacterium
DKRPLRT

SEQ ID NO: 252863 - protein, 5 aa, Mycobacterium
DKRQG

SEQ ID NO: 252864 - protein, 7 aa, Mycobacterium
DKRQKSD

SEQ ID NO: 252865 - protein, 4 aa, Mycobacterium
DKRS

SEQ ID NO: 252866 - protein, 9 aa, Mycobacterium
DKRSASGAD

SEQ ID NO: 252867 - protein, 7 aa, Mycobacterium
DKSAQFK

SEQ ID NO: 252868 - protein, 9 aa, Mycobacterium
DKSARSSQD

SEQ ID NO: 252869 - protein, 8 aa, Mycobacterium
DKSEPPKG

SEQ ID NO: 252870 - protein, 7 aa, Mycobacterium
DKSNPDL

SEQ ID NO: 252871 - protein, 7 aa, Mycobacterium
DKSPAQA

SEQ ID NO: 252872 - protein, 10 aa, Mycobacterium
DKSPGTPRSP

SEQ ID NO: 252873 - protein, 7 aa, Mycobacterium
DKSPPRW

SEQ ID NO: 252874 - protein, 7 aa, Mycobacterium
DKSPSQA

SEQ ID NO: 252875 - protein, 6 aa, Mycobacterium
DKSRSD

SEQ ID NO: 252876 - protein, 11 aa, Mycobacterium
DKSRSDGSGHG

SEQ ID NO: 252877 - protein, 10 aa, Mycobacterium
DKSRSRAAGS

SEQ ID NO: 252878 - protein, 9 aa, Mycobacterium
DKSSDDTLR

SEQ ID NO: 252879 - protein, 24 aa, Mycobacterium
DKTAALDGDKTAAVPSPAPTDTVE

SEQ ID NO: 252880 - protein, 4 aa, Mycobacterium
DKTG

SEQ ID NO: 252881 - protein, 10 aa, Mycobacterium
DKTGTLTENG

SEQ ID NO: 252882 - protein, 8 aa, Mycobacterium
DKTGTLTQ

SEQ ID NO: 252883 - protein, 8 aa, Mycobacterium
DKTKVDHD

SEQ ID NO: 252884 - protein, 4 aa, Mycobacterium
DKTP

SEQ ID NO: 252885 - protein, 9 aa, Mycobacterium
DKTRAAGVS

SEQ ID NO: 252886 - protein, 8 aa, Mycobacterium
DKTSDDPL

SEQ ID NO: 252887 - protein, 10 aa, Mycobacterium
DKTSPKPDLS

SEQ ID NO: 252888 - protein, 10 aa, Mycobacterium
DKVGNKFNRP

SEQ ID NO: 252889 - protein, 5 aa, Mycobacterium
DKVNT

SEQ ID NO: 252890 - protein, 6 aa, Mycobacterium
DKVPAD

SEQ ID NO: 252891 - protein, 14 aa, Mycobacterium
DKVRSGAITAPLGS

SEQ ID NO: 252892 - protein, 7 aa, Mycobacterium
DKVSATQ

SEQ ID NO: 252893 - protein, 7 aa, Mycobacterium
DKVSEEL

SEQ ID NO: 252894 - protein, 5 aa, Mycobacterium
DKVTG

SEQ ID NO: 252895 - protein, 8 aa, Mycobacterium
DKVTGADV

SEQ ID NO: 252896 - protein, 20 aa, Mycobacterium
DKYPEVGSERQDLRQYPGGS

SEQ ID NO: 252897 - protein, 6 aa, Mycobacterium
DKYPNG

SEQ ID NO: 252898 - protein, 16 aa, Mycobacterium
DKYQREAIAGGTPRDV

SEQ ID NO: 252899 - protein, 8 aa, Mycobacterium
DLADPSYQ

SEQ ID NO: 252900 - protein, 16 aa, Mycobacterium
DLAEGTGKLRAGGQEL

SEQ ID NO: 252901 - protein, 5 aa, Mycobacterium
DLAKA

SEQ ID NO: 252902 - protein, 4 aa, Mycobacterium
DLAP

SEQ ID NO: 252903 - protein, 25 aa, Mycobacterium
DLAPEAGAQSSQTASQSDAVDTGSS

SEQ ID NO: 252904 - protein, 18 aa, Mycobacterium
DLAPGPLPDRIEGDAQLG

SEQ ID NO: 252905 - protein, 13 aa, Mycobacterium
DLAPPTARDPRGV

SEQ ID NO: 252906 - protein, 16 aa, Mycobacterium
DLAPPTSGDPRGTGLA

SEQ ID NO: 252907 - protein, 10 aa, Mycobacterium
DLAQPPPGSI

SEQ ID NO: 252908 - protein, 21 aa, Mycobacterium
DLAQTAPKDQTWQSMLLPPPV

SEQ ID NO: 252909 - protein, 5 aa, Mycobacterium
DLARQ

SEQ ID NO: 252910 - protein, 13 aa, Mycobacterium
DLATAHAASTAPL

SEQ ID NO: 252911 - protein, 6 aa, Mycobacterium
DLDAGG

SEQ ID NO: 252912 - protein, 5 aa, Mycobacterium
DLDEG

SEQ ID NO: 252913 - protein, 17 aa, Mycobacterium
DLDGPGARDPGGPARRI

SEQ ID NO: 252914 - protein, 6 aa, Mycobacterium
DLDGRG

SEQ ID NO: 252915 - protein, 8 aa, Mycobacterium
DLDGSGGH

SEQ ID NO: 252916 - protein, 11 aa, Mycobacterium
DLDNKGLSTLS

SEQ ID NO: 252917 - protein, 10 aa, Mycobacterium
DLDNKTLSAV

SEQ ID NO: 252918 - protein, 8 aa, Mycobacterium
DLDPAGKA

SEQ ID NO: 252919 - protein, 6 aa, Mycobacterium
DLDPEE

SEQ ID NO: 252920 - protein, 12 aa, Mycobacterium
DLDPSDRPSVPK

SEQ ID NO: 252921 - protein, 8 aa, Mycobacterium
DLDPTGKA

SEQ ID NO: 252922 - protein, 8 aa, Mycobacterium
DLDPTLRR

SEQ ID NO: 252923 - protein, 5 aa, Mycobacterium
DLDQR

SEQ ID NO: 252924 - protein, 8 aa, Mycobacterium
DLDRSGKA

SEQ ID NO: 252925 - protein, 13 aa, Mycobacterium
DLEDDGQITKQPF

SEQ ID NO: 252926 - protein, 20 aa, Mycobacterium
DLEEAPSAHTGAETDSGTYE

SEQ ID NO: 252927 - protein, 4 aa, Mycobacterium
DLEG

SEQ ID NO: 252928 - protein, 6 aa, Mycobacterium
DLEGPD

SEQ ID NO: 252929 - protein, 14 aa, Mycobacterium
DLERRKREANDALQ

SEQ ID NO: 252930 - protein, 14 aa, Mycobacterium
DLERRKREAQDALQ

SEQ ID NO: 252931 - protein, 4 aa, Mycobacterium
DLGA

SEQ ID NO: 252932 - protein, 11 aa, Mycobacterium
DLGAAQANRAL

SEQ ID NO: 252933 - protein, 10 aa, Mycobacterium
DLGAEDEAGE

SEQ ID NO: 252934 - protein, 10 aa, Mycobacterium
DLGAESVRRA

SEQ ID NO: 252935 - protein, 5 aa, Mycobacterium
DLGAS

SEQ ID NO: 252936 - protein, 12 aa, Mycobacterium
DLGDSAGNGLTA

SEQ ID NO: 252937 - protein, 4 aa, Mycobacterium
DLGE

SEQ ID NO: 252938 - protein, 7 aa, Mycobacterium
DLGEDSR

SEQ ID NO: 252939 - protein, 8 aa, Mycobacterium
DLGGQGVR

SEQ ID NO: 252940 - protein, 9 aa, Mycobacterium
DLGGSDPTI

SEQ ID NO: 252941 - protein, 6 aa, Mycobacterium
DLGGSK

SEQ ID NO: 252942 - protein, 5 aa, Mycobacterium
DLGHR

SEQ ID NO: 252943 - protein, 10 aa, Mycobacterium
DLGPDSPAGV

SEQ ID NO: 252944 - protein, 17 aa, Mycobacterium
DLGPPKPTDIDPAIPPG

SEQ ID NO: 252945 - protein, 15 aa, Mycobacterium
DLGQNANNLNKSQFE

SEQ ID NO: 252946 - protein, 5 aa, Mycobacterium
DLGQT

SEQ ID NO: 252947 - protein, 20 aa, Mycobacterium
DLGRAQQGAKGAGGNGVRTE

SEQ ID NO: 252948 - protein, 15 aa, Mycobacterium
DLGRNANDLNKPQFE

SEQ ID NO: 252949 - protein, 53 aa, Mycobacterium
DLGSANYPHDESDPESPDEQPAAPARARRPRLRRRSTAKTPRPGKDEPKPRRR

SEQ ID NO: 252950 - protein, 10 aa, Mycobacterium
DLGSGSTGRK

SEQ ID NO: 252951 - protein, 16 aa, Mycobacterium
DLGSRNVSAQARTVSA

SEQ ID NO: 252952 - protein, 8 aa, Mycobacterium
DLGSRTMR

SEQ ID NO: 252953 - protein, 15 aa, Mycobacterium
DLGTNTVKGLPDAVG

SEQ ID NO: 252954 - protein, 5 aa, Mycobacterium
DLGYR

SEQ ID NO: 252955 - protein, 6 aa, Mycobacterium
DLKTAG

SEQ ID NO: 252956 - protein, 4 aa, Mycobacterium
DLMP

SEQ ID NO: 252957 - protein, 9 aa, Mycobacterium
DLNANAGKG

SEQ ID NO: 252958 - protein, 6 aa, Mycobacterium
DLNESD

SEQ ID NO: 252959 - protein, 4 aa, Mycobacterium
DLNR

SEQ ID NO: 252960 - protein, 9 aa, Mycobacterium
DLPAATATQ

SEQ ID NO: 252961 - protein, 9 aa, Mycobacterium
DLPADPDGL

SEQ ID NO: 252962 - protein, 6 aa, Mycobacterium
DLPAGE

SEQ ID NO: 252963 - protein, 8 aa, Mycobacterium
DLPANQGY

SEQ ID NO: 252964 - protein, 8 aa, Mycobacterium
DLPAQNDV

SEQ ID NO: 252965 - protein, 7 aa, Mycobacterium
DLPARSR

SEQ ID NO: 252966 - protein, 9 aa, Mycobacterium
DLPASTKDG

SEQ ID NO: 252967 - protein, 11 aa, Mycobacterium
DLPAYRRNPPA

SEQ ID NO: 252968 - protein, 7 aa, Mycobacterium
DLPDESR

SEQ ID NO: 252969 - protein, 13 aa, Mycobacterium
DLPDSEVAASAAG

SEQ ID NO: 252970 - protein, 11 aa, Mycobacterium
DLPEDDREPAA

SEQ ID NO: 252971 - protein, 17 aa, Mycobacterium
DLPEESRASGFGRSEST

SEQ ID NO: 252972 - protein, 8 aa, Mycobacterium
DLPESDPA

SEQ ID NO: 252973 - protein, 7 aa, Mycobacterium
DLPESTN

SEQ ID NO: 252974 - protein, 10 aa, Mycobacterium
DLPGDTTPAS

SEQ ID NO: 252975 - protein, 7 aa, Mycobacterium
DLPGGEL

SEQ ID NO: 252976 - protein, 20 aa, Mycobacterium
DLPGSPEFNAPSVAAPGFPD

SEQ ID NO: 252977 - protein, 7 aa, Mycobacterium
DLPISTT

SEQ ID NO: 252978 - protein, 9 aa, Mycobacterium
DLPNTPGAA

SEQ ID NO: 252979 - protein, 8 aa, Mycobacterium
DLPPRTPV

SEQ ID NO: 252980 - protein, 7 aa, Mycobacterium
DLPPSPF

SEQ ID NO: 252981 - protein, 8 aa, Mycobacterium
DLPQDSRG

SEQ ID NO: 252982 - protein, 5 aa, Mycobacterium
DLPQP

SEQ ID NO: 252983 - protein, 8 aa, Mycobacterium
DLPQPRSD

SEQ ID NO: 252984 - protein, 7 aa, Mycobacterium
DLPQTTV

SEQ ID NO: 252985 - protein, 8 aa, Mycobacterium
DLPRDGKA

SEQ ID NO: 252986 - protein, 14 aa, Mycobacterium
DLPRRPSGRIERDA

SEQ ID NO: 252987 - protein, 11 aa, Mycobacterium
DLPRSVKPDNA

SEQ ID NO: 252988 - protein, 14 aa, Mycobacterium
DLPSDPAELSEKEP

SEQ ID NO: 252989 - protein, 9 aa, Mycobacterium
DLPSGPGQV

SEQ ID NO: 252990 - protein, 8 aa, Mycobacterium
DLPYPEGV

SEQ ID NO: 252991 - protein, 11 aa, Mycobacterium
DLQRPDAPWGK

SEQ ID NO: 252992 - protein, 8 aa, Mycobacterium
DLRDPQAV

SEQ ID NO: 252993 - protein, 8 aa, Mycobacterium
DLRDPQTM

SEQ ID NO: 252994 - protein, 12 aa, Mycobacterium
DLRDPRAVTEQY

SEQ ID NO: 252995 - protein, 6 aa, Mycobacterium
DLRDPS

SEQ ID NO: 252996 - protein, 4 aa, Mycobacterium
DLRE

SEQ ID NO: 252997 - protein, 6 aa, Mycobacterium
DLRNPR

SEQ ID NO: 252998 - protein, 6 aa, Mycobacterium
DLRNPS

SEQ ID NO: 252999 - protein, 5 aa, Mycobacterium
DLRPD

SEQ ID NO: 253000 - protein, 15 aa, Mycobacterium
DLRPDQSYPPKPPVG

SEQ ID NO: 253001 - protein, 8 aa, Mycobacterium
DLRPEDKA

SEQ ID NO: 253002 - protein, 5 aa, Mycobacterium
DLRPG

SEQ ID NO: 253003 - protein, 8 aa, Mycobacterium
DLRPGSAL

SEQ ID NO: 253004 - protein, 6 aa, Mycobacterium
DLRPQY

SEQ ID NO: 253005 - protein, 11 aa, Mycobacterium
DLRSDPPSGRH

SEQ ID NO: 253006 - protein, 8 aa, Mycobacterium
DLRSPKAL

SEQ ID NO: 253007 - protein, 7 aa, Mycobacterium
DLRSPTA

SEQ ID NO: 253008 - protein, 6 aa, Mycobacterium
DLRTAG

SEQ ID NO: 253009 - protein, 23 aa, Mycobacterium
DLSAPDARGSSETTVDTAPRRLS

SEQ ID NO: 253010 - protein, 9 aa, Mycobacterium
DLSDADLDD

SEQ ID NO: 253011 - protein, 6 aa, Mycobacterium
DLSDPA

SEQ ID NO: 253012 - protein, 9 aa, Mycobacterium
DLSEADRRD

SEQ ID NO: 253013 - protein, 10 aa, Mycobacterium
DLSESPDNAE

SEQ ID NO: 253014 - protein, 16 aa, Mycobacterium
DLSETLDNVGDAGLPE

SEQ ID NO: 253015 - protein, 7 aa, Mycobacterium
DLSGAGT

SEQ ID NO: 253016 - protein, 8 aa, Mycobacterium
DLSGAGTA

SEQ ID NO: 253017 - protein, 12 aa, Mycobacterium
DLSGGEAFTASS

SEQ ID NO: 253018 - protein, 7 aa, Mycobacterium
DLSGLGD

SEQ ID NO: 253019 - protein, 7 aa, Mycobacterium
DLSNPDE

SEQ ID NO: 253020 - protein, 13 aa, Mycobacterium
DLSNTTHETTRLT

SEQ ID NO: 253021 - protein, 6 aa, Mycobacterium
DLSPDA

SEQ ID NO: 253022 - protein, 10 aa, Mycobacterium
DLSPGTPLTT

SEQ ID NO: 253023 - protein, 9 aa, Mycobacterium
DLSPRTPTI

SEQ ID NO: 253024 - protein, 7 aa, Mycobacterium
DLSSLGD

SEQ ID NO: 253025 - protein, 7 aa, Mycobacterium
DLTDAQR

SEQ ID NO: 253026 - protein, 10 aa, Mycobacterium
DLTDTATATR

SEQ ID NO: 253027 - protein, 7 aa, Mycobacterium
DLTERDR

SEQ ID NO: 253028 - protein, 9 aa, Mycobacterium
DLTGAEPTV

SEQ ID NO: 253029 - protein, 5 aa, Mycobacterium
DLTGE

SEQ ID NO: 253030 - protein, 5 aa, Mycobacterium
DLTGN

SEQ ID NO: 253031 - protein, 7 aa, Mycobacterium
DLTGPGV

SEQ ID NO: 253032 - protein, 10 aa, Mycobacterium
DLTNTAKATR

SEQ ID NO: 253033 - protein, 7 aa, Mycobacterium
DLTPATK

SEQ ID NO: 253034 - protein, 7 aa, Mycobacterium
DLTPDTD

SEQ ID NO: 253035 - protein, 7 aa, Mycobacterium
DLTPGDS

SEQ ID NO: 253036 - protein, 13 aa, Mycobacterium
DLTPNSGTKAQTI

SEQ ID NO: 253037 - protein, 10 aa, Mycobacterium
DLTPSQRGRP

SEQ ID NO: 253038 - protein, 5 aa, Mycobacterium
DLTRG

SEQ ID NO: 253039 - protein, 6 aa, Mycobacterium
DLTSHD

SEQ ID NO: 253040 - protein, 17 aa, Mycobacterium
DLTSRNVSAQASTVSAG

SEQ ID NO: 253041 - protein, 6 aa, Mycobacterium
DLTSSG

SEQ ID NO: 253042 - protein, 17 aa, Mycobacterium
DLTTDTAGTNTAALNQS

SEQ ID NO: 253043 - protein, 14 aa, Mycobacterium
DLTTNSTGTDTAAL

SEQ ID NO: 253044 - protein, 9 aa, Mycobacterium
DLYGRRKRD

SEQ ID NO: 253045 - protein, 9 aa, Mycobacterium
DLYSSNTRS

SEQ ID NO: 253046 - protein, 9 aa, Mycobacterium
DLYSSTPRA

SEQ ID NO: 253047 - protein, 5 aa, Mycobacterium
DMDTE

SEQ ID NO: 253048 - protein, 14 aa, Mycobacterium
DMPDTGGARPSGGV

SEQ ID NO: 253049 - protein, 8 aa, Mycobacterium
DMPGEQPA

SEQ ID NO: 253050 - protein, 7 aa, Mycobacterium
DMPGPDG

SEQ ID NO: 253051 - protein, 8 aa, Mycobacterium
DMPGRDSG

SEQ ID NO: 253052 - protein, 6 aa, Mycobacterium
DMPNSA

SEQ ID NO: 253053 - protein, 4 aa, Mycobacterium
DMPT

SEQ ID NO: 253054 - protein, 7 aa, Mycobacterium
DMRNPES

SEQ ID NO: 253055 - protein, 6 aa, Mycobacterium
DMRNSG

SEQ ID NO: 253056 - protein, 7 aa, Mycobacterium
DMSDGSR

SEQ ID NO: 253057 - protein, 6 aa, Mycobacterium
DMSGRA

SEQ ID NO: 253058 - protein, 7 aa, Mycobacterium
DMSGREA

SEQ ID NO: 253059 - protein, 12 aa, Mycobacterium
DMSPNTGNKAQT

SEQ ID NO: 253060 - protein, 6 aa, Mycobacterium
DMTGTF

SEQ ID NO: 253061 - protein, 6 aa, Mycobacterium
DNAAAM

SEQ ID NO: 253062 - protein, 6 aa, Mycobacterium
DNAAAT

SEQ ID NO: 253063 - protein, 9 aa, Mycobacterium
DNAATATTL

SEQ ID NO: 253064 - protein, 7 aa, Mycobacterium
DNAATDI

SEQ ID NO: 253065 - protein, 16 aa, Mycobacterium
DNADALTSSGRAKVTT

SEQ ID NO: 253066 - protein, 15 aa, Mycobacterium
DNADANSCSQSPSLT

SEQ ID NO: 253067 - protein, 5 aa, Mycobacterium
DNADR

SEQ ID NO: 253068 - protein, 7 aa, Mycobacterium
DNAEAEA

SEQ ID NO: 253069 - protein, 12 aa, Mycobacterium
DNAEDEALGAAR

SEQ ID NO: 253070 - protein, 6 aa, Mycobacterium
DNAEVA

SEQ ID NO: 253071 - protein, 16 aa, Mycobacterium
DNAGALSDSGRSTVTA

SEQ ID NO: 253072 - protein, 5 aa, Mycobacterium
DNAKN

SEQ ID NO: 253073 - protein, 8 aa, Mycobacterium
DNAPGTVV

SEQ ID NO: 253074 - protein, 7 aa, Mycobacterium
DNARTAA

SEQ ID NO: 253075 - protein, 8 aa, Mycobacterium
DNARTAGA

SEQ ID NO: 253076 - protein, 8 aa, Mycobacterium
DNARTAKA

SEQ ID NO: 253077 - protein, 5 aa, Mycobacterium
DNASG

SEQ ID NO: 253078 - protein, 11 aa, Mycobacterium
DNASTDATPQI

SEQ ID NO: 253079 - protein, 8 aa, Mycobacterium
DNASTDST

SEQ ID NO: 253080 - protein, 5 aa, Mycobacterium
DNDAK

SEQ ID NO: 253081 - protein, 14 aa, Mycobacterium
DNDGIEDTNVRSRA

SEQ ID NO: 253082 - protein, 11 aa, Mycobacterium
DNDHTQAKSGV

SEQ ID NO: 253083 - protein, 7 aa, Mycobacterium
DNDIGDG

SEQ ID NO: 253084 - protein, 10 aa, Mycobacterium
DNDPEAPPPK

SEQ ID NO: 253085 - protein, 15 aa, Mycobacterium
DNEAESSAAGRGKTV

SEQ ID NO: 253086 - protein, 7 aa, Mycobacterium
DNEAVAR

SEQ ID NO: 253087 - protein, 7 aa, Mycobacterium
DNEDIKT

SEQ ID NO: 253088 - protein, 12 aa, Mycobacterium
DNEHVQRARRQG

SEQ ID NO: 253089 - protein, 5 aa, Mycobacterium
DNEIR

SEQ ID NO: 253090 - protein, 7 aa, Mycobacterium
DNETEAY

SEQ ID NO: 253091 - protein, 7 aa, Mycobacterium
DNFTRSA

SEQ ID NO: 253092 - protein, 4 aa, Mycobacterium
DNGA

SEQ ID NO: 253093 - protein, 5 aa, Mycobacterium
DNGAE

SEQ ID NO: 253094 - protein, 9 aa, Mycobacterium
DNGDGAGIR

SEQ ID NO: 253095 - protein, 7 aa, Mycobacterium
DNGDGIA

SEQ ID NO: 253096 - protein, 8 aa, Mycobacterium
DNGELSPG

SEQ ID NO: 253097 - protein, 4 aa, Mycobacterium
DNGG

SEQ ID NO: 253098 - protein, 5 aa, Mycobacterium
DNGGA

SEQ ID NO: 253099 - protein, 7 aa, Mycobacterium
DNGGSGY

SEQ ID NO: 253100 - protein, 5 aa, Mycobacterium
DNGHM

SEQ ID NO: 253101 - protein, 10 aa, Mycobacterium
DNGKELPQGE

SEQ ID NO: 253102 - protein, 9 aa, Mycobacterium
DNGNELPRG

SEQ ID NO: 253103 - protein, 10 aa, Mycobacterium
DNGNEVSQGQ

SEQ ID NO: 253104 - protein, 10 aa, Mycobacterium
DNGPGISPQE

SEQ ID NO: 253105 - protein, 12 aa, Mycobacterium
DNGRDEPSADGV

SEQ ID NO: 253106 - protein, 10 aa, Mycobacterium
DNGRGVPEDE

SEQ ID NO: 253107 - protein, 11 aa, Mycobacterium
DNGSGVPEDER

SEQ ID NO: 253108 - protein, 11 aa, Mycobacterium
DNGSGVPEEER

SEQ ID NO: 253109 - protein, 6 aa, Mycobacterium
DNGTAS

SEQ ID NO: 253110 - protein, 7 aa, Mycobacterium
DNGTTSI

SEQ ID NO: 253111 - protein, 10 aa, Mycobacterium
DNGVEQARGH

SEQ ID NO: 253112 - protein, 11 aa, Mycobacterium
DNGVTRMPPGQ

SEQ ID NO: 253113 - protein, 8 aa, Mycobacterium
DNGYPGLK

SEQ ID NO: 253114 - protein, 5 aa, Mycobacterium
DNHEG

SEQ ID NO: 253115 - protein, 11 aa, Mycobacterium
DNHSKVTDQQV

SEQ ID NO: 253116 - protein, 8 aa, Mycobacterium
DNHTTAAA

SEQ ID NO: 253117 - protein, 8 aa, Mycobacterium
DNIDEARS

SEQ ID NO: 253118 - protein, 6 aa, Mycobacterium
DNIEPA

SEQ ID NO: 253119 - protein, 4 aa, Mycobacterium
DNKA

SEQ ID NO: 253120 - protein, 6 aa, Mycobacterium
DNKGSA

SEQ ID NO: 253121 - protein, 7 aa, Mycobacterium
DNLGNPA

SEQ ID NO: 253122 - protein, 5 aa, Mycobacterium
DNLGR

SEQ ID NO: 253123 - protein, 15 aa, Mycobacterium
DNLPSDAARSVKTYP

SEQ ID NO: 253124 - protein, 7 aa, Mycobacterium
DNLTETF

SEQ ID NO: 253125 - protein, 4 aa, Mycobacterium
DNNA

SEQ ID NO: 253126 - protein, 11 aa, Mycobacterium
DNNAPTHPEIT

SEQ ID NO: 253127 - protein, 7 aa, Mycobacterium
DNNGEGG

SEQ ID NO: 253128 - protein, 14 aa, Mycobacterium
DNNSHATGTAEDSR

SEQ ID NO: 253129 - protein, 9 aa, Mycobacterium
DNPAAAGQV

SEQ ID NO: 253130 - protein, 8 aa, Mycobacterium
DNPASAAA

SEQ ID NO: 253131 - protein, 6 aa, Mycobacterium
DNPDGA

SEQ ID NO: 253132 - protein, 9 aa, Mycobacterium
DNPDLAPKA

SEQ ID NO: 253133 - protein, 28 aa, Mycobacterium
DNPEDKVPPTGESGTAVGRSRKRFSDDP

SEQ ID NO: 253134 - protein, 6 aa, Mycobacterium
DNPEDP

SEQ ID NO: 253135 - protein, 7 aa, Mycobacterium
DNPEDPK

SEQ ID NO: 253136 - protein, 10 aa, Mycobacterium
DNPGPTDPAT

SEQ ID NO: 253137 - protein, 4 aa, Mycobacterium
DNPK

SEQ ID NO: 253138 - protein, 6 aa, Mycobacterium
DNPLTA

SEQ ID NO: 253139 - protein, 5 aa, Mycobacterium
DNPPG

SEQ ID NO: 253140 - protein, 7 aa, Mycobacterium
DNPQRVA

SEQ ID NO: 253141 - protein, 22 aa, Mycobacterium
DNPSGPRPLDPPPSPAPPPDAF

SEQ ID NO: 253142 - protein, 4 aa, Mycobacterium
DNPT

SEQ ID NO: 253143 - protein, 6 aa, Mycobacterium
DNPTDL

SEQ ID NO: 253144 - protein, 9 aa, Mycobacterium
DNPTKSYLQ

SEQ ID NO: 253145 - protein, 4 aa, Mycobacterium
DNPY

SEQ ID NO: 253146 - protein, 5 aa, Mycobacterium
DNPYE

SEQ ID NO: 253147 - protein, 8 aa, Mycobacterium
DNPYRPEF

SEQ ID NO: 253148 - protein, 11 aa, Mycobacterium
DNQAAADSVAT

SEQ ID NO: 253149 - protein, 8 aa, Mycobacterium
DNQATADR

SEQ ID NO: 253150 - protein, 12 aa, Mycobacterium
DNQPLTAKDQRN

SEQ ID NO: 253151 - protein, 7 aa, Mycobacterium
DNQTAAY

SEQ ID NO: 253152 - protein, 6 aa, Mycobacterium
DNRAVA

SEQ ID NO: 253153 - protein, 6 aa, Mycobacterium
DNRPTE

SEQ ID NO: 253154 - protein, 9 aa, Mycobacterium
DNRPTQAAG

SEQ ID NO: 253155 - protein, 9 aa, Mycobacterium
DNRPVNSAD

SEQ ID NO: 253156 - protein, 5 aa, Mycobacterium
DNRRA

SEQ ID NO: 253157 - protein, 14 aa, Mycobacterium
DNRRAAGRLAEEAG

SEQ ID NO: 253158 - protein, 8 aa, Mycobacterium
DNRTNQIC

SEQ ID NO: 253159 - protein, 4 aa, Mycobacterium
DNRW

SEQ ID NO: 253160 - protein, 6 aa, Mycobacterium
DNSAGL

SEQ ID NO: 253161 - protein, 17 aa, Mycobacterium
DNSAQRHARLSGQLTGA

SEQ ID NO: 253162 - protein, 4 aa, Mycobacterium
DNSD

SEQ ID NO: 253163 - protein, 5 aa, Mycobacterium
DNSDT

SEQ ID NO: 253164 - protein, 7 aa, Mycobacterium
DNSEQAV

SEQ ID NO: 253165 - protein, 8 aa, Mycobacterium
DNSESVKA

SEQ ID NO: 253166 - protein, 4 aa, Mycobacterium
DNSG

SEQ ID NO: 253167 - protein, 6 aa, Mycobacterium
DNSGEI

SEQ ID NO: 253168 - protein, 6 aa, Mycobacterium
DNSGSA

SEQ ID NO: 253169 - protein, 10 aa, Mycobacterium
DNSGSASGAT

SEQ ID NO: 253170 - protein, 7 aa, Mycobacterium
DNSKNAV

SEQ ID NO: 253171 - protein, 7 aa, Mycobacterium
DNSKSAV

SEQ ID NO: 253172 - protein, 16 aa, Mycobacterium
DNSNDSEPSAAPPVTY

SEQ ID NO: 253173 - protein, 8 aa, Mycobacterium
DNSPATER

SEQ ID NO: 253174 - protein, 9 aa, Mycobacterium
DNSSSAPAQ

SEQ ID NO: 253175 - protein, 4 aa, Mycobacterium
DNST

SEQ ID NO: 253176 - protein, 14 aa, Mycobacterium
DNSTDEPASHGGGQ

SEQ ID NO: 253177 - protein, 9 aa, Mycobacterium
DNSTPPQGV

SEQ ID NO: 253178 - protein, 10 aa, Mycobacterium
DNTAETTATG

SEQ ID NO: 253179 - protein, 9 aa, Mycobacterium
DNTAETVAT

SEQ ID NO: 253180 - protein, 31 aa, Mycobacterium
DNTFDPSQDIGRQADRQMGNPSVSSPFEPGS

SEQ ID NO: 253181 - protein, 19 aa, Mycobacterium
DNTFDPSQNLGKQGNREMG

SEQ ID NO: 253182 - protein, 18 aa, Mycobacterium
DNTFNPAQDVSRQENRQL

SEQ ID NO: 253183 - protein, 13 aa, Mycobacterium
DNTFTTEPSNLAS

SEQ ID NO: 253184 - protein, 6 aa, Mycobacterium
DNTPEG

SEQ ID NO: 253185 - protein, 8 aa, Mycobacterium
DNTSAIPA

SEQ ID NO: 253186 - protein, 6 aa, Mycobacterium
DNTSGV

SEQ ID NO: 253187 - protein, 4 aa, Mycobacterium
DNTT

SEQ ID NO: 253188 - protein, 5 aa, Mycobacterium
DNTTR

SEQ ID NO: 253189 - protein, 6 aa, Mycobacterium
DNTYPG

SEQ ID NO: 253190 - protein, 4 aa, Mycobacterium
DNVD

SEQ ID NO: 253191 - protein, 38 aa, Mycobacterium
DNVEHDAAEKVSAVDSTDEDPAQDSKDASDSDEGGSGM

SEQ ID NO: 253192 - protein, 10 aa, Mycobacterium
DNVGTKQQEL

SEQ ID NO: 253193 - protein, 8 aa, Mycobacterium
DNVPQSAA

SEQ ID NO: 253194 - protein, 7 aa, Mycobacterium
DNVRGGF

SEQ ID NO: 253195 - protein, 5 aa, Mycobacterium
DNVSQ

SEQ ID NO: 253196 - protein, 7 aa, Mycobacterium
DNVSTDQ

SEQ ID NO: 253197 - protein, 5 aa, Mycobacterium
DNYIK

SEQ ID NO: 253198 - protein, 7 aa, Mycobacterium
DNYNGDV

SEQ ID NO: 253199 - protein, 5 aa, Mycobacterium
DNYSG

SEQ ID NO: 253200 - protein, 14 aa, Mycobacterium
DPAAAAEQPEEPST

SEQ ID NO: 253201 - protein, 10 aa, Mycobacterium
DPAAAPKTRS

SEQ ID NO: 253202 - protein, 8 aa, Mycobacterium
DPAAAQSQ

SEQ ID NO: 253203 - protein, 13 aa, Mycobacterium
DPAAKPSARVAAG

SEQ ID NO: 253204 - protein, 5 aa, Mycobacterium
DPAAL

SEQ ID NO: 253205 - protein, 8 aa, Mycobacterium
DPAAPLSY

SEQ ID NO: 253206 - protein, 7 aa, Mycobacterium
DPAAPTR

SEQ ID NO: 253207 - protein, 6 aa, Mycobacterium
DPADRV

SEQ ID NO: 253208 - protein, 7 aa, Mycobacterium
DPAEADT

SEQ ID NO: 253209 - protein, 6 aa, Mycobacterium
DPAEDA

SEQ ID NO: 253210 - protein, 13 aa, Mycobacterium
DPAEGDRAPAGAF

SEQ ID NO: 253211 - protein, 12 aa, Mycobacterium
DPAEGGAASAAI

SEQ ID NO: 253212 - protein, 11 aa, Mycobacterium
DPAEPHRASTP

SEQ ID NO: 253213 - protein, 12 aa, Mycobacterium
DPAERAQLSGEL

SEQ ID NO: 253214 - protein, 13 aa, Mycobacterium
DPAERPASAEEFG

SEQ ID NO: 253215 - protein, 6 aa, Mycobacterium
DPAERV

SEQ ID NO: 253216 - protein, 9 aa, Mycobacterium
DPAGAHSDA

SEQ ID NO: 253217 - protein, 5 aa, Mycobacterium
DPAGD

SEQ ID NO: 253218 - protein, 12 aa, Mycobacterium
DPAGDAGHEEHP

SEQ ID NO: 253219 - protein, 13 aa, Mycobacterium
DPAGDAGYTDHPP

SEQ ID NO: 253220 - protein, 5 aa, Mycobacterium
DPAGG

SEQ ID NO: 253221 - protein, 7 aa, Mycobacterium
DPAGGVR

SEQ ID NO: 253222 - protein, 6 aa, Mycobacterium
DPAGIT

SEQ ID NO: 253223 - protein, 7 aa, Mycobacterium
DPAGITA

SEQ ID NO: 253224 - protein, 7 aa, Mycobacterium
DPAGLPA

SEQ ID NO: 253225 - protein, 15 aa, Mycobacterium
DPAGNAGYPDDHPPR

SEQ ID NO: 253226 - protein, 7 aa, Mycobacterium
DPAGQPL

SEQ ID NO: 253227 - protein, 16 aa, Mycobacterium
DPAGQPLRGGFPDPNL

SEQ ID NO: 253228 - protein, 8 aa, Mycobacterium
DPAGSADK

SEQ ID NO: 253229 - protein, 10 aa, Mycobacterium
DPAGSKTEFQ

SEQ ID NO: 253230 - protein, 17 aa, Mycobacterium
DPAGTTEGRAAPNGNVS

SEQ ID NO: 253231 - protein, 83 aa, Mycobacterium
DPAGYNPYGQAPYGYGQPQAGGQYPYPPTGPYTNPQGGAPSYGPGTYPPQQFPQAGQPYGTGPGWPTGPYSPGPPPKGPGSKA

SEQ ID NO: 253232 - protein, 12 aa, Mycobacterium
DPAHAERVAAET

SEQ ID NO: 253233 - protein, 6 aa, Mycobacterium
DPAHAR

SEQ ID NO: 253234 - protein, 7 aa, Mycobacterium
DPAHKTQ

SEQ ID NO: 253235 - protein, 7 aa, Mycobacterium
DPAHPDA

SEQ ID NO: 253236 - protein, 4 aa, Mycobacterium
DPAK

SEQ ID NO: 253237 - protein, 16 aa, Mycobacterium
DPAKEAESGAPEQADQ

SEQ ID NO: 253238 - protein, 4 aa, Mycobacterium
DPAL

SEQ ID NO: 253239 - protein, 6 aa, Mycobacterium
DPALPP

SEQ ID NO: 253240 - protein, 6 aa, Mycobacterium
DPALPR

SEQ ID NO: 253241 - protein, 12 aa, Mycobacterium
DPALRYPTAGEL

SEQ ID NO: 253242 - protein, 8 aa, Mycobacterium
DPALSSKT

SEQ ID NO: 253243 - protein, 12 aa, Mycobacterium
DPALTSASGATN

SEQ ID NO: 253244 - protein, 8 aa, Mycobacterium
DPANGDTT

SEQ ID NO: 253245 - protein, 7 aa, Mycobacterium
DPANGGP

SEQ ID NO: 253246 - protein, 12 aa, Mycobacterium
DPAPEDNSESTL

SEQ ID NO: 253247 - protein, 5 aa, Mycobacterium
DPAQA

SEQ ID NO: 253248 - protein, 8 aa, Mycobacterium
DPAQEEVA

SEQ ID NO: 253249 - protein, 13 aa, Mycobacterium
DPAQGQQRASTST

SEQ ID NO: 253250 - protein, 26 aa, Mycobacterium
DPAQHRQTVTQPVPATTPAPIAAPEP

SEQ ID NO: 253251 - protein, 12 aa, Mycobacterium
DPAQPGPLGQPL

SEQ ID NO: 253252 - protein, 6 aa, Mycobacterium
DPAQPT

SEQ ID NO: 253253 - protein, 12 aa, Mycobacterium
DPARNDSAATIA

SEQ ID NO: 253254 - protein, 5 aa, Mycobacterium
DPARP

SEQ ID NO: 253255 - protein, 8 aa, Mycobacterium
DPARTRRL

SEQ ID NO: 253256 - protein, 7 aa, Mycobacterium
DPASELV

SEQ ID NO: 253257 - protein, 10 aa, Mycobacterium
DPASESARAA

SEQ ID NO: 253258 - protein, 8 aa, Mycobacterium
DPATAEGI

SEQ ID NO: 253259 - protein, 8 aa, Mycobacterium
DPATDTYR

SEQ ID NO: 253260 - protein, 8 aa, Mycobacterium
DPATGEVD

SEQ ID NO: 253261 - protein, 9 aa, Mycobacterium
DPATGQLTG

SEQ ID NO: 253262 - protein, 9 aa, Mycobacterium
DPATNELTG

SEQ ID NO: 253263 - protein, 8 aa, Mycobacterium
DPATPEDF

SEQ ID NO: 253264 - protein, 7 aa, Mycobacterium
DPATPLP

SEQ ID NO: 253265 - protein, 14 aa, Mycobacterium
DPATQLSGTPKGYY

SEQ ID NO: 253266 - protein, 8 aa, Mycobacterium
DPATRAKA

SEQ ID NO: 253267 - protein, 21 aa, Mycobacterium
DPATSKGIASVDQERQAAKEA

SEQ ID NO: 253268 - protein, 21 aa, Mycobacterium
DPATTKGIASVDQERKAAKEA

SEQ ID NO: 253269 - protein, 5 aa, Mycobacterium
DPATW

SEQ ID NO: 253270 - protein, 5 aa, Mycobacterium
DPAVA

SEQ ID NO: 253271 - protein, 15 aa, Mycobacterium
DPAYADPAQSLLPPS

SEQ ID NO: 253272 - protein, 9 aa, Mycobacterium
DPCAPGQVT

SEQ ID NO: 253273 - protein, 11 aa, Mycobacterium
DPCGGQPCGDP

SEQ ID NO: 253274 - protein, 7 aa, Mycobacterium
DPDADLA

SEQ ID NO: 253275 - protein, 7 aa, Mycobacterium
DPDADLE

SEQ ID NO: 253276 - protein, 16 aa, Mycobacterium
DPDADPDDIARKPGLT

SEQ ID NO: 253277 - protein, 9 aa, Mycobacterium
DPDADPSEF

SEQ ID NO: 253278 - protein, 6 aa, Mycobacterium
DPDAGA

SEQ ID NO: 253279 - protein, 7 aa, Mycobacterium
DPDAGDA

SEQ ID NO: 253280 - protein, 5 aa, Mycobacterium
DPDDR

SEQ ID NO: 253281 - protein, 9 aa, Mycobacterium
DPDEQKHWE

SEQ ID NO: 253282 - protein, 8 aa, Mycobacterium
DPDEQPVA

SEQ ID NO: 253283 - protein, 6 aa, Mycobacterium
DPDETS

SEQ ID NO: 253284 - protein, 6 aa, Mycobacterium
DPDEVR

SEQ ID NO: 253285 - protein, 18 aa, Mycobacterium
DPDFDSGRPLSSPAAPQL

SEQ ID NO: 253286 - protein, 8 aa, Mycobacterium
DPDGAIED

SEQ ID NO: 253287 - protein, 11 aa, Mycobacterium
DPDGGTSEHQR

SEQ ID NO: 253288 - protein, 9 aa, Mycobacterium
DPDGRPESG

SEQ ID NO: 253289 - protein, 11 aa, Mycobacterium
DPDKDAEKYAP

SEQ ID NO: 253290 - protein, 13 aa, Mycobacterium
DPDKDREKYAPMP

SEQ ID NO: 253291 - protein, 5 aa, Mycobacterium
DPDKM

SEQ ID NO: 253292 - protein, 5 aa, Mycobacterium
DPDKP

SEQ ID NO: 253293 - protein, 11 aa, Mycobacterium
DPDKTRKSALR

SEQ ID NO: 253294 - protein, 4 aa, Mycobacterium
DPDN

SEQ ID NO: 253295 - protein, 10 aa, Mycobacterium
DPDNASATPR

SEQ ID NO: 253296 - protein, 6 aa, Mycobacterium
DPDNAV

SEQ ID NO: 253297 - protein, 9 aa, Mycobacterium
DPDNDPSKM

SEQ ID NO: 253298 - protein, 21 aa, Mycobacterium
DPDPCDLDDEQGSEGEARPDW

SEQ ID NO: 253299 - protein, 22 aa, Mycobacterium
DPDPCDYPEDQGSEADANSDWE

SEQ ID NO: 253300 - protein, 12 aa, Mycobacterium
DPDPDAEGKTYT

SEQ ID NO: 253301 - protein, 8 aa, Mycobacterium
DPDPDALG

SEQ ID NO: 253302 - protein, 16 aa, Mycobacterium
DPDPDAVGKSYTRSGG

SEQ ID NO: 253303 - protein, 13 aa, Mycobacterium
DPDPDAVGKTYTR

SEQ ID NO: 253304 - protein, 7 aa, Mycobacterium
DPDPRRR

SEQ ID NO: 253305 - protein, 6 aa, Mycobacterium
DPDPSL

SEQ ID NO: 253306 - protein, 8 aa, Mycobacterium
DPDQISTD

SEQ ID NO: 253307 - protein, 4 aa, Mycobacterium
DPDR

SEQ ID NO: 253308 - protein, 6 aa, Mycobacterium
DPDRDP

SEQ ID NO: 253309 - protein, 15 aa, Mycobacterium
DPDRPKDRPAKSPRL

SEQ ID NO: 253310 - protein, 11 aa, Mycobacterium
DPDTAFDTAPR

SEQ ID NO: 253311 - protein, 7 aa, Mycobacterium
DPDTGTL

SEQ ID NO: 253312 - protein, 7 aa, Mycobacterium
DPDYSND

SEQ ID NO: 253313 - protein, 5 aa, Mycobacterium
DPEAE

SEQ ID NO: 253314 - protein, 10 aa, Mycobacterium
DPEANAARDT

SEQ ID NO: 253315 - protein, 5 aa, Mycobacterium
DPEAR

SEQ ID NO: 253316 - protein, 6 aa, Mycobacterium
DPEARI

SEQ ID NO: 253317 - protein, 4 aa, Mycobacterium
DPED

SEQ ID NO: 253318 - protein, 22 aa, Mycobacterium
DPEDDLTPAKYSSDFGSAGTTT

SEQ ID NO: 253319 - protein, 7 aa, Mycobacterium
DPEDMAA

SEQ ID NO: 253320 - protein, 8 aa, Mycobacterium
DPEDMGAR

SEQ ID NO: 253321 - protein, 7 aa, Mycobacterium
DPEDPTP

SEQ ID NO: 253322 - protein, 5 aa, Mycobacterium
DPEDR

SEQ ID NO: 253323 - protein, 7 aa, Mycobacterium
DPEEHTR

SEQ ID NO: 253324 - protein, 12 aa, Mycobacterium
DPEFNKQRQGKI

SEQ ID NO: 253325 - protein, 9 aa, Mycobacterium
DPEGPPGAG

SEQ ID NO: 253326 - protein, 7 aa, Mycobacterium
DPEHAAR

SEQ ID NO: 253327 - protein, 15 aa, Mycobacterium
DPEHSRPDTPQPPLN

SEQ ID NO: 253328 - protein, 15 aa, Mycobacterium
DPEHYKPGAVRGRNG

SEQ ID NO: 253329 - protein, 7 aa, Mycobacterium
DPEKHAD

SEQ ID NO: 253330 - protein, 18 aa, Mycobacterium
DPEKTQRSAHRRDSGVSG

SEQ ID NO: 253331 - protein, 7 aa, Mycobacterium
DPEKVNT

SEQ ID NO: 253332 - protein, 5 aa, Mycobacterium
DPELD

SEQ ID NO: 253333 - protein, 5 aa, Mycobacterium
DPEPD

SEQ ID NO: 253334 - protein, 5 aa, Mycobacterium
DPEPL

SEQ ID NO: 253335 - protein, 6 aa, Mycobacterium
DPEPPR

SEQ ID NO: 253336 - protein, 8 aa, Mycobacterium
DPEPTVPG

SEQ ID NO: 253337 - protein, 7 aa, Mycobacterium
DPEQHQN

SEQ ID NO: 253338 - protein, 15 aa, Mycobacterium
DPEQTRKSAQRREAG

SEQ ID NO: 253339 - protein, 5 aa, Mycobacterium
DPEQV

SEQ ID NO: 253340 - protein, 8 aa, Mycobacterium
DPERDSGR

SEQ ID NO: 253341 - protein, 4 aa, Mycobacterium
DPES

SEQ ID NO: 253342 - protein, 8 aa, Mycobacterium
DPESAGKP

SEQ ID NO: 253343 - protein, 6 aa, Mycobacterium
DPESAR

SEQ ID NO: 253344 - protein, 10 aa, Mycobacterium
DPESGHQRAP

SEQ ID NO: 253345 - protein, 17 aa, Mycobacterium
DPESTISITPGTRNRGG

SEQ ID NO: 253346 - protein, 4 aa, Mycobacterium
DPET

SEQ ID NO: 253347 - protein, 7 aa, Mycobacterium
DPETENE

SEQ ID NO: 253348 - protein, 9 aa, Mycobacterium
DPETGTGDR

SEQ ID NO: 253349 - protein, 6 aa, Mycobacterium
DPETQH

SEQ ID NO: 253350 - protein, 4 aa, Mycobacterium
DPEV

SEQ ID NO: 253351 - protein, 8 aa, Mycobacterium
DPEVDALE

SEQ ID NO: 253352 - protein, 14 aa, Mycobacterium
DPEVMGSDTNHRAT

SEQ ID NO: 253353 - protein, 16 aa, Mycobacterium
DPEVPEEEEPELPGVT

SEQ ID NO: 253354 - protein, 10 aa, Mycobacterium
DPEVRDDPRI

SEQ ID NO: 253355 - protein, 4 aa, Mycobacterium
DPFE

SEQ ID NO: 253356 - protein, 5 aa, Mycobacterium
DPFEP

SEQ ID NO: 253357 - protein, 8 aa, Mycobacterium
DPFGAGSF

SEQ ID NO: 253358 - protein, 6 aa, Mycobacterium
DPFGSV

SEQ ID NO: 253359 - protein, 6 aa, Mycobacterium
DPFPTG

SEQ ID NO: 253360 - protein, 5 aa, Mycobacterium
DPFST

SEQ ID NO: 253361 - protein, 4 aa, Mycobacterium
DPGA

SEQ ID NO: 253362 - protein, 19 aa, Mycobacterium
DPGAGGGGYAGLPAKYTSF

SEQ ID NO: 253363 - protein, 21 aa, Mycobacterium
DPGAPAAPAQAAPRPAAAPRL

SEQ ID NO: 253364 - protein, 14 aa, Mycobacterium
DPGARPPLPDPDRL

SEQ ID NO: 253365 - protein, 7 aa, Mycobacterium
DPGASPY

SEQ ID NO: 253366 - protein, 10 aa, Mycobacterium
DPGCRSSRDE

SEQ ID NO: 253367 - protein, 8 aa, Mycobacterium
DPGDRPRA

SEQ ID NO: 253368 - protein, 10 aa, Mycobacterium
DPGDVGADRQ

SEQ ID NO: 253369 - protein, 4 aa, Mycobacterium
DPGE

SEQ ID NO: 253370 - protein, 7 aa, Mycobacterium
DPGEDGQ

SEQ ID NO: 253371 - protein, 9 aa, Mycobacterium
DPGEPTPTA

SEQ ID NO: 253372 - protein, 8 aa, Mycobacterium
DPGETTDD

SEQ ID NO: 253373 - protein, 9 aa, Mycobacterium
DPGGPPNAA

SEQ ID NO: 253374 - protein, 16 aa, Mycobacterium
DPGIGAEEQPAEAVST

SEQ ID NO: 253375 - protein, 20 aa, Mycobacterium
DPGIGAQETPALASSTRPFT

SEQ ID NO: 253376 - protein, 16 aa, Mycobacterium
DPGKPSVSERAKGERR

SEQ ID NO: 253377 - protein, 16 aa, Mycobacterium
DPGLGTSAGRPDPAVE

SEQ ID NO: 253378 - protein, 11 aa, Mycobacterium
DPGLSSPGVQA

SEQ ID NO: 253379 - protein, 4 aa, Mycobacterium
DPGN

SEQ ID NO: 253380 - protein, 7 aa, Mycobacterium
DPGNAEA

SEQ ID NO: 253381 - protein, 18 aa, Mycobacterium
DPGNASAMENVGKAQSRR

SEQ ID NO: 253382 - protein, 14 aa, Mycobacterium
DPGNVAANVSAGAQ

SEQ ID NO: 253383 - protein, 15 aa, Mycobacterium
DPGNVAANVSAGSQY

SEQ ID NO: 253384 - protein, 14 aa, Mycobacterium
DPGNVASNVSAGAK

SEQ ID NO: 253385 - protein, 9 aa, Mycobacterium
DPGQGLGPE

SEQ ID NO: 253386 - protein, 10 aa, Mycobacterium
DPGQPGGHTS

SEQ ID NO: 253387 - protein, 4 aa, Mycobacterium
DPGR

SEQ ID NO: 253388 - protein, 12 aa, Mycobacterium
DPGRPGGNTSIK

SEQ ID NO: 253389 - protein, 7 aa, Mycobacterium
DPGSEAQ

SEQ ID NO: 253390 - protein, 7 aa, Mycobacterium
DPGSETQ

SEQ ID NO: 253391 - protein, 9 aa, Mycobacterium
DPGSGTVSL

SEQ ID NO: 253392 - protein, 15 aa, Mycobacterium
DPGSPARLRAAPATE

SEQ ID NO: 253393 - protein, 10 aa, Mycobacterium
DPGSPSPSRV

SEQ ID NO: 253394 - protein, 9 aa, Mycobacterium
DPGSVGADR

SEQ ID NO: 253395 - protein, 5 aa, Mycobacterium
DPGTD

SEQ ID NO: 253396 - protein, 11 aa, Mycobacterium
DPGTGEVNPRA

SEQ ID NO: 253397 - protein, 5 aa, Mycobacterium
DPGVR

SEQ ID NO: 253398 - protein, 8 aa, Mycobacterium
DPGVTSPV

SEQ ID NO: 253399 - protein, 20 aa, Mycobacterium
DPGYAAAAAKRESSGAQRTV

SEQ ID NO: 253400 - protein, 20 aa, Mycobacterium
DPGYAAAAEERKAGKPPRKR

SEQ ID NO: 253401 - protein, 23 aa, Mycobacterium
DPGYAAAAEKRGDAALPATGRGR

SEQ ID NO: 253402 - protein, 18 aa, Mycobacterium
DPGYAAAAQDGKPRSAVS

SEQ ID NO: 253403 - protein, 22 aa, Mycobacterium
DPGYAASAAKRDGSTAPTDGRA

SEQ ID NO: 253404 - protein, 7 aa, Mycobacterium
DPHAEEE

SEQ ID NO: 253405 - protein, 12 aa, Mycobacterium
DPHAKPAESSIG

SEQ ID NO: 253406 - protein, 6 aa, Mycobacterium
DPHDGS

SEQ ID NO: 253407 - protein, 6 aa, Mycobacterium
DPHFGG

SEQ ID NO: 253408 - protein, 8 aa, Mycobacterium
DPHGTPVT

SEQ ID NO: 253409 - protein, 6 aa, Mycobacterium
DPHHGT

SEQ ID NO: 253410 - protein, 22 aa, Mycobacterium
DPHHVDQEQAPPTPPYPTPPYY

SEQ ID NO: 253411 - protein, 6 aa, Mycobacterium
DPHLPG

SEQ ID NO: 253412 - protein, 7 aa, Mycobacterium
DPHLPGR

SEQ ID NO: 253413 - protein, 5 aa, Mycobacterium
DPHNG

SEQ ID NO: 253414 - protein, 7 aa, Mycobacterium
DPHNGGV

SEQ ID NO: 253415 - protein, 8 aa, Mycobacterium
DPHNPASI

SEQ ID NO: 253416 - protein, 6 aa, Mycobacterium
DPHPSD

SEQ ID NO: 253417 - protein, 20 aa, Mycobacterium
DPHPSDVDDEWPDPDARANW

SEQ ID NO: 253418 - protein, 14 aa, Mycobacterium
DPHRGLSGGEAAER

SEQ ID NO: 253419 - protein, 5 aa, Mycobacterium
DPHRP

SEQ ID NO: 253420 - protein, 17 aa, Mycobacterium
DPHSDDIRDANGQYGDE

SEQ ID NO: 253421 - protein, 17 aa, Mycobacterium
DPHTGRYVGPDGKLYQQ

SEQ ID NO: 253422 - protein, 15 aa, Mycobacterium
DPHTGSYVAPDGQVY

SEQ ID NO: 253423 - protein, 4 aa, Mycobacterium
DPIA

SEQ ID NO: 253424 - protein, 5 aa, Mycobacterium
DPIAP

SEQ ID NO: 253425 - protein, 4 aa, Mycobacterium
DPIE

SEQ ID NO: 253426 - protein, 8 aa, Mycobacterium
DPIGAESQ

SEQ ID NO: 253427 - protein, 11 aa, Mycobacterium
DPIGDKSAWGQ

SEQ ID NO: 253428 - protein, 9 aa, Mycobacterium
DPIGEESQF

SEQ ID NO: 253429 - protein, 4 aa, Mycobacterium
DPIP

SEQ ID NO: 253430 - protein, 21 aa, Mycobacterium
DPIPGLPDTPLPPSHSESEFD

SEQ ID NO: 253431 - protein, 13 aa, Mycobacterium
DPIPPSERHEGIS

SEQ ID NO: 253432 - protein, 8 aa, Mycobacterium
DPISPDEQ

SEQ ID NO: 253433 - protein, 6 aa, Mycobacterium
DPITAD

SEQ ID NO: 253434 - protein, 16 aa, Mycobacterium
DPITAQAGGRLTPAEI

SEQ ID NO: 253435 - protein, 6 aa, Mycobacterium
DPITTD

SEQ ID NO: 253436 - protein, 7 aa, Mycobacterium
DPIVGNE

SEQ ID NO: 253437 - protein, 7 aa, Mycobacterium
DPKAERT

SEQ ID NO: 253438 - protein, 39 aa, Mycobacterium
DPKLADNVNREKNARKHEAYAQRYGARPETTDSYSSSDP

SEQ ID NO: 253439 - protein, 11 aa, Mycobacterium
DPKPGAFTEKD

SEQ ID NO: 253440 - protein, 14 aa, Mycobacterium
DPKQRTLMEAKRTR

SEQ ID NO: 253441 - protein, 14 aa, Mycobacterium
DPKQRTTIEARRLQ

SEQ ID NO: 253442 - protein, 11 aa, Mycobacterium
DPKQTGQSRGW

SEQ ID NO: 253443 - protein, 9 aa, Mycobacterium
DPKRATTTR

SEQ ID NO: 253444 - protein, 7 aa, Mycobacterium
DPKTGGI

SEQ ID NO: 253445 - protein, 4 aa, Mycobacterium
DPKY

SEQ ID NO: 253446 - protein, 6 aa, Mycobacterium
DPLAGI

SEQ ID NO: 253447 - protein, 4 aa, Mycobacterium
DPLD

SEQ ID NO: 253448 - protein, 8 aa, Mycobacterium
DPLDDSEA

SEQ ID NO: 253449 - protein, 6 aa, Mycobacterium
DPLDSP

SEQ ID NO: 253450 - protein, 19 aa, Mycobacterium
DPLGHPNSEVGADPSRPYA

SEQ ID NO: 253451 - protein, 11 aa, Mycobacterium
DPLGNNPAQPD

SEQ ID NO: 253452 - protein, 13 aa, Mycobacterium
DPLGSGEATATMS

SEQ ID NO: 253453 - protein, 5 aa, Mycobacterium
DPLGV

SEQ ID NO: 253454 - protein, 54 aa, Mycobacterium
DPLPEENDQNAKNLGTSDEKSGQTKAPATKKTPAPTAAPEARHEQVTTTTPGDV

SEQ ID NO: 253455 - protein, 54 aa, Mycobacterium
DPLPEENDQNAKNLSASSGSGTTGASKAPTTRKPSPTPEAQHEQVTTTSPSGVT

SEQ ID NO: 253456 - protein, 37 aa, Mycobacterium
DPLPEERNPDNSPVPGTPESLAAEPGSGVDGEGPSDE

SEQ ID NO: 253457 - protein, 9 aa, Mycobacterium
DPLPEPETA

SEQ ID NO: 253458 - protein, 11 aa, Mycobacterium
DPLSEEGTSHI

SEQ ID NO: 253459 - protein, 6 aa, Mycobacterium
DPLSES

SEQ ID NO: 253460 - protein, 11 aa, Mycobacterium
DPLTEEGTARM

SEQ ID NO: 253461 - protein, 30 aa, Mycobacterium
DPLTEEGTSRVEPLKTAAEDAIKGTPLEGS

SEQ ID NO: 253462 - protein, 4 aa, Mycobacterium
DPME

SEQ ID NO: 253463 - protein, 4 aa, Mycobacterium
DPMG

SEQ ID NO: 253464 - protein, 7 aa, Mycobacterium
DPMTPEG

SEQ ID NO: 253465 - protein, 4 aa, Mycobacterium
DPNA

SEQ ID NO: 253466 - protein, 9 aa, Mycobacterium
DPNAGRSAH

SEQ ID NO: 253467 - protein, 20 aa, Mycobacterium
DPNAGYSAHAATRPKHNPVP

SEQ ID NO: 253468 - protein, 9 aa, Mycobacterium
DPNAPRSPA

SEQ ID NO: 253469 - protein, 7 aa, Mycobacterium
DPNEVGQ

SEQ ID NO: 253470 - protein, 8 aa, Mycobacterium
DPNEVGQR

SEQ ID NO: 253471 - protein, 5 aa, Mycobacterium
DPNGF

SEQ ID NO: 253472 - protein, 8 aa, Mycobacterium
DPNGLTPG

SEQ ID NO: 253473 - protein, 53 aa, Mycobacterium
DPNGVGFENGAPPPAPTPIEGTPENPGPAVPPGSPCSYTPPGNGLPSPGNPLP

SEQ ID NO: 253474 - protein, 8 aa, Mycobacterium
DPNGYQPL

SEQ ID NO: 253475 - protein, 6 aa, Mycobacterium
DPNLSS

SEQ ID NO: 253476 - protein, 8 aa, Mycobacterium
DPNNPNGG

SEQ ID NO: 253477 - protein, 5 aa, Mycobacterium
DPNPC

SEQ ID NO: 253478 - protein, 9 aa, Mycobacterium
DPNPPLPPW

SEQ ID NO: 253479 - protein, 11 aa, Mycobacterium
DPNPTASSFQP

SEQ ID NO: 253480 - protein, 7 aa, Mycobacterium
DPNRDAL

SEQ ID NO: 253481 - protein, 5 aa, Mycobacterium
DPNTV

SEQ ID NO: 253482 - protein, 6 aa, Mycobacterium
DPPAAA

SEQ ID NO: 253483 - protein, 20 aa, Mycobacterium
DPPAGAGVGYNGPIKLRFGA

SEQ ID NO: 253484 - protein, 8 aa, Mycobacterium
DPPAGNGG

SEQ ID NO: 253485 - protein, 8 aa, Mycobacterium
DPPAGRPD

SEQ ID NO: 253486 - protein, 15 aa, Mycobacterium
DPPAGSYPTAEERRR

SEQ ID NO: 253487 - protein, 17 aa, Mycobacterium
DPPAGTYPDEDERRDNQ

SEQ ID NO: 253488 - protein, 15 aa, Mycobacterium
DPPAGTYPDPDERRK

SEQ ID NO: 253489 - protein, 6 aa, Mycobacterium
DPPARG

SEQ ID NO: 253490 - protein, 6 aa, Mycobacterium
DPPAVA

SEQ ID NO: 253491 - protein, 6 aa, Mycobacterium
DPPDHT

SEQ ID NO: 253492 - protein, 8 aa, Mycobacterium
DPPGDTPL

SEQ ID NO: 253493 - protein, 9 aa, Mycobacterium
DPPGGNGGA

SEQ ID NO: 253494 - protein, 8 aa, Mycobacterium
DPPKEPPW

SEQ ID NO: 253495 - protein, 6 aa, Mycobacterium
DPPPCA

SEQ ID NO: 253496 - protein, 15 aa, Mycobacterium
DPPPNPKKPGSGEGL

SEQ ID NO: 253497 - protein, 6 aa, Mycobacterium
DPPQTA

SEQ ID NO: 253498 - protein, 10 aa, Mycobacterium
DPPRAAASSA

SEQ ID NO: 253499 - protein, 12 aa, Mycobacterium
DPPRADSAETIA

SEQ ID NO: 253500 - protein, 17 aa, Mycobacterium
DPPREPAIETATPAEDT

SEQ ID NO: 253501 - protein, 8 aa, Mycobacterium
DPPRERRP

SEQ ID NO: 253502 - protein, 8 aa, Mycobacterium
DPPRGAAR

SEQ ID NO: 253503 - protein, 22 aa, Mycobacterium
DPPRKSRKIATDAELASPYRGS

SEQ ID NO: 253504 - protein, 21 aa, Mycobacterium
DPPRKSRKVASKEELASPYRG

SEQ ID NO: 253505 - protein, 21 aa, Mycobacterium
DPPRPARADAARTDLANPYRN

SEQ ID NO: 253506 - protein, 11 aa, Mycobacterium
DPPRPEAGEAI

SEQ ID NO: 253507 - protein, 8 aa, Mycobacterium
DPPRQGAA

SEQ ID NO: 253508 - protein, 14 aa, Mycobacterium
DPPRRTPPTASGTE

SEQ ID NO: 253509 - protein, 9 aa, Mycobacterium
DPPRTAAKS

SEQ ID NO: 253510 - protein, 23 aa, Mycobacterium
DPPSIDPGAVPPDVTGPDQPTEQ

SEQ ID NO: 253511 - protein, 14 aa, Mycobacterium
DPPTPRAPTPSEQL

SEQ ID NO: 253512 - protein, 13 aa, Mycobacterium
DPPVGQPGTPALP

SEQ ID NO: 253513 - protein, 4 aa, Mycobacterium
DPQA

SEQ ID NO: 253514 - protein, 10 aa, Mycobacterium
DPQAGRSSAS

SEQ ID NO: 253515 - protein, 6 aa, Mycobacterium
DPQAGT

SEQ ID NO: 253516 - protein, 9 aa, Mycobacterium
DPQARNVPT

SEQ ID NO: 253517 - protein, 14 aa, Mycobacterium
DPQDPATTAGYNKA

SEQ ID NO: 253518 - protein, 4 aa, Mycobacterium
DPQE

SEQ ID NO: 253519 - protein, 8 aa, Mycobacterium
DPQESTTL

SEQ ID NO: 253520 - protein, 8 aa, Mycobacterium
DPQGNDPQ

SEQ ID NO: 253521 - protein, 6 aa, Mycobacterium
DPQGRQ

SEQ ID NO: 253522 - protein, 7 aa, Mycobacterium
DPQRAPN

SEQ ID NO: 253523 - protein, 5 aa, Mycobacterium
DPQSA

SEQ ID NO: 253524 - protein, 7 aa, Mycobacterium
DPQTEEV

SEQ ID NO: 253525 - protein, 7 aa, Mycobacterium
DPQVNEP

SEQ ID NO: 253526 - protein, 4 aa, Mycobacterium
DPRA

SEQ ID NO: 253527 - protein, 8 aa, Mycobacterium
DPRAATPW

SEQ ID NO: 253528 - protein, 6 aa, Mycobacterium
DPRAIR

SEQ ID NO: 253529 - protein, 5 aa, Mycobacterium
DPRAN

SEQ ID NO: 253530 - protein, 11 aa, Mycobacterium
DPRAPAPQAGQ

SEQ ID NO: 253531 - protein, 12 aa, Mycobacterium
DPRAPAPSAGAL

SEQ ID NO: 253532 - protein, 12 aa, Mycobacterium
DPRASKKRPDRT

SEQ ID NO: 253533 - protein, 7 aa, Mycobacterium
DPRDEFT

SEQ ID NO: 253534 - protein, 4 aa, Mycobacterium
DPRE

SEQ ID NO: 253535 - protein, 5 aa, Mycobacterium
DPREA

SEQ ID NO: 253536 - protein, 4 aa, Mycobacterium
DPRG

SEQ ID NO: 253537 - protein, 10 aa, Mycobacterium
DPRGIYGSEG

SEQ ID NO: 253538 - protein, 6 aa, Mycobacterium
DPRGNQ

SEQ ID NO: 253539 - protein, 6 aa, Mycobacterium
DPRGWS

SEQ ID NO: 253540 - protein, 5 aa, Mycobacterium
DPRID

SEQ ID NO: 253541 - protein, 4 aa, Mycobacterium
DPRK

SEQ ID NO: 253542 - protein, 5 aa, Mycobacterium
DPRLP

SEQ ID NO: 253543 - protein, 9 aa, Mycobacterium
DPRPDRPRT

SEQ ID NO: 253544 - protein, 7 aa, Mycobacterium
DPRPDTA

SEQ ID NO: 253545 - protein, 6 aa, Mycobacterium
DPRPLR

SEQ ID NO: 253546 - protein, 4 aa, Mycobacterium
DPRR

SEQ ID NO: 253547 - protein, 6 aa, Mycobacterium
DPRRPL

SEQ ID NO: 253548 - protein, 8 aa, Mycobacterium
DPRSAQSA

SEQ ID NO: 253549 - protein, 7 aa, Mycobacterium
DPRSRPI

SEQ ID NO: 253550 - protein, 6 aa, Mycobacterium
DPRSRR

SEQ ID NO: 253551 - protein, 9 aa, Mycobacterium
DPRSRRIST

SEQ ID NO: 253552 - protein, 5 aa, Mycobacterium
DPRSY

SEQ ID NO: 253553 - protein, 4 aa, Mycobacterium
DPRT

SEQ ID NO: 253554 - protein, 9 aa, Mycobacterium
DPRTEGLSD

SEQ ID NO: 253555 - protein, 6 aa, Mycobacterium
DPRTGA

SEQ ID NO: 253556 - protein, 7 aa, Mycobacterium
DPRTGGI

SEQ ID NO: 253557 - protein, 6 aa, Mycobacterium
DPRVPP

SEQ ID NO: 253558 - protein, 6 aa, Mycobacterium
DPRVTP

SEQ ID NO: 253559 - protein, 6 aa, Mycobacterium
DPSAAR

SEQ ID NO: 253560 - protein, 18 aa, Mycobacterium
DPSAATSEQRSISLPGSR

SEQ ID NO: 253561 - protein, 15 aa, Mycobacterium
DPSADPQATGYQSRQ

SEQ ID NO: 253562 - protein, 5 aa, Mycobacterium
DPSAG

SEQ ID NO: 253563 - protein, 8 aa, Mycobacterium
DPSAIPQQ

SEQ ID NO: 253564 - protein, 7 aa, Mycobacterium
DPSAQPQ

SEQ ID NO: 253565 - protein, 9 aa, Mycobacterium
DPSDSAAAP

SEQ ID NO: 253566 - protein, 27 aa, Mycobacterium
DPSESQMGHSSIESREAARRTLNRPGF

SEQ ID NO: 253567 - protein, 27 aa, Mycobacterium
DPSESQMGHSSLESRDAARRTLNRPGF

SEQ ID NO: 253568 - protein, 8 aa, Mycobacterium
DPSETTTL

SEQ ID NO: 253569 - protein, 6 aa, Mycobacterium
DPSGAV

SEQ ID NO: 253570 - protein, 5 aa, Mycobacterium
DPSGW

SEQ ID NO: 253571 - protein, 7 aa, Mycobacterium
DPSGYID

SEQ ID NO: 253572 - protein, 5 aa, Mycobacterium
DPSHL

SEQ ID NO: 253573 - protein, 15 aa, Mycobacterium
DPSKQPDEVNSKTWH

SEQ ID NO: 253574 - protein, 4 aa, Mycobacterium
DPSL

SEQ ID NO: 253575 - protein, 6 aa, Mycobacterium
DPSLPN

SEQ ID NO: 253576 - protein, 9 aa, Mycobacterium
DPSNEGNLN

SEQ ID NO: 253577 - protein, 7 aa, Mycobacterium
DPSNSAA

SEQ ID NO: 253578 - protein, 17 aa, Mycobacterium
DPSPARLAGESAASPRR

SEQ ID NO: 253579 - protein, 14 aa, Mycobacterium
DPSPGSAATDASMT

SEQ ID NO: 253580 - protein, 11 aa, Mycobacterium
DPSPGTPEGPW

SEQ ID NO: 253581 - protein, 9 aa, Mycobacterium
DPSPRRLPP

SEQ ID NO: 253582 - protein, 7 aa, Mycobacterium
DPSQGLA

SEQ ID NO: 253583 - protein, 5 aa, Mycobacterium
DPSQT

SEQ ID NO: 253584 - protein, 23 aa, Mycobacterium
DPSQVLQQQGPQQAGPAREQTQD

SEQ ID NO: 253585 - protein, 8 aa, Mycobacterium
DPSRATGL

SEQ ID NO: 253586 - protein, 13 aa, Mycobacterium
DPSRKRHSGGTGL

SEQ ID NO: 253587 - protein, 6 aa, Mycobacterium
DPSRRV

SEQ ID NO: 253588 - protein, 5 aa, Mycobacterium
DPSRY

SEQ ID NO: 253589 - protein, 4 aa, Mycobacterium
DPSS

SEQ ID NO: 253590 - protein, 10 aa, Mycobacterium
DPSSESARAA

SEQ ID NO: 253591 - protein, 10 aa, Mycobacterium
DPSSTEATPE

SEQ ID NO: 253592 - protein, 4 aa, Mycobacterium
DPST

SEQ ID NO: 253593 - protein, 7 aa, Mycobacterium
DPSTGTV

SEQ ID NO: 253594 - protein, 5 aa, Mycobacterium
DPSTR

SEQ ID NO: 253595 - protein, 6 aa, Mycobacterium
DPSVPD

SEQ ID NO: 253596 - protein, 5 aa, Mycobacterium
DPSWT

SEQ ID NO: 253597 - protein, 4 aa, Mycobacterium
DPTA

SEQ ID NO: 253598 - protein, 8 aa, Mycobacterium
DPTAGHAR

SEQ ID NO: 253599 - protein, 7 aa, Mycobacterium
DPTARAT

SEQ ID NO: 253600 - protein, 5 aa, Mycobacterium
DPTCS

SEQ ID NO: 253601 - protein, 18 aa, Mycobacterium
DPTDPRQLGQPLRGHSDT

SEQ ID NO: 253602 - protein, 5 aa, Mycobacterium
DPTEL

SEQ ID NO: 253603 - protein, 8 aa, Mycobacterium
DPTELADG

SEQ ID NO: 253604 - protein, 6 aa, Mycobacterium
DPTEPD

SEQ ID NO: 253605 - protein, 7 aa, Mycobacterium
DPTERSV

SEQ ID NO: 253606 - protein, 4 aa, Mycobacterium
DPTF

SEQ ID NO: 253607 - protein, 17 aa, Mycobacterium
DPTGAGRSITANGASRD

SEQ ID NO: 253608 - protein, 6 aa, Mycobacterium
DPTGEH

SEQ ID NO: 253609 - protein, 5 aa, Mycobacterium
DPTGF

SEQ ID NO: 253610 - protein, 7 aa, Mycobacterium
DPTGGPF

SEQ ID NO: 253611 - protein, 10 aa, Mycobacterium
DPTGGQQRAP

SEQ ID NO: 253612 - protein, 13 aa, Mycobacterium
DPTGLTPTARQRY

SEQ ID NO: 253613 - protein, 5 aa, Mycobacterium
DPTGR

SEQ ID NO: 253614 - protein, 4 aa, Mycobacterium
DPTI

SEQ ID NO: 253615 - protein, 5 aa, Mycobacterium
DPTID

SEQ ID NO: 253616 - protein, 7 aa, Mycobacterium
DPTLGER

SEQ ID NO: 253617 - protein, 7 aa, Mycobacterium
DPTMYGG

SEQ ID NO: 253618 - protein, 6 aa, Mycobacterium
DPTNGA

SEQ ID NO: 253619 - protein, 27 aa, Mycobacterium
DPTNSGSASTSPTTAAPSYTATQTAAA

SEQ ID NO: 253620 - protein, 7 aa, Mycobacterium
DPTPRPI

SEQ ID NO: 253621 - protein, 9 aa, Mycobacterium
DPTPRPIPP

SEQ ID NO: 253622 - protein, 6 aa, Mycobacterium
DPTPVD

SEQ ID NO: 253623 - protein, 5 aa, Mycobacterium
DPTRG

SEQ ID NO: 253624 - protein, 9 aa, Mycobacterium
DPTRTEGTR

SEQ ID NO: 253625 - protein, 8 aa, Mycobacterium
DPTSGTVT

SEQ ID NO: 253626 - protein, 11 aa, Mycobacterium
DPTTGKYGPLY

SEQ ID NO: 253627 - protein, 7 aa, Mycobacterium
DPTTPGG

SEQ ID NO: 253628 - protein, 8 aa, Mycobacterium
DPTTPGGM

SEQ ID NO: 253629 - protein, 8 aa, Mycobacterium
DPTTPHGP

SEQ ID NO: 253630 - protein, 11 aa, Mycobacterium
DPTTPNGPLPV

SEQ ID NO: 253631 - protein, 4 aa, Mycobacterium
DPVA

SEQ ID NO: 253632 - protein, 23 aa, Mycobacterium
DPVAPAMTSEARTATTAARPWTP

SEQ ID NO: 253633 - protein, 4 aa, Mycobacterium
DPVG

SEQ ID NO: 253634 - protein, 13 aa, Mycobacterium
DPVGDDSTGPGWG

SEQ ID NO: 253635 - protein, 10 aa, Mycobacterium
DPVGPNGEHA

SEQ ID NO: 253636 - protein, 9 aa, Mycobacterium
DPVNEASRL

SEQ ID NO: 253637 - protein, 8 aa, Mycobacterium
DPVPDDHD

SEQ ID NO: 253638 - protein, 6 aa, Mycobacterium
DPVQGM

SEQ ID NO: 253639 - protein, 5 aa, Mycobacterium
DPVSG

SEQ ID NO: 253640 - protein, 5 aa, Mycobacterium
DPVTA

SEQ ID NO: 253641 - protein, 7 aa, Mycobacterium
DPVTNTL

SEQ ID NO: 253642 - protein, 7 aa, Mycobacterium
DPYGPTE

SEQ ID NO: 253643 - protein, 11 aa, Mycobacterium
DPYGRPPGTNG

SEQ ID NO: 253644 - protein, 6 aa, Mycobacterium
DPYKYP

SEQ ID NO: 253645 - protein, 12 aa, Mycobacterium
DPYLREGEEEAE

SEQ ID NO: 253646 - protein, 5 aa, Mycobacterium
DPYPT

SEQ ID NO: 253647 - protein, 6 aa, Mycobacterium
DPYPVR

SEQ ID NO: 253648 - protein, 12 aa, Mycobacterium
DPYQAPDGYPIK

SEQ ID NO: 253649 - protein, 11 aa, Mycobacterium
DPYQAPEGYPI

SEQ ID NO: 253650 - protein, 15 aa, Mycobacterium
DPYTGDEDPQTAQKI

SEQ ID NO: 253651 - protein, 15 aa, Mycobacterium
DPYTGDEDPQTQQKI

SEQ ID NO: 253652 - protein, 22 aa, Mycobacterium
DPYTLSSDRGAEPDIGPQPDLP

SEQ ID NO: 253653 - protein, 4 aa, Mycobacterium
DPYV

SEQ ID NO: 253654 - protein, 18 aa, Mycobacterium
DQAAAGHRATVAESSRPR

SEQ ID NO: 253655 - protein, 31 aa, Mycobacterium
DQAAPAPRFSRTPAGPVAAPPAATTPIDEIN

SEQ ID NO: 253656 - protein, 31 aa, Mycobacterium
DQAAPGPRFSRTPAAPVGRPPAATSPITEIG

SEQ ID NO: 253657 - protein, 10 aa, Mycobacterium
DQADSAALPA

SEQ ID NO: 253658 - protein, 5 aa, Mycobacterium
DQAIR

SEQ ID NO: 253659 - protein, 4 aa, Mycobacterium
DQAP

SEQ ID NO: 253660 - protein, 7 aa, Mycobacterium
DQAPIEP

SEQ ID NO: 253661 - protein, 17 aa, Mycobacterium
DQAPPATNGRPKASARA

SEQ ID NO: 253662 - protein, 8 aa, Mycobacterium
DQARAQPL

SEQ ID NO: 253663 - protein, 9 aa, Mycobacterium
DQARGMDSD

SEQ ID NO: 253664 - protein, 13 aa, Mycobacterium
DQARPPRERRTGD

SEQ ID NO: 253665 - protein, 8 aa, Mycobacterium
DQARQSTV

SEQ ID NO: 253666 - protein, 15 aa, Mycobacterium
DQARRERAEAEVAER

SEQ ID NO: 253667 - protein, 6 aa, Mycobacterium
DQARRR

SEQ ID NO: 253668 - protein, 6 aa, Mycobacterium
DQASDQ

SEQ ID NO: 253669 - protein, 5 aa, Mycobacterium
DQATA

SEQ ID NO: 253670 - protein, 17 aa, Mycobacterium
DQATDQTRAEIATQGPK

SEQ ID NO: 253671 - protein, 7 aa, Mycobacterium
DQATGHE

SEQ ID NO: 253672 - protein, 8 aa, Mycobacterium
DQCDGDPR

SEQ ID NO: 253673 - protein, 6 aa, Mycobacterium
DQCRGA

SEQ ID NO: 253674 - protein, 12 aa, Mycobacterium
DQDEPQPDKEPT

SEQ ID NO: 253675 - protein, 7 aa, Mycobacterium
DQDGRED

SEQ ID NO: 253676 - protein, 7 aa, Mycobacterium
DQDIQDA

SEQ ID NO: 253677 - protein, 6 aa, Mycobacterium
DQDNAQ

SEQ ID NO: 253678 - protein, 4 aa, Mycobacterium
DQDR

SEQ ID NO: 253679 - protein, 6 aa, Mycobacterium
DQDSGA

SEQ ID NO: 253680 - protein, 5 aa, Mycobacterium
DQDTA

SEQ ID NO: 253681 - protein, 4 aa, Mycobacterium
DQEA

SEQ ID NO: 253682 - protein, 14 aa, Mycobacterium
DQEADEDSADEDGY

SEQ ID NO: 253683 - protein, 4 aa, Mycobacterium
DQEG

SEQ ID NO: 253684 - protein, 5 aa, Mycobacterium
DQFGP

SEQ ID NO: 253685 - protein, 18 aa, Mycobacterium
DQGAGTEYPEAAAAVDAT

SEQ ID NO: 253686 - protein, 16 aa, Mycobacterium
DQGAQIADKIAARIAD

SEQ ID NO: 253687 - protein, 7 aa, Mycobacterium
DQGARQY

SEQ ID NO: 253688 - protein, 14 aa, Mycobacterium
DQGASGAVKVAIDQ

SEQ ID NO: 253689 - protein, 13 aa, Mycobacterium
DQGDAIDSRYHPS

SEQ ID NO: 253690 - protein, 11 aa, Mycobacterium
DQGEALANESV

SEQ ID NO: 253691 - protein, 6 aa, Mycobacterium
DQGGAL

SEQ ID NO: 253692 - protein, 8 aa, Mycobacterium
DQGGAPGE

SEQ ID NO: 253693 - protein, 5 aa, Mycobacterium
DQGGY

SEQ ID NO: 253694 - protein, 10 aa, Mycobacterium
DQGHTARRDA

SEQ ID NO: 253695 - protein, 4 aa, Mycobacterium
DQGN

SEQ ID NO: 253696 - protein, 9 aa, Mycobacterium
DQGPGAADE

SEQ ID NO: 253697 - protein, 10 aa, Mycobacterium
DQGPGIPPEE

SEQ ID NO: 253698 - protein, 6 aa, Mycobacterium
DQGQAS

SEQ ID NO: 253699 - protein, 6 aa, Mycobacterium
DQGQLA

SEQ ID NO: 253700 - protein, 7 aa, Mycobacterium
DQGSGSA

SEQ ID NO: 253701 - protein, 6 aa, Mycobacterium
DQGTAS

SEQ ID NO: 253702 - protein, 5 aa, Mycobacterium
DQHEA

SEQ ID NO: 253703 - protein, 12 aa, Mycobacterium
DQHEPAPERQEP

SEQ ID NO: 253704 - protein, 12 aa, Mycobacterium
DQHHPKPPPVRR

SEQ ID NO: 253705 - protein, 4 aa, Mycobacterium
DQHL

SEQ ID NO: 253706 - protein, 5 aa, Mycobacterium
DQHRD

SEQ ID NO: 253707 - protein, 13 aa, Mycobacterium
DQIADASSGMNQR

SEQ ID NO: 253708 - protein, 7 aa, Mycobacterium
DQIADSR

SEQ ID NO: 253709 - protein, 5 aa, Mycobacterium
DQIGE

SEQ ID NO: 253710 - protein, 7 aa, Mycobacterium
DQIGGDS

SEQ ID NO: 253711 - protein, 8 aa, Mycobacterium
DQIGKAGD

SEQ ID NO: 253712 - protein, 5 aa, Mycobacterium
DQIGS

SEQ ID NO: 253713 - protein, 5 aa, Mycobacterium
DQIGT

SEQ ID NO: 253714 - protein, 5 aa, Mycobacterium
DQIKD

SEQ ID NO: 253715 - protein, 6 aa, Mycobacterium
DQISGD

SEQ ID NO: 253716 - protein, 6 aa, Mycobacterium
DQITDK

SEQ ID NO: 253717 - protein, 6 aa, Mycobacterium
DQITED

SEQ ID NO: 253718 - protein, 9 aa, Mycobacterium
DQITNRPQD

SEQ ID NO: 253719 - protein, 7 aa, Mycobacterium
DQITSKP

SEQ ID NO: 253720 - protein, 38 aa, Mycobacterium
DQKALPEPKGASTPAASDGAAQTTATAVRTSTKDRDRA

SEQ ID NO: 253721 - protein, 13 aa, Mycobacterium
DQKFTPADMPANQ

SEQ ID NO: 253722 - protein, 5 aa, Mycobacterium
DQKHV

SEQ ID NO: 253723 - protein, 8 aa, Mycobacterium
DQKTDGRS

SEQ ID NO: 253724 - protein, 4 aa, Mycobacterium
DQLE

SEQ ID NO: 253725 - protein, 12 aa, Mycobacterium
DQLEAAASRESV

SEQ ID NO: 253726 - protein, 7 aa, Mycobacterium
DQLGADE

SEQ ID NO: 253727 - protein, 8 aa, Mycobacterium
DQLGTGQQ

SEQ ID NO: 253728 - protein, 10 aa, Mycobacterium
DQLNSGAQRL

SEQ ID NO: 253729 - protein, 16 aa, Mycobacterium
DQLNTEPASATGGGVS

SEQ ID NO: 253730 - protein, 5 aa, Mycobacterium
DQLQT

SEQ ID NO: 253731 - protein, 4 aa, Mycobacterium
DQLR

SEQ ID NO: 253732 - protein, 12 aa, Mycobacterium
DQLRAPQGTLSE

SEQ ID NO: 253733 - protein, 13 aa, Mycobacterium
DQLTDARGRLADA

SEQ ID NO: 253734 - protein, 17 aa, Mycobacterium
DQLTPARDVESVPGAGL

SEQ ID NO: 253735 - protein, 18 aa, Mycobacterium
DQMRQRGHRGAENDELPR

SEQ ID NO: 253736 - protein, 8 aa, Mycobacterium
DQNAADGA

SEQ ID NO: 253737 - protein, 25 aa, Mycobacterium
DQNAQLSNCSNGGAELENCGSAPDL

SEQ ID NO: 253738 - protein, 26 aa, Mycobacterium
DQNAQLSNCTNGAAQPQDCGSAPDIT

SEQ ID NO: 253739 - protein, 8 aa, Mycobacterium
DQNDPKVY

SEQ ID NO: 253740 - protein, 6 aa, Mycobacterium
DQNGEE

SEQ ID NO: 253741 - protein, 35 aa, Mycobacterium
DQPAAATPAQPPHPPPGTERPVPDEPARPPFDSDA

SEQ ID NO: 253742 - protein, 18 aa, Mycobacterium
DQPAPDAGAARDAEADYD

SEQ ID NO: 253743 - protein, 10 aa, Mycobacterium
DQPAPPGTQA

SEQ ID NO: 253744 - protein, 63 aa, Mycobacterium
DQPDAIPTTAGTQVAATTSTATTTTTSAPPTTSTSAPPTTSASPTTSSAPTTSGTVEQTEQST

SEQ ID NO: 253745 - protein, 9 aa, Mycobacterium
DQPDIYSQP

SEQ ID NO: 253746 - protein, 5 aa, Mycobacterium
DQPFE

SEQ ID NO: 253747 - protein, 6 aa, Mycobacterium
DQPFTA

SEQ ID NO: 253748 - protein, 8 aa, Mycobacterium
DQPGGAPG

SEQ ID NO: 253749 - protein, 6 aa, Mycobacterium
DQPGGL

SEQ ID NO: 253750 - protein, 8 aa, Mycobacterium
DQPGGLGP

SEQ ID NO: 253751 - protein, 7 aa, Mycobacterium
DQPGGLQ

SEQ ID NO: 253752 - protein, 28 aa, Mycobacterium
DQPGGTDTHVTPGQRDHGGGSGAGQVTS

SEQ ID NO: 253753 - protein, 6 aa, Mycobacterium
DQPGMS

SEQ ID NO: 253754 - protein, 6 aa, Mycobacterium
DQPLDD

SEQ ID NO: 253755 - protein, 7 aa, Mycobacterium
DQPLGDE

SEQ ID NO: 253756 - protein, 7 aa, Mycobacterium
DQPLGDN

SEQ ID NO: 253757 - protein, 8 aa, Mycobacterium
DQPLGPGA

SEQ ID NO: 253758 - protein, 8 aa, Mycobacterium
DQPLGTEA

SEQ ID NO: 253759 - protein, 6 aa, Mycobacterium
DQPLSE

SEQ ID NO: 253760 - protein, 7 aa, Mycobacterium
DQPLTDS

SEQ ID NO: 253761 - protein, 7 aa, Mycobacterium
DQPNPWY

SEQ ID NO: 253762 - protein, 7 aa, Mycobacterium
DQPNRTL

SEQ ID NO: 253763 - protein, 17 aa, Mycobacterium
DQPPQPGGGEPEYPAPT

SEQ ID NO: 253764 - protein, 6 aa, Mycobacterium
DQPPWT

SEQ ID NO: 253765 - protein, 7 aa, Mycobacterium
DQPQPVN

SEQ ID NO: 253766 - protein, 6 aa, Mycobacterium
DQPQRV

SEQ ID NO: 253767 - protein, 8 aa, Mycobacterium
DQPTPGKL

SEQ ID NO: 253768 - protein, 4 aa, Mycobacterium
DQPW

SEQ ID NO: 253769 - protein, 7 aa, Mycobacterium
DQQEAAT

SEQ ID NO: 253770 - protein, 6 aa, Mycobacterium
DQQGNM

SEQ ID NO: 253771 - protein, 6 aa, Mycobacterium
DQQQHA

SEQ ID NO: 253772 - protein, 5 aa, Mycobacterium
DQQSA

SEQ ID NO: 253773 - protein, 4 aa, Mycobacterium
DQQV

SEQ ID NO: 253774 - protein, 9 aa, Mycobacterium
DQRKREAYT

SEQ ID NO: 253775 - protein, 8 aa, Mycobacterium
DQRQPVPV

SEQ ID NO: 253776 - protein, 5 aa, Mycobacterium
DQRRR

SEQ ID NO: 253777 - protein, 10 aa, Mycobacterium
DQRRRGETEL

SEQ ID NO: 253778 - protein, 13 aa, Mycobacterium
DQRRRKAYTPEDI

SEQ ID NO: 253779 - protein, 34 aa, Mycobacterium
DQRVDERAARAAESAPAVAQASASLQRTEEARAA

SEQ ID NO: 253780 - protein, 14 aa, Mycobacterium
DQRVPTRAPSATRT

SEQ ID NO: 253781 - protein, 6 aa, Mycobacterium
DQSDDL

SEQ ID NO: 253782 - protein, 13 aa, Mycobacterium
DQSDTGSKDPGAM

SEQ ID NO: 253783 - protein, 6 aa, Mycobacterium
DQSELG

SEQ ID NO: 253784 - protein, 15 aa, Mycobacterium
DQSEYEPHDQPADPV

SEQ ID NO: 253785 - protein, 7 aa, Mycobacterium
DQSGEGY

SEQ ID NO: 253786 - protein, 7 aa, Mycobacterium
DQSGSRV

SEQ ID NO: 253787 - protein, 7 aa, Mycobacterium
DQSITTA

SEQ ID NO: 253788 - protein, 9 aa, Mycobacterium
DQSKRTTNG

SEQ ID NO: 253789 - protein, 12 aa, Mycobacterium
DQSPRFTPEQFP

SEQ ID NO: 253790 - protein, 11 aa, Mycobacterium
DQSRAANEESV

SEQ ID NO: 253791 - protein, 8 aa, Mycobacterium
DQSRNEDS

SEQ ID NO: 253792 - protein, 6 aa, Mycobacterium
DQSRNH

SEQ ID NO: 253793 - protein, 13 aa, Mycobacterium
DQSRRDELNDTDQ

SEQ ID NO: 253794 - protein, 14 aa, Mycobacterium
DQSRRGELGDAGQD

SEQ ID NO: 253795 - protein, 8 aa, Mycobacterium
DQSRSDLQ

SEQ ID NO: 253796 - protein, 6 aa, Mycobacterium
DQSRTH

SEQ ID NO: 253797 - protein, 9 aa, Mycobacterium
DQSSSGAPR

SEQ ID NO: 253798 - protein, 9 aa, Mycobacterium
DQSSTGTAC

SEQ ID NO: 253799 - protein, 9 aa, Mycobacterium
DQSTAGDAS

SEQ ID NO: 253800 - protein, 7 aa, Mycobacterium
DQSTHVT

SEQ ID NO: 253801 - protein, 4 aa, Mycobacterium
DQTA

SEQ ID NO: 253802 - protein, 4 aa, Mycobacterium
DQTD

SEQ ID NO: 253803 - protein, 11 aa, Mycobacterium
DQTDNSRQATL

SEQ ID NO: 253804 - protein, 16 aa, Mycobacterium
DQTEAAGTATAGSRST

SEQ ID NO: 253805 - protein, 11 aa, Mycobacterium
DQTGRRLNRAG

SEQ ID NO: 253806 - protein, 6 aa, Mycobacterium
DQTPAA

SEQ ID NO: 253807 - protein, 6 aa, Mycobacterium
DQTPDF

SEQ ID NO: 253808 - protein, 5 aa, Mycobacterium
DQTPG

SEQ ID NO: 253809 - protein, 6 aa, Mycobacterium
DQTPLR

SEQ ID NO: 253810 - protein, 10 aa, Mycobacterium
DQTRQLDTDG

SEQ ID NO: 253811 - protein, 6 aa, Mycobacterium
DQTRSA

SEQ ID NO: 253812 - protein, 4 aa, Mycobacterium
DQTS

SEQ ID NO: 253813 - protein, 10 aa, Mycobacterium
DQTSAGGGVG

SEQ ID NO: 253814 - protein, 8 aa, Mycobacterium
DQTSDDPL

SEQ ID NO: 253815 - protein, 15 aa, Mycobacterium
DQTSTAPSRANGPYP

SEQ ID NO: 253816 - protein, 5 aa, Mycobacterium
DQTTA

SEQ ID NO: 253817 - protein, 7 aa, Mycobacterium
DQTTEPT

SEQ ID NO: 253818 - protein, 6 aa, Mycobacterium
DQTTLS

SEQ ID NO: 253819 - protein, 4 aa, Mycobacterium
DQTV

SEQ ID NO: 253820 - protein, 5 aa, Mycobacterium
DQTYP

SEQ ID NO: 253821 - protein, 6 aa, Mycobacterium
DQVAER

SEQ ID NO: 253822 - protein, 11 aa, Mycobacterium
DQVGSKGQELT

SEQ ID NO: 253823 - protein, 12 aa, Mycobacterium
DQVGSKGQELTN

SEQ ID NO: 253824 - protein, 38 aa, Mycobacterium
DQVRKDDHNDGAAAGTTTTEPAPVDAATGSAPQPRHHV

SEQ ID NO: 253825 - protein, 7 aa, Mycobacterium
DQVSATE

SEQ ID NO: 253826 - protein, 7 aa, Mycobacterium
DQVSKTE

SEQ ID NO: 253827 - protein, 4 aa, Mycobacterium
DQVT

SEQ ID NO: 253828 - protein, 6 aa, Mycobacterium
DQYAEQ

SEQ ID NO: 253829 - protein, 5 aa, Mycobacterium
DQYAQ

SEQ ID NO: 253830 - protein, 6 aa, Mycobacterium
DQYSAY

SEQ ID NO: 253831 - protein, 7 aa, Mycobacterium
DRAADPL

SEQ ID NO: 253832 - protein, 9 aa, Mycobacterium
DRAAGRRRV

SEQ ID NO: 253833 - protein, 16 aa, Mycobacterium
DRAATALAASTAATGQ

SEQ ID NO: 253834 - protein, 4 aa, Mycobacterium
DRAD

SEQ ID NO: 253835 - protein, 20 aa, Mycobacterium
DRADESARRKRNEEPWSVGR

SEQ ID NO: 253836 - protein, 10 aa, Mycobacterium
DRADRRRANR

SEQ ID NO: 253837 - protein, 16 aa, Mycobacterium
DRADRTTVATEPVAQP

SEQ ID NO: 253838 - protein, 9 aa, Mycobacterium
DRAEADKAK

SEQ ID NO: 253839 - protein, 8 aa, Mycobacterium
DRAEPARE

SEQ ID NO: 253840 - protein, 8 aa, Mycobacterium
DRAERGAD

SEQ ID NO: 253841 - protein, 13 aa, Mycobacterium
DRAGALKNPAKVR

SEQ ID NO: 253842 - protein, 9 aa, Mycobacterium
DRAGGHPGD

SEQ ID NO: 253843 - protein, 5 aa, Mycobacterium
DRAGM

SEQ ID NO: 253844 - protein, 5 aa, Mycobacterium
DRAGR

SEQ ID NO: 253845 - protein, 7 aa, Mycobacterium
DRAGRHS

SEQ ID NO: 253846 - protein, 7 aa, Mycobacterium
DRAGTAR

SEQ ID NO: 253847 - protein, 22 aa, Mycobacterium
DRAKGNIDDQFTQRRDVRNGDA

SEQ ID NO: 253848 - protein, 8 aa, Mycobacterium
DRANEPGF

SEQ ID NO: 253849 - protein, 5 aa, Mycobacterium
DRANR

SEQ ID NO: 253850 - protein, 10 aa, Mycobacterium
DRAPDSPPKW

SEQ ID NO: 253851 - protein, 8 aa, Mycobacterium
DRAPDSVA

SEQ ID NO: 253852 - protein, 13 aa, Mycobacterium
DRAPEEMPRQSSP

SEQ ID NO: 253853 - protein, 8 aa, Mycobacterium
DRAPGTLN

SEQ ID NO: 253854 - protein, 18 aa, Mycobacterium
DRAPGTSYGGRENGPPVN

SEQ ID NO: 253855 - protein, 9 aa, Mycobacterium
DRAPTTPRK

SEQ ID NO: 253856 - protein, 6 aa, Mycobacterium
DRAPVS

SEQ ID NO: 253857 - protein, 5 aa, Mycobacterium
DRAQA

SEQ ID NO: 253858 - protein, 9 aa, Mycobacterium
DRAQSGSVI

SEQ ID NO: 253859 - protein, 9 aa, Mycobacterium
DRAQSQTDL

SEQ ID NO: 253860 - protein, 6 aa, Mycobacterium
DRARDA

SEQ ID NO: 253861 - protein, 6 aa, Mycobacterium
DRARKG

SEQ ID NO: 253862 - protein, 6 aa, Mycobacterium
DRARPE

SEQ ID NO: 253863 - protein, 9 aa, Mycobacterium
DRARQEKQK

SEQ ID NO: 253864 - protein, 9 aa, Mycobacterium
DRARTLTDD

SEQ ID NO: 253865 - protein, 12 aa, Mycobacterium
DRARTVAEDHSR

SEQ ID NO: 253866 - protein, 24 aa, Mycobacterium
DRASAGRLQPSARSCRGIGPRAAP

SEQ ID NO: 253867 - protein, 5 aa, Mycobacterium
DRASD

SEQ ID NO: 253868 - protein, 9 aa, Mycobacterium
DRASGRARD

SEQ ID NO: 253869 - protein, 34 aa, Mycobacterium
DRASHADDDHVDRGDYGYGDYGEQDDFGEQDDYD

SEQ ID NO: 253870 - protein, 9 aa, Mycobacterium
DRASTPLQQ

SEQ ID NO: 253871 - protein, 4 aa, Mycobacterium
DRAT

SEQ ID NO: 253872 - protein, 9 aa, Mycobacterium
DRATPLRDD

SEQ ID NO: 253873 - protein, 8 aa, Mycobacterium
DRAVESMD

SEQ ID NO: 253874 - protein, 16 aa, Mycobacterium
DRAYQPPDAPAKQGFA

SEQ ID NO: 253875 - protein, 8 aa, Mycobacterium
DRAYQPVD

SEQ ID NO: 253876 - protein, 8 aa, Mycobacterium
DRDAAERE

SEQ ID NO: 253877 - protein, 9 aa, Mycobacterium
DRDAASGAV

SEQ ID NO: 253878 - protein, 9 aa, Mycobacterium
DRDAASGGV

SEQ ID NO: 253879 - protein, 12 aa, Mycobacterium
DRDADGAGRRAR

SEQ ID NO: 253880 - protein, 36 aa, Mycobacterium
DRDATIDQDSTTSADAVGDQAIRDGRGSDHSVGQPG

SEQ ID NO: 253881 - protein, 11 aa, Mycobacterium
DRDCKGPKETL

SEQ ID NO: 253882 - protein, 7 aa, Mycobacterium
DRDEPAQ

SEQ ID NO: 253883 - protein, 4 aa, Mycobacterium
DRDG

SEQ ID NO: 253884 - protein, 14 aa, Mycobacterium
DRDGARPDGFDASG

SEQ ID NO: 253885 - protein, 19 aa, Mycobacterium
DRDGAVAQESLRGNNIARG

SEQ ID NO: 253886 - protein, 21 aa, Mycobacterium
DRDGGAGPAISAGAQIPEDTE

SEQ ID NO: 253887 - protein, 7 aa, Mycobacterium
DRDGPVT

SEQ ID NO: 253888 - protein, 9 aa, Mycobacterium
DRDKPASIP

SEQ ID NO: 253889 - protein, 7 aa, Mycobacterium
DRDNPYG

SEQ ID NO: 253890 - protein, 7 aa, Mycobacterium
DRDPASV

SEQ ID NO: 253891 - protein, 5 aa, Mycobacterium
DRDPE

SEQ ID NO: 253892 - protein, 9 aa, Mycobacterium
DRDPSDTEV

SEQ ID NO: 253893 - protein, 5 aa, Mycobacterium
DRDQA

SEQ ID NO: 253894 - protein, 6 aa, Mycobacterium
DRDQAG

SEQ ID NO: 253895 - protein, 5 aa, Mycobacterium
DRDQH

SEQ ID NO: 253896 - protein, 6 aa, Mycobacterium
DRDQPV

SEQ ID NO: 253897 - protein, 11 aa, Mycobacterium
DRDRERAADRL

SEQ ID NO: 253898 - protein, 6 aa, Mycobacterium
DRDRLD

SEQ ID NO: 253899 - protein, 4 aa, Mycobacterium
DRDS

SEQ ID NO: 253900 - protein, 5 aa, Mycobacterium
DRDSG

SEQ ID NO: 253901 - protein, 4 aa, Mycobacterium
DRDT

SEQ ID NO: 253902 - protein, 9 aa, Mycobacterium
DRDVSAREW

SEQ ID NO: 253903 - protein, 18 aa, Mycobacterium
DREAEPALPENNDVGPVP

SEQ ID NO: 253904 - protein, 7 aa, Mycobacterium
DREAKQT

SEQ ID NO: 253905 - protein, 5 aa, Mycobacterium
DREAL

SEQ ID NO: 253906 - protein, 6 aa, Mycobacterium
DREAYL

SEQ ID NO: 253907 - protein, 6 aa, Mycobacterium
DREEFR

SEQ ID NO: 253908 - protein, 30 aa, Mycobacterium
DREGRSTSKPASSGPEDSVNADPQASQTKP

SEQ ID NO: 253909 - protein, 5 aa, Mycobacterium
DREGY

SEQ ID NO: 253910 - protein, 6 aa, Mycobacterium
DREIDS

SEQ ID NO: 253911 - protein, 29 aa, Mycobacterium
DREPESEDDAEGNEAPPPSPRGLSSGERI

SEQ ID NO: 253912 - protein, 10 aa, Mycobacterium
DRERADRSDR

SEQ ID NO: 253913 - protein, 9 aa, Mycobacterium
DRERRTAPI

SEQ ID NO: 253914 - protein, 14 aa, Mycobacterium
DRESELRPPVRSGF

SEQ ID NO: 253915 - protein, 6 aa, Mycobacterium
DRETRA

SEQ ID NO: 253916 - protein, 7 aa, Mycobacterium
DREVADA

SEQ ID NO: 253917 - protein, 28 aa, Mycobacterium
DRFAGTGVSPTQAARALEATRSYGGGNL

SEQ ID NO: 253918 - protein, 17 aa, Mycobacterium
DRFERTTGTLAPRAAVP

SEQ ID NO: 253919 - protein, 7 aa, Mycobacterium
DRFGADE

SEQ ID NO: 253920 - protein, 6 aa, Mycobacterium
DRFGGG

SEQ ID NO: 253921 - protein, 8 aa, Mycobacterium
DRFSATPT

SEQ ID NO: 253922 - protein, 4 aa, Mycobacterium
DRGA

SEQ ID NO: 253923 - protein, 9 aa, Mycobacterium
DRGAAGQRS

SEQ ID NO: 253924 - protein, 6 aa, Mycobacterium
DRGAAT

SEQ ID NO: 253925 - protein, 9 aa, Mycobacterium
DRGAGSGET

SEQ ID NO: 253926 - protein, 6 aa, Mycobacterium
DRGARS

SEQ ID NO: 253927 - protein, 5 aa, Mycobacterium
DRGAY

SEQ ID NO: 253928 - protein, 6 aa, Mycobacterium
DRGAYS

SEQ ID NO: 253929 - protein, 7 aa, Mycobacterium
DRGCGQV

SEQ ID NO: 253930 - protein, 6 aa, Mycobacterium
DRGDGK

SEQ ID NO: 253931 - protein, 7 aa, Mycobacterium
DRGEADG

SEQ ID NO: 253932 - protein, 7 aa, Mycobacterium
DRGEDAG

SEQ ID NO: 253933 - protein, 7 aa, Mycobacterium
DRGEEDG

SEQ ID NO: 253934 - protein, 7 aa, Mycobacterium
DRGESDG

SEQ ID NO: 253935 - protein, 8 aa, Mycobacterium
DRGESGGQ

SEQ ID NO: 253936 - protein, 12 aa, Mycobacterium
DRGFSGGDGGLQ

SEQ ID NO: 253937 - protein, 17 aa, Mycobacterium
DRGGNGQAHGSVPDDGF

SEQ ID NO: 253938 - protein, 11 aa, Mycobacterium
DRGGVTVQAGG

SEQ ID NO: 253939 - protein, 4 aa, Mycobacterium
DRGL

SEQ ID NO: 253940 - protein, 8 aa, Mycobacterium
DRGLQAER

SEQ ID NO: 253941 - protein, 9 aa, Mycobacterium
DRGLQAERT

SEQ ID NO: 253942 - protein, 14 aa, Mycobacterium
DRGLVRSNNEDSVY

SEQ ID NO: 253943 - protein, 7 aa, Mycobacterium
DRGMDGG

SEQ ID NO: 253944 - protein, 6 aa, Mycobacterium
DRGNSR

SEQ ID NO: 253945 - protein, 4 aa, Mycobacterium
DRGP

SEQ ID NO: 253946 - protein, 9 aa, Mycobacterium
DRGPGAPIR

SEQ ID NO: 253947 - protein, 10 aa, Mycobacterium
DRGPGAPIRD

SEQ ID NO: 253948 - protein, 14 aa, Mycobacterium
DRGPGIPADSLGEL

SEQ ID NO: 253949 - protein, 10 aa, Mycobacterium
DRGPGIPPQE

SEQ ID NO: 253950 - protein, 12 aa, Mycobacterium
DRGPGMSQEDAS

SEQ ID NO: 253951 - protein, 5 aa, Mycobacterium
DRGPL

SEQ ID NO: 253952 - protein, 18 aa, Mycobacterium
DRGQPIGAADAAANRERT

SEQ ID NO: 253953 - protein, 5 aa, Mycobacterium
DRGQW

SEQ ID NO: 253954 - protein, 8 aa, Mycobacterium
DRGRAAVE

SEQ ID NO: 253955 - protein, 9 aa, Mycobacterium
DRGRAPLDD

SEQ ID NO: 253956 - protein, 5 aa, Mycobacterium
DRGRR

SEQ ID NO: 253957 - protein, 6 aa, Mycobacterium
DRGRRV

SEQ ID NO: 253958 - protein, 6 aa, Mycobacterium
DRGTAS

SEQ ID NO: 253959 - protein, 7 aa, Mycobacterium
DRGTAYR

SEQ ID NO: 253960 - protein, 6 aa, Mycobacterium
DRGTSE

SEQ ID NO: 253961 - protein, 5 aa, Mycobacterium
DRGTV

SEQ ID NO: 253962 - protein, 6 aa, Mycobacterium
DRGVTR

SEQ ID NO: 253963 - protein, 5 aa, Mycobacterium
DRGYA

SEQ ID NO: 253964 - protein, 7 aa, Mycobacterium
DRGYRPP

SEQ ID NO: 253965 - protein, 4 aa, Mycobacterium
DRHA

SEQ ID NO: 253966 - protein, 13 aa, Mycobacterium
DRHDGASRDVDRK

SEQ ID NO: 253967 - protein, 12 aa, Mycobacterium
DRHDGASREIDR

SEQ ID NO: 253968 - protein, 12 aa, Mycobacterium
DRHDGASREVDR

SEQ ID NO: 253969 - protein, 13 aa, Mycobacterium
DRHDGPGSAEVDR

SEQ ID NO: 253970 - protein, 11 aa, Mycobacterium
DRHDGRSPELH

SEQ ID NO: 253971 - protein, 12 aa, Mycobacterium
DRHGHPEPGPYR

SEQ ID NO: 253972 - protein, 6 aa, Mycobacterium
DRHPTA

SEQ ID NO: 253973 - protein, 13 aa, Mycobacterium
DRHRAAQTKADTE

SEQ ID NO: 253974 - protein, 5 aa, Mycobacterium
DRHSG

SEQ ID NO: 253975 - protein, 4 aa, Mycobacterium
DRIA

SEQ ID NO: 253976 - protein, 6 aa, Mycobacterium
DRIGGG

SEQ ID NO: 253977 - protein, 7 aa, Mycobacterium
DRIGPIG

SEQ ID NO: 253978 - protein, 7 aa, Mycobacterium
DRIGPTS

SEQ ID NO: 253979 - protein, 5 aa, Mycobacterium
DRIGR

SEQ ID NO: 253980 - protein, 6 aa, Mycobacterium
DRIGRR

SEQ ID NO: 253981 - protein, 14 aa, Mycobacterium
DRIGSASLNTDQNI

SEQ ID NO: 253982 - protein, 6 aa, Mycobacterium
DRIGSY

SEQ ID NO: 253983 - protein, 5 aa, Mycobacterium
DRIGT

SEQ ID NO: 253984 - protein, 4 aa, Mycobacterium
DRIS

SEQ ID NO: 253985 - protein, 7 aa, Mycobacterium
DRISGSR

SEQ ID NO: 253986 - protein, 5 aa, Mycobacterium
DRKAD

SEQ ID NO: 253987 - protein, 15 aa, Mycobacterium
DRKALRTSAPSSIGY

SEQ ID NO: 253988 - protein, 7 aa, Mycobacterium
DRKERLD

SEQ ID NO: 253989 - protein, 8 aa, Mycobacterium
DRKERLDR

SEQ ID NO: 253990 - protein, 13 aa, Mycobacterium
DRKNLPDDAHSNM

SEQ ID NO: 253991 - protein, 6 aa, Mycobacterium
DRKQLG

SEQ ID NO: 253992 - protein, 9 aa, Mycobacterium
DRKRDISNG

SEQ ID NO: 253993 - protein, 38 aa, Mycobacterium
DRKRGGNPPGQGARNGARKAAQPPAGKASRKAPRKATR

SEQ ID NO: 253994 - protein, 14 aa, Mycobacterium
DRKTSDRDTSGVGR

SEQ ID NO: 253995 - protein, 7 aa, Mycobacterium
DRKVADA

SEQ ID NO: 253996 - protein, 10 aa, Mycobacterium
DRLARGEISP

SEQ ID NO: 253997 - protein, 5 aa, Mycobacterium
DRLDE

SEQ ID NO: 253998 - protein, 7 aa, Mycobacterium
DRLDEPL

SEQ ID NO: 253999 - protein, 5 aa, Mycobacterium
DRLDG

SEQ ID NO: 254000 - protein, 6 aa, Mycobacterium
DRLEDS

SEQ ID NO: 254001 - protein, 12 aa, Mycobacterium
DRLEEERADAES

SEQ ID NO: 254002 - protein, 5 aa, Mycobacterium
DRLGG

SEQ ID NO: 254003 - protein, 5 aa, Mycobacterium
DRLGR

SEQ ID NO: 254004 - protein, 11 aa, Mycobacterium
DRLGSDSEAGL

SEQ ID NO: 254005 - protein, 15 aa, Mycobacterium
DRLKEERRDAESPTA

SEQ ID NO: 254006 - protein, 12 aa, Mycobacterium
DRLRPREHAEWS

SEQ ID NO: 254007 - protein, 17 aa, Mycobacterium
DRLSEDEATRAQRTSAP

SEQ ID NO: 254008 - protein, 7 aa, Mycobacterium
DRLSGGA

SEQ ID NO: 254009 - protein, 10 aa, Mycobacterium
DRMSPAQAER

SEQ ID NO: 254010 - protein, 28 aa, Mycobacterium
DRNAEPALPADNDVGSDPTTLPSVNGSN

SEQ ID NO: 254011 - protein, 27 aa, Mycobacterium
DRNAEPALPANNDVGPNPTTLPSVNGS

SEQ ID NO: 254012 - protein, 10 aa, Mycobacterium
DRNALPAPEY

SEQ ID NO: 254013 - protein, 10 aa, Mycobacterium
DRNDASQKID

SEQ ID NO: 254014 - protein, 6 aa, Mycobacterium
DRNDDD

SEQ ID NO: 254015 - protein, 5 aa, Mycobacterium
DRNGD

SEQ ID NO: 254016 - protein, 5 aa, Mycobacterium
DRNGL

SEQ ID NO: 254017 - protein, 8 aa, Mycobacterium
DRNGRRAA

SEQ ID NO: 254018 - protein, 4 aa, Mycobacterium
DRNK

SEQ ID NO: 254019 - protein, 4 aa, Mycobacterium
DRNN

SEQ ID NO: 254020 - protein, 7 aa, Mycobacterium
DRNPRQT

SEQ ID NO: 254021 - protein, 7 aa, Mycobacterium
DRNPTGH

SEQ ID NO: 254022 - protein, 6 aa, Mycobacterium
DRNRPG

SEQ ID NO: 254023 - protein, 11 aa, Mycobacterium
DRNVSASIEGA

SEQ ID NO: 254024 - protein, 20 aa, Mycobacterium
DRPAGLDNPRAPRRSGGMPN

SEQ ID NO: 254025 - protein, 8 aa, Mycobacterium
DRPAPAES

SEQ ID NO: 254026 - protein, 6 aa, Mycobacterium
DRPATL

SEQ ID NO: 254027 - protein, 10 aa, Mycobacterium
DRPDGRAPRW

SEQ ID NO: 254028 - protein, 5 aa, Mycobacterium
DRPDN

SEQ ID NO: 254029 - protein, 22 aa, Mycobacterium
DRPDPDCRSANAALADSYRTDI

SEQ ID NO: 254030 - protein, 11 aa, Mycobacterium
DRPDPQDNRRS

SEQ ID NO: 254031 - protein, 7 aa, Mycobacterium
DRPDQPR

SEQ ID NO: 254032 - protein, 7 aa, Mycobacterium
DRPEAQS

SEQ ID NO: 254033 - protein, 6 aa, Mycobacterium
DRPEND

SEQ ID NO: 254034 - protein, 8 aa, Mycobacterium
DRPEPARE

SEQ ID NO: 254035 - protein, 12 aa, Mycobacterium
DRPEPLPRLRVA

SEQ ID NO: 254036 - protein, 8 aa, Mycobacterium
DRPEPSEA

SEQ ID NO: 254037 - protein, 114 aa, Mycobacterium
DRPEPTESSGQPSDPGQTPPPTRSGESTESSDTASPPPESNPPYTYGASQGAYDTASQAPYGTAPQAPYGSQPYGSQPYGAYPGAYPGSYPPPYGGGYPAQPPAQGAAGPRNGL

SEQ ID NO: 254038 - protein, 5 aa, Mycobacterium
DRPES

SEQ ID NO: 254039 - protein, 6 aa, Mycobacterium
DRPFTP

SEQ ID NO: 254040 - protein, 8 aa, Mycobacterium
DRPGFGEY

SEQ ID NO: 254041 - protein, 12 aa, Mycobacterium
DRPGGLPPGATD

SEQ ID NO: 254042 - protein, 10 aa, Mycobacterium
DRPGTARPAV

SEQ ID NO: 254043 - protein, 8 aa, Mycobacterium
DRPGTREA

SEQ ID NO: 254044 - protein, 4 aa, Mycobacterium
DRPL

SEQ ID NO: 254045 - protein, 8 aa, Mycobacterium
DRPLGPAE

SEQ ID NO: 254046 - protein, 7 aa, Mycobacterium
DRPPIPP

SEQ ID NO: 254047 - protein, 10 aa, Mycobacterium
DRPPQAGAGE

SEQ ID NO: 254048 - protein, 17 aa, Mycobacterium
DRPPRKAEEPRRYGPQT

SEQ ID NO: 254049 - protein, 19 aa, Mycobacterium
DRPPRKREEPRRYAGRGEK

SEQ ID NO: 254050 - protein, 13 aa, Mycobacterium
DRPPRNAEEPRRY

SEQ ID NO: 254051 - protein, 14 aa, Mycobacterium
DRPPRRPDEPRRFD

SEQ ID NO: 254052 - protein, 22 aa, Mycobacterium
DRPPRSADEPRRFDDAKRRTPL

SEQ ID NO: 254053 - protein, 21 aa, Mycobacterium
DRPPRSADEPRRFDDARRRTP

SEQ ID NO: 254054 - protein, 14 aa, Mycobacterium
DRPPRSSDEPRRFD

SEQ ID NO: 254055 - protein, 8 aa, Mycobacterium
DRPPSGSA

SEQ ID NO: 254056 - protein, 16 aa, Mycobacterium
DRPRDDPASGTGSGGG

SEQ ID NO: 254057 - protein, 10 aa, Mycobacterium
DRPREVPPDR

SEQ ID NO: 254058 - protein, 9 aa, Mycobacterium
DRPRGEAAH

SEQ ID NO: 254059 - protein, 5 aa, Mycobacterium
DRPSS

SEQ ID NO: 254060 - protein, 14 aa, Mycobacterium
DRPTGGLPTVKGDP

SEQ ID NO: 254061 - protein, 6 aa, Mycobacterium
DRPTPE

SEQ ID NO: 254062 - protein, 7 aa, Mycobacterium
DRPTPTH

SEQ ID NO: 254063 - protein, 8 aa, Mycobacterium
DRPVDPDT

SEQ ID NO: 254064 - protein, 8 aa, Mycobacterium
DRPVDPGA

SEQ ID NO: 254065 - protein, 7 aa, Mycobacterium
DRPVDQA

SEQ ID NO: 254066 - protein, 7 aa, Mycobacterium
DRPVDRD

SEQ ID NO: 254067 - protein, 8 aa, Mycobacterium
DRPVPSES

SEQ ID NO: 254068 - protein, 12 aa, Mycobacterium
DRPVTDYSGSGV

SEQ ID NO: 254069 - protein, 25 aa, Mycobacterium
DRPVTTVSAQTNTSVTKPKTTDADS

SEQ ID NO: 254070 - protein, 4 aa, Mycobacterium
DRPW

SEQ ID NO: 254071 - protein, 14 aa, Mycobacterium
DRPYPTEADAAATR

SEQ ID NO: 254072 - protein, 5 aa, Mycobacterium
DRQGL

SEQ ID NO: 254073 - protein, 7 aa, Mycobacterium
DRQGPGK

SEQ ID NO: 254074 - protein, 41 aa, Mycobacterium
DRQHPEPDQAADEGTDPVTPDEPPGADGNGSARPPGPADDP

SEQ ID NO: 254075 - protein, 5 aa, Mycobacterium
DRQIE

SEQ ID NO: 254076 - protein, 6 aa, Mycobacterium
DRQLPP

SEQ ID NO: 254077 - protein, 10 aa, Mycobacterium
DRQPDNEVPP

SEQ ID NO: 254078 - protein, 7 aa, Mycobacterium
DRQQPAE

SEQ ID NO: 254079 - protein, 8 aa, Mycobacterium
DRQRRSLS

SEQ ID NO: 254080 - protein, 6 aa, Mycobacterium
DRQSPT

SEQ ID NO: 254081 - protein, 11 aa, Mycobacterium
DRQTASGGGAV

SEQ ID NO: 254082 - protein, 6 aa, Mycobacterium
DRQTLN

SEQ ID NO: 254083 - protein, 15 aa, Mycobacterium
DRQYAAQAQARHPVT

SEQ ID NO: 254084 - protein, 10 aa, Mycobacterium
DRRALPAPDY

SEQ ID NO: 254085 - protein, 26 aa, Mycobacterium
DRRALPAPEYQSAQRYRAPETETEKT

SEQ ID NO: 254086 - protein, 26 aa, Mycobacterium
DRRALPAPEYRSAANDYRAPSTPAEQ

SEQ ID NO: 254087 - protein, 6 aa, Mycobacterium
DRRAQL

SEQ ID NO: 254088 - protein, 15 aa, Mycobacterium
DRRASGRAVSAQTTV

SEQ ID NO: 254089 - protein, 8 aa, Mycobacterium
DRRATTTL

SEQ ID NO: 254090 - protein, 6 aa, Mycobacterium
DRRDAR

SEQ ID NO: 254091 - protein, 6 aa, Mycobacterium
DRRDQL

SEQ ID NO: 254092 - protein, 29 aa, Mycobacterium
DRRGKAETPAPTVPAEPPSQPKPGKPRVE

SEQ ID NO: 254093 - protein, 6 aa, Mycobacterium
DRRGPA

SEQ ID NO: 254094 - protein, 7 aa, Mycobacterium
DRRGPGK

SEQ ID NO: 254095 - protein, 5 aa, Mycobacterium
DRRGQ

SEQ ID NO: 254096 - protein, 15 aa, Mycobacterium
DRRGQPATTASNEGY

SEQ ID NO: 254097 - protein, 7 aa, Mycobacterium
DRRGQRS

SEQ ID NO: 254098 - protein, 10 aa, Mycobacterium
DRRGRDIESA

SEQ ID NO: 254099 - protein, 14 aa, Mycobacterium
DRRGRRSRPQESKS

SEQ ID NO: 254100 - protein, 8 aa, Mycobacterium
DRRGYRSA

SEQ ID NO: 254101 - protein, 8 aa, Mycobacterium
DRRKARRA

SEQ ID NO: 254102 - protein, 18 aa, Mycobacterium
DRRNTGDEQSSARARESP

SEQ ID NO: 254103 - protein, 10 aa, Mycobacterium
DRRPAAPGET

SEQ ID NO: 254104 - protein, 25 aa, Mycobacterium
DRRPADQHIGPDDVEDHEQHQPRAA

SEQ ID NO: 254105 - protein, 8 aa, Mycobacterium
DRRPPAPA

SEQ ID NO: 254106 - protein, 14 aa, Mycobacterium
DRRRAAQTKADTEY

SEQ ID NO: 254107 - protein, 19 aa, Mycobacterium
DRRRGSRGVPPDRDRAGPA

SEQ ID NO: 254108 - protein, 6 aa, Mycobacterium
DRRRPD

SEQ ID NO: 254109 - protein, 5 aa, Mycobacterium
DRRRY

SEQ ID NO: 254110 - protein, 12 aa, Mycobacterium
DRRSAARAALTA

SEQ ID NO: 254111 - protein, 5 aa, Mycobacterium
DRRSG

SEQ ID NO: 254112 - protein, 10 aa, Mycobacterium
DRRSSSKIGS

SEQ ID NO: 254113 - protein, 4 aa, Mycobacterium
DRRT

SEQ ID NO: 254114 - protein, 5 aa, Mycobacterium
DRRTT

SEQ ID NO: 254115 - protein, 8 aa, Mycobacterium
DRRWERDT

SEQ ID NO: 254116 - protein, 4 aa, Mycobacterium
DRSA

SEQ ID NO: 254117 - protein, 9 aa, Mycobacterium
DRSAPSEAL

SEQ ID NO: 254118 - protein, 8 aa, Mycobacterium
DRSASQLR

SEQ ID NO: 254119 - protein, 8 aa, Mycobacterium
DRSGAAVP

SEQ ID NO: 254120 - protein, 13 aa, Mycobacterium
DRSGFTGDATGTT

SEQ ID NO: 254121 - protein, 5 aa, Mycobacterium
DRSGL

SEQ ID NO: 254122 - protein, 12 aa, Mycobacterium
DRSGQRPWSENT

SEQ ID NO: 254123 - protein, 6 aa, Mycobacterium
DRSKQI

SEQ ID NO: 254124 - protein, 32 aa, Mycobacterium
DRSNRNAGESDSGTTVSGTTDSGEDSGEDEID

SEQ ID NO: 254125 - protein, 6 aa, Mycobacterium
DRSPGM

SEQ ID NO: 254126 - protein, 10 aa, Mycobacterium
DRSPKVPADL

SEQ ID NO: 254127 - protein, 14 aa, Mycobacterium
DRSPRFTAPGDQPP

SEQ ID NO: 254128 - protein, 14 aa, Mycobacterium
DRSPRLTAAGDQPP

SEQ ID NO: 254129 - protein, 15 aa, Mycobacterium
DRSPRLTAPRDQPPP

SEQ ID NO: 254130 - protein, 7 aa, Mycobacterium
DRSPSDA

SEQ ID NO: 254131 - protein, 10 aa, Mycobacterium
DRSQRAASAA

SEQ ID NO: 254132 - protein, 13 aa, Mycobacterium
DRSRAKGASQWGP

SEQ ID NO: 254133 - protein, 11 aa, Mycobacterium
DRSRAKGPSRW

SEQ ID NO: 254134 - protein, 30 aa, Mycobacterium
DRSSSADRGAASSSAPPGVGATPPSKPTLQ

SEQ ID NO: 254135 - protein, 9 aa, Mycobacterium
DRSSVEPEV

SEQ ID NO: 254136 - protein, 13 aa, Mycobacterium
DRSTAPYSDAIPT

SEQ ID NO: 254137 - protein, 10 aa, Mycobacterium
DRSTLEHAES

SEQ ID NO: 254138 - protein, 10 aa, Mycobacterium
DRSTQLTTGT

SEQ ID NO: 254139 - protein, 6 aa, Mycobacterium
DRSYHP

SEQ ID NO: 254140 - protein, 7 aa, Mycobacterium
DRTAGDI

SEQ ID NO: 254141 - protein, 5 aa, Mycobacterium
DRTAL

SEQ ID NO: 254142 - protein, 6 aa, Mycobacterium
DRTAPA

SEQ ID NO: 254143 - protein, 6 aa, Mycobacterium
DRTAPF

SEQ ID NO: 254144 - protein, 10 aa, Mycobacterium
DRTDPTKNWA

SEQ ID NO: 254145 - protein, 6 aa, Mycobacterium
DRTEEP

SEQ ID NO: 254146 - protein, 6 aa, Mycobacterium
DRTERP

SEQ ID NO: 254147 - protein, 21 aa, Mycobacterium
DRTGAAASQPTEAEPAPAVRP

SEQ ID NO: 254148 - protein, 7 aa, Mycobacterium
DRTGGGK

SEQ ID NO: 254149 - protein, 8 aa, Mycobacterium
DRTGPKGN

SEQ ID NO: 254150 - protein, 7 aa, Mycobacterium
DRTGRRK

SEQ ID NO: 254151 - protein, 36 aa, Mycobacterium
DRTPPLTRAAPSYALKSKTVAGEALADDQRPQTEFR

SEQ ID NO: 254152 - protein, 7 aa, Mycobacterium
DRTPRVA

SEQ ID NO: 254153 - protein, 6 aa, Mycobacterium
DRTRRQ

SEQ ID NO: 254154 - protein, 5 aa, Mycobacterium
DRTTA

SEQ ID NO: 254155 - protein, 7 aa, Mycobacterium
DRTTEPT

SEQ ID NO: 254156 - protein, 8 aa, Mycobacterium
DRTVPEAE

SEQ ID NO: 254157 - protein, 9 aa, Mycobacterium
DRVAAASPT

SEQ ID NO: 254158 - protein, 6 aa, Mycobacterium
DRVGGG

SEQ ID NO: 254159 - protein, 9 aa, Mycobacterium
DRVGGRSFT

SEQ ID NO: 254160 - protein, 11 aa, Mycobacterium
DRVGGRSFTGS

SEQ ID NO: 254161 - protein, 7 aa, Mycobacterium
DRVGGSR

SEQ ID NO: 254162 - protein, 6 aa, Mycobacterium
DRVGSR

SEQ ID NO: 254163 - protein, 14 aa, Mycobacterium
DRVLSGSDGPRSRA

SEQ ID NO: 254164 - protein, 8 aa, Mycobacterium
DRVPGGGS

SEQ ID NO: 254165 - protein, 26 aa, Mycobacterium
DRWSERSSRVEGQSVDTRDTNSTYCR

SEQ ID NO: 254166 - protein, 5 aa, Mycobacterium
DRWTG

SEQ ID NO: 254167 - protein, 8 aa, Mycobacterium
DRYDPNSR

SEQ ID NO: 254168 - protein, 4 aa, Mycobacterium
DRYG

SEQ ID NO: 254169 - protein, 5 aa, Mycobacterium
DRYGG

SEQ ID NO: 254170 - protein, 9 aa, Mycobacterium
DRYGHGTGD

SEQ ID NO: 254171 - protein, 5 aa, Mycobacterium
DRYGR

SEQ ID NO: 254172 - protein, 31 aa, Mycobacterium
DRYRDEDAAGVSDADPYAPGADTRADTLDDA

SEQ ID NO: 254173 - protein, 9 aa, Mycobacterium
DRYSDDETF

SEQ ID NO: 254174 - protein, 6 aa, Mycobacterium
DSAADF

SEQ ID NO: 254175 - protein, 11 aa, Mycobacterium
DSAAEEHRSAP

SEQ ID NO: 254176 - protein, 9 aa, Mycobacterium
DSAAEGTTV

SEQ ID NO: 254177 - protein, 9 aa, Mycobacterium
DSAAGGMSP

SEQ ID NO: 254178 - protein, 13 aa, Mycobacterium
DSAAGPNRGARQG

SEQ ID NO: 254179 - protein, 8 aa, Mycobacterium
DSAARHHG

SEQ ID NO: 254180 - protein, 9 aa, Mycobacterium
DSAATLDGR

SEQ ID NO: 254181 - protein, 9 aa, Mycobacterium
DSADSNVRV

SEQ ID NO: 254182 - protein, 10 aa, Mycobacterium
DSADVPTERG

SEQ ID NO: 254183 - protein, 7 aa, Mycobacterium
DSADYED

SEQ ID NO: 254184 - protein, 7 aa, Mycobacterium
DSADYHE

SEQ ID NO: 254185 - protein, 10 aa, Mycobacterium
DSAEGEGNST

SEQ ID NO: 254186 - protein, 17 aa, Mycobacterium
DSAEKDTADGSDLGGGT

SEQ ID NO: 254187 - protein, 12 aa, Mycobacterium
DSAGDMGAAART

SEQ ID NO: 254188 - protein, 9 aa, Mycobacterium
DSAGEVNGT

SEQ ID NO: 254189 - protein, 16 aa, Mycobacterium
DSAGKPIGGGFPDPNL

SEQ ID NO: 254190 - protein, 10 aa, Mycobacterium
DSAGLSPADL

SEQ ID NO: 254191 - protein, 16 aa, Mycobacterium
DSAGRPIGGGFPDPNL

SEQ ID NO: 254192 - protein, 7 aa, Mycobacterium
DSAGSTP

SEQ ID NO: 254193 - protein, 13 aa, Mycobacterium
DSAGVDDAKEYNS

SEQ ID NO: 254194 - protein, 11 aa, Mycobacterium
DSAGVSREAAA

SEQ ID NO: 254195 - protein, 7 aa, Mycobacterium
DSAHRDQ

SEQ ID NO: 254196 - protein, 11 aa, Mycobacterium
DSAKGITETAE

SEQ ID NO: 254197 - protein, 37 aa, Mycobacterium
DSALAGKDGSLTYDRGSDGAVIPGSYRDRHDAVNGST

SEQ ID NO: 254198 - protein, 61 aa, Mycobacterium
DSAPAPAAEAEAEAPESEAAAPPASDVPLPPPPTNPAGPSPNGQSSSTPDLKGAADALNQE

SEQ ID NO: 254199 - protein, 10 aa, Mycobacterium
DSAPGQITSD

SEQ ID NO: 254200 - protein, 8 aa, Mycobacterium
DSAQRSAT

SEQ ID NO: 254201 - protein, 12 aa, Mycobacterium
DSARDREHGGAG

SEQ ID NO: 254202 - protein, 30 aa, Mycobacterium
DSARETPGTDVTAAPCTAPSARDGTPPTAR

SEQ ID NO: 254203 - protein, 7 aa, Mycobacterium
DSARGAR

SEQ ID NO: 254204 - protein, 6 aa, Mycobacterium
DSARIQ

SEQ ID NO: 254205 - protein, 7 aa, Mycobacterium
DSARPGM

SEQ ID NO: 254206 - protein, 9 aa, Mycobacterium
DSARPSDRD

SEQ ID NO: 254207 - protein, 26 aa, Mycobacterium
DSARSGSATLAAGARQLSDGINQATD

SEQ ID NO: 254208 - protein, 9 aa, Mycobacterium
DSARSRNTV

SEQ ID NO: 254209 - protein, 14 aa, Mycobacterium
DSASAGSQEDRVRE

SEQ ID NO: 254210 - protein, 8 aa, Mycobacterium
DSASGLYE

SEQ ID NO: 254211 - protein, 8 aa, Mycobacterium
DSASRPER

SEQ ID NO: 254212 - protein, 8 aa, Mycobacterium
DSASTKVH

SEQ ID NO: 254213 - protein, 10 aa, Mycobacterium
DSATARRQDA

SEQ ID NO: 254214 - protein, 6 aa, Mycobacterium
DSATDT

SEQ ID NO: 254215 - protein, 10 aa, Mycobacterium
DSATDVAKDA

SEQ ID NO: 254216 - protein, 7 aa, Mycobacterium
DSAVEPT

SEQ ID NO: 254217 - protein, 4 aa, Mycobacterium
DSCP

SEQ ID NO: 254218 - protein, 13 aa, Mycobacterium
DSCTTSDHGREIS

SEQ ID NO: 254219 - protein, 4 aa, Mycobacterium
DSDA

SEQ ID NO: 254220 - protein, 11 aa, Mycobacterium
DSDAGETGVAT

SEQ ID NO: 254221 - protein, 7 aa, Mycobacterium
DSDDPTY

SEQ ID NO: 254222 - protein, 8 aa, Mycobacterium
DSDERTSL

SEQ ID NO: 254223 - protein, 7 aa, Mycobacterium
DSDGPDV

SEQ ID NO: 254224 - protein, 7 aa, Mycobacterium
DSDGPTY

SEQ ID NO: 254225 - protein, 18 aa, Mycobacterium
DSDGRGLHDRLTGTAVVR

SEQ ID NO: 254226 - protein, 8 aa, Mycobacterium
DSDGVRRT

SEQ ID NO: 254227 - protein, 5 aa, Mycobacterium
DSDHA

SEQ ID NO: 254228 - protein, 7 aa, Mycobacterium
DSDHDRR

SEQ ID NO: 254229 - protein, 6 aa, Mycobacterium
DSDKFA

SEQ ID NO: 254230 - protein, 4 aa, Mycobacterium
DSDN

SEQ ID NO: 254231 - protein, 8 aa, Mycobacterium
DSDNGTIR

SEQ ID NO: 254232 - protein, 6 aa, Mycobacterium
DSDPAV

SEQ ID NO: 254233 - protein, 23 aa, Mycobacterium
DSDPDSADSAPAATEGESSGEGM

SEQ ID NO: 254234 - protein, 8 aa, Mycobacterium
DSDPHFPR

SEQ ID NO: 254235 - protein, 17 aa, Mycobacterium
DSDPRQAASSPTTTTVS

SEQ ID NO: 254236 - protein, 7 aa, Mycobacterium
DSDQRGL

SEQ ID NO: 254237 - protein, 11 aa, Mycobacterium
DSDRTLDDGYG

SEQ ID NO: 254238 - protein, 7 aa, Mycobacterium
DSDSPTY

SEQ ID NO: 254239 - protein, 5 aa, Mycobacterium
DSDTR

SEQ ID NO: 254240 - protein, 12 aa, Mycobacterium
DSDYRYERQQSR

SEQ ID NO: 254241 - protein, 15 aa, Mycobacterium
DSEAVATGKEPFRAD

SEQ ID NO: 254242 - protein, 8 aa, Mycobacterium
DSEGGLPV

SEQ ID NO: 254243 - protein, 13 aa, Mycobacterium
DSEGLARDKEPFQ

SEQ ID NO: 254244 - protein, 11 aa, Mycobacterium
DSEGSGTLDPQ

SEQ ID NO: 254245 - protein, 10 aa, Mycobacterium
DSEHASTPME

SEQ ID NO: 254246 - protein, 20 aa, Mycobacterium
DSELRAQQAATAAQRAENAT

SEQ ID NO: 254247 - protein, 5 aa, Mycobacterium
DSEQI

SEQ ID NO: 254248 - protein, 8 aa, Mycobacterium
DSEQLPGP

SEQ ID NO: 254249 - protein, 7 aa, Mycobacterium
DSESPTY

SEQ ID NO: 254250 - protein, 9 aa, Mycobacterium
DSFGDPMTG

SEQ ID NO: 254251 - protein, 5 aa, Mycobacterium
DSFKT

SEQ ID NO: 254252 - protein, 6 aa, Mycobacterium
DSFPGV

SEQ ID NO: 254253 - protein, 10 aa, Mycobacterium
DSFSSSPTWR

SEQ ID NO: 254254 - protein, 9 aa, Mycobacterium
DSFTAAGGG

SEQ ID NO: 254255 - protein, 9 aa, Mycobacterium
DSGAEHDRA

SEQ ID NO: 254256 - protein, 7 aa, Mycobacterium
DSGAGDR

SEQ ID NO: 254257 - protein, 5 aa, Mycobacterium
DSGAL

SEQ ID NO: 254258 - protein, 20 aa, Mycobacterium
DSGALTEEEFQSEKRRILDG

SEQ ID NO: 254259 - protein, 20 aa, Mycobacterium
DSGALTESEFESEKRRILQG

SEQ ID NO: 254260 - protein, 19 aa, Mycobacterium
DSGALTQEEFEAEKRRILD

SEQ ID NO: 254261 - protein, 10 aa, Mycobacterium
DSGARGATNT

SEQ ID NO: 254262 - protein, 6 aa, Mycobacterium
DSGARW

SEQ ID NO: 254263 - protein, 4 aa, Mycobacterium
DSGD

SEQ ID NO: 254264 - protein, 6 aa, Mycobacterium
DSGDGF

SEQ ID NO: 254265 - protein, 8 aa, Mycobacterium
DSGDGVAP

SEQ ID NO: 254266 - protein, 19 aa, Mycobacterium
DSGDNVSPQYTNPGRFTGG

SEQ ID NO: 254267 - protein, 5 aa, Mycobacterium
DSGDR

SEQ ID NO: 254268 - protein, 18 aa, Mycobacterium
DSGFDRAGRSAPNPHEAT

SEQ ID NO: 254269 - protein, 16 aa, Mycobacterium
DSGFGRPAAGSAHPHE

SEQ ID NO: 254270 - protein, 7 aa, Mycobacterium
DSGGANI

SEQ ID NO: 254271 - protein, 8 aa, Mycobacterium
DSGGGTDL

SEQ ID NO: 254272 - protein, 10 aa, Mycobacterium
DSGGINTGDK

SEQ ID NO: 254273 - protein, 9 aa, Mycobacterium
DSGGLESGG

SEQ ID NO: 254274 - protein, 9 aa, Mycobacterium
DSGGNPLPQ

SEQ ID NO: 254275 - protein, 28 aa, Mycobacterium
DSGGNTTGNLSAPGQADAADAASAAAAL

SEQ ID NO: 254276 - protein, 7 aa, Mycobacterium
DSGGYYY

SEQ ID NO: 254277 - protein, 5 aa, Mycobacterium
DSGHN

SEQ ID NO: 254278 - protein, 6 aa, Mycobacterium
DSGIEQ

SEQ ID NO: 254279 - protein, 5 aa, Mycobacterium
DSGKQ

SEQ ID NO: 254280 - protein, 7 aa, Mycobacterium
DSGLAEP

SEQ ID NO: 254281 - protein, 23 aa, Mycobacterium
DSGLAQDDDELSEHTNDTDGYKN

SEQ ID NO: 254282 - protein, 16 aa, Mycobacterium
DSGLDRPPPGSGNPHE

SEQ ID NO: 254283 - protein, 12 aa, Mycobacterium
DSGLGADRLTES

SEQ ID NO: 254284 - protein, 13 aa, Mycobacterium
DSGLGTDRRAGSA

SEQ ID NO: 254285 - protein, 6 aa, Mycobacterium
DSGLNP

SEQ ID NO: 254286 - protein, 6 aa, Mycobacterium
DSGLSR

SEQ ID NO: 254287 - protein, 4 aa, Mycobacterium
DSGN

SEQ ID NO: 254288 - protein, 31 aa, Mycobacterium
DSGNRLAPRPVSRPPVDPASRREFSRPDGLR

SEQ ID NO: 254289 - protein, 5 aa, Mycobacterium
DSGPF

SEQ ID NO: 254290 - protein, 31 aa, Mycobacterium
DSGPGAPTPPPLQSPGVAGAPPAPSDGHDHH

SEQ ID NO: 254291 - protein, 29 aa, Mycobacterium
DSGPGMDPDTFEKATQRGYSTKADTSGHG

SEQ ID NO: 254292 - protein, 6 aa, Mycobacterium
DSGPHG

SEQ ID NO: 254293 - protein, 15 aa, Mycobacterium
DSGPLLESQAETTDA

SEQ ID NO: 254294 - protein, 10 aa, Mycobacterium
DSGPNAGANT

SEQ ID NO: 254295 - protein, 10 aa, Mycobacterium
DSGPNAGATT

SEQ ID NO: 254296 - protein, 9 aa, Mycobacterium
DSGPNEGAD

SEQ ID NO: 254297 - protein, 9 aa, Mycobacterium
DSGPNKGAR

SEQ ID NO: 254298 - protein, 9 aa, Mycobacterium
DSGQLSKTP

SEQ ID NO: 254299 - protein, 6 aa, Mycobacterium
DSGQLT

SEQ ID NO: 254300 - protein, 15 aa, Mycobacterium
DSGQPARMDSHDTAI

SEQ ID NO: 254301 - protein, 16 aa, Mycobacterium
DSGQVDGATIRRPDGT

SEQ ID NO: 254302 - protein, 5 aa, Mycobacterium
DSGRD

SEQ ID NO: 254303 - protein, 10 aa, Mycobacterium
DSGRRVQGSA

SEQ ID NO: 254304 - protein, 14 aa, Mycobacterium
DSGRVGARDMPSGD

SEQ ID NO: 254305 - protein, 9 aa, Mycobacterium
DSGSGAVPV

SEQ ID NO: 254306 - protein, 5 aa, Mycobacterium
DSGSS

SEQ ID NO: 254307 - protein, 8 aa, Mycobacterium
DSGSSIAP

SEQ ID NO: 254308 - protein, 28 aa, Mycobacterium
DSGTETASASTSTTETSSPFDVPPPAEA

SEQ ID NO: 254309 - protein, 10 aa, Mycobacterium
DSGVQDGPAR

SEQ ID NO: 254310 - protein, 4 aa, Mycobacterium
DSGW

SEQ ID NO: 254311 - protein, 14 aa, Mycobacterium
DSGWQGSAARSYGA

SEQ ID NO: 254312 - protein, 8 aa, Mycobacterium
DSGYADAT

SEQ ID NO: 254313 - protein, 9 aa, Mycobacterium
DSHDGDDAL

SEQ ID NO: 254314 - protein, 5 aa, Mycobacterium
DSHDI

SEQ ID NO: 254315 - protein, 6 aa, Mycobacterium
DSHGVP

SEQ ID NO: 254316 - protein, 6 aa, Mycobacterium
DSHPNL

SEQ ID NO: 254317 - protein, 7 aa, Mycobacterium
DSHPPAG

SEQ ID NO: 254318 - protein, 6 aa, Mycobacterium
DSHQPW

SEQ ID NO: 254319 - protein, 9 aa, Mycobacterium
DSHSPATHT

SEQ ID NO: 254320 - protein, 4 aa, Mycobacterium
DSIS

SEQ ID NO: 254321 - protein, 8 aa, Mycobacterium
DSKDTDAL

SEQ ID NO: 254322 - protein, 4 aa, Mycobacterium
DSKF

SEQ ID NO: 254323 - protein, 6 aa, Mycobacterium
DSKGSN

SEQ ID NO: 254324 - protein, 36 aa, Mycobacterium
DSKPIAAQDELNTATAAAQPAGAPVEPSLDDEDQAQ

SEQ ID NO: 254325 - protein, 8 aa, Mycobacterium
DSKPPAGV

SEQ ID NO: 254326 - protein, 9 aa, Mycobacterium
DSKRSRSAA

SEQ ID NO: 254327 - protein, 10 aa, Mycobacterium
DSKSTQFSSS

SEQ ID NO: 254328 - protein, 4 aa, Mycobacterium
DSKV

SEQ ID NO: 254329 - protein, 5 aa, Mycobacterium
DSLGP

SEQ ID NO: 254330 - protein, 6 aa, Mycobacterium
DSLGRR

SEQ ID NO: 254331 - protein, 10 aa, Mycobacterium
DSLKDATPHL

SEQ ID NO: 254332 - protein, 4 aa, Mycobacterium
DSLM

SEQ ID NO: 254333 - protein, 16 aa, Mycobacterium
DSLSDEEASRAEKATA

SEQ ID NO: 254334 - protein, 23 aa, Mycobacterium
DSLSTATRDQSTGIVGGKPPEIA

SEQ ID NO: 254335 - protein, 6 aa, Mycobacterium
DSLTDR

SEQ ID NO: 254336 - protein, 8 aa, Mycobacterium
DSLTPQQR

SEQ ID NO: 254337 - protein, 26 aa, Mycobacterium
DSMADEAARRGPSTPSTPAQPSSMAS

SEQ ID NO: 254338 - protein, 4 aa, Mycobacterium
DSME

SEQ ID NO: 254339 - protein, 10 aa, Mycobacterium
DSMSPQEAAR

SEQ ID NO: 254340 - protein, 10 aa, Mycobacterium
DSMTDAVDDS

SEQ ID NO: 254341 - protein, 10 aa, Mycobacterium
DSMTPQEATR

SEQ ID NO: 254342 - protein, 19 aa, Mycobacterium
DSNAGHDASGPDEGPAAPV

SEQ ID NO: 254343 - protein, 9 aa, Mycobacterium
DSNAPQLDS

SEQ ID NO: 254344 - protein, 6 aa, Mycobacterium
DSNGVP

SEQ ID NO: 254345 - protein, 6 aa, Mycobacterium
DSNHGA

SEQ ID NO: 254346 - protein, 4 aa, Mycobacterium
DSNI

SEQ ID NO: 254347 - protein, 8 aa, Mycobacterium
DSNKVDDN

SEQ ID NO: 254348 - protein, 7 aa, Mycobacterium
DSNNVDQ

SEQ ID NO: 254349 - protein, 16 aa, Mycobacterium
DSNPDHARSATTGGAA

SEQ ID NO: 254350 - protein, 17 aa, Mycobacterium
DSNPGYIRSTSTGSATF

SEQ ID NO: 254351 - protein, 8 aa, Mycobacterium
DSNPTHAG

SEQ ID NO: 254352 - protein, 9 aa, Mycobacterium
DSNPTHAGL

SEQ ID NO: 254353 - protein, 18 aa, Mycobacterium
DSNPTHPGLRSAATGGAT

SEQ ID NO: 254354 - protein, 18 aa, Mycobacterium
DSNPTHTGLRSAATRGAS

SEQ ID NO: 254355 - protein, 18 aa, Mycobacterium
DSNPTHTGLRSAATRGAT

SEQ ID NO: 254356 - protein, 22 aa, Mycobacterium
DSNPVPSTGAPGNSTFNSAKAG

SEQ ID NO: 254357 - protein, 7 aa, Mycobacterium
DSNQVDQ

SEQ ID NO: 254358 - protein, 6 aa, Mycobacterium
DSNSSP

SEQ ID NO: 254359 - protein, 4 aa, Mycobacterium
DSPA

SEQ ID NO: 254360 - protein, 17 aa, Mycobacterium
DSPAARQPAPTPPQPVA

SEQ ID NO: 254361 - protein, 11 aa, Mycobacterium
DSPADAGAATA

SEQ ID NO: 254362 - protein, 7 aa, Mycobacterium
DSPAHAH

SEQ ID NO: 254363 - protein, 12 aa, Mycobacterium
DSPDDLDPALRR

SEQ ID NO: 254364 - protein, 28 aa, Mycobacterium
DSPDNTAKAETPATHAQTPHVAAPSRTP

SEQ ID NO: 254365 - protein, 10 aa, Mycobacterium
DSPEGRAASL

SEQ ID NO: 254366 - protein, 5 aa, Mycobacterium
DSPFG

SEQ ID NO: 254367 - protein, 8 aa, Mycobacterium
DSPGSLTP

SEQ ID NO: 254368 - protein, 8 aa, Mycobacterium
DSPGSTRL

SEQ ID NO: 254369 - protein, 6 aa, Mycobacterium
DSPLAR

SEQ ID NO: 254370 - protein, 6 aa, Mycobacterium
DSPLGG

SEQ ID NO: 254371 - protein, 7 aa, Mycobacterium
DSPPALA

SEQ ID NO: 254372 - protein, 7 aa, Mycobacterium
DSPPAVV

SEQ ID NO: 254373 - protein, 9 aa, Mycobacterium
DSPPEELAP

SEQ ID NO: 254374 - protein, 15 aa, Mycobacterium
DSPPKPAPAASLPKT

SEQ ID NO: 254375 - protein, 7 aa, Mycobacterium
DSPQPAF

SEQ ID NO: 254376 - protein, 7 aa, Mycobacterium
DSPQPAL

SEQ ID NO: 254377 - protein, 14 aa, Mycobacterium
DSPQSPEKPPARAR

SEQ ID NO: 254378 - protein, 13 aa, Mycobacterium
DSPRLESGASRLQ

SEQ ID NO: 254379 - protein, 13 aa, Mycobacterium
DSPRSESGASRLQ

SEQ ID NO: 254380 - protein, 8 aa, Mycobacterium
DSPRVGTT

SEQ ID NO: 254381 - protein, 5 aa, Mycobacterium
DSPSC

SEQ ID NO: 254382 - protein, 8 aa, Mycobacterium
DSPSDKGI

SEQ ID NO: 254383 - protein, 7 aa, Mycobacterium
DSPSWTP

SEQ ID NO: 254384 - protein, 9 aa, Mycobacterium
DSPTARRQD

SEQ ID NO: 254385 - protein, 5 aa, Mycobacterium
DSPTV

SEQ ID NO: 254386 - protein, 21 aa, Mycobacterium
DSPTVVPTPPPAVPPAPPAPH

SEQ ID NO: 254387 - protein, 10 aa, Mycobacterium
DSPVGHNPGA

SEQ ID NO: 254388 - protein, 8 aa, Mycobacterium
DSQALPAG

SEQ ID NO: 254389 - protein, 10 aa, Mycobacterium
DSQANSRDPI

SEQ ID NO: 254390 - protein, 5 aa, Mycobacterium
DSQAR

SEQ ID NO: 254391 - protein, 16 aa, Mycobacterium
DSQAVAAGKDPFTQDG

SEQ ID NO: 254392 - protein, 8 aa, Mycobacterium
DSQGAANA

SEQ ID NO: 254393 - protein, 7 aa, Mycobacterium
DSQGAQE

SEQ ID NO: 254394 - protein, 15 aa, Mycobacterium
DSQLATAQESIRTAN

SEQ ID NO: 254395 - protein, 9 aa, Mycobacterium
DSQPDPPAD

SEQ ID NO: 254396 - protein, 7 aa, Mycobacterium
DSQRELD

SEQ ID NO: 254397 - protein, 16 aa, Mycobacterium
DSQSVGAVRSGRVGGA

SEQ ID NO: 254398 - protein, 10 aa, Mycobacterium
DSQTHSSDAI

SEQ ID NO: 254399 - protein, 7 aa, Mycobacterium
DSQVTRD

SEQ ID NO: 254400 - protein, 8 aa, Mycobacterium
DSRAAGSD

SEQ ID NO: 254401 - protein, 8 aa, Mycobacterium
DSRADDSV

SEQ ID NO: 254402 - protein, 39 aa, Mycobacterium
DSRAQTEDDPTVTDTSGWSQHGPAAGTGPDAVTEPVGRR

SEQ ID NO: 254403 - protein, 29 aa, Mycobacterium
DSRASTKVRVNETGSPSAAAGEITARSVT

SEQ ID NO: 254404 - protein, 13 aa, Mycobacterium
DSRDMPSRTDTLG

SEQ ID NO: 254405 - protein, 6 aa, Mycobacterium
DSRDRR

SEQ ID NO: 254406 - protein, 4 aa, Mycobacterium
DSRE

SEQ ID NO: 254407 - protein, 6 aa, Mycobacterium
DSRERS

SEQ ID NO: 254408 - protein, 6 aa, Mycobacterium
DSRGLG

SEQ ID NO: 254409 - protein, 5 aa, Mycobacterium
DSRIA

SEQ ID NO: 254410 - protein, 24 aa, Mycobacterium
DSRLGSNAEIGAGTTEDAAGARSD

SEQ ID NO: 254411 - protein, 11 aa, Mycobacterium
DSRLPKELTSG

SEQ ID NO: 254412 - protein, 4 aa, Mycobacterium
DSRM

SEQ ID NO: 254413 - protein, 18 aa, Mycobacterium
DSRNGLEERVGEKVEAEP

SEQ ID NO: 254414 - protein, 11 aa, Mycobacterium
DSRNTSDVAKK

SEQ ID NO: 254415 - protein, 18 aa, Mycobacterium
DSRPASSVRPGSRSAEVP

SEQ ID NO: 254416 - protein, 5 aa, Mycobacterium
DSRPD

SEQ ID NO: 254417 - protein, 13 aa, Mycobacterium
DSRPGRNQPPGAF

SEQ ID NO: 254418 - protein, 8 aa, Mycobacterium
DSRPGSEW

SEQ ID NO: 254419 - protein, 8 aa, Mycobacterium
DSRPRRPR

SEQ ID NO: 254420 - protein, 8 aa, Mycobacterium
DSRPSPED

SEQ ID NO: 254421 - protein, 26 aa, Mycobacterium
DSRQGLTTEQQRELTTGGDPGDGRTD

SEQ ID NO: 254422 - protein, 8 aa, Mycobacterium
DSRSARGP

SEQ ID NO: 254423 - protein, 5 aa, Mycobacterium
DSRTL

SEQ ID NO: 254424 - protein, 5 aa, Mycobacterium
DSRTN

SEQ ID NO: 254425 - protein, 7 aa, Mycobacterium
DSRTNEI

SEQ ID NO: 254426 - protein, 9 aa, Mycobacterium
DSRTSPELD

SEQ ID NO: 254427 - protein, 11 aa, Mycobacterium
DSRTVSEPYET

SEQ ID NO: 254428 - protein, 11 aa, Mycobacterium
DSRYRASAGLR

SEQ ID NO: 254429 - protein, 11 aa, Mycobacterium
DSSAASPPHLP

SEQ ID NO: 254430 - protein, 10 aa, Mycobacterium
DSSAASSHIP

SEQ ID NO: 254431 - protein, 17 aa, Mycobacterium
DSSAQGLTATEASQRLQ

SEQ ID NO: 254432 - protein, 12 aa, Mycobacterium
DSSATAQERSRA

SEQ ID NO: 254433 - protein, 8 aa, Mycobacterium
DSSDIDPL

SEQ ID NO: 254434 - protein, 12 aa, Mycobacterium
DSSEPVLQYATA

SEQ ID NO: 254435 - protein, 23 aa, Mycobacterium
DSSERRRELDRQSAPGDSRRGFD

SEQ ID NO: 254436 - protein, 6 aa, Mycobacterium
DSSGEI

SEQ ID NO: 254437 - protein, 32 aa, Mycobacterium
DSSGLEPEADADDDEEMPAPIPRNASRRRRFD

SEQ ID NO: 254438 - protein, 42 aa, Mycobacterium
DSSGLEPPAEDADDDDEVPAPMPRSAARRRRLDAKTAAAVSA

SEQ ID NO: 254439 - protein, 20 aa, Mycobacterium
DSSGLEPPEDPQDDHDAPAS

SEQ ID NO: 254440 - protein, 9 aa, Mycobacterium
DSSGPPLPP

SEQ ID NO: 254441 - protein, 6 aa, Mycobacterium
DSSIPP

SEQ ID NO: 254442 - protein, 6 aa, Mycobacterium
DSSKND

SEQ ID NO: 254443 - protein, 5 aa, Mycobacterium
DSSLA

SEQ ID NO: 254444 - protein, 12 aa, Mycobacterium
DSSLTSVSGASN

SEQ ID NO: 254445 - protein, 6 aa, Mycobacterium
DSSPAR

SEQ ID NO: 254446 - protein, 7 aa, Mycobacterium
DSSPDLR

SEQ ID NO: 254447 - protein, 8 aa, Mycobacterium
DSSPDPAN

SEQ ID NO: 254448 - protein, 6 aa, Mycobacterium
DSSPVS

SEQ ID NO: 254449 - protein, 13 aa, Mycobacterium
DSSRARASGGTGL

SEQ ID NO: 254450 - protein, 6 aa, Mycobacterium
DSSRHL

SEQ ID NO: 254451 - protein, 13 aa, Mycobacterium
DSSRTRSSGGTGL

SEQ ID NO: 254452 - protein, 9 aa, Mycobacterium
DSSSKGATA

SEQ ID NO: 254453 - protein, 13 aa, Mycobacterium
DSSSLTSGDSVRA

SEQ ID NO: 254454 - protein, 9 aa, Mycobacterium
DSSSPQPIP

SEQ ID NO: 254455 - protein, 4 aa, Mycobacterium
DSST

SEQ ID NO: 254456 - protein, 10 aa, Mycobacterium
DSSTGEFKDE

SEQ ID NO: 254457 - protein, 5 aa, Mycobacterium
DSSVT

SEQ ID NO: 254458 - protein, 21 aa, Mycobacterium
DSTAGNATEKVAGNGDGEYRK

SEQ ID NO: 254459 - protein, 9 aa, Mycobacterium
DSTAPAQGR

SEQ ID NO: 254460 - protein, 13 aa, Mycobacterium
DSTDGLTDCDGRG

SEQ ID NO: 254461 - protein, 8 aa, Mycobacterium
DSTEPLAR

SEQ ID NO: 254462 - protein, 8 aa, Mycobacterium
DSTFTAGD

SEQ ID NO: 254463 - protein, 4 aa, Mycobacterium
DSTG

SEQ ID NO: 254464 - protein, 7 aa, Mycobacterium
DSTGDPV

SEQ ID NO: 254465 - protein, 9 aa, Mycobacterium
DSTGTAASM

SEQ ID NO: 254466 - protein, 4 aa, Mycobacterium
DSTI

SEQ ID NO: 254467 - protein, 6 aa, Mycobacterium
DSTIEA

SEQ ID NO: 254468 - protein, 5 aa, Mycobacterium
DSTNP

SEQ ID NO: 254469 - protein, 5 aa, Mycobacterium
DSTPV

SEQ ID NO: 254470 - protein, 12 aa, Mycobacterium
DSTRAADPGALV

SEQ ID NO: 254471 - protein, 6 aa, Mycobacterium
DSTRDR

SEQ ID NO: 254472 - protein, 5 aa, Mycobacterium
DSTRT

SEQ ID NO: 254473 - protein, 43 aa, Mycobacterium
DSTSSDQPGSGKPPKPQSGPGPAAASGPAATTTPASTPFDPDA

SEQ ID NO: 254474 - protein, 7 aa, Mycobacterium
DSTTAYS

SEQ ID NO: 254475 - protein, 7 aa, Mycobacterium
DSTTKTA

SEQ ID NO: 254476 - protein, 8 aa, Mycobacterium
DSTTNQPI

SEQ ID NO: 254477 - protein, 6 aa, Mycobacterium
DSTTRE

SEQ ID NO: 254478 - protein, 7 aa, Mycobacterium
DSVDKNR

SEQ ID NO: 254479 - protein, 14 aa, Mycobacterium
DSVGAEAQARLDEA

SEQ ID NO: 254480 - protein, 11 aa, Mycobacterium
DSVGTGTRAGP

SEQ ID NO: 254481 - protein, 26 aa, Mycobacterium
DSVGTQRSPSPSGTDSRDPQQPWAEV

SEQ ID NO: 254482 - protein, 4 aa, Mycobacterium
DSVL

SEQ ID NO: 254483 - protein, 15 aa, Mycobacterium
DSVPGRRGPGRWGST

SEQ ID NO: 254484 - protein, 10 aa, Mycobacterium
DSVPKGQFEA

SEQ ID NO: 254485 - protein, 11 aa, Mycobacterium
DSVQTGEGPLA

SEQ ID NO: 254486 - protein, 6 aa, Mycobacterium
DSVRAS

SEQ ID NO: 254487 - protein, 4 aa, Mycobacterium
DSVS

SEQ ID NO: 254488 - protein, 6 aa, Mycobacterium
DSVSGY

SEQ ID NO: 254489 - protein, 47 aa, Mycobacterium
DSVTAPAPDPQAEPQTQPAPPSSDAPIPPPPTDPSGPSGNGATANLA

SEQ ID NO: 254490 - protein, 6 aa, Mycobacterium
DSVTDN

SEQ ID NO: 254491 - protein, 6 aa, Mycobacterium
DSWQGE

SEQ ID NO: 254492 - protein, 7 aa, Mycobacterium
DSWSTRS

SEQ ID NO: 254493 - protein, 6 aa, Mycobacterium
DSWTEN

SEQ ID NO: 254494 - protein, 23 aa, Mycobacterium
DSYADDGDDAEGNYDEDRGKLPG

SEQ ID NO: 254495 - protein, 4 aa, Mycobacterium
DSYG

SEQ ID NO: 254496 - protein, 12 aa, Mycobacterium
DSYNASAGPVGD

SEQ ID NO: 254497 - protein, 11 aa, Mycobacterium
DSYNASSGPIG

SEQ ID NO: 254498 - protein, 8 aa, Mycobacterium
DSYSEEGP

SEQ ID NO: 254499 - protein, 4 aa, Mycobacterium
DSYT

SEQ ID NO: 254500 - protein, 10 aa, Mycobacterium
DTAADGTPGI

SEQ ID NO: 254501 - protein, 10 aa, Mycobacterium
DTAAEVSGAV

SEQ ID NO: 254502 - protein, 7 aa, Mycobacterium
DTAAGLE

SEQ ID NO: 254503 - protein, 9 aa, Mycobacterium
DTAAGTASG

SEQ ID NO: 254504 - protein, 14 aa, Mycobacterium
DTAALTAAARSAGV

SEQ ID NO: 254505 - protein, 4 aa, Mycobacterium
DTAD

SEQ ID NO: 254506 - protein, 6 aa, Mycobacterium
DTADEI

SEQ ID NO: 254507 - protein, 5 aa, Mycobacterium
DTADG

SEQ ID NO: 254508 - protein, 16 aa, Mycobacterium
DTADTGAAGSVIGGPL

SEQ ID NO: 254509 - protein, 12 aa, Mycobacterium
DTADTPPADVDG

SEQ ID NO: 254510 - protein, 7 aa, Mycobacterium
DTAEDDK

SEQ ID NO: 254511 - protein, 9 aa, Mycobacterium
DTAERVQGQ

SEQ ID NO: 254512 - protein, 73 aa, Mycobacterium
DTAEVDADEPVDYPEDAVDAENAAASEETMSDGVAAETAADDVDASDEPEATGDTDTPEVTATASDAETEERK

SEQ ID NO: 254513 - protein, 12 aa, Mycobacterium
DTAGDMGASART

SEQ ID NO: 254514 - protein, 7 aa, Mycobacterium
DTAGKPL

SEQ ID NO: 254515 - protein, 6 aa, Mycobacterium
DTAGQE

SEQ ID NO: 254516 - protein, 5 aa, Mycobacterium
DTAGR

SEQ ID NO: 254517 - protein, 10 aa, Mycobacterium
DTAIDTTTPQ

SEQ ID NO: 254518 - protein, 8 aa, Mycobacterium
DTAKNDDS

SEQ ID NO: 254519 - protein, 11 aa, Mycobacterium
DTAKPTSAEAI

SEQ ID NO: 254520 - protein, 10 aa, Mycobacterium
DTALRDGAAL

SEQ ID NO: 254521 - protein, 4 aa, Mycobacterium
DTAM

SEQ ID NO: 254522 - protein, 7 aa, Mycobacterium
DTANGAP

SEQ ID NO: 254523 - protein, 7 aa, Mycobacterium
DTANNDD

SEQ ID NO: 254524 - protein, 17 aa, Mycobacterium
DTANPNAFATGRNPRNA

SEQ ID NO: 254525 - protein, 8 aa, Mycobacterium
DTAPEVPR

SEQ ID NO: 254526 - protein, 18 aa, Mycobacterium
DTARADVQATQGIAGGRY

SEQ ID NO: 254527 - protein, 9 aa, Mycobacterium
DTARASARP

SEQ ID NO: 254528 - protein, 7 aa, Mycobacterium
DTARDGL

SEQ ID NO: 254529 - protein, 13 aa, Mycobacterium
DTARGAQPNTALA

SEQ ID NO: 254530 - protein, 10 aa, Mycobacterium
DTARPSSAEW

SEQ ID NO: 254531 - protein, 26 aa, Mycobacterium
DTARSGSATLATGAKQLSDGINQATD

SEQ ID NO: 254532 - protein, 7 aa, Mycobacterium
DTASAMG

SEQ ID NO: 254533 - protein, 8 aa, Mycobacterium
DTASGGAI

SEQ ID NO: 254534 - protein, 9 aa, Mycobacterium
DTASPEQRQ

SEQ ID NO: 254535 - protein, 9 aa, Mycobacterium
DTATAGASG

SEQ ID NO: 254536 - protein, 6 aa, Mycobacterium
DTATEF

SEQ ID NO: 254537 - protein, 8 aa, Mycobacterium
DTATPAVY

SEQ ID NO: 254538 - protein, 6 aa, Mycobacterium
DTATPV

SEQ ID NO: 254539 - protein, 7 aa, Mycobacterium
DTATTTT

SEQ ID NO: 254540 - protein, 5 aa, Mycobacterium
DTATV

SEQ ID NO: 254541 - protein, 7 aa, Mycobacterium
DTAVTTS

SEQ ID NO: 254542 - protein, 7 aa, Mycobacterium
DTCRNTP

SEQ ID NO: 254543 - protein, 6 aa, Mycobacterium
DTDAQQ

SEQ ID NO: 254544 - protein, 10 aa, Mycobacterium
DTDEGGMSDN

SEQ ID NO: 254545 - protein, 10 aa, Mycobacterium
DTDGSPGDGY

SEQ ID NO: 254546 - protein, 18 aa, Mycobacterium
DTDGTGQRADRRPPGPES

SEQ ID NO: 254547 - protein, 19 aa, Mycobacterium
DTDGYGERADRRPPGAEQY

SEQ ID NO: 254548 - protein, 19 aa, Mycobacterium
DTDGYGERGDQRPPGSEKY

SEQ ID NO: 254549 - protein, 4 aa, Mycobacterium
DTDH

SEQ ID NO: 254550 - protein, 8 aa, Mycobacterium
DTDMPPTA

SEQ ID NO: 254551 - protein, 18 aa, Mycobacterium
DTDNGTETDDGDNRGQTA

SEQ ID NO: 254552 - protein, 6 aa, Mycobacterium
DTDNNR

SEQ ID NO: 254553 - protein, 7 aa, Mycobacterium
DTDNRWA

SEQ ID NO: 254554 - protein, 15 aa, Mycobacterium
DTDPAKGSTVSAGAE

SEQ ID NO: 254555 - protein, 9 aa, Mycobacterium
DTDPARAAA

SEQ ID NO: 254556 - protein, 8 aa, Mycobacterium
DTDPNRAA

SEQ ID NO: 254557 - protein, 9 aa, Mycobacterium
DTDQDRRAV

SEQ ID NO: 254558 - protein, 6 aa, Mycobacterium
DTDQQA

SEQ ID NO: 254559 - protein, 5 aa, Mycobacterium
DTDRD

SEQ ID NO: 254560 - protein, 10 aa, Mycobacterium
DTDRDGNTRS

SEQ ID NO: 254561 - protein, 4 aa, Mycobacterium
DTDS

SEQ ID NO: 254562 - protein, 6 aa, Mycobacterium
DTDTEA

SEQ ID NO: 254563 - protein, 8 aa, Mycobacterium
DTDTGPHL

SEQ ID NO: 254564 - protein, 7 aa, Mycobacterium
DTDTPDH

SEQ ID NO: 254565 - protein, 27 aa, Mycobacterium
DTDVTAGLTSEAAEERRHRHGPNQLTE

SEQ ID NO: 254566 - protein, 10 aa, Mycobacterium
DTEAEGDKTL

SEQ ID NO: 254567 - protein, 11 aa, Mycobacterium
DTEAEKLRSSI

SEQ ID NO: 254568 - protein, 13 aa, Mycobacterium
DTEATPEITPVGP

SEQ ID NO: 254569 - protein, 5 aa, Mycobacterium
DTEAV

SEQ ID NO: 254570 - protein, 19 aa, Mycobacterium
DTEDPEAGVTGAADAAAEA

SEQ ID NO: 254571 - protein, 6 aa, Mycobacterium
DTEGAL

SEQ ID NO: 254572 - protein, 14 aa, Mycobacterium
DTEGRSFETDTSAQ

SEQ ID NO: 254573 - protein, 12 aa, Mycobacterium
DTEHDGGNQSVD

SEQ ID NO: 254574 - protein, 5 aa, Mycobacterium
DTEKA

SEQ ID NO: 254575 - protein, 6 aa, Mycobacterium
DTELNR

SEQ ID NO: 254576 - protein, 8 aa, Mycobacterium
DTELSDER

SEQ ID NO: 254577 - protein, 12 aa, Mycobacterium
DTEPADSGGYGF

SEQ ID NO: 254578 - protein, 9 aa, Mycobacterium
DTESTTGYA

SEQ ID NO: 254579 - protein, 7 aa, Mycobacterium
DTETSPL

SEQ ID NO: 254580 - protein, 5 aa, Mycobacterium
DTEVT

SEQ ID NO: 254581 - protein, 13 aa, Mycobacterium
DTFEADESADVTS

SEQ ID NO: 254582 - protein, 6 aa, Mycobacterium
DTFGGD

SEQ ID NO: 254583 - protein, 21 aa, Mycobacterium
DTGAAQPGDADAGAAEDTRST

SEQ ID NO: 254584 - protein, 12 aa, Mycobacterium
DTGADADGADTV

SEQ ID NO: 254585 - protein, 7 aa, Mycobacterium
DTGAGVP

SEQ ID NO: 254586 - protein, 10 aa, Mycobacterium
DTGASEDGAL

SEQ ID NO: 254587 - protein, 10 aa, Mycobacterium
DTGCGPATTA

SEQ ID NO: 254588 - protein, 7 aa, Mycobacterium
DTGDAGL

SEQ ID NO: 254589 - protein, 7 aa, Mycobacterium
DTGEGIA

SEQ ID NO: 254590 - protein, 8 aa, Mycobacterium
DTGEGIAP

SEQ ID NO: 254591 - protein, 8 aa, Mycobacterium
DTGEMAPS

SEQ ID NO: 254592 - protein, 6 aa, Mycobacterium
DTGERS

SEQ ID NO: 254593 - protein, 6 aa, Mycobacterium
DTGGYG

SEQ ID NO: 254594 - protein, 15 aa, Mycobacterium
DTGLTVNGKPLKEPY

SEQ ID NO: 254595 - protein, 5 aa, Mycobacterium
DTGMT

SEQ ID NO: 254596 - protein, 4 aa, Mycobacterium
DTGP

SEQ ID NO: 254597 - protein, 6 aa, Mycobacterium
DTGPAA

SEQ ID NO: 254598 - protein, 6 aa, Mycobacterium
DTGPGA

SEQ ID NO: 254599 - protein, 10 aa, Mycobacterium
DTGPGIAPHE

SEQ ID NO: 254600 - protein, 8 aa, Mycobacterium
DTGPGVPE

SEQ ID NO: 254601 - protein, 6 aa, Mycobacterium
DTGPLN

SEQ ID NO: 254602 - protein, 7 aa, Mycobacterium
DTGPPPA

SEQ ID NO: 254603 - protein, 7 aa, Mycobacterium
DTGPSTV

SEQ ID NO: 254604 - protein, 12 aa, Mycobacterium
DTGQLNKGDKVR

SEQ ID NO: 254605 - protein, 16 aa, Mycobacterium
DTGQPVGAPLRGHTAD

SEQ ID NO: 254606 - protein, 8 aa, Mycobacterium
DTGQPVGR

SEQ ID NO: 254607 - protein, 5 aa, Mycobacterium
DTGQS

SEQ ID NO: 254608 - protein, 6 aa, Mycobacterium
DTGQTT

SEQ ID NO: 254609 - protein, 14 aa, Mycobacterium
DTGRDEPSAEGEGQ

SEQ ID NO: 254610 - protein, 4 aa, Mycobacterium
DTGS

SEQ ID NO: 254611 - protein, 19 aa, Mycobacterium
DTGSDTDKAPAAAHEPDEA

SEQ ID NO: 254612 - protein, 30 aa, Mycobacterium
DTGSEPAIKGSEPPIELDGSAGQAVRENSH

SEQ ID NO: 254613 - protein, 7 aa, Mycobacterium
DTGSEPL

SEQ ID NO: 254614 - protein, 8 aa, Mycobacterium
DTGSGKTT

SEQ ID NO: 254615 - protein, 5 aa, Mycobacterium
DTGTN

SEQ ID NO: 254616 - protein, 6 aa, Mycobacterium
DTGVGI

SEQ ID NO: 254617 - protein, 8 aa, Mycobacterium
DTGVPRPG

SEQ ID NO: 254618 - protein, 22 aa, Mycobacterium
DTHAEETDPVENAQQRSSPRPI

SEQ ID NO: 254619 - protein, 8 aa, Mycobacterium
DTHGHATG

SEQ ID NO: 254620 - protein, 33 aa, Mycobacterium
DTHGPTHRSANKQAHDPDSDTKGISSSSSSHIR

SEQ ID NO: 254621 - protein, 8 aa, Mycobacterium
DTHGPTRA

SEQ ID NO: 254622 - protein, 11 aa, Mycobacterium
DTIAGPASPVA

SEQ ID NO: 254623 - protein, 6 aa, Mycobacterium
DTIDES

SEQ ID NO: 254624 - protein, 4 aa, Mycobacterium
DTIE

SEQ ID NO: 254625 - protein, 10 aa, Mycobacterium
DTIGKRDDQI

SEQ ID NO: 254626 - protein, 24 aa, Mycobacterium
DTKAQQAAENAVNTTLQSENPDLR

SEQ ID NO: 254627 - protein, 13 aa, Mycobacterium
DTKCGNGMSHTND

SEQ ID NO: 254628 - protein, 24 aa, Mycobacterium
DTKPPLPGGDPQSSVLNRVEYGNR

SEQ ID NO: 254629 - protein, 24 aa, Mycobacterium
DTKPPLPGGDPSSSVLNRVEYGNR

SEQ ID NO: 254630 - protein, 8 aa, Mycobacterium
DTKRSSVD

SEQ ID NO: 254631 - protein, 15 aa, Mycobacterium
DTKSAEEPAPDFPGA

SEQ ID NO: 254632 - protein, 6 aa, Mycobacterium
DTKSGG

SEQ ID NO: 254633 - protein, 16 aa, Mycobacterium
DTKSYGPDKAYTETKL

SEQ ID NO: 254634 - protein, 6 aa, Mycobacterium
DTLAAG

SEQ ID NO: 254635 - protein, 6 aa, Mycobacterium
DTLGTS

SEQ ID NO: 254636 - protein, 7 aa, Mycobacterium
DTLPDRA

SEQ ID NO: 254637 - protein, 5 aa, Mycobacterium
DTLQR

SEQ ID NO: 254638 - protein, 5 aa, Mycobacterium
DTLRP

SEQ ID NO: 254639 - protein, 5 aa, Mycobacterium
DTLSD

SEQ ID NO: 254640 - protein, 8 aa, Mycobacterium
DTLSEAQN

SEQ ID NO: 254641 - protein, 5 aa, Mycobacterium
DTNAI

SEQ ID NO: 254642 - protein, 9 aa, Mycobacterium
DTNATLGNT

SEQ ID NO: 254643 - protein, 7 aa, Mycobacterium
DTNGQPM

SEQ ID NO: 254644 - protein, 7 aa, Mycobacterium
DTNTHNK

SEQ ID NO: 254645 - protein, 21 aa, Mycobacterium
DTPADPAQLAAGKSAADAGFK

SEQ ID NO: 254646 - protein, 5 aa, Mycobacterium
DTPAE

SEQ ID NO: 254647 - protein, 30 aa, Mycobacterium
DTPAGARAGLDDLQDGADRLADGSRQVAGG

SEQ ID NO: 254648 - protein, 12 aa, Mycobacterium
DTPANGVRGSRN

SEQ ID NO: 254649 - protein, 12 aa, Mycobacterium
DTPANSVRGSRN

SEQ ID NO: 254650 - protein, 8 aa, Mycobacterium
DTPAPPGV

SEQ ID NO: 254651 - protein, 9 aa, Mycobacterium
DTPAPPGVQ

SEQ ID NO: 254652 - protein, 5 aa, Mycobacterium
DTPAR

SEQ ID NO: 254653 - protein, 14 aa, Mycobacterium
DTPATQAKAETPVP

SEQ ID NO: 254654 - protein, 4 aa, Mycobacterium
DTPE

SEQ ID NO: 254655 - protein, 5 aa, Mycobacterium
DTPED

SEQ ID NO: 254656 - protein, 14 aa, Mycobacterium
DTPEEHPKVDEAER

SEQ ID NO: 254657 - protein, 5 aa, Mycobacterium
DTPEF

SEQ ID NO: 254658 - protein, 6 aa, Mycobacterium
DTPEFE

SEQ ID NO: 254659 - protein, 9 aa, Mycobacterium
DTPESRNER

SEQ ID NO: 254660 - protein, 9 aa, Mycobacterium
DTPESTSER

SEQ ID NO: 254661 - protein, 14 aa, Mycobacterium
DTPETEAKSQAPRE

SEQ ID NO: 254662 - protein, 14 aa, Mycobacterium
DTPETKAKSETPVP

SEQ ID NO: 254663 - protein, 13 aa, Mycobacterium
DTPGQQAVSSKTL

SEQ ID NO: 254664 - protein, 5 aa, Mycobacterium
DTPGV

SEQ ID NO: 254665 - protein, 27 aa, Mycobacterium
DTPGVNDVAGEDESPPADELAPASPAH

SEQ ID NO: 254666 - protein, 4 aa, Mycobacterium
DTPH

SEQ ID NO: 254667 - protein, 4 aa, Mycobacterium
DTPK

SEQ ID NO: 254668 - protein, 14 aa, Mycobacterium
DTPKAPRTWKDMLP

SEQ ID NO: 254669 - protein, 30 aa, Mycobacterium
DTPLARETDYGRVDDHSSAIRAPGDKRRTF

SEQ ID NO: 254670 - protein, 8 aa, Mycobacterium
DTPNTSFG

SEQ ID NO: 254671 - protein, 12 aa, Mycobacterium
DTPPESKPEPPV

SEQ ID NO: 254672 - protein, 12 aa, Mycobacterium
DTPQAAYADNRA

SEQ ID NO: 254673 - protein, 5 aa, Mycobacterium
DTPQF

SEQ ID NO: 254674 - protein, 9 aa, Mycobacterium
DTPQGKALG

SEQ ID NO: 254675 - protein, 13 aa, Mycobacterium
DTPQGSAASPETM

SEQ ID NO: 254676 - protein, 6 aa, Mycobacterium
DTPQRR

SEQ ID NO: 254677 - protein, 7 aa, Mycobacterium
DTPRAEA

SEQ ID NO: 254678 - protein, 8 aa, Mycobacterium
DTPRGPAA

SEQ ID NO: 254679 - protein, 7 aa, Mycobacterium
DTPRPAA

SEQ ID NO: 254680 - protein, 9 aa, Mycobacterium
DTPRPPGIT

SEQ ID NO: 254681 - protein, 8 aa, Mycobacterium
DTPRPQAR

SEQ ID NO: 254682 - protein, 17 aa, Mycobacterium
DTPRPQQALPQPASGSA

SEQ ID NO: 254683 - protein, 8 aa, Mycobacterium
DTPRPTAA

SEQ ID NO: 254684 - protein, 5 aa, Mycobacterium
DTPRR

SEQ ID NO: 254685 - protein, 6 aa, Mycobacterium
DTPSDK

SEQ ID NO: 254686 - protein, 5 aa, Mycobacterium
DTPSF

SEQ ID NO: 254687 - protein, 8 aa, Mycobacterium
DTPTAREI

SEQ ID NO: 254688 - protein, 11 aa, Mycobacterium
DTPTSHRNTQP

SEQ ID NO: 254689 - protein, 29 aa, Mycobacterium
DTPVARETDYGRVDQHSSAVRAPGDARHT

SEQ ID NO: 254690 - protein, 6 aa, Mycobacterium
DTQARG

SEQ ID NO: 254691 - protein, 9 aa, Mycobacterium
DTQASSEAV

SEQ ID NO: 254692 - protein, 10 aa, Mycobacterium
DTQPGSARPV

SEQ ID NO: 254693 - protein, 8 aa, Mycobacterium
DTQRRANA

SEQ ID NO: 254694 - protein, 10 aa, Mycobacterium
DTQSGVNSSA

SEQ ID NO: 254695 - protein, 5 aa, Mycobacterium
DTQTA

SEQ ID NO: 254696 - protein, 13 aa, Mycobacterium
DTQTRTPIPVDTR

SEQ ID NO: 254697 - protein, 7 aa, Mycobacterium
DTQVAGH

SEQ ID NO: 254698 - protein, 22 aa, Mycobacterium
DTRCAEQPACRDAGSGENEQAP

SEQ ID NO: 254699 - protein, 4 aa, Mycobacterium
DTRD

SEQ ID NO: 254700 - protein, 5 aa, Mycobacterium
DTRDY

SEQ ID NO: 254701 - protein, 6 aa, Mycobacterium
DTRDYY

SEQ ID NO: 254702 - protein, 7 aa, Mycobacterium
DTRETTA

SEQ ID NO: 254703 - protein, 6 aa, Mycobacterium
DTRGQQ

SEQ ID NO: 254704 - protein, 9 aa, Mycobacterium
DTRGYKPVD

SEQ ID NO: 254705 - protein, 19 aa, Mycobacterium
DTRNGVKEDRVGDKVEAEQ

SEQ ID NO: 254706 - protein, 9 aa, Mycobacterium
DTRPADPEL

SEQ ID NO: 254707 - protein, 17 aa, Mycobacterium
DTRPEDYEDAEIADGAG

SEQ ID NO: 254708 - protein, 18 aa, Mycobacterium
DTRPEDYEDAEIADGAGE

SEQ ID NO: 254709 - protein, 18 aa, Mycobacterium
DTRPEDYEDAEISDGAGE

SEQ ID NO: 254710 - protein, 10 aa, Mycobacterium
DTRPGTARPV

SEQ ID NO: 254711 - protein, 5 aa, Mycobacterium
DTRPS

SEQ ID NO: 254712 - protein, 5 aa, Mycobacterium
DTRPY

SEQ ID NO: 254713 - protein, 5 aa, Mycobacterium
DTRQL

SEQ ID NO: 254714 - protein, 17 aa, Mycobacterium
DTRRGSIGPEARTRLAE

SEQ ID NO: 254715 - protein, 16 aa, Mycobacterium
DTRRGSVGPDARTRLA

SEQ ID NO: 254716 - protein, 15 aa, Mycobacterium
DTRRGSVGPEARTRL

SEQ ID NO: 254717 - protein, 5 aa, Mycobacterium
DTRRL

SEQ ID NO: 254718 - protein, 8 aa, Mycobacterium
DTRSDDSV

SEQ ID NO: 254719 - protein, 10 aa, Mycobacterium
DTRSGDRTST

SEQ ID NO: 254720 - protein, 12 aa, Mycobacterium
DTRTADLAGDRC

SEQ ID NO: 254721 - protein, 8 aa, Mycobacterium
DTRTGADR

SEQ ID NO: 254722 - protein, 11 aa, Mycobacterium
DTRTQDAPPQG

SEQ ID NO: 254723 - protein, 11 aa, Mycobacterium
DTRYSSSPTQL

SEQ ID NO: 254724 - protein, 7 aa, Mycobacterium
DTRYTSG

SEQ ID NO: 254725 - protein, 4 aa, Mycobacterium
DTSA

SEQ ID NO: 254726 - protein, 12 aa, Mycobacterium
DTSALDRAKSAG

SEQ ID NO: 254727 - protein, 7 aa, Mycobacterium
DTSATSL

SEQ ID NO: 254728 - protein, 10 aa, Mycobacterium
DTSCSNTRGQ

SEQ ID NO: 254729 - protein, 6 aa, Mycobacterium
DTSDDE

SEQ ID NO: 254730 - protein, 11 aa, Mycobacterium
DTSEISKQDAA

SEQ ID NO: 254731 - protein, 33 aa, Mycobacterium
DTSELPPPQDGSGRESPGAPGEARVPDDPGDAT

SEQ ID NO: 254732 - protein, 5 aa, Mycobacterium
DTSES

SEQ ID NO: 254733 - protein, 4 aa, Mycobacterium
DTSG

SEQ ID NO: 254734 - protein, 6 aa, Mycobacterium
DTSGES

SEQ ID NO: 254735 - protein, 5 aa, Mycobacterium
DTSGI

SEQ ID NO: 254736 - protein, 7 aa, Mycobacterium
DTSGKVQ

SEQ ID NO: 254737 - protein, 7 aa, Mycobacterium
DTSGNPF

SEQ ID NO: 254738 - protein, 8 aa, Mycobacterium
DTSGPGSN

SEQ ID NO: 254739 - protein, 12 aa, Mycobacterium
DTSGVSPSGYAG

SEQ ID NO: 254740 - protein, 10 aa, Mycobacterium
DTSPADKDAS

SEQ ID NO: 254741 - protein, 9 aa, Mycobacterium
DTSRNVKGD

SEQ ID NO: 254742 - protein, 13 aa, Mycobacterium
DTSRTRASGGTGL

SEQ ID NO: 254743 - protein, 13 aa, Mycobacterium
DTSSFTSGLAERD

SEQ ID NO: 254744 - protein, 30 aa, Mycobacterium
DTSSPVESGTTSVGEETTAPVTAPSGRRTW

SEQ ID NO: 254745 - protein, 16 aa, Mycobacterium
DTSTVSTQTTAEFRSS

SEQ ID NO: 254746 - protein, 8 aa, Mycobacterium
DTSVAGHQ

SEQ ID NO: 254747 - protein, 5 aa, Mycobacterium
DTTAP

SEQ ID NO: 254748 - protein, 40 aa, Mycobacterium
DTTELPPWQRGPATRARQQPQAPESPRPDGPRGGGQAGLD

SEQ ID NO: 254749 - protein, 6 aa, Mycobacterium
DTTFPE

SEQ ID NO: 254750 - protein, 4 aa, Mycobacterium
DTTG

SEQ ID NO: 254751 - protein, 6 aa, Mycobacterium
DTTGSV

SEQ ID NO: 254752 - protein, 5 aa, Mycobacterium
DTTHL

SEQ ID NO: 254753 - protein, 54 aa, Mycobacterium
DTTKLANPNTTTVPSTPPMQDEITTTKPPPPPPPPPPPPTTEPPPPTATETQTV

SEQ ID NO: 254754 - protein, 10 aa, Mycobacterium
DTTKSVSPAA

SEQ ID NO: 254755 - protein, 4 aa, Mycobacterium
DTTL

SEQ ID NO: 254756 - protein, 8 aa, Mycobacterium
DTTNPDEQ

SEQ ID NO: 254757 - protein, 13 aa, Mycobacterium
DTTPLGSQSTAHI

SEQ ID NO: 254758 - protein, 4 aa, Mycobacterium
DTTT

SEQ ID NO: 254759 - protein, 6 aa, Mycobacterium
DTTTTD

SEQ ID NO: 254760 - protein, 30 aa, Mycobacterium
DTTVKRDRADPERNPAREVPNRPGRGLTPD

SEQ ID NO: 254761 - protein, 8 aa, Mycobacterium
DTVERNGI

SEQ ID NO: 254762 - protein, 10 aa, Mycobacterium
DTVKDSAADA

SEQ ID NO: 254763 - protein, 16 aa, Mycobacterium
DTVNPAASEDPSSPIA

SEQ ID NO: 254764 - protein, 12 aa, Mycobacterium
DTVPGGEPPGTS

SEQ ID NO: 254765 - protein, 12 aa, Mycobacterium
DTVPGGQPPGTS

SEQ ID NO: 254766 - protein, 8 aa, Mycobacterium
DTVPGGST

SEQ ID NO: 254767 - protein, 4 aa, Mycobacterium
DTVR

SEQ ID NO: 254768 - protein, 10 aa, Mycobacterium
DTVRGATEHE

SEQ ID NO: 254769 - protein, 7 aa, Mycobacterium
DTVSDNA

SEQ ID NO: 254770 - protein, 5 aa, Mycobacterium
DTVTA

SEQ ID NO: 254771 - protein, 12 aa, Mycobacterium
DTWQGPSAGRYQ

SEQ ID NO: 254772 - protein, 7 aa, Mycobacterium
DTYDSLP

SEQ ID NO: 254773 - protein, 4 aa, Mycobacterium
DTYG

SEQ ID NO: 254774 - protein, 9 aa, Mycobacterium
DTYPTQRSR

SEQ ID NO: 254775 - protein, 4 aa, Mycobacterium
DTYR

SEQ ID NO: 254776 - protein, 18 aa, Mycobacterium
DTYRRVPAPDAMAPPTAE

SEQ ID NO: 254777 - protein, 9 aa, Mycobacterium
DTYSDPVPF

SEQ ID NO: 254778 - protein, 7 aa, Mycobacterium
DVAAPDP

SEQ ID NO: 254779 - protein, 11 aa, Mycobacterium
DVAASATRSPW

SEQ ID NO: 254780 - protein, 6 aa, Mycobacterium
DVAASD

SEQ ID NO: 254781 - protein, 10 aa, Mycobacterium
DVAASRNVEK

SEQ ID NO: 254782 - protein, 4 aa, Mycobacterium
DVAD

SEQ ID NO: 254783 - protein, 10 aa, Mycobacterium
DVAERGRTRR

SEQ ID NO: 254784 - protein, 14 aa, Mycobacterium
DVAGERSSDPPDLD

SEQ ID NO: 254785 - protein, 17 aa, Mycobacterium
DVAGRGELVGSQPHRRG

SEQ ID NO: 254786 - protein, 7 aa, Mycobacterium
DVANTST

SEQ ID NO: 254787 - protein, 4 aa, Mycobacterium
DVAP

SEQ ID NO: 254788 - protein, 5 aa, Mycobacterium
DVAPG

SEQ ID NO: 254789 - protein, 5 aa, Mycobacterium
DVAPP

SEQ ID NO: 254790 - protein, 6 aa, Mycobacterium
DVAQKE

SEQ ID NO: 254791 - protein, 12 aa, Mycobacterium
DVDADEDDDELN

SEQ ID NO: 254792 - protein, 16 aa, Mycobacterium
DVDGTEVSGTATSMGS

SEQ ID NO: 254793 - protein, 5 aa, Mycobacterium
DVDGV

SEQ ID NO: 254794 - protein, 4 aa, Mycobacterium
DVDP

SEQ ID NO: 254795 - protein, 14 aa, Mycobacterium
DVDPETGGASANSL

SEQ ID NO: 254796 - protein, 6 aa, Mycobacterium
DVDPSL

SEQ ID NO: 254797 - protein, 11 aa, Mycobacterium
DVEADREHPTK

SEQ ID NO: 254798 - protein, 4 aa, Mycobacterium
DVEG

SEQ ID NO: 254799 - protein, 13 aa, Mycobacterium
DVEGDDLTHGNTL

SEQ ID NO: 254800 - protein, 12 aa, Mycobacterium
DVEPGTPTPQAR

SEQ ID NO: 254801 - protein, 10 aa, Mycobacterium
DVEPTATGAR

SEQ ID NO: 254802 - protein, 15 aa, Mycobacterium
DVESEPVADEPQERH

SEQ ID NO: 254803 - protein, 8 aa, Mycobacterium
DVETTSRQ

SEQ ID NO: 254804 - protein, 9 aa, Mycobacterium
DVGAGTGPV

SEQ ID NO: 254805 - protein, 13 aa, Mycobacterium
DVGASGDGVGGTR

SEQ ID NO: 254806 - protein, 12 aa, Mycobacterium
DVGGEETRSLQS

SEQ ID NO: 254807 - protein, 6 aa, Mycobacterium
DVGGPT

SEQ ID NO: 254808 - protein, 18 aa, Mycobacterium
DVGGRPVTVRSSDGGTEW

SEQ ID NO: 254809 - protein, 10 aa, Mycobacterium
DVGGTPHDIP

SEQ ID NO: 254810 - protein, 5 aa, Mycobacterium
DVGGY

SEQ ID NO: 254811 - protein, 4 aa, Mycobacterium
DVGP

SEQ ID NO: 254812 - protein, 6 aa, Mycobacterium
DVGPRD

SEQ ID NO: 254813 - protein, 7 aa, Mycobacterium
DVGQPEA

SEQ ID NO: 254814 - protein, 11 aa, Mycobacterium
DVGQPLGNESV

SEQ ID NO: 254815 - protein, 8 aa, Mycobacterium
DVGQSATA

SEQ ID NO: 254816 - protein, 9 aa, Mycobacterium
DVGSASTEL

SEQ ID NO: 254817 - protein, 8 aa, Mycobacterium
DVGTDVDD

SEQ ID NO: 254818 - protein, 12 aa, Mycobacterium
DVHPAEAGSGVP

SEQ ID NO: 254819 - protein, 4 aa, Mycobacterium
DVKP

SEQ ID NO: 254820 - protein, 12 aa, Mycobacterium
DVKPGSPAEQAG

SEQ ID NO: 254821 - protein, 11 aa, Mycobacterium
DVKTNPSAGTI

SEQ ID NO: 254822 - protein, 16 aa, Mycobacterium
DVNEDGVAAAPADVPG

SEQ ID NO: 254823 - protein, 4 aa, Mycobacterium
DVNG

SEQ ID NO: 254824 - protein, 11 aa, Mycobacterium
DVNIGENPTPR

SEQ ID NO: 254825 - protein, 9 aa, Mycobacterium
DVNPPTDTA

SEQ ID NO: 254826 - protein, 9 aa, Mycobacterium
DVPAGKGVS

SEQ ID NO: 254827 - protein, 31 aa, Mycobacterium
DVPDGAPPAPVGGPQAAPSAFGRNGSRVNPG

SEQ ID NO: 254828 - protein, 8 aa, Mycobacterium
DVPETPLQ

SEQ ID NO: 254829 - protein, 11 aa, Mycobacterium
DVPGELDGVGP

SEQ ID NO: 254830 - protein, 7 aa, Mycobacterium
DVPGGGA

SEQ ID NO: 254831 - protein, 5 aa, Mycobacterium
DVPID

SEQ ID NO: 254832 - protein, 20 aa, Mycobacterium
DVPLPNRRQDRRADDPAAAV

SEQ ID NO: 254833 - protein, 4 aa, Mycobacterium
DVPN

SEQ ID NO: 254834 - protein, 6 aa, Mycobacterium
DVPPAS

SEQ ID NO: 254835 - protein, 7 aa, Mycobacterium
DVPPDYS

SEQ ID NO: 254836 - protein, 8 aa, Mycobacterium
DVPPGGSL

SEQ ID NO: 254837 - protein, 5 aa, Mycobacterium
DVPPL

SEQ ID NO: 254838 - protein, 6 aa, Mycobacterium
DVPPLA

SEQ ID NO: 254839 - protein, 12 aa, Mycobacterium
DVPPPDGTPPRW

SEQ ID NO: 254840 - protein, 8 aa, Mycobacterium
DVPPPSAA

SEQ ID NO: 254841 - protein, 9 aa, Mycobacterium
DVPPPSAAI

SEQ ID NO: 254842 - protein, 9 aa, Mycobacterium
DVPPPSTRI

SEQ ID NO: 254843 - protein, 5 aa, Mycobacterium
DVPPR

SEQ ID NO: 254844 - protein, 10 aa, Mycobacterium
DVPRRGQKVP

SEQ ID NO: 254845 - protein, 6 aa, Mycobacterium
DVPSAE

SEQ ID NO: 254846 - protein, 6 aa, Mycobacterium
DVPSGA

SEQ ID NO: 254847 - protein, 9 aa, Mycobacterium
DVPTPAQAE

SEQ ID NO: 254848 - protein, 9 aa, Mycobacterium
DVPTPPRAT

SEQ ID NO: 254849 - protein, 5 aa, Mycobacterium
DVPTY

SEQ ID NO: 254850 - protein, 18 aa, Mycobacterium
DVPVDATPAQIQETARAT

SEQ ID NO: 254851 - protein, 19 aa, Mycobacterium
DVQAAQRAYTRQGGDNAGA

SEQ ID NO: 254852 - protein, 11 aa, Mycobacterium
DVQAEATDVDV

SEQ ID NO: 254853 - protein, 7 aa, Mycobacterium
DVQAEPD

SEQ ID NO: 254854 - protein, 14 aa, Mycobacterium
DVQAPSEAIDGVPE

SEQ ID NO: 254855 - protein, 6 aa, Mycobacterium
DVQGTG

SEQ ID NO: 254856 - protein, 5 aa, Mycobacterium
DVQGY

SEQ ID NO: 254857 - protein, 5 aa, Mycobacterium
DVQTV

SEQ ID NO: 254858 - protein, 5 aa, Mycobacterium
DVRDA

SEQ ID NO: 254859 - protein, 15 aa, Mycobacterium
DVREDGVSAPPEAVE

SEQ ID NO: 254860 - protein, 15 aa, Mycobacterium
DVRGARTEVPGEGRG

SEQ ID NO: 254861 - protein, 10 aa, Mycobacterium
DVRGQASADA

SEQ ID NO: 254862 - protein, 15 aa, Mycobacterium
DVRPAAATQPSPREG

SEQ ID NO: 254863 - protein, 6 aa, Mycobacterium
DVRPGA

SEQ ID NO: 254864 - protein, 9 aa, Mycobacterium
DVRPTRSGA

SEQ ID NO: 254865 - protein, 5 aa, Mycobacterium
DVRTQ

SEQ ID NO: 254866 - protein, 4 aa, Mycobacterium
DVRV

SEQ ID NO: 254867 - protein, 19 aa, Mycobacterium
DVSATTGASGRFRDQGQQR

SEQ ID NO: 254868 - protein, 12 aa, Mycobacterium
DVSDTAPDRPQA

SEQ ID NO: 254869 - protein, 13 aa, Mycobacterium
DVSGDGDAATIGA

SEQ ID NO: 254870 - protein, 14 aa, Mycobacterium
DVSGDGDAATISAA

SEQ ID NO: 254871 - protein, 6 aa, Mycobacterium
DVSGGG

SEQ ID NO: 254872 - protein, 7 aa, Mycobacterium
DVSGLDD

SEQ ID NO: 254873 - protein, 8 aa, Mycobacterium
DVSGPTLR

SEQ ID NO: 254874 - protein, 10 aa, Mycobacterium
DVSGQASADA

SEQ ID NO: 254875 - protein, 12 aa, Mycobacterium
DVSGQPLSDFGP

SEQ ID NO: 254876 - protein, 14 aa, Mycobacterium
DVSGRLGNKPDSAT

SEQ ID NO: 254877 - protein, 10 aa, Mycobacterium
DVSKQRVEGS

SEQ ID NO: 254878 - protein, 10 aa, Mycobacterium
DVSPDRPQRR

SEQ ID NO: 254879 - protein, 6 aa, Mycobacterium
DVSPDS

SEQ ID NO: 254880 - protein, 4 aa, Mycobacterium
DVSS

SEQ ID NO: 254881 - protein, 10 aa, Mycobacterium
DVSSDDGSPV

SEQ ID NO: 254882 - protein, 5 aa, Mycobacterium
DVTDE

SEQ ID NO: 254883 - protein, 7 aa, Mycobacterium
DVTDSTQ

SEQ ID NO: 254884 - protein, 7 aa, Mycobacterium
DVTESAD

SEQ ID NO: 254885 - protein, 9 aa, Mycobacterium
DVTNGPRGL

SEQ ID NO: 254886 - protein, 15 aa, Mycobacterium
DVTNPAARNEQSSPI

SEQ ID NO: 254887 - protein, 15 aa, Mycobacterium
DVTNPAARNETSSPI

SEQ ID NO: 254888 - protein, 4 aa, Mycobacterium
DVTP

SEQ ID NO: 254889 - protein, 11 aa, Mycobacterium
DVTPAENGEPN

SEQ ID NO: 254890 - protein, 11 aa, Mycobacterium
DVTPATGSEPN

SEQ ID NO: 254891 - protein, 13 aa, Mycobacterium
DVTPDTSVDDDDE

SEQ ID NO: 254892 - protein, 5 aa, Mycobacterium
DVTPG

SEQ ID NO: 254893 - protein, 6 aa, Mycobacterium
DVTPTQ

SEQ ID NO: 254894 - protein, 8 aa, Mycobacterium
DVTQSSSA

SEQ ID NO: 254895 - protein, 5 aa, Mycobacterium
DVTRG

SEQ ID NO: 254896 - protein, 6 aa, Mycobacterium
DVTSQR

SEQ ID NO: 254897 - protein, 15 aa, Mycobacterium
DVTTSTDAATVTASD

SEQ ID NO: 254898 - protein, 12 aa, Mycobacterium
DVVDGAKRDDSI

SEQ ID NO: 254899 - protein, 9 aa, Mycobacterium
DVVGGNRQA

SEQ ID NO: 254900 - protein, 7 aa, Mycobacterium
DVVGSAA

SEQ ID NO: 254901 - protein, 12 aa, Mycobacterium
DVVTDEGSSDPK

SEQ ID NO: 254902 - protein, 10 aa, Mycobacterium
DVVTTSSQPV

SEQ ID NO: 254903 - protein, 11 aa, Mycobacterium
DVYPDPDRFEP

SEQ ID NO: 254904 - protein, 9 aa, Mycobacterium
DWARPGGDH

SEQ ID NO: 254905 - protein, 5 aa, Mycobacterium
DWDGE

SEQ ID NO: 254906 - protein, 6 aa, Mycobacterium
DWGEAA

SEQ ID NO: 254907 - protein, 5 aa, Mycobacterium
DWGPE

SEQ ID NO: 254908 - protein, 6 aa, Mycobacterium
DWPAQR

SEQ ID NO: 254909 - protein, 12 aa, Mycobacterium
DWPDAGRPRRAG

SEQ ID NO: 254910 - protein, 9 aa, Mycobacterium
DWPDTSSGE

SEQ ID NO: 254911 - protein, 8 aa, Mycobacterium
DWPPEPTE

SEQ ID NO: 254912 - protein, 10 aa, Mycobacterium
DWPSSAGGMP

SEQ ID NO: 254913 - protein, 34 aa, Mycobacterium
DWPSSAHSAEAQPITAASSTRPSTGWEDAPPLSA

SEQ ID NO: 254914 - protein, 11 aa, Mycobacterium
DWQGPSAESYA

SEQ ID NO: 254915 - protein, 15 aa, Mycobacterium
DWSDDRPTMKIPAPT

SEQ ID NO: 254916 - protein, 6 aa, Mycobacterium
DWSGAA

SEQ ID NO: 254917 - protein, 11 aa, Mycobacterium
DWTAEDRERVS

SEQ ID NO: 254918 - protein, 12 aa, Mycobacterium
DWTKDGNKLPDG

SEQ ID NO: 254919 - protein, 12 aa, Mycobacterium
DWTSEEKDQVSE

SEQ ID NO: 254920 - protein, 7 aa, Mycobacterium
DYADRTN

SEQ ID NO: 254921 - protein, 12 aa, Mycobacterium
DYAGDRRRAREA

SEQ ID NO: 254922 - protein, 6 aa, Mycobacterium
DYAGTD

SEQ ID NO: 254923 - protein, 12 aa, Mycobacterium
DYARLSAGQSAA

SEQ ID NO: 254924 - protein, 5 aa, Mycobacterium
DYARQ

SEQ ID NO: 254925 - protein, 19 aa, Mycobacterium
DYASTANLQAPPAAGSTVP

SEQ ID NO: 254926 - protein, 4 aa, Mycobacterium
DYDA

SEQ ID NO: 254927 - protein, 9 aa, Mycobacterium
DYDDEPYDY

SEQ ID NO: 254928 - protein, 6 aa, Mycobacterium
DYDEDD

SEQ ID NO: 254929 - protein, 6 aa, Mycobacterium
DYDRAT

SEQ ID NO: 254930 - protein, 5 aa, Mycobacterium
DYDTE

SEQ ID NO: 254931 - protein, 14 aa, Mycobacterium
DYDVETKVGNGDPM

SEQ ID NO: 254932 - protein, 98 aa, Mycobacterium
DYEAADPPPRSRRRPRPQDDPDLRAQPPRETRRDPHTRRNPYERPAPRSSRFDPYEPPEPAEPPNRYERRGTRYEPYEPPRRRSAPGGPTAANPTHHP

SEQ ID NO: 254933 - protein, 15 aa, Mycobacterium
DYEQAPPPDAEPPVP

SEQ ID NO: 254934 - protein, 7 aa, Mycobacterium
DYFPPES

SEQ ID NO: 254935 - protein, 13 aa, Mycobacterium
DYGAGRVSGDLEG

SEQ ID NO: 254936 - protein, 4 aa, Mycobacterium
DYGS

SEQ ID NO: 254937 - protein, 8 aa, Mycobacterium
DYGSTGEL

SEQ ID NO: 254938 - protein, 4 aa, Mycobacterium
DYKD

SEQ ID NO: 254939 - protein, 6 aa, Mycobacterium
DYPATG

SEQ ID NO: 254940 - protein, 5 aa, Mycobacterium
DYPDA

SEQ ID NO: 254941 - protein, 6 aa, Mycobacterium
DYPDGP

SEQ ID NO: 254942 - protein, 10 aa, Mycobacterium
DYPEDETDEL

SEQ ID NO: 254943 - protein, 37 aa, Mycobacterium
DYPEEASAEGEAEAVTDGPEPTGESSVAAEGRGDESA

SEQ ID NO: 254944 - protein, 7 aa, Mycobacterium
DYPEPNA

SEQ ID NO: 254945 - protein, 4 aa, Mycobacterium
DYPG

SEQ ID NO: 254946 - protein, 27 aa, Mycobacterium
DYPNEDEPDEPPSGAVDTAAEEPKRRR

SEQ ID NO: 254947 - protein, 7 aa, Mycobacterium
DYPPGWS

SEQ ID NO: 254948 - protein, 7 aa, Mycobacterium
DYPTRGD

SEQ ID NO: 254949 - protein, 5 aa, Mycobacterium
DYPVP

SEQ ID NO: 254950 - protein, 6 aa, Mycobacterium
DYPVPG

SEQ ID NO: 254951 - protein, 5 aa, Mycobacterium
DYQDP

SEQ ID NO: 254952 - protein, 4 aa, Mycobacterium
DYRA

SEQ ID NO: 254953 - protein, 4 aa, Mycobacterium
DYRD

SEQ ID NO: 254954 - protein, 4 aa, Mycobacterium
DYRS

SEQ ID NO: 254955 - protein, 8 aa, Mycobacterium
DYSAGKSS

SEQ ID NO: 254956 - protein, 14 aa, Mycobacterium
DYSAPRSYYDPAAP

SEQ ID NO: 254957 - protein, 10 aa, Mycobacterium
DYSDETTELP

SEQ ID NO: 254958 - protein, 15 aa, Mycobacterium
DYSDGIRGTDDDRVG

SEQ ID NO: 254959 - protein, 16 aa, Mycobacterium
DYSDGIRGTDDVRSGP

SEQ ID NO: 254960 - protein, 14 aa, Mycobacterium
DYSGASGYTSARPQ

SEQ ID NO: 254961 - protein, 15 aa, Mycobacterium
DYSGTASSPAGSQQL

SEQ ID NO: 254962 - protein, 4 aa, Mycobacterium
DYSP

SEQ ID NO: 254963 - protein, 7 aa, Mycobacterium
DYSSTRH

SEQ ID NO: 254964 - protein, 4 aa, Mycobacterium
DYTT

SEQ ID NO: 254965 - protein, 11 aa, Mycobacterium
DYTVGTTRQSF

SEQ ID NO: 254966 - protein, 5 aa, Mycobacterium
DYVPT

SEQ ID NO: 254967 - protein, 5 aa, Mycobacterium
DYVRT

SEQ ID NO: 254968 - protein, 14 aa, Mycobacterium
DYVSTGDGTRDCDA

SEQ ID NO: 254969 - protein, 8 aa, Mycobacterium
EAAAADRE

SEQ ID NO: 254970 - protein, 12 aa, Mycobacterium
EAAADPGNQTAA

SEQ ID NO: 254971 - protein, 8 aa, Mycobacterium
EAAAEPGF

SEQ ID NO: 254972 - protein, 14 aa, Mycobacterium
EAAAEQRVKGQQAA

SEQ ID NO: 254973 - protein, 5 aa, Mycobacterium
EAAAG

SEQ ID NO: 254974 - protein, 8 aa, Mycobacterium
EAAAGAYA

SEQ ID NO: 254975 - protein, 10 aa, Mycobacterium
EAAAGDTDRF

SEQ ID NO: 254976 - protein, 6 aa, Mycobacterium
EAAAGI

SEQ ID NO: 254977 - protein, 6 aa, Mycobacterium
EAAAGL

SEQ ID NO: 254978 - protein, 11 aa, Mycobacterium
EAAAKDPQLQQ

SEQ ID NO: 254979 - protein, 7 aa, Mycobacterium
EAAAPAC

SEQ ID NO: 254980 - protein, 9 aa, Mycobacterium
EAAARTGGL

SEQ ID NO: 254981 - protein, 8 aa, Mycobacterium
EAAASDHL

SEQ ID NO: 254982 - protein, 18 aa, Mycobacterium
EAADPAQIARDTAEPWEG

SEQ ID NO: 254983 - protein, 21 aa, Mycobacterium
EAADQTESAPETASEEKTRPS

SEQ ID NO: 254984 - protein, 11 aa, Mycobacterium
EAADRAAAPAA

SEQ ID NO: 254985 - protein, 10 aa, Mycobacterium
EAADRAQRTV

SEQ ID NO: 254986 - protein, 4 aa, Mycobacterium
EAAE

SEQ ID NO: 254987 - protein, 20 aa, Mycobacterium
EAAEEDSGDSLLDSLFDSVE

SEQ ID NO: 254988 - protein, 9 aa, Mycobacterium
EAAEGGMGP

SEQ ID NO: 254989 - protein, 5 aa, Mycobacterium
EAAEL

SEQ ID NO: 254990 - protein, 5 aa, Mycobacterium
EAAER

SEQ ID NO: 254991 - protein, 6 aa, Mycobacterium
EAAERG

SEQ ID NO: 254992 - protein, 6 aa, Mycobacterium
EAAERR

SEQ ID NO: 254993 - protein, 23 aa, Mycobacterium
EAAESDGLADSAFTAGAADPGVT

SEQ ID NO: 254994 - protein, 7 aa, Mycobacterium
EAAGAEY

SEQ ID NO: 254995 - protein, 10 aa, Mycobacterium
EAAGDESLSR

SEQ ID NO: 254996 - protein, 9 aa, Mycobacterium
EAAGGRVDA

SEQ ID NO: 254997 - protein, 9 aa, Mycobacterium
EAAGKKELA

SEQ ID NO: 254998 - protein, 6 aa, Mycobacterium
EAAGLG

SEQ ID NO: 254999 - protein, 8 aa, Mycobacterium
EAAGNAHL

SEQ ID NO: 255000 - protein, 5 aa, Mycobacterium
EAAGR

SEQ ID NO: 255001 - protein, 7 aa, Mycobacterium
EAAGRAG

SEQ ID NO: 255002 - protein, 12 aa, Mycobacterium
EAAGRSPAQEIA

SEQ ID NO: 255003 - protein, 5 aa, Mycobacterium
EAAGV

SEQ ID NO: 255004 - protein, 5 aa, Mycobacterium
EAAHG

SEQ ID NO: 255005 - protein, 10 aa, Mycobacterium
EAAHRSEQRA

SEQ ID NO: 255006 - protein, 10 aa, Mycobacterium
EAAHSSEQRA

SEQ ID NO: 255007 - protein, 8 aa, Mycobacterium
EAAKANDF

SEQ ID NO: 255008 - protein, 5 aa, Mycobacterium
EAAKQ

SEQ ID NO: 255009 - protein, 10 aa, Mycobacterium
EAAKRNRRNG

SEQ ID NO: 255010 - protein, 7 aa, Mycobacterium
EAALGQA

SEQ ID NO: 255011 - protein, 9 aa, Mycobacterium
EAANSPSQF

SEQ ID NO: 255012 - protein, 4 aa, Mycobacterium
EAAP

SEQ ID NO: 255013 - protein, 10 aa, Mycobacterium
EAAPAPNHVY

SEQ ID NO: 255014 - protein, 7 aa, Mycobacterium
EAAPARR

SEQ ID NO: 255015 - protein, 23 aa, Mycobacterium
EAAPGAPVASGAESAPPKRPPAW

SEQ ID NO: 255016 - protein, 14 aa, Mycobacterium
EAAPGQEWPGGPYR

SEQ ID NO: 255017 - protein, 9 aa, Mycobacterium
EAAPPPQRF

SEQ ID NO: 255018 - protein, 7 aa, Mycobacterium
EAAPQRR

SEQ ID NO: 255019 - protein, 8 aa, Mycobacterium
EAAPRALP

SEQ ID NO: 255020 - protein, 8 aa, Mycobacterium
EAAPSPAG

SEQ ID NO: 255021 - protein, 7 aa, Mycobacterium
EAAPTLA

SEQ ID NO: 255022 - protein, 9 aa, Mycobacterium
EAAQAQGRT

SEQ ID NO: 255023 - protein, 7 aa, Mycobacterium
EAAQERN

SEQ ID NO: 255024 - protein, 4 aa, Mycobacterium
EAAR

SEQ ID NO: 255025 - protein, 5 aa, Mycobacterium
EAARE

SEQ ID NO: 255026 - protein, 9 aa, Mycobacterium
EAAREPFST

SEQ ID NO: 255027 - protein, 10 aa, Mycobacterium
EAARGGSGPH

SEQ ID NO: 255028 - protein, 10 aa, Mycobacterium
EAARGSSPKN

SEQ ID NO: 255029 - protein, 5 aa, Mycobacterium
EAARR

SEQ ID NO: 255030 - protein, 14 aa, Mycobacterium
EAARSAQPNTTLSD

SEQ ID NO: 255031 - protein, 6 aa, Mycobacterium
EAARSL

SEQ ID NO: 255032 - protein, 9 aa, Mycobacterium
EAASANRTI

SEQ ID NO: 255033 - protein, 10 aa, Mycobacterium
EAASEDNERN

SEQ ID NO: 255034 - protein, 7 aa, Mycobacterium
EAASEHP

SEQ ID NO: 255035 - protein, 11 aa, Mycobacterium
EAASEMDGTRT

SEQ ID NO: 255036 - protein, 7 aa, Mycobacterium
EAASPVR

SEQ ID NO: 255037 - protein, 38 aa, Mycobacterium
EAASTDRDASAVPDEQEPTRTPTRRGRGHRRSRKALAA

SEQ ID NO: 255038 - protein, 17 aa, Mycobacterium
EAATAAHHHPSAEETYE

SEQ ID NO: 255039 - protein, 18 aa, Mycobacterium
EAATGTYSVTGEFLAPDA

SEQ ID NO: 255040 - protein, 8 aa, Mycobacterium
EAATKPAD

SEQ ID NO: 255041 - protein, 5 aa, Mycobacterium
EAATN

SEQ ID NO: 255042 - protein, 8 aa, Mycobacterium
EAATNPSE

SEQ ID NO: 255043 - protein, 7 aa, Mycobacterium
EAATPTN

SEQ ID NO: 255044 - protein, 20 aa, Mycobacterium
EAATTRDRVEAEHRARVGQP

SEQ ID NO: 255045 - protein, 10 aa, Mycobacterium
EAAVAEKSLA

SEQ ID NO: 255046 - protein, 13 aa, Mycobacterium
EAAVDQSAITGET

SEQ ID NO: 255047 - protein, 17 aa, Mycobacterium
EAAVPEPDVPETVTGEP

SEQ ID NO: 255048 - protein, 8 aa, Mycobacterium
EADADTQI

SEQ ID NO: 255049 - protein, 25 aa, Mycobacterium
EADAPADEPAPQQARVERSSPQQQP

SEQ ID NO: 255050 - protein, 14 aa, Mycobacterium
EADASGADRKTRLE

SEQ ID NO: 255051 - protein, 7 aa, Mycobacterium
EADDARA

SEQ ID NO: 255052 - protein, 7 aa, Mycobacterium
EADDPVI

SEQ ID NO: 255053 - protein, 8 aa, Mycobacterium
EADDQSRA

SEQ ID NO: 255054 - protein, 7 aa, Mycobacterium
EADEMSG

SEQ ID NO: 255055 - protein, 8 aa, Mycobacterium
EADHRSAE

SEQ ID NO: 255056 - protein, 6 aa, Mycobacterium
EADKTH

SEQ ID NO: 255057 - protein, 5 aa, Mycobacterium
EADPA

SEQ ID NO: 255058 - protein, 9 aa, Mycobacterium
EADPAATEL

SEQ ID NO: 255059 - protein, 10 aa, Mycobacterium
EADPAATELA

SEQ ID NO: 255060 - protein, 6 aa, Mycobacterium
EADPAH

SEQ ID NO: 255061 - protein, 10 aa, Mycobacterium
EADPELEGMG

SEQ ID NO: 255062 - protein, 6 aa, Mycobacterium
EADPER

SEQ ID NO: 255063 - protein, 6 aa, Mycobacterium
EADPFG

SEQ ID NO: 255064 - protein, 7 aa, Mycobacterium
EADRLSS

SEQ ID NO: 255065 - protein, 8 aa, Mycobacterium
EADRTAGT

SEQ ID NO: 255066 - protein, 10 aa, Mycobacterium
EADSARRAAI

SEQ ID NO: 255067 - protein, 6 aa, Mycobacterium
EADTAN

SEQ ID NO: 255068 - protein, 6 aa, Mycobacterium
EADTKH

SEQ ID NO: 255069 - protein, 6 aa, Mycobacterium
EADTRV

SEQ ID NO: 255070 - protein, 18 aa, Mycobacterium
EADTSNTPDAADTPADGR

SEQ ID NO: 255071 - protein, 7 aa, Mycobacterium
EADVDTQ

SEQ ID NO: 255072 - protein, 5 aa, Mycobacterium
EADYR

SEQ ID NO: 255073 - protein, 12 aa, Mycobacterium
EAEAADARNDAI

SEQ ID NO: 255074 - protein, 9 aa, Mycobacterium
EAEAAEAEA

SEQ ID NO: 255075 - protein, 8 aa, Mycobacterium
EAEAASRA

SEQ ID NO: 255076 - protein, 30 aa, Mycobacterium
EAEAASRAIAQRPAPEAGDEIARPDERNAP

SEQ ID NO: 255077 - protein, 11 aa, Mycobacterium
EAEAEAAEAEA

SEQ ID NO: 255078 - protein, 9 aa, Mycobacterium
EAEAEEEGI

SEQ ID NO: 255079 - protein, 9 aa, Mycobacterium
EAEARPAPA

SEQ ID NO: 255080 - protein, 13 aa, Mycobacterium
EAEDDLGKHHTQT

SEQ ID NO: 255081 - protein, 7 aa, Mycobacterium
EAEDTRK

SEQ ID NO: 255082 - protein, 8 aa, Mycobacterium
EAEDTRKH

SEQ ID NO: 255083 - protein, 6 aa, Mycobacterium
EAEEDS

SEQ ID NO: 255084 - protein, 30 aa, Mycobacterium
EAEGAHAKAIEDAKADAAQIAEEAKADAVQ

SEQ ID NO: 255085 - protein, 6 aa, Mycobacterium
EAEGKF

SEQ ID NO: 255086 - protein, 8 aa, Mycobacterium
EAEGPSTA

SEQ ID NO: 255087 - protein, 8 aa, Mycobacterium
EAEHAESG

SEQ ID NO: 255088 - protein, 17 aa, Mycobacterium
EAEKAAAAAELDPRAGN

SEQ ID NO: 255089 - protein, 6 aa, Mycobacterium
EAEKTG

SEQ ID NO: 255090 - protein, 4 aa, Mycobacterium
EAEL

SEQ ID NO: 255091 - protein, 18 aa, Mycobacterium
EAEPDRAHRNDELPTDAE

SEQ ID NO: 255092 - protein, 8 aa, Mycobacterium
EAEPGRRQ

SEQ ID NO: 255093 - protein, 6 aa, Mycobacterium
EAEPLR

SEQ ID NO: 255094 - protein, 11 aa, Mycobacterium
EAEPVADETAY

SEQ ID NO: 255095 - protein, 6 aa, Mycobacterium
EAEPVG

SEQ ID NO: 255096 - protein, 9 aa, Mycobacterium
EAERIADEH

SEQ ID NO: 255097 - protein, 5 aa, Mycobacterium
EAETV

SEQ ID NO: 255098 - protein, 56 aa, Mycobacterium
EAEVEAESEVEAEVEADTAADVEAEDTDVEDATDVEVEATDDVEAPDVEAEAPADV

SEQ ID NO: 255099 - protein, 14 aa, Mycobacterium
EAEYGDKRTEILRD

SEQ ID NO: 255100 - protein, 10 aa, Mycobacterium
EAFADGAKKG

SEQ ID NO: 255101 - protein, 16 aa, Mycobacterium
EAFENPEESFTSPRPL

SEQ ID NO: 255102 - protein, 8 aa, Mycobacterium
EAGAENAP

SEQ ID NO: 255103 - protein, 25 aa, Mycobacterium
EAGAGNDRVGEAGAGESGVADGDRS

SEQ ID NO: 255104 - protein, 11 aa, Mycobacterium
EAGASADPLTD

SEQ ID NO: 255105 - protein, 20 aa, Mycobacterium
EAGATETPRPASGSYHTRDS

SEQ ID NO: 255106 - protein, 8 aa, Mycobacterium
EAGDESGM

SEQ ID NO: 255107 - protein, 8 aa, Mycobacterium
EAGDGSGL

SEQ ID NO: 255108 - protein, 9 aa, Mycobacterium
EAGERTRVT

SEQ ID NO: 255109 - protein, 13 aa, Mycobacterium
EAGGAVTLPGSYG

SEQ ID NO: 255110 - protein, 8 aa, Mycobacterium
EAGGHRRI

SEQ ID NO: 255111 - protein, 14 aa, Mycobacterium
EAGGIDPAGTAAVG

SEQ ID NO: 255112 - protein, 8 aa, Mycobacterium
EAGGLYPR

SEQ ID NO: 255113 - protein, 7 aa, Mycobacterium
EAGGTRR

SEQ ID NO: 255114 - protein, 7 aa, Mycobacterium
EAGIGKT

SEQ ID NO: 255115 - protein, 6 aa, Mycobacterium
EAGKPL

SEQ ID NO: 255116 - protein, 13 aa, Mycobacterium
EAGLESETADTAQ

SEQ ID NO: 255117 - protein, 8 aa, Mycobacterium
EAGPAAGT

SEQ ID NO: 255118 - protein, 21 aa, Mycobacterium
EAGPAEDKDYGEHREITADGA

SEQ ID NO: 255119 - protein, 21 aa, Mycobacterium
EAGPAEDKDYGEHREITAEGA

SEQ ID NO: 255120 - protein, 51 aa, Mycobacterium
EAGPAGASSTPQAKPQPSPVPAAEAASAPSTQSRPSPAQVAPSGANGQSNK

SEQ ID NO: 255121 - protein, 7 aa, Mycobacterium
EAGPARL

SEQ ID NO: 255122 - protein, 6 aa, Mycobacterium
EAGPDV

SEQ ID NO: 255123 - protein, 6 aa, Mycobacterium
EAGPNR

SEQ ID NO: 255124 - protein, 7 aa, Mycobacterium
EAGPQRL

SEQ ID NO: 255125 - protein, 7 aa, Mycobacterium
EAGPRRV

SEQ ID NO: 255126 - protein, 5 aa, Mycobacterium
EAGPV

SEQ ID NO: 255127 - protein, 23 aa, Mycobacterium
EAGQGAQLAADANPQLKAEAEQV

SEQ ID NO: 255128 - protein, 14 aa, Mycobacterium
EAGQNSHDDAAQVH

SEQ ID NO: 255129 - protein, 11 aa, Mycobacterium
EAGQSSAQASL

SEQ ID NO: 255130 - protein, 10 aa, Mycobacterium
EAGQTPGQAS

SEQ ID NO: 255131 - protein, 6 aa, Mycobacterium
EAGRAA

SEQ ID NO: 255132 - protein, 7 aa, Mycobacterium
EAGRKLS

SEQ ID NO: 255133 - protein, 6 aa, Mycobacterium
EAGRPA

SEQ ID NO: 255134 - protein, 7 aa, Mycobacterium
EAGRPAV

SEQ ID NO: 255135 - protein, 8 aa, Mycobacterium
EAGRPPRR

SEQ ID NO: 255136 - protein, 5 aa, Mycobacterium
EAGSE

SEQ ID NO: 255137 - protein, 8 aa, Mycobacterium
EAGSEHPI

SEQ ID NO: 255138 - protein, 5 aa, Mycobacterium
EAGSG

SEQ ID NO: 255139 - protein, 8 aa, Mycobacterium
EAGSRTAG

SEQ ID NO: 255140 - protein, 11 aa, Mycobacterium
EAGSYGKDTRG

SEQ ID NO: 255141 - protein, 8 aa, Mycobacterium
EAGTPPDV

SEQ ID NO: 255142 - protein, 10 aa, Mycobacterium
EAGTPPGVAE

SEQ ID NO: 255143 - protein, 12 aa, Mycobacterium
EAGTQKISAGDY

SEQ ID NO: 255144 - protein, 8 aa, Mycobacterium
EAGTSNQS

SEQ ID NO: 255145 - protein, 10 aa, Mycobacterium
EAGTSTRVTV

SEQ ID NO: 255146 - protein, 10 aa, Mycobacterium
EAGTWEDPAD

SEQ ID NO: 255147 - protein, 4 aa, Mycobacterium
EAGV

SEQ ID NO: 255148 - protein, 24 aa, Mycobacterium
EAGVAGGGEDGPPALDVVIKSLLL

SEQ ID NO: 255149 - protein, 24 aa, Mycobacterium
EAGVDGGGPDGAPKLPVTVKNIQL

SEQ ID NO: 255150 - protein, 24 aa, Mycobacterium
EAHAGRSHGPDDGDVTRLDEENVR

SEQ ID NO: 255151 - protein, 19 aa, Mycobacterium
EAHDDDDDEDDAEPETDQI

SEQ ID NO: 255152 - protein, 8 aa, Mycobacterium
EAHGDADN

SEQ ID NO: 255153 - protein, 6 aa, Mycobacterium
EAHGQT

SEQ ID NO: 255154 - protein, 40 aa, Mycobacterium
EAHHRPDARPVRAPASRTPPAGDHTPDRPGPRIASRTKTS

SEQ ID NO: 255155 - protein, 26 aa, Mycobacterium
EAHPSDGSAGGVIAGSEGTEGRNGSD

SEQ ID NO: 255156 - protein, 4 aa, Mycobacterium
EAHR

SEQ ID NO: 255157 - protein, 16 aa, Mycobacterium
EAHSTTLSSGPGPGPL

SEQ ID NO: 255158 - protein, 8 aa, Mycobacterium
EAHTAGRL

SEQ ID NO: 255159 - protein, 8 aa, Mycobacterium
EAHTHGHH

SEQ ID NO: 255160 - protein, 8 aa, Mycobacterium
EAIGPDAA

SEQ ID NO: 255161 - protein, 8 aa, Mycobacterium
EAIPAPEV

SEQ ID NO: 255162 - protein, 10 aa, Mycobacterium
EAIPQQSRTS

SEQ ID NO: 255163 - protein, 6 aa, Mycobacterium
EAKADV

SEQ ID NO: 255164 - protein, 7 aa, Mycobacterium
EAKARQR

SEQ ID NO: 255165 - protein, 16 aa, Mycobacterium
EAKDAGKTAFGSAANV

SEQ ID NO: 255166 - protein, 12 aa, Mycobacterium
EAKGTGATSEEA

SEQ ID NO: 255167 - protein, 16 aa, Mycobacterium
EAKKSHAQALRATNPG

SEQ ID NO: 255168 - protein, 12 aa, Mycobacterium
EAKKTRGMLDPQ

SEQ ID NO: 255169 - protein, 12 aa, Mycobacterium
EAKLSAKNAARR

SEQ ID NO: 255170 - protein, 7 aa, Mycobacterium
EAKNDDS

SEQ ID NO: 255171 - protein, 8 aa, Mycobacterium
EAKNDDSF

SEQ ID NO: 255172 - protein, 10 aa, Mycobacterium
EAKPAGKAQK

SEQ ID NO: 255173 - protein, 7 aa, Mycobacterium
EAKRGFR

SEQ ID NO: 255174 - protein, 17 aa, Mycobacterium
EAKRSGGNQYRRARESA

SEQ ID NO: 255175 - protein, 4 aa, Mycobacterium
EAKS

SEQ ID NO: 255176 - protein, 10 aa, Mycobacterium
EAKSPSTPEL

SEQ ID NO: 255177 - protein, 4 aa, Mycobacterium
EALA

SEQ ID NO: 255178 - protein, 7 aa, Mycobacterium
EALAGSR

SEQ ID NO: 255179 - protein, 12 aa, Mycobacterium
EALDPKAKIRLE

SEQ ID NO: 255180 - protein, 6 aa, Mycobacterium
EALETA

SEQ ID NO: 255181 - protein, 10 aa, Mycobacterium
EALKGTPLES

SEQ ID NO: 255182 - protein, 4 aa, Mycobacterium
EALP

SEQ ID NO: 255183 - protein, 10 aa, Mycobacterium
EALSGPQGEI

SEQ ID NO: 255184 - protein, 7 aa, Mycobacterium
EALSPEG

SEQ ID NO: 255185 - protein, 4 aa, Mycobacterium
EALT

SEQ ID NO: 255186 - protein, 30 aa, Mycobacterium
EALTDAEPEESDAEGEPEGPALPTSEHSPY

SEQ ID NO: 255187 - protein, 8 aa, Mycobacterium
EAMSPEGI

SEQ ID NO: 255188 - protein, 9 aa, Mycobacterium
EANAQGASE

SEQ ID NO: 255189 - protein, 8 aa, Mycobacterium
EANARARR

SEQ ID NO: 255190 - protein, 10 aa, Mycobacterium
EANARVAGSP

SEQ ID NO: 255191 - protein, 9 aa, Mycobacterium
EANGKKEIA

SEQ ID NO: 255192 - protein, 21 aa, Mycobacterium
EANKGDESAAPVTAAPPPVIT

SEQ ID NO: 255193 - protein, 8 aa, Mycobacterium
EANPTNRQ

SEQ ID NO: 255194 - protein, 5 aa, Mycobacterium
EANRV

SEQ ID NO: 255195 - protein, 8 aa, Mycobacterium
EANSEHPV

SEQ ID NO: 255196 - protein, 9 aa, Mycobacterium
EANTAEDTV

SEQ ID NO: 255197 - protein, 7 aa, Mycobacterium
EANTELA

SEQ ID NO: 255198 - protein, 22 aa, Mycobacterium
EAPAIEPPRIPGLGAPAPGALR

SEQ ID NO: 255199 - protein, 9 aa, Mycobacterium
EAPAVEARP

SEQ ID NO: 255200 - protein, 11 aa, Mycobacterium
EAPEGPSTSTL

SEQ ID NO: 255201 - protein, 7 aa, Mycobacterium
EAPETVD

SEQ ID NO: 255202 - protein, 10 aa, Mycobacterium
EAPGLQGLPG

SEQ ID NO: 255203 - protein, 12 aa, Mycobacterium
EAPGPDRRYSRT

SEQ ID NO: 255204 - protein, 9 aa, Mycobacterium
EAPGRPTGL

SEQ ID NO: 255205 - protein, 8 aa, Mycobacterium
EAPGRPTT

SEQ ID NO: 255206 - protein, 10 aa, Mycobacterium
EAPLEATGRG

SEQ ID NO: 255207 - protein, 9 aa, Mycobacterium
EAPLTGESA

SEQ ID NO: 255208 - protein, 15 aa, Mycobacterium
EAPPAPADSTPSQQW

SEQ ID NO: 255209 - protein, 18 aa, Mycobacterium
EAPPDQIPGENPEPPRQP

SEQ ID NO: 255210 - protein, 9 aa, Mycobacterium
EAPPELHPQ

SEQ ID NO: 255211 - protein, 14 aa, Mycobacterium
EAPPERPKDTVTEI

SEQ ID NO: 255212 - protein, 6 aa, Mycobacterium
EAPPLT

SEQ ID NO: 255213 - protein, 20 aa, Mycobacterium
EAPPLTAPGIPNAGAPAPFT

SEQ ID NO: 255214 - protein, 17 aa, Mycobacterium
EAPPPRPSRIKPGLPAG

SEQ ID NO: 255215 - protein, 6 aa, Mycobacterium
EAPPQL

SEQ ID NO: 255216 - protein, 8 aa, Mycobacterium
EAPPVNGE

SEQ ID NO: 255217 - protein, 8 aa, Mycobacterium
EAPQLPSG

SEQ ID NO: 255218 - protein, 11 aa, Mycobacterium
EAPQPQAPPRT

SEQ ID NO: 255219 - protein, 7 aa, Mycobacterium
EAPQTIR

SEQ ID NO: 255220 - protein, 7 aa, Mycobacterium
EAPREAT

SEQ ID NO: 255221 - protein, 5 aa, Mycobacterium
EAPRR

SEQ ID NO: 255222 - protein, 5 aa, Mycobacterium
EAPSV

SEQ ID NO: 255223 - protein, 6 aa, Mycobacterium
EAPSVP

SEQ ID NO: 255224 - protein, 4 aa, Mycobacterium
EAPT

SEQ ID NO: 255225 - protein, 6 aa, Mycobacterium
EAPTGT

SEQ ID NO: 255226 - protein, 7 aa, Mycobacterium
EAPTRQS

SEQ ID NO: 255227 - protein, 10 aa, Mycobacterium
EAPTRTARSA

SEQ ID NO: 255228 - protein, 16 aa, Mycobacterium
EAPVPSEAGGADAVSG

SEQ ID NO: 255229 - protein, 12 aa, Mycobacterium
EAPWDERPGEAA

SEQ ID NO: 255230 - protein, 9 aa, Mycobacterium
EAQAEDEDD

SEQ ID NO: 255231 - protein, 13 aa, Mycobacterium
EAQAGKANAQRLA

SEQ ID NO: 255232 - protein, 11 aa, Mycobacterium
EAQGGKAPVQR

SEQ ID NO: 255233 - protein, 9 aa, Mycobacterium
EAQGGVPDG

SEQ ID NO: 255234 - protein, 10 aa, Mycobacterium
EAQHDRAPIQ

SEQ ID NO: 255235 - protein, 11 aa, Mycobacterium
EAQNDRAPIQT

SEQ ID NO: 255236 - protein, 4 aa, Mycobacterium
EAQP

SEQ ID NO: 255237 - protein, 9 aa, Mycobacterium
EAQPVGEEA

SEQ ID NO: 255238 - protein, 5 aa, Mycobacterium
EAQRE

SEQ ID NO: 255239 - protein, 11 aa, Mycobacterium
EAQRREKVPTK

SEQ ID NO: 255240 - protein, 9 aa, Mycobacterium
EAQTDAGRI

SEQ ID NO: 255241 - protein, 8 aa, Mycobacterium
EAQTMDPQ

SEQ ID NO: 255242 - protein, 15 aa, Mycobacterium
EAQVQADAAELAESV

SEQ ID NO: 255243 - protein, 12 aa, Mycobacterium
EARAAGEDRETA

SEQ ID NO: 255244 - protein, 11 aa, Mycobacterium
EARAAGVDRES

SEQ ID NO: 255245 - protein, 12 aa, Mycobacterium
EARAPERTIPRA

SEQ ID NO: 255246 - protein, 9 aa, Mycobacterium
EARAQAADR

SEQ ID NO: 255247 - protein, 10 aa, Mycobacterium
EARAQAGGLP

SEQ ID NO: 255248 - protein, 11 aa, Mycobacterium
EARASGADHEE

SEQ ID NO: 255249 - protein, 5 aa, Mycobacterium
EARAV

SEQ ID NO: 255250 - protein, 6 aa, Mycobacterium
EARDEE

SEQ ID NO: 255251 - protein, 8 aa, Mycobacterium
EARDNFGN

SEQ ID NO: 255252 - protein, 6 aa, Mycobacterium
EAREPQ

SEQ ID NO: 255253 - protein, 11 aa, Mycobacterium
EARERNPDPAL

SEQ ID NO: 255254 - protein, 13 aa, Mycobacterium
EARGAGEDPETAY

SEQ ID NO: 255255 - protein, 7 aa, Mycobacterium
EARGDTH

SEQ ID NO: 255256 - protein, 11 aa, Mycobacterium
EARGEGESREK

SEQ ID NO: 255257 - protein, 8 aa, Mycobacterium
EARGGERG

SEQ ID NO: 255258 - protein, 7 aa, Mycobacterium
EARGHGV

SEQ ID NO: 255259 - protein, 6 aa, Mycobacterium
EARGHS

SEQ ID NO: 255260 - protein, 24 aa, Mycobacterium
EARGNQPLRPGASLPLGQSTTPYQ

SEQ ID NO: 255261 - protein, 11 aa, Mycobacterium
EARGSGEDRET

SEQ ID NO: 255262 - protein, 12 aa, Mycobacterium
EARGTGEDQGTA

SEQ ID NO: 255263 - protein, 13 aa, Mycobacterium
EARHAGEDRETAY

SEQ ID NO: 255264 - protein, 12 aa, Mycobacterium
EARKQEAQDALQ

SEQ ID NO: 255265 - protein, 17 aa, Mycobacterium
EARKRNRSGRDSMSAIR

SEQ ID NO: 255266 - protein, 7 aa, Mycobacterium
EARNNAL

SEQ ID NO: 255267 - protein, 6 aa, Mycobacterium
EARPGA

SEQ ID NO: 255268 - protein, 7 aa, Mycobacterium
EARQAGA

SEQ ID NO: 255269 - protein, 11 aa, Mycobacterium
EARQAGEDAET

SEQ ID NO: 255270 - protein, 11 aa, Mycobacterium
EARQAGEDKET

SEQ ID NO: 255271 - protein, 10 aa, Mycobacterium
EARQAGEDRE

SEQ ID NO: 255272 - protein, 12 aa, Mycobacterium
EARQAGEDREDA

SEQ ID NO: 255273 - protein, 11 aa, Mycobacterium
EARQAGEDRES

SEQ ID NO: 255274 - protein, 13 aa, Mycobacterium
EARQAGEDRETAY

SEQ ID NO: 255275 - protein, 10 aa, Mycobacterium
EARQAGESRE

SEQ ID NO: 255276 - protein, 12 aa, Mycobacterium
EARQAGESREDA

SEQ ID NO: 255277 - protein, 12 aa, Mycobacterium
EARQAGQDRETA

SEQ ID NO: 255278 - protein, 13 aa, Mycobacterium
EARQAGQDRETAY

SEQ ID NO: 255279 - protein, 11 aa, Mycobacterium
EARQCGEDRET

SEQ ID NO: 255280 - protein, 11 aa, Mycobacterium
EARQPERTIPR

SEQ ID NO: 255281 - protein, 12 aa, Mycobacterium
EARQSGESREDA

SEQ ID NO: 255282 - protein, 12 aa, Mycobacterium
EARQVGQDRENA

SEQ ID NO: 255283 - protein, 5 aa, Mycobacterium
EARRA

SEQ ID NO: 255284 - protein, 11 aa, Mycobacterium
EARRAGEDPVT

SEQ ID NO: 255285 - protein, 12 aa, Mycobacterium
EARRAGESREEA

SEQ ID NO: 255286 - protein, 13 aa, Mycobacterium
EARRAGQDPTSAY

SEQ ID NO: 255287 - protein, 6 aa, Mycobacterium
EARRAR

SEQ ID NO: 255288 - protein, 13 aa, Mycobacterium
EARRDAKRRARGH

SEQ ID NO: 255289 - protein, 22 aa, Mycobacterium
EARREAKRRVSGRAVNEPKPVA

SEQ ID NO: 255290 - protein, 5 aa, Mycobacterium
EARRG

SEQ ID NO: 255291 - protein, 10 aa, Mycobacterium
EARRGGVSHE

SEQ ID NO: 255292 - protein, 14 aa, Mycobacterium
EARRLQPDQAPPNV

SEQ ID NO: 255293 - protein, 23 aa, Mycobacterium
EARRQYDDGTIPATGDRPDAAPI

SEQ ID NO: 255294 - protein, 9 aa, Mycobacterium
EARRSQPRV

SEQ ID NO: 255295 - protein, 14 aa, Mycobacterium
EARSAGEDRPSAYQ

SEQ ID NO: 255296 - protein, 8 aa, Mycobacterium
EARSFGED

SEQ ID NO: 255297 - protein, 9 aa, Mycobacterium
EARSHGQDR

SEQ ID NO: 255298 - protein, 9 aa, Mycobacterium
EARSIGESR

SEQ ID NO: 255299 - protein, 13 aa, Mycobacterium
EARSTGQSREEAY

SEQ ID NO: 255300 - protein, 5 aa, Mycobacterium
EARSV

SEQ ID NO: 255301 - protein, 12 aa, Mycobacterium
EARSVGEDREQS

SEQ ID NO: 255302 - protein, 12 aa, Mycobacterium
EARSVGESREQA

SEQ ID NO: 255303 - protein, 4 aa, Mycobacterium
EART

SEQ ID NO: 255304 - protein, 12 aa, Mycobacterium
EARTAGEDKETA

SEQ ID NO: 255305 - protein, 28 aa, Mycobacterium
EARTERTRRTGSCGTSTTPSSSTTDARS

SEQ ID NO: 255306 - protein, 16 aa, Mycobacterium
EARTGRDILTHLCVIR

SEQ ID NO: 255307 - protein, 12 aa, Mycobacterium
EARTLGESKEQA

SEQ ID NO: 255308 - protein, 15 aa, Mycobacterium
EARTRERLGQPGIDP

SEQ ID NO: 255309 - protein, 5 aa, Mycobacterium
EARTT

SEQ ID NO: 255310 - protein, 14 aa, Mycobacterium
EASADTGEIAPTPL

SEQ ID NO: 255311 - protein, 8 aa, Mycobacterium
EASAGGVA

SEQ ID NO: 255312 - protein, 57 aa, Mycobacterium
EASAGRAEQEKADPDEGPDRRESQARAAEDQERRDEPEPAPEHADDDALGAPAPERA

SEQ ID NO: 255313 - protein, 9 aa, Mycobacterium
EASATKAKT

SEQ ID NO: 255314 - protein, 9 aa, Mycobacterium
EASDAAALE

SEQ ID NO: 255315 - protein, 11 aa, Mycobacterium
EASDDVPPSTL

SEQ ID NO: 255316 - protein, 9 aa, Mycobacterium
EASGAENLA

SEQ ID NO: 255317 - protein, 9 aa, Mycobacterium
EASGAENMA

SEQ ID NO: 255318 - protein, 16 aa, Mycobacterium
EASGNNDQTAIESAQA

SEQ ID NO: 255319 - protein, 8 aa, Mycobacterium
EASGPHAP

SEQ ID NO: 255320 - protein, 10 aa, Mycobacterium
EASGSETPKW

SEQ ID NO: 255321 - protein, 5 aa, Mycobacterium
EASNR

SEQ ID NO: 255322 - protein, 8 aa, Mycobacterium
EASPPPGL

SEQ ID NO: 255323 - protein, 8 aa, Mycobacterium
EASPPQRR

SEQ ID NO: 255324 - protein, 47 aa, Mycobacterium
EASPQSADHPQKADSKPAASTKPAPGARPVRPTGTKQRPTGKRNAGR

SEQ ID NO: 255325 - protein, 7 aa, Mycobacterium
EASPTLP

SEQ ID NO: 255326 - protein, 5 aa, Mycobacterium
EASQT

SEQ ID NO: 255327 - protein, 6 aa, Mycobacterium
EASRDW

SEQ ID NO: 255328 - protein, 12 aa, Mycobacterium
EASRFPLSDYTF

SEQ ID NO: 255329 - protein, 7 aa, Mycobacterium
EASRGLK

SEQ ID NO: 255330 - protein, 6 aa, Mycobacterium
EASRRK

SEQ ID NO: 255331 - protein, 8 aa, Mycobacterium
EASRTLDD

SEQ ID NO: 255332 - protein, 12 aa, Mycobacterium
EASSDDEVAQGS

SEQ ID NO: 255333 - protein, 9 aa, Mycobacterium
EASSGEAGQ

SEQ ID NO: 255334 - protein, 7 aa, Mycobacterium
EASWRPA

SEQ ID NO: 255335 - protein, 13 aa, Mycobacterium
EATAETVRPPGRV

SEQ ID NO: 255336 - protein, 8 aa, Mycobacterium
EATAQGVT

SEQ ID NO: 255337 - protein, 13 aa, Mycobacterium
EATASQASPAVRS

SEQ ID NO: 255338 - protein, 16 aa, Mycobacterium
EATCAGGGTTPVKDTA

SEQ ID NO: 255339 - protein, 5 aa, Mycobacterium
EATDA

SEQ ID NO: 255340 - protein, 5 aa, Mycobacterium
EATGG

SEQ ID NO: 255341 - protein, 7 aa, Mycobacterium
EATGGDL

SEQ ID NO: 255342 - protein, 12 aa, Mycobacterium
EATGPTPPQLPD

SEQ ID NO: 255343 - protein, 7 aa, Mycobacterium
EATGQPI

SEQ ID NO: 255344 - protein, 19 aa, Mycobacterium
EATKAESASITRPARVEAA

SEQ ID NO: 255345 - protein, 12 aa, Mycobacterium
EATKEGTLAGSS

SEQ ID NO: 255346 - protein, 12 aa, Mycobacterium
EATKEGTLAGST

SEQ ID NO: 255347 - protein, 13 aa, Mycobacterium
EATLQGNQVGAPD

SEQ ID NO: 255348 - protein, 6 aa, Mycobacterium
EATMRP

SEQ ID NO: 255349 - protein, 6 aa, Mycobacterium
EATPED

SEQ ID NO: 255350 - protein, 6 aa, Mycobacterium
EATPVA

SEQ ID NO: 255351 - protein, 18 aa, Mycobacterium
EATQKHPVAPIPASAPSM

SEQ ID NO: 255352 - protein, 9 aa, Mycobacterium
EATRAGTVQ

SEQ ID NO: 255353 - protein, 8 aa, Mycobacterium
EATRDTGP

SEQ ID NO: 255354 - protein, 5 aa, Mycobacterium
EATRE

SEQ ID NO: 255355 - protein, 5 aa, Mycobacterium
EATSW

SEQ ID NO: 255356 - protein, 11 aa, Mycobacterium
EATTLTATGSM

SEQ ID NO: 255357 - protein, 16 aa, Mycobacterium
EATVKDTAAEIAARGG

SEQ ID NO: 255358 - protein, 17 aa, Mycobacterium
EATVKDTAAEIAARGGV

SEQ ID NO: 255359 - protein, 4 aa, Mycobacterium
EAVA

SEQ ID NO: 255360 - protein, 5 aa, Mycobacterium
EAVAQ

SEQ ID NO: 255361 - protein, 13 aa, Mycobacterium
EAVDGAGAGLGAG

SEQ ID NO: 255362 - protein, 7 aa, Mycobacterium
EAVDNDN

SEQ ID NO: 255363 - protein, 6 aa, Mycobacterium
EAVEGE

SEQ ID NO: 255364 - protein, 9 aa, Mycobacterium
EAVGSGYQL

SEQ ID NO: 255365 - protein, 8 aa, Mycobacterium
EAVKGTPL

SEQ ID NO: 255366 - protein, 9 aa, Mycobacterium
EAVKGTPLA

SEQ ID NO: 255367 - protein, 35 aa, Mycobacterium
EAVKTEPDAESTQDVSDDVDDVTADEAEDQDEGGL

SEQ ID NO: 255368 - protein, 30 aa, Mycobacterium
EAVNDADEDVDAEAEAEAAGLGSVDGDEVA

SEQ ID NO: 255369 - protein, 5 aa, Mycobacterium
EAVQS

SEQ ID NO: 255370 - protein, 6 aa, Mycobacterium
EAVSEP

SEQ ID NO: 255371 - protein, 9 aa, Mycobacterium
EAVSGAEDF

SEQ ID NO: 255372 - protein, 15 aa, Mycobacterium
EAWDDEPKQRRATRR

SEQ ID NO: 255373 - protein, 5 aa, Mycobacterium
EAYED

SEQ ID NO: 255374 - protein, 5 aa, Mycobacterium
EAYPQ

SEQ ID NO: 255375 - protein, 9 aa, Mycobacterium
EAYTTGKPH

SEQ ID NO: 255376 - protein, 12 aa, Mycobacterium
ECASGVPDSTTT

SEQ ID NO: 255377 - protein, 5 aa, Mycobacterium
ECGAR

SEQ ID NO: 255378 - protein, 9 aa, Mycobacterium
ECGDSGGPV

SEQ ID NO: 255379 - protein, 9 aa, Mycobacterium
ECGGDPSQA

SEQ ID NO: 255380 - protein, 6 aa, Mycobacterium
ECGKSA

SEQ ID NO: 255381 - protein, 5 aa, Mycobacterium
ECGKT

SEQ ID NO: 255382 - protein, 7 aa, Mycobacterium
ECGKTAT

SEQ ID NO: 255383 - protein, 6 aa, Mycobacterium
ECGRTT

SEQ ID NO: 255384 - protein, 10 aa, Mycobacterium
ECGSPSTGQV

SEQ ID NO: 255385 - protein, 13 aa, Mycobacterium
ECPDSCSDAVPAI

SEQ ID NO: 255386 - protein, 6 aa, Mycobacterium
ECPEGT

SEQ ID NO: 255387 - protein, 12 aa, Mycobacterium
ECTDPKKVPGRA

SEQ ID NO: 255388 - protein, 10 aa, Mycobacterium
ECTGPGPAAL

SEQ ID NO: 255389 - protein, 10 aa, Mycobacterium
ECTNSPRGDT

SEQ ID NO: 255390 - protein, 9 aa, Mycobacterium
EDAAAWDNG

SEQ ID NO: 255391 - protein, 83 aa, Mycobacterium
EDADAGAGALDATGTPEAPSGGSRGTSPKGRPTPKRNEARRTARKGPVAPAPMTAAEARARRKSLAGPKLSREERKADRVANR

SEQ ID NO: 255392 - protein, 5 aa, Mycobacterium
EDADR

SEQ ID NO: 255393 - protein, 7 aa, Mycobacterium
EDADTRV

SEQ ID NO: 255394 - protein, 8 aa, Mycobacterium
EDAERQID

SEQ ID NO: 255395 - protein, 10 aa, Mycobacterium
EDAGPAGAEL

SEQ ID NO: 255396 - protein, 9 aa, Mycobacterium
EDAGPAGKQ

SEQ ID NO: 255397 - protein, 10 aa, Mycobacterium
EDAGPGGAQI

SEQ ID NO: 255398 - protein, 39 aa, Mycobacterium
EDANTGNEPVPYTGPDATGEYGRTATAFDQQRDQPPAIE

SEQ ID NO: 255399 - protein, 4 aa, Mycobacterium
EDAP

SEQ ID NO: 255400 - protein, 6 aa, Mycobacterium
EDAPKA

SEQ ID NO: 255401 - protein, 10 aa, Mycobacterium
EDAPRPAPPD

SEQ ID NO: 255402 - protein, 33 aa, Mycobacterium
EDAPTVPEPAVKPRRKKPEAAKPANKAEEAAKE

SEQ ID NO: 255403 - protein, 10 aa, Mycobacterium
EDAQEGAQAL

SEQ ID NO: 255404 - protein, 9 aa, Mycobacterium
EDAQPTRVD

SEQ ID NO: 255405 - protein, 4 aa, Mycobacterium
EDAR

SEQ ID NO: 255406 - protein, 10 aa, Mycobacterium
EDARARAEQQ

SEQ ID NO: 255407 - protein, 9 aa, Mycobacterium
EDARRRGAG

SEQ ID NO: 255408 - protein, 7 aa, Mycobacterium
EDASEHP

SEQ ID NO: 255409 - protein, 9 aa, Mycobacterium
EDASSVKRQ

SEQ ID NO: 255410 - protein, 16 aa, Mycobacterium
EDATALPAGEATLSDE

SEQ ID NO: 255411 - protein, 5 aa, Mycobacterium
EDATR

SEQ ID NO: 255412 - protein, 7 aa, Mycobacterium
EDATRLT

SEQ ID NO: 255413 - protein, 22 aa, Mycobacterium
EDDAELDDESAVEITERPNLNK

SEQ ID NO: 255414 - protein, 9 aa, Mycobacterium
EDDAPAAGT

SEQ ID NO: 255415 - protein, 31 aa, Mycobacterium
EDDAPAGEPVPYAGPDYETQAGATAARPPVE

SEQ ID NO: 255416 - protein, 18 aa, Mycobacterium
EDDDADAPTAEIPIARPT

SEQ ID NO: 255417 - protein, 26 aa, Mycobacterium
EDDDVAAPVAAPAVTSRKKTPKEPKL

SEQ ID NO: 255418 - protein, 5 aa, Mycobacterium
EDDPE

SEQ ID NO: 255419 - protein, 10 aa, Mycobacterium
EDDPSKSLNT

SEQ ID NO: 255420 - protein, 5 aa, Mycobacterium
EDDPV

SEQ ID NO: 255421 - protein, 14 aa, Mycobacterium
EDDRRAAVNEASAL

SEQ ID NO: 255422 - protein, 8 aa, Mycobacterium
EDDSETLR

SEQ ID NO: 255423 - protein, 14 aa, Mycobacterium
EDDSPAVSEATGRS

SEQ ID NO: 255424 - protein, 15 aa, Mycobacterium
EDDSTCAASGDTSRV

SEQ ID NO: 255425 - protein, 5 aa, Mycobacterium
EDDYN

SEQ ID NO: 255426 - protein, 6 aa, Mycobacterium
EDEAER

SEQ ID NO: 255427 - protein, 10 aa, Mycobacterium
EDEARSAARL

SEQ ID NO: 255428 - protein, 22 aa, Mycobacterium
EDEEYDEYEDDEYEDDEEYEDY

SEQ ID NO: 255429 - protein, 6 aa, Mycobacterium
EDEFTS

SEQ ID NO: 255430 - protein, 17 aa, Mycobacterium
EDEGPPPPPTDRVTEIP

SEQ ID NO: 255431 - protein, 5 aa, Mycobacterium
EDEHD

SEQ ID NO: 255432 - protein, 20 aa, Mycobacterium
EDEPATRKPDGRDTLAHKLS

SEQ ID NO: 255433 - protein, 21 aa, Mycobacterium
EDESDQPETRRGSFGKPAPGF

SEQ ID NO: 255434 - protein, 14 aa, Mycobacterium
EDETKTDEVPKKKK

SEQ ID NO: 255435 - protein, 6 aa, Mycobacterium
EDEVSG

SEQ ID NO: 255436 - protein, 16 aa, Mycobacterium
EDFDSITGKGVRATVG

SEQ ID NO: 255437 - protein, 5 aa, Mycobacterium
EDFGG

SEQ ID NO: 255438 - protein, 8 aa, Mycobacterium
EDFPTTPH

SEQ ID NO: 255439 - protein, 7 aa, Mycobacterium
EDFTEGE

SEQ ID NO: 255440 - protein, 14 aa, Mycobacterium
EDFTPQASAVAGSV

SEQ ID NO: 255441 - protein, 7 aa, Mycobacterium
EDGAGGF

SEQ ID NO: 255442 - protein, 10 aa, Mycobacterium
EDGDAGSADL

SEQ ID NO: 255443 - protein, 11 aa, Mycobacterium
EDGDPADPMTD

SEQ ID NO: 255444 - protein, 5 aa, Mycobacterium
EDGEA

SEQ ID NO: 255445 - protein, 5 aa, Mycobacterium
EDGEF

SEQ ID NO: 255446 - protein, 8 aa, Mycobacterium
EDGEPITD

SEQ ID NO: 255447 - protein, 13 aa, Mycobacterium
EDGEPQQGQPADK

SEQ ID NO: 255448 - protein, 5 aa, Mycobacterium
EDGGP

SEQ ID NO: 255449 - protein, 6 aa, Mycobacterium
EDGGTA

SEQ ID NO: 255450 - protein, 7 aa, Mycobacterium
EDGHPVD

SEQ ID NO: 255451 - protein, 6 aa, Mycobacterium
EDGMST

SEQ ID NO: 255452 - protein, 6 aa, Mycobacterium
EDGPDV

SEQ ID NO: 255453 - protein, 15 aa, Mycobacterium
EDGPPEELTAREGGH

SEQ ID NO: 255454 - protein, 15 aa, Mycobacterium
EDGPPEVGVPSQPGL

SEQ ID NO: 255455 - protein, 9 aa, Mycobacterium
EDGQHDPGY

SEQ ID NO: 255456 - protein, 13 aa, Mycobacterium
EDGQIKMSKVEFV

SEQ ID NO: 255457 - protein, 8 aa, Mycobacterium
EDGRGEVQ

SEQ ID NO: 255458 - protein, 7 aa, Mycobacterium
EDGRGGR

SEQ ID NO: 255459 - protein, 9 aa, Mycobacterium
EDGRTTDAI

SEQ ID NO: 255460 - protein, 15 aa, Mycobacterium
EDGSPADLIGRTDGA

SEQ ID NO: 255461 - protein, 6 aa, Mycobacterium
EDGSTH

SEQ ID NO: 255462 - protein, 12 aa, Mycobacterium
EDGTADDRLPGQ

SEQ ID NO: 255463 - protein, 7 aa, Mycobacterium
EDGTGEL

SEQ ID NO: 255464 - protein, 6 aa, Mycobacterium
EDGTTT

SEQ ID NO: 255465 - protein, 5 aa, Mycobacterium
EDGTY

SEQ ID NO: 255466 - protein, 5 aa, Mycobacterium
EDHAS

SEQ ID NO: 255467 - protein, 7 aa, Mycobacterium
EDHGNGG

SEQ ID NO: 255468 - protein, 4 aa, Mycobacterium
EDHH

SEQ ID NO: 255469 - protein, 6 aa, Mycobacterium
EDIDRS

SEQ ID NO: 255470 - protein, 6 aa, Mycobacterium
EDKENR

SEQ ID NO: 255471 - protein, 19 aa, Mycobacterium
EDKGAVAQGERLNAGQEVS

SEQ ID NO: 255472 - protein, 4 aa, Mycobacterium
EDKK

SEQ ID NO: 255473 - protein, 8 aa, Mycobacterium
EDKLGDAA

SEQ ID NO: 255474 - protein, 6 aa, Mycobacterium
EDKSIR

SEQ ID NO: 255475 - protein, 22 aa, Mycobacterium
EDKSKLSEAEIAEGERQLVGGE

SEQ ID NO: 255476 - protein, 7 aa, Mycobacterium
EDKTHPA

SEQ ID NO: 255477 - protein, 4 aa, Mycobacterium
EDLA

SEQ ID NO: 255478 - protein, 8 aa, Mycobacterium
EDLDAGGM

SEQ ID NO: 255479 - protein, 9 aa, Mycobacterium
EDLDPALRR

SEQ ID NO: 255480 - protein, 7 aa, Mycobacterium
EDLEPGD

SEQ ID NO: 255481 - protein, 15 aa, Mycobacterium
EDLEQRKREAEDALQ

SEQ ID NO: 255482 - protein, 8 aa, Mycobacterium
EDLGGGTQ

SEQ ID NO: 255483 - protein, 6 aa, Mycobacterium
EDLGPE

SEQ ID NO: 255484 - protein, 7 aa, Mycobacterium
EDLGRGG

SEQ ID NO: 255485 - protein, 15 aa, Mycobacterium
EDLGSNASNLNKPQF

SEQ ID NO: 255486 - protein, 4 aa, Mycobacterium
EDLP

SEQ ID NO: 255487 - protein, 10 aa, Mycobacterium
EDLPPGTTPY

SEQ ID NO: 255488 - protein, 6 aa, Mycobacterium
EDLRTS

SEQ ID NO: 255489 - protein, 8 aa, Mycobacterium
EDLTSTRD

SEQ ID NO: 255490 - protein, 7 aa, Mycobacterium
EDMDAGG

SEQ ID NO: 255491 - protein, 6 aa, Mycobacterium
EDMGPE

SEQ ID NO: 255492 - protein, 7 aa, Mycobacterium
EDNAAAD

SEQ ID NO: 255493 - protein, 7 aa, Mycobacterium
EDNGDSQ

SEQ ID NO: 255494 - protein, 8 aa, Mycobacterium
EDNGMSHD

SEQ ID NO: 255495 - protein, 14 aa, Mycobacterium
EDNKTYDLSGQAGP

SEQ ID NO: 255496 - protein, 14 aa, Mycobacterium
EDNQTYDLSGQAGP

SEQ ID NO: 255497 - protein, 14 aa, Mycobacterium
EDNTTYDLTGQTEP

SEQ ID NO: 255498 - protein, 7 aa, Mycobacterium
EDPAEDA

SEQ ID NO: 255499 - protein, 26 aa, Mycobacterium
EDPAETALQGPLPPPDRGCEGNPGRV

SEQ ID NO: 255500 - protein, 26 aa, Mycobacterium
EDPAGARESWSRPSSGMSAGGATPPL

SEQ ID NO: 255501 - protein, 72 aa, Mycobacterium
EDPAGPDDTAAETDGPAEPTEPVDASEAEMTDTTETTAQTGTTAEADASEEFEGPRRRARRERAERRAARDR

SEQ ID NO: 255502 - protein, 5 aa, Mycobacterium
EDPAL

SEQ ID NO: 255503 - protein, 5 aa, Mycobacterium
EDPAV

SEQ ID NO: 255504 - protein, 6 aa, Mycobacterium
EDPDRR

SEQ ID NO: 255505 - protein, 10 aa, Mycobacterium
EDPEDNTPIP

SEQ ID NO: 255506 - protein, 7 aa, Mycobacterium
EDPEDPD

SEQ ID NO: 255507 - protein, 5 aa, Mycobacterium
EDPEP

SEQ ID NO: 255508 - protein, 7 aa, Mycobacterium
EDPEPVD

SEQ ID NO: 255509 - protein, 9 aa, Mycobacterium
EDPETGAKY

SEQ ID NO: 255510 - protein, 5 aa, Mycobacterium
EDPEV

SEQ ID NO: 255511 - protein, 5 aa, Mycobacterium
EDPEW

SEQ ID NO: 255512 - protein, 10 aa, Mycobacterium
EDPGPGVAPD

SEQ ID NO: 255513 - protein, 10 aa, Mycobacterium
EDPGPGVSPE

SEQ ID NO: 255514 - protein, 11 aa, Mycobacterium
EDPGRPPDTPP

SEQ ID NO: 255515 - protein, 14 aa, Mycobacterium
EDPIPPSERHEGIS

SEQ ID NO: 255516 - protein, 14 aa, Mycobacterium
EDPIPPSRRHEGIS

SEQ ID NO: 255517 - protein, 22 aa, Mycobacterium
EDPKFASSVRGGGFRAPTARRR

SEQ ID NO: 255518 - protein, 24 aa, Mycobacterium
EDPKFASSVRGGRLGATSGRRRLQ

SEQ ID NO: 255519 - protein, 22 aa, Mycobacterium
EDPKFASSVRGGTLRAPSARRR

SEQ ID NO: 255520 - protein, 22 aa, Mycobacterium
EDPKFASSVRGGTLRAPSTRRR

SEQ ID NO: 255521 - protein, 6 aa, Mycobacterium
EDPNAG

SEQ ID NO: 255522 - protein, 4 aa, Mycobacterium
EDPP

SEQ ID NO: 255523 - protein, 53 aa, Mycobacterium
EDPPAARFGPTLNEGSGAKAPAAGISAAAAAAASARSRARRKRAARIKDPAPQ

SEQ ID NO: 255524 - protein, 53 aa, Mycobacterium
EDPPAARFGPTLNEGSGAKAPAAGISAAAAAAASARSRARRKRGARIKDPAPQ

SEQ ID NO: 255525 - protein, 9 aa, Mycobacterium
EDPPKPSER

SEQ ID NO: 255526 - protein, 9 aa, Mycobacterium
EDPPREGIG

SEQ ID NO: 255527 - protein, 6 aa, Mycobacterium
EDPRVT

SEQ ID NO: 255528 - protein, 10 aa, Mycobacterium
EDPSRAASDW

SEQ ID NO: 255529 - protein, 9 aa, Mycobacterium
EDPTSNSTH

SEQ ID NO: 255530 - protein, 17 aa, Mycobacterium
EDPVAPSKHNPEIPPGL

SEQ ID NO: 255531 - protein, 16 aa, Mycobacterium
EDPVPPSQRHDGISPD

SEQ ID NO: 255532 - protein, 16 aa, Mycobacterium
EDPVPPSQRHTGISPE

SEQ ID NO: 255533 - protein, 10 aa, Mycobacterium
EDPVPPSRRH

SEQ ID NO: 255534 - protein, 6 aa, Mycobacterium
EDQGGT

SEQ ID NO: 255535 - protein, 10 aa, Mycobacterium
EDQQAEIGRA

SEQ ID NO: 255536 - protein, 29 aa, Mycobacterium
EDQQPPTVVSSPTTRTSTTTAPSQPTIPP

SEQ ID NO: 255537 - protein, 5 aa, Mycobacterium
EDQRS

SEQ ID NO: 255538 - protein, 7 aa, Mycobacterium
EDRAAAA

SEQ ID NO: 255539 - protein, 13 aa, Mycobacterium
EDRAAAEDRAAAE

SEQ ID NO: 255540 - protein, 18 aa, Mycobacterium
EDRDLERQRHEMEAIRTR

SEQ ID NO: 255541 - protein, 8 aa, Mycobacterium
EDRDPGMP

SEQ ID NO: 255542 - protein, 5 aa, Mycobacterium
EDREQ

SEQ ID NO: 255543 - protein, 6 aa, Mycobacterium
EDRETA

SEQ ID NO: 255544 - protein, 17 aa, Mycobacterium
EDRGASAQGQDLRAGDE

SEQ ID NO: 255545 - protein, 8 aa, Mycobacterium
EDRGLGPS

SEQ ID NO: 255546 - protein, 7 aa, Mycobacterium
EDRPATS

SEQ ID NO: 255547 - protein, 7 aa, Mycobacterium
EDRRDLA

SEQ ID NO: 255548 - protein, 12 aa, Mycobacterium
EDRRDRENAEPD

SEQ ID NO: 255549 - protein, 9 aa, Mycobacterium
EDRRDSDVQ

SEQ ID NO: 255550 - protein, 16 aa, Mycobacterium
EDRSESTDLADQHPDK

SEQ ID NO: 255551 - protein, 19 aa, Mycobacterium
EDSAKIGDDGWKEMLGPQP

SEQ ID NO: 255552 - protein, 5 aa, Mycobacterium
EDSAR

SEQ ID NO: 255553 - protein, 11 aa, Mycobacterium
EDSATSSGSIG

SEQ ID NO: 255554 - protein, 6 aa, Mycobacterium
EDSDNE

SEQ ID NO: 255555 - protein, 11 aa, Mycobacterium
EDSEGGQGPHG

SEQ ID NO: 255556 - protein, 9 aa, Mycobacterium
EDSENGRGL

SEQ ID NO: 255557 - protein, 4 aa, Mycobacterium
EDSF

SEQ ID NO: 255558 - protein, 10 aa, Mycobacterium
EDSGNLSAGE

SEQ ID NO: 255559 - protein, 9 aa, Mycobacterium
EDSGSGDQA

SEQ ID NO: 255560 - protein, 7 aa, Mycobacterium
EDSKRAL

SEQ ID NO: 255561 - protein, 15 aa, Mycobacterium
EDSTTVLPAPPTTEL

SEQ ID NO: 255562 - protein, 8 aa, Mycobacterium
EDSYTTGS

SEQ ID NO: 255563 - protein, 5 aa, Mycobacterium
EDTAR

SEQ ID NO: 255564 - protein, 4 aa, Mycobacterium
EDTD

SEQ ID NO: 255565 - protein, 24 aa, Mycobacterium
EDTDPALATAPDSSPGTEPVVYDE

SEQ ID NO: 255566 - protein, 16 aa, Mycobacterium
EDTESASAGSLAHSEE

SEQ ID NO: 255567 - protein, 13 aa, Mycobacterium
EDTGPAQQPATTR

SEQ ID NO: 255568 - protein, 12 aa, Mycobacterium
EDTGPTPPQLPD

SEQ ID NO: 255569 - protein, 15 aa, Mycobacterium
EDTGSAQAGAKITDA

SEQ ID NO: 255570 - protein, 7 aa, Mycobacterium
EDTGTQS

SEQ ID NO: 255571 - protein, 5 aa, Mycobacterium
EDTIT

SEQ ID NO: 255572 - protein, 6 aa, Mycobacterium
EDTLPG

SEQ ID NO: 255573 - protein, 4 aa, Mycobacterium
EDTP

SEQ ID NO: 255574 - protein, 7 aa, Mycobacterium
EDTPPDV

SEQ ID NO: 255575 - protein, 12 aa, Mycobacterium
EDTPTSTGTVGS

SEQ ID NO: 255576 - protein, 9 aa, Mycobacterium
EDTQEDTDE

SEQ ID NO: 255577 - protein, 13 aa, Mycobacterium
EDTQLSDETVLSG

SEQ ID NO: 255578 - protein, 7 aa, Mycobacterium
EDTRTDI

SEQ ID NO: 255579 - protein, 6 aa, Mycobacterium
EDTTAL

SEQ ID NO: 255580 - protein, 7 aa, Mycobacterium
EDTTGTV

SEQ ID NO: 255581 - protein, 5 aa, Mycobacterium
EDTVR

SEQ ID NO: 255582 - protein, 6 aa, Mycobacterium
EDVDPV

SEQ ID NO: 255583 - protein, 5 aa, Mycobacterium
EDVEV

SEQ ID NO: 255584 - protein, 25 aa, Mycobacterium
EDVGDGQWRRKGQVQGRPAHAGETI

SEQ ID NO: 255585 - protein, 5 aa, Mycobacterium
EDVGG

SEQ ID NO: 255586 - protein, 7 aa, Mycobacterium
EDVPPLD

SEQ ID NO: 255587 - protein, 9 aa, Mycobacterium
EDVTDRGRT

SEQ ID NO: 255588 - protein, 36 aa, Mycobacterium
EDWDAAADGEDWDPVPAPMAPPEQPAPQQAWNAPAP

SEQ ID NO: 255589 - protein, 6 aa, Mycobacterium
EDYEAA

SEQ ID NO: 255590 - protein, 6 aa, Mycobacterium
EDYERD

SEQ ID NO: 255591 - protein, 6 aa, Mycobacterium
EDYGTA

SEQ ID NO: 255592 - protein, 7 aa, Mycobacterium
EDYNDNE

SEQ ID NO: 255593 - protein, 4 aa, Mycobacterium
EDYP

SEQ ID NO: 255594 - protein, 7 aa, Mycobacterium
EDYQEAG

SEQ ID NO: 255595 - protein, 9 aa, Mycobacterium
EDYQKVASQ

SEQ ID NO: 255596 - protein, 10 aa, Mycobacterium
EDYRTRTAEA

SEQ ID NO: 255597 - protein, 10 aa, Mycobacterium
EDYSPTTPDA

SEQ ID NO: 255598 - protein, 9 aa, Mycobacterium
EEAAESDDS

SEQ ID NO: 255599 - protein, 9 aa, Mycobacterium
EEAAKSGVE

SEQ ID NO: 255600 - protein, 12 aa, Mycobacterium
EEAAQANGFIKA

SEQ ID NO: 255601 - protein, 5 aa, Mycobacterium
EEADR

SEQ ID NO: 255602 - protein, 12 aa, Mycobacterium
EEAEAEAAEAEA

SEQ ID NO: 255603 - protein, 7 aa, Mycobacterium
EEAEAEH

SEQ ID NO: 255604 - protein, 6 aa, Mycobacterium
EEAEAT

SEQ ID NO: 255605 - protein, 8 aa, Mycobacterium
EEAEQGMG

SEQ ID NO: 255606 - protein, 9 aa, Mycobacterium
EEAERDNRV

SEQ ID NO: 255607 - protein, 9 aa, Mycobacterium
EEAERDTRI

SEQ ID NO: 255608 - protein, 5 aa, Mycobacterium
EEAGA

SEQ ID NO: 255609 - protein, 6 aa, Mycobacterium
EEAGGD

SEQ ID NO: 255610 - protein, 7 aa, Mycobacterium
EEAGPAL

SEQ ID NO: 255611 - protein, 12 aa, Mycobacterium
EEAGQRAETTLA

SEQ ID NO: 255612 - protein, 9 aa, Mycobacterium
EEAGTAKPK

SEQ ID NO: 255613 - protein, 18 aa, Mycobacterium
EEAGTGISKPRVGPGASV

SEQ ID NO: 255614 - protein, 17 aa, Mycobacterium
EEAKAKNSAAPDPQQRL

SEQ ID NO: 255615 - protein, 17 aa, Mycobacterium
EEALADPKVSDKTLGEP

SEQ ID NO: 255616 - protein, 7 aa, Mycobacterium
EEANHQF

SEQ ID NO: 255617 - protein, 5 aa, Mycobacterium
EEANR

SEQ ID NO: 255618 - protein, 5 aa, Mycobacterium
EEANS

SEQ ID NO: 255619 - protein, 15 aa, Mycobacterium
EEAPEPDPDELPATG

SEQ ID NO: 255620 - protein, 12 aa, Mycobacterium
EEAQQDRAPIQT

SEQ ID NO: 255621 - protein, 15 aa, Mycobacterium
EEAQQRIAQSRPDLG

SEQ ID NO: 255622 - protein, 9 aa, Mycobacterium
EEARALPEV

SEQ ID NO: 255623 - protein, 14 aa, Mycobacterium
EEARARAEQEVSST

SEQ ID NO: 255624 - protein, 7 aa, Mycobacterium
EEARTGT

SEQ ID NO: 255625 - protein, 4 aa, Mycobacterium
EEAV

SEQ ID NO: 255626 - protein, 4 aa, Mycobacterium
EEAY

SEQ ID NO: 255627 - protein, 4 aa, Mycobacterium
EEDL

SEQ ID NO: 255628 - protein, 8 aa, Mycobacterium
EEDRAKVA

SEQ ID NO: 255629 - protein, 16 aa, Mycobacterium
EEDRRRAAQTKADTEY

SEQ ID NO: 255630 - protein, 16 aa, Mycobacterium
EEDRRRAEQTKADTEY

SEQ ID NO: 255631 - protein, 9 aa, Mycobacterium
EEDSGALPL

SEQ ID NO: 255632 - protein, 4 aa, Mycobacterium
EEDV

SEQ ID NO: 255633 - protein, 5 aa, Mycobacterium
EEEAE

SEQ ID NO: 255634 - protein, 24 aa, Mycobacterium
EEEAPATTKAEAAAPAAEAKPVSG

SEQ ID NO: 255635 - protein, 14 aa, Mycobacterium
EEEDEEDEDSDTDV

SEQ ID NO: 255636 - protein, 6 aa, Mycobacterium
EEEHTR

SEQ ID NO: 255637 - protein, 22 aa, Mycobacterium
EEEPADPVEALPASADRRDGRV

SEQ ID NO: 255638 - protein, 15 aa, Mycobacterium
EEEPPPPRSTEAVTE

SEQ ID NO: 255639 - protein, 9 aa, Mycobacterium
EEESPALES

SEQ ID NO: 255640 - protein, 7 aa, Mycobacterium
EEESPAV

SEQ ID NO: 255641 - protein, 17 aa, Mycobacterium
EEESTGIDESEHAESGY

SEQ ID NO: 255642 - protein, 5 aa, Mycobacterium
EEETR

SEQ ID NO: 255643 - protein, 6 aa, Mycobacterium
EEEVSG

SEQ ID NO: 255644 - protein, 7 aa, Mycobacterium
EEEYAGI

SEQ ID NO: 255645 - protein, 8 aa, Mycobacterium
EEFTGPPR

SEQ ID NO: 255646 - protein, 8 aa, Mycobacterium
EEGDSDSS

SEQ ID NO: 255647 - protein, 6 aa, Mycobacterium
EEGGAP

SEQ ID NO: 255648 - protein, 4 aa, Mycobacterium
EEGN

SEQ ID NO: 255649 - protein, 20 aa, Mycobacterium
EEGRALPSLDTQDSTDGRVE

SEQ ID NO: 255650 - protein, 5 aa, Mycobacterium
EEGRG

SEQ ID NO: 255651 - protein, 6 aa, Mycobacterium
EEGRPG

SEQ ID NO: 255652 - protein, 16 aa, Mycobacterium
EEGSGGSRQLRPGDTI

SEQ ID NO: 255653 - protein, 7 aa, Mycobacterium
EEGSSHQ

SEQ ID NO: 255654 - protein, 5 aa, Mycobacterium
EEGST

SEQ ID NO: 255655 - protein, 12 aa, Mycobacterium
EEGTRKISSGDY

SEQ ID NO: 255656 - protein, 7 aa, Mycobacterium
EEGVTED

SEQ ID NO: 255657 - protein, 9 aa, Mycobacterium
EEHPVGPPR

SEQ ID NO: 255658 - protein, 4 aa, Mycobacterium
EEHQ

SEQ ID NO: 255659 - protein, 5 aa, Mycobacterium
EEHSR

SEQ ID NO: 255660 - protein, 8 aa, Mycobacterium
EEIDPGPM

SEQ ID NO: 255661 - protein, 6 aa, Mycobacterium
EEIGSA

SEQ ID NO: 255662 - protein, 7 aa, Mycobacterium
EEKITGD

SEQ ID NO: 255663 - protein, 5 aa, Mycobacterium
EEKQT

SEQ ID NO: 255664 - protein, 9 aa, Mycobacterium
EELADAAQL

SEQ ID NO: 255665 - protein, 8 aa, Mycobacterium
EELDPALQ

SEQ ID NO: 255666 - protein, 18 aa, Mycobacterium
EELESVKREADVERDDAE

SEQ ID NO: 255667 - protein, 4 aa, Mycobacterium
EELG

SEQ ID NO: 255668 - protein, 7 aa, Mycobacterium
EELPGGL

SEQ ID NO: 255669 - protein, 14 aa, Mycobacterium
EELQSRDPMVEFRV

SEQ ID NO: 255670 - protein, 5 aa, Mycobacterium
EELSD

SEQ ID NO: 255671 - protein, 11 aa, Mycobacterium
EELSKGDHGAL

SEQ ID NO: 255672 - protein, 19 aa, Mycobacterium
EELTAGRAKRCASGDGTPL

SEQ ID NO: 255673 - protein, 8 aa, Mycobacterium
EELTDAQQ

SEQ ID NO: 255674 - protein, 5 aa, Mycobacterium
EELTG

SEQ ID NO: 255675 - protein, 7 aa, Mycobacterium
EELTQSG

SEQ ID NO: 255676 - protein, 10 aa, Mycobacterium
EEMKATTDEM

SEQ ID NO: 255677 - protein, 22 aa, Mycobacterium
EEMNPNTAPPRTSLRSGGPQSL

SEQ ID NO: 255678 - protein, 15 aa, Mycobacterium
EEMPPPPPELEPDLD

SEQ ID NO: 255679 - protein, 10 aa, Mycobacterium
EEMYEPERTL

SEQ ID NO: 255680 - protein, 15 aa, Mycobacterium
EENAGQAKVSDVEFI

SEQ ID NO: 255681 - protein, 8 aa, Mycobacterium
EENPNLQR

SEQ ID NO: 255682 - protein, 5 aa, Mycobacterium
EENRQ

SEQ ID NO: 255683 - protein, 6 aa, Mycobacterium
EENRSL

SEQ ID NO: 255684 - protein, 18 aa, Mycobacterium
EENTDGFEHTTRRTYAEQ

SEQ ID NO: 255685 - protein, 10 aa, Mycobacterium
EENTNGFQHT

SEQ ID NO: 255686 - protein, 4 aa, Mycobacterium
EENV

SEQ ID NO: 255687 - protein, 8 aa, Mycobacterium
EEPATKAC

SEQ ID NO: 255688 - protein, 6 aa, Mycobacterium
EEPDRR

SEQ ID NO: 255689 - protein, 14 aa, Mycobacterium
EEPDSAGDSSAELE

SEQ ID NO: 255690 - protein, 23 aa, Mycobacterium
EEPDSVNEAPHQPDSDGEPADAH

SEQ ID NO: 255691 - protein, 9 aa, Mycobacterium
EEPELPGLT

SEQ ID NO: 255692 - protein, 12 aa, Mycobacterium
EEPGRGVSATID

SEQ ID NO: 255693 - protein, 5 aa, Mycobacterium
EEPID

SEQ ID NO: 255694 - protein, 21 aa, Mycobacterium
EEPPAADGGATTRSPGPADDP

SEQ ID NO: 255695 - protein, 13 aa, Mycobacterium
EEPPRLSDHRPEL

SEQ ID NO: 255696 - protein, 9 aa, Mycobacterium
EEPRAADDV

SEQ ID NO: 255697 - protein, 7 aa, Mycobacterium
EEPSGGT

SEQ ID NO: 255698 - protein, 21 aa, Mycobacterium
EEQAETEEREADNARQEDELA

SEQ ID NO: 255699 - protein, 12 aa, Mycobacterium
EEQDPNNDNLPI

SEQ ID NO: 255700 - protein, 6 aa, Mycobacterium
EEQGLS

SEQ ID NO: 255701 - protein, 8 aa, Mycobacterium
EEQHTAAS

SEQ ID NO: 255702 - protein, 6 aa, Mycobacterium
EEQRQV

SEQ ID NO: 255703 - protein, 5 aa, Mycobacterium
EEQRR

SEQ ID NO: 255704 - protein, 16 aa, Mycobacterium
EEQRRRAASQQQSTSL

SEQ ID NO: 255705 - protein, 15 aa, Mycobacterium
EEQRRRSAAQQQSKT

SEQ ID NO: 255706 - protein, 13 aa, Mycobacterium
EEQRRRVAAEQQS

SEQ ID NO: 255707 - protein, 4 aa, Mycobacterium
EERE

SEQ ID NO: 255708 - protein, 5 aa, Mycobacterium
EERER

SEQ ID NO: 255709 - protein, 6 aa, Mycobacterium
EERGRL

SEQ ID NO: 255710 - protein, 7 aa, Mycobacterium
EERHARS

SEQ ID NO: 255711 - protein, 4 aa, Mycobacterium
EERL

SEQ ID NO: 255712 - protein, 10 aa, Mycobacterium
EERLADSRSY

SEQ ID NO: 255713 - protein, 6 aa, Mycobacterium
EERPGA

SEQ ID NO: 255714 - protein, 9 aa, Mycobacterium
EERPPAESS

SEQ ID NO: 255715 - protein, 11 aa, Mycobacterium
EERPPSESRRA

SEQ ID NO: 255716 - protein, 9 aa, Mycobacterium
EERQGFPPA

SEQ ID NO: 255717 - protein, 14 aa, Mycobacterium
EERQQAQRTGPAAH

SEQ ID NO: 255718 - protein, 4 aa, Mycobacterium
EERR

SEQ ID NO: 255719 - protein, 5 aa, Mycobacterium
EERRV

SEQ ID NO: 255720 - protein, 16 aa, Mycobacterium
EERSAPLNAADAPSTL

SEQ ID NO: 255721 - protein, 65 aa, Mycobacterium
EERSASDPQTVLGPPQDGFSAVPGAAAAHSDRADSSPAPTDPHGAASPTAIPQPISAPHSSGDGI

SEQ ID NO: 255722 - protein, 11 aa, Mycobacterium
EERSKGLDSEE

SEQ ID NO: 255723 - protein, 11 aa, Mycobacterium
EERSKGLSRED

SEQ ID NO: 255724 - protein, 11 aa, Mycobacterium
EERSRGLDREE

SEQ ID NO: 255725 - protein, 7 aa, Mycobacterium
EESADQL

SEQ ID NO: 255726 - protein, 15 aa, Mycobacterium
EESAEASKKLAEADA

SEQ ID NO: 255727 - protein, 6 aa, Mycobacterium
EESARN

SEQ ID NO: 255728 - protein, 7 aa, Mycobacterium
EESCERG

SEQ ID NO: 255729 - protein, 13 aa, Mycobacterium
EESGESEEHPTGE

SEQ ID NO: 255730 - protein, 7 aa, Mycobacterium
EESGRGD

SEQ ID NO: 255731 - protein, 5 aa, Mycobacterium
EESHD

SEQ ID NO: 255732 - protein, 8 aa, Mycobacterium
EESKRGFR

SEQ ID NO: 255733 - protein, 9 aa, Mycobacterium
EESLRQGTE

SEQ ID NO: 255734 - protein, 12 aa, Mycobacterium
EESPGTGSGEDP

SEQ ID NO: 255735 - protein, 12 aa, Mycobacterium
EESPRTRAGART

SEQ ID NO: 255736 - protein, 17 aa, Mycobacterium
EESRRGLRTTPIAPRER

SEQ ID NO: 255737 - protein, 7 aa, Mycobacterium
EESTEAY

SEQ ID NO: 255738 - protein, 5 aa, Mycobacterium
EESTH

SEQ ID NO: 255739 - protein, 7 aa, Mycobacterium
EESTLGR

SEQ ID NO: 255740 - protein, 21 aa, Mycobacterium
EETAALGGETAALPDSAPTNA

SEQ ID NO: 255741 - protein, 11 aa, Mycobacterium
EETAHPERNVP

SEQ ID NO: 255742 - protein, 8 aa, Mycobacterium
EETDAGLN

SEQ ID NO: 255743 - protein, 6 aa, Mycobacterium
EETDMR

SEQ ID NO: 255744 - protein, 49 aa, Mycobacterium
EETEAKARAAKAEADAKAAEAEAKAAEAARLADTASTSRDALTSSQEHI

SEQ ID NO: 255745 - protein, 8 aa, Mycobacterium
EETGAGLK

SEQ ID NO: 255746 - protein, 9 aa, Mycobacterium
EETGQRAEP

SEQ ID NO: 255747 - protein, 30 aa, Mycobacterium
EETGTLNPVPGRTATELARDAGAALPALSG

SEQ ID NO: 255748 - protein, 10 aa, Mycobacterium
EETKHPQRDV

SEQ ID NO: 255749 - protein, 11 aa, Mycobacterium
EETKRPQRDVP

SEQ ID NO: 255750 - protein, 14 aa, Mycobacterium
EETPAPVPEAPSRR

SEQ ID NO: 255751 - protein, 13 aa, Mycobacterium
EETPPQPRDPAAV

SEQ ID NO: 255752 - protein, 17 aa, Mycobacterium
EETRGKNLEDMHAEALG

SEQ ID NO: 255753 - protein, 28 aa, Mycobacterium
EETRGRALSETSAATRLTEPETRSDPVD

SEQ ID NO: 255754 - protein, 8 aa, Mycobacterium
EETTAANA

SEQ ID NO: 255755 - protein, 11 aa, Mycobacterium
EETVNPERNVP

SEQ ID NO: 255756 - protein, 4 aa, Mycobacterium
EETY

SEQ ID NO: 255757 - protein, 54 aa, Mycobacterium
EEVAEEAEEVEEAEVADTDVETETETETEKTEAEKTEKTEAEKTETESGTDAGA

SEQ ID NO: 255758 - protein, 5 aa, Mycobacterium
EEVDD

SEQ ID NO: 255759 - protein, 5 aa, Mycobacterium
EEVEH

SEQ ID NO: 255760 - protein, 8 aa, Mycobacterium
EEVERTKA

SEQ ID NO: 255761 - protein, 7 aa, Mycobacterium
EEVGAGI

SEQ ID NO: 255762 - protein, 9 aa, Mycobacterium
EEVGEPQSQ

SEQ ID NO: 255763 - protein, 10 aa, Mycobacterium
EEVGSPPAQP

SEQ ID NO: 255764 - protein, 16 aa, Mycobacterium
EEVPRIAGSNDPYPDC

SEQ ID NO: 255765 - protein, 7 aa, Mycobacterium
EEVRDPA

SEQ ID NO: 255766 - protein, 8 aa, Mycobacterium
EEVRDPGR

SEQ ID NO: 255767 - protein, 8 aa, Mycobacterium
EEVRNPGI

SEQ ID NO: 255768 - protein, 9 aa, Mycobacterium
EEVRNPGVQ

SEQ ID NO: 255769 - protein, 9 aa, Mycobacterium
EEYGGGGAG

SEQ ID NO: 255770 - protein, 12 aa, Mycobacterium
EEYGGPAAPELA

SEQ ID NO: 255771 - protein, 5 aa, Mycobacterium
EEYRR

SEQ ID NO: 255772 - protein, 23 aa, Mycobacterium
EFDDGDDYEGYSDFAGDDADTVE

SEQ ID NO: 255773 - protein, 6 aa, Mycobacterium
EFDNSY

SEQ ID NO: 255774 - protein, 13 aa, Mycobacterium
EFDPETDGAELER

SEQ ID NO: 255775 - protein, 12 aa, Mycobacterium
EFDPRAAAGVGP

SEQ ID NO: 255776 - protein, 5 aa, Mycobacterium
EFEET

SEQ ID NO: 255777 - protein, 7 aa, Mycobacterium
EFEGQSA

SEQ ID NO: 255778 - protein, 7 aa, Mycobacterium
EFEKSAN

SEQ ID NO: 255779 - protein, 17 aa, Mycobacterium
EFEPPKTAPSPTSLRPN

SEQ ID NO: 255780 - protein, 5 aa, Mycobacterium
EFGAS

SEQ ID NO: 255781 - protein, 17 aa, Mycobacterium
EFGPSTGSGKPTGPVQP

SEQ ID NO: 255782 - protein, 5 aa, Mycobacterium
EFGSI

SEQ ID NO: 255783 - protein, 9 aa, Mycobacterium
EFKPDQSPT

SEQ ID NO: 255784 - protein, 4 aa, Mycobacterium
EFNE

SEQ ID NO: 255785 - protein, 6 aa, Mycobacterium
EFNSDA

SEQ ID NO: 255786 - protein, 6 aa, Mycobacterium
EFNSDN

SEQ ID NO: 255787 - protein, 9 aa, Mycobacterium
EFPAAHGPH

SEQ ID NO: 255788 - protein, 9 aa, Mycobacterium
EFPAPKTHA

SEQ ID NO: 255789 - protein, 8 aa, Mycobacterium
EFPAPTTH

SEQ ID NO: 255790 - protein, 9 aa, Mycobacterium
EFPESTAPA

SEQ ID NO: 255791 - protein, 5 aa, Mycobacterium
EFPGK

SEQ ID NO: 255792 - protein, 9 aa, Mycobacterium
EFPGPAEGA

SEQ ID NO: 255793 - protein, 7 aa, Mycobacterium
EFPRSAP

SEQ ID NO: 255794 - protein, 6 aa, Mycobacterium
EFPSGR

SEQ ID NO: 255795 - protein, 32 aa, Mycobacterium
EFPTDPRAVDVGPANYAGQPPPSMPYPQRRSK

SEQ ID NO: 255796 - protein, 7 aa, Mycobacterium
EFRGKRD

SEQ ID NO: 255797 - protein, 28 aa, Mycobacterium
EFRKTDELQESAAPNEQWQGSASKAYDA

SEQ ID NO: 255798 - protein, 6 aa, Mycobacterium
EFSAGT

SEQ ID NO: 255799 - protein, 7 aa, Mycobacterium
EFSGDGI

SEQ ID NO: 255800 - protein, 12 aa, Mycobacterium
EFSPLDPTNAPH

SEQ ID NO: 255801 - protein, 6 aa, Mycobacterium
EFSSDP

SEQ ID NO: 255802 - protein, 5 aa, Mycobacterium
EFTDT

SEQ ID NO: 255803 - protein, 7 aa, Mycobacterium
EFTDTAG

SEQ ID NO: 255804 - protein, 11 aa, Mycobacterium
EFTESAKHAGI

SEQ ID NO: 255805 - protein, 5 aa, Mycobacterium
EGAAA

SEQ ID NO: 255806 - protein, 9 aa, Mycobacterium
EGAAEGAAS

SEQ ID NO: 255807 - protein, 10 aa, Mycobacterium
EGAAEGAASL

SEQ ID NO: 255808 - protein, 57 aa, Mycobacterium
EGADISAASDHADESAANSGDTSSAATSRGPKTTGPKGRPTPKRNDATRSKKGPVVP

SEQ ID NO: 255809 - protein, 31 aa, Mycobacterium
EGAEASTSHAGGPETGPAPAAPAAPGPAEAG

SEQ ID NO: 255810 - protein, 13 aa, Mycobacterium
EGAERVAAGDYSQ

SEQ ID NO: 255811 - protein, 57 aa, Mycobacterium
EGAEVSAKAEDSQGAQTRSPAEPATSRGSRATGPKGRPTPKRSEARRSAKKGPVVPA

SEQ ID NO: 255812 - protein, 6 aa, Mycobacterium
EGAGAA

SEQ ID NO: 255813 - protein, 8 aa, Mycobacterium
EGAGELTE

SEQ ID NO: 255814 - protein, 8 aa, Mycobacterium
EGAGINGM

SEQ ID NO: 255815 - protein, 15 aa, Mycobacterium
EGAGKPHHATRPDGL

SEQ ID NO: 255816 - protein, 6 aa, Mycobacterium
EGAGNI

SEQ ID NO: 255817 - protein, 15 aa, Mycobacterium
EGAGSPKQLKPGDTI

SEQ ID NO: 255818 - protein, 9 aa, Mycobacterium
EGAGYGPTA

SEQ ID NO: 255819 - protein, 6 aa, Mycobacterium
EGAIEG

SEQ ID NO: 255820 - protein, 8 aa, Mycobacterium
EGAKTTLA

SEQ ID NO: 255821 - protein, 8 aa, Mycobacterium
EGALSEEV

SEQ ID NO: 255822 - protein, 8 aa, Mycobacterium
EGAPGIGP

SEQ ID NO: 255823 - protein, 10 aa, Mycobacterium
EGAPNLPSGY

SEQ ID NO: 255824 - protein, 7 aa, Mycobacterium
EGAQGGM

SEQ ID NO: 255825 - protein, 13 aa, Mycobacterium
EGAQISTEAAKGL

SEQ ID NO: 255826 - protein, 8 aa, Mycobacterium
EGAQWDED

SEQ ID NO: 255827 - protein, 5 aa, Mycobacterium
EGARQ

SEQ ID NO: 255828 - protein, 6 aa, Mycobacterium
EGARTD

SEQ ID NO: 255829 - protein, 7 aa, Mycobacterium
EGARVSS

SEQ ID NO: 255830 - protein, 17 aa, Mycobacterium
EGARYGSKHKTTVADSS

SEQ ID NO: 255831 - protein, 9 aa, Mycobacterium
EGASGSALR

SEQ ID NO: 255832 - protein, 10 aa, Mycobacterium
EGASTGPSVI

SEQ ID NO: 255833 - protein, 4 aa, Mycobacterium
EGAV

SEQ ID NO: 255834 - protein, 5 aa, Mycobacterium
EGAVA

SEQ ID NO: 255835 - protein, 6 aa, Mycobacterium
EGAVDG

SEQ ID NO: 255836 - protein, 14 aa, Mycobacterium
EGCADDWKSARSGL

SEQ ID NO: 255837 - protein, 7 aa, Mycobacterium
EGDAQST

SEQ ID NO: 255838 - protein, 7 aa, Mycobacterium
EGDENST

SEQ ID NO: 255839 - protein, 55 aa, Mycobacterium
EGDLSDGAHYAGAGDHAADYSADGADEYPDFGSGPAGEEPPSPESAAAPPPPFRT

SEQ ID NO: 255840 - protein, 8 aa, Mycobacterium
EGDNAGRP

SEQ ID NO: 255841 - protein, 10 aa, Mycobacterium
EGDPASTEGI

SEQ ID NO: 255842 - protein, 9 aa, Mycobacterium
EGDPATPEG

SEQ ID NO: 255843 - protein, 10 aa, Mycobacterium
EGDPATPEGV

SEQ ID NO: 255844 - protein, 8 aa, Mycobacterium
EGDPATVE

SEQ ID NO: 255845 - protein, 6 aa, Mycobacterium
EGDPDR

SEQ ID NO: 255846 - protein, 8 aa, Mycobacterium
EGDPEEPI

SEQ ID NO: 255847 - protein, 10 aa, Mycobacterium
EGDPGGAEAA

SEQ ID NO: 255848 - protein, 11 aa, Mycobacterium
EGDPKENFPGP

SEQ ID NO: 255849 - protein, 4 aa, Mycobacterium
EGDS

SEQ ID NO: 255850 - protein, 7 aa, Mycobacterium
EGDTLSE

SEQ ID NO: 255851 - protein, 12 aa, Mycobacterium
EGDTTWRPRWCK

SEQ ID NO: 255852 - protein, 7 aa, Mycobacterium
EGDVEGR

SEQ ID NO: 255853 - protein, 8 aa, Mycobacterium
EGDYDGTE

SEQ ID NO: 255854 - protein, 6 aa, Mycobacterium
EGDYDV

SEQ ID NO: 255855 - protein, 6 aa, Mycobacterium
EGEAQL

SEQ ID NO: 255856 - protein, 11 aa, Mycobacterium
EGEAVEVSAEK

SEQ ID NO: 255857 - protein, 6 aa, Mycobacterium
EGECEA

SEQ ID NO: 255858 - protein, 11 aa, Mycobacterium
EGEDANTEPDY

SEQ ID NO: 255859 - protein, 50 aa, Mycobacterium
EGEDAVQRAEASAQRPEREPQSWPAAETMAGPVAPRPGGTGWSERSGHHP

SEQ ID NO: 255860 - protein, 4 aa, Mycobacterium
EGEL

SEQ ID NO: 255861 - protein, 15 aa, Mycobacterium
EGELTADGLGGSANQ

SEQ ID NO: 255862 - protein, 18 aa, Mycobacterium
EGEPEEAPAPPPSEEGNR

SEQ ID NO: 255863 - protein, 13 aa, Mycobacterium
EGEPEIDTAADDA

SEQ ID NO: 255864 - protein, 12 aa, Mycobacterium
EGEPETADDGVD

SEQ ID NO: 255865 - protein, 7 aa, Mycobacterium
EGESTRM

SEQ ID NO: 255866 - protein, 6 aa, Mycobacterium
EGETDS

SEQ ID NO: 255867 - protein, 8 aa, Mycobacterium
EGETSTKA

SEQ ID NO: 255868 - protein, 33 aa, Mycobacterium
EGEVEAAAEAEEAEEAEEAEEAEEAEEAEPGEI

SEQ ID NO: 255869 - protein, 17 aa, Mycobacterium
EGEVEAAAEAEEAEVGE

SEQ ID NO: 255870 - protein, 15 aa, Mycobacterium
EGEVEEAEEAEPGEV

SEQ ID NO: 255871 - protein, 6 aa, Mycobacterium
EGEVPA

SEQ ID NO: 255872 - protein, 7 aa, Mycobacterium
EGEVPTT

SEQ ID NO: 255873 - protein, 7 aa, Mycobacterium
EGFTDSG

SEQ ID NO: 255874 - protein, 12 aa, Mycobacterium
EGGAASPEHSHT

SEQ ID NO: 255875 - protein, 6 aa, Mycobacterium
EGGAGL

SEQ ID NO: 255876 - protein, 22 aa, Mycobacterium
EGGANGVAGNLDNAGNSADGVP

SEQ ID NO: 255877 - protein, 17 aa, Mycobacterium
EGGEEGLSLTGGPAPQL

SEQ ID NO: 255878 - protein, 7 aa, Mycobacterium
EGGEGAI

SEQ ID NO: 255879 - protein, 5 aa, Mycobacterium
EGGER

SEQ ID NO: 255880 - protein, 8 aa, Mycobacterium
EGGGEQSA

SEQ ID NO: 255881 - protein, 12 aa, Mycobacterium
EGGGPQQGMPAD

SEQ ID NO: 255882 - protein, 8 aa, Mycobacterium
EGGLAPVP

SEQ ID NO: 255883 - protein, 25 aa, Mycobacterium
EGGLKEGEASAPARPPGSKSRKGRA

SEQ ID NO: 255884 - protein, 11 aa, Mycobacterium
EGGNGTQDCDA

SEQ ID NO: 255885 - protein, 10 aa, Mycobacterium
EGGPAAAEAR

SEQ ID NO: 255886 - protein, 8 aa, Mycobacterium
EGGPEGVG

SEQ ID NO: 255887 - protein, 6 aa, Mycobacterium
EGGPFR

SEQ ID NO: 255888 - protein, 12 aa, Mycobacterium
EGGRCAEPDEGD

SEQ ID NO: 255889 - protein, 4 aa, Mycobacterium
EGGS

SEQ ID NO: 255890 - protein, 6 aa, Mycobacterium
EGGSAL

SEQ ID NO: 255891 - protein, 6 aa, Mycobacterium
EGGSVR

SEQ ID NO: 255892 - protein, 19 aa, Mycobacterium
EGGVRAGDGIATDPEDPTQ

SEQ ID NO: 255893 - protein, 12 aa, Mycobacterium
EGGYEAPGGNGR

SEQ ID NO: 255894 - protein, 18 aa, Mycobacterium
EGHDPTGDQDDTDRRGGD

SEQ ID NO: 255895 - protein, 7 aa, Mycobacterium
EGHGNPA

SEQ ID NO: 255896 - protein, 9 aa, Mycobacterium
EGIGRPDSA

SEQ ID NO: 255897 - protein, 10 aa, Mycobacterium
EGIRGGEAAI

SEQ ID NO: 255898 - protein, 16 aa, Mycobacterium
EGKETRGSGTAAATVT

SEQ ID NO: 255899 - protein, 9 aa, Mycobacterium
EGKGLKGGA

SEQ ID NO: 255900 - protein, 5 aa, Mycobacterium
EGKPL

SEQ ID NO: 255901 - protein, 7 aa, Mycobacterium
EGKPVDI

SEQ ID NO: 255902 - protein, 8 aa, Mycobacterium
EGKSTRNV

SEQ ID NO: 255903 - protein, 4 aa, Mycobacterium
EGKT

SEQ ID NO: 255904 - protein, 5 aa, Mycobacterium
EGLEG

SEQ ID NO: 255905 - protein, 34 aa, Mycobacterium
EGLGGNCQYPEAEPASKPNNAPRTGKVPTEPAQV

SEQ ID NO: 255906 - protein, 6 aa, Mycobacterium
EGLGPN

SEQ ID NO: 255907 - protein, 5 aa, Mycobacterium
EGLPA

SEQ ID NO: 255908 - protein, 6 aa, Mycobacterium
EGLSRG

SEQ ID NO: 255909 - protein, 7 aa, Mycobacterium
EGLSTGL

SEQ ID NO: 255910 - protein, 6 aa, Mycobacterium
EGMPNG

SEQ ID NO: 255911 - protein, 10 aa, Mycobacterium
EGMRGHGDDV

SEQ ID NO: 255912 - protein, 9 aa, Mycobacterium
EGMSATGPQ

SEQ ID NO: 255913 - protein, 5 aa, Mycobacterium
EGMSG

SEQ ID NO: 255914 - protein, 10 aa, Mycobacterium
EGMSGGPTIE

SEQ ID NO: 255915 - protein, 4 aa, Mycobacterium
EGNK

SEQ ID NO: 255916 - protein, 5 aa, Mycobacterium
EGNLD

SEQ ID NO: 255917 - protein, 8 aa, Mycobacterium
EGNPDGPA

SEQ ID NO: 255918 - protein, 8 aa, Mycobacterium
EGNPDGPT

SEQ ID NO: 255919 - protein, 8 aa, Mycobacterium
EGNPPSRA

SEQ ID NO: 255920 - protein, 7 aa, Mycobacterium
EGNSDSS

SEQ ID NO: 255921 - protein, 82 aa, Mycobacterium
EGPADEPGEGEPGTPAVEGDAGEGEPGSRVAQGDAAEREPGSRVAQGDAAEGEPVSPAAEGEAGSPAAEGEPGPTAAERDPE

SEQ ID NO: 255922 - protein, 7 aa, Mycobacterium
EGPAMAP

SEQ ID NO: 255923 - protein, 14 aa, Mycobacterium
EGPAPRDTQLPARA

SEQ ID NO: 255924 - protein, 7 aa, Mycobacterium
EGPDAGW

SEQ ID NO: 255925 - protein, 12 aa, Mycobacterium
EGPDNGLSLQGA

SEQ ID NO: 255926 - protein, 13 aa, Mycobacterium
EGPDNGLSLQGAT

SEQ ID NO: 255927 - protein, 9 aa, Mycobacterium
EGPESQRRR

SEQ ID NO: 255928 - protein, 9 aa, Mycobacterium
EGPGIPHGA

SEQ ID NO: 255929 - protein, 10 aa, Mycobacterium
EGPGIPRGAE

SEQ ID NO: 255930 - protein, 11 aa, Mycobacterium
EGPGMSQEDAR

SEQ ID NO: 255931 - protein, 11 aa, Mycobacterium
EGPGMTGEDAQ

SEQ ID NO: 255932 - protein, 7 aa, Mycobacterium
EGPGPAF

SEQ ID NO: 255933 - protein, 9 aa, Mycobacterium
EGPGTPEVL

SEQ ID NO: 255934 - protein, 10 aa, Mycobacterium
EGPGVPHGAE

SEQ ID NO: 255935 - protein, 12 aa, Mycobacterium
EGPGVPPGSQGQ

SEQ ID NO: 255936 - protein, 19 aa, Mycobacterium
EGPHSAGTMDSESVAPSTT

SEQ ID NO: 255937 - protein, 8 aa, Mycobacterium
EGPKPPDQ

SEQ ID NO: 255938 - protein, 5 aa, Mycobacterium
EGPLE

SEQ ID NO: 255939 - protein, 11 aa, Mycobacterium
EGPLKPPQQLS

SEQ ID NO: 255940 - protein, 8 aa, Mycobacterium
EGPMPPKR

SEQ ID NO: 255941 - protein, 8 aa, Mycobacterium
EGPNRRSV

SEQ ID NO: 255942 - protein, 27 aa, Mycobacterium
EGPQEHDAEPAAPAAPGSDEVAPLSFA

SEQ ID NO: 255943 - protein, 7 aa, Mycobacterium
EGPSAGW

SEQ ID NO: 255944 - protein, 6 aa, Mycobacterium
EGPSEA

SEQ ID NO: 255945 - protein, 28 aa, Mycobacterium
EGPSGAASPGGPGGRLSDDDTPTGPMRT

SEQ ID NO: 255946 - protein, 7 aa, Mycobacterium
EGPSTTG

SEQ ID NO: 255947 - protein, 16 aa, Mycobacterium
EGPTTAIDTGQGDPVE

SEQ ID NO: 255948 - protein, 12 aa, Mycobacterium
EGPVKPPKQLSA

SEQ ID NO: 255949 - protein, 5 aa, Mycobacterium
EGPVP

SEQ ID NO: 255950 - protein, 12 aa, Mycobacterium
EGPVQPPKQLSA

SEQ ID NO: 255951 - protein, 5 aa, Mycobacterium
EGPVS

SEQ ID NO: 255952 - protein, 4 aa, Mycobacterium
EGPY

SEQ ID NO: 255953 - protein, 6 aa, Mycobacterium
EGQAAD

SEQ ID NO: 255954 - protein, 14 aa, Mycobacterium
EGQAAPPTPPAPLE

SEQ ID NO: 255955 - protein, 5 aa, Mycobacterium
EGQAL

SEQ ID NO: 255956 - protein, 6 aa, Mycobacterium
EGQALR

SEQ ID NO: 255957 - protein, 4 aa, Mycobacterium
EGQD

SEQ ID NO: 255958 - protein, 8 aa, Mycobacterium
EGQDEGLS

SEQ ID NO: 255959 - protein, 8 aa, Mycobacterium
EGQEGDRG

SEQ ID NO: 255960 - protein, 9 aa, Mycobacterium
EGQELDTTE

SEQ ID NO: 255961 - protein, 4 aa, Mycobacterium
EGQL

SEQ ID NO: 255962 - protein, 5 aa, Mycobacterium
EGQLE

SEQ ID NO: 255963 - protein, 8 aa, Mycobacterium
EGQNTTAA

SEQ ID NO: 255964 - protein, 4 aa, Mycobacterium
EGQR

SEQ ID NO: 255965 - protein, 7 aa, Mycobacterium
EGQSAGW

SEQ ID NO: 255966 - protein, 5 aa, Mycobacterium
EGQSH

SEQ ID NO: 255967 - protein, 6 aa, Mycobacterium
EGQSKD

SEQ ID NO: 255968 - protein, 23 aa, Mycobacterium
EGQTITKGTVPAEIGPALDTANR

SEQ ID NO: 255969 - protein, 6 aa, Mycobacterium
EGRAGA

SEQ ID NO: 255970 - protein, 7 aa, Mycobacterium
EGRAQAA

SEQ ID NO: 255971 - protein, 13 aa, Mycobacterium
EGRATVEATGRHT

SEQ ID NO: 255972 - protein, 15 aa, Mycobacterium
EGRDATRALRRGTVG

SEQ ID NO: 255973 - protein, 11 aa, Mycobacterium
EGRDGTGGAAG

SEQ ID NO: 255974 - protein, 5 aa, Mycobacterium
EGRDP

SEQ ID NO: 255975 - protein, 7 aa, Mycobacterium
EGRDPIA

SEQ ID NO: 255976 - protein, 16 aa, Mycobacterium
EGRDPTDAPSESDTEG

SEQ ID NO: 255977 - protein, 16 aa, Mycobacterium
EGRDPTDRPPEPDTEG

SEQ ID NO: 255978 - protein, 12 aa, Mycobacterium
EGRDPTNPDNKG

SEQ ID NO: 255979 - protein, 11 aa, Mycobacterium
EGREDPAGADE

SEQ ID NO: 255980 - protein, 5 aa, Mycobacterium
EGREL

SEQ ID NO: 255981 - protein, 19 aa, Mycobacterium
EGRHRTRTTGQQPTGLPGD

SEQ ID NO: 255982 - protein, 8 aa, Mycobacterium
EGRPASAY

SEQ ID NO: 255983 - protein, 5 aa, Mycobacterium
EGRPT

SEQ ID NO: 255984 - protein, 5 aa, Mycobacterium
EGRQE

SEQ ID NO: 255985 - protein, 15 aa, Mycobacterium
EGRQLADKMVAKVAG

SEQ ID NO: 255986 - protein, 7 aa, Mycobacterium
EGRRAKL

SEQ ID NO: 255987 - protein, 5 aa, Mycobacterium
EGRRD

SEQ ID NO: 255988 - protein, 7 aa, Mycobacterium
EGRSFTG

SEQ ID NO: 255989 - protein, 5 aa, Mycobacterium
EGRSL

SEQ ID NO: 255990 - protein, 25 aa, Mycobacterium
EGRTPQEDAVREAQRRLTERAGEAR

SEQ ID NO: 255991 - protein, 4 aa, Mycobacterium
EGRV

SEQ ID NO: 255992 - protein, 14 aa, Mycobacterium
EGRYPLGSTTTAHI

SEQ ID NO: 255993 - protein, 7 aa, Mycobacterium
EGSAGRV

SEQ ID NO: 255994 - protein, 6 aa, Mycobacterium
EGSAIH

SEQ ID NO: 255995 - protein, 10 aa, Mycobacterium
EGSAQLGPAA

SEQ ID NO: 255996 - protein, 10 aa, Mycobacterium
EGSASARDVN

SEQ ID NO: 255997 - protein, 8 aa, Mycobacterium
EGSDGTWE

SEQ ID NO: 255998 - protein, 6 aa, Mycobacterium
EGSGFS

SEQ ID NO: 255999 - protein, 15 aa, Mycobacterium
EGSKNTLVPQSGTSF

SEQ ID NO: 256000 - protein, 5 aa, Mycobacterium
EGSPS

SEQ ID NO: 256001 - protein, 9 aa, Mycobacterium
EGSQERSPI

SEQ ID NO: 256002 - protein, 11 aa, Mycobacterium
EGSQRAPGSEL

SEQ ID NO: 256003 - protein, 5 aa, Mycobacterium
EGSRA

SEQ ID NO: 256004 - protein, 9 aa, Mycobacterium
EGSRAATDA

SEQ ID NO: 256005 - protein, 6 aa, Mycobacterium
EGSRRE

SEQ ID NO: 256006 - protein, 5 aa, Mycobacterium
EGSRT

SEQ ID NO: 256007 - protein, 7 aa, Mycobacterium
EGSRVSS

SEQ ID NO: 256008 - protein, 7 aa, Mycobacterium
EGSSARV

SEQ ID NO: 256009 - protein, 11 aa, Mycobacterium
EGSTELNASLG

SEQ ID NO: 256010 - protein, 5 aa, Mycobacterium
EGSTF

SEQ ID NO: 256011 - protein, 5 aa, Mycobacterium
EGSTL

SEQ ID NO: 256012 - protein, 16 aa, Mycobacterium
EGSTPLGKTPIPPERT

SEQ ID NO: 256013 - protein, 14 aa, Mycobacterium
EGSTRRWEADPDAM

SEQ ID NO: 256014 - protein, 10 aa, Mycobacterium
EGSTRTFAPG

SEQ ID NO: 256015 - protein, 5 aa, Mycobacterium
EGSVR

SEQ ID NO: 256016 - protein, 14 aa, Mycobacterium
EGTAFRAPEGDYET

SEQ ID NO: 256017 - protein, 7 aa, Mycobacterium
EGTDASR

SEQ ID NO: 256018 - protein, 11 aa, Mycobacterium
EGTDPTAWADK

SEQ ID NO: 256019 - protein, 9 aa, Mycobacterium
EGTEGGGAA

SEQ ID NO: 256020 - protein, 11 aa, Mycobacterium
EGTGAPTDQFN

SEQ ID NO: 256021 - protein, 15 aa, Mycobacterium
EGTGKPHHTARPDGL

SEQ ID NO: 256022 - protein, 4 aa, Mycobacterium
EGTL

SEQ ID NO: 256023 - protein, 9 aa, Mycobacterium
EGTLGDDAH

SEQ ID NO: 256024 - protein, 21 aa, Mycobacterium
EGTLQATEELPAKSDQCAAAG

SEQ ID NO: 256025 - protein, 4 aa, Mycobacterium
EGTP

SEQ ID NO: 256026 - protein, 5 aa, Mycobacterium
EGTPL

SEQ ID NO: 256027 - protein, 48 aa, Mycobacterium
EGTPLPPGSPGPRGTPPGPPSSPVPLGQPPIPPGSSVPPPANLQPPVP

SEQ ID NO: 256028 - protein, 29 aa, Mycobacterium
EGTPMPAPAPGAAPASVPGPVPAAGGPPV

SEQ ID NO: 256029 - protein, 16 aa, Mycobacterium
EGTQEFSREQAENESR

SEQ ID NO: 256030 - protein, 14 aa, Mycobacterium
EGTRLDTTAVGPFK

SEQ ID NO: 256031 - protein, 15 aa, Mycobacterium
EGTRVDTTEVGPFKK

SEQ ID NO: 256032 - protein, 8 aa, Mycobacterium
EGTSEAAG

SEQ ID NO: 256033 - protein, 8 aa, Mycobacterium
EGTSTRNV

SEQ ID NO: 256034 - protein, 4 aa, Mycobacterium
EGTT

SEQ ID NO: 256035 - protein, 16 aa, Mycobacterium
EGTTTKQDSGIPGGRG

SEQ ID NO: 256036 - protein, 5 aa, Mycobacterium
EGTVG

SEQ ID NO: 256037 - protein, 17 aa, Mycobacterium
EGVAGPEAANNASAAGT

SEQ ID NO: 256038 - protein, 4 aa, Mycobacterium
EGVD

SEQ ID NO: 256039 - protein, 10 aa, Mycobacterium
EGVDPSNPAM

SEQ ID NO: 256040 - protein, 16 aa, Mycobacterium
EGVDPTPRPPTPEPVA

SEQ ID NO: 256041 - protein, 11 aa, Mycobacterium
EGVEDRATAQR

SEQ ID NO: 256042 - protein, 7 aa, Mycobacterium
EGVHDEQ

SEQ ID NO: 256043 - protein, 4 aa, Mycobacterium
EGVP

SEQ ID NO: 256044 - protein, 7 aa, Mycobacterium
EGVPAHD

SEQ ID NO: 256045 - protein, 14 aa, Mycobacterium
EGVPDAAAGGASTC

SEQ ID NO: 256046 - protein, 6 aa, Mycobacterium
EGVPGV

SEQ ID NO: 256047 - protein, 9 aa, Mycobacterium
EGVSARDGT

SEQ ID NO: 256048 - protein, 9 aa, Mycobacterium
EGVTPEAHA

SEQ ID NO: 256049 - protein, 5 aa, Mycobacterium
EGVTS

SEQ ID NO: 256050 - protein, 19 aa, Mycobacterium
EGVVATPSAFTDAAAGNQA

SEQ ID NO: 256051 - protein, 14 aa, Mycobacterium
EGWEKNPSPTFRSG

SEQ ID NO: 256052 - protein, 25 aa, Mycobacterium
EGWQSNSGSRKGIEAGRTDPVSGQR

SEQ ID NO: 256053 - protein, 18 aa, Mycobacterium
EGYAPGACQPLEPSKGTL

SEQ ID NO: 256054 - protein, 4 aa, Mycobacterium
EGYD

SEQ ID NO: 256055 - protein, 18 aa, Mycobacterium
EGYGTDVAKRGGRLSAGQ

SEQ ID NO: 256056 - protein, 6 aa, Mycobacterium
EHAEAN

SEQ ID NO: 256057 - protein, 4 aa, Mycobacterium
EHAG

SEQ ID NO: 256058 - protein, 10 aa, Mycobacterium
EHAGGIPSTV

SEQ ID NO: 256059 - protein, 7 aa, Mycobacterium
EHAPDVA

SEQ ID NO: 256060 - protein, 4 aa, Mycobacterium
EHAS

SEQ ID NO: 256061 - protein, 7 aa, Mycobacterium
EHATDDA

SEQ ID NO: 256062 - protein, 11 aa, Mycobacterium
EHDDDWGGGRR

SEQ ID NO: 256063 - protein, 8 aa, Mycobacterium
EHDGPEPV

SEQ ID NO: 256064 - protein, 11 aa, Mycobacterium
EHDRKQWSRNV

SEQ ID NO: 256065 - protein, 7 aa, Mycobacterium
EHDRPAA

SEQ ID NO: 256066 - protein, 4 aa, Mycobacterium
EHDS

SEQ ID NO: 256067 - protein, 6 aa, Mycobacterium
EHEAAA

SEQ ID NO: 256068 - protein, 12 aa, Mycobacterium
EHEGAQESSMEL

SEQ ID NO: 256069 - protein, 20 aa, Mycobacterium
EHEQDRDVEAGYDGAGGRWP

SEQ ID NO: 256070 - protein, 25 aa, Mycobacterium
EHESARDTRISDTAAGGYAQADSGL

SEQ ID NO: 256071 - protein, 14 aa, Mycobacterium
EHFSETGTELTPPR

SEQ ID NO: 256072 - protein, 8 aa, Mycobacterium
EHGDGTRG

SEQ ID NO: 256073 - protein, 7 aa, Mycobacterium
EHGDTRV

SEQ ID NO: 256074 - protein, 6 aa, Mycobacterium
EHGPQH

SEQ ID NO: 256075 - protein, 6 aa, Mycobacterium
EHGRLS

SEQ ID NO: 256076 - protein, 6 aa, Mycobacterium
EHGSGT

SEQ ID NO: 256077 - protein, 12 aa, Mycobacterium
EHGSPVDTEASQ

SEQ ID NO: 256078 - protein, 11 aa, Mycobacterium
EHHEASGKELA

SEQ ID NO: 256079 - protein, 7 aa, Mycobacterium
EHHGTPV

SEQ ID NO: 256080 - protein, 4 aa, Mycobacterium
EHHP

SEQ ID NO: 256081 - protein, 15 aa, Mycobacterium
EHHSKTAEAATQADA

SEQ ID NO: 256082 - protein, 4 aa, Mycobacterium
EHIP

SEQ ID NO: 256083 - protein, 5 aa, Mycobacterium
EHKTP

SEQ ID NO: 256084 - protein, 30 aa, Mycobacterium
EHLPPSDVHPTNGSGAPGRYDSDDPTMKAN

SEQ ID NO: 256085 - protein, 9 aa, Mycobacterium
EHLSTDTTT

SEQ ID NO: 256086 - protein, 4 aa, Mycobacterium
EHNA

SEQ ID NO: 256087 - protein, 7 aa, Mycobacterium
EHNPNDA

SEQ ID NO: 256088 - protein, 4 aa, Mycobacterium
EHPA

SEQ ID NO: 256089 - protein, 8 aa, Mycobacterium
EHPADRTA

SEQ ID NO: 256090 - protein, 13 aa, Mycobacterium
EHPDASGAALAAS

SEQ ID NO: 256091 - protein, 11 aa, Mycobacterium
EHPDASGGALA

SEQ ID NO: 256092 - protein, 15 aa, Mycobacterium
EHPDASGGALAASRE

SEQ ID NO: 256093 - protein, 8 aa, Mycobacterium
EHPDGAGA

SEQ ID NO: 256094 - protein, 10 aa, Mycobacterium
EHPDGAGAAL

SEQ ID NO: 256095 - protein, 10 aa, Mycobacterium
EHPDSPGGAL

SEQ ID NO: 256096 - protein, 17 aa, Mycobacterium
EHPGETYPAPPAELIAD

SEQ ID NO: 256097 - protein, 9 aa, Mycobacterium
EHPLTSSPL

SEQ ID NO: 256098 - protein, 6 aa, Mycobacterium
EHPQNH

SEQ ID NO: 256099 - protein, 6 aa, Mycobacterium
EHPQPG

SEQ ID NO: 256100 - protein, 5 aa, Mycobacterium
EHPSA

SEQ ID NO: 256101 - protein, 5 aa, Mycobacterium
EHPSP

SEQ ID NO: 256102 - protein, 6 aa, Mycobacterium
EHQAGA

SEQ ID NO: 256103 - protein, 14 aa, Mycobacterium
EHQARRGATSTEPF

SEQ ID NO: 256104 - protein, 4 aa, Mycobacterium
EHQD

SEQ ID NO: 256105 - protein, 13 aa, Mycobacterium
EHQGHSAAVPARA

SEQ ID NO: 256106 - protein, 4 aa, Mycobacterium
EHRG

SEQ ID NO: 256107 - protein, 10 aa, Mycobacterium
EHRGASSGFG

SEQ ID NO: 256108 - protein, 6 aa, Mycobacterium
EHRGTR

SEQ ID NO: 256109 - protein, 39 aa, Mycobacterium
EHRPGAVGHREPGEHDAAHQQARDQKDHESGDEHGGKHR

SEQ ID NO: 256110 - protein, 5 aa, Mycobacterium
EHRPR

SEQ ID NO: 256111 - protein, 9 aa, Mycobacterium
EHRQPSRRT

SEQ ID NO: 256112 - protein, 8 aa, Mycobacterium
EHRWRGQT

SEQ ID NO: 256113 - protein, 15 aa, Mycobacterium
EHSAPMAPEDAPSLT

SEQ ID NO: 256114 - protein, 12 aa, Mycobacterium
EHSAPMTPLDAP

SEQ ID NO: 256115 - protein, 7 aa, Mycobacterium
EHSRNQL

SEQ ID NO: 256116 - protein, 6 aa, Mycobacterium
EHSTAD

SEQ ID NO: 256117 - protein, 6 aa, Mycobacterium
EHSTED

SEQ ID NO: 256118 - protein, 4 aa, Mycobacterium
EHTG

SEQ ID NO: 256119 - protein, 5 aa, Mycobacterium
EHTGD

SEQ ID NO: 256120 - protein, 5 aa, Mycobacterium
EHTGQ

SEQ ID NO: 256121 - protein, 14 aa, Mycobacterium
EHTKQLGDGAEQIP

SEQ ID NO: 256122 - protein, 8 aa, Mycobacterium
EHTRNTAR

SEQ ID NO: 256123 - protein, 11 aa, Mycobacterium
EIAGSVRESET

SEQ ID NO: 256124 - protein, 5 aa, Mycobacterium
EIAPN

SEQ ID NO: 256125 - protein, 7 aa, Mycobacterium
EIAPPTR

SEQ ID NO: 256126 - protein, 5 aa, Mycobacterium
EIARG

SEQ ID NO: 256127 - protein, 5 aa, Mycobacterium
EIAST

SEQ ID NO: 256128 - protein, 14 aa, Mycobacterium
EIATTDADRAQVTP

SEQ ID NO: 256129 - protein, 6 aa, Mycobacterium
EIDPGA

SEQ ID NO: 256130 - protein, 9 aa, Mycobacterium
EIDREQQRR

SEQ ID NO: 256131 - protein, 9 aa, Mycobacterium
EIEAQAADE

SEQ ID NO: 256132 - protein, 8 aa, Mycobacterium
EIEKRSDI

SEQ ID NO: 256133 - protein, 11 aa, Mycobacterium
EIEPQEPEAEA

SEQ ID NO: 256134 - protein, 13 aa, Mycobacterium
EIEPRGSETLKPR

SEQ ID NO: 256135 - protein, 10 aa, Mycobacterium
EIERNKASSY

SEQ ID NO: 256136 - protein, 4 aa, Mycobacterium
EIGA

SEQ ID NO: 256137 - protein, 6 aa, Mycobacterium
EIGAPQ

SEQ ID NO: 256138 - protein, 6 aa, Mycobacterium
EIGERS

SEQ ID NO: 256139 - protein, 10 aa, Mycobacterium
EIGTNGGGIL

SEQ ID NO: 256140 - protein, 8 aa, Mycobacterium
EIHGGTAS

SEQ ID NO: 256141 - protein, 8 aa, Mycobacterium
EINSGAAG

SEQ ID NO: 256142 - protein, 5 aa, Mycobacterium
EIPAA

SEQ ID NO: 256143 - protein, 5 aa, Mycobacterium
EIPAG

SEQ ID NO: 256144 - protein, 7 aa, Mycobacterium
EIPASSA

SEQ ID NO: 256145 - protein, 5 aa, Mycobacterium
EIPER

SEQ ID NO: 256146 - protein, 6 aa, Mycobacterium
EIPGAG

SEQ ID NO: 256147 - protein, 19 aa, Mycobacterium
EIPHPSATPEPGSAAPAGA

SEQ ID NO: 256148 - protein, 9 aa, Mycobacterium
EIPPSPNDQ

SEQ ID NO: 256149 - protein, 5 aa, Mycobacterium
EIPQE

SEQ ID NO: 256150 - protein, 10 aa, Mycobacterium
EIPRSPNDND

SEQ ID NO: 256151 - protein, 10 aa, Mycobacterium
EIPRSPNDRD

SEQ ID NO: 256152 - protein, 10 aa, Mycobacterium
EIPRTTSGKL

SEQ ID NO: 256153 - protein, 15 aa, Mycobacterium
EIPTENGQQRFPRDA

SEQ ID NO: 256154 - protein, 7 aa, Mycobacterium
EIREGRS

SEQ ID NO: 256155 - protein, 12 aa, Mycobacterium
EIREGRSYRSAV

SEQ ID NO: 256156 - protein, 9 aa, Mycobacterium
EIRGGASGV

SEQ ID NO: 256157 - protein, 9 aa, Mycobacterium
EIRGRAQGL

SEQ ID NO: 256158 - protein, 7 aa, Mycobacterium
EIRGRSS

SEQ ID NO: 256159 - protein, 9 aa, Mycobacterium
EIRPESRDA

SEQ ID NO: 256160 - protein, 10 aa, Mycobacterium
EIRPESRDAV

SEQ ID NO: 256161 - protein, 9 aa, Mycobacterium
EIRPESREA

SEQ ID NO: 256162 - protein, 11 aa, Mycobacterium
EIRSEARPTTA

SEQ ID NO: 256163 - protein, 6 aa, Mycobacterium
EIRSRK

SEQ ID NO: 256164 - protein, 5 aa, Mycobacterium
EISDR

SEQ ID NO: 256165 - protein, 6 aa, Mycobacterium
EISEEY

SEQ ID NO: 256166 - protein, 10 aa, Mycobacterium
EISGGSTGRK

SEQ ID NO: 256167 - protein, 10 aa, Mycobacterium
EISRDGKPAA

SEQ ID NO: 256168 - protein, 10 aa, Mycobacterium
EISRQTGMPL

SEQ ID NO: 256169 - protein, 7 aa, Mycobacterium
EITSGKD

SEQ ID NO: 256170 - protein, 31 aa, Mycobacterium
EITTTKPPPPPPPPPPPPSTEIPTATETQTV

SEQ ID NO: 256171 - protein, 4 aa, Mycobacterium
EITV

SEQ ID NO: 256172 - protein, 8 aa, Mycobacterium
EKADGVTV

SEQ ID NO: 256173 - protein, 4 aa, Mycobacterium
EKAP

SEQ ID NO: 256174 - protein, 6 aa, Mycobacterium
EKARKS

SEQ ID NO: 256175 - protein, 13 aa, Mycobacterium
EKASAPMGEPAAS

SEQ ID NO: 256176 - protein, 14 aa, Mycobacterium
EKDGDRWLISKFDP

SEQ ID NO: 256177 - protein, 8 aa, Mycobacterium
EKDGGERR

SEQ ID NO: 256178 - protein, 6 aa, Mycobacterium
EKDPKF

SEQ ID NO: 256179 - protein, 17 aa, Mycobacterium
EKDSSGKPRVQYDGSPA

SEQ ID NO: 256180 - protein, 10 aa, Mycobacterium
EKEEEAKKAE

SEQ ID NO: 256181 - protein, 9 aa, Mycobacterium
EKEEEQKKL

SEQ ID NO: 256182 - protein, 10 aa, Mycobacterium
EKEGAQGPFS

SEQ ID NO: 256183 - protein, 8 aa, Mycobacterium
EKEPQGAF

SEQ ID NO: 256184 - protein, 8 aa, Mycobacterium
EKEQPPAV

SEQ ID NO: 256185 - protein, 6 aa, Mycobacterium
EKESQA

SEQ ID NO: 256186 - protein, 4 aa, Mycobacterium
EKEV

SEQ ID NO: 256187 - protein, 13 aa, Mycobacterium
EKFPAPNGETRKP

SEQ ID NO: 256188 - protein, 12 aa, Mycobacterium
EKGDATSSEAAR

SEQ ID NO: 256189 - protein, 9 aa, Mycobacterium
EKGGPAANE

SEQ ID NO: 256190 - protein, 12 aa, Mycobacterium
EKGGTEEQATKA

SEQ ID NO: 256191 - protein, 12 aa, Mycobacterium
EKGLGPADEAAY

SEQ ID NO: 256192 - protein, 20 aa, Mycobacterium
EKGTDVPGHKGEPGQPTDAE

SEQ ID NO: 256193 - protein, 6 aa, Mycobacterium
EKHPTA

SEQ ID NO: 256194 - protein, 19 aa, Mycobacterium
EKHRDQGEFTPKDQPPDPV

SEQ ID NO: 256195 - protein, 8 aa, Mycobacterium
EKIATDGT

SEQ ID NO: 256196 - protein, 16 aa, Mycobacterium
EKIATDGVVTDGASAV

SEQ ID NO: 256197 - protein, 5 aa, Mycobacterium
EKIPV

SEQ ID NO: 256198 - protein, 16 aa, Mycobacterium
EKIPVDGEITDGRAAV

SEQ ID NO: 256199 - protein, 12 aa, Mycobacterium
EKISDQPETRRR

SEQ ID NO: 256200 - protein, 8 aa, Mycobacterium
EKKGTWGP

SEQ ID NO: 256201 - protein, 10 aa, Mycobacterium
EKKPKDAETK

SEQ ID NO: 256202 - protein, 8 aa, Mycobacterium
EKKRTARL

SEQ ID NO: 256203 - protein, 7 aa, Mycobacterium
EKKSLAD

SEQ ID NO: 256204 - protein, 4 aa, Mycobacterium
EKKT

SEQ ID NO: 256205 - protein, 5 aa, Mycobacterium
EKKTY

SEQ ID NO: 256206 - protein, 6 aa, Mycobacterium
EKLATA

SEQ ID NO: 256207 - protein, 11 aa, Mycobacterium
EKLGKKARARL

SEQ ID NO: 256208 - protein, 4 aa, Mycobacterium
EKLP

SEQ ID NO: 256209 - protein, 12 aa, Mycobacterium
EKLQSKNDQTLN

SEQ ID NO: 256210 - protein, 18 aa, Mycobacterium
EKNGDEEPTTQPDKEKAA

SEQ ID NO: 256211 - protein, 11 aa, Mycobacterium
EKNKAKEHETR

SEQ ID NO: 256212 - protein, 12 aa, Mycobacterium
EKNPDAGAGKAI

SEQ ID NO: 256213 - protein, 7 aa, Mycobacterium
EKNRPAP

SEQ ID NO: 256214 - protein, 8 aa, Mycobacterium
EKPEDPES

SEQ ID NO: 256215 - protein, 6 aa, Mycobacterium
EKPEDV

SEQ ID NO: 256216 - protein, 4 aa, Mycobacterium
EKPG

SEQ ID NO: 256217 - protein, 13 aa, Mycobacterium
EKPGISDPAKPVR

SEQ ID NO: 256218 - protein, 7 aa, Mycobacterium
EKPGPAA

SEQ ID NO: 256219 - protein, 5 aa, Mycobacterium
EKPGV

SEQ ID NO: 256220 - protein, 10 aa, Mycobacterium
EKPKQRRAAR

SEQ ID NO: 256221 - protein, 7 aa, Mycobacterium
EKPLAAD

SEQ ID NO: 256222 - protein, 7 aa, Mycobacterium
EKPLGAQ

SEQ ID NO: 256223 - protein, 27 aa, Mycobacterium
EKPQPMSDEGDHQPPAKSTKAVTRPGD

SEQ ID NO: 256224 - protein, 28 aa, Mycobacterium
EKPSPLESTPEGGLGEKARGEKHEQKHA

SEQ ID NO: 256225 - protein, 7 aa, Mycobacterium
EKPTITN

SEQ ID NO: 256226 - protein, 12 aa, Mycobacterium
EKPWGTPQIQRG

SEQ ID NO: 256227 - protein, 13 aa, Mycobacterium
EKQQVELGGEERR

SEQ ID NO: 256228 - protein, 6 aa, Mycobacterium
EKQTKT

SEQ ID NO: 256229 - protein, 5 aa, Mycobacterium
EKRAP

SEQ ID NO: 256230 - protein, 20 aa, Mycobacterium
EKRASYSDSNLDSKPFNPKQ

SEQ ID NO: 256231 - protein, 23 aa, Mycobacterium
EKRDEAKTSVTSVKKSGAKNDGL

SEQ ID NO: 256232 - protein, 13 aa, Mycobacterium
EKRDSSGGVSDDE

SEQ ID NO: 256233 - protein, 6 aa, Mycobacterium
EKREQL

SEQ ID NO: 256234 - protein, 20 aa, Mycobacterium
EKRESYSDSNLDNKPFNPKE

SEQ ID NO: 256235 - protein, 7 aa, Mycobacterium
EKRGRGG

SEQ ID NO: 256236 - protein, 18 aa, Mycobacterium
EKRQAARSELGKRTVGKK

SEQ ID NO: 256237 - protein, 7 aa, Mycobacterium
EKRYRSM

SEQ ID NO: 256238 - protein, 8 aa, Mycobacterium
EKSLAGKA

SEQ ID NO: 256239 - protein, 10 aa, Mycobacterium
EKSPAQTLPG

SEQ ID NO: 256240 - protein, 13 aa, Mycobacterium
EKSPSFEGRPDRV

SEQ ID NO: 256241 - protein, 9 aa, Mycobacterium
EKSPSGVSS

SEQ ID NO: 256242 - protein, 6 aa, Mycobacterium
EKSPSW

SEQ ID NO: 256243 - protein, 13 aa, Mycobacterium
EKSPTFEGRPDWD

SEQ ID NO: 256244 - protein, 17 aa, Mycobacterium
EKSPTNIGPDFGKAGPF

SEQ ID NO: 256245 - protein, 5 aa, Mycobacterium
EKSVD

SEQ ID NO: 256246 - protein, 8 aa, Mycobacterium
EKSYYTTT

SEQ ID NO: 256247 - protein, 16 aa, Mycobacterium
EKTAQTATDEIHRDEN

SEQ ID NO: 256248 - protein, 7 aa, Mycobacterium
EKTGGFG

SEQ ID NO: 256249 - protein, 35 aa, Mycobacterium
EKTGYTATLPTPRAPAPSDASGDTPNADGIDDPEL

SEQ ID NO: 256250 - protein, 12 aa, Mycobacterium
EKTSDNAEDFNP

SEQ ID NO: 256251 - protein, 8 aa, Mycobacterium
EKTSTYKA

SEQ ID NO: 256252 - protein, 21 aa, Mycobacterium
EKYPEVGSERQDLRQYPGGSL

SEQ ID NO: 256253 - protein, 14 aa, Mycobacterium
EKYRSANDLPDGAK

SEQ ID NO: 256254 - protein, 8 aa, Mycobacterium
ELAASGRT

SEQ ID NO: 256255 - protein, 10 aa, Mycobacterium
ELADGGKRAR

SEQ ID NO: 256256 - protein, 10 aa, Mycobacterium
ELADGRDRDD

SEQ ID NO: 256257 - protein, 5 aa, Mycobacterium
ELAEE

SEQ ID NO: 256258 - protein, 10 aa, Mycobacterium
ELAEGRDRDE

SEQ ID NO: 256259 - protein, 10 aa, Mycobacterium
ELAEGSAPRQ

SEQ ID NO: 256260 - protein, 11 aa, Mycobacterium
ELAEGSDPDEA

SEQ ID NO: 256261 - protein, 10 aa, Mycobacterium
ELAEGSSREE

SEQ ID NO: 256262 - protein, 12 aa, Mycobacterium
ELAGANAAEREP

SEQ ID NO: 256263 - protein, 5 aa, Mycobacterium
ELAGD

SEQ ID NO: 256264 - protein, 6 aa, Mycobacterium
ELAGDA

SEQ ID NO: 256265 - protein, 9 aa, Mycobacterium
ELAGEQERA

SEQ ID NO: 256266 - protein, 5 aa, Mycobacterium
ELAGG

SEQ ID NO: 256267 - protein, 8 aa, Mycobacterium
ELAGSPDV

SEQ ID NO: 256268 - protein, 5 aa, Mycobacterium
ELAPK

SEQ ID NO: 256269 - protein, 4 aa, Mycobacterium
ELAQ

SEQ ID NO: 256270 - protein, 7 aa, Mycobacterium
ELAQPVT

SEQ ID NO: 256271 - protein, 10 aa, Mycobacterium
ELAQTTSTGP

SEQ ID NO: 256272 - protein, 16 aa, Mycobacterium
ELARAAAAGLSSSDPL

SEQ ID NO: 256273 - protein, 6 aa, Mycobacterium
ELARGQ

SEQ ID NO: 256274 - protein, 10 aa, Mycobacterium
ELARSGDRER

SEQ ID NO: 256275 - protein, 14 aa, Mycobacterium
ELASTTVTDTGANH

SEQ ID NO: 256276 - protein, 17 aa, Mycobacterium
ELATGPGVGTEWELTVP

SEQ ID NO: 256277 - protein, 11 aa, Mycobacterium
ELATPESGKAY

SEQ ID NO: 256278 - protein, 8 aa, Mycobacterium
ELDDTRRA

SEQ ID NO: 256279 - protein, 6 aa, Mycobacterium
ELDEAT

SEQ ID NO: 256280 - protein, 7 aa, Mycobacterium
ELDELPR

SEQ ID NO: 256281 - protein, 5 aa, Mycobacterium
ELDER

SEQ ID NO: 256282 - protein, 4 aa, Mycobacterium
ELDG

SEQ ID NO: 256283 - protein, 12 aa, Mycobacterium
ELDGANPAEREP

SEQ ID NO: 256284 - protein, 5 aa, Mycobacterium
ELDGR

SEQ ID NO: 256285 - protein, 8 aa, Mycobacterium
ELDGRERA

SEQ ID NO: 256286 - protein, 18 aa, Mycobacterium
ELDPDNAKPFMTSPSSSC

SEQ ID NO: 256287 - protein, 17 aa, Mycobacterium
ELDPRAAAIREELEGPA

SEQ ID NO: 256288 - protein, 8 aa, Mycobacterium
ELDPRADP

SEQ ID NO: 256289 - protein, 17 aa, Mycobacterium
ELDPRAEAIRTQLESEI

SEQ ID NO: 256290 - protein, 17 aa, Mycobacterium
ELDPRVANPNVEGRPRP

SEQ ID NO: 256291 - protein, 12 aa, Mycobacterium
ELEDDHTDLRDA

SEQ ID NO: 256292 - protein, 4 aa, Mycobacterium
ELEE

SEQ ID NO: 256293 - protein, 10 aa, Mycobacterium
ELEEQAAAHD

SEQ ID NO: 256294 - protein, 7 aa, Mycobacterium
ELEEQGR

SEQ ID NO: 256295 - protein, 10 aa, Mycobacterium
ELEEQKAKLA

SEQ ID NO: 256296 - protein, 13 aa, Mycobacterium
ELEETEPSRPPKR

SEQ ID NO: 256297 - protein, 9 aa, Mycobacterium
ELEPEPAHG

SEQ ID NO: 256298 - protein, 7 aa, Mycobacterium
ELEQQGR

SEQ ID NO: 256299 - protein, 8 aa, Mycobacterium
ELEREGGL

SEQ ID NO: 256300 - protein, 8 aa, Mycobacterium
ELERTGGL

SEQ ID NO: 256301 - protein, 4 aa, Mycobacterium
ELES

SEQ ID NO: 256302 - protein, 11 aa, Mycobacterium
ELGAAKANDAL

SEQ ID NO: 256303 - protein, 6 aa, Mycobacterium
ELGADT

SEQ ID NO: 256304 - protein, 6 aa, Mycobacterium
ELGAGR

SEQ ID NO: 256305 - protein, 9 aa, Mycobacterium
ELGATGGAA

SEQ ID NO: 256306 - protein, 9 aa, Mycobacterium
ELGDGAGER

SEQ ID NO: 256307 - protein, 9 aa, Mycobacterium
ELGEGRSHE

SEQ ID NO: 256308 - protein, 41 aa, Mycobacterium
ELGEPGIQPAESPAETGDGDETEKPASRSEDGDPSGASESL

SEQ ID NO: 256309 - protein, 15 aa, Mycobacterium
ELGEQADDDADARAV

SEQ ID NO: 256310 - protein, 4 aa, Mycobacterium
ELGG

SEQ ID NO: 256311 - protein, 15 aa, Mycobacterium
ELGGAGSEVSGDTGL

SEQ ID NO: 256312 - protein, 13 aa, Mycobacterium
ELGGGSSEASGDT

SEQ ID NO: 256313 - protein, 6 aa, Mycobacterium
ELGGIP

SEQ ID NO: 256314 - protein, 11 aa, Mycobacterium
ELGGPADSDLG

SEQ ID NO: 256315 - protein, 5 aa, Mycobacterium
ELGGT

SEQ ID NO: 256316 - protein, 5 aa, Mycobacterium
ELGHK

SEQ ID NO: 256317 - protein, 5 aa, Mycobacterium
ELGHR

SEQ ID NO: 256318 - protein, 24 aa, Mycobacterium
ELGLNGPSSSTSSSATNSAAAGRM

SEQ ID NO: 256319 - protein, 7 aa, Mycobacterium
ELGLPDE

SEQ ID NO: 256320 - protein, 13 aa, Mycobacterium
ELGRTDSHNDAID

SEQ ID NO: 256321 - protein, 11 aa, Mycobacterium
ELGRTENHRDA

SEQ ID NO: 256322 - protein, 12 aa, Mycobacterium
ELGSPQSTEAYT

SEQ ID NO: 256323 - protein, 8 aa, Mycobacterium
ELGTNGGG

SEQ ID NO: 256324 - protein, 10 aa, Mycobacterium
ELGTNGGGFY

SEQ ID NO: 256325 - protein, 8 aa, Mycobacterium
ELGTPKSY

SEQ ID NO: 256326 - protein, 16 aa, Mycobacterium
ELHGGKAALEESPLGG

SEQ ID NO: 256327 - protein, 25 aa, Mycobacterium
ELHGGTAALESSPLGGARLVLRLPG

SEQ ID NO: 256328 - protein, 26 aa, Mycobacterium
ELHGGTAELESSPLGGARLVLRLPGP

SEQ ID NO: 256329 - protein, 16 aa, Mycobacterium
ELHGGTASLEDSPFGG

SEQ ID NO: 256330 - protein, 26 aa, Mycobacterium
ELHGGTASLGSSPLGGARLLLRLPGP

SEQ ID NO: 256331 - protein, 26 aa, Mycobacterium
ELHGGTATLAESPLGGARLLLRLPGP

SEQ ID NO: 256332 - protein, 7 aa, Mycobacterium
ELKPSQQ

SEQ ID NO: 256333 - protein, 11 aa, Mycobacterium
ELMPGNPPFGP

SEQ ID NO: 256334 - protein, 12 aa, Mycobacterium
ELNAPDTPPARR

SEQ ID NO: 256335 - protein, 7 aa, Mycobacterium
ELNASGT

SEQ ID NO: 256336 - protein, 4 aa, Mycobacterium
ELNP

SEQ ID NO: 256337 - protein, 5 aa, Mycobacterium
ELNPD

SEQ ID NO: 256338 - protein, 12 aa, Mycobacterium
ELNSGKNRQEAI

SEQ ID NO: 256339 - protein, 5 aa, Mycobacterium
ELPAA

SEQ ID NO: 256340 - protein, 6 aa, Mycobacterium
ELPAGI

SEQ ID NO: 256341 - protein, 8 aa, Mycobacterium
ELPAGPHD

SEQ ID NO: 256342 - protein, 6 aa, Mycobacterium
ELPARD

SEQ ID NO: 256343 - protein, 9 aa, Mycobacterium
ELPASGGLY

SEQ ID NO: 256344 - protein, 4 aa, Mycobacterium
ELPD

SEQ ID NO: 256345 - protein, 8 aa, Mycobacterium
ELPDGRDG

SEQ ID NO: 256346 - protein, 14 aa, Mycobacterium
ELPDGSETPLGRGG

SEQ ID NO: 256347 - protein, 50 aa, Mycobacterium
ELPDLSGPAPRPVQRKPAPDRGADNSGAHPVAGAARSAAAEARESRESRF

SEQ ID NO: 256348 - protein, 56 aa, Mycobacterium
ELPDLSGPIPRAQRRSAPDRPVDAPATTTTASRAVTTESRESRVQVSPRRGRGPVR

SEQ ID NO: 256349 - protein, 11 aa, Mycobacterium
ELPEPAKETAS

SEQ ID NO: 256350 - protein, 4 aa, Mycobacterium
ELPG

SEQ ID NO: 256351 - protein, 5 aa, Mycobacterium
ELPGA

SEQ ID NO: 256352 - protein, 6 aa, Mycobacterium
ELPGCP

SEQ ID NO: 256353 - protein, 7 aa, Mycobacterium
ELPGGHG

SEQ ID NO: 256354 - protein, 14 aa, Mycobacterium
ELPGHGPDPSLTAT

SEQ ID NO: 256355 - protein, 7 aa, Mycobacterium
ELPGNPR

SEQ ID NO: 256356 - protein, 12 aa, Mycobacterium
ELPGPRRPGDDQ

SEQ ID NO: 256357 - protein, 13 aa, Mycobacterium
ELPGSPPENPQYT

SEQ ID NO: 256358 - protein, 6 aa, Mycobacterium
ELPKPN

SEQ ID NO: 256359 - protein, 5 aa, Mycobacterium
ELPKQ

SEQ ID NO: 256360 - protein, 4 aa, Mycobacterium
ELPR

SEQ ID NO: 256361 - protein, 6 aa, Mycobacterium
ELPRTA

SEQ ID NO: 256362 - protein, 5 aa, Mycobacterium
ELPSD

SEQ ID NO: 256363 - protein, 6 aa, Mycobacterium
ELPTDV

SEQ ID NO: 256364 - protein, 11 aa, Mycobacterium
ELQAQSSDEVA

SEQ ID NO: 256365 - protein, 10 aa, Mycobacterium
ELQDSDSPIA

SEQ ID NO: 256366 - protein, 5 aa, Mycobacterium
ELQEQ

SEQ ID NO: 256367 - protein, 6 aa, Mycobacterium
ELQGGI

SEQ ID NO: 256368 - protein, 23 aa, Mycobacterium
ELQGPGETGDGTPATADTAPVRY

SEQ ID NO: 256369 - protein, 13 aa, Mycobacterium
ELQPQENSGIYPD

SEQ ID NO: 256370 - protein, 6 aa, Mycobacterium
ELQRGQ

SEQ ID NO: 256371 - protein, 8 aa, Mycobacterium
ELQRTGGL

SEQ ID NO: 256372 - protein, 7 aa, Mycobacterium
ELQSAGK

SEQ ID NO: 256373 - protein, 11 aa, Mycobacterium
ELQSDPPAALD

SEQ ID NO: 256374 - protein, 10 aa, Mycobacterium
ELQSSPTAMD

SEQ ID NO: 256375 - protein, 6 aa, Mycobacterium
ELQTRG

SEQ ID NO: 256376 - protein, 7 aa, Mycobacterium
ELRDPKH

SEQ ID NO: 256377 - protein, 7 aa, Mycobacterium
ELRGEPG

SEQ ID NO: 256378 - protein, 9 aa, Mycobacterium
ELRNTPAEL

SEQ ID NO: 256379 - protein, 4 aa, Mycobacterium
ELRP

SEQ ID NO: 256380 - protein, 5 aa, Mycobacterium
ELRPD

SEQ ID NO: 256381 - protein, 5 aa, Mycobacterium
ELRPE

SEQ ID NO: 256382 - protein, 8 aa, Mycobacterium
ELRPEDKA

SEQ ID NO: 256383 - protein, 5 aa, Mycobacterium
ELRRD

SEQ ID NO: 256384 - protein, 9 aa, Mycobacterium
ELSDARDAA

SEQ ID NO: 256385 - protein, 7 aa, Mycobacterium
ELSGAGA

SEQ ID NO: 256386 - protein, 6 aa, Mycobacterium
ELSGGL

SEQ ID NO: 256387 - protein, 13 aa, Mycobacterium
ELSGKSTTGEQAL

SEQ ID NO: 256388 - protein, 5 aa, Mycobacterium
ELSGN

SEQ ID NO: 256389 - protein, 23 aa, Mycobacterium
ELSMPTPTDHDPESEAPPRRRLG

SEQ ID NO: 256390 - protein, 7 aa, Mycobacterium
ELSNEEY

SEQ ID NO: 256391 - protein, 7 aa, Mycobacterium
ELSNRGG

SEQ ID NO: 256392 - protein, 4 aa, Mycobacterium
ELSP

SEQ ID NO: 256393 - protein, 6 aa, Mycobacterium
ELSPDE

SEQ ID NO: 256394 - protein, 6 aa, Mycobacterium
ELSPEE

SEQ ID NO: 256395 - protein, 9 aa, Mycobacterium
ELSPQQART

SEQ ID NO: 256396 - protein, 7 aa, Mycobacterium
ELSPSPT

SEQ ID NO: 256397 - protein, 5 aa, Mycobacterium
ELSSR

SEQ ID NO: 256398 - protein, 8 aa, Mycobacterium
ELSSSDDI

SEQ ID NO: 256399 - protein, 22 aa, Mycobacterium
ELTAASEGTVQLTDGGAGQPRH

SEQ ID NO: 256400 - protein, 7 aa, Mycobacterium
ELTAQQA

SEQ ID NO: 256401 - protein, 5 aa, Mycobacterium
ELTDG

SEQ ID NO: 256402 - protein, 6 aa, Mycobacterium
ELTDPV

SEQ ID NO: 256403 - protein, 12 aa, Mycobacterium
ELTDPVEQRRRL

SEQ ID NO: 256404 - protein, 5 aa, Mycobacterium
ELTDQ

SEQ ID NO: 256405 - protein, 4 aa, Mycobacterium
ELTE

SEQ ID NO: 256406 - protein, 19 aa, Mycobacterium
ELTEEAAKANAIAKADELS

SEQ ID NO: 256407 - protein, 9 aa, Mycobacterium
ELTGAGVSN

SEQ ID NO: 256408 - protein, 16 aa, Mycobacterium
ELTGETPESDADAERD

SEQ ID NO: 256409 - protein, 20 aa, Mycobacterium
ELTGTNPAGRAALPRPNSTG

SEQ ID NO: 256410 - protein, 5 aa, Mycobacterium
ELTNE

SEQ ID NO: 256411 - protein, 6 aa, Mycobacterium
ELTPAQ

SEQ ID NO: 256412 - protein, 10 aa, Mycobacterium
ELTPDGQPWS

SEQ ID NO: 256413 - protein, 11 aa, Mycobacterium
ELTPEESDRAM

SEQ ID NO: 256414 - protein, 11 aa, Mycobacterium
ELTPQTPQMPD

SEQ ID NO: 256415 - protein, 16 aa, Mycobacterium
ELTSNTRDTDTEALNQ

SEQ ID NO: 256416 - protein, 9 aa, Mycobacterium
ELTSPEDAV

SEQ ID NO: 256417 - protein, 8 aa, Mycobacterium
ELTSTENK

SEQ ID NO: 256418 - protein, 7 aa, Mycobacterium
EMDSGEV

SEQ ID NO: 256419 - protein, 6 aa, Mycobacterium
EMDTGN

SEQ ID NO: 256420 - protein, 11 aa, Mycobacterium
EMEQRSGLGYE

SEQ ID NO: 256421 - protein, 14 aa, Mycobacterium
EMGADGAPQPLDRA

SEQ ID NO: 256422 - protein, 16 aa, Mycobacterium
EMGPAGSAGSTAALGG

SEQ ID NO: 256423 - protein, 4 aa, Mycobacterium
EMGT

SEQ ID NO: 256424 - protein, 13 aa, Mycobacterium
EMKHGSDAGFDGS

SEQ ID NO: 256425 - protein, 6 aa, Mycobacterium
EMLPGG

SEQ ID NO: 256426 - protein, 4 aa, Mycobacterium
EMNR

SEQ ID NO: 256427 - protein, 4 aa, Mycobacterium
EMPA

SEQ ID NO: 256428 - protein, 4 aa, Mycobacterium
EMPE

SEQ ID NO: 256429 - protein, 19 aa, Mycobacterium
EMPPPPDGAPGFGGEGGGL

SEQ ID NO: 256430 - protein, 20 aa, Mycobacterium
EMPPSPGNSPALRGSDGTAV

SEQ ID NO: 256431 - protein, 47 aa, Mycobacterium
EMQSENKPENSALGTQSDAPAANPTPVQSQRVDPPAPSEQGHSEARP

SEQ ID NO: 256432 - protein, 43 aa, Mycobacterium
EMQSETKAEPSAIETNTANPTPVQSQRIDPAAATGQDQTEARP

SEQ ID NO: 256433 - protein, 43 aa, Mycobacterium
EMQSETKNQPPALDTNPASPTPVQSQRVEPPASTEPGHTEARP

SEQ ID NO: 256434 - protein, 8 aa, Mycobacterium
EMSDTTHS

SEQ ID NO: 256435 - protein, 9 aa, Mycobacterium
EMSENANAM

SEQ ID NO: 256436 - protein, 10 aa, Mycobacterium
EMSENSTAMG

SEQ ID NO: 256437 - protein, 10 aa, Mycobacterium
EMSKNSTAMG

SEQ ID NO: 256438 - protein, 8 aa, Mycobacterium
EMSPETGE

SEQ ID NO: 256439 - protein, 4 aa, Mycobacterium
EMTE

SEQ ID NO: 256440 - protein, 15 aa, Mycobacterium
ENAAEPLKNKYNDAE

SEQ ID NO: 256441 - protein, 6 aa, Mycobacterium
ENAARA

SEQ ID NO: 256442 - protein, 8 aa, Mycobacterium
ENAASPWR

SEQ ID NO: 256443 - protein, 8 aa, Mycobacterium
ENAATAWR

SEQ ID NO: 256444 - protein, 10 aa, Mycobacterium
ENAATGARAL

SEQ ID NO: 256445 - protein, 7 aa, Mycobacterium
ENADGIT

SEQ ID NO: 256446 - protein, 8 aa, Mycobacterium
ENADRSTE

SEQ ID NO: 256447 - protein, 21 aa, Mycobacterium
ENAGRPLPTGHADDAQRATMT

SEQ ID NO: 256448 - protein, 9 aa, Mycobacterium
ENARHGGAR

SEQ ID NO: 256449 - protein, 7 aa, Mycobacterium
ENARQAG

SEQ ID NO: 256450 - protein, 7 aa, Mycobacterium
ENASEHP

SEQ ID NO: 256451 - protein, 8 aa, Mycobacterium
ENASEHPI

SEQ ID NO: 256452 - protein, 4 aa, Mycobacterium
ENAT

SEQ ID NO: 256453 - protein, 6 aa, Mycobacterium
ENDDLR

SEQ ID NO: 256454 - protein, 6 aa, Mycobacterium
ENDGGT

SEQ ID NO: 256455 - protein, 4 aa, Mycobacterium
ENED

SEQ ID NO: 256456 - protein, 5 aa, Mycobacterium
ENEEP

SEQ ID NO: 256457 - protein, 13 aa, Mycobacterium
ENEHPLKESSDLR

SEQ ID NO: 256458 - protein, 17 aa, Mycobacterium
ENERAELEKQRQRAELE

SEQ ID NO: 256459 - protein, 8 aa, Mycobacterium
ENESTTRR

SEQ ID NO: 256460 - protein, 8 aa, Mycobacterium
ENEYTPNI

SEQ ID NO: 256461 - protein, 19 aa, Mycobacterium
ENGAQQDRFPGGTQQIAEA

SEQ ID NO: 256462 - protein, 15 aa, Mycobacterium
ENGAQQELIPGGTQQ

SEQ ID NO: 256463 - protein, 7 aa, Mycobacterium
ENGAVSN

SEQ ID NO: 256464 - protein, 14 aa, Mycobacterium
ENGDDSAPSDLAQR

SEQ ID NO: 256465 - protein, 6 aa, Mycobacterium
ENGGEP

SEQ ID NO: 256466 - protein, 7 aa, Mycobacterium
ENGGRAR

SEQ ID NO: 256467 - protein, 6 aa, Mycobacterium
ENGGSY

SEQ ID NO: 256468 - protein, 10 aa, Mycobacterium
ENGIGARAGG

SEQ ID NO: 256469 - protein, 10 aa, Mycobacterium
ENGKELPQGE

SEQ ID NO: 256470 - protein, 9 aa, Mycobacterium
ENGLSPADL

SEQ ID NO: 256471 - protein, 9 aa, Mycobacterium
ENGLTNPDE

SEQ ID NO: 256472 - protein, 12 aa, Mycobacterium
ENGLTPADEETY

SEQ ID NO: 256473 - protein, 4 aa, Mycobacterium
ENGP

SEQ ID NO: 256474 - protein, 10 aa, Mycobacterium
ENGPAGKAGM

SEQ ID NO: 256475 - protein, 10 aa, Mycobacterium
ENGPPKTRLG

SEQ ID NO: 256476 - protein, 4 aa, Mycobacterium
ENGR

SEQ ID NO: 256477 - protein, 6 aa, Mycobacterium
ENGRPT

SEQ ID NO: 256478 - protein, 4 aa, Mycobacterium
ENGT

SEQ ID NO: 256479 - protein, 12 aa, Mycobacterium
ENGTADDRLPGQ

SEQ ID NO: 256480 - protein, 8 aa, Mycobacterium
ENHPQAER

SEQ ID NO: 256481 - protein, 7 aa, Mycobacterium
ENIEGRS

SEQ ID NO: 256482 - protein, 26 aa, Mycobacterium
ENIGDAHGHGHGHAGAEAIGGSASGK

SEQ ID NO: 256483 - protein, 8 aa, Mycobacterium
ENISPKEV

SEQ ID NO: 256484 - protein, 12 aa, Mycobacterium
ENKGNPWGQNAK

SEQ ID NO: 256485 - protein, 16 aa, Mycobacterium
ENKGNPWGQNASDRTN

SEQ ID NO: 256486 - protein, 5 aa, Mycobacterium
ENLDR

SEQ ID NO: 256487 - protein, 8 aa, Mycobacterium
ENLNTDDL

SEQ ID NO: 256488 - protein, 8 aa, Mycobacterium
ENLTTGQT

SEQ ID NO: 256489 - protein, 11 aa, Mycobacterium
ENMDGLPDRAA

SEQ ID NO: 256490 - protein, 4 aa, Mycobacterium
ENNG

SEQ ID NO: 256491 - protein, 6 aa, Mycobacterium
ENNKLT

SEQ ID NO: 256492 - protein, 21 aa, Mycobacterium
ENNPLAGWDGAGTVTSRGRGA

SEQ ID NO: 256493 - protein, 8 aa, Mycobacterium
ENNPLPGW

SEQ ID NO: 256494 - protein, 7 aa, Mycobacterium
ENNTGNM

SEQ ID NO: 256495 - protein, 7 aa, Mycobacterium
ENPAGKI

SEQ ID NO: 256496 - protein, 5 aa, Mycobacterium
ENPAL

SEQ ID NO: 256497 - protein, 5 aa, Mycobacterium
ENPLE

SEQ ID NO: 256498 - protein, 4 aa, Mycobacterium
ENPN

SEQ ID NO: 256499 - protein, 7 aa, Mycobacterium
ENPQENR

SEQ ID NO: 256500 - protein, 7 aa, Mycobacterium
ENPQYPA

SEQ ID NO: 256501 - protein, 6 aa, Mycobacterium
ENPSGT

SEQ ID NO: 256502 - protein, 7 aa, Mycobacterium
ENPSGTV

SEQ ID NO: 256503 - protein, 9 aa, Mycobacterium
ENPSLDQPG

SEQ ID NO: 256504 - protein, 5 aa, Mycobacterium
ENQPL

SEQ ID NO: 256505 - protein, 8 aa, Mycobacterium
ENQPSTEL

SEQ ID NO: 256506 - protein, 6 aa, Mycobacterium
ENQSGV

SEQ ID NO: 256507 - protein, 6 aa, Mycobacterium
ENQTAM

SEQ ID NO: 256508 - protein, 21 aa, Mycobacterium
ENRCPPTQDAGQPVSASLPGD

SEQ ID NO: 256509 - protein, 8 aa, Mycobacterium
ENRNGAPV

SEQ ID NO: 256510 - protein, 5 aa, Mycobacterium
ENRQE

SEQ ID NO: 256511 - protein, 6 aa, Mycobacterium
ENRQSF

SEQ ID NO: 256512 - protein, 8 aa, Mycobacterium
ENSAPPSV

SEQ ID NO: 256513 - protein, 7 aa, Mycobacterium
ENSGPVL

SEQ ID NO: 256514 - protein, 4 aa, Mycobacterium
ENSN

SEQ ID NO: 256515 - protein, 31 aa, Mycobacterium
ENSNGSTGKHVSGPGTGPSPDTATYTSGDRT

SEQ ID NO: 256516 - protein, 6 aa, Mycobacterium
ENSPSW

SEQ ID NO: 256517 - protein, 7 aa, Mycobacterium
ENSRADQ

SEQ ID NO: 256518 - protein, 7 aa, Mycobacterium
ENSTADQ

SEQ ID NO: 256519 - protein, 16 aa, Mycobacterium
ENTATARAAIASTGPE

SEQ ID NO: 256520 - protein, 14 aa, Mycobacterium
ENTGAGSDVDYGEH

SEQ ID NO: 256521 - protein, 6 aa, Mycobacterium
ENTHGF

SEQ ID NO: 256522 - protein, 24 aa, Mycobacterium
ENTPSSSPAQTHHGLSGPPGMRMA

SEQ ID NO: 256523 - protein, 10 aa, Mycobacterium
ENTRGNGGGL

SEQ ID NO: 256524 - protein, 5 aa, Mycobacterium
ENTSS

SEQ ID NO: 256525 - protein, 9 aa, Mycobacterium
ENTSTAAVG

SEQ ID NO: 256526 - protein, 11 aa, Mycobacterium
ENVAADNGRRL

SEQ ID NO: 256527 - protein, 7 aa, Mycobacterium
ENVAAGA

SEQ ID NO: 256528 - protein, 7 aa, Mycobacterium
ENVASGA

SEQ ID NO: 256529 - protein, 6 aa, Mycobacterium
ENVPVP

SEQ ID NO: 256530 - protein, 9 aa, Mycobacterium
ENVSGCGAQ

SEQ ID NO: 256531 - protein, 6 aa, Mycobacterium
EPAAAQ

SEQ ID NO: 256532 - protein, 8 aa, Mycobacterium
EPAAARSV

SEQ ID NO: 256533 - protein, 17 aa, Mycobacterium
EPAAEPDSTLANRGYQA

SEQ ID NO: 256534 - protein, 17 aa, Mycobacterium
EPAAEPVPEPVDTGVLV

SEQ ID NO: 256535 - protein, 17 aa, Mycobacterium
EPAAPVRTSRAARSGVP

SEQ ID NO: 256536 - protein, 6 aa, Mycobacterium
EPAARF

SEQ ID NO: 256537 - protein, 21 aa, Mycobacterium
EPAATPSSTDSNRGYASADRH

SEQ ID NO: 256538 - protein, 5 aa, Mycobacterium
EPADG

SEQ ID NO: 256539 - protein, 14 aa, Mycobacterium
EPAEELRSARTGQE

SEQ ID NO: 256540 - protein, 14 aa, Mycobacterium
EPAEELRSARTPQE

SEQ ID NO: 256541 - protein, 11 aa, Mycobacterium
EPAGDGTLPDR

SEQ ID NO: 256542 - protein, 5 aa, Mycobacterium
EPAGI

SEQ ID NO: 256543 - protein, 10 aa, Mycobacterium
EPAGPASQWA

SEQ ID NO: 256544 - protein, 18 aa, Mycobacterium
EPAGPASRWARSAKPGDA

SEQ ID NO: 256545 - protein, 10 aa, Mycobacterium
EPAGSGTLRS

SEQ ID NO: 256546 - protein, 17 aa, Mycobacterium
EPAITSSPSAASPDTVA

SEQ ID NO: 256547 - protein, 22 aa, Mycobacterium
EPAKYSAAQQVSGDSVPGAPQP

SEQ ID NO: 256548 - protein, 13 aa, Mycobacterium
EPALASPGRPQAP

SEQ ID NO: 256549 - protein, 8 aa, Mycobacterium
EPALGGPL

SEQ ID NO: 256550 - protein, 5 aa, Mycobacterium
EPANP

SEQ ID NO: 256551 - protein, 14 aa, Mycobacterium
EPANPVAGSAAALA

SEQ ID NO: 256552 - protein, 21 aa, Mycobacterium
EPAPADGPDIAAAGADGEAEW

SEQ ID NO: 256553 - protein, 18 aa, Mycobacterium
EPAPDAAAAAVGAAEPAR

SEQ ID NO: 256554 - protein, 7 aa, Mycobacterium
EPAPEPD

SEQ ID NO: 256555 - protein, 11 aa, Mycobacterium
EPAPGQTVPQD

SEQ ID NO: 256556 - protein, 5 aa, Mycobacterium
EPAPM

SEQ ID NO: 256557 - protein, 9 aa, Mycobacterium
EPAPPGGGS

SEQ ID NO: 256558 - protein, 18 aa, Mycobacterium
EPAPQGAAAWQPEAPDGE

SEQ ID NO: 256559 - protein, 6 aa, Mycobacterium
EPAQET

SEQ ID NO: 256560 - protein, 7 aa, Mycobacterium
EPAQRGR

SEQ ID NO: 256561 - protein, 9 aa, Mycobacterium
EPASTTAGI

SEQ ID NO: 256562 - protein, 17 aa, Mycobacterium
EPATASSGLLSKDGKTG

SEQ ID NO: 256563 - protein, 5 aa, Mycobacterium
EPATT

SEQ ID NO: 256564 - protein, 5 aa, Mycobacterium
EPAVA

SEQ ID NO: 256565 - protein, 6 aa, Mycobacterium
EPCADT

SEQ ID NO: 256566 - protein, 8 aa, Mycobacterium
EPCETTKR

SEQ ID NO: 256567 - protein, 5 aa, Mycobacterium
EPCPD

SEQ ID NO: 256568 - protein, 5 aa, Mycobacterium
EPCPG

SEQ ID NO: 256569 - protein, 4 aa, Mycobacterium
EPDA

SEQ ID NO: 256570 - protein, 9 aa, Mycobacterium
EPDAGATLE

SEQ ID NO: 256571 - protein, 48 aa, Mycobacterium
EPDAGQSEAPLAARGADAPGAAAQEEPGAESRAADEDESKPAKKSTLR

SEQ ID NO: 256572 - protein, 20 aa, Mycobacterium
EPDAGSNSHKITTTARRDGT

SEQ ID NO: 256573 - protein, 12 aa, Mycobacterium
EPDAMPVPDGPV

SEQ ID NO: 256574 - protein, 5 aa, Mycobacterium
EPDAN

SEQ ID NO: 256575 - protein, 7 aa, Mycobacterium
EPDANEG

SEQ ID NO: 256576 - protein, 23 aa, Mycobacterium
EPDAPDGSTGQPAEPDATPTTPR

SEQ ID NO: 256577 - protein, 5 aa, Mycobacterium
EPDDI

SEQ ID NO: 256578 - protein, 4 aa, Mycobacterium
EPDE

SEQ ID NO: 256579 - protein, 6 aa, Mycobacterium
EPDEFD

SEQ ID NO: 256580 - protein, 6 aa, Mycobacterium
EPDEIE

SEQ ID NO: 256581 - protein, 10 aa, Mycobacterium
EPDGAASLPD

SEQ ID NO: 256582 - protein, 7 aa, Mycobacterium
EPDGAQP

SEQ ID NO: 256583 - protein, 5 aa, Mycobacterium
EPDGP

SEQ ID NO: 256584 - protein, 7 aa, Mycobacterium
EPDGQAP

SEQ ID NO: 256585 - protein, 7 aa, Mycobacterium
EPDKKRN

SEQ ID NO: 256586 - protein, 9 aa, Mycobacterium
EPDNDPANM

SEQ ID NO: 256587 - protein, 15 aa, Mycobacterium
EPDNPDEAGEEEPQE

SEQ ID NO: 256588 - protein, 4 aa, Mycobacterium
EPDP

SEQ ID NO: 256589 - protein, 7 aa, Mycobacterium
EPDPAEM

SEQ ID NO: 256590 - protein, 26 aa, Mycobacterium
EPDPALASGKDKPANRQPDASQAAGL

SEQ ID NO: 256591 - protein, 8 aa, Mycobacterium
EPDPEASG

SEQ ID NO: 256592 - protein, 5 aa, Mycobacterium
EPDPN

SEQ ID NO: 256593 - protein, 29 aa, Mycobacterium
EPDPSLAPVKRDSAADRQANGAQAAGLIP

SEQ ID NO: 256594 - protein, 15 aa, Mycobacterium
EPDPSLGVDRADPAV

SEQ ID NO: 256595 - protein, 8 aa, Mycobacterium
EPDQAEMQ

SEQ ID NO: 256596 - protein, 4 aa, Mycobacterium
EPDR

SEQ ID NO: 256597 - protein, 5 aa, Mycobacterium
EPDRW

SEQ ID NO: 256598 - protein, 4 aa, Mycobacterium
EPDS

SEQ ID NO: 256599 - protein, 5 aa, Mycobacterium
EPDSN

SEQ ID NO: 256600 - protein, 7 aa, Mycobacterium
EPDSNDG

SEQ ID NO: 256601 - protein, 13 aa, Mycobacterium
EPDSPVDVNADPV

SEQ ID NO: 256602 - protein, 8 aa, Mycobacterium
EPDSRAIE

SEQ ID NO: 256603 - protein, 4 aa, Mycobacterium
EPDT

SEQ ID NO: 256604 - protein, 17 aa, Mycobacterium
EPDTDHDPSRSCNEQRV

SEQ ID NO: 256605 - protein, 5 aa, Mycobacterium
EPDTN

SEQ ID NO: 256606 - protein, 31 aa, Mycobacterium
EPDTPPASPALASKPSVPAPTTSGGPALNGT

SEQ ID NO: 256607 - protein, 44 aa, Mycobacterium
EPDTSADDEQTPEGAGPGDADVADAHTETEPADDDSDPDEPMTA

SEQ ID NO: 256608 - protein, 12 aa, Mycobacterium
EPDTTRAHGDSD

SEQ ID NO: 256609 - protein, 5 aa, Mycobacterium
EPDTV

SEQ ID NO: 256610 - protein, 4 aa, Mycobacterium
EPDV

SEQ ID NO: 256611 - protein, 8 aa, Mycobacterium
EPEAPAYP

SEQ ID NO: 256612 - protein, 26 aa, Mycobacterium
EPEEAADPASALQPPVSRTGRAPALT

SEQ ID NO: 256613 - protein, 7 aa, Mycobacterium
EPEEGLG

SEQ ID NO: 256614 - protein, 23 aa, Mycobacterium
EPEESPDPQPAAPPPADGAPRWT

SEQ ID NO: 256615 - protein, 24 aa, Mycobacterium
EPEESPEPEPASRPNGDLGRATGR

SEQ ID NO: 256616 - protein, 10 aa, Mycobacterium
EPEGTGALPD

SEQ ID NO: 256617 - protein, 5 aa, Mycobacterium
EPEKN

SEQ ID NO: 256618 - protein, 12 aa, Mycobacterium
EPENHEASGKEL

SEQ ID NO: 256619 - protein, 12 aa, Mycobacterium
EPENSVASGKSL

SEQ ID NO: 256620 - protein, 18 aa, Mycobacterium
EPEPAAEVSGDAQGEWPQ

SEQ ID NO: 256621 - protein, 45 aa, Mycobacterium
EPEPETPAPVAAEPVAPPVAPETPQAPEAPEAPEAPEAPEAPEVA

SEQ ID NO: 256622 - protein, 6 aa, Mycobacterium
EPEPLP

SEQ ID NO: 256623 - protein, 28 aa, Mycobacterium
EPEPRWPKSEPITRTKAGPERSEYPRPL

SEQ ID NO: 256624 - protein, 27 aa, Mycobacterium
EPEPRWPRSEPIARRKSGPERSEYPRP

SEQ ID NO: 256625 - protein, 5 aa, Mycobacterium
EPEPS

SEQ ID NO: 256626 - protein, 22 aa, Mycobacterium
EPEPTPSTTGDESEDTPRQDGG

SEQ ID NO: 256627 - protein, 26 aa, Mycobacterium
EPEPVNGGDATGGANPASRKAGELTT

SEQ ID NO: 256628 - protein, 6 aa, Mycobacterium
EPERPI

SEQ ID NO: 256629 - protein, 8 aa, Mycobacterium
EPERRPAE

SEQ ID NO: 256630 - protein, 21 aa, Mycobacterium
EPETALAPDQLPPREAVPAPQ

SEQ ID NO: 256631 - protein, 15 aa, Mycobacterium
EPFDANYSGEEDVNG

SEQ ID NO: 256632 - protein, 7 aa, Mycobacterium
EPFDDDR

SEQ ID NO: 256633 - protein, 10 aa, Mycobacterium
EPFGQGHSRT

SEQ ID NO: 256634 - protein, 5 aa, Mycobacterium
EPFRT

SEQ ID NO: 256635 - protein, 7 aa, Mycobacterium
EPGAADA

SEQ ID NO: 256636 - protein, 48 aa, Mycobacterium
EPGAGQPEPKASGPESDTTGETAPPAGAAESAESDSGASKPAKKSTLR

SEQ ID NO: 256637 - protein, 11 aa, Mycobacterium
EPGAPGNARGF

SEQ ID NO: 256638 - protein, 7 aa, Mycobacterium
EPGATAD

SEQ ID NO: 256639 - protein, 18 aa, Mycobacterium
EPGDAPATKPEKAMASTS

SEQ ID NO: 256640 - protein, 12 aa, Mycobacterium
EPGEQDHAGGRK

SEQ ID NO: 256641 - protein, 20 aa, Mycobacterium
EPGGDYVQSTDGLTDCDGHG

SEQ ID NO: 256642 - protein, 9 aa, Mycobacterium
EPGKPTPDA

SEQ ID NO: 256643 - protein, 32 aa, Mycobacterium
EPGLGSRPVPDDAASAPRSVPTPADGPAERYA

SEQ ID NO: 256644 - protein, 11 aa, Mycobacterium
EPGLSEVGDNP

SEQ ID NO: 256645 - protein, 7 aa, Mycobacterium
EPGPEDD

SEQ ID NO: 256646 - protein, 6 aa, Mycobacterium
EPGPLV

SEQ ID NO: 256647 - protein, 5 aa, Mycobacterium
EPGPS

SEQ ID NO: 256648 - protein, 14 aa, Mycobacterium
EPGPSRHPDEYPDK

SEQ ID NO: 256649 - protein, 4 aa, Mycobacterium
EPGR

SEQ ID NO: 256650 - protein, 6 aa, Mycobacterium
EPGRSL

SEQ ID NO: 256651 - protein, 17 aa, Mycobacterium
EPGRTATPAGSISTPVD

SEQ ID NO: 256652 - protein, 14 aa, Mycobacterium
EPGSARIQPSGSRI

SEQ ID NO: 256653 - protein, 19 aa, Mycobacterium
EPGTGSPQPTGTILAELPL

SEQ ID NO: 256654 - protein, 19 aa, Mycobacterium
EPGTGSTKPTGTVLAELPL

SEQ ID NO: 256655 - protein, 19 aa, Mycobacterium
EPGTGSTQPTGAILAELPL

SEQ ID NO: 256656 - protein, 7 aa, Mycobacterium
EPGTTTA

SEQ ID NO: 256657 - protein, 5 aa, Mycobacterium
EPGYA

SEQ ID NO: 256658 - protein, 17 aa, Mycobacterium
EPHESGSTERATTGRIT

SEQ ID NO: 256659 - protein, 8 aa, Mycobacterium
EPHPPTGH

SEQ ID NO: 256660 - protein, 19 aa, Mycobacterium
EPIAATSGTGRTPRTDREA

SEQ ID NO: 256661 - protein, 23 aa, Mycobacterium
EPIEPPAPVSGTTAGRATVDDDA

SEQ ID NO: 256662 - protein, 4 aa, Mycobacterium
EPIH

SEQ ID NO: 256663 - protein, 14 aa, Mycobacterium
EPINPQYTGMPPTG

SEQ ID NO: 256664 - protein, 21 aa, Mycobacterium
EPIPGGKTQITGQFTQDTARE

SEQ ID NO: 256665 - protein, 6 aa, Mycobacterium
EPIPSA

SEQ ID NO: 256666 - protein, 9 aa, Mycobacterium
EPIPSPQST

SEQ ID NO: 256667 - protein, 11 aa, Mycobacterium
EPIQAQPCEPE

SEQ ID NO: 256668 - protein, 6 aa, Mycobacterium
EPKDEL

SEQ ID NO: 256669 - protein, 11 aa, Mycobacterium
EPKDYPEDERP

SEQ ID NO: 256670 - protein, 9 aa, Mycobacterium
EPKEYGRGS

SEQ ID NO: 256671 - protein, 11 aa, Mycobacterium
EPKGAGKARGW

SEQ ID NO: 256672 - protein, 7 aa, Mycobacterium
EPKKAAA

SEQ ID NO: 256673 - protein, 8 aa, Mycobacterium
EPKKAAAA

SEQ ID NO: 256674 - protein, 8 aa, Mycobacterium
EPKNNDPW

SEQ ID NO: 256675 - protein, 6 aa, Mycobacterium
EPKPVT

SEQ ID NO: 256676 - protein, 8 aa, Mycobacterium
EPKPYLGD

SEQ ID NO: 256677 - protein, 10 aa, Mycobacterium
EPKSAARQSL

SEQ ID NO: 256678 - protein, 11 aa, Mycobacterium
EPLAGGDATAT

SEQ ID NO: 256679 - protein, 17 aa, Mycobacterium
EPLEQPSGELPGVPGLS

SEQ ID NO: 256680 - protein, 5 aa, Mycobacterium
EPLGT

SEQ ID NO: 256681 - protein, 14 aa, Mycobacterium
EPLLDGQAQKADAI

SEQ ID NO: 256682 - protein, 5 aa, Mycobacterium
EPLNT

SEQ ID NO: 256683 - protein, 11 aa, Mycobacterium
EPLPPPRPGVE

SEQ ID NO: 256684 - protein, 7 aa, Mycobacterium
EPLPPQR

SEQ ID NO: 256685 - protein, 20 aa, Mycobacterium
EPLPYAQPQPAGRPVPSAPA

SEQ ID NO: 256686 - protein, 6 aa, Mycobacterium
EPLSDE

SEQ ID NO: 256687 - protein, 26 aa, Mycobacterium
EPLSNSGHAQLNSDTSARRRSNPRDI

SEQ ID NO: 256688 - protein, 9 aa, Mycobacterium
EPLSRKQDI

SEQ ID NO: 256689 - protein, 13 aa, Mycobacterium
EPLSRRQPADAPG

SEQ ID NO: 256690 - protein, 17 aa, Mycobacterium
EPLTAGTGVAPIGAPVP

SEQ ID NO: 256691 - protein, 43 aa, Mycobacterium
EPLTSSGERRIRENPRSRSSPLTVPDSKTNPSGPTTGPQHTGF

SEQ ID NO: 256692 - protein, 4 aa, Mycobacterium
EPMP

SEQ ID NO: 256693 - protein, 11 aa, Mycobacterium
EPNGPGRLPDN

SEQ ID NO: 256694 - protein, 4 aa, Mycobacterium
EPNH

SEQ ID NO: 256695 - protein, 8 aa, Mycobacterium
EPNPDTRP

SEQ ID NO: 256696 - protein, 8 aa, Mycobacterium
EPNPEERP

SEQ ID NO: 256697 - protein, 15 aa, Mycobacterium
EPNPVQNGQKELTTT

SEQ ID NO: 256698 - protein, 13 aa, Mycobacterium
EPNREHVGPPPRP

SEQ ID NO: 256699 - protein, 6 aa, Mycobacterium
EPNSAI

SEQ ID NO: 256700 - protein, 82 aa, Mycobacterium
EPNSGAPGYEAAGYPPSGYADPPPAYGPPPAYGPPPGYGAPPPGYGPPPPGYGPPPGYGPPPPGYGPPPGYGPPPPGYGPPL

SEQ ID NO: 256701 - protein, 8 aa, Mycobacterium
EPNSPGAA

SEQ ID NO: 256702 - protein, 6 aa, Mycobacterium
EPPAGV

SEQ ID NO: 256703 - protein, 6 aa, Mycobacterium
EPPARW

SEQ ID NO: 256704 - protein, 8 aa, Mycobacterium
EPPDDAPE

SEQ ID NO: 256705 - protein, 22 aa, Mycobacterium
EPPDDLPGCREPADADEEATAE

SEQ ID NO: 256706 - protein, 8 aa, Mycobacterium
EPPDELPG

SEQ ID NO: 256707 - protein, 4 aa, Mycobacterium
EPPE

SEQ ID NO: 256708 - protein, 5 aa, Mycobacterium
EPPEA

SEQ ID NO: 256709 - protein, 19 aa, Mycobacterium
EPPFEPRTNGHPGRSTHHP

SEQ ID NO: 256710 - protein, 5 aa, Mycobacterium
EPPFI

SEQ ID NO: 256711 - protein, 9 aa, Mycobacterium
EPPFTGDSP

SEQ ID NO: 256712 - protein, 13 aa, Mycobacterium
EPPGGDDTRSWGP

SEQ ID NO: 256713 - protein, 9 aa, Mycobacterium
EPPGGDRTA

SEQ ID NO: 256714 - protein, 19 aa, Mycobacterium
EPPGGSSQPTSPVFAELPL

SEQ ID NO: 256715 - protein, 11 aa, Mycobacterium
EPPGPYSRTTL

SEQ ID NO: 256716 - protein, 12 aa, Mycobacterium
EPPHRVKNTADR

SEQ ID NO: 256717 - protein, 19 aa, Mycobacterium
EPPKNPDAGDAGAAQQVGR

SEQ ID NO: 256718 - protein, 9 aa, Mycobacterium
EPPKPVRVA

SEQ ID NO: 256719 - protein, 14 aa, Mycobacterium
EPPKPVRVAPSAPI

SEQ ID NO: 256720 - protein, 7 aa, Mycobacterium
EPPPDDN

SEQ ID NO: 256721 - protein, 8 aa, Mycobacterium
EPPPPAEI

SEQ ID NO: 256722 - protein, 15 aa, Mycobacterium
EPPPRPSQLRPGRVP

SEQ ID NO: 256723 - protein, 8 aa, Mycobacterium
EPPPRPSV

SEQ ID NO: 256724 - protein, 6 aa, Mycobacterium
EPPPVS

SEQ ID NO: 256725 - protein, 4 aa, Mycobacterium
EPPQ

SEQ ID NO: 256726 - protein, 6 aa, Mycobacterium
EPPQNY

SEQ ID NO: 256727 - protein, 6 aa, Mycobacterium
EPPRAL

SEQ ID NO: 256728 - protein, 21 aa, Mycobacterium
EPPRRRGSTGGPNNANPKHHP

SEQ ID NO: 256729 - protein, 17 aa, Mycobacterium
EPPVLDDETSRPAAASA

SEQ ID NO: 256730 - protein, 5 aa, Mycobacterium
EPPYK

SEQ ID NO: 256731 - protein, 18 aa, Mycobacterium
EPQAAPVPEAPSTGDTAR

SEQ ID NO: 256732 - protein, 5 aa, Mycobacterium
EPQDD

SEQ ID NO: 256733 - protein, 8 aa, Mycobacterium
EPQIHGTG

SEQ ID NO: 256734 - protein, 6 aa, Mycobacterium
EPQPGE

SEQ ID NO: 256735 - protein, 14 aa, Mycobacterium
EPQREGKGRLARRA

SEQ ID NO: 256736 - protein, 13 aa, Mycobacterium
EPQSAPPRGSAFT

SEQ ID NO: 256737 - protein, 7 aa, Mycobacterium
EPQWGPP

SEQ ID NO: 256738 - protein, 28 aa, Mycobacterium
EPRDAFGPDGPRGVPSGAPANTPIESQD

SEQ ID NO: 256739 - protein, 7 aa, Mycobacterium
EPRDELA

SEQ ID NO: 256740 - protein, 4 aa, Mycobacterium
EPRE

SEQ ID NO: 256741 - protein, 11 aa, Mycobacterium
EPRESNANEAE

SEQ ID NO: 256742 - protein, 7 aa, Mycobacterium
EPRGDRA

SEQ ID NO: 256743 - protein, 7 aa, Mycobacterium
EPRGPLP

SEQ ID NO: 256744 - protein, 4 aa, Mycobacterium
EPRK

SEQ ID NO: 256745 - protein, 4 aa, Mycobacterium
EPRN

SEQ ID NO: 256746 - protein, 9 aa, Mycobacterium
EPRPSRTAR

SEQ ID NO: 256747 - protein, 5 aa, Mycobacterium
EPRPT

SEQ ID NO: 256748 - protein, 12 aa, Mycobacterium
EPRQYRMPHAVG

SEQ ID NO: 256749 - protein, 4 aa, Mycobacterium
EPRR

SEQ ID NO: 256750 - protein, 11 aa, Mycobacterium
EPRSDAGPYLQ

SEQ ID NO: 256751 - protein, 7 aa, Mycobacterium
EPRSRRN

SEQ ID NO: 256752 - protein, 4 aa, Mycobacterium
EPRV

SEQ ID NO: 256753 - protein, 12 aa, Mycobacterium
EPRVSRDVESDS

SEQ ID NO: 256754 - protein, 8 aa, Mycobacterium
EPSAADDL

SEQ ID NO: 256755 - protein, 8 aa, Mycobacterium
EPSAAEDL

SEQ ID NO: 256756 - protein, 8 aa, Mycobacterium
EPSAEEDL

SEQ ID NO: 256757 - protein, 5 aa, Mycobacterium
EPSDV

SEQ ID NO: 256758 - protein, 6 aa, Mycobacterium
EPSDVT

SEQ ID NO: 256759 - protein, 8 aa, Mycobacterium
EPSESARR

SEQ ID NO: 256760 - protein, 5 aa, Mycobacterium
EPSGD

SEQ ID NO: 256761 - protein, 8 aa, Mycobacterium
EPSGPAHL

SEQ ID NO: 256762 - protein, 9 aa, Mycobacterium
EPSNRPGLA

SEQ ID NO: 256763 - protein, 19 aa, Mycobacterium
EPSPDVQAETAPPGPTPDD

SEQ ID NO: 256764 - protein, 8 aa, Mycobacterium
EPSQAQMQ

SEQ ID NO: 256765 - protein, 4 aa, Mycobacterium
EPSR

SEQ ID NO: 256766 - protein, 18 aa, Mycobacterium
EPSSTRRLDGPTDAPDGL

SEQ ID NO: 256767 - protein, 11 aa, Mycobacterium
EPSTGDDLTSE

SEQ ID NO: 256768 - protein, 5 aa, Mycobacterium
EPSTS

SEQ ID NO: 256769 - protein, 10 aa, Mycobacterium
EPTAAGTPRI

SEQ ID NO: 256770 - protein, 11 aa, Mycobacterium
EPTAGLDGEQQ

SEQ ID NO: 256771 - protein, 11 aa, Mycobacterium
EPTAGLDPAQQ

SEQ ID NO: 256772 - protein, 29 aa, Mycobacterium
EPTDVATSQPAGYGGSPERSNGDPATVPA

SEQ ID NO: 256773 - protein, 19 aa, Mycobacterium
EPTEAQAGASGRETASGQR

SEQ ID NO: 256774 - protein, 17 aa, Mycobacterium
EPTETSVSGPHATAGQR

SEQ ID NO: 256775 - protein, 17 aa, Mycobacterium
EPTETSVSGPHATPGQR

SEQ ID NO: 256776 - protein, 4 aa, Mycobacterium
EPTG

SEQ ID NO: 256777 - protein, 4 aa, Mycobacterium
EPTK

SEQ ID NO: 256778 - protein, 4 aa, Mycobacterium
EPTN

SEQ ID NO: 256779 - protein, 4 aa, Mycobacterium
EPTR

SEQ ID NO: 256780 - protein, 7 aa, Mycobacterium
EPTRDTI

SEQ ID NO: 256781 - protein, 8 aa, Mycobacterium
EPTRGPRA

SEQ ID NO: 256782 - protein, 7 aa, Mycobacterium
EPTSRRT

SEQ ID NO: 256783 - protein, 6 aa, Mycobacterium
EPTTED

SEQ ID NO: 256784 - protein, 15 aa, Mycobacterium
EPTTGASSDIDQATK

SEQ ID NO: 256785 - protein, 18 aa, Mycobacterium
EPTTGAVSDIEQATKKAR

SEQ ID NO: 256786 - protein, 19 aa, Mycobacterium
EPTTGEGTAEPGEAVQPPV

SEQ ID NO: 256787 - protein, 8 aa, Mycobacterium
EPTTPKDM

SEQ ID NO: 256788 - protein, 17 aa, Mycobacterium
EPVAEPEQVTEAPAPDI

SEQ ID NO: 256789 - protein, 10 aa, Mycobacterium
EPVDGRARSE

SEQ ID NO: 256790 - protein, 4 aa, Mycobacterium
EPVE

SEQ ID NO: 256791 - protein, 7 aa, Mycobacterium
EPVGGTE

SEQ ID NO: 256792 - protein, 5 aa, Mycobacterium
EPVNE

SEQ ID NO: 256793 - protein, 8 aa, Mycobacterium
EPVPAVPP

SEQ ID NO: 256794 - protein, 8 aa, Mycobacterium
EPVSEDDL

SEQ ID NO: 256795 - protein, 5 aa, Mycobacterium
EPYER

SEQ ID NO: 256796 - protein, 32 aa, Mycobacterium
EPYGDRYEESREPYEPRRRRPPSTGSGGTHHP

SEQ ID NO: 256797 - protein, 23 aa, Mycobacterium
EPYNRRAEKADGSLYPEDQPDRV

SEQ ID NO: 256798 - protein, 5 aa, Mycobacterium
EPYSI

SEQ ID NO: 256799 - protein, 8 aa, Mycobacterium
EPYTTADG

SEQ ID NO: 256800 - protein, 4 aa, Mycobacterium
EQAA

SEQ ID NO: 256801 - protein, 8 aa, Mycobacterium
EQAAEQEN

SEQ ID NO: 256802 - protein, 31 aa, Mycobacterium
EQAAPAPRFSRTPAGPVGPPPATITPIGEIN

SEQ ID NO: 256803 - protein, 7 aa, Mycobacterium
EQADTRQ

SEQ ID NO: 256804 - protein, 12 aa, Mycobacterium
EQAEAEAAEAEA

SEQ ID NO: 256805 - protein, 21 aa, Mycobacterium
EQAEAEAQEAEALATAARARA

SEQ ID NO: 256806 - protein, 8 aa, Mycobacterium
EQAEEAGY

SEQ ID NO: 256807 - protein, 12 aa, Mycobacterium
EQAEELRRSNAE

SEQ ID NO: 256808 - protein, 9 aa, Mycobacterium
EQAEKLGRQ

SEQ ID NO: 256809 - protein, 6 aa, Mycobacterium
EQAGRT

SEQ ID NO: 256810 - protein, 10 aa, Mycobacterium
EQAKTTNPAS

SEQ ID NO: 256811 - protein, 14 aa, Mycobacterium
EQAKVTTEAQVNAT

SEQ ID NO: 256812 - protein, 12 aa, Mycobacterium
EQARKGSSQRLA

SEQ ID NO: 256813 - protein, 10 aa, Mycobacterium
EQARTAGLDL

SEQ ID NO: 256814 - protein, 4 aa, Mycobacterium
EQAT

SEQ ID NO: 256815 - protein, 8 aa, Mycobacterium
EQATAEQL

SEQ ID NO: 256816 - protein, 5 aa, Mycobacterium
EQATG

SEQ ID NO: 256817 - protein, 5 aa, Mycobacterium
EQATV

SEQ ID NO: 256818 - protein, 7 aa, Mycobacterium
EQCTENG

SEQ ID NO: 256819 - protein, 7 aa, Mycobacterium
EQDADNA

SEQ ID NO: 256820 - protein, 8 aa, Mycobacterium
EQDGQSIT

SEQ ID NO: 256821 - protein, 4 aa, Mycobacterium
EQDI

SEQ ID NO: 256822 - protein, 6 aa, Mycobacterium
EQDKKH

SEQ ID NO: 256823 - protein, 9 aa, Mycobacterium
EQDNNTTKI

SEQ ID NO: 256824 - protein, 43 aa, Mycobacterium
EQDPYGADDRHPELGAEEYPDFGTHPDGPEPSDPKPAATPPPP

SEQ ID NO: 256825 - protein, 13 aa, Mycobacterium
EQDRTKDALASAR

SEQ ID NO: 256826 - protein, 14 aa, Mycobacterium
EQDRTKSALASARD

SEQ ID NO: 256827 - protein, 19 aa, Mycobacterium
EQDSKQDSKQDSKQDSKQE

SEQ ID NO: 256828 - protein, 6 aa, Mycobacterium
EQDTKH

SEQ ID NO: 256829 - protein, 6 aa, Mycobacterium
EQDTRH

SEQ ID NO: 256830 - protein, 5 aa, Mycobacterium
EQEAE

SEQ ID NO: 256831 - protein, 8 aa, Mycobacterium
EQEGPGAA

SEQ ID NO: 256832 - protein, 12 aa, Mycobacterium
EQEGRTEESTSM

SEQ ID NO: 256833 - protein, 18 aa, Mycobacterium
EQEQHTNGDGRDSARANF

SEQ ID NO: 256834 - protein, 13 aa, Mycobacterium
EQERTKAALTSAR

SEQ ID NO: 256835 - protein, 13 aa, Mycobacterium
EQESTRRGPAMMP

SEQ ID NO: 256836 - protein, 16 aa, Mycobacterium
EQETTRRGSATAGVGP

SEQ ID NO: 256837 - protein, 6 aa, Mycobacterium
EQFPGR

SEQ ID NO: 256838 - protein, 6 aa, Mycobacterium
EQFSEH

SEQ ID NO: 256839 - protein, 4 aa, Mycobacterium
EQGA

SEQ ID NO: 256840 - protein, 11 aa, Mycobacterium
EQGAADNDESV

SEQ ID NO: 256841 - protein, 8 aa, Mycobacterium
EQGALKTD

SEQ ID NO: 256842 - protein, 14 aa, Mycobacterium
EQGERDFVRVVDSE

SEQ ID NO: 256843 - protein, 4 aa, Mycobacterium
EQGP

SEQ ID NO: 256844 - protein, 6 aa, Mycobacterium
EQGQAD

SEQ ID NO: 256845 - protein, 4 aa, Mycobacterium
EQGR

SEQ ID NO: 256846 - protein, 5 aa, Mycobacterium
EQGRG

SEQ ID NO: 256847 - protein, 7 aa, Mycobacterium
EQGRNDL

SEQ ID NO: 256848 - protein, 7 aa, Mycobacterium
EQGTEEH

SEQ ID NO: 256849 - protein, 9 aa, Mycobacterium
EQGVTDDQL

SEQ ID NO: 256850 - protein, 9 aa, Mycobacterium
EQHARSKQR

SEQ ID NO: 256851 - protein, 4 aa, Mycobacterium
EQHE

SEQ ID NO: 256852 - protein, 9 aa, Mycobacterium
EQHGDESKV

SEQ ID NO: 256853 - protein, 6 aa, Mycobacterium
EQHPEG

SEQ ID NO: 256854 - protein, 33 aa, Mycobacterium
EQHQQTDQGDQLDPRRPAQRAGASGKPNAAKDV

SEQ ID NO: 256855 - protein, 9 aa, Mycobacterium
EQIANEGPR

SEQ ID NO: 256856 - protein, 11 aa, Mycobacterium
EQIDSAGNTAI

SEQ ID NO: 256857 - protein, 6 aa, Mycobacterium
EQIESE

SEQ ID NO: 256858 - protein, 34 aa, Mycobacterium
EQIGDPDDEAQWPAAAQPTVPLTRPDGPTGTPME

SEQ ID NO: 256859 - protein, 4 aa, Mycobacterium
EQIP

SEQ ID NO: 256860 - protein, 4 aa, Mycobacterium
EQIT

SEQ ID NO: 256861 - protein, 6 aa, Mycobacterium
EQITSR

SEQ ID NO: 256862 - protein, 9 aa, Mycobacterium
EQKETLPDS

SEQ ID NO: 256863 - protein, 6 aa, Mycobacterium
EQKETV

SEQ ID NO: 256864 - protein, 7 aa, Mycobacterium
EQKHANA

SEQ ID NO: 256865 - protein, 4 aa, Mycobacterium
EQLA

SEQ ID NO: 256866 - protein, 5 aa, Mycobacterium
EQLGD

SEQ ID NO: 256867 - protein, 10 aa, Mycobacterium
EQLGDDYEEA

SEQ ID NO: 256868 - protein, 5 aa, Mycobacterium
EQLGE

SEQ ID NO: 256869 - protein, 11 aa, Mycobacterium
EQLGSGTTGKQ

SEQ ID NO: 256870 - protein, 6 aa, Mycobacterium
EQLPDS

SEQ ID NO: 256871 - protein, 29 aa, Mycobacterium
EQLPQHKSGTMPRRPAKKATAAETPRKRA

SEQ ID NO: 256872 - protein, 13 aa, Mycobacterium
EQLQKSPANKSAY

SEQ ID NO: 256873 - protein, 14 aa, Mycobacterium
EQLTGDPVDGRADQ

SEQ ID NO: 256874 - protein, 7 aa, Mycobacterium
EQLTRND

SEQ ID NO: 256875 - protein, 9 aa, Mycobacterium
EQMGPQGAR

SEQ ID NO: 256876 - protein, 4 aa, Mycobacterium
EQMK

SEQ ID NO: 256877 - protein, 10 aa, Mycobacterium
EQNAERGRLT

SEQ ID NO: 256878 - protein, 8 aa, Mycobacterium
EQNDRGQI

SEQ ID NO: 256879 - protein, 4 aa, Mycobacterium
EQNQ

SEQ ID NO: 256880 - protein, 17 aa, Mycobacterium
EQNRDAIKQSVGNSSQI

SEQ ID NO: 256881 - protein, 7 aa, Mycobacterium
EQNRPDL

SEQ ID NO: 256882 - protein, 9 aa, Mycobacterium
EQPAPPLRP

SEQ ID NO: 256883 - protein, 10 aa, Mycobacterium
EQPASAEVSH

SEQ ID NO: 256884 - protein, 6 aa, Mycobacterium
EQPDTG

SEQ ID NO: 256885 - protein, 7 aa, Mycobacterium
EQPGFAP

SEQ ID NO: 256886 - protein, 7 aa, Mycobacterium
EQPGPAA

SEQ ID NO: 256887 - protein, 9 aa, Mycobacterium
EQPGTPEMT

SEQ ID NO: 256888 - protein, 4 aa, Mycobacterium
EQPK

SEQ ID NO: 256889 - protein, 7 aa, Mycobacterium
EQPLGDA

SEQ ID NO: 256890 - protein, 7 aa, Mycobacterium
EQPLSPQ

SEQ ID NO: 256891 - protein, 9 aa, Mycobacterium
EQPNDSENF

SEQ ID NO: 256892 - protein, 108 aa, Mycobacterium
EQPRRRRPRPDGQSPEPRRRPRPSSSREPREPRRSRESREDRESRGAPSREPRERRVRRDRYDPYDRGDTYDRGDAYERPRPQRERPQRPRYDDYEPYGSDGPSSHHP

SEQ ID NO: 256893 - protein, 8 aa, Mycobacterium
EQPSQTDY

SEQ ID NO: 256894 - protein, 5 aa, Mycobacterium
EQPSR

SEQ ID NO: 256895 - protein, 10 aa, Mycobacterium
EQPTSPEQGY

SEQ ID NO: 256896 - protein, 9 aa, Mycobacterium
EQQAEAAGI

SEQ ID NO: 256897 - protein, 5 aa, Mycobacterium
EQQAG

SEQ ID NO: 256898 - protein, 13 aa, Mycobacterium
EQQDSGSKDPGAM

SEQ ID NO: 256899 - protein, 8 aa, Mycobacterium
EQQEKVPD

SEQ ID NO: 256900 - protein, 9 aa, Mycobacterium
EQQETVPDE

SEQ ID NO: 256901 - protein, 4 aa, Mycobacterium
EQQI

SEQ ID NO: 256902 - protein, 7 aa, Mycobacterium
EQQLAPT

SEQ ID NO: 256903 - protein, 13 aa, Mycobacterium
EQQPDTDEDRPAE

SEQ ID NO: 256904 - protein, 6 aa, Mycobacterium
EQQSQT

SEQ ID NO: 256905 - protein, 4 aa, Mycobacterium
EQQV

SEQ ID NO: 256906 - protein, 6 aa, Mycobacterium
EQQVPR

SEQ ID NO: 256907 - protein, 10 aa, Mycobacterium
EQQVTARPDA

SEQ ID NO: 256908 - protein, 6 aa, Mycobacterium
EQRATA

SEQ ID NO: 256909 - protein, 7 aa, Mycobacterium
EQRATEP

SEQ ID NO: 256910 - protein, 4 aa, Mycobacterium
EQRE

SEQ ID NO: 256911 - protein, 8 aa, Mycobacterium
EQREAAER

SEQ ID NO: 256912 - protein, 11 aa, Mycobacterium
EQRGDPGYKAT

SEQ ID NO: 256913 - protein, 8 aa, Mycobacterium
EQRGGERG

SEQ ID NO: 256914 - protein, 9 aa, Mycobacterium
EQRGPCTTS

SEQ ID NO: 256915 - protein, 6 aa, Mycobacterium
EQRGRA

SEQ ID NO: 256916 - protein, 11 aa, Mycobacterium
EQRKAKLGDPA

SEQ ID NO: 256917 - protein, 10 aa, Mycobacterium
EQRKGQLADP

SEQ ID NO: 256918 - protein, 4 aa, Mycobacterium
EQRL

SEQ ID NO: 256919 - protein, 6 aa, Mycobacterium
EQRPEC

SEQ ID NO: 256920 - protein, 5 aa, Mycobacterium
EQRPK

SEQ ID NO: 256921 - protein, 5 aa, Mycobacterium
EQRPL

SEQ ID NO: 256922 - protein, 4 aa, Mycobacterium
EQRR

SEQ ID NO: 256923 - protein, 11 aa, Mycobacterium
EQRRSEQAQAA

SEQ ID NO: 256924 - protein, 9 aa, Mycobacterium
EQRRSGVDH

SEQ ID NO: 256925 - protein, 5 aa, Mycobacterium
EQSAA

SEQ ID NO: 256926 - protein, 12 aa, Mycobacterium
EQSAGTETDRAG

SEQ ID NO: 256927 - protein, 11 aa, Mycobacterium
EQSDGTETDRA

SEQ ID NO: 256928 - protein, 12 aa, Mycobacterium
EQSDGTETDRAG

SEQ ID NO: 256929 - protein, 12 aa, Mycobacterium
EQSEGTETDRAG

SEQ ID NO: 256930 - protein, 14 aa, Mycobacterium
EQSERDFVRVVDAE

SEQ ID NO: 256931 - protein, 5 aa, Mycobacterium
EQSGT

SEQ ID NO: 256932 - protein, 14 aa, Mycobacterium
EQSIADTDEPGTKL

SEQ ID NO: 256933 - protein, 7 aa, Mycobacterium
EQSLGAD

SEQ ID NO: 256934 - protein, 12 aa, Mycobacterium
EQSNPVLPGTEP

SEQ ID NO: 256935 - protein, 12 aa, Mycobacterium
EQSRKGASQRLA

SEQ ID NO: 256936 - protein, 12 aa, Mycobacterium
EQSRVSTKATVQ

SEQ ID NO: 256937 - protein, 12 aa, Mycobacterium
EQSSLREGDTVT

SEQ ID NO: 256938 - protein, 8 aa, Mycobacterium
EQSYAAAN

SEQ ID NO: 256939 - protein, 5 aa, Mycobacterium
EQTAA

SEQ ID NO: 256940 - protein, 15 aa, Mycobacterium
EQTDAGPREAVRSTG

SEQ ID NO: 256941 - protein, 11 aa, Mycobacterium
EQTGKRDGEPA

SEQ ID NO: 256942 - protein, 7 aa, Mycobacterium
EQTGQKV

SEQ ID NO: 256943 - protein, 7 aa, Mycobacterium
EQTGTTI

SEQ ID NO: 256944 - protein, 12 aa, Mycobacterium
EQTNPMLPMSPS

SEQ ID NO: 256945 - protein, 5 aa, Mycobacterium
EQTPD

SEQ ID NO: 256946 - protein, 16 aa, Mycobacterium
EQTQTPTDRGQRLSGA

SEQ ID NO: 256947 - protein, 14 aa, Mycobacterium
EQTRSIDAGDEAPR

SEQ ID NO: 256948 - protein, 10 aa, Mycobacterium
EQTTNNATAM

SEQ ID NO: 256949 - protein, 4 aa, Mycobacterium
EQTY

SEQ ID NO: 256950 - protein, 8 aa, Mycobacterium
EQVDSPQC

SEQ ID NO: 256951 - protein, 6 aa, Mycobacterium
EQVERR

SEQ ID NO: 256952 - protein, 9 aa, Mycobacterium
EQVRDAGNR

SEQ ID NO: 256953 - protein, 7 aa, Mycobacterium
EQVTGAS

SEQ ID NO: 256954 - protein, 5 aa, Mycobacterium
EQVTR

SEQ ID NO: 256955 - protein, 8 aa, Mycobacterium
EQYPDPDR

SEQ ID NO: 256956 - protein, 12 aa, Mycobacterium
ERAADRTTDDAR

SEQ ID NO: 256957 - protein, 11 aa, Mycobacterium
ERAAEDERGRW

SEQ ID NO: 256958 - protein, 13 aa, Mycobacterium
ERAAQPANTEANL

SEQ ID NO: 256959 - protein, 16 aa, Mycobacterium
ERAARAVEAAAQQGQL

SEQ ID NO: 256960 - protein, 6 aa, Mycobacterium
ERAARR

SEQ ID NO: 256961 - protein, 4 aa, Mycobacterium
ERAD

SEQ ID NO: 256962 - protein, 10 aa, Mycobacterium
ERADEAEATR

SEQ ID NO: 256963 - protein, 23 aa, Mycobacterium
ERADQGEKRHRTSGSGGLGPQAS

SEQ ID NO: 256964 - protein, 6 aa, Mycobacterium
ERADRA

SEQ ID NO: 256965 - protein, 21 aa, Mycobacterium
ERAEEAASEAGARVDETRDRL

SEQ ID NO: 256966 - protein, 13 aa, Mycobacterium
ERAEGLAGTGSRF

SEQ ID NO: 256967 - protein, 9 aa, Mycobacterium
ERAEGPITA

SEQ ID NO: 256968 - protein, 14 aa, Mycobacterium
ERAENARRAEELVG

SEQ ID NO: 256969 - protein, 14 aa, Mycobacterium
ERAENGRRGAELVD

SEQ ID NO: 256970 - protein, 7 aa, Mycobacterium
ERAGAQA

SEQ ID NO: 256971 - protein, 10 aa, Mycobacterium
ERAGATAVAA

SEQ ID NO: 256972 - protein, 10 aa, Mycobacterium
ERAGDPSTRV

SEQ ID NO: 256973 - protein, 12 aa, Mycobacterium
ERAGEARASGKV

SEQ ID NO: 256974 - protein, 18 aa, Mycobacterium
ERAGGSRTLLRPGLLSST

SEQ ID NO: 256975 - protein, 8 aa, Mycobacterium
ERAGPGRF

SEQ ID NO: 256976 - protein, 13 aa, Mycobacterium
ERAGPGSAAPALG

SEQ ID NO: 256977 - protein, 5 aa, Mycobacterium
ERAGQ

SEQ ID NO: 256978 - protein, 5 aa, Mycobacterium
ERAGR

SEQ ID NO: 256979 - protein, 13 aa, Mycobacterium
ERAGTPSDSPERD

SEQ ID NO: 256980 - protein, 7 aa, Mycobacterium
ERAKRGP

SEQ ID NO: 256981 - protein, 11 aa, Mycobacterium
ERAPRIPGSGE

SEQ ID NO: 256982 - protein, 11 aa, Mycobacterium
ERAPTEEDERN

SEQ ID NO: 256983 - protein, 5 aa, Mycobacterium
ERAPV

SEQ ID NO: 256984 - protein, 19 aa, Mycobacterium
ERARRTADTYRGDNPRPLG

SEQ ID NO: 256985 - protein, 7 aa, Mycobacterium
ERARTGA

SEQ ID NO: 256986 - protein, 11 aa, Mycobacterium
ERASEDRAAGR

SEQ ID NO: 256987 - protein, 10 aa, Mycobacterium
ERASSAAPAE

SEQ ID NO: 256988 - protein, 9 aa, Mycobacterium
ERASSTAPA

SEQ ID NO: 256989 - protein, 10 aa, Mycobacterium
ERASSTAPAD

SEQ ID NO: 256990 - protein, 10 aa, Mycobacterium
ERATSRRAAT

SEQ ID NO: 256991 - protein, 8 aa, Mycobacterium
ERATTRRA

SEQ ID NO: 256992 - protein, 5 aa, Mycobacterium
ERAWQ

SEQ ID NO: 256993 - protein, 10 aa, Mycobacterium
ERDAGRIDDE

SEQ ID NO: 256994 - protein, 7 aa, Mycobacterium
ERDAPTE

SEQ ID NO: 256995 - protein, 5 aa, Mycobacterium
ERDDI

SEQ ID NO: 256996 - protein, 59 aa, Mycobacterium
ERDDSTPDEPTNDELGTDASADSPVESPDSATPPAEAPGSASSAEGATESVDTEQAPAT

SEQ ID NO: 256997 - protein, 10 aa, Mycobacterium
ERDEEDPDRL

SEQ ID NO: 256998 - protein, 5 aa, Mycobacterium
ERDGE

SEQ ID NO: 256999 - protein, 13 aa, Mycobacterium
ERDGPPDKPNWAT

SEQ ID NO: 257000 - protein, 7 aa, Mycobacterium
ERDGTAI

SEQ ID NO: 257001 - protein, 7 aa, Mycobacterium
ERDKARM

SEQ ID NO: 257002 - protein, 7 aa, Mycobacterium
ERDPHDP

SEQ ID NO: 257003 - protein, 5 aa, Mycobacterium
ERDPR

SEQ ID NO: 257004 - protein, 4 aa, Mycobacterium
ERDQ

SEQ ID NO: 257005 - protein, 6 aa, Mycobacterium
ERDQNA

SEQ ID NO: 257006 - protein, 4 aa, Mycobacterium
ERDR

SEQ ID NO: 257007 - protein, 12 aa, Mycobacterium
ERDRRLEHDQDH

SEQ ID NO: 257008 - protein, 14 aa, Mycobacterium
ERDSGTAEALDGAR

SEQ ID NO: 257009 - protein, 31 aa, Mycobacterium
ERDSKESAESEEPKESEEGKKTGKKSDADSS

SEQ ID NO: 257010 - protein, 6 aa, Mycobacterium
EREAEP

SEQ ID NO: 257011 - protein, 20 aa, Mycobacterium
EREAPTETIATAEQESPTEV

SEQ ID NO: 257012 - protein, 7 aa, Mycobacterium
EREATAD

SEQ ID NO: 257013 - protein, 13 aa, Mycobacterium
EREDHDLPGSEPV

SEQ ID NO: 257014 - protein, 9 aa, Mycobacterium
EREDKVDEI

SEQ ID NO: 257015 - protein, 7 aa, Mycobacterium
EREDPAK

SEQ ID NO: 257016 - protein, 7 aa, Mycobacterium
EREEGPL

SEQ ID NO: 257017 - protein, 7 aa, Mycobacterium
EREGFSQ

SEQ ID NO: 257018 - protein, 6 aa, Mycobacterium
EREHRS

SEQ ID NO: 257019 - protein, 9 aa, Mycobacterium
ERELPSSAP

SEQ ID NO: 257020 - protein, 9 aa, Mycobacterium
ERENKVDDV

SEQ ID NO: 257021 - protein, 21 aa, Mycobacterium
EREPEPAPQAEAAAAAEAPTL

SEQ ID NO: 257022 - protein, 13 aa, Mycobacterium
EREPEPIAPGNTV

SEQ ID NO: 257023 - protein, 6 aa, Mycobacterium
EREPRD

SEQ ID NO: 257024 - protein, 11 aa, Mycobacterium
EREPTPEDERN

SEQ ID NO: 257025 - protein, 7 aa, Mycobacterium
EREPVPP

SEQ ID NO: 257026 - protein, 4 aa, Mycobacterium
ERER

SEQ ID NO: 257027 - protein, 8 aa, Mycobacterium
ERESARFG

SEQ ID NO: 257028 - protein, 15 aa, Mycobacterium
ERESGGHDDSGQSRR

SEQ ID NO: 257029 - protein, 10 aa, Mycobacterium
ERESGPADNR

SEQ ID NO: 257030 - protein, 9 aa, Mycobacterium
ERESSVSTY

SEQ ID NO: 257031 - protein, 7 aa, Mycobacterium
ERETARF

SEQ ID NO: 257032 - protein, 4 aa, Mycobacterium
ERFE

SEQ ID NO: 257033 - protein, 4 aa, Mycobacterium
ERFG

SEQ ID NO: 257034 - protein, 6 aa, Mycobacterium
ERFGPG

SEQ ID NO: 257035 - protein, 4 aa, Mycobacterium
ERFN

SEQ ID NO: 257036 - protein, 11 aa, Mycobacterium
ERGAARDWPYG

SEQ ID NO: 257037 - protein, 6 aa, Mycobacterium
ERGAEQ

SEQ ID NO: 257038 - protein, 7 aa, Mycobacterium
ERGAGVP

SEQ ID NO: 257039 - protein, 7 aa, Mycobacterium
ERGALQT

SEQ ID NO: 257040 - protein, 7 aa, Mycobacterium
ERGDDAA

SEQ ID NO: 257041 - protein, 6 aa, Mycobacterium
ERGDDE

SEQ ID NO: 257042 - protein, 9 aa, Mycobacterium
ERGEGSMSK

SEQ ID NO: 257043 - protein, 6 aa, Mycobacterium
ERGEID

SEQ ID NO: 257044 - protein, 8 aa, Mycobacterium
ERGETTND

SEQ ID NO: 257045 - protein, 11 aa, Mycobacterium
ERGGNDDGTPV

SEQ ID NO: 257046 - protein, 10 aa, Mycobacterium
ERGGPATAAP

SEQ ID NO: 257047 - protein, 25 aa, Mycobacterium
ERGGTATFADPAEATAALGARTPED

SEQ ID NO: 257048 - protein, 7 aa, Mycobacterium
ERGGVGP

SEQ ID NO: 257049 - protein, 9 aa, Mycobacterium
ERGHPGATI

SEQ ID NO: 257050 - protein, 5 aa, Mycobacterium
ERGIA

SEQ ID NO: 257051 - protein, 4 aa, Mycobacterium
ERGL

SEQ ID NO: 257052 - protein, 7 aa, Mycobacterium
ERGLPEA

SEQ ID NO: 257053 - protein, 7 aa, Mycobacterium
ERGLRRG

SEQ ID NO: 257054 - protein, 12 aa, Mycobacterium
ERGPGAKPGGLG

SEQ ID NO: 257055 - protein, 13 aa, Mycobacterium
ERGPRLGPPPTMP

SEQ ID NO: 257056 - protein, 13 aa, Mycobacterium
ERGPRMQPPPAMP

SEQ ID NO: 257057 - protein, 5 aa, Mycobacterium
ERGPS

SEQ ID NO: 257058 - protein, 5 aa, Mycobacterium
ERGQA

SEQ ID NO: 257059 - protein, 7 aa, Mycobacterium
ERGRAVN

SEQ ID NO: 257060 - protein, 5 aa, Mycobacterium
ERGSA

SEQ ID NO: 257061 - protein, 14 aa, Mycobacterium
ERGSGSAPAKLPED

SEQ ID NO: 257062 - protein, 21 aa, Mycobacterium
ERGSHGDEGFGPPGSETSKSI

SEQ ID NO: 257063 - protein, 9 aa, Mycobacterium
ERGSPTWGP

SEQ ID NO: 257064 - protein, 10 aa, Mycobacterium
ERGSRDPRDV

SEQ ID NO: 257065 - protein, 5 aa, Mycobacterium
ERGTP

SEQ ID NO: 257066 - protein, 10 aa, Mycobacterium
ERGTPSSGGT

SEQ ID NO: 257067 - protein, 6 aa, Mycobacterium
ERGVAA

SEQ ID NO: 257068 - protein, 17 aa, Mycobacterium
ERGWSPARHRDDRVGRR

SEQ ID NO: 257069 - protein, 6 aa, Mycobacterium
ERGYPG

SEQ ID NO: 257070 - protein, 12 aa, Mycobacterium
ERHDGASREIDR

SEQ ID NO: 257071 - protein, 4 aa, Mycobacterium
ERHG

SEQ ID NO: 257072 - protein, 4 aa, Mycobacterium
ERHR

SEQ ID NO: 257073 - protein, 12 aa, Mycobacterium
ERIEEEREEADA

SEQ ID NO: 257074 - protein, 11 aa, Mycobacterium
ERIEPKGPKDI

SEQ ID NO: 257075 - protein, 4 aa, Mycobacterium
ERIG

SEQ ID NO: 257076 - protein, 13 aa, Mycobacterium
ERIPAPIGLARRP

SEQ ID NO: 257077 - protein, 5 aa, Mycobacterium
ERIRS

SEQ ID NO: 257078 - protein, 12 aa, Mycobacterium
ERKAADKALKAQ

SEQ ID NO: 257079 - protein, 18 aa, Mycobacterium
ERKARALKKAGNRQLRPK

SEQ ID NO: 257080 - protein, 4 aa, Mycobacterium
ERKR

SEQ ID NO: 257081 - protein, 11 aa, Mycobacterium
ERKRRAYSADE

SEQ ID NO: 257082 - protein, 6 aa, Mycobacterium
ERKSAI

SEQ ID NO: 257083 - protein, 4 aa, Mycobacterium
ERLA

SEQ ID NO: 257084 - protein, 10 aa, Mycobacterium
ERLAPGSQSR

SEQ ID NO: 257085 - protein, 6 aa, Mycobacterium
ERLDRS

SEQ ID NO: 257086 - protein, 6 aa, Mycobacterium
ERLGET

SEQ ID NO: 257087 - protein, 5 aa, Mycobacterium
ERLGP

SEQ ID NO: 257088 - protein, 7 aa, Mycobacterium
ERLGPGS

SEQ ID NO: 257089 - protein, 6 aa, Mycobacterium
ERLGTR

SEQ ID NO: 257090 - protein, 4 aa, Mycobacterium
ERLP

SEQ ID NO: 257091 - protein, 6 aa, Mycobacterium
ERLPAG

SEQ ID NO: 257092 - protein, 5 aa, Mycobacterium
ERLPK

SEQ ID NO: 257093 - protein, 5 aa, Mycobacterium
ERLRE

SEQ ID NO: 257094 - protein, 44 aa, Mycobacterium
ERLREEQATDERLREEQMPAPEHAGEESRGEQTDVPVSATAPTP

SEQ ID NO: 257095 - protein, 15 aa, Mycobacterium
ERLRPPPGYKDTTVP

SEQ ID NO: 257096 - protein, 7 aa, Mycobacterium
ERLSHST

SEQ ID NO: 257097 - protein, 10 aa, Mycobacterium
ERLTSKPATV

SEQ ID NO: 257098 - protein, 10 aa, Mycobacterium
ERMERREAQR

SEQ ID NO: 257099 - protein, 7 aa, Mycobacterium
ERMTGDG

SEQ ID NO: 257100 - protein, 12 aa, Mycobacterium
ERNAKARWNPKS

SEQ ID NO: 257101 - protein, 10 aa, Mycobacterium
ERNEDDPQRL

SEQ ID NO: 257102 - protein, 9 aa, Mycobacterium
ERNEEDPER

SEQ ID NO: 257103 - protein, 10 aa, Mycobacterium
ERNEQDPDRL

SEQ ID NO: 257104 - protein, 10 aa, Mycobacterium
ERNGERRSGK

SEQ ID NO: 257105 - protein, 6 aa, Mycobacterium
ERNPQL

SEQ ID NO: 257106 - protein, 7 aa, Mycobacterium
ERNQNHP

SEQ ID NO: 257107 - protein, 4 aa, Mycobacterium
ERNR

SEQ ID NO: 257108 - protein, 4 aa, Mycobacterium
ERNS

SEQ ID NO: 257109 - protein, 8 aa, Mycobacterium
ERNSGRLD

SEQ ID NO: 257110 - protein, 4 aa, Mycobacterium
ERPA

SEQ ID NO: 257111 - protein, 6 aa, Mycobacterium
ERPAEQ

SEQ ID NO: 257112 - protein, 14 aa, Mycobacterium
ERPANDSGSKDPSV

SEQ ID NO: 257113 - protein, 5 aa, Mycobacterium
ERPAQ

SEQ ID NO: 257114 - protein, 15 aa, Mycobacterium
ERPASHNRAAAVGAP

SEQ ID NO: 257115 - protein, 14 aa, Mycobacterium
ERPDGDGDGAGSIR

SEQ ID NO: 257116 - protein, 5 aa, Mycobacterium
ERPDL

SEQ ID NO: 257117 - protein, 8 aa, Mycobacterium
ERPDPSKP

SEQ ID NO: 257118 - protein, 5 aa, Mycobacterium
ERPDY

SEQ ID NO: 257119 - protein, 8 aa, Mycobacterium
ERPEADRP

SEQ ID NO: 257120 - protein, 7 aa, Mycobacterium
ERPEETE

SEQ ID NO: 257121 - protein, 5 aa, Mycobacterium
ERPEL

SEQ ID NO: 257122 - protein, 4 aa, Mycobacterium
ERPG

SEQ ID NO: 257123 - protein, 5 aa, Mycobacterium
ERPGE

SEQ ID NO: 257124 - protein, 13 aa, Mycobacterium
ERPGPATAAPALG

SEQ ID NO: 257125 - protein, 6 aa, Mycobacterium
ERPHPY

SEQ ID NO: 257126 - protein, 17 aa, Mycobacterium
ERPKWSDGTVTPSTPMT

SEQ ID NO: 257127 - protein, 7 aa, Mycobacterium
ERPLHGT

SEQ ID NO: 257128 - protein, 14 aa, Mycobacterium
ERPPGGSRVSPAAP

SEQ ID NO: 257129 - protein, 21 aa, Mycobacterium
ERPPNWPNGPAEEMAEDAPKR

SEQ ID NO: 257130 - protein, 12 aa, Mycobacterium
ERPPSRADARST

SEQ ID NO: 257131 - protein, 11 aa, Mycobacterium
ERPPTHDDERN

SEQ ID NO: 257132 - protein, 11 aa, Mycobacterium
ERPPTKADQRN

SEQ ID NO: 257133 - protein, 10 aa, Mycobacterium
ERPPTPQDQR

SEQ ID NO: 257134 - protein, 10 aa, Mycobacterium
ERPRSETGRI

SEQ ID NO: 257135 - protein, 5 aa, Mycobacterium
ERPTA

SEQ ID NO: 257136 - protein, 7 aa, Mycobacterium
ERPTMTN

SEQ ID NO: 257137 - protein, 8 aa, Mycobacterium
ERPTRARR

SEQ ID NO: 257138 - protein, 8 aa, Mycobacterium
ERPVPSKW

SEQ ID NO: 257139 - protein, 9 aa, Mycobacterium
ERQAEADSL

SEQ ID NO: 257140 - protein, 10 aa, Mycobacterium
ERQDRDGFEP

SEQ ID NO: 257141 - protein, 11 aa, Mycobacterium
ERQGSRPVTPA

SEQ ID NO: 257142 - protein, 10 aa, Mycobacterium
ERQKNQLADP

SEQ ID NO: 257143 - protein, 9 aa, Mycobacterium
ERQKTSSEL

SEQ ID NO: 257144 - protein, 6 aa, Mycobacterium
ERQLKD

SEQ ID NO: 257145 - protein, 11 aa, Mycobacterium
ERQPTPEDERN

SEQ ID NO: 257146 - protein, 10 aa, Mycobacterium
ERQPTSTDQR

SEQ ID NO: 257147 - protein, 64 aa, Mycobacterium
ERQQRDAGGQDQAEADEEPEDQQAVDYPDDEAGVDESFDDAEPEATEESEESAVSADRGGDDST

SEQ ID NO: 257148 - protein, 27 aa, Mycobacterium
ERQQREAASKDQDEAEQPADADGEADY

SEQ ID NO: 257149 - protein, 9 aa, Mycobacterium
ERQQSNPST

SEQ ID NO: 257150 - protein, 22 aa, Mycobacterium
ERQRAAQSRARRYRPGPPPGWE

SEQ ID NO: 257151 - protein, 15 aa, Mycobacterium
ERQRRDAGGAEPEHV

SEQ ID NO: 257152 - protein, 4 aa, Mycobacterium
ERQS

SEQ ID NO: 257153 - protein, 15 aa, Mycobacterium
ERQSKAQRVTGRERV

SEQ ID NO: 257154 - protein, 4 aa, Mycobacterium
ERQV

SEQ ID NO: 257155 - protein, 4 aa, Mycobacterium
ERRA

SEQ ID NO: 257156 - protein, 9 aa, Mycobacterium
ERRAAPRRR

SEQ ID NO: 257157 - protein, 19 aa, Mycobacterium
ERRADDRRVEQPDVGGGGA

SEQ ID NO: 257158 - protein, 5 aa, Mycobacterium
ERRAF

SEQ ID NO: 257159 - protein, 10 aa, Mycobacterium
ERRAGRGSGV

SEQ ID NO: 257160 - protein, 10 aa, Mycobacterium
ERRARGPDQL

SEQ ID NO: 257161 - protein, 20 aa, Mycobacterium
ERREATVPAPVAPAPPLPEG

SEQ ID NO: 257162 - protein, 15 aa, Mycobacterium
ERREGPEPVALVADT

SEQ ID NO: 257163 - protein, 13 aa, Mycobacterium
ERRELREDPAAEL

SEQ ID NO: 257164 - protein, 12 aa, Mycobacterium
ERRGEGGRATAQ

SEQ ID NO: 257165 - protein, 9 aa, Mycobacterium
ERRGGKTGF

SEQ ID NO: 257166 - protein, 7 aa, Mycobacterium
ERRGKPS

SEQ ID NO: 257167 - protein, 8 aa, Mycobacterium
ERRGTRRD

SEQ ID NO: 257168 - protein, 18 aa, Mycobacterium
ERRHGTSDTYPASLPGDD

SEQ ID NO: 257169 - protein, 12 aa, Mycobacterium
ERRKQEAQDALQ

SEQ ID NO: 257170 - protein, 11 aa, Mycobacterium
ERRKSQRELSQ

SEQ ID NO: 257171 - protein, 8 aa, Mycobacterium
ERRKTQRE

SEQ ID NO: 257172 - protein, 27 aa, Mycobacterium
ERRKTQRELSEERFRPGGHPTPMPNPG

SEQ ID NO: 257173 - protein, 27 aa, Mycobacterium
ERRKTQRELSQERFQPGGHPTPLPGPG

SEQ ID NO: 257174 - protein, 27 aa, Mycobacterium
ERRKTQRELSQERFQPGGHPTPMPSPG

SEQ ID NO: 257175 - protein, 4 aa, Mycobacterium
ERRP

SEQ ID NO: 257176 - protein, 5 aa, Mycobacterium
ERRQA

SEQ ID NO: 257177 - protein, 9 aa, Mycobacterium
ERRRADRAD

SEQ ID NO: 257178 - protein, 5 aa, Mycobacterium
ERRRE

SEQ ID NO: 257179 - protein, 15 aa, Mycobacterium
ERRRPPKDASPEDLA

SEQ ID NO: 257180 - protein, 5 aa, Mycobacterium
ERRRQ

SEQ ID NO: 257181 - protein, 9 aa, Mycobacterium
ERRRRSEAA

SEQ ID NO: 257182 - protein, 7 aa, Mycobacterium
ERRRSRR

SEQ ID NO: 257183 - protein, 5 aa, Mycobacterium
ERRSA

SEQ ID NO: 257184 - protein, 5 aa, Mycobacterium
ERRSD

SEQ ID NO: 257185 - protein, 4 aa, Mycobacterium
ERRV

SEQ ID NO: 257186 - protein, 7 aa, Mycobacterium
ERRYTGA

SEQ ID NO: 257187 - protein, 6 aa, Mycobacterium
ERSAAA

SEQ ID NO: 257188 - protein, 16 aa, Mycobacterium
ERSDEDSEAIAPGNTV

SEQ ID NO: 257189 - protein, 5 aa, Mycobacterium
ERSEE

SEQ ID NO: 257190 - protein, 7 aa, Mycobacterium
ERSGAFG

SEQ ID NO: 257191 - protein, 15 aa, Mycobacterium
ERSGQIGGGRGVNQP

SEQ ID NO: 257192 - protein, 5 aa, Mycobacterium
ERSKQ

SEQ ID NO: 257193 - protein, 7 aa, Mycobacterium
ERSPDIP

SEQ ID NO: 257194 - protein, 27 aa, Mycobacterium
ERSPRDPDLDEDADQRSAGERAPAEKM

SEQ ID NO: 257195 - protein, 5 aa, Mycobacterium
ERSQQ

SEQ ID NO: 257196 - protein, 4 aa, Mycobacterium
ERSR

SEQ ID NO: 257197 - protein, 41 aa, Mycobacterium
ERSRGARTSARGSGAAADGEADVDQAAEEVDEEYDSSRDTQ

SEQ ID NO: 257198 - protein, 8 aa, Mycobacterium
ERSRPGGP

SEQ ID NO: 257199 - protein, 8 aa, Mycobacterium
ERSRRHDI

SEQ ID NO: 257200 - protein, 5 aa, Mycobacterium
ERSRT

SEQ ID NO: 257201 - protein, 5 aa, Mycobacterium
ERSRY

SEQ ID NO: 257202 - protein, 8 aa, Mycobacterium
ERSSARTR

SEQ ID NO: 257203 - protein, 7 aa, Mycobacterium
ERSTGEP

SEQ ID NO: 257204 - protein, 7 aa, Mycobacterium
ERSWSET

SEQ ID NO: 257205 - protein, 16 aa, Mycobacterium
ERTARKRLPALLHRVA

SEQ ID NO: 257206 - protein, 6 aa, Mycobacterium
ERTEPA

SEQ ID NO: 257207 - protein, 9 aa, Mycobacterium
ERTEQTRAD

SEQ ID NO: 257208 - protein, 9 aa, Mycobacterium
ERTGAPIGV

SEQ ID NO: 257209 - protein, 7 aa, Mycobacterium
ERTGASG

SEQ ID NO: 257210 - protein, 6 aa, Mycobacterium
ERTGLT

SEQ ID NO: 257211 - protein, 7 aa, Mycobacterium
ERTGRGR

SEQ ID NO: 257212 - protein, 11 aa, Mycobacterium
ERTPKVGSHID

SEQ ID NO: 257213 - protein, 12 aa, Mycobacterium
ERTPTPDEARDT

SEQ ID NO: 257214 - protein, 8 aa, Mycobacterium
ERTQASTA

SEQ ID NO: 257215 - protein, 6 aa, Mycobacterium
ERTQTP

SEQ ID NO: 257216 - protein, 4 aa, Mycobacterium
ERTR

SEQ ID NO: 257217 - protein, 6 aa, Mycobacterium
ERTRAT

SEQ ID NO: 257218 - protein, 8 aa, Mycobacterium
ERTRGDWD

SEQ ID NO: 257219 - protein, 6 aa, Mycobacterium
ERTSRA

SEQ ID NO: 257220 - protein, 9 aa, Mycobacterium
ERTSTPAFS

SEQ ID NO: 257221 - protein, 5 aa, Mycobacterium
ERTTE

SEQ ID NO: 257222 - protein, 9 aa, Mycobacterium
ERVATDGEV

SEQ ID NO: 257223 - protein, 36 aa, Mycobacterium
ERVATDGTITAGRTALNTSAITGESVPVEAGPGDEV

SEQ ID NO: 257224 - protein, 12 aa, Mycobacterium
ERVDTGRSARGG

SEQ ID NO: 257225 - protein, 8 aa, Mycobacterium
ERVEANTS

SEQ ID NO: 257226 - protein, 10 aa, Mycobacterium
ERVEANTSTA

SEQ ID NO: 257227 - protein, 8 aa, Mycobacterium
ERVEDPER

SEQ ID NO: 257228 - protein, 4 aa, Mycobacterium
ERVG

SEQ ID NO: 257229 - protein, 6 aa, Mycobacterium
ERVGGD

SEQ ID NO: 257230 - protein, 5 aa, Mycobacterium
ERVGS

SEQ ID NO: 257231 - protein, 4 aa, Mycobacterium
ERVQ

SEQ ID NO: 257232 - protein, 10 aa, Mycobacterium
ERVSAATKAV

SEQ ID NO: 257233 - protein, 10 aa, Mycobacterium
ERVSNVSPPT

SEQ ID NO: 257234 - protein, 6 aa, Mycobacterium
ERWSAS

SEQ ID NO: 257235 - protein, 6 aa, Mycobacterium
ERYDRA

SEQ ID NO: 257236 - protein, 10 aa, Mycobacterium
ERYKDSKGDF

SEQ ID NO: 257237 - protein, 10 aa, Mycobacterium
ERYNDSKGDF

SEQ ID NO: 257238 - protein, 6 aa, Mycobacterium
ERYPDG

SEQ ID NO: 257239 - protein, 12 aa, Mycobacterium
ESAAAESGTATT

SEQ ID NO: 257240 - protein, 9 aa, Mycobacterium
ESAAGAASG

SEQ ID NO: 257241 - protein, 18 aa, Mycobacterium
ESAAGKGAELAETAHEAG

SEQ ID NO: 257242 - protein, 7 aa, Mycobacterium
ESAAGVQ

SEQ ID NO: 257243 - protein, 8 aa, Mycobacterium
ESAAPDRA

SEQ ID NO: 257244 - protein, 8 aa, Mycobacterium
ESAARGRS

SEQ ID NO: 257245 - protein, 38 aa, Mycobacterium
ESAARPTPPRALGRPPAAPGKSAVRTVGGSTRRDQARA

SEQ ID NO: 257246 - protein, 8 aa, Mycobacterium
ESAATGAS

SEQ ID NO: 257247 - protein, 6 aa, Mycobacterium
ESADLP

SEQ ID NO: 257248 - protein, 9 aa, Mycobacterium
ESADPDVDA

SEQ ID NO: 257249 - protein, 4 aa, Mycobacterium
ESAE

SEQ ID NO: 257250 - protein, 14 aa, Mycobacterium
ESAEAPPSGLGTAR

SEQ ID NO: 257251 - protein, 11 aa, Mycobacterium
ESAEQARAAGE

SEQ ID NO: 257252 - protein, 11 aa, Mycobacterium
ESAETPSYGGY

SEQ ID NO: 257253 - protein, 6 aa, Mycobacterium
ESAGAD

SEQ ID NO: 257254 - protein, 9 aa, Mycobacterium
ESAGPVGDT

SEQ ID NO: 257255 - protein, 8 aa, Mycobacterium
ESAGSGKL

SEQ ID NO: 257256 - protein, 5 aa, Mycobacterium
ESAGT

SEQ ID NO: 257257 - protein, 5 aa, Mycobacterium
ESAGY

SEQ ID NO: 257258 - protein, 7 aa, Mycobacterium
ESAIKGF

SEQ ID NO: 257259 - protein, 9 aa, Mycobacterium
ESAITGESA

SEQ ID NO: 257260 - protein, 9 aa, Mycobacterium
ESAKTTDLR

SEQ ID NO: 257261 - protein, 8 aa, Mycobacterium
ESALAAEP

SEQ ID NO: 257262 - protein, 15 aa, Mycobacterium
ESALTDPGLDRGDQD

SEQ ID NO: 257263 - protein, 16 aa, Mycobacterium
ESALTEPGLDRDDTDY

SEQ ID NO: 257264 - protein, 13 aa, Mycobacterium
ESALTGESAPVRK

SEQ ID NO: 257265 - protein, 9 aa, Mycobacterium
ESALTGESV

SEQ ID NO: 257266 - protein, 10 aa, Mycobacterium
ESAPALADSA

SEQ ID NO: 257267 - protein, 12 aa, Mycobacterium
ESAPAQQAGRLS

SEQ ID NO: 257268 - protein, 7 aa, Mycobacterium
ESAQKTR

SEQ ID NO: 257269 - protein, 10 aa, Mycobacterium
ESARADELRD

SEQ ID NO: 257270 - protein, 16 aa, Mycobacterium
ESARAGTLAPTLESSE

SEQ ID NO: 257271 - protein, 7 aa, Mycobacterium
ESARKTR

SEQ ID NO: 257272 - protein, 16 aa, Mycobacterium
ESARRKPYKAPSDGSL

SEQ ID NO: 257273 - protein, 18 aa, Mycobacterium
ESARSSASWAGDRYRRSK

SEQ ID NO: 257274 - protein, 16 aa, Mycobacterium
ESASEGLLDQEEGTRL

SEQ ID NO: 257275 - protein, 7 aa, Mycobacterium
ESASHDP

SEQ ID NO: 257276 - protein, 7 aa, Mycobacterium
ESASPDR

SEQ ID NO: 257277 - protein, 8 aa, Mycobacterium
ESASQHPI

SEQ ID NO: 257278 - protein, 14 aa, Mycobacterium
ESATPAEKAKKADH

SEQ ID NO: 257279 - protein, 10 aa, Mycobacterium
ESATPEQRAE

SEQ ID NO: 257280 - protein, 4 aa, Mycobacterium
ESAV

SEQ ID NO: 257281 - protein, 4 aa, Mycobacterium
ESCG

SEQ ID NO: 257282 - protein, 9 aa, Mycobacterium
ESCQRGPNQ

SEQ ID NO: 257283 - protein, 6 aa, Mycobacterium
ESDAEI

SEQ ID NO: 257284 - protein, 12 aa, Mycobacterium
ESDANPATEVGQ

SEQ ID NO: 257285 - protein, 12 aa, Mycobacterium
ESDANPSTEVGQ

SEQ ID NO: 257286 - protein, 6 aa, Mycobacterium
ESDARG

SEQ ID NO: 257287 - protein, 10 aa, Mycobacterium
ESDDEFSTTE

SEQ ID NO: 257288 - protein, 9 aa, Mycobacterium
ESDEPLNAK

SEQ ID NO: 257289 - protein, 10 aa, Mycobacterium
ESDEQADDPA

SEQ ID NO: 257290 - protein, 11 aa, Mycobacterium
ESDGDGTTVES

SEQ ID NO: 257291 - protein, 12 aa, Mycobacterium
ESDGDGTTVESE

SEQ ID NO: 257292 - protein, 12 aa, Mycobacterium
ESDLTGEASGPW

SEQ ID NO: 257293 - protein, 7 aa, Mycobacterium
ESDPQAA

SEQ ID NO: 257294 - protein, 10 aa, Mycobacterium
ESDRESGARQ

SEQ ID NO: 257295 - protein, 7 aa, Mycobacterium
ESDSDNT

SEQ ID NO: 257296 - protein, 9 aa, Mycobacterium
ESDSFGVGG

SEQ ID NO: 257297 - protein, 7 aa, Mycobacterium
ESDSNSV

SEQ ID NO: 257298 - protein, 9 aa, Mycobacterium
ESDTGSAAE

SEQ ID NO: 257299 - protein, 6 aa, Mycobacterium
ESDTVA

SEQ ID NO: 257300 - protein, 7 aa, Mycobacterium
ESEAAPV

SEQ ID NO: 257301 - protein, 26 aa, Mycobacterium
ESEAESAADEAEAAQAEGESDIGEPE

SEQ ID NO: 257302 - protein, 5 aa, Mycobacterium
ESEAR

SEQ ID NO: 257303 - protein, 15 aa, Mycobacterium
ESEDVDGRLAPEPEL

SEQ ID NO: 257304 - protein, 15 aa, Mycobacterium
ESEEDREPIPRPPAR

SEQ ID NO: 257305 - protein, 33 aa, Mycobacterium
ESEFDDSATSVIPASDEWDDEAPADDSPAPARG

SEQ ID NO: 257306 - protein, 16 aa, Mycobacterium
ESEHHGDGDGRESARA

SEQ ID NO: 257307 - protein, 5 aa, Mycobacterium
ESEHR

SEQ ID NO: 257308 - protein, 6 aa, Mycobacterium
ESEHTG

SEQ ID NO: 257309 - protein, 9 aa, Mycobacterium
ESEKPAPWY

SEQ ID NO: 257310 - protein, 4 aa, Mycobacterium
ESEL

SEQ ID NO: 257311 - protein, 11 aa, Mycobacterium
ESELSKRQAEL

SEQ ID NO: 257312 - protein, 46 aa, Mycobacterium
ESENVSSAAVAKAKTDFATAENAGQPERQKIESASRPNNYTVGVGN

SEQ ID NO: 257313 - protein, 20 aa, Mycobacterium
ESEPDTEDQPVYERRSPVET

SEQ ID NO: 257314 - protein, 7 aa, Mycobacterium
ESEPVLT

SEQ ID NO: 257315 - protein, 4 aa, Mycobacterium
ESER

SEQ ID NO: 257316 - protein, 22 aa, Mycobacterium
ESERGRASFTTEGTTGLPAGGE

SEQ ID NO: 257317 - protein, 13 aa, Mycobacterium
ESESDYEGSEDYL

SEQ ID NO: 257318 - protein, 8 aa, Mycobacterium
ESESEDRY

SEQ ID NO: 257319 - protein, 8 aa, Mycobacterium
ESESEGLL

SEQ ID NO: 257320 - protein, 6 aa, Mycobacterium
ESESRR

SEQ ID NO: 257321 - protein, 5 aa, Mycobacterium
ESEST

SEQ ID NO: 257322 - protein, 9 aa, Mycobacterium
ESEVPPAPA

SEQ ID NO: 257323 - protein, 18 aa, Mycobacterium
ESFDPEHPEPDQEADEGT

SEQ ID NO: 257324 - protein, 9 aa, Mycobacterium
ESFEPQYES

SEQ ID NO: 257325 - protein, 10 aa, Mycobacterium
ESFEPQYESL

SEQ ID NO: 257326 - protein, 19 aa, Mycobacterium
ESFGASADNNAKDAVPYNP

SEQ ID NO: 257327 - protein, 21 aa, Mycobacterium
ESGAAESGADPHDDRDDDPNS

SEQ ID NO: 257328 - protein, 9 aa, Mycobacterium
ESGAPGAAD

SEQ ID NO: 257329 - protein, 12 aa, Mycobacterium
ESGATGPAAEPW

SEQ ID NO: 257330 - protein, 4 aa, Mycobacterium
ESGD

SEQ ID NO: 257331 - protein, 4 aa, Mycobacterium
ESGE

SEQ ID NO: 257332 - protein, 8 aa, Mycobacterium
ESGFNDAP

SEQ ID NO: 257333 - protein, 10 aa, Mycobacterium
ESGGEVNPYT

SEQ ID NO: 257334 - protein, 15 aa, Mycobacterium
ESGHAGGGAVDARGT

SEQ ID NO: 257335 - protein, 16 aa, Mycobacterium
ESGHAGGGAVDARGTA

SEQ ID NO: 257336 - protein, 5 aa, Mycobacterium
ESGKS

SEQ ID NO: 257337 - protein, 20 aa, Mycobacterium
ESGLPPDPKPQPASVGMTQS

SEQ ID NO: 257338 - protein, 6 aa, Mycobacterium
ESGMST

SEQ ID NO: 257339 - protein, 7 aa, Mycobacterium
ESGMTEP

SEQ ID NO: 257340 - protein, 5 aa, Mycobacterium
ESGQI

SEQ ID NO: 257341 - protein, 7 aa, Mycobacterium
ESGQPVV

SEQ ID NO: 257342 - protein, 10 aa, Mycobacterium
ESGQSGEPAF

SEQ ID NO: 257343 - protein, 7 aa, Mycobacterium
ESGREHK

SEQ ID NO: 257344 - protein, 9 aa, Mycobacterium
ESGREHKGE

SEQ ID NO: 257345 - protein, 132 aa, Mycobacterium
ESGRETGDDDADEAPPRKARAGRGAASSSRARRTARGDRSASRSARAHSRRTRETLDDAGEAGERRPNRRGSSAARDYDTAEPPRRSRRRPRPDGDLDPRGQSPRESRREPRTRRSPYERPYEQPRSSRFDG

SEQ ID NO: 257346 - protein, 4 aa, Mycobacterium
ESGS

SEQ ID NO: 257347 - protein, 4 aa, Mycobacterium
ESGV

SEQ ID NO: 257348 - protein, 6 aa, Mycobacterium
ESGVDI

SEQ ID NO: 257349 - protein, 5 aa, Mycobacterium
ESGVQ

SEQ ID NO: 257350 - protein, 4 aa, Mycobacterium
ESGW

SEQ ID NO: 257351 - protein, 5 aa, Mycobacterium
ESGYA

SEQ ID NO: 257352 - protein, 13 aa, Mycobacterium
ESHAEPPSRSAAL

SEQ ID NO: 257353 - protein, 4 aa, Mycobacterium
ESHM

SEQ ID NO: 257354 - protein, 26 aa, Mycobacterium
ESHPGRTQGGPGAVTLPQPQARSHPV

SEQ ID NO: 257355 - protein, 8 aa, Mycobacterium
ESHQAEEQ

SEQ ID NO: 257356 - protein, 5 aa, Mycobacterium
ESHSP

SEQ ID NO: 257357 - protein, 7 aa, Mycobacterium
ESHSSAW

SEQ ID NO: 257358 - protein, 6 aa, Mycobacterium
ESHSTA

SEQ ID NO: 257359 - protein, 7 aa, Mycobacterium
ESHSTSW

SEQ ID NO: 257360 - protein, 6 aa, Mycobacterium
ESHTTS

SEQ ID NO: 257361 - protein, 6 aa, Mycobacterium
ESIDDN

SEQ ID NO: 257362 - protein, 7 aa, Mycobacterium
ESIPKNV

SEQ ID NO: 257363 - protein, 8 aa, Mycobacterium
ESKAGLNT

SEQ ID NO: 257364 - protein, 8 aa, Mycobacterium
ESKPMGKG

SEQ ID NO: 257365 - protein, 8 aa, Mycobacterium
ESKSQTMR

SEQ ID NO: 257366 - protein, 4 aa, Mycobacterium
ESLA

SEQ ID NO: 257367 - protein, 9 aa, Mycobacterium
ESLDDPPEE

SEQ ID NO: 257368 - protein, 11 aa, Mycobacterium
ESLDSIDETTQ

SEQ ID NO: 257369 - protein, 6 aa, Mycobacterium
ESLETH

SEQ ID NO: 257370 - protein, 7 aa, Mycobacterium
ESLGAGS

SEQ ID NO: 257371 - protein, 8 aa, Mycobacterium
ESLNPSAA

SEQ ID NO: 257372 - protein, 4 aa, Mycobacterium
ESLP

SEQ ID NO: 257373 - protein, 8 aa, Mycobacterium
ESLPARPD

SEQ ID NO: 257374 - protein, 12 aa, Mycobacterium
ESLPTGHAAPQV

SEQ ID NO: 257375 - protein, 7 aa, Mycobacterium
ESLPTRP

SEQ ID NO: 257376 - protein, 7 aa, Mycobacterium
ESLPVGK

SEQ ID NO: 257377 - protein, 13 aa, Mycobacterium
ESLPVSKAPDSKV

SEQ ID NO: 257378 - protein, 12 aa, Mycobacterium
ESLRAAPDGGLG

SEQ ID NO: 257379 - protein, 5 aa, Mycobacterium
ESLSK

SEQ ID NO: 257380 - protein, 7 aa, Mycobacterium
ESLTDDT

SEQ ID NO: 257381 - protein, 12 aa, Mycobacterium
ESLTKEARPVSG

SEQ ID NO: 257382 - protein, 13 aa, Mycobacterium
ESMASNDVPPNRL

SEQ ID NO: 257383 - protein, 6 aa, Mycobacterium
ESMDGN

SEQ ID NO: 257384 - protein, 5 aa, Mycobacterium
ESMPS

SEQ ID NO: 257385 - protein, 10 aa, Mycobacterium
ESNGAWEPDQ

SEQ ID NO: 257386 - protein, 5 aa, Mycobacterium
ESNPI

SEQ ID NO: 257387 - protein, 7 aa, Mycobacterium
ESNRRQV

SEQ ID NO: 257388 - protein, 10 aa, Mycobacterium
ESNRTPAEVA

SEQ ID NO: 257389 - protein, 6 aa, Mycobacterium
ESNTDS

SEQ ID NO: 257390 - protein, 8 aa, Mycobacterium
ESPAANRR

SEQ ID NO: 257391 - protein, 9 aa, Mycobacterium
ESPAPSGIR

SEQ ID NO: 257392 - protein, 19 aa, Mycobacterium
ESPAPSVSQVGRPSPIVRP

SEQ ID NO: 257393 - protein, 5 aa, Mycobacterium
ESPAY

SEQ ID NO: 257394 - protein, 4 aa, Mycobacterium
ESPC

SEQ ID NO: 257395 - protein, 5 aa, Mycobacterium
ESPEF

SEQ ID NO: 257396 - protein, 7 aa, Mycobacterium
ESPEFDR

SEQ ID NO: 257397 - protein, 7 aa, Mycobacterium
ESPEFNR

SEQ ID NO: 257398 - protein, 18 aa, Mycobacterium
ESPEFVDTKEAGKVVSNP

SEQ ID NO: 257399 - protein, 7 aa, Mycobacterium
ESPEGRS

SEQ ID NO: 257400 - protein, 5 aa, Mycobacterium
ESPGF

SEQ ID NO: 257401 - protein, 5 aa, Mycobacterium
ESPKV

SEQ ID NO: 257402 - protein, 8 aa, Mycobacterium
ESPLGAEA

SEQ ID NO: 257403 - protein, 6 aa, Mycobacterium
ESPMYG

SEQ ID NO: 257404 - protein, 7 aa, Mycobacterium
ESPPAGT

SEQ ID NO: 257405 - protein, 54 aa, Mycobacterium
ESPPPAEVTQPAEASQQAEPNQQGESDQPETADPAAKPPATRRPTSTTDAYADS

SEQ ID NO: 257406 - protein, 7 aa, Mycobacterium
ESPPPLA

SEQ ID NO: 257407 - protein, 6 aa, Mycobacterium
ESPRGE

SEQ ID NO: 257408 - protein, 6 aa, Mycobacterium
ESPRPG

SEQ ID NO: 257409 - protein, 5 aa, Mycobacterium
ESPSA

SEQ ID NO: 257410 - protein, 11 aa, Mycobacterium
ESPSAAESDTA

SEQ ID NO: 257411 - protein, 7 aa, Mycobacterium
ESPSREA

SEQ ID NO: 257412 - protein, 7 aa, Mycobacterium
ESPTAVQ

SEQ ID NO: 257413 - protein, 40 aa, Mycobacterium
ESPTEPDAPAPPRPAPARPVAPPSDDTDTDTADRFGPVDT

SEQ ID NO: 257414 - protein, 6 aa, Mycobacterium
ESPTLG

SEQ ID NO: 257415 - protein, 7 aa, Mycobacterium
ESPVDSG

SEQ ID NO: 257416 - protein, 6 aa, Mycobacterium
ESPVTD

SEQ ID NO: 257417 - protein, 11 aa, Mycobacterium
ESQGNNSAAMG

SEQ ID NO: 257418 - protein, 6 aa, Mycobacterium
ESQKRA

SEQ ID NO: 257419 - protein, 4 aa, Mycobacterium
ESQL

SEQ ID NO: 257420 - protein, 17 aa, Mycobacterium
ESQLSTALSARDEAEHA

SEQ ID NO: 257421 - protein, 7 aa, Mycobacterium
ESQPDTV

SEQ ID NO: 257422 - protein, 8 aa, Mycobacterium
ESQPPDGV

SEQ ID NO: 257423 - protein, 14 aa, Mycobacterium
ESQQSEISVMETLQ

SEQ ID NO: 257424 - protein, 9 aa, Mycobacterium
ESQRQQRAW

SEQ ID NO: 257425 - protein, 11 aa, Mycobacterium
ESRAAGGNQTI

SEQ ID NO: 257426 - protein, 10 aa, Mycobacterium
ESRAPGRRRV

SEQ ID NO: 257427 - protein, 11 aa, Mycobacterium
ESRARAASRDR

SEQ ID NO: 257428 - protein, 11 aa, Mycobacterium
ESRASGRRRVP

SEQ ID NO: 257429 - protein, 11 aa, Mycobacterium
ESRATTGEGTQ

SEQ ID NO: 257430 - protein, 45 aa, Mycobacterium
ESRCAPTRHGHSEAERNTHEAARRGRHELPADRPRPEIGPVPRTG

SEQ ID NO: 257431 - protein, 57 aa, Mycobacterium
ESRDENRGTATQHGHSKTTPKSHATAKHGRHEMPADRSRPDRGPRETQDSTGARRGR

SEQ ID NO: 257432 - protein, 9 aa, Mycobacterium
ESRDPDPTE

SEQ ID NO: 257433 - protein, 11 aa, Mycobacterium
ESRDPSASRRL

SEQ ID NO: 257434 - protein, 8 aa, Mycobacterium
ESRDRQAR

SEQ ID NO: 257435 - protein, 8 aa, Mycobacterium
ESRDRQSR

SEQ ID NO: 257436 - protein, 12 aa, Mycobacterium
ESRERAESKNRE

SEQ ID NO: 257437 - protein, 8 aa, Mycobacterium
ESRERQAR

SEQ ID NO: 257438 - protein, 5 aa, Mycobacterium
ESRGG

SEQ ID NO: 257439 - protein, 10 aa, Mycobacterium
ESRGRGNISA

SEQ ID NO: 257440 - protein, 7 aa, Mycobacterium
ESRGRRF

SEQ ID NO: 257441 - protein, 5 aa, Mycobacterium
ESRKP

SEQ ID NO: 257442 - protein, 9 aa, Mycobacterium
ESRNGSTRV

SEQ ID NO: 257443 - protein, 7 aa, Mycobacterium
ESRPTVA

SEQ ID NO: 257444 - protein, 15 aa, Mycobacterium
ESRQRRAESAELSAS

SEQ ID NO: 257445 - protein, 4 aa, Mycobacterium
ESRR

SEQ ID NO: 257446 - protein, 8 aa, Mycobacterium
ESRRAVPT

SEQ ID NO: 257447 - protein, 6 aa, Mycobacterium
ESRSDS

SEQ ID NO: 257448 - protein, 6 aa, Mycobacterium
ESRSQA

SEQ ID NO: 257449 - protein, 6 aa, Mycobacterium
ESRTAL

SEQ ID NO: 257450 - protein, 26 aa, Mycobacterium
ESRTPNASARSSGVGYEGGAPSHTVE

SEQ ID NO: 257451 - protein, 19 aa, Mycobacterium
ESRTQGTESAAPAAQNSDV

SEQ ID NO: 257452 - protein, 21 aa, Mycobacterium
ESSAYQDATEGAQPSGGRRQQ

SEQ ID NO: 257453 - protein, 21 aa, Mycobacterium
ESSAYQSAHDDAHAGDQGRQQ

SEQ ID NO: 257454 - protein, 10 aa, Mycobacterium
ESSDAQTVSA

SEQ ID NO: 257455 - protein, 8 aa, Mycobacterium
ESSDTPQV

SEQ ID NO: 257456 - protein, 10 aa, Mycobacterium
ESSEAETVSA

SEQ ID NO: 257457 - protein, 148 aa, Mycobacterium
ESSESAADGSEPTPAGYEAPSIEHTPSAPDTSSDDTPPHGYTPPPAYNPPPSSTPPMYGTPPNTGYPAPGDFTSPPYPPPPAGYGAQNYPPPGYGAQGYGAQGYGPQGYGAQSYGAQGYPSPYGAYPGGYPGADYGYGTPAQQGSNGM

SEQ ID NO: 257458 - protein, 9 aa, Mycobacterium
ESSGGIQPY

SEQ ID NO: 257459 - protein, 6 aa, Mycobacterium
ESSKLT

SEQ ID NO: 257460 - protein, 11 aa, Mycobacterium
ESSKTYREVRE

SEQ ID NO: 257461 - protein, 11 aa, Mycobacterium
ESSPGPDQPKF

SEQ ID NO: 257462 - protein, 11 aa, Mycobacterium
ESSPGPGQPKF

SEQ ID NO: 257463 - protein, 10 aa, Mycobacterium
ESSPRGIAAQ

SEQ ID NO: 257464 - protein, 6 aa, Mycobacterium
ESSPRH

SEQ ID NO: 257465 - protein, 7 aa, Mycobacterium
ESSPSHI

SEQ ID NO: 257466 - protein, 5 aa, Mycobacterium
ESSPT

SEQ ID NO: 257467 - protein, 7 aa, Mycobacterium
ESSPTHI

SEQ ID NO: 257468 - protein, 20 aa, Mycobacterium
ESSRGYAASIGTTGTSNGHP

SEQ ID NO: 257469 - protein, 22 aa, Mycobacterium
ESSRGYSAAIGTAAGEASAGGP

SEQ ID NO: 257470 - protein, 24 aa, Mycobacterium
ESSRSAQAQLDEQTAELRRSNTEL

SEQ ID NO: 257471 - protein, 4 aa, Mycobacterium
ESST

SEQ ID NO: 257472 - protein, 10 aa, Mycobacterium
ESSTDPLTGA

SEQ ID NO: 257473 - protein, 6 aa, Mycobacterium
ESSTIR

SEQ ID NO: 257474 - protein, 12 aa, Mycobacterium
ESSVEAETAPYV

SEQ ID NO: 257475 - protein, 8 aa, Mycobacterium
ESSVPQSP

SEQ ID NO: 257476 - protein, 20 aa, Mycobacterium
ESSVRSGLAPAERDSAGQPV

SEQ ID NO: 257477 - protein, 10 aa, Mycobacterium
ESSVSSYREV

SEQ ID NO: 257478 - protein, 9 aa, Mycobacterium
ESTALNERI

SEQ ID NO: 257479 - protein, 6 aa, Mycobacterium
ESTDYP

SEQ ID NO: 257480 - protein, 12 aa, Mycobacterium
ESTETAVTPVRI

SEQ ID NO: 257481 - protein, 5 aa, Mycobacterium
ESTGA

SEQ ID NO: 257482 - protein, 7 aa, Mycobacterium
ESTGEPH

SEQ ID NO: 257483 - protein, 6 aa, Mycobacterium
ESTGFP

SEQ ID NO: 257484 - protein, 9 aa, Mycobacterium
ESTGNPGKF

SEQ ID NO: 257485 - protein, 9 aa, Mycobacterium
ESTGSGTMH

SEQ ID NO: 257486 - protein, 10 aa, Mycobacterium
ESTGSTLATG

SEQ ID NO: 257487 - protein, 11 aa, Mycobacterium
ESTGSTYATGE

SEQ ID NO: 257488 - protein, 5 aa, Mycobacterium
ESTPH

SEQ ID NO: 257489 - protein, 7 aa, Mycobacterium
ESTQPAI

SEQ ID NO: 257490 - protein, 7 aa, Mycobacterium
ESTQPAV

SEQ ID NO: 257491 - protein, 4 aa, Mycobacterium
ESTR

SEQ ID NO: 257492 - protein, 7 aa, Mycobacterium
ESTRADW

SEQ ID NO: 257493 - protein, 5 aa, Mycobacterium
ESTRD

SEQ ID NO: 257494 - protein, 8 aa, Mycobacterium
ESTRRAAG

SEQ ID NO: 257495 - protein, 7 aa, Mycobacterium
ESTRRDW

SEQ ID NO: 257496 - protein, 8 aa, Mycobacterium
ESTSGSFQ

SEQ ID NO: 257497 - protein, 5 aa, Mycobacterium
ESVAN

SEQ ID NO: 257498 - protein, 5 aa, Mycobacterium
ESVAP

SEQ ID NO: 257499 - protein, 6 aa, Mycobacterium
ESVAPL

SEQ ID NO: 257500 - protein, 7 aa, Mycobacterium
ESVASGP

SEQ ID NO: 257501 - protein, 14 aa, Mycobacterium
ESVDNIDEATSQLG

SEQ ID NO: 257502 - protein, 27 aa, Mycobacterium
ESVGGPQGDLGFPTSSEDEGGLGPNSR

SEQ ID NO: 257503 - protein, 5 aa, Mycobacterium
ESVPA

SEQ ID NO: 257504 - protein, 8 aa, Mycobacterium
ESVPDSRR

SEQ ID NO: 257505 - protein, 8 aa, Mycobacterium
ESVPVEKS

SEQ ID NO: 257506 - protein, 5 aa, Mycobacterium
ESVRA

SEQ ID NO: 257507 - protein, 16 aa, Mycobacterium
ESVRQETGEPLPEPHG

SEQ ID NO: 257508 - protein, 7 aa, Mycobacterium
ESVSASP

SEQ ID NO: 257509 - protein, 13 aa, Mycobacterium
ESVSGKRPFTGDG

SEQ ID NO: 257510 - protein, 10 aa, Mycobacterium
ESVTAGQDRE

SEQ ID NO: 257511 - protein, 7 aa, Mycobacterium
ESVTGKP

SEQ ID NO: 257512 - protein, 8 aa, Mycobacterium
ESVTPSAL

SEQ ID NO: 257513 - protein, 11 aa, Mycobacterium
ESYAPSAFDDD

SEQ ID NO: 257514 - protein, 10 aa, Mycobacterium
ESYDPRTGAW

SEQ ID NO: 257515 - protein, 16 aa, Mycobacterium
ESYDPRTGAWQTGPPL

SEQ ID NO: 257516 - protein, 7 aa, Mycobacterium
ESYGNAE

SEQ ID NO: 257517 - protein, 11 aa, Mycobacterium
ESYNSSAGPVG

SEQ ID NO: 257518 - protein, 6 aa, Mycobacterium
ESYRDE

SEQ ID NO: 257519 - protein, 4 aa, Mycobacterium
ESYT

SEQ ID NO: 257520 - protein, 28 aa, Mycobacterium
ETAAAKSGGGGAASGSRHGMNDGWVTRK

SEQ ID NO: 257521 - protein, 10 aa, Mycobacterium
ETAADIETAR

SEQ ID NO: 257522 - protein, 17 aa, Mycobacterium
ETAAGAGRRVREPAGES

SEQ ID NO: 257523 - protein, 11 aa, Mycobacterium
ETAAGPRAPDY

SEQ ID NO: 257524 - protein, 10 aa, Mycobacterium
ETAAPEDEYP

SEQ ID NO: 257525 - protein, 11 aa, Mycobacterium
ETAASLDSSAL

SEQ ID NO: 257526 - protein, 7 aa, Mycobacterium
ETADGLR

SEQ ID NO: 257527 - protein, 10 aa, Mycobacterium
ETADTAEERA

SEQ ID NO: 257528 - protein, 12 aa, Mycobacterium
ETADTVDTSTAL

SEQ ID NO: 257529 - protein, 17 aa, Mycobacterium
ETAEVADAAGVRPVTGP

SEQ ID NO: 257530 - protein, 45 aa, Mycobacterium
ETAGALPVGDSAQMAEPTPLSVDGRSAVDEPAVDDDTADESELDT

SEQ ID NO: 257531 - protein, 6 aa, Mycobacterium
ETAGGQ

SEQ ID NO: 257532 - protein, 8 aa, Mycobacterium
ETAGSRRA

SEQ ID NO: 257533 - protein, 5 aa, Mycobacterium
ETAHT

SEQ ID NO: 257534 - protein, 11 aa, Mycobacterium
ETAIPSNVTAT

SEQ ID NO: 257535 - protein, 11 aa, Mycobacterium
ETANAAARTWT

SEQ ID NO: 257536 - protein, 16 aa, Mycobacterium
ETANRADQETSASTRV

SEQ ID NO: 257537 - protein, 10 aa, Mycobacterium
ETAPPPSDFK

SEQ ID NO: 257538 - protein, 7 aa, Mycobacterium
ETAPPRW

SEQ ID NO: 257539 - protein, 12 aa, Mycobacterium
ETAPRELRAAAR

SEQ ID NO: 257540 - protein, 4 aa, Mycobacterium
ETAQ

SEQ ID NO: 257541 - protein, 7 aa, Mycobacterium
ETAQPAI

SEQ ID NO: 257542 - protein, 5 aa, Mycobacterium
ETARA

SEQ ID NO: 257543 - protein, 7 aa, Mycobacterium
ETARPHY

SEQ ID NO: 257544 - protein, 11 aa, Mycobacterium
ETARRPTCTEA

SEQ ID NO: 257545 - protein, 5 aa, Mycobacterium
ETART

SEQ ID NO: 257546 - protein, 10 aa, Mycobacterium
ETASELPDGQ

SEQ ID NO: 257547 - protein, 5 aa, Mycobacterium
ETAST

SEQ ID NO: 257548 - protein, 4 aa, Mycobacterium
ETAT

SEQ ID NO: 257549 - protein, 14 aa, Mycobacterium
ETATGEDDQKVQTT

SEQ ID NO: 257550 - protein, 9 aa, Mycobacterium
ETATPTPIS

SEQ ID NO: 257551 - protein, 5 aa, Mycobacterium
ETCGP

SEQ ID NO: 257552 - protein, 13 aa, Mycobacterium
ETCTGDSARRAGN

SEQ ID NO: 257553 - protein, 9 aa, Mycobacterium
ETDAAARGR

SEQ ID NO: 257554 - protein, 28 aa, Mycobacterium
ETDAAERAAAKSGTDRPRFERRSPVETT

SEQ ID NO: 257555 - protein, 7 aa, Mycobacterium
ETDADAA

SEQ ID NO: 257556 - protein, 17 aa, Mycobacterium
ETDAEGRPRVQYDGEPA

SEQ ID NO: 257557 - protein, 26 aa, Mycobacterium
ETDAGDAAQGAVELSGSDPDRATGGV

SEQ ID NO: 257558 - protein, 13 aa, Mycobacterium
ETDARVKPANRGL

SEQ ID NO: 257559 - protein, 14 aa, Mycobacterium
ETDARVKPSARGLH

SEQ ID NO: 257560 - protein, 14 aa, Mycobacterium
ETDARVKPSSRGLH

SEQ ID NO: 257561 - protein, 5 aa, Mycobacterium
ETDNE

SEQ ID NO: 257562 - protein, 9 aa, Mycobacterium
ETDNGTTSV

SEQ ID NO: 257563 - protein, 7 aa, Mycobacterium
ETDPDAA

SEQ ID NO: 257564 - protein, 25 aa, Mycobacterium
ETDPDAAPAGATDRPRYARRSPVET

SEQ ID NO: 257565 - protein, 8 aa, Mycobacterium
ETDPVATE

SEQ ID NO: 257566 - protein, 7 aa, Mycobacterium
ETDPVGR

SEQ ID NO: 257567 - protein, 11 aa, Mycobacterium
ETDQPLGDDAH

SEQ ID NO: 257568 - protein, 8 aa, Mycobacterium
ETDRAATT

SEQ ID NO: 257569 - protein, 9 aa, Mycobacterium
ETDRAATTL

SEQ ID NO: 257570 - protein, 6 aa, Mycobacterium
ETDRDI

SEQ ID NO: 257571 - protein, 10 aa, Mycobacterium
ETDRTGGQRR

SEQ ID NO: 257572 - protein, 13 aa, Mycobacterium
ETDSANRAATAAQ

SEQ ID NO: 257573 - protein, 10 aa, Mycobacterium
ETDSGGHQKI

SEQ ID NO: 257574 - protein, 11 aa, Mycobacterium
ETDSTGAPQIQ

SEQ ID NO: 257575 - protein, 10 aa, Mycobacterium
ETDSTGAQQI

SEQ ID NO: 257576 - protein, 4 aa, Mycobacterium
ETDV

SEQ ID NO: 257577 - protein, 14 aa, Mycobacterium
ETDWRPSEDKEVDP

SEQ ID NO: 257578 - protein, 18 aa, Mycobacterium
ETEETDGAGDGAAETGAD

SEQ ID NO: 257579 - protein, 4 aa, Mycobacterium
ETEP

SEQ ID NO: 257580 - protein, 6 aa, Mycobacterium
ETEPKE

SEQ ID NO: 257581 - protein, 18 aa, Mycobacterium
ETEPRAASLEDSGATDPA

SEQ ID NO: 257582 - protein, 48 aa, Mycobacterium
ETEQSLREPRRAVPEVPASRPARPAPNATAPTAPQPPAPSAHETGSHS

SEQ ID NO: 257583 - protein, 4 aa, Mycobacterium
ETER

SEQ ID NO: 257584 - protein, 6 aa, Mycobacterium
ETERDR

SEQ ID NO: 257585 - protein, 21 aa, Mycobacterium
ETERSTASASALAAQENERQR

SEQ ID NO: 257586 - protein, 5 aa, Mycobacterium
ETERY

SEQ ID NO: 257587 - protein, 8 aa, Mycobacterium
ETESEHPL

SEQ ID NO: 257588 - protein, 18 aa, Mycobacterium
ETESVGDEGKPSKPHRRN

SEQ ID NO: 257589 - protein, 8 aa, Mycobacterium
ETETTRLT

SEQ ID NO: 257590 - protein, 5 aa, Mycobacterium
ETEVP

SEQ ID NO: 257591 - protein, 7 aa, Mycobacterium
ETFAENS

SEQ ID NO: 257592 - protein, 39 aa, Mycobacterium
ETFDPEHPEADQAVDDGTVGASAEEPETSSDSADQRGDD

SEQ ID NO: 257593 - protein, 7 aa, Mycobacterium
ETFGQHG

SEQ ID NO: 257594 - protein, 8 aa, Mycobacterium
ETFPDRDA

SEQ ID NO: 257595 - protein, 27 aa, Mycobacterium
ETGAGAASSFSDDAYTAAGATVGPNTE

SEQ ID NO: 257596 - protein, 5 aa, Mycobacterium
ETGAI

SEQ ID NO: 257597 - protein, 7 aa, Mycobacterium
ETGATVA

SEQ ID NO: 257598 - protein, 31 aa, Mycobacterium
ETGAVGDADAAATEAADRRDRPTIPAALSGR

SEQ ID NO: 257599 - protein, 5 aa, Mycobacterium
ETGDP

SEQ ID NO: 257600 - protein, 6 aa, Mycobacterium
ETGDTA

SEQ ID NO: 257601 - protein, 7 aa, Mycobacterium
ETGDTSV

SEQ ID NO: 257602 - protein, 4 aa, Mycobacterium
ETGH

SEQ ID NO: 257603 - protein, 22 aa, Mycobacterium
ETGHAARQTVRESVEAERPEAA

SEQ ID NO: 257604 - protein, 15 aa, Mycobacterium
ETGKTLDQGDPEVSE

SEQ ID NO: 257605 - protein, 4 aa, Mycobacterium
ETGL

SEQ ID NO: 257606 - protein, 5 aa, Mycobacterium
ETGLE

SEQ ID NO: 257607 - protein, 6 aa, Mycobacterium
ETGLPA

SEQ ID NO: 257608 - protein, 15 aa, Mycobacterium
ETGLTVDGKPLKEPY

SEQ ID NO: 257609 - protein, 5 aa, Mycobacterium
ETGPD

SEQ ID NO: 257610 - protein, 11 aa, Mycobacterium
ETGPGAADEAS

SEQ ID NO: 257611 - protein, 5 aa, Mycobacterium
ETGRD

SEQ ID NO: 257612 - protein, 4 aa, Mycobacterium
ETGS

SEQ ID NO: 257613 - protein, 13 aa, Mycobacterium
ETGSEGDEASDET

SEQ ID NO: 257614 - protein, 10 aa, Mycobacterium
ETGSRLGRQV

SEQ ID NO: 257615 - protein, 16 aa, Mycobacterium
ETGTAQSLSEATRHSS

SEQ ID NO: 257616 - protein, 8 aa, Mycobacterium
ETGTKTEY

SEQ ID NO: 257617 - protein, 9 aa, Mycobacterium
ETGTTTAST

SEQ ID NO: 257618 - protein, 7 aa, Mycobacterium
ETGYARP

SEQ ID NO: 257619 - protein, 21 aa, Mycobacterium
ETHGATHARTDREAAEPEHRG

SEQ ID NO: 257620 - protein, 4 aa, Mycobacterium
ETHP

SEQ ID NO: 257621 - protein, 10 aa, Mycobacterium
ETIGKRDEDV

SEQ ID NO: 257622 - protein, 10 aa, Mycobacterium
ETINKRDTEL

SEQ ID NO: 257623 - protein, 8 aa, Mycobacterium
ETKAETRG

SEQ ID NO: 257624 - protein, 17 aa, Mycobacterium
ETKGNPWGQNAKDRTNW

SEQ ID NO: 257625 - protein, 16 aa, Mycobacterium
ETKGNPWGQNASDRTN

SEQ ID NO: 257626 - protein, 17 aa, Mycobacterium
ETKGNPWGQNSKDRTNW

SEQ ID NO: 257627 - protein, 14 aa, Mycobacterium
ETKGRALEDMDSAI

SEQ ID NO: 257628 - protein, 7 aa, Mycobacterium
ETKQRPY

SEQ ID NO: 257629 - protein, 8 aa, Mycobacterium
ETKSATMR

SEQ ID NO: 257630 - protein, 11 aa, Mycobacterium
ETKSDQEGMQG

SEQ ID NO: 257631 - protein, 16 aa, Mycobacterium
ETKYGGEKTLDQIDQS

SEQ ID NO: 257632 - protein, 10 aa, Mycobacterium
ETLAGASESV

SEQ ID NO: 257633 - protein, 8 aa, Mycobacterium
ETLAPAEQ

SEQ ID NO: 257634 - protein, 4 aa, Mycobacterium
ETLD

SEQ ID NO: 257635 - protein, 12 aa, Mycobacterium
ETLGKTAGSVTK

SEQ ID NO: 257636 - protein, 10 aa, Mycobacterium
ETLGMKPSDV

SEQ ID NO: 257637 - protein, 5 aa, Mycobacterium
ETLGS

SEQ ID NO: 257638 - protein, 17 aa, Mycobacterium
ETLGSTADIATDKTGTL

SEQ ID NO: 257639 - protein, 12 aa, Mycobacterium
ETLPPSARRPLR

SEQ ID NO: 257640 - protein, 10 aa, Mycobacterium
ETLPTSHRRP

SEQ ID NO: 257641 - protein, 8 aa, Mycobacterium
ETLQSGED

SEQ ID NO: 257642 - protein, 6 aa, Mycobacterium
ETLRQG

SEQ ID NO: 257643 - protein, 11 aa, Mycobacterium
ETLSGSAAGPV

SEQ ID NO: 257644 - protein, 11 aa, Mycobacterium
ETLSNDQTAKL

SEQ ID NO: 257645 - protein, 11 aa, Mycobacterium
ETLSNDQTTKL

SEQ ID NO: 257646 - protein, 11 aa, Mycobacterium
ETLSNEQTEKL

SEQ ID NO: 257647 - protein, 8 aa, Mycobacterium
ETLSSQDR

SEQ ID NO: 257648 - protein, 5 aa, Mycobacterium
ETLTN

SEQ ID NO: 257649 - protein, 10 aa, Mycobacterium
ETLTQAPASL

SEQ ID NO: 257650 - protein, 10 aa, Mycobacterium
ETLTQAPTSL

SEQ ID NO: 257651 - protein, 8 aa, Mycobacterium
ETMPDDEQ

SEQ ID NO: 257652 - protein, 28 aa, Mycobacterium
ETNASERRAGPGGGREPSYRRRSPVETT

SEQ ID NO: 257653 - protein, 6 aa, Mycobacterium
ETNEQM

SEQ ID NO: 257654 - protein, 14 aa, Mycobacterium
ETNGAASLFEARAG

SEQ ID NO: 257655 - protein, 29 aa, Mycobacterium
ETNGDSSGKHGGPGTTPPPDHGPRADAES

SEQ ID NO: 257656 - protein, 11 aa, Mycobacterium
ETNGEGTPQIQ

SEQ ID NO: 257657 - protein, 5 aa, Mycobacterium
ETNGV

SEQ ID NO: 257658 - protein, 4 aa, Mycobacterium
ETNN

SEQ ID NO: 257659 - protein, 7 aa, Mycobacterium
ETNRAPF

SEQ ID NO: 257660 - protein, 5 aa, Mycobacterium
ETNRG

SEQ ID NO: 257661 - protein, 29 aa, Mycobacterium
ETNVGETSVTPTALPQTTPVARGGPATID

SEQ ID NO: 257662 - protein, 4 aa, Mycobacterium
ETPA

SEQ ID NO: 257663 - protein, 6 aa, Mycobacterium
ETPAEE

SEQ ID NO: 257664 - protein, 9 aa, Mycobacterium
ETPAGMSAT

SEQ ID NO: 257665 - protein, 15 aa, Mycobacterium
ETPAHGTAFDETISR

SEQ ID NO: 257666 - protein, 6 aa, Mycobacterium
ETPAIE

SEQ ID NO: 257667 - protein, 12 aa, Mycobacterium
ETPANSVRGSRN

SEQ ID NO: 257668 - protein, 8 aa, Mycobacterium
ETPAPDGI

SEQ ID NO: 257669 - protein, 8 aa, Mycobacterium
ETPAPPGI

SEQ ID NO: 257670 - protein, 9 aa, Mycobacterium
ETPAPPGVT

SEQ ID NO: 257671 - protein, 5 aa, Mycobacterium
ETPAQ

SEQ ID NO: 257672 - protein, 5 aa, Mycobacterium
ETPDG

SEQ ID NO: 257673 - protein, 11 aa, Mycobacterium
ETPDGGATPDA

SEQ ID NO: 257674 - protein, 12 aa, Mycobacterium
ETPDLAPFSGTD

SEQ ID NO: 257675 - protein, 6 aa, Mycobacterium
ETPDLP

SEQ ID NO: 257676 - protein, 11 aa, Mycobacterium
ETPDPEPGPGE

SEQ ID NO: 257677 - protein, 6 aa, Mycobacterium
ETPDQV

SEQ ID NO: 257678 - protein, 4 aa, Mycobacterium
ETPE

SEQ ID NO: 257679 - protein, 6 aa, Mycobacterium
ETPEFD

SEQ ID NO: 257680 - protein, 5 aa, Mycobacterium
ETPGF

SEQ ID NO: 257681 - protein, 8 aa, Mycobacterium
ETPGPAGV

SEQ ID NO: 257682 - protein, 4 aa, Mycobacterium
ETPK

SEQ ID NO: 257683 - protein, 5 aa, Mycobacterium
ETPMQ

SEQ ID NO: 257684 - protein, 13 aa, Mycobacterium
ETPPPLPADLPPN

SEQ ID NO: 257685 - protein, 14 aa, Mycobacterium
ETPPPRPSSINPGL

SEQ ID NO: 257686 - protein, 17 aa, Mycobacterium
ETPQHASNGEDIQTTTT

SEQ ID NO: 257687 - protein, 10 aa, Mycobacterium
ETPRPQHATS

SEQ ID NO: 257688 - protein, 4 aa, Mycobacterium
ETPV

SEQ ID NO: 257689 - protein, 4 aa, Mycobacterium
ETPY

SEQ ID NO: 257690 - protein, 11 aa, Mycobacterium
ETQAGNDPIDP

SEQ ID NO: 257691 - protein, 16 aa, Mycobacterium
ETQGSAGSTPLSAETI

SEQ ID NO: 257692 - protein, 17 aa, Mycobacterium
ETQKSVDKLSGTRDGLA

SEQ ID NO: 257693 - protein, 7 aa, Mycobacterium
ETQSPGV

SEQ ID NO: 257694 - protein, 7 aa, Mycobacterium
ETQTSNS

SEQ ID NO: 257695 - protein, 11 aa, Mycobacterium
ETRAQADNLQD

SEQ ID NO: 257696 - protein, 7 aa, Mycobacterium
ETRDGEA

SEQ ID NO: 257697 - protein, 5 aa, Mycobacterium
ETREA

SEQ ID NO: 257698 - protein, 5 aa, Mycobacterium
ETREQ

SEQ ID NO: 257699 - protein, 13 aa, Mycobacterium
ETRGDDAAATGRG

SEQ ID NO: 257700 - protein, 34 aa, Mycobacterium
ETRGDEVADLGGERTEDSIADEPEAPAETGPSRG

SEQ ID NO: 257701 - protein, 23 aa, Mycobacterium
ETRGEPLPTDTTAHPVPHPEKSL

SEQ ID NO: 257702 - protein, 10 aa, Mycobacterium
ETRPGKRAPT

SEQ ID NO: 257703 - protein, 24 aa, Mycobacterium
ETRPRPSAEHTPARPLGPEAGGEV

SEQ ID NO: 257704 - protein, 24 aa, Mycobacterium
ETRPTPSTEHTPGRPLGPEAGGEV

SEQ ID NO: 257705 - protein, 12 aa, Mycobacterium
ETRRGQQAPMPV

SEQ ID NO: 257706 - protein, 37 aa, Mycobacterium
ETRRGSIGPEARTRLAEATRQLEAARAKRSTNPNEAV

SEQ ID NO: 257707 - protein, 10 aa, Mycobacterium
ETRRTGQDGY

SEQ ID NO: 257708 - protein, 10 aa, Mycobacterium
ETRSGTPSVG

SEQ ID NO: 257709 - protein, 5 aa, Mycobacterium
ETRTA

SEQ ID NO: 257710 - protein, 6 aa, Mycobacterium
ETRTGG

SEQ ID NO: 257711 - protein, 14 aa, Mycobacterium
ETRTYRDAKSNTEV

SEQ ID NO: 257712 - protein, 21 aa, Mycobacterium
ETSAGTTELTASAAGTAGAPH

SEQ ID NO: 257713 - protein, 7 aa, Mycobacterium
ETSDGAT

SEQ ID NO: 257714 - protein, 8 aa, Mycobacterium
ETSDVSAS

SEQ ID NO: 257715 - protein, 12 aa, Mycobacterium
ETSEAVGGLGPS

SEQ ID NO: 257716 - protein, 21 aa, Mycobacterium
ETSERRARRAADTAQRAETAT

SEQ ID NO: 257717 - protein, 8 aa, Mycobacterium
ETSFPSGH

SEQ ID NO: 257718 - protein, 18 aa, Mycobacterium
ETSGGSGRPLSDIDGPIH

SEQ ID NO: 257719 - protein, 6 aa, Mycobacterium
ETSGKN

SEQ ID NO: 257720 - protein, 8 aa, Mycobacterium
ETSPPHRS

SEQ ID NO: 257721 - protein, 7 aa, Mycobacterium
ETSPPRL

SEQ ID NO: 257722 - protein, 7 aa, Mycobacterium
ETSPRHE

SEQ ID NO: 257723 - protein, 9 aa, Mycobacterium
ETSPSRIRG

SEQ ID NO: 257724 - protein, 6 aa, Mycobacterium
ETSPTH

SEQ ID NO: 257725 - protein, 6 aa, Mycobacterium
ETSPTL

SEQ ID NO: 257726 - protein, 4 aa, Mycobacterium
ETSR

SEQ ID NO: 257727 - protein, 16 aa, Mycobacterium
ETSSFSNTLADNNQTV

SEQ ID NO: 257728 - protein, 14 aa, Mycobacterium
ETSSKERPDPSLTA

SEQ ID NO: 257729 - protein, 9 aa, Mycobacterium
ETSSRVGQR

SEQ ID NO: 257730 - protein, 5 aa, Mycobacterium
ETSTG

SEQ ID NO: 257731 - protein, 9 aa, Mycobacterium
ETSTPATAQ

SEQ ID NO: 257732 - protein, 4 aa, Mycobacterium
ETSY

SEQ ID NO: 257733 - protein, 4 aa, Mycobacterium
ETTA

SEQ ID NO: 257734 - protein, 7 aa, Mycobacterium
ETTAANA

SEQ ID NO: 257735 - protein, 5 aa, Mycobacterium
ETTAT

SEQ ID NO: 257736 - protein, 4 aa, Mycobacterium
ETTE

SEQ ID NO: 257737 - protein, 7 aa, Mycobacterium
ETTIPAG

SEQ ID NO: 257738 - protein, 14 aa, Mycobacterium
ETTKELSGPRAEEL

SEQ ID NO: 257739 - protein, 16 aa, Mycobacterium
ETTQFSAADETAAIDP

SEQ ID NO: 257740 - protein, 5 aa, Mycobacterium
ETTTA

SEQ ID NO: 257741 - protein, 6 aa, Mycobacterium
ETVAKG

SEQ ID NO: 257742 - protein, 19 aa, Mycobacterium
ETVDADDDGVPDIYQPRQD

SEQ ID NO: 257743 - protein, 20 aa, Mycobacterium
ETVDEDRDGVPDVYQTRQDR

SEQ ID NO: 257744 - protein, 8 aa, Mycobacterium
ETVEGRGK

SEQ ID NO: 257745 - protein, 10 aa, Mycobacterium
ETVGGGTPSE

SEQ ID NO: 257746 - protein, 4 aa, Mycobacterium
ETVP

SEQ ID NO: 257747 - protein, 12 aa, Mycobacterium
ETVPGGNPPGAS

SEQ ID NO: 257748 - protein, 9 aa, Mycobacterium
ETVPRQREA

SEQ ID NO: 257749 - protein, 21 aa, Mycobacterium
ETVRDGKPAAKFTLEVYPRYL

SEQ ID NO: 257750 - protein, 4 aa, Mycobacterium
ETVS

SEQ ID NO: 257751 - protein, 4 aa, Mycobacterium
ETVT

SEQ ID NO: 257752 - protein, 6 aa, Mycobacterium
ETVTPA

SEQ ID NO: 257753 - protein, 20 aa, Mycobacterium
ETVTQPSGLADVPAGELASG

SEQ ID NO: 257754 - protein, 8 aa, Mycobacterium
ETWDNGDR

SEQ ID NO: 257755 - protein, 4 aa, Mycobacterium
ETWE

SEQ ID NO: 257756 - protein, 6 aa, Mycobacterium
ETWPTL

SEQ ID NO: 257757 - protein, 4 aa, Mycobacterium
ETYA

SEQ ID NO: 257758 - protein, 11 aa, Mycobacterium
ETYDEDGPAGW

SEQ ID NO: 257759 - protein, 6 aa, Mycobacterium
ETYDGD

SEQ ID NO: 257760 - protein, 5 aa, Mycobacterium
ETYSQ

SEQ ID NO: 257761 - protein, 13 aa, Mycobacterium
EVADTAPSPIGGA

SEQ ID NO: 257762 - protein, 16 aa, Mycobacterium
EVADTEPSAVGASRAV

SEQ ID NO: 257763 - protein, 37 aa, Mycobacterium
EVAEGPDEGPDTEEGPATEGVGAEVSKGEPDASEPTV

SEQ ID NO: 257764 - protein, 4 aa, Mycobacterium
EVAG

SEQ ID NO: 257765 - protein, 10 aa, Mycobacterium
EVAGADPQLR

SEQ ID NO: 257766 - protein, 5 aa, Mycobacterium
EVAHG

SEQ ID NO: 257767 - protein, 21 aa, Mycobacterium
EVANPEANPGPNSGKETLAPR

SEQ ID NO: 257768 - protein, 11 aa, Mycobacterium
EVAPTSRLTQA

SEQ ID NO: 257769 - protein, 11 aa, Mycobacterium
EVARTTSGKIR

SEQ ID NO: 257770 - protein, 8 aa, Mycobacterium
EVASEQNA

SEQ ID NO: 257771 - protein, 12 aa, Mycobacterium
EVATSDADRAMR

SEQ ID NO: 257772 - protein, 12 aa, Mycobacterium
EVATTDEDRERK

SEQ ID NO: 257773 - protein, 14 aa, Mycobacterium
EVDDDDAADVAQPQ

SEQ ID NO: 257774 - protein, 12 aa, Mycobacterium
EVDESTLTGESL

SEQ ID NO: 257775 - protein, 27 aa, Mycobacterium
EVDESTLTGESLPVSKQTEPTPGAPLA

SEQ ID NO: 257776 - protein, 5 aa, Mycobacterium
EVDGK

SEQ ID NO: 257777 - protein, 8 aa, Mycobacterium
EVDGVGPA

SEQ ID NO: 257778 - protein, 6 aa, Mycobacterium
EVDPPD

SEQ ID NO: 257779 - protein, 7 aa, Mycobacterium
EVEAEPD

SEQ ID NO: 257780 - protein, 20 aa, Mycobacterium
EVEAPDSRTSESVRPRSRAE

SEQ ID NO: 257781 - protein, 25 aa, Mycobacterium
EVEDSAAADDGTVRDVESSGVELTK

SEQ ID NO: 257782 - protein, 13 aa, Mycobacterium
EVEEAAASLGAGN

SEQ ID NO: 257783 - protein, 16 aa, Mycobacterium
EVEEAAASLGASGPKI

SEQ ID NO: 257784 - protein, 6 aa, Mycobacterium
EVEEQG

SEQ ID NO: 257785 - protein, 13 aa, Mycobacterium
EVEETTVGGEPRA

SEQ ID NO: 257786 - protein, 7 aa, Mycobacterium
EVENDPD

SEQ ID NO: 257787 - protein, 9 aa, Mycobacterium
EVENETRGG

SEQ ID NO: 257788 - protein, 29 aa, Mycobacterium
EVEPEDDVAAEPDVSGAAEAGAVGAGANG

SEQ ID NO: 257789 - protein, 12 aa, Mycobacterium
EVEPTETGARAT

SEQ ID NO: 257790 - protein, 13 aa, Mycobacterium
EVEPTEVGGSPRH

SEQ ID NO: 257791 - protein, 13 aa, Mycobacterium
EVEQSEVGGSPRH

SEQ ID NO: 257792 - protein, 7 aa, Mycobacterium
EVEQTAA

SEQ ID NO: 257793 - protein, 19 aa, Mycobacterium
EVERATGEPLPEPQGKPLR

SEQ ID NO: 257794 - protein, 18 aa, Mycobacterium
EVERDTGQRLPDPPGRPL

SEQ ID NO: 257795 - protein, 13 aa, Mycobacterium
EVERSEVGGSPRH

SEQ ID NO: 257796 - protein, 19 aa, Mycobacterium
EVERSTGRPLDEPEGSLTV

SEQ ID NO: 257797 - protein, 12 aa, Mycobacterium
EVERTAAKGAKS

SEQ ID NO: 257798 - protein, 5 aa, Mycobacterium
EVESP

SEQ ID NO: 257799 - protein, 5 aa, Mycobacterium
EVGAG

SEQ ID NO: 257800 - protein, 10 aa, Mycobacterium
EVGEANPGST

SEQ ID NO: 257801 - protein, 19 aa, Mycobacterium
EVGEERSVSLTPKDAPSMQ

SEQ ID NO: 257802 - protein, 8 aa, Mycobacterium
EVGGGAPV

SEQ ID NO: 257803 - protein, 23 aa, Mycobacterium
EVGHSHGGHGTSEFSVGGGASGT

SEQ ID NO: 257804 - protein, 4 aa, Mycobacterium
EVGK

SEQ ID NO: 257805 - protein, 9 aa, Mycobacterium
EVGNTGSAS

SEQ ID NO: 257806 - protein, 5 aa, Mycobacterium
EVGPK

SEQ ID NO: 257807 - protein, 8 aa, Mycobacterium
EVGPTSRS

SEQ ID NO: 257808 - protein, 10 aa, Mycobacterium
EVGQENPGAT

SEQ ID NO: 257809 - protein, 9 aa, Mycobacterium
EVGQPPGVV

SEQ ID NO: 257810 - protein, 9 aa, Mycobacterium
EVGTAPELD

SEQ ID NO: 257811 - protein, 8 aa, Mycobacterium
EVGTTGSE

SEQ ID NO: 257812 - protein, 7 aa, Mycobacterium
EVGTTPK

SEQ ID NO: 257813 - protein, 14 aa, Mycobacterium
EVKEAQKSGDFARY

SEQ ID NO: 257814 - protein, 4 aa, Mycobacterium
EVKP

SEQ ID NO: 257815 - protein, 9 aa, Mycobacterium
EVKSTRKPV

SEQ ID NO: 257816 - protein, 4 aa, Mycobacterium
EVME

SEQ ID NO: 257817 - protein, 10 aa, Mycobacterium
EVNAGKPRDE

SEQ ID NO: 257818 - protein, 25 aa, Mycobacterium
EVNAPPPPGTEVRPAEPGPVPPGFP

SEQ ID NO: 257819 - protein, 4 aa, Mycobacterium
EVNG

SEQ ID NO: 257820 - protein, 8 aa, Mycobacterium
EVNPPGKG

SEQ ID NO: 257821 - protein, 5 aa, Mycobacterium
EVPAG

SEQ ID NO: 257822 - protein, 14 aa, Mycobacterium
EVPAPADPAPAPSS

SEQ ID NO: 257823 - protein, 5 aa, Mycobacterium
EVPDD

SEQ ID NO: 257824 - protein, 15 aa, Mycobacterium
EVPDPTQRPPQPDRP

SEQ ID NO: 257825 - protein, 5 aa, Mycobacterium
EVPDQ

SEQ ID NO: 257826 - protein, 6 aa, Mycobacterium
EVPEAD

SEQ ID NO: 257827 - protein, 13 aa, Mycobacterium
EVPEDEAADIGSV

SEQ ID NO: 257828 - protein, 4 aa, Mycobacterium
EVPG

SEQ ID NO: 257829 - protein, 8 aa, Mycobacterium
EVPIPGSD

SEQ ID NO: 257830 - protein, 15 aa, Mycobacterium
EVPNPTQRPPQPDRP

SEQ ID NO: 257831 - protein, 4 aa, Mycobacterium
EVPP

SEQ ID NO: 257832 - protein, 21 aa, Mycobacterium
EVPPDASALNGDGVVGAIAED

SEQ ID NO: 257833 - protein, 8 aa, Mycobacterium
EVPPPNEI

SEQ ID NO: 257834 - protein, 9 aa, Mycobacterium
EVPPSASPG

SEQ ID NO: 257835 - protein, 8 aa, Mycobacterium
EVPPSSRH

SEQ ID NO: 257836 - protein, 5 aa, Mycobacterium
EVPSA

SEQ ID NO: 257837 - protein, 5 aa, Mycobacterium
EVQNM

SEQ ID NO: 257838 - protein, 6 aa, Mycobacterium
EVQRER

SEQ ID NO: 257839 - protein, 9 aa, Mycobacterium
EVQVPTDSL

SEQ ID NO: 257840 - protein, 4 aa, Mycobacterium
EVRA

SEQ ID NO: 257841 - protein, 8 aa, Mycobacterium
EVRAKDPA

SEQ ID NO: 257842 - protein, 13 aa, Mycobacterium
EVRDARDNVDANA

SEQ ID NO: 257843 - protein, 10 aa, Mycobacterium
EVREQAPGRA

SEQ ID NO: 257844 - protein, 6 aa, Mycobacterium
EVRGDA

SEQ ID NO: 257845 - protein, 7 aa, Mycobacterium
EVRPEAA

SEQ ID NO: 257846 - protein, 5 aa, Mycobacterium
EVRTE

SEQ ID NO: 257847 - protein, 8 aa, Mycobacterium
EVRTSESE

SEQ ID NO: 257848 - protein, 10 aa, Mycobacterium
EVSADTEYRE

SEQ ID NO: 257849 - protein, 74 aa, Mycobacterium
EVSGKPLPADEPGDEAQSNPAGADSDSDSDAEPDTEPDSESDGEPDADAPAETEDASQPEDSRPRRRRPHPKSS

SEQ ID NO: 257850 - protein, 10 aa, Mycobacterium
EVSGTSPKIR

SEQ ID NO: 257851 - protein, 9 aa, Mycobacterium
EVSHGPDSV

SEQ ID NO: 257852 - protein, 9 aa, Mycobacterium
EVSNDPEDI

SEQ ID NO: 257853 - protein, 15 aa, Mycobacterium
EVSPKEAGGSPRHQT

SEQ ID NO: 257854 - protein, 13 aa, Mycobacterium
EVSPKEEGGSPRH

SEQ ID NO: 257855 - protein, 27 aa, Mycobacterium
EVSPRATRPIPVTAGPARDEIDPASAG

SEQ ID NO: 257856 - protein, 7 aa, Mycobacterium
EVSQPTV

SEQ ID NO: 257857 - protein, 8 aa, Mycobacterium
EVSRRNLR

SEQ ID NO: 257858 - protein, 12 aa, Mycobacterium
EVSSDPSNTRTN

SEQ ID NO: 257859 - protein, 6 aa, Mycobacterium
EVSTSP

SEQ ID NO: 257860 - protein, 21 aa, Mycobacterium
EVTDDDEDDDDFDDDDPETDL

SEQ ID NO: 257861 - protein, 5 aa, Mycobacterium
EVTDE

SEQ ID NO: 257862 - protein, 6 aa, Mycobacterium
EVTEDS

SEQ ID NO: 257863 - protein, 10 aa, Mycobacterium
EVTHRGKPAA

SEQ ID NO: 257864 - protein, 6 aa, Mycobacterium
EVTPGR

SEQ ID NO: 257865 - protein, 7 aa, Mycobacterium
EVTQGEL

SEQ ID NO: 257866 - protein, 9 aa, Mycobacterium
EVTRDGVPA

SEQ ID NO: 257867 - protein, 14 aa, Mycobacterium
EVTSEPKGVSSQAA

SEQ ID NO: 257868 - protein, 71 aa, Mycobacterium
EVTTSSTTTTTKSRTRTTTSTTTGGTNMSTTSASATATTATTATSATTSISVPGPTTTSVPREATKDEQYQ

SEQ ID NO: 257869 - protein, 16 aa, Mycobacterium
EVVAGGKRSGSATLGT

SEQ ID NO: 257870 - protein, 34 aa, Mycobacterium
EWDDPDYEDYEDGQSEGDYEATREFTRGATPMDN

SEQ ID NO: 257871 - protein, 4 aa, Mycobacterium
EWER

SEQ ID NO: 257872 - protein, 5 aa, Mycobacterium
EWGPA

SEQ ID NO: 257873 - protein, 7 aa, Mycobacterium
EWPAPAT

SEQ ID NO: 257874 - protein, 9 aa, Mycobacterium
EWPAPDTHA

SEQ ID NO: 257875 - protein, 8 aa, Mycobacterium
EWRTATDS

SEQ ID NO: 257876 - protein, 6 aa, Mycobacterium
EWSPAG

SEQ ID NO: 257877 - protein, 5 aa, Mycobacterium
EYAAA

SEQ ID NO: 257878 - protein, 7 aa, Mycobacterium
EYAGAAE

SEQ ID NO: 257879 - protein, 7 aa, Mycobacterium
EYAGNAA

SEQ ID NO: 257880 - protein, 7 aa, Mycobacterium
EYAGREA

SEQ ID NO: 257881 - protein, 9 aa, Mycobacterium
EYAKDIPSA

SEQ ID NO: 257882 - protein, 9 aa, Mycobacterium
EYAKSIPAN

SEQ ID NO: 257883 - protein, 14 aa, Mycobacterium
EYAKTIPSSATARV

SEQ ID NO: 257884 - protein, 10 aa, Mycobacterium
EYAPADRRGR

SEQ ID NO: 257885 - protein, 10 aa, Mycobacterium
EYAPTGKRGR

SEQ ID NO: 257886 - protein, 4 aa, Mycobacterium
EYAQ

SEQ ID NO: 257887 - protein, 10 aa, Mycobacterium
EYAQTSTVSP

SEQ ID NO: 257888 - protein, 8 aa, Mycobacterium
EYASGTPW

SEQ ID NO: 257889 - protein, 5 aa, Mycobacterium
EYASS

SEQ ID NO: 257890 - protein, 10 aa, Mycobacterium
EYASSIPSTV

SEQ ID NO: 257891 - protein, 8 aa, Mycobacterium
EYATAAEE

SEQ ID NO: 257892 - protein, 6 aa, Mycobacterium
EYDHDE

SEQ ID NO: 257893 - protein, 11 aa, Mycobacterium
EYDPATGTYMG

SEQ ID NO: 257894 - protein, 6 aa, Mycobacterium
EYDPEF

SEQ ID NO: 257895 - protein, 20 aa, Mycobacterium
EYDPTTGTYTGPDGRQYTRS

SEQ ID NO: 257896 - protein, 6 aa, Mycobacterium
EYDQRQ

SEQ ID NO: 257897 - protein, 54 aa, Mycobacterium
EYEDASDDEYEDENQDSDESARGEERADTDQRVAGSLSESRRRRRESTTAAAVS

SEQ ID NO: 257898 - protein, 19 aa, Mycobacterium
EYEDDAECEEDDGEYGRST

SEQ ID NO: 257899 - protein, 9 aa, Mycobacterium
EYERSGDMR

SEQ ID NO: 257900 - protein, 5 aa, Mycobacterium
EYGGG

SEQ ID NO: 257901 - protein, 16 aa, Mycobacterium
EYGGRRSRSRHSTDYR

SEQ ID NO: 257902 - protein, 5 aa, Mycobacterium
EYGIE

SEQ ID NO: 257903 - protein, 46 aa, Mycobacterium
EYGPLGGEDPVGFTPNGVSDTLEPAEPVAANPGTPNSDGPVDKPNI

SEQ ID NO: 257904 - protein, 47 aa, Mycobacterium
EYGPLGGENPVGFTPNGVSDTLEPAEPVGANPGTVNSDGPVDKPNIG

SEQ ID NO: 257905 - protein, 5 aa, Mycobacterium
EYGSA

SEQ ID NO: 257906 - protein, 5 aa, Mycobacterium
EYKGR

SEQ ID NO: 257907 - protein, 10 aa, Mycobacterium
EYNSGTPWAK

SEQ ID NO: 257908 - protein, 11 aa, Mycobacterium
EYNSRGSGALR

SEQ ID NO: 257909 - protein, 56 aa, Mycobacterium
EYPDDDAEAEPAAEDVEDAEEGSEDTEGPEDTEGQEDADTAEESTVSADAKRDDSA

SEQ ID NO: 257910 - protein, 27 aa, Mycobacterium
EYPGDHAGEYPGDHPDAAYAGAADPNL

SEQ ID NO: 257911 - protein, 13 aa, Mycobacterium
EYPGGPLPPSPSL

SEQ ID NO: 257912 - protein, 4 aa, Mycobacterium
EYPK

SEQ ID NO: 257913 - protein, 5 aa, Mycobacterium
EYPQL

SEQ ID NO: 257914 - protein, 7 aa, Mycobacterium
EYPQVGG

SEQ ID NO: 257915 - protein, 17 aa, Mycobacterium
EYPTDQYPPNDPKAQEP

SEQ ID NO: 257916 - protein, 17 aa, Mycobacterium
EYPTDQYPPNDPKAQQP

SEQ ID NO: 257917 - protein, 7 aa, Mycobacterium
EYPTNQY

SEQ ID NO: 257918 - protein, 15 aa, Mycobacterium
EYPTNQYPPNDPKLK

SEQ ID NO: 257919 - protein, 15 aa, Mycobacterium
EYPTNQYQPDNPALQ

SEQ ID NO: 257920 - protein, 16 aa, Mycobacterium
EYPTTQYKADDPAAQQ

SEQ ID NO: 257921 - protein, 13 aa, Mycobacterium
EYQDGEPSTNGHG

SEQ ID NO: 257922 - protein, 12 aa, Mycobacterium
EYQKTQTAEEIA

SEQ ID NO: 257923 - protein, 8 aa, Mycobacterium
EYQYSTPD

SEQ ID NO: 257924 - protein, 4 aa, Mycobacterium
EYRA

SEQ ID NO: 257925 - protein, 6 aa, Mycobacterium
EYREKA

SEQ ID NO: 257926 - protein, 4 aa, Mycobacterium
EYRG

SEQ ID NO: 257927 - protein, 7 aa, Mycobacterium
EYRGGAG

SEQ ID NO: 257928 - protein, 5 aa, Mycobacterium
EYRIG

SEQ ID NO: 257929 - protein, 10 aa, Mycobacterium
EYRPPGSNEN

SEQ ID NO: 257930 - protein, 5 aa, Mycobacterium
EYRSE

SEQ ID NO: 257931 - protein, 7 aa, Mycobacterium
EYSDDQA

SEQ ID NO: 257932 - protein, 20 aa, Mycobacterium
EYSPSQNRGRAATAVPIGTS

SEQ ID NO: 257933 - protein, 5 aa, Mycobacterium
EYSRP

SEQ ID NO: 257934 - protein, 7 aa, Mycobacterium
EYSTDSE

SEQ ID NO: 257935 - protein, 4 aa, Mycobacterium
EYTA

SEQ ID NO: 257936 - protein, 5 aa, Mycobacterium
EYTAN

SEQ ID NO: 257937 - protein, 5 aa, Mycobacterium
EYTSL

SEQ ID NO: 257938 - protein, 8 aa, Mycobacterium
FAAGTASN

SEQ ID NO: 257939 - protein, 6 aa, Mycobacterium
FADGAR

SEQ ID NO: 257940 - protein, 8 aa, Mycobacterium
FADGGSRI

SEQ ID NO: 257941 - protein, 4 aa, Mycobacterium
FADN

SEQ ID NO: 257942 - protein, 9 aa, Mycobacterium
FADPDGAGY

SEQ ID NO: 257943 - protein, 15 aa, Mycobacterium
FADPGPSDSRVPAQA

SEQ ID NO: 257944 - protein, 9 aa, Mycobacterium
FAGAGDGPV

SEQ ID NO: 257945 - protein, 7 aa, Mycobacterium
FAGEAQA

SEQ ID NO: 257946 - protein, 10 aa, Mycobacterium
FAGEGTTTTA

SEQ ID NO: 257947 - protein, 7 aa, Mycobacterium
FAGETQA

SEQ ID NO: 257948 - protein, 9 aa, Mycobacterium
FAGGSPEFD

SEQ ID NO: 257949 - protein, 8 aa, Mycobacterium
FAGGTPEF

SEQ ID NO: 257950 - protein, 10 aa, Mycobacterium
FAGKGEQLNR

SEQ ID NO: 257951 - protein, 23 aa, Mycobacterium
FAGKSAAPLSPPAAEPSLVDAAS

SEQ ID NO: 257952 - protein, 7 aa, Mycobacterium
FAGPESV

SEQ ID NO: 257953 - protein, 7 aa, Mycobacterium
FAGSAAS

SEQ ID NO: 257954 - protein, 20 aa, Mycobacterium
FAGSATTANITGAAGTVTDM

SEQ ID NO: 257955 - protein, 7 aa, Mycobacterium
FAGSGIP

SEQ ID NO: 257956 - protein, 9 aa, Mycobacterium
FAGSGTGPV

SEQ ID NO: 257957 - protein, 11 aa, Mycobacterium
FAGSPADIEQA

SEQ ID NO: 257958 - protein, 11 aa, Mycobacterium
FAGSTNAARTQ

SEQ ID NO: 257959 - protein, 13 aa, Mycobacterium
FAGTSAKGSTVRP

SEQ ID NO: 257960 - protein, 8 aa, Mycobacterium
FAGTYSSE

SEQ ID NO: 257961 - protein, 7 aa, Mycobacterium
FAKAAKS

SEQ ID NO: 257962 - protein, 7 aa, Mycobacterium
FAKSGDV

SEQ ID NO: 257963 - protein, 5 aa, Mycobacterium
FAPAA

SEQ ID NO: 257964 - protein, 11 aa, Mycobacterium
FAPAAEDSTGA

SEQ ID NO: 257965 - protein, 6 aa, Mycobacterium
FAPADS

SEQ ID NO: 257966 - protein, 6 aa, Mycobacterium
FAPATA

SEQ ID NO: 257967 - protein, 5 aa, Mycobacterium
FAPDP

SEQ ID NO: 257968 - protein, 21 aa, Mycobacterium
FAPDPAPSPPQGPVGGGFSPP

SEQ ID NO: 257969 - protein, 16 aa, Mycobacterium
FAPEPAATTTEVRRRT

SEQ ID NO: 257970 - protein, 6 aa, Mycobacterium
FAPGGR

SEQ ID NO: 257971 - protein, 17 aa, Mycobacterium
FAPGSDGLGGTDANDPF

SEQ ID NO: 257972 - protein, 5 aa, Mycobacterium
FAPNA

SEQ ID NO: 257973 - protein, 5 aa, Mycobacterium
FAPNG

SEQ ID NO: 257974 - protein, 7 aa, Mycobacterium
FAPQPVS

SEQ ID NO: 257975 - protein, 29 aa, Mycobacterium
FAPRPEAGRSDAFRRPPPARNGREASHFQ

SEQ ID NO: 257976 - protein, 4 aa, Mycobacterium
FAPS

SEQ ID NO: 257977 - protein, 5 aa, Mycobacterium
FAPSG

SEQ ID NO: 257978 - protein, 7 aa, Mycobacterium
FAPTATN

SEQ ID NO: 257979 - protein, 10 aa, Mycobacterium
FAPTATTDHR

SEQ ID NO: 257980 - protein, 6 aa, Mycobacterium
FAPTDD

SEQ ID NO: 257981 - protein, 6 aa, Mycobacterium
FAQQGR

SEQ ID NO: 257982 - protein, 10 aa, Mycobacterium
FAQSGLDAAE

SEQ ID NO: 257983 - protein, 5 aa, Mycobacterium
FAQTD

SEQ ID NO: 257984 - protein, 13 aa, Mycobacterium
FARPGPSRRIMTD

SEQ ID NO: 257985 - protein, 9 aa, Mycobacterium
FASDSTRLN

SEQ ID NO: 257986 - protein, 10 aa, Mycobacterium
FASGDDATRF

SEQ ID NO: 257987 - protein, 6 aa, Mycobacterium
FASPQD

SEQ ID NO: 257988 - protein, 4 aa, Mycobacterium
FASQ

SEQ ID NO: 257989 - protein, 8 aa, Mycobacterium
FASQPKCS

SEQ ID NO: 257990 - protein, 15 aa, Mycobacterium
FASRTPVNDNPDKVE

SEQ ID NO: 257991 - protein, 12 aa, Mycobacterium
FASSSPDGLDSA

SEQ ID NO: 257992 - protein, 10 aa, Mycobacterium
FASSTGPAVT

SEQ ID NO: 257993 - protein, 46 aa, Mycobacterium
FASTPPGGFAPSSPAVPVPGSAPSTGWPAPSVPGAPVAPSAPVPTP

SEQ ID NO: 257994 - protein, 10 aa, Mycobacterium
FATASESPDK

SEQ ID NO: 257995 - protein, 16 aa, Mycobacterium
FATGGGQSSGEQNAGL

SEQ ID NO: 257996 - protein, 17 aa, Mycobacterium
FATGNVTTAELQDATPA

SEQ ID NO: 257997 - protein, 8 aa, Mycobacterium
FATGPAPL

SEQ ID NO: 257998 - protein, 11 aa, Mycobacterium
FATGPPPPGIP

SEQ ID NO: 257999 - protein, 5 aa, Mycobacterium
FATPD

SEQ ID NO: 258000 - protein, 7 aa, Mycobacterium
FATRDSE

SEQ ID NO: 258001 - protein, 7 aa, Mycobacterium
FATSGLE

SEQ ID NO: 258002 - protein, 8 aa, Mycobacterium
FATSTTIN

SEQ ID NO: 258003 - protein, 4 aa, Mycobacterium
FATT

SEQ ID NO: 258004 - protein, 7 aa, Mycobacterium
FATTGRS

SEQ ID NO: 258005 - protein, 5 aa, Mycobacterium
FDAEA

SEQ ID NO: 258006 - protein, 19 aa, Mycobacterium
FDAPAGKLAEAVDGRRGQL

SEQ ID NO: 258007 - protein, 10 aa, Mycobacterium
FDAPGGNPRQ

SEQ ID NO: 258008 - protein, 18 aa, Mycobacterium
FDAPPGKGGDQVDGRRGQ

SEQ ID NO: 258009 - protein, 12 aa, Mycobacterium
FDARRGQLAPSQ

SEQ ID NO: 258010 - protein, 6 aa, Mycobacterium
FDASRS

SEQ ID NO: 258011 - protein, 11 aa, Mycobacterium
FDATDGVDELS

SEQ ID NO: 258012 - protein, 27 aa, Mycobacterium
FDDAEPDDASSEPAPWSPDDDAQAALQ

SEQ ID NO: 258013 - protein, 9 aa, Mycobacterium
FDDAKNDDS

SEQ ID NO: 258014 - protein, 4 aa, Mycobacterium
FDDE

SEQ ID NO: 258015 - protein, 7 aa, Mycobacterium
FDDSRND

SEQ ID NO: 258016 - protein, 5 aa, Mycobacterium
FDDTA

SEQ ID NO: 258017 - protein, 4 aa, Mycobacterium
FDEA

SEQ ID NO: 258018 - protein, 6 aa, Mycobacterium
FDEAKN

SEQ ID NO: 258019 - protein, 10 aa, Mycobacterium
FDEAKNDDSF

SEQ ID NO: 258020 - protein, 13 aa, Mycobacterium
FDEDPEGGDSRHG

SEQ ID NO: 258021 - protein, 8 aa, Mycobacterium
FDEEQATR

SEQ ID NO: 258022 - protein, 6 aa, Mycobacterium
FDEGQA

SEQ ID NO: 258023 - protein, 5 aa, Mycobacterium
FDEGS

SEQ ID NO: 258024 - protein, 7 aa, Mycobacterium
FDEPGQP

SEQ ID NO: 258025 - protein, 16 aa, Mycobacterium
FDEQTGESPETAETGA

SEQ ID NO: 258026 - protein, 6 aa, Mycobacterium
FDERTN

SEQ ID NO: 258027 - protein, 9 aa, Mycobacterium
FDGAGERLY

SEQ ID NO: 258028 - protein, 9 aa, Mycobacterium
FDGAKNDDT

SEQ ID NO: 258029 - protein, 14 aa, Mycobacterium
FDGEVTSQKFTGGE

SEQ ID NO: 258030 - protein, 11 aa, Mycobacterium
FDGGKGLPEPV

SEQ ID NO: 258031 - protein, 6 aa, Mycobacterium
FDGSAA

SEQ ID NO: 258032 - protein, 8 aa, Mycobacterium
FDKDGKGL

SEQ ID NO: 258033 - protein, 6 aa, Mycobacterium
FDNAKN

SEQ ID NO: 258034 - protein, 8 aa, Mycobacterium
FDNDDVKT

SEQ ID NO: 258035 - protein, 7 aa, Mycobacterium
FDNEDFK

SEQ ID NO: 258036 - protein, 8 aa, Mycobacterium
FDNEDVKT

SEQ ID NO: 258037 - protein, 4 aa, Mycobacterium
FDNH

SEQ ID NO: 258038 - protein, 11 aa, Mycobacterium
FDPAGTTARQS

SEQ ID NO: 258039 - protein, 10 aa, Mycobacterium
FDPAKPGREL

SEQ ID NO: 258040 - protein, 18 aa, Mycobacterium
FDPDGGSFATGSRDGTVR

SEQ ID NO: 258041 - protein, 11 aa, Mycobacterium
FDPDTDADEPT

SEQ ID NO: 258042 - protein, 8 aa, Mycobacterium
FDPEDTSE

SEQ ID NO: 258043 - protein, 18 aa, Mycobacterium
FDPETQHASHTEEDPNDD

SEQ ID NO: 258044 - protein, 10 aa, Mycobacterium
FDPGNGQAQR

SEQ ID NO: 258045 - protein, 6 aa, Mycobacterium
FDPNAQ

SEQ ID NO: 258046 - protein, 7 aa, Mycobacterium
FDPNSKF

SEQ ID NO: 258047 - protein, 8 aa, Mycobacterium
FDPQSGKW

SEQ ID NO: 258048 - protein, 5 aa, Mycobacterium
FDPSQ

SEQ ID NO: 258049 - protein, 10 aa, Mycobacterium
FDPSRSEQPV

SEQ ID NO: 258050 - protein, 6 aa, Mycobacterium
FDPSVG

SEQ ID NO: 258051 - protein, 4 aa, Mycobacterium
FDQG

SEQ ID NO: 258052 - protein, 8 aa, Mycobacterium
FDQPGSRH

SEQ ID NO: 258053 - protein, 6 aa, Mycobacterium
FDQSKN

SEQ ID NO: 258054 - protein, 7 aa, Mycobacterium
FDQSRTP

SEQ ID NO: 258055 - protein, 11 aa, Mycobacterium
FDRPDGTTQPL

SEQ ID NO: 258056 - protein, 7 aa, Mycobacterium
FDRRPKA

SEQ ID NO: 258057 - protein, 12 aa, Mycobacterium
FDRTQKAASAAD

SEQ ID NO: 258058 - protein, 4 aa, Mycobacterium
FDSD

SEQ ID NO: 258059 - protein, 5 aa, Mycobacterium
FDSDN

SEQ ID NO: 258060 - protein, 4 aa, Mycobacterium
FDSN

SEQ ID NO: 258061 - protein, 17 aa, Mycobacterium
FDSRKSELQQRVDSTDV

SEQ ID NO: 258062 - protein, 9 aa, Mycobacterium
FDSSRNDDS

SEQ ID NO: 258063 - protein, 9 aa, Mycobacterium
FDTAKNDDS

SEQ ID NO: 258064 - protein, 7 aa, Mycobacterium
FDTDPDC

SEQ ID NO: 258065 - protein, 10 aa, Mycobacterium
FDTDTEAQEN

SEQ ID NO: 258066 - protein, 6 aa, Mycobacterium
FDTHPS

SEQ ID NO: 258067 - protein, 13 aa, Mycobacterium
FDTPAGTSGPDYY

SEQ ID NO: 258068 - protein, 27 aa, Mycobacterium
FDYDGADPERKEAMTSRPEGKDEHGIE

SEQ ID NO: 258069 - protein, 15 aa, Mycobacterium
FEDDSAEGVEQGEDW

SEQ ID NO: 258070 - protein, 15 aa, Mycobacterium
FEDDVDDTAATGEDW

SEQ ID NO: 258071 - protein, 10 aa, Mycobacterium
FEGGEVDARS

SEQ ID NO: 258072 - protein, 13 aa, Mycobacterium
FEGGLREPMLPAT

SEQ ID NO: 258073 - protein, 19 aa, Mycobacterium
FEKEAEPGASDGGTPTAPT

SEQ ID NO: 258074 - protein, 9 aa, Mycobacterium
FENDTRSRV

SEQ ID NO: 258075 - protein, 8 aa, Mycobacterium
FENEDVKT

SEQ ID NO: 258076 - protein, 13 aa, Mycobacterium
FENPAVSQAAGAI

SEQ ID NO: 258077 - protein, 16 aa, Mycobacterium
FENPAVSQAAGNIGSA

SEQ ID NO: 258078 - protein, 4 aa, Mycobacterium
FEPG

SEQ ID NO: 258079 - protein, 5 aa, Mycobacterium
FEPGD

SEQ ID NO: 258080 - protein, 6 aa, Mycobacterium
FEPGDS

SEQ ID NO: 258081 - protein, 21 aa, Mycobacterium
FEPGPGDPEDTDDHDKPEADR

SEQ ID NO: 258082 - protein, 7 aa, Mycobacterium
FEPPAVT

SEQ ID NO: 258083 - protein, 14 aa, Mycobacterium
FERPGAVSDPESRS

SEQ ID NO: 258084 - protein, 14 aa, Mycobacterium
FERPGDATGAEART

SEQ ID NO: 258085 - protein, 14 aa, Mycobacterium
FERPGDATGPETRQ

SEQ ID NO: 258086 - protein, 14 aa, Mycobacterium
FERPGQASGPQDRT

SEQ ID NO: 258087 - protein, 6 aa, Mycobacterium
FERSPG

SEQ ID NO: 258088 - protein, 4 aa, Mycobacterium
FESD

SEQ ID NO: 258089 - protein, 8 aa, Mycobacterium
FESSRGYA

SEQ ID NO: 258090 - protein, 5 aa, Mycobacterium
FETAS

SEQ ID NO: 258091 - protein, 7 aa, Mycobacterium
FETTEDG

SEQ ID NO: 258092 - protein, 8 aa, Mycobacterium
FEYPEQGG

SEQ ID NO: 258093 - protein, 7 aa, Mycobacterium
FGAAASA

SEQ ID NO: 258094 - protein, 11 aa, Mycobacterium
FGADGARRSPQ

SEQ ID NO: 258095 - protein, 5 aa, Mycobacterium
FGADY

SEQ ID NO: 258096 - protein, 7 aa, Mycobacterium
FGAGDRA

SEQ ID NO: 258097 - protein, 14 aa, Mycobacterium
FGAGNRSSAVTEGV

SEQ ID NO: 258098 - protein, 5 aa, Mycobacterium
FGAGP

SEQ ID NO: 258099 - protein, 36 aa, Mycobacterium
FGASARTKAPEPYDAEAAAGTAPAQHQPRSQRRRRA

SEQ ID NO: 258100 - protein, 5 aa, Mycobacterium
FGDDD

SEQ ID NO: 258101 - protein, 10 aa, Mycobacterium
FGDDEATSAV

SEQ ID NO: 258102 - protein, 9 aa, Mycobacterium
FGDDESRER

SEQ ID NO: 258103 - protein, 9 aa, Mycobacterium
FGDDRAGAF

SEQ ID NO: 258104 - protein, 8 aa, Mycobacterium
FGDKPRHD

SEQ ID NO: 258105 - protein, 15 aa, Mycobacterium
FGDPARDRGKTQMEP

SEQ ID NO: 258106 - protein, 9 aa, Mycobacterium
FGDPVGAGA

SEQ ID NO: 258107 - protein, 10 aa, Mycobacterium
FGDPVGPGTL

SEQ ID NO: 258108 - protein, 7 aa, Mycobacterium
FGDSTGY

SEQ ID NO: 258109 - protein, 7 aa, Mycobacterium
FGEEGSK

SEQ ID NO: 258110 - protein, 10 aa, Mycobacterium
FGEERTRPFT

SEQ ID NO: 258111 - protein, 10 aa, Mycobacterium
FGENNNASNY

SEQ ID NO: 258112 - protein, 6 aa, Mycobacterium
FGERTA

SEQ ID NO: 258113 - protein, 6 aa, Mycobacterium
FGESAR

SEQ ID NO: 258114 - protein, 10 aa, Mycobacterium
FGESESNNTA

SEQ ID NO: 258115 - protein, 7 aa, Mycobacterium
FGESGPP

SEQ ID NO: 258116 - protein, 5 aa, Mycobacterium
FGESP

SEQ ID NO: 258117 - protein, 5 aa, Mycobacterium
FGGAG

SEQ ID NO: 258118 - protein, 11 aa, Mycobacterium
FGGDGANRSPQ

SEQ ID NO: 258119 - protein, 5 aa, Mycobacterium
FGGDT

SEQ ID NO: 258120 - protein, 13 aa, Mycobacterium
FGGDTQGGSTITQ

SEQ ID NO: 258121 - protein, 13 aa, Mycobacterium
FGGEAGPVPNDGF

SEQ ID NO: 258122 - protein, 4 aa, Mycobacterium
FGGF

SEQ ID NO: 258123 - protein, 27 aa, Mycobacterium
FGGGGVAPGAGGDGGDKHVKATSAADA

SEQ ID NO: 258124 - protein, 26 aa, Mycobacterium
FGGGGVAPSGDGGGDKHVKATSAADA

SEQ ID NO: 258125 - protein, 26 aa, Mycobacterium
FGGGGVAPSGDGGGDKTVKATSAADA

SEQ ID NO: 258126 - protein, 26 aa, Mycobacterium
FGGGGVSPSADGGGDKHVKATSAADA

SEQ ID NO: 258127 - protein, 7 aa, Mycobacterium
FGGGRSA

SEQ ID NO: 258128 - protein, 4 aa, Mycobacterium
FGGK

SEQ ID NO: 258129 - protein, 11 aa, Mycobacterium
FGGKETPAVDA

SEQ ID NO: 258130 - protein, 5 aa, Mycobacterium
FGGKG

SEQ ID NO: 258131 - protein, 6 aa, Mycobacterium
FGGKGR

SEQ ID NO: 258132 - protein, 4 aa, Mycobacterium
FGGN

SEQ ID NO: 258133 - protein, 7 aa, Mycobacterium
FGGNGRS

SEQ ID NO: 258134 - protein, 18 aa, Mycobacterium
FGGNPSGGQPRRSGPIQV

SEQ ID NO: 258135 - protein, 8 aa, Mycobacterium
FGGNTRKV

SEQ ID NO: 258136 - protein, 4 aa, Mycobacterium
FGGP

SEQ ID NO: 258137 - protein, 8 aa, Mycobacterium
FGGPVEGG

SEQ ID NO: 258138 - protein, 18 aa, Mycobacterium
FGGSRFGGNVGPVGSQYE

SEQ ID NO: 258139 - protein, 27 aa, Mycobacterium
FGGSSGSAGSSGASPKQVREADDRIND

SEQ ID NO: 258140 - protein, 7 aa, Mycobacterium
FGKPDGY

SEQ ID NO: 258141 - protein, 7 aa, Mycobacterium
FGNGGTN

SEQ ID NO: 258142 - protein, 6 aa, Mycobacterium
FGNGPR

SEQ ID NO: 258143 - protein, 6 aa, Mycobacterium
FGNTGA

SEQ ID NO: 258144 - protein, 7 aa, Mycobacterium
FGNTGGD

SEQ ID NO: 258145 - protein, 7 aa, Mycobacterium
FGPAATN

SEQ ID NO: 258146 - protein, 6 aa, Mycobacterium
FGPAPE

SEQ ID NO: 258147 - protein, 15 aa, Mycobacterium
FGPDGNTLASGSVDD

SEQ ID NO: 258148 - protein, 7 aa, Mycobacterium
FGPEADV

SEQ ID NO: 258149 - protein, 8 aa, Mycobacterium
FGPEASGG

SEQ ID NO: 258150 - protein, 31 aa, Mycobacterium
FGPGGAPAERGEFRGPQAPDRSETPTTAPAR

SEQ ID NO: 258151 - protein, 6 aa, Mycobacterium
FGPGGG

SEQ ID NO: 258152 - protein, 11 aa, Mycobacterium
FGPGPGPLSEA

SEQ ID NO: 258153 - protein, 6 aa, Mycobacterium
FGPGRE

SEQ ID NO: 258154 - protein, 8 aa, Mycobacterium
FGPGSNGP

SEQ ID NO: 258155 - protein, 12 aa, Mycobacterium
FGPHDGPPIPPL

SEQ ID NO: 258156 - protein, 56 aa, Mycobacterium
FGPNGIPSDVSADPVMEQPGTDNFADSDSGVVTGTEVGTEGGTTAAAGINGSRARL

SEQ ID NO: 258157 - protein, 6 aa, Mycobacterium
FGPNRA

SEQ ID NO: 258158 - protein, 14 aa, Mycobacterium
FGPPSQIGPELGTT

SEQ ID NO: 258159 - protein, 17 aa, Mycobacterium
FGPRPESAAWQDNSNPF

SEQ ID NO: 258160 - protein, 14 aa, Mycobacterium
FGPRSGDGYSSSGP

SEQ ID NO: 258161 - protein, 12 aa, Mycobacterium
FGPSDAYQPRDD

SEQ ID NO: 258162 - protein, 9 aa, Mycobacterium
FGPSGRAAA

SEQ ID NO: 258163 - protein, 5 aa, Mycobacterium
FGPTD

SEQ ID NO: 258164 - protein, 8 aa, Mycobacterium
FGPTGKGF

SEQ ID NO: 258165 - protein, 6 aa, Mycobacterium
FGPTPV

SEQ ID NO: 258166 - protein, 12 aa, Mycobacterium
FGQAEANESVKA

SEQ ID NO: 258167 - protein, 7 aa, Mycobacterium
FGQDGRG

SEQ ID NO: 258168 - protein, 23 aa, Mycobacterium
FGQEIRDDGPQHHQKKRGTPSMG

SEQ ID NO: 258169 - protein, 15 aa, Mycobacterium
FGQSDQLNGVSTGQV

SEQ ID NO: 258170 - protein, 8 aa, Mycobacterium
FGREEWPN

SEQ ID NO: 258171 - protein, 6 aa, Mycobacterium
FGRPDG

SEQ ID NO: 258172 - protein, 6 aa, Mycobacterium
FGRPGI

SEQ ID NO: 258173 - protein, 16 aa, Mycobacterium
FGRPTSVTAPTGDLPT

SEQ ID NO: 258174 - protein, 4 aa, Mycobacterium
FGRQ

SEQ ID NO: 258175 - protein, 8 aa, Mycobacterium
FGRSAAKR

SEQ ID NO: 258176 - protein, 8 aa, Mycobacterium
FGRTAGSA

SEQ ID NO: 258177 - protein, 5 aa, Mycobacterium
FGSAE

SEQ ID NO: 258178 - protein, 6 aa, Mycobacterium
FGSDGA

SEQ ID NO: 258179 - protein, 4 aa, Mycobacterium
FGSG

SEQ ID NO: 258180 - protein, 5 aa, Mycobacterium
FGSGS

SEQ ID NO: 258181 - protein, 10 aa, Mycobacterium
FGSSDVKGEM

SEQ ID NO: 258182 - protein, 9 aa, Mycobacterium
FGSSGGPLA

SEQ ID NO: 258183 - protein, 6 aa, Mycobacterium
FGSTEG

SEQ ID NO: 258184 - protein, 7 aa, Mycobacterium
FGSTEGG

SEQ ID NO: 258185 - protein, 14 aa, Mycobacterium
FGTAPNPGGGLPYT

SEQ ID NO: 258186 - protein, 11 aa, Mycobacterium
FGTESTAPFQQ

SEQ ID NO: 258187 - protein, 10 aa, Mycobacterium
FGTGHDSQGM

SEQ ID NO: 258188 - protein, 14 aa, Mycobacterium
FGTGNTGRKANEVL

SEQ ID NO: 258189 - protein, 19 aa, Mycobacterium
FGTGPLPEFKREVSRKTVA

SEQ ID NO: 258190 - protein, 7 aa, Mycobacterium
FGTGTAE

SEQ ID NO: 258191 - protein, 5 aa, Mycobacterium
FGTPS

SEQ ID NO: 258192 - protein, 10 aa, Mycobacterium
FGTPVGPGSL

SEQ ID NO: 258193 - protein, 8 aa, Mycobacterium
FGTTPTGT

SEQ ID NO: 258194 - protein, 7 aa, Mycobacterium
FHESDSD

SEQ ID NO: 258195 - protein, 4 aa, Mycobacterium
FKAP

SEQ ID NO: 258196 - protein, 4 aa, Mycobacterium
FKDY

SEQ ID NO: 258197 - protein, 7 aa, Mycobacterium
FKETNTG

SEQ ID NO: 258198 - protein, 53 aa, Mycobacterium
FKPEGVGEDLKSDPVVSKPGVVNSDASPNKPNAAITDSAGTAGGKGPVGVNGS

SEQ ID NO: 258199 - protein, 17 aa, Mycobacterium
FKPEGVGEDLQSDPVVT

SEQ ID NO: 258200 - protein, 4 aa, Mycobacterium
FKPG

SEQ ID NO: 258201 - protein, 7 aa, Mycobacterium
FKPGGEP

SEQ ID NO: 258202 - protein, 19 aa, Mycobacterium
FKPPPDLAPPPGTEVGPDG

SEQ ID NO: 258203 - protein, 7 aa, Mycobacterium
FKPRRQR

SEQ ID NO: 258204 - protein, 7 aa, Mycobacterium
FKPSGEH

SEQ ID NO: 258205 - protein, 7 aa, Mycobacterium
FKPSYND

SEQ ID NO: 258206 - protein, 7 aa, Mycobacterium
FKTGQQV

SEQ ID NO: 258207 - protein, 9 aa, Mycobacterium
FNASGGPVG

SEQ ID NO: 258208 - protein, 12 aa, Mycobacterium
FNATTVSRTPVK

SEQ ID NO: 258209 - protein, 5 aa, Mycobacterium
FNAVE

SEQ ID NO: 258210 - protein, 8 aa, Mycobacterium
FNEGNTDS

SEQ ID NO: 258211 - protein, 9 aa, Mycobacterium
FNESNSDSS

SEQ ID NO: 258212 - protein, 8 aa, Mycobacterium
FNETGGGN

SEQ ID NO: 258213 - protein, 9 aa, Mycobacterium
FNGAPAVEP

SEQ ID NO: 258214 - protein, 7 aa, Mycobacterium
FNGGNNA

SEQ ID NO: 258215 - protein, 8 aa, Mycobacterium
FNGSGPEL

SEQ ID NO: 258216 - protein, 8 aa, Mycobacterium
FNGSGQEL

SEQ ID NO: 258217 - protein, 10 aa, Mycobacterium
FNGTDPAPTL

SEQ ID NO: 258218 - protein, 9 aa, Mycobacterium
FNNDNSAQM

SEQ ID NO: 258219 - protein, 8 aa, Mycobacterium
FNNDNTAQ

SEQ ID NO: 258220 - protein, 9 aa, Mycobacterium
FNNNSSTNL

SEQ ID NO: 258221 - protein, 6 aa, Mycobacterium
FNNPDF

SEQ ID NO: 258222 - protein, 9 aa, Mycobacterium
FNPETGRAE

SEQ ID NO: 258223 - protein, 6 aa, Mycobacterium
FNQSQQ

SEQ ID NO: 258224 - protein, 6 aa, Mycobacterium
FNQTDQ

SEQ ID NO: 258225 - protein, 6 aa, Mycobacterium
FNSPTT

SEQ ID NO: 258226 - protein, 5 aa, Mycobacterium
FNSSS

SEQ ID NO: 258227 - protein, 7 aa, Mycobacterium
FNTADDE

SEQ ID NO: 258228 - protein, 12 aa, Mycobacterium
FNTAQSENLPIP

SEQ ID NO: 258229 - protein, 29 aa, Mycobacterium
FNTPPPSPSAAPYYQGASANWGGPPPQFA

SEQ ID NO: 258230 - protein, 5 aa, Mycobacterium
FNTPS

SEQ ID NO: 258231 - protein, 11 aa, Mycobacterium
FPAADTGAARV

SEQ ID NO: 258232 - protein, 4 aa, Mycobacterium
FPAG

SEQ ID NO: 258233 - protein, 7 aa, Mycobacterium
FPAPPRQ

SEQ ID NO: 258234 - protein, 13 aa, Mycobacterium
FPAPSGAAVATTA

SEQ ID NO: 258235 - protein, 16 aa, Mycobacterium
FPAPTADNDPFYPSGS

SEQ ID NO: 258236 - protein, 8 aa, Mycobacterium
FPASAVPP

SEQ ID NO: 258237 - protein, 16 aa, Mycobacterium
FPATASGGRVMLLLSA

SEQ ID NO: 258238 - protein, 8 aa, Mycobacterium
FPATPPRV

SEQ ID NO: 258239 - protein, 10 aa, Mycobacterium
FPATQSYADG

SEQ ID NO: 258240 - protein, 9 aa, Mycobacterium
FPATQTYAD

SEQ ID NO: 258241 - protein, 8 aa, Mycobacterium
FPDDNAKA

SEQ ID NO: 258242 - protein, 28 aa, Mycobacterium
FPDDTRPRPLEPSTLDNPRIVEDMRHGY

SEQ ID NO: 258243 - protein, 10 aa, Mycobacterium
FPDGRRIPGW

SEQ ID NO: 258244 - protein, 7 aa, Mycobacterium
FPDGSAD

SEQ ID NO: 258245 - protein, 8 aa, Mycobacterium
FPDGSADD

SEQ ID NO: 258246 - protein, 8 aa, Mycobacterium
FPDGTTPA

SEQ ID NO: 258247 - protein, 8 aa, Mycobacterium
FPDNTEGG

SEQ ID NO: 258248 - protein, 55 aa, Mycobacterium; identical to SEQ ID NO: 5425

SEQ ID NO: 258249 - protein, 37 aa, Mycobacterium
FPDPNGTRFPNGAPPPAPPVREGTPDHPGPAVPPGAS

SEQ ID NO: 258250 - protein, 22 aa, Mycobacterium
FPDPQQVKSSPTVRNLHAPSIT

SEQ ID NO: 258251 - protein, 8 aa, Mycobacterium
FPDQGASP

SEQ ID NO: 258252 - protein, 5 aa, Mycobacterium
FPDRA

SEQ ID NO: 258253 - protein, 6 aa, Mycobacterium
FPDRGD

SEQ ID NO: 258254 - protein, 14 aa, Mycobacterium
FPDSGRRRPSGDEG

SEQ ID NO: 258255 - protein, 10 aa, Mycobacterium
FPDSPEALNP

SEQ ID NO: 258256 - protein, 4 aa, Mycobacterium
FPDT

SEQ ID NO: 258257 - protein, 5 aa, Mycobacterium
FPEDT

SEQ ID NO: 258258 - protein, 8 aa, Mycobacterium
FPEGPQRD

SEQ ID NO: 258259 - protein, 4 aa, Mycobacterium
FPEM

SEQ ID NO: 258260 - protein, 4 aa, Mycobacterium
FPEN

SEQ ID NO: 258261 - protein, 21 aa, Mycobacterium
FPEPPATSINPWGTGKPGLGD

SEQ ID NO: 258262 - protein, 9 aa, Mycobacterium
FPGDMNTPD

SEQ ID NO: 258263 - protein, 12 aa, Mycobacterium
FPGDRLGPDDSV

SEQ ID NO: 258264 - protein, 4 aa, Mycobacterium
FPGE

SEQ ID NO: 258265 - protein, 5 aa, Mycobacterium
FPGEA

SEQ ID NO: 258266 - protein, 19 aa, Mycobacterium
FPGEAPADVTNDATVLPAA

SEQ ID NO: 258267 - protein, 11 aa, Mycobacterium
FPGGGDDIHGP

SEQ ID NO: 258268 - protein, 5 aa, Mycobacterium
FPGGS

SEQ ID NO: 258269 - protein, 14 aa, Mycobacterium
FPGHGDHPGYELEN

SEQ ID NO: 258270 - protein, 4 aa, Mycobacterium
FPGI

SEQ ID NO: 258271 - protein, 8 aa, Mycobacterium
FPGNRPAR

SEQ ID NO: 258272 - protein, 13 aa, Mycobacterium
FPGPLPAEDDQDE

SEQ ID NO: 258273 - protein, 21 aa, Mycobacterium
FPGPPISGVPEGAGINTAKDQ

SEQ ID NO: 258274 - protein, 5 aa, Mycobacterium
FPGQP

SEQ ID NO: 258275 - protein, 8 aa, Mycobacterium
FPGQSAPE

SEQ ID NO: 258276 - protein, 4 aa, Mycobacterium
FPGR

SEQ ID NO: 258277 - protein, 5 aa, Mycobacterium
FPGSR

SEQ ID NO: 258278 - protein, 10 aa, Mycobacterium
FPKGPARNAA

SEQ ID NO: 258279 - protein, 9 aa, Mycobacterium
FPKSERNKA

SEQ ID NO: 258280 - protein, 16 aa, Mycobacterium
FPKTEVGGVTVYDLQS

SEQ ID NO: 258281 - protein, 14 aa, Mycobacterium
FPNEKIDPARSGGD

SEQ ID NO: 258282 - protein, 30 aa, Mycobacterium
FPNGSQKVGVEGRYGLQNKDPISLGESNVG

SEQ ID NO: 258283 - protein, 9 aa, Mycobacterium
FPNPKEKAR

SEQ ID NO: 258284 - protein, 11 aa, Mycobacterium
FPPAPRPPVSG

SEQ ID NO: 258285 - protein, 8 aa, Mycobacterium
FPPAQRGK

SEQ ID NO: 258286 - protein, 4 aa, Mycobacterium
FPPD

SEQ ID NO: 258287 - protein, 8 aa, Mycobacterium
FPPERRGT

SEQ ID NO: 258288 - protein, 6 aa, Mycobacterium
FPPGAQ

SEQ ID NO: 258289 - protein, 25 aa, Mycobacterium
FPPGPDADQPGKAGLAVDGNPSTSW

SEQ ID NO: 258290 - protein, 6 aa, Mycobacterium
FPPPSD

SEQ ID NO: 258291 - protein, 7 aa, Mycobacterium
FPPPTDV

SEQ ID NO: 258292 - protein, 12 aa, Mycobacterium
FPPPYPPPQPGF

SEQ ID NO: 258293 - protein, 9 aa, Mycobacterium
FPPQSRTTG

SEQ ID NO: 258294 - protein, 6 aa, Mycobacterium
FPPSEW

SEQ ID NO: 258295 - protein, 5 aa, Mycobacterium
FPPST

SEQ ID NO: 258296 - protein, 18 aa, Mycobacterium
FPPTGAARAGNGHKDEDA

SEQ ID NO: 258297 - protein, 8 aa, Mycobacterium
FPQDNPAA

SEQ ID NO: 258298 - protein, 4 aa, Mycobacterium
FPQR

SEQ ID NO: 258299 - protein, 10 aa, Mycobacterium
FPRGSARNVA

SEQ ID NO: 258300 - protein, 23 aa, Mycobacterium
FPRPATPASAAAPPHSAYRPAQT

SEQ ID NO: 258301 - protein, 12 aa, Mycobacterium
FPRTGPGALAPM

SEQ ID NO: 258302 - protein, 14 aa, Mycobacterium
FPRTGPGSLAGTGR

SEQ ID NO: 258303 - protein, 10 aa, Mycobacterium
FPSADEASRF

SEQ ID NO: 258304 - protein, 7 aa, Mycobacterium
FPSAGGA

SEQ ID NO: 258305 - protein, 10 aa, Mycobacterium
FPSAGTGSEI

SEQ ID NO: 258306 - protein, 7 aa, Mycobacterium
FPSASAS

SEQ ID NO: 258307 - protein, 9 aa, Mycobacterium
FPSDVAAGE

SEQ ID NO: 258308 - protein, 9 aa, Mycobacterium
FPSEPTTTV

SEQ ID NO: 258309 - protein, 4 aa, Mycobacterium
FPSG

SEQ ID NO: 258310 - protein, 6 aa, Mycobacterium
FPSGSR

SEQ ID NO: 258311 - protein, 8 aa, Mycobacterium
FPSLPGLP

SEQ ID NO: 258312 - protein, 4 aa, Mycobacterium
FPSP

SEQ ID NO: 258313 - protein, 18 aa, Mycobacterium
FPSPPDWTPTATAPFKSA

SEQ ID NO: 258314 - protein, 12 aa, Mycobacterium
FPSSASADPHGY

SEQ ID NO: 258315 - protein, 4 aa, Mycobacterium
FPST

SEQ ID NO: 258316 - protein, 9 aa, Mycobacterium
FPSTAGSIA

SEQ ID NO: 258317 - protein, 6 aa, Mycobacterium
FPSTQR

SEQ ID NO: 258318 - protein, 13 aa, Mycobacterium
FPSTSSAEHTDPR

SEQ ID NO: 258319 - protein, 4 aa, Mycobacterium
FPSY

SEQ ID NO: 258320 - protein, 15 aa, Mycobacterium
FPTANESDGGIEPAS

SEQ ID NO: 258321 - protein, 8 aa, Mycobacterium
FPTDRGWD

SEQ ID NO: 258322 - protein, 6 aa, Mycobacterium
FPTPPL

SEQ ID NO: 258323 - protein, 21 aa, Mycobacterium
FPTPTPAPAPTQTSSPAISSS

SEQ ID NO: 258324 - protein, 8 aa, Mycobacterium
FPTSDEGG

SEQ ID NO: 258325 - protein, 4 aa, Mycobacterium
FPTT

SEQ ID NO: 258326 - protein, 15 aa, Mycobacterium
FPVGPDPSTTSAPDQ

SEQ ID NO: 258327 - protein, 5 aa, Mycobacterium
FPYKG

SEQ ID NO: 258328 - protein, 8 aa, Mycobacterium
FQESDSNS

SEQ ID NO: 258329 - protein, 8 aa, Mycobacterium
FQESDSTN

SEQ ID NO: 258330 - protein, 7 aa, Mycobacterium
FQESGND

SEQ ID NO: 258331 - protein, 8 aa, Mycobacterium
FQESNSTN

SEQ ID NO: 258332 - protein, 11 aa, Mycobacterium
FQGAAAGDEVV

SEQ ID NO: 258333 - protein, 5 aa, Mycobacterium
FQGSA

SEQ ID NO: 258334 - protein, 15 aa, Mycobacterium
FQGTAASDEAVKRSG

SEQ ID NO: 258335 - protein, 11 aa, Mycobacterium
FQNSAQSQTTM

SEQ ID NO: 258336 - protein, 50 aa, Mycobacterium
FQPDIPADEPQRSTSRPPEPANGDIGGETRRGPASFDAPRERAADSPGDD

SEQ ID NO: 258337 - protein, 23 aa, Mycobacterium
FQPKGARQDPNDPNTTQTAGSIR

SEQ ID NO: 258338 - protein, 4 aa, Mycobacterium
FQPL

SEQ ID NO: 258339 - protein, 5 aa, Mycobacterium
FQPPM

SEQ ID NO: 258340 - protein, 7 aa, Mycobacterium
FQPPNAV

SEQ ID NO: 258341 - protein, 5 aa, Mycobacterium
FQPPQ

SEQ ID NO: 258342 - protein, 15 aa, Mycobacterium
FQPQEAAASDRTDAE

SEQ ID NO: 258343 - protein, 15 aa, Mycobacterium
FQPQEGAASDRTDAE

SEQ ID NO: 258344 - protein, 20 aa, Mycobacterium
FQPSYNERQAQPSDSPANVG

SEQ ID NO: 258345 - protein, 9 aa, Mycobacterium
FQQYDSDTT

SEQ ID NO: 258346 - protein, 9 aa, Mycobacterium
FQRSGEGGY

SEQ ID NO: 258347 - protein, 10 aa, Mycobacterium
FQSGNDPVAN

SEQ ID NO: 258348 - protein, 6 aa, Mycobacterium
FQTATG

SEQ ID NO: 258349 - protein, 6 aa, Mycobacterium
FQTSGG

SEQ ID NO: 258350 - protein, 5 aa, Mycobacterium
FRAAT

SEQ ID NO: 258351 - protein, 8 aa, Mycobacterium
FRDGNAGN

SEQ ID NO: 258352 - protein, 4 aa, Mycobacterium
FREA

SEQ ID NO: 258353 - protein, 8 aa, Mycobacterium
FREQGASP

SEQ ID NO: 258354 - protein, 46 aa, Mycobacterium
FRGGPPPGAPGPGQLPGAPKPPAPGQLPGGPQSPAPTPAPATPGAH

SEQ ID NO: 258355 - protein, 4 aa, Mycobacterium
FRGK

SEQ ID NO: 258356 - protein, 6 aa, Mycobacterium
FRGKSA

SEQ ID NO: 258357 - protein, 4 aa, Mycobacterium
FRGP

SEQ ID NO: 258358 - protein, 16 aa, Mycobacterium
FRGPAENSTPPDSCSA

SEQ ID NO: 258359 - protein, 8 aa, Mycobacterium
FRGSTAER

SEQ ID NO: 258360 - protein, 5 aa, Mycobacterium
FRPNQ

SEQ ID NO: 258361 - protein, 19 aa, Mycobacterium
FRPPEAAADVGGAGAVGKA

SEQ ID NO: 258362 - protein, 7 aa, Mycobacterium
FRPQPAP

SEQ ID NO: 258363 - protein, 15 aa, Mycobacterium
FRPSASESRRGRTRR

SEQ ID NO: 258364 - protein, 6 aa, Mycobacterium
FRQPGE

SEQ ID NO: 258365 - protein, 12 aa, Mycobacterium
FRQPGEVSLTPA

SEQ ID NO: 258366 - protein, 22 aa, Mycobacterium
FRRPTAVSRGTGDEDTAALPVP

SEQ ID NO: 258367 - protein, 6 aa, Mycobacterium
FRSPES

SEQ ID NO: 258368 - protein, 9 aa, Mycobacterium
FRSSGEGGY

SEQ ID NO: 258369 - protein, 25 aa, Mycobacterium
FRTARRAGTTVHSRSRQPEDCVTTT

SEQ ID NO: 258370 - protein, 5 aa, Mycobacterium
FRTPP

SEQ ID NO: 258371 - protein, 5 aa, Mycobacterium
FSAPG

SEQ ID NO: 258372 - protein, 6 aa, Mycobacterium
FSAPGA

SEQ ID NO: 258373 - protein, 6 aa, Mycobacterium
FSASPG

SEQ ID NO: 258374 - protein, 10 aa, Mycobacterium
FSATTTTGDI

SEQ ID NO: 258375 - protein, 9 aa, Mycobacterium
FSDADSPDR

SEQ ID NO: 258376 - protein, 4 aa, Mycobacterium
FSDG

SEQ ID NO: 258377 - protein, 9 aa, Mycobacterium
FSDGDSGRK

SEQ ID NO: 258378 - protein, 6 aa, Mycobacterium
FSDNSD

SEQ ID NO: 258379 - protein, 5 aa, Mycobacterium
FSDTA

SEQ ID NO: 258380 - protein, 9 aa, Mycobacterium
FSDTYSSAA

SEQ ID NO: 258381 - protein, 11 aa, Mycobacterium
FSEHADGRDRL

SEQ ID NO: 258382 - protein, 8 aa, Mycobacterium
FSEPDPPP

SEQ ID NO: 258383 - protein, 5 aa, Mycobacterium
FSFGG

SEQ ID NO: 258384 - protein, 5 aa, Mycobacterium
FSGAV

SEQ ID NO: 258385 - protein, 4 aa, Mycobacterium
FSGD

SEQ ID NO: 258386 - protein, 6 aa, Mycobacterium
FSGDQI

SEQ ID NO: 258387 - protein, 5 aa, Mycobacterium
FSGET

SEQ ID NO: 258388 - protein, 15 aa, Mycobacterium
FSGGDAIRPRPNIED

SEQ ID NO: 258389 - protein, 9 aa, Mycobacterium
FSGGGVEGL

SEQ ID NO: 258390 - protein, 7 aa, Mycobacterium
FSGGQRQ

SEQ ID NO: 258391 - protein, 8 aa, Mycobacterium
FSGGTAAV

SEQ ID NO: 258392 - protein, 6 aa, Mycobacterium
FSGGTC

SEQ ID NO: 258393 - protein, 7 aa, Mycobacterium
FSGNSEF

SEQ ID NO: 258394 - protein, 8 aa, Mycobacterium
FSGPDGGW

SEQ ID NO: 258395 - protein, 8 aa, Mycobacterium
FSGPPTPA

SEQ ID NO: 258396 - protein, 10 aa, Mycobacterium
FSGQALSDTG

SEQ ID NO: 258397 - protein, 8 aa, Mycobacterium
FSGRDNPI

SEQ ID NO: 258398 - protein, 6 aa, Mycobacterium
FSGRST

SEQ ID NO: 258399 - protein, 16 aa, Mycobacterium
FSGSPTNVRVTGPPAT

SEQ ID NO: 258400 - protein, 4 aa, Mycobacterium
FSGT

SEQ ID NO: 258401 - protein, 10 aa, Mycobacterium
FSGTPATEPI

SEQ ID NO: 258402 - protein, 18 aa, Mycobacterium
FSGTTGGGDGSGGAAVSE

SEQ ID NO: 258403 - protein, 22 aa, Mycobacterium
FSKRPGGRPYAPGVDLGSDDGV

SEQ ID NO: 258404 - protein, 4 aa, Mycobacterium
FSNG

SEQ ID NO: 258405 - protein, 12 aa, Mycobacterium
FSPAPDDYRDTP

SEQ ID NO: 258406 - protein, 14 aa, Mycobacterium
FSPDGAPDNPQQAS

SEQ ID NO: 258407 - protein, 14 aa, Mycobacterium
FSPDGEADNPGQAD

SEQ ID NO: 258408 - protein, 25 aa, Mycobacterium
FSPDGGRIVSGSPDGRRTPPGSVEG

SEQ ID NO: 258409 - protein, 6 aa, Mycobacterium
FSPDGH

SEQ ID NO: 258410 - protein, 16 aa, Mycobacterium
FSPDGKRVASGSGDRT

SEQ ID NO: 258411 - protein, 7 aa, Mycobacterium
FSPDGQA

SEQ ID NO: 258412 - protein, 16 aa, Mycobacterium
FSPDGRRIVSGSADDT

SEQ ID NO: 258413 - protein, 16 aa, Mycobacterium
FSPDGRRIVSGSADST

SEQ ID NO: 258414 - protein, 16 aa, Mycobacterium
FSPDGRRIVSGSDDKT

SEQ ID NO: 258415 - protein, 15 aa, Mycobacterium
FSPDGTRIASGSRDG

SEQ ID NO: 258416 - protein, 7 aa, Mycobacterium
FSPDNSR

SEQ ID NO: 258417 - protein, 5 aa, Mycobacterium
FSPDP

SEQ ID NO: 258418 - protein, 11 aa, Mycobacterium
FSPDQVGSTAQ

SEQ ID NO: 258419 - protein, 6 aa, Mycobacterium
FSPDSQ

SEQ ID NO: 258420 - protein, 7 aa, Mycobacterium
FSPEDTA

SEQ ID NO: 258421 - protein, 19 aa, Mycobacterium
FSPEPDDDADDQELAHPSR

SEQ ID NO: 258422 - protein, 4 aa, Mycobacterium
FSPG

SEQ ID NO: 258423 - protein, 13 aa, Mycobacterium
FSPGAPNASADRA

SEQ ID NO: 258424 - protein, 14 aa, Mycobacterium
FSPGGTPDHPGQAG

SEQ ID NO: 258425 - protein, 8 aa, Mycobacterium
FSPGTADS

SEQ ID NO: 258426 - protein, 7 aa, Mycobacterium
FSPNGVP

SEQ ID NO: 258427 - protein, 9 aa, Mycobacterium
FSPNGVPDH

SEQ ID NO: 258428 - protein, 42 aa, Mycobacterium
FSPPLPGSGPQGSWYPPADPAYADQAAYAPTYGSQPPPWAPG

SEQ ID NO: 258429 - protein, 5 aa, Mycobacterium
FSPPR

SEQ ID NO: 258430 - protein, 4 aa, Mycobacterium
FSPS

SEQ ID NO: 258431 - protein, 6 aa, Mycobacterium
FSPSLQ

SEQ ID NO: 258432 - protein, 6 aa, Mycobacterium
FSPSRM

SEQ ID NO: 258433 - protein, 12 aa, Mycobacterium
FSPTAPNASVDR

SEQ ID NO: 258434 - protein, 11 aa, Mycobacterium
FSPTAPTDAID

SEQ ID NO: 258435 - protein, 20 aa, Mycobacterium
FSQGNDATQIAEDARSPWDE

SEQ ID NO: 258436 - protein, 8 aa, Mycobacterium
FSQPSSRA

SEQ ID NO: 258437 - protein, 34 aa, Mycobacterium
FSQTPSAVETVEPADRIDTSGLPAVGDDATLPRD

SEQ ID NO: 258438 - protein, 8 aa, Mycobacterium
FSQTSADG

SEQ ID NO: 258439 - protein, 18 aa, Mycobacterium
FSRANDAIKAATGRTPTL

SEQ ID NO: 258440 - protein, 4 aa, Mycobacterium
FSRK

SEQ ID NO: 258441 - protein, 7 aa, Mycobacterium
FSRNGTR

SEQ ID NO: 258442 - protein, 12 aa, Mycobacterium
FSRTAQPSPDRP

SEQ ID NO: 258443 - protein, 4 aa, Mycobacterium
FSSA

SEQ ID NO: 258444 - protein, 7 aa, Mycobacterium
FSSARSH

SEQ ID NO: 258445 - protein, 10 aa, Mycobacterium
FSSDAQGIAN

SEQ ID NO: 258446 - protein, 17 aa, Mycobacterium
FSSDGRRIVSGGSIADG

SEQ ID NO: 258447 - protein, 5 aa, Mycobacterium
FSSDP

SEQ ID NO: 258448 - protein, 7 aa, Mycobacterium
FSSGDVT

SEQ ID NO: 258449 - protein, 7 aa, Mycobacterium
FSSGTAV

SEQ ID NO: 258450 - protein, 35 aa, Mycobacterium
FSSPPPMQTVGTSTTAPPPPTSVPPPTSAAPLPPP

SEQ ID NO: 258451 - protein, 6 aa, Mycobacterium
FSSSPE

SEQ ID NO: 258452 - protein, 6 aa, Mycobacterium
FSSSPT

SEQ ID NO: 258453 - protein, 4 aa, Mycobacterium
FSTD

SEQ ID NO: 258454 - protein, 6 aa, Mycobacterium
FSTDGH

SEQ ID NO: 258455 - protein, 16 aa, Mycobacterium
FSTGVTDHRPERAAPF

SEQ ID NO: 258456 - protein, 5 aa, Mycobacterium
FSTPT

SEQ ID NO: 258457 - protein, 6 aa, Mycobacterium
FSTSAA

SEQ ID NO: 258458 - protein, 12 aa, Mycobacterium
FSTSDDDAAKFD

SEQ ID NO: 258459 - protein, 12 aa, Mycobacterium
FSTSDDEAAPFD

SEQ ID NO: 258460 - protein, 19 aa, Mycobacterium
FSTSNDDAAKFDPETVQGD

SEQ ID NO: 258461 - protein, 7 aa, Mycobacterium
FSTSNDV

SEQ ID NO: 258462 - protein, 7 aa, Mycobacterium
FSTSNPH

SEQ ID NO: 258463 - protein, 8 aa, Mycobacterium
FSTTDENN

SEQ ID NO: 258464 - protein, 8 aa, Mycobacterium
FSTTDPGK

SEQ ID NO: 258465 - protein, 10 aa, Mycobacterium
FSVPEDPPAG

SEQ ID NO: 258466 - protein, 6 aa, Mycobacterium
FTAGDG

SEQ ID NO: 258467 - protein, 8 aa, Mycobacterium
FTAGDNRT

SEQ ID NO: 258468 - protein, 5 aa, Mycobacterium
FTAGP

SEQ ID NO: 258469 - protein, 6 aa, Mycobacterium
FTAGPA

SEQ ID NO: 258470 - protein, 9 aa, Mycobacterium
FTAGTPVQA

SEQ ID NO: 258471 - protein, 11 aa, Mycobacterium
FTAPKSPIGYA

SEQ ID NO: 258472 - protein, 9 aa, Mycobacterium
FTARGDSDS

SEQ ID NO: 258473 - protein, 9 aa, Mycobacterium
FTATTSNNC

SEQ ID NO: 258474 - protein, 10 aa, Mycobacterium
FTDADGNPLP

SEQ ID NO: 258475 - protein, 5 aa, Mycobacterium
FTDAG

SEQ ID NO: 258476 - protein, 8 aa, Mycobacterium
FTDDNAKS

SEQ ID NO: 258477 - protein, 8 aa, Mycobacterium
FTDGDTRT

SEQ ID NO: 258478 - protein, 9 aa, Mycobacterium
FTDGPIPAA

SEQ ID NO: 258479 - protein, 9 aa, Mycobacterium
FTDGSDGFG

SEQ ID NO: 258480 - protein, 7 aa, Mycobacterium
FTDGTND

SEQ ID NO: 258481 - protein, 4 aa, Mycobacterium
FTDL

SEQ ID NO: 258482 - protein, 9 aa, Mycobacterium
FTDNPVPAA

SEQ ID NO: 258483 - protein, 8 aa, Mycobacterium
FTDPGPGR

SEQ ID NO: 258484 - protein, 4 aa, Mycobacterium
FTDY

SEQ ID NO: 258485 - protein, 5 aa, Mycobacterium
FTEAN

SEQ ID NO: 258486 - protein, 12 aa, Mycobacterium
FTGAGFTTTESE

SEQ ID NO: 258487 - protein, 11 aa, Mycobacterium
FTGGDNAPTLE

SEQ ID NO: 258488 - protein, 5 aa, Mycobacterium
FTGGE

SEQ ID NO: 258489 - protein, 8 aa, Mycobacterium
FTGGGMPD

SEQ ID NO: 258490 - protein, 17 aa, Mycobacterium
FTGGPEGEILMRLRKRH

SEQ ID NO: 258491 - protein, 5 aa, Mycobacterium
FTGGT

SEQ ID NO: 258492 - protein, 23 aa, Mycobacterium
FTGKGGALSSGKYAPDLEPANEQ

SEQ ID NO: 258493 - protein, 23 aa, Mycobacterium
FTGKGGALSSGKYAPNLEPANEQ

SEQ ID NO: 258494 - protein, 4 aa, Mycobacterium
FTGN

SEQ ID NO: 258495 - protein, 6 aa, Mycobacterium
FTGNGG

SEQ ID NO: 258496 - protein, 36 aa, Mycobacterium
FTGNPEAERRGRSFDHADGDDAKKTEPVPVAAGQTQ

SEQ ID NO: 258497 - protein, 12 aa, Mycobacterium
FTGPQDASNPLP

SEQ ID NO: 258498 - protein, 10 aa, Mycobacterium
FTGTANNVDT

SEQ ID NO: 258499 - protein, 9 aa, Mycobacterium
FTGTDSPHY

SEQ ID NO: 258500 - protein, 13 aa, Mycobacterium
FTKQYKDKTGKTI

SEQ ID NO: 258501 - protein, 8 aa, Mycobacterium
FTNTDQEL

SEQ ID NO: 258502 - protein, 5 aa, Mycobacterium
FTPAA

SEQ ID NO: 258503 - protein, 32 aa, Mycobacterium
FTPAGTEPFDADQASEVRRAAERTAARGAELA

SEQ ID NO: 258504 - protein, 22 aa, Mycobacterium
FTPAPQHNSPAASTAASTTNVT

SEQ ID NO: 258505 - protein, 8 aa, Mycobacterium
FTPAQATS

SEQ ID NO: 258506 - protein, 4 aa, Mycobacterium
FTPD

SEQ ID NO: 258507 - protein, 15 aa, Mycobacterium
FTPDPAVRPDGDGAG

SEQ ID NO: 258508 - protein, 10 aa, Mycobacterium
FTPDPRPAKV

SEQ ID NO: 258509 - protein, 10 aa, Mycobacterium
FTPDPRPNAV

SEQ ID NO: 258510 - protein, 11 aa, Mycobacterium
FTPDQMGSTAQ

SEQ ID NO: 258511 - protein, 11 aa, Mycobacterium
FTPEAAASGPL

SEQ ID NO: 258512 - protein, 5 aa, Mycobacterium
FTPEE

SEQ ID NO: 258513 - protein, 13 aa, Mycobacterium
FTPEEVENETRGG

SEQ ID NO: 258514 - protein, 11 aa, Mycobacterium
FTPESIGDTAQ

SEQ ID NO: 258515 - protein, 4 aa, Mycobacterium
FTPG

SEQ ID NO: 258516 - protein, 12 aa, Mycobacterium
FTPGAPDSSIDR

SEQ ID NO: 258517 - protein, 20 aa, Mycobacterium
FTPGSPSGGSGGSPGGPGGT

SEQ ID NO: 258518 - protein, 5 aa, Mycobacterium
FTPKT

SEQ ID NO: 258519 - protein, 13 aa, Mycobacterium
FTPNGIPADVSAD

SEQ ID NO: 258520 - protein, 10 aa, Mycobacterium
FTPNPRPNAV

SEQ ID NO: 258521 - protein, 17 aa, Mycobacterium
FTPPSTPRPTPSEAEFT

SEQ ID NO: 258522 - protein, 12 aa, Mycobacterium
FTPQASAVAGSV

SEQ ID NO: 258523 - protein, 11 aa, Mycobacterium
FTPQPPATATT

SEQ ID NO: 258524 - protein, 4 aa, Mycobacterium
FTPS

SEQ ID NO: 258525 - protein, 8 aa, Mycobacterium
FTPTRKRG

SEQ ID NO: 258526 - protein, 9 aa, Mycobacterium
FTQPTTTKK

SEQ ID NO: 258527 - protein, 7 aa, Mycobacterium
FTRGDSR

SEQ ID NO: 258528 - protein, 9 aa, Mycobacterium
FTRGDTRTA

SEQ ID NO: 258529 - protein, 17 aa, Mycobacterium
FTRGRASTAETQSTESS

SEQ ID NO: 258530 - protein, 7 aa, Mycobacterium
FTRTGDV

SEQ ID NO: 258531 - protein, 24 aa, Mycobacterium
FTSEATGDVRTGGADGADTATGPT

SEQ ID NO: 258532 - protein, 5 aa, Mycobacterium
FTSRP

SEQ ID NO: 258533 - protein, 11 aa, Mycobacterium
FTSRPVSRTPV

SEQ ID NO: 258534 - protein, 8 aa, Mycobacterium
FTSRSTGL

SEQ ID NO: 258535 - protein, 10 aa, Mycobacterium
FTSSTKASEW

SEQ ID NO: 258536 - protein, 4 aa, Mycobacterium
FTST

SEQ ID NO: 258537 - protein, 10 aa, Mycobacterium
FTTDPQGIAD

SEQ ID NO: 258538 - protein, 10 aa, Mycobacterium
FTTGPTATVG

SEQ ID NO: 258539 - protein, 11 aa, Mycobacterium
FTTSPGPNGEV

SEQ ID NO: 258540 - protein, 11 aa, Mycobacterium
FTTTGEPDTLT

SEQ ID NO: 258541 - protein, 9 aa, Mycobacterium
FTYPGADRP

SEQ ID NO: 258542 - protein, 10 aa, Mycobacterium
FTYPGADRPV

SEQ ID NO: 258543 - protein, 14 aa, Mycobacterium
FTYTPGAAAAGRAD

SEQ ID NO: 258544 - protein, 6 aa, Mycobacterium
FVEGRG

SEQ ID NO: 258545 - protein, 4 aa, Mycobacterium
FVGT

SEQ ID NO: 258546 - protein, 9 aa, Mycobacterium
FVPQDRPRT

SEQ ID NO: 258547 - protein, 10 aa, Mycobacterium
FYDEGSQSVT

SEQ ID NO: 258548 - protein, 27 aa, Mycobacterium
FYGGGSVPPDGSNGPPPPDYKPPQPGK

SEQ ID NO: 258549 - protein, 9 aa, Mycobacterium
FYGGSAAPL

SEQ ID NO: 258550 - protein, 5 aa, Mycobacterium
FYPTG

SEQ ID NO: 258551 - protein, 4 aa, Mycobacterium
FYSN

SEQ ID NO: 258552 - protein, 5 aa, Mycobacterium
FYSNP

SEQ ID NO: 258553 - protein, 9 aa, Mycobacterium
GAAAAATVA

SEQ ID NO: 258554 - protein, 13 aa, Mycobacterium
GAAAAGGAAAAIT

SEQ ID NO: 258555 - protein, 12 aa, Mycobacterium
GAAAAMESLAGP

SEQ ID NO: 258556 - protein, 8 aa, Mycobacterium
GAAAASDL

SEQ ID NO: 258557 - protein, 6 aa, Mycobacterium
GAAADI

SEQ ID NO: 258558 - protein, 5 aa, Mycobacterium
GAAAE

SEQ ID NO: 258559 - protein, 6 aa, Mycobacterium
GAAAEA

SEQ ID NO: 258560 - protein, 18 aa, Mycobacterium
GAAAESSDPWNNAGTGHS

SEQ ID NO: 258561 - protein, 5 aa, Mycobacterium
GAAAG

SEQ ID NO: 258562 - protein, 14 aa, Mycobacterium
GAAAGAAARPWQPP

SEQ ID NO: 258563 - protein, 6 aa, Mycobacterium
GAAAGI

SEQ ID NO: 258564 - protein, 16 aa, Mycobacterium
GAAAGLGDAAGKLAAA

SEQ ID NO: 258565 - protein, 9 aa, Mycobacterium
GAAAGTQVS

SEQ ID NO: 258566 - protein, 8 aa, Mycobacterium
GAAALGEV

SEQ ID NO: 258567 - protein, 7 aa, Mycobacterium
GAAANGL

SEQ ID NO: 258568 - protein, 80 aa, Mycobacterium
GAAAPAPAAVGDRHSAHHRGGAGHHDPGRAAHHDHQRAGRQRPRRPRWPRAGRPASSTAATAAVTDAEQRSATISPGPLA

SEQ ID NO: 258569 - protein, 5 aa, Mycobacterium
GAAAQ

SEQ ID NO: 258570 - protein, 8 aa, Mycobacterium
GAAASALL

SEQ ID NO: 258571 - protein, 7 aa, Mycobacterium
GAAASTQ

SEQ ID NO: 258572 - protein, 9 aa, Mycobacterium
GAAATAAAL

SEQ ID NO: 258573 - protein, 6 aa, Mycobacterium
GAAATD

SEQ ID NO: 258574 - protein, 12 aa, Mycobacterium
GAAATSRGEPLA

SEQ ID NO: 258575 - protein, 6 aa, Mycobacterium
GAAATV

SEQ ID NO: 258576 - protein, 6 aa, Mycobacterium
GAADGS

SEQ ID NO: 258577 - protein, 11 aa, Mycobacterium
GAADGTGFSEG

SEQ ID NO: 258578 - protein, 8 aa, Mycobacterium
GAADRPHK

SEQ ID NO: 258579 - protein, 10 aa, Mycobacterium
GAAEESSIDQ

SEQ ID NO: 258580 - protein, 8 aa, Mycobacterium
GAAEGRPP

SEQ ID NO: 258581 - protein, 19 aa, Mycobacterium
GAAEGSSGCRPGPPGNRRR

SEQ ID NO: 258582 - protein, 8 aa, Mycobacterium
GAAELTEE

SEQ ID NO: 258583 - protein, 6 aa, Mycobacterium
GAAETV

SEQ ID NO: 258584 - protein, 10 aa, Mycobacterium
GAAGADHPGD

SEQ ID NO: 258585 - protein, 26 aa, Mycobacterium
GAAGAEDDEPTESAETQRAGELAEPH

SEQ ID NO: 258586 - protein, 14 aa, Mycobacterium
GAAGDDKPANPPHP

SEQ ID NO: 258587 - protein, 6 aa, Mycobacterium
GAAGEP

SEQ ID NO: 258588 - protein, 10 aa, Mycobacterium
GAAGERSVSD

SEQ ID NO: 258589 - protein, 7 aa, Mycobacterium
GAAGGAL

SEQ ID NO: 258590 - protein, 7 aa, Mycobacterium
GAAGGGY

SEQ ID NO: 258591 - protein, 15 aa, Mycobacterium
GAAGGIGTGGDREPP

SEQ ID NO: 258592 - protein, 20 aa, Mycobacterium
GAAGGPSGAASTDNLWLTRP

SEQ ID NO: 258593 - protein, 9 aa, Mycobacterium
GAAGGPVAA

SEQ ID NO: 258594 - protein, 11 aa, Mycobacterium
GAAGHAGPQHV

SEQ ID NO: 258595 - protein, 5 aa, Mycobacterium
GAAGL

SEQ ID NO: 258596 - protein, 7 aa, Mycobacterium
GAAGNAA

SEQ ID NO: 258597 - protein, 6 aa, Mycobacterium
GAAGPF

SEQ ID NO: 258598 - protein, 7 aa, Mycobacterium
GAAGPTW

SEQ ID NO: 258599 - protein, 19 aa, Mycobacterium
GAAGQLSPRSSQQSAPSQT

SEQ ID NO: 258600 - protein, 12 aa, Mycobacterium
GAAGSAVATDLG

SEQ ID NO: 258601 - protein, 6 aa, Mycobacterium
GAAGSL

SEQ ID NO: 258602 - protein, 8 aa, Mycobacterium
GAAGSTLA

SEQ ID NO: 258603 - protein, 16 aa, Mycobacterium
GAAGTLPAEKKPQVGG

SEQ ID NO: 258604 - protein, 15 aa, Mycobacterium
GAAGTLPPEKKPQVG

SEQ ID NO: 258605 - protein, 7 aa, Mycobacterium
GAAGVAA

SEQ ID NO: 258606 - protein, 8 aa, Mycobacterium
GAAGVSGA

SEQ ID NO: 258607 - protein, 9 aa, Mycobacterium
GAAGVTGAG

SEQ ID NO: 258608 - protein, 12 aa, Mycobacterium
GAAHPAHRPALV

SEQ ID NO: 258609 - protein, 7 aa, Mycobacterium
GAAHPEQ

SEQ ID NO: 258610 - protein, 11 aa, Mycobacterium
GAAIASTDRCD

SEQ ID NO: 258611 - protein, 15 aa, Mycobacterium
GAAKRAREARHASRE

SEQ ID NO: 258612 - protein, 6 aa, Mycobacterium
GAALAG

SEQ ID NO: 258613 - protein, 6 aa, Mycobacterium
GAALEG

SEQ ID NO: 258614 - protein, 5 aa, Mycobacterium
GAALP

SEQ ID NO: 258615 - protein, 5 aa, Mycobacterium
GAANA

SEQ ID NO: 258616 - protein, 7 aa, Mycobacterium
GAANGSA

SEQ ID NO: 258617 - protein, 9 aa, Mycobacterium
GAANIASGA

SEQ ID NO: 258618 - protein, 6 aa, Mycobacterium
GAANRV

SEQ ID NO: 258619 - protein, 4 aa, Mycobacterium
GAAP

SEQ ID NO: 258620 - protein, 29 aa, Mycobacterium
GAAPADPTVPADAVTASGSGLDPDISPAY

SEQ ID NO: 258621 - protein, 9 aa, Mycobacterium
GAAPAGDGE

SEQ ID NO: 258622 - protein, 24 aa, Mycobacterium
GAAPAPAPTPTPEPATEPAAPAPP

SEQ ID NO: 258623 - protein, 36 aa, Mycobacterium
GAAPASAGSAAAAPTHTTQAPSAETAAAAAQPGGDS

SEQ ID NO: 258624 - protein, 7 aa, Mycobacterium
GAAPASP

SEQ ID NO: 258625 - protein, 28 aa, Mycobacterium
GAAPDTPAVPADAVTASGSGLDPHISPS

SEQ ID NO: 258626 - protein, 10 aa, Mycobacterium
GAAPEQADAA

SEQ ID NO: 258627 - protein, 5 aa, Mycobacterium
GAAPG

SEQ ID NO: 258628 - protein, 10 aa, Mycobacterium
GAAPGDAGAV

SEQ ID NO: 258629 - protein, 10 aa, Mycobacterium
GAAPGHDITG

SEQ ID NO: 258630 - protein, 10 aa, Mycobacterium
GAAPGSSVDD

SEQ ID NO: 258631 - protein, 10 aa, Mycobacterium
GAAPNQSVTD

SEQ ID NO: 258632 - protein, 11 aa, Mycobacterium
GAAPPAAASTL

SEQ ID NO: 258633 - protein, 61 aa, Mycobacterium
GAAPPGPARTGQPMYPSSSAPWRPTGYPASPAPPPPSNFPPPPPRPGPQPPQQATKPPEVA

SEQ ID NO: 258634 - protein, 38 aa, Mycobacterium
GAAPRDEGRDQYRDEPRPDRRSRPRAPRRPQAESWEYD

SEQ ID NO: 258635 - protein, 7 aa, Mycobacterium
GAAPREL

SEQ ID NO: 258636 - protein, 10 aa, Mycobacterium
GAAPRPPVSD

SEQ ID NO: 258637 - protein, 8 aa, Mycobacterium
GAAPRYGL

SEQ ID NO: 258638 - protein, 30 aa, Mycobacterium
GAAPSPRTAAPATTSASAAPPTSPGPVAPD

SEQ ID NO: 258639 - protein, 6 aa, Mycobacterium
GAAPTA

SEQ ID NO: 258640 - protein, 14 aa, Mycobacterium
GAAPTERAGQATGI

SEQ ID NO: 258641 - protein, 13 aa, Mycobacterium
GAAPTGRRPLAER

SEQ ID NO: 258642 - protein, 6 aa, Mycobacterium
GAAPTT

SEQ ID NO: 258643 - protein, 8 aa, Mycobacterium
GAAPTTGY

SEQ ID NO: 258644 - protein, 9 aa, Mycobacterium
GAAPTTGYT

SEQ ID NO: 258645 - protein, 8 aa, Mycobacterium
GAAPTTSY

SEQ ID NO: 258646 - protein, 7 aa, Mycobacterium
GAAPWSA

SEQ ID NO: 258647 - protein, 12 aa, Mycobacterium
GAAPYELSKPVA

SEQ ID NO: 258648 - protein, 8 aa, Mycobacterium
GAAQANAA

SEQ ID NO: 258649 - protein, 7 aa, Mycobacterium
GAAQASA

SEQ ID NO: 258650 - protein, 9 aa, Mycobacterium
GAAQAVEDA

SEQ ID NO: 258651 - protein, 5 aa, Mycobacterium
GAAQE

SEQ ID NO: 258652 - protein, 20 aa, Mycobacterium
GAAQGPYAAASTDHLWLTRP

SEQ ID NO: 258653 - protein, 19 aa, Mycobacterium
GAAQSAEGFAPAGAATQMA

SEQ ID NO: 258654 - protein, 10 aa, Mycobacterium
GAAQSGPTQY

SEQ ID NO: 258655 - protein, 14 aa, Mycobacterium
GAARDAQKKGDFAA

SEQ ID NO: 258656 - protein, 14 aa, Mycobacterium
GAARDLGPRPRTGH

SEQ ID NO: 258657 - protein, 8 aa, Mycobacterium
GAARGPEH

SEQ ID NO: 258658 - protein, 7 aa, Mycobacterium
GAARKGP

SEQ ID NO: 258659 - protein, 5 aa, Mycobacterium
GAARP

SEQ ID NO: 258660 - protein, 21 aa, Mycobacterium
GAARPAKPSPKQADAANDESV

SEQ ID NO: 258661 - protein, 21 aa, Mycobacterium
GAARPARPTPKQAHAANDESV

SEQ ID NO: 258662 - protein, 21 aa, Mycobacterium
GAARPATPNPAEAHAANDESV

SEQ ID NO: 258663 - protein, 10 aa, Mycobacterium
GAARSARPNH

SEQ ID NO: 258664 - protein, 16 aa, Mycobacterium
GAARTGARAAPVPLEV

SEQ ID NO: 258665 - protein, 16 aa, Mycobacterium
GAARTGARDAPVPVEV

SEQ ID NO: 258666 - protein, 9 aa, Mycobacterium
GAASAAGGA

SEQ ID NO: 258667 - protein, 9 aa, Mycobacterium
GAASAGDAA

SEQ ID NO: 258668 - protein, 13 aa, Mycobacterium
GAASASAFSTANT

SEQ ID NO: 258669 - protein, 12 aa, Mycobacterium
GAASDLDDQYQA

SEQ ID NO: 258670 - protein, 10 aa, Mycobacterium
GAASDSSLAQ

SEQ ID NO: 258671 - protein, 12 aa, Mycobacterium
GAASGHAPTGAG

SEQ ID NO: 258672 - protein, 7 aa, Mycobacterium
GAASGIG

SEQ ID NO: 258673 - protein, 8 aa, Mycobacterium
GAASGNMR

SEQ ID NO: 258674 - protein, 37 aa, Mycobacterium
GAASGQAAGGEQQSSAGAGGGSASASGDDLFGTSRPS

SEQ ID NO: 258675 - protein, 15 aa, Mycobacterium
GAASGSITGAPSPYI

SEQ ID NO: 258676 - protein, 7 aa, Mycobacterium
GAASNNL

SEQ ID NO: 258677 - protein, 9 aa, Mycobacterium
GAASRQGAL

SEQ ID NO: 258678 - protein, 15 aa, Mycobacterium
GAASSGAISGAPNPY

SEQ ID NO: 258679 - protein, 13 aa, Mycobacterium
GAASSTKDIQDYA

SEQ ID NO: 258680 - protein, 6 aa, Mycobacterium
GAASSV

SEQ ID NO: 258681 - protein, 14 aa, Mycobacterium
GAASTAKDWKDGST

SEQ ID NO: 258682 - protein, 4 aa, Mycobacterium
GAAT

SEQ ID NO: 258683 - protein, 7 aa, Mycobacterium
GAATAGM

SEQ ID NO: 258684 - protein, 10 aa, Mycobacterium
GAATPATRDR

SEQ ID NO: 258685 - protein, 14 aa, Mycobacterium
GAATPDGFSGVAPE

SEQ ID NO: 258686 - protein, 21 aa, Mycobacterium
GAATPGPRENPVDADMSGTEF

SEQ ID NO: 258687 - protein, 15 aa, Mycobacterium
GAATPKPTAKESAIR

SEQ ID NO: 258688 - protein, 24 aa, Mycobacterium
GAATPSPAPAATSGTRSPGPNPAE

SEQ ID NO: 258689 - protein, 17 aa, Mycobacterium
GAATPVVDGTPSAGADW

SEQ ID NO: 258690 - protein, 8 aa, Mycobacterium
GAATQKWP

SEQ ID NO: 258691 - protein, 6 aa, Mycobacterium
GAATQS

SEQ ID NO: 258692 - protein, 5 aa, Mycobacterium
GAATS

SEQ ID NO: 258693 - protein, 4 aa, Mycobacterium
GAAV

SEQ ID NO: 258694 - protein, 6 aa, Mycobacterium
GAAVGE

SEQ ID NO: 258695 - protein, 8 aa, Mycobacterium
GAAVGSAA

SEQ ID NO: 258696 - protein, 8 aa, Mycobacterium
GACAPPGV

SEQ ID NO: 258697 - protein, 30 aa, Mycobacterium
GACAPSRSAATNAGGVAAEQTATEAGGGHY

SEQ ID NO: 258698 - protein, 6 aa, Mycobacterium
GADAAR

SEQ ID NO: 258699 - protein, 7 aa, Mycobacterium
GADAARE

SEQ ID NO: 258700 - protein, 9 aa, Mycobacterium
GADAGAFSG

SEQ ID NO: 258701 - protein, 23 aa, Mycobacterium
GADAKSAARASARKKAPRPDGAE

SEQ ID NO: 258702 - protein, 6 aa, Mycobacterium
GADALD

SEQ ID NO: 258703 - protein, 24 aa, Mycobacterium
GADAPQATPPTPQAAENNEDTGRK

SEQ ID NO: 258704 - protein, 12 aa, Mycobacterium
GADDDFSTTERL

SEQ ID NO: 258705 - protein, 16 aa, Mycobacterium
GADDEDPDAVDTTPTP

SEQ ID NO: 258706 - protein, 30 aa, Mycobacterium
GADDESAAATEESADGADEATDDKPAGRKR

SEQ ID NO: 258707 - protein, 13 aa, Mycobacterium
GADDNYSTKPRVE

SEQ ID NO: 258708 - protein, 4 aa, Mycobacterium
GADE

SEQ ID NO: 258709 - protein, 8 aa, Mycobacterium
GADEDQLS

SEQ ID NO: 258710 - protein, 9 aa, Mycobacterium
GADESGRRT

SEQ ID NO: 258711 - protein, 8 aa, Mycobacterium
GADEVSQG

SEQ ID NO: 258712 - protein, 30 aa, Mycobacterium
GADEYGDYGPDDDEFADDYEDEAPAGTRLS

SEQ ID NO: 258713 - protein, 11 aa, Mycobacterium
GADGAATMPHG

SEQ ID NO: 258714 - protein, 9 aa, Mycobacterium
GADGAHRSP

SEQ ID NO: 258715 - protein, 6 aa, Mycobacterium
GADGKA

SEQ ID NO: 258716 - protein, 10 aa, Mycobacterium
GADGKGQDFA

SEQ ID NO: 258717 - protein, 14 aa, Mycobacterium
GADGPADATGLGLG

SEQ ID NO: 258718 - protein, 7 aa, Mycobacterium
GADGPDM

SEQ ID NO: 258719 - protein, 9 aa, Mycobacterium
GADGRPTAG

SEQ ID NO: 258720 - protein, 11 aa, Mycobacterium
GADGRPTATIT

SEQ ID NO: 258721 - protein, 15 aa, Mycobacterium
GADGYRRRVTVLSKH

SEQ ID NO: 258722 - protein, 4 aa, Mycobacterium
GADI

SEQ ID NO: 258723 - protein, 8 aa, Mycobacterium
GADKNGAF

SEQ ID NO: 258724 - protein, 6 aa, Mycobacterium
GADNSI

SEQ ID NO: 258725 - protein, 7 aa, Mycobacterium
GADPCAG

SEQ ID NO: 258726 - protein, 37 aa, Mycobacterium
GADPDEANRRFKERNQQQSQAPSPQSPADLGEPPRTD

SEQ ID NO: 258727 - protein, 37 aa, Mycobacterium
GADPDEANRRFKERNQQSSQPPTPQSPADLGEPPQTN

SEQ ID NO: 258728 - protein, 9 aa, Mycobacterium
GADPEEANR

SEQ ID NO: 258729 - protein, 7 aa, Mycobacterium
GADPERD

SEQ ID NO: 258730 - protein, 8 aa, Mycobacterium
GADPFDET

SEQ ID NO: 258731 - protein, 8 aa, Mycobacterium
GADPGGAH

SEQ ID NO: 258732 - protein, 6 aa, Mycobacterium
GADPST

SEQ ID NO: 258733 - protein, 6 aa, Mycobacterium
GADPTI

SEQ ID NO: 258734 - protein, 4 aa, Mycobacterium
GADQ

SEQ ID NO: 258735 - protein, 14 aa, Mycobacterium
GADQGGLEQVSRAD

SEQ ID NO: 258736 - protein, 5 aa, Mycobacterium
GADQH

SEQ ID NO: 258737 - protein, 6 aa, Mycobacterium
GADQTA

SEQ ID NO: 258738 - protein, 7 aa, Mycobacterium
GADRDTT

SEQ ID NO: 258739 - protein, 13 aa, Mycobacterium
GADRYSEAAPVTD

SEQ ID NO: 258740 - protein, 4 aa, Mycobacterium
GADS

SEQ ID NO: 258741 - protein, 7 aa, Mycobacterium
GADSALT

SEQ ID NO: 258742 - protein, 14 aa, Mycobacterium
GADSASSSGAISDA

SEQ ID NO: 258743 - protein, 9 aa, Mycobacterium
GADSNGSDV

SEQ ID NO: 258744 - protein, 11 aa, Mycobacterium
GADSPAETEPD

SEQ ID NO: 258745 - protein, 8 aa, Mycobacterium
GADSSSSE

SEQ ID NO: 258746 - protein, 6 aa, Mycobacterium
GADTAL

SEQ ID NO: 258747 - protein, 5 aa, Mycobacterium
GADTQ

SEQ ID NO: 258748 - protein, 9 aa, Mycobacterium
GADTQERRA

SEQ ID NO: 258749 - protein, 10 aa, Mycobacterium
GADTQERRAA

SEQ ID NO: 258750 - protein, 18 aa, Mycobacterium
GADTQNRRAAELASGELP

SEQ ID NO: 258751 - protein, 6 aa, Mycobacterium
GADTTH

SEQ ID NO: 258752 - protein, 4 aa, Mycobacterium
GADV

SEQ ID NO: 258753 - protein, 12 aa, Mycobacterium
GADVDAGGSQSH

SEQ ID NO: 258754 - protein, 4 aa, Mycobacterium
GAEA

SEQ ID NO: 258755 - protein, 8 aa, Mycobacterium
GAEAGEAV

SEQ ID NO: 258756 - protein, 8 aa, Mycobacterium
GAEAGTTP

SEQ ID NO: 258757 - protein, 8 aa, Mycobacterium
GAEANSPV

SEQ ID NO: 258758 - protein, 9 aa, Mycobacterium
GAEAPEAQL

SEQ ID NO: 258759 - protein, 5 aa, Mycobacterium
GAEAV

SEQ ID NO: 258760 - protein, 12 aa, Mycobacterium
GAEAVGEFPTDR

SEQ ID NO: 258761 - protein, 6 aa, Mycobacterium
GAEDAD

SEQ ID NO: 258762 - protein, 7 aa, Mycobacterium
GAEEKLE

SEQ ID NO: 258763 - protein, 8 aa, Mycobacterium
GAEEPEPV

SEQ ID NO: 258764 - protein, 5 aa, Mycobacterium
GAEGI

SEQ ID NO: 258765 - protein, 7 aa, Mycobacterium
GAEGSTL

SEQ ID NO: 258766 - protein, 7 aa, Mycobacterium
GAEIAGA

SEQ ID NO: 258767 - protein, 7 aa, Mycobacterium
GAEIPDG

SEQ ID NO: 258768 - protein, 14 aa, Mycobacterium
GAEIPEDYWRTLVH

SEQ ID NO: 258769 - protein, 14 aa, Mycobacterium
GAEIPESYWRTLVN

SEQ ID NO: 258770 - protein, 8 aa, Mycobacterium
GAEITPST

SEQ ID NO: 258771 - protein, 5 aa, Mycobacterium
GAENR

SEQ ID NO: 258772 - protein, 6 aa, Mycobacterium
GAENRH

SEQ ID NO: 258773 - protein, 7 aa, Mycobacterium
GAEPAGA

SEQ ID NO: 258774 - protein, 10 aa, Mycobacterium
GAEPASWQDL

SEQ ID NO: 258775 - protein, 26 aa, Mycobacterium
GAEPDVDPDGAGPASSAEAADEDQNS

SEQ ID NO: 258776 - protein, 10 aa, Mycobacterium
GAEPGSPTAG

SEQ ID NO: 258777 - protein, 18 aa, Mycobacterium
GAEPGVRGGTAVRPVADT

SEQ ID NO: 258778 - protein, 7 aa, Mycobacterium
GAEPPAK

SEQ ID NO: 258779 - protein, 7 aa, Mycobacterium
GAEPPAQ

SEQ ID NO: 258780 - protein, 11 aa, Mycobacterium
GAEPPDGGSGV

SEQ ID NO: 258781 - protein, 25 aa, Mycobacterium
GAEPPSGDIAPELAPEEVNGPSDPV

SEQ ID NO: 258782 - protein, 14 aa, Mycobacterium
GAEPRSRREATPLV

SEQ ID NO: 258783 - protein, 8 aa, Mycobacterium
GAEPTDTL

SEQ ID NO: 258784 - protein, 7 aa, Mycobacterium
GAEPVSA

SEQ ID NO: 258785 - protein, 9 aa, Mycobacterium
GAEPVSPAT

SEQ ID NO: 258786 - protein, 6 aa, Mycobacterium
GAEQRI

SEQ ID NO: 258787 - protein, 13 aa, Mycobacterium
GAERDERERGPEK

SEQ ID NO: 258788 - protein, 5 aa, Mycobacterium
GAERR

SEQ ID NO: 258789 - protein, 6 aa, Mycobacterium
GAERTF

SEQ ID NO: 258790 - protein, 8 aa, Mycobacterium
GAESAAGE

SEQ ID NO: 258791 - protein, 9 aa, Mycobacterium
GAESALTQA

SEQ ID NO: 258792 - protein, 7 aa, Mycobacterium
GAESDEV

SEQ ID NO: 258793 - protein, 7 aa, Mycobacterium
GAESGVA

SEQ ID NO: 258794 - protein, 6 aa, Mycobacterium
GAESTS

SEQ ID NO: 258795 - protein, 4 aa, Mycobacterium
GAET

SEQ ID NO: 258796 - protein, 7 aa, Mycobacterium
GAETYAP

SEQ ID NO: 258797 - protein, 5 aa, Mycobacterium
GAEWG

SEQ ID NO: 258798 - protein, 8 aa, Mycobacterium
GAEYAGAG

SEQ ID NO: 258799 - protein, 7 aa, Mycobacterium
GAEYGGA

SEQ ID NO: 258800 - protein, 5 aa, Mycobacterium
GAEYR

SEQ ID NO: 258801 - protein, 4 aa, Mycobacterium
GAFA

SEQ ID NO: 258802 - protein, 10 aa, Mycobacterium
GAFGGSFPAP

SEQ ID NO: 258803 - protein, 7 aa, Mycobacterium
GAFNNDT

SEQ ID NO: 258804 - protein, 7 aa, Mycobacterium
GAFSPSA

SEQ ID NO: 258805 - protein, 13 aa, Mycobacterium
GAFSPSQLPPPGD

SEQ ID NO: 258806 - protein, 8 aa, Mycobacterium
GAFTEAGA

SEQ ID NO: 258807 - protein, 21 aa, Mycobacterium
GAFTSGTPYDTDIENPLKPPS

SEQ ID NO: 258808 - protein, 10 aa, Mycobacterium
GAGAAGAGAM

SEQ ID NO: 258809 - protein, 9 aa, Mycobacterium
GAGADAEPA

SEQ ID NO: 258810 - protein, 10 aa, Mycobacterium
GAGAEQAGAT

SEQ ID NO: 258811 - protein, 6 aa, Mycobacterium
GAGAGA

SEQ ID NO: 258812 - protein, 13 aa, Mycobacterium
GAGAGDDAVRDSG

SEQ ID NO: 258813 - protein, 8 aa, Mycobacterium
GAGAGELS

SEQ ID NO: 258814 - protein, 7 aa, Mycobacterium
GAGAGIG

SEQ ID NO: 258815 - protein, 9 aa, Mycobacterium
GAGAPTSYP

SEQ ID NO: 258816 - protein, 7 aa, Mycobacterium
GAGAQRL

SEQ ID NO: 258817 - protein, 8 aa, Mycobacterium
GAGARGPT

SEQ ID NO: 258818 - protein, 9 aa, Mycobacterium
GAGARPSVE

SEQ ID NO: 258819 - protein, 8 aa, Mycobacterium
GAGARPVV

SEQ ID NO: 258820 - protein, 11 aa, Mycobacterium
GAGARPVVQDP

SEQ ID NO: 258821 - protein, 5 aa, Mycobacterium
GAGAS

SEQ ID NO: 258822 - protein, 6 aa, Mycobacterium
GAGASA

SEQ ID NO: 258823 - protein, 12 aa, Mycobacterium
GAGASRQPAKSF

SEQ ID NO: 258824 - protein, 5 aa, Mycobacterium
GAGDA

SEQ ID NO: 258825 - protein, 6 aa, Mycobacterium
GAGDAA

SEQ ID NO: 258826 - protein, 11 aa, Mycobacterium
GAGDAAHAKSV

SEQ ID NO: 258827 - protein, 13 aa, Mycobacterium
GAGDAITASANTA

SEQ ID NO: 258828 - protein, 9 aa, Mycobacterium
GAGDAQDAL

SEQ ID NO: 258829 - protein, 9 aa, Mycobacterium
GAGDAQDAV

SEQ ID NO: 258830 - protein, 7 aa, Mycobacterium
GAGDARG

SEQ ID NO: 258831 - protein, 14 aa, Mycobacterium
GAGDDDTPRAHADS

SEQ ID NO: 258832 - protein, 14 aa, Mycobacterium
GAGDGTDRSTVGSE

SEQ ID NO: 258833 - protein, 9 aa, Mycobacterium
GAGDRLDDT

SEQ ID NO: 258834 - protein, 7 aa, Mycobacterium
GAGDTRG

SEQ ID NO: 258835 - protein, 8 aa, Mycobacterium
GAGDVSHA

SEQ ID NO: 258836 - protein, 4 aa, Mycobacterium
GAGE

SEQ ID NO: 258837 - protein, 5 aa, Mycobacterium
GAGEA

SEQ ID NO: 258838 - protein, 18 aa, Mycobacterium
GAGEAAAAVGGAEAAAVG

SEQ ID NO: 258839 - protein, 11 aa, Mycobacterium
GAGEERRVSSS

SEQ ID NO: 258840 - protein, 5 aa, Mycobacterium
GAGEP

SEQ ID NO: 258841 - protein, 7 aa, Mycobacterium
GAGFEDA

SEQ ID NO: 258842 - protein, 5 aa, Mycobacterium
GAGFG

SEQ ID NO: 258843 - protein, 4 aa, Mycobacterium
GAGG

SEQ ID NO: 258844 - protein, 14 aa, Mycobacterium
GAGGAAAMSSSGNP

SEQ ID NO: 258845 - protein, 7 aa, Mycobacterium
GAGGAPL

SEQ ID NO: 258846 - protein, 6 aa, Mycobacterium
GAGGAR

SEQ ID NO: 258847 - protein, 7 aa, Mycobacterium
GAGGDGS

SEQ ID NO: 258848 - protein, 25 aa, Mycobacterium
GAGGDTAAVAGGEQGTAKSTSAADA

SEQ ID NO: 258849 - protein, 8 aa, Mycobacterium
GAGGEREY

SEQ ID NO: 258850 - protein, 7 aa, Mycobacterium
GAGGEYA

SEQ ID NO: 258851 - protein, 12 aa, Mycobacterium
GAGGGSATTTYA

SEQ ID NO: 258852 - protein, 11 aa, Mycobacterium
GAGGHHPTGAH

SEQ ID NO: 258853 - protein, 8 aa, Mycobacterium
GAGGLGPT

SEQ ID NO: 258854 - protein, 5 aa, Mycobacterium
GAGGM

SEQ ID NO: 258855 - protein, 6 aa, Mycobacterium
GAGGMA

SEQ ID NO: 258856 - protein, 9 aa, Mycobacterium
GAGGPPVMA

SEQ ID NO: 258857 - protein, 17 aa, Mycobacterium
GAGGPSVVGADSATPGV

SEQ ID NO: 258858 - protein, 11 aa, Mycobacterium
GAGGQQQMSRP

SEQ ID NO: 258859 - protein, 8 aa, Mycobacterium
GAGGSNAK

SEQ ID NO: 258860 - protein, 12 aa, Mycobacterium
GAGGSRAAQGDF

SEQ ID NO: 258861 - protein, 12 aa, Mycobacterium
GAGGSRGISGAA

SEQ ID NO: 258862 - protein, 7 aa, Mycobacterium
GAGGSVT

SEQ ID NO: 258863 - protein, 15 aa, Mycobacterium
GAGGTPNQPSNGTAS

SEQ ID NO: 258864 - protein, 5 aa, Mycobacterium
GAGGV

SEQ ID NO: 258865 - protein, 40 aa, Mycobacterium
GAGHEPGDELEPFDGDAEPAADQTGQTDAYSRAYSAPESE

SEQ ID NO: 258866 - protein, 21 aa, Mycobacterium
GAGHRPEGRLERGGAALDEGG

SEQ ID NO: 258867 - protein, 8 aa, Mycobacterium
GAGIGDGI

SEQ ID NO: 258868 - protein, 9 aa, Mycobacterium
GAGIGDGVA

SEQ ID NO: 258869 - protein, 5 aa, Mycobacterium
GAGKD

SEQ ID NO: 258870 - protein, 7 aa, Mycobacterium
GAGKGTR

SEQ ID NO: 258871 - protein, 4 aa, Mycobacterium
GAGL

SEQ ID NO: 258872 - protein, 5 aa, Mycobacterium
GAGLA

SEQ ID NO: 258873 - protein, 7 aa, Mycobacterium
GAGLATP

SEQ ID NO: 258874 - protein, 8 aa, Mycobacterium
GAGLDGAD

SEQ ID NO: 258875 - protein, 12 aa, Mycobacterium
GAGLPGDTTPAS

SEQ ID NO: 258876 - protein, 7 aa, Mycobacterium
GAGLTTP

SEQ ID NO: 258877 - protein, 5 aa, Mycobacterium
GAGNG

SEQ ID NO: 258878 - protein, 9 aa, Mycobacterium
GAGNGPEGD

SEQ ID NO: 258879 - protein, 5 aa, Mycobacterium
GAGNL

SEQ ID NO: 258880 - protein, 7 aa, Mycobacterium
GAGNPLT

SEQ ID NO: 258881 - protein, 20 aa, Mycobacterium
GAGNSAKRDESGHVTQSGDM

SEQ ID NO: 258882 - protein, 6 aa, Mycobacterium
GAGNTE

SEQ ID NO: 258883 - protein, 8 aa, Mycobacterium
GAGPDAEY

SEQ ID NO: 258884 - protein, 10 aa, Mycobacterium
GAGPDVPHGP

SEQ ID NO: 258885 - protein, 7 aa, Mycobacterium
GAGPGER

SEQ ID NO: 258886 - protein, 9 aa, Mycobacterium
GAGPGPGPL

SEQ ID NO: 258887 - protein, 6 aa, Mycobacterium
GAGPGQ

SEQ ID NO: 258888 - protein, 10 aa, Mycobacterium
GAGPGSGASY

SEQ ID NO: 258889 - protein, 11 aa, Mycobacterium
GAGPHAGDKSI

SEQ ID NO: 258890 - protein, 15 aa, Mycobacterium
GAGPHAGDKSIDAPV

SEQ ID NO: 258891 - protein, 16 aa, Mycobacterium
GAGPHAGDKSPDRPVP

SEQ ID NO: 258892 - protein, 5 aa, Mycobacterium
GAGPL

SEQ ID NO: 258893 - protein, 45 aa, Mycobacterium
GAGPPPGPGPAQPPPMAPAAPPWPGPQPAEPAAPRLAPPPAPDLA

SEQ ID NO: 258894 - protein, 10 aa, Mycobacterium
GAGPSGATRL

SEQ ID NO: 258895 - protein, 6 aa, Mycobacterium
GAGPTT

SEQ ID NO: 258896 - protein, 4 aa, Mycobacterium
GAGQ

SEQ ID NO: 258897 - protein, 8 aa, Mycobacterium
GAGQGGRQ

SEQ ID NO: 258898 - protein, 11 aa, Mycobacterium
GAGQPRREPAP

SEQ ID NO: 258899 - protein, 17 aa, Mycobacterium
GAGRLRGRRSGRGQMPQ

SEQ ID NO: 258900 - protein, 15 aa, Mycobacterium
GAGRNVSPGMASYSA

SEQ ID NO: 258901 - protein, 14 aa, Mycobacterium
GAGRPADQQNSSIS

SEQ ID NO: 258902 - protein, 11 aa, Mycobacterium
GAGRPDRAQLP

SEQ ID NO: 258903 - protein, 13 aa, Mycobacterium
GAGRPHHETRPDG

SEQ ID NO: 258904 - protein, 17 aa, Mycobacterium
GAGRSGPSAGADGGFGR

SEQ ID NO: 258905 - protein, 6 aa, Mycobacterium
GAGRSR

SEQ ID NO: 258906 - protein, 5 aa, Mycobacterium
GAGRT

SEQ ID NO: 258907 - protein, 11 aa, Mycobacterium
GAGSAAAATPR

SEQ ID NO: 258908 - protein, 6 aa, Mycobacterium
GAGSAV

SEQ ID NO: 258909 - protein, 7 aa, Mycobacterium
GAGSGSV

SEQ ID NO: 258910 - protein, 9 aa, Mycobacterium
GAGSGVYNA

SEQ ID NO: 258911 - protein, 6 aa, Mycobacterium
GAGSKD

SEQ ID NO: 258912 - protein, 9 aa, Mycobacterium
GAGSSASRA

SEQ ID NO: 258913 - protein, 16 aa, Mycobacterium
GAGSTAPRDNSATLKR

SEQ ID NO: 258914 - protein, 8 aa, Mycobacterium
GAGSTRHS

SEQ ID NO: 258915 - protein, 7 aa, Mycobacterium
GAGSTRL

SEQ ID NO: 258916 - protein, 11 aa, Mycobacterium
GAGSVSGGQRR

SEQ ID NO: 258917 - protein, 7 aa, Mycobacterium
GAGTAAH

SEQ ID NO: 258918 - protein, 9 aa, Mycobacterium
GAGTAAQRA

SEQ ID NO: 258919 - protein, 6 aa, Mycobacterium
GAGTAI

SEQ ID NO: 258920 - protein, 6 aa, Mycobacterium
GAGTAV

SEQ ID NO: 258921 - protein, 6 aa, Mycobacterium
GAGTGG

SEQ ID NO: 258922 - protein, 5 aa, Mycobacterium
GAGTH

SEQ ID NO: 258923 - protein, 9 aa, Mycobacterium
GAGTNDTAH

SEQ ID NO: 258924 - protein, 8 aa, Mycobacterium
GAGTTAQL

SEQ ID NO: 258925 - protein, 4 aa, Mycobacterium
GAGV

SEQ ID NO: 258926 - protein, 5 aa, Mycobacterium
GAHAG

SEQ ID NO: 258927 - protein, 8 aa, Mycobacterium
GAHAGPEA

SEQ ID NO: 258928 - protein, 6 aa, Mycobacterium
GAHCPS

SEQ ID NO: 258929 - protein, 9 aa, Mycobacterium
GAHIPEDKQ

SEQ ID NO: 258930 - protein, 14 aa, Mycobacterium
GAHKYSPDVSPKQV

SEQ ID NO: 258931 - protein, 7 aa, Mycobacterium
GAHPTKV

SEQ ID NO: 258932 - protein, 15 aa, Mycobacterium
GAHRQVRSGPQSPVR

SEQ ID NO: 258933 - protein, 11 aa, Mycobacterium
GAHRSGRLPTE

SEQ ID NO: 258934 - protein, 5 aa, Mycobacterium
GAHRV

SEQ ID NO: 258935 - protein, 13 aa, Mycobacterium
GAHSARSTVVAPG

SEQ ID NO: 258936 - protein, 14 aa, Mycobacterium
GAHTNGAANGTADS

SEQ ID NO: 258937 - protein, 24 aa, Mycobacterium
GAHVAGEPAGVAGPVARPAKPRLL

SEQ ID NO: 258938 - protein, 14 aa, Mycobacterium
GAIAEEVKEPRRNV

SEQ ID NO: 258939 - protein, 9 aa, Mycobacterium
GAIAGAPNP

SEQ ID NO: 258940 - protein, 9 aa, Mycobacterium
GAIAPTRDQ

SEQ ID NO: 258941 - protein, 9 aa, Mycobacterium
GAIEPAPPQ

SEQ ID NO: 258942 - protein, 9 aa, Mycobacterium
GAIGAGTRN

SEQ ID NO: 258943 - protein, 7 aa, Mycobacterium
GAIQGAK

SEQ ID NO: 258944 - protein, 8 aa, Mycobacterium
GAISGEVG

SEQ ID NO: 258945 - protein, 10 aa, Mycobacterium
GAITAPADPV

SEQ ID NO: 258946 - protein, 7 aa, Mycobacterium
GAKEKQI

SEQ ID NO: 258947 - protein, 7 aa, Mycobacterium
GAKESLN

SEQ ID NO: 258948 - protein, 8 aa, Mycobacterium
GAKESLNV

SEQ ID NO: 258949 - protein, 5 aa, Mycobacterium
GAKHV

SEQ ID NO: 258950 - protein, 7 aa, Mycobacterium
GAKKDHI

SEQ ID NO: 258951 - protein, 33 aa, Mycobacterium
GAKKPGAKKAAAPTGETKPAEAAAPAAPAAPVK

SEQ ID NO: 258952 - protein, 63 aa, Mycobacterium
GAKPPAGPGGPHGSGPAGRSTEEADESTDTADTPAEGDTEPADEQPQRPESSVPVEPAGQNPA

SEQ ID NO: 258953 - protein, 8 aa, Mycobacterium
GAKPPPGI

SEQ ID NO: 258954 - protein, 6 aa, Mycobacterium
GAKPVR

SEQ ID NO: 258955 - protein, 9 aa, Mycobacterium
GAKPYGYSG

SEQ ID NO: 258956 - protein, 8 aa, Mycobacterium
GAKQKDIS

SEQ ID NO: 258957 - protein, 7 aa, Mycobacterium
GAKQQRI

SEQ ID NO: 258958 - protein, 8 aa, Mycobacterium
GAKRKQIS

SEQ ID NO: 258959 - protein, 43 aa, Mycobacterium
GAKRPGAKKATAETSAATPPAASASPPASQAPAAAAAPAPPVK

SEQ ID NO: 258960 - protein, 9 aa, Mycobacterium
GAKRTEPFT

SEQ ID NO: 258961 - protein, 14 aa, Mycobacterium
GAKSAAKSAELEQS

SEQ ID NO: 258962 - protein, 7 aa, Mycobacterium
GAKSVRQ

SEQ ID NO: 258963 - protein, 7 aa, Mycobacterium
GAKVNEI

SEQ ID NO: 258964 - protein, 6 aa, Mycobacterium
GAKVSG

SEQ ID NO: 258965 - protein, 14 aa, Mycobacterium
GALAKAASSVTGYD

SEQ ID NO: 258966 - protein, 6 aa, Mycobacterium
GALAPR

SEQ ID NO: 258967 - protein, 9 aa, Mycobacterium
GALAQPAKR

SEQ ID NO: 258968 - protein, 4 aa, Mycobacterium
GALD

SEQ ID NO: 258969 - protein, 14 aa, Mycobacterium
GALDPTKSVPRNTI

SEQ ID NO: 258970 - protein, 37 aa, Mycobacterium
GALDRGDSERPPASDSAPGDAPAEEPPEEGLRPTTRQ

SEQ ID NO: 258971 - protein, 19 aa, Mycobacterium
GALEGTDVESFPKPTEIGG

SEQ ID NO: 258972 - protein, 12 aa, Mycobacterium
GALEPSRAASIT

SEQ ID NO: 258973 - protein, 4 aa, Mycobacterium
GALG

SEQ ID NO: 258974 - protein, 6 aa, Mycobacterium
GALGAG

SEQ ID NO: 258975 - protein, 16 aa, Mycobacterium
GALGGKTGYTDDAQQT

SEQ ID NO: 258976 - protein, 10 aa, Mycobacterium
GALGQARSAT

SEQ ID NO: 258977 - protein, 5 aa, Mycobacterium
GALGT

SEQ ID NO: 258978 - protein, 19 aa, Mycobacterium
GALKGTSKESFPKPTEIGG

SEQ ID NO: 258979 - protein, 18 aa, Mycobacterium
GALNAQEYASRRAQIISE

SEQ ID NO: 258980 - protein, 8 aa, Mycobacterium
GALPAASA

SEQ ID NO: 258981 - protein, 17 aa, Mycobacterium
GALPEPADFANTEGQGV

SEQ ID NO: 258982 - protein, 8 aa, Mycobacterium
GALPGRRR

SEQ ID NO: 258983 - protein, 12 aa, Mycobacterium
GALPQANPQRVK

SEQ ID NO: 258984 - protein, 6 aa, Mycobacterium
GALPSP

SEQ ID NO: 258985 - protein, 9 aa, Mycobacterium
GALPTPDDL

SEQ ID NO: 258986 - protein, 4 aa, Mycobacterium
GALR

SEQ ID NO: 258987 - protein, 4 aa, Mycobacterium
GALS

SEQ ID NO: 258988 - protein, 6 aa, Mycobacterium
GALSGV

SEQ ID NO: 258989 - protein, 7 aa, Mycobacterium
GALTSAR

SEQ ID NO: 258990 - protein, 7 aa, Mycobacterium
GAMAPTE

SEQ ID NO: 258991 - protein, 8 aa, Mycobacterium
GAMSPARA

SEQ ID NO: 258992 - protein, 8 aa, Mycobacterium
GANAAASE

SEQ ID NO: 258993 - protein, 14 aa, Mycobacterium
GANGGGRANAIGGA

SEQ ID NO: 258994 - protein, 8 aa, Mycobacterium
GANGSGKT

SEQ ID NO: 258995 - protein, 11 aa, Mycobacterium
GANGSNIGRPL

SEQ ID NO: 258996 - protein, 9 aa, Mycobacterium
GANGTGKST

SEQ ID NO: 258997 - protein, 11 aa, Mycobacterium
GANLATSDPTV

SEQ ID NO: 258998 - protein, 5 aa, Mycobacterium
GANND

SEQ ID NO: 258999 - protein, 7 aa, Mycobacterium
GANNTET

SEQ ID NO: 259000 - protein, 17 aa, Mycobacterium
GANPCTDIDEADTTIEI

SEQ ID NO: 259001 - protein, 8 aa, Mycobacterium
GANPSQLQ

SEQ ID NO: 259002 - protein, 6 aa, Mycobacterium
GANQTR

SEQ ID NO: 259003 - protein, 15 aa, Mycobacterium
GANRGNTIPRRCDGE

SEQ ID NO: 259004 - protein, 7 aa, Mycobacterium
GANRPAA

SEQ ID NO: 259005 - protein, 8 aa, Mycobacterium
GANRTDQA

SEQ ID NO: 259006 - protein, 6 aa, Mycobacterium
GANTEF

SEQ ID NO: 259007 - protein, 10 aa, Mycobacterium
GANVTPDEVQ

SEQ ID NO: 259008 - protein, 4 aa, Mycobacterium
GAPA

SEQ ID NO: 259009 - protein, 17 aa, Mycobacterium
GAPAAARAYQRQQTKLS

SEQ ID NO: 259010 - protein, 7 aa, Mycobacterium
GAPAAMP

SEQ ID NO: 259011 - protein, 9 aa, Mycobacterium
GAPAGTASA

SEQ ID NO: 259012 - protein, 16 aa, Mycobacterium
GAPAHDGAKGTRRRRP

SEQ ID NO: 259013 - protein, 5 aa, Mycobacterium
GAPAI

SEQ ID NO: 259014 - protein, 29 aa, Mycobacterium
GAPAPARPTHRHSAPDPDPVAEPSQPSRM

SEQ ID NO: 259015 - protein, 10 aa, Mycobacterium
GAPAPGAPPL

SEQ ID NO: 259016 - protein, 8 aa, Mycobacterium
GAPAPLPG

SEQ ID NO: 259017 - protein, 10 aa, Mycobacterium
GAPAPSQSAL

SEQ ID NO: 259018 - protein, 38 aa, Mycobacterium
GAPAPTASTAAPTPTTTSPATPGSAPAPTPPPAGAEGL

SEQ ID NO: 259019 - protein, 9 aa, Mycobacterium
GAPAPTRSR

SEQ ID NO: 259020 - protein, 9 aa, Mycobacterium
GAPAQTAAA

SEQ ID NO: 259021 - protein, 8 aa, Mycobacterium
GAPARIDS

SEQ ID NO: 259022 - protein, 6 aa, Mycobacterium
GAPASR

SEQ ID NO: 259023 - protein, 6 aa, Mycobacterium
GAPATD

SEQ ID NO: 259024 - protein, 28 aa, Mycobacterium
GAPAVSPGSGPGGPGEVPTSVAPSTTPG

SEQ ID NO: 259025 - protein, 12 aa, Mycobacterium
GAPDDTGERATV

SEQ ID NO: 259026 - protein, 7 aa, Mycobacterium
GAPDRPI

SEQ ID NO: 259027 - protein, 6 aa, Mycobacterium
GAPDSV

SEQ ID NO: 259028 - protein, 5 aa, Mycobacterium
GAPDT

SEQ ID NO: 259029 - protein, 8 aa, Mycobacterium
GAPEDDSD

SEQ ID NO: 259030 - protein, 8 aa, Mycobacterium
GAPEDSWR

SEQ ID NO: 259031 - protein, 14 aa, Mycobacterium
GAPEGSESSSGAAT

SEQ ID NO: 259032 - protein, 8 aa, Mycobacterium
GAPEGSWR

SEQ ID NO: 259033 - protein, 25 aa, Mycobacterium
GAPERGPGMPQISEGRAPAKPDEVA

SEQ ID NO: 259034 - protein, 9 aa, Mycobacterium
GAPERGTDA

SEQ ID NO: 259035 - protein, 7 aa, Mycobacterium
GAPETVG

SEQ ID NO: 259036 - protein, 6 aa, Mycobacterium
GAPFPD

SEQ ID NO: 259037 - protein, 7 aa, Mycobacterium
GAPFPHG

SEQ ID NO: 259038 - protein, 4 aa, Mycobacterium
GAPG

SEQ ID NO: 259039 - protein, 10 aa, Mycobacterium
GAPGAGRGAL

SEQ ID NO: 259040 - protein, 9 aa, Mycobacterium
GAPGAPGLD

SEQ ID NO: 259041 - protein, 40 aa, Mycobacterium
GAPGDAPEDASKDTADDASKDAQTGTPEAGQSETKVPRTR

SEQ ID NO: 259042 - protein, 7 aa, Mycobacterium
GAPGDLP

SEQ ID NO: 259043 - protein, 7 aa, Mycobacterium
GAPGGID

SEQ ID NO: 259044 - protein, 6 aa, Mycobacterium
GAPGLP

SEQ ID NO: 259045 - protein, 12 aa, Mycobacterium
GAPGPDGFSGVA

SEQ ID NO: 259046 - protein, 10 aa, Mycobacterium
GAPGPGEGTR

SEQ ID NO: 259047 - protein, 9 aa, Mycobacterium
GAPGQGNYA

SEQ ID NO: 259048 - protein, 13 aa, Mycobacterium
GAPGQPPDTAGPR

SEQ ID NO: 259049 - protein, 11 aa, Mycobacterium
GAPGRALDASG

SEQ ID NO: 259050 - protein, 8 aa, Mycobacterium
GAPGRGLD

SEQ ID NO: 259051 - protein, 7 aa, Mycobacterium
GAPGRLG

SEQ ID NO: 259052 - protein, 6 aa, Mycobacterium
GAPGSH

SEQ ID NO: 259053 - protein, 8 aa, Mycobacterium
GAPGSLTV

SEQ ID NO: 259054 - protein, 11 aa, Mycobacterium
GAPGSQAPQRE

SEQ ID NO: 259055 - protein, 8 aa, Mycobacterium
GAPGTTAN

SEQ ID NO: 259056 - protein, 6 aa, Mycobacterium
GAPHES

SEQ ID NO: 259057 - protein, 4 aa, Mycobacterium
GAPI

SEQ ID NO: 259058 - protein, 12 aa, Mycobacterium
GAPINGLPPEFG

SEQ ID NO: 259059 - protein, 7 aa, Mycobacterium
GAPIYGS

SEQ ID NO: 259060 - protein, 7 aa, Mycobacterium
GAPLGSA

SEQ ID NO: 259061 - protein, 6 aa, Mycobacterium
GAPLPK

SEQ ID NO: 259062 - protein, 4 aa, Mycobacterium
GAPM

SEQ ID NO: 259063 - protein, 6 aa, Mycobacterium
GAPNRV

SEQ ID NO: 259064 - protein, 9 aa, Mycobacterium
GAPNSAVHS

SEQ ID NO: 259065 - protein, 14 aa, Mycobacterium
GAPPDISVLTLRAD

SEQ ID NO: 259066 - protein, 14 aa, Mycobacterium
GAPPDISVLTLRSG

SEQ ID NO: 259067 - protein, 32 aa, Mycobacterium
GAPPEASDTSPAPSSTPPPRTPTLSAPVRGAD

SEQ ID NO: 259068 - protein, 9 aa, Mycobacterium
GAPPEREYP

SEQ ID NO: 259069 - protein, 9 aa, Mycobacterium
GAPPGHVAT

SEQ ID NO: 259070 - protein, 11 aa, Mycobacterium
GAPPGQPTRMG

SEQ ID NO: 259071 - protein, 7 aa, Mycobacterium
GAPPMGE

SEQ ID NO: 259072 - protein, 23 aa, Mycobacterium
GAPPPPPRPHDPTHPAPEPVRPM

SEQ ID NO: 259073 - protein, 13 aa, Mycobacterium
GAPPRAGATPPAE

SEQ ID NO: 259074 - protein, 8 aa, Mycobacterium
GAPPTPLP

SEQ ID NO: 259075 - protein, 8 aa, Mycobacterium
GAPPYGGS

SEQ ID NO: 259076 - protein, 8 aa, Mycobacterium
GAPPYRAD

SEQ ID NO: 259077 - protein, 9 aa, Mycobacterium
GAPPYRTDS

SEQ ID NO: 259078 - protein, 6 aa, Mycobacterium
GAPQDM

SEQ ID NO: 259079 - protein, 7 aa, Mycobacterium
GAPQGSW

SEQ ID NO: 259080 - protein, 7 aa, Mycobacterium
GAPQGTW

SEQ ID NO: 259081 - protein, 8 aa, Mycobacterium
GAPQQDRV

SEQ ID NO: 259082 - protein, 5 aa, Mycobacterium
GAPQR

SEQ ID NO: 259083 - protein, 9 aa, Mycobacterium
GAPQSGKSM

SEQ ID NO: 259084 - protein, 10 aa, Mycobacterium
GAPQSGKSTA

SEQ ID NO: 259085 - protein, 11 aa, Mycobacterium
GAPQSGKSTTL

SEQ ID NO: 259086 - protein, 4 aa, Mycobacterium
GAPR

SEQ ID NO: 259087 - protein, 5 aa, Mycobacterium
GAPRA

SEQ ID NO: 259088 - protein, 11 aa, Mycobacterium
GAPRGRGHPED

SEQ ID NO: 259089 - protein, 19 aa, Mycobacterium
GAPRPDEADSAADTDGRAG

SEQ ID NO: 259090 - protein, 4 aa, Mycobacterium
GAPS

SEQ ID NO: 259091 - protein, 29 aa, Mycobacterium
GAPSAPPSQPRSTPAPRQSAGRETNRPFD

SEQ ID NO: 259092 - protein, 8 aa, Mycobacterium
GAPSNASL

SEQ ID NO: 259093 - protein, 4 aa, Mycobacterium
GAPT

SEQ ID NO: 259094 - protein, 8 aa, Mycobacterium
GAPTEGEH

SEQ ID NO: 259095 - protein, 7 aa, Mycobacterium
GAPTPKV

SEQ ID NO: 259096 - protein, 8 aa, Mycobacterium
GAPTPLAG

SEQ ID NO: 259097 - protein, 5 aa, Mycobacterium
GAPTY

SEQ ID NO: 259098 - protein, 5 aa, Mycobacterium
GAPVE

SEQ ID NO: 259099 - protein, 9 aa, Mycobacterium
GAPVRPPVR

SEQ ID NO: 259100 - protein, 7 aa, Mycobacterium
GAPVSDA

SEQ ID NO: 259101 - protein, 15 aa, Mycobacterium
GAPVSPTAEDKERTP

SEQ ID NO: 259102 - protein, 6 aa, Mycobacterium
GAPVSR

SEQ ID NO: 259103 - protein, 7 aa, Mycobacterium
GAPWSTR

SEQ ID NO: 259104 - protein, 10 aa, Mycobacterium
GAPYTPKAGC

SEQ ID NO: 259105 - protein, 4 aa, Mycobacterium
GAQA

SEQ ID NO: 259106 - protein, 17 aa, Mycobacterium
GAQAGPPSAPAGERDGS

SEQ ID NO: 259107 - protein, 6 aa, Mycobacterium
GAQDRL

SEQ ID NO: 259108 - protein, 7 aa, Mycobacterium
GAQDTAA

SEQ ID NO: 259109 - protein, 9 aa, Mycobacterium
GAQEIGAGN

SEQ ID NO: 259110 - protein, 5 aa, Mycobacterium
GAQEL

SEQ ID NO: 259111 - protein, 8 aa, Mycobacterium
GAQGGTSV

SEQ ID NO: 259112 - protein, 6 aa, Mycobacterium
GAQGQR

SEQ ID NO: 259113 - protein, 6 aa, Mycobacterium
GAQHGA

SEQ ID NO: 259114 - protein, 4 aa, Mycobacterium
GAQI

SEQ ID NO: 259115 - protein, 8 aa, Mycobacterium
GAQIPRNT

SEQ ID NO: 259116 - protein, 5 aa, Mycobacterium
GAQKT

SEQ ID NO: 259117 - protein, 8 aa, Mycobacterium
GAQLSKGV

SEQ ID NO: 259118 - protein, 9 aa, Mycobacterium
GAQNTTQRL

SEQ ID NO: 259119 - protein, 4 aa, Mycobacterium
GAQP

SEQ ID NO: 259120 - protein, 5 aa, Mycobacterium
GAQPA

SEQ ID NO: 259121 - protein, 6 aa, Mycobacterium
GAQPAV

SEQ ID NO: 259122 - protein, 7 aa, Mycobacterium
GAQPGTL

SEQ ID NO: 259123 - protein, 29 aa, Mycobacterium
GAQPLNAPSTTPAGVQVGPGTGYPKGDTF

SEQ ID NO: 259124 - protein, 12 aa, Mycobacterium
GAQPQLAPGQSP

SEQ ID NO: 259125 - protein, 7 aa, Mycobacterium
GAQQRAN

SEQ ID NO: 259126 - protein, 9 aa, Mycobacterium
GAQRDSRAP

SEQ ID NO: 259127 - protein, 13 aa, Mycobacterium
GAQRGPDAPGIQR

SEQ ID NO: 259128 - protein, 7 aa, Mycobacterium
GAQRKKV

SEQ ID NO: 259129 - protein, 7 aa, Mycobacterium
GAQRPDV

SEQ ID NO: 259130 - protein, 8 aa, Mycobacterium
GAQRTDLP

SEQ ID NO: 259131 - protein, 9 aa, Mycobacterium
GAQSAAGLG

SEQ ID NO: 259132 - protein, 10 aa, Mycobacterium
GAQSAQEDAH

SEQ ID NO: 259133 - protein, 8 aa, Mycobacterium
GAQTDPEL

SEQ ID NO: 259134 - protein, 9 aa, Mycobacterium
GAQTQMAPV

SEQ ID NO: 259135 - protein, 5 aa, Mycobacterium
GAQWT

SEQ ID NO: 259136 - protein, 22 aa, Mycobacterium
GAQYAAGGAETTAAAAVETPTE

SEQ ID NO: 259137 - protein, 4 aa, Mycobacterium
GARA

SEQ ID NO: 259138 - protein, 19 aa, Mycobacterium
GARDAGAECDRIPDATPGV

SEQ ID NO: 259139 - protein, 19 aa, Mycobacterium
GARDAGAECDRIPDTTPGV

SEQ ID NO: 259140 - protein, 6 aa, Mycobacterium
GARDGE

SEQ ID NO: 259141 - protein, 10 aa, Mycobacterium
GARDKGADLN

SEQ ID NO: 259142 - protein, 5 aa, Mycobacterium
GARDR

SEQ ID NO: 259143 - protein, 7 aa, Mycobacterium
GARERGL

SEQ ID NO: 259144 - protein, 15 aa, Mycobacterium
GARGATTGSPVPQMS

SEQ ID NO: 259145 - protein, 6 aa, Mycobacterium
GARGIR

SEQ ID NO: 259146 - protein, 11 aa, Mycobacterium
GARGSDAARTA

SEQ ID NO: 259147 - protein, 4 aa, Mycobacterium
GARI

SEQ ID NO: 259148 - protein, 8 aa, Mycobacterium
GARITPPA

SEQ ID NO: 259149 - protein, 13 aa, Mycobacterium
GARKAEVGAESAR

SEQ ID NO: 259150 - protein, 7 aa, Mycobacterium
GARKGTM

SEQ ID NO: 259151 - protein, 12 aa, Mycobacterium
GARKPHKGTVQK

SEQ ID NO: 259152 - protein, 6 aa, Mycobacterium
GARPFA

SEQ ID NO: 259153 - protein, 8 aa, Mycobacterium
GARPGADR

SEQ ID NO: 259154 - protein, 8 aa, Mycobacterium
GARPGGFG

SEQ ID NO: 259155 - protein, 18 aa, Mycobacterium
GARPGGFGALDGKTNEIC

SEQ ID NO: 259156 - protein, 17 aa, Mycobacterium
GARPGGFGDLNGRTNEI

SEQ ID NO: 259157 - protein, 8 aa, Mycobacterium
GARPPRPA

SEQ ID NO: 259158 - protein, 7 aa, Mycobacterium
GARPQTT

SEQ ID NO: 259159 - protein, 5 aa, Mycobacterium
GARPS

SEQ ID NO: 259160 - protein, 10 aa, Mycobacterium
GARPSAKTSI

SEQ ID NO: 259161 - protein, 24 aa, Mycobacterium
GARPTGPVADETAANRAPARTGEH

SEQ ID NO: 259162 - protein, 6 aa, Mycobacterium
GARPTT

SEQ ID NO: 259163 - protein, 6 aa, Mycobacterium
GARQAR

SEQ ID NO: 259164 - protein, 12 aa, Mycobacterium
GARRPESAEHPR

SEQ ID NO: 259165 - protein, 49 aa, Mycobacterium
GARRPGAKKAAAKPAAAPAPAAEKPAEQAAEPEKPAEKPAEPEKPEPPV

SEQ ID NO: 259166 - protein, 53 aa, Mycobacterium
GARRPGAKKAAPATESAPEPAQPATAPEPTEPATSAPKDEAPETSSTPEPPVK

SEQ ID NO: 259167 - protein, 53 aa, Mycobacterium
GARRPGAKKKAPAAAPDSAPAAAPESAPAAPSSNGSDSSKGDDRVVGDEAPVK

SEQ ID NO: 259168 - protein, 26 aa, Mycobacterium
GARRPLRTRARNTTPIAAAGTEVIER

SEQ ID NO: 259169 - protein, 26 aa, Mycobacterium
GARRPLRTRPRNTSSIAAAGTEVIER

SEQ ID NO: 259170 - protein, 13 aa, Mycobacterium
GARRRVGSPAVVA

SEQ ID NO: 259171 - protein, 4 aa, Mycobacterium
GARS

SEQ ID NO: 259172 - protein, 13 aa, Mycobacterium
GARSAAKKQALEA

SEQ ID NO: 259173 - protein, 49 aa, Mycobacterium
GARSAQEQPTPRAAGTAVTDAELDGEEEPVDEPQLADEPELADDSELDT

SEQ ID NO: 259174 - protein, 4 aa, Mycobacterium
GART

SEQ ID NO: 259175 - protein, 9 aa, Mycobacterium
GARTDRVAP

SEQ ID NO: 259176 - protein, 8 aa, Mycobacterium
GARTSTSE

SEQ ID NO: 259177 - protein, 4 aa, Mycobacterium
GARV

SEQ ID NO: 259178 - protein, 10 aa, Mycobacterium
GARVAGSGTI

SEQ ID NO: 259179 - protein, 8 aa, Mycobacterium
GARWDEDD

SEQ ID NO: 259180 - protein, 8 aa, Mycobacterium
GASADDPV

SEQ ID NO: 259181 - protein, 9 aa, Mycobacterium
GASADGDIS

SEQ ID NO: 259182 - protein, 9 aa, Mycobacterium
GASALGAAT

SEQ ID NO: 259183 - protein, 7 aa, Mycobacterium
GASAMPD

SEQ ID NO: 259184 - protein, 13 aa, Mycobacterium
GASAPTTDGEEAR

SEQ ID NO: 259185 - protein, 11 aa, Mycobacterium
GASAVSGRLGG

SEQ ID NO: 259186 - protein, 6 aa, Mycobacterium
GASDPT

SEQ ID NO: 259187 - protein, 9 aa, Mycobacterium
GASDRADAL

SEQ ID NO: 259188 - protein, 11 aa, Mycobacterium
GASDTKSDELE

SEQ ID NO: 259189 - protein, 6 aa, Mycobacterium
GASEAL

SEQ ID NO: 259190 - protein, 7 aa, Mycobacterium
GASEGLA

SEQ ID NO: 259191 - protein, 11 aa, Mycobacterium
GASELTQPWES

SEQ ID NO: 259192 - protein, 5 aa, Mycobacterium
GASER

SEQ ID NO: 259193 - protein, 10 aa, Mycobacterium
GASESSAWSN

SEQ ID NO: 259194 - protein, 5 aa, Mycobacterium
GASFT

SEQ ID NO: 259195 - protein, 4 aa, Mycobacterium
GASG

SEQ ID NO: 259196 - protein, 5 aa, Mycobacterium
GASGA

SEQ ID NO: 259197 - protein, 10 aa, Mycobacterium
GASGAAFGTQ

SEQ ID NO: 259198 - protein, 9 aa, Mycobacterium
GASGAAMGT

SEQ ID NO: 259199 - protein, 12 aa, Mycobacterium
GASGADSATSDL

SEQ ID NO: 259200 - protein, 8 aa, Mycobacterium
GASGIGKT

SEQ ID NO: 259201 - protein, 5 aa, Mycobacterium
GASGL

SEQ ID NO: 259202 - protein, 12 aa, Mycobacterium
GASGLDAATADA

SEQ ID NO: 259203 - protein, 23 aa, Mycobacterium
GASGNPPIRGRTSNGSEATADPL

SEQ ID NO: 259204 - protein, 6 aa, Mycobacterium
GASGSF

SEQ ID NO: 259205 - protein, 7 aa, Mycobacterium
GASGSYP

SEQ ID NO: 259206 - protein, 7 aa, Mycobacterium
GASHSEG

SEQ ID NO: 259207 - protein, 8 aa, Mycobacterium
GASIAGTE

SEQ ID NO: 259208 - protein, 4 aa, Mycobacterium
GASK

SEQ ID NO: 259209 - protein, 10 aa, Mycobacterium
GASLPEARAT

SEQ ID NO: 259210 - protein, 8 aa, Mycobacterium
GASLPSAN

SEQ ID NO: 259211 - protein, 11 aa, Mycobacterium
GASLPSHTAAN

SEQ ID NO: 259212 - protein, 11 aa, Mycobacterium
GASLSGGQRQR

SEQ ID NO: 259213 - protein, 8 aa, Mycobacterium
GASLTESA

SEQ ID NO: 259214 - protein, 11 aa, Mycobacterium
GASNDREVTCD

SEQ ID NO: 259215 - protein, 7 aa, Mycobacterium
GASNGTI

SEQ ID NO: 259216 - protein, 15 aa, Mycobacterium
GASNRNDAAGSLSAT

SEQ ID NO: 259217 - protein, 4 aa, Mycobacterium
GASP

SEQ ID NO: 259218 - protein, 10 aa, Mycobacterium
GASPGASTAV

SEQ ID NO: 259219 - protein, 6 aa, Mycobacterium
GASPVK

SEQ ID NO: 259220 - protein, 8 aa, Mycobacterium
GASRSKNV

SEQ ID NO: 259221 - protein, 4 aa, Mycobacterium
GASS

SEQ ID NO: 259222 - protein, 6 aa, Mycobacterium
GASSDR

SEQ ID NO: 259223 - protein, 11 aa, Mycobacterium
GASSGGPRGPI

SEQ ID NO: 259224 - protein, 6 aa, Mycobacterium
GASSGV

SEQ ID NO: 259225 - protein, 9 aa, Mycobacterium
GASSGVASN

SEQ ID NO: 259226 - protein, 13 aa, Mycobacterium
GASSQGAKAYREA

SEQ ID NO: 259227 - protein, 13 aa, Mycobacterium
GASSQGAQTYREA

SEQ ID NO: 259228 - protein, 6 aa, Mycobacterium
GASSSG

SEQ ID NO: 259229 - protein, 9 aa, Mycobacterium
GASSSGGVG

SEQ ID NO: 259230 - protein, 6 aa, Mycobacterium
GASSSL

SEQ ID NO: 259231 - protein, 8 aa, Mycobacterium
GASSTRRR

SEQ ID NO: 259232 - protein, 5 aa, Mycobacterium
GASSW

SEQ ID NO: 259233 - protein, 4 aa, Mycobacterium
GAST

SEQ ID NO: 259234 - protein, 13 aa, Mycobacterium
GASTQGARTYREA

SEQ ID NO: 259235 - protein, 9 aa, Mycobacterium
GASTQGARV

SEQ ID NO: 259236 - protein, 6 aa, Mycobacterium
GASTRN

SEQ ID NO: 259237 - protein, 6 aa, Mycobacterium
GASTTI

SEQ ID NO: 259238 - protein, 7 aa, Mycobacterium
GASTTTG

SEQ ID NO: 259239 - protein, 15 aa, Mycobacterium
GASTYHAATGETQQP

SEQ ID NO: 259240 - protein, 10 aa, Mycobacterium
GASVAAPDPV

SEQ ID NO: 259241 - protein, 9 aa, Mycobacterium
GASVDGASL

SEQ ID NO: 259242 - protein, 6 aa, Mycobacterium
GASVSG

SEQ ID NO: 259243 - protein, 4 aa, Mycobacterium
GASW

SEQ ID NO: 259244 - protein, 6 aa, Mycobacterium
GASYSN

SEQ ID NO: 259245 - protein, 4 aa, Mycobacterium
GATA

SEQ ID NO: 259246 - protein, 7 aa, Mycobacterium
GATAAGV

SEQ ID NO: 259247 - protein, 6 aa, Mycobacterium
GATACG

SEQ ID NO: 259248 - protein, 11 aa, Mycobacterium
GATAESDESSI

SEQ ID NO: 259249 - protein, 7 aa, Mycobacterium
GATAGGV

SEQ ID NO: 259250 - protein, 8 aa, Mycobacterium
GATAGGVN

SEQ ID NO: 259251 - protein, 7 aa, Mycobacterium
GATAGPL

SEQ ID NO: 259252 - protein, 19 aa, Mycobacterium
GATAGPYAPADSTDDLWLT

SEQ ID NO: 259253 - protein, 10 aa, Mycobacterium
GATAPAQGLA

SEQ ID NO: 259254 - protein, 7 aa, Mycobacterium
GATASFG

SEQ ID NO: 259255 - protein, 21 aa, Mycobacterium
GATASVTNSVQAQATARRDAA

SEQ ID NO: 259256 - protein, 9 aa, Mycobacterium
GATASVTRA

SEQ ID NO: 259257 - protein, 14 aa, Mycobacterium
GATATSVSTEEIYG

SEQ ID NO: 259258 - protein, 6 aa, Mycobacterium
GATATT

SEQ ID NO: 259259 - protein, 5 aa, Mycobacterium
GATEA

SEQ ID NO: 259260 - protein, 8 aa, Mycobacterium
GATEAGAD

SEQ ID NO: 259261 - protein, 6 aa, Mycobacterium
GATECK

SEQ ID NO: 259262 - protein, 9 aa, Mycobacterium
GATEGEGTQ

SEQ ID NO: 259263 - protein, 8 aa, Mycobacterium
GATENDRK

SEQ ID NO: 259264 - protein, 8 aa, Mycobacterium
GATETPGL

SEQ ID NO: 259265 - protein, 5 aa, Mycobacterium
GATGA

SEQ ID NO: 259266 - protein, 14 aa, Mycobacterium
GATGDLKKDFTPAS

SEQ ID NO: 259267 - protein, 14 aa, Mycobacterium
GATGEFKDTYTKAS

SEQ ID NO: 259268 - protein, 9 aa, Mycobacterium
GATGEFRDG

SEQ ID NO: 259269 - protein, 6 aa, Mycobacterium
GATGGV

SEQ ID NO: 259270 - protein, 8 aa, Mycobacterium
GATGNPLT

SEQ ID NO: 259271 - protein, 6 aa, Mycobacterium
GATGPG

SEQ ID NO: 259272 - protein, 9 aa, Mycobacterium
GATGPVQNM

SEQ ID NO: 259273 - protein, 12 aa, Mycobacterium
GATGSAITSQAS

SEQ ID NO: 259274 - protein, 15 aa, Mycobacterium
GATGSATNHSATDVP

SEQ ID NO: 259275 - protein, 6 aa, Mycobacterium
GATGSF

SEQ ID NO: 259276 - protein, 8 aa, Mycobacterium
GATGSGKS

SEQ ID NO: 259277 - protein, 9 aa, Mycobacterium
GATGSGKST

SEQ ID NO: 259278 - protein, 7 aa, Mycobacterium
GATGSYP

SEQ ID NO: 259279 - protein, 9 aa, Mycobacterium
GATGTSGAE

SEQ ID NO: 259280 - protein, 10 aa, Mycobacterium
GATHPTHGSP

SEQ ID NO: 259281 - protein, 9 aa, Mycobacterium
GATHPVHGS

SEQ ID NO: 259282 - protein, 4 aa, Mycobacterium
GATI

SEQ ID NO: 259283 - protein, 6 aa, Mycobacterium
GATIDE

SEQ ID NO: 259284 - protein, 17 aa, Mycobacterium
GATKPRLGPSGRDSVVG

SEQ ID NO: 259285 - protein, 10 aa, Mycobacterium
GATKSLPPGA

SEQ ID NO: 259286 - protein, 4 aa, Mycobacterium
GATL

SEQ ID NO: 259287 - protein, 7 aa, Mycobacterium
GATLGSA

SEQ ID NO: 259288 - protein, 6 aa, Mycobacterium
GATMAG

SEQ ID NO: 259289 - protein, 6 aa, Mycobacterium
GATNPG

SEQ ID NO: 259290 - protein, 12 aa, Mycobacterium
GATNPRTAANGY

SEQ ID NO: 259291 - protein, 7 aa, Mycobacterium
GATPAGA

SEQ ID NO: 259292 - protein, 5 aa, Mycobacterium
GATPG

SEQ ID NO: 259293 - protein, 24 aa, Mycobacterium
GATPGNATGRGRGAPGLPTPPRGW

SEQ ID NO: 259294 - protein, 63 aa, Mycobacterium
GATPGTVAAPAPDPQAEPETQPAQPASEVPIPPPPTDPSGPNGNGAAQAKPDPAGAADALNQQ

SEQ ID NO: 259295 - protein, 6 aa, Mycobacterium
GATPHT

SEQ ID NO: 259296 - protein, 16 aa, Mycobacterium
GATPPDGPPGPDQPMR

SEQ ID NO: 259297 - protein, 16 aa, Mycobacterium
GATPPHREQYSDPEKP

SEQ ID NO: 259298 - protein, 25 aa, Mycobacterium
GATPPSAAAGRRGVPSLPTPPKGWP

SEQ ID NO: 259299 - protein, 6 aa, Mycobacterium
GATPSS

SEQ ID NO: 259300 - protein, 6 aa, Mycobacterium
GATPTS

SEQ ID NO: 259301 - protein, 6 aa, Mycobacterium
GATQPV

SEQ ID NO: 259302 - protein, 12 aa, Mycobacterium
GATQRVGTGACV

SEQ ID NO: 259303 - protein, 7 aa, Mycobacterium
GATQSTL

SEQ ID NO: 259304 - protein, 9 aa, Mycobacterium
GATQTTLAD

SEQ ID NO: 259305 - protein, 9 aa, Mycobacterium
GATRADEGR

SEQ ID NO: 259306 - protein, 5 aa, Mycobacterium
GATRS

SEQ ID NO: 259307 - protein, 6 aa, Mycobacterium
GATSFA

SEQ ID NO: 259308 - protein, 8 aa, Mycobacterium
GATSGQAL

SEQ ID NO: 259309 - protein, 10 aa, Mycobacterium
GATSLAGAAS

SEQ ID NO: 259310 - protein, 11 aa, Mycobacterium
GATSLAGAASG

SEQ ID NO: 259311 - protein, 10 aa, Mycobacterium
GATSSPSSLS

SEQ ID NO: 259312 - protein, 6 aa, Mycobacterium
GATSVF

SEQ ID NO: 259313 - protein, 4 aa, Mycobacterium
GATT

SEQ ID NO: 259314 - protein, 9 aa, Mycobacterium
GATTADRDR

SEQ ID NO: 259315 - protein, 7 aa, Mycobacterium
GATTAGI

SEQ ID NO: 259316 - protein, 44 aa, Mycobacterium
GATTAPNGRPVPVTPGVRPDTGEPNPPGPQPSETPGQPTAKPMP

SEQ ID NO: 259317 - protein, 5 aa, Mycobacterium
GATTH

SEQ ID NO: 259318 - protein, 5 aa, Mycobacterium
GATTS

SEQ ID NO: 259319 - protein, 9 aa, Mycobacterium
GATTVPHGP

SEQ ID NO: 259320 - protein, 5 aa, Mycobacterium
GATVE

SEQ ID NO: 259321 - protein, 15 aa, Mycobacterium
GATVGKNADVAPGSA

SEQ ID NO: 259322 - protein, 5 aa, Mycobacterium
GATVN

SEQ ID NO: 259323 - protein, 7 aa, Mycobacterium
GATVSRR

SEQ ID NO: 259324 - protein, 4 aa, Mycobacterium
GATW

SEQ ID NO: 259325 - protein, 8 aa, Mycobacterium
GATWGWGS

SEQ ID NO: 259326 - protein, 7 aa, Mycobacterium
GAVAPGT

SEQ ID NO: 259327 - protein, 5 aa, Mycobacterium
GAVEA

SEQ ID NO: 259328 - protein, 69 aa, Mycobacterium
GAVEPQEVDAPPVPDEAGGLGAVEGEEAAEAAAGAGAARASVSDDAEASNDADAETEAAGLGSVDGDEV

SEQ ID NO: 259329 - protein, 12 aa, Mycobacterium
GAVETDDGPQLQ

SEQ ID NO: 259330 - protein, 4 aa, Mycobacterium
GAVG

SEQ ID NO: 259331 - protein, 5 aa, Mycobacterium
GAVGA

SEQ ID NO: 259332 - protein, 5 aa, Mycobacterium
GAVGG

SEQ ID NO: 259333 - protein, 7 aa, Mycobacterium
GAVGGGA

SEQ ID NO: 259334 - protein, 11 aa, Mycobacterium
GAVKAGRAGAL

SEQ ID NO: 259335 - protein, 7 aa, Mycobacterium
GAVKPDD

SEQ ID NO: 259336 - protein, 4 aa, Mycobacterium
GAVP

SEQ ID NO: 259337 - protein, 6 aa, Mycobacterium
GAVPGN

SEQ ID NO: 259338 - protein, 5 aa, Mycobacterium
GAVPP

SEQ ID NO: 259339 - protein, 17 aa, Mycobacterium
GAVPPNPSELLGSQSAR

SEQ ID NO: 259340 - protein, 6 aa, Mycobacterium
GAVPQG

SEQ ID NO: 259341 - protein, 5 aa, Mycobacterium
GAVPS

SEQ ID NO: 259342 - protein, 6 aa, Mycobacterium
GAVPSE

SEQ ID NO: 259343 - protein, 8 aa, Mycobacterium
GAVSPARV

SEQ ID NO: 259344 - protein, 7 aa, Mycobacterium
GAVTPAA

SEQ ID NO: 259345 - protein, 15 aa, Mycobacterium
GAVTSAPKTESDARI

SEQ ID NO: 259346 - protein, 22 aa, Mycobacterium
GAVTTSAGLRTTLDGDTDRYEA

SEQ ID NO: 259347 - protein, 7 aa, Mycobacterium
GAWDGPS

SEQ ID NO: 259348 - protein, 10 aa, Mycobacterium
GAWDGPSADQ

SEQ ID NO: 259349 - protein, 8 aa, Mycobacterium
GAWDGPTA

SEQ ID NO: 259350 - protein, 8 aa, Mycobacterium
GAWQGPSA

SEQ ID NO: 259351 - protein, 8 aa, Mycobacterium
GAWQGPSV

SEQ ID NO: 259352 - protein, 8 aa, Mycobacterium
GAWQGPTA

SEQ ID NO: 259353 - protein, 6 aa, Mycobacterium
GAYAPA

SEQ ID NO: 259354 - protein, 7 aa, Mycobacterium
GAYAPAG

SEQ ID NO: 259355 - protein, 4 aa, Mycobacterium
GAYD

SEQ ID NO: 259356 - protein, 7 aa, Mycobacterium
GAYGPKV

SEQ ID NO: 259357 - protein, 24 aa, Mycobacterium
GAYGPLGPLGGEDPQGFSPDGVPD

SEQ ID NO: 259358 - protein, 7 aa, Mycobacterium
GAYGPTV

SEQ ID NO: 259359 - protein, 10 aa, Mycobacterium
GAYPARPANQ

SEQ ID NO: 259360 - protein, 13 aa, Mycobacterium
GAYQRTAPRPTTV

SEQ ID NO: 259361 - protein, 13 aa, Mycobacterium
GAYRATKVGPDAY

SEQ ID NO: 259362 - protein, 5 aa, Mycobacterium
GCAPS

SEQ ID NO: 259363 - protein, 4 aa, Mycobacterium
GCDT

SEQ ID NO: 259364 - protein, 7 aa, Mycobacterium
GCGKSTA

SEQ ID NO: 259365 - protein, 5 aa, Mycobacterium
GCGKT

SEQ ID NO: 259366 - protein, 4 aa, Mycobacterium
GCQP

SEQ ID NO: 259367 - protein, 5 aa, Mycobacterium
GCRQG

SEQ ID NO: 259368 - protein, 8 aa, Mycobacterium
GCSKTTTG

SEQ ID NO: 259369 - protein, 7 aa, Mycobacterium
GCSPRRP

SEQ ID NO: 259370 - protein, 5 aa, Mycobacterium
GCTPA

SEQ ID NO: 259371 - protein, 4 aa, Mycobacterium
GDAA

SEQ ID NO: 259372 - protein, 8 aa, Mycobacterium
GDAAAERT

SEQ ID NO: 259373 - protein, 8 aa, Mycobacterium
GDAAANEI

SEQ ID NO: 259374 - protein, 9 aa, Mycobacterium
GDAAEARQA

SEQ ID NO: 259375 - protein, 13 aa, Mycobacterium
GDAAPNAGTRNET

SEQ ID NO: 259376 - protein, 6 aa, Mycobacterium
GDADGS

SEQ ID NO: 259377 - protein, 8 aa, Mycobacterium
GDADSARA

SEQ ID NO: 259378 - protein, 10 aa, Mycobacterium
GDADVGGRLT

SEQ ID NO: 259379 - protein, 12 aa, Mycobacterium
GDAFTTASPQVL

SEQ ID NO: 259380 - protein, 5 aa, Mycobacterium
GDAGA

SEQ ID NO: 259381 - protein, 8 aa, Mycobacterium
GDAGARRA

SEQ ID NO: 259382 - protein, 9 aa, Mycobacterium
GDAGGNGGE

SEQ ID NO: 259383 - protein, 7 aa, Mycobacterium
GDAGPDI

SEQ ID NO: 259384 - protein, 7 aa, Mycobacterium
GDAGPDL

SEQ ID NO: 259385 - protein, 8 aa, Mycobacterium
GDAGSGTL

SEQ ID NO: 259386 - protein, 7 aa, Mycobacterium
GDAGSGY

SEQ ID NO: 259387 - protein, 8 aa, Mycobacterium
GDAKSATA

SEQ ID NO: 259388 - protein, 5 aa, Mycobacterium
GDANP

SEQ ID NO: 259389 - protein, 23 aa, Mycobacterium
GDAPLPPEAPAPPPGFGNTPPTG

SEQ ID NO: 259390 - protein, 10 aa, Mycobacterium
GDAPVDAAHS

SEQ ID NO: 259391 - protein, 6 aa, Mycobacterium
GDAQWR

SEQ ID NO: 259392 - protein, 7 aa, Mycobacterium
GDARAAR

SEQ ID NO: 259393 - protein, 15 aa, Mycobacterium
GDARAARGTEVDRPD

SEQ ID NO: 259394 - protein, 5 aa, Mycobacterium
GDARP

SEQ ID NO: 259395 - protein, 9 aa, Mycobacterium
GDARSGVGG

SEQ ID NO: 259396 - protein, 11 aa, Mycobacterium
GDARVGAPTVT

SEQ ID NO: 259397 - protein, 6 aa, Mycobacterium
GDASDL

SEQ ID NO: 259398 - protein, 9 aa, Mycobacterium
GDASGLTAT

SEQ ID NO: 259399 - protein, 18 aa, Mycobacterium
GDASGPYLANGDSTCSDN

SEQ ID NO: 259400 - protein, 8 aa, Mycobacterium
GDASPARI

SEQ ID NO: 259401 - protein, 7 aa, Mycobacterium
GDASPDL

SEQ ID NO: 259402 - protein, 12 aa, Mycobacterium
GDASPNTGDQKH

SEQ ID NO: 259403 - protein, 11 aa, Mycobacterium
GDASQTSDRPD

SEQ ID NO: 259404 - protein, 7 aa, Mycobacterium
GDATALA

SEQ ID NO: 259405 - protein, 7 aa, Mycobacterium
GDATASL

SEQ ID NO: 259406 - protein, 7 aa, Mycobacterium
GDATKSD

SEQ ID NO: 259407 - protein, 5 aa, Mycobacterium
GDATL

SEQ ID NO: 259408 - protein, 15 aa, Mycobacterium
GDAVTNPRTGEHDPT

SEQ ID NO: 259409 - protein, 8 aa, Mycobacterium
GDAWPPGR

SEQ ID NO: 259410 - protein, 6 aa, Mycobacterium
GDAWPT

SEQ ID NO: 259411 - protein, 6 aa, Mycobacterium
GDCGDA

SEQ ID NO: 259412 - protein, 12 aa, Mycobacterium
GDDADDSAAAPY

SEQ ID NO: 259413 - protein, 9 aa, Mycobacterium
GDDALKRKA

SEQ ID NO: 259414 - protein, 6 aa, Mycobacterium
GDDAPR

SEQ ID NO: 259415 - protein, 8 aa, Mycobacterium
GDDCPDST

SEQ ID NO: 259416 - protein, 28 aa, Mycobacterium
GDDDASGANDGAQHPGIEAPAVPGAADD

SEQ ID NO: 259417 - protein, 6 aa, Mycobacterium
GDDDPD

SEQ ID NO: 259418 - protein, 8 aa, Mycobacterium
GDDDTQPM

SEQ ID NO: 259419 - protein, 10 aa, Mycobacterium
GDDDTRATVD

SEQ ID NO: 259420 - protein, 6 aa, Mycobacterium
GDDEST

SEQ ID NO: 259421 - protein, 7 aa, Mycobacterium
GDDESTV

SEQ ID NO: 259422 - protein, 8 aa, Mycobacterium
GDDETTSV

SEQ ID NO: 259423 - protein, 13 aa, Mycobacterium
GDDEVAQDTGSQG

SEQ ID NO: 259424 - protein, 10 aa, Mycobacterium
GDDFDGPAPE

SEQ ID NO: 259425 - protein, 5 aa, Mycobacterium
GDDFG

SEQ ID NO: 259426 - protein, 7 aa, Mycobacterium
GDDGEHP

SEQ ID NO: 259427 - protein, 6 aa, Mycobacterium
GDDGEW

SEQ ID NO: 259428 - protein, 41 aa, Mycobacterium
GDDHHGDDQQPGSPPPAAHPVEAPAPTPSSAPEAATPVPID

SEQ ID NO: 259429 - protein, 12 aa, Mycobacterium
GDDKGNVAGDPA

SEQ ID NO: 259430 - protein, 8 aa, Mycobacterium
GDDLGRGG

SEQ ID NO: 259431 - protein, 46 aa, Mycobacterium
GDDNASTGNTGITPPEGATSTSESTTTTTSNRSATANVSGTDEQGF

SEQ ID NO: 259432 - protein, 4 aa, Mycobacterium
GDDP

SEQ ID NO: 259433 - protein, 6 aa, Mycobacterium
GDDPAT

SEQ ID NO: 259434 - protein, 7 aa, Mycobacterium
GDDPDRV

SEQ ID NO: 259435 - protein, 7 aa, Mycobacterium
GDDPEAI

SEQ ID NO: 259436 - protein, 9 aa, Mycobacterium
GDDPPTDMA

SEQ ID NO: 259437 - protein, 6 aa, Mycobacterium
GDDPRT

SEQ ID NO: 259438 - protein, 7 aa, Mycobacterium
GDDPYQY

SEQ ID NO: 259439 - protein, 14 aa, Mycobacterium
GDDQEQAAATLGAN

SEQ ID NO: 259440 - protein, 7 aa, Mycobacterium
GDDSDAS

SEQ ID NO: 259441 - protein, 9 aa, Mycobacterium
GDDSDRETW

SEQ ID NO: 259442 - protein, 9 aa, Mycobacterium
GDDSLPAES

SEQ ID NO: 259443 - protein, 10 aa, Mycobacterium
GDDSQGGKAA

SEQ ID NO: 259444 - protein, 9 aa, Mycobacterium
GDDTDAEHR

SEQ ID NO: 259445 - protein, 4 aa, Mycobacterium
GDDV

SEQ ID NO: 259446 - protein, 12 aa, Mycobacterium
GDDVGSRARSTA

SEQ ID NO: 259447 - protein, 6 aa, Mycobacterium
GDDYRR

SEQ ID NO: 259448 - protein, 9 aa, Mycobacterium
GDEDIRKQS

SEQ ID NO: 259449 - protein, 7 aa, Mycobacterium
GDEEIRK

SEQ ID NO: 259450 - protein, 12 aa, Mycobacterium
GDEELVQVAWSA

SEQ ID NO: 259451 - protein, 6 aa, Mycobacterium
GDEFTG

SEQ ID NO: 259452 - protein, 9 aa, Mycobacterium
GDEGFRTPF

SEQ ID NO: 259453 - protein, 7 aa, Mycobacterium
GDEGNTE

SEQ ID NO: 259454 - protein, 5 aa, Mycobacterium
GDEGT

SEQ ID NO: 259455 - protein, 5 aa, Mycobacterium
GDEHY

SEQ ID NO: 259456 - protein, 5 aa, Mycobacterium
GDEIP

SEQ ID NO: 259457 - protein, 6 aa, Mycobacterium
GDEKDL

SEQ ID NO: 259458 - protein, 5 aa, Mycobacterium
GDELE

SEQ ID NO: 259459 - protein, 10 aa, Mycobacterium
GDELPGQGAG

SEQ ID NO: 259460 - protein, 10 aa, Mycobacterium
GDENASTAAE

SEQ ID NO: 259461 - protein, 10 aa, Mycobacterium
GDENSAPRHA

SEQ ID NO: 259462 - protein, 11 aa, Mycobacterium
GDENVRKKSYY

SEQ ID NO: 259463 - protein, 10 aa, Mycobacterium
GDENVRKQSY

SEQ ID NO: 259464 - protein, 16 aa, Mycobacterium
GDEPAKPVRVPAEREP

SEQ ID NO: 259465 - protein, 11 aa, Mycobacterium
GDEPDQGQREA

SEQ ID NO: 259466 - protein, 7 aa, Mycobacterium
GDEPLKR

SEQ ID NO: 259467 - protein, 6 aa, Mycobacterium
GDEPLV

SEQ ID NO: 259468 - protein, 10 aa, Mycobacterium
GDEPTPQQRE

SEQ ID NO: 259469 - protein, 12 aa, Mycobacterium
GDEPTPQQRESA

SEQ ID NO: 259470 - protein, 14 aa, Mycobacterium
GDEQQRTRAALESA

SEQ ID NO: 259471 - protein, 8 aa, Mycobacterium
GDERSGIG

SEQ ID NO: 259472 - protein, 6 aa, Mycobacterium
GDERVD

SEQ ID NO: 259473 - protein, 13 aa, Mycobacterium
GDESDQPEARRGS

SEQ ID NO: 259474 - protein, 22 aa, Mycobacterium
GDESDQPEERRGSFGKPAPGFE

SEQ ID NO: 259475 - protein, 5 aa, Mycobacterium
GDETA

SEQ ID NO: 259476 - protein, 11 aa, Mycobacterium
GDETYGRDRTS

SEQ ID NO: 259477 - protein, 19 aa, Mycobacterium
GDETYNGEVSSQKFSGGQV

SEQ ID NO: 259478 - protein, 18 aa, Mycobacterium
GDFAADDAENQPVGSDSG

SEQ ID NO: 259479 - protein, 5 aa, Mycobacterium
GDFGA

SEQ ID NO: 259480 - protein, 13 aa, Mycobacterium
GDFGTTVGGQPVS

SEQ ID NO: 259481 - protein, 10 aa, Mycobacterium
GDFPASTRDG

SEQ ID NO: 259482 - protein, 13 aa, Mycobacterium
GDFSADDKYTGAK

SEQ ID NO: 259483 - protein, 5 aa, Mycobacterium
GDFTD

SEQ ID NO: 259484 - protein, 4 aa, Mycobacterium
GDGA

SEQ ID NO: 259485 - protein, 9 aa, Mycobacterium
GDGANDAAA

SEQ ID NO: 259486 - protein, 11 aa, Mycobacterium
GDGANDAAAIR

SEQ ID NO: 259487 - protein, 6 aa, Mycobacterium
GDGAPA

SEQ ID NO: 259488 - protein, 7 aa, Mycobacterium
GDGATRR

SEQ ID NO: 259489 - protein, 7 aa, Mycobacterium
GDGDRAA

SEQ ID NO: 259490 - protein, 15 aa, Mycobacterium
GDGDRVSSPGPSSAA

SEQ ID NO: 259491 - protein, 6 aa, Mycobacterium
GDGDSI

SEQ ID NO: 259492 - protein, 7 aa, Mycobacterium
GDGDTRG

SEQ ID NO: 259493 - protein, 6 aa, Mycobacterium
GDGDYY

SEQ ID NO: 259494 - protein, 9 aa, Mycobacterium
GDGEQPDQV

SEQ ID NO: 259495 - protein, 6 aa, Mycobacterium
GDGEVE

SEQ ID NO: 259496 - protein, 7 aa, Mycobacterium
GDGEVGR

SEQ ID NO: 259497 - protein, 9 aa, Mycobacterium
GDGGAGPAA

SEQ ID NO: 259498 - protein, 7 aa, Mycobacterium
GDGGGEE

SEQ ID NO: 259499 - protein, 7 aa, Mycobacterium
GDGGGGF

SEQ ID NO: 259500 - protein, 7 aa, Mycobacterium
GDGGLGS

SEQ ID NO: 259501 - protein, 12 aa, Mycobacterium
GDGGTADQTGAL

SEQ ID NO: 259502 - protein, 7 aa, Mycobacterium
GDGGVSR

SEQ ID NO: 259503 - protein, 14 aa, Mycobacterium
GDGHEGLPASEGIA

SEQ ID NO: 259504 - protein, 8 aa, Mycobacterium
GDGLSDCD

SEQ ID NO: 259505 - protein, 12 aa, Mycobacterium
GDGLSGVAAPQM

SEQ ID NO: 259506 - protein, 10 aa, Mycobacterium
GDGLTPGSAE

SEQ ID NO: 259507 - protein, 21 aa, Mycobacterium
GDGNGNENEEEVPGSALRPGD

SEQ ID NO: 259508 - protein, 5 aa, Mycobacterium
GDGNY

SEQ ID NO: 259509 - protein, 7 aa, Mycobacterium
GDGPARI

SEQ ID NO: 259510 - protein, 7 aa, Mycobacterium
GDGPDTV

SEQ ID NO: 259511 - protein, 8 aa, Mycobacterium
GDGPLTRP

SEQ ID NO: 259512 - protein, 9 aa, Mycobacterium
GDGPPRTRL

SEQ ID NO: 259513 - protein, 7 aa, Mycobacterium
GDGPQIR

SEQ ID NO: 259514 - protein, 15 aa, Mycobacterium
GDGPQLRSIDPKADV

SEQ ID NO: 259515 - protein, 6 aa, Mycobacterium
GDGPQM

SEQ ID NO: 259516 - protein, 6 aa, Mycobacterium
GDGPQV

SEQ ID NO: 259517 - protein, 7 aa, Mycobacterium
GDGPQVR

SEQ ID NO: 259518 - protein, 15 aa, Mycobacterium
GDGPRAAAAAGPVAQ

SEQ ID NO: 259519 - protein, 16 aa, Mycobacterium
GDGPRAASAAGPVDQV

SEQ ID NO: 259520 - protein, 16 aa, Mycobacterium
GDGPRAASTAGPVDQV

SEQ ID NO: 259521 - protein, 17 aa, Mycobacterium
GDGPRAATAAGPADQVP

SEQ ID NO: 259522 - protein, 19 aa, Mycobacterium
GDGPREATSAGPATQIPGP

SEQ ID NO: 259523 - protein, 7 aa, Mycobacterium
GDGPSGL

SEQ ID NO: 259524 - protein, 7 aa, Mycobacterium
GDGPSWM

SEQ ID NO: 259525 - protein, 7 aa, Mycobacterium
GDGPTRG

SEQ ID NO: 259526 - protein, 10 aa, Mycobacterium
GDGPVDEGGT

SEQ ID NO: 259527 - protein, 7 aa, Mycobacterium
GDGQEPG

SEQ ID NO: 259528 - protein, 7 aa, Mycobacterium
GDGQLQG

SEQ ID NO: 259529 - protein, 13 aa, Mycobacterium
GDGQPVAESSDAR

SEQ ID NO: 259530 - protein, 7 aa, Mycobacterium
GDGRERV

SEQ ID NO: 259531 - protein, 10 aa, Mycobacterium
GDGSADDPVI

SEQ ID NO: 259532 - protein, 11 aa, Mycobacterium
GDGSPGHPGDD

SEQ ID NO: 259533 - protein, 7 aa, Mycobacterium
GDGSQRV

SEQ ID NO: 259534 - protein, 6 aa, Mycobacterium
GDGTAA

SEQ ID NO: 259535 - protein, 18 aa, Mycobacterium
GDGTDRPCPDPSLPIPTK

SEQ ID NO: 259536 - protein, 10 aa, Mycobacterium
GDGTDRPCPH

SEQ ID NO: 259537 - protein, 22 aa, Mycobacterium
GDGTDTPCPNPALPIPTKRSGY

SEQ ID NO: 259538 - protein, 9 aa, Mycobacterium
GDGTDVPCP

SEQ ID NO: 259539 - protein, 12 aa, Mycobacterium
GDGTNDAPALAQ

SEQ ID NO: 259540 - protein, 18 aa, Mycobacterium
GDGTPDNGDRLAASGAKF

SEQ ID NO: 259541 - protein, 7 aa, Mycobacterium
GDGTSTV

SEQ ID NO: 259542 - protein, 9 aa, Mycobacterium
GDGTTTQTH

SEQ ID NO: 259543 - protein, 7 aa, Mycobacterium
GDGVAGA

SEQ ID NO: 259544 - protein, 10 aa, Mycobacterium
GDGVNDAPAL

SEQ ID NO: 259545 - protein, 12 aa, Mycobacterium
GDGVNDAPALKQ

SEQ ID NO: 259546 - protein, 16 aa, Mycobacterium
GDGVNDAPALKQADAG

SEQ ID NO: 259547 - protein, 29 aa, Mycobacterium
GDGVNDAPALKQADAGIAVSGATDAARAA

SEQ ID NO: 259548 - protein, 12 aa, Mycobacterium
GDGVNDAPALRQ

SEQ ID NO: 259549 - protein, 13 aa, Mycobacterium
GDGVNDSPALKKA

SEQ ID NO: 259550 - protein, 7 aa, Mycobacterium
GDGVRAR

SEQ ID NO: 259551 - protein, 25 aa, Mycobacterium
GDGYDDGPRTPAMPSTWDGDPAPSP

SEQ ID NO: 259552 - protein, 5 aa, Mycobacterium
GDHGD

SEQ ID NO: 259553 - protein, 14 aa, Mycobacterium
GDHGPTAGTKQQTI

SEQ ID NO: 259554 - protein, 32 aa, Mycobacterium
GDHKTTASASPSSSEPTSSAAAPADDSVPPLP

SEQ ID NO: 259555 - protein, 7 aa, Mycobacterium
GDHPATA

SEQ ID NO: 259556 - protein, 9 aa, Mycobacterium
GDHPATATA

SEQ ID NO: 259557 - protein, 8 aa, Mycobacterium
GDHPAVGQ

SEQ ID NO: 259558 - protein, 8 aa, Mycobacterium
GDHPDTAR

SEQ ID NO: 259559 - protein, 7 aa, Mycobacterium
GDHPPHG

SEQ ID NO: 259560 - protein, 6 aa, Mycobacterium
GDHPRT

SEQ ID NO: 259561 - protein, 7 aa, Mycobacterium
GDHPSTA

SEQ ID NO: 259562 - protein, 7 aa, Mycobacterium
GDHPTTA

SEQ ID NO: 259563 - protein, 4 aa, Mycobacterium
GDHR

SEQ ID NO: 259564 - protein, 6 aa, Mycobacterium
GDHSGL

SEQ ID NO: 259565 - protein, 7 aa, Mycobacterium
GDHSGLA

SEQ ID NO: 259566 - protein, 7 aa, Mycobacterium
GDHSTEA

SEQ ID NO: 259567 - protein, 9 aa, Mycobacterium
GDHTAPSET

SEQ ID NO: 259568 - protein, 7 aa, Mycobacterium
GDHTRQD

SEQ ID NO: 259569 - protein, 9 aa, Mycobacterium
GDIAPQPDW

SEQ ID NO: 259570 - protein, 9 aa, Mycobacterium
GDIARRGAD

SEQ ID NO: 259571 - protein, 4 aa, Mycobacterium
GDID

SEQ ID NO: 259572 - protein, 8 aa, Mycobacterium
GDIDEDEF

SEQ ID NO: 259573 - protein, 13 aa, Mycobacterium
GDIESTNGEMLGS

SEQ ID NO: 259574 - protein, 6 aa, Mycobacterium
GDIPGQ

SEQ ID NO: 259575 - protein, 6 aa, Mycobacterium
GDKGAS

SEQ ID NO: 259576 - protein, 9 aa, Mycobacterium
GDKGQPNLG

SEQ ID NO: 259577 - protein, 8 aa, Mycobacterium
GDKLDERG

SEQ ID NO: 259578 - protein, 8 aa, Mycobacterium
GDKLGGDL

SEQ ID NO: 259579 - protein, 8 aa, Mycobacterium
GDKNATRT

SEQ ID NO: 259580 - protein, 6 aa, Mycobacterium
GDKPFG

SEQ ID NO: 259581 - protein, 6 aa, Mycobacterium
GDKPGA

SEQ ID NO: 259582 - protein, 8 aa, Mycobacterium
GDKSATRT

SEQ ID NO: 259583 - protein, 8 aa, Mycobacterium
GDKSRTAV

SEQ ID NO: 259584 - protein, 6 aa, Mycobacterium
GDKTAA

SEQ ID NO: 259585 - protein, 10 aa, Mycobacterium
GDLDDSESRI

SEQ ID NO: 259586 - protein, 8 aa, Mycobacterium
GDLDEDAW

SEQ ID NO: 259587 - protein, 10 aa, Mycobacterium
GDLDEDSWEE

SEQ ID NO: 259588 - protein, 9 aa, Mycobacterium
GDLDEDSWQ

SEQ ID NO: 259589 - protein, 10 aa, Mycobacterium
GDLDEDSWQD

SEQ ID NO: 259590 - protein, 10 aa, Mycobacterium
GDLDEESWEE

SEQ ID NO: 259591 - protein, 4 aa, Mycobacterium
GDLE

SEQ ID NO: 259592 - protein, 7 aa, Mycobacterium
GDLEPYE

SEQ ID NO: 259593 - protein, 11 aa, Mycobacterium
GDLGDGDSPIS

SEQ ID NO: 259594 - protein, 12 aa, Mycobacterium
GDLGRPEDPWST

SEQ ID NO: 259595 - protein, 12 aa, Mycobacterium
GDLGSPQSKHAY

SEQ ID NO: 259596 - protein, 11 aa, Mycobacterium
GDLGSSAARKY

SEQ ID NO: 259597 - protein, 7 aa, Mycobacterium
GDLGTPL

SEQ ID NO: 259598 - protein, 6 aa, Mycobacterium
GDLNGF

SEQ ID NO: 259599 - protein, 18 aa, Mycobacterium
GDLPPAANRPDGTDADSA

SEQ ID NO: 259600 - protein, 7 aa, Mycobacterium
GDLPPAV

SEQ ID NO: 259601 - protein, 11 aa, Mycobacterium
GDLQGGSTITQ

SEQ ID NO: 259602 - protein, 11 aa, Mycobacterium
GDLQTAGGETA

SEQ ID NO: 259603 - protein, 7 aa, Mycobacterium
GDLRDEQ

SEQ ID NO: 259604 - protein, 5 aa, Mycobacterium
GDLRR

SEQ ID NO: 259605 - protein, 10 aa, Mycobacterium
GDLSGTGVAP

SEQ ID NO: 259606 - protein, 8 aa, Mycobacterium
GDMGETLA

SEQ ID NO: 259607 - protein, 4 aa, Mycobacterium
GDNA

SEQ ID NO: 259608 - protein, 8 aa, Mycobacterium
GDNARTAA

SEQ ID NO: 259609 - protein, 10 aa, Mycobacterium
GDNARTAEAV

SEQ ID NO: 259610 - protein, 9 aa, Mycobacterium
GDNARTANA

SEQ ID NO: 259611 - protein, 6 aa, Mycobacterium
GDNAVS

SEQ ID NO: 259612 - protein, 10 aa, Mycobacterium
GDNDNTTGVG

SEQ ID NO: 259613 - protein, 17 aa, Mycobacterium
GDNDPEPPDPKDLTQSA

SEQ ID NO: 259614 - protein, 9 aa, Mycobacterium
GDNERTARA

SEQ ID NO: 259615 - protein, 9 aa, Mycobacterium
GDNGAAARA

SEQ ID NO: 259616 - protein, 4 aa, Mycobacterium
GDNP

SEQ ID NO: 259617 - protein, 10 aa, Mycobacterium
GDNPAARQEV

SEQ ID NO: 259618 - protein, 8 aa, Mycobacterium
GDNPRAAA

SEQ ID NO: 259619 - protein, 7 aa, Mycobacterium
GDNPTVA

SEQ ID NO: 259620 - protein, 9 aa, Mycobacterium
GDNQATAAA

SEQ ID NO: 259621 - protein, 7 aa, Mycobacterium
GDNQRVA

SEQ ID NO: 259622 - protein, 8 aa, Mycobacterium
GDNQVRTT

SEQ ID NO: 259623 - protein, 7 aa, Mycobacterium
GDNRPYP

SEQ ID NO: 259624 - protein, 10 aa, Mycobacterium
GDNRSQAEAR

SEQ ID NO: 259625 - protein, 4 aa, Mycobacterium
GDNS

SEQ ID NO: 259626 - protein, 7 aa, Mycobacterium
GDNSKEA

SEQ ID NO: 259627 - protein, 7 aa, Mycobacterium
GDNSRTA

SEQ ID NO: 259628 - protein, 8 aa, Mycobacterium
GDNTRTAH

SEQ ID NO: 259629 - protein, 10 aa, Mycobacterium
GDNTRTANAV

SEQ ID NO: 259630 - protein, 15 aa, Mycobacterium
GDNVNSAQIDDREQQ

SEQ ID NO: 259631 - protein, 15 aa, Mycobacterium
GDPAAGVEARRAAAS

SEQ ID NO: 259632 - protein, 7 aa, Mycobacterium
GDPAARR

SEQ ID NO: 259633 - protein, 11 aa, Mycobacterium
GDPADSELDRK

SEQ ID NO: 259634 - protein, 29 aa, Mycobacterium
GDPADSELDRKAAQHVPRGKPGRGLAGDG

SEQ ID NO: 259635 - protein, 25 aa, Mycobacterium
GDPADSEVDRRGARQVPRDRPGRGL

SEQ ID NO: 259636 - protein, 30 aa, Mycobacterium
GDPADSEVDRRQAQQVPRDRPGRGLAPDGS

SEQ ID NO: 259637 - protein, 11 aa, Mycobacterium
GDPAESEMDRR

SEQ ID NO: 259638 - protein, 30 aa, Mycobacterium
GDPAESEMDRRRARDLADRPPGRALTREGR

SEQ ID NO: 259639 - protein, 5 aa, Mycobacterium
GDPAN

SEQ ID NO: 259640 - protein, 6 aa, Mycobacterium
GDPAPL

SEQ ID NO: 259641 - protein, 16 aa, Mycobacterium
GDPAPQFPAGPTASQI

SEQ ID NO: 259642 - protein, 8 aa, Mycobacterium
GDPARGHP

SEQ ID NO: 259643 - protein, 5 aa, Mycobacterium
GDPAT

SEQ ID NO: 259644 - protein, 17 aa, Mycobacterium
GDPATAAGVQSRDGKAA

SEQ ID NO: 259645 - protein, 8 aa, Mycobacterium
GDPATAEG

SEQ ID NO: 259646 - protein, 9 aa, Mycobacterium
GDPATPEGI

SEQ ID NO: 259647 - protein, 9 aa, Mycobacterium
GDPATPEGL

SEQ ID NO: 259648 - protein, 9 aa, Mycobacterium
GDPATSESV

SEQ ID NO: 259649 - protein, 4 aa, Mycobacterium
GDPD

SEQ ID NO: 259650 - protein, 9 aa, Mycobacterium
GDPDAPEGI

SEQ ID NO: 259651 - protein, 5 aa, Mycobacterium
GDPDH

SEQ ID NO: 259652 - protein, 16 aa, Mycobacterium
GDPDPGAAALPARAQG

SEQ ID NO: 259653 - protein, 9 aa, Mycobacterium
GDPDRPEGI

SEQ ID NO: 259654 - protein, 9 aa, Mycobacterium
GDPDSTLSY

SEQ ID NO: 259655 - protein, 5 aa, Mycobacterium
GDPDV

SEQ ID NO: 259656 - protein, 10 aa, Mycobacterium
GDPEEPTPTA

SEQ ID NO: 259657 - protein, 18 aa, Mycobacterium
GDPEGPNLDQLYAWWKKH

SEQ ID NO: 259658 - protein, 10 aa, Mycobacterium
GDPEKSLPRK

SEQ ID NO: 259659 - protein, 10 aa, Mycobacterium
GDPGADEDRL

SEQ ID NO: 259660 - protein, 5 aa, Mycobacterium
GDPGD

SEQ ID NO: 259661 - protein, 13 aa, Mycobacterium
GDPGGGKSNRTKL

SEQ ID NO: 259662 - protein, 7 aa, Mycobacterium
GDPGGPR

SEQ ID NO: 259663 - protein, 6 aa, Mycobacterium
GDPGIG

SEQ ID NO: 259664 - protein, 10 aa, Mycobacterium
GDPGTPDSLS

SEQ ID NO: 259665 - protein, 8 aa, Mycobacterium
GDPGTRMY

SEQ ID NO: 259666 - protein, 5 aa, Mycobacterium
GDPHA

SEQ ID NO: 259667 - protein, 4 aa, Mycobacterium
GDPI

SEQ ID NO: 259668 - protein, 8 aa, Mycobacterium
GDPIGDAA

SEQ ID NO: 259669 - protein, 9 aa, Mycobacterium
GDPIGDEKR

SEQ ID NO: 259670 - protein, 9 aa, Mycobacterium
GDPIGDESR

SEQ ID NO: 259671 - protein, 9 aa, Mycobacterium
GDPIGDPRA

SEQ ID NO: 259672 - protein, 13 aa, Mycobacterium
GDPIGDPRAWSQA

SEQ ID NO: 259673 - protein, 13 aa, Mycobacterium
GDPKGEGTGGPGY

SEQ ID NO: 259674 - protein, 10 aa, Mycobacterium
GDPKVNTPLT

SEQ ID NO: 259675 - protein, 4 aa, Mycobacterium
GDPL

SEQ ID NO: 259676 - protein, 9 aa, Mycobacterium
GDPLGDEAR

SEQ ID NO: 259677 - protein, 9 aa, Mycobacterium
GDPLSPEGV

SEQ ID NO: 259678 - protein, 18 aa, Mycobacterium
GDPLTEAAAQSSDGRAAY

SEQ ID NO: 259679 - protein, 7 aa, Mycobacterium
GDPLTPE

SEQ ID NO: 259680 - protein, 4 aa, Mycobacterium
GDPM

SEQ ID NO: 259681 - protein, 6 aa, Mycobacterium
GDPMSQ

SEQ ID NO: 259682 - protein, 7 aa, Mycobacterium
GDPMSQE

SEQ ID NO: 259683 - protein, 8 aa, Mycobacterium
GDPMSQEG

SEQ ID NO: 259684 - protein, 9 aa, Mycobacterium
GDPMTPEGI

SEQ ID NO: 259685 - protein, 7 aa, Mycobacterium
GDPNIGT

SEQ ID NO: 259686 - protein, 4 aa, Mycobacterium
GDPP

SEQ ID NO: 259687 - protein, 5 aa, Mycobacterium
GDPPA

SEQ ID NO: 259688 - protein, 6 aa, Mycobacterium
GDPPAC

SEQ ID NO: 259689 - protein, 13 aa, Mycobacterium
GDPPKESSAANDD

SEQ ID NO: 259690 - protein, 12 aa, Mycobacterium
GDPPKKRSAANN

SEQ ID NO: 259691 - protein, 13 aa, Mycobacterium
GDPPKKRSAANNH

SEQ ID NO: 259692 - protein, 13 aa, Mycobacterium
GDPPKKRSAANSH

SEQ ID NO: 259693 - protein, 12 aa, Mycobacterium
GDPPKKRSAANT

SEQ ID NO: 259694 - protein, 16 aa, Mycobacterium
GDPPKLRTAANDQMTD

SEQ ID NO: 259695 - protein, 6 aa, Mycobacterium
GDPPPC

SEQ ID NO: 259696 - protein, 7 aa, Mycobacterium
GDPPPCS

SEQ ID NO: 259697 - protein, 10 aa, Mycobacterium
GDPPTAASPW

SEQ ID NO: 259698 - protein, 12 aa, Mycobacterium
GDPQEGTPRGSL

SEQ ID NO: 259699 - protein, 5 aa, Mycobacterium
GDPQG

SEQ ID NO: 259700 - protein, 14 aa, Mycobacterium
GDPQPAPDRPTAAP

SEQ ID NO: 259701 - protein, 9 aa, Mycobacterium
GDPQSAQGI

SEQ ID NO: 259702 - protein, 9 aa, Mycobacterium
GDPQSPEGI

SEQ ID NO: 259703 - protein, 9 aa, Mycobacterium
GDPQTPDGM

SEQ ID NO: 259704 - protein, 16 aa, Mycobacterium
GDPQTSTSGSGNVIER

SEQ ID NO: 259705 - protein, 17 aa, Mycobacterium
GDPRFGYSTSPANVPTP

SEQ ID NO: 259706 - protein, 18 aa, Mycobacterium
GDPRGPNLEELYSWWKKH

SEQ ID NO: 259707 - protein, 8 aa, Mycobacterium
GDPRRGPR

SEQ ID NO: 259708 - protein, 10 aa, Mycobacterium
GDPRRTTNPL

SEQ ID NO: 259709 - protein, 6 aa, Mycobacterium
GDPRSG

SEQ ID NO: 259710 - protein, 6 aa, Mycobacterium
GDPRSL

SEQ ID NO: 259711 - protein, 7 aa, Mycobacterium
GDPRTLS

SEQ ID NO: 259712 - protein, 9 aa, Mycobacterium
GDPSLNEIN

SEQ ID NO: 259713 - protein, 9 aa, Mycobacterium
GDPSLTDIN

SEQ ID NO: 259714 - protein, 5 aa, Mycobacterium
GDPSW

SEQ ID NO: 259715 - protein, 12 aa, Mycobacterium
GDPTAGHARAPL

SEQ ID NO: 259716 - protein, 8 aa, Mycobacterium
GDPTAGTV

SEQ ID NO: 259717 - protein, 14 aa, Mycobacterium
GDPTATGSGGPGYE

SEQ ID NO: 259718 - protein, 6 aa, Mycobacterium
GDPTEA

SEQ ID NO: 259719 - protein, 14 aa, Mycobacterium
GDPTGEGTGGPGYQ

SEQ ID NO: 259720 - protein, 10 aa, Mycobacterium
GDPTGGQQRA

SEQ ID NO: 259721 - protein, 13 aa, Mycobacterium
GDPTGKGTGGPGY

SEQ ID NO: 259722 - protein, 14 aa, Mycobacterium
GDPTGTGTGGPGYQ

SEQ ID NO: 259723 - protein, 6 aa, Mycobacterium
GDPTGV

SEQ ID NO: 259724 - protein, 9 aa, Mycobacterium
GDPTPAAAA

SEQ ID NO: 259725 - protein, 10 aa, Mycobacterium
GDPTPRADPW

SEQ ID NO: 259726 - protein, 13 aa, Mycobacterium
GDPTTATAAEGER

SEQ ID NO: 259727 - protein, 9 aa, Mycobacterium
GDPTTGTVP

SEQ ID NO: 259728 - protein, 12 aa, Mycobacterium
GDPTTPDGPLPV

SEQ ID NO: 259729 - protein, 10 aa, Mycobacterium
GDPTTPNGPL

SEQ ID NO: 259730 - protein, 6 aa, Mycobacterium
GDPVAA

SEQ ID NO: 259731 - protein, 9 aa, Mycobacterium
GDPVAVTDR

SEQ ID NO: 259732 - protein, 8 aa, Mycobacterium
GDPVEPPQ

SEQ ID NO: 259733 - protein, 12 aa, Mycobacterium
GDPVGDPKAWPQ

SEQ ID NO: 259734 - protein, 12 aa, Mycobacterium
GDPVGDPKSWPQ

SEQ ID NO: 259735 - protein, 11 aa, Mycobacterium
GDPVGDPRAWP

SEQ ID NO: 259736 - protein, 11 aa, Mycobacterium
GDPVGDPRSWP

SEQ ID NO: 259737 - protein, 9 aa, Mycobacterium
GDPVGPGTL

SEQ ID NO: 259738 - protein, 5 aa, Mycobacterium
GDPVP

SEQ ID NO: 259739 - protein, 6 aa, Mycobacterium
GDPVPT

SEQ ID NO: 259740 - protein, 12 aa, Mycobacterium
GDQAPQKTTSTV

SEQ ID NO: 259741 - protein, 7 aa, Mycobacterium
GDQEVRK

SEQ ID NO: 259742 - protein, 12 aa, Mycobacterium
GDQGESLANESV

SEQ ID NO: 259743 - protein, 13 aa, Mycobacterium
GDQGESLANESVE

SEQ ID NO: 259744 - protein, 13 aa, Mycobacterium
GDQGGSQANESVT

SEQ ID NO: 259745 - protein, 11 aa, Mycobacterium
GDQGPVPIQGT

SEQ ID NO: 259746 - protein, 12 aa, Mycobacterium
GDQGSTVSDESI

SEQ ID NO: 259747 - protein, 9 aa, Mycobacterium
GDQGTPTLG

SEQ ID NO: 259748 - protein, 16 aa, Mycobacterium
GDQGTTEGKESVTAVQ

SEQ ID NO: 259749 - protein, 5 aa, Mycobacterium
GDQIQ

SEQ ID NO: 259750 - protein, 7 aa, Mycobacterium
GDQLDER

SEQ ID NO: 259751 - protein, 19 aa, Mycobacterium
GDQPARPSSEEIAAQPDLQ

SEQ ID NO: 259752 - protein, 13 aa, Mycobacterium
GDQQASAGVPTAA

SEQ ID NO: 259753 - protein, 62 aa, Mycobacterium
GDQQGSNQTPTSTTTTAPTTTTTTVESATTTTTPSPTTTAEAPPATTPQGQPPAQQPTHAPT

SEQ ID NO: 259754 - protein, 4 aa, Mycobacterium
GDQR

SEQ ID NO: 259755 - protein, 20 aa, Mycobacterium
GDQSPEGLRKTAQSYRRRTR

SEQ ID NO: 259756 - protein, 6 aa, Mycobacterium
GDQSPL

SEQ ID NO: 259757 - protein, 9 aa, Mycobacterium
GDQSTPALA

SEQ ID NO: 259758 - protein, 13 aa, Mycobacterium
GDQSYRPTETSEI

SEQ ID NO: 259759 - protein, 15 aa, Mycobacterium
GDQTLSAAPAKEDTW

SEQ ID NO: 259760 - protein, 17 aa, Mycobacterium
GDQYGAGQLSEGQAAAA

SEQ ID NO: 259761 - protein, 4 aa, Mycobacterium
GDRA

SEQ ID NO: 259762 - protein, 7 aa, Mycobacterium
GDRAATA

SEQ ID NO: 259763 - protein, 17 aa, Mycobacterium
GDRAATDGVITSGRTSL

SEQ ID NO: 259764 - protein, 13 aa, Mycobacterium
GDRADAMDDSGTD

SEQ ID NO: 259765 - protein, 5 aa, Mycobacterium
GDRAE

SEQ ID NO: 259766 - protein, 6 aa, Mycobacterium
GDRANA

SEQ ID NO: 259767 - protein, 6 aa, Mycobacterium
GDRAPV

SEQ ID NO: 259768 - protein, 11 aa, Mycobacterium
GDRATPLPNPG

SEQ ID NO: 259769 - protein, 4 aa, Mycobacterium
GDRD

SEQ ID NO: 259770 - protein, 8 aa, Mycobacterium
GDRDKARM

SEQ ID NO: 259771 - protein, 7 aa, Mycobacterium
GDRDNRI

SEQ ID NO: 259772 - protein, 8 aa, Mycobacterium
GDRDNTVG

SEQ ID NO: 259773 - protein, 5 aa, Mycobacterium
GDRDR

SEQ ID NO: 259774 - protein, 16 aa, Mycobacterium
GDRERAERADDEYEYV

SEQ ID NO: 259775 - protein, 5 aa, Mycobacterium
GDRES

SEQ ID NO: 259776 - protein, 14 aa, Mycobacterium
GDRGPNVGSKDQSV

SEQ ID NO: 259777 - protein, 7 aa, Mycobacterium
GDRGRSL

SEQ ID NO: 259778 - protein, 4 aa, Mycobacterium
GDRI

SEQ ID NO: 259779 - protein, 5 aa, Mycobacterium
GDRIP

SEQ ID NO: 259780 - protein, 4 aa, Mycobacterium
GDRL

SEQ ID NO: 259781 - protein, 7 aa, Mycobacterium
GDRLDPG

SEQ ID NO: 259782 - protein, 7 aa, Mycobacterium
GDRNAAR

SEQ ID NO: 259783 - protein, 8 aa, Mycobacterium
GDRNARGF

SEQ ID NO: 259784 - protein, 4 aa, Mycobacterium
GDRP

SEQ ID NO: 259785 - protein, 8 aa, Mycobacterium
GDRPDSTL

SEQ ID NO: 259786 - protein, 7 aa, Mycobacterium
GDRPFDE

SEQ ID NO: 259787 - protein, 5 aa, Mycobacterium
GDRPG

SEQ ID NO: 259788 - protein, 8 aa, Mycobacterium
GDRPGADR

SEQ ID NO: 259789 - protein, 8 aa, Mycobacterium
GDRPLEQS

SEQ ID NO: 259790 - protein, 8 aa, Mycobacterium
GDRPLTPA

SEQ ID NO: 259791 - protein, 8 aa, Mycobacterium
GDRPLTPE

SEQ ID NO: 259792 - protein, 6 aa, Mycobacterium
GDRPSI

SEQ ID NO: 259793 - protein, 6 aa, Mycobacterium
GDRPSL

SEQ ID NO: 259794 - protein, 5 aa, Mycobacterium
GDRPV

SEQ ID NO: 259795 - protein, 4 aa, Mycobacterium
GDRQ

SEQ ID NO: 259796 - protein, 8 aa, Mycobacterium
GDRQQFRD

SEQ ID NO: 259797 - protein, 8 aa, Mycobacterium
GDRSDQID

SEQ ID NO: 259798 - protein, 6 aa, Mycobacterium
GDRSEQ

SEQ ID NO: 259799 - protein, 5 aa, Mycobacterium
GDRSG

SEQ ID NO: 259800 - protein, 7 aa, Mycobacterium
GDRSPLV

SEQ ID NO: 259801 - protein, 13 aa, Mycobacterium
GDRSPNVGPKDQT

SEQ ID NO: 259802 - protein, 7 aa, Mycobacterium
GDRSTQV

SEQ ID NO: 259803 - protein, 4 aa, Mycobacterium
GDRT

SEQ ID NO: 259804 - protein, 13 aa, Mycobacterium
GDRTEASIKTTSV

SEQ ID NO: 259805 - protein, 39 aa, Mycobacterium
GDRTTSTPPHPPSRPPGRPQPGRAPAVSRGPNTSEPTQM

SEQ ID NO: 259806 - protein, 6 aa, Mycobacterium
GDRVGR

SEQ ID NO: 259807 - protein, 8 aa, Mycobacterium
GDRWPPGR

SEQ ID NO: 259808 - protein, 15 aa, Mycobacterium
GDRYDPATNATVGGT

SEQ ID NO: 259809 - protein, 7 aa, Mycobacterium
GDRYGPK

SEQ ID NO: 259810 - protein, 8 aa, Mycobacterium
GDSAAYAA

SEQ ID NO: 259811 - protein, 50 aa, Mycobacterium
GDSADVGAEAVTQPLATAAPSAQQPAAEDEFEGPRRRARRERAERRAAQA

SEQ ID NO: 259812 - protein, 8 aa, Mycobacterium
GDSAPKPV

SEQ ID NO: 259813 - protein, 12 aa, Mycobacterium
GDSFGGGPREPM

SEQ ID NO: 259814 - protein, 6 aa, Mycobacterium
GDSGAS

SEQ ID NO: 259815 - protein, 6 aa, Mycobacterium
GDSGHD

SEQ ID NO: 259816 - protein, 7 aa, Mycobacterium
GDSGKGS

SEQ ID NO: 259817 - protein, 11 aa, Mycobacterium
GDSGPATPRRR

SEQ ID NO: 259818 - protein, 10 aa, Mycobacterium
GDSLPRSRPT

SEQ ID NO: 259819 - protein, 8 aa, Mycobacterium
GDSPVASA

SEQ ID NO: 259820 - protein, 4 aa, Mycobacterium
GDSR

SEQ ID NO: 259821 - protein, 13 aa, Mycobacterium
GDSRANPPGTSAA

SEQ ID NO: 259822 - protein, 52 aa, Mycobacterium
GDSRPTVRTMSSSGSGELKREGKREDAKRDEVKREEEGVDTKPQPIVQAEEL

SEQ ID NO: 259823 - protein, 6 aa, Mycobacterium
GDSRRA

SEQ ID NO: 259824 - protein, 6 aa, Mycobacterium
GDSSAQ

SEQ ID NO: 259825 - protein, 21 aa, Mycobacterium
GDSTIQSSGAAPPTPDGLQSV

SEQ ID NO: 259826 - protein, 18 aa, Mycobacterium
GDSTIQSSPAVPPVPDGF

SEQ ID NO: 259827 - protein, 8 aa, Mycobacterium
GDSTKVRV

SEQ ID NO: 259828 - protein, 6 aa, Mycobacterium
GDSTLT

SEQ ID NO: 259829 - protein, 7 aa, Mycobacterium
GDSVSRR

SEQ ID NO: 259830 - protein, 9 aa, Mycobacterium
GDSYNEDGP

SEQ ID NO: 259831 - protein, 12 aa, Mycobacterium
GDTADSKLARKI

SEQ ID NO: 259832 - protein, 10 aa, Mycobacterium
GDTARVPAGT

SEQ ID NO: 259833 - protein, 5 aa, Mycobacterium
GDTAV

SEQ ID NO: 259834 - protein, 17 aa, Mycobacterium
GDTAVQSSPAAPPVPEG

SEQ ID NO: 259835 - protein, 24 aa, Mycobacterium
GDTDRVSSPGPSSAAGAVADQPHT

SEQ ID NO: 259836 - protein, 18 aa, Mycobacterium
GDTELGDSLPRARPTFAR

SEQ ID NO: 259837 - protein, 6 aa, Mycobacterium
GDTEVK

SEQ ID NO: 259838 - protein, 4 aa, Mycobacterium
GDTF

SEQ ID NO: 259839 - protein, 7 aa, Mycobacterium
GDTGHNP

SEQ ID NO: 259840 - protein, 11 aa, Mycobacterium
GDTGLDSGRAQ

SEQ ID NO: 259841 - protein, 7 aa, Mycobacterium
GDTGPGT

SEQ ID NO: 259842 - protein, 7 aa, Mycobacterium
GDTIADG

SEQ ID NO: 259843 - protein, 6 aa, Mycobacterium
GDTIGA

SEQ ID NO: 259844 - protein, 5 aa, Mycobacterium
GDTKV

SEQ ID NO: 259845 - protein, 8 aa, Mycobacterium
GDTLANES

SEQ ID NO: 259846 - protein, 12 aa, Mycobacterium
GDTLSGAGMSPP

SEQ ID NO: 259847 - protein, 6 aa, Mycobacterium
GDTNGL

SEQ ID NO: 259848 - protein, 9 aa, Mycobacterium
GDTNTTTGV

SEQ ID NO: 259849 - protein, 7 aa, Mycobacterium
GDTPQDA

SEQ ID NO: 259850 - protein, 10 aa, Mycobacterium
GDTPQGVPHP

SEQ ID NO: 259851 - protein, 7 aa, Mycobacterium
GDTPWGP

SEQ ID NO: 259852 - protein, 51 aa, Mycobacterium
GDTQAQLRAPSSTAESPRRPAEWTGATPPIEPPNGPGQESAAGPAAPDRPA

SEQ ID NO: 259853 - protein, 4 aa, Mycobacterium
GDTR

SEQ ID NO: 259854 - protein, 11 aa, Mycobacterium
GDTRDSYSGAD

SEQ ID NO: 259855 - protein, 4 aa, Mycobacterium
GDTT

SEQ ID NO: 259856 - protein, 6 aa, Mycobacterium
GDTTKV

SEQ ID NO: 259857 - protein, 6 aa, Mycobacterium
GDTTPS

SEQ ID NO: 259858 - protein, 22 aa, Mycobacterium
GDTTVQSSPAKPPVPDGLSSVP

SEQ ID NO: 259859 - protein, 4 aa, Mycobacterium
GDTV

SEQ ID NO: 259860 - protein, 9 aa, Mycobacterium
GDTVARVGG

SEQ ID NO: 259861 - protein, 6 aa, Mycobacterium
GDTVTI

SEQ ID NO: 259862 - protein, 7 aa, Mycobacterium
GDTVTVG

SEQ ID NO: 259863 - protein, 9 aa, Mycobacterium
GDTYSPAAQ

SEQ ID NO: 259864 - protein, 12 aa, Mycobacterium
GDVAGGVTAELS

SEQ ID NO: 259865 - protein, 7 aa, Mycobacterium
GDVAGNV

SEQ ID NO: 259866 - protein, 6 aa, Mycobacterium
GDVDAS

SEQ ID NO: 259867 - protein, 6 aa, Mycobacterium
GDVDGF

SEQ ID NO: 259868 - protein, 9 aa, Mycobacterium
GDVDGISGA

SEQ ID NO: 259869 - protein, 8 aa, Mycobacterium
GDVEEPDL

SEQ ID NO: 259870 - protein, 4 aa, Mycobacterium
GDVG

SEQ ID NO: 259871 - protein, 5 aa, Mycobacterium
GDVGG

SEQ ID NO: 259872 - protein, 7 aa, Mycobacterium
GDVGSLR

SEQ ID NO: 259873 - protein, 11 aa, Mycobacterium
GDVGSPESYAA

SEQ ID NO: 259874 - protein, 7 aa, Mycobacterium
GDVKEEG

SEQ ID NO: 259875 - protein, 6 aa, Mycobacterium
GDVNPD

SEQ ID NO: 259876 - protein, 9 aa, Mycobacterium
GDVPDPAAA

SEQ ID NO: 259877 - protein, 7 aa, Mycobacterium
GDVPGWD

SEQ ID NO: 259878 - protein, 4 aa, Mycobacterium
GDVR

SEQ ID NO: 259879 - protein, 13 aa, Mycobacterium
GDVSQSASAVGQL

SEQ ID NO: 259880 - protein, 7 aa, Mycobacterium
GDVSYEA

SEQ ID NO: 259881 - protein, 7 aa, Mycobacterium
GDVTETI

SEQ ID NO: 259882 - protein, 13 aa, Mycobacterium
GDVTSTNGDQVTS

SEQ ID NO: 259883 - protein, 6 aa, Mycobacterium
GDVTTL

SEQ ID NO: 259884 - protein, 8 aa, Mycobacterium
GDVVPSAA

SEQ ID NO: 259885 - protein, 5 aa, Mycobacterium
GDWGP

SEQ ID NO: 259886 - protein, 12 aa, Mycobacterium
GDWGSKGAQPQD

SEQ ID NO: 259887 - protein, 5 aa, Mycobacterium
GDWSG

SEQ ID NO: 259888 - protein, 6 aa, Mycobacterium
GDWSGA

SEQ ID NO: 259889 - protein, 8 aa, Mycobacterium
GDYAESQL

SEQ ID NO: 259890 - protein, 13 aa, Mycobacterium
GDYASNESLANTE

SEQ ID NO: 259891 - protein, 14 aa, Mycobacterium
GDYDPETDGAELER

SEQ ID NO: 259892 - protein, 9 aa, Mycobacterium
GDYGPLGPL

SEQ ID NO: 259893 - protein, 25 aa, Mycobacterium
GDYGPLGPLGGTNPTGFTPNGVPEH

SEQ ID NO: 259894 - protein, 8 aa, Mycobacterium
GDYPPTKD

SEQ ID NO: 259895 - protein, 19 aa, Mycobacterium
GDYPRRADDDKSSFTDDLG

SEQ ID NO: 259896 - protein, 6 aa, Mycobacterium
GDYQPV

SEQ ID NO: 259897 - protein, 9 aa, Mycobacterium
GDYRTTPGR

SEQ ID NO: 259898 - protein, 5 aa, Mycobacterium
GDYSP

SEQ ID NO: 259899 - protein, 17 aa, Mycobacterium
GDYVSNGDGTADCDGHG

SEQ ID NO: 259900 - protein, 10 aa, Mycobacterium
GEAAANESTI

SEQ ID NO: 259901 - protein, 9 aa, Mycobacterium
GEAAEPEKV

SEQ ID NO: 259902 - protein, 7 aa, Mycobacterium
GEAAPVG

SEQ ID NO: 259903 - protein, 6 aa, Mycobacterium
GEAASN

SEQ ID NO: 259904 - protein, 13 aa, Mycobacterium
GEAATAAAKTNTF

SEQ ID NO: 259905 - protein, 9 aa, Mycobacterium
GEADQTGAL

SEQ ID NO: 259906 - protein, 8 aa, Mycobacterium
GEAELRGG

SEQ ID NO: 259907 - protein, 11 aa, Mycobacterium
GEAETLAPGIK

SEQ ID NO: 259908 - protein, 13 aa, Mycobacterium
GEAETPARADRLE

SEQ ID NO: 259909 - protein, 7 aa, Mycobacterium
GEAGDMA

SEQ ID NO: 259910 - protein, 11 aa, Mycobacterium
GEAGLNTDQNI

SEQ ID NO: 259911 - protein, 6 aa, Mycobacterium
GEAGRQ

SEQ ID NO: 259912 - protein, 14 aa, Mycobacterium
GEAHSAPMTPLDAP

SEQ ID NO: 259913 - protein, 6 aa, Mycobacterium
GEAKTN

SEQ ID NO: 259914 - protein, 6 aa, Mycobacterium
GEALAS

SEQ ID NO: 259915 - protein, 5 aa, Mycobacterium
GEALT

SEQ ID NO: 259916 - protein, 8 aa, Mycobacterium
GEANRAGA

SEQ ID NO: 259917 - protein, 4 aa, Mycobacterium
GEAP

SEQ ID NO: 259918 - protein, 10 aa, Mycobacterium
GEAPPLGAEG

SEQ ID NO: 259919 - protein, 22 aa, Mycobacterium
GEAPTAATPAVASTPTGAIPHP

SEQ ID NO: 259920 - protein, 8 aa, Mycobacterium
GEAPTEAQ

SEQ ID NO: 259921 - protein, 19 aa, Mycobacterium
GEAQAPQKPRQFDEAQTDA

SEQ ID NO: 259922 - protein, 10 aa, Mycobacterium
GEAQAPRKEP

SEQ ID NO: 259923 - protein, 14 aa, Mycobacterium
GEAQAPSKPPHFDE

SEQ ID NO: 259924 - protein, 11 aa, Mycobacterium
GEAQPGQSAPS

SEQ ID NO: 259925 - protein, 7 aa, Mycobacterium
GEAQQLT

SEQ ID NO: 259926 - protein, 7 aa, Mycobacterium
GEARDPE

SEQ ID NO: 259927 - protein, 14 aa, Mycobacterium
GEARFQEKDAGAQR

SEQ ID NO: 259928 - protein, 14 aa, Mycobacterium
GEASAETTFTSTRP

SEQ ID NO: 259929 - protein, 10 aa, Mycobacterium
GEASSFTDSF

SEQ ID NO: 259930 - protein, 5 aa, Mycobacterium
GEASV

SEQ ID NO: 259931 - protein, 4 aa, Mycobacterium
GEAT

SEQ ID NO: 259932 - protein, 6 aa, Mycobacterium
GEATFD

SEQ ID NO: 259933 - protein, 4 aa, Mycobacterium
GECQ

SEQ ID NO: 259934 - protein, 9 aa, Mycobacterium
GEDADSAAF

SEQ ID NO: 259935 - protein, 8 aa, Mycobacterium
GEDANPTF

SEQ ID NO: 259936 - protein, 11 aa, Mycobacterium
GEDDAEYSDAD

SEQ ID NO: 259937 - protein, 6 aa, Mycobacterium
GEDEET

SEQ ID NO: 259938 - protein, 4 aa, Mycobacterium
GEDF

SEQ ID NO: 259939 - protein, 4 aa, Mycobacterium
GEDG

SEQ ID NO: 259940 - protein, 6 aa, Mycobacterium
GEDGDG

SEQ ID NO: 259941 - protein, 17 aa, Mycobacterium
GEDGENSKAAMSPGTPF

SEQ ID NO: 259942 - protein, 7 aa, Mycobacterium
GEDHRRR

SEQ ID NO: 259943 - protein, 14 aa, Mycobacterium
GEDIEYADREGVGR

SEQ ID NO: 259944 - protein, 8 aa, Mycobacterium
GEDNTSWP

SEQ ID NO: 259945 - protein, 11 aa, Mycobacterium
GEDSGSSGSSW

SEQ ID NO: 259946 - protein, 5 aa, Mycobacterium
GEDSP

SEQ ID NO: 259947 - protein, 5 aa, Mycobacterium
GEDTA

SEQ ID NO: 259948 - protein, 8 aa, Mycobacterium
GEDTNPIS

SEQ ID NO: 259949 - protein, 8 aa, Mycobacterium
GEDTRLAD

SEQ ID NO: 259950 - protein, 8 aa, Mycobacterium
GEDVSDLS

SEQ ID NO: 259951 - protein, 4 aa, Mycobacterium
GEDY

SEQ ID NO: 259952 - protein, 8 aa, Mycobacterium
GEEAAASL

SEQ ID NO: 259953 - protein, 15 aa, Mycobacterium
GEEAAESEEPAEPEA

SEQ ID NO: 259954 - protein, 6 aa, Mycobacterium
GEEDAD

SEQ ID NO: 259955 - protein, 5 aa, Mycobacterium
GEEHK

SEQ ID NO: 259956 - protein, 6 aa, Mycobacterium
GEEIPE

SEQ ID NO: 259957 - protein, 14 aa, Mycobacterium
GEEIPQTKEETRAR

SEQ ID NO: 259958 - protein, 6 aa, Mycobacterium
GEEPAS

SEQ ID NO: 259959 - protein, 5 aa, Mycobacterium
GEEPT

SEQ ID NO: 259960 - protein, 6 aa, Mycobacterium
GEEPTR

SEQ ID NO: 259961 - protein, 8 aa, Mycobacterium
GEERTRPF

SEQ ID NO: 259962 - protein, 13 aa, Mycobacterium
GEESKDPDRVPGR

SEQ ID NO: 259963 - protein, 9 aa, Mycobacterium
GEESSGRRR

SEQ ID NO: 259964 - protein, 13 aa, Mycobacterium
GEETKDPGKTPGI

SEQ ID NO: 259965 - protein, 6 aa, Mycobacterium
GEETRH

SEQ ID NO: 259966 - protein, 17 aa, Mycobacterium
GEFDNGVQSDSAPRGRL

SEQ ID NO: 259967 - protein, 7 aa, Mycobacterium
GEFDPGA

SEQ ID NO: 259968 - protein, 5 aa, Mycobacterium
GEFGD

SEQ ID NO: 259969 - protein, 5 aa, Mycobacterium
GEFNR

SEQ ID NO: 259970 - protein, 4 aa, Mycobacterium
GEGA

SEQ ID NO: 259971 - protein, 9 aa, Mycobacterium
GEGAGGPEP

SEQ ID NO: 259972 - protein, 8 aa, Mycobacterium
GEGARARE

SEQ ID NO: 259973 - protein, 5 aa, Mycobacterium
GEGAT

SEQ ID NO: 259974 - protein, 8 aa, Mycobacterium
GEGATGEV

SEQ ID NO: 259975 - protein, 18 aa, Mycobacterium
GEGATPAGQRTGPDGHPD

SEQ ID NO: 259976 - protein, 8 aa, Mycobacterium
GEGEDLET

SEQ ID NO: 259977 - protein, 10 aa, Mycobacterium
GEGEDLQTEE

SEQ ID NO: 259978 - protein, 5 aa, Mycobacterium
GEGGA

SEQ ID NO: 259979 - protein, 15 aa, Mycobacterium
GEGGASPSEQARQVD

SEQ ID NO: 259980 - protein, 69 aa, Mycobacterium
GEGGHDDNTDSPPTGGEASEPAPWESPAAESAPPAYPPPGPTDHPPGYPPSYPPPVPPPPGYEQPPGYF

SEQ ID NO: 259981 - protein, 20 aa, Mycobacterium
GEGGRGPGPSPATSAPGPSR

SEQ ID NO: 259982 - protein, 6 aa, Mycobacterium
GEGGTV

SEQ ID NO: 259983 - protein, 13 aa, Mycobacterium
GEGINDAPALKSA

SEQ ID NO: 259984 - protein, 6 aa, Mycobacterium
GEGISA

SEQ ID NO: 259985 - protein, 5 aa, Mycobacterium
GEGIT

SEQ ID NO: 259986 - protein, 4 aa, Mycobacterium
GEGK

SEQ ID NO: 259987 - protein, 8 aa, Mycobacterium
GEGPDDLA

SEQ ID NO: 259988 - protein, 9 aa, Mycobacterium
GEGPDGTPV

SEQ ID NO: 259989 - protein, 8 aa, Mycobacterium
GEGPGAAG

SEQ ID NO: 259990 - protein, 9 aa, Mycobacterium
GEGQTIGQA

SEQ ID NO: 259991 - protein, 4 aa, Mycobacterium
GEGR

SEQ ID NO: 259992 - protein, 7 aa, Mycobacterium
GEGRGGW

SEQ ID NO: 259993 - protein, 9 aa, Mycobacterium
GEGVGPAAA

SEQ ID NO: 259994 - protein, 19 aa, Mycobacterium
GEGVSLRGSDEIASGTATV

SEQ ID NO: 259995 - protein, 8 aa, Mycobacterium
GEGYSTDG

SEQ ID NO: 259996 - protein, 6 aa, Mycobacterium
GEHAGT

SEQ ID NO: 259997 - protein, 6 aa, Mycobacterium
GEHGGL

SEQ ID NO: 259998 - protein, 5 aa, Mycobacterium
GEHGP

SEQ ID NO: 259999 - protein, 19 aa, Mycobacterium
GEHGREVPNPLPRGAIGKT

SEQ ID NO: 260000 - protein, 4 aa, Mycobacterium
GEHP

SEQ ID NO: 260001 - protein, 6 aa, Mycobacterium
GEHRGR

SEQ ID NO: 260002 - protein, 6 aa, Mycobacterium
GEHRRR

SEQ ID NO: 260003 - protein, 4 aa, Mycobacterium
GEHT

SEQ ID NO: 260004 - protein, 8 aa, Mycobacterium
GEHTARRA

SEQ ID NO: 260005 - protein, 6 aa, Mycobacterium
GEIAPA

SEQ ID NO: 260006 - protein, 11 aa, Mycobacterium
GEIAPGSWPSA

SEQ ID NO: 260007 - protein, 4 aa, Mycobacterium
GEID

SEQ ID NO: 260008 - protein, 18 aa, Mycobacterium
GEIDEDEYQRRMTLLREH

SEQ ID NO: 260009 - protein, 9 aa, Mycobacterium
GEIDSGPVN

SEQ ID NO: 260010 - protein, 7 aa, Mycobacterium
GEIEPGA

SEQ ID NO: 260011 - protein, 10 aa, Mycobacterium
GEIGSHPRAT

SEQ ID NO: 260012 - protein, 7 aa, Mycobacterium
GEIPDAP

SEQ ID NO: 260013 - protein, 5 aa, Mycobacterium
GEIPT

SEQ ID NO: 260014 - protein, 6 aa, Mycobacterium
GEIQSD

SEQ ID NO: 260015 - protein, 11 aa, Mycobacterium
GEIRDDRASDD

SEQ ID NO: 260016 - protein, 8 aa, Mycobacterium
GEKAERRQ

SEQ ID NO: 260017 - protein, 9 aa, Mycobacterium
GEKAKGRQW

SEQ ID NO: 260018 - protein, 9 aa, Mycobacterium
GEKAKGRTW

SEQ ID NO: 260019 - protein, 6 aa, Mycobacterium
GEKDAD

SEQ ID NO: 260020 - protein, 8 aa, Mycobacterium
GEKDGPAL

SEQ ID NO: 260021 - protein, 7 aa, Mycobacterium
GEKIATD

SEQ ID NO: 260022 - protein, 8 aa, Mycobacterium
GEKIATDG

SEQ ID NO: 260023 - protein, 18 aa, Mycobacterium
GEKIATDGVVTSGSSAVD

SEQ ID NO: 260024 - protein, 6 aa, Mycobacterium
GEKLGR

SEQ ID NO: 260025 - protein, 8 aa, Mycobacterium
GEKPRRNS

SEQ ID NO: 260026 - protein, 5 aa, Mycobacterium
GEKVA

SEQ ID NO: 260027 - protein, 7 aa, Mycobacterium
GEKVATD

SEQ ID NO: 260028 - protein, 4 aa, Mycobacterium
GELA

SEQ ID NO: 260029 - protein, 12 aa, Mycobacterium
GELAENTKGALR

SEQ ID NO: 260030 - protein, 12 aa, Mycobacterium
GELAPSAPPRPL

SEQ ID NO: 260031 - protein, 10 aa, Mycobacterium
GELARSRQTT

SEQ ID NO: 260032 - protein, 12 aa, Mycobacterium
GELASADGGFGS

SEQ ID NO: 260033 - protein, 4 aa, Mycobacterium
GELD

SEQ ID NO: 260034 - protein, 6 aa, Mycobacterium
GELDRR

SEQ ID NO: 260035 - protein, 17 aa, Mycobacterium
GELGGPLPPSVEEQTTV

SEQ ID NO: 260036 - protein, 6 aa, Mycobacterium
GELGSS

SEQ ID NO: 260037 - protein, 12 aa, Mycobacterium
GELGTPKAFESY

SEQ ID NO: 260038 - protein, 8 aa, Mycobacterium
GELGTPRA

SEQ ID NO: 260039 - protein, 10 aa, Mycobacterium
GELGTPSSYA

SEQ ID NO: 260040 - protein, 14 aa, Mycobacterium
GELNDRLPGRRAVG

SEQ ID NO: 260041 - protein, 6 aa, Mycobacterium
GELNGG

SEQ ID NO: 260042 - protein, 7 aa, Mycobacterium
GELPDRR

SEQ ID NO: 260043 - protein, 7 aa, Mycobacterium
GELPPGL

SEQ ID NO: 260044 - protein, 8 aa, Mycobacterium
GELPSAQT

SEQ ID NO: 260045 - protein, 10 aa, Mycobacterium
GELQRAQGAP

SEQ ID NO: 260046 - protein, 11 aa, Mycobacterium
GELSGAGARSI

SEQ ID NO: 260047 - protein, 8 aa, Mycobacterium
GELSPGAP

SEQ ID NO: 260048 - protein, 8 aa, Mycobacterium
GELSPGRP

SEQ ID NO: 260049 - protein, 9 aa, Mycobacterium
GELSTEDDH

SEQ ID NO: 260050 - protein, 9 aa, Mycobacterium
GELSTSDDH

SEQ ID NO: 260051 - protein, 9 aa, Mycobacterium
GELSTSEDH

SEQ ID NO: 260052 - protein, 9 aa, Mycobacterium
GELSTTDDH

SEQ ID NO: 260053 - protein, 5 aa, Mycobacterium
GELTP

SEQ ID NO: 260054 - protein, 10 aa, Mycobacterium
GELVGPDGAR

SEQ ID NO: 260055 - protein, 5 aa, Mycobacterium
GEMSA

SEQ ID NO: 260056 - protein, 5 aa, Mycobacterium
GEMSR

SEQ ID NO: 260057 - protein, 5 aa, Mycobacterium
GEMTR

SEQ ID NO: 260058 - protein, 12 aa, Mycobacterium
GENDLDHPKRTS

SEQ ID NO: 260059 - protein, 12 aa, Mycobacterium
GENDWDHPKRTS

SEQ ID NO: 260060 - protein, 4 aa, Mycobacterium
GENF

SEQ ID NO: 260061 - protein, 13 aa, Mycobacterium
GENGDGATVDEDN

SEQ ID NO: 260062 - protein, 8 aa, Mycobacterium
GENISAKE

SEQ ID NO: 260063 - protein, 8 aa, Mycobacterium
GENLGTAP

SEQ ID NO: 260064 - protein, 9 aa, Mycobacterium
GENNNATNY

SEQ ID NO: 260065 - protein, 8 aa, Mycobacterium
GENNTESV

SEQ ID NO: 260066 - protein, 5 aa, Mycobacterium
GENVY

SEQ ID NO: 260067 - protein, 7 aa, Mycobacterium
GENYSTG

SEQ ID NO: 260068 - protein, 9 aa, Mycobacterium
GEPADAAVS

SEQ ID NO: 260069 - protein, 11 aa, Mycobacterium
GEPADAGNGIT

SEQ ID NO: 260070 - protein, 26 aa, Mycobacterium
GEPAEADEPDDEPFGDEPYEETPEEP

SEQ ID NO: 260071 - protein, 7 aa, Mycobacterium
GEPAERS

SEQ ID NO: 260072 - protein, 29 aa, Mycobacterium
GEPAGEEERAQGHTRSVRPTLSGPGHADQ

SEQ ID NO: 260073 - protein, 7 aa, Mycobacterium
GEPAGIA

SEQ ID NO: 260074 - protein, 8 aa, Mycobacterium
GEPAPWPQ

SEQ ID NO: 260075 - protein, 5 aa, Mycobacterium
GEPDA

SEQ ID NO: 260076 - protein, 16 aa, Mycobacterium
GEPDDGVPEPRAPKPL

SEQ ID NO: 260077 - protein, 23 aa, Mycobacterium
GEPEEDRTADGADWSRDVDEGRA

SEQ ID NO: 260078 - protein, 23 aa, Mycobacterium
GEPEIDTSGDDVSDWTRNGPAER

SEQ ID NO: 260079 - protein, 9 aa, Mycobacterium
GEPEVADDG

SEQ ID NO: 260080 - protein, 4 aa, Mycobacterium
GEPF

SEQ ID NO: 260081 - protein, 8 aa, Mycobacterium
GEPGATAD

SEQ ID NO: 260082 - protein, 9 aa, Mycobacterium
GEPGETRRQ

SEQ ID NO: 260083 - protein, 5 aa, Mycobacterium
GEPGG

SEQ ID NO: 260084 - protein, 7 aa, Mycobacterium
GEPGGRM

SEQ ID NO: 260085 - protein, 5 aa, Mycobacterium
GEPGR

SEQ ID NO: 260086 - protein, 7 aa, Mycobacterium
GEPGRAH

SEQ ID NO: 260087 - protein, 8 aa, Mycobacterium
GEPGSRMY

SEQ ID NO: 260088 - protein, 5 aa, Mycobacterium
GEPGY

SEQ ID NO: 260089 - protein, 13 aa, Mycobacterium
GEPIPARPCRSEP

SEQ ID NO: 260090 - protein, 12 aa, Mycobacterium
GEPKTKTLQSTN

SEQ ID NO: 260091 - protein, 6 aa, Mycobacterium
GEPLPA

SEQ ID NO: 260092 - protein, 10 aa, Mycobacterium
GEPLPAAHGY

SEQ ID NO: 260093 - protein, 5 aa, Mycobacterium
GEPNA

SEQ ID NO: 260094 - protein, 4 aa, Mycobacterium
GEPP

SEQ ID NO: 260095 - protein, 8 aa, Mycobacterium
GEPPFVGD

SEQ ID NO: 260096 - protein, 16 aa, Mycobacterium
GEPPKRLTAANQQMTD

SEQ ID NO: 260097 - protein, 6 aa, Mycobacterium
GEPPTL

SEQ ID NO: 260098 - protein, 18 aa, Mycobacterium
GEPPTLPQARIPDQASPR

SEQ ID NO: 260099 - protein, 7 aa, Mycobacterium
GEPQNMP

SEQ ID NO: 260100 - protein, 4 aa, Mycobacterium
GEPR

SEQ ID NO: 260101 - protein, 5 aa, Mycobacterium
GEPRR

SEQ ID NO: 260102 - protein, 18 aa, Mycobacterium
GEPSDNFTIPGTESQRAV

SEQ ID NO: 260103 - protein, 20 aa, Mycobacterium
GEPSRYRSEPQRQHLAASPA

SEQ ID NO: 260104 - protein, 20 aa, Mycobacterium
GEPSRYRSEPQRQHMATMPA

SEQ ID NO: 260105 - protein, 10 aa, Mycobacterium
GEPSSPRQLR

SEQ ID NO: 260106 - protein, 7 aa, Mycobacterium
GEPTHEH

SEQ ID NO: 260107 - protein, 8 aa, Mycobacterium
GEPTPGTV

SEQ ID NO: 260108 - protein, 12 aa, Mycobacterium
GEPVDNPDQRIQ

SEQ ID NO: 260109 - protein, 10 aa, Mycobacterium
GEPVETPTAE

SEQ ID NO: 260110 - protein, 9 aa, Mycobacterium
GEPVGPGSL

SEQ ID NO: 260111 - protein, 5 aa, Mycobacterium
GEPVN

SEQ ID NO: 260112 - protein, 6 aa, Mycobacterium
GEPVRS

SEQ ID NO: 260113 - protein, 12 aa, Mycobacterium
GEPWPPPLKEPA

SEQ ID NO: 260114 - protein, 12 aa, Mycobacterium
GEPWPPPTPEPA

SEQ ID NO: 260115 - protein, 12 aa, Mycobacterium
GEPWPPPVPEPA

SEQ ID NO: 260116 - protein, 11 aa, Mycobacterium
GEPWPQPMPEP

SEQ ID NO: 260117 - protein, 11 aa, Mycobacterium
GEQAAAASANM

SEQ ID NO: 260118 - protein, 9 aa, Mycobacterium
GEQAGEIGE

SEQ ID NO: 260119 - protein, 8 aa, Mycobacterium
GEQAQQAA

SEQ ID NO: 260120 - protein, 9 aa, Mycobacterium
GEQASVARK

SEQ ID NO: 260121 - protein, 27 aa, Mycobacterium
GEQETGALGPLGGSAPSGFTADGVPDK

SEQ ID NO: 260122 - protein, 6 aa, Mycobacterium
GEQGAG

SEQ ID NO: 260123 - protein, 16 aa, Mycobacterium
GEQGITGDSFTPQGLA

SEQ ID NO: 260124 - protein, 13 aa, Mycobacterium
GEQGQTLANDGVQ

SEQ ID NO: 260125 - protein, 59 aa, Mycobacterium
GEQGTSPTPSTSSTSTTTTTTTTPPTTTTTTPTTSSAVEAPAQQPTQQPTRAPSQQVPT

SEQ ID NO: 260126 - protein, 5 aa, Mycobacterium
GEQLR

SEQ ID NO: 260127 - protein, 9 aa, Mycobacterium
GEQPEAPKV

SEQ ID NO: 260128 - protein, 6 aa, Mycobacterium
GEQPSA

SEQ ID NO: 260129 - protein, 9 aa, Mycobacterium
GEQRKENDR

SEQ ID NO: 260130 - protein, 10 aa, Mycobacterium
GEQRTAPFSQ

SEQ ID NO: 260131 - protein, 17 aa, Mycobacterium
GEQSDATTATASSGSDR

SEQ ID NO: 260132 - protein, 7 aa, Mycobacterium
GEQSEAA

SEQ ID NO: 260133 - protein, 9 aa, Mycobacterium
GEQSNLPAH

SEQ ID NO: 260134 - protein, 31 aa, Mycobacterium
GEQTNPTHHRPPPRRGVPRGPLPRPAPPLPL

SEQ ID NO: 260135 - protein, 4 aa, Mycobacterium
GERA

SEQ ID NO: 260136 - protein, 6 aa, Mycobacterium
GERADE

SEQ ID NO: 260137 - protein, 11 aa, Mycobacterium
GERAESKQLKS

SEQ ID NO: 260138 - protein, 8 aa, Mycobacterium
GERAESVE

SEQ ID NO: 260139 - protein, 9 aa, Mycobacterium
GERAKGRGW

SEQ ID NO: 260140 - protein, 15 aa, Mycobacterium
GERAPRIPGSGEPYP

SEQ ID NO: 260141 - protein, 8 aa, Mycobacterium
GERARGRG

SEQ ID NO: 260142 - protein, 8 aa, Mycobacterium
GERARGRQ

SEQ ID NO: 260143 - protein, 4 aa, Mycobacterium
GERD

SEQ ID NO: 260144 - protein, 5 aa, Mycobacterium
GERDA

SEQ ID NO: 260145 - protein, 6 aa, Mycobacterium
GERDAT

SEQ ID NO: 260146 - protein, 8 aa, Mycobacterium
GERDPRRL

SEQ ID NO: 260147 - protein, 6 aa, Mycobacterium
GERDRR

SEQ ID NO: 260148 - protein, 9 aa, Mycobacterium
GEREPVPSA

SEQ ID NO: 260149 - protein, 7 aa, Mycobacterium
GERHQTR

SEQ ID NO: 260150 - protein, 5 aa, Mycobacterium
GERIA

SEQ ID NO: 260151 - protein, 6 aa, Mycobacterium
GERIAT

SEQ ID NO: 260152 - protein, 36 aa, Mycobacterium
GERISADGTVIGGASEVDQSSITGEPLPAAKDVGDD

SEQ ID NO: 260153 - protein, 7 aa, Mycobacterium
GERLDPT

SEQ ID NO: 260154 - protein, 11 aa, Mycobacterium
GERLDSAGGHV

SEQ ID NO: 260155 - protein, 5 aa, Mycobacterium
GERPD

SEQ ID NO: 260156 - protein, 9 aa, Mycobacterium
GERPGPGAS

SEQ ID NO: 260157 - protein, 7 aa, Mycobacterium
GERPGQA

SEQ ID NO: 260158 - protein, 8 aa, Mycobacterium
GERPGTLA

SEQ ID NO: 260159 - protein, 4 aa, Mycobacterium
GERQ

SEQ ID NO: 260160 - protein, 7 aa, Mycobacterium
GERQQVN

SEQ ID NO: 260161 - protein, 4 aa, Mycobacterium
GERR

SEQ ID NO: 260162 - protein, 14 aa, Mycobacterium
GERRPGPTSRRVPT

SEQ ID NO: 260163 - protein, 10 aa, Mycobacterium
GERRRAERER

SEQ ID NO: 260164 - protein, 8 aa, Mycobacterium
GERRRRER

SEQ ID NO: 260165 - protein, 10 aa, Mycobacterium
GERRRREREQ

SEQ ID NO: 260166 - protein, 5 aa, Mycobacterium
GERRY

SEQ ID NO: 260167 - protein, 11 aa, Mycobacterium
GERSAKTPRVP

SEQ ID NO: 260168 - protein, 21 aa, Mycobacterium
GERSATSDESATAEDAEANTG

SEQ ID NO: 260169 - protein, 9 aa, Mycobacterium
GERSERATL

SEQ ID NO: 260170 - protein, 5 aa, Mycobacterium
GERST

SEQ ID NO: 260171 - protein, 11 aa, Mycobacterium
GERTEGAEDNR

SEQ ID NO: 260172 - protein, 17 aa, Mycobacterium
GERTGPPSAPAGLADGS

SEQ ID NO: 260173 - protein, 6 aa, Mycobacterium
GERTGW

SEQ ID NO: 260174 - protein, 11 aa, Mycobacterium
GERVSPARSDI

SEQ ID NO: 260175 - protein, 12 aa, Mycobacterium
GESADGAVISEG

SEQ ID NO: 260176 - protein, 6 aa, Mycobacterium
GESAEE

SEQ ID NO: 260177 - protein, 14 aa, Mycobacterium
GESCNGDSARRSGN

SEQ ID NO: 260178 - protein, 14 aa, Mycobacterium
GESCSASGGAPGFT

SEQ ID NO: 260179 - protein, 10 aa, Mycobacterium
GESFEPQYES

SEQ ID NO: 260180 - protein, 5 aa, Mycobacterium
GESGL

SEQ ID NO: 260181 - protein, 7 aa, Mycobacterium
GESGLEQ

SEQ ID NO: 260182 - protein, 10 aa, Mycobacterium
GESGTDVARE

SEQ ID NO: 260183 - protein, 29 aa, Mycobacterium
GESGTPREYDYETNTDTRNYTYTGSGGVP

SEQ ID NO: 260184 - protein, 35 aa, Mycobacterium
GESGTSSGTATPGTATAGGGAGLPRHSEANGRDFG

SEQ ID NO: 260185 - protein, 4 aa, Mycobacterium
GESH

SEQ ID NO: 260186 - protein, 8 aa, Mycobacterium
GESLTNGP

SEQ ID NO: 260187 - protein, 7 aa, Mycobacterium
GESNSDS

SEQ ID NO: 260188 - protein, 13 aa, Mycobacterium
GESPNSPNSSKIT

SEQ ID NO: 260189 - protein, 4 aa, Mycobacterium
GESQ

SEQ ID NO: 260190 - protein, 11 aa, Mycobacterium
GESQMNGEGRT

SEQ ID NO: 260191 - protein, 8 aa, Mycobacterium
GESQSSAW

SEQ ID NO: 260192 - protein, 4 aa, Mycobacterium
GESS

SEQ ID NO: 260193 - protein, 5 aa, Mycobacterium
GESSS

SEQ ID NO: 260194 - protein, 6 aa, Mycobacterium
GESTAA

SEQ ID NO: 260195 - protein, 13 aa, Mycobacterium
GESTGTAPTNDVE

SEQ ID NO: 260196 - protein, 11 aa, Mycobacterium
GESTLEAAGRG

SEQ ID NO: 260197 - protein, 8 aa, Mycobacterium
GESVGSGP

SEQ ID NO: 260198 - protein, 8 aa, Mycobacterium
GESVPVEK

SEQ ID NO: 260199 - protein, 16 aa, Mycobacterium
GESVPVEKSVGDRVAG

SEQ ID NO: 260200 - protein, 19 aa, Mycobacterium
GESVPVEKTVGDRVAGATV

SEQ ID NO: 260201 - protein, 10 aa, Mycobacterium
GETAADPGFQ

SEQ ID NO: 260202 - protein, 7 aa, Mycobacterium
GETAERA

SEQ ID NO: 260203 - protein, 9 aa, Mycobacterium
GETAPGVAA

SEQ ID NO: 260204 - protein, 14 aa, Mycobacterium
GETCNGDSARRSGN

SEQ ID NO: 260205 - protein, 14 aa, Mycobacterium
GETCTGDSARRSGN

SEQ ID NO: 260206 - protein, 14 aa, Mycobacterium
GETDARVKPSNRGL

SEQ ID NO: 260207 - protein, 11 aa, Mycobacterium
GETDIDGEGRT

SEQ ID NO: 260208 - protein, 11 aa, Mycobacterium
GETDIDSEGRT

SEQ ID NO: 260209 - protein, 5 aa, Mycobacterium
GETDN

SEQ ID NO: 260210 - protein, 8 aa, Mycobacterium
GETEHART

SEQ ID NO: 260211 - protein, 8 aa, Mycobacterium
GETEHPRT

SEQ ID NO: 260212 - protein, 11 aa, Mycobacterium
GETELDGEGRT

SEQ ID NO: 260213 - protein, 23 aa, Mycobacterium
GETELPDERKRPAVREEREAPAE

SEQ ID NO: 260214 - protein, 23 aa, Mycobacterium
GETGEAGEAGAVGEAVGAVRTAN

SEQ ID NO: 260215 - protein, 8 aa, Mycobacterium
GETGERMY

SEQ ID NO: 260216 - protein, 6 aa, Mycobacterium
GETGGV

SEQ ID NO: 260217 - protein, 7 aa, Mycobacterium
GETGGVV

SEQ ID NO: 260218 - protein, 15 aa, Mycobacterium
GETGLGLGNPENSEN

SEQ ID NO: 260219 - protein, 5 aa, Mycobacterium
GETGN

SEQ ID NO: 260220 - protein, 7 aa, Mycobacterium
GETGSAY

SEQ ID NO: 260221 - protein, 8 aa, Mycobacterium
GETGSRGM

SEQ ID NO: 260222 - protein, 8 aa, Mycobacterium
GETGTSVS

SEQ ID NO: 260223 - protein, 9 aa, Mycobacterium
GETNRAPFD

SEQ ID NO: 260224 - protein, 11 aa, Mycobacterium
GETPLEATGRG

SEQ ID NO: 260225 - protein, 6 aa, Mycobacterium
GETPPR

SEQ ID NO: 260226 - protein, 6 aa, Mycobacterium
GETPQE

SEQ ID NO: 260227 - protein, 4 aa, Mycobacterium
GETR

SEQ ID NO: 260228 - protein, 6 aa, Mycobacterium
GETRDG

SEQ ID NO: 260229 - protein, 10 aa, Mycobacterium
GETSPGVDGG

SEQ ID NO: 260230 - protein, 22 aa, Mycobacterium
GETTHDRRAAARAERQRAELEA

SEQ ID NO: 260231 - protein, 8 aa, Mycobacterium
GETTVGQV

SEQ ID NO: 260232 - protein, 4 aa, Mycobacterium
GETV

SEQ ID NO: 260233 - protein, 6 aa, Mycobacterium
GETVTG

SEQ ID NO: 260234 - protein, 9 aa, Mycobacterium
GEVAGTDGS

SEQ ID NO: 260235 - protein, 5 aa, Mycobacterium
GEVAR

SEQ ID NO: 260236 - protein, 6 aa, Mycobacterium
GEVASS

SEQ ID NO: 260237 - protein, 10 aa, Mycobacterium
GEVDESGLET

SEQ ID NO: 260238 - protein, 7 aa, Mycobacterium
GEVEDTH

SEQ ID NO: 260239 - protein, 7 aa, Mycobacterium
GEVEEPD

SEQ ID NO: 260240 - protein, 19 aa, Mycobacterium
GEVERDTGQPLPEPQGRPL

SEQ ID NO: 260241 - protein, 21 aa, Mycobacterium
GEVGEKSEQGFAARKDSGYLP

SEQ ID NO: 260242 - protein, 22 aa, Mycobacterium
GEVKDQRTVDKADAYTFCPDKS

SEQ ID NO: 260243 - protein, 12 aa, Mycobacterium
GEVNASTDSQER

SEQ ID NO: 260244 - protein, 11 aa, Mycobacterium
GEVNNADPQLR

SEQ ID NO: 260245 - protein, 4 aa, Mycobacterium
GEVP

SEQ ID NO: 260246 - protein, 6 aa, Mycobacterium
GEVPAT

SEQ ID NO: 260247 - protein, 5 aa, Mycobacterium
GEVPP

SEQ ID NO: 260248 - protein, 6 aa, Mycobacterium
GEVPTT

SEQ ID NO: 260249 - protein, 4 aa, Mycobacterium
GEVR

SEQ ID NO: 260250 - protein, 5 aa, Mycobacterium
GEVRD

SEQ ID NO: 260251 - protein, 4 aa, Mycobacterium
GEVS

SEQ ID NO: 260252 - protein, 9 aa, Mycobacterium
GEVSDGALT

SEQ ID NO: 260253 - protein, 13 aa, Mycobacterium
GEVTSTNGDQISS

SEQ ID NO: 260254 - protein, 7 aa, Mycobacterium
GEWGGAT

SEQ ID NO: 260255 - protein, 4 aa, Mycobacterium
GEWR

SEQ ID NO: 260256 - protein, 4 aa, Mycobacterium
GEWS

SEQ ID NO: 260257 - protein, 6 aa, Mycobacterium
GEYPPV

SEQ ID NO: 260258 - protein, 4 aa, Mycobacterium
GEYS

SEQ ID NO: 260259 - protein, 4 aa, Mycobacterium
GFAA

SEQ ID NO: 260260 - protein, 5 aa, Mycobacterium
GFAAS

SEQ ID NO: 260261 - protein, 9 aa, Mycobacterium
GFADSPEWR

SEQ ID NO: 260262 - protein, 15 aa, Mycobacterium
GFAGEFNSDANAVAH

SEQ ID NO: 260263 - protein, 4 aa, Mycobacterium
GFAP

SEQ ID NO: 260264 - protein, 6 aa, Mycobacterium
GFAPDG

SEQ ID NO: 260265 - protein, 8 aa, Mycobacterium
GFAPDGKY

SEQ ID NO: 260266 - protein, 7 aa, Mycobacterium
GFAPDGR

SEQ ID NO: 260267 - protein, 5 aa, Mycobacterium
GFAPE

SEQ ID NO: 260268 - protein, 6 aa, Mycobacterium
GFAPTS

SEQ ID NO: 260269 - protein, 4 aa, Mycobacterium
GFAS

SEQ ID NO: 260270 - protein, 4 aa, Mycobacterium
GFAT

SEQ ID NO: 260271 - protein, 5 aa, Mycobacterium
GFDAG

SEQ ID NO: 260272 - protein, 4 aa, Mycobacterium
GFDN

SEQ ID NO: 260273 - protein, 5 aa, Mycobacterium
GFDPG

SEQ ID NO: 260274 - protein, 7 aa, Mycobacterium
GFDPGPR

SEQ ID NO: 260275 - protein, 6 aa, Mycobacterium
GFDRDN

SEQ ID NO: 260276 - protein, 5 aa, Mycobacterium
GFEDA

SEQ ID NO: 260277 - protein, 12 aa, Mycobacterium
GFETDRDHDPNL

SEQ ID NO: 260278 - protein, 10 aa, Mycobacterium
GFGDPADGGT

SEQ ID NO: 260279 - protein, 18 aa, Mycobacterium
GFGGGGGYGGYGGGFGGF

SEQ ID NO: 260280 - protein, 12 aa, Mycobacterium
GFGGGSATTTYA

SEQ ID NO: 260281 - protein, 6 aa, Mycobacterium
GFGGGT

SEQ ID NO: 260282 - protein, 6 aa, Mycobacterium
GFGGNR

SEQ ID NO: 260283 - protein, 5 aa, Mycobacterium
GFGGT

SEQ ID NO: 260284 - protein, 5 aa, Mycobacterium
GFGPG

SEQ ID NO: 260285 - protein, 7 aa, Mycobacterium
GFGPTSE

SEQ ID NO: 260286 - protein, 8 aa, Mycobacterium
GFGPTSEG

SEQ ID NO: 260287 - protein, 9 aa, Mycobacterium
GFGTGTAEL

SEQ ID NO: 260288 - protein, 5 aa, Mycobacterium
GFKES

SEQ ID NO: 260289 - protein, 5 aa, Mycobacterium
GFNDE

SEQ ID NO: 260290 - protein, 7 aa, Mycobacterium
GFNGTGY

SEQ ID NO: 260291 - protein, 9 aa, Mycobacterium
GFNRGPTVT

SEQ ID NO: 260292 - protein, 13 aa, Mycobacterium
GFPDRGDGLASGA

SEQ ID NO: 260293 - protein, 5 aa, Mycobacterium
GFPPS

SEQ ID NO: 260294 - protein, 5 aa, Mycobacterium
GFPTP

SEQ ID NO: 260295 - protein, 8 aa, Mycobacterium
GFQGSAEG

SEQ ID NO: 260296 - protein, 11 aa, Mycobacterium
GFQQQDQASTA

SEQ ID NO: 260297 - protein, 6 aa, Mycobacterium
GFQRDG

SEQ ID NO: 260298 - protein, 12 aa, Mycobacterium
GFQRPTPVLDMK

SEQ ID NO: 260299 - protein, 16 aa, Mycobacterium
GFRAEDATSPDSDVTD

SEQ ID NO: 260300 - protein, 13 aa, Mycobacterium
GFRAEGTDLPTSD

SEQ ID NO: 260301 - protein, 5 aa, Mycobacterium
GFRGG

SEQ ID NO: 260302 - protein, 7 aa, Mycobacterium
GFRGKTG

SEQ ID NO: 260303 - protein, 12 aa, Mycobacterium
GFRGQGERMGQA

SEQ ID NO: 260304 - protein, 11 aa, Mycobacterium
GFSDDDEDRVT

SEQ ID NO: 260305 - protein, 5 aa, Mycobacterium
GFSGN

SEQ ID NO: 260306 - protein, 6 aa, Mycobacterium
GFSPET

SEQ ID NO: 260307 - protein, 10 aa, Mycobacterium
GFSPRTRSAA

SEQ ID NO: 260308 - protein, 6 aa, Mycobacterium
GFSSGT

SEQ ID NO: 260309 - protein, 7 aa, Mycobacterium
GFSSRTD

SEQ ID NO: 260310 - protein, 4 aa, Mycobacterium
GFST

SEQ ID NO: 260311 - protein, 15 aa, Mycobacterium
GFTAGSPIEALTDDR

SEQ ID NO: 260312 - protein, 12 aa, Mycobacterium
GFTDPDNDPEKM

SEQ ID NO: 260313 - protein, 10 aa, Mycobacterium
GFYDEGSQSV

SEQ ID NO: 260314 - protein, 6 aa, Mycobacterium
GFYSNP

SEQ ID NO: 260315 - protein, 6 aa, Mycobacterium
GGAAAM

SEQ ID NO: 260316 - protein, 6 aa, Mycobacterium
GGAAAR

SEQ ID NO: 260317 - protein, 12 aa, Mycobacterium
GGAAEKAGIPNG

SEQ ID NO: 260318 - protein, 8 aa, Mycobacterium
GGAAPGLA

SEQ ID NO: 260319 - protein, 6 aa, Mycobacterium
GGAATD

SEQ ID NO: 260320 - protein, 7 aa, Mycobacterium
GGAATGI

SEQ ID NO: 260321 - protein, 9 aa, Mycobacterium
GGAATTSLG

SEQ ID NO: 260322 - protein, 6 aa, Mycobacterium
GGAAVA

SEQ ID NO: 260323 - protein, 6 aa, Mycobacterium
GGAAVE

SEQ ID NO: 260324 - protein, 4 aa, Mycobacterium
GGAD

SEQ ID NO: 260325 - protein, 7 aa, Mycobacterium
GGADAAD

SEQ ID NO: 260326 - protein, 12 aa, Mycobacterium
GGADADGGDPDP

SEQ ID NO: 260327 - protein, 15 aa, Mycobacterium
GGADANGAEPEDGEE

SEQ ID NO: 260328 - protein, 9 aa, Mycobacterium
GGADGAAAE

SEQ ID NO: 260329 - protein, 5 aa, Mycobacterium
GGADV

SEQ ID NO: 260330 - protein, 17 aa, Mycobacterium
GGAEAARASASLDEWGP

SEQ ID NO: 260331 - protein, 18 aa, Mycobacterium
GGAEPAFGTPPADGPPRL

SEQ ID NO: 260332 - protein, 7 aa, Mycobacterium
GGAEPGW

SEQ ID NO: 260333 - protein, 7 aa, Mycobacterium
GGAEPQY

SEQ ID NO: 260334 - protein, 13 aa, Mycobacterium
GGAEQQIYRMSEQ

SEQ ID NO: 260335 - protein, 6 aa, Mycobacterium
GGAFGT

SEQ ID NO: 260336 - protein, 22 aa, Mycobacterium
GGAFNNDTECVNGRRGNAADHL

SEQ ID NO: 260337 - protein, 22 aa, Mycobacterium
GGAFNNDTECVNGSRGNAADHL

SEQ ID NO: 260338 - protein, 4 aa, Mycobacterium
GGAG

SEQ ID NO: 260339 - protein, 5 aa, Mycobacterium
GGAGA

SEQ ID NO: 260340 - protein, 7 aa, Mycobacterium
GGAGAAR

SEQ ID NO: 260341 - protein, 6 aa, Mycobacterium
GGAGAI

SEQ ID NO: 260342 - protein, 8 aa, Mycobacterium
GGAGAPSA

SEQ ID NO: 260343 - protein, 17 aa, Mycobacterium
GGAGDDVEGMPRSQSVA

SEQ ID NO: 260344 - protein, 6 aa, Mycobacterium
GGAGEL

SEQ ID NO: 260345 - protein, 5 aa, Mycobacterium
GGAGG

SEQ ID NO: 260346 - protein, 6 aa, Mycobacterium
GGAGGL

SEQ ID NO: 260347 - protein, 34 aa, Mycobacterium
GGAGHHSSWSGSGSSSYGGSSRSSGSSFRGGGGR

SEQ ID NO: 260348 - protein, 8 aa, Mycobacterium
GGAGLAAT

SEQ ID NO: 260349 - protein, 8 aa, Mycobacterium
GGAGLGLR

SEQ ID NO: 260350 - protein, 10 aa, Mycobacterium
GGAGNPGAPY

SEQ ID NO: 260351 - protein, 7 aa, Mycobacterium
GGAGQPV

SEQ ID NO: 260352 - protein, 15 aa, Mycobacterium
GGAGSNDKDIKEYGA

SEQ ID NO: 260353 - protein, 14 aa, Mycobacterium
GGAGSNNKDIKQYA

SEQ ID NO: 260354 - protein, 6 aa, Mycobacterium
GGAGTN

SEQ ID NO: 260355 - protein, 4 aa, Mycobacterium
GGAI

SEQ ID NO: 260356 - protein, 10 aa, Mycobacterium
GGAKAVGNAV

SEQ ID NO: 260357 - protein, 9 aa, Mycobacterium
GGAKPRQAH

SEQ ID NO: 260358 - protein, 65 aa, Mycobacterium
GGAKRPGAKKTAAAPAEDKPAAAAAPAKGLGIAGGAKRPGAKKAAPAAEAAPAADAPAKAEPEVK

SEQ ID NO: 260359 - protein, 4 aa, Mycobacterium
GGAL

SEQ ID NO: 260360 - protein, 12 aa, Mycobacterium
GGALAAALARRE

SEQ ID NO: 260361 - protein, 9 aa, Mycobacterium
GGALAPAGE

SEQ ID NO: 260362 - protein, 6 aa, Mycobacterium
GGALGN

SEQ ID NO: 260363 - protein, 29 aa, Mycobacterium
GGALPPEPKRHRAEPEPEPEPYPDTGEFD

SEQ ID NO: 260364 - protein, 10 aa, Mycobacterium
GGANAPGCSS

SEQ ID NO: 260365 - protein, 10 aa, Mycobacterium
GGANIPSVTT

SEQ ID NO: 260366 - protein, 7 aa, Mycobacterium
GGANPGV

SEQ ID NO: 260367 - protein, 7 aa, Mycobacterium
GGAPELK

SEQ ID NO: 260368 - protein, 5 aa, Mycobacterium
GGAPF

SEQ ID NO: 260369 - protein, 5 aa, Mycobacterium
GGAPG

SEQ ID NO: 260370 - protein, 38 aa, Mycobacterium
GGAPGGAAAAPPPAPAPGVPPPPADAPPAAAAPVAPVP

SEQ ID NO: 260371 - protein, 7 aa, Mycobacterium
GGAPGSF

SEQ ID NO: 260372 - protein, 11 aa, Mycobacterium
GGAPKPTPGAI

SEQ ID NO: 260373 - protein, 9 aa, Mycobacterium
GGAPMDEGA

SEQ ID NO: 260374 - protein, 6 aa, Mycobacterium
GGAPNP

SEQ ID NO: 260375 - protein, 7 aa, Mycobacterium
GGAPNPY

SEQ ID NO: 260376 - protein, 7 aa, Mycobacterium
GGAPTSH

SEQ ID NO: 260377 - protein, 9 aa, Mycobacterium
GGAPVSTAG

SEQ ID NO: 260378 - protein, 6 aa, Mycobacterium
GGAPYY

SEQ ID NO: 260379 - protein, 27 aa, Mycobacterium
GGAQAKTNVPQGMGSGTGRPLAEARQR

SEQ ID NO: 260380 - protein, 7 aa, Mycobacterium
GGAQDRL

SEQ ID NO: 260381 - protein, 13 aa, Mycobacterium
GGAQEMGESGNPL

SEQ ID NO: 260382 - protein, 9 aa, Mycobacterium
GGAQLDRDA

SEQ ID NO: 260383 - protein, 8 aa, Mycobacterium
GGARDRVT

SEQ ID NO: 260384 - protein, 5 aa, Mycobacterium
GGARG

SEQ ID NO: 260385 - protein, 8 aa, Mycobacterium
GGARMGSQ

SEQ ID NO: 260386 - protein, 5 aa, Mycobacterium
GGARP

SEQ ID NO: 260387 - protein, 4 aa, Mycobacterium
GGAS

SEQ ID NO: 260388 - protein, 8 aa, Mycobacterium
GGASDERV

SEQ ID NO: 260389 - protein, 5 aa, Mycobacterium
GGASG

SEQ ID NO: 260390 - protein, 9 aa, Mycobacterium
GGASGVASS

SEQ ID NO: 260391 - protein, 6 aa, Mycobacterium
GGATGA

SEQ ID NO: 260392 - protein, 5 aa, Mycobacterium
GGATV

SEQ ID NO: 260393 - protein, 8 aa, Mycobacterium
GGATVANQ

SEQ ID NO: 260394 - protein, 6 aa, Mycobacterium
GGATWA

SEQ ID NO: 260395 - protein, 4 aa, Mycobacterium
GGAV

SEQ ID NO: 260396 - protein, 8 aa, Mycobacterium
GGAVGVGE

SEQ ID NO: 260397 - protein, 10 aa, Mycobacterium
GGAVRTEADA

SEQ ID NO: 260398 - protein, 5 aa, Mycobacterium
GGAVT

SEQ ID NO: 260399 - protein, 11 aa, Mycobacterium
GGAWEGPTAEQ

SEQ ID NO: 260400 - protein, 9 aa, Mycobacterium
GGCAEPDEL

SEQ ID NO: 260401 - protein, 4 aa, Mycobacterium
GGDA

SEQ ID NO: 260402 - protein, 10 aa, Mycobacterium
GGDAFTTPSA

SEQ ID NO: 260403 - protein, 10 aa, Mycobacterium
GGDAGEATTY

SEQ ID NO: 260404 - protein, 8 aa, Mycobacterium
GGDANHPV

SEQ ID NO: 260405 - protein, 9 aa, Mycobacterium
GGDAPASFG

SEQ ID NO: 260406 - protein, 9 aa, Mycobacterium
GGDDDASSL

SEQ ID NO: 260407 - protein, 7 aa, Mycobacterium
GGDDPFD

SEQ ID NO: 260408 - protein, 8 aa, Mycobacterium
GGDDPVRY

SEQ ID NO: 260409 - protein, 9 aa, Mycobacterium
GGDENRPNP

SEQ ID NO: 260410 - protein, 8 aa, Mycobacterium
GGDFTDAG

SEQ ID NO: 260411 - protein, 6 aa, Mycobacterium
GGDGEA

SEQ ID NO: 260412 - protein, 10 aa, Mycobacterium
GGDGGAAGDA

SEQ ID NO: 260413 - protein, 8 aa, Mycobacterium
GGDGLSDC

SEQ ID NO: 260414 - protein, 9 aa, Mycobacterium
GGDGPSASG

SEQ ID NO: 260415 - protein, 8 aa, Mycobacterium
GGDGREPE

SEQ ID NO: 260416 - protein, 8 aa, Mycobacterium
GGDGRPAL

SEQ ID NO: 260417 - protein, 12 aa, Mycobacterium
GGDGTVKQMSLP

SEQ ID NO: 260418 - protein, 6 aa, Mycobacterium
GGDHGA

SEQ ID NO: 260419 - protein, 8 aa, Mycobacterium
GGDHGLSS

SEQ ID NO: 260420 - protein, 9 aa, Mycobacterium
GGDHPRPRI

SEQ ID NO: 260421 - protein, 5 aa, Mycobacterium
GGDIA

SEQ ID NO: 260422 - protein, 5 aa, Mycobacterium
GGDKT

SEQ ID NO: 260423 - protein, 10 aa, Mycobacterium
GGDKTLNDLD

SEQ ID NO: 260424 - protein, 8 aa, Mycobacterium
GGDNDTAS

SEQ ID NO: 260425 - protein, 6 aa, Mycobacterium
GGDNRS

SEQ ID NO: 260426 - protein, 8 aa, Mycobacterium
GGDPAEQV

SEQ ID NO: 260427 - protein, 6 aa, Mycobacterium
GGDPAR

SEQ ID NO: 260428 - protein, 8 aa, Mycobacterium
GGDPDPLG

SEQ ID NO: 260429 - protein, 14 aa, Mycobacterium
GGDPDVGKKEPTFG

SEQ ID NO: 260430 - protein, 9 aa, Mycobacterium
GGDPEAAEG

SEQ ID NO: 260431 - protein, 6 aa, Mycobacterium
GGDPIA

SEQ ID NO: 260432 - protein, 5 aa, Mycobacterium
GGDQL

SEQ ID NO: 260433 - protein, 10 aa, Mycobacterium
GGDQLKKYGP

SEQ ID NO: 260434 - protein, 23 aa, Mycobacterium
GGDSASQSPVAVPSDAESARADA

SEQ ID NO: 260435 - protein, 129 aa, Mycobacterium
GGDSDDPDDVADAAPPAPEAGRRSSRSSRSSTGGRSTTRRTDRTRARRTRPPVEDQPDPGAERPRRRRPTPPPDHDAAEPPRRARRRPRPPGDSDLRATPPRQPRRDPHTRRNPYESYERPAPRTSRFD

SEQ ID NO: 260436 - protein, 9 aa, Mycobacterium
GGDSGSVSA

SEQ ID NO: 260437 - protein, 81 aa, Mycobacterium
GGDSGSVSATVADPTQTSQPATTAPQDASSTPRPLPPVAPSLSPETVTTVTPSPTAPAATAEPAPVAPPAEAAPPPAVNPR

SEQ ID NO: 260438 - protein, 10 aa, Mycobacterium
GGDSPSSAHR

SEQ ID NO: 260439 - protein, 21 aa, Mycobacterium
GGDSQGMGGGRGSGPGFSGTP

SEQ ID NO: 260440 - protein, 10 aa, Mycobacterium
GGDSQGSEVT

SEQ ID NO: 260441 - protein, 34 aa, Mycobacterium
GGDSSSQSPVAVPADSESARADAARAALPGGDQV

SEQ ID NO: 260442 - protein, 9 aa, Mycobacterium
GGDTATAAS

SEQ ID NO: 260443 - protein, 7 aa, Mycobacterium
GGDTDGA

SEQ ID NO: 260444 - protein, 5 aa, Mycobacterium
GGDTL

SEQ ID NO: 260445 - protein, 9 aa, Mycobacterium
GGDTPAQAS

SEQ ID NO: 260446 - protein, 7 aa, Mycobacterium
GGDTRRA

SEQ ID NO: 260447 - protein, 4 aa, Mycobacterium
GGDV

SEQ ID NO: 260448 - protein, 6 aa, Mycobacterium
GGDVEA

SEQ ID NO: 260449 - protein, 10 aa, Mycobacterium
GGDYAGPGKR

SEQ ID NO: 260450 - protein, 12 aa, Mycobacterium
GGEAGPVPNDGF

SEQ ID NO: 260451 - protein, 9 aa, Mycobacterium
GGEASSSTQ

SEQ ID NO: 260452 - protein, 4 aa, Mycobacterium
GGED

SEQ ID NO: 260453 - protein, 6 aa, Mycobacterium
GGEEKL

SEQ ID NO: 260454 - protein, 7 aa, Mycobacterium
GGEEPTQ

SEQ ID NO: 260455 - protein, 10 aa, Mycobacterium
GGEETRSLDS

SEQ ID NO: 260456 - protein, 4 aa, Mycobacterium
GGEG

SEQ ID NO: 260457 - protein, 14 aa, Mycobacterium
GGEGDGEATAAEGR

SEQ ID NO: 260458 - protein, 11 aa, Mycobacterium
GGEGLGLRSGG

SEQ ID NO: 260459 - protein, 12 aa, Mycobacterium
GGEGLGLRSPGP

SEQ ID NO: 260460 - protein, 18 aa, Mycobacterium
GGEIPDGDTNKLDSAAKA

SEQ ID NO: 260461 - protein, 8 aa, Mycobacterium
GGELDPPK

SEQ ID NO: 260462 - protein, 7 aa, Mycobacterium
GGELPEP

SEQ ID NO: 260463 - protein, 6 aa, Mycobacterium
GGEMSR

SEQ ID NO: 260464 - protein, 13 aa, Mycobacterium
GGENNAQKNAQTL

SEQ ID NO: 260465 - protein, 8 aa, Mycobacterium
GGENRSRA

SEQ ID NO: 260466 - protein, 6 aa, Mycobacterium
GGENSM

SEQ ID NO: 260467 - protein, 13 aa, Mycobacterium
GGENYAQSNAQTI

SEQ ID NO: 260468 - protein, 4 aa, Mycobacterium
GGEP

SEQ ID NO: 260469 - protein, 7 aa, Mycobacterium
GGEPTLH

SEQ ID NO: 260470 - protein, 12 aa, Mycobacterium
GGERDGKPNEPV

SEQ ID NO: 260471 - protein, 6 aa, Mycobacterium
GGERER

SEQ ID NO: 260472 - protein, 6 aa, Mycobacterium
GGERSA

SEQ ID NO: 260473 - protein, 10 aa, Mycobacterium
GGESDVSSGP

SEQ ID NO: 260474 - protein, 13 aa, Mycobacterium
GGESNAQKNAQTL

SEQ ID NO: 260475 - protein, 18 aa, Mycobacterium
GGESPASQAGAPAPTPRP

SEQ ID NO: 260476 - protein, 4 aa, Mycobacterium
GGET

SEQ ID NO: 260477 - protein, 14 aa, Mycobacterium
GGETNAQKTAKQLS

SEQ ID NO: 260478 - protein, 7 aa, Mycobacterium
GGETREV

SEQ ID NO: 260479 - protein, 5 aa, Mycobacterium
GGETV

SEQ ID NO: 260480 - protein, 10 aa, Mycobacterium
GGEVGEAGRT

SEQ ID NO: 260481 - protein, 6 aa, Mycobacterium
GGEWAG

SEQ ID NO: 260482 - protein, 5 aa, Mycobacterium
GGEWG

SEQ ID NO: 260483 - protein, 8 aa, Mycobacterium
GGEWPRPL

SEQ ID NO: 260484 - protein, 15 aa, Mycobacterium
GGFADPGAESSQANR

SEQ ID NO: 260485 - protein, 15 aa, Mycobacterium
GGFEDPNSESARASE

SEQ ID NO: 260486 - protein, 4 aa, Mycobacterium
GGFG

SEQ ID NO: 260487 - protein, 32 aa, Mycobacterium
GGFGGGRSSGRPTSYGGSSHSSGRNYGGGGGR

SEQ ID NO: 260488 - protein, 32 aa, Mycobacterium
GGFGGWSPTSFGGSSSSSSGSSGGGFMGGGGR

SEQ ID NO: 260489 - protein, 4 aa, Mycobacterium
GGFK

SEQ ID NO: 260490 - protein, 14 aa, Mycobacterium
GGFQDPTSESARAT

SEQ ID NO: 260491 - protein, 12 aa, Mycobacterium
GGFRDGGAMPGT

SEQ ID NO: 260492 - protein, 16 aa, Mycobacterium
GGGAGGGGNADQSGAL

SEQ ID NO: 260493 - protein, 9 aa, Mycobacterium
GGGAGRSRA

SEQ ID NO: 260494 - protein, 6 aa, Mycobacterium
GGGANI

SEQ ID NO: 260495 - protein, 12 aa, Mycobacterium
GGGAPSESRLDG

SEQ ID NO: 260496 - protein, 8 aa, Mycobacterium
GGGARDVQ

SEQ ID NO: 260497 - protein, 6 aa, Mycobacterium
GGGARG

SEQ ID NO: 260498 - protein, 5 aa, Mycobacterium
GGGAS

SEQ ID NO: 260499 - protein, 9 aa, Mycobacterium
GGGATAQEL

SEQ ID NO: 260500 - protein, 5 aa, Mycobacterium
GGGDA

SEQ ID NO: 260501 - protein, 9 aa, Mycobacterium
GGGDAPPPA

SEQ ID NO: 260502 - protein, 9 aa, Mycobacterium
GGGDAPPTM

SEQ ID NO: 260503 - protein, 5 aa, Mycobacterium
GGGDF

SEQ ID NO: 260504 - protein, 6 aa, Mycobacterium
GGGDHG

SEQ ID NO: 260505 - protein, 9 aa, Mycobacterium
GGGDKPPPA

SEQ ID NO: 260506 - protein, 10 aa, Mycobacterium
GGGDKPPPAR

SEQ ID NO: 260507 - protein, 5 aa, Mycobacterium
GGGDL

SEQ ID NO: 260508 - protein, 8 aa, Mycobacterium
GGGDPVRN

SEQ ID NO: 260509 - protein, 5 aa, Mycobacterium
GGGDR

SEQ ID NO: 260510 - protein, 7 aa, Mycobacterium
GGGDTRG

SEQ ID NO: 260511 - protein, 4 aa, Mycobacterium
GGGE

SEQ ID NO: 260512 - protein, 10 aa, Mycobacterium
GGGEGPPPAR

SEQ ID NO: 260513 - protein, 12 aa, Mycobacterium
GGGERDKETPIS

SEQ ID NO: 260514 - protein, 5 aa, Mycobacterium
GGGEV

SEQ ID NO: 260515 - protein, 7 aa, Mycobacterium
GGGEYRT

SEQ ID NO: 260516 - protein, 4 aa, Mycobacterium
GGGF

SEQ ID NO: 260517 - protein, 4 aa, Mycobacterium
GGGG

SEQ ID NO: 260518 - protein, 11 aa, Mycobacterium
GGGGDAANVDD

SEQ ID NO: 260519 - protein, 17 aa, Mycobacterium
GGGGGLTPSDVAPARLT

SEQ ID NO: 260520 - protein, 7 aa, Mycobacterium
GGGGHSV

SEQ ID NO: 260521 - protein, 13 aa, Mycobacterium
GGGGLQGGSTITQ

SEQ ID NO: 260522 - protein, 16 aa, Mycobacterium
GGGGPSGPQPPAEAQP

SEQ ID NO: 260523 - protein, 6 aa, Mycobacterium
GGGGQA

SEQ ID NO: 260524 - protein, 23 aa, Mycobacterium
GGGGRSVATAAESVGRAAAEQAG

SEQ ID NO: 260525 - protein, 6 aa, Mycobacterium
GGGGTF

SEQ ID NO: 260526 - protein, 7 aa, Mycobacterium
GGGGTLD

SEQ ID NO: 260527 - protein, 9 aa, Mycobacterium
GGGGTTATQ

SEQ ID NO: 260528 - protein, 5 aa, Mycobacterium
GGGGV

SEQ ID NO: 260529 - protein, 5 aa, Mycobacterium
GGGGW

SEQ ID NO: 260530 - protein, 52 aa, Mycobacterium
GGGGYERGFEAGRDSAYADAGDNGGQSAGYDSSQGDVGFGGGYDSGGGDVDF

SEQ ID NO: 260531 - protein, 6 aa, Mycobacterium
GGGHGV

SEQ ID NO: 260532 - protein, 6 aa, Mycobacterium
GGGHPL

SEQ ID NO: 260533 - protein, 14 aa, Mycobacterium
GGGIAGGTATTADC

SEQ ID NO: 260534 - protein, 5 aa, Mycobacterium
GGGID

SEQ ID NO: 260535 - protein, 7 aa, Mycobacterium
GGGINRD

SEQ ID NO: 260536 - protein, 16 aa, Mycobacterium
GGGIVTPDESSRDSGA

SEQ ID NO: 260537 - protein, 9 aa, Mycobacterium
GGGKGATPV

SEQ ID NO: 260538 - protein, 8 aa, Mycobacterium
GGGKGRPS

SEQ ID NO: 260539 - protein, 6 aa, Mycobacterium
GGGLAG

SEQ ID NO: 260540 - protein, 11 aa, Mycobacterium
GGGLANESAAA

SEQ ID NO: 260541 - protein, 14 aa, Mycobacterium
GGGLDPQDVDELED

SEQ ID NO: 260542 - protein, 7 aa, Mycobacterium
GGGLDRD

SEQ ID NO: 260543 - protein, 7 aa, Mycobacterium
GGGLNKD

SEQ ID NO: 260544 - protein, 66 aa, Mycobacterium
GGGLNKDELGLNGPSSSASASSSTTPSAAAGSVVKPTRASVYSPDGEVDNPGTAGQAIDGDPSTAW

SEQ ID NO: 260545 - protein, 5 aa, Mycobacterium
GGGLR

SEQ ID NO: 260546 - protein, 8 aa, Mycobacterium
GGGLSPAS

SEQ ID NO: 260547 - protein, 5 aa, Mycobacterium
GGGLT

SEQ ID NO: 260548 - protein, 6 aa, Mycobacterium
GGGLTT

SEQ ID NO: 260549 - protein, 8 aa, Mycobacterium
GGGNFSAS

SEQ ID NO: 260550 - protein, 5 aa, Mycobacterium
GGGNI

SEQ ID NO: 260551 - protein, 4 aa, Mycobacterium
GGGP

SEQ ID NO: 260552 - protein, 9 aa, Mycobacterium
GGGPAGSTD

SEQ ID NO: 260553 - protein, 19 aa, Mycobacterium
GGGPAPGPIPYPGAPPYGA

SEQ ID NO: 260554 - protein, 7 aa, Mycobacterium
GGGPDGF

SEQ ID NO: 260555 - protein, 9 aa, Mycobacterium
GGGPEGSTE

SEQ ID NO: 260556 - protein, 8 aa, Mycobacterium
GGGPGDAT

SEQ ID NO: 260557 - protein, 6 aa, Mycobacterium
GGGPGY

SEQ ID NO: 260558 - protein, 9 aa, Mycobacterium
GGGPHPQDW

SEQ ID NO: 260559 - protein, 8 aa, Mycobacterium
GGGPSGVG

SEQ ID NO: 260560 - protein, 9 aa, Mycobacterium
GGGQPTRRL

SEQ ID NO: 260561 - protein, 11 aa, Mycobacterium
GGGQRDPETPM

SEQ ID NO: 260562 - protein, 11 aa, Mycobacterium
GGGQRDPQTPI

SEQ ID NO: 260563 - protein, 15 aa, Mycobacterium
GGGQRWREDKPSRSA

SEQ ID NO: 260564 - protein, 5 aa, Mycobacterium
GGGQT

SEQ ID NO: 260565 - protein, 7 aa, Mycobacterium
GGGRDKH

SEQ ID NO: 260566 - protein, 9 aa, Mycobacterium
GGGREGAPV

SEQ ID NO: 260567 - protein, 7 aa, Mycobacterium
GGGRELA

SEQ ID NO: 260568 - protein, 9 aa, Mycobacterium
GGGRGDLGR

SEQ ID NO: 260569 - protein, 7 aa, Mycobacterium
GGGRLDK

SEQ ID NO: 260570 - protein, 6 aa, Mycobacterium
GGGRLG

SEQ ID NO: 260571 - protein, 15 aa, Mycobacterium
GGGRPASPGSTERNA

SEQ ID NO: 260572 - protein, 9 aa, Mycobacterium
GGGRRGGTP

SEQ ID NO: 260573 - protein, 18 aa, Mycobacterium
GGGSDFGGGSDSGGGDFG

SEQ ID NO: 260574 - protein, 7 aa, Mycobacterium
GGGSEAL

SEQ ID NO: 260575 - protein, 16 aa, Mycobacterium
GGGSGGKKVPEINADR

SEQ ID NO: 260576 - protein, 9 aa, Mycobacterium
GGGSGRSRA

SEQ ID NO: 260577 - protein, 9 aa, Mycobacterium
GGGSPATAA

SEQ ID NO: 260578 - protein, 10 aa, Mycobacterium
GGGSQNGAVA

SEQ ID NO: 260579 - protein, 7 aa, Mycobacterium
GGGSQTP

SEQ ID NO: 260580 - protein, 6 aa, Mycobacterium
GGGSRF

SEQ ID NO: 260581 - protein, 6 aa, Mycobacterium
GGGSSI

SEQ ID NO: 260582 - protein, 6 aa, Mycobacterium
GGGTAA

SEQ ID NO: 260583 - protein, 8 aa, Mycobacterium
GGGTDGYV

SEQ ID NO: 260584 - protein, 5 aa, Mycobacterium
GGGTI

SEQ ID NO: 260585 - protein, 5 aa, Mycobacterium
GGGTL

SEQ ID NO: 260586 - protein, 6 aa, Mycobacterium
GGGTPL

SEQ ID NO: 260587 - protein, 9 aa, Mycobacterium
GGGTSAPSN

SEQ ID NO: 260588 - protein, 9 aa, Mycobacterium
GGGTSAVAV

SEQ ID NO: 260589 - protein, 10 aa, Mycobacterium
GGGTSLSGET

SEQ ID NO: 260590 - protein, 12 aa, Mycobacterium
GGGVRGRRTAKT

SEQ ID NO: 260591 - protein, 4 aa, Mycobacterium
GGGW

SEQ ID NO: 260592 - protein, 32 aa, Mycobacterium
GGGWGGTPPGTPPQQLGGPAPWNQPASRQRNP

SEQ ID NO: 260593 - protein, 10 aa, Mycobacterium
GGGWQGSAAQ

SEQ ID NO: 260594 - protein, 19 aa, Mycobacterium
GGHDGSNCEPVSPPAQTAV

SEQ ID NO: 260595 - protein, 8 aa, Mycobacterium
GGHEQQAI

SEQ ID NO: 260596 - protein, 9 aa, Mycobacterium
GGHGFGGGH

SEQ ID NO: 260597 - protein, 16 aa, Mycobacterium
GGHGFGGGHGFGGFGH

SEQ ID NO: 260598 - protein, 7 aa, Mycobacterium
GGHPSLA

SEQ ID NO: 260599 - protein, 7 aa, Mycobacterium
GGHQAAT

SEQ ID NO: 260600 - protein, 6 aa, Mycobacterium
GGHQSS

SEQ ID NO: 260601 - protein, 8 aa, Mycobacterium
GGHQTATL

SEQ ID NO: 260602 - protein, 12 aa, Mycobacterium
GGHRSADGRRGV

SEQ ID NO: 260603 - protein, 7 aa, Mycobacterium
GGHTAHT

SEQ ID NO: 260604 - protein, 9 aa, Mycobacterium
GGHTGKTGD

SEQ ID NO: 260605 - protein, 6 aa, Mycobacterium
GGHYGE

SEQ ID NO: 260606 - protein, 10 aa, Mycobacterium
GGIAGEPEEI

SEQ ID NO: 260607 - protein, 10 aa, Mycobacterium
GGIAPSPESF

SEQ ID NO: 260608 - protein, 4 aa, Mycobacterium
GGID

SEQ ID NO: 260609 - protein, 8 aa, Mycobacterium
GGIEGETV

SEQ ID NO: 260610 - protein, 7 aa, Mycobacterium
GGIETPE

SEQ ID NO: 260611 - protein, 4 aa, Mycobacterium
GGIG

SEQ ID NO: 260612 - protein, 10 aa, Mycobacterium
GGIGPGATDT

SEQ ID NO: 260613 - protein, 6 aa, Mycobacterium
GGIPGM

SEQ ID NO: 260614 - protein, 9 aa, Mycobacterium
GGIQQPASL

SEQ ID NO: 260615 - protein, 9 aa, Mycobacterium
GGITPGNDV

SEQ ID NO: 260616 - protein, 7 aa, Mycobacterium
GGITSPD

SEQ ID NO: 260617 - protein, 12 aa, Mycobacterium
GGKAGFPPDGRA

SEQ ID NO: 260618 - protein, 8 aa, Mycobacterium
GGKAQDDF

SEQ ID NO: 260619 - protein, 9 aa, Mycobacterium
GGKDGQGVN

SEQ ID NO: 260620 - protein, 8 aa, Mycobacterium
GGKDHDEA

SEQ ID NO: 260621 - protein, 7 aa, Mycobacterium
GGKEFGQ

SEQ ID NO: 260622 - protein, 7 aa, Mycobacterium
GGKEFGR

SEQ ID NO: 260623 - protein, 10 aa, Mycobacterium
GGKKPYGYQG

SEQ ID NO: 260624 - protein, 5 aa, Mycobacterium
GGKLA

SEQ ID NO: 260625 - protein, 8 aa, Mycobacterium
GGKLPPPV

SEQ ID NO: 260626 - protein, 6 aa, Mycobacterium
GGKNAA

SEQ ID NO: 260627 - protein, 7 aa, Mycobacterium
GGKPNSL

SEQ ID NO: 260628 - protein, 7 aa, Mycobacterium
GGKPNSR

SEQ ID NO: 260629 - protein, 29 aa, Mycobacterium
GGKPRRKPGPYRSPTDRPGMQRPSEGARF

SEQ ID NO: 260630 - protein, 14 aa, Mycobacterium
GGKTAFLGPPDQIG

SEQ ID NO: 260631 - protein, 19 aa, Mycobacterium
GGKTAFLGPPDQIGPAMGT

SEQ ID NO: 260632 - protein, 20 aa, Mycobacterium
GGKTAYRGSPEQIGDAMGTT

SEQ ID NO: 260633 - protein, 9 aa, Mycobacterium
GGKTGAGKT

SEQ ID NO: 260634 - protein, 8 aa, Mycobacterium
GGKTITTS

SEQ ID NO: 260635 - protein, 13 aa, Mycobacterium
GGKTTSPGEQAGI

SEQ ID NO: 260636 - protein, 7 aa, Mycobacterium
GGLAAGN

SEQ ID NO: 260637 - protein, 9 aa, Mycobacterium
GGLAGEPEE

SEQ ID NO: 260638 - protein, 10 aa, Mycobacterium
GGLAGEPEEI

SEQ ID NO: 260639 - protein, 11 aa, Mycobacterium
GGLDGIRERAG

SEQ ID NO: 260640 - protein, 9 aa, Mycobacterium
GGLDPDQVQ

SEQ ID NO: 260641 - protein, 11 aa, Mycobacterium
GGLDPEQVDEL

SEQ ID NO: 260642 - protein, 7 aa, Mycobacterium
GGLEPGN

SEQ ID NO: 260643 - protein, 11 aa, Mycobacterium
GGLESVSTGRV

SEQ ID NO: 260644 - protein, 12 aa, Mycobacterium
GGLGAGSTRQHD

SEQ ID NO: 260645 - protein, 6 aa, Mycobacterium
GGLGTG

SEQ ID NO: 260646 - protein, 7 aa, Mycobacterium
GGLGTGP

SEQ ID NO: 260647 - protein, 4 aa, Mycobacterium
GGLK

SEQ ID NO: 260648 - protein, 7 aa, Mycobacterium
GGLPNDR

SEQ ID NO: 260649 - protein, 10 aa, Mycobacterium
GGLPPGEALP

SEQ ID NO: 260650 - protein, 14 aa, Mycobacterium
GGLPTSEDPAEPSA

SEQ ID NO: 260651 - protein, 8 aa, Mycobacterium
GGLRAGDD

SEQ ID NO: 260652 - protein, 5 aa, Mycobacterium
GGLRS

SEQ ID NO: 260653 - protein, 17 aa, Mycobacterium
GGLTATTRARDSDRQDT

SEQ ID NO: 260654 - protein, 6 aa, Mycobacterium
GGLTPA

SEQ ID NO: 260655 - protein, 5 aa, Mycobacterium
GGLTT

SEQ ID NO: 260656 - protein, 20 aa, Mycobacterium
GGLTTGAPVRVSGAPAGQVQ

SEQ ID NO: 260657 - protein, 5 aa, Mycobacterium
GGMEL

SEQ ID NO: 260658 - protein, 4 aa, Mycobacterium
GGMG

SEQ ID NO: 260659 - protein, 6 aa, Mycobacterium
GGMGAG

SEQ ID NO: 260660 - protein, 11 aa, Mycobacterium
GGMPQGLAPDG

SEQ ID NO: 260661 - protein, 6 aa, Mycobacterium
GGMSAG

SEQ ID NO: 260662 - protein, 4 aa, Mycobacterium
GGNA

SEQ ID NO: 260663 - protein, 5 aa, Mycobacterium
GGNAA

SEQ ID NO: 260664 - protein, 14 aa, Mycobacterium
GGNGAPADPATQTA

SEQ ID NO: 260665 - protein, 6 aa, Mycobacterium
GGNGFS

SEQ ID NO: 260666 - protein, 9 aa, Mycobacterium
GGNGPGVAA

SEQ ID NO: 260667 - protein, 7 aa, Mycobacterium
GGNLGPV

SEQ ID NO: 260668 - protein, 15 aa, Mycobacterium
GGNNDGASANIPRKL

SEQ ID NO: 260669 - protein, 10 aa, Mycobacterium
GGNPAAAALS

SEQ ID NO: 260670 - protein, 8 aa, Mycobacterium
GGNPQSAD

SEQ ID NO: 260671 - protein, 8 aa, Mycobacterium
GGNPRNVQ

SEQ ID NO: 260672 - protein, 4 aa, Mycobacterium
GGNR

SEQ ID NO: 260673 - protein, 11 aa, Mycobacterium
GGNRESGHGAT

SEQ ID NO: 260674 - protein, 13 aa, Mycobacterium
GGNRGESLANESV

SEQ ID NO: 260675 - protein, 7 aa, Mycobacterium
GGNRQSA

SEQ ID NO: 260676 - protein, 17 aa, Mycobacterium
GGNRTGPPAGATGIADG

SEQ ID NO: 260677 - protein, 7 aa, Mycobacterium
GGNTRNV

SEQ ID NO: 260678 - protein, 8 aa, Mycobacterium
GGNVPGKK

SEQ ID NO: 260679 - protein, 7 aa, Mycobacterium
GGNYDPT

SEQ ID NO: 260680 - protein, 6 aa, Mycobacterium
GGPADF

SEQ ID NO: 260681 - protein, 5 aa, Mycobacterium
GGPAE

SEQ ID NO: 260682 - protein, 7 aa, Mycobacterium
GGPAGAL

SEQ ID NO: 260683 - protein, 8 aa, Mycobacterium
GGPAGRSV

SEQ ID NO: 260684 - protein, 9 aa, Mycobacterium
GGPAGSDLG

SEQ ID NO: 260685 - protein, 9 aa, Mycobacterium
GGPAPTPRP

SEQ ID NO: 260686 - protein, 5 aa, Mycobacterium
GGPAR

SEQ ID NO: 260687 - protein, 5 aa, Mycobacterium
GGPAS

SEQ ID NO: 260688 - protein, 6 aa, Mycobacterium
GGPAVG

SEQ ID NO: 260689 - protein, 6 aa, Mycobacterium
GGPDID

SEQ ID NO: 260690 - protein, 7 aa, Mycobacterium
GGPDRPL

SEQ ID NO: 260691 - protein, 6 aa, Mycobacterium
GGPDRR

SEQ ID NO: 260692 - protein, 7 aa, Mycobacterium
GGPEAVA

SEQ ID NO: 260693 - protein, 70 aa, Mycobacterium
GGPEGGMQRGGGDWNRDRDRGRSGDHGRDWDRDRDRGGQGDRDQRGDRDSDGPASPGWQRTPPTGQPPGV

SEQ ID NO: 260694 - protein, 5 aa, Mycobacterium
GGPEI

SEQ ID NO: 260695 - protein, 30 aa, Mycobacterium
GGPELTPAALTNGETLEADGAPTDDEDVEG

SEQ ID NO: 260696 - protein, 8 aa, Mycobacterium
GGPERQSS

SEQ ID NO: 260697 - protein, 33 aa, Mycobacterium
GGPEVNTPAIPTDGDLPEVEGPDDDVEGIRTPK

SEQ ID NO: 260698 - protein, 14 aa, Mycobacterium
GGPFARRTPDRPHP

SEQ ID NO: 260699 - protein, 5 aa, Mycobacterium
GGPGA

SEQ ID NO: 260700 - protein, 6 aa, Mycobacterium
GGPGAG

SEQ ID NO: 260701 - protein, 6 aa, Mycobacterium
GGPGAV

SEQ ID NO: 260702 - protein, 5 aa, Mycobacterium
GGPGD

SEQ ID NO: 260703 - protein, 8 aa, Mycobacterium
GGPGFSTS

SEQ ID NO: 260704 - protein, 5 aa, Mycobacterium
GGPGG

SEQ ID NO: 260705 - protein, 39 aa, Mycobacterium
GGPGGPGGQAGVQQGGPASATPGAPGPGQIPSSVAPSRT

SEQ ID NO: 260706 - protein, 6 aa, Mycobacterium
GGPGPV

SEQ ID NO: 260707 - protein, 8 aa, Mycobacterium
GGPGSTRV

SEQ ID NO: 260708 - protein, 7 aa, Mycobacterium
GGPGTRM

SEQ ID NO: 260709 - protein, 7 aa, Mycobacterium
GGPGVAT

SEQ ID NO: 260710 - protein, 6 aa, Mycobacterium
GGPHRC

SEQ ID NO: 260711 - protein, 13 aa, Mycobacterium
GGPHRGERDDDTA

SEQ ID NO: 260712 - protein, 13 aa, Mycobacterium
GGPHTDQTLDGPG

SEQ ID NO: 260713 - protein, 5 aa, Mycobacterium
GGPIS

SEQ ID NO: 260714 - protein, 4 aa, Mycobacterium
GGPK

SEQ ID NO: 260715 - protein, 7 aa, Mycobacterium
GGPKVGD

SEQ ID NO: 260716 - protein, 10 aa, Mycobacterium
GGPLAEPPLT

SEQ ID NO: 260717 - protein, 5 aa, Mycobacterium
GGPLR

SEQ ID NO: 260718 - protein, 16 aa, Mycobacterium
GGPLSYAPSVGDYTRR

SEQ ID NO: 260719 - protein, 10 aa, Mycobacterium
GGPMAETRPV

SEQ ID NO: 260720 - protein, 6 aa, Mycobacterium
GGPNEP

SEQ ID NO: 260721 - protein, 33 aa, Mycobacterium
GGPNGGVPAVSPSTGPGGPTQVPTSVAPATTPG

SEQ ID NO: 260722 - protein, 11 aa, Mycobacterium
GGPPADRNQRQ

SEQ ID NO: 260723 - protein, 15 aa, Mycobacterium
GGPPDPSKGRCAFKN

SEQ ID NO: 260724 - protein, 14 aa, Mycobacterium
GGPPDPSKGRCSED

SEQ ID NO: 260725 - protein, 7 aa, Mycobacterium
GGPPTAL

SEQ ID NO: 260726 - protein, 5 aa, Mycobacterium
GGPQI

SEQ ID NO: 260727 - protein, 20 aa, Mycobacterium
GGPQQPTQPAAPGNPNAGSL

SEQ ID NO: 260728 - protein, 8 aa, Mycobacterium
GGPRPVTV

SEQ ID NO: 260729 - protein, 7 aa, Mycobacterium
GGPRRKG

SEQ ID NO: 260730 - protein, 8 aa, Mycobacterium
GGPRRQPY

SEQ ID NO: 260731 - protein, 6 aa, Mycobacterium
GGPRRR

SEQ ID NO: 260732 - protein, 10 aa, Mycobacterium
GGPRSGKSTA

SEQ ID NO: 260733 - protein, 13 aa, Mycobacterium
GGPSATANTASPL

SEQ ID NO: 260734 - protein, 7 aa, Mycobacterium
GGPSGIG

SEQ ID NO: 260735 - protein, 10 aa, Mycobacterium
GGPSGNPPII

SEQ ID NO: 260736 - protein, 24 aa, Mycobacterium
GGPSGNPPVRGRTSGTETATADPL

SEQ ID NO: 260737 - protein, 7 aa, Mycobacterium
GGPSGVA

SEQ ID NO: 260738 - protein, 7 aa, Mycobacterium
GGPSGVG

SEQ ID NO: 260739 - protein, 6 aa, Mycobacterium
GGPSPR

SEQ ID NO: 260740 - protein, 7 aa, Mycobacterium
GGPSRAD

SEQ ID NO: 260741 - protein, 13 aa, Mycobacterium
GGPSVDDDLDRDL

SEQ ID NO: 260742 - protein, 6 aa, Mycobacterium
GGPSVS

SEQ ID NO: 260743 - protein, 7 aa, Mycobacterium
GGPTGTL

SEQ ID NO: 260744 - protein, 7 aa, Mycobacterium
GGPTPVG

SEQ ID NO: 260745 - protein, 6 aa, Mycobacterium
GGPTQG

SEQ ID NO: 260746 - protein, 8 aa, Mycobacterium
GGPTSQPQ

SEQ ID NO: 260747 - protein, 4 aa, Mycobacterium
GGPV

SEQ ID NO: 260748 - protein, 5 aa, Mycobacterium
GGPVR

SEQ ID NO: 260749 - protein, 6 aa, Mycobacterium
GGQAGI

SEQ ID NO: 260750 - protein, 29 aa, Mycobacterium
GGQGGPGGPPGGGLGGPPAGGPGGPGGGA

SEQ ID NO: 260751 - protein, 16 aa, Mycobacterium
GGQGVQDTGDAAPSRS

SEQ ID NO: 260752 - protein, 4 aa, Mycobacterium
GGQL

SEQ ID NO: 260753 - protein, 5 aa, Mycobacterium
GGQLR

SEQ ID NO: 260754 - protein, 14 aa, Mycobacterium
GGQPDPSKGRCAFA

SEQ ID NO: 260755 - protein, 6 aa, Mycobacterium
GGQPMS

SEQ ID NO: 260756 - protein, 13 aa, Mycobacterium
GGQQPGDLPPGTV

SEQ ID NO: 260757 - protein, 10 aa, Mycobacterium
GGQQQMSRPK

SEQ ID NO: 260758 - protein, 5 aa, Mycobacterium
GGQQY

SEQ ID NO: 260759 - protein, 16 aa, Mycobacterium
GGQRDEVAAGAAGEGA

SEQ ID NO: 260760 - protein, 8 aa, Mycobacterium
GGQRDPVG

SEQ ID NO: 260761 - protein, 6 aa, Mycobacterium
GGQRYG

SEQ ID NO: 260762 - protein, 9 aa, Mycobacterium
GGQSTAQAS

SEQ ID NO: 260763 - protein, 9 aa, Mycobacterium
GGQTPAQAS

SEQ ID NO: 260764 - protein, 5 aa, Mycobacterium
GGQYR

SEQ ID NO: 260765 - protein, 5 aa, Mycobacterium
GGRAG

SEQ ID NO: 260766 - protein, 13 aa, Mycobacterium
GGRAGFPMDGRSG

SEQ ID NO: 260767 - protein, 8 aa, Mycobacterium
GGRAISSA

SEQ ID NO: 260768 - protein, 15 aa, Mycobacterium
GGRALTAAESTGLER

SEQ ID NO: 260769 - protein, 11 aa, Mycobacterium
GGRDIGAAPTR

SEQ ID NO: 260770 - protein, 8 aa, Mycobacterium
GGREDAGV

SEQ ID NO: 260771 - protein, 6 aa, Mycobacterium
GGRFGK

SEQ ID NO: 260772 - protein, 12 aa, Mycobacterium
GGRFSKDIPGLK

SEQ ID NO: 260773 - protein, 8 aa, Mycobacterium
GGRGGVGG

SEQ ID NO: 260774 - protein, 6 aa, Mycobacterium
GGRGPA

SEQ ID NO: 260775 - protein, 26 aa, Mycobacterium
GGRGPSPGGTTTPTTTPTTATPSTSI

SEQ ID NO: 260776 - protein, 6 aa, Mycobacterium
GGRGSL

SEQ ID NO: 260777 - protein, 6 aa, Mycobacterium
GGRIAA

SEQ ID NO: 260778 - protein, 9 aa, Mycobacterium
GGRLPAKEL

SEQ ID NO: 260779 - protein, 4 aa, Mycobacterium
GGRM

SEQ ID NO: 260780 - protein, 7 aa, Mycobacterium
GGRMAPE

SEQ ID NO: 260781 - protein, 6 aa, Mycobacterium
GGRNGQ

SEQ ID NO: 260782 - protein, 4 aa, Mycobacterium
GGRP

SEQ ID NO: 260783 - protein, 7 aa, Mycobacterium
GGRPAAA

SEQ ID NO: 260784 - protein, 12 aa, Mycobacterium
GGRPGADGRESG

SEQ ID NO: 260785 - protein, 8 aa, Mycobacterium
GGRPGGLR

SEQ ID NO: 260786 - protein, 6 aa, Mycobacterium
GGRPHT

SEQ ID NO: 260787 - protein, 16 aa, Mycobacterium
GGRPIAPADAAHNRAR

SEQ ID NO: 260788 - protein, 20 aa, Mycobacterium
GGRPPLLDGPPPWDEVAIER

SEQ ID NO: 260789 - protein, 9 aa, Mycobacterium
GGRPSPTDG

SEQ ID NO: 260790 - protein, 6 aa, Mycobacterium
GGRQIG

SEQ ID NO: 260791 - protein, 9 aa, Mycobacterium
GGRQPTAAD

SEQ ID NO: 260792 - protein, 4 aa, Mycobacterium
GGRR

SEQ ID NO: 260793 - protein, 9 aa, Mycobacterium
GGRRADQRA

SEQ ID NO: 260794 - protein, 7 aa, Mycobacterium
GGRRAQA

SEQ ID NO: 260795 - protein, 13 aa, Mycobacterium
GGRRKDPGPPGRV

SEQ ID NO: 260796 - protein, 5 aa, Mycobacterium
GGRRS

SEQ ID NO: 260797 - protein, 8 aa, Mycobacterium
GGRRVDRR

SEQ ID NO: 260798 - protein, 10 aa, Mycobacterium
GGRSGATTAL

SEQ ID NO: 260799 - protein, 8 aa, Mycobacterium
GGRSGLPV

SEQ ID NO: 260800 - protein, 5 aa, Mycobacterium
GGRSI

SEQ ID NO: 260801 - protein, 10 aa, Mycobacterium
GGRSPPATPH

SEQ ID NO: 260802 - protein, 5 aa, Mycobacterium
GGRSR

SEQ ID NO: 260803 - protein, 7 aa, Mycobacterium
GGRTATT

SEQ ID NO: 260804 - protein, 5 aa, Mycobacterium
GGRTF

SEQ ID NO: 260805 - protein, 8 aa, Mycobacterium
GGRTVTAV

SEQ ID NO: 260806 - protein, 5 aa, Mycobacterium
GGRYE

SEQ ID NO: 260807 - protein, 4 aa, Mycobacterium
GGSA

SEQ ID NO: 260808 - protein, 6 aa, Mycobacterium
GGSADI

SEQ ID NO: 260809 - protein, 6 aa, Mycobacterium
GGSAGG

SEQ ID NO: 260810 - protein, 6 aa, Mycobacterium
GGSAGS

SEQ ID NO: 260811 - protein, 10 aa, Mycobacterium
GGSALAAGNS

SEQ ID NO: 260812 - protein, 15 aa, Mycobacterium
GGSALANDQQISGDR

SEQ ID NO: 260813 - protein, 10 aa, Mycobacterium
GGSALSAGNS

SEQ ID NO: 260814 - protein, 96 aa, Mycobacterium
GGSAPSGAPDAPPRNEPPRNDPPRNEPAPRNDRTDVVRPEPKPRPEGGRPEGAAYASELPDLSGPRPPQPPRKPVERPSTESKPPAKGSPSPAGRV

SEQ ID NO: 260815 - protein, 22 aa, Mycobacterium
GGSARTAQLAATESVRTATEST

SEQ ID NO: 260816 - protein, 8 aa, Mycobacterium
GGSATPAT

SEQ ID NO: 260817 - protein, 6 aa, Mycobacterium
GGSATV

SEQ ID NO: 260818 - protein, 26 aa, Mycobacterium
GGSDAGAAGGAAEQGTVKATSASDAA

SEQ ID NO: 260819 - protein, 16 aa, Mycobacterium
GGSDANGADGEDDETD

SEQ ID NO: 260820 - protein, 40 aa, Mycobacterium
GGSDPQPPRIAAPPSSSSDTSTPPSTSAVEGVSGTDSQGF

SEQ ID NO: 260821 - protein, 11 aa, Mycobacterium
GGSDRPAQPAR

SEQ ID NO: 260822 - protein, 7 aa, Mycobacterium
GGSEGLA

SEQ ID NO: 260823 - protein, 5 aa, Mycobacterium
GGSET

SEQ ID NO: 260824 - protein, 23 aa, Mycobacterium
GGSFNNDTECVNGPRGNSADHLT

SEQ ID NO: 260825 - protein, 4 aa, Mycobacterium
GGSG

SEQ ID NO: 260826 - protein, 9 aa, Mycobacterium
GGSGAGKTT

SEQ ID NO: 260827 - protein, 6 aa, Mycobacterium
GGSGAI

SEQ ID NO: 260828 - protein, 9 aa, Mycobacterium
GGSGAPIGT

SEQ ID NO: 260829 - protein, 30 aa, Mycobacterium
GGSGASTGPNGSNVSTPPATNGDIAATAPA

SEQ ID NO: 260830 - protein, 10 aa, Mycobacterium
GGSGDPTDID

SEQ ID NO: 260831 - protein, 14 aa, Mycobacterium
GGSGGEAADGGDPD

SEQ ID NO: 260832 - protein, 35 aa, Mycobacterium
GGSGGVGRAQGGSGGVGRAQGGSGGVGRAQNGRRI

SEQ ID NO: 260833 - protein, 7 aa, Mycobacterium
GGSGGVV

SEQ ID NO: 260834 - protein, 7 aa, Mycobacterium
GGSGITG

SEQ ID NO: 260835 - protein, 8 aa, Mycobacterium
GGSGKLGN

SEQ ID NO: 260836 - protein, 8 aa, Mycobacterium
GGSGKTTA

SEQ ID NO: 260837 - protein, 8 aa, Mycobacterium
GGSGRLGN

SEQ ID NO: 260838 - protein, 12 aa, Mycobacterium
GGSGSNDKDIKE

SEQ ID NO: 260839 - protein, 12 aa, Mycobacterium
GGSGSNDKDIKQ

SEQ ID NO: 260840 - protein, 7 aa, Mycobacterium
GGSGSQY

SEQ ID NO: 260841 - protein, 8 aa, Mycobacterium
GGSGSSIT

SEQ ID NO: 260842 - protein, 12 aa, Mycobacterium
GGSGSSVTLADA

SEQ ID NO: 260843 - protein, 8 aa, Mycobacterium
GGSGTMSN

SEQ ID NO: 260844 - protein, 8 aa, Mycobacterium
GGSGTSAT

SEQ ID NO: 260845 - protein, 7 aa, Mycobacterium
GGSGTSM

SEQ ID NO: 260846 - protein, 8 aa, Mycobacterium
GGSGTSVT

SEQ ID NO: 260847 - protein, 10 aa, Mycobacterium
GGSGTVEATA

SEQ ID NO: 260848 - protein, 5 aa, Mycobacterium
GGSHP

SEQ ID NO: 260849 - protein, 19 aa, Mycobacterium
GGSHQDAHAGDHDGHDPHD

SEQ ID NO: 260850 - protein, 4 aa, Mycobacterium
GGSI

SEQ ID NO: 260851 - protein, 13 aa, Mycobacterium
GGSIDHGELATAG

SEQ ID NO: 260852 - protein, 10 aa, Mycobacterium
GGSKGLGTAV

SEQ ID NO: 260853 - protein, 8 aa, Mycobacterium
GGSKPYGY

SEQ ID NO: 260854 - protein, 9 aa, Mycobacterium
GGSKPYGYS

SEQ ID NO: 260855 - protein, 4 aa, Mycobacterium
GGSL

SEQ ID NO: 260856 - protein, 13 aa, Mycobacterium
GGSLSIDAALKKK

SEQ ID NO: 260857 - protein, 18 aa, Mycobacterium
GGSLTGPTRGVDQGADTV

SEQ ID NO: 260858 - protein, 5 aa, Mycobacterium
GGSMG

SEQ ID NO: 260859 - protein, 9 aa, Mycobacterium
GGSNDTGSV

SEQ ID NO: 260860 - protein, 9 aa, Mycobacterium
GGSNNTGSV

SEQ ID NO: 260861 - protein, 7 aa, Mycobacterium
GGSPAQA

SEQ ID NO: 260862 - protein, 21 aa, Mycobacterium
GGSPDGDRPGDTVDGGSCGQG

SEQ ID NO: 260863 - protein, 8 aa, Mycobacterium
GGSPDRAF

SEQ ID NO: 260864 - protein, 10 aa, Mycobacterium
GGSPGDKSAF

SEQ ID NO: 260865 - protein, 6 aa, Mycobacterium
GGSPLE

SEQ ID NO: 260866 - protein, 13 aa, Mycobacterium
GGSPLQVSGPAAG

SEQ ID NO: 260867 - protein, 6 aa, Mycobacterium
GGSPLR

SEQ ID NO: 260868 - protein, 5 aa, Mycobacterium
GGSPV

SEQ ID NO: 260869 - protein, 9 aa, Mycobacterium
GGSQAEESA

SEQ ID NO: 260870 - protein, 5 aa, Mycobacterium
GGSQR

SEQ ID NO: 260871 - protein, 9 aa, Mycobacterium
GGSQTTSRP

SEQ ID NO: 260872 - protein, 4 aa, Mycobacterium
GGSR

SEQ ID NO: 260873 - protein, 5 aa, Mycobacterium
GGSRL

SEQ ID NO: 260874 - protein, 7 aa, Mycobacterium
GGSRLDK

SEQ ID NO: 260875 - protein, 9 aa, Mycobacterium
GGSRPYGYS

SEQ ID NO: 260876 - protein, 11 aa, Mycobacterium
GGSRRRVAPGA

SEQ ID NO: 260877 - protein, 6 aa, Mycobacterium
GGSRRS

SEQ ID NO: 260878 - protein, 5 aa, Mycobacterium
GGSSL

SEQ ID NO: 260879 - protein, 14 aa, Mycobacterium
GGSSQFEEPTGSIA

SEQ ID NO: 260880 - protein, 15 aa, Mycobacterium
GGSTAVGDDQVTATA

SEQ ID NO: 260881 - protein, 17 aa, Mycobacterium
GGSTAVGDGQLTSSAET

SEQ ID NO: 260882 - protein, 7 aa, Mycobacterium
GGSTDLP

SEQ ID NO: 260883 - protein, 19 aa, Mycobacterium
GGSTGSSDAATLGVSGAEH

SEQ ID NO: 260884 - protein, 20 aa, Mycobacterium
GGSTVATKIAGTAAQFNDQY

SEQ ID NO: 260885 - protein, 15 aa, Mycobacterium
GGSTVTVTASGGQPI

SEQ ID NO: 260886 - protein, 5 aa, Mycobacterium
GGSTW

SEQ ID NO: 260887 - protein, 5 aa, Mycobacterium
GGSVG

SEQ ID NO: 260888 - protein, 6 aa, Mycobacterium
GGSYSI

SEQ ID NO: 260889 - protein, 14 aa, Mycobacterium
GGTAATYKDMHDGS

SEQ ID NO: 260890 - protein, 15 aa, Mycobacterium
GGTAATYKDMRDGSN

SEQ ID NO: 260891 - protein, 6 aa, Mycobacterium
GGTADF

SEQ ID NO: 260892 - protein, 15 aa, Mycobacterium
GGTAELSTDQGEGTE

SEQ ID NO: 260893 - protein, 6 aa, Mycobacterium
GGTAEV

SEQ ID NO: 260894 - protein, 5 aa, Mycobacterium
GGTAL

SEQ ID NO: 260895 - protein, 6 aa, Mycobacterium
GGTAPA

SEQ ID NO: 260896 - protein, 7 aa, Mycobacterium
GGTAPAI

SEQ ID NO: 260897 - protein, 7 aa, Mycobacterium
GGTAPAV

SEQ ID NO: 260898 - protein, 86 aa, Mycobacterium
GGTAQADPAESSSDDSVAATAPAGSRPDRPARPPDAERPSRIERAASGNSEDVAADRDPETARRTPRKPDAGERPLERPDSPLPGP

SEQ ID NO: 260899 - protein, 15 aa, Mycobacterium
GGTAQLSTNTGEGTE

SEQ ID NO: 260900 - protein, 7 aa, Mycobacterium
GGTARDV

SEQ ID NO: 260901 - protein, 23 aa, Mycobacterium
GGTASLQNSPLGGARLLLKLPGP

SEQ ID NO: 260902 - protein, 5 aa, Mycobacterium
GGTET

SEQ ID NO: 260903 - protein, 8 aa, Mycobacterium
GGTEVAKD

SEQ ID NO: 260904 - protein, 20 aa, Mycobacterium
GGTFDNDTECVNGPRGNAAD

SEQ ID NO: 260905 - protein, 12 aa, Mycobacterium
GGTGAPPYGPAW

SEQ ID NO: 260906 - protein, 5 aa, Mycobacterium
GGTGG

SEQ ID NO: 260907 - protein, 6 aa, Mycobacterium
GGTGGL

SEQ ID NO: 260908 - protein, 7 aa, Mycobacterium
GGTGGSL

SEQ ID NO: 260909 - protein, 7 aa, Mycobacterium
GGTGMAG

SEQ ID NO: 260910 - protein, 8 aa, Mycobacterium
GGTGMAGS

SEQ ID NO: 260911 - protein, 5 aa, Mycobacterium
GGTGP

SEQ ID NO: 260912 - protein, 6 aa, Mycobacterium
GGTGSV

SEQ ID NO: 260913 - protein, 7 aa, Mycobacterium
GGTGTSI

SEQ ID NO: 260914 - protein, 5 aa, Mycobacterium
GGTIS

SEQ ID NO: 260915 - protein, 4 aa, Mycobacterium
GGTK

SEQ ID NO: 260916 - protein, 16 aa, Mycobacterium
GGTKVSLPAAGAQGTI

SEQ ID NO: 260917 - protein, 6 aa, Mycobacterium
GGTLRQ

SEQ ID NO: 260918 - protein, 6 aa, Mycobacterium
GGTLSS

SEQ ID NO: 260919 - protein, 4 aa, Mycobacterium
GGTN

SEQ ID NO: 260920 - protein, 8 aa, Mycobacterium
GGTNGNAD

SEQ ID NO: 260921 - protein, 8 aa, Mycobacterium
GGTNGTAD

SEQ ID NO: 260922 - protein, 7 aa, Mycobacterium
GGTPHDI

SEQ ID NO: 260923 - protein, 8 aa, Mycobacterium
GGTPHGIP

SEQ ID NO: 260924 - protein, 6 aa, Mycobacterium
GGTPLR

SEQ ID NO: 260925 - protein, 8 aa, Mycobacterium
GGTPREIP

SEQ ID NO: 260926 - protein, 21 aa, Mycobacterium
GGTPRPGVGTPAVQGEPETER

SEQ ID NO: 260927 - protein, 28 aa, Mycobacterium
GGTPRPKPGPYRSPDREHAPKGPSEAAR

SEQ ID NO: 260928 - protein, 9 aa, Mycobacterium
GGTPSGIPH

SEQ ID NO: 260929 - protein, 17 aa, Mycobacterium
GGTPTPELPQPPTDSRT

SEQ ID NO: 260930 - protein, 7 aa, Mycobacterium
GGTQAEA

SEQ ID NO: 260931 - protein, 5 aa, Mycobacterium
GGTRG

SEQ ID NO: 260932 - protein, 4 aa, Mycobacterium
GGTS

SEQ ID NO: 260933 - protein, 6 aa, Mycobacterium
GGTSAL

SEQ ID NO: 260934 - protein, 5 aa, Mycobacterium
GGTSS

SEQ ID NO: 260935 - protein, 9 aa, Mycobacterium
GGTSSIGPG

SEQ ID NO: 260936 - protein, 6 aa, Mycobacterium
GGTSTA

SEQ ID NO: 260937 - protein, 8 aa, Mycobacterium
GGTSTTLE

SEQ ID NO: 260938 - protein, 7 aa, Mycobacterium
GGTTELG

SEQ ID NO: 260939 - protein, 6 aa, Mycobacterium
GGTTGP

SEQ ID NO: 260940 - protein, 7 aa, Mycobacterium
GGTTGPV

SEQ ID NO: 260941 - protein, 10 aa, Mycobacterium
GGTTVSFPRG

SEQ ID NO: 260942 - protein, 16 aa, Mycobacterium
GGTTVSFPRGDSQVTQ

SEQ ID NO: 260943 - protein, 21 aa, Mycobacterium
GGTTVSMPAAGATGQVQTSQV

SEQ ID NO: 260944 - protein, 18 aa, Mycobacterium
GGTTVSMPANGTHGTVHT

SEQ ID NO: 260945 - protein, 4 aa, Mycobacterium
GGTY

SEQ ID NO: 260946 - protein, 8 aa, Mycobacterium
GGVDVTGA

SEQ ID NO: 260947 - protein, 5 aa, Mycobacterium
GGVEG

SEQ ID NO: 260948 - protein, 18 aa, Mycobacterium
GGVGDTSLSGRTCPNPTP

SEQ ID NO: 260949 - protein, 4 aa, Mycobacterium
GGVI

SEQ ID NO: 260950 - protein, 15 aa, Mycobacterium
GGVNAAADALGPGAL

SEQ ID NO: 260951 - protein, 7 aa, Mycobacterium
GGVPGLS

SEQ ID NO: 260952 - protein, 7 aa, Mycobacterium
GGVPGNN

SEQ ID NO: 260953 - protein, 16 aa, Mycobacterium
GGVRSRLRGARDRVPG

SEQ ID NO: 260954 - protein, 19 aa, Mycobacterium
GGVRVSGDPERSREGSPLY

SEQ ID NO: 260955 - protein, 8 aa, Mycobacterium
GGVSGGTV

SEQ ID NO: 260956 - protein, 13 aa, Mycobacterium
GGVSPTVKKGDTF

SEQ ID NO: 260957 - protein, 6 aa, Mycobacterium
GGVSSD

SEQ ID NO: 260958 - protein, 8 aa, Mycobacterium
GGVSSTAF

SEQ ID NO: 260959 - protein, 4 aa, Mycobacterium
GGVT

SEQ ID NO: 260960 - protein, 7 aa, Mycobacterium
GGVTGPL

SEQ ID NO: 260961 - protein, 6 aa, Mycobacterium
GGVTPE

SEQ ID NO: 260962 - protein, 4 aa, Mycobacterium
GGWG

SEQ ID NO: 260963 - protein, 17 aa, Mycobacterium
GGWGDPSGSPSAVDSDA

SEQ ID NO: 260964 - protein, 18 aa, Mycobacterium
GGWGDPTSSAKSGTDGSL

SEQ ID NO: 260965 - protein, 21 aa, Mycobacterium
GGWGDPTSSAKSSSDGPAPVD

SEQ ID NO: 260966 - protein, 12 aa, Mycobacterium
GGWQENEGPEDL

SEQ ID NO: 260967 - protein, 36 aa, Mycobacterium
GGWRPPDWPPPGYPYDPNRPYPGWQPPQRKPSGGEI

SEQ ID NO: 260968 - protein, 26 aa, Mycobacterium
GGWSPTSFGGSSGGSSGGGFMGGGGR

SEQ ID NO: 260969 - protein, 5 aa, Mycobacterium
GGYAP

SEQ ID NO: 260970 - protein, 20 aa, Mycobacterium
GGYARSDGDQLSLTPAGAQQ

SEQ ID NO: 260971 - protein, 13 aa, Mycobacterium
GGYATGQADGAPF

SEQ ID NO: 260972 - protein, 5 aa, Mycobacterium
GGYDG

SEQ ID NO: 260973 - protein, 6 aa, Mycobacterium
GGYETA

SEQ ID NO: 260974 - protein, 7 aa, Mycobacterium
GGYETAS

SEQ ID NO: 260975 - protein, 4 aa, Mycobacterium
GGYG

SEQ ID NO: 260976 - protein, 44 aa, Mycobacterium
GGYGPAGFPPPRYPPPPGYGPPPGWQPPGYGAPGYPPPYGGPPV

SEQ ID NO: 260977 - protein, 28 aa, Mycobacterium
GGYPGYPPPGYADPYGYGAYGQTGGTNG

SEQ ID NO: 260978 - protein, 9 aa, Mycobacterium
GGYRGKTGD

SEQ ID NO: 260979 - protein, 5 aa, Mycobacterium
GGYRQ

SEQ ID NO: 260980 - protein, 10 aa, Mycobacterium
GGYSATSAGL

SEQ ID NO: 260981 - protein, 14 aa, Mycobacterium
GGYSFPSGHAAGTA

SEQ ID NO: 260982 - protein, 4 aa, Mycobacterium
GGYT

SEQ ID NO: 260983 - protein, 6 aa, Mycobacterium
GHADRE

SEQ ID NO: 260984 - protein, 5 aa, Mycobacterium
GHADS

SEQ ID NO: 260985 - protein, 22 aa, Mycobacterium
GHADTENGHPLPVRDPDAVRAS

SEQ ID NO: 260986 - protein, 14 aa, Mycobacterium
GHAEPTTLATPVDR

SEQ ID NO: 260987 - protein, 8 aa, Mycobacterium
GHAGGQPG

SEQ ID NO: 260988 - protein, 18 aa, Mycobacterium
GHAGQALQTAGRGATRDT

SEQ ID NO: 260989 - protein, 8 aa, Mycobacterium
GHAGRRRA

SEQ ID NO: 260990 - protein, 27 aa, Mycobacterium
GHAPSDGVGEPTAADVEASQAEERRAD

SEQ ID NO: 260991 - protein, 4 aa, Mycobacterium
GHAS

SEQ ID NO: 260992 - protein, 11 aa, Mycobacterium
GHASDSGPGDV

SEQ ID NO: 260993 - protein, 7 aa, Mycobacterium
GHATGRD

SEQ ID NO: 260994 - protein, 12 aa, Mycobacterium
GHATSSADSGTP

SEQ ID NO: 260995 - protein, 10 aa, Mycobacterium
GHDATPASDV

SEQ ID NO: 260996 - protein, 5 aa, Mycobacterium
GHDEE

SEQ ID NO: 260997 - protein, 4 aa, Mycobacterium
GHDG

SEQ ID NO: 260998 - protein, 24 aa, Mycobacterium
GHDKSTAVEPSASAPGKPVTDPSG

SEQ ID NO: 260999 - protein, 8 aa, Mycobacterium
GHDKTHDV

SEQ ID NO: 261000 - protein, 24 aa, Mycobacterium
GHDKTPAVTRPAAPEGTTPTDPSG

SEQ ID NO: 261001 - protein, 6 aa, Mycobacterium
GHDLDT

SEQ ID NO: 261002 - protein, 7 aa, Mycobacterium
GHDLRNP

SEQ ID NO: 261003 - protein, 11 aa, Mycobacterium
GHDPNDGVGGD

SEQ ID NO: 261004 - protein, 7 aa, Mycobacterium
GHDTTED

SEQ ID NO: 261005 - protein, 7 aa, Mycobacterium
GHEEGPE

SEQ ID NO: 261006 - protein, 10 aa, Mycobacterium
GHEIGGATAE

SEQ ID NO: 261007 - protein, 9 aa, Mycobacterium
GHEIGGEAA

SEQ ID NO: 261008 - protein, 11 aa, Mycobacterium
GHEIGGPTSEL

SEQ ID NO: 261009 - protein, 6 aa, Mycobacterium
GHELRT

SEQ ID NO: 261010 - protein, 5 aa, Mycobacterium
GHEPE

SEQ ID NO: 261011 - protein, 8 aa, Mycobacterium
GHEQQAAT

SEQ ID NO: 261012 - protein, 8 aa, Mycobacterium
GHERGRRA

SEQ ID NO: 261013 - protein, 7 aa, Mycobacterium
GHERPTR

SEQ ID NO: 261014 - protein, 21 aa, Mycobacterium
GHERPTRLASPAEPVDASARR

SEQ ID NO: 261015 - protein, 8 aa, Mycobacterium
GHETPVRP

SEQ ID NO: 261016 - protein, 6 aa, Mycobacterium
GHETRI

SEQ ID NO: 261017 - protein, 6 aa, Mycobacterium
GHGAEG

SEQ ID NO: 261018 - protein, 5 aa, Mycobacterium
GHGDG

SEQ ID NO: 261019 - protein, 6 aa, Mycobacterium
GHGDHA

SEQ ID NO: 261020 - protein, 6 aa, Mycobacterium
GHGFSA

SEQ ID NO: 261021 - protein, 17 aa, Mycobacterium
GHGGDTAGRKLSANDES

SEQ ID NO: 261022 - protein, 19 aa, Mycobacterium
GHGGHGGHGHSHDGEGGIT

SEQ ID NO: 261023 - protein, 12 aa, Mycobacterium
GHGGPDGPHHQA

SEQ ID NO: 261024 - protein, 14 aa, Mycobacterium
GHGGPGGGARSASQ

SEQ ID NO: 261025 - protein, 10 aa, Mycobacterium
GHGKSPAPRS

SEQ ID NO: 261026 - protein, 6 aa, Mycobacterium
GHGPAN

SEQ ID NO: 261027 - protein, 5 aa, Mycobacterium
GHGPR

SEQ ID NO: 261028 - protein, 9 aa, Mycobacterium
GHGQAKQGI

SEQ ID NO: 261029 - protein, 7 aa, Mycobacterium
GHGQRRA

SEQ ID NO: 261030 - protein, 6 aa, Mycobacterium
GHGREG

SEQ ID NO: 261031 - protein, 7 aa, Mycobacterium
GHGRESD

SEQ ID NO: 261032 - protein, 20 aa, Mycobacterium
GHGRHEDLPARSGTSEGNID

SEQ ID NO: 261033 - protein, 8 aa, Mycobacterium
GHGRHEEL

SEQ ID NO: 261034 - protein, 7 aa, Mycobacterium
GHGRYDE

SEQ ID NO: 261035 - protein, 4 aa, Mycobacterium
GHGS

SEQ ID NO: 261036 - protein, 6 aa, Mycobacterium
GHGTGT

SEQ ID NO: 261037 - protein, 12 aa, Mycobacterium
GHHDGPPTSDDL

SEQ ID NO: 261038 - protein, 5 aa, Mycobacterium
GHHHG

SEQ ID NO: 261039 - protein, 7 aa, Mycobacterium
GHHPGRG

SEQ ID NO: 261040 - protein, 23 aa, Mycobacterium
GHHQPSPARQSQVNEPEGSTPEL

SEQ ID NO: 261041 - protein, 22 aa, Mycobacterium
GHHTRDDGPPSHHSKRGTPSMG

SEQ ID NO: 261042 - protein, 7 aa, Mycobacterium
GHKKDSL

SEQ ID NO: 261043 - protein, 7 aa, Mycobacterium
GHKKEEL

SEQ ID NO: 261044 - protein, 18 aa, Mycobacterium
GHKQPTRLASPIEPATPR

SEQ ID NO: 261045 - protein, 5 aa, Mycobacterium
GHKRE

SEQ ID NO: 261046 - protein, 4 aa, Mycobacterium
GHLT

SEQ ID NO: 261047 - protein, 6 aa, Mycobacterium
GHMRPG

SEQ ID NO: 261048 - protein, 10 aa, Mycobacterium
GHNGAGKSTA

SEQ ID NO: 261049 - protein, 9 aa, Mycobacterium
GHNGGPPAG

SEQ ID NO: 261050 - protein, 7 aa, Mycobacterium
GHNLDST

SEQ ID NO: 261051 - protein, 9 aa, Mycobacterium
GHPAAGSQR

SEQ ID NO: 261052 - protein, 48 aa, Mycobacterium
GHPAGPPAPGRPTPRPAAYPPPRPPAATRAAHPADPNLGAPTQRETQR

SEQ ID NO: 261053 - protein, 9 aa, Mycobacterium
GHPAPSGWA

SEQ ID NO: 261054 - protein, 10 aa, Mycobacterium
GHPDLAPGAV

SEQ ID NO: 261055 - protein, 17 aa, Mycobacterium
GHPGDPAGGLSAYESQR

SEQ ID NO: 261056 - protein, 5 aa, Mycobacterium
GHPGG

SEQ ID NO: 261057 - protein, 7 aa, Mycobacterium
GHPGPSV

SEQ ID NO: 261058 - protein, 20 aa, Mycobacterium
GHPIGSGAIKPGYDPRLTNE

SEQ ID NO: 261059 - protein, 5 aa, Mycobacterium
GHPPG

SEQ ID NO: 261060 - protein, 10 aa, Mycobacterium
GHPQGGGSET

SEQ ID NO: 261061 - protein, 42 aa, Mycobacterium
GHPRSTNNLASAVSSEPDNIRGTVDSARSDRETLANARKEGE

SEQ ID NO: 261062 - protein, 10 aa, Mycobacterium
GHPRYPGQPG

SEQ ID NO: 261063 - protein, 9 aa, Mycobacterium
GHQDRTAAR

SEQ ID NO: 261064 - protein, 4 aa, Mycobacterium
GHQK

SEQ ID NO: 261065 - protein, 9 aa, Mycobacterium
GHQQQTGSC

SEQ ID NO: 261066 - protein, 8 aa, Mycobacterium
GHQRARSE

SEQ ID NO: 261067 - protein, 7 aa, Mycobacterium
GHQTPAR

SEQ ID NO: 261068 - protein, 18 aa, Mycobacterium
GHRAADEPLVEAQAPGAA

SEQ ID NO: 261069 - protein, 5 aa, Mycobacterium
GHRAE

SEQ ID NO: 261070 - protein, 18 aa, Mycobacterium
GHRCPGGKLAPALSRSQG

SEQ ID NO: 261071 - protein, 5 aa, Mycobacterium
GHRDR

SEQ ID NO: 261072 - protein, 5 aa, Mycobacterium
GHRRT

SEQ ID NO: 261073 - protein, 7 aa, Mycobacterium
GHRTAGT

SEQ ID NO: 261074 - protein, 7 aa, Mycobacterium
GHRTPAD

SEQ ID NO: 261075 - protein, 6 aa, Mycobacterium
GHRVAP

SEQ ID NO: 261076 - protein, 7 aa, Mycobacterium
GHSGRDS

SEQ ID NO: 261077 - protein, 7 aa, Mycobacterium
GHSLDTT

SEQ ID NO: 261078 - protein, 6 aa, Mycobacterium
GHSPPW

SEQ ID NO: 261079 - protein, 4 aa, Mycobacterium
GHSR

SEQ ID NO: 261080 - protein, 12 aa, Mycobacterium
GHSSAGGSHDLA

SEQ ID NO: 261081 - protein, 7 aa, Mycobacterium
GHSSGVA

SEQ ID NO: 261082 - protein, 13 aa, Mycobacterium
GHSSSGGAHDIAT

SEQ ID NO: 261083 - protein, 12 aa, Mycobacterium
GHSSSGGAHDLA

SEQ ID NO: 261084 - protein, 6 aa, Mycobacterium
GHSWPA

SEQ ID NO: 261085 - protein, 17 aa, Mycobacterium
GHTAPGVVPPHQGSCRP

SEQ ID NO: 261086 - protein, 9 aa, Mycobacterium
GHTATPVGA

SEQ ID NO: 261087 - protein, 5 aa, Mycobacterium
GHTGA

SEQ ID NO: 261088 - protein, 7 aa, Mycobacterium
GHTGGIS

SEQ ID NO: 261089 - protein, 5 aa, Mycobacterium
GHTNR

SEQ ID NO: 261090 - protein, 5 aa, Mycobacterium
GHTNS

SEQ ID NO: 261091 - protein, 14 aa, Mycobacterium
GHTRYPVTGSHPDD

SEQ ID NO: 261092 - protein, 4 aa, Mycobacterium
GHTT

SEQ ID NO: 261093 - protein, 7 aa, Mycobacterium
GHTTPAR

SEQ ID NO: 261094 - protein, 22 aa, Mycobacterium
GHVPPSPGARGDAEEDDFYHPA

SEQ ID NO: 261095 - protein, 13 aa, Mycobacterium
GHWPTEPSPAPET

SEQ ID NO: 261096 - protein, 8 aa, Mycobacterium
GIAEPESY

SEQ ID NO: 261097 - protein, 4 aa, Mycobacterium
GIAH

SEQ ID NO: 261098 - protein, 7 aa, Mycobacterium
GIAPAGG

SEQ ID NO: 261099 - protein, 8 aa, Mycobacterium
GIAPDDRV

SEQ ID NO: 261100 - protein, 5 aa, Mycobacterium
GIAPH

SEQ ID NO: 261101 - protein, 5 aa, Mycobacterium
GIAPR

SEQ ID NO: 261102 - protein, 5 aa, Mycobacterium
GIARS

SEQ ID NO: 261103 - protein, 5 aa, Mycobacterium
GIASA

SEQ ID NO: 261104 - protein, 7 aa, Mycobacterium
GIDENAL

SEQ ID NO: 261105 - protein, 4 aa, Mycobacterium
GIDG

SEQ ID NO: 261106 - protein, 9 aa, Mycobacterium
GIDGSPSKF

SEQ ID NO: 261107 - protein, 10 aa, Mycobacterium
GIDPSAGEAL

SEQ ID NO: 261108 - protein, 9 aa, Mycobacterium
GIDPTTDDG

SEQ ID NO: 261109 - protein, 8 aa, Mycobacterium
GIDPTTDE

SEQ ID NO: 261110 - protein, 5 aa, Mycobacterium
GIDQD

SEQ ID NO: 261111 - protein, 7 aa, Mycobacterium
GIDRGEP

SEQ ID NO: 261112 - protein, 13 aa, Mycobacterium
GIDTAGSESISAD

SEQ ID NO: 261113 - protein, 4 aa, Mycobacterium
GIEG

SEQ ID NO: 261114 - protein, 8 aa, Mycobacterium
GIEPTGAS

SEQ ID NO: 261115 - protein, 9 aa, Mycobacterium
GIEPTGDGV

SEQ ID NO: 261116 - protein, 6 aa, Mycobacterium
GIEQTA

SEQ ID NO: 261117 - protein, 10 aa, Mycobacterium
GIESRRRRAA

SEQ ID NO: 261118 - protein, 4 aa, Mycobacterium
GIEV

SEQ ID NO: 261119 - protein, 5 aa, Mycobacterium
GIEVG

SEQ ID NO: 261120 - protein, 5 aa, Mycobacterium
GIGAG

SEQ ID NO: 261121 - protein, 13 aa, Mycobacterium
GIGARPAARPPVT

SEQ ID NO: 261122 - protein, 7 aa, Mycobacterium
GIGATQA

SEQ ID NO: 261123 - protein, 6 aa, Mycobacterium
GIGGEY

SEQ ID NO: 261124 - protein, 8 aa, Mycobacterium
GIGGQNRD

SEQ ID NO: 261125 - protein, 6 aa, Mycobacterium
GIGIPE

SEQ ID NO: 261126 - protein, 5 aa, Mycobacterium
GIGIT

SEQ ID NO: 261127 - protein, 7 aa, Mycobacterium
GIGKTLA

SEQ ID NO: 261128 - protein, 4 aa, Mycobacterium
GIGP

SEQ ID NO: 261129 - protein, 7 aa, Mycobacterium
GIGPEDT

SEQ ID NO: 261130 - protein, 13 aa, Mycobacterium
GIGPTKSRSPATV

SEQ ID NO: 261131 - protein, 5 aa, Mycobacterium
GIGQA

SEQ ID NO: 261132 - protein, 4 aa, Mycobacterium
GIGS

SEQ ID NO: 261133 - protein, 5 aa, Mycobacterium
GIGSV

SEQ ID NO: 261134 - protein, 14 aa, Mycobacterium
GIKTPRPTATRSRR

SEQ ID NO: 261135 - protein, 8 aa, Mycobacterium
GINDAPAL

SEQ ID NO: 261136 - protein, 10 aa, Mycobacterium
GINDAPALAT

SEQ ID NO: 261137 - protein, 8 aa, Mycobacterium
GINDGPAL

SEQ ID NO: 261138 - protein, 11 aa, Mycobacterium
GINDGPALAGA

SEQ ID NO: 261139 - protein, 10 aa, Mycobacterium
GINDGPALAS

SEQ ID NO: 261140 - protein, 8 aa, Mycobacterium
GINGQTRI

SEQ ID NO: 261141 - protein, 19 aa, Mycobacterium
GINGWGGRKSRDELEATAR

SEQ ID NO: 261142 - protein, 6 aa, Mycobacterium
GIPAGD

SEQ ID NO: 261143 - protein, 12 aa, Mycobacterium
GIPAPQADSPQC

SEQ ID NO: 261144 - protein, 18 aa, Mycobacterium
GIPDASGTLPVDKRPQVS

SEQ ID NO: 261145 - protein, 7 aa, Mycobacterium
GIPDPGD

SEQ ID NO: 261146 - protein, 8 aa, Mycobacterium
GIPDPGDV

SEQ ID NO: 261147 - protein, 9 aa, Mycobacterium
GIPDPRRRS

SEQ ID NO: 261148 - protein, 16 aa, Mycobacterium
GIPEGDTSSFWGSTLF

SEQ ID NO: 261149 - protein, 40 aa, Mycobacterium
GIPEPPSIRYPGGPAPGPIPYPGAPPYGAPRYAPDGTPLY

SEQ ID NO: 261150 - protein, 5 aa, Mycobacterium
GIPES

SEQ ID NO: 261151 - protein, 17 aa, Mycobacterium
GIPETKGSLGGTENTVS

SEQ ID NO: 261152 - protein, 4 aa, Mycobacterium
GIPG

SEQ ID NO: 261153 - protein, 5 aa, Mycobacterium
GIPGV

SEQ ID NO: 261154 - protein, 9 aa, Mycobacterium
GIPGVPDAP

SEQ ID NO: 261155 - protein, 6 aa, Mycobacterium
GIPGVS

SEQ ID NO: 261156 - protein, 6 aa, Mycobacterium
GIPPDD

SEQ ID NO: 261157 - protein, 10 aa, Mycobacterium
GIPPDDRANW

SEQ ID NO: 261158 - protein, 13 aa, Mycobacterium
GIPPQTDDHNRGR

SEQ ID NO: 261159 - protein, 13 aa, Mycobacterium
GIPSPPEPGESPE

SEQ ID NO: 261160 - protein, 5 aa, Mycobacterium
GIQPG

SEQ ID NO: 261161 - protein, 7 aa, Mycobacterium
GIQTSER

SEQ ID NO: 261162 - protein, 7 aa, Mycobacterium
GIRAGSG

SEQ ID NO: 261163 - protein, 5 aa, Mycobacterium
GIRPL

SEQ ID NO: 261164 - protein, 4 aa, Mycobacterium
GIRS

SEQ ID NO: 261165 - protein, 12 aa, Mycobacterium
GIRTSETTRTAF

SEQ ID NO: 261166 - protein, 4 aa, Mycobacterium
GISA

SEQ ID NO: 261167 - protein, 5 aa, Mycobacterium
GISAG

SEQ ID NO: 261168 - protein, 10 aa, Mycobacterium
GISAGNTGER

SEQ ID NO: 261169 - protein, 6 aa, Mycobacterium
GISEQT

SEQ ID NO: 261170 - protein, 6 aa, Mycobacterium
GISESL

SEQ ID NO: 261171 - protein, 5 aa, Mycobacterium
GISEV

SEQ ID NO: 261172 - protein, 5 aa, Mycobacterium
GISGT

SEQ ID NO: 261173 - protein, 10 aa, Mycobacterium
GISSGRSGAQ

SEQ ID NO: 261174 - protein, 10 aa, Mycobacterium
GISSGTRESG

SEQ ID NO: 261175 - protein, 13 aa, Mycobacterium
GISSPKASEFTSR

SEQ ID NO: 261176 - protein, 7 aa, Mycobacterium
GISSRYG

SEQ ID NO: 261177 - protein, 10 aa, Mycobacterium
GISVPADGSL

SEQ ID NO: 261178 - protein, 8 aa, Mycobacterium
GISYGQPA

SEQ ID NO: 261179 - protein, 8 aa, Mycobacterium
GISYSQPA

SEQ ID NO: 261180 - protein, 14 aa, Mycobacterium
GITDENGDEPPRTA

SEQ ID NO: 261181 - protein, 13 aa, Mycobacterium
GITDQNGDEPPRM

SEQ ID NO: 261182 - protein, 5 aa, Mycobacterium
GITET

SEQ ID NO: 261183 - protein, 8 aa, Mycobacterium
GITGKSGT

SEQ ID NO: 261184 - protein, 8 aa, Mycobacterium
GITGPENV

SEQ ID NO: 261185 - protein, 8 aa, Mycobacterium
GITGSTVG

SEQ ID NO: 261186 - protein, 7 aa, Mycobacterium
GITGTAG

SEQ ID NO: 261187 - protein, 4 aa, Mycobacterium
GITN

SEQ ID NO: 261188 - protein, 5 aa, Mycobacterium
GITNQ

SEQ ID NO: 261189 - protein, 5 aa, Mycobacterium
GITPE

SEQ ID NO: 261190 - protein, 6 aa, Mycobacterium
GITPEA

SEQ ID NO: 261191 - protein, 8 aa, Mycobacterium
GITPEAHA

SEQ ID NO: 261192 - protein, 7 aa, Mycobacterium
GITPQAH

SEQ ID NO: 261193 - protein, 13 aa, Mycobacterium
GITRPEGTPIANT

SEQ ID NO: 261194 - protein, 12 aa, Mycobacterium
GITRPEGTPIER

SEQ ID NO: 261195 - protein, 12 aa, Mycobacterium
GITRPTGEPLEE

SEQ ID NO: 261196 - protein, 11 aa, Mycobacterium
GITRPTGNVPE

SEQ ID NO: 261197 - protein, 7 aa, Mycobacterium
GITSQPE

SEQ ID NO: 261198 - protein, 11 aa, Mycobacterium
GITYSNPGHAV

SEQ ID NO: 261199 - protein, 20 aa, Mycobacterium
GIVGQDGNSDGVLEDPAPAI

SEQ ID NO: 261200 - protein, 5 aa, Mycobacterium
GIYNG

SEQ ID NO: 261201 - protein, 4 aa, Mycobacterium
GIYP

SEQ ID NO: 261202 - protein, 6 aa, Mycobacterium
GIYSGD

SEQ ID NO: 261203 - protein, 7 aa, Mycobacterium
GIYTPEG

SEQ ID NO: 261204 - protein, 5 aa, Mycobacterium
GKAAA

SEQ ID NO: 261205 - protein, 6 aa, Mycobacterium
GKAAAI

SEQ ID NO: 261206 - protein, 6 aa, Mycobacterium
GKAAIA

SEQ ID NO: 261207 - protein, 12 aa, Mycobacterium
GKAAKQAENPEN

SEQ ID NO: 261208 - protein, 7 aa, Mycobacterium
GKAAQFG

SEQ ID NO: 261209 - protein, 8 aa, Mycobacterium
GKAAQFGR

SEQ ID NO: 261210 - protein, 9 aa, Mycobacterium
GKADATEDE

SEQ ID NO: 261211 - protein, 6 aa, Mycobacterium
GKAEAI

SEQ ID NO: 261212 - protein, 13 aa, Mycobacterium
GKAERSKPPSILP

SEQ ID NO: 261213 - protein, 66 aa, Mycobacterium
GKAGDGAAAHGTAEPEETAEADEEVDAAASPDEPAGEQTGEKSGEKPRETSGEKSRAKPEEAGPRT

SEQ ID NO: 261214 - protein, 4 aa, Mycobacterium
GKAH

SEQ ID NO: 261215 - protein, 9 aa, Mycobacterium
GKAPAQVST

SEQ ID NO: 261216 - protein, 6 aa, Mycobacterium
GKAQAI

SEQ ID NO: 261217 - protein, 6 aa, Mycobacterium
GKAQQP

SEQ ID NO: 261218 - protein, 6 aa, Mycobacterium
GKARAV

SEQ ID NO: 261219 - protein, 10 aa, Mycobacterium
GKARQAGQRS

SEQ ID NO: 261220 - protein, 9 aa, Mycobacterium
GKARQSGNR

SEQ ID NO: 261221 - protein, 11 aa, Mycobacterium
GKARQTGNRPV

SEQ ID NO: 261222 - protein, 16 aa, Mycobacterium
GKARSVSMSPSDAPSI

SEQ ID NO: 261223 - protein, 9 aa, Mycobacterium
GKARTGAAL

SEQ ID NO: 261224 - protein, 12 aa, Mycobacterium
GKASSGTSGSFG

SEQ ID NO: 261225 - protein, 10 aa, Mycobacterium
GKATEAGRTG

SEQ ID NO: 261226 - protein, 62 aa, Mycobacterium
GKATSGTATEPGPAEDADATAEVTDAAADDGDKADEPAKAAKAPKAKKDKAAGGDGGSPNRF

SEQ ID NO: 261227 - protein, 5 aa, Mycobacterium
GKAVG

SEQ ID NO: 261228 - protein, 9 aa, Mycobacterium
GKCRQTYTG

SEQ ID NO: 261229 - protein, 9 aa, Mycobacterium
GKDANGSDI

SEQ ID NO: 261230 - protein, 8 aa, Mycobacterium
GKDFSKET

SEQ ID NO: 261231 - protein, 9 aa, Mycobacterium
GKDGGGGLT

SEQ ID NO: 261232 - protein, 6 aa, Mycobacterium
GKDGQE

SEQ ID NO: 261233 - protein, 10 aa, Mycobacterium
GKDGRATASI

SEQ ID NO: 261234 - protein, 16 aa, Mycobacterium
GKDKPGPEDGKALQRG

SEQ ID NO: 261235 - protein, 4 aa, Mycobacterium
GKDM

SEQ ID NO: 261236 - protein, 12 aa, Mycobacterium
GKDPYTEGPAAA

SEQ ID NO: 261237 - protein, 8 aa, Mycobacterium
GKDRDPID

SEQ ID NO: 261238 - protein, 7 aa, Mycobacterium
GKDSRAQ

SEQ ID NO: 261239 - protein, 7 aa, Mycobacterium
GKDSRAR

SEQ ID NO: 261240 - protein, 9 aa, Mycobacterium
GKDSSNPGE

SEQ ID NO: 261241 - protein, 63 aa, Mycobacterium
GKDTSEAASGVAPESASAAGAESPAEPAESGAGEAASGGATGPVAGTSEAKPAAKAAAPERNR

SEQ ID NO: 261242 - protein, 8 aa, Mycobacterium
GKDYSRET

SEQ ID NO: 261243 - protein, 10 aa, Mycobacterium
GKEAISDSRS

SEQ ID NO: 261244 - protein, 8 aa, Mycobacterium
GKEGDPTL

SEQ ID NO: 261245 - protein, 7 aa, Mycobacterium
GKEGNTV

SEQ ID NO: 261246 - protein, 9 aa, Mycobacterium
GKEGSPELL

SEQ ID NO: 261247 - protein, 6 aa, Mycobacterium
GKEGWS

SEQ ID NO: 261248 - protein, 4 aa, Mycobacterium
GKEH

SEQ ID NO: 261249 - protein, 6 aa, Mycobacterium
GKEHKG

SEQ ID NO: 261250 - protein, 17 aa, Mycobacterium
GKEPCATVDSADTAIEV

SEQ ID NO: 261251 - protein, 8 aa, Mycobacterium
GKEPFSRD

SEQ ID NO: 261252 - protein, 9 aa, Mycobacterium
GKESRDRLK

SEQ ID NO: 261253 - protein, 29 aa, Mycobacterium
GKETVPSNPDNPKGAFTAARTAKDQGVPI

SEQ ID NO: 261254 - protein, 29 aa, Mycobacterium
GKETVPSNPDNPKGAYTAARTAKDQGVPI

SEQ ID NO: 261255 - protein, 28 aa, Mycobacterium
GKETVPSNPDNPKGAYTAARTAKDQQVP

SEQ ID NO: 261256 - protein, 7 aa, Mycobacterium
GKEVPAS

SEQ ID NO: 261257 - protein, 5 aa, Mycobacterium
GKFGP

SEQ ID NO: 261258 - protein, 4 aa, Mycobacterium
GKFR

SEQ ID NO: 261259 - protein, 7 aa, Mycobacterium
GKGAGFA

SEQ ID NO: 261260 - protein, 5 aa, Mycobacterium
GKGAR

SEQ ID NO: 261261 - protein, 21 aa, Mycobacterium
GKGATFADAPIPGVPPSTDTY

SEQ ID NO: 261262 - protein, 11 aa, Mycobacterium
GKGEDDATPAF

SEQ ID NO: 261263 - protein, 6 aa, Mycobacterium
GKGGQP

SEQ ID NO: 261264 - protein, 10 aa, Mycobacterium
GKGGTEVAKD

SEQ ID NO: 261265 - protein, 7 aa, Mycobacterium
GKGGVGV

SEQ ID NO: 261266 - protein, 11 aa, Mycobacterium
GKGIAAPLPES

SEQ ID NO: 261267 - protein, 5 aa, Mycobacterium
GKGIG

SEQ ID NO: 261268 - protein, 12 aa, Mycobacterium
GKGLEASKRGAA

SEQ ID NO: 261269 - protein, 9 aa, Mycobacterium
GKGLSGPSV

SEQ ID NO: 261270 - protein, 11 aa, Mycobacterium
GKGLSPATARA

SEQ ID NO: 261271 - protein, 17 aa, Mycobacterium
GKGNPVDPTGLAGDATV

SEQ ID NO: 261272 - protein, 7 aa, Mycobacterium
GKGPFHN

SEQ ID NO: 261273 - protein, 5 aa, Mycobacterium
GKGPM

SEQ ID NO: 261274 - protein, 7 aa, Mycobacterium
GKGPPVH

SEQ ID NO: 261275 - protein, 8 aa, Mycobacterium
GKGPSASG

SEQ ID NO: 261276 - protein, 10 aa, Mycobacterium
GKGRPADRPA

SEQ ID NO: 261277 - protein, 4 aa, Mycobacterium
GKGS

SEQ ID NO: 261278 - protein, 10 aa, Mycobacterium
GKGSGPDATR

SEQ ID NO: 261279 - protein, 8 aa, Mycobacterium
GKGSTPVD

SEQ ID NO: 261280 - protein, 9 aa, Mycobacterium
GKGWGEGAV

SEQ ID NO: 261281 - protein, 5 aa, Mycobacterium
GKGYW

SEQ ID NO: 261282 - protein, 4 aa, Mycobacterium
GKHD

SEQ ID NO: 261283 - protein, 6 aa, Mycobacterium
GKHPRD

SEQ ID NO: 261284 - protein, 10 aa, Mycobacterium
GKHQRDTSRA

SEQ ID NO: 261285 - protein, 16 aa, Mycobacterium
GKHSDQPGARKASGGV

SEQ ID NO: 261286 - protein, 4 aa, Mycobacterium
GKIA

SEQ ID NO: 261287 - protein, 6 aa, Mycobacterium
GKIAGN

SEQ ID NO: 261288 - protein, 6 aa, Mycobacterium
GKIDGN

SEQ ID NO: 261289 - protein, 5 aa, Mycobacterium
GKIEA

SEQ ID NO: 261290 - protein, 6 aa, Mycobacterium
GKIPAS

SEQ ID NO: 261291 - protein, 9 aa, Mycobacterium
GKIPQSPAI

SEQ ID NO: 261292 - protein, 11 aa, Mycobacterium
GKKADPTPKGR

SEQ ID NO: 261293 - protein, 12 aa, Mycobacterium
GKKGSPDQLAPG

SEQ ID NO: 261294 - protein, 13 aa, Mycobacterium
GKKQGSRVDESQV

SEQ ID NO: 261295 - protein, 7 aa, Mycobacterium
GKLADQD

SEQ ID NO: 261296 - protein, 9 aa, Mycobacterium
GKLDSDDAV

SEQ ID NO: 261297 - protein, 7 aa, Mycobacterium
GKLPASL

SEQ ID NO: 261298 - protein, 7 aa, Mycobacterium
GKLPDSL

SEQ ID NO: 261299 - protein, 8 aa, Mycobacterium
GKLPSLAE

SEQ ID NO: 261300 - protein, 11 aa, Mycobacterium
GKLRESGKLSA

SEQ ID NO: 261301 - protein, 6 aa, Mycobacterium
GKLTNT

SEQ ID NO: 261302 - protein, 8 aa, Mycobacterium
GKMRPKQA

SEQ ID NO: 261303 - protein, 4 aa, Mycobacterium
GKNA

SEQ ID NO: 261304 - protein, 5 aa, Mycobacterium
GKNAR

SEQ ID NO: 261305 - protein, 31 aa, Mycobacterium
GKNGNDREYDYENNAGTKNSTYTGSGGVPVG

SEQ ID NO: 261306 - protein, 9 aa, Mycobacterium
GKNSPTPGE

SEQ ID NO: 261307 - protein, 46 aa, Mycobacterium
GKNVAPTDAPTTRVPGGNPAGPDAPTTRSSVAGTHRPDRRNADREI

SEQ ID NO: 261308 - protein, 4 aa, Mycobacterium
GKPA

SEQ ID NO: 261309 - protein, 7 aa, Mycobacterium
GKPAMAS

SEQ ID NO: 261310 - protein, 5 aa, Mycobacterium
GKPDF

SEQ ID NO: 261311 - protein, 9 aa, Mycobacterium
GKPEPGRAG

SEQ ID NO: 261312 - protein, 6 aa, Mycobacterium
GKPFPG

SEQ ID NO: 261313 - protein, 4 aa, Mycobacterium
GKPG

SEQ ID NO: 261314 - protein, 8 aa, Mycobacterium
GKPHLGPV

SEQ ID NO: 261315 - protein, 5 aa, Mycobacterium
GKPIA

SEQ ID NO: 261316 - protein, 6 aa, Mycobacterium
GKPIPA

SEQ ID NO: 261317 - protein, 5 aa, Mycobacterium
GKPLD

SEQ ID NO: 261318 - protein, 24 aa, Mycobacterium
GKPLPGSGPAVESEREARALADDV

SEQ ID NO: 261319 - protein, 24 aa, Mycobacterium
GKPLPGSGPAVETEREARALADDV

SEQ ID NO: 261320 - protein, 6 aa, Mycobacterium
GKPLRE

SEQ ID NO: 261321 - protein, 8 aa, Mycobacterium
GKPPDGVS

SEQ ID NO: 261322 - protein, 5 aa, Mycobacterium
GKPPM

SEQ ID NO: 261323 - protein, 5 aa, Mycobacterium
GKPPW

SEQ ID NO: 261324 - protein, 5 aa, Mycobacterium
GKPQD

SEQ ID NO: 261325 - protein, 18 aa, Mycobacterium
GKPSRYRCEPQRQHLVAV

SEQ ID NO: 261326 - protein, 20 aa, Mycobacterium
GKPSRYRSEPQRQHLAAVPA

SEQ ID NO: 261327 - protein, 20 aa, Mycobacterium
GKPSRYRSEPQRQHLASVPA

SEQ ID NO: 261328 - protein, 4 aa, Mycobacterium
GKPV

SEQ ID NO: 261329 - protein, 10 aa, Mycobacterium
GKPVEDGALP

SEQ ID NO: 261330 - protein, 5 aa, Mycobacterium
GKPVG

SEQ ID NO: 261331 - protein, 7 aa, Mycobacterium
GKPVGSS

SEQ ID NO: 261332 - protein, 5 aa, Mycobacterium
GKPVT

SEQ ID NO: 261333 - protein, 5 aa, Mycobacterium
GKPYF

SEQ ID NO: 261334 - protein, 13 aa, Mycobacterium
GKPYTDAQGNTDG

SEQ ID NO: 261335 - protein, 13 aa, Mycobacterium
GKPYVDADGNTDG

SEQ ID NO: 261336 - protein, 9 aa, Mycobacterium
GKQAATHAR

SEQ ID NO: 261337 - protein, 9 aa, Mycobacterium
GKQRANGVK

SEQ ID NO: 261338 - protein, 11 aa, Mycobacterium
GKQYSSNGGAV

SEQ ID NO: 261339 - protein, 18 aa, Mycobacterium
GKRAATPRECRDSKPYVP

SEQ ID NO: 261340 - protein, 18 aa, Mycobacterium
GKRAATPRECRSKEPYVP

SEQ ID NO: 261341 - protein, 9 aa, Mycobacterium
GKRAPAGNH

SEQ ID NO: 261342 - protein, 8 aa, Mycobacterium
GKRAPMTA

SEQ ID NO: 261343 - protein, 6 aa, Mycobacterium
GKRAPT

SEQ ID NO: 261344 - protein, 8 aa, Mycobacterium
GKRAPTAK

SEQ ID NO: 261345 - protein, 15 aa, Mycobacterium
GKRDEEGEPVPGAEA

SEQ ID NO: 261346 - protein, 8 aa, Mycobacterium
GKRGSAAS

SEQ ID NO: 261347 - protein, 9 aa, Mycobacterium
GKRHRESTI

SEQ ID NO: 261348 - protein, 9 aa, Mycobacterium
GKRPFTGDG

SEQ ID NO: 261349 - protein, 9 aa, Mycobacterium
GKRQGKDTA

SEQ ID NO: 261350 - protein, 8 aa, Mycobacterium
GKRQPDVG

SEQ ID NO: 261351 - protein, 7 aa, Mycobacterium
GKRRQPD

SEQ ID NO: 261352 - protein, 8 aa, Mycobacterium
GKRRQPDA

SEQ ID NO: 261353 - protein, 7 aa, Mycobacterium
GKRRQPN

SEQ ID NO: 261354 - protein, 14 aa, Mycobacterium
GKRSTSTGTAPSSS

SEQ ID NO: 261355 - protein, 19 aa, Mycobacterium
GKSADRSRLQYRADAQAAL

SEQ ID NO: 261356 - protein, 11 aa, Mycobacterium
GKSAEATRAAR

SEQ ID NO: 261357 - protein, 7 aa, Mycobacterium
GKSAGGI

SEQ ID NO: 261358 - protein, 6 aa, Mycobacterium
GKSGAD

SEQ ID NO: 261359 - protein, 8 aa, Mycobacterium
GKSGCGKT

SEQ ID NO: 261360 - protein, 9 aa, Mycobacterium
GKSGSGKST

SEQ ID NO: 261361 - protein, 6 aa, Mycobacterium
GKSGTG

SEQ ID NO: 261362 - protein, 9 aa, Mycobacterium
GKSGTGKTT

SEQ ID NO: 261363 - protein, 7 aa, Mycobacterium
GKSLEEI

SEQ ID NO: 261364 - protein, 12 aa, Mycobacterium
GKSSRALTTYGT

SEQ ID NO: 261365 - protein, 4 aa, Mycobacterium
GKSV

SEQ ID NO: 261366 - protein, 7 aa, Mycobacterium
GKSVGSS

SEQ ID NO: 261367 - protein, 7 aa, Mycobacterium
GKTADDF

SEQ ID NO: 261368 - protein, 10 aa, Mycobacterium
GKTAPARGTV

SEQ ID NO: 261369 - protein, 7 aa, Mycobacterium
GKTAPAS

SEQ ID NO: 261370 - protein, 53 aa, Mycobacterium
GKTDTDNADLQADTDPEIADSADSAAEQPVAADASAKAAKGQTNSEERGPRTR

SEQ ID NO: 261371 - protein, 30 aa, Mycobacterium
GKTGADREYDYETSTETKNYTYTGSGGVPI

SEQ ID NO: 261372 - protein, 31 aa, Mycobacterium
GKTGDTDREYDYETNTETKNYTYGGKGGVPI

SEQ ID NO: 261373 - protein, 6 aa, Mycobacterium
GKTGFG

SEQ ID NO: 261374 - protein, 10 aa, Mycobacterium
GKTGTAQQIN

SEQ ID NO: 261375 - protein, 19 aa, Mycobacterium
GKTGYGMSDPMGNNPAQPD

SEQ ID NO: 261376 - protein, 4 aa, Mycobacterium
GKTI

SEQ ID NO: 261377 - protein, 12 aa, Mycobacterium
GKTLEPKRAMRT

SEQ ID NO: 261378 - protein, 8 aa, Mycobacterium
GKTPVAVK

SEQ ID NO: 261379 - protein, 8 aa, Mycobacterium
GKTRRTPR

SEQ ID NO: 261380 - protein, 9 aa, Mycobacterium
GKTSIADRA

SEQ ID NO: 261381 - protein, 4 aa, Mycobacterium
GKTT

SEQ ID NO: 261382 - protein, 7 aa, Mycobacterium
GKTVDAG

SEQ ID NO: 261383 - protein, 10 aa, Mycobacterium
GKTVTGQPVG

SEQ ID NO: 261384 - protein, 6 aa, Mycobacterium
GKVASE

SEQ ID NO: 261385 - protein, 13 aa, Mycobacterium
GKVDRARLRKLLD

SEQ ID NO: 261386 - protein, 13 aa, Mycobacterium
GKVDTRRLRKLFD

SEQ ID NO: 261387 - protein, 9 aa, Mycobacterium
GKVDTSAIG

SEQ ID NO: 261388 - protein, 6 aa, Mycobacterium
GKVPKA

SEQ ID NO: 261389 - protein, 9 aa, Mycobacterium
GKVPPPGSG

SEQ ID NO: 261390 - protein, 4 aa, Mycobacterium
GKVV

SEQ ID NO: 261391 - protein, 13 aa, Mycobacterium
GKWDLDGQDETTL

SEQ ID NO: 261392 - protein, 24 aa, Mycobacterium
GKYASTAGVPARSAPKPEPGAPLS

SEQ ID NO: 261393 - protein, 5 aa, Mycobacterium
GKYGS

SEQ ID NO: 261394 - protein, 4 aa, Mycobacterium
GKYP

SEQ ID NO: 261395 - protein, 14 aa, Mycobacterium
GKYSSSRGPSFSSY

SEQ ID NO: 261396 - protein, 5 aa, Mycobacterium
GLAAD

SEQ ID NO: 261397 - protein, 9 aa, Mycobacterium
GLADTRDYY

SEQ ID NO: 261398 - protein, 5 aa, Mycobacterium
GLAEQ

SEQ ID NO: 261399 - protein, 8 aa, Mycobacterium
GLAGDSAK

SEQ ID NO: 261400 - protein, 9 aa, Mycobacterium
GLAGDSAKI

SEQ ID NO: 261401 - protein, 7 aa, Mycobacterium
GLAGGRG

SEQ ID NO: 261402 - protein, 12 aa, Mycobacterium
GLAGKGKQFNTT

SEQ ID NO: 261403 - protein, 8 aa, Mycobacterium
GLAGLSES

SEQ ID NO: 261404 - protein, 9 aa, Mycobacterium
GLAGNPAPR

SEQ ID NO: 261405 - protein, 8 aa, Mycobacterium
GLAGPAAV

SEQ ID NO: 261406 - protein, 8 aa, Mycobacterium
GLAGPAPK

SEQ ID NO: 261407 - protein, 16 aa, Mycobacterium
GLAGPDSRVSTFSASD

SEQ ID NO: 261408 - protein, 10 aa, Mycobacterium
GLAGPQNTGK

SEQ ID NO: 261409 - protein, 8 aa, Mycobacterium
GLAGPRAT

SEQ ID NO: 261410 - protein, 9 aa, Mycobacterium
GLAGSPEFS

SEQ ID NO: 261411 - protein, 8 aa, Mycobacterium
GLAGTSDS

SEQ ID NO: 261412 - protein, 14 aa, Mycobacterium
GLANNGTATFEPAA

SEQ ID NO: 261413 - protein, 15 aa, Mycobacterium
GLANNGTATLQPAAD

SEQ ID NO: 261414 - protein, 6 aa, Mycobacterium
GLANTA

SEQ ID NO: 261415 - protein, 4 aa, Mycobacterium
GLAP

SEQ ID NO: 261416 - protein, 7 aa, Mycobacterium
GLAPDGV

SEQ ID NO: 261417 - protein, 10 aa, Mycobacterium
GLAPLRPGRA

SEQ ID NO: 261418 - protein, 5 aa, Mycobacterium
GLAPP

SEQ ID NO: 261419 - protein, 5 aa, Mycobacterium
GLAPQ

SEQ ID NO: 261420 - protein, 6 aa, Mycobacterium
GLAPQN

SEQ ID NO: 261421 - protein, 6 aa, Mycobacterium
GLAPRG

SEQ ID NO: 261422 - protein, 8 aa, Mycobacterium
GLAPSQAE

SEQ ID NO: 261423 - protein, 16 aa, Mycobacterium
GLAQNGPAIADTDAGY

SEQ ID NO: 261424 - protein, 8 aa, Mycobacterium
GLARGGRS

SEQ ID NO: 261425 - protein, 8 aa, Mycobacterium
GLASDPAP

SEQ ID NO: 261426 - protein, 7 aa, Mycobacterium
GLASPPD

SEQ ID NO: 261427 - protein, 9 aa, Mycobacterium
GLASQAGNH

SEQ ID NO: 261428 - protein, 9 aa, Mycobacterium
GLATGPAVQ

SEQ ID NO: 261429 - protein, 9 aa, Mycobacterium
GLATGSRQL

SEQ ID NO: 261430 - protein, 48 aa, Mycobacterium
GLDAAGKPAARPPSPPAPPPAPAPAPAPETNGELPEFGAGDALKAGNA

SEQ ID NO: 261431 - protein, 12 aa, Mycobacterium
GLDATGQQLGST

SEQ ID NO: 261432 - protein, 5 aa, Mycobacterium
GLDDA

SEQ ID NO: 261433 - protein, 14 aa, Mycobacterium
GLDEDGDDPSARSD

SEQ ID NO: 261434 - protein, 4 aa, Mycobacterium
GLDG

SEQ ID NO: 261435 - protein, 9 aa, Mycobacterium
GLDGAGDRF

SEQ ID NO: 261436 - protein, 48 aa, Mycobacterium
GLDGAPGPTAPSPSDRQRPPPPPPPPSPHSNGHTPRYGSDDALTAGNP

SEQ ID NO: 261437 - protein, 10 aa, Mycobacterium
GLDGRAGRRL

SEQ ID NO: 261438 - protein, 7 aa, Mycobacterium
GLDGTVA

SEQ ID NO: 261439 - protein, 6 aa, Mycobacterium
GLDNQR

SEQ ID NO: 261440 - protein, 8 aa, Mycobacterium
GLDPDAAD

SEQ ID NO: 261441 - protein, 12 aa, Mycobacterium
GLDPESEGEGDI

SEQ ID NO: 261442 - protein, 9 aa, Mycobacterium
GLDPGTIGT

SEQ ID NO: 261443 - protein, 17 aa, Mycobacterium
GLDPKRARMTARNSPHR

SEQ ID NO: 261444 - protein, 18 aa, Mycobacterium
GLDPKRARRIARSSPHRR

SEQ ID NO: 261445 - protein, 15 aa, Mycobacterium
GLDRETQNDVVTRER

SEQ ID NO: 261446 - protein, 9 aa, Mycobacterium
GLDRNPRRT

SEQ ID NO: 261447 - protein, 20 aa, Mycobacterium
GLDTEGDDVEDATALPPLPD

SEQ ID NO: 261448 - protein, 8 aa, Mycobacterium
GLDTGQLS

SEQ ID NO: 261449 - protein, 12 aa, Mycobacterium
GLDTTPFGGDDG

SEQ ID NO: 261450 - protein, 13 aa, Mycobacterium
GLEAKGGARGVAD

SEQ ID NO: 261451 - protein, 8 aa, Mycobacterium
GLEDNPGY

SEQ ID NO: 261452 - protein, 5 aa, Mycobacterium
GLEGG

SEQ ID NO: 261453 - protein, 12 aa, Mycobacterium
GLEGKGKQINTT

SEQ ID NO: 261454 - protein, 4 aa, Mycobacterium
GLEI

SEQ ID NO: 261455 - protein, 5 aa, Mycobacterium
GLEQT

SEQ ID NO: 261456 - protein, 8 aa, Mycobacterium
GLEQTSRV

SEQ ID NO: 261457 - protein, 10 aa, Mycobacterium
GLERAEASAD

SEQ ID NO: 261458 - protein, 11 aa, Mycobacterium
GLESATDSEGQ

SEQ ID NO: 261459 - protein, 4 aa, Mycobacterium
GLET

SEQ ID NO: 261460 - protein, 10 aa, Mycobacterium
GLGAASSSCS

SEQ ID NO: 261461 - protein, 11 aa, Mycobacterium
GLGAESVEKAE

SEQ ID NO: 261462 - protein, 11 aa, Mycobacterium
GLGAGDEPPVT

SEQ ID NO: 261463 - protein, 9 aa, Mycobacterium
GLGAGSTRL

SEQ ID NO: 261464 - protein, 5 aa, Mycobacterium
GLGAP

SEQ ID NO: 261465 - protein, 6 aa, Mycobacterium
GLGAPG

SEQ ID NO: 261466 - protein, 9 aa, Mycobacterium
GLGAPQLAG

SEQ ID NO: 261467 - protein, 5 aa, Mycobacterium
GLGDE

SEQ ID NO: 261468 - protein, 16 aa, Mycobacterium
GLGDTDTDARSVSAAE

SEQ ID NO: 261469 - protein, 8 aa, Mycobacterium
GLGEDEAS

SEQ ID NO: 261470 - protein, 7 aa, Mycobacterium
GLGEDTA

SEQ ID NO: 261471 - protein, 5 aa, Mycobacterium
GLGEP

SEQ ID NO: 261472 - protein, 8 aa, Mycobacterium
GLGGATGR

SEQ ID NO: 261473 - protein, 30 aa, Mycobacterium
GLGGGGFGGGFGGGGFGGGGGGGFSGGGGR

SEQ ID NO: 261474 - protein, 8 aa, Mycobacterium
GLGGGNYA

SEQ ID NO: 261475 - protein, 10 aa, Mycobacterium
GLGGGNYSAS

SEQ ID NO: 261476 - protein, 11 aa, Mycobacterium
GLGGGNYSASL

SEQ ID NO: 261477 - protein, 5 aa, Mycobacterium
GLGGL

SEQ ID NO: 261478 - protein, 7 aa, Mycobacterium
GLGGPRT

SEQ ID NO: 261479 - protein, 5 aa, Mycobacterium
GLGGR

SEQ ID NO: 261480 - protein, 6 aa, Mycobacterium
GLGGTQ

SEQ ID NO: 261481 - protein, 6 aa, Mycobacterium
GLGGTV

SEQ ID NO: 261482 - protein, 9 aa, Mycobacterium
GLGKDRQSV

SEQ ID NO: 261483 - protein, 8 aa, Mycobacterium
GLGKDSRA

SEQ ID NO: 261484 - protein, 17 aa, Mycobacterium
GLGKEAGLADEHGTLPG

SEQ ID NO: 261485 - protein, 7 aa, Mycobacterium
GLGKSRP

SEQ ID NO: 261486 - protein, 11 aa, Mycobacterium
GLGLPQATATG

SEQ ID NO: 261487 - protein, 4 aa, Mycobacterium
GLGM

SEQ ID NO: 261488 - protein, 7 aa, Mycobacterium
GLGNAGA

SEQ ID NO: 261489 - protein, 7 aa, Mycobacterium
GLGNGER

SEQ ID NO: 261490 - protein, 13 aa, Mycobacterium
GLGNGQPGTVPAA

SEQ ID NO: 261491 - protein, 14 aa, Mycobacterium
GLGNGQPGTVPAAS

SEQ ID NO: 261492 - protein, 4 aa, Mycobacterium
GLGP

SEQ ID NO: 261493 - protein, 27 aa, Mycobacterium
GLGPEAGWQGSAARAYGAQNRAQSERA

SEQ ID NO: 261494 - protein, 8 aa, Mycobacterium
GLGPEQAE

SEQ ID NO: 261495 - protein, 7 aa, Mycobacterium
GLGPPIG

SEQ ID NO: 261496 - protein, 9 aa, Mycobacterium
GLGPPKEVT

SEQ ID NO: 261497 - protein, 14 aa, Mycobacterium
GLGPPKEVTLSGGA

SEQ ID NO: 261498 - protein, 6 aa, Mycobacterium
GLGPPR

SEQ ID NO: 261499 - protein, 8 aa, Mycobacterium
GLGPPREV

SEQ ID NO: 261500 - protein, 7 aa, Mycobacterium
GLGQGTA

SEQ ID NO: 261501 - protein, 14 aa, Mycobacterium
GLGQPKTTALTGAS

SEQ ID NO: 261502 - protein, 15 aa, Mycobacterium
GLGQPKTTDLSGSTW

SEQ ID NO: 261503 - protein, 13 aa, Mycobacterium
GLGRGRDGSLDGE

SEQ ID NO: 261504 - protein, 4 aa, Mycobacterium
GLGS

SEQ ID NO: 261505 - protein, 6 aa, Mycobacterium
GLGSAG

SEQ ID NO: 261506 - protein, 5 aa, Mycobacterium
GLGSD

SEQ ID NO: 261507 - protein, 34 aa, Mycobacterium
GLGSEVGKAAGGAVRAAGSALSKAGGAVASFFGS

SEQ ID NO: 261508 - protein, 7 aa, Mycobacterium
GLGSQPV

SEQ ID NO: 261509 - protein, 10 aa, Mycobacterium
GLGSTAFPID

SEQ ID NO: 261510 - protein, 7 aa, Mycobacterium
GLGTADD

SEQ ID NO: 261511 - protein, 7 aa, Mycobacterium
GLGTAGA

SEQ ID NO: 261512 - protein, 6 aa, Mycobacterium
GLGTGA

SEQ ID NO: 261513 - protein, 5 aa, Mycobacterium
GLGTL

SEQ ID NO: 261514 - protein, 5 aa, Mycobacterium
GLGTR

SEQ ID NO: 261515 - protein, 10 aa, Mycobacterium
GLGTTATGTI

SEQ ID NO: 261516 - protein, 9 aa, Mycobacterium
GLGTTSTGT

SEQ ID NO: 261517 - protein, 6 aa, Mycobacterium
GLHDGP

SEQ ID NO: 261518 - protein, 21 aa, Mycobacterium
GLHDKAQGSIVEAGGKPVGSR

SEQ ID NO: 261519 - protein, 8 aa, Mycobacterium
GLKERSTH

SEQ ID NO: 261520 - protein, 18 aa, Mycobacterium
GLKGEADAGEDIDPDMPS

SEQ ID NO: 261521 - protein, 6 aa, Mycobacterium
GLLPNQ

SEQ ID NO: 261522 - protein, 5 aa, Mycobacterium
GLNDW

SEQ ID NO: 261523 - protein, 28 aa, Mycobacterium
GLNEQAKAQADNATAQGDAFDKAKNDDT

SEQ ID NO: 261524 - protein, 5 aa, Mycobacterium
GLNES

SEQ ID NO: 261525 - protein, 8 aa, Mycobacterium
GLNGREGD

SEQ ID NO: 261526 - protein, 11 aa, Mycobacterium
GLNPTRTRQPT

SEQ ID NO: 261527 - protein, 5 aa, Mycobacterium
GLNRD

SEQ ID NO: 261528 - protein, 7 aa, Mycobacterium
GLNSDTS

SEQ ID NO: 261529 - protein, 4 aa, Mycobacterium
GLNT

SEQ ID NO: 261530 - protein, 8 aa, Mycobacterium
GLNTDQLS

SEQ ID NO: 261531 - protein, 4 aa, Mycobacterium
GLPA

SEQ ID NO: 261532 - protein, 8 aa, Mycobacterium
GLPAGSLD

SEQ ID NO: 261533 - protein, 9 aa, Mycobacterium
GLPAPQVPA

SEQ ID NO: 261534 - protein, 11 aa, Mycobacterium
GLPDDTGFTPR

SEQ ID NO: 261535 - protein, 5 aa, Mycobacterium
GLPDE

SEQ ID NO: 261536 - protein, 7 aa, Mycobacterium
GLPDEPL

SEQ ID NO: 261537 - protein, 12 aa, Mycobacterium
GLPDGVDDPDFK

SEQ ID NO: 261538 - protein, 12 aa, Mycobacterium
GLPEENPGVTEP

SEQ ID NO: 261539 - protein, 11 aa, Mycobacterium
GLPEENPSLAG

SEQ ID NO: 261540 - protein, 15 aa, Mycobacterium
GLPEQVGGPNQIGTN

SEQ ID NO: 261541 - protein, 11 aa, Mycobacterium
GLPESGPGSLA

SEQ ID NO: 261542 - protein, 8 aa, Mycobacterium
GLPGADRG

SEQ ID NO: 261543 - protein, 7 aa, Mycobacterium
GLPGEPE

SEQ ID NO: 261544 - protein, 8 aa, Mycobacterium
GLPGKSQT

SEQ ID NO: 261545 - protein, 5 aa, Mycobacterium
GLPGL

SEQ ID NO: 261546 - protein, 16 aa, Mycobacterium
GLPGQDPFGPQKKSKP

SEQ ID NO: 261547 - protein, 5 aa, Mycobacterium
GLPGV

SEQ ID NO: 261548 - protein, 4 aa, Mycobacterium
GLPH

SEQ ID NO: 261549 - protein, 5 aa, Mycobacterium
GLPHP

SEQ ID NO: 261550 - protein, 7 aa, Mycobacterium
GLPHRAA

SEQ ID NO: 261551 - protein, 14 aa, Mycobacterium
GLPHRSATRSFAEG

SEQ ID NO: 261552 - protein, 10 aa, Mycobacterium
GLPHSSNEQF

SEQ ID NO: 261553 - protein, 4 aa, Mycobacterium
GLPK

SEQ ID NO: 261554 - protein, 18 aa, Mycobacterium
GLPNASGTLSIENKPQVT

SEQ ID NO: 261555 - protein, 9 aa, Mycobacterium
GLPNGGLTD

SEQ ID NO: 261556 - protein, 25 aa, Mycobacterium
GLPNGRPEVTPPPPGEGDCAPENAD

SEQ ID NO: 261557 - protein, 10 aa, Mycobacterium
GLPNPGPVTS

SEQ ID NO: 261558 - protein, 7 aa, Mycobacterium
GLPNSYG

SEQ ID NO: 261559 - protein, 4 aa, Mycobacterium
GLPP

SEQ ID NO: 261560 - protein, 9 aa, Mycobacterium
GLPPAGDEL

SEQ ID NO: 261561 - protein, 32 aa, Mycobacterium
GLPPAPPPGRPRDPGPPPAGSEPFTPPVPGAI

SEQ ID NO: 261562 - protein, 25 aa, Mycobacterium
GLPPAPPPGTPREPGPPPPGSEPAV

SEQ ID NO: 261563 - protein, 5 aa, Mycobacterium
GLPPL

SEQ ID NO: 261564 - protein, 5 aa, Mycobacterium
GLPPP

SEQ ID NO: 261565 - protein, 6 aa, Mycobacterium
GLPPSQ

SEQ ID NO: 261566 - protein, 9 aa, Mycobacterium
GLPPTPPKY

SEQ ID NO: 261567 - protein, 13 aa, Mycobacterium
GLPQNSPTGLPTG

SEQ ID NO: 261568 - protein, 7 aa, Mycobacterium
GLPQRAS

SEQ ID NO: 261569 - protein, 6 aa, Mycobacterium
GLPRGA

SEQ ID NO: 261570 - protein, 8 aa, Mycobacterium
GLPSDDPL

SEQ ID NO: 261571 - protein, 7 aa, Mycobacterium
GLPSGAS

SEQ ID NO: 261572 - protein, 7 aa, Mycobacterium
GLPSSSA

SEQ ID NO: 261573 - protein, 10 aa, Mycobacterium
GLPSTEDLTN

SEQ ID NO: 261574 - protein, 12 aa, Mycobacterium
GLPTDARRGHDE

SEQ ID NO: 261575 - protein, 9 aa, Mycobacterium
GLPTRPEKL

SEQ ID NO: 261576 - protein, 9 aa, Mycobacterium
GLQDDRDAL

SEQ ID NO: 261577 - protein, 10 aa, Mycobacterium
GLQDKADGSI

SEQ ID NO: 261578 - protein, 8 aa, Mycobacterium
GLQEPRSV

SEQ ID NO: 261579 - protein, 7 aa, Mycobacterium
GLQGETM

SEQ ID NO: 261580 - protein, 8 aa, Mycobacterium
GLQGGSAS

SEQ ID NO: 261581 - protein, 16 aa, Mycobacterium
GLQPADEQVGRRATRD

SEQ ID NO: 261582 - protein, 5 aa, Mycobacterium
GLQQS

SEQ ID NO: 261583 - protein, 4 aa, Mycobacterium
GLQS

SEQ ID NO: 261584 - protein, 10 aa, Mycobacterium
GLQSDPNSMA

SEQ ID NO: 261585 - protein, 8 aa, Mycobacterium
GLQSTAPV

SEQ ID NO: 261586 - protein, 9 aa, Mycobacterium
GLQTASERL

SEQ ID NO: 261587 - protein, 7 aa, Mycobacterium
GLQTGSS

SEQ ID NO: 261588 - protein, 9 aa, Mycobacterium
GLQTNPNAL

SEQ ID NO: 261589 - protein, 10 aa, Mycobacterium
GLQTNPNGLA

SEQ ID NO: 261590 - protein, 6 aa, Mycobacterium
GLQTQY

SEQ ID NO: 261591 - protein, 22 aa, Mycobacterium
GLQTSQRREPVAGRDGLPSPRA

SEQ ID NO: 261592 - protein, 25 aa, Mycobacterium
GLRAAQRGQTGTITATDYTDNKELE

SEQ ID NO: 261593 - protein, 9 aa, Mycobacterium
GLRAEAASQ

SEQ ID NO: 261594 - protein, 6 aa, Mycobacterium
GLRAGA

SEQ ID NO: 261595 - protein, 10 aa, Mycobacterium
GLRDKADGSI

SEQ ID NO: 261596 - protein, 13 aa, Mycobacterium
GLREAQRGQTGTV

SEQ ID NO: 261597 - protein, 13 aa, Mycobacterium
GLRGADELSAEDA

SEQ ID NO: 261598 - protein, 7 aa, Mycobacterium
GLRGAPR

SEQ ID NO: 261599 - protein, 5 aa, Mycobacterium
GLRGG

SEQ ID NO: 261600 - protein, 6 aa, Mycobacterium
GLRGGS

SEQ ID NO: 261601 - protein, 12 aa, Mycobacterium
GLRGHGDDLGAT

SEQ ID NO: 261602 - protein, 8 aa, Mycobacterium
GLRGQGPL

SEQ ID NO: 261603 - protein, 16 aa, Mycobacterium
GLRGRGPAMGQGLTDA

SEQ ID NO: 261604 - protein, 6 aa, Mycobacterium
GLRGSY

SEQ ID NO: 261605 - protein, 5 aa, Mycobacterium
GLRPD

SEQ ID NO: 261606 - protein, 7 aa, Mycobacterium
GLRPGEE

SEQ ID NO: 261607 - protein, 22 aa, Mycobacterium
GLRPGPGTAAVSDAMSRGVRAA

SEQ ID NO: 261608 - protein, 5 aa, Mycobacterium
GLRPR

SEQ ID NO: 261609 - protein, 8 aa, Mycobacterium
GLRPTTLN

SEQ ID NO: 261610 - protein, 9 aa, Mycobacterium
GLRSGTPLR

SEQ ID NO: 261611 - protein, 12 aa, Mycobacterium
GLRTEVPERATA

SEQ ID NO: 261612 - protein, 12 aa, Mycobacterium
GLRTPGSPLGSA

SEQ ID NO: 261613 - protein, 4 aa, Mycobacterium
GLRY

SEQ ID NO: 261614 - protein, 9 aa, Mycobacterium
GLSAEGHER

SEQ ID NO: 261615 - protein, 7 aa, Mycobacterium
GLSAGSA

SEQ ID NO: 261616 - protein, 13 aa, Mycobacterium
GLSANSADGYAQL

SEQ ID NO: 261617 - protein, 5 aa, Mycobacterium
GLSDC

SEQ ID NO: 261618 - protein, 10 aa, Mycobacterium
GLSDPGPVTT

SEQ ID NO: 261619 - protein, 10 aa, Mycobacterium
GLSDQQRQNS

SEQ ID NO: 261620 - protein, 10 aa, Mycobacterium
GLSESDQEAA

SEQ ID NO: 261621 - protein, 4 aa, Mycobacterium
GLSG

SEQ ID NO: 261622 - protein, 7 aa, Mycobacterium
GLSGAPG

SEQ ID NO: 261623 - protein, 10 aa, Mycobacterium
GLSGDSSAFD

SEQ ID NO: 261624 - protein, 12 aa, Mycobacterium
GLSGDSSAFDAR

SEQ ID NO: 261625 - protein, 9 aa, Mycobacterium
GLSGGVDGI

SEQ ID NO: 261626 - protein, 9 aa, Mycobacterium
GLSGPTPAP

SEQ ID NO: 261627 - protein, 7 aa, Mycobacterium
GLSGQNP

SEQ ID NO: 261628 - protein, 11 aa, Mycobacterium
GLSLDSGSKVT

SEQ ID NO: 261629 - protein, 10 aa, Mycobacterium
GLSMDPGSKV

SEQ ID NO: 261630 - protein, 6 aa, Mycobacterium
GLSPAA

SEQ ID NO: 261631 - protein, 6 aa, Mycobacterium
GLSPAI

SEQ ID NO: 261632 - protein, 8 aa, Mycobacterium
GLSPDGKA

SEQ ID NO: 261633 - protein, 17 aa, Mycobacterium
GLSPDKTLEQTKEYMTP

SEQ ID NO: 261634 - protein, 9 aa, Mycobacterium
GLSPEARQR

SEQ ID NO: 261635 - protein, 7 aa, Mycobacterium
GLSPHTR

SEQ ID NO: 261636 - protein, 6 aa, Mycobacterium
GLSPNG

SEQ ID NO: 261637 - protein, 10 aa, Mycobacterium
GLSPRDYPGA

SEQ ID NO: 261638 - protein, 8 aa, Mycobacterium
GLSQTAPD

SEQ ID NO: 261639 - protein, 8 aa, Mycobacterium
GLSRTPTW

SEQ ID NO: 261640 - protein, 7 aa, Mycobacterium
GLSSDDA

SEQ ID NO: 261641 - protein, 10 aa, Mycobacterium
GLSSRSDSPL

SEQ ID NO: 261642 - protein, 9 aa, Mycobacterium
GLSSSAGVG

SEQ ID NO: 261643 - protein, 6 aa, Mycobacterium
GLSTDS

SEQ ID NO: 261644 - protein, 9 aa, Mycobacterium
GLSTGGEYA

SEQ ID NO: 261645 - protein, 11 aa, Mycobacterium
GLSTKGGPIGV

SEQ ID NO: 261646 - protein, 14 aa, Mycobacterium
GLSTQGGPTGVANS

SEQ ID NO: 261647 - protein, 14 aa, Mycobacterium
GLSTRGGPAGVANS

SEQ ID NO: 261648 - protein, 21 aa, Mycobacterium
GLSTSERVAGTDSQGKTTTKT

SEQ ID NO: 261649 - protein, 8 aa, Mycobacterium
GLSTTGPT

SEQ ID NO: 261650 - protein, 14 aa, Mycobacterium
GLSTVGGPTGVANS

SEQ ID NO: 261651 - protein, 7 aa, Mycobacterium
GLSVPSG

SEQ ID NO: 261652 - protein, 18 aa, Mycobacterium
GLTAATARTVAEELTDQN

SEQ ID NO: 261653 - protein, 5 aa, Mycobacterium
GLTAE

SEQ ID NO: 261654 - protein, 12 aa, Mycobacterium
GLTAGDNAQARG

SEQ ID NO: 261655 - protein, 6 aa, Mycobacterium
GLTASQ

SEQ ID NO: 261656 - protein, 4 aa, Mycobacterium
GLTD

SEQ ID NO: 261657 - protein, 11 aa, Mycobacterium
GLTDDGDEAPA

SEQ ID NO: 261658 - protein, 11 aa, Mycobacterium
GLTDDGEEAPA

SEQ ID NO: 261659 - protein, 11 aa, Mycobacterium
GLTDGDAATQA

SEQ ID NO: 261660 - protein, 8 aa, Mycobacterium
GLTDPEAR

SEQ ID NO: 261661 - protein, 8 aa, Mycobacterium
GLTDQEAR

SEQ ID NO: 261662 - protein, 9 aa, Mycobacterium
GLTDQEARV

SEQ ID NO: 261663 - protein, 8 aa, Mycobacterium
GLTDTGRH

SEQ ID NO: 261664 - protein, 10 aa, Mycobacterium
GLTEASDRHR

SEQ ID NO: 261665 - protein, 5 aa, Mycobacterium
GLTEQ

SEQ ID NO: 261666 - protein, 8 aa, Mycobacterium
GLTEQHRQ

SEQ ID NO: 261667 - protein, 9 aa, Mycobacterium
GLTGATGYA

SEQ ID NO: 261668 - protein, 15 aa, Mycobacterium
GLTGELNNGLEEASG

SEQ ID NO: 261669 - protein, 5 aa, Mycobacterium
GLTGI

SEQ ID NO: 261670 - protein, 8 aa, Mycobacterium
GLTPAGVD

SEQ ID NO: 261671 - protein, 22 aa, Mycobacterium
GLTPDQKPGRVTAAAREAEGAP

SEQ ID NO: 261672 - protein, 18 aa, Mycobacterium
GLTPEPSTSVASSVRAAG

SEQ ID NO: 261673 - protein, 9 aa, Mycobacterium
GLTPSGPLA

SEQ ID NO: 261674 - protein, 23 aa, Mycobacterium
GLTPTGAKATLSLSTSPKVPADL

SEQ ID NO: 261675 - protein, 8 aa, Mycobacterium
GLTQGKPF

SEQ ID NO: 261676 - protein, 7 aa, Mycobacterium
GLTQTAS

SEQ ID NO: 261677 - protein, 5 aa, Mycobacterium
GLTRA

SEQ ID NO: 261678 - protein, 9 aa, Mycobacterium
GLTSDQADL

SEQ ID NO: 261679 - protein, 5 aa, Mycobacterium
GLTSQ

SEQ ID NO: 261680 - protein, 4 aa, Mycobacterium
GLTT

SEQ ID NO: 261681 - protein, 6 aa, Mycobacterium
GLTTGT

SEQ ID NO: 261682 - protein, 14 aa, Mycobacterium
GLTTKGGPAGVANS

SEQ ID NO: 261683 - protein, 5 aa, Mycobacterium
GLTVD

SEQ ID NO: 261684 - protein, 5 aa, Mycobacterium
GLTVG

SEQ ID NO: 261685 - protein, 7 aa, Mycobacterium
GLVPDSA

SEQ ID NO: 261686 - protein, 7 aa, Mycobacterium
GLVQGTG

SEQ ID NO: 261687 - protein, 7 aa, Mycobacterium
GMADPRD

SEQ ID NO: 261688 - protein, 15 aa, Mycobacterium
GMAGRDTAGLSGGEL

SEQ ID NO: 261689 - protein, 7 aa, Mycobacterium
GMAGTAV

SEQ ID NO: 261690 - protein, 41 aa, Mycobacterium
GMAPSLAESTAPAPAAGLASAGSAVPASNPASAVASERGAD

SEQ ID NO: 261691 - protein, 11 aa, Mycobacterium
GMASDSGTGGV

SEQ ID NO: 261692 - protein, 12 aa, Mycobacterium
GMATGSVSTGRQ

SEQ ID NO: 261693 - protein, 8 aa, Mycobacterium
GMATQTGQ

SEQ ID NO: 261694 - protein, 6 aa, Mycobacterium
GMDSDQ

SEQ ID NO: 261695 - protein, 5 aa, Mycobacterium
GMDTE

SEQ ID NO: 261696 - protein, 5 aa, Mycobacterium
GMGEN

SEQ ID NO: 261697 - protein, 10 aa, Mycobacterium
GMGPATETYL

SEQ ID NO: 261698 - protein, 7 aa, Mycobacterium
GMGPPGR

SEQ ID NO: 261699 - protein, 11 aa, Mycobacterium
GMGSSPNIAGA

SEQ ID NO: 261700 - protein, 4 aa, Mycobacterium
GMGT

SEQ ID NO: 261701 - protein, 5 aa, Mycobacterium
GMNGY

SEQ ID NO: 261702 - protein, 7 aa, Mycobacterium
GMPDGTG

SEQ ID NO: 261703 - protein, 33 aa, Mycobacterium
GMPGGGGAPATPANAPATPANAPASPAAAAATP

SEQ ID NO: 261704 - protein, 11 aa, Mycobacterium
GMPGGSDPASW

SEQ ID NO: 261705 - protein, 8 aa, Mycobacterium
GMPPDKTG

SEQ ID NO: 261706 - protein, 6 aa, Mycobacterium
GMPPEQ

SEQ ID NO: 261707 - protein, 6 aa, Mycobacterium
GMPPRS

SEQ ID NO: 261708 - protein, 11 aa, Mycobacterium
GMPSDDSSERM

SEQ ID NO: 261709 - protein, 5 aa, Mycobacterium
GMPTG

SEQ ID NO: 261710 - protein, 18 aa, Mycobacterium
GMQEEAAAAPDRPQPPVD

SEQ ID NO: 261711 - protein, 5 aa, Mycobacterium
GMQTE

SEQ ID NO: 261712 - protein, 8 aa, Mycobacterium
GMSASGPQ

SEQ ID NO: 261713 - protein, 17 aa, Mycobacterium
GMSPAPLSSTPAQVADA

SEQ ID NO: 261714 - protein, 6 aa, Mycobacterium
GMTGTG

SEQ ID NO: 261715 - protein, 8 aa, Mycobacterium
GMTNSGDM

SEQ ID NO: 261716 - protein, 7 aa, Mycobacterium
GMTSSGG

SEQ ID NO: 261717 - protein, 15 aa, Mycobacterium
GNADAKANPDPDRRE

SEQ ID NO: 261718 - protein, 18 aa, Mycobacterium
GNADGGGLANGLPDEHQQ

SEQ ID NO: 261719 - protein, 10 aa, Mycobacterium
GNAEAARRAG

SEQ ID NO: 261720 - protein, 9 aa, Mycobacterium
GNAERGSAR

SEQ ID NO: 261721 - protein, 4 aa, Mycobacterium
GNAG

SEQ ID NO: 261722 - protein, 5 aa, Mycobacterium
GNAGA

SEQ ID NO: 261723 - protein, 6 aa, Mycobacterium
GNAGAA

SEQ ID NO: 261724 - protein, 4 aa, Mycobacterium
GNAI

SEQ ID NO: 261725 - protein, 5 aa, Mycobacterium
GNAPA

SEQ ID NO: 261726 - protein, 7 aa, Mycobacterium
GNAPEVP

SEQ ID NO: 261727 - protein, 5 aa, Mycobacterium
GNAST

SEQ ID NO: 261728 - protein, 4 aa, Mycobacterium
GNAT

SEQ ID NO: 261729 - protein, 5 aa, Mycobacterium
GNATQ

SEQ ID NO: 261730 - protein, 16 aa, Mycobacterium
GNAVKADPSAGTAATD

SEQ ID NO: 261731 - protein, 6 aa, Mycobacterium
GNDAAH

SEQ ID NO: 261732 - protein, 7 aa, Mycobacterium
GNDAGVS

SEQ ID NO: 261733 - protein, 7 aa, Mycobacterium
GNDANVG

SEQ ID NO: 261734 - protein, 9 aa, Mycobacterium
GNDARSDLA

SEQ ID NO: 261735 - protein, 7 aa, Mycobacterium
GNDDSDF

SEQ ID NO: 261736 - protein, 9 aa, Mycobacterium
GNDKEVQGA

SEQ ID NO: 261737 - protein, 19 aa, Mycobacterium
GNDMGTARTKAAAADATLS

SEQ ID NO: 261738 - protein, 5 aa, Mycobacterium
GNDPE

SEQ ID NO: 261739 - protein, 5 aa, Mycobacterium
GNDRR

SEQ ID NO: 261740 - protein, 17 aa, Mycobacterium
GNDVANSFGTSVGAGTL

SEQ ID NO: 261741 - protein, 8 aa, Mycobacterium
GNDYADDL

SEQ ID NO: 261742 - protein, 7 aa, Mycobacterium
GNDYAPA

SEQ ID NO: 261743 - protein, 6 aa, Mycobacterium
GNEAEY

SEQ ID NO: 261744 - protein, 5 aa, Mycobacterium
GNEAL

SEQ ID NO: 261745 - protein, 5 aa, Mycobacterium
GNEGA

SEQ ID NO: 261746 - protein, 11 aa, Mycobacterium
GNELGDRREGR

SEQ ID NO: 261747 - protein, 4 aa, Mycobacterium
GNEP

SEQ ID NO: 261748 - protein, 6 aa, Mycobacterium
GNETPI

SEQ ID NO: 261749 - protein, 4 aa, Mycobacterium
GNEV

SEQ ID NO: 261750 - protein, 5 aa, Mycobacterium
GNEVQ

SEQ ID NO: 261751 - protein, 4 aa, Mycobacterium
GNEY

SEQ ID NO: 261752 - protein, 11 aa, Mycobacterium
GNFAGNATSAR

SEQ ID NO: 261753 - protein, 6 aa, Mycobacterium
GNFSPT

SEQ ID NO: 261754 - protein, 7 aa, Mycobacterium
GNGAAQP

SEQ ID NO: 261755 - protein, 7 aa, Mycobacterium
GNGARTD

SEQ ID NO: 261756 - protein, 9 aa, Mycobacterium
GNGASATVQ

SEQ ID NO: 261757 - protein, 4 aa, Mycobacterium
GNGC

SEQ ID NO: 261758 - protein, 16 aa, Mycobacterium
GNGDGAGLANGLPDDH

SEQ ID NO: 261759 - protein, 10 aa, Mycobacterium
GNGDTSHAEV

SEQ ID NO: 261760 - protein, 9 aa, Mycobacterium
GNGEANQQT

SEQ ID NO: 261761 - protein, 16 aa, Mycobacterium
GNGFKTVTPKEDPTGY

SEQ ID NO: 261762 - protein, 9 aa, Mycobacterium
GNGGDVPAE

SEQ ID NO: 261763 - protein, 7 aa, Mycobacterium
GNGGHDA

SEQ ID NO: 261764 - protein, 7 aa, Mycobacterium
GNGGPIS

SEQ ID NO: 261765 - protein, 4 aa, Mycobacterium
GNGI

SEQ ID NO: 261766 - protein, 5 aa, Mycobacterium
GNGIA

SEQ ID NO: 261767 - protein, 6 aa, Mycobacterium
GNGIAG

SEQ ID NO: 261768 - protein, 6 aa, Mycobacterium
GNGIER

SEQ ID NO: 261769 - protein, 7 aa, Mycobacterium
GNGIGPD

SEQ ID NO: 261770 - protein, 8 aa, Mycobacterium
GNGKPGLA

SEQ ID NO: 261771 - protein, 6 aa, Mycobacterium
GNGLDL

SEQ ID NO: 261772 - protein, 6 aa, Mycobacterium
GNGLGA

SEQ ID NO: 261773 - protein, 7 aa, Mycobacterium
GNGNRRT

SEQ ID NO: 261774 - protein, 5 aa, Mycobacterium
GNGPA

SEQ ID NO: 261775 - protein, 9 aa, Mycobacterium
GNGPDKAVE

SEQ ID NO: 261776 - protein, 20 aa, Mycobacterium
GNGQQDDASGIKSGELAKRG

SEQ ID NO: 261777 - protein, 11 aa, Mycobacterium
GNGRDDGALAN

SEQ ID NO: 261778 - protein, 4 aa, Mycobacterium
GNGS

SEQ ID NO: 261779 - protein, 5 aa, Mycobacterium
GNGSH

SEQ ID NO: 261780 - protein, 6 aa, Mycobacterium
GNGSTY

SEQ ID NO: 261781 - protein, 7 aa, Mycobacterium
GNGTDVA

SEQ ID NO: 261782 - protein, 13 aa, Mycobacterium
GNHENELGNGPIG

SEQ ID NO: 261783 - protein, 14 aa, Mycobacterium
GNHENELGNGPIGY

SEQ ID NO: 261784 - protein, 5 aa, Mycobacterium
GNHEP

SEQ ID NO: 261785 - protein, 7 aa, Mycobacterium
GNHGSYL

SEQ ID NO: 261786 - protein, 10 aa, Mycobacterium
GNIAGNPTEY

SEQ ID NO: 261787 - protein, 13 aa, Mycobacterium
GNKLNGAKYPHYW

SEQ ID NO: 261788 - protein, 11 aa, Mycobacterium
GNKPTLGGEGA

SEQ ID NO: 261789 - protein, 44 aa, Mycobacterium
GNKSNNAGPSGTPATSGDSTSEPDNSEQNATGCTPNVSAGERPL

SEQ ID NO: 261790 - protein, 10 aa, Mycobacterium
GNKSRGGPAV

SEQ ID NO: 261791 - protein, 5 aa, Mycobacterium
GNLDM

SEQ ID NO: 261792 - protein, 4 aa, Mycobacterium
GNLG

SEQ ID NO: 261793 - protein, 9 aa, Mycobacterium
GNLGAGYQT

SEQ ID NO: 261794 - protein, 5 aa, Mycobacterium
GNLGG

SEQ ID NO: 261795 - protein, 7 aa, Mycobacterium
GNLGNNS

SEQ ID NO: 261796 - protein, 9 aa, Mycobacterium
GNLGSETVN

SEQ ID NO: 261797 - protein, 5 aa, Mycobacterium
GNLSG

SEQ ID NO: 261798 - protein, 5 aa, Mycobacterium
GNLSR

SEQ ID NO: 261799 - protein, 13 aa, Mycobacterium
GNLTGGGFEVEGS

SEQ ID NO: 261800 - protein, 24 aa, Mycobacterium
GNNKQPSPDQLTQARSSLNEAKQG

SEQ ID NO: 261801 - protein, 7 aa, Mycobacterium
GNNPYPL

SEQ ID NO: 261802 - protein, 6 aa, Mycobacterium
GNPAAN

SEQ ID NO: 261803 - protein, 12 aa, Mycobacterium
GNPADSGKIRGQ

SEQ ID NO: 261804 - protein, 19 aa, Mycobacterium
GNPAKPLSSQEMAESPPLE

SEQ ID NO: 261805 - protein, 12 aa, Mycobacterium
GNPASPPPPPRP

SEQ ID NO: 261806 - protein, 18 aa, Mycobacterium
GNPDAAVREEEPKRSRRP

SEQ ID NO: 261807 - protein, 6 aa, Mycobacterium
GNPDGP

SEQ ID NO: 261808 - protein, 8 aa, Mycobacterium
GNPDGPQL

SEQ ID NO: 261809 - protein, 6 aa, Mycobacterium
GNPDLS

SEQ ID NO: 261810 - protein, 7 aa, Mycobacterium
GNPDLSN

SEQ ID NO: 261811 - protein, 22 aa, Mycobacterium
GNPGLDASARAQQLEAAAGKAM

SEQ ID NO: 261812 - protein, 7 aa, Mycobacterium
GNPHATR

SEQ ID NO: 261813 - protein, 5 aa, Mycobacterium
GNPHR

SEQ ID NO: 261814 - protein, 4 aa, Mycobacterium
GNPK

SEQ ID NO: 261815 - protein, 4 aa, Mycobacterium
GNPL

SEQ ID NO: 261816 - protein, 10 aa, Mycobacterium
GNPQDSGKIR

SEQ ID NO: 261817 - protein, 6 aa, Mycobacterium
GNPRGI

SEQ ID NO: 261818 - protein, 9 aa, Mycobacterium
GNPRIGAGR

SEQ ID NO: 261819 - protein, 5 aa, Mycobacterium
GNPRL

SEQ ID NO: 261820 - protein, 14 aa, Mycobacterium
GNPRPAQARTAEGP

SEQ ID NO: 261821 - protein, 5 aa, Mycobacterium
GNPRQ

SEQ ID NO: 261822 - protein, 6 aa, Mycobacterium
GNPRQY

SEQ ID NO: 261823 - protein, 4 aa, Mycobacterium
GNPS

SEQ ID NO: 261824 - protein, 10 aa, Mycobacterium
GNPSASPAPR

SEQ ID NO: 261825 - protein, 6 aa, Mycobacterium
GNPSSA

SEQ ID NO: 261826 - protein, 10 aa, Mycobacterium
GNPTAGHARA

SEQ ID NO: 261827 - protein, 10 aa, Mycobacterium
GNPTDSGKIR

SEQ ID NO: 261828 - protein, 11 aa, Mycobacterium
GNPTEGATRAS

SEQ ID NO: 261829 - protein, 9 aa, Mycobacterium
GNPTGLTVD

SEQ ID NO: 261830 - protein, 4 aa, Mycobacterium
GNPV

SEQ ID NO: 261831 - protein, 8 aa, Mycobacterium
GNPVATGF

SEQ ID NO: 261832 - protein, 12 aa, Mycobacterium
GNPVTPHPASTA

SEQ ID NO: 261833 - protein, 4 aa, Mycobacterium
GNPW

SEQ ID NO: 261834 - protein, 20 aa, Mycobacterium
GNPWPSRKDLRQSSGAIGRG

SEQ ID NO: 261835 - protein, 4 aa, Mycobacterium
GNPY

SEQ ID NO: 261836 - protein, 7 aa, Mycobacterium
GNQADYS

SEQ ID NO: 261837 - protein, 8 aa, Mycobacterium
GNQDSARA

SEQ ID NO: 261838 - protein, 8 aa, Mycobacterium
GNQGAYGN

SEQ ID NO: 261839 - protein, 12 aa, Mycobacterium
GNQGEALSNESV

SEQ ID NO: 261840 - protein, 12 aa, Mycobacterium
GNQGEPLGNESV

SEQ ID NO: 261841 - protein, 11 aa, Mycobacterium
GNQGEPRANEA

SEQ ID NO: 261842 - protein, 12 aa, Mycobacterium
GNQGESLANESV

SEQ ID NO: 261843 - protein, 12 aa, Mycobacterium
GNQGESLASESV

SEQ ID NO: 261844 - protein, 13 aa, Mycobacterium
GNQGGTAANEALT

SEQ ID NO: 261845 - protein, 12 aa, Mycobacterium
GNQGTPLGDESV

SEQ ID NO: 261846 - protein, 12 aa, Mycobacterium
GNQGTTLANESV

SEQ ID NO: 261847 - protein, 13 aa, Mycobacterium
GNQGTTLANESVE

SEQ ID NO: 261848 - protein, 14 aa, Mycobacterium
GNQGTTLANQSVDS

SEQ ID NO: 261849 - protein, 12 aa, Mycobacterium
GNQGTTLGQDSI

SEQ ID NO: 261850 - protein, 13 aa, Mycobacterium
GNQGTTQANDSVD

SEQ ID NO: 261851 - protein, 12 aa, Mycobacterium
GNQGTTQGQESV

SEQ ID NO: 261852 - protein, 8 aa, Mycobacterium
GNQRDAAG

SEQ ID NO: 261853 - protein, 10 aa, Mycobacterium
GNQRSNWPQP

SEQ ID NO: 261854 - protein, 11 aa, Mycobacterium
GNQTPDAGERG

SEQ ID NO: 261855 - protein, 7 aa, Mycobacterium
GNQTPGD

SEQ ID NO: 261856 - protein, 5 aa, Mycobacterium
GNRAP

SEQ ID NO: 261857 - protein, 6 aa, Mycobacterium
GNRAPV

SEQ ID NO: 261858 - protein, 9 aa, Mycobacterium
GNRDGGTNP

SEQ ID NO: 261859 - protein, 8 aa, Mycobacterium
GNRDGQNP

SEQ ID NO: 261860 - protein, 7 aa, Mycobacterium
GNREAAR

SEQ ID NO: 261861 - protein, 8 aa, Mycobacterium
GNREGGNP

SEQ ID NO: 261862 - protein, 8 aa, Mycobacterium
GNRENSNP

SEQ ID NO: 261863 - protein, 14 aa, Mycobacterium
GNRERAAMSTGGHG

SEQ ID NO: 261864 - protein, 6 aa, Mycobacterium
GNRETP

SEQ ID NO: 261865 - protein, 7 aa, Mycobacterium
GNRETPS

SEQ ID NO: 261866 - protein, 5 aa, Mycobacterium
GNRFG

SEQ ID NO: 261867 - protein, 9 aa, Mycobacterium
GNRGASPAA

SEQ ID NO: 261868 - protein, 5 aa, Mycobacterium
GNRHA

SEQ ID NO: 261869 - protein, 6 aa, Mycobacterium
GNRPGL

SEQ ID NO: 261870 - protein, 13 aa, Mycobacterium
GNRRIIDSDDEVD

SEQ ID NO: 261871 - protein, 5 aa, Mycobacterium
GNRRV

SEQ ID NO: 261872 - protein, 6 aa, Mycobacterium
GNRSEQ

SEQ ID NO: 261873 - protein, 5 aa, Mycobacterium
GNRSP

SEQ ID NO: 261874 - protein, 11 aa, Mycobacterium
GNRTSDQPRPL

SEQ ID NO: 261875 - protein, 4 aa, Mycobacterium
GNRV

SEQ ID NO: 261876 - protein, 5 aa, Mycobacterium
GNSAL

SEQ ID NO: 261877 - protein, 7 aa, Mycobacterium
GNSDGSM

SEQ ID NO: 261878 - protein, 8 aa, Mycobacterium
GNSDKVRV

SEQ ID NO: 261879 - protein, 7 aa, Mycobacterium
GNSGPWD

SEQ ID NO: 261880 - protein, 4 aa, Mycobacterium
GNSK

SEQ ID NO: 261881 - protein, 5 aa, Mycobacterium
GNSKV

SEQ ID NO: 261882 - protein, 4 aa, Mycobacterium
GNSL

SEQ ID NO: 261883 - protein, 13 aa, Mycobacterium
GNSPENPSTESVQ

SEQ ID NO: 261884 - protein, 9 aa, Mycobacterium
GNSRDGENP

SEQ ID NO: 261885 - protein, 22 aa, Mycobacterium
GNSSSPLSFQTDPGAKDDGIPA

SEQ ID NO: 261886 - protein, 4 aa, Mycobacterium
GNST

SEQ ID NO: 261887 - protein, 9 aa, Mycobacterium
GNSTQASTA

SEQ ID NO: 261888 - protein, 4 aa, Mycobacterium
GNSV

SEQ ID NO: 261889 - protein, 7 aa, Mycobacterium
GNSVGKG

SEQ ID NO: 261890 - protein, 14 aa, Mycobacterium
GNSWKDAADMPTPR

SEQ ID NO: 261891 - protein, 22 aa, Mycobacterium
GNTARSRRTPDRGAAFAELSDR

SEQ ID NO: 261892 - protein, 9 aa, Mycobacterium
GNTDRHGAA

SEQ ID NO: 261893 - protein, 13 aa, Mycobacterium
GNTERVATGTCIN

SEQ ID NO: 261894 - protein, 4 aa, Mycobacterium
GNTG

SEQ ID NO: 261895 - protein, 24 aa, Mycobacterium
GNTGGDCAQNPLPDASAPEDARGW

SEQ ID NO: 261896 - protein, 24 aa, Mycobacterium
GNTGGDCSQNPMPDASTPNDPRGW

SEQ ID NO: 261897 - protein, 21 aa, Mycobacterium
GNTGGDCTQNPAPPAGDPDSW

SEQ ID NO: 261898 - protein, 13 aa, Mycobacterium
GNTGKLEANESVD

SEQ ID NO: 261899 - protein, 8 aa, Mycobacterium
GNTGNGEG

SEQ ID NO: 261900 - protein, 24 aa, Mycobacterium
GNTGQDCSQNPPPDPSVPSDPRGW

SEQ ID NO: 261901 - protein, 10 aa, Mycobacterium
GNTKAGLRAT

SEQ ID NO: 261902 - protein, 5 aa, Mycobacterium
GNTPI

SEQ ID NO: 261903 - protein, 5 aa, Mycobacterium
GNTRP

SEQ ID NO: 261904 - protein, 4 aa, Mycobacterium
GNTS

SEQ ID NO: 261905 - protein, 20 aa, Mycobacterium
GNTSSPLDFTTDPGAKPDGV

SEQ ID NO: 261906 - protein, 5 aa, Mycobacterium
GNTTG

SEQ ID NO: 261907 - protein, 8 aa, Mycobacterium
GNTVDGTS

SEQ ID NO: 261908 - protein, 6 aa, Mycobacterium
GNVDSS

SEQ ID NO: 261909 - protein, 5 aa, Mycobacterium
GNVES

SEQ ID NO: 261910 - protein, 19 aa, Mycobacterium
GNVGAGQCRHQNPLDAPGW

SEQ ID NO: 261911 - protein, 7 aa, Mycobacterium
GNVGAKE

SEQ ID NO: 261912 - protein, 8 aa, Mycobacterium
GNVGAKER

SEQ ID NO: 261913 - protein, 7 aa, Mycobacterium
GNVGAKQ

SEQ ID NO: 261914 - protein, 8 aa, Mycobacterium
GNVGANER

SEQ ID NO: 261915 - protein, 8 aa, Mycobacterium
GNVGATAR

SEQ ID NO: 261916 - protein, 25 aa, Mycobacterium
GNVGGPGQCQDPNPRDVGAADQVRT

SEQ ID NO: 261917 - protein, 20 aa, Mycobacterium
GNVGNESAAMGNDCKQNPIY

SEQ ID NO: 261918 - protein, 6 aa, Mycobacterium
GNVKET

SEQ ID NO: 261919 - protein, 6 aa, Mycobacterium
GNVKGS

SEQ ID NO: 261920 - protein, 6 aa, Mycobacterium
GNVTAA

SEQ ID NO: 261921 - protein, 5 aa, Mycobacterium
GNYEQ

SEQ ID NO: 261922 - protein, 8 aa, Mycobacterium
GPAAAGTG

SEQ ID NO: 261923 - protein, 12 aa, Mycobacterium
GPAAAQAVTYPE

SEQ ID NO: 261924 - protein, 11 aa, Mycobacterium
GPAADSRTAVG

SEQ ID NO: 261925 - protein, 9 aa, Mycobacterium
GPAAGAAKK

SEQ ID NO: 261926 - protein, 7 aa, Mycobacterium
GPAAHPS

SEQ ID NO: 261927 - protein, 15 aa, Mycobacterium
GPAAMSADQQIAGDR

SEQ ID NO: 261928 - protein, 40 aa, Mycobacterium
GPAAPAKATKSGGASSAVAASIERSAEHQSEQRLGSTARR

SEQ ID NO: 261929 - protein, 10 aa, Mycobacterium
GPAARAAGSG

SEQ ID NO: 261930 - protein, 6 aa, Mycobacterium
GPADRD

SEQ ID NO: 261931 - protein, 15 aa, Mycobacterium
GPADREVSTPPSEST

SEQ ID NO: 261932 - protein, 4 aa, Mycobacterium
GPAE

SEQ ID NO: 261933 - protein, 16 aa, Mycobacterium
GPAEDQDATPASPYQR

SEQ ID NO: 261934 - protein, 9 aa, Mycobacterium
GPAESGGLP

SEQ ID NO: 261935 - protein, 5 aa, Mycobacterium
GPAGA

SEQ ID NO: 261936 - protein, 8 aa, Mycobacterium
GPAGAGKR

SEQ ID NO: 261937 - protein, 7 aa, Mycobacterium
GPAGAIP

SEQ ID NO: 261938 - protein, 37 aa, Mycobacterium
GPAGEGPVREPASRSAEPTRPGAEPPAPGKPSPRRYS

SEQ ID NO: 261939 - protein, 10 aa, Mycobacterium
GPAGPDGSFP

SEQ ID NO: 261940 - protein, 6 aa, Mycobacterium
GPAGPF

SEQ ID NO: 261941 - protein, 10 aa, Mycobacterium
GPAGSDNALP

SEQ ID NO: 261942 - protein, 5 aa, Mycobacterium
GPAGW

SEQ ID NO: 261943 - protein, 5 aa, Mycobacterium
GPAHA

SEQ ID NO: 261944 - protein, 6 aa, Mycobacterium
GPAIGA

SEQ ID NO: 261945 - protein, 12 aa, Mycobacterium
GPALGESAQPLD

SEQ ID NO: 261946 - protein, 11 aa, Mycobacterium
GPALSPGTAFG

SEQ ID NO: 261947 - protein, 6 aa, Mycobacterium
GPALSR

SEQ ID NO: 261948 - protein, 7 aa, Mycobacterium
GPALSRS

SEQ ID NO: 261949 - protein, 7 aa, Mycobacterium
GPALTNP

SEQ ID NO: 261950 - protein, 4 aa, Mycobacterium
GPAM

SEQ ID NO: 261951 - protein, 4 aa, Mycobacterium
GPAN

SEQ ID NO: 261952 - protein, 4 aa, Mycobacterium
GPAP

SEQ ID NO: 261953 - protein, 11 aa, Mycobacterium
GPAPAWKKARG

SEQ ID NO: 261954 - protein, 6 aa, Mycobacterium
GPAPFD

SEQ ID NO: 261955 - protein, 16 aa, Mycobacterium
GPAPGPIPYPGAPPYG

SEQ ID NO: 261956 - protein, 8 aa, Mycobacterium
GPAPLAGD

SEQ ID NO: 261957 - protein, 8 aa, Mycobacterium
GPAPLASD

SEQ ID NO: 261958 - protein, 15 aa, Mycobacterium
GPAPLASDTLNAADE

SEQ ID NO: 261959 - protein, 14 aa, Mycobacterium
GPAPLASDTLTAAD

SEQ ID NO: 261960 - protein, 15 aa, Mycobacterium
GPAPLTTDMNEAADK

SEQ ID NO: 261961 - protein, 50 aa, Mycobacterium
GPAPPGVSSGPRATTGAAATATDTTRAAAPAALSSSRASRRKRSKNRVGV

SEQ ID NO: 261962 - protein, 7 aa, Mycobacterium
GPAPTLD

SEQ ID NO: 261963 - protein, 5 aa, Mycobacterium
GPAPV

SEQ ID NO: 261964 - protein, 4 aa, Mycobacterium
GPAQ

SEQ ID NO: 261965 - protein, 12 aa, Mycobacterium
GPAQRSTDGGRP

SEQ ID NO: 261966 - protein, 5 aa, Mycobacterium
GPARR

SEQ ID NO: 261967 - protein, 6 aa, Mycobacterium
GPARTL

SEQ ID NO: 261968 - protein, 6 aa, Mycobacterium
GPARVP

SEQ ID NO: 261969 - protein, 6 aa, Mycobacterium
GPASAA

SEQ ID NO: 261970 - protein, 24 aa, Mycobacterium
GPASADVDQCAPPGIDSASALPTN

SEQ ID NO: 261971 - protein, 10 aa, Mycobacterium
GPASDAQTPA

SEQ ID NO: 261972 - protein, 19 aa, Mycobacterium
GPASDDAAAQDLTAGQKVA

SEQ ID NO: 261973 - protein, 6 aa, Mycobacterium
GPASTA

SEQ ID NO: 261974 - protein, 6 aa, Mycobacterium
GPATAG

SEQ ID NO: 261975 - protein, 41 aa, Mycobacterium
GPATETPGTPETPDNPPEADEFEGPRRRARRERAERRAAQA

SEQ ID NO: 261976 - protein, 8 aa, Mycobacterium
GPATGSAI

SEQ ID NO: 261977 - protein, 7 aa, Mycobacterium
GPATLGH

SEQ ID NO: 261978 - protein, 8 aa, Mycobacterium
GPATPDEL

SEQ ID NO: 261979 - protein, 7 aa, Mycobacterium
GPATPGY

SEQ ID NO: 261980 - protein, 11 aa, Mycobacterium
GPATRSRRTQE

SEQ ID NO: 261981 - protein, 11 aa, Mycobacterium
GPATTSADQEI

SEQ ID NO: 261982 - protein, 5 aa, Mycobacterium
GPATV

SEQ ID NO: 261983 - protein, 20 aa, Mycobacterium
GPAVASVGEDPPTRESEADS

SEQ ID NO: 261984 - protein, 8 aa, Mycobacterium
GPAVGRPV

SEQ ID NO: 261985 - protein, 6 aa, Mycobacterium
GPAVPA

SEQ ID NO: 261986 - protein, 8 aa, Mycobacterium
GPAVTETP

SEQ ID NO: 261987 - protein, 12 aa, Mycobacterium
GPAYAGSGQTAV

SEQ ID NO: 261988 - protein, 23 aa, Mycobacterium
GPDADDPSELTTSAAPEQGAAPL

SEQ ID NO: 261989 - protein, 10 aa, Mycobacterium
GPDAEGLTDR

SEQ ID NO: 261990 - protein, 5 aa, Mycobacterium
GPDAR

SEQ ID NO: 261991 - protein, 6 aa, Mycobacterium
GPDDAQ

SEQ ID NO: 261992 - protein, 5 aa, Mycobacterium
GPDDC

SEQ ID NO: 261993 - protein, 9 aa, Mycobacterium
GPDDCAAAN

SEQ ID NO: 261994 - protein, 16 aa, Mycobacterium
GPDDKTDQWQAGDPVV

SEQ ID NO: 261995 - protein, 10 aa, Mycobacterium
GPDDSKRAVH

SEQ ID NO: 261996 - protein, 9 aa, Mycobacterium
GPDDTKRAI

SEQ ID NO: 261997 - protein, 10 aa, Mycobacterium
GPDDTKRAIH

SEQ ID NO: 261998 - protein, 6 aa, Mycobacterium
GPDDYR

SEQ ID NO: 261999 - protein, 5 aa, Mycobacterium
GPDEC

SEQ ID NO: 262000 - protein, 8 aa, Mycobacterium
GPDGARTY

SEQ ID NO: 262001 - protein, 8 aa, Mycobacterium
GPDGDDLD

SEQ ID NO: 262002 - protein, 5 aa, Mycobacterium
GPDGE

SEQ ID NO: 262003 - protein, 10 aa, Mycobacterium
GPDGEPAGSI

SEQ ID NO: 262004 - protein, 8 aa, Mycobacterium
GPDGGPGR

SEQ ID NO: 262005 - protein, 12 aa, Mycobacterium
GPDGGWQGSAAQ

SEQ ID NO: 262006 - protein, 5 aa, Mycobacterium
GPDGN

SEQ ID NO: 262007 - protein, 10 aa, Mycobacterium
GPDGQNPPDE

SEQ ID NO: 262008 - protein, 9 aa, Mycobacterium
GPDGRPTAG

SEQ ID NO: 262009 - protein, 17 aa, Mycobacterium
GPDGTVRASSDPSRVGA

SEQ ID NO: 262010 - protein, 4 aa, Mycobacterium
GPDK

SEQ ID NO: 262011 - protein, 5 aa, Mycobacterium
GPDKV

SEQ ID NO: 262012 - protein, 5 aa, Mycobacterium
GPDLG

SEQ ID NO: 262013 - protein, 10 aa, Mycobacterium
GPDLRTDQTI

SEQ ID NO: 262014 - protein, 8 aa, Mycobacterium
GPDNAGGP

SEQ ID NO: 262015 - protein, 4 aa, Mycobacterium
GPDP

SEQ ID NO: 262016 - protein, 9 aa, Mycobacterium
GPDPSALAA

SEQ ID NO: 262017 - protein, 9 aa, Mycobacterium
GPDPSALAT

SEQ ID NO: 262018 - protein, 8 aa, Mycobacterium
GPDRESST

SEQ ID NO: 262019 - protein, 5 aa, Mycobacterium
GPDRY

SEQ ID NO: 262020 - protein, 11 aa, Mycobacterium
GPDSAIGTTTL

SEQ ID NO: 262021 - protein, 6 aa, Mycobacterium
GPDSTW

SEQ ID NO: 262022 - protein, 85 aa, Mycobacterium
GPDVAPPPAPPAFGTTRNGNLPGPPNAFDQNNPLPPPWYPQPGPPPAPAPGVVPGNPAPVNAPAPAAPAPAAPSGPLLPAEAGGT

SEQ ID NO: 262023 - protein, 6 aa, Mycobacterium
GPEAAV

SEQ ID NO: 262024 - protein, 8 aa, Mycobacterium
GPEAGGLE

SEQ ID NO: 262025 - protein, 7 aa, Mycobacterium
GPEAQRR

SEQ ID NO: 262026 - protein, 5 aa, Mycobacterium
GPEAT

SEQ ID NO: 262027 - protein, 13 aa, Mycobacterium
GPEATGLPQTPDD

SEQ ID NO: 262028 - protein, 4 aa, Mycobacterium
GPED

SEQ ID NO: 262029 - protein, 13 aa, Mycobacterium
GPEDLQRNAATVG

SEQ ID NO: 262030 - protein, 8 aa, Mycobacterium
GPEEDTDD

SEQ ID NO: 262031 - protein, 5 aa, Mycobacterium
GPEEL

SEQ ID NO: 262032 - protein, 4 aa, Mycobacterium
GPEG

SEQ ID NO: 262033 - protein, 6 aa, Mycobacterium
GPEGPA

SEQ ID NO: 262034 - protein, 6 aa, Mycobacterium
GPEGQA

SEQ ID NO: 262035 - protein, 10 aa, Mycobacterium
GPEGRSGIPA

SEQ ID NO: 262036 - protein, 6 aa, Mycobacterium
GPEIRA

SEQ ID NO: 262037 - protein, 12 aa, Mycobacterium
GPEKPGEPDVSR

SEQ ID NO: 262038 - protein, 4 aa, Mycobacterium
GPEL

SEQ ID NO: 262039 - protein, 11 aa, Mycobacterium
GPEPSRSQQQA

SEQ ID NO: 262040 - protein, 21 aa, Mycobacterium
GPEPTTGDPADTRDRARTRRG

SEQ ID NO: 262041 - protein, 8 aa, Mycobacterium
GPEQDTDD

SEQ ID NO: 262042 - protein, 18 aa, Mycobacterium
GPEQESAGIDEAEHAENG

SEQ ID NO: 262043 - protein, 18 aa, Mycobacterium
GPERKARDSRKRSRPYLT

SEQ ID NO: 262044 - protein, 8 aa, Mycobacterium
GPERKTRA

SEQ ID NO: 262045 - protein, 11 aa, Mycobacterium
GPESNTMTPRT

SEQ ID NO: 262046 - protein, 8 aa, Mycobacterium
GPETNRRD

SEQ ID NO: 262047 - protein, 14 aa, Mycobacterium
GPEVGGPPDGSACD

SEQ ID NO: 262048 - protein, 9 aa, Mycobacterium
GPFGGPSTI

SEQ ID NO: 262049 - protein, 14 aa, Mycobacterium
GPFPGPPPQRPSGN

SEQ ID NO: 262050 - protein, 11 aa, Mycobacterium
GPFPKDAVQSA

SEQ ID NO: 262051 - protein, 11 aa, Mycobacterium
GPFSKETVQDA

SEQ ID NO: 262052 - protein, 7 aa, Mycobacterium
GPFTEYG

SEQ ID NO: 262053 - protein, 50 aa, Mycobacterium
GPGADATATGPAATEPPAGQAPQTQGNNTAPPAAQPPNRQGQAPAGRPEV

SEQ ID NO: 262054 - protein, 7 aa, Mycobacterium
GPGADGG

SEQ ID NO: 262055 - protein, 6 aa, Mycobacterium
GPGAEV

SEQ ID NO: 262056 - protein, 7 aa, Mycobacterium
GPGAFNE

SEQ ID NO: 262057 - protein, 59 aa, Mycobacterium
GPGAGATATDVAPAEGRPAQSTPNGQQPAASPPPAANADGRPAQAPPPPSAATPTGPVQ

SEQ ID NO: 262058 - protein, 60 aa, Mycobacterium
GPGAGDAATGIQPTEAGVPANPPANPPPATGPGGTPPPTAVVPPPPDGAATLSPAKAAAL

SEQ ID NO: 262059 - protein, 52 aa, Mycobacterium
GPGAGDAATGIQPTEGGAPANVPPNNAPSPEALPGTPPSPPTAVPPAPEASV

SEQ ID NO: 262060 - protein, 6 aa, Mycobacterium
GPGALG

SEQ ID NO: 262061 - protein, 6 aa, Mycobacterium
GPGALQ

SEQ ID NO: 262062 - protein, 17 aa, Mycobacterium
GPGAPISDGERISEDTD

SEQ ID NO: 262063 - protein, 6 aa, Mycobacterium
GPGAPT

SEQ ID NO: 262064 - protein, 8 aa, Mycobacterium
GPGARGAD

SEQ ID NO: 262065 - protein, 18 aa, Mycobacterium
GPGATADSADQHEKYSNA

SEQ ID NO: 262066 - protein, 7 aa, Mycobacterium
GPGDSMT

SEQ ID NO: 262067 - protein, 8 aa, Mycobacterium
GPGDTQLE

SEQ ID NO: 262068 - protein, 77 aa, Mycobacterium
GPGDTTEEAPDPSSQPAHAIGRTSRSTRTSRNSRTASRRSDRSRSRHARSGGDDPVDPAAERPRRRRPAQPRDYRDY

SEQ ID NO: 262069 - protein, 4 aa, Mycobacterium
GPGE

SEQ ID NO: 262070 - protein, 5 aa, Mycobacterium
GPGEF

SEQ ID NO: 262071 - protein, 6 aa, Mycobacterium
GPGFAQ

SEQ ID NO: 262072 - protein, 9 aa, Mycobacterium
GPGFAQETS

SEQ ID NO: 262073 - protein, 4 aa, Mycobacterium
GPGG

SEQ ID NO: 262074 - protein, 46 aa, Mycobacterium
GPGGGGGFPGGDDDRGGRGGGRGGRHGGGHGGGHGRGGFNIPFIPG

SEQ ID NO: 262075 - protein, 42 aa, Mycobacterium
GPGGGGGFPGGGDDGDDHGGGRGGGHGRGHGRGGFNIPFIPG

SEQ ID NO: 262076 - protein, 5 aa, Mycobacterium
GPGGP

SEQ ID NO: 262077 - protein, 10 aa, Mycobacterium
GPGGPGPGQG

SEQ ID NO: 262078 - protein, 14 aa, Mycobacterium
GPGHYRTTQPMPVS

SEQ ID NO: 262079 - protein, 5 aa, Mycobacterium
GPGIP

SEQ ID NO: 262080 - protein, 8 aa, Mycobacterium
GPGIPPAE

SEQ ID NO: 262081 - protein, 8 aa, Mycobacterium
GPGKARAV

SEQ ID NO: 262082 - protein, 11 aa, Mycobacterium
GPGKGGLASNR

SEQ ID NO: 262083 - protein, 9 aa, Mycobacterium
GPGKNGLAA

SEQ ID NO: 262084 - protein, 4 aa, Mycobacterium
GPGL

SEQ ID NO: 262085 - protein, 6 aa, Mycobacterium
GPGLAR

SEQ ID NO: 262086 - protein, 15 aa, Mycobacterium
GPGLHPAPPPGGPPL

SEQ ID NO: 262087 - protein, 5 aa, Mycobacterium
GPGLS

SEQ ID NO: 262088 - protein, 4 aa, Mycobacterium
GPGN

SEQ ID NO: 262089 - protein, 13 aa, Mycobacterium
GPGNGAGGESAEN

SEQ ID NO: 262090 - protein, 4 aa, Mycobacterium
GPGP

SEQ ID NO: 262091 - protein, 7 aa, Mycobacterium
GPGPGPI

SEQ ID NO: 262092 - protein, 22 aa, Mycobacterium
GPGPGWPGAPRRWSKRPARRAR

SEQ ID NO: 262093 - protein, 6 aa, Mycobacterium
GPGPIL

SEQ ID NO: 262094 - protein, 7 aa, Mycobacterium
GPGPTFD

SEQ ID NO: 262095 - protein, 4 aa, Mycobacterium
GPGQ

SEQ ID NO: 262096 - protein, 7 aa, Mycobacterium
GPGQAGE

SEQ ID NO: 262097 - protein, 29 aa, Mycobacterium
GPGQPGRSPVVQGRPSITSAAAPQVGANG

SEQ ID NO: 262098 - protein, 8 aa, Mycobacterium
GPGQPSLA

SEQ ID NO: 262099 - protein, 19 aa, Mycobacterium
GPGQQPSPTTTPAVPTTPQ

SEQ ID NO: 262100 - protein, 8 aa, Mycobacterium
GPGRDGLA

SEQ ID NO: 262101 - protein, 17 aa, Mycobacterium
GPGRDGQQLRVIRRLRS

SEQ ID NO: 262102 - protein, 16 aa, Mycobacterium
GPGRDGSGDGAGHPNA

SEQ ID NO: 262103 - protein, 5 aa, Mycobacterium
GPGRF

SEQ ID NO: 262104 - protein, 8 aa, Mycobacterium
GPGRGGLA

SEQ ID NO: 262105 - protein, 6 aa, Mycobacterium
GPGRGT

SEQ ID NO: 262106 - protein, 10 aa, Mycobacterium
GPGRTGQPDG

SEQ ID NO: 262107 - protein, 6 aa, Mycobacterium
GPGRYG

SEQ ID NO: 262108 - protein, 7 aa, Mycobacterium
GPGRYGL

SEQ ID NO: 262109 - protein, 8 aa, Mycobacterium
GPGRYGLD

SEQ ID NO: 262110 - protein, 11 aa, Mycobacterium
GPGSDGEPAAT

SEQ ID NO: 262111 - protein, 10 aa, Mycobacterium
GPGSGLTGSI

SEQ ID NO: 262112 - protein, 6 aa, Mycobacterium
GPGSVG

SEQ ID NO: 262113 - protein, 5 aa, Mycobacterium
GPGSW

SEQ ID NO: 262114 - protein, 6 aa, Mycobacterium
GPGVED

SEQ ID NO: 262115 - protein, 12 aa, Mycobacterium
GPGVSPRANLGR

SEQ ID NO: 262116 - protein, 4 aa, Mycobacterium
GPGW

SEQ ID NO: 262117 - protein, 6 aa, Mycobacterium
GPGWST

SEQ ID NO: 262118 - protein, 13 aa, Mycobacterium
GPHDLEKNAATVG

SEQ ID NO: 262119 - protein, 11 aa, Mycobacterium
GPHGHPSASGW

SEQ ID NO: 262120 - protein, 7 aa, Mycobacterium
GPHPATY

SEQ ID NO: 262121 - protein, 4 aa, Mycobacterium
GPHQ

SEQ ID NO: 262122 - protein, 5 aa, Mycobacterium
GPHSG

SEQ ID NO: 262123 - protein, 12 aa, Mycobacterium
GPHTDQSLDGPG

SEQ ID NO: 262124 - protein, 11 aa, Mycobacterium
GPHTDQTLDGA

SEQ ID NO: 262125 - protein, 12 aa, Mycobacterium
GPHTDRSLGAQG

SEQ ID NO: 262126 - protein, 11 aa, Mycobacterium
GPHTLKGKSAA

SEQ ID NO: 262127 - protein, 16 aa, Mycobacterium
GPIAAPVGAETFSARS

SEQ ID NO: 262128 - protein, 4 aa, Mycobacterium
GPIE

SEQ ID NO: 262129 - protein, 12 aa, Mycobacterium
GPIEPGQAQQTT

SEQ ID NO: 262130 - protein, 13 aa, Mycobacterium
GPIPPAGDSLDAY

SEQ ID NO: 262131 - protein, 5 aa, Mycobacterium
GPIPT

SEQ ID NO: 262132 - protein, 5 aa, Mycobacterium
GPIRP

SEQ ID NO: 262133 - protein, 12 aa, Mycobacterium
GPISATVRSARG

SEQ ID NO: 262134 - protein, 5 aa, Mycobacterium
GPISD

SEQ ID NO: 262135 - protein, 12 aa, Mycobacterium
GPITEAPRGGRL

SEQ ID NO: 262136 - protein, 8 aa, Mycobacterium
GPKECEAV

SEQ ID NO: 262137 - protein, 9 aa, Mycobacterium
GPKFDPNGK

SEQ ID NO: 262138 - protein, 24 aa, Mycobacterium
GPKGPDGKPSKQAISDSAVSETWG

SEQ ID NO: 262139 - protein, 6 aa, Mycobacterium
GPKGRA

SEQ ID NO: 262140 - protein, 27 aa, Mycobacterium
GPKGTDGKPSRQAISDSAVSETWGDQI

SEQ ID NO: 262141 - protein, 4 aa, Mycobacterium
GPKI

SEQ ID NO: 262142 - protein, 12 aa, Mycobacterium
GPKLGDKARKRL

SEQ ID NO: 262143 - protein, 6 aa, Mycobacterium
GPKPAG

SEQ ID NO: 262144 - protein, 5 aa, Mycobacterium
GPKRL

SEQ ID NO: 262145 - protein, 13 aa, Mycobacterium
GPKSPDAASGPSW

SEQ ID NO: 262146 - protein, 7 aa, Mycobacterium
GPLAGGY

SEQ ID NO: 262147 - protein, 11 aa, Mycobacterium
GPLAPGPQNSI

SEQ ID NO: 262148 - protein, 4 aa, Mycobacterium
GPLD

SEQ ID NO: 262149 - protein, 6 aa, Mycobacterium
GPLDTE

SEQ ID NO: 262150 - protein, 15 aa, Mycobacterium
GPLGLGNAGEPVAAT

SEQ ID NO: 262151 - protein, 15 aa, Mycobacterium
GPLGLGNPGSPVAVT

SEQ ID NO: 262152 - protein, 5 aa, Mycobacterium
GPLGP

SEQ ID NO: 262153 - protein, 21 aa, Mycobacterium
GPLPAPSRSIAASSAPPKALE

SEQ ID NO: 262154 - protein, 13 aa, Mycobacterium
GPLPNRPNNTSGT

SEQ ID NO: 262155 - protein, 5 aa, Mycobacterium
GPLPP

SEQ ID NO: 262156 - protein, 6 aa, Mycobacterium
GPLPPA

SEQ ID NO: 262157 - protein, 7 aa, Mycobacterium
GPLPPPR

SEQ ID NO: 262158 - protein, 17 aa, Mycobacterium
GPLQVSDQQINQARDTA

SEQ ID NO: 262159 - protein, 21 aa, Mycobacterium
GPLRGAGDAAREIAGAGQSLG

SEQ ID NO: 262160 - protein, 4 aa, Mycobacterium
GPLS

SEQ ID NO: 262161 - protein, 12 aa, Mycobacterium
GPLTGRRSAPLT

SEQ ID NO: 262162 - protein, 13 aa, Mycobacterium
GPLTPKDSHWEHT

SEQ ID NO: 262163 - protein, 7 aa, Mycobacterium
GPLTPPR

SEQ ID NO: 262164 - protein, 7 aa, Mycobacterium
GPLTPQD

SEQ ID NO: 262165 - protein, 16 aa, Mycobacterium
GPMGHGATGSGPRYGV

SEQ ID NO: 262166 - protein, 4 aa, Mycobacterium
GPNA

SEQ ID NO: 262167 - protein, 7 aa, Mycobacterium
GPNDADG

SEQ ID NO: 262168 - protein, 4 aa, Mycobacterium
GPNE

SEQ ID NO: 262169 - protein, 13 aa, Mycobacterium
GPNEDADGVIPDR

SEQ ID NO: 262170 - protein, 11 aa, Mycobacterium
GPNGEPETADV

SEQ ID NO: 262171 - protein, 8 aa, Mycobacterium
GPNGETTA

SEQ ID NO: 262172 - protein, 9 aa, Mycobacterium
GPNGETTSI

SEQ ID NO: 262173 - protein, 10 aa, Mycobacterium
GPNGGPETGT

SEQ ID NO: 262174 - protein, 15 aa, Mycobacterium
GPNGVDQAGTAAASQ

SEQ ID NO: 262175 - protein, 4 aa, Mycobacterium
GPNI

SEQ ID NO: 262176 - protein, 5 aa, Mycobacterium
GPNKD

SEQ ID NO: 262177 - protein, 6 aa, Mycobacterium
GPNKDN

SEQ ID NO: 262178 - protein, 9 aa, Mycobacterium
GPNKPDPSQ

SEQ ID NO: 262179 - protein, 8 aa, Mycobacterium
GPNNSPTV

SEQ ID NO: 262180 - protein, 6 aa, Mycobacterium
GPNPGH

SEQ ID NO: 262181 - protein, 9 aa, Mycobacterium
GPNQRSGGA

SEQ ID NO: 262182 - protein, 6 aa, Mycobacterium
GPNRGS

SEQ ID NO: 262183 - protein, 5 aa, Mycobacterium
GPNRV

SEQ ID NO: 262184 - protein, 4 aa, Mycobacterium
GPNS

SEQ ID NO: 262185 - protein, 6 aa, Mycobacterium
GPNSAH

SEQ ID NO: 262186 - protein, 13 aa, Mycobacterium
GPNSGASKPSGAN

SEQ ID NO: 262187 - protein, 8 aa, Mycobacterium
GPNSSPTV

SEQ ID NO: 262188 - protein, 4 aa, Mycobacterium
GPNT

SEQ ID NO: 262189 - protein, 7 aa, Mycobacterium
GPNTISP

SEQ ID NO: 262190 - protein, 9 aa, Mycobacterium
GPNTPYPGT

SEQ ID NO: 262191 - protein, 4 aa, Mycobacterium
GPNV

SEQ ID NO: 262192 - protein, 17 aa, Mycobacterium
GPPAAPADPAPTSSTPM

SEQ ID NO: 262193 - protein, 7 aa, Mycobacterium
GPPAEGD

SEQ ID NO: 262194 - protein, 5 aa, Mycobacterium
GPPAF

SEQ ID NO: 262195 - protein, 25 aa, Mycobacterium
GPPAGLPSGLPSVPPVGPPTGRIGT

SEQ ID NO: 262196 - protein, 6 aa, Mycobacterium
GPPAPG

SEQ ID NO: 262197 - protein, 6 aa, Mycobacterium
GPPASD

SEQ ID NO: 262198 - protein, 6 aa, Mycobacterium
GPPDDP

SEQ ID NO: 262199 - protein, 7 aa, Mycobacterium
GPPDSMT

SEQ ID NO: 262200 - protein, 8 aa, Mycobacterium
GPPEWNGN

SEQ ID NO: 262201 - protein, 5 aa, Mycobacterium
GPPEY

SEQ ID NO: 262202 - protein, 13 aa, Mycobacterium
GPPGAEKPTVRQS

SEQ ID NO: 262203 - protein, 9 aa, Mycobacterium
GPPGAGKSS

SEQ ID NO: 262204 - protein, 17 aa, Mycobacterium
GPPGDNEGYDLTTGHNH

SEQ ID NO: 262205 - protein, 16 aa, Mycobacterium
GPPGEVDDGPEERAPL

SEQ ID NO: 262206 - protein, 8 aa, Mycobacterium
GPPGRRTD

SEQ ID NO: 262207 - protein, 9 aa, Mycobacterium
GPPGSATSA

SEQ ID NO: 262208 - protein, 7 aa, Mycobacterium
GPPGSEE

SEQ ID NO: 262209 - protein, 9 aa, Mycobacterium
GPPGSGKST

SEQ ID NO: 262210 - protein, 8 aa, Mycobacterium
GPPGSTAN

SEQ ID NO: 262211 - protein, 8 aa, Mycobacterium
GPPGSTAT

SEQ ID NO: 262212 - protein, 24 aa, Mycobacterium
GPPGWQPSTTATPRAEDAAAVTTS

SEQ ID NO: 262213 - protein, 5 aa, Mycobacterium
GPPGY

SEQ ID NO: 262214 - protein, 5 aa, Mycobacterium
GPPLN

SEQ ID NO: 262215 - protein, 8 aa, Mycobacterium
GPPLPSTV

SEQ ID NO: 262216 - protein, 5 aa, Mycobacterium
GPPNA

SEQ ID NO: 262217 - protein, 7 aa, Mycobacterium
GPPNALD

SEQ ID NO: 262218 - protein, 8 aa, Mycobacterium
GPPPATDA

SEQ ID NO: 262219 - protein, 8 aa, Mycobacterium
GPPPATDH

SEQ ID NO: 262220 - protein, 8 aa, Mycobacterium
GPPPATDQ

SEQ ID NO: 262221 - protein, 9 aa, Mycobacterium
GPPPGTDDE

SEQ ID NO: 262222 - protein, 6 aa, Mycobacterium
GPPPMM

SEQ ID NO: 262223 - protein, 45 aa, Mycobacterium
GPPPPGMGPGMGPGMGPGMSPGPHGGATGPVQTPSAPAPSTPPAR

SEQ ID NO: 262224 - protein, 15 aa, Mycobacterium
GPPPPPGPGGGGPSM

SEQ ID NO: 262225 - protein, 10 aa, Mycobacterium
GPPPPPMGGP

SEQ ID NO: 262226 - protein, 52 aa, Mycobacterium
GPPPPYGQPQYGEPQYGQPQYGQPAYGQPYPPPPPLPYPNDPSDPSFGEAPR

SEQ ID NO: 262227 - protein, 7 aa, Mycobacterium
GPPPQVD

SEQ ID NO: 262228 - protein, 7 aa, Mycobacterium
GPPPTGR

SEQ ID NO: 262229 - protein, 10 aa, Mycobacterium
GPPQEAAPVQ

SEQ ID NO: 262230 - protein, 5 aa, Mycobacterium
GPPQQ

SEQ ID NO: 262231 - protein, 8 aa, Mycobacterium
GPPQSAAR

SEQ ID NO: 262232 - protein, 15 aa, Mycobacterium
GPPTARIVASNGEID

SEQ ID NO: 262233 - protein, 12 aa, Mycobacterium
GPPTESKRDIVK

SEQ ID NO: 262234 - protein, 53 aa, Mycobacterium
GPPTTVPVGPPGAPPVPETAPPVPPPGAPVPPGAPPPPGAPVPPGAPPGPLPP

SEQ ID NO: 262235 - protein, 9 aa, Mycobacterium
GPPVRDAVP

SEQ ID NO: 262236 - protein, 6 aa, Mycobacterium
GPQAKG

SEQ ID NO: 262237 - protein, 6 aa, Mycobacterium
GPQARG

SEQ ID NO: 262238 - protein, 9 aa, Mycobacterium
GPQDGRNAL

SEQ ID NO: 262239 - protein, 10 aa, Mycobacterium
GPQEGSPGPG

SEQ ID NO: 262240 - protein, 33 aa, Mycobacterium
GPQGSWPPGSMGPSGPWGPGQWQPPTTTPTTPR

SEQ ID NO: 262241 - protein, 11 aa, Mycobacterium
GPQGTTASYES

SEQ ID NO: 262242 - protein, 11 aa, Mycobacterium
GPQGTTPSHES

SEQ ID NO: 262243 - protein, 4 aa, Mycobacterium
GPQL

SEQ ID NO: 262244 - protein, 8 aa, Mycobacterium
GPQNQADL

SEQ ID NO: 262245 - protein, 5 aa, Mycobacterium
GPQPL

SEQ ID NO: 262246 - protein, 16 aa, Mycobacterium
GPQPYEGTKMEYGFKR

SEQ ID NO: 262247 - protein, 8 aa, Mycobacterium
GPQRPLDE

SEQ ID NO: 262248 - protein, 16 aa, Mycobacterium
GPQRSTPPSATKLNSP

SEQ ID NO: 262249 - protein, 5 aa, Mycobacterium
GPQRT

SEQ ID NO: 262250 - protein, 11 aa, Mycobacterium
GPQSGKSTAAR

SEQ ID NO: 262251 - protein, 6 aa, Mycobacterium
GPQTTQ

SEQ ID NO: 262252 - protein, 4 aa, Mycobacterium
GPRA

SEQ ID NO: 262253 - protein, 6 aa, Mycobacterium
GPRAAE

SEQ ID NO: 262254 - protein, 25 aa, Mycobacterium
GPRAAGLRAEASGQLKVTETEKALR

SEQ ID NO: 262255 - protein, 5 aa, Mycobacterium
GPRAE

SEQ ID NO: 262256 - protein, 6 aa, Mycobacterium
GPRAGF

SEQ ID NO: 262257 - protein, 19 aa, Mycobacterium
GPRAPGSSYGSRDNGPPVD

SEQ ID NO: 262258 - protein, 20 aa, Mycobacterium
GPRAPGSSYGSRENGPPANE

SEQ ID NO: 262259 - protein, 19 aa, Mycobacterium
GPRAPGSSYGSRENGPPVN

SEQ ID NO: 262260 - protein, 5 aa, Mycobacterium
GPRAR

SEQ ID NO: 262261 - protein, 6 aa, Mycobacterium
GPRARV

SEQ ID NO: 262262 - protein, 7 aa, Mycobacterium
GPRDARG

SEQ ID NO: 262263 - protein, 14 aa, Mycobacterium
GPRDARGNVSRPTR

SEQ ID NO: 262264 - protein, 7 aa, Mycobacterium
GPRDERG

SEQ ID NO: 262265 - protein, 9 aa, Mycobacterium
GPRDSHGNV

SEQ ID NO: 262266 - protein, 4 aa, Mycobacterium
GPRE

SEQ ID NO: 262267 - protein, 4 aa, Mycobacterium
GPRG

SEQ ID NO: 262268 - protein, 10 aa, Mycobacterium
GPRGPGKGTL

SEQ ID NO: 262269 - protein, 5 aa, Mycobacterium
GPRHQ

SEQ ID NO: 262270 - protein, 18 aa, Mycobacterium
GPRHTGAHPPGPGPARAE

SEQ ID NO: 262271 - protein, 5 aa, Mycobacterium
GPRKG

SEQ ID NO: 262272 - protein, 4 aa, Mycobacterium
GPRL

SEQ ID NO: 262273 - protein, 7 aa, Mycobacterium
GPRLTPG

SEQ ID NO: 262274 - protein, 14 aa, Mycobacterium
GPRNGTNNAVSSSA

SEQ ID NO: 262275 - protein, 19 aa, Mycobacterium
GPRPAAGKPNVAVAPGEHP

SEQ ID NO: 262276 - protein, 13 aa, Mycobacterium
GPRPELESSQPGF

SEQ ID NO: 262277 - protein, 8 aa, Mycobacterium
GPRPERPE

SEQ ID NO: 262278 - protein, 15 aa, Mycobacterium
GPRPESAKFQSNSSP

SEQ ID NO: 262279 - protein, 12 aa, Mycobacterium
GPRPLVRSLLLR

SEQ ID NO: 262280 - protein, 9 aa, Mycobacterium
GPRPPLATE

SEQ ID NO: 262281 - protein, 13 aa, Mycobacterium
GPRPQHIPASPAQ

SEQ ID NO: 262282 - protein, 8 aa, Mycobacterium
GPRPQVQR

SEQ ID NO: 262283 - protein, 23 aa, Mycobacterium
GPRPRETRRERARRRAAARRRRN

SEQ ID NO: 262284 - protein, 19 aa, Mycobacterium
GPRPRRDADMTSSAPRLPD

SEQ ID NO: 262285 - protein, 35 aa, Mycobacterium
GPRPRSSGDPEERRDGRRDPRRDGEHALSAGNPVG

SEQ ID NO: 262286 - protein, 7 aa, Mycobacterium
GPRPSSA

SEQ ID NO: 262287 - protein, 8 aa, Mycobacterium
GPRQLGPG

SEQ ID NO: 262288 - protein, 4 aa, Mycobacterium
GPRR

SEQ ID NO: 262289 - protein, 9 aa, Mycobacterium
GPRRTNGGW

SEQ ID NO: 262290 - protein, 9 aa, Mycobacterium
GPRSGGSTG

SEQ ID NO: 262291 - protein, 7 aa, Mycobacterium
GPRSTGL

SEQ ID NO: 262292 - protein, 7 aa, Mycobacterium
GPRTEGL

SEQ ID NO: 262293 - protein, 14 aa, Mycobacterium
GPRTGTNNPVSSGA

SEQ ID NO: 262294 - protein, 4 aa, Mycobacterium
GPRV

SEQ ID NO: 262295 - protein, 5 aa, Mycobacterium
GPRYQ

SEQ ID NO: 262296 - protein, 6 aa, Mycobacterium
GPSAAG

SEQ ID NO: 262297 - protein, 7 aa, Mycobacterium
GPSAAPV

SEQ ID NO: 262298 - protein, 8 aa, Mycobacterium
GPSAARNS

SEQ ID NO: 262299 - protein, 10 aa, Mycobacterium
GPSAATRTRY

SEQ ID NO: 262300 - protein, 6 aa, Mycobacterium
GPSALT

SEQ ID NO: 262301 - protein, 10 aa, Mycobacterium
GPSATPAQGL

SEQ ID NO: 262302 - protein, 4 aa, Mycobacterium
GPSC

SEQ ID NO: 262303 - protein, 4 aa, Mycobacterium
GPSD

SEQ ID NO: 262304 - protein, 10 aa, Mycobacterium
GPSDAYRGKG

SEQ ID NO: 262305 - protein, 4 aa, Mycobacterium
GPSE

SEQ ID NO: 262306 - protein, 26 aa, Mycobacterium
GPSEHDSEPAAPRPPDADDVAPLSFA

SEQ ID NO: 262307 - protein, 15 aa, Mycobacterium
GPSELAARTPADRDR

SEQ ID NO: 262308 - protein, 8 aa, Mycobacterium
GPSENRTT

SEQ ID NO: 262309 - protein, 4 aa, Mycobacterium
GPSF

SEQ ID NO: 262310 - protein, 4 aa, Mycobacterium
GPSG

SEQ ID NO: 262311 - protein, 12 aa, Mycobacterium
GPSGAGKSTFAR

SEQ ID NO: 262312 - protein, 10 aa, Mycobacterium
GPSGAGKSTI

SEQ ID NO: 262313 - protein, 10 aa, Mycobacterium
GPSGAGKSTL

SEQ ID NO: 262314 - protein, 7 aa, Mycobacterium
GPSGCGK

SEQ ID NO: 262315 - protein, 6 aa, Mycobacterium
GPSGGL

SEQ ID NO: 262316 - protein, 8 aa, Mycobacterium
GPSGIDPL

SEQ ID NO: 262317 - protein, 6 aa, Mycobacterium
GPSGIG

SEQ ID NO: 262318 - protein, 38 aa, Mycobacterium
GPSGIPEDSPTGRTLEDPVPAEEPADEEKTGKKRGALR

SEQ ID NO: 262319 - protein, 7 aa, Mycobacterium
GPSGPGL

SEQ ID NO: 262320 - protein, 8 aa, Mycobacterium
GPSGRAAA

SEQ ID NO: 262321 - protein, 10 aa, Mycobacterium
GPSGSGKSTL

SEQ ID NO: 262322 - protein, 9 aa, Mycobacterium
GPSGTGKTT

SEQ ID NO: 262323 - protein, 4 aa, Mycobacterium
GPSI

SEQ ID NO: 262324 - protein, 8 aa, Mycobacterium
GPSKGGGY

SEQ ID NO: 262325 - protein, 8 aa, Mycobacterium
GPSLGGAS

SEQ ID NO: 262326 - protein, 7 aa, Mycobacterium
GPSLSRA

SEQ ID NO: 262327 - protein, 7 aa, Mycobacterium
GPSNAPR

SEQ ID NO: 262328 - protein, 8 aa, Mycobacterium
GPSPETRR

SEQ ID NO: 262329 - protein, 5 aa, Mycobacterium
GPSPL

SEQ ID NO: 262330 - protein, 6 aa, Mycobacterium
GPSPTL

SEQ ID NO: 262331 - protein, 5 aa, Mycobacterium
GPSPV

SEQ ID NO: 262332 - protein, 22 aa, Mycobacterium
GPSQQPSQPPGRRAGGPYDGSW

SEQ ID NO: 262333 - protein, 14 aa, Mycobacterium
GPSRLSSSRPVGAR

SEQ ID NO: 262334 - protein, 6 aa, Mycobacterium
GPSSPI

SEQ ID NO: 262335 - protein, 7 aa, Mycobacterium
GPSSPLS

SEQ ID NO: 262336 - protein, 6 aa, Mycobacterium
GPSSPV

SEQ ID NO: 262337 - protein, 8 aa, Mycobacterium
GPSSSAAT

SEQ ID NO: 262338 - protein, 5 aa, Mycobacterium
GPSTL

SEQ ID NO: 262339 - protein, 14 aa, Mycobacterium
GPTAHRPDAPTRIP

SEQ ID NO: 262340 - protein, 6 aa, Mycobacterium
GPTAPT

SEQ ID NO: 262341 - protein, 11 aa, Mycobacterium
GPTASREQRRS

SEQ ID NO: 262342 - protein, 6 aa, Mycobacterium
GPTDHV

SEQ ID NO: 262343 - protein, 5 aa, Mycobacterium
GPTDQ

SEQ ID NO: 262344 - protein, 5 aa, Mycobacterium
GPTEA

SEQ ID NO: 262345 - protein, 6 aa, Mycobacterium
GPTEAT

SEQ ID NO: 262346 - protein, 12 aa, Mycobacterium
GPTEQQPKGPFG

SEQ ID NO: 262347 - protein, 9 aa, Mycobacterium
GPTGAGKST

SEQ ID NO: 262348 - protein, 7 aa, Mycobacterium
GPTGAHG

SEQ ID NO: 262349 - protein, 6 aa, Mycobacterium
GPTGVE

SEQ ID NO: 262350 - protein, 4 aa, Mycobacterium
GPTH

SEQ ID NO: 262351 - protein, 6 aa, Mycobacterium
GPTHRD

SEQ ID NO: 262352 - protein, 4 aa, Mycobacterium
GPTI

SEQ ID NO: 262353 - protein, 11 aa, Mycobacterium
GPTKDQPTGPF

SEQ ID NO: 262354 - protein, 7 aa, Mycobacterium
GPTLSRG

SEQ ID NO: 262355 - protein, 4 aa, Mycobacterium
GPTN

SEQ ID NO: 262356 - protein, 6 aa, Mycobacterium
GPTPAG

SEQ ID NO: 262357 - protein, 6 aa, Mycobacterium
GPTPDL

SEQ ID NO: 262358 - protein, 13 aa, Mycobacterium
GPTPEAPDFAGSR

SEQ ID NO: 262359 - protein, 7 aa, Mycobacterium
GPTPGGV

SEQ ID NO: 262360 - protein, 11 aa, Mycobacterium
GPTTGSMQGPL

SEQ ID NO: 262361 - protein, 9 aa, Mycobacterium
GPTTSSSVP

SEQ ID NO: 262362 - protein, 6 aa, Mycobacterium
GPTVDE

SEQ ID NO: 262363 - protein, 5 aa, Mycobacterium
GPVAG

SEQ ID NO: 262364 - protein, 27 aa, Mycobacterium
GPVAPTPAPGPAPAPVGAPLPAEAGAG

SEQ ID NO: 262365 - protein, 27 aa, Mycobacterium
GPVAPTPGPAAAPAPVGAPLPAEAGAG

SEQ ID NO: 262366 - protein, 6 aa, Mycobacterium
GPVDEH

SEQ ID NO: 262367 - protein, 10 aa, Mycobacterium
GPVEDDSSTL

SEQ ID NO: 262368 - protein, 15 aa, Mycobacterium
GPVEEEDSVALEGAH

SEQ ID NO: 262369 - protein, 5 aa, Mycobacterium
GPVEP

SEQ ID NO: 262370 - protein, 7 aa, Mycobacterium
GPVGEPQ

SEQ ID NO: 262371 - protein, 8 aa, Mycobacterium
GPVGNPNA

SEQ ID NO: 262372 - protein, 6 aa, Mycobacterium
GPVNEA

SEQ ID NO: 262373 - protein, 5 aa, Mycobacterium
GPVNK

SEQ ID NO: 262374 - protein, 4 aa, Mycobacterium
GPVP

SEQ ID NO: 262375 - protein, 6 aa, Mycobacterium
GPVPVT

SEQ ID NO: 262376 - protein, 9 aa, Mycobacterium
GPVRQQDQQ

SEQ ID NO: 262377 - protein, 14 aa, Mycobacterium
GPVTGPPPPSPSGN

SEQ ID NO: 262378 - protein, 6 aa, Mycobacterium
GPVTSE

SEQ ID NO: 262379 - protein, 7 aa, Mycobacterium
GPVTSGP

SEQ ID NO: 262380 - protein, 5 aa, Mycobacterium
GPVVG

SEQ ID NO: 262381 - protein, 14 aa, Mycobacterium
GPYADEDDYDDYPP

SEQ ID NO: 262382 - protein, 8 aa, Mycobacterium
GPYAKEGW

SEQ ID NO: 262383 - protein, 11 aa, Mycobacterium
GPYDPGERSRP

SEQ ID NO: 262384 - protein, 61 aa, Mycobacterium
GPYGNPYGQEPQWGPPPQGGQYPYPPTGPYQYPPPPYPPPGQPFPPGPYPQGPPPGGPGSK

SEQ ID NO: 262385 - protein, 4 aa, Mycobacterium
GPYK

SEQ ID NO: 262386 - protein, 5 aa, Mycobacterium
GPYLQ

SEQ ID NO: 262387 - protein, 5 aa, Mycobacterium
GPYLT

SEQ ID NO: 262388 - protein, 4 aa, Mycobacterium
GPYP

SEQ ID NO: 262389 - protein, 4 aa, Mycobacterium
GPYR

SEQ ID NO: 262390 - protein, 7 aa, Mycobacterium
GPYRESN

SEQ ID NO: 262391 - protein, 8 aa, Mycobacterium
GPYRESNL

SEQ ID NO: 262392 - protein, 11 aa, Mycobacterium
GPYRESNLRDA

SEQ ID NO: 262393 - protein, 12 aa, Mycobacterium
GPYRGSNLRGAY

SEQ ID NO: 262394 - protein, 17 aa, Mycobacterium
GPYSLDAAGGRRLPLNR

SEQ ID NO: 262395 - protein, 11 aa, Mycobacterium
GPYSPTGKPHV

SEQ ID NO: 262396 - protein, 5 aa, Mycobacterium
GPYTG

SEQ ID NO: 262397 - protein, 6 aa, Mycobacterium
GQAAPA

SEQ ID NO: 262398 - protein, 14 aa, Mycobacterium
GQAASGAEEGGKNQ

SEQ ID NO: 262399 - protein, 13 aa, Mycobacterium
GQADEIARGANAK

SEQ ID NO: 262400 - protein, 6 aa, Mycobacterium
GQADGV

SEQ ID NO: 262401 - protein, 8 aa, Mycobacterium
GQAEAARS

SEQ ID NO: 262402 - protein, 5 aa, Mycobacterium
GQAGE

SEQ ID NO: 262403 - protein, 10 aa, Mycobacterium
GQAGMGGGLA

SEQ ID NO: 262404 - protein, 9 aa, Mycobacterium
GQAGNPLGP

SEQ ID NO: 262405 - protein, 8 aa, Mycobacterium
GQAGNQDT

SEQ ID NO: 262406 - protein, 12 aa, Mycobacterium
GQAGPRSQQAGH

SEQ ID NO: 262407 - protein, 5 aa, Mycobacterium
GQAGS

SEQ ID NO: 262408 - protein, 6 aa, Mycobacterium
GQAHSF

SEQ ID NO: 262409 - protein, 6 aa, Mycobacterium
GQAIPD

SEQ ID NO: 262410 - protein, 8 aa, Mycobacterium
GQAKDAGL

SEQ ID NO: 262411 - protein, 10 aa, Mycobacterium
GQAPDAPKVL

SEQ ID NO: 262412 - protein, 16 aa, Mycobacterium
GQAPLTTDLTDAGEKS

SEQ ID NO: 262413 - protein, 31 aa, Mycobacterium
GQAPPPPATGPAAAEHPGAPAPPRPQPRNGD

SEQ ID NO: 262414 - protein, 18 aa, Mycobacterium
GQAPSGFDAGLLQAAFER

SEQ ID NO: 262415 - protein, 7 aa, Mycobacterium
GQAQQAL

SEQ ID NO: 262416 - protein, 18 aa, Mycobacterium
GQARDEVKHQTGADQIEA

SEQ ID NO: 262417 - protein, 7 aa, Mycobacterium
GQARDPE

SEQ ID NO: 262418 - protein, 8 aa, Mycobacterium
GQARPADR

SEQ ID NO: 262419 - protein, 20 aa, Mycobacterium
GQARSQTQEAEQRRREADLS

SEQ ID NO: 262420 - protein, 5 aa, Mycobacterium
GQASR

SEQ ID NO: 262421 - protein, 9 aa, Mycobacterium
GQASSTRMG

SEQ ID NO: 262422 - protein, 6 aa, Mycobacterium
GQATSF

SEQ ID NO: 262423 - protein, 8 aa, Mycobacterium
GQATTDAN

SEQ ID NO: 262424 - protein, 4 aa, Mycobacterium
GQAV

SEQ ID NO: 262425 - protein, 4 aa, Mycobacterium
GQAY

SEQ ID NO: 262426 - protein, 5 aa, Mycobacterium
GQDFT

SEQ ID NO: 262427 - protein, 6 aa, Mycobacterium
GQDGDG

SEQ ID NO: 262428 - protein, 11 aa, Mycobacterium
GQDGPLAPTAG

SEQ ID NO: 262429 - protein, 6 aa, Mycobacterium
GQDMPP

SEQ ID NO: 262430 - protein, 5 aa, Mycobacterium
GQDQD

SEQ ID NO: 262431 - protein, 10 aa, Mycobacterium
GQDRTGPGKE

SEQ ID NO: 262432 - protein, 5 aa, Mycobacterium
GQDSP

SEQ ID NO: 262433 - protein, 7 aa, Mycobacterium
GQDSQTV

SEQ ID NO: 262434 - protein, 4 aa, Mycobacterium
GQEA

SEQ ID NO: 262435 - protein, 6 aa, Mycobacterium
GQECQQ

SEQ ID NO: 262436 - protein, 4 aa, Mycobacterium
GQEK

SEQ ID NO: 262437 - protein, 8 aa, Mycobacterium
GQERTAPF

SEQ ID NO: 262438 - protein, 4 aa, Mycobacterium
GQEV

SEQ ID NO: 262439 - protein, 7 aa, Mycobacterium
GQEVPGA

SEQ ID NO: 262440 - protein, 4 aa, Mycobacterium
GQFG

SEQ ID NO: 262441 - protein, 4 aa, Mycobacterium
GQFT

SEQ ID NO: 262442 - protein, 4 aa, Mycobacterium
GQGA

SEQ ID NO: 262443 - protein, 8 aa, Mycobacterium
GQGAAQAS

SEQ ID NO: 262444 - protein, 7 aa, Mycobacterium
GQGAKFS

SEQ ID NO: 262445 - protein, 7 aa, Mycobacterium
GQGAPQW

SEQ ID NO: 262446 - protein, 6 aa, Mycobacterium
GQGDSP

SEQ ID NO: 262447 - protein, 10 aa, Mycobacterium
GQGGKVPQQL

SEQ ID NO: 262448 - protein, 6 aa, Mycobacterium
GQGGNL

SEQ ID NO: 262449 - protein, 9 aa, Mycobacterium
GQGGNVPAQ

SEQ ID NO: 262450 - protein, 4 aa, Mycobacterium
GQGL

SEQ ID NO: 262451 - protein, 5 aa, Mycobacterium
GQGMS

SEQ ID NO: 262452 - protein, 13 aa, Mycobacterium
GQGNLVSGPGSYP

SEQ ID NO: 262453 - protein, 9 aa, Mycobacterium
GQGPGRSRA

SEQ ID NO: 262454 - protein, 6 aa, Mycobacterium
GQGPTV

SEQ ID NO: 262455 - protein, 5 aa, Mycobacterium
GQGRD

SEQ ID NO: 262456 - protein, 11 aa, Mycobacterium
GQGRDEGPLAN

SEQ ID NO: 262457 - protein, 8 aa, Mycobacterium
GQGRNADA

SEQ ID NO: 262458 - protein, 5 aa, Mycobacterium
GQGRT

SEQ ID NO: 262459 - protein, 4 aa, Mycobacterium
GQGS

SEQ ID NO: 262460 - protein, 24 aa, Mycobacterium
GQGSALSSRAHLGAGGKPVDQQTL

SEQ ID NO: 262461 - protein, 6 aa, Mycobacterium
GQGSNF

SEQ ID NO: 262462 - protein, 12 aa, Mycobacterium
GQGSSSGQQLPF

SEQ ID NO: 262463 - protein, 4 aa, Mycobacterium
GQGV

SEQ ID NO: 262464 - protein, 5 aa, Mycobacterium
GQGVD

SEQ ID NO: 262465 - protein, 4 aa, Mycobacterium
GQHD

SEQ ID NO: 262466 - protein, 9 aa, Mycobacterium
GQHDPAPHV

SEQ ID NO: 262467 - protein, 26 aa, Mycobacterium
GQHDPAPKVPHPVSGVSAPRTAEGPH

SEQ ID NO: 262468 - protein, 22 aa, Mycobacterium
GQHDPAPSVPAVNQAPRTAEGP

SEQ ID NO: 262469 - protein, 10 aa, Mycobacterium
GQHDPKPTVP

SEQ ID NO: 262470 - protein, 17 aa, Mycobacterium
GQHDPTKRRPRLRRAAS

SEQ ID NO: 262471 - protein, 12 aa, Mycobacterium
GQHSEQAAAQEI

SEQ ID NO: 262472 - protein, 9 aa, Mycobacterium
GQIDDSGRE

SEQ ID NO: 262473 - protein, 6 aa, Mycobacterium
GQIGDK

SEQ ID NO: 262474 - protein, 5 aa, Mycobacterium
GQIGS

SEQ ID NO: 262475 - protein, 4 aa, Mycobacterium
GQKM

SEQ ID NO: 262476 - protein, 11 aa, Mycobacterium
GQLAGSGYGSA

SEQ ID NO: 262477 - protein, 4 aa, Mycobacterium
GQLG

SEQ ID NO: 262478 - protein, 12 aa, Mycobacterium
GQLGASTALTTL

SEQ ID NO: 262479 - protein, 8 aa, Mycobacterium
GQLGGSPY

SEQ ID NO: 262480 - protein, 16 aa, Mycobacterium
GQLGSASTLATLPSDV

SEQ ID NO: 262481 - protein, 5 aa, Mycobacterium
GQLGT

SEQ ID NO: 262482 - protein, 6 aa, Mycobacterium
GQLPAA

SEQ ID NO: 262483 - protein, 7 aa, Mycobacterium
GQLPEAA

SEQ ID NO: 262484 - protein, 7 aa, Mycobacterium
GQLPQDG

SEQ ID NO: 262485 - protein, 9 aa, Mycobacterium
GQLSGASYR

SEQ ID NO: 262486 - protein, 9 aa, Mycobacterium
GQLTTEDDH

SEQ ID NO: 262487 - protein, 14 aa, Mycobacterium
GQMENQKENATAMG

SEQ ID NO: 262488 - protein, 7 aa, Mycobacterium
GQMGDNP

SEQ ID NO: 262489 - protein, 5 aa, Mycobacterium
GQMTK

SEQ ID NO: 262490 - protein, 7 aa, Mycobacterium
GQMTKTD

SEQ ID NO: 262491 - protein, 7 aa, Mycobacterium
GQNAESC

SEQ ID NO: 262492 - protein, 7 aa, Mycobacterium
GQNAGDN

SEQ ID NO: 262493 - protein, 6 aa, Mycobacterium
GQNAKQ

SEQ ID NO: 262494 - protein, 10 aa, Mycobacterium
GQNGAGKSTT

SEQ ID NO: 262495 - protein, 5 aa, Mycobacterium
GQNGL

SEQ ID NO: 262496 - protein, 7 aa, Mycobacterium
GQNGVPS

SEQ ID NO: 262497 - protein, 4 aa, Mycobacterium
GQNP

SEQ ID NO: 262498 - protein, 30 aa, Mycobacterium
GQNQQSAETTAEPSPTSDTPTSDAPPPGMD

SEQ ID NO: 262499 - protein, 12 aa, Mycobacterium
GQNVGELDKPRF

SEQ ID NO: 262500 - protein, 6 aa, Mycobacterium
GQPAAP

SEQ ID NO: 262501 - protein, 6 aa, Mycobacterium
GQPAED

SEQ ID NO: 262502 - protein, 6 aa, Mycobacterium
GQPAEE

SEQ ID NO: 262503 - protein, 5 aa, Mycobacterium
GQPAN

SEQ ID NO: 262504 - protein, 5 aa, Mycobacterium
GQPAP

SEQ ID NO: 262505 - protein, 16 aa, Mycobacterium
GQPAPAPTDDPSQGAV

SEQ ID NO: 262506 - protein, 10 aa, Mycobacterium
GQPAPQPQIQ

SEQ ID NO: 262507 - protein, 7 aa, Mycobacterium
GQPAPVG

SEQ ID NO: 262508 - protein, 12 aa, Mycobacterium
GQPASDRTDNIG

SEQ ID NO: 262509 - protein, 11 aa, Mycobacterium
GQPASGRTDDI

SEQ ID NO: 262510 - protein, 8 aa, Mycobacterium
GQPASTAT

SEQ ID NO: 262511 - protein, 8 aa, Mycobacterium
GQPATSAD

SEQ ID NO: 262512 - protein, 7 aa, Mycobacterium
GQPDEGV

SEQ ID NO: 262513 - protein, 18 aa, Mycobacterium
GQPDETPSAEATMRSPEA

SEQ ID NO: 262514 - protein, 38 aa, Mycobacterium
GQPDPADLDRPDPPHARRAAESGATHDNADQRVEQEHR

SEQ ID NO: 262515 - protein, 24 aa, Mycobacterium
GQPDRADLDREDEPAAPEKGAQWQ

SEQ ID NO: 262516 - protein, 30 aa, Mycobacterium
GQPDRADLDRPDPPAARHAASGHRVDEEHR

SEQ ID NO: 262517 - protein, 34 aa, Mycobacterium
GQPDRADLDRPDPPHPRHADAHDRADHRVEQEHR

SEQ ID NO: 262518 - protein, 34 aa, Mycobacterium
GQPDRADLDRPDPPSARHTQQVGAPDRRVEEEHR

SEQ ID NO: 262519 - protein, 18 aa, Mycobacterium
GQPDRADLEADPTRPDPI

SEQ ID NO: 262520 - protein, 16 aa, Mycobacterium
GQPDRADLTPPGEHHD

SEQ ID NO: 262521 - protein, 7 aa, Mycobacterium
GQPDRTR

SEQ ID NO: 262522 - protein, 7 aa, Mycobacterium
GQPELGP

SEQ ID NO: 262523 - protein, 7 aa, Mycobacterium
GQPESGL

SEQ ID NO: 262524 - protein, 6 aa, Mycobacterium
GQPGGL

SEQ ID NO: 262525 - protein, 7 aa, Mycobacterium
GQPGIPA

SEQ ID NO: 262526 - protein, 5 aa, Mycobacterium
GQPGL

SEQ ID NO: 262527 - protein, 6 aa, Mycobacterium
GQPGLT

SEQ ID NO: 262528 - protein, 13 aa, Mycobacterium
GQPGNDGFSGVAP

SEQ ID NO: 262529 - protein, 31 aa, Mycobacterium
GQPGSQGESEVAGEVTGDAPPNPEAEVDGPP

SEQ ID NO: 262530 - protein, 5 aa, Mycobacterium
GQPGV

SEQ ID NO: 262531 - protein, 12 aa, Mycobacterium
GQPKLADNSLTE

SEQ ID NO: 262532 - protein, 10 aa, Mycobacterium
GQPLPAEHGY

SEQ ID NO: 262533 - protein, 12 aa, Mycobacterium
GQPPFEGDAEEL

SEQ ID NO: 262534 - protein, 14 aa, Mycobacterium
GQPPFETEDAGELK

SEQ ID NO: 262535 - protein, 6 aa, Mycobacterium
GQPQLA

SEQ ID NO: 262536 - protein, 6 aa, Mycobacterium
GQPRAT

SEQ ID NO: 262537 - protein, 5 aa, Mycobacterium
GQPRQ

SEQ ID NO: 262538 - protein, 14 aa, Mycobacterium
GQPSPDDGFSGVAP

SEQ ID NO: 262539 - protein, 9 aa, Mycobacterium
GQPSRQAAA

SEQ ID NO: 262540 - protein, 10 aa, Mycobacterium
GQPSRQAAAP

SEQ ID NO: 262541 - protein, 6 aa, Mycobacterium
GQPSRT

SEQ ID NO: 262542 - protein, 9 aa, Mycobacterium
GQPTANTGL

SEQ ID NO: 262543 - protein, 6 aa, Mycobacterium
GQPTAT

SEQ ID NO: 262544 - protein, 6 aa, Mycobacterium
GQPTDL

SEQ ID NO: 262545 - protein, 6 aa, Mycobacterium
GQPTPR

SEQ ID NO: 262546 - protein, 16 aa, Mycobacterium
GQPTRLATPIETAELD

SEQ ID NO: 262547 - protein, 7 aa, Mycobacterium
GQPVGAE

SEQ ID NO: 262548 - protein, 7 aa, Mycobacterium
GQPVSAE

SEQ ID NO: 262549 - protein, 23 aa, Mycobacterium
GQQAEPDRGSSAPPRGPSSGERI

SEQ ID NO: 262550 - protein, 5 aa, Mycobacterium
GQQAG

SEQ ID NO: 262551 - protein, 7 aa, Mycobacterium
GQQAQQA

SEQ ID NO: 262552 - protein, 6 aa, Mycobacterium
GQQEAG

SEQ ID NO: 262553 - protein, 8 aa, Mycobacterium
GQQSQETV

SEQ ID NO: 262554 - protein, 14 aa, Mycobacterium
GQRAAQAEETLRNA

SEQ ID NO: 262555 - protein, 12 aa, Mycobacterium
GQRAEQAAADDI

SEQ ID NO: 262556 - protein, 6 aa, Mycobacterium
GQRANL

SEQ ID NO: 262557 - protein, 6 aa, Mycobacterium
GQRANV

SEQ ID NO: 262558 - protein, 9 aa, Mycobacterium
GQRATIEGR

SEQ ID NO: 262559 - protein, 14 aa, Mycobacterium
GQRATQAGETLRNA

SEQ ID NO: 262560 - protein, 9 aa, Mycobacterium
GQRATVEGR

SEQ ID NO: 262561 - protein, 9 aa, Mycobacterium
GQRESGGLG

SEQ ID NO: 262562 - protein, 9 aa, Mycobacterium
GQRGTNAED

SEQ ID NO: 262563 - protein, 9 aa, Mycobacterium
GQRGTNPQD

SEQ ID NO: 262564 - protein, 5 aa, Mycobacterium
GQRHG

SEQ ID NO: 262565 - protein, 6 aa, Mycobacterium
GQRKSV

SEQ ID NO: 262566 - protein, 11 aa, Mycobacterium
GQRLAKDPAAF

SEQ ID NO: 262567 - protein, 17 aa, Mycobacterium
GQRPALATAAGPTGEAV

SEQ ID NO: 262568 - protein, 9 aa, Mycobacterium
GQRPALQGQ

SEQ ID NO: 262569 - protein, 6 aa, Mycobacterium
GQRPAY

SEQ ID NO: 262570 - protein, 14 aa, Mycobacterium
GQRPGPAAGQPPQR

SEQ ID NO: 262571 - protein, 17 aa, Mycobacterium
GQRPLQGIGAQANAAAR

SEQ ID NO: 262572 - protein, 8 aa, Mycobacterium
GQRQNVPY

SEQ ID NO: 262573 - protein, 12 aa, Mycobacterium
GQRQPVPVDDET

SEQ ID NO: 262574 - protein, 4 aa, Mycobacterium
GQRR

SEQ ID NO: 262575 - protein, 7 aa, Mycobacterium
GQRRRAA

SEQ ID NO: 262576 - protein, 5 aa, Mycobacterium
GQRSP

SEQ ID NO: 262577 - protein, 11 aa, Mycobacterium
GQRSRASAGMG

SEQ ID NO: 262578 - protein, 4 aa, Mycobacterium
GQRT

SEQ ID NO: 262579 - protein, 14 aa, Mycobacterium
GQRTGVGLPGESAG

SEQ ID NO: 262580 - protein, 15 aa, Mycobacterium
GQRTGVGLPGESAGL

SEQ ID NO: 262581 - protein, 14 aa, Mycobacterium
GQRTNAGLPGESAG

SEQ ID NO: 262582 - protein, 15 aa, Mycobacterium
GQRTNVGLPGESSGL

SEQ ID NO: 262583 - protein, 20 aa, Mycobacterium
GQRVPPPISPTTARAYATGS

SEQ ID NO: 262584 - protein, 13 aa, Mycobacterium
GQSAGVSADRRAA

SEQ ID NO: 262585 - protein, 5 aa, Mycobacterium
GQSEG

SEQ ID NO: 262586 - protein, 5 aa, Mycobacterium
GQSEK

SEQ ID NO: 262587 - protein, 5 aa, Mycobacterium
GQSFD

SEQ ID NO: 262588 - protein, 4 aa, Mycobacterium
GQSG

SEQ ID NO: 262589 - protein, 6 aa, Mycobacterium
GQSGDV

SEQ ID NO: 262590 - protein, 7 aa, Mycobacterium
GQSGHPN

SEQ ID NO: 262591 - protein, 7 aa, Mycobacterium
GQSGHSN

SEQ ID NO: 262592 - protein, 5 aa, Mycobacterium
GQSGS

SEQ ID NO: 262593 - protein, 9 aa, Mycobacterium
GQSGSGKTT

SEQ ID NO: 262594 - protein, 10 aa, Mycobacterium
GQSGTDVARE

SEQ ID NO: 262595 - protein, 7 aa, Mycobacterium
GQSIGPR

SEQ ID NO: 262596 - protein, 4 aa, Mycobacterium
GQSL

SEQ ID NO: 262597 - protein, 30 aa, Mycobacterium
GQSPDHGRSRGIGRQDRAGRRQDEGDVSLR

SEQ ID NO: 262598 - protein, 6 aa, Mycobacterium
GQSPGV

SEQ ID NO: 262599 - protein, 8 aa, Mycobacterium
GQSPSLAD

SEQ ID NO: 262600 - protein, 6 aa, Mycobacterium
GQSRGW

SEQ ID NO: 262601 - protein, 8 aa, Mycobacterium
GQSTRGAL

SEQ ID NO: 262602 - protein, 8 aa, Mycobacterium
GQSTTPYQ

SEQ ID NO: 262603 - protein, 4 aa, Mycobacterium
GQTA

SEQ ID NO: 262604 - protein, 6 aa, Mycobacterium
GQTATQ

SEQ ID NO: 262605 - protein, 5 aa, Mycobacterium
GQTCA

SEQ ID NO: 262606 - protein, 7 aa, Mycobacterium
GQTDGPF

SEQ ID NO: 262607 - protein, 5 aa, Mycobacterium
GQTDV

SEQ ID NO: 262608 - protein, 24 aa, Mycobacterium
GQTGRRGALRSSANDSKVSLSTDG

SEQ ID NO: 262609 - protein, 7 aa, Mycobacterium
GQTHAQA

SEQ ID NO: 262610 - protein, 4 aa, Mycobacterium
GQTI

SEQ ID NO: 262611 - protein, 11 aa, Mycobacterium
GQTIDNTTPPT

SEQ ID NO: 262612 - protein, 5 aa, Mycobacterium
GQTIG

SEQ ID NO: 262613 - protein, 7 aa, Mycobacterium
GQTIGPD

SEQ ID NO: 262614 - protein, 9 aa, Mycobacterium
GQTLGGYAR

SEQ ID NO: 262615 - protein, 9 aa, Mycobacterium
GQTLTDKRS

SEQ ID NO: 262616 - protein, 14 aa, Mycobacterium
GQTNLQATATDQTF

SEQ ID NO: 262617 - protein, 4 aa, Mycobacterium
GQTQ

SEQ ID NO: 262618 - protein, 7 aa, Mycobacterium
GQTQTQA

SEQ ID NO: 262619 - protein, 6 aa, Mycobacterium
GQTRDA

SEQ ID NO: 262620 - protein, 7 aa, Mycobacterium
GQTSAPY

SEQ ID NO: 262621 - protein, 11 aa, Mycobacterium
GQTTESRGTVE

SEQ ID NO: 262622 - protein, 7 aa, Mycobacterium
GQTTTPY

SEQ ID NO: 262623 - protein, 10 aa, Mycobacterium
GQTVGGYARP

SEQ ID NO: 262624 - protein, 22 aa, Mycobacterium
GQTVNRAATATTAAAGAVGGAA

SEQ ID NO: 262625 - protein, 18 aa, Mycobacterium
GQTVPEEQTWQTMLLPPK

SEQ ID NO: 262626 - protein, 12 aa, Mycobacterium
GQTWSGGPPRTE

SEQ ID NO: 262627 - protein, 31 aa, Mycobacterium
GQVAPQAAPRQAPRVAAPAPAPAPAPAAPPL

SEQ ID NO: 262628 - protein, 6 aa, Mycobacterium
GQVGAA

SEQ ID NO: 262629 - protein, 5 aa, Mycobacterium
GQVGG

SEQ ID NO: 262630 - protein, 21 aa, Mycobacterium
GQVGGATTSATARLGRASSIG

SEQ ID NO: 262631 - protein, 7 aa, Mycobacterium
GQVGNED

SEQ ID NO: 262632 - protein, 20 aa, Mycobacterium
GQVLPQQQQMDSEGAEAGGF

SEQ ID NO: 262633 - protein, 21 aa, Mycobacterium
GQVNGPKLANNAITTDPAVSQ

SEQ ID NO: 262634 - protein, 9 aa, Mycobacterium
GQVPAPVPA

SEQ ID NO: 262635 - protein, 4 aa, Mycobacterium
GQVR

SEQ ID NO: 262636 - protein, 14 aa, Mycobacterium
GQVRDSVKNSLGTA

SEQ ID NO: 262637 - protein, 5 aa, Mycobacterium
GQYEG

SEQ ID NO: 262638 - protein, 19 aa, Mycobacterium
GQYQDQGEYAPKDQPPDPV

SEQ ID NO: 262639 - protein, 4 aa, Mycobacterium
GQYW

SEQ ID NO: 262640 - protein, 4 aa, Mycobacterium
GRAA

SEQ ID NO: 262641 - protein, 10 aa, Mycobacterium
GRAAATQEEI

SEQ ID NO: 262642 - protein, 19 aa, Mycobacterium
GRAAERADEGDIGSQAVAA

SEQ ID NO: 262643 - protein, 9 aa, Mycobacterium
GRAAGPLIG

SEQ ID NO: 262644 - protein, 8 aa, Mycobacterium
GRAAGTGA

SEQ ID NO: 262645 - protein, 5 aa, Mycobacterium
GRAAL

SEQ ID NO: 262646 - protein, 6 aa, Mycobacterium
GRAAPT

SEQ ID NO: 262647 - protein, 15 aa, Mycobacterium
GRAATETEQTQASTA

SEQ ID NO: 262648 - protein, 22 aa, Mycobacterium
GRAATSAADSLGRKINEWRHNP

SEQ ID NO: 262649 - protein, 21 aa, Mycobacterium
GRAATSAADSLGRKINEWRQP

SEQ ID NO: 262650 - protein, 12 aa, Mycobacterium
GRAAYDEERRGE

SEQ ID NO: 262651 - protein, 4 aa, Mycobacterium
GRAD

SEQ ID NO: 262652 - protein, 9 aa, Mycobacterium
GRADAAKTL

SEQ ID NO: 262653 - protein, 9 aa, Mycobacterium
GRADATDDE

SEQ ID NO: 262654 - protein, 5 aa, Mycobacterium
GRADD

SEQ ID NO: 262655 - protein, 6 aa, Mycobacterium
GRADDN

SEQ ID NO: 262656 - protein, 6 aa, Mycobacterium
GRADMD

SEQ ID NO: 262657 - protein, 7 aa, Mycobacterium
GRADQYS

SEQ ID NO: 262658 - protein, 6 aa, Mycobacterium
GRAECG

SEQ ID NO: 262659 - protein, 10 aa, Mycobacterium
GRAEHTPGGQ

SEQ ID NO: 262660 - protein, 10 aa, Mycobacterium
GRAGEGAATA

SEQ ID NO: 262661 - protein, 6 aa, Mycobacterium
GRAGGL

SEQ ID NO: 262662 - protein, 8 aa, Mycobacterium
GRAGGSVQ

SEQ ID NO: 262663 - protein, 6 aa, Mycobacterium
GRAGPF

SEQ ID NO: 262664 - protein, 45 aa, Mycobacterium
GRAGPHRHRAEAEVPGSFSGRAGPHRHRAEAEVPGSGRAGPHRHR

SEQ ID NO: 262665 - protein, 5 aa, Mycobacterium
GRAGR

SEQ ID NO: 262666 - protein, 14 aa, Mycobacterium
GRAHARTTSQEADQ

SEQ ID NO: 262667 - protein, 18 aa, Mycobacterium
GRAHRGADEPATDAAPPA

SEQ ID NO: 262668 - protein, 5 aa, Mycobacterium
GRAIT

SEQ ID NO: 262669 - protein, 7 aa, Mycobacterium
GRANEVT

SEQ ID NO: 262670 - protein, 4 aa, Mycobacterium
GRAP

SEQ ID NO: 262671 - protein, 7 aa, Mycobacterium
GRAPDND

SEQ ID NO: 262672 - protein, 7 aa, Mycobacterium
GRAPDNT

SEQ ID NO: 262673 - protein, 11 aa, Mycobacterium
GRAPDPDAPAQ

SEQ ID NO: 262674 - protein, 7 aa, Mycobacterium
GRAPEFA

SEQ ID NO: 262675 - protein, 7 aa, Mycobacterium
GRAPEND

SEQ ID NO: 262676 - protein, 19 aa, Mycobacterium
GRAPEQATGTEADGRADQY

SEQ ID NO: 262677 - protein, 6 aa, Mycobacterium
GRAPFE

SEQ ID NO: 262678 - protein, 12 aa, Mycobacterium
GRAPIQPSGELP

SEQ ID NO: 262679 - protein, 5 aa, Mycobacterium
GRAPL

SEQ ID NO: 262680 - protein, 8 aa, Mycobacterium
GRAPLDTP

SEQ ID NO: 262681 - protein, 6 aa, Mycobacterium
GRAPLP

SEQ ID NO: 262682 - protein, 71 aa, Mycobacterium
GRAQQPDPPAPPAPNTSTSPTPEPATAPAGRSPRARRATTAHKSPATAQSAPQQTTKLADRPGRRSSTYFR

SEQ ID NO: 262683 - protein, 15 aa, Mycobacterium
GRARGVRARRPDGTA

SEQ ID NO: 262684 - protein, 6 aa, Mycobacterium
GRARLA

SEQ ID NO: 262685 - protein, 8 aa, Mycobacterium
GRARPTGK

SEQ ID NO: 262686 - protein, 11 aa, Mycobacterium
GRARRPRRPAK

SEQ ID NO: 262687 - protein, 4 aa, Mycobacterium
GRAS

SEQ ID NO: 262688 - protein, 7 aa, Mycobacterium
GRASNPH

SEQ ID NO: 262689 - protein, 5 aa, Mycobacterium
GRASQ

SEQ ID NO: 262690 - protein, 11 aa, Mycobacterium
GRATAGGAEIA

SEQ ID NO: 262691 - protein, 6 aa, Mycobacterium
GRATDN

SEQ ID NO: 262692 - protein, 7 aa, Mycobacterium
GRATDND

SEQ ID NO: 262693 - protein, 9 aa, Mycobacterium
GRDDAKNLE

SEQ ID NO: 262694 - protein, 7 aa, Mycobacterium
GRDDANI

SEQ ID NO: 262695 - protein, 10 aa, Mycobacterium
GRDDETPEFN

SEQ ID NO: 262696 - protein, 6 aa, Mycobacterium
GRDDGG

SEQ ID NO: 262697 - protein, 8 aa, Mycobacterium
GRDDGGPD

SEQ ID NO: 262698 - protein, 14 aa, Mycobacterium
GRDEEDIGESPTSA

SEQ ID NO: 262699 - protein, 21 aa, Mycobacterium
GRDEGAYEETLEAEMEAKTVT

SEQ ID NO: 262700 - protein, 9 aa, Mycobacterium
GRDEGRPPR

SEQ ID NO: 262701 - protein, 6 aa, Mycobacterium
GRDGIS

SEQ ID NO: 262702 - protein, 20 aa, Mycobacterium
GRDGPAELRSPDGPRQLPPG

SEQ ID NO: 262703 - protein, 7 aa, Mycobacterium
GRDGVPV

SEQ ID NO: 262704 - protein, 6 aa, Mycobacterium
GRDHSG

SEQ ID NO: 262705 - protein, 11 aa, Mycobacterium
GRDKDSSTSIQ

SEQ ID NO: 262706 - protein, 12 aa, Mycobacterium
GRDKTSSAPADV

SEQ ID NO: 262707 - protein, 9 aa, Mycobacterium
GRDLPQTTP

SEQ ID NO: 262708 - protein, 9 aa, Mycobacterium
GRDPEAREK

SEQ ID NO: 262709 - protein, 10 aa, Mycobacterium
GRDPEERERT

SEQ ID NO: 262710 - protein, 9 aa, Mycobacterium
GRDPGGLDL

SEQ ID NO: 262711 - protein, 8 aa, Mycobacterium
GRDPHEQH

SEQ ID NO: 262712 - protein, 6 aa, Mycobacterium
GRDPYT

SEQ ID NO: 262713 - protein, 7 aa, Mycobacterium
GRDPYTG

SEQ ID NO: 262714 - protein, 7 aa, Mycobacterium
GRDRGWR

SEQ ID NO: 262715 - protein, 8 aa, Mycobacterium
GRDRPKPL

SEQ ID NO: 262716 - protein, 8 aa, Mycobacterium
GRDRRPAL

SEQ ID NO: 262717 - protein, 5 aa, Mycobacterium
GRDRT

SEQ ID NO: 262718 - protein, 4 aa, Mycobacterium
GRDS

SEQ ID NO: 262719 - protein, 6 aa, Mycobacterium
GRDSPW

SEQ ID NO: 262720 - protein, 5 aa, Mycobacterium
GRDTR

SEQ ID NO: 262721 - protein, 4 aa, Mycobacterium
GRDV

SEQ ID NO: 262722 - protein, 5 aa, Mycobacterium
GRDVE

SEQ ID NO: 262723 - protein, 5 aa, Mycobacterium
GRDVT

SEQ ID NO: 262724 - protein, 12 aa, Mycobacterium
GREAFSDDEAGN

SEQ ID NO: 262725 - protein, 15 aa, Mycobacterium
GREATPVEQTQASTA

SEQ ID NO: 262726 - protein, 10 aa, Mycobacterium
GRECGDAAGP

SEQ ID NO: 262727 - protein, 10 aa, Mycobacterium
GREDRTAPIT

SEQ ID NO: 262728 - protein, 6 aa, Mycobacterium
GREEAR

SEQ ID NO: 262729 - protein, 6 aa, Mycobacterium
GREEEL

SEQ ID NO: 262730 - protein, 12 aa, Mycobacterium
GREERNASLGPG

SEQ ID NO: 262731 - protein, 6 aa, Mycobacterium
GREGEL

SEQ ID NO: 262732 - protein, 6 aa, Mycobacterium
GREGGD

SEQ ID NO: 262733 - protein, 25 aa, Mycobacterium
GREGRTEVPTGPLADPVNGQPRSAA

SEQ ID NO: 262734 - protein, 92 aa, Mycobacterium
GREGYQRGQDAYDRAKDLNSRAPWAKKPDDDSSDTPDEPDQPLTGPPVNGRPPGGRPPSPGRASQQTPAPQAPAADVAASSTAGGTAAAADG

SEQ ID NO: 262735 - protein, 4 aa, Mycobacterium
GREH

SEQ ID NO: 262736 - protein, 10 aa, Mycobacterium
GREIGGDTAQ

SEQ ID NO: 262737 - protein, 10 aa, Mycobacterium
GREIGGETAK

SEQ ID NO: 262738 - protein, 5 aa, Mycobacterium
GREPE

SEQ ID NO: 262739 - protein, 13 aa, Mycobacterium
GREPEKCPAPTEL

SEQ ID NO: 262740 - protein, 6 aa, Mycobacterium
GREPEL

SEQ ID NO: 262741 - protein, 8 aa, Mycobacterium
GREPRSEF

SEQ ID NO: 262742 - protein, 14 aa, Mycobacterium
GREPTGGTVERPGA

SEQ ID NO: 262743 - protein, 12 aa, Mycobacterium
GREPVAVDPENG

SEQ ID NO: 262744 - protein, 35 aa, Mycobacterium
GRESQPSAVPPGVLPPSSTTSHPHKPRPASQDASC

SEQ ID NO: 262745 - protein, 12 aa, Mycobacterium
GRETQAPEPVTA

SEQ ID NO: 262746 - protein, 5 aa, Mycobacterium
GRFDP

SEQ ID NO: 262747 - protein, 6 aa, Mycobacterium
GRFDQG

SEQ ID NO: 262748 - protein, 6 aa, Mycobacterium
GRFDSG

SEQ ID NO: 262749 - protein, 4 aa, Mycobacterium
GRFT

SEQ ID NO: 262750 - protein, 12 aa, Mycobacterium
GRGAAGSPPDRH

SEQ ID NO: 262751 - protein, 26 aa, Mycobacterium
GRGAGAAAVGLPTSSISLPSGGGSVS

SEQ ID NO: 262752 - protein, 10 aa, Mycobacterium
GRGAGPEQRI

SEQ ID NO: 262753 - protein, 9 aa, Mycobacterium
GRGAPKVVR

SEQ ID NO: 262754 - protein, 18 aa, Mycobacterium
GRGAPVGAADAAKNRSRA

SEQ ID NO: 262755 - protein, 5 aa, Mycobacterium
GRGAQ

SEQ ID NO: 262756 - protein, 5 aa, Mycobacterium
GRGDA

SEQ ID NO: 262757 - protein, 15 aa, Mycobacterium
GRGDARSNPDPDRRA

SEQ ID NO: 262758 - protein, 5 aa, Mycobacterium
GRGDL

SEQ ID NO: 262759 - protein, 9 aa, Mycobacterium
GRGDSDPRV

SEQ ID NO: 262760 - protein, 9 aa, Mycobacterium
GRGEAALST

SEQ ID NO: 262761 - protein, 9 aa, Mycobacterium
GRGEDIEST

SEQ ID NO: 262762 - protein, 11 aa, Mycobacterium
GRGEKLTGGGF

SEQ ID NO: 262763 - protein, 33 aa, Mycobacterium
GRGFTRGSATTAAAAADDSTIEYGPGADAGAQV

SEQ ID NO: 262764 - protein, 10 aa, Mycobacterium
GRGGDGTVDI

SEQ ID NO: 262765 - protein, 28 aa, Mycobacterium
GRGGGPGFGGGPGPGGGGPGPGGGGSRG

SEQ ID NO: 262766 - protein, 6 aa, Mycobacterium
GRGGIT

SEQ ID NO: 262767 - protein, 8 aa, Mycobacterium
GRGGPYLA

SEQ ID NO: 262768 - protein, 11 aa, Mycobacterium
GRGGRSSPRGR

SEQ ID NO: 262769 - protein, 11 aa, Mycobacterium
GRGGSQEMSRS

SEQ ID NO: 262770 - protein, 5 aa, Mycobacterium
GRGHG

SEQ ID NO: 262771 - protein, 8 aa, Mycobacterium
GRGHLPGD

SEQ ID NO: 262772 - protein, 11 aa, Mycobacterium
GRGLSGGQRQR

SEQ ID NO: 262773 - protein, 10 aa, Mycobacterium
GRGPDDHPRV

SEQ ID NO: 262774 - protein, 8 aa, Mycobacterium
GRGPDGTQ

SEQ ID NO: 262775 - protein, 8 aa, Mycobacterium
GRGPESSL

SEQ ID NO: 262776 - protein, 6 aa, Mycobacterium
GRGPLS

SEQ ID NO: 262777 - protein, 8 aa, Mycobacterium
GRGPPTLP

SEQ ID NO: 262778 - protein, 36 aa, Mycobacterium
GRGPRPRRPKPADRSSHRRPVTYPEQRNSSPPGVNA

SEQ ID NO: 262779 - protein, 9 aa, Mycobacterium
GRGQGPERR

SEQ ID NO: 262780 - protein, 9 aa, Mycobacterium
GRGQPKVVR

SEQ ID NO: 262781 - protein, 8 aa, Mycobacterium
GRGRAADA

SEQ ID NO: 262782 - protein, 8 aa, Mycobacterium
GRGRDDDS

SEQ ID NO: 262783 - protein, 7 aa, Mycobacterium
GRGRDFP

SEQ ID NO: 262784 - protein, 8 aa, Mycobacterium
GRGRPEDA

SEQ ID NO: 262785 - protein, 15 aa, Mycobacterium
GRGSGGVPARTTSGV

SEQ ID NO: 262786 - protein, 10 aa, Mycobacterium
GRGSGPARPL

SEQ ID NO: 262787 - protein, 5 aa, Mycobacterium
GRGSS

SEQ ID NO: 262788 - protein, 17 aa, Mycobacterium
GRGSSPAAEPDHDDLGD

SEQ ID NO: 262789 - protein, 9 aa, Mycobacterium
GRGTAALAG

SEQ ID NO: 262790 - protein, 5 aa, Mycobacterium
GRGTP

SEQ ID NO: 262791 - protein, 7 aa, Mycobacterium
GRGTRMY

SEQ ID NO: 262792 - protein, 14 aa, Mycobacterium
GRGVSGTVSGRSVR

SEQ ID NO: 262793 - protein, 4 aa, Mycobacterium
GRGW

SEQ ID NO: 262794 - protein, 9 aa, Mycobacterium
GRGYPVAPE

SEQ ID NO: 262795 - protein, 7 aa, Mycobacterium
GRHAPGE

SEQ ID NO: 262796 - protein, 13 aa, Mycobacterium
GRHGAGRAPQGAV

SEQ ID NO: 262797 - protein, 6 aa, Mycobacterium
GRHGTP

SEQ ID NO: 262798 - protein, 7 aa, Mycobacterium
GRHRRGR

SEQ ID NO: 262799 - protein, 4 aa, Mycobacterium
GRHS

SEQ ID NO: 262800 - protein, 5 aa, Mycobacterium
GRHSI

SEQ ID NO: 262801 - protein, 10 aa, Mycobacterium
GRIDGGDATE

SEQ ID NO: 262802 - protein, 4 aa, Mycobacterium
GRIG

SEQ ID NO: 262803 - protein, 5 aa, Mycobacterium
GRIGN

SEQ ID NO: 262804 - protein, 20 aa, Mycobacterium
GRINNSEPSGSEAEFQPSAQ

SEQ ID NO: 262805 - protein, 4 aa, Mycobacterium
GRIP

SEQ ID NO: 262806 - protein, 7 aa, Mycobacterium
GRIPGTA

SEQ ID NO: 262807 - protein, 12 aa, Mycobacterium
GRIPGTALGPSR

SEQ ID NO: 262808 - protein, 11 aa, Mycobacterium
GRIPGTAMGPS

SEQ ID NO: 262809 - protein, 5 aa, Mycobacterium
GRIPN

SEQ ID NO: 262810 - protein, 6 aa, Mycobacterium
GRIPPA

SEQ ID NO: 262811 - protein, 5 aa, Mycobacterium
GRIQN

SEQ ID NO: 262812 - protein, 13 aa, Mycobacterium
GRITPEQAHNHPQ

SEQ ID NO: 262813 - protein, 15 aa, Mycobacterium
GRKARTGAEDVPRDG

SEQ ID NO: 262814 - protein, 9 aa, Mycobacterium
GRKAYDEEL

SEQ ID NO: 262815 - protein, 12 aa, Mycobacterium
GRKAYDEERRGE

SEQ ID NO: 262816 - protein, 11 aa, Mycobacterium
GRKGTERAEGL

SEQ ID NO: 262817 - protein, 8 aa, Mycobacterium
GRKIQGSA

SEQ ID NO: 262818 - protein, 12 aa, Mycobacterium
GRKLRKGAASSV

SEQ ID NO: 262819 - protein, 6 aa, Mycobacterium
GRLADS

SEQ ID NO: 262820 - protein, 16 aa, Mycobacterium
GRLASGERLPSSRALA

SEQ ID NO: 262821 - protein, 4 aa, Mycobacterium
GRLD

SEQ ID NO: 262822 - protein, 12 aa, Mycobacterium
GRLDQPPRSRVG

SEQ ID NO: 262823 - protein, 8 aa, Mycobacterium
GRLEPDGD

SEQ ID NO: 262824 - protein, 9 aa, Mycobacterium
GRLGDSRSD

SEQ ID NO: 262825 - protein, 8 aa, Mycobacterium
GRLGKREA

SEQ ID NO: 262826 - protein, 4 aa, Mycobacterium
GRLP

SEQ ID NO: 262827 - protein, 5 aa, Mycobacterium
GRLPA

SEQ ID NO: 262828 - protein, 9 aa, Mycobacterium
GRLPPNGER

SEQ ID NO: 262829 - protein, 9 aa, Mycobacterium
GRLPVDNPA

SEQ ID NO: 262830 - protein, 4 aa, Mycobacterium
GRLS

SEQ ID NO: 262831 - protein, 7 aa, Mycobacterium
GRLSQDR

SEQ ID NO: 262832 - protein, 11 aa, Mycobacterium
GRLSTSASDVY

SEQ ID NO: 262833 - protein, 15 aa, Mycobacterium
GRLSVSSSAADSTAL

SEQ ID NO: 262834 - protein, 4 aa, Mycobacterium
GRMP

SEQ ID NO: 262835 - protein, 17 aa, Mycobacterium
GRMTKGKAALAGAASGA

SEQ ID NO: 262836 - protein, 4 aa, Mycobacterium
GRNA

SEQ ID NO: 262837 - protein, 5 aa, Mycobacterium
GRNAE

SEQ ID NO: 262838 - protein, 7 aa, Mycobacterium
GRNEGGV

SEQ ID NO: 262839 - protein, 5 aa, Mycobacterium
GRNER

SEQ ID NO: 262840 - protein, 10 aa, Mycobacterium
GRNGAGKSTA

SEQ ID NO: 262841 - protein, 12 aa, Mycobacterium
GRNGAGKSTALQ

SEQ ID NO: 262842 - protein, 11 aa, Mycobacterium
GRNGAGKSTTL

SEQ ID NO: 262843 - protein, 9 aa, Mycobacterium
GRNGSGKTT

SEQ ID NO: 262844 - protein, 26 aa, Mycobacterium
GRNGSQRQGALQGSDQDRGRDPGQIP

SEQ ID NO: 262845 - protein, 5 aa, Mycobacterium
GRNPL

SEQ ID NO: 262846 - protein, 8 aa, Mycobacterium
GRNPTTGE

SEQ ID NO: 262847 - protein, 5 aa, Mycobacterium
GRNRL

SEQ ID NO: 262848 - protein, 5 aa, Mycobacterium
GRNRP

SEQ ID NO: 262849 - protein, 9 aa, Mycobacterium
GRNVAGSGE

SEQ ID NO: 262850 - protein, 8 aa, Mycobacterium
GRNVARSG

SEQ ID NO: 262851 - protein, 13 aa, Mycobacterium
GRPAAEESSARAG

SEQ ID NO: 262852 - protein, 9 aa, Mycobacterium
GRPAAGDAE

SEQ ID NO: 262853 - protein, 6 aa, Mycobacterium
GRPAAL

SEQ ID NO: 262854 - protein, 6 aa, Mycobacterium
GRPADD

SEQ ID NO: 262855 - protein, 7 aa, Mycobacterium
GRPAGFT

SEQ ID NO: 262856 - protein, 13 aa, Mycobacterium
GRPAGGGHLNRSC

SEQ ID NO: 262857 - protein, 9 aa, Mycobacterium
GRPAGPAAV

SEQ ID NO: 262858 - protein, 5 aa, Mycobacterium
GRPAL

SEQ ID NO: 262859 - protein, 5 aa, Mycobacterium
GRPAP

SEQ ID NO: 262860 - protein, 7 aa, Mycobacterium
GRPAPTD

SEQ ID NO: 262861 - protein, 5 aa, Mycobacterium
GRPAQ

SEQ ID NO: 262862 - protein, 10 aa, Mycobacterium
GRPAQGNREF

SEQ ID NO: 262863 - protein, 28 aa, Mycobacterium
GRPARDKTAKPAKPKATKSAKPRTTRTR

SEQ ID NO: 262864 - protein, 21 aa, Mycobacterium
GRPAVNKAPVSLSGAPAPKLG

SEQ ID NO: 262865 - protein, 16 aa, Mycobacterium
GRPDATDAQVERAARE

SEQ ID NO: 262866 - protein, 11 aa, Mycobacterium
GRPDATDAQVR

SEQ ID NO: 262867 - protein, 10 aa, Mycobacterium
GRPDATDEDL

SEQ ID NO: 262868 - protein, 10 aa, Mycobacterium
GRPDGGPPPR

SEQ ID NO: 262869 - protein, 8 aa, Mycobacterium
GRPDGPRI

SEQ ID NO: 262870 - protein, 6 aa, Mycobacterium
GRPDLT

SEQ ID NO: 262871 - protein, 9 aa, Mycobacterium
GRPDNPVSE

SEQ ID NO: 262872 - protein, 9 aa, Mycobacterium
GRPDNVTTS

SEQ ID NO: 262873 - protein, 16 aa, Mycobacterium
GRPDSGGARAAALGSA

SEQ ID NO: 262874 - protein, 16 aa, Mycobacterium
GRPDSSGARAATLPPR

SEQ ID NO: 262875 - protein, 16 aa, Mycobacterium
GRPDSTGARAAKLDAG

SEQ ID NO: 262876 - protein, 5 aa, Mycobacterium
GRPDT

SEQ ID NO: 262877 - protein, 13 aa, Mycobacterium
GRPDTGVGGGVSQ

SEQ ID NO: 262878 - protein, 4 aa, Mycobacterium
GRPE

SEQ ID NO: 262879 - protein, 10 aa, Mycobacterium
GRPEASPDDI

SEQ ID NO: 262880 - protein, 7 aa, Mycobacterium
GRPEEGA

SEQ ID NO: 262881 - protein, 9 aa, Mycobacterium
GRPETDDSA

SEQ ID NO: 262882 - protein, 4 aa, Mycobacterium
GRPF

SEQ ID NO: 262883 - protein, 5 aa, Mycobacterium
GRPFG

SEQ ID NO: 262884 - protein, 19 aa, Mycobacterium
GRPGASDAQVRDAAAAVGA

SEQ ID NO: 262885 - protein, 8 aa, Mycobacterium
GRPGASEA

SEQ ID NO: 262886 - protein, 14 aa, Mycobacterium
GRPGATDDEVRAAA

SEQ ID NO: 262887 - protein, 10 aa, Mycobacterium
GRPGPGGSVL

SEQ ID NO: 262888 - protein, 6 aa, Mycobacterium
GRPGPI

SEQ ID NO: 262889 - protein, 5 aa, Mycobacterium
GRPHE

SEQ ID NO: 262890 - protein, 10 aa, Mycobacterium
GRPHRTRGSA

SEQ ID NO: 262891 - protein, 4 aa, Mycobacterium
GRPI

SEQ ID NO: 262892 - protein, 12 aa, Mycobacterium
GRPIDNPDQRIQ

SEQ ID NO: 262893 - protein, 6 aa, Mycobacterium
GRPLPD

SEQ ID NO: 262894 - protein, 9 aa, Mycobacterium
GRPNPHSHN

SEQ ID NO: 262895 - protein, 9 aa, Mycobacterium
GRPPARGGL

SEQ ID NO: 262896 - protein, 5 aa, Mycobacterium
GRPPL

SEQ ID NO: 262897 - protein, 10 aa, Mycobacterium
GRPPNRAESR

SEQ ID NO: 262898 - protein, 9 aa, Mycobacterium
GRPPQTESM

SEQ ID NO: 262899 - protein, 8 aa, Mycobacterium
GRPPRRGA

SEQ ID NO: 262900 - protein, 6 aa, Mycobacterium
GRPPVT

SEQ ID NO: 262901 - protein, 7 aa, Mycobacterium
GRPQHGE

SEQ ID NO: 262902 - protein, 30 aa, Mycobacterium
GRPQNRTFREDDEPASAVASTQRDEVRRTD

SEQ ID NO: 262903 - protein, 8 aa, Mycobacterium
GRPQTLTT

SEQ ID NO: 262904 - protein, 11 aa, Mycobacterium
GRPRDPGRAPG

SEQ ID NO: 262905 - protein, 9 aa, Mycobacterium
GRPRDTSID

SEQ ID NO: 262906 - protein, 9 aa, Mycobacterium
GRPRETAST

SEQ ID NO: 262907 - protein, 8 aa, Mycobacterium
GRPRGSFG

SEQ ID NO: 262908 - protein, 55 aa, Mycobacterium
GRPRGTSETLQRHPTDAGALEAERLGDEDVTDDPWRDPSAPVALGTPAQPPPPPV

SEQ ID NO: 262909 - protein, 5 aa, Mycobacterium
GRPRK

SEQ ID NO: 262910 - protein, 6 aa, Mycobacterium
GRPRNE

SEQ ID NO: 262911 - protein, 19 aa, Mycobacterium
GRPRPAPRRASSAERSRAI

SEQ ID NO: 262912 - protein, 8 aa, Mycobacterium
GRPRPATK

SEQ ID NO: 262913 - protein, 13 aa, Mycobacterium
GRPRQPKNPDGTM

SEQ ID NO: 262914 - protein, 24 aa, Mycobacterium
GRPSAAGAGYDPLSSGGSNLGPES

SEQ ID NO: 262915 - protein, 8 aa, Mycobacterium
GRPSAGLA

SEQ ID NO: 262916 - protein, 9 aa, Mycobacterium
GRPSDGLAD

SEQ ID NO: 262917 - protein, 14 aa, Mycobacterium
GRPSDGLADTLREQ

SEQ ID NO: 262918 - protein, 9 aa, Mycobacterium
GRPSEETPL

SEQ ID NO: 262919 - protein, 7 aa, Mycobacterium
GRPSERL

SEQ ID NO: 262920 - protein, 13 aa, Mycobacterium
GRPSPEDIDPEAG

SEQ ID NO: 262921 - protein, 22 aa, Mycobacterium
GRPSRYRSEPDRSHAGAPLAVG

SEQ ID NO: 262922 - protein, 4 aa, Mycobacterium
GRPT

SEQ ID NO: 262923 - protein, 8 aa, Mycobacterium
GRPTAEQV

SEQ ID NO: 262924 - protein, 5 aa, Mycobacterium
GRPTD

SEQ ID NO: 262925 - protein, 5 aa, Mycobacterium
GRPTG

SEQ ID NO: 262926 - protein, 6 aa, Mycobacterium
GRPTNV

SEQ ID NO: 262927 - protein, 12 aa, Mycobacterium
GRPTRKDLPALG

SEQ ID NO: 262928 - protein, 4 aa, Mycobacterium
GRPV

SEQ ID NO: 262929 - protein, 4 aa, Mycobacterium
GRPY

SEQ ID NO: 262930 - protein, 5 aa, Mycobacterium
GRPYR

SEQ ID NO: 262931 - protein, 8 aa, Mycobacterium
GRQAATAL

SEQ ID NO: 262932 - protein, 9 aa, Mycobacterium
GRQAQPGMN

SEQ ID NO: 262933 - protein, 12 aa, Mycobacterium
GRQAYEEERHGE

SEQ ID NO: 262934 - protein, 5 aa, Mycobacterium
GRQDT

SEQ ID NO: 262935 - protein, 4 aa, Mycobacterium
GRQG

SEQ ID NO: 262936 - protein, 12 aa, Mycobacterium
GRQGDAPDKTLD

SEQ ID NO: 262937 - protein, 4 aa, Mycobacterium
GRQI

SEQ ID NO: 262938 - protein, 12 aa, Mycobacterium
GRQIGAATGWWT

SEQ ID NO: 262939 - protein, 15 aa, Mycobacterium
GRQIGDPMTGHSSDV

SEQ ID NO: 262940 - protein, 5 aa, Mycobacterium
GRQIP

SEQ ID NO: 262941 - protein, 4 aa, Mycobacterium
GRQK

SEQ ID NO: 262942 - protein, 11 aa, Mycobacterium
GRQKGSGAPMG

SEQ ID NO: 262943 - protein, 9 aa, Mycobacterium
GRQLGEQDH

SEQ ID NO: 262944 - protein, 4 aa, Mycobacterium
GRQP

SEQ ID NO: 262945 - protein, 7 aa, Mycobacterium
GRQRGIP

SEQ ID NO: 262946 - protein, 8 aa, Mycobacterium
GRQRSQVV

SEQ ID NO: 262947 - protein, 9 aa, Mycobacterium
GRQSGDDAA

SEQ ID NO: 262948 - protein, 14 aa, Mycobacterium
GRQTEAAEVATPAR

SEQ ID NO: 262949 - protein, 8 aa, Mycobacterium
GRQTPEMS

SEQ ID NO: 262950 - protein, 4 aa, Mycobacterium
GRQY

SEQ ID NO: 262951 - protein, 5 aa, Mycobacterium
GRRAA

SEQ ID NO: 262952 - protein, 16 aa, Mycobacterium
GRRAEAAGRSPEHITP

SEQ ID NO: 262953 - protein, 5 aa, Mycobacterium
GRRAG

SEQ ID NO: 262954 - protein, 9 aa, Mycobacterium
GRRAPTQLA

SEQ ID NO: 262955 - protein, 6 aa, Mycobacterium
GRRAPY

SEQ ID NO: 262956 - protein, 9 aa, Mycobacterium
GRRAYPQDN

SEQ ID NO: 262957 - protein, 9 aa, Mycobacterium
GRRDAAKHQ

SEQ ID NO: 262958 - protein, 8 aa, Mycobacterium
GRRDDDYV

SEQ ID NO: 262959 - protein, 26 aa, Mycobacterium
GRRDPATGAGQRSRRPQNTSDERHTR

SEQ ID NO: 262960 - protein, 7 aa, Mycobacterium
GRRDTAL

SEQ ID NO: 262961 - protein, 11 aa, Mycobacterium
GRRDTSASRQE

SEQ ID NO: 262962 - protein, 4 aa, Mycobacterium
GRRE

SEQ ID NO: 262963 - protein, 11 aa, Mycobacterium
GRRENAAARAR

SEQ ID NO: 262964 - protein, 11 aa, Mycobacterium
GRRGDFAGRRG

SEQ ID NO: 262965 - protein, 8 aa, Mycobacterium
GRRGESIP

SEQ ID NO: 262966 - protein, 11 aa, Mycobacterium
GRRGRSTSRCS

SEQ ID NO: 262967 - protein, 6 aa, Mycobacterium
GRRGTQ

SEQ ID NO: 262968 - protein, 12 aa, Mycobacterium
GRRHAREAAGDD

SEQ ID NO: 262969 - protein, 4 aa, Mycobacterium
GRRI

SEQ ID NO: 262970 - protein, 6 aa, Mycobacterium
GRRKRD

SEQ ID NO: 262971 - protein, 4 aa, Mycobacterium
GRRL

SEQ ID NO: 262972 - protein, 8 aa, Mycobacterium
GRRNDQLR

SEQ ID NO: 262973 - protein, 11 aa, Mycobacterium
GRRPFDRDNPA

SEQ ID NO: 262974 - protein, 9 aa, Mycobacterium
GRRPFPQEE

SEQ ID NO: 262975 - protein, 7 aa, Mycobacterium
GRRPGPL

SEQ ID NO: 262976 - protein, 14 aa, Mycobacterium
GRRPLAERVGGAGQ

SEQ ID NO: 262977 - protein, 9 aa, Mycobacterium
GRRPTPDEI

SEQ ID NO: 262978 - protein, 4 aa, Mycobacterium
GRRQ

SEQ ID NO: 262979 - protein, 21 aa, Mycobacterium
GRRQAGVGQEVGPNAPGQGAE

SEQ ID NO: 262980 - protein, 7 aa, Mycobacterium
GRRQARE

SEQ ID NO: 262981 - protein, 83 aa, Mycobacterium
GRRQPDDADDTVGRRQPDDADDTVGRRQPDDADDTVGRRQPDDADDTVGRRQPDDADDTVGRRQPDDADDTVGRRQPDAESGQ

SEQ ID NO: 262982 - protein, 21 aa, Mycobacterium
GRRQPGVGNDIGPNPPGQGAE

SEQ ID NO: 262983 - protein, 21 aa, Mycobacterium
GRRQPGVGNDIPPSPPGEGAE

SEQ ID NO: 262984 - protein, 4 aa, Mycobacterium
GRRR

SEQ ID NO: 262985 - protein, 26 aa, Mycobacterium
GRRRPDRATPSRRKADGDTGRRKADQ

SEQ ID NO: 262986 - protein, 53 aa, Mycobacterium
GRRRPGEDAEPSAGASDSTPEAPAADGPDKPAGPVGPEDAAEESKTVGHQAEP

SEQ ID NO: 262987 - protein, 10 aa, Mycobacterium
GRRRRPGSVP

SEQ ID NO: 262988 - protein, 10 aa, Mycobacterium
GRRSDPASVA

SEQ ID NO: 262989 - protein, 8 aa, Mycobacterium
GRRSLRPD

SEQ ID NO: 262990 - protein, 8 aa, Mycobacterium
GRRSPIPG

SEQ ID NO: 262991 - protein, 5 aa, Mycobacterium
GRRSR

SEQ ID NO: 262992 - protein, 29 aa, Mycobacterium
GRRSRELGAPPARGGHAGVTAGADRHAGV

SEQ ID NO: 262993 - protein, 9 aa, Mycobacterium
GRRSRIDAA

SEQ ID NO: 262994 - protein, 10 aa, Mycobacterium
GRRSRIDATN

SEQ ID NO: 262995 - protein, 8 aa, Mycobacterium
GRRSRPVA

SEQ ID NO: 262996 - protein, 14 aa, Mycobacterium
GRRSSSPRRQRRAR

SEQ ID NO: 262997 - protein, 4 aa, Mycobacterium
GRRT

SEQ ID NO: 262998 - protein, 6 aa, Mycobacterium
GRRTAK

SEQ ID NO: 262999 - protein, 11 aa, Mycobacterium
GRRTDPTPKGR

SEQ ID NO: 263000 - protein, 4 aa, Mycobacterium
GRRV

SEQ ID NO: 263001 - protein, 5 aa, Mycobacterium
GRRYP

SEQ ID NO: 263002 - protein, 8 aa, Mycobacterium
GRSAADLD

SEQ ID NO: 263003 - protein, 9 aa, Mycobacterium
GRSADDIED

SEQ ID NO: 263004 - protein, 9 aa, Mycobacterium
GRSADTLGD

SEQ ID NO: 263005 - protein, 10 aa, Mycobacterium
GRSADTSTVA

SEQ ID NO: 263006 - protein, 10 aa, Mycobacterium
GRSARGPEHV

SEQ ID NO: 263007 - protein, 6 aa, Mycobacterium
GRSDAA

SEQ ID NO: 263008 - protein, 11 aa, Mycobacterium
GRSDATDDELE

SEQ ID NO: 263009 - protein, 7 aa, Mycobacterium
GRSDRKL

SEQ ID NO: 263010 - protein, 14 aa, Mycobacterium
GRSEATHISAPVGD

SEQ ID NO: 263011 - protein, 14 aa, Mycobacterium
GRSEATHVCAPAEA

SEQ ID NO: 263012 - protein, 8 aa, Mycobacterium
GRSEEGCA

SEQ ID NO: 263013 - protein, 12 aa, Mycobacterium
GRSEGFSKPAPS

SEQ ID NO: 263014 - protein, 12 aa, Mycobacterium
GRSETTHVSAPT

SEQ ID NO: 263015 - protein, 13 aa, Mycobacterium
GRSGAAPDTGRTL

SEQ ID NO: 263016 - protein, 8 aa, Mycobacterium
GRSGALSR

SEQ ID NO: 263017 - protein, 9 aa, Mycobacterium
GRSGALSRS

SEQ ID NO: 263018 - protein, 8 aa, Mycobacterium
GRSGPMTR

SEQ ID NO: 263019 - protein, 10 aa, Mycobacterium
GRSGRRGATA

SEQ ID NO: 263020 - protein, 7 aa, Mycobacterium
GRSGSAY

SEQ ID NO: 263021 - protein, 10 aa, Mycobacterium
GRSGSDLTLE

SEQ ID NO: 263022 - protein, 10 aa, Mycobacterium
GRSGSGKTSL

SEQ ID NO: 263023 - protein, 9 aa, Mycobacterium
GRSGSGKTT

SEQ ID NO: 263024 - protein, 10 aa, Mycobacterium
GRSGTDVARE

SEQ ID NO: 263025 - protein, 10 aa, Mycobacterium
GRSGTEVAKD

SEQ ID NO: 263026 - protein, 9 aa, Mycobacterium
GRSGWRSST

SEQ ID NO: 263027 - protein, 13 aa, Mycobacterium
GRSHARETRGTDN

SEQ ID NO: 263028 - protein, 8 aa, Mycobacterium
GRSHASGR

SEQ ID NO: 263029 - protein, 20 aa, Mycobacterium
GRSHGPEDGDVTRLDDAQVR

SEQ ID NO: 263030 - protein, 8 aa, Mycobacterium
GRSIGPDS

SEQ ID NO: 263031 - protein, 24 aa, Mycobacterium
GRSLARSSEQYRDPVGSPPPAPKL

SEQ ID NO: 263032 - protein, 22 aa, Mycobacterium
GRSLARSSERYRDPGGSLSPEL

SEQ ID NO: 263033 - protein, 5 aa, Mycobacterium
GRSLT

SEQ ID NO: 263034 - protein, 4 aa, Mycobacterium
GRSM

SEQ ID NO: 263035 - protein, 4 aa, Mycobacterium
GRSP

SEQ ID NO: 263036 - protein, 7 aa, Mycobacterium
GRSPADA

SEQ ID NO: 263037 - protein, 8 aa, Mycobacterium
GRSPGSDI

SEQ ID NO: 263038 - protein, 7 aa, Mycobacterium
GRSPQRL

SEQ ID NO: 263039 - protein, 7 aa, Mycobacterium
GRSPVAV

SEQ ID NO: 263040 - protein, 18 aa, Mycobacterium
GRSQQGAKGAGGNGVRTE

SEQ ID NO: 263041 - protein, 4 aa, Mycobacterium
GRSR

SEQ ID NO: 263042 - protein, 7 aa, Mycobacterium
GRSREDM

SEQ ID NO: 263043 - protein, 7 aa, Mycobacterium
GRSREEC

SEQ ID NO: 263044 - protein, 11 aa, Mycobacterium
GRSRGNGPNDF

SEQ ID NO: 263045 - protein, 9 aa, Mycobacterium
GRSRQRTGA

SEQ ID NO: 263046 - protein, 10 aa, Mycobacterium
GRSRQRTGAS

SEQ ID NO: 263047 - protein, 9 aa, Mycobacterium
GRSSAGTGD

SEQ ID NO: 263048 - protein, 9 aa, Mycobacterium
GRSSLSAAA

SEQ ID NO: 263049 - protein, 8 aa, Mycobacterium
GRSSTADI

SEQ ID NO: 263050 - protein, 4 aa, Mycobacterium
GRST

SEQ ID NO: 263051 - protein, 5 aa, Mycobacterium
GRSTE

SEQ ID NO: 263052 - protein, 8 aa, Mycobacterium
GRSTETYL

SEQ ID NO: 263053 - protein, 9 aa, Mycobacterium
GRSTQQKEL

SEQ ID NO: 263054 - protein, 12 aa, Mycobacterium
GRSTSTTPEDTV

SEQ ID NO: 263055 - protein, 7 aa, Mycobacterium
GRSYSGL

SEQ ID NO: 263056 - protein, 5 aa, Mycobacterium
GRTAA

SEQ ID NO: 263057 - protein, 11 aa, Mycobacterium
GRTAGSDGLGE

SEQ ID NO: 263058 - protein, 6 aa, Mycobacterium
GRTAPA

SEQ ID NO: 263059 - protein, 8 aa, Mycobacterium
GRTAPTQL

SEQ ID NO: 263060 - protein, 7 aa, Mycobacterium
GRTASRS

SEQ ID NO: 263061 - protein, 5 aa, Mycobacterium
GRTAT

SEQ ID NO: 263062 - protein, 9 aa, Mycobacterium
GRTDGTVTG

SEQ ID NO: 263063 - protein, 7 aa, Mycobacterium
GRTDTRH

SEQ ID NO: 263064 - protein, 4 aa, Mycobacterium
GRTE

SEQ ID NO: 263065 - protein, 13 aa, Mycobacterium
GRTEATESAEEKK

SEQ ID NO: 263066 - protein, 6 aa, Mycobacterium
GRTEDI

SEQ ID NO: 263067 - protein, 8 aa, Mycobacterium
GRTEEAEK

SEQ ID NO: 263068 - protein, 7 aa, Mycobacterium
GRTEEAQ

SEQ ID NO: 263069 - protein, 10 aa, Mycobacterium
GRTEPAGVGT

SEQ ID NO: 263070 - protein, 6 aa, Mycobacterium
GRTFTG

SEQ ID NO: 263071 - protein, 4 aa, Mycobacterium
GRTG

SEQ ID NO: 263072 - protein, 338 aa, Mycobacterium
GRTGDGGDGGDGGAAGSPGNGGAGAHGDAGHLDGGAGGNGGNSGAAGSGGTGGSGTVGGANGVGGASVTAAGGHGGRGGDGHSTTDAGIDGGRGGNGGDGGNLGNGGDGGHGGNASSGRGGAGGDGGDGTIDNAATTSDVTGGRGGNGGHSTTNSAGDGGDGGAAVNAGTGSALGGAGGNGGNSNGDTNTAGAGDGGAGGDATITGASSATSTAIGGAGGNGGTAERGAGGIGGDGGDATVDNTESAANVSGGKGGTGGRGGFHTSGSGGHGGAGGDATTSGLGSVTGGVGGVADGRGSNGDSGNGGNGGNATITNTTSTAAATGGAGGGGGRRHRRR

SEQ ID NO: 263073 - protein, 6 aa, Mycobacterium
GRTGGE

SEQ ID NO: 263074 - protein, 5 aa, Mycobacterium
GRTGL

SEQ ID NO: 263075 - protein, 13 aa, Mycobacterium
GRTGPAGTGSAAR

SEQ ID NO: 263076 - protein, 6 aa, Mycobacterium
GRTGRV

SEQ ID NO: 263077 - protein, 6 aa, Mycobacterium
GRTGRY

SEQ ID NO: 263078 - protein, 6 aa, Mycobacterium
GRTHPT

SEQ ID NO: 263079 - protein, 4 aa, Mycobacterium
GRTK

SEQ ID NO: 263080 - protein, 11 aa, Mycobacterium
GRTLGEQDRQY

SEQ ID NO: 263081 - protein, 5 aa, Mycobacterium
GRTLP

SEQ ID NO: 263082 - protein, 8 aa, Mycobacterium
GRTNYRNP

SEQ ID NO: 263083 - protein, 9 aa, Mycobacterium
GRTPMTPDY

SEQ ID NO: 263084 - protein, 7 aa, Mycobacterium
GRTPPEK

SEQ ID NO: 263085 - protein, 16 aa, Mycobacterium
GRTPPPPATREPVPAE

SEQ ID NO: 263086 - protein, 10 aa, Mycobacterium
GRTPPPPIKR

SEQ ID NO: 263087 - protein, 11 aa, Mycobacterium
GRTPPPPPLNP

SEQ ID NO: 263088 - protein, 18 aa, Mycobacterium
GRTPPPPPPSRLPSIPEA

SEQ ID NO: 263089 - protein, 16 aa, Mycobacterium
GRTPPPPPVNLNPSPV

SEQ ID NO: 263090 - protein, 6 aa, Mycobacterium
GRTPYR

SEQ ID NO: 263091 - protein, 23 aa, Mycobacterium
GRTQPVSVESRRSRTPALDAGRA

SEQ ID NO: 263092 - protein, 26 aa, Mycobacterium
GRTQQVTRARRRPTSAAANREATAVP

SEQ ID NO: 263093 - protein, 10 aa, Mycobacterium
GRTRADNDEA

SEQ ID NO: 263094 - protein, 5 aa, Mycobacterium
GRTRD

SEQ ID NO: 263095 - protein, 6 aa, Mycobacterium
GRTRDE

SEQ ID NO: 263096 - protein, 10 aa, Mycobacterium
GRTRGHGPND

SEQ ID NO: 263097 - protein, 21 aa, Mycobacterium
GRTSAGRIGVDPTSGDPSGWP

SEQ ID NO: 263098 - protein, 9 aa, Mycobacterium
GRTSAGRVG

SEQ ID NO: 263099 - protein, 15 aa, Mycobacterium
GRTSSTTRDQSTPRN

SEQ ID NO: 263100 - protein, 10 aa, Mycobacterium
GRTTGSGETQ

SEQ ID NO: 263101 - protein, 5 aa, Mycobacterium
GRTTT

SEQ ID NO: 263102 - protein, 7 aa, Mycobacterium
GRTTVDE

SEQ ID NO: 263103 - protein, 4 aa, Mycobacterium
GRTV

SEQ ID NO: 263104 - protein, 13 aa, Mycobacterium
GRTVGKPLAGHQG

SEQ ID NO: 263105 - protein, 22 aa, Mycobacterium
GRTVSQAATVTTAAAGAVGGAA

SEQ ID NO: 263106 - protein, 13 aa, Mycobacterium
GRTVSTQVARPRH

SEQ ID NO: 263107 - protein, 4 aa, Mycobacterium
GRVD

SEQ ID NO: 263108 - protein, 6 aa, Mycobacterium
GRVDGA

SEQ ID NO: 263109 - protein, 4 aa, Mycobacterium
GRVE

SEQ ID NO: 263110 - protein, 13 aa, Mycobacterium
GRVEKNDERLGQA

SEQ ID NO: 263111 - protein, 9 aa, Mycobacterium
GRVEPDQDT

SEQ ID NO: 263112 - protein, 9 aa, Mycobacterium
GRVGDDRPV

SEQ ID NO: 263113 - protein, 4 aa, Mycobacterium
GRVP

SEQ ID NO: 263114 - protein, 14 aa, Mycobacterium
GRVPGDGPEQAARP

SEQ ID NO: 263115 - protein, 25 aa, Mycobacterium
GRVPGSGPEQANRPLVGTAEQGGVI

SEQ ID NO: 263116 - protein, 8 aa, Mycobacterium
GRVQGDGT

SEQ ID NO: 263117 - protein, 9 aa, Mycobacterium
GRVREAGKT

SEQ ID NO: 263118 - protein, 4 aa, Mycobacterium
GRVS

SEQ ID NO: 263119 - protein, 8 aa, Mycobacterium
GRVSAPSV

SEQ ID NO: 263120 - protein, 5 aa, Mycobacterium
GRVSV

SEQ ID NO: 263121 - protein, 10 aa, Mycobacterium
GRVTESGTHT

SEQ ID NO: 263122 - protein, 13 aa, Mycobacterium
GRVTGAADAGRTL

SEQ ID NO: 263123 - protein, 7 aa, Mycobacterium
GRVTGGP

SEQ ID NO: 263124 - protein, 11 aa, Mycobacterium
GRVTPAAGDVR

SEQ ID NO: 263125 - protein, 10 aa, Mycobacterium
GRVTSSATSQ

SEQ ID NO: 263126 - protein, 12 aa, Mycobacterium
GRWGGVNSVNPQ

SEQ ID NO: 263127 - protein, 18 aa, Mycobacterium
GRWSKSGDPGRCTREAGG

SEQ ID NO: 263128 - protein, 12 aa, Mycobacterium
GRWSPDSGETIG

SEQ ID NO: 263129 - protein, 5 aa, Mycobacterium
GRYLP

SEQ ID NO: 263130 - protein, 16 aa, Mycobacterium
GRYPDAEPDPDDVGDS

SEQ ID NO: 263131 - protein, 14 aa, Mycobacterium
GSAAAAAAEGAPQA

SEQ ID NO: 263132 - protein, 9 aa, Mycobacterium
GSAAAAATE

SEQ ID NO: 263133 - protein, 11 aa, Mycobacterium
GSAAALAPSTL

SEQ ID NO: 263134 - protein, 11 aa, Mycobacterium
GSAAATAGLPK

SEQ ID NO: 263135 - protein, 14 aa, Mycobacterium
GSAAESDRPQKLDG

SEQ ID NO: 263136 - protein, 17 aa, Mycobacterium
GSAALDPSKTLAQSGIA

SEQ ID NO: 263137 - protein, 5 aa, Mycobacterium
GSAAR

SEQ ID NO: 263138 - protein, 10 aa, Mycobacterium
GSAARPGAAA

SEQ ID NO: 263139 - protein, 6 aa, Mycobacterium
GSAASA

SEQ ID NO: 263140 - protein, 5 aa, Mycobacterium
GSAAT

SEQ ID NO: 263141 - protein, 6 aa, Mycobacterium
GSAATA

SEQ ID NO: 263142 - protein, 11 aa, Mycobacterium
GSAATAGEGTQ

SEQ ID NO: 263143 - protein, 11 aa, Mycobacterium
GSAATEGEGTQ

SEQ ID NO: 263144 - protein, 14 aa, Mycobacterium
GSAATYKDMQQGAD

SEQ ID NO: 263145 - protein, 5 aa, Mycobacterium
GSACP

SEQ ID NO: 263146 - protein, 9 aa, Mycobacterium
GSADPGELR

SEQ ID NO: 263147 - protein, 6 aa, Mycobacterium
GSADQQ

SEQ ID NO: 263148 - protein, 9 aa, Mycobacterium
GSAEHPEPG

SEQ ID NO: 263149 - protein, 7 aa, Mycobacterium
GSAFPGD

SEQ ID NO: 263150 - protein, 6 aa, Mycobacterium
GSAFST

SEQ ID NO: 263151 - protein, 4 aa, Mycobacterium
GSAG

SEQ ID NO: 263152 - protein, 5 aa, Mycobacterium
GSAGA

SEQ ID NO: 263153 - protein, 23 aa, Mycobacterium
GSAGADTKAAEKPAESAAPAGKP

SEQ ID NO: 263154 - protein, 6 aa, Mycobacterium
GSAGEP

SEQ ID NO: 263155 - protein, 18 aa, Mycobacterium
GSAGSDGNKVAPRRANKK

SEQ ID NO: 263156 - protein, 9 aa, Mycobacterium
GSAIGGAAG

SEQ ID NO: 263157 - protein, 4 aa, Mycobacterium
GSAL

SEQ ID NO: 263158 - protein, 12 aa, Mycobacterium
GSALRTPQRQDV

SEQ ID NO: 263159 - protein, 9 aa, Mycobacterium
GSALSQRRY

SEQ ID NO: 263160 - protein, 7 aa, Mycobacterium
GSALTAA

SEQ ID NO: 263161 - protein, 4 aa, Mycobacterium
GSAM

SEQ ID NO: 263162 - protein, 4 aa, Mycobacterium
GSAP

SEQ ID NO: 263163 - protein, 7 aa, Mycobacterium
GSAPALG

SEQ ID NO: 263164 - protein, 10 aa, Mycobacterium
GSAPGPTLRG

SEQ ID NO: 263165 - protein, 7 aa, Mycobacterium
GSAPLST

SEQ ID NO: 263166 - protein, 8 aa, Mycobacterium
GSAPLTQQ

SEQ ID NO: 263167 - protein, 9 aa, Mycobacterium
GSAPLTQQV

SEQ ID NO: 263168 - protein, 9 aa, Mycobacterium
GSAPLTSQI

SEQ ID NO: 263169 - protein, 8 aa, Mycobacterium
GSAPNCPL

SEQ ID NO: 263170 - protein, 20 aa, Mycobacterium
GSAPRALGAEPQQQAPPTAP

SEQ ID NO: 263171 - protein, 7 aa, Mycobacterium
GSAPSFT

SEQ ID NO: 263172 - protein, 16 aa, Mycobacterium
GSAPTVTAAPTGHTTE

SEQ ID NO: 263173 - protein, 5 aa, Mycobacterium
GSAQW

SEQ ID NO: 263174 - protein, 6 aa, Mycobacterium
GSARHG

SEQ ID NO: 263175 - protein, 8 aa, Mycobacterium
GSARNTVT

SEQ ID NO: 263176 - protein, 13 aa, Mycobacterium
GSARPLTEDEPMP

SEQ ID NO: 263177 - protein, 5 aa, Mycobacterium
GSARQ

SEQ ID NO: 263178 - protein, 4 aa, Mycobacterium
GSAS

SEQ ID NO: 263179 - protein, 11 aa, Mycobacterium
GSASDDATTLR

SEQ ID NO: 263180 - protein, 6 aa, Mycobacterium
GSASGA

SEQ ID NO: 263181 - protein, 10 aa, Mycobacterium
GSASKSLAPG

SEQ ID NO: 263182 - protein, 8 aa, Mycobacterium
GSASNYRD

SEQ ID NO: 263183 - protein, 13 aa, Mycobacterium
GSASSAADAISEA

SEQ ID NO: 263184 - protein, 5 aa, Mycobacterium
GSASY

SEQ ID NO: 263185 - protein, 6 aa, Mycobacterium
GSATDW

SEQ ID NO: 263186 - protein, 12 aa, Mycobacterium
GSATGSRAPMGA

SEQ ID NO: 263187 - protein, 6 aa, Mycobacterium
GSATNF

SEQ ID NO: 263188 - protein, 6 aa, Mycobacterium
GSATRT

SEQ ID NO: 263189 - protein, 6 aa, Mycobacterium
GSATRV

SEQ ID NO: 263190 - protein, 13 aa, Mycobacterium
GSATSVSQEDSVR

SEQ ID NO: 263191 - protein, 14 aa, Mycobacterium
GSAVDGSASAPPTA

SEQ ID NO: 263192 - protein, 6 aa, Mycobacterium
GSDAFA

SEQ ID NO: 263193 - protein, 14 aa, Mycobacterium
GSDAHSESASGRMS

SEQ ID NO: 263194 - protein, 20 aa, Mycobacterium
GSDAQRSRVNSAASSRPEDA

SEQ ID NO: 263195 - protein, 7 aa, Mycobacterium
GSDATAV

SEQ ID NO: 263196 - protein, 12 aa, Mycobacterium
GSDATDASATRI

SEQ ID NO: 263197 - protein, 10 aa, Mycobacterium
GSDAVAGSAQ

SEQ ID NO: 263198 - protein, 8 aa, Mycobacterium
GSDEPNRR

SEQ ID NO: 263199 - protein, 12 aa, Mycobacterium
GSDGEQWPVPGD

SEQ ID NO: 263200 - protein, 12 aa, Mycobacterium
GSDGGGEQTAPM

SEQ ID NO: 263201 - protein, 10 aa, Mycobacterium
GSDGKPTKLT

SEQ ID NO: 263202 - protein, 9 aa, Mycobacterium
GSDGPSASG

SEQ ID NO: 263203 - protein, 5 aa, Mycobacterium
GSDGQ

SEQ ID NO: 263204 - protein, 10 aa, Mycobacterium
GSDGRAPADL

SEQ ID NO: 263205 - protein, 9 aa, Mycobacterium
GSDGTASRM

SEQ ID NO: 263206 - protein, 7 aa, Mycobacterium
GSDIASS

SEQ ID NO: 263207 - protein, 10 aa, Mycobacterium
GSDKARESFD

SEQ ID NO: 263208 - protein, 6 aa, Mycobacterium
GSDLGA

SEQ ID NO: 263209 - protein, 9 aa, Mycobacterium
GSDLSPDHG

SEQ ID NO: 263210 - protein, 6 aa, Mycobacterium
GSDPAH

SEQ ID NO: 263211 - protein, 7 aa, Mycobacterium
GSDPASV

SEQ ID NO: 263212 - protein, 6 aa, Mycobacterium
GSDPCA

SEQ ID NO: 263213 - protein, 7 aa, Mycobacterium
GSDPESV

SEQ ID NO: 263214 - protein, 5 aa, Mycobacterium
GSDPG

SEQ ID NO: 263215 - protein, 6 aa, Mycobacterium
GSDPLT

SEQ ID NO: 263216 - protein, 9 aa, Mycobacterium
GSDQPTQSA

SEQ ID NO: 263217 - protein, 5 aa, Mycobacterium
GSDRA

SEQ ID NO: 263218 - protein, 10 aa, Mycobacterium
GSDSGPGATR

SEQ ID NO: 263219 - protein, 16 aa, Mycobacterium
GSDTAAINGVPTATDV

SEQ ID NO: 263220 - protein, 19 aa, Mycobacterium
GSDTERNRADSAASFRSED

SEQ ID NO: 263221 - protein, 33 aa, Mycobacterium
GSDTPGEPESSGAGLTASLPAGLKSHGDDSELS

SEQ ID NO: 263222 - protein, 6 aa, Mycobacterium
GSDTVT

SEQ ID NO: 263223 - protein, 4 aa, Mycobacterium
GSDV

SEQ ID NO: 263224 - protein, 7 aa, Mycobacterium
GSEAGIT

SEQ ID NO: 263225 - protein, 9 aa, Mycobacterium
GSEDEARSA

SEQ ID NO: 263226 - protein, 6 aa, Mycobacterium
GSEDGT

SEQ ID NO: 263227 - protein, 7 aa, Mycobacterium
GSEDGTL

SEQ ID NO: 263228 - protein, 6 aa, Mycobacterium
GSEDLR

SEQ ID NO: 263229 - protein, 24 aa, Mycobacterium
GSEFEAKKTAKSGEKLNKAKTDMA

SEQ ID NO: 263230 - protein, 11 aa, Mycobacterium
GSEFEGGSREP

SEQ ID NO: 263231 - protein, 7 aa, Mycobacterium
GSEGAAD

SEQ ID NO: 263232 - protein, 9 aa, Mycobacterium
GSEGAADAV

SEQ ID NO: 263233 - protein, 9 aa, Mycobacterium
GSEKLSNPV

SEQ ID NO: 263234 - protein, 4 aa, Mycobacterium
GSEL

SEQ ID NO: 263235 - protein, 5 aa, Mycobacterium
GSELD

SEQ ID NO: 263236 - protein, 13 aa, Mycobacterium
GSEPDRAPAPTEL

SEQ ID NO: 263237 - protein, 6 aa, Mycobacterium
GSEPGI

SEQ ID NO: 263238 - protein, 6 aa, Mycobacterium
GSEPIS

SEQ ID NO: 263239 - protein, 5 aa, Mycobacterium
GSEPV

SEQ ID NO: 263240 - protein, 15 aa, Mycobacterium
GSEQERTKAALESAR

SEQ ID NO: 263241 - protein, 7 aa, Mycobacterium
GSERAAN

SEQ ID NO: 263242 - protein, 5 aa, Mycobacterium
GSERT

SEQ ID NO: 263243 - protein, 6 aa, Mycobacterium
GSERTF

SEQ ID NO: 263244 - protein, 4 aa, Mycobacterium
GSES

SEQ ID NO: 263245 - protein, 16 aa, Mycobacterium
GSESNRCSTGAQVYGA

SEQ ID NO: 263246 - protein, 7 aa, Mycobacterium
GSESYRG

SEQ ID NO: 263247 - protein, 8 aa, Mycobacterium
GSETAPLQ

SEQ ID NO: 263248 - protein, 10 aa, Mycobacterium
GSETAPLQPS

SEQ ID NO: 263249 - protein, 17 aa, Mycobacterium
GSETHSGLSSPGSMRYR

SEQ ID NO: 263250 - protein, 7 aa, Mycobacterium
GSETNYA

SEQ ID NO: 263251 - protein, 5 aa, Mycobacterium
GSETP

SEQ ID NO: 263252 - protein, 9 aa, Mycobacterium
GSETYRVEP

SEQ ID NO: 263253 - protein, 7 aa, Mycobacterium
GSEVARE

SEQ ID NO: 263254 - protein, 15 aa, Mycobacterium
GSEWGADGANRADQV

SEQ ID NO: 263255 - protein, 4 aa, Mycobacterium
GSEY

SEQ ID NO: 263256 - protein, 5 aa, Mycobacterium
GSFAE

SEQ ID NO: 263257 - protein, 7 aa, Mycobacterium
GSFGGEA

SEQ ID NO: 263258 - protein, 11 aa, Mycobacterium
GSFGGGAGGGM

SEQ ID NO: 263259 - protein, 10 aa, Mycobacterium
GSFGGGTSGE

SEQ ID NO: 263260 - protein, 5 aa, Mycobacterium
GSFPE

SEQ ID NO: 263261 - protein, 4 aa, Mycobacterium
GSFS

SEQ ID NO: 263262 - protein, 18 aa, Mycobacterium
GSFTPRHASSAAQTPTPH

SEQ ID NO: 263263 - protein, 17 aa, Mycobacterium
GSFTSSITSVSSSAPPF

SEQ ID NO: 263264 - protein, 8 aa, Mycobacterium
GSFYGGGS

SEQ ID NO: 263265 - protein, 7 aa, Mycobacterium
GSGADAC

SEQ ID NO: 263266 - protein, 7 aa, Mycobacterium
GSGAEEY

SEQ ID NO: 263267 - protein, 7 aa, Mycobacterium
GSGAGGA

SEQ ID NO: 263268 - protein, 8 aa, Mycobacterium
GSGAPRGD

SEQ ID NO: 263269 - protein, 11 aa, Mycobacterium
GSGAPTVTADG

SEQ ID NO: 263270 - protein, 35 aa, Mycobacterium
GSGARNSGGGGRPGGGGSLYETGDVAKAKANKRPG

SEQ ID NO: 263271 - protein, 5 aa, Mycobacterium
GSGAS

SEQ ID NO: 263272 - protein, 8 aa, Mycobacterium
GSGASATV

SEQ ID NO: 263273 - protein, 9 aa, Mycobacterium
GSGATGGFA

SEQ ID NO: 263274 - protein, 7 aa, Mycobacterium
GSGATRV

SEQ ID NO: 263275 - protein, 8 aa, Mycobacterium
GSGDPHDP

SEQ ID NO: 263276 - protein, 7 aa, Mycobacterium
GSGDPTR

SEQ ID NO: 263277 - protein, 9 aa, Mycobacterium
GSGDRFEGT

SEQ ID NO: 263278 - protein, 9 aa, Mycobacterium
GSGDSAVPR

SEQ ID NO: 263279 - protein, 50 aa, Mycobacterium
GSGDWGPSLGPTVGGRSGAKAPAATIPAAGAAAASRASARSRRRRRTEMR

SEQ ID NO: 263280 - protein, 8 aa, Mycobacterium
GSGEAAEK

SEQ ID NO: 263281 - protein, 9 aa, Mycobacterium
GSGEAVSAG

SEQ ID NO: 263282 - protein, 10 aa, Mycobacterium
GSGESGADAE

SEQ ID NO: 263283 - protein, 10 aa, Mycobacterium
GSGEVKGELT

SEQ ID NO: 263284 - protein, 5 aa, Mycobacterium
GSGFD

SEQ ID NO: 263285 - protein, 7 aa, Mycobacterium
GSGFEEP

SEQ ID NO: 263286 - protein, 5 aa, Mycobacterium
GSGFP

SEQ ID NO: 263287 - protein, 8 aa, Mycobacterium
GSGGARDS

SEQ ID NO: 263288 - protein, 5 aa, Mycobacterium
GSGGM

SEQ ID NO: 263289 - protein, 18 aa, Mycobacterium
GSGGPPIQPGAEIPEDTE

SEQ ID NO: 263290 - protein, 8 aa, Mycobacterium
GSGGRQVG

SEQ ID NO: 263291 - protein, 8 aa, Mycobacterium
GSGGTPGI

SEQ ID NO: 263292 - protein, 19 aa, Mycobacterium
GSGHDHHPHSHSGRGGKIG

SEQ ID NO: 263293 - protein, 9 aa, Mycobacterium
GSGHHNEGM

SEQ ID NO: 263294 - protein, 7 aa, Mycobacterium
GSGKVVT

SEQ ID NO: 263295 - protein, 8 aa, Mycobacterium
GSGLGGDE

SEQ ID NO: 263296 - protein, 7 aa, Mycobacterium
GSGLGNA

SEQ ID NO: 263297 - protein, 11 aa, Mycobacterium
GSGLSGGERQR

SEQ ID NO: 263298 - protein, 5 aa, Mycobacterium
GSGMN

SEQ ID NO: 263299 - protein, 4 aa, Mycobacterium
GSGN

SEQ ID NO: 263300 - protein, 5 aa, Mycobacterium
GSGNG

SEQ ID NO: 263301 - protein, 8 aa, Mycobacterium
GSGNTVGE

SEQ ID NO: 263302 - protein, 6 aa, Mycobacterium
GSGPAA

SEQ ID NO: 263303 - protein, 7 aa, Mycobacterium
GSGPEQA

SEQ ID NO: 263304 - protein, 11 aa, Mycobacterium
GSGPEQATRPL

SEQ ID NO: 263305 - protein, 7 aa, Mycobacterium
GSGPEVP

SEQ ID NO: 263306 - protein, 7 aa, Mycobacterium
GSGPIES

SEQ ID NO: 263307 - protein, 9 aa, Mycobacterium
GSGQAPTAI

SEQ ID NO: 263308 - protein, 9 aa, Mycobacterium
GSGQAPTAV

SEQ ID NO: 263309 - protein, 9 aa, Mycobacterium
GSGQPGPVI

SEQ ID NO: 263310 - protein, 11 aa, Mycobacterium
GSGQSGAEAEP

SEQ ID NO: 263311 - protein, 8 aa, Mycobacterium
GSGRPGFD

SEQ ID NO: 263312 - protein, 15 aa, Mycobacterium
GSGRPKTHGRTVTAR

SEQ ID NO: 263313 - protein, 6 aa, Mycobacterium
GSGRPY

SEQ ID NO: 263314 - protein, 21 aa, Mycobacterium
GSGRRGGTGQRERMVASRAAE

SEQ ID NO: 263315 - protein, 5 aa, Mycobacterium
GSGRS

SEQ ID NO: 263316 - protein, 7 aa, Mycobacterium
GSGRTSG

SEQ ID NO: 263317 - protein, 10 aa, Mycobacterium
GSGRTSGGWV

SEQ ID NO: 263318 - protein, 8 aa, Mycobacterium
GSGSDYGT

SEQ ID NO: 263319 - protein, 5 aa, Mycobacterium
GSGSK

SEQ ID NO: 263320 - protein, 7 aa, Mycobacterium
GSGSSHT

SEQ ID NO: 263321 - protein, 6 aa, Mycobacterium
GSGSTA

SEQ ID NO: 263322 - protein, 6 aa, Mycobacterium
GSGSVV

SEQ ID NO: 263323 - protein, 7 aa, Mycobacterium
GSGTAAR

SEQ ID NO: 263324 - protein, 6 aa, Mycobacterium
GSGTAL

SEQ ID NO: 263325 - protein, 6 aa, Mycobacterium
GSGTDV

SEQ ID NO: 263326 - protein, 8 aa, Mycobacterium
GSGTFGES

SEQ ID NO: 263327 - protein, 6 aa, Mycobacterium
GSGTGL

SEQ ID NO: 263328 - protein, 15 aa, Mycobacterium
GSGTISGDGKVGSIG

SEQ ID NO: 263329 - protein, 7 aa, Mycobacterium
GSGTPLR

SEQ ID NO: 263330 - protein, 8 aa, Mycobacterium
GSGTSITA

SEQ ID NO: 263331 - protein, 9 aa, Mycobacterium
GSGTTADAL

SEQ ID NO: 263332 - protein, 11 aa, Mycobacterium
GSGVGKPGAEV

SEQ ID NO: 263333 - protein, 5 aa, Mycobacterium
GSGVP

SEQ ID NO: 263334 - protein, 6 aa, Mycobacterium
GSGVPR

SEQ ID NO: 263335 - protein, 6 aa, Mycobacterium
GSGVRS

SEQ ID NO: 263336 - protein, 4 aa, Mycobacterium
GSGY

SEQ ID NO: 263337 - protein, 10 aa, Mycobacterium
GSGYRNPPSL

SEQ ID NO: 263338 - protein, 7 aa, Mycobacterium
GSHAGGV

SEQ ID NO: 263339 - protein, 5 aa, Mycobacterium
GSHEG

SEQ ID NO: 263340 - protein, 4 aa, Mycobacterium
GSHF

SEQ ID NO: 263341 - protein, 22 aa, Mycobacterium
GSHGDDQDADRSDSPAGELSAD

SEQ ID NO: 263342 - protein, 47 aa, Mycobacterium
GSHGKSPTAAPSTSSSTTSQPRGQQTATDCTPNVSGGEMPRTDSITA

SEQ ID NO: 263343 - protein, 5 aa, Mycobacterium
GSHNS

SEQ ID NO: 263344 - protein, 18 aa, Mycobacterium
GSHRATPIARPSEVQNTG

SEQ ID NO: 263345 - protein, 6 aa, Mycobacterium
GSHRSF

SEQ ID NO: 263346 - protein, 6 aa, Mycobacterium
GSHTGG

SEQ ID NO: 263347 - protein, 5 aa, Mycobacterium
GSHVD

SEQ ID NO: 263348 - protein, 7 aa, Mycobacterium
GSIEERA

SEQ ID NO: 263349 - protein, 8 aa, Mycobacterium
GSIEERAA

SEQ ID NO: 263350 - protein, 10 aa, Mycobacterium
GSIEGKAAVP

SEQ ID NO: 263351 - protein, 8 aa, Mycobacterium
GSIGAGGV

SEQ ID NO: 263352 - protein, 4 aa, Mycobacterium
GSIP

SEQ ID NO: 263353 - protein, 11 aa, Mycobacterium
GSIPTTTSGKI

SEQ ID NO: 263354 - protein, 4 aa, Mycobacterium
GSIQ

SEQ ID NO: 263355 - protein, 8 aa, Mycobacterium
GSIRVGGQ

SEQ ID NO: 263356 - protein, 5 aa, Mycobacterium
GSISE

SEQ ID NO: 263357 - protein, 8 aa, Mycobacterium
GSISPRLA

SEQ ID NO: 263358 - protein, 4 aa, Mycobacterium
GSIT

SEQ ID NO: 263359 - protein, 4 aa, Mycobacterium
GSKA

SEQ ID NO: 263360 - protein, 6 aa, Mycobacterium
GSKEET

SEQ ID NO: 263361 - protein, 6 aa, Mycobacterium
GSKEQT

SEQ ID NO: 263362 - protein, 7 aa, Mycobacterium
GSKETAE

SEQ ID NO: 263363 - protein, 29 aa, Mycobacterium
GSKIGPAAMPKGPLPAQAKMRGVQRTVRR

SEQ ID NO: 263364 - protein, 8 aa, Mycobacterium
GSKLDPTL

SEQ ID NO: 263365 - protein, 14 aa, Mycobacterium
GSKPAALNAGDEAA

SEQ ID NO: 263366 - protein, 21 aa, Mycobacterium
GSKPGESRGGGNNAASNPAWK

SEQ ID NO: 263367 - protein, 15 aa, Mycobacterium
GSKPKERSNEDKPAW

SEQ ID NO: 263368 - protein, 29 aa, Mycobacterium
GSKPKSPEPADTRAEPVSDTEPEAELALA

SEQ ID NO: 263369 - protein, 10 aa, Mycobacterium
GSKSAALSPD

SEQ ID NO: 263370 - protein, 14 aa, Mycobacterium
GSKSQLRESNSLAA

SEQ ID NO: 263371 - protein, 7 aa, Mycobacterium
GSKVTYN

SEQ ID NO: 263372 - protein, 6 aa, Mycobacterium
GSLAPD

SEQ ID NO: 263373 - protein, 10 aa, Mycobacterium
GSLATESTEA

SEQ ID NO: 263374 - protein, 11 aa, Mycobacterium
GSLGTPPQSYN

SEQ ID NO: 263375 - protein, 7 aa, Mycobacterium
GSLIPGS

SEQ ID NO: 263376 - protein, 9 aa, Mycobacterium
GSLKGEGEI

SEQ ID NO: 263377 - protein, 6 aa, Mycobacterium
GSLKPL

SEQ ID NO: 263378 - protein, 29 aa, Mycobacterium
GSLNYEGADPERKKAMTSKPEGKDAHGNE

SEQ ID NO: 263379 - protein, 4 aa, Mycobacterium
GSLP

SEQ ID NO: 263380 - protein, 7 aa, Mycobacterium
GSLPAGE

SEQ ID NO: 263381 - protein, 5 aa, Mycobacterium
GSLQG

SEQ ID NO: 263382 - protein, 6 aa, Mycobacterium
GSLQRR

SEQ ID NO: 263383 - protein, 7 aa, Mycobacterium
GSLRDER

SEQ ID NO: 263384 - protein, 8 aa, Mycobacterium
GSLSAPTD

SEQ ID NO: 263385 - protein, 6 aa, Mycobacterium
GSLSGA

SEQ ID NO: 263386 - protein, 7 aa, Mycobacterium
GSLSGAL

SEQ ID NO: 263387 - protein, 6 aa, Mycobacterium
GSLTEN

SEQ ID NO: 263388 - protein, 12 aa, Mycobacterium
GSLTSQTAANGL

SEQ ID NO: 263389 - protein, 5 aa, Mycobacterium
GSMAG

SEQ ID NO: 263390 - protein, 6 aa, Mycobacterium
GSMAGQ

SEQ ID NO: 263391 - protein, 17 aa, Mycobacterium
GSMGNPPRKSQTPQQRK

SEQ ID NO: 263392 - protein, 5 aa, Mycobacterium
GSMHR

SEQ ID NO: 263393 - protein, 25 aa, Mycobacterium
GSMNRDAARQKADARAKAAREGRRA

SEQ ID NO: 263394 - protein, 9 aa, Mycobacterium
GSMSPEDSH

SEQ ID NO: 263395 - protein, 7 aa, Mycobacterium
GSMVGRT

SEQ ID NO: 263396 - protein, 11 aa, Mycobacterium
GSNAEAARRTG

SEQ ID NO: 263397 - protein, 10 aa, Mycobacterium
GSNAKAARLS

SEQ ID NO: 263398 - protein, 9 aa, Mycobacterium
GSNNPYLDK

SEQ ID NO: 263399 - protein, 10 aa, Mycobacterium
GSNQASGYQL

SEQ ID NO: 263400 - protein, 7 aa, Mycobacterium
GSNQNAD

SEQ ID NO: 263401 - protein, 6 aa, Mycobacterium
GSNRAL

SEQ ID NO: 263402 - protein, 7 aa, Mycobacterium
GSNRRQV

SEQ ID NO: 263403 - protein, 5 aa, Mycobacterium
GSNSV

SEQ ID NO: 263404 - protein, 4 aa, Mycobacterium
GSNT

SEQ ID NO: 263405 - protein, 5 aa, Mycobacterium
GSNTQ

SEQ ID NO: 263406 - protein, 23 aa, Mycobacterium
GSPAAPQADPEAAQPVEPAKPPA

SEQ ID NO: 263407 - protein, 11 aa, Mycobacterium
GSPAAPSGIKD

SEQ ID NO: 263408 - protein, 9 aa, Mycobacterium
GSPAAYASG

SEQ ID NO: 263409 - protein, 22 aa, Mycobacterium
GSPADTDAMTAETNAAARTWTP

SEQ ID NO: 263410 - protein, 6 aa, Mycobacterium
GSPAVA

SEQ ID NO: 263411 - protein, 7 aa, Mycobacterium
GSPDRGA

SEQ ID NO: 263412 - protein, 14 aa, Mycobacterium
GSPDSPEGRSAAGG

SEQ ID NO: 263413 - protein, 16 aa, Mycobacterium
GSPDSQSHQHDHSHHC

SEQ ID NO: 263414 - protein, 14 aa, Mycobacterium
GSPEAEGHQHGHQC

SEQ ID NO: 263415 - protein, 12 aa, Mycobacterium
GSPEDPEARRRA

SEQ ID NO: 263416 - protein, 9 aa, Mycobacterium
GSPEGEDNI

SEQ ID NO: 263417 - protein, 10 aa, Mycobacterium
GSPENAAGTV

SEQ ID NO: 263418 - protein, 7 aa, Mycobacterium
GSPEPGD

SEQ ID NO: 263419 - protein, 13 aa, Mycobacterium
GSPEPSGHRATAL

SEQ ID NO: 263420 - protein, 9 aa, Mycobacterium
GSPESPELR

SEQ ID NO: 263421 - protein, 9 aa, Mycobacterium
GSPETPALR

SEQ ID NO: 263422 - protein, 9 aa, Mycobacterium
GSPFEGEQD

SEQ ID NO: 263423 - protein, 12 aa, Mycobacterium
GSPFHSAKPKGQ

SEQ ID NO: 263424 - protein, 7 aa, Mycobacterium
GSPFSTP

SEQ ID NO: 263425 - protein, 8 aa, Mycobacterium
GSPFSTPT

SEQ ID NO: 263426 - protein, 7 aa, Mycobacterium
GSPFSTQ

SEQ ID NO: 263427 - protein, 7 aa, Mycobacterium
GSPFSTR

SEQ ID NO: 263428 - protein, 8 aa, Mycobacterium
GSPGASTA

SEQ ID NO: 263429 - protein, 12 aa, Mycobacterium
GSPGDPEARRRA

SEQ ID NO: 263430 - protein, 8 aa, Mycobacterium
GSPGSTAT

SEQ ID NO: 263431 - protein, 5 aa, Mycobacterium
GSPIR

SEQ ID NO: 263432 - protein, 6 aa, Mycobacterium
GSPKAV

SEQ ID NO: 263433 - protein, 7 aa, Mycobacterium
GSPKQGI

SEQ ID NO: 263434 - protein, 6 aa, Mycobacterium
GSPLPG

SEQ ID NO: 263435 - protein, 35 aa, Mycobacterium
GSPLPPGVTAPPQGPPPAPQPPPNFAGTNPGPMLP

SEQ ID NO: 263436 - protein, 19 aa, Mycobacterium
GSPMGRTRDAAPGAPPHRP

SEQ ID NO: 263437 - protein, 9 aa, Mycobacterium
GSPNAGKTS

SEQ ID NO: 263438 - protein, 9 aa, Mycobacterium
GSPNAGKTT

SEQ ID NO: 263439 - protein, 13 aa, Mycobacterium
GSPNQKGPGAKIR

SEQ ID NO: 263440 - protein, 7 aa, Mycobacterium
GSPPALN

SEQ ID NO: 263441 - protein, 10 aa, Mycobacterium
GSPPAQLSGR

SEQ ID NO: 263442 - protein, 8 aa, Mycobacterium
GSPPGTEL

SEQ ID NO: 263443 - protein, 5 aa, Mycobacterium
GSPPR

SEQ ID NO: 263444 - protein, 13 aa, Mycobacterium
GSPPRRDAAATKA

SEQ ID NO: 263445 - protein, 9 aa, Mycobacterium
GSPPYRADS

SEQ ID NO: 263446 - protein, 13 aa, Mycobacterium
GSPPYRADSASTL

SEQ ID NO: 263447 - protein, 13 aa, Mycobacterium
GSPPYRSDSAGTL

SEQ ID NO: 263448 - protein, 5 aa, Mycobacterium
GSPQA

SEQ ID NO: 263449 - protein, 9 aa, Mycobacterium
GSPQDGGRI

SEQ ID NO: 263450 - protein, 15 aa, Mycobacterium
GSPRVTIDGDASAAR

SEQ ID NO: 263451 - protein, 4 aa, Mycobacterium
GSPS

SEQ ID NO: 263452 - protein, 22 aa, Mycobacterium
GSPSEGAPFGRARPAQLPPGRG

SEQ ID NO: 263453 - protein, 12 aa, Mycobacterium
GSPTAPLPFGTE

SEQ ID NO: 263454 - protein, 11 aa, Mycobacterium
GSPTGSGHPEP

SEQ ID NO: 263455 - protein, 7 aa, Mycobacterium
GSPTPPR

SEQ ID NO: 263456 - protein, 9 aa, Mycobacterium
GSPTSSPVT

SEQ ID NO: 263457 - protein, 6 aa, Mycobacterium
GSPTTL

SEQ ID NO: 263458 - protein, 8 aa, Mycobacterium
GSPTTSKV

SEQ ID NO: 263459 - protein, 9 aa, Mycobacterium
GSPTTSSVP

SEQ ID NO: 263460 - protein, 5 aa, Mycobacterium
GSPVA

SEQ ID NO: 263461 - protein, 9 aa, Mycobacterium
GSPVEGEHD

SEQ ID NO: 263462 - protein, 8 aa, Mycobacterium
GSPVPKGA

SEQ ID NO: 263463 - protein, 5 aa, Mycobacterium
GSPVQ

SEQ ID NO: 263464 - protein, 7 aa, Mycobacterium
GSQAAVD

SEQ ID NO: 263465 - protein, 5 aa, Mycobacterium
GSQAP

SEQ ID NO: 263466 - protein, 6 aa, Mycobacterium
GSQAPA

SEQ ID NO: 263467 - protein, 7 aa, Mycobacterium
GSQAPKA

SEQ ID NO: 263468 - protein, 7 aa, Mycobacterium
GSQAPTA

SEQ ID NO: 263469 - protein, 7 aa, Mycobacterium
GSQARRQ

SEQ ID NO: 263470 - protein, 5 aa, Mycobacterium
GSQDT

SEQ ID NO: 263471 - protein, 11 aa, Mycobacterium
GSQGEPVPLPA

SEQ ID NO: 263472 - protein, 15 aa, Mycobacterium
GSQGLGLGNPDNSEN

SEQ ID NO: 263473 - protein, 12 aa, Mycobacterium
GSQGTSASHESV

SEQ ID NO: 263474 - protein, 4 aa, Mycobacterium
GSQI

SEQ ID NO: 263475 - protein, 5 aa, Mycobacterium
GSQLG

SEQ ID NO: 263476 - protein, 6 aa, Mycobacterium
GSQNPV

SEQ ID NO: 263477 - protein, 4 aa, Mycobacterium
GSQP

SEQ ID NO: 263478 - protein, 11 aa, Mycobacterium
GSQPLADDAEE

SEQ ID NO: 263479 - protein, 12 aa, Mycobacterium
GSQRAGLGGLTR

SEQ ID NO: 263480 - protein, 7 aa, Mycobacterium
GSQRGAD

SEQ ID NO: 263481 - protein, 4 aa, Mycobacterium
GSQS

SEQ ID NO: 263482 - protein, 7 aa, Mycobacterium
GSQSGNF

SEQ ID NO: 263483 - protein, 13 aa, Mycobacterium
GSQSGTSANSGLA

SEQ ID NO: 263484 - protein, 17 aa, Mycobacterium
GSQTHSGLYSPGPLRIR

SEQ ID NO: 263485 - protein, 5 aa, Mycobacterium
GSQWA

SEQ ID NO: 263486 - protein, 7 aa, Mycobacterium
GSQWPGM

SEQ ID NO: 263487 - protein, 17 aa, Mycobacterium
GSRAAAMPKGPLPGQAK

SEQ ID NO: 263488 - protein, 8 aa, Mycobacterium
GSRADAWG

SEQ ID NO: 263489 - protein, 29 aa, Mycobacterium
GSRAGAGALPKGPLPNAGKMRGVQRSVRR

SEQ ID NO: 263490 - protein, 6 aa, Mycobacterium
GSRASI

SEQ ID NO: 263491 - protein, 5 aa, Mycobacterium
GSRAT

SEQ ID NO: 263492 - protein, 9 aa, Mycobacterium
GSRDITAPE

SEQ ID NO: 263493 - protein, 5 aa, Mycobacterium
GSRDL

SEQ ID NO: 263494 - protein, 9 aa, Mycobacterium
GSRDPASTY

SEQ ID NO: 263495 - protein, 12 aa, Mycobacterium
GSRDRGIDHSAA

SEQ ID NO: 263496 - protein, 4 aa, Mycobacterium
GSRE

SEQ ID NO: 263497 - protein, 14 aa, Mycobacterium
GSRGAGRSGELAAQ

SEQ ID NO: 263498 - protein, 12 aa, Mycobacterium
GSRGPDGKPYAA

SEQ ID NO: 263499 - protein, 9 aa, Mycobacterium
GSRGRAGTA

SEQ ID NO: 263500 - protein, 5 aa, Mycobacterium
GSRHH

SEQ ID NO: 263501 - protein, 13 aa, Mycobacterium
GSRIERNNTRIGQ

SEQ ID NO: 263502 - protein, 6 aa, Mycobacterium
GSRIGE

SEQ ID NO: 263503 - protein, 12 aa, Mycobacterium
GSRIPEDRTAPA

SEQ ID NO: 263504 - protein, 13 aa, Mycobacterium
GSRLASGQTHRTP

SEQ ID NO: 263505 - protein, 7 aa, Mycobacterium
GSRLDDT

SEQ ID NO: 263506 - protein, 9 aa, Mycobacterium
GSRLGYQES

SEQ ID NO: 263507 - protein, 10 aa, Mycobacterium
GSRLRPGTEV

SEQ ID NO: 263508 - protein, 6 aa, Mycobacterium
GSRNGT

SEQ ID NO: 263509 - protein, 4 aa, Mycobacterium
GSRP

SEQ ID NO: 263510 - protein, 7 aa, Mycobacterium
GSRPDLY

SEQ ID NO: 263511 - protein, 9 aa, Mycobacterium
GSRPELRGQ

SEQ ID NO: 263512 - protein, 9 aa, Mycobacterium
GSRPFCTPG

SEQ ID NO: 263513 - protein, 5 aa, Mycobacterium
GSRPM

SEQ ID NO: 263514 - protein, 19 aa, Mycobacterium
GSRPPAAAPSVAVGPGEHP

SEQ ID NO: 263515 - protein, 12 aa, Mycobacterium
GSRPREIAVRAG

SEQ ID NO: 263516 - protein, 5 aa, Mycobacterium
GSRPS

SEQ ID NO: 263517 - protein, 6 aa, Mycobacterium
GSRPSL

SEQ ID NO: 263518 - protein, 13 aa, Mycobacterium
GSRPYIAGSTDNS

SEQ ID NO: 263519 - protein, 7 aa, Mycobacterium
GSRQETV

SEQ ID NO: 263520 - protein, 8 aa, Mycobacterium
GSRQGAPA

SEQ ID NO: 263521 - protein, 20 aa, Mycobacterium
GSRRASAPVPEDADEQPALA

SEQ ID NO: 263522 - protein, 18 aa, Mycobacterium
GSRRGDSETPQKATPKPV

SEQ ID NO: 263523 - protein, 6 aa, Mycobacterium
GSRRRG

SEQ ID NO: 263524 - protein, 6 aa, Mycobacterium
GSRSEV

SEQ ID NO: 263525 - protein, 10 aa, Mycobacterium
GSRSIADYGG

SEQ ID NO: 263526 - protein, 4 aa, Mycobacterium
GSRT

SEQ ID NO: 263527 - protein, 7 aa, Mycobacterium
GSRTAEE

SEQ ID NO: 263528 - protein, 9 aa, Mycobacterium
GSRTARDNY

SEQ ID NO: 263529 - protein, 4 aa, Mycobacterium
GSRV

SEQ ID NO: 263530 - protein, 5 aa, Mycobacterium
GSSAA

SEQ ID NO: 263531 - protein, 5 aa, Mycobacterium
GSSAD

SEQ ID NO: 263532 - protein, 8 aa, Mycobacterium
GSSADPQA

SEQ ID NO: 263533 - protein, 5 aa, Mycobacterium
GSSAG

SEQ ID NO: 263534 - protein, 6 aa, Mycobacterium
GSSAIT

SEQ ID NO: 263535 - protein, 12 aa, Mycobacterium
GSSALPTVSVPG

SEQ ID NO: 263536 - protein, 13 aa, Mycobacterium
GSSALPTVSVPPG

SEQ ID NO: 263537 - protein, 9 aa, Mycobacterium
GSSAPPPAV

SEQ ID NO: 263538 - protein, 7 aa, Mycobacterium
GSSATAA

SEQ ID NO: 263539 - protein, 16 aa, Mycobacterium
GSSDAANSITVDKPPA

SEQ ID NO: 263540 - protein, 125 aa, Mycobacterium
GSSDKPATRPPGVSPAPTTSAPAPPPPTEGSPEPAPPPPGTQEPAPQAPPPAPPSTQAPPPTAETTPPPRRRPNRRKARRPRRRHRRRPPSRRQRPSRRQRPSRRQRPSRRPPPRHRQPSKCRQC

SEQ ID NO: 263541 - protein, 20 aa, Mycobacterium
GSSDNTGEKRISDDVANNAI

SEQ ID NO: 263542 - protein, 5 aa, Mycobacterium
GSSDP

SEQ ID NO: 263543 - protein, 21 aa, Mycobacterium
GSSDTGTSGTTDDGGPASGTL

SEQ ID NO: 263544 - protein, 9 aa, Mycobacterium
GSSDTLAGR

SEQ ID NO: 263545 - protein, 4 aa, Mycobacterium
GSSF

SEQ ID NO: 263546 - protein, 7 aa, Mycobacterium
GSSFESD

SEQ ID NO: 263547 - protein, 20 aa, Mycobacterium
GSSFRRDSTECRPAGQRETA

SEQ ID NO: 263548 - protein, 4 aa, Mycobacterium
GSSG

SEQ ID NO: 263549 - protein, 10 aa, Mycobacterium
GSSGAATALA

SEQ ID NO: 263550 - protein, 9 aa, Mycobacterium
GSSGAGGVM

SEQ ID NO: 263551 - protein, 10 aa, Mycobacterium
GSSGAGKSTI

SEQ ID NO: 263552 - protein, 8 aa, Mycobacterium
GSSGGPFA

SEQ ID NO: 263553 - protein, 6 aa, Mycobacterium
GSSGPF

SEQ ID NO: 263554 - protein, 12 aa, Mycobacterium
GSSGPGNSVKDS

SEQ ID NO: 263555 - protein, 9 aa, Mycobacterium
GSSGPPKGV

SEQ ID NO: 263556 - protein, 8 aa, Mycobacterium
GSSGSGNL

SEQ ID NO: 263557 - protein, 9 aa, Mycobacterium
GSSGSPKGV

SEQ ID NO: 263558 - protein, 22 aa, Mycobacterium
GSSHSSSSGTAFSGGAGGGDFD

SEQ ID NO: 263559 - protein, 9 aa, Mycobacterium
GSSKRGTRS

SEQ ID NO: 263560 - protein, 9 aa, Mycobacterium
GSSLPSQSV

SEQ ID NO: 263561 - protein, 9 aa, Mycobacterium
GSSLSTDAV

SEQ ID NO: 263562 - protein, 4 aa, Mycobacterium
GSSN

SEQ ID NO: 263563 - protein, 10 aa, Mycobacterium
GSSNAAGYQL

SEQ ID NO: 263564 - protein, 9 aa, Mycobacterium
GSSNSPISG

SEQ ID NO: 263565 - protein, 5 aa, Mycobacterium
GSSPI

SEQ ID NO: 263566 - protein, 9 aa, Mycobacterium
GSSPKSKVK

SEQ ID NO: 263567 - protein, 8 aa, Mycobacterium
GSSPLSQT

SEQ ID NO: 263568 - protein, 12 aa, Mycobacterium
GSSQFEEPTGSI

SEQ ID NO: 263569 - protein, 13 aa, Mycobacterium
GSSQFEEPTGSIA

SEQ ID NO: 263570 - protein, 8 aa, Mycobacterium
GSSQSSAW

SEQ ID NO: 263571 - protein, 5 aa, Mycobacterium
GSSRD

SEQ ID NO: 263572 - protein, 10 aa, Mycobacterium
GSSRDETATP

SEQ ID NO: 263573 - protein, 10 aa, Mycobacterium
GSSREPDAPR

SEQ ID NO: 263574 - protein, 24 aa, Mycobacterium
GSSSDDVAVPQSGGFGAGPVDPAG

SEQ ID NO: 263575 - protein, 7 aa, Mycobacterium
GSSSEGV

SEQ ID NO: 263576 - protein, 13 aa, Mycobacterium
GSSSIKATAERRR

SEQ ID NO: 263577 - protein, 5 aa, Mycobacterium
GSSSM

SEQ ID NO: 263578 - protein, 11 aa, Mycobacterium
GSSSPSTGATL

SEQ ID NO: 263579 - protein, 7 aa, Mycobacterium
GSSSPYT

SEQ ID NO: 263580 - protein, 7 aa, Mycobacterium
GSSTPTA

SEQ ID NO: 263581 - protein, 5 aa, Mycobacterium
GSSTT

SEQ ID NO: 263582 - protein, 6 aa, Mycobacterium
GSSVAD

SEQ ID NO: 263583 - protein, 6 aa, Mycobacterium
GSSVSG

SEQ ID NO: 263584 - protein, 5 aa, Mycobacterium
GSSWR

SEQ ID NO: 263585 - protein, 4 aa, Mycobacterium
GSTA

SEQ ID NO: 263586 - protein, 14 aa, Mycobacterium
GSTAALAAAPRGMP

SEQ ID NO: 263587 - protein, 15 aa, Mycobacterium
GSTAALAAAPRGVPA

SEQ ID NO: 263588 - protein, 6 aa, Mycobacterium
GSTAGA

SEQ ID NO: 263589 - protein, 7 aa, Mycobacterium
GSTAGAT

SEQ ID NO: 263590 - protein, 4 aa, Mycobacterium
GSTD

SEQ ID NO: 263591 - protein, 5 aa, Mycobacterium
GSTDL

SEQ ID NO: 263592 - protein, 13 aa, Mycobacterium
GSTDTGHEAADQP

SEQ ID NO: 263593 - protein, 6 aa, Mycobacterium
GSTEAG

SEQ ID NO: 263594 - protein, 19 aa, Mycobacterium
GSTEHPSITGSRPSAPEDK

SEQ ID NO: 263595 - protein, 7 aa, Mycobacterium
GSTESGS

SEQ ID NO: 263596 - protein, 19 aa, Mycobacterium
GSTESSQQQDPGCDDGEGQ

SEQ ID NO: 263597 - protein, 4 aa, Mycobacterium
GSTF

SEQ ID NO: 263598 - protein, 5 aa, Mycobacterium
GSTFG

SEQ ID NO: 263599 - protein, 5 aa, Mycobacterium
GSTGA

SEQ ID NO: 263600 - protein, 8 aa, Mycobacterium
GSTGAGKS

SEQ ID NO: 263601 - protein, 8 aa, Mycobacterium
GSTGAPKG

SEQ ID NO: 263602 - protein, 18 aa, Mycobacterium
GSTGEFNDSYRKSSQQFR

SEQ ID NO: 263603 - protein, 13 aa, Mycobacterium
GSTGERGAQGRLP

SEQ ID NO: 263604 - protein, 14 aa, Mycobacterium
GSTGLATADAPLAD

SEQ ID NO: 263605 - protein, 5 aa, Mycobacterium
GSTGR

SEQ ID NO: 263606 - protein, 8 aa, Mycobacterium
GSTGRPKP

SEQ ID NO: 263607 - protein, 21 aa, Mycobacterium
GSTGRPSPPVGLGSGGLGSIS

SEQ ID NO: 263608 - protein, 9 aa, Mycobacterium
GSTGSEITT

SEQ ID NO: 263609 - protein, 8 aa, Mycobacterium
GSTGSGKS

SEQ ID NO: 263610 - protein, 13 aa, Mycobacterium
GSTHSDVKQRSRA

SEQ ID NO: 263611 - protein, 10 aa, Mycobacterium
GSTHTAGPPF

SEQ ID NO: 263612 - protein, 11 aa, Mycobacterium
GSTHTAGPPFA

SEQ ID NO: 263613 - protein, 7 aa, Mycobacterium
GSTHTFA

SEQ ID NO: 263614 - protein, 4 aa, Mycobacterium
GSTI

SEQ ID NO: 263615 - protein, 5 aa, Mycobacterium
GSTIP

SEQ ID NO: 263616 - protein, 4 aa, Mycobacterium
GSTK

SEQ ID NO: 263617 - protein, 5 aa, Mycobacterium
GSTLG

SEQ ID NO: 263618 - protein, 6 aa, Mycobacterium
GSTLPG

SEQ ID NO: 263619 - protein, 8 aa, Mycobacterium
GSTNGDHH

SEQ ID NO: 263620 - protein, 7 aa, Mycobacterium
GSTNGTY

SEQ ID NO: 263621 - protein, 8 aa, Mycobacterium
GSTPPSAR

SEQ ID NO: 263622 - protein, 8 aa, Mycobacterium
GSTPVANQ

SEQ ID NO: 263623 - protein, 5 aa, Mycobacterium
GSTQT

SEQ ID NO: 263624 - protein, 6 aa, Mycobacterium
GSTQTT

SEQ ID NO: 263625 - protein, 9 aa, Mycobacterium
GSTRARITT

SEQ ID NO: 263626 - protein, 5 aa, Mycobacterium
GSTRL

SEQ ID NO: 263627 - protein, 5 aa, Mycobacterium
GSTRY

SEQ ID NO: 263628 - protein, 9 aa, Mycobacterium
GSTSGQQLP

SEQ ID NO: 263629 - protein, 9 aa, Mycobacterium
GSTSKSLSQ

SEQ ID NO: 263630 - protein, 4 aa, Mycobacterium
GSTT

SEQ ID NO: 263631 - protein, 11 aa, Mycobacterium
GSTTAAAYQNE

SEQ ID NO: 263632 - protein, 11 aa, Mycobacterium
GSTTLTSTGAV

SEQ ID NO: 263633 - protein, 4 aa, Mycobacterium
GSTV

SEQ ID NO: 263634 - protein, 6 aa, Mycobacterium
GSTVPG

SEQ ID NO: 263635 - protein, 7 aa, Mycobacterium
GSTVQEL

SEQ ID NO: 263636 - protein, 9 aa, Mycobacterium
GSVAAATPR

SEQ ID NO: 263637 - protein, 7 aa, Mycobacterium
GSVATYS

SEQ ID NO: 263638 - protein, 6 aa, Mycobacterium
GSVDDA

SEQ ID NO: 263639 - protein, 29 aa, Mycobacterium
GSVDETQCPAGTEANSYPSPARVYCLARA

SEQ ID NO: 263640 - protein, 7 aa, Mycobacterium
GSVDGPL

SEQ ID NO: 263641 - protein, 5 aa, Mycobacterium
GSVDP

SEQ ID NO: 263642 - protein, 24 aa, Mycobacterium
GSVDPADDVEAVTSAGLTGRRGGH

SEQ ID NO: 263643 - protein, 4 aa, Mycobacterium
GSVE

SEQ ID NO: 263644 - protein, 8 aa, Mycobacterium
GSVEERAA

SEQ ID NO: 263645 - protein, 6 aa, Mycobacterium
GSVERR

SEQ ID NO: 263646 - protein, 4 aa, Mycobacterium
GSVG

SEQ ID NO: 263647 - protein, 10 aa, Mycobacterium
GSVGAAATGL

SEQ ID NO: 263648 - protein, 6 aa, Mycobacterium
GSVGAP

SEQ ID NO: 263649 - protein, 11 aa, Mycobacterium
GSVGGGDPGWP

SEQ ID NO: 263650 - protein, 4 aa, Mycobacterium
GSVH

SEQ ID NO: 263651 - protein, 6 aa, Mycobacterium
GSVHRS

SEQ ID NO: 263652 - protein, 4 aa, Mycobacterium
GSVI

SEQ ID NO: 263653 - protein, 4 aa, Mycobacterium
GSVL

SEQ ID NO: 263654 - protein, 9 aa, Mycobacterium
GSVMGQPGA

SEQ ID NO: 263655 - protein, 7 aa, Mycobacterium
GSVPAGA

SEQ ID NO: 263656 - protein, 8 aa, Mycobacterium
GSVPPREI

SEQ ID NO: 263657 - protein, 8 aa, Mycobacterium
GSVPTPGM

SEQ ID NO: 263658 - protein, 4 aa, Mycobacterium
GSVR

SEQ ID NO: 263659 - protein, 9 aa, Mycobacterium
GSVSEHPGM

SEQ ID NO: 263660 - protein, 11 aa, Mycobacterium
GSVSSTPGAAV

SEQ ID NO: 263661 - protein, 12 aa, Mycobacterium
GSVTAESSDERT

SEQ ID NO: 263662 - protein, 11 aa, Mycobacterium
GSVTARSANGY

SEQ ID NO: 263663 - protein, 4 aa, Mycobacterium
GSWQ

SEQ ID NO: 263664 - protein, 10 aa, Mycobacterium
GSWQGPSASE

SEQ ID NO: 263665 - protein, 8 aa, Mycobacterium
GSWRGSAA

SEQ ID NO: 263666 - protein, 5 aa, Mycobacterium
GSWTP

SEQ ID NO: 263667 - protein, 7 aa, Mycobacterium
GSYADPV

SEQ ID NO: 263668 - protein, 4 aa, Mycobacterium
GSYD

SEQ ID NO: 263669 - protein, 8 aa, Mycobacterium
GSYPEGDY

SEQ ID NO: 263670 - protein, 4 aa, Mycobacterium
GSYR

SEQ ID NO: 263671 - protein, 11 aa, Mycobacterium
GSYRAVEPRDN

SEQ ID NO: 263672 - protein, 9 aa, Mycobacterium
GSYSPEDSH

SEQ ID NO: 263673 - protein, 11 aa, Mycobacterium
GSYSPTPTTMS

SEQ ID NO: 263674 - protein, 8 aa, Mycobacterium
GSYSTQYP

SEQ ID NO: 263675 - protein, 13 aa, Mycobacterium
GSYTTAAQQQSRL

SEQ ID NO: 263676 - protein, 13 aa, Mycobacterium
GSYTTGAQQQSKL

SEQ ID NO: 263677 - protein, 6 aa, Mycobacterium
GTAAAG

SEQ ID NO: 263678 - protein, 14 aa, Mycobacterium
GTAADDSGKSRRVR

SEQ ID NO: 263679 - protein, 8 aa, Mycobacterium
GTAAGREL

SEQ ID NO: 263680 - protein, 6 aa, Mycobacterium
GTAAGV

SEQ ID NO: 263681 - protein, 16 aa, Mycobacterium
GTAALGGLTGSDTQYD

SEQ ID NO: 263682 - protein, 14 aa, Mycobacterium
GTAANDLDRANLTP

SEQ ID NO: 263683 - protein, 6 aa, Mycobacterium
GTAAPD

SEQ ID NO: 263684 - protein, 7 aa, Mycobacterium
GTAAPEA

SEQ ID NO: 263685 - protein, 18 aa, Mycobacterium
GTAAPPVTAAPAAQPVRR

SEQ ID NO: 263686 - protein, 27 aa, Mycobacterium
GTAAPQVPADAVTASGSGLDPDISPAY

SEQ ID NO: 263687 - protein, 19 aa, Mycobacterium
GTAAQTATVTDPGAFAQSG

SEQ ID NO: 263688 - protein, 18 aa, Mycobacterium
GTAASPDQKDAVGSAATS

SEQ ID NO: 263689 - protein, 13 aa, Mycobacterium
GTAATNRDLQEGA

SEQ ID NO: 263690 - protein, 4 aa, Mycobacterium
GTAD

SEQ ID NO: 263691 - protein, 10 aa, Mycobacterium
GTADAGHFTD

SEQ ID NO: 263692 - protein, 6 aa, Mycobacterium
GTADDT

SEQ ID NO: 263693 - protein, 14 aa, Mycobacterium
GTADPAAARSELTN

SEQ ID NO: 263694 - protein, 8 aa, Mycobacterium
GTADPAEL

SEQ ID NO: 263695 - protein, 9 aa, Mycobacterium
GTADPAQLR

SEQ ID NO: 263696 - protein, 5 aa, Mycobacterium
GTADR

SEQ ID NO: 263697 - protein, 8 aa, Mycobacterium
GTADTARI

SEQ ID NO: 263698 - protein, 8 aa, Mycobacterium
GTAEFGSA

SEQ ID NO: 263699 - protein, 9 aa, Mycobacterium
GTAEQGGVI

SEQ ID NO: 263700 - protein, 16 aa, Mycobacterium
GTAERSGLWSPAPLRL

SEQ ID NO: 263701 - protein, 7 aa, Mycobacterium
GTAGAQA

SEQ ID NO: 263702 - protein, 7 aa, Mycobacterium
GTAGDAR

SEQ ID NO: 263703 - protein, 17 aa, Mycobacterium
GTAGGPGRGRSGIAGRA

SEQ ID NO: 263704 - protein, 15 aa, Mycobacterium
GTAGKEIVGQPGGLT

SEQ ID NO: 263705 - protein, 11 aa, Mycobacterium
GTAGPDGAFSP

SEQ ID NO: 263706 - protein, 6 aa, Mycobacterium
GTAGQN

SEQ ID NO: 263707 - protein, 9 aa, Mycobacterium
GTAGRPGSA

SEQ ID NO: 263708 - protein, 5 aa, Mycobacterium
GTAGS

SEQ ID NO: 263709 - protein, 7 aa, Mycobacterium
GTAGSGG

SEQ ID NO: 263710 - protein, 9 aa, Mycobacterium
GTAIPSNVT

SEQ ID NO: 263711 - protein, 6 aa, Mycobacterium
GTAKRT

SEQ ID NO: 263712 - protein, 8 aa, Mycobacterium
GTALAGTG

SEQ ID NO: 263713 - protein, 14 aa, Mycobacterium
GTALASAPQTTPAP

SEQ ID NO: 263714 - protein, 9 aa, Mycobacterium
GTALGVQGT

SEQ ID NO: 263715 - protein, 5 aa, Mycobacterium
GTAMS

SEQ ID NO: 263716 - protein, 12 aa, Mycobacterium
GTANLRSDETEK

SEQ ID NO: 263717 - protein, 8 aa, Mycobacterium
GTANPAKL

SEQ ID NO: 263718 - protein, 13 aa, Mycobacterium
GTAPAAAGTTAAA

SEQ ID NO: 263719 - protein, 10 aa, Mycobacterium
GTAPAAASTH

SEQ ID NO: 263720 - protein, 6 aa, Mycobacterium
GTAPGL

SEQ ID NO: 263721 - protein, 9 aa, Mycobacterium
GTAPSAETL

SEQ ID NO: 263722 - protein, 14 aa, Mycobacterium
GTAPTAKDWKDGST

SEQ ID NO: 263723 - protein, 7 aa, Mycobacterium
GTAPTYH

SEQ ID NO: 263724 - protein, 14 aa, Mycobacterium
GTAPTYKDIQDGAK

SEQ ID NO: 263725 - protein, 9 aa, Mycobacterium
GTAQINRDS

SEQ ID NO: 263726 - protein, 5 aa, Mycobacterium
GTAQR

SEQ ID NO: 263727 - protein, 6 aa, Mycobacterium
GTAQRR

SEQ ID NO: 263728 - protein, 26 aa, Mycobacterium
GTARDDLGRCPAGEPASNAPMSEAGV

SEQ ID NO: 263729 - protein, 26 aa, Mycobacterium
GTARDITDRHRSGEITAEQAGADLSR

SEQ ID NO: 263730 - protein, 17 aa, Mycobacterium
GTARFPGDKPGEQTGEQ

SEQ ID NO: 263731 - protein, 6 aa, Mycobacterium
GTARGC

SEQ ID NO: 263732 - protein, 11 aa, Mycobacterium
GTARPDPSTMS

SEQ ID NO: 263733 - protein, 4 aa, Mycobacterium
GTAS

SEQ ID NO: 263734 - protein, 5 aa, Mycobacterium
GTASG

SEQ ID NO: 263735 - protein, 8 aa, Mycobacterium
GTASRPKG

SEQ ID NO: 263736 - protein, 14 aa, Mycobacterium
GTASTYKDIQDGAK

SEQ ID NO: 263737 - protein, 7 aa, Mycobacterium
GTATDSE

SEQ ID NO: 263738 - protein, 5 aa, Mycobacterium
GTATG

SEQ ID NO: 263739 - protein, 10 aa, Mycobacterium
GTATGGPIPQ

SEQ ID NO: 263740 - protein, 8 aa, Mycobacterium
GTATHPDA

SEQ ID NO: 263741 - protein, 14 aa, Mycobacterium
GTATIDGNGYEPTA

SEQ ID NO: 263742 - protein, 5 aa, Mycobacterium
GTATN

SEQ ID NO: 263743 - protein, 16 aa, Mycobacterium
GTATRSGLWSPAPLRK

SEQ ID NO: 263744 - protein, 17 aa, Mycobacterium
GTATRSGLWSPGKIRIG

SEQ ID NO: 263745 - protein, 16 aa, Mycobacterium
GTATRSGWWSPAPLRL

SEQ ID NO: 263746 - protein, 10 aa, Mycobacterium
GTATTLGDPI

SEQ ID NO: 263747 - protein, 13 aa, Mycobacterium
GTATTTDAADAHR

SEQ ID NO: 263748 - protein, 12 aa, Mycobacterium
GTAVVSGNGEKI

SEQ ID NO: 263749 - protein, 9 aa, Mycobacterium
GTDAATLRR

SEQ ID NO: 263750 - protein, 14 aa, Mycobacterium
GTDADADGTAAARN

SEQ ID NO: 263751 - protein, 14 aa, Mycobacterium
GTDADVADPDATRL

SEQ ID NO: 263752 - protein, 18 aa, Mycobacterium
GTDADVETGAGRMPPARA

SEQ ID NO: 263753 - protein, 5 aa, Mycobacterium
GTDAG

SEQ ID NO: 263754 - protein, 5 aa, Mycobacterium
GTDAS

SEQ ID NO: 263755 - protein, 10 aa, Mycobacterium
GTDDDQLSDQ

SEQ ID NO: 263756 - protein, 6 aa, Mycobacterium
GTDDTV

SEQ ID NO: 263757 - protein, 9 aa, Mycobacterium
GTDEAKPDF

SEQ ID NO: 263758 - protein, 10 aa, Mycobacterium
GTDEDPVAAE

SEQ ID NO: 263759 - protein, 12 aa, Mycobacterium
GTDEPTINDETT

SEQ ID NO: 263760 - protein, 8 aa, Mycobacterium
GTDETVQQ

SEQ ID NO: 263761 - protein, 6 aa, Mycobacterium
GTDGST

SEQ ID NO: 263762 - protein, 9 aa, Mycobacterium
GTDIDGQVQ

SEQ ID NO: 263763 - protein, 12 aa, Mycobacterium
GTDLPATSGGAP

SEQ ID NO: 263764 - protein, 9 aa, Mycobacterium
GTDLSPDHG

SEQ ID NO: 263765 - protein, 9 aa, Mycobacterium
GTDMTGTDA

SEQ ID NO: 263766 - protein, 14 aa, Mycobacterium
GTDPDASGFGSPAA

SEQ ID NO: 263767 - protein, 16 aa, Mycobacterium
GTDPGANASVSAGDEI

SEQ ID NO: 263768 - protein, 15 aa, Mycobacterium
GTDPGANTSVGAGAD

SEQ ID NO: 263769 - protein, 17 aa, Mycobacterium
GTDPRDVHEALRAARYP

SEQ ID NO: 263770 - protein, 4 aa, Mycobacterium
GTDQ

SEQ ID NO: 263771 - protein, 7 aa, Mycobacterium
GTDQQTR

SEQ ID NO: 263772 - protein, 6 aa, Mycobacterium
GTDRHN

SEQ ID NO: 263773 - protein, 7 aa, Mycobacterium
GTDSEGV

SEQ ID NO: 263774 - protein, 9 aa, Mycobacterium
GTDSGQSRR

SEQ ID NO: 263775 - protein, 8 aa, Mycobacterium
GTDSRLGR

SEQ ID NO: 263776 - protein, 17 aa, Mycobacterium
GTDTGADAEQANVGAAG

SEQ ID NO: 263777 - protein, 14 aa, Mycobacterium
GTDTLADGSRQLAD

SEQ ID NO: 263778 - protein, 6 aa, Mycobacterium
GTDTQG

SEQ ID NO: 263779 - protein, 29 aa, Mycobacterium
GTDTSCCGPTAAASQPDQPAAASAPAPAH

SEQ ID NO: 263780 - protein, 8 aa, Mycobacterium
GTDVSKGA

SEQ ID NO: 263781 - protein, 9 aa, Mycobacterium
GTEAAKEAA

SEQ ID NO: 263782 - protein, 8 aa, Mycobacterium
GTEARDGH

SEQ ID NO: 263783 - protein, 6 aa, Mycobacterium
GTEDLA

SEQ ID NO: 263784 - protein, 18 aa, Mycobacterium
GTEDLSASVGSTHPPGTP

SEQ ID NO: 263785 - protein, 6 aa, Mycobacterium
GTEDLT

SEQ ID NO: 263786 - protein, 9 aa, Mycobacterium
GTEEQGGVI

SEQ ID NO: 263787 - protein, 6 aa, Mycobacterium
GTEEQK

SEQ ID NO: 263788 - protein, 5 aa, Mycobacterium
GTEGI

SEQ ID NO: 263789 - protein, 9 aa, Mycobacterium
GTEGRSEVS

SEQ ID NO: 263790 - protein, 7 aa, Mycobacterium
GTEIGTD

SEQ ID NO: 263791 - protein, 6 aa, Mycobacterium
GTEIRE

SEQ ID NO: 263792 - protein, 13 aa, Mycobacterium
GTENDDDRPAPIP

SEQ ID NO: 263793 - protein, 4 aa, Mycobacterium
GTEP

SEQ ID NO: 263794 - protein, 7 aa, Mycobacterium
GTEPATV

SEQ ID NO: 263795 - protein, 10 aa, Mycobacterium
GTEPQSVRER

SEQ ID NO: 263796 - protein, 7 aa, Mycobacterium
GTEPSTV

SEQ ID NO: 263797 - protein, 4 aa, Mycobacterium
GTEQ

SEQ ID NO: 263798 - protein, 7 aa, Mycobacterium
GTEQDSA

SEQ ID NO: 263799 - protein, 15 aa, Mycobacterium
GTEQQRTKAALESAR

SEQ ID NO: 263800 - protein, 6 aa, Mycobacterium
GTERHQ

SEQ ID NO: 263801 - protein, 15 aa, Mycobacterium
GTERIADTGLPPGTR

SEQ ID NO: 263802 - protein, 7 aa, Mycobacterium
GTERTDH

SEQ ID NO: 263803 - protein, 8 aa, Mycobacterium
GTERTDQD

SEQ ID NO: 263804 - protein, 4 aa, Mycobacterium
GTES

SEQ ID NO: 263805 - protein, 6 aa, Mycobacterium
GTESDR

SEQ ID NO: 263806 - protein, 7 aa, Mycobacterium
GTESRGV

SEQ ID NO: 263807 - protein, 6 aa, Mycobacterium
GTETVD

SEQ ID NO: 263808 - protein, 7 aa, Mycobacterium
GTEVKPA

SEQ ID NO: 263809 - protein, 4 aa, Mycobacterium
GTEW

SEQ ID NO: 263810 - protein, 6 aa, Mycobacterium
GTEYQE

SEQ ID NO: 263811 - protein, 4 aa, Mycobacterium
GTFA

SEQ ID NO: 263812 - protein, 13 aa, Mycobacterium
GTFDDPDRRPRSF

SEQ ID NO: 263813 - protein, 4 aa, Mycobacterium
GTFR

SEQ ID NO: 263814 - protein, 12 aa, Mycobacterium
GTFTPDPRPATV

SEQ ID NO: 263815 - protein, 11 aa, Mycobacterium
GTFTPDPRPSA

SEQ ID NO: 263816 - protein, 16 aa, Mycobacterium
GTFTQSETKSLPEDKG

SEQ ID NO: 263817 - protein, 6 aa, Mycobacterium
GTGAAP

SEQ ID NO: 263818 - protein, 9 aa, Mycobacterium
GTGAGLPDF

SEQ ID NO: 263819 - protein, 6 aa, Mycobacterium
GTGAHT

SEQ ID NO: 263820 - protein, 5 aa, Mycobacterium
GTGAL

SEQ ID NO: 263821 - protein, 11 aa, Mycobacterium
GTGANPKPVRE

SEQ ID NO: 263822 - protein, 6 aa, Mycobacterium
GTGASS

SEQ ID NO: 263823 - protein, 13 aa, Mycobacterium
GTGAVSKDLSEGA

SEQ ID NO: 263824 - protein, 15 aa, Mycobacterium
GTGAYRATKVGREAY

SEQ ID NO: 263825 - protein, 20 aa, Mycobacterium
GTGDGFERTTGTLAPRAAVP

SEQ ID NO: 263826 - protein, 5 aa, Mycobacterium
GTGDH

SEQ ID NO: 263827 - protein, 14 aa, Mycobacterium
GTGDIGTTKAHENT

SEQ ID NO: 263828 - protein, 6 aa, Mycobacterium
GTGDPA

SEQ ID NO: 263829 - protein, 6 aa, Mycobacterium
GTGDPD

SEQ ID NO: 263830 - protein, 13 aa, Mycobacterium
GTGDRSTRPSTGL

SEQ ID NO: 263831 - protein, 10 aa, Mycobacterium
GTGEDKSPEL

SEQ ID NO: 263832 - protein, 11 aa, Mycobacterium
GTGESRVKEPA

SEQ ID NO: 263833 - protein, 4 aa, Mycobacterium
GTGG

SEQ ID NO: 263834 - protein, 5 aa, Mycobacterium
GTGGM

SEQ ID NO: 263835 - protein, 7 aa, Mycobacterium
GTGGNTA

SEQ ID NO: 263836 - protein, 6 aa, Mycobacterium
GTGGVV

SEQ ID NO: 263837 - protein, 9 aa, Mycobacterium
GTGKTTTVG

SEQ ID NO: 263838 - protein, 5 aa, Mycobacterium
GTGLA

SEQ ID NO: 263839 - protein, 4 aa, Mycobacterium
GTGN

SEQ ID NO: 263840 - protein, 7 aa, Mycobacterium
GTGNEDP

SEQ ID NO: 263841 - protein, 6 aa, Mycobacterium
GTGNTY

SEQ ID NO: 263842 - protein, 5 aa, Mycobacterium
GTGNV

SEQ ID NO: 263843 - protein, 4 aa, Mycobacterium
GTGP

SEQ ID NO: 263844 - protein, 5 aa, Mycobacterium
GTGPA

SEQ ID NO: 263845 - protein, 7 aa, Mycobacterium
GTGPASE

SEQ ID NO: 263846 - protein, 10 aa, Mycobacterium
GTGPDSDHPA

SEQ ID NO: 263847 - protein, 7 aa, Mycobacterium
GTGPENA

SEQ ID NO: 263848 - protein, 8 aa, Mycobacterium
GTGPHAEE

SEQ ID NO: 263849 - protein, 11 aa, Mycobacterium
GTGPKKGKDAA

SEQ ID NO: 263850 - protein, 15 aa, Mycobacterium
GTGPLDTHHSAGGGL

SEQ ID NO: 263851 - protein, 7 aa, Mycobacterium
GTGPQNA

SEQ ID NO: 263852 - protein, 7 aa, Mycobacterium
GTGPQQA

SEQ ID NO: 263853 - protein, 8 aa, Mycobacterium
GTGPQQSI

SEQ ID NO: 263854 - protein, 6 aa, Mycobacterium
GTGPTA

SEQ ID NO: 263855 - protein, 18 aa, Mycobacterium
GTGPTPADGLPITLERLS

SEQ ID NO: 263856 - protein, 7 aa, Mycobacterium
GTGQPIG

SEQ ID NO: 263857 - protein, 16 aa, Mycobacterium
GTGQPIGAPLTGHTAS

SEQ ID NO: 263858 - protein, 23 aa, Mycobacterium
GTGQWGAPEGQWQGAPPAQGQYG

SEQ ID NO: 263859 - protein, 4 aa, Mycobacterium
GTGR

SEQ ID NO: 263860 - protein, 7 aa, Mycobacterium
GTGRGAE

SEQ ID NO: 263861 - protein, 8 aa, Mycobacterium
GTGRGATG

SEQ ID NO: 263862 - protein, 10 aa, Mycobacterium
GTGRPGWDGG

SEQ ID NO: 263863 - protein, 7 aa, Mycobacterium
GTGRSIA

SEQ ID NO: 263864 - protein, 9 aa, Mycobacterium
GTGRTSGAW

SEQ ID NO: 263865 - protein, 5 aa, Mycobacterium
GTGSD

SEQ ID NO: 263866 - protein, 7 aa, Mycobacterium
GTGSLAT

SEQ ID NO: 263867 - protein, 9 aa, Mycobacterium
GTGSPASRA

SEQ ID NO: 263868 - protein, 8 aa, Mycobacterium
GTGSPIPS

SEQ ID NO: 263869 - protein, 8 aa, Mycobacterium
GTGSSGIQ

SEQ ID NO: 263870 - protein, 10 aa, Mycobacterium
GTGSSQLRSA

SEQ ID NO: 263871 - protein, 6 aa, Mycobacterium
GTGSTG

SEQ ID NO: 263872 - protein, 10 aa, Mycobacterium
GTGTDAAIEA

SEQ ID NO: 263873 - protein, 9 aa, Mycobacterium
GTGTKNPDA

SEQ ID NO: 263874 - protein, 6 aa, Mycobacterium
GTGTLT

SEQ ID NO: 263875 - protein, 5 aa, Mycobacterium
GTGTV

SEQ ID NO: 263876 - protein, 15 aa, Mycobacterium
GTGVDRSGARLSGDR

SEQ ID NO: 263877 - protein, 6 aa, Mycobacterium
GTGVGF

SEQ ID NO: 263878 - protein, 8 aa, Mycobacterium
GTGYAPDG

SEQ ID NO: 263879 - protein, 9 aa, Mycobacterium
GTGYAPDGV

SEQ ID NO: 263880 - protein, 6 aa, Mycobacterium
GTGYSS

SEQ ID NO: 263881 - protein, 6 aa, Mycobacterium
GTHAEK

SEQ ID NO: 263882 - protein, 4 aa, Mycobacterium
GTHD

SEQ ID NO: 263883 - protein, 8 aa, Mycobacterium
GTHDDETI

SEQ ID NO: 263884 - protein, 5 aa, Mycobacterium
GTHGG

SEQ ID NO: 263885 - protein, 11 aa, Mycobacterium
GTHQEAAPLQT

SEQ ID NO: 263886 - protein, 10 aa, Mycobacterium
GTHRSGRLPA

SEQ ID NO: 263887 - protein, 12 aa, Mycobacterium
GTHVPSGVGPGI

SEQ ID NO: 263888 - protein, 15 aa, Mycobacterium
GTIAAKNVKGELSGQ

SEQ ID NO: 263889 - protein, 5 aa, Mycobacterium
GTIAG

SEQ ID NO: 263890 - protein, 8 aa, Mycobacterium
GTIAGPAR

SEQ ID NO: 263891 - protein, 6 aa, Mycobacterium
GTIASS

SEQ ID NO: 263892 - protein, 4 aa, Mycobacterium
GTID

SEQ ID NO: 263893 - protein, 5 aa, Mycobacterium
GTIDP

SEQ ID NO: 263894 - protein, 12 aa, Mycobacterium
GTIDTDNGPSLR

SEQ ID NO: 263895 - protein, 7 aa, Mycobacterium
GTIEERA

SEQ ID NO: 263896 - protein, 17 aa, Mycobacterium
GTIPSPTVTPAATDEPL

SEQ ID NO: 263897 - protein, 6 aa, Mycobacterium
GTIQER

SEQ ID NO: 263898 - protein, 17 aa, Mycobacterium
GTITGESVANGLTTGQT

SEQ ID NO: 263899 - protein, 8 aa, Mycobacterium
GTITGTSV

SEQ ID NO: 263900 - protein, 5 aa, Mycobacterium
GTITL

SEQ ID NO: 263901 - protein, 11 aa, Mycobacterium
GTITLGNREAS

SEQ ID NO: 263902 - protein, 7 aa, Mycobacterium
GTITPAA

SEQ ID NO: 263903 - protein, 15 aa, Mycobacterium
GTKAAAEDRRRGTGP

SEQ ID NO: 263904 - protein, 10 aa, Mycobacterium
GTKGGEIEMD

SEQ ID NO: 263905 - protein, 7 aa, Mycobacterium
GTKGKTA

SEQ ID NO: 263906 - protein, 7 aa, Mycobacterium
GTKGRTA

SEQ ID NO: 263907 - protein, 20 aa, Mycobacterium
GTKPLVTSGGASVYGSGLPG

SEQ ID NO: 263908 - protein, 7 aa, Mycobacterium
GTKTAPL

SEQ ID NO: 263909 - protein, 8 aa, Mycobacterium
GTKTDTER

SEQ ID NO: 263910 - protein, 9 aa, Mycobacterium
GTKTGEIEM

SEQ ID NO: 263911 - protein, 18 aa, Mycobacterium
GTKVGPAAVPKGPLPQAA

SEQ ID NO: 263912 - protein, 27 aa, Mycobacterium
GTLDGQEVADAPIGAPGDHTLDAGTTL

SEQ ID NO: 263913 - protein, 28 aa, Mycobacterium
GTLDNRDVEGVPIGSAGRHTLGAGSSLT

SEQ ID NO: 263914 - protein, 12 aa, Mycobacterium
GTLGDPTAAESL

SEQ ID NO: 263915 - protein, 12 aa, Mycobacterium
GTLGTTTTGTAA

SEQ ID NO: 263916 - protein, 4 aa, Mycobacterium
GTLP

SEQ ID NO: 263917 - protein, 10 aa, Mycobacterium
GTLPDLDDEQ

SEQ ID NO: 263918 - protein, 4 aa, Mycobacterium
GTLQ

SEQ ID NO: 263919 - protein, 23 aa, Mycobacterium
GTLRSTASGESSAAHAAQPRIRP

SEQ ID NO: 263920 - protein, 10 aa, Mycobacterium
GTLSAATRPV

SEQ ID NO: 263921 - protein, 5 aa, Mycobacterium
GTLSP

SEQ ID NO: 263922 - protein, 8 aa, Mycobacterium
GTLSSGER

SEQ ID NO: 263923 - protein, 6 aa, Mycobacterium
GTLTEN

SEQ ID NO: 263924 - protein, 11 aa, Mycobacterium
GTLTRGEPTVT

SEQ ID NO: 263925 - protein, 14 aa, Mycobacterium
GTLTVTGAGKSTTL

SEQ ID NO: 263926 - protein, 15 aa, Mycobacterium
GTLTYDGADAARKKA

SEQ ID NO: 263927 - protein, 15 aa, Mycobacterium
GTLTYDGADPARKKA

SEQ ID NO: 263928 - protein, 8 aa, Mycobacterium
GTNDAQKT

SEQ ID NO: 263929 - protein, 7 aa, Mycobacterium
GTNGQDR

SEQ ID NO: 263930 - protein, 10 aa, Mycobacterium
GTNGTGLPVP

SEQ ID NO: 263931 - protein, 7 aa, Mycobacterium
GTNGTPF

SEQ ID NO: 263932 - protein, 5 aa, Mycobacterium
GTNIG

SEQ ID NO: 263933 - protein, 7 aa, Mycobacterium
GTNITDD

SEQ ID NO: 263934 - protein, 7 aa, Mycobacterium
GTNPALN

SEQ ID NO: 263935 - protein, 17 aa, Mycobacterium
GTNPDADEPSGSKDETL

SEQ ID NO: 263936 - protein, 9 aa, Mycobacterium
GTNPPKGQM

SEQ ID NO: 263937 - protein, 7 aa, Mycobacterium
GTNSDMI

SEQ ID NO: 263938 - protein, 14 aa, Mycobacterium
GTNSEALKNAIIDS

SEQ ID NO: 263939 - protein, 15 aa, Mycobacterium
GTNSVTVESAGQTYD

SEQ ID NO: 263940 - protein, 4 aa, Mycobacterium
GTNT

SEQ ID NO: 263941 - protein, 12 aa, Mycobacterium
GTNTDPYQRAEG

SEQ ID NO: 263942 - protein, 5 aa, Mycobacterium
GTNTK

SEQ ID NO: 263943 - protein, 10 aa, Mycobacterium
GTPAESGTAQ

SEQ ID NO: 263944 - protein, 5 aa, Mycobacterium
GTPAG

SEQ ID NO: 263945 - protein, 6 aa, Mycobacterium
GTPAGT

SEQ ID NO: 263946 - protein, 10 aa, Mycobacterium
GTPAKSGDSL

SEQ ID NO: 263947 - protein, 15 aa, Mycobacterium
GTPAQGAVPARPPMA

SEQ ID NO: 263948 - protein, 9 aa, Mycobacterium
GTPASPATE

SEQ ID NO: 263949 - protein, 19 aa, Mycobacterium
GTPAVAATAPVQAAGPVGK

SEQ ID NO: 263950 - protein, 4 aa, Mycobacterium
GTPD

SEQ ID NO: 263951 - protein, 10 aa, Mycobacterium
GTPDDADAVE

SEQ ID NO: 263952 - protein, 7 aa, Mycobacterium
GTPDLSS

SEQ ID NO: 263953 - protein, 7 aa, Mycobacterium
GTPDLTG

SEQ ID NO: 263954 - protein, 9 aa, Mycobacterium
GTPDTYNHY

SEQ ID NO: 263955 - protein, 11 aa, Mycobacterium
GTPDYGAPARL

SEQ ID NO: 263956 - protein, 12 aa, Mycobacterium
GTPDYGSPARLD

SEQ ID NO: 263957 - protein, 6 aa, Mycobacterium
GTPEAA

SEQ ID NO: 263958 - protein, 5 aa, Mycobacterium
GTPEL

SEQ ID NO: 263959 - protein, 6 aa, Mycobacterium
GTPELS

SEQ ID NO: 263960 - protein, 7 aa, Mycobacterium
GTPESPR

SEQ ID NO: 263961 - protein, 6 aa, Mycobacterium
GTPEVP

SEQ ID NO: 263962 - protein, 29 aa, Mycobacterium
GTPGIPRTALPGAAPPAAATPVVVPANHS

SEQ ID NO: 263963 - protein, 19 aa, Mycobacterium
GTPGISRTPLPSAPAAGAP

SEQ ID NO: 263964 - protein, 5 aa, Mycobacterium
GTPGM

SEQ ID NO: 263965 - protein, 6 aa, Mycobacterium
GTPGRR

SEQ ID NO: 263966 - protein, 39 aa, Mycobacterium
GTPGVDRAGGVRPGDTPPDSAQTKATANRDPAAGRNLTP

SEQ ID NO: 263967 - protein, 15 aa, Mycobacterium
GTPGVPQTGFPGTVH

SEQ ID NO: 263968 - protein, 4 aa, Mycobacterium
GTPH

SEQ ID NO: 263969 - protein, 4 aa, Mycobacterium
GTPK

SEQ ID NO: 263970 - protein, 13 aa, Mycobacterium
GTPKLPPSSADFP

SEQ ID NO: 263971 - protein, 6 aa, Mycobacterium
GTPLES

SEQ ID NO: 263972 - protein, 7 aa, Mycobacterium
GTPLPES

SEQ ID NO: 263973 - protein, 42 aa, Mycobacterium
GTPLPPGAVPRGDAAGPRGENPPPGTAGAAVPPMPSSGPTLA

SEQ ID NO: 263974 - protein, 29 aa, Mycobacterium
GTPLPPGSPGPRGTPPTPPGAPAPPPAVP

SEQ ID NO: 263975 - protein, 15 aa, Mycobacterium
GTPLPPGVGPPEETV

SEQ ID NO: 263976 - protein, 11 aa, Mycobacterium
GTPLPRHPSPT

SEQ ID NO: 263977 - protein, 7 aa, Mycobacterium
GTPLRSR

SEQ ID NO: 263978 - protein, 12 aa, Mycobacterium
GTPLRSRAADAA

SEQ ID NO: 263979 - protein, 13 aa, Mycobacterium
GTPLRSRAADTAL

SEQ ID NO: 263980 - protein, 4 aa, Mycobacterium
GTPM

SEQ ID NO: 263981 - protein, 14 aa, Mycobacterium
GTPPAQAVSPPGID

SEQ ID NO: 263982 - protein, 5 aa, Mycobacterium
GTPPN

SEQ ID NO: 263983 - protein, 6 aa, Mycobacterium
GTPPSA

SEQ ID NO: 263984 - protein, 5 aa, Mycobacterium
GTPPT

SEQ ID NO: 263985 - protein, 9 aa, Mycobacterium
GTPPVSGHE

SEQ ID NO: 263986 - protein, 8 aa, Mycobacterium
GTPPYQTQ

SEQ ID NO: 263987 - protein, 11 aa, Mycobacterium
GTPQKKGEYAA

SEQ ID NO: 263988 - protein, 11 aa, Mycobacterium
GTPQKRGEYGA

SEQ ID NO: 263989 - protein, 6 aa, Mycobacterium
GTPQSI

SEQ ID NO: 263990 - protein, 17 aa, Mycobacterium
GTPRARTTAQVAASTAG

SEQ ID NO: 263991 - protein, 8 aa, Mycobacterium
GTPRFPDQ

SEQ ID NO: 263992 - protein, 5 aa, Mycobacterium
GTPRG

SEQ ID NO: 263993 - protein, 13 aa, Mycobacterium
GTPRLPDDRTVDA

SEQ ID NO: 263994 - protein, 9 aa, Mycobacterium
GTPRLPDER

SEQ ID NO: 263995 - protein, 9 aa, Mycobacterium
GTPRRPDEH

SEQ ID NO: 263996 - protein, 13 aa, Mycobacterium
GTPSGSPPGPTGY

SEQ ID NO: 263997 - protein, 11 aa, Mycobacterium
GTPSHPPSAAD

SEQ ID NO: 263998 - protein, 13 aa, Mycobacterium
GTPSHPPSAADYP

SEQ ID NO: 263999 - protein, 7 aa, Mycobacterium
GTPSQLS

SEQ ID NO: 264000 - protein, 14 aa, Mycobacterium
GTPSYLPSAADYPE

SEQ ID NO: 264001 - protein, 5 aa, Mycobacterium
GTPTE

SEQ ID NO: 264002 - protein, 5 aa, Mycobacterium
GTPTH

SEQ ID NO: 264003 - protein, 5 aa, Mycobacterium
GTPTR

SEQ ID NO: 264004 - protein, 7 aa, Mycobacterium
GTPTSAD

SEQ ID NO: 264005 - protein, 9 aa, Mycobacterium
GTPTSSRVT

SEQ ID NO: 264006 - protein, 5 aa, Mycobacterium
GTPVL

SEQ ID NO: 264007 - protein, 7 aa, Mycobacterium
GTPYGTV

SEQ ID NO: 264008 - protein, 15 aa, Mycobacterium
GTQAQQQELAKNATE

SEQ ID NO: 264009 - protein, 9 aa, Mycobacterium
GTQDDVDGC

SEQ ID NO: 264010 - protein, 13 aa, Mycobacterium
GTQEDANSEGTRV

SEQ ID NO: 264011 - protein, 10 aa, Mycobacterium
GTQGEALANE

SEQ ID NO: 264012 - protein, 7 aa, Mycobacterium
GTQRDPC

SEQ ID NO: 264013 - protein, 8 aa, Mycobacterium
GTQSIGPG

SEQ ID NO: 264014 - protein, 4 aa, Mycobacterium
GTRD

SEQ ID NO: 264015 - protein, 5 aa, Mycobacterium
GTRLQ

SEQ ID NO: 264016 - protein, 8 aa, Mycobacterium
GTRPGGDI

SEQ ID NO: 264017 - protein, 7 aa, Mycobacterium
GTRPGRR

SEQ ID NO: 264018 - protein, 13 aa, Mycobacterium
GTRPPAAPKAVEH

SEQ ID NO: 264019 - protein, 6 aa, Mycobacterium
GTRPSV

SEQ ID NO: 264020 - protein, 7 aa, Mycobacterium
GTRPTKG

SEQ ID NO: 264021 - protein, 5 aa, Mycobacterium
GTRRA

SEQ ID NO: 264022 - protein, 9 aa, Mycobacterium
GTRRTPAGR

SEQ ID NO: 264023 - protein, 13 aa, Mycobacterium
GTRSAAKHQDLEQ

SEQ ID NO: 264024 - protein, 5 aa, Mycobacterium
GTRSD

SEQ ID NO: 264025 - protein, 14 aa, Mycobacterium
GTRTATVEAGEDVD

SEQ ID NO: 264026 - protein, 6 aa, Mycobacterium
GTRTPG

SEQ ID NO: 264027 - protein, 9 aa, Mycobacterium
GTRTRPGPI

SEQ ID NO: 264028 - protein, 6 aa, Mycobacterium
GTSAAG

SEQ ID NO: 264029 - protein, 7 aa, Mycobacterium
GTSAAPL

SEQ ID NO: 264030 - protein, 20 aa, Mycobacterium
GTSAKPVSPFSSTGASEHNR

SEQ ID NO: 264031 - protein, 34 aa, Mycobacterium
GTSAPAGAPAPVKAPPPEAEAPPVRGENLPAEAY

SEQ ID NO: 264032 - protein, 34 aa, Mycobacterium
GTSAPSGAPSGPVKTSAPEPDDVPARSDGPPVEA

SEQ ID NO: 264033 - protein, 16 aa, Mycobacterium
GTSAPVTVTPSETALS

SEQ ID NO: 264034 - protein, 5 aa, Mycobacterium
GTSAT

SEQ ID NO: 264035 - protein, 12 aa, Mycobacterium
GTSDLQSTLTTQ

SEQ ID NO: 264036 - protein, 8 aa, Mycobacterium
GTSEAELN

SEQ ID NO: 264037 - protein, 20 aa, Mycobacterium
GTSEDASPSLPALPRPRSDD

SEQ ID NO: 264038 - protein, 7 aa, Mycobacterium
GTSFPSG

SEQ ID NO: 264039 - protein, 10 aa, Mycobacterium
GTSGANLTEM

SEQ ID NO: 264040 - protein, 16 aa, Mycobacterium
GTSGDEPLPPGTEERV

SEQ ID NO: 264041 - protein, 8 aa, Mycobacterium
GTSGDMRL

SEQ ID NO: 264042 - protein, 9 aa, Mycobacterium
GTSGDPKAV

SEQ ID NO: 264043 - protein, 5 aa, Mycobacterium
GTSGP

SEQ ID NO: 264044 - protein, 6 aa, Mycobacterium
GTSGPL

SEQ ID NO: 264045 - protein, 8 aa, Mycobacterium
GTSGRSVR

SEQ ID NO: 264046 - protein, 8 aa, Mycobacterium
GTSGSARV

SEQ ID NO: 264047 - protein, 7 aa, Mycobacterium
GTSGSVR

SEQ ID NO: 264048 - protein, 8 aa, Mycobacterium
GTSGTARV

SEQ ID NO: 264049 - protein, 13 aa, Mycobacterium
GTSHTESLQSPAG

SEQ ID NO: 264050 - protein, 7 aa, Mycobacterium
GTSLART

SEQ ID NO: 264051 - protein, 6 aa, Mycobacterium
GTSNHM

SEQ ID NO: 264052 - protein, 19 aa, Mycobacterium
GTSNNKPVNTTVPAPLPEP

SEQ ID NO: 264053 - protein, 9 aa, Mycobacterium
GTSPELKEK

SEQ ID NO: 264054 - protein, 14 aa, Mycobacterium
GTSQKLTEKYNQDL

SEQ ID NO: 264055 - protein, 29 aa, Mycobacterium
GTSQTWARDESSRACSREDVPDRNRNSTL

SEQ ID NO: 264056 - protein, 8 aa, Mycobacterium
GTSRPDET

SEQ ID NO: 264057 - protein, 7 aa, Mycobacterium
GTSRSSA

SEQ ID NO: 264058 - protein, 7 aa, Mycobacterium
GTSSPIG

SEQ ID NO: 264059 - protein, 9 aa, Mycobacterium
GTSSPIGAP

SEQ ID NO: 264060 - protein, 11 aa, Mycobacterium
GTSSTPTQLPE

SEQ ID NO: 264061 - protein, 5 aa, Mycobacterium
GTSTQ

SEQ ID NO: 264062 - protein, 6 aa, Mycobacterium
GTSTRS

SEQ ID NO: 264063 - protein, 6 aa, Mycobacterium
GTSTVT

SEQ ID NO: 264064 - protein, 8 aa, Mycobacterium
GTSVETAR

SEQ ID NO: 264065 - protein, 4 aa, Mycobacterium
GTSY

SEQ ID NO: 264066 - protein, 6 aa, Mycobacterium
GTSYAA

SEQ ID NO: 264067 - protein, 8 aa, Mycobacterium
GTTADKGG

SEQ ID NO: 264068 - protein, 10 aa, Mycobacterium
GTTAGVGNPV

SEQ ID NO: 264069 - protein, 7 aa, Mycobacterium
GTTARSA

SEQ ID NO: 264070 - protein, 8 aa, Mycobacterium
GTTARSAR

SEQ ID NO: 264071 - protein, 11 aa, Mycobacterium
GTTASRSGSGL

SEQ ID NO: 264072 - protein, 19 aa, Mycobacterium
GTTDGKSQAGFFEITVQAA

SEQ ID NO: 264073 - protein, 19 aa, Mycobacterium
GTTDGKSRADISEITVQAA

SEQ ID NO: 264074 - protein, 19 aa, Mycobacterium
GTTDGKSRSAISGLTIRAA

SEQ ID NO: 264075 - protein, 7 aa, Mycobacterium
GTTESLE

SEQ ID NO: 264076 - protein, 10 aa, Mycobacterium
GTTGAGKTTL

SEQ ID NO: 264077 - protein, 11 aa, Mycobacterium
GTTGDYAGDGV

SEQ ID NO: 264078 - protein, 15 aa, Mycobacterium
GTTGESPTTTDDEKR

SEQ ID NO: 264079 - protein, 11 aa, Mycobacterium
GTTGIYGQSTG

SEQ ID NO: 264080 - protein, 5 aa, Mycobacterium
GTTGL

SEQ ID NO: 264081 - protein, 6 aa, Mycobacterium
GTTGLG

SEQ ID NO: 264082 - protein, 8 aa, Mycobacterium
GTTGLPKG

SEQ ID NO: 264083 - protein, 7 aa, Mycobacterium
GTTGMPK

SEQ ID NO: 264084 - protein, 5 aa, Mycobacterium
GTTGP

SEQ ID NO: 264085 - protein, 9 aa, Mycobacterium
GTTGPPKRV

SEQ ID NO: 264086 - protein, 8 aa, Mycobacterium
GTTGPVKA

SEQ ID NO: 264087 - protein, 8 aa, Mycobacterium
GTTGPVKD

SEQ ID NO: 264088 - protein, 9 aa, Mycobacterium
GTTGPVKNM

SEQ ID NO: 264089 - protein, 7 aa, Mycobacterium
GTTGRAV

SEQ ID NO: 264090 - protein, 8 aa, Mycobacterium
GTTGRTKL

SEQ ID NO: 264091 - protein, 19 aa, Mycobacterium
GTTGTPKGANRAAPPSLAP

SEQ ID NO: 264092 - protein, 19 aa, Mycobacterium
GTTGTPKGANRSAPPSLAP

SEQ ID NO: 264093 - protein, 9 aa, Mycobacterium
GTTGTPKGV

SEQ ID NO: 264094 - protein, 15 aa, Mycobacterium
GTTGTPKGVPRTSHI

SEQ ID NO: 264095 - protein, 19 aa, Mycobacterium
GTTGVPKGVPRTPKVSSGV

SEQ ID NO: 264096 - protein, 11 aa, Mycobacterium
GTTGVYGQSTG

SEQ ID NO: 264097 - protein, 4 aa, Mycobacterium
GTTH

SEQ ID NO: 264098 - protein, 5 aa, Mycobacterium
GTTIS

SEQ ID NO: 264099 - protein, 18 aa, Mycobacterium
GTTKGESRTAISDITLRA

SEQ ID NO: 264100 - protein, 10 aa, Mycobacterium
GTTKQHGRRE

SEQ ID NO: 264101 - protein, 19 aa, Mycobacterium
GTTNGESRTSISEITLRAA

SEQ ID NO: 264102 - protein, 19 aa, Mycobacterium
GTTNGKSQAGFFEITVQAA

SEQ ID NO: 264103 - protein, 13 aa, Mycobacterium
GTTPKIGAGETKS

SEQ ID NO: 264104 - protein, 9 aa, Mycobacterium
GTTPNGTLN

SEQ ID NO: 264105 - protein, 10 aa, Mycobacterium
GTTPQVGQGA

SEQ ID NO: 264106 - protein, 11 aa, Mycobacterium
GTTPQVGQGTG

SEQ ID NO: 264107 - protein, 7 aa, Mycobacterium
GTTQTMN

SEQ ID NO: 264108 - protein, 7 aa, Mycobacterium
GTTRDGY

SEQ ID NO: 264109 - protein, 10 aa, Mycobacterium
GTTRDGYADY

SEQ ID NO: 264110 - protein, 18 aa, Mycobacterium
GTTRDGYADYDERSWDET

SEQ ID NO: 264111 - protein, 4 aa, Mycobacterium
GTTS

SEQ ID NO: 264112 - protein, 13 aa, Mycobacterium
GTTSALAATGQPG

SEQ ID NO: 264113 - protein, 13 aa, Mycobacterium
GTTSGAAAVPAGG

SEQ ID NO: 264114 - protein, 5 aa, Mycobacterium
GTTTA

SEQ ID NO: 264115 - protein, 6 aa, Mycobacterium
GTTYAA

SEQ ID NO: 264116 - protein, 7 aa, Mycobacterium
GTTYREY

SEQ ID NO: 264117 - protein, 15 aa, Mycobacterium
GTVATANAGPGSNGS

SEQ ID NO: 264118 - protein, 10 aa, Mycobacterium
GTVDAGYQTR

SEQ ID NO: 264119 - protein, 5 aa, Mycobacterium
GTVDP

SEQ ID NO: 264120 - protein, 4 aa, Mycobacterium
GTVG

SEQ ID NO: 264121 - protein, 6 aa, Mycobacterium
GTVGEL

SEQ ID NO: 264122 - protein, 5 aa, Mycobacterium
GTVNG

SEQ ID NO: 264123 - protein, 8 aa, Mycobacterium
GTVPQPAT

SEQ ID NO: 264124 - protein, 6 aa, Mycobacterium
GTVPTA

SEQ ID NO: 264125 - protein, 14 aa, Mycobacterium
GTVPTGQSYRGPSS

SEQ ID NO: 264126 - protein, 9 aa, Mycobacterium
GTVQASTTI

SEQ ID NO: 264127 - protein, 7 aa, Mycobacterium
GTVQGPK

SEQ ID NO: 264128 - protein, 4 aa, Mycobacterium
GTVR

SEQ ID NO: 264129 - protein, 13 aa, Mycobacterium
GTVSTTPAYVGQD

SEQ ID NO: 264130 - protein, 23 aa, Mycobacterium
GTVTSSAALRTSLDGSTDQYQPA

SEQ ID NO: 264131 - protein, 12 aa, Mycobacterium
GTVTSTNGDRIE

SEQ ID NO: 264132 - protein, 13 aa, Mycobacterium
GTVTSTNGDRIEP

SEQ ID NO: 264133 - protein, 5 aa, Mycobacterium
GTVTT

SEQ ID NO: 264134 - protein, 6 aa, Mycobacterium
GTVTVG

SEQ ID NO: 264135 - protein, 13 aa, Mycobacterium
GTVVSDGPAPLDQ

SEQ ID NO: 264136 - protein, 9 aa, Mycobacterium
GTWDPTEPT

SEQ ID NO: 264137 - protein, 7 aa, Mycobacterium
GTWESSR

SEQ ID NO: 264138 - protein, 5 aa, Mycobacterium
GTYPA

SEQ ID NO: 264139 - protein, 4 aa, Mycobacterium
GTYR

SEQ ID NO: 264140 - protein, 13 aa, Mycobacterium
GTYSTGAQQESRL

SEQ ID NO: 264141 - protein, 6 aa, Mycobacterium
GTYTTG

SEQ ID NO: 264142 - protein, 13 aa, Mycobacterium
GTYTTGAQRQSKL

SEQ ID NO: 264143 - protein, 10 aa, Mycobacterium
GVAADPATLG

SEQ ID NO: 264144 - protein, 5 aa, Mycobacterium
GVAAG

SEQ ID NO: 264145 - protein, 10 aa, Mycobacterium
GVAAPRSARV

SEQ ID NO: 264146 - protein, 5 aa, Mycobacterium
GVADG

SEQ ID NO: 264147 - protein, 16 aa, Mycobacterium
GVADGNGDKIKSGLDE

SEQ ID NO: 264148 - protein, 8 aa, Mycobacterium
GVADRGPS

SEQ ID NO: 264149 - protein, 28 aa, Mycobacterium
GVAGAIDPPVVPPGPPPPDPAPGPDQPM

SEQ ID NO: 264150 - protein, 9 aa, Mycobacterium
GVAGNPTEY

SEQ ID NO: 264151 - protein, 6 aa, Mycobacterium
GVAGRG

SEQ ID NO: 264152 - protein, 9 aa, Mycobacterium
GVAKGDTAR

SEQ ID NO: 264153 - protein, 8 aa, Mycobacterium
GVAKGDTH

SEQ ID NO: 264154 - protein, 7 aa, Mycobacterium
GVANGTS

SEQ ID NO: 264155 - protein, 7 aa, Mycobacterium
GVANSST

SEQ ID NO: 264156 - protein, 10 aa, Mycobacterium
GVAPDSASPG

SEQ ID NO: 264157 - protein, 12 aa, Mycobacterium
GVAPDSRVRPDD

SEQ ID NO: 264158 - protein, 8 aa, Mycobacterium
GVAPNGAT

SEQ ID NO: 264159 - protein, 7 aa, Mycobacterium
GVAPSQA

SEQ ID NO: 264160 - protein, 5 aa, Mycobacterium
GVAQQ

SEQ ID NO: 264161 - protein, 5 aa, Mycobacterium
GVARG

SEQ ID NO: 264162 - protein, 4 aa, Mycobacterium
GVAS

SEQ ID NO: 264163 - protein, 5 aa, Mycobacterium
GVASA

SEQ ID NO: 264164 - protein, 4 aa, Mycobacterium
GVAT

SEQ ID NO: 264165 - protein, 6 aa, Mycobacterium
GVATRK

SEQ ID NO: 264166 - protein, 11 aa, Mycobacterium
GVATRTHADPH

SEQ ID NO: 264167 - protein, 7 aa, Mycobacterium
GVDAGGA

SEQ ID NO: 264168 - protein, 6 aa, Mycobacterium
GVDANG

SEQ ID NO: 264169 - protein, 22 aa, Mycobacterium
GVDASVPKQVAAPPDTPPADPL

SEQ ID NO: 264170 - protein, 9 aa, Mycobacterium
GVDDPAGGV

SEQ ID NO: 264171 - protein, 5 aa, Mycobacterium
GVDEL

SEQ ID NO: 264172 - protein, 15 aa, Mycobacterium
GVDERSRRGEPQRSV

SEQ ID NO: 264173 - protein, 5 aa, Mycobacterium
GVDGP

SEQ ID NO: 264174 - protein, 14 aa, Mycobacterium
GVDGSRLPRGNHTT

SEQ ID NO: 264175 - protein, 12 aa, Mycobacterium
GVDGSRPFCTGG

SEQ ID NO: 264176 - protein, 12 aa, Mycobacterium
GVDPSQGTQPRA

SEQ ID NO: 264177 - protein, 12 aa, Mycobacterium
GVDPSVGSVGDA

SEQ ID NO: 264178 - protein, 12 aa, Mycobacterium
GVDPTDADPAGW

SEQ ID NO: 264179 - protein, 15 aa, Mycobacterium
GVDPTDRPQGSDTEG

SEQ ID NO: 264180 - protein, 12 aa, Mycobacterium
GVDQPIYRLSER

SEQ ID NO: 264181 - protein, 4 aa, Mycobacterium
GVDR

SEQ ID NO: 264182 - protein, 24 aa, Mycobacterium
GVDSPRRDVEDDRNGQPAGIGVAG

SEQ ID NO: 264183 - protein, 4 aa, Mycobacterium
GVED

SEQ ID NO: 264184 - protein, 5 aa, Mycobacterium
GVEDE

SEQ ID NO: 264185 - protein, 8 aa, Mycobacterium
GVEDNPGY

SEQ ID NO: 264186 - protein, 24 aa, Mycobacterium
GVEDPTLDDAQSSDAHPGEYARDD

SEQ ID NO: 264187 - protein, 10 aa, Mycobacterium
GVEDRETLNS

SEQ ID NO: 264188 - protein, 13 aa, Mycobacterium
GVEGDKPGQTADG

SEQ ID NO: 264189 - protein, 16 aa, Mycobacterium
GVELPAGTEGQIQVSG

SEQ ID NO: 264190 - protein, 8 aa, Mycobacterium
GVENKGTL

SEQ ID NO: 264191 - protein, 9 aa, Mycobacterium
GVENTDDRK

SEQ ID NO: 264192 - protein, 10 aa, Mycobacterium
GVEPTATGVE

SEQ ID NO: 264193 - protein, 8 aa, Mycobacterium
GVERGSAA

SEQ ID NO: 264194 - protein, 7 aa, Mycobacterium
GVERPSA

SEQ ID NO: 264195 - protein, 9 aa, Mycobacterium
GVESYYDDG

SEQ ID NO: 264196 - protein, 5 aa, Mycobacterium
GVETR

SEQ ID NO: 264197 - protein, 9 aa, Mycobacterium
GVFSPGRAQ

SEQ ID NO: 264198 - protein, 14 aa, Mycobacterium
GVFSPSRAKIPQRT

SEQ ID NO: 264199 - protein, 14 aa, Mycobacterium
GVFSPTRAQIPERT

SEQ ID NO: 264200 - protein, 4 aa, Mycobacterium
GVGA

SEQ ID NO: 264201 - protein, 15 aa, Mycobacterium
GVGAGDDAVRASGRD

SEQ ID NO: 264202 - protein, 11 aa, Mycobacterium
GVGDPDDTRIS

SEQ ID NO: 264203 - protein, 7 aa, Mycobacterium
GVGDRVT

SEQ ID NO: 264204 - protein, 16 aa, Mycobacterium
GVGEAGSAAATAGQTL

SEQ ID NO: 264205 - protein, 15 aa, Mycobacterium
GVGEAGSASASVQQM

SEQ ID NO: 264206 - protein, 10 aa, Mycobacterium
GVGEDAGRLD

SEQ ID NO: 264207 - protein, 5 aa, Mycobacterium
GVGEY

SEQ ID NO: 264208 - protein, 7 aa, Mycobacterium
GVGGFKN

SEQ ID NO: 264209 - protein, 10 aa, Mycobacterium
GVGGPAGAAA

SEQ ID NO: 264210 - protein, 4 aa, Mycobacterium
GVGH

SEQ ID NO: 264211 - protein, 5 aa, Mycobacterium
GVGHG

SEQ ID NO: 264212 - protein, 7 aa, Mycobacterium
GVGIPEG

SEQ ID NO: 264213 - protein, 14 aa, Mycobacterium
GVGITGGTAARRLG

SEQ ID NO: 264214 - protein, 7 aa, Mycobacterium
GVGKGSR

SEQ ID NO: 264215 - protein, 13 aa, Mycobacterium
GVGLSSAPKPVSA

SEQ ID NO: 264216 - protein, 22 aa, Mycobacterium
GVGPGSAARPPQGGSLERQEAS

SEQ ID NO: 264217 - protein, 7 aa, Mycobacterium
GVGPIRA

SEQ ID NO: 264218 - protein, 6 aa, Mycobacterium
GVGPVT

SEQ ID NO: 264219 - protein, 5 aa, Mycobacterium
GVGQA

SEQ ID NO: 264220 - protein, 4 aa, Mycobacterium
GVGR

SEQ ID NO: 264221 - protein, 6 aa, Mycobacterium
GVGRGD

SEQ ID NO: 264222 - protein, 12 aa, Mycobacterium
GVGRSSLNRRWS

SEQ ID NO: 264223 - protein, 4 aa, Mycobacterium
GVGS

SEQ ID NO: 264224 - protein, 7 aa, Mycobacterium
GVGTPGI

SEQ ID NO: 264225 - protein, 8 aa, Mycobacterium
GVHPNDAG

SEQ ID NO: 264226 - protein, 6 aa, Mycobacterium
GVHPTA

SEQ ID NO: 264227 - protein, 18 aa, Mycobacterium
GVIPGSDPAAVTPSQATL

SEQ ID NO: 264228 - protein, 8 aa, Mycobacterium
GVITSDSR

SEQ ID NO: 264229 - protein, 13 aa, Mycobacterium
GVKGDKPGQTADG

SEQ ID NO: 264230 - protein, 14 aa, Mycobacterium
GVKGDQAGQTANGR

SEQ ID NO: 264231 - protein, 6 aa, Mycobacterium
GVKPAT

SEQ ID NO: 264232 - protein, 6 aa, Mycobacterium
GVKPSA

SEQ ID NO: 264233 - protein, 7 aa, Mycobacterium
GVKTPGV

SEQ ID NO: 264234 - protein, 13 aa, Mycobacterium
GVLPAEKKPQVGG

SEQ ID NO: 264235 - protein, 6 aa, Mycobacterium
GVLPGQ

SEQ ID NO: 264236 - protein, 7 aa, Mycobacterium
GVLPGSD

SEQ ID NO: 264237 - protein, 13 aa, Mycobacterium
GVLSGSDRAEVTS

SEQ ID NO: 264238 - protein, 9 aa, Mycobacterium
GVLSPDGSK

SEQ ID NO: 264239 - protein, 22 aa, Mycobacterium
GVNADPGKTPAVDSVPKPVTGG

SEQ ID NO: 264240 - protein, 9 aa, Mycobacterium
GVNAPTKPY

SEQ ID NO: 264241 - protein, 4 aa, Mycobacterium
GVND

SEQ ID NO: 264242 - protein, 5 aa, Mycobacterium
GVNDA

SEQ ID NO: 264243 - protein, 8 aa, Mycobacterium
GVNDAAAL

SEQ ID NO: 264244 - protein, 10 aa, Mycobacterium
GVNDAAALAT

SEQ ID NO: 264245 - protein, 10 aa, Mycobacterium
GVNDAPALAQ

SEQ ID NO: 264246 - protein, 10 aa, Mycobacterium
GVNDAPAMAA

SEQ ID NO: 264247 - protein, 10 aa, Mycobacterium
GVNDSAALAT

SEQ ID NO: 264248 - protein, 5 aa, Mycobacterium
GVNES

SEQ ID NO: 264249 - protein, 8 aa, Mycobacterium
GVNGSRAR

SEQ ID NO: 264250 - protein, 17 aa, Mycobacterium
GVNPDKDAPSGSTDETL

SEQ ID NO: 264251 - protein, 7 aa, Mycobacterium
GVNPRDG

SEQ ID NO: 264252 - protein, 4 aa, Mycobacterium
GVPA

SEQ ID NO: 264253 - protein, 10 aa, Mycobacterium
GVPAAEGSTL

SEQ ID NO: 264254 - protein, 8 aa, Mycobacterium
GVPADDEL

SEQ ID NO: 264255 - protein, 12 aa, Mycobacterium
GVPAENPNLDEP

SEQ ID NO: 264256 - protein, 6 aa, Mycobacterium
GVPAHD

SEQ ID NO: 264257 - protein, 19 aa, Mycobacterium
GVPAPDSARVSSLERSGAF

SEQ ID NO: 264258 - protein, 19 aa, Mycobacterium
GVPAPPPPPPEAPPPSETV

SEQ ID NO: 264259 - protein, 14 aa, Mycobacterium
GVPAPPPPPPPPSV

SEQ ID NO: 264260 - protein, 19 aa, Mycobacterium
GVPAPPPPPPSAAPPSETV

SEQ ID NO: 264261 - protein, 16 aa, Mycobacterium
GVPASTAAQVSSLPPV

SEQ ID NO: 264262 - protein, 10 aa, Mycobacterium
GVPDGHGHNY

SEQ ID NO: 264263 - protein, 7 aa, Mycobacterium
GVPDHGP

SEQ ID NO: 264264 - protein, 6 aa, Mycobacterium
GVPEAA

SEQ ID NO: 264265 - protein, 13 aa, Mycobacterium
GVPEENPPLAEPG

SEQ ID NO: 264266 - protein, 5 aa, Mycobacterium
GVPEF

SEQ ID NO: 264267 - protein, 8 aa, Mycobacterium
GVPENVTA

SEQ ID NO: 264268 - protein, 11 aa, Mycobacterium
GVPEPESEPEA

SEQ ID NO: 264269 - protein, 4 aa, Mycobacterium
GVPG

SEQ ID NO: 264270 - protein, 14 aa, Mycobacterium
GVPGAAASGFGTRV

SEQ ID NO: 264271 - protein, 25 aa, Mycobacterium
GVPGAVPGETPHVAPGAQPQAPGPV

SEQ ID NO: 264272 - protein, 6 aa, Mycobacterium
GVPGGA

SEQ ID NO: 264273 - protein, 6 aa, Mycobacterium
GVPGGQ

SEQ ID NO: 264274 - protein, 14 aa, Mycobacterium
GVPGPGPETRTGNE

SEQ ID NO: 264275 - protein, 6 aa, Mycobacterium
GVPGQD

SEQ ID NO: 264276 - protein, 13 aa, Mycobacterium
GVPGRGPETRTAN

SEQ ID NO: 264277 - protein, 8 aa, Mycobacterium
GVPGSNSS

SEQ ID NO: 264278 - protein, 6 aa, Mycobacterium
GVPGVA

SEQ ID NO: 264279 - protein, 6 aa, Mycobacterium
GVPGVG

SEQ ID NO: 264280 - protein, 6 aa, Mycobacterium
GVPIPS

SEQ ID NO: 264281 - protein, 9 aa, Mycobacterium
GVPKGRKPV

SEQ ID NO: 264282 - protein, 7 aa, Mycobacterium
GVPMPSQ

SEQ ID NO: 264283 - protein, 4 aa, Mycobacterium
GVPP

SEQ ID NO: 264284 - protein, 6 aa, Mycobacterium
GVPPAA

SEQ ID NO: 264285 - protein, 8 aa, Mycobacterium
GVPPDDRV

SEQ ID NO: 264286 - protein, 9 aa, Mycobacterium
GVPPPPGDM

SEQ ID NO: 264287 - protein, 8 aa, Mycobacterium
GVPPPTVQ

SEQ ID NO: 264288 - protein, 5 aa, Mycobacterium
GVPPR

SEQ ID NO: 264289 - protein, 21 aa, Mycobacterium
GVPQAPPPPPSSTAPPTPSET

SEQ ID NO: 264290 - protein, 11 aa, Mycobacterium
GVPRDDEPPLD

SEQ ID NO: 264291 - protein, 8 aa, Mycobacterium
GVPRGRTG

SEQ ID NO: 264292 - protein, 7 aa, Mycobacterium
GVPRPSL

SEQ ID NO: 264293 - protein, 4 aa, Mycobacterium
GVPS

SEQ ID NO: 264294 - protein, 10 aa, Mycobacterium
GVPSPGAPPL

SEQ ID NO: 264295 - protein, 8 aa, Mycobacterium
GVPTPAVN

SEQ ID NO: 264296 - protein, 5 aa, Mycobacterium
GVPTQ

SEQ ID NO: 264297 - protein, 5 aa, Mycobacterium
GVPVD

SEQ ID NO: 264298 - protein, 9 aa, Mycobacterium
GVPVPPNAR

SEQ ID NO: 264299 - protein, 10 aa, Mycobacterium
GVQAQEPRHS

SEQ ID NO: 264300 - protein, 8 aa, Mycobacterium
GVQDSDTR

SEQ ID NO: 264301 - protein, 6 aa, Mycobacterium
GVQEDD

SEQ ID NO: 264302 - protein, 7 aa, Mycobacterium
GVQGNAG

SEQ ID NO: 264303 - protein, 4 aa, Mycobacterium
GVQI

SEQ ID NO: 264304 - protein, 30 aa, Mycobacterium
GVQPGPRLPNVDGGGDFVDSTDGLTDCDGH

SEQ ID NO: 264305 - protein, 34 aa, Mycobacterium
GVQPGPRLPNVEAGGDYIESTDGLTDCDGHGTSV

SEQ ID NO: 264306 - protein, 8 aa, Mycobacterium
GVQQLDQQ

SEQ ID NO: 264307 - protein, 12 aa, Mycobacterium
GVQRTRNAGITT

SEQ ID NO: 264308 - protein, 6 aa, Mycobacterium
GVQSAE

SEQ ID NO: 264309 - protein, 7 aa, Mycobacterium
GVQSPPA

SEQ ID NO: 264310 - protein, 6 aa, Mycobacterium
GVQTES

SEQ ID NO: 264311 - protein, 7 aa, Mycobacterium
GVRAGDG

SEQ ID NO: 264312 - protein, 5 aa, Mycobacterium
GVRDR

SEQ ID NO: 264313 - protein, 7 aa, Mycobacterium
GVRGGDG

SEQ ID NO: 264314 - protein, 10 aa, Mycobacterium
GVRGNAADHL

SEQ ID NO: 264315 - protein, 7 aa, Mycobacterium
GVRGNAR

SEQ ID NO: 264316 - protein, 15 aa, Mycobacterium
GVRGQGERIGQATTD

SEQ ID NO: 264317 - protein, 5 aa, Mycobacterium
GVRND

SEQ ID NO: 264318 - protein, 7 aa, Mycobacterium
GVRPGES

SEQ ID NO: 264319 - protein, 16 aa, Mycobacterium
GVRPGPRLPNVDPGGD

SEQ ID NO: 264320 - protein, 16 aa, Mycobacterium
GVRPGPRLPNVEPGGD

SEQ ID NO: 264321 - protein, 24 aa, Mycobacterium
GVRPPAGKRSIDPSALPGQTMTPD

SEQ ID NO: 264322 - protein, 9 aa, Mycobacterium
GVRSYDDDG

SEQ ID NO: 264323 - protein, 10 aa, Mycobacterium
GVRSYDDDGS

SEQ ID NO: 264324 - protein, 7 aa, Mycobacterium
GVRTPGK

SEQ ID NO: 264325 - protein, 12 aa, Mycobacterium
GVSAAAAARTAS

SEQ ID NO: 264326 - protein, 7 aa, Mycobacterium
GVSAGDG

SEQ ID NO: 264327 - protein, 9 aa, Mycobacterium
GVSAHTAAD

SEQ ID NO: 264328 - protein, 14 aa, Mycobacterium
GVSAKLGNKPDAKS

SEQ ID NO: 264329 - protein, 8 aa, Mycobacterium
GVSARQAV

SEQ ID NO: 264330 - protein, 17 aa, Mycobacterium
GVSASSTNAAASGRFVP

SEQ ID NO: 264331 - protein, 5 aa, Mycobacterium
GVSDH

SEQ ID NO: 264332 - protein, 4 aa, Mycobacterium
GVSE

SEQ ID NO: 264333 - protein, 11 aa, Mycobacterium
GVSETDRTRSR

SEQ ID NO: 264334 - protein, 12 aa, Mycobacterium
GVSGAARPPSEF

SEQ ID NO: 264335 - protein, 7 aa, Mycobacterium
GVSNHAA

SEQ ID NO: 264336 - protein, 8 aa, Mycobacterium
GVSPASAA

SEQ ID NO: 264337 - protein, 5 aa, Mycobacterium
GVSPY

SEQ ID NO: 264338 - protein, 46 aa, Mycobacterium
GVSQPTTPAKRHPHGQDNAVAAGTAADERAPVDAAAAPRSMTPTAQ

SEQ ID NO: 264339 - protein, 8 aa, Mycobacterium
GVSRTPLQ

SEQ ID NO: 264340 - protein, 12 aa, Mycobacterium
GVSSAGLAAGSG

SEQ ID NO: 264341 - protein, 10 aa, Mycobacterium
GVSSNSGVAA

SEQ ID NO: 264342 - protein, 5 aa, Mycobacterium
GVSSR

SEQ ID NO: 264343 - protein, 10 aa, Mycobacterium
GVSSSSSNTV

SEQ ID NO: 264344 - protein, 6 aa, Mycobacterium
GVSSST

SEQ ID NO: 264345 - protein, 11 aa, Mycobacterium
GVSTDAAAGTL

SEQ ID NO: 264346 - protein, 7 aa, Mycobacterium
GVSTPRL

SEQ ID NO: 264347 - protein, 10 aa, Mycobacterium
GVTADGDPIG

SEQ ID NO: 264348 - protein, 11 aa, Mycobacterium
GVTATSPRSTA

SEQ ID NO: 264349 - protein, 9 aa, Mycobacterium
GVTDESGAQ

SEQ ID NO: 264350 - protein, 7 aa, Mycobacterium
GVTETGT

SEQ ID NO: 264351 - protein, 25 aa, Mycobacterium
GVTGKPVIAGSSDPAFRGKEQRWNP

SEQ ID NO: 264352 - protein, 5 aa, Mycobacterium
GVTGQ

SEQ ID NO: 264353 - protein, 9 aa, Mycobacterium
GVTKQHAGP

SEQ ID NO: 264354 - protein, 11 aa, Mycobacterium
GVTPASNGQPN

SEQ ID NO: 264355 - protein, 32 aa, Mycobacterium
GVTPGPRLPNVDPGGDFVGSGDGLTDCDGSGT

SEQ ID NO: 264356 - protein, 9 aa, Mycobacterium
GVTPNGDPI

SEQ ID NO: 264357 - protein, 12 aa, Mycobacterium
GVTPSAGTQPNR

SEQ ID NO: 264358 - protein, 11 aa, Mycobacterium
GVTRPAGAVPE

SEQ ID NO: 264359 - protein, 10 aa, Mycobacterium
GVTRPTGARL

SEQ ID NO: 264360 - protein, 11 aa, Mycobacterium
GVTRPTGERLD

SEQ ID NO: 264361 - protein, 10 aa, Mycobacterium
GVTRSNLSGF

SEQ ID NO: 264362 - protein, 5 aa, Mycobacterium
GVTSY

SEQ ID NO: 264363 - protein, 8 aa, Mycobacterium
GVTTPGPV

SEQ ID NO: 264364 - protein, 12 aa, Mycobacterium
GVTTSSPRSTTH

SEQ ID NO: 264365 - protein, 13 aa, Mycobacterium
GVTVTSDQGQAEA

SEQ ID NO: 264366 - protein, 4 aa, Mycobacterium
GVVR

SEQ ID NO: 264367 - protein, 22 aa, Mycobacterium
GVYESSEDQPAVPAEGRGDEAA

SEQ ID NO: 264368 - protein, 6 aa, Mycobacterium
GVYSGD

SEQ ID NO: 264369 - protein, 8 aa, Mycobacterium
GWADPASG

SEQ ID NO: 264370 - protein, 9 aa, Mycobacterium
GWADRGNPA

SEQ ID NO: 264371 - protein, 20 aa, Mycobacterium
GWANRPPPPPPAFETTRHRP

SEQ ID NO: 264372 - protein, 8 aa, Mycobacterium
GWAPSGKY

SEQ ID NO: 264373 - protein, 7 aa, Mycobacterium
GWDPAPY

SEQ ID NO: 264374 - protein, 5 aa, Mycobacterium
GWEPG

SEQ ID NO: 264375 - protein, 15 aa, Mycobacterium
GWGDPTGSARSGADT

SEQ ID NO: 264376 - protein, 20 aa, Mycobacterium
GWGDPTSSAKSSADGPAPVD

SEQ ID NO: 264377 - protein, 8 aa, Mycobacterium
GWGEPVGV

SEQ ID NO: 264378 - protein, 11 aa, Mycobacterium
GWGPTEDGLGP

SEQ ID NO: 264379 - protein, 6 aa, Mycobacterium
GWNQSD

SEQ ID NO: 264380 - protein, 5 aa, Mycobacterium
GWNTG

SEQ ID NO: 264381 - protein, 7 aa, Mycobacterium
GWPEGTG

SEQ ID NO: 264382 - protein, 26 aa, Mycobacterium
GWPPPGQAPHPQPGYQPYPPQPYPYP

SEQ ID NO: 264383 - protein, 18 aa, Mycobacterium
GWPPPPGGPQQQQPPQQQ

SEQ ID NO: 264384 - protein, 17 aa, Mycobacterium
GWPPPQQSQQPGYQPQQ

SEQ ID NO: 264385 - protein, 4 aa, Mycobacterium
GWPQ

SEQ ID NO: 264386 - protein, 5 aa, Mycobacterium
GWPTT

SEQ ID NO: 264387 - protein, 20 aa, Mycobacterium
GWQADNAPQHTGPDFGKASP

SEQ ID NO: 264388 - protein, 7 aa, Mycobacterium
GWQGAAS

SEQ ID NO: 264389 - protein, 12 aa, Mycobacterium
GWRPDPTARYEG

SEQ ID NO: 264390 - protein, 10 aa, Mycobacterium
GWRSTSPRWG

SEQ ID NO: 264391 - protein, 6 aa, Mycobacterium
GWSAPA

SEQ ID NO: 264392 - protein, 10 aa, Mycobacterium
GWSSAGSDPM

SEQ ID NO: 264393 - protein, 5 aa, Mycobacterium
GWSSL

SEQ ID NO: 264394 - protein, 8 aa, Mycobacterium
GWTDPASG

SEQ ID NO: 264395 - protein, 5 aa, Mycobacterium
GWTEE

SEQ ID NO: 264396 - protein, 14 aa, Mycobacterium
GWVPGDDADPVTTE

SEQ ID NO: 264397 - protein, 5 aa, Mycobacterium
GYAAK

SEQ ID NO: 264398 - protein, 15 aa, Mycobacterium
GYAGRAGSMVPRAGS

SEQ ID NO: 264399 - protein, 7 aa, Mycobacterium
GYANTKI

SEQ ID NO: 264400 - protein, 8 aa, Mycobacterium
GYANTTID

SEQ ID NO: 264401 - protein, 4 aa, Mycobacterium
GYAP

SEQ ID NO: 264402 - protein, 14 aa, Mycobacterium
GYAPGGGAAPPADR

SEQ ID NO: 264403 - protein, 17 aa, Mycobacterium
GYASREGDTLSLTPAGL

SEQ ID NO: 264404 - protein, 14 aa, Mycobacterium
GYATGDDAVKDSGV

SEQ ID NO: 264405 - protein, 4 aa, Mycobacterium
GYAY

SEQ ID NO: 264406 - protein, 6 aa, Mycobacterium
GYDANG

SEQ ID NO: 264407 - protein, 5 aa, Mycobacterium
GYDDA

SEQ ID NO: 264408 - protein, 9 aa, Mycobacterium
GYDDGPVAA

SEQ ID NO: 264409 - protein, 16 aa, Mycobacterium
GYDDSLDEEDEPSTPR

SEQ ID NO: 264410 - protein, 23 aa, Mycobacterium
GYDGQPVNATPGEDGPVPLNGTS

SEQ ID NO: 264411 - protein, 4 aa, Mycobacterium
GYDP

SEQ ID NO: 264412 - protein, 19 aa, Mycobacterium
GYDTPLGAASSLSGGEKQR

SEQ ID NO: 264413 - protein, 11 aa, Mycobacterium
GYEAPGGNGRS

SEQ ID NO: 264414 - protein, 4 aa, Mycobacterium
GYEG

SEQ ID NO: 264415 - protein, 10 aa, Mycobacterium
GYETSYNDRD

SEQ ID NO: 264416 - protein, 4 aa, Mycobacterium
GYEY

SEQ ID NO: 264417 - protein, 4 aa, Mycobacterium
GYGA

SEQ ID NO: 264418 - protein, 7 aa, Mycobacterium
GYGAGES

SEQ ID NO: 264419 - protein, 21 aa, Mycobacterium
GYGGGGDRDTGSTGQSAPGPM

SEQ ID NO: 264420 - protein, 9 aa, Mycobacterium
GYGGPNAQQ

SEQ ID NO: 264421 - protein, 11 aa, Mycobacterium
GYGGSNAQQPI

SEQ ID NO: 264422 - protein, 8 aa, Mycobacterium
GYGPPRGE

SEQ ID NO: 264423 - protein, 9 aa, Mycobacterium
GYGPPRGNA

SEQ ID NO: 264424 - protein, 7 aa, Mycobacterium
GYGPTVS

SEQ ID NO: 264425 - protein, 14 aa, Mycobacterium
GYGQTGTLAQRAGH

SEQ ID NO: 264426 - protein, 10 aa, Mycobacterium
GYGRPEASRE

SEQ ID NO: 264427 - protein, 15 aa, Mycobacterium
GYGRPHASRDEITAA

SEQ ID NO: 264428 - protein, 5 aa, Mycobacterium
GYGTA

SEQ ID NO: 264429 - protein, 5 aa, Mycobacterium
GYGYG

SEQ ID NO: 264430 - protein, 10 aa, Mycobacterium
GYHAGPPLRT

SEQ ID NO: 264431 - protein, 4 aa, Mycobacterium
GYHP

SEQ ID NO: 264432 - protein, 5 aa, Mycobacterium
GYINT

SEQ ID NO: 264433 - protein, 5 aa, Mycobacterium
GYKTG

SEQ ID NO: 264434 - protein, 9 aa, Mycobacterium
GYKTNYDSK

SEQ ID NO: 264435 - protein, 10 aa, Mycobacterium
GYKTNYNDRD

SEQ ID NO: 264436 - protein, 5 aa, Mycobacterium
GYKTS

SEQ ID NO: 264437 - protein, 23 aa, Mycobacterium
GYKTSYDTRPYMPASAPANIGYT

SEQ ID NO: 264438 - protein, 22 aa, Mycobacterium
GYKTSYDTRPYMPSSAAANVGY

SEQ ID NO: 264439 - protein, 41 aa, Mycobacterium
GYMPDEPGYTPPAKVSLGPGTAARPARGETLEATNDRGIEQ

SEQ ID NO: 264440 - protein, 39 aa, Mycobacterium
GYMPDEPGYTPPAKVSVGPGTAARPARGESLESTHDREI

SEQ ID NO: 264441 - protein, 13 aa, Mycobacterium
GYMPDEPGYTPPV

SEQ ID NO: 264442 - protein, 6 aa, Mycobacterium
GYNADG

SEQ ID NO: 264443 - protein, 5 aa, Mycobacterium
GYNGS

SEQ ID NO: 264444 - protein, 11 aa, Mycobacterium
GYNPSYSDQKY

SEQ ID NO: 264445 - protein, 7 aa, Mycobacterium
GYNPSYT

SEQ ID NO: 264446 - protein, 15 aa, Mycobacterium
GYNRDGRDRDGRNEW

SEQ ID NO: 264447 - protein, 32 aa, Mycobacterium
GYPAAGQPGYGGYPPGYPMPPRPTPPKSAGTG

SEQ ID NO: 264448 - protein, 6 aa, Mycobacterium
GYPAST

SEQ ID NO: 264449 - protein, 7 aa, Mycobacterium
GYPASTP

SEQ ID NO: 264450 - protein, 4 aa, Mycobacterium
GYPD

SEQ ID NO: 264451 - protein, 14 aa, Mycobacterium
GYPGDFNPSTGTTT

SEQ ID NO: 264452 - protein, 9 aa, Mycobacterium
GYPGGRGDY

SEQ ID NO: 264453 - protein, 5 aa, Mycobacterium
GYPKE

SEQ ID NO: 264454 - protein, 4 aa, Mycobacterium
GYPN

SEQ ID NO: 264455 - protein, 13 aa, Mycobacterium
GYPPQQPAAQAPN

SEQ ID NO: 264456 - protein, 10 aa, Mycobacterium
GYPSPEDIDP

SEQ ID NO: 264457 - protein, 8 aa, Mycobacterium
GYPTDPTV

SEQ ID NO: 264458 - protein, 4 aa, Mycobacterium
GYQA

SEQ ID NO: 264459 - protein, 10 aa, Mycobacterium
GYQSNKSSQI

SEQ ID NO: 264460 - protein, 9 aa, Mycobacterium
GYQTDKSDQ

SEQ ID NO: 264461 - protein, 18 aa, Mycobacterium
GYQTGDPARCDTFATNNL

SEQ ID NO: 264462 - protein, 9 aa, Mycobacterium
GYQTNKSDQ

SEQ ID NO: 264463 - protein, 6 aa, Mycobacterium
GYQTNY

SEQ ID NO: 264464 - protein, 9 aa, Mycobacterium
GYQTNYNDR

SEQ ID NO: 264465 - protein, 5 aa, Mycobacterium
GYQTS

SEQ ID NO: 264466 - protein, 6 aa, Mycobacterium
GYQTSY

SEQ ID NO: 264467 - protein, 7 aa, Mycobacterium
GYQTSYD

SEQ ID NO: 264468 - protein, 9 aa, Mycobacterium
GYQTSYNDR

SEQ ID NO: 264469 - protein, 8 aa, Mycobacterium
GYRDVRGQ

SEQ ID NO: 264470 - protein, 6 aa, Mycobacterium
GYRPAY

SEQ ID NO: 264471 - protein, 5 aa, Mycobacterium
GYRSD

SEQ ID NO: 264472 - protein, 11 aa, Mycobacterium
GYSAADTDSID

SEQ ID NO: 264473 - protein, 21 aa, Mycobacterium
GYSDAGNESGAGLARSYPAGG

SEQ ID NO: 264474 - protein, 12 aa, Mycobacterium
GYSFPSGHATGT

SEQ ID NO: 264475 - protein, 14 aa, Mycobacterium
GYSFPSGHATGTAA

SEQ ID NO: 264476 - protein, 7 aa, Mycobacterium
GYSGNPW

SEQ ID NO: 264477 - protein, 16 aa, Mycobacterium
GYSGSPEPPAVSAQPM

SEQ ID NO: 264478 - protein, 20 aa, Mycobacterium
GYSPEQDTATQLSPSEQARS

SEQ ID NO: 264479 - protein, 12 aa, Mycobacterium
GYSPEQLGSTAQ

SEQ ID NO: 264480 - protein, 5 aa, Mycobacterium
GYSPN

SEQ ID NO: 264481 - protein, 12 aa, Mycobacterium
GYSPRVDAADHS

SEQ ID NO: 264482 - protein, 20 aa, Mycobacterium
GYSSSSSSQQVTASAAPMAQ

SEQ ID NO: 264483 - protein, 9 aa, Mycobacterium
GYTGGGGKQ

SEQ ID NO: 264484 - protein, 9 aa, Mycobacterium
GYTGGGKKQ

SEQ ID NO: 264485 - protein, 8 aa, Mycobacterium
GYTPERAG

SEQ ID NO: 264486 - protein, 6 aa, Mycobacterium
GYTPGA

SEQ ID NO: 264487 - protein, 10 aa, Mycobacterium
GYTPGYDDRQ

SEQ ID NO: 264488 - protein, 13 aa, Mycobacterium
GYYPTGDLGRLDS

SEQ ID NO: 264489 - protein, 7 aa, Mycobacterium
HAAAQRK

SEQ ID NO: 264490 - protein, 5 aa, Mycobacterium
HAAAS

SEQ ID NO: 264491 - protein, 7 aa, Mycobacterium
HAADDGY

SEQ ID NO: 264492 - protein, 8 aa, Mycobacterium
HAADPSTV

SEQ ID NO: 264493 - protein, 12 aa, Mycobacterium
HAAEADDDYGYG

SEQ ID NO: 264494 - protein, 6 aa, Mycobacterium
HAAEQR

SEQ ID NO: 264495 - protein, 4 aa, Mycobacterium
HAAG

SEQ ID NO: 264496 - protein, 10 aa, Mycobacterium
HAAPSAPSKS

SEQ ID NO: 264497 - protein, 41 aa, Mycobacterium
HAAPVPPASLSEAARPSALNTSSMPAPPRGGHDDPTSAISA

SEQ ID NO: 264498 - protein, 13 aa, Mycobacterium
HAARDKRSTNVTE

SEQ ID NO: 264499 - protein, 11 aa, Mycobacterium
HAARSESGGRA

SEQ ID NO: 264500 - protein, 4 aa, Mycobacterium
HADA

SEQ ID NO: 264501 - protein, 7 aa, Mycobacterium
HADESEV

SEQ ID NO: 264502 - protein, 6 aa, Mycobacterium
HADPTL

SEQ ID NO: 264503 - protein, 6 aa, Mycobacterium
HADQEA

SEQ ID NO: 264504 - protein, 9 aa, Mycobacterium
HADRHGPRR

SEQ ID NO: 264505 - protein, 9 aa, Mycobacterium
HADSDQPRR

SEQ ID NO: 264506 - protein, 5 aa, Mycobacterium
HADTR

SEQ ID NO: 264507 - protein, 16 aa, Mycobacterium
HADTSARSGTSTEEPA

SEQ ID NO: 264508 - protein, 14 aa, Mycobacterium
HAEAESADDDEDNT

SEQ ID NO: 264509 - protein, 5 aa, Mycobacterium
HAEAN

SEQ ID NO: 264510 - protein, 26 aa, Mycobacterium
HAEATAPAGSGLSQPVNPPTALPPAV

SEQ ID NO: 264511 - protein, 4 aa, Mycobacterium
HAEG

SEQ ID NO: 264512 - protein, 12 aa, Mycobacterium
HAEPARDPDRTA

SEQ ID NO: 264513 - protein, 12 aa, Mycobacterium
HAEPEPAPDATP

SEQ ID NO: 264514 - protein, 7 aa, Mycobacterium
HAEPQAC

SEQ ID NO: 264515 - protein, 6 aa, Mycobacterium
HAERGA

SEQ ID NO: 264516 - protein, 8 aa, Mycobacterium
HAERSEGL

SEQ ID NO: 264517 - protein, 16 aa, Mycobacterium
HAESAADDRDPDAEHA

SEQ ID NO: 264518 - protein, 7 aa, Mycobacterium
HAESKPV

SEQ ID NO: 264519 - protein, 6 aa, Mycobacterium
HAESPR

SEQ ID NO: 264520 - protein, 6 aa, Mycobacterium
HAESSE

SEQ ID NO: 264521 - protein, 7 aa, Mycobacterium
HAETAYA

SEQ ID NO: 264522 - protein, 9 aa, Mycobacterium
HAETAYPEG

SEQ ID NO: 264523 - protein, 7 aa, Mycobacterium
HAETAYT

SEQ ID NO: 264524 - protein, 9 aa, Mycobacterium
HAGAPAAAA

SEQ ID NO: 264525 - protein, 8 aa, Mycobacterium
HAGDPSMR

SEQ ID NO: 264526 - protein, 18 aa, Mycobacterium
HAGGPRPLDPPPPAPDAF

SEQ ID NO: 264527 - protein, 6 aa, Mycobacterium
HAGGTP

SEQ ID NO: 264528 - protein, 6 aa, Mycobacterium
HAGNGA

SEQ ID NO: 264529 - protein, 16 aa, Mycobacterium
HAGPVDAPRGVKAGDS

SEQ ID NO: 264530 - protein, 10 aa, Mycobacterium
HAGPVTASGD

SEQ ID NO: 264531 - protein, 17 aa, Mycobacterium
HAGRDADTGSPEPGSEA

SEQ ID NO: 264532 - protein, 5 aa, Mycobacterium
HAGRP

SEQ ID NO: 264533 - protein, 4 aa, Mycobacterium
HAGS

SEQ ID NO: 264534 - protein, 5 aa, Mycobacterium
HAGST

SEQ ID NO: 264535 - protein, 5 aa, Mycobacterium
HAGTT

SEQ ID NO: 264536 - protein, 13 aa, Mycobacterium
HAHAGASGATGSA

SEQ ID NO: 264537 - protein, 10 aa, Mycobacterium
HAHDQSDEHL

SEQ ID NO: 264538 - protein, 13 aa, Mycobacterium
HAKPTRSGRRSLP

SEQ ID NO: 264539 - protein, 17 aa, Mycobacterium
HAKSDAPHADAIPEPAR

SEQ ID NO: 264540 - protein, 8 aa, Mycobacterium
HAKTDTVR

SEQ ID NO: 264541 - protein, 15 aa, Mycobacterium
HANAASTLAANAQAL

SEQ ID NO: 264542 - protein, 10 aa, Mycobacterium
HANAQQARDQ

SEQ ID NO: 264543 - protein, 13 aa, Mycobacterium
HANREAGAGKEAY

SEQ ID NO: 264544 - protein, 6 aa, Mycobacterium
HANTRV

SEQ ID NO: 264545 - protein, 45 aa, Mycobacterium
HAPAAAPVRQPTRQLTRGPGDDWPGAQRPDHQPEKPDDDEYRPVT

SEQ ID NO: 264546 - protein, 42 aa, Mycobacterium
HAPADAEAGAHHHGSDAGQADHHNDPEPDPAAPPGDTGGHDH

SEQ ID NO: 264547 - protein, 10 aa, Mycobacterium
HAPAGADTSR

SEQ ID NO: 264548 - protein, 17 aa, Mycobacterium
HAPAKGRTRAVTARGAP

SEQ ID NO: 264549 - protein, 4 aa, Mycobacterium
HAPD

SEQ ID NO: 264550 - protein, 7 aa, Mycobacterium
HAPDGAP

SEQ ID NO: 264551 - protein, 7 aa, Mycobacterium
HAPDGPI

SEQ ID NO: 264552 - protein, 10 aa, Mycobacterium
HAPDRGHAEL

SEQ ID NO: 264553 - protein, 4 aa, Mycobacterium
HAPE

SEQ ID NO: 264554 - protein, 5 aa, Mycobacterium
HAPEI

SEQ ID NO: 264555 - protein, 4 aa, Mycobacterium
HAPG

SEQ ID NO: 264556 - protein, 6 aa, Mycobacterium
HAPGGP

SEQ ID NO: 264557 - protein, 6 aa, Mycobacterium
HAPGPL

SEQ ID NO: 264558 - protein, 23 aa, Mycobacterium
HAPHHSPAEYADKYRGKFDDGYE

SEQ ID NO: 264559 - protein, 5 aa, Mycobacterium
HAPLS

SEQ ID NO: 264560 - protein, 9 aa, Mycobacterium
HAPPGKRGF

SEQ ID NO: 264561 - protein, 8 aa, Mycobacterium
HAPPGRRG

SEQ ID NO: 264562 - protein, 9 aa, Mycobacterium
HAPQNYTRD

SEQ ID NO: 264563 - protein, 5 aa, Mycobacterium
HAPRY

SEQ ID NO: 264564 - protein, 14 aa, Mycobacterium
HAPSRRAVEPVEDG

SEQ ID NO: 264565 - protein, 4 aa, Mycobacterium
HAPT

SEQ ID NO: 264566 - protein, 7 aa, Mycobacterium
HAPTGRR

SEQ ID NO: 264567 - protein, 5 aa, Mycobacterium
HAPTL

SEQ ID NO: 264568 - protein, 12 aa, Mycobacterium
HAPTQDISETSL

SEQ ID NO: 264569 - protein, 9 aa, Mycobacterium
HAQANLAEG

SEQ ID NO: 264570 - protein, 22 aa, Mycobacterium
HAQGCNGQNPDPLPGDPTRGWS

SEQ ID NO: 264571 - protein, 18 aa, Mycobacterium
HAQKAQAAHDQGLDEDEL

SEQ ID NO: 264572 - protein, 8 aa, Mycobacterium
HAQPQRVA

SEQ ID NO: 264573 - protein, 14 aa, Mycobacterium
HARAESNENAAQKG

SEQ ID NO: 264574 - protein, 5 aa, Mycobacterium
HARAG

SEQ ID NO: 264575 - protein, 5 aa, Mycobacterium
HARDD

SEQ ID NO: 264576 - protein, 10 aa, Mycobacterium
HARRSGAEYD

SEQ ID NO: 264577 - protein, 4 aa, Mycobacterium
HART

SEQ ID NO: 264578 - protein, 8 aa, Mycobacterium
HARYSGET

SEQ ID NO: 264579 - protein, 7 aa, Mycobacterium
HASAAEE

SEQ ID NO: 264580 - protein, 16 aa, Mycobacterium
HASAMRKQQAAASELA

SEQ ID NO: 264581 - protein, 7 aa, Mycobacterium
HASDRRR

SEQ ID NO: 264582 - protein, 12 aa, Mycobacterium
HASGAIAGAPNP

SEQ ID NO: 264583 - protein, 8 aa, Mycobacterium
HASKRRST

SEQ ID NO: 264584 - protein, 4 aa, Mycobacterium
HASP

SEQ ID NO: 264585 - protein, 11 aa, Mycobacterium
HASPDQPMPDG

SEQ ID NO: 264586 - protein, 6 aa, Mycobacterium
HASRPD

SEQ ID NO: 264587 - protein, 11 aa, Mycobacterium
HASRPGPGRTL

SEQ ID NO: 264588 - protein, 10 aa, Mycobacterium
HASSDNPVRG

SEQ ID NO: 264589 - protein, 27 aa, Mycobacterium
HATDDAINQAAADPALRGSRPQPRPNR

SEQ ID NO: 264590 - protein, 8 aa, Mycobacterium
HATDGRRS

SEQ ID NO: 264591 - protein, 7 aa, Mycobacterium
HATGGKV

SEQ ID NO: 264592 - protein, 6 aa, Mycobacterium
HATGGR

SEQ ID NO: 264593 - protein, 14 aa, Mycobacterium
HATGQRTSHPAQAQ

SEQ ID NO: 264594 - protein, 4 aa, Mycobacterium
HATP

SEQ ID NO: 264595 - protein, 6 aa, Mycobacterium
HATPAT

SEQ ID NO: 264596 - protein, 6 aa, Mycobacterium
HATPSS

SEQ ID NO: 264597 - protein, 10 aa, Mycobacterium
HATRTATVSA

SEQ ID NO: 264598 - protein, 13 aa, Mycobacterium
HAVQEGGGIRSAP

SEQ ID NO: 264599 - protein, 18 aa, Mycobacterium
HDAADSIDNALESSAAGI

SEQ ID NO: 264600 - protein, 9 aa, Mycobacterium
HDAAQNELN

SEQ ID NO: 264601 - protein, 4 aa, Mycobacterium
HDAD

SEQ ID NO: 264602 - protein, 6 aa, Mycobacterium
HDADNA

SEQ ID NO: 264603 - protein, 7 aa, Mycobacterium
HDADNLT

SEQ ID NO: 264604 - protein, 19 aa, Mycobacterium
HDAEHDVEGAENDYDENDY

SEQ ID NO: 264605 - protein, 22 aa, Mycobacterium
HDAEPAPPQAPDADDEAPLSFA

SEQ ID NO: 264606 - protein, 22 aa, Mycobacterium
HDAEPAPPQTPSDDEVAPLSFA

SEQ ID NO: 264607 - protein, 22 aa, Mycobacterium
HDAEPAPPRAPDDDEVAPLSFA

SEQ ID NO: 264608 - protein, 21 aa, Mycobacterium
HDAEPSPPASDDDSVKPLSFA

SEQ ID NO: 264609 - protein, 14 aa, Mycobacterium
HDAGDSVDAALETS

SEQ ID NO: 264610 - protein, 6 aa, Mycobacterium
HDALPT

SEQ ID NO: 264611 - protein, 11 aa, Mycobacterium
HDAPDLPTPRE

SEQ ID NO: 264612 - protein, 8 aa, Mycobacterium
HDAQHTYP

SEQ ID NO: 264613 - protein, 6 aa, Mycobacterium
HDASER

SEQ ID NO: 264614 - protein, 8 aa, Mycobacterium
HDDDRVTL

SEQ ID NO: 264615 - protein, 7 aa, Mycobacterium
HDDGEAR

SEQ ID NO: 264616 - protein, 7 aa, Mycobacterium
HDDGRLD

SEQ ID NO: 264617 - protein, 4 aa, Mycobacterium
HDDH

SEQ ID NO: 264618 - protein, 5 aa, Mycobacterium
HDDIT

SEQ ID NO: 264619 - protein, 13 aa, Mycobacterium
HDDLTQGIRGGPT

SEQ ID NO: 264620 - protein, 6 aa, Mycobacterium
HDDNDT

SEQ ID NO: 264621 - protein, 8 aa, Mycobacterium
HDDNDTRI

SEQ ID NO: 264622 - protein, 42 aa, Mycobacterium
HDDNPQPTGQRTTSTTARTTTGSTATTTPAPSTTSRRPDAQT

SEQ ID NO: 264623 - protein, 18 aa, Mycobacterium
HDDQERQHDGDVQQQGRR

SEQ ID NO: 264624 - protein, 9 aa, Mycobacterium
HDDSHPESE

SEQ ID NO: 264625 - protein, 7 aa, Mycobacterium
HDDTPTV

SEQ ID NO: 264626 - protein, 6 aa, Mycobacterium
HDEAKN

SEQ ID NO: 264627 - protein, 13 aa, Mycobacterium
HDEEKAEQNAGTW

SEQ ID NO: 264628 - protein, 5 aa, Mycobacterium
HDEND

SEQ ID NO: 264629 - protein, 4 aa, Mycobacterium
HDEQ

SEQ ID NO: 264630 - protein, 30 aa, Mycobacterium
HDERSAPSAPAETTETVAPTSQAKPGNGRV

SEQ ID NO: 264631 - protein, 7 aa, Mycobacterium
HDERTTS

SEQ ID NO: 264632 - protein, 12 aa, Mycobacterium
HDETKPDHKPKQ

SEQ ID NO: 264633 - protein, 7 aa, Mycobacterium
HDGEPQT

SEQ ID NO: 264634 - protein, 35 aa, Mycobacterium
HDGEYDDEYEYDEDYDDARYDERDGDFSDDFSDGY

SEQ ID NO: 264635 - protein, 7 aa, Mycobacterium
HDGGDYE

SEQ ID NO: 264636 - protein, 6 aa, Mycobacterium
HDGHGD

SEQ ID NO: 264637 - protein, 8 aa, Mycobacterium
HDGKSGNL

SEQ ID NO: 264638 - protein, 10 aa, Mycobacterium
HDGPSPPATA

SEQ ID NO: 264639 - protein, 19 aa, Mycobacterium
HDGSGDVIKTPNRSDPNQT

SEQ ID NO: 264640 - protein, 11 aa, Mycobacterium
HDGSQSPGSQD

SEQ ID NO: 264641 - protein, 10 aa, Mycobacterium
HDGSTESDRL

SEQ ID NO: 264642 - protein, 13 aa, Mycobacterium
HDGSVTAESAAGQ

SEQ ID NO: 264643 - protein, 12 aa, Mycobacterium
HDGSVTAESAHG

SEQ ID NO: 264644 - protein, 20 aa, Mycobacterium
HDHDHDSYGSYDDGYEDEGY

SEQ ID NO: 264645 - protein, 8 aa, Mycobacterium
HDKEPGRL

SEQ ID NO: 264646 - protein, 16 aa, Mycobacterium
HDKKGGGATADAVRVT

SEQ ID NO: 264647 - protein, 9 aa, Mycobacterium
HDKNAEPEK

SEQ ID NO: 264648 - protein, 32 aa, Mycobacterium
HDKPGTAEGPTDAPRAPVGARAGHPGGPQQRV

SEQ ID NO: 264649 - protein, 4 aa, Mycobacterium
HDKS

SEQ ID NO: 264650 - protein, 25 aa, Mycobacterium
HDLGPDVRSPSESPENENLEHIASN

SEQ ID NO: 264651 - protein, 5 aa, Mycobacterium
HDLPP

SEQ ID NO: 264652 - protein, 10 aa, Mycobacterium
HDLPSDDAEL

SEQ ID NO: 264653 - protein, 8 aa, Mycobacterium
HDLRTPKA

SEQ ID NO: 264654 - protein, 7 aa, Mycobacterium
HDLRTPR

SEQ ID NO: 264655 - protein, 8 aa, Mycobacterium
HDLRTPRG

SEQ ID NO: 264656 - protein, 6 aa, Mycobacterium
HDMRNS

SEQ ID NO: 264657 - protein, 8 aa, Mycobacterium
HDNEDAPE

SEQ ID NO: 264658 - protein, 5 aa, Mycobacterium
HDNNA

SEQ ID NO: 264659 - protein, 7 aa, Mycobacterium
HDPADGS

SEQ ID NO: 264660 - protein, 12 aa, Mycobacterium
HDPARADDDAYV

SEQ ID NO: 264661 - protein, 7 aa, Mycobacterium
HDPATGA

SEQ ID NO: 264662 - protein, 14 aa, Mycobacterium
HDPDGRPPHTRRRG

SEQ ID NO: 264663 - protein, 9 aa, Mycobacterium
HDPDGRRQP

SEQ ID NO: 264664 - protein, 10 aa, Mycobacterium
HDPDRTDDDA

SEQ ID NO: 264665 - protein, 11 aa, Mycobacterium
HDPEDANPDVQ

SEQ ID NO: 264666 - protein, 8 aa, Mycobacterium
HDPGARDE

SEQ ID NO: 264667 - protein, 20 aa, Mycobacterium
HDPHATPSAVTGADAEKSVV

SEQ ID NO: 264668 - protein, 10 aa, Mycobacterium
HDPNDGVGGN

SEQ ID NO: 264669 - protein, 9 aa, Mycobacterium
HDPPSIGSV

SEQ ID NO: 264670 - protein, 10 aa, Mycobacterium
HDPQPSSPGL

SEQ ID NO: 264671 - protein, 6 aa, Mycobacterium
HDPRTK

SEQ ID NO: 264672 - protein, 5 aa, Mycobacterium
HDPSF

SEQ ID NO: 264673 - protein, 7 aa, Mycobacterium
HDPTTRE

SEQ ID NO: 264674 - protein, 6 aa, Mycobacterium
HDPWKG

SEQ ID NO: 264675 - protein, 23 aa, Mycobacterium
HDPYGAGVSAARAAAAAQAVRAP

SEQ ID NO: 264676 - protein, 5 aa, Mycobacterium
HDPYS

SEQ ID NO: 264677 - protein, 4 aa, Mycobacterium
HDQL

SEQ ID NO: 264678 - protein, 6 aa, Mycobacterium
HDQPHT

SEQ ID NO: 264679 - protein, 10 aa, Mycobacterium
HDQQTQEASW

SEQ ID NO: 264680 - protein, 13 aa, Mycobacterium
HDQQTRLASPVQA

SEQ ID NO: 264681 - protein, 9 aa, Mycobacterium
HDRADGTRD

SEQ ID NO: 264682 - protein, 12 aa, Mycobacterium
HDRGDTDQARAY

SEQ ID NO: 264683 - protein, 10 aa, Mycobacterium
HDRGHRQGGV

SEQ ID NO: 264684 - protein, 12 aa, Mycobacterium
HDRNERSQRIPR

SEQ ID NO: 264685 - protein, 5 aa, Mycobacterium
HDRPD

SEQ ID NO: 264686 - protein, 9 aa, Mycobacterium
HDRSAEPER

SEQ ID NO: 264687 - protein, 4 aa, Mycobacterium
HDRT

SEQ ID NO: 264688 - protein, 11 aa, Mycobacterium
HDRTDETANES

SEQ ID NO: 264689 - protein, 6 aa, Mycobacterium
HDSALR

SEQ ID NO: 264690 - protein, 7 aa, Mycobacterium
HDSEPLR

SEQ ID NO: 264691 - protein, 6 aa, Mycobacterium
HDSGVS

SEQ ID NO: 264692 - protein, 4 aa, Mycobacterium
HDSN

SEQ ID NO: 264693 - protein, 7 aa, Mycobacterium
HDSTETR

SEQ ID NO: 264694 - protein, 4 aa, Mycobacterium
HDTA

SEQ ID NO: 264695 - protein, 5 aa, Mycobacterium
HDTEH

SEQ ID NO: 264696 - protein, 9 aa, Mycobacterium
HDTEPGRAA

SEQ ID NO: 264697 - protein, 6 aa, Mycobacterium
HDTGGR

SEQ ID NO: 264698 - protein, 6 aa, Mycobacterium
HDTGNA

SEQ ID NO: 264699 - protein, 6 aa, Mycobacterium
HDTSPG

SEQ ID NO: 264700 - protein, 16 aa, Mycobacterium
HDVEDHSAEPHADSAA

SEQ ID NO: 264701 - protein, 13 aa, Mycobacterium
HDVRGDGTRGRQV

SEQ ID NO: 264702 - protein, 6 aa, Mycobacterium
HEADRR

SEQ ID NO: 264703 - protein, 4 aa, Mycobacterium
HEAE

SEQ ID NO: 264704 - protein, 9 aa, Mycobacterium
HEAGNAGYG

SEQ ID NO: 264705 - protein, 11 aa, Mycobacterium
HEAPKGSEGGL

SEQ ID NO: 264706 - protein, 10 aa, Mycobacterium
HEAPPQPVTV

SEQ ID NO: 264707 - protein, 6 aa, Mycobacterium
HEAQEQ

SEQ ID NO: 264708 - protein, 7 aa, Mycobacterium
HEARGRI

SEQ ID NO: 264709 - protein, 7 aa, Mycobacterium
HEATGGS

SEQ ID NO: 264710 - protein, 14 aa, Mycobacterium
HEATVGQTSPAPWS

SEQ ID NO: 264711 - protein, 9 aa, Mycobacterium
HEDGAASDV

SEQ ID NO: 264712 - protein, 4 aa, Mycobacterium
HEEL

SEQ ID NO: 264713 - protein, 20 aa, Mycobacterium
HEEREARQAQEAAQQDQAGS

SEQ ID NO: 264714 - protein, 13 aa, Mycobacterium
HEETPTAAIGPAA

SEQ ID NO: 264715 - protein, 5 aa, Mycobacterium
HEGDV

SEQ ID NO: 264716 - protein, 6 aa, Mycobacterium
HEGEER

SEQ ID NO: 264717 - protein, 6 aa, Mycobacterium
HEGNGG

SEQ ID NO: 264718 - protein, 26 aa, Mycobacterium
HEGRSEVASGPLADPVGGSSGQPRSA

SEQ ID NO: 264719 - protein, 25 aa, Mycobacterium
HEGRSEVPGGPLSDPVNGQPRSAAL

SEQ ID NO: 264720 - protein, 23 aa, Mycobacterium
HEGRSEVPTGPLADPVNGQPRSA

SEQ ID NO: 264721 - protein, 8 aa, Mycobacterium
HEGTEAST

SEQ ID NO: 264722 - protein, 8 aa, Mycobacterium
HEHAEEFE

SEQ ID NO: 264723 - protein, 35 aa, Mycobacterium
HEHKSNTAATTTSSSSPESTTPAGPAPSAPPLPAF

SEQ ID NO: 264724 - protein, 11 aa, Mycobacterium
HEIQDTTNELR

SEQ ID NO: 264725 - protein, 7 aa, Mycobacterium
HEITDEP

SEQ ID NO: 264726 - protein, 11 aa, Mycobacterium
HEKDGADHQHG

SEQ ID NO: 264727 - protein, 4 aa, Mycobacterium
HEKH

SEQ ID NO: 264728 - protein, 9 aa, Mycobacterium
HEKTTTSAE

SEQ ID NO: 264729 - protein, 4 aa, Mycobacterium
HEKY

SEQ ID NO: 264730 - protein, 5 aa, Mycobacterium
HEKYA

SEQ ID NO: 264731 - protein, 6 aa, Mycobacterium
HELGED

SEQ ID NO: 264732 - protein, 5 aa, Mycobacterium
HELPT

SEQ ID NO: 264733 - protein, 7 aa, Mycobacterium
HEMPEPT

SEQ ID NO: 264734 - protein, 9 aa, Mycobacterium
HEPADEQLD

SEQ ID NO: 264735 - protein, 9 aa, Mycobacterium
HEPCEQDQQ

SEQ ID NO: 264736 - protein, 9 aa, Mycobacterium
HEPGNRDSV

SEQ ID NO: 264737 - protein, 14 aa, Mycobacterium
HEPGRGGVRSDQID

SEQ ID NO: 264738 - protein, 8 aa, Mycobacterium
HEPGRKDP

SEQ ID NO: 264739 - protein, 7 aa, Mycobacterium
HEPGSQN

SEQ ID NO: 264740 - protein, 10 aa, Mycobacterium
HEPPASAEVR

SEQ ID NO: 264741 - protein, 6 aa, Mycobacterium
HEPSDN

SEQ ID NO: 264742 - protein, 5 aa, Mycobacterium
HEPSR

SEQ ID NO: 264743 - protein, 7 aa, Mycobacterium
HEPTCRS

SEQ ID NO: 264744 - protein, 6 aa, Mycobacterium
HEQQNG

SEQ ID NO: 264745 - protein, 12 aa, Mycobacterium
HERDGADHQHGH

SEQ ID NO: 264746 - protein, 13 aa, Mycobacterium
HERPAPAPPDETE

SEQ ID NO: 264747 - protein, 7 aa, Mycobacterium
HESDSDS

SEQ ID NO: 264748 - protein, 4 aa, Mycobacterium
HESE

SEQ ID NO: 264749 - protein, 5 aa, Mycobacterium
HESGA

SEQ ID NO: 264750 - protein, 45 aa, Mycobacterium
HESGETERDRRDAVTEDHADHADDGDCPPDDDRYADDDYADDDRY

SEQ ID NO: 264751 - protein, 7 aa, Mycobacterium
HESNSTN

SEQ ID NO: 264752 - protein, 6 aa, Mycobacterium
HESSND

SEQ ID NO: 264753 - protein, 4 aa, Mycobacterium
HEST

SEQ ID NO: 264754 - protein, 6 aa, Mycobacterium
HETPER

SEQ ID NO: 264755 - protein, 5 aa, Mycobacterium
HETSQ

SEQ ID NO: 264756 - protein, 7 aa, Mycobacterium
HETTATG

SEQ ID NO: 264757 - protein, 5 aa, Mycobacterium
HEVGT

SEQ ID NO: 264758 - protein, 5 aa, Mycobacterium
HEWPQ

SEQ ID NO: 264759 - protein, 12 aa, Mycobacterium
HEYASGTPWAKT

SEQ ID NO: 264760 - protein, 6 aa, Mycobacterium
HEYDQG

SEQ ID NO: 264761 - protein, 12 aa, Mycobacterium
HEYGSGTPWAKT

SEQ ID NO: 264762 - protein, 10 aa, Mycobacterium
HFPESKMSTP

SEQ ID NO: 264763 - protein, 4 aa, Mycobacterium
HFPP

SEQ ID NO: 264764 - protein, 6 aa, Mycobacterium
HFPPDD

SEQ ID NO: 264765 - protein, 6 aa, Mycobacterium
HFPPSR

SEQ ID NO: 264766 - protein, 8 aa, Mycobacterium
HFSTGGTA

SEQ ID NO: 264767 - protein, 6 aa, Mycobacterium
HFTTPT

SEQ ID NO: 264768 - protein, 4 aa, Mycobacterium
HGAA

SEQ ID NO: 264769 - protein, 11 aa, Mycobacterium
HGAAPASPHAA

SEQ ID NO: 264770 - protein, 10 aa, Mycobacterium
HGAAPDDGYG

SEQ ID NO: 264771 - protein, 6 aa, Mycobacterium
HGADPT

SEQ ID NO: 264772 - protein, 9 aa, Mycobacterium
HGADQLAGG

SEQ ID NO: 264773 - protein, 6 aa, Mycobacterium
HGAEPH

SEQ ID NO: 264774 - protein, 8 aa, Mycobacterium
HGAKPGAT

SEQ ID NO: 264775 - protein, 33 aa, Mycobacterium
HGAKPGQSAAPPTTTAAPPPSTSPPPTLTTPEQ

SEQ ID NO: 264776 - protein, 14 aa, Mycobacterium
HGALDSDGADLSES

SEQ ID NO: 264777 - protein, 8 aa, Mycobacterium
HGANSAYP

SEQ ID NO: 264778 - protein, 13 aa, Mycobacterium
HGAPAADAKGEQR

SEQ ID NO: 264779 - protein, 7 aa, Mycobacterium
HGARPGA

SEQ ID NO: 264780 - protein, 17 aa, Mycobacterium
HGARTTPMTASGKSRSL

SEQ ID NO: 264781 - protein, 6 aa, Mycobacterium
HGASDH

SEQ ID NO: 264782 - protein, 8 aa, Mycobacterium
HGASDQLK

SEQ ID NO: 264783 - protein, 4 aa, Mycobacterium
HGAT

SEQ ID NO: 264784 - protein, 8 aa, Mycobacterium
HGATNPIW

SEQ ID NO: 264785 - protein, 5 aa, Mycobacterium
HGATP

SEQ ID NO: 264786 - protein, 7 aa, Mycobacterium
HGDAGRS

SEQ ID NO: 264787 - protein, 5 aa, Mycobacterium
HGDAP

SEQ ID NO: 264788 - protein, 12 aa, Mycobacterium
HGDAPPDEARED

SEQ ID NO: 264789 - protein, 12 aa, Mycobacterium
HGDEQAVGSPLN

SEQ ID NO: 264790 - protein, 13 aa, Mycobacterium
HGDEQAVGSPLNA

SEQ ID NO: 264791 - protein, 11 aa, Mycobacterium
HGDEQAVGTPL

SEQ ID NO: 264792 - protein, 16 aa, Mycobacterium
HGDEQAVGTPLNDTEL

SEQ ID NO: 264793 - protein, 12 aa, Mycobacterium
HGDERTVGSPLT

SEQ ID NO: 264794 - protein, 20 aa, Mycobacterium
HGDGAEKSADLRSGFPDPNL

SEQ ID NO: 264795 - protein, 12 aa, Mycobacterium
HGDGPEVTGPGE

SEQ ID NO: 264796 - protein, 7 aa, Mycobacterium
HGDGTAR

SEQ ID NO: 264797 - protein, 57 aa, Mycobacterium
HGDHAPAGAAGGHHGTAAEAADGDHHGTGAEPEEGSDRGTSAEHADGHDGGRPESVI

SEQ ID NO: 264798 - protein, 10 aa, Mycobacterium
HGDHTPGPAT

SEQ ID NO: 264799 - protein, 6 aa, Mycobacterium
HGDPME

SEQ ID NO: 264800 - protein, 7 aa, Mycobacterium
HGDPPSA

SEQ ID NO: 264801 - protein, 10 aa, Mycobacterium
HGDQKRRGMA

SEQ ID NO: 264802 - protein, 10 aa, Mycobacterium
HGDQSGSGLA

SEQ ID NO: 264803 - protein, 5 aa, Mycobacterium
HGDSE

SEQ ID NO: 264804 - protein, 5 aa, Mycobacterium
HGDYP

SEQ ID NO: 264805 - protein, 10 aa, Mycobacterium
HGEAAGTSAA

SEQ ID NO: 264806 - protein, 5 aa, Mycobacterium
HGEAG

SEQ ID NO: 264807 - protein, 12 aa, Mycobacterium
HGEEPGESQNGK

SEQ ID NO: 264808 - protein, 8 aa, Mycobacterium
HGEHPGYE

SEQ ID NO: 264809 - protein, 8 aa, Mycobacterium
HGEPDSQR

SEQ ID NO: 264810 - protein, 8 aa, Mycobacterium
HGEPPTGR

SEQ ID NO: 264811 - protein, 6 aa, Mycobacterium
HGEPVN

SEQ ID NO: 264812 - protein, 15 aa, Mycobacterium
HGEPYRADGSALPGK

SEQ ID NO: 264813 - protein, 4 aa, Mycobacterium
HGGA

SEQ ID NO: 264814 - protein, 19 aa, Mycobacterium
HGGADGPNEPVADPPSIGA

SEQ ID NO: 264815 - protein, 26 aa, Mycobacterium
HGGATVATTQTGVSTPDPKAARVQTR

SEQ ID NO: 264816 - protein, 12 aa, Mycobacterium
HGGDESASITAE

SEQ ID NO: 264817 - protein, 18 aa, Mycobacterium
HGGDNGSTKQSAAVAPPV

SEQ ID NO: 264818 - protein, 8 aa, Mycobacterium
HGGDPGAH

SEQ ID NO: 264819 - protein, 4 aa, Mycobacterium
HGGE

SEQ ID NO: 264820 - protein, 4 aa, Mycobacterium
HGGG

SEQ ID NO: 264821 - protein, 6 aa, Mycobacterium
HGGGAP

SEQ ID NO: 264822 - protein, 11 aa, Mycobacterium
HGGGEASVTST

SEQ ID NO: 264823 - protein, 8 aa, Mycobacterium
HGGGRYPV

SEQ ID NO: 264824 - protein, 7 aa, Mycobacterium
HGGGTPS

SEQ ID NO: 264825 - protein, 4 aa, Mycobacterium
HGGI

SEQ ID NO: 264826 - protein, 6 aa, Mycobacterium
HGGPAL

SEQ ID NO: 264827 - protein, 6 aa, Mycobacterium
HGGPGG

SEQ ID NO: 264828 - protein, 23 aa, Mycobacterium
HGGSGPAPTLRQQTAGEPVGGAA

SEQ ID NO: 264829 - protein, 6 aa, Mycobacterium
HGGSIS

SEQ ID NO: 264830 - protein, 22 aa, Mycobacterium
HGGSLTASNLDTGARFEVRLPA

SEQ ID NO: 264831 - protein, 11 aa, Mycobacterium
HGGSRDGGTGL

SEQ ID NO: 264832 - protein, 26 aa, Mycobacterium
HGGSVTAASDGAGTGATFTVELPTTR

SEQ ID NO: 264833 - protein, 4 aa, Mycobacterium
HGGT

SEQ ID NO: 264834 - protein, 15 aa, Mycobacterium
HGGTISAQSGSGKTS

SEQ ID NO: 264835 - protein, 9 aa, Mycobacterium
HGHPDNGSH

SEQ ID NO: 264836 - protein, 7 aa, Mycobacterium
HGHPNAE

SEQ ID NO: 264837 - protein, 28 aa, Mycobacterium
HGHRPPSAAPAEPASAPPRPTSPDNTAR

SEQ ID NO: 264838 - protein, 6 aa, Mycobacterium
HGHRRD

SEQ ID NO: 264839 - protein, 9 aa, Mycobacterium
HGHTDRRDA

SEQ ID NO: 264840 - protein, 10 aa, Mycobacterium
HGHYTNATDA

SEQ ID NO: 264841 - protein, 8 aa, Mycobacterium
HGIDPSQY

SEQ ID NO: 264842 - protein, 10 aa, Mycobacterium
HGKPTSFGAA

SEQ ID NO: 264843 - protein, 10 aa, Mycobacterium
HGLGPDDEQV

SEQ ID NO: 264844 - protein, 7 aa, Mycobacterium
HGLPAAS

SEQ ID NO: 264845 - protein, 10 aa, Mycobacterium
HGLSQADEEV

SEQ ID NO: 264846 - protein, 14 aa, Mycobacterium
HGLTPGPSAVIPDT

SEQ ID NO: 264847 - protein, 5 aa, Mycobacterium
HGMPE

SEQ ID NO: 264848 - protein, 6 aa, Mycobacterium
HGMPTT

SEQ ID NO: 264849 - protein, 8 aa, Mycobacterium
HGNGGREL

SEQ ID NO: 264850 - protein, 8 aa, Mycobacterium
HGNPSAAQ

SEQ ID NO: 264851 - protein, 7 aa, Mycobacterium
HGNPSAE

SEQ ID NO: 264852 - protein, 8 aa, Mycobacterium
HGNPSAEQ

SEQ ID NO: 264853 - protein, 13 aa, Mycobacterium
HGNSGGPKTPEID

SEQ ID NO: 264854 - protein, 7 aa, Mycobacterium
HGPAAAA

SEQ ID NO: 264855 - protein, 12 aa, Mycobacterium
HGPAAPDPGATV

SEQ ID NO: 264856 - protein, 6 aa, Mycobacterium
HGPAGV

SEQ ID NO: 264857 - protein, 8 aa, Mycobacterium
HGPDSWQG

SEQ ID NO: 264858 - protein, 7 aa, Mycobacterium
HGPGAAV

SEQ ID NO: 264859 - protein, 10 aa, Mycobacterium
HGPGADPTRV

SEQ ID NO: 264860 - protein, 12 aa, Mycobacterium
HGPGAPIREGGH

SEQ ID NO: 264861 - protein, 6 aa, Mycobacterium
HGPGCT

SEQ ID NO: 264862 - protein, 9 aa, Mycobacterium
HGPGIPPAE

SEQ ID NO: 264863 - protein, 8 aa, Mycobacterium
HGPGIPPH

SEQ ID NO: 264864 - protein, 9 aa, Mycobacterium
HGPGIPPQE

SEQ ID NO: 264865 - protein, 9 aa, Mycobacterium
HGPGPAITD

SEQ ID NO: 264866 - protein, 20 aa, Mycobacterium
HGPHGEDEDGHDDVRAGGQV

SEQ ID NO: 264867 - protein, 6 aa, Mycobacterium
HGPHRD

SEQ ID NO: 264868 - protein, 9 aa, Mycobacterium
HGPIKTQSR

SEQ ID NO: 264869 - protein, 4 aa, Mycobacterium
HGPK

SEQ ID NO: 264870 - protein, 22 aa, Mycobacterium
HGPNDQFPDDTLDDSGLPITGG

SEQ ID NO: 264871 - protein, 4 aa, Mycobacterium
HGPQ

SEQ ID NO: 264872 - protein, 7 aa, Mycobacterium
HGPQGGL

SEQ ID NO: 264873 - protein, 5 aa, Mycobacterium
HGPRP

SEQ ID NO: 264874 - protein, 11 aa, Mycobacterium
HGPRRDDRAKV

SEQ ID NO: 264875 - protein, 6 aa, Mycobacterium
HGPRTN

SEQ ID NO: 264876 - protein, 4 aa, Mycobacterium
HGPS

SEQ ID NO: 264877 - protein, 6 aa, Mycobacterium
HGPSTY

SEQ ID NO: 264878 - protein, 4 aa, Mycobacterium
HGPT

SEQ ID NO: 264879 - protein, 6 aa, Mycobacterium
HGPTLR

SEQ ID NO: 264880 - protein, 6 aa, Mycobacterium
HGPYTG

SEQ ID NO: 264881 - protein, 12 aa, Mycobacterium
HGQNPTVKKGAT

SEQ ID NO: 264882 - protein, 5 aa, Mycobacterium
HGQPV

SEQ ID NO: 264883 - protein, 16 aa, Mycobacterium
HGQVPATDTKQAARTD

SEQ ID NO: 264884 - protein, 8 aa, Mycobacterium
HGRAKTAE

SEQ ID NO: 264885 - protein, 9 aa, Mycobacterium
HGRDGWPDD

SEQ ID NO: 264886 - protein, 23 aa, Mycobacterium
HGRGGPEPTPVDDDNTAPLATAR

SEQ ID NO: 264887 - protein, 10 aa, Mycobacterium
HGRHQQSGSC

SEQ ID NO: 264888 - protein, 7 aa, Mycobacterium
HGRKRTA

SEQ ID NO: 264889 - protein, 5 aa, Mycobacterium
HGRPF

SEQ ID NO: 264890 - protein, 12 aa, Mycobacterium
HGRPFRRRNPRP

SEQ ID NO: 264891 - protein, 7 aa, Mycobacterium
HGRPGSR

SEQ ID NO: 264892 - protein, 11 aa, Mycobacterium
HGRQATNDSEA

SEQ ID NO: 264893 - protein, 5 aa, Mycobacterium
HGRRK

SEQ ID NO: 264894 - protein, 8 aa, Mycobacterium
HGRTPSER

SEQ ID NO: 264895 - protein, 4 aa, Mycobacterium
HGRV

SEQ ID NO: 264896 - protein, 8 aa, Mycobacterium
HGSDPARV

SEQ ID NO: 264897 - protein, 5 aa, Mycobacterium
HGSGG

SEQ ID NO: 264898 - protein, 16 aa, Mycobacterium
HGSGLDPGSTAGVGQL

SEQ ID NO: 264899 - protein, 17 aa, Mycobacterium
HGSPAGAADAEGPHAGN

SEQ ID NO: 264900 - protein, 5 aa, Mycobacterium
HGSPL

SEQ ID NO: 264901 - protein, 41 aa, Mycobacterium
HGSPTQHQGTTGVEPSEATAPTGSFDEVDSSSQQAEPPRDG

SEQ ID NO: 264902 - protein, 6 aa, Mycobacterium
HGSRPT

SEQ ID NO: 264903 - protein, 47 aa, Mycobacterium
HGSSDSPSRRRNQDPRDANSHPGMANYPTGSAPRERLRASSSSNRYL

SEQ ID NO: 264904 - protein, 108 aa, Mycobacterium
HGSTGTPVTPKPGATTTPQPSPPPSPAQTTPAPAQQAPVQTSTAAPAAPPPTSTQPAPTTTEPPPTTSEPPATTTEPPPTTTPPTATATSPPAPPPPSSTDNPPTSVQ

SEQ ID NO: 264905 - protein, 4 aa, Mycobacterium
HGTA

SEQ ID NO: 264906 - protein, 9 aa, Mycobacterium
HGTDSVPAK

SEQ ID NO: 264907 - protein, 5 aa, Mycobacterium
HGTEA

SEQ ID NO: 264908 - protein, 14 aa, Mycobacterium
HGTEESRTPPAGKR

SEQ ID NO: 264909 - protein, 9 aa, Mycobacterium
HGTETTVAP

SEQ ID NO: 264910 - protein, 10 aa, Mycobacterium
HGTGAHMSGP

SEQ ID NO: 264911 - protein, 9 aa, Mycobacterium
HGTGDAQKT

SEQ ID NO: 264912 - protein, 5 aa, Mycobacterium
HGTGT

SEQ ID NO: 264913 - protein, 12 aa, Mycobacterium
HGTGTTLGDPIE

SEQ ID NO: 264914 - protein, 10 aa, Mycobacterium
HGTSDGQKTM

SEQ ID NO: 264915 - protein, 10 aa, Mycobacterium
HGVKTHDRKG

SEQ ID NO: 264916 - protein, 5 aa, Mycobacterium
HGYDE

SEQ ID NO: 264917 - protein, 7 aa, Mycobacterium
HHAEPRD

SEQ ID NO: 264918 - protein, 5 aa, Mycobacterium
HHAET

SEQ ID NO: 264919 - protein, 8 aa, Mycobacterium
HHAGRDES

SEQ ID NO: 264920 - protein, 7 aa, Mycobacterium
HHATGGE

SEQ ID NO: 264921 - protein, 4 aa, Mycobacterium
HHCE

SEQ ID NO: 264922 - protein, 20 aa, Mycobacterium
HHDAGAGHAEAGSHHAPSAP

SEQ ID NO: 264923 - protein, 7 aa, Mycobacterium
HHDERVT

SEQ ID NO: 264924 - protein, 6 aa, Mycobacterium
HHDGGI

SEQ ID NO: 264925 - protein, 16 aa, Mycobacterium
HHDNRGDHGGHAGHGA

SEQ ID NO: 264926 - protein, 8 aa, Mycobacterium
HHDPPGRR

SEQ ID NO: 264927 - protein, 7 aa, Mycobacterium
HHDTAEA

SEQ ID NO: 264928 - protein, 4 aa, Mycobacterium
HHEL

SEQ ID NO: 264929 - protein, 5 aa, Mycobacterium
HHEQT

SEQ ID NO: 264930 - protein, 4 aa, Mycobacterium
HHES

SEQ ID NO: 264931 - protein, 7 aa, Mycobacterium
HHESPSV

SEQ ID NO: 264932 - protein, 8 aa, Mycobacterium
HHGDRDTS

SEQ ID NO: 264933 - protein, 6 aa, Mycobacterium
HHGEAS

SEQ ID NO: 264934 - protein, 8 aa, Mycobacterium
HHNHPSAN

SEQ ID NO: 264935 - protein, 19 aa, Mycobacterium
HHNPLPATNNSHVSAGDYA

SEQ ID NO: 264936 - protein, 11 aa, Mycobacterium
HHNTTVAAPPH

SEQ ID NO: 264937 - protein, 4 aa, Mycobacterium
HHPD

SEQ ID NO: 264938 - protein, 9 aa, Mycobacterium
HHPPAGARA

SEQ ID NO: 264939 - protein, 4 aa, Mycobacterium
HHPT

SEQ ID NO: 264940 - protein, 25 aa, Mycobacterium
HHRAGQRYAGQRQAGRVRALEGQRY

SEQ ID NO: 264941 - protein, 11 aa, Mycobacterium
HHRGNESRRDR

SEQ ID NO: 264942 - protein, 6 aa, Mycobacterium
HHSEAA

SEQ ID NO: 264943 - protein, 15 aa, Mycobacterium
HHSEAADQIASYDDT

SEQ ID NO: 264944 - protein, 8 aa, Mycobacterium
HHSERDTS

SEQ ID NO: 264945 - protein, 8 aa, Mycobacterium
HHSPATHV

SEQ ID NO: 264946 - protein, 4 aa, Mycobacterium
HHSS

SEQ ID NO: 264947 - protein, 5 aa, Mycobacterium
HHSSE

SEQ ID NO: 264948 - protein, 13 aa, Mycobacterium
HHTASRPETPDTT

SEQ ID NO: 264949 - protein, 6 aa, Mycobacterium
HIAGPD

SEQ ID NO: 264950 - protein, 7 aa, Mycobacterium
HIDPDTP

SEQ ID NO: 264951 - protein, 5 aa, Mycobacterium
HIGST

SEQ ID NO: 264952 - protein, 21 aa, Mycobacterium
HIPGTAEAPRALSYHARPTAP

SEQ ID NO: 264953 - protein, 6 aa, Mycobacterium
HKAREA

SEQ ID NO: 264954 - protein, 6 aa, Mycobacterium
HKASEI

SEQ ID NO: 264955 - protein, 5 aa, Mycobacterium
HKERQ

SEQ ID NO: 264956 - protein, 8 aa, Mycobacterium
HKGPRTNF

SEQ ID NO: 264957 - protein, 16 aa, Mycobacterium
HKKPAATGAGDTVRVT

SEQ ID NO: 264958 - protein, 8 aa, Mycobacterium
HKLGDDAH

SEQ ID NO: 264959 - protein, 25 aa, Mycobacterium
HKPAAPQMIPPRGETPKPPKTGRRN

SEQ ID NO: 264960 - protein, 9 aa, Mycobacterium
HKPGDTEFP

SEQ ID NO: 264961 - protein, 6 aa, Mycobacterium
HKPGEH

SEQ ID NO: 264962 - protein, 9 aa, Mycobacterium
HKPKRTFAE

SEQ ID NO: 264963 - protein, 11 aa, Mycobacterium
HKQPEKVRQPL

SEQ ID NO: 264964 - protein, 9 aa, Mycobacterium
HKQTAASSN

SEQ ID NO: 264965 - protein, 18 aa, Mycobacterium
HKQTASSSNGWQSSEAGG

SEQ ID NO: 264966 - protein, 51 aa, Mycobacterium
HKRAPAKKIPAAKKVPETPDADTASTQEIAPAKVTPAQQVPDATESSAEQT

SEQ ID NO: 264967 - protein, 9 aa, Mycobacterium
HKRPNPIRS

SEQ ID NO: 264968 - protein, 8 aa, Mycobacterium
HLDGPTEA

SEQ ID NO: 264969 - protein, 9 aa, Mycobacterium
HLDSRTEEQ

SEQ ID NO: 264970 - protein, 15 aa, Mycobacterium
HLGGGPQLPMLPATW

SEQ ID NO: 264971 - protein, 6 aa, Mycobacterium
HLSATT

SEQ ID NO: 264972 - protein, 5 aa, Mycobacterium
HLSEQ

SEQ ID NO: 264973 - protein, 13 aa, Mycobacterium
HLSPETQRALAPA

SEQ ID NO: 264974 - protein, 13 aa, Mycobacterium
HLSPETQRAVAPA

SEQ ID NO: 264975 - protein, 13 aa, Mycobacterium
HLSPETRRALAPA

SEQ ID NO: 264976 - protein, 13 aa, Mycobacterium
HLSPNTQRTLGNA

SEQ ID NO: 264977 - protein, 13 aa, Mycobacterium
HLSPQTQRALAPA

SEQ ID NO: 264978 - protein, 19 aa, Mycobacterium
HLSSDRCPRSATAGKIGSR

SEQ ID NO: 264979 - protein, 5 aa, Mycobacterium
HLTPK

SEQ ID NO: 264980 - protein, 14 aa, Mycobacterium
HMGPQGAELAQTAR

SEQ ID NO: 264981 - protein, 4 aa, Mycobacterium
HMSN

SEQ ID NO: 264982 - protein, 8 aa, Mycobacterium
HMSPGAPG

SEQ ID NO: 264983 - protein, 7 aa, Mycobacterium
HNAEYTQ

SEQ ID NO: 264984 - protein, 31 aa, Mycobacterium
HNAQTLGNRPTTTAPTTAPKAPPASPADEVQ

SEQ ID NO: 264985 - protein, 9 aa, Mycobacterium
HNATETERR

SEQ ID NO: 264986 - protein, 6 aa, Mycobacterium
HNDSDL

SEQ ID NO: 264987 - protein, 4 aa, Mycobacterium
HNDT

SEQ ID NO: 264988 - protein, 16 aa, Mycobacterium
HNETDGRAEKPPKRHR

SEQ ID NO: 264989 - protein, 7 aa, Mycobacterium
HNGLGSD

SEQ ID NO: 264990 - protein, 8 aa, Mycobacterium
HNGPRTEF

SEQ ID NO: 264991 - protein, 6 aa, Mycobacterium
HNGQPT

SEQ ID NO: 264992 - protein, 5 aa, Mycobacterium
HNGTQ

SEQ ID NO: 264993 - protein, 26 aa, Mycobacterium
HNLAGGRPSAAKTGTVQLGDTTANKD

SEQ ID NO: 264994 - protein, 6 aa, Mycobacterium
HNLDST

SEQ ID NO: 264995 - protein, 14 aa, Mycobacterium
HNLPSSELGTDADV

SEQ ID NO: 264996 - protein, 4 aa, Mycobacterium
HNNC

SEQ ID NO: 264997 - protein, 4 aa, Mycobacterium
HNPA

SEQ ID NO: 264998 - protein, 7 aa, Mycobacterium
HNPAHTV

SEQ ID NO: 264999 - protein, 7 aa, Mycobacterium
HNPALPQ

SEQ ID NO: 265000 - protein, 7 aa, Mycobacterium
HNPRRDL

SEQ ID NO: 265001 - protein, 9 aa, Mycobacterium
HNPTGTLEP

SEQ ID NO: 265002 - protein, 10 aa, Mycobacterium
HNRDDGSPEV

SEQ ID NO: 265003 - protein, 9 aa, Mycobacterium
HNRPKLERY

SEQ ID NO: 265004 - protein, 10 aa, Mycobacterium
HNRTSRENHQ

SEQ ID NO: 265005 - protein, 11 aa, Mycobacterium
HNRTSRENRQI

SEQ ID NO: 265006 - protein, 6 aa, Mycobacterium
HNTDRG

SEQ ID NO: 265007 - protein, 9 aa, Mycobacterium
HNTGAPAPG

SEQ ID NO: 265008 - protein, 12 aa, Mycobacterium
HNTPSTITTYSD

SEQ ID NO: 265009 - protein, 19 aa, Mycobacterium
HNVPQEDVSCGGSKSEWPL

SEQ ID NO: 265010 - protein, 27 aa, Mycobacterium
HNWTSGRQERPASARPARSAETASQRI

SEQ ID NO: 265011 - protein, 24 aa, Mycobacterium
HPAANKPATAASPPGDLGKPPKTS

SEQ ID NO: 265012 - protein, 6 aa, Mycobacterium
HPADGT

SEQ ID NO: 265013 - protein, 6 aa, Mycobacterium
HPADRT

SEQ ID NO: 265014 - protein, 9 aa, Mycobacterium
HPAGDGHRD

SEQ ID NO: 265015 - protein, 14 aa, Mycobacterium
HPAGESQPAGVGGV

SEQ ID NO: 265016 - protein, 5 aa, Mycobacterium
HPAKV

SEQ ID NO: 265017 - protein, 20 aa, Mycobacterium
HPALSPEPVSSGIQVSSGDR

SEQ ID NO: 265018 - protein, 12 aa, Mycobacterium
HPANGEKPETSE

SEQ ID NO: 265019 - protein, 6 aa, Mycobacterium
HPAPER

SEQ ID NO: 265020 - protein, 30 aa, Mycobacterium
HPAPGPGWSAAPPTSPPPPPPAAGGGFTPP

SEQ ID NO: 265021 - protein, 9 aa, Mycobacterium
HPAPGYSRE

SEQ ID NO: 265022 - protein, 20 aa, Mycobacterium
HPAPKSVNPTPAPPQTSQTV

SEQ ID NO: 265023 - protein, 15 aa, Mycobacterium
HPAPPPEGTEPILTS

SEQ ID NO: 265024 - protein, 13 aa, Mycobacterium
HPAPPPTGPILIS

SEQ ID NO: 265025 - protein, 5 aa, Mycobacterium
HPAPV

SEQ ID NO: 265026 - protein, 11 aa, Mycobacterium
HPARASAEAHG

SEQ ID NO: 265027 - protein, 13 aa, Mycobacterium
HPARPGPEGAGIQ

SEQ ID NO: 265028 - protein, 9 aa, Mycobacterium
HPDAAGTAA

SEQ ID NO: 265029 - protein, 4 aa, Mycobacterium
HPDD

SEQ ID NO: 265030 - protein, 6 aa, Mycobacterium
HPDDID

SEQ ID NO: 265031 - protein, 6 aa, Mycobacterium
HPDDVD

SEQ ID NO: 265032 - protein, 5 aa, Mycobacterium
HPDGD

SEQ ID NO: 265033 - protein, 6 aa, Mycobacterium
HPDGDG

SEQ ID NO: 265034 - protein, 4 aa, Mycobacterium
HPDH

SEQ ID NO: 265035 - protein, 6 aa, Mycobacterium
HPDKTA

SEQ ID NO: 265036 - protein, 4 aa, Mycobacterium
HPDL

SEQ ID NO: 265037 - protein, 5 aa, Mycobacterium
HPDNE

SEQ ID NO: 265038 - protein, 13 aa, Mycobacterium
HPDPAAMDPEQPF

SEQ ID NO: 265039 - protein, 6 aa, Mycobacterium
HPDPDT

SEQ ID NO: 265040 - protein, 17 aa, Mycobacterium
HPDSVAPRTARKTDSRL

SEQ ID NO: 265041 - protein, 18 aa, Mycobacterium
HPDSYEAPAASAVSPDGV

SEQ ID NO: 265042 - protein, 5 aa, Mycobacterium
HPDVS

SEQ ID NO: 265043 - protein, 16 aa, Mycobacterium
HPDWEPDETPPHTAGK

SEQ ID NO: 265044 - protein, 10 aa, Mycobacterium
HPEAPSPASA

SEQ ID NO: 265045 - protein, 9 aa, Mycobacterium
HPEAPSPVS

SEQ ID NO: 265046 - protein, 7 aa, Mycobacterium
HPEAQGS

SEQ ID NO: 265047 - protein, 13 aa, Mycobacterium
HPEARADNGNTEY

SEQ ID NO: 265048 - protein, 9 aa, Mycobacterium
HPEDRDKLQ

SEQ ID NO: 265049 - protein, 8 aa, Mycobacterium
HPEGLGPN

SEQ ID NO: 265050 - protein, 9 aa, Mycobacterium
HPEGLSGGA

SEQ ID NO: 265051 - protein, 12 aa, Mycobacterium
HPEHPERPEPIA

SEQ ID NO: 265052 - protein, 6 aa, Mycobacterium
HPENDR

SEQ ID NO: 265053 - protein, 4 aa, Mycobacterium
HPEP

SEQ ID NO: 265054 - protein, 6 aa, Mycobacterium
HPEPAA

SEQ ID NO: 265055 - protein, 8 aa, Mycobacterium
HPEPAQEV

SEQ ID NO: 265056 - protein, 18 aa, Mycobacterium
HPEPVPGPPPADPTSAIA

SEQ ID NO: 265057 - protein, 7 aa, Mycobacterium
HPERPSS

SEQ ID NO: 265058 - protein, 5 aa, Mycobacterium
HPERS

SEQ ID NO: 265059 - protein, 5 aa, Mycobacterium
HPERY

SEQ ID NO: 265060 - protein, 4 aa, Mycobacterium
HPET

SEQ ID NO: 265061 - protein, 5 aa, Mycobacterium
HPETS

SEQ ID NO: 265062 - protein, 6 aa, Mycobacterium
HPFENP

SEQ ID NO: 265063 - protein, 8 aa, Mycobacterium
HPFENPTP

SEQ ID NO: 265064 - protein, 6 aa, Mycobacterium
HPFPGD

SEQ ID NO: 265065 - protein, 24 aa, Mycobacterium
HPGAELPAATRAVDTTPQTRLTPE

SEQ ID NO: 265066 - protein, 8 aa, Mycobacterium
HPGARGGK

SEQ ID NO: 265067 - protein, 12 aa, Mycobacterium
HPGDAKPASTQS

SEQ ID NO: 265068 - protein, 9 aa, Mycobacterium
HPGDGDESL

SEQ ID NO: 265069 - protein, 7 aa, Mycobacterium
HPGKTAP

SEQ ID NO: 265070 - protein, 7 aa, Mycobacterium
HPGKTSP

SEQ ID NO: 265071 - protein, 6 aa, Mycobacterium
HPGLES

SEQ ID NO: 265072 - protein, 7 aa, Mycobacterium
HPGPGFS

SEQ ID NO: 265073 - protein, 11 aa, Mycobacterium
HPGPQPPPTRM

SEQ ID NO: 265074 - protein, 6 aa, Mycobacterium
HPGRQL

SEQ ID NO: 265075 - protein, 6 aa, Mycobacterium
HPGSLG

SEQ ID NO: 265076 - protein, 7 aa, Mycobacterium
HPGTDDQ

SEQ ID NO: 265077 - protein, 8 aa, Mycobacterium
HPGTPTNF

SEQ ID NO: 265078 - protein, 5 aa, Mycobacterium
HPGVA

SEQ ID NO: 265079 - protein, 5 aa, Mycobacterium
HPGVS

SEQ ID NO: 265080 - protein, 7 aa, Mycobacterium
HPHASPV

SEQ ID NO: 265081 - protein, 5 aa, Mycobacterium
HPHPP

SEQ ID NO: 265082 - protein, 4 aa, Mycobacterium
HPHR

SEQ ID NO: 265083 - protein, 5 aa, Mycobacterium
HPHRR

SEQ ID NO: 265084 - protein, 6 aa, Mycobacterium
HPHRRS

SEQ ID NO: 265085 - protein, 5 aa, Mycobacterium
HPHSD

SEQ ID NO: 265086 - protein, 5 aa, Mycobacterium
HPHTA

SEQ ID NO: 265087 - protein, 42 aa, Mycobacterium
HPKLSPQSPAPGPDDPVPPAPPGPPEPPPPPAPAADGFSGVA

SEQ ID NO: 265088 - protein, 5 aa, Mycobacterium
HPLGD

SEQ ID NO: 265089 - protein, 10 aa, Mycobacterium
HPLPSSDEAA

SEQ ID NO: 265090 - protein, 16 aa, Mycobacterium
HPLTGEPLSDKSKTVA

SEQ ID NO: 265091 - protein, 11 aa, Mycobacterium
HPNLQDPNPPL

SEQ ID NO: 265092 - protein, 6 aa, Mycobacterium
HPNPPA

SEQ ID NO: 265093 - protein, 7 aa, Mycobacterium
HPNRASS

SEQ ID NO: 265094 - protein, 6 aa, Mycobacterium
HPPAAF

SEQ ID NO: 265095 - protein, 11 aa, Mycobacterium
HPPAAKGTDMT

SEQ ID NO: 265096 - protein, 16 aa, Mycobacterium
HPPATGPAAGSPGHSD

SEQ ID NO: 265097 - protein, 4 aa, Mycobacterium
HPPD

SEQ ID NO: 265098 - protein, 4 aa, Mycobacterium
HPPI

SEQ ID NO: 265099 - protein, 18 aa, Mycobacterium
HPPLPAGAAAAGSGSHSD

SEQ ID NO: 265100 - protein, 4 aa, Mycobacterium
HPPM

SEQ ID NO: 265101 - protein, 6 aa, Mycobacterium
HPPPRL

SEQ ID NO: 265102 - protein, 5 aa, Mycobacterium
HPPPW

SEQ ID NO: 265103 - protein, 4 aa, Mycobacterium
HPPS

SEQ ID NO: 265104 - protein, 6 aa, Mycobacterium
HPPSAR

SEQ ID NO: 265105 - protein, 6 aa, Mycobacterium
HPPTKA

SEQ ID NO: 265106 - protein, 9 aa, Mycobacterium
HPPTKAQRE

SEQ ID NO: 265107 - protein, 5 aa, Mycobacterium
HPPTL

SEQ ID NO: 265108 - protein, 17 aa, Mycobacterium
HPQGETREEIQANQAAA

SEQ ID NO: 265109 - protein, 17 aa, Mycobacterium
HPQPGPDGRVQQPERAE

SEQ ID NO: 265110 - protein, 23 aa, Mycobacterium
HPQTADSAGGYPYPGWEQSGDTV

SEQ ID NO: 265111 - protein, 5 aa, Mycobacterium
HPRER

SEQ ID NO: 265112 - protein, 5 aa, Mycobacterium
HPRES

SEQ ID NO: 265113 - protein, 7 aa, Mycobacterium
HPRESRG

SEQ ID NO: 265114 - protein, 10 aa, Mycobacterium
HPRKPERLSR

SEQ ID NO: 265115 - protein, 4 aa, Mycobacterium
HPRL

SEQ ID NO: 265116 - protein, 7 aa, Mycobacterium
HPRPADL

SEQ ID NO: 265117 - protein, 11 aa, Mycobacterium
HPRPLSGPSHR

SEQ ID NO: 265118 - protein, 11 aa, Mycobacterium
HPRPVGGPGYR

SEQ ID NO: 265119 - protein, 5 aa, Mycobacterium
HPRRH

SEQ ID NO: 265120 - protein, 6 aa, Mycobacterium
HPRTAA

SEQ ID NO: 265121 - protein, 10 aa, Mycobacterium
HPSHGSPSVS

SEQ ID NO: 265122 - protein, 23 aa, Mycobacterium
HPSPRREPTAGRPAEQPRSPSRP

SEQ ID NO: 265123 - protein, 6 aa, Mycobacterium
HPSQRP

SEQ ID NO: 265124 - protein, 5 aa, Mycobacterium
HPSSA

SEQ ID NO: 265125 - protein, 17 aa, Mycobacterium
HPSTEPLASRSPTAPSH

SEQ ID NO: 265126 - protein, 4 aa, Mycobacterium
HPSV

SEQ ID NO: 265127 - protein, 8 aa, Mycobacterium
HPSYAERD

SEQ ID NO: 265128 - protein, 5 aa, Mycobacterium
HPTAL

SEQ ID NO: 265129 - protein, 11 aa, Mycobacterium
HPTAVNPDRAL

SEQ ID NO: 265130 - protein, 16 aa, Mycobacterium
HPTAVNPDRALRKESM

SEQ ID NO: 265131 - protein, 10 aa, Mycobacterium
HPTERSPHIS

SEQ ID NO: 265132 - protein, 11 aa, Mycobacterium
HPTPPEKGDSV

SEQ ID NO: 265133 - protein, 4 aa, Mycobacterium
HPTR

SEQ ID NO: 265134 - protein, 12 aa, Mycobacterium
HPTTPFVAVDYD

SEQ ID NO: 265135 - protein, 5 aa, Mycobacterium
HPVRG

SEQ ID NO: 265136 - protein, 5 aa, Mycobacterium
HPVTA

SEQ ID NO: 265137 - protein, 12 aa, Mycobacterium
HPVTGEPFSDKS

SEQ ID NO: 265138 - protein, 6 aa, Mycobacterium
HQAAGT

SEQ ID NO: 265139 - protein, 22 aa, Mycobacterium
HQAAQDELNKPIYSKGSATEQI

SEQ ID NO: 265140 - protein, 6 aa, Mycobacterium
HQAAQH

SEQ ID NO: 265141 - protein, 7 aa, Mycobacterium
HQAAQRE

SEQ ID NO: 265142 - protein, 7 aa, Mycobacterium
HQADQQR

SEQ ID NO: 265143 - protein, 9 aa, Mycobacterium
HQADQTTAY

SEQ ID NO: 265144 - protein, 9 aa, Mycobacterium
HQANQANAY

SEQ ID NO: 265145 - protein, 22 aa, Mycobacterium
HQAPRRPSLGSGSRPRSNEDDD

SEQ ID NO: 265146 - protein, 19 aa, Mycobacterium
HQAPSDHGPVLEPACEPLG

SEQ ID NO: 265147 - protein, 31 aa, Mycobacterium
HQAQHKARQSKHERTGAAAEAESPTESPSEE

SEQ ID NO: 265148 - protein, 40 aa, Mycobacterium
HQAQHKARRGKRAEPAATESTPAATESTPDVAEPESSSEQ

SEQ ID NO: 265149 - protein, 26 aa, Mycobacterium
HQAQHQARERARAGAVEGTSENPSEQ

SEQ ID NO: 265150 - protein, 4 aa, Mycobacterium
HQAS

SEQ ID NO: 265151 - protein, 5 aa, Mycobacterium
HQATG

SEQ ID NO: 265152 - protein, 6 aa, Mycobacterium
HQDDQG

SEQ ID NO: 265153 - protein, 11 aa, Mycobacterium
HQDSAAPQEQW

SEQ ID NO: 265154 - protein, 20 aa, Mycobacterium
HQDSLNGSTNGSSNGSTNGE

SEQ ID NO: 265155 - protein, 10 aa, Mycobacterium
HQDSTSDDQW

SEQ ID NO: 265156 - protein, 23 aa, Mycobacterium
HQERSSAPNGSSDGASNGSSNGH

SEQ ID NO: 265157 - protein, 10 aa, Mycobacterium
HQGNPASVQG

SEQ ID NO: 265158 - protein, 74 aa, Mycobacterium
HQGSAGTPPSTTAVPVPGRTSATWPAQHSGPTGRPPVQRPPTGPYPGAGAYPPGGPRPVPAPPPPAAQSRPAHV

SEQ ID NO: 265159 - protein, 11 aa, Mycobacterium
HQGTAGRPPLT

SEQ ID NO: 265160 - protein, 6 aa, Mycobacterium
HQGVDT

SEQ ID NO: 265161 - protein, 21 aa, Mycobacterium
HQIETGSQGVAGNLASAGHGA

SEQ ID NO: 265162 - protein, 6 aa, Mycobacterium
HQPAQL

SEQ ID NO: 265163 - protein, 4 aa, Mycobacterium
HQPE

SEQ ID NO: 265164 - protein, 6 aa, Mycobacterium
HQPGPG

SEQ ID NO: 265165 - protein, 4 aa, Mycobacterium
HQPL

SEQ ID NO: 265166 - protein, 6 aa, Mycobacterium
HQPPVH

SEQ ID NO: 265167 - protein, 15 aa, Mycobacterium
HQPSPPAASRPVRPL

SEQ ID NO: 265168 - protein, 6 aa, Mycobacterium
HQPTEG

SEQ ID NO: 265169 - protein, 6 aa, Mycobacterium
HQPTGG

SEQ ID NO: 265170 - protein, 9 aa, Mycobacterium
HQQPDGSVR

SEQ ID NO: 265171 - protein, 7 aa, Mycobacterium
HQQQRAA

SEQ ID NO: 265172 - protein, 9 aa, Mycobacterium
HQQTAATAY

SEQ ID NO: 265173 - protein, 5 aa, Mycobacterium
HQRPD

SEQ ID NO: 265174 - protein, 4 aa, Mycobacterium
HQSD

SEQ ID NO: 265175 - protein, 8 aa, Mycobacterium
HQSEKGIE

SEQ ID NO: 265176 - protein, 17 aa, Mycobacterium
HQSEPDRSDSVPPRTAV

SEQ ID NO: 265177 - protein, 8 aa, Mycobacterium
HQSRSASP

SEQ ID NO: 265178 - protein, 14 aa, Mycobacterium
HQTAAPEKEPAATP

SEQ ID NO: 265179 - protein, 27 aa, Mycobacterium
HQTAGAPHSASTPTNPAPAAANTGPFT

SEQ ID NO: 265180 - protein, 10 aa, Mycobacterium
HQTDTDAAGP

SEQ ID NO: 265181 - protein, 13 aa, Mycobacterium
HQTENSHDTNLRD

SEQ ID NO: 265182 - protein, 11 aa, Mycobacterium
HQTRSSTTQTG

SEQ ID NO: 265183 - protein, 4 aa, Mycobacterium
HQVT

SEQ ID NO: 265184 - protein, 4 aa, Mycobacterium
HRAA

SEQ ID NO: 265185 - protein, 14 aa, Mycobacterium
HRAADGSPGSSAAP

SEQ ID NO: 265186 - protein, 21 aa, Mycobacterium
HRAAQDELNKPIYSKGSSADQ

SEQ ID NO: 265187 - protein, 26 aa, Mycobacterium
HRADPDALVGGSDATARDAAAAAGHD

SEQ ID NO: 265188 - protein, 6 aa, Mycobacterium
HRAEGG

SEQ ID NO: 265189 - protein, 5 aa, Mycobacterium
HRAET

SEQ ID NO: 265190 - protein, 4 aa, Mycobacterium
HRAH

SEQ ID NO: 265191 - protein, 8 aa, Mycobacterium
HRAHPSAN

SEQ ID NO: 265192 - protein, 6 aa, Mycobacterium
HRAPRR

SEQ ID NO: 265193 - protein, 5 aa, Mycobacterium
HRAPY

SEQ ID NO: 265194 - protein, 4 aa, Mycobacterium
HRAR

SEQ ID NO: 265195 - protein, 13 aa, Mycobacterium
HRARDRAADALRT

SEQ ID NO: 265196 - protein, 12 aa, Mycobacterium
HRDADAEQARER

SEQ ID NO: 265197 - protein, 6 aa, Mycobacterium
HRDDLS

SEQ ID NO: 265198 - protein, 8 aa, Mycobacterium
HRDGGQAQ

SEQ ID NO: 265199 - protein, 5 aa, Mycobacterium
HRDGQ

SEQ ID NO: 265200 - protein, 10 aa, Mycobacterium
HRDGRPSTVP

SEQ ID NO: 265201 - protein, 6 aa, Mycobacterium
HRDKPA

SEQ ID NO: 265202 - protein, 6 aa, Mycobacterium
HRDNPS

SEQ ID NO: 265203 - protein, 10 aa, Mycobacterium
HRDPDPGPWD

SEQ ID NO: 265204 - protein, 5 aa, Mycobacterium
HRDPE

SEQ ID NO: 265205 - protein, 9 aa, Mycobacterium
HREAAAGKF

SEQ ID NO: 265206 - protein, 5 aa, Mycobacterium
HREAT

SEQ ID NO: 265207 - protein, 15 aa, Mycobacterium
HREESARHQSTGERA

SEQ ID NO: 265208 - protein, 14 aa, Mycobacterium
HRESPPGDPSPIRR

SEQ ID NO: 265209 - protein, 5 aa, Mycobacterium
HRETT

SEQ ID NO: 265210 - protein, 6 aa, Mycobacterium
HRETTA

SEQ ID NO: 265211 - protein, 4 aa, Mycobacterium
HRGA

SEQ ID NO: 265212 - protein, 5 aa, Mycobacterium
HRGAE

SEQ ID NO: 265213 - protein, 12 aa, Mycobacterium
HRGDAPLPPTAT

SEQ ID NO: 265214 - protein, 12 aa, Mycobacterium
HRGHQDPRSAAS

SEQ ID NO: 265215 - protein, 4 aa, Mycobacterium
HRGP

SEQ ID NO: 265216 - protein, 4 aa, Mycobacterium
HRGR

SEQ ID NO: 265217 - protein, 6 aa, Mycobacterium
HRGRAV

SEQ ID NO: 265218 - protein, 8 aa, Mycobacterium
HRGTAAAL

SEQ ID NO: 265219 - protein, 6 aa, Mycobacterium
HRHDRP

SEQ ID NO: 265220 - protein, 8 aa, Mycobacterium
HRKEKHRR

SEQ ID NO: 265221 - protein, 5 aa, Mycobacterium
HRKSP

SEQ ID NO: 265222 - protein, 5 aa, Mycobacterium
HRLPG

SEQ ID NO: 265223 - protein, 5 aa, Mycobacterium
HRNAD

SEQ ID NO: 265224 - protein, 14 aa, Mycobacterium
HRNDAPPKPSGFDP

SEQ ID NO: 265225 - protein, 23 aa, Mycobacterium
HRNGSDPGSQQGVPDSDTSPHLA

SEQ ID NO: 265226 - protein, 5 aa, Mycobacterium
HRNGT

SEQ ID NO: 265227 - protein, 17 aa, Mycobacterium
HRNTEPARVPDEAVAEP

SEQ ID NO: 265228 - protein, 24 aa, Mycobacterium
HRPALETERTAGRVTSSRIDTEDD

SEQ ID NO: 265229 - protein, 4 aa, Mycobacterium
HRPC

SEQ ID NO: 265230 - protein, 7 aa, Mycobacterium
HRPDATT

SEQ ID NO: 265231 - protein, 9 aa, Mycobacterium
HRPGDGRSV

SEQ ID NO: 265232 - protein, 5 aa, Mycobacterium
HRPGF

SEQ ID NO: 265233 - protein, 6 aa, Mycobacterium
HRPGQV

SEQ ID NO: 265234 - protein, 16 aa, Mycobacterium
HRPIAPADNAANSKRK

SEQ ID NO: 265235 - protein, 5 aa, Mycobacterium
HRPPP

SEQ ID NO: 265236 - protein, 5 aa, Mycobacterium
HRPPV

SEQ ID NO: 265237 - protein, 6 aa, Mycobacterium
HRPPVA

SEQ ID NO: 265238 - protein, 7 aa, Mycobacterium
HRPPVAE

SEQ ID NO: 265239 - protein, 11 aa, Mycobacterium
HRPRRPSRSLR

SEQ ID NO: 265240 - protein, 17 aa, Mycobacterium
HRPSEVGVPGENPNLTE

SEQ ID NO: 265241 - protein, 6 aa, Mycobacterium
HRPSGT

SEQ ID NO: 265242 - protein, 5 aa, Mycobacterium
HRPSR

SEQ ID NO: 265243 - protein, 4 aa, Mycobacterium
HRPT

SEQ ID NO: 265244 - protein, 6 aa, Mycobacterium
HRPTGT

SEQ ID NO: 265245 - protein, 4 aa, Mycobacterium
HRPY

SEQ ID NO: 265246 - protein, 6 aa, Mycobacterium
HRQGAG

SEQ ID NO: 265247 - protein, 6 aa, Mycobacterium
HRQPDP

SEQ ID NO: 265248 - protein, 14 aa, Mycobacterium
HRQPPPAPSEPAVG

SEQ ID NO: 265249 - protein, 14 aa, Mycobacterium
HRQQRTDADRSRQF

SEQ ID NO: 265250 - protein, 23 aa, Mycobacterium
HRQTAAPDGRRGPDRPAGAGRRA

SEQ ID NO: 265251 - protein, 9 aa, Mycobacterium
HRRAGRGTD

SEQ ID NO: 265252 - protein, 5 aa, Mycobacterium
HRRAL

SEQ ID NO: 265253 - protein, 4 aa, Mycobacterium
HRRG

SEQ ID NO: 265254 - protein, 30 aa, Mycobacterium
HRRKNAAEHPGSEPGSSLGGQDTSPPSDRR

SEQ ID NO: 265255 - protein, 11 aa, Mycobacterium
HRRPAPSPIRP

SEQ ID NO: 265256 - protein, 8 aa, Mycobacterium
HRRPITPA

SEQ ID NO: 265257 - protein, 20 aa, Mycobacterium
HRRPPPAPPVPNAEPSPWRP

SEQ ID NO: 265258 - protein, 23 aa, Mycobacterium
HRRRSASSGSPEVGHSKVLSVKV

SEQ ID NO: 265259 - protein, 11 aa, Mycobacterium
HRRRTAEAAAL

SEQ ID NO: 265260 - protein, 17 aa, Mycobacterium
HRRSQAATEPVAQTAEI

SEQ ID NO: 265261 - protein, 6 aa, Mycobacterium
HRSRPQ

SEQ ID NO: 265262 - protein, 7 aa, Mycobacterium
HRSRQAK

SEQ ID NO: 265263 - protein, 17 aa, Mycobacterium
HRSTPDIASEPAVGSTV

SEQ ID NO: 265264 - protein, 6 aa, Mycobacterium
HRSTVE

SEQ ID NO: 265265 - protein, 13 aa, Mycobacterium
HRTAGRSPAPAPA

SEQ ID NO: 265266 - protein, 4 aa, Mycobacterium
HRTD

SEQ ID NO: 265267 - protein, 26 aa, Mycobacterium
HRTDADTARGDAAVPVPGRSQADSGL

SEQ ID NO: 265268 - protein, 18 aa, Mycobacterium
HRTDETGDTTQERVPQPS

SEQ ID NO: 265269 - protein, 13 aa, Mycobacterium
HRTGGESAADAAT

SEQ ID NO: 265270 - protein, 6 aa, Mycobacterium
HRTNYA

SEQ ID NO: 265271 - protein, 5 aa, Mycobacterium
HRTQS

SEQ ID NO: 265272 - protein, 13 aa, Mycobacterium
HRTRDGEPAGIGG

SEQ ID NO: 265273 - protein, 4 aa, Mycobacterium
HRTS

SEQ ID NO: 265274 - protein, 10 aa, Mycobacterium
HRVGQPKTRC

SEQ ID NO: 265275 - protein, 13 aa, Mycobacterium
HRVNGKPPASTEY

SEQ ID NO: 265276 - protein, 18 aa, Mycobacterium
HSAGAESLPTGSAGAAYK

SEQ ID NO: 265277 - protein, 10 aa, Mycobacterium
HSAGHAAGTT

SEQ ID NO: 265278 - protein, 8 aa, Mycobacterium
HSANGTYV

SEQ ID NO: 265279 - protein, 12 aa, Mycobacterium
HSANRPKRNPVP

SEQ ID NO: 265280 - protein, 20 aa, Mycobacterium
HSAPESEPLPAPADAAPDIA

SEQ ID NO: 265281 - protein, 11 aa, Mycobacterium
HSAPMTPLDAP

SEQ ID NO: 265282 - protein, 14 aa, Mycobacterium
HSAQRRGDSWPGAY

SEQ ID NO: 265283 - protein, 8 aa, Mycobacterium
HSAQVESI

SEQ ID NO: 265284 - protein, 15 aa, Mycobacterium
HSARNQCATARTELQ

SEQ ID NO: 265285 - protein, 7 aa, Mycobacterium
HSATPRD

SEQ ID NO: 265286 - protein, 25 aa, Mycobacterium
HSAYPTGVASPQLPPATPWAPSQMS

SEQ ID NO: 265287 - protein, 4 aa, Mycobacterium
HSDD

SEQ ID NO: 265288 - protein, 27 aa, Mycobacterium
HSDGTAPDRIGPVGDGADDDAAPRLPE

SEQ ID NO: 265289 - protein, 29 aa, Mycobacterium
HSDQPDQPDESDQPDASQDVRDDDRTSAI

SEQ ID NO: 265290 - protein, 14 aa, Mycobacterium
HSDRAAEAAPSRAT

SEQ ID NO: 265291 - protein, 9 aa, Mycobacterium
HSDRDDVGR

SEQ ID NO: 265292 - protein, 6 aa, Mycobacterium
HSDTDV

SEQ ID NO: 265293 - protein, 5 aa, Mycobacterium
HSDTE

SEQ ID NO: 265294 - protein, 9 aa, Mycobacterium
HSEAAGTAA

SEQ ID NO: 265295 - protein, 47 aa, Mycobacterium
HSEAEPGAAGDAPSSGQVSAVSATGSGDHAPAPTDLSQMTASSVPCV

SEQ ID NO: 265296 - protein, 6 aa, Mycobacterium
HSEHKP

SEQ ID NO: 265297 - protein, 4 aa, Mycobacterium
HSEK

SEQ ID NO: 265298 - protein, 5 aa, Mycobacterium
HSGDK

SEQ ID NO: 265299 - protein, 6 aa, Mycobacterium
HSGDPV

SEQ ID NO: 265300 - protein, 6 aa, Mycobacterium
HSGDRS

SEQ ID NO: 265301 - protein, 8 aa, Mycobacterium
HSGEERAT

SEQ ID NO: 265302 - protein, 6 aa, Mycobacterium
HSGPAT

SEQ ID NO: 265303 - protein, 10 aa, Mycobacterium
HSGPESADLD

SEQ ID NO: 265304 - protein, 7 aa, Mycobacterium
HSGQSLA

SEQ ID NO: 265305 - protein, 6 aa, Mycobacterium
HSGRED

SEQ ID NO: 265306 - protein, 7 aa, Mycobacterium
HSGSEPL

SEQ ID NO: 265307 - protein, 6 aa, Mycobacterium
HSGSGG

SEQ ID NO: 265308 - protein, 10 aa, Mycobacterium
HSGSGTNPLN

SEQ ID NO: 265309 - protein, 7 aa, Mycobacterium
HSGTETP

SEQ ID NO: 265310 - protein, 6 aa, Mycobacterium
HSGYTR

SEQ ID NO: 265311 - protein, 22 aa, Mycobacterium
HSHDAADSIDDALSASAAGTRA

SEQ ID NO: 265312 - protein, 13 aa, Mycobacterium
HSHGHGVNADADR

SEQ ID NO: 265313 - protein, 9 aa, Mycobacterium
HSHTDPLTG

SEQ ID NO: 265314 - protein, 8 aa, Mycobacterium
HSIPGRTE

SEQ ID NO: 265315 - protein, 10 aa, Mycobacterium
HSLEEKNEEL

SEQ ID NO: 265316 - protein, 4 aa, Mycobacterium
HSLG

SEQ ID NO: 265317 - protein, 16 aa, Mycobacterium
HSNDDEQDPDTFASHG

SEQ ID NO: 265318 - protein, 16 aa, Mycobacterium
HSNDDVEDPDTFASHG

SEQ ID NO: 265319 - protein, 8 aa, Mycobacterium
HSNGGQQM

SEQ ID NO: 265320 - protein, 8 aa, Mycobacterium
HSNNSEEK

SEQ ID NO: 265321 - protein, 8 aa, Mycobacterium
HSNRTRRG

SEQ ID NO: 265322 - protein, 4 aa, Mycobacterium
HSPA

SEQ ID NO: 265323 - protein, 7 aa, Mycobacterium
HSPAAAT

SEQ ID NO: 265324 - protein, 7 aa, Mycobacterium
HSPAKER

SEQ ID NO: 265325 - protein, 4 aa, Mycobacterium
HSPD

SEQ ID NO: 265326 - protein, 5 aa, Mycobacterium
HSPDA

SEQ ID NO: 265327 - protein, 6 aa, Mycobacterium
HSPDDE

SEQ ID NO: 265328 - protein, 12 aa, Mycobacterium
HSPDDRRGRYGA

SEQ ID NO: 265329 - protein, 7 aa, Mycobacterium
HSPDSQR

SEQ ID NO: 265330 - protein, 4 aa, Mycobacterium
HSPG

SEQ ID NO: 265331 - protein, 7 aa, Mycobacterium
HSPGPGG

SEQ ID NO: 265332 - protein, 7 aa, Mycobacterium
HSPNASR

SEQ ID NO: 265333 - protein, 8 aa, Mycobacterium
HSPNPSRG

SEQ ID NO: 265334 - protein, 4 aa, Mycobacterium
HSPP

SEQ ID NO: 265335 - protein, 6 aa, Mycobacterium
HSPPGW

SEQ ID NO: 265336 - protein, 4 aa, Mycobacterium
HSPR

SEQ ID NO: 265337 - protein, 7 aa, Mycobacterium
HSPRNRR

SEQ ID NO: 265338 - protein, 7 aa, Mycobacterium
HSPRTTR

SEQ ID NO: 265339 - protein, 25 aa, Mycobacterium
HSPSGSAIAEEAAPTPRTPDPRSAL

SEQ ID NO: 265340 - protein, 16 aa, Mycobacterium
HSPSHGAGPANIKPDY

SEQ ID NO: 265341 - protein, 5 aa, Mycobacterium
HSPTG

SEQ ID NO: 265342 - protein, 18 aa, Mycobacterium
HSQDADEMPDPEGRTRRA

SEQ ID NO: 265343 - protein, 5 aa, Mycobacterium
HSQGE

SEQ ID NO: 265344 - protein, 6 aa, Mycobacterium
HSQGEI

SEQ ID NO: 265345 - protein, 9 aa, Mycobacterium
HSQGPGPAH

SEQ ID NO: 265346 - protein, 7 aa, Mycobacterium
HSQGSLA

SEQ ID NO: 265347 - protein, 7 aa, Mycobacterium
HSQTAIG

SEQ ID NO: 265348 - protein, 8 aa, Mycobacterium
HSRAHATR

SEQ ID NO: 265349 - protein, 6 aa, Mycobacterium
HSRARS

SEQ ID NO: 265350 - protein, 8 aa, Mycobacterium
HSRGAGQT

SEQ ID NO: 265351 - protein, 13 aa, Mycobacterium
HSRGGKPFTGAGY

SEQ ID NO: 265352 - protein, 6 aa, Mycobacterium
HSRHDD

SEQ ID NO: 265353 - protein, 9 aa, Mycobacterium
HSRHGSPHA

SEQ ID NO: 265354 - protein, 23 aa, Mycobacterium
HSRPASGGARQRRSKGAGGSFTS

SEQ ID NO: 265355 - protein, 7 aa, Mycobacterium
HSRSTRV

SEQ ID NO: 265356 - protein, 9 aa, Mycobacterium
HSRTRSRSS

SEQ ID NO: 265357 - protein, 4 aa, Mycobacterium
HSSD

SEQ ID NO: 265358 - protein, 14 aa, Mycobacterium
HSSEPIPAAKGQLR

SEQ ID NO: 265359 - protein, 7 aa, Mycobacterium
HSSGDKS

SEQ ID NO: 265360 - protein, 7 aa, Mycobacterium
HSSGSLA

SEQ ID NO: 265361 - protein, 13 aa, Mycobacterium
HSSPGQDSGGERR

SEQ ID NO: 265362 - protein, 8 aa, Mycobacterium
HSSPPKRH

SEQ ID NO: 265363 - protein, 7 aa, Mycobacterium
HSSPPVT

SEQ ID NO: 265364 - protein, 4 aa, Mycobacterium
HSTD

SEQ ID NO: 265365 - protein, 10 aa, Mycobacterium
HSTPERTSTV

SEQ ID NO: 265366 - protein, 21 aa, Mycobacterium
HSTVETTHEVQQTTKDLRDSI

SEQ ID NO: 265367 - protein, 5 aa, Mycobacterium
HSVGT

SEQ ID NO: 265368 - protein, 5 aa, Mycobacterium
HSVPT

SEQ ID NO: 265369 - protein, 14 aa, Mycobacterium
HSVSPLPTGEVSPA

SEQ ID NO: 265370 - protein, 15 aa, Mycobacterium
HSVSSQRGGPNMAGA

SEQ ID NO: 265371 - protein, 6 aa, Mycobacterium
HSWNSN

SEQ ID NO: 265372 - protein, 5 aa, Mycobacterium
HTAAA

SEQ ID NO: 265373 - protein, 8 aa, Mycobacterium
HTAEDTVS

SEQ ID NO: 265374 - protein, 5 aa, Mycobacterium
HTAEH

SEQ ID NO: 265375 - protein, 6 aa, Mycobacterium
HTAPPR

SEQ ID NO: 265376 - protein, 7 aa, Mycobacterium
HTARGGR

SEQ ID NO: 265377 - protein, 9 aa, Mycobacterium
HTASTDRKS

SEQ ID NO: 265378 - protein, 7 aa, Mycobacterium
HTATARQ

SEQ ID NO: 265379 - protein, 26 aa, Mycobacterium
HTATASSANQSSAMEPTGNRPPGTMS

SEQ ID NO: 265380 - protein, 14 aa, Mycobacterium
HTDARRPRPAVAAP

SEQ ID NO: 265381 - protein, 4 aa, Mycobacterium
HTDE

SEQ ID NO: 265382 - protein, 7 aa, Mycobacterium
HTDPDAR

SEQ ID NO: 265383 - protein, 7 aa, Mycobacterium
HTDPEAL

SEQ ID NO: 265384 - protein, 6 aa, Mycobacterium
HTDPRK

SEQ ID NO: 265385 - protein, 15 aa, Mycobacterium
HTDQAEDRAPESEPP

SEQ ID NO: 265386 - protein, 6 aa, Mycobacterium
HTDQQS

SEQ ID NO: 265387 - protein, 11 aa, Mycobacterium
HTDTPSVVPSA

SEQ ID NO: 265388 - protein, 21 aa, Mycobacterium
HTEEGDTSEQQSGAEHMSPDP

SEQ ID NO: 265389 - protein, 4 aa, Mycobacterium
HTEG

SEQ ID NO: 265390 - protein, 5 aa, Mycobacterium
HTENL

SEQ ID NO: 265391 - protein, 6 aa, Mycobacterium
HTEQQE

SEQ ID NO: 265392 - protein, 6 aa, Mycobacterium
HTETTT

SEQ ID NO: 265393 - protein, 14 aa, Mycobacterium
HTEVADTGRNRALA

SEQ ID NO: 265394 - protein, 10 aa, Mycobacterium
HTEVEDNRRN

SEQ ID NO: 265395 - protein, 10 aa, Mycobacterium
HTEVENTRRN

SEQ ID NO: 265396 - protein, 11 aa, Mycobacterium
HTEVKDNRRNR

SEQ ID NO: 265397 - protein, 5 aa, Mycobacterium
HTGAG

SEQ ID NO: 265398 - protein, 7 aa, Mycobacterium
HTGAHAP

SEQ ID NO: 265399 - protein, 4 aa, Mycobacterium
HTGD

SEQ ID NO: 265400 - protein, 4 aa, Mycobacterium
HTGG

SEQ ID NO: 265401 - protein, 4 aa, Mycobacterium
HTGN

SEQ ID NO: 265402 - protein, 4 aa, Mycobacterium
HTGP

SEQ ID NO: 265403 - protein, 5 aa, Mycobacterium
HTGPG

SEQ ID NO: 265404 - protein, 7 aa, Mycobacterium
HTGPGTV

SEQ ID NO: 265405 - protein, 8 aa, Mycobacterium
HTGPRTNF

SEQ ID NO: 265406 - protein, 5 aa, Mycobacterium
HTGPV

SEQ ID NO: 265407 - protein, 5 aa, Mycobacterium
HTGQQ

SEQ ID NO: 265408 - protein, 5 aa, Mycobacterium
HTGSE

SEQ ID NO: 265409 - protein, 7 aa, Mycobacterium
HTGSSKG

SEQ ID NO: 265410 - protein, 8 aa, Mycobacterium
HTGTPPVS

SEQ ID NO: 265411 - protein, 20 aa, Mycobacterium
HTGTTGAPPWGQPPPQPTVA

SEQ ID NO: 265412 - protein, 11 aa, Mycobacterium
HTIGTAQQSLG

SEQ ID NO: 265413 - protein, 14 aa, Mycobacterium
HTNAPGSKNPKRWQ

SEQ ID NO: 265414 - protein, 13 aa, Mycobacterium
HTNAPGSRNPKRW

SEQ ID NO: 265415 - protein, 13 aa, Mycobacterium
HTNTPGSKNAKRW

SEQ ID NO: 265416 - protein, 14 aa, Mycobacterium
HTNTPGSKNAKRWQ

SEQ ID NO: 265417 - protein, 13 aa, Mycobacterium
HTNTPGSKNHKRW

SEQ ID NO: 265418 - protein, 13 aa, Mycobacterium
HTNTPGSKNPKRW

SEQ ID NO: 265419 - protein, 4 aa, Mycobacterium
HTPA

SEQ ID NO: 265420 - protein, 5 aa, Mycobacterium
HTPAK

SEQ ID NO: 265421 - protein, 11 aa, Mycobacterium
HTPAQRDQDIR

SEQ ID NO: 265422 - protein, 8 aa, Mycobacterium
HTPARGRV

SEQ ID NO: 265423 - protein, 13 aa, Mycobacterium
HTPEPHTSQSHRR

SEQ ID NO: 265424 - protein, 7 aa, Mycobacterium
HTPEPSD

SEQ ID NO: 265425 - protein, 7 aa, Mycobacterium
HTPGDLD

SEQ ID NO: 265426 - protein, 5 aa, Mycobacterium
HTPPA

SEQ ID NO: 265427 - protein, 10 aa, Mycobacterium
HTPPALKHTG

SEQ ID NO: 265428 - protein, 13 aa, Mycobacterium
HTPPDADAVTGAL

SEQ ID NO: 265429 - protein, 8 aa, Mycobacterium
HTPPGGTV

SEQ ID NO: 265430 - protein, 8 aa, Mycobacterium
HTPPGTTV

SEQ ID NO: 265431 - protein, 7 aa, Mycobacterium
HTPPPNR

SEQ ID NO: 265432 - protein, 5 aa, Mycobacterium
HTPTD

SEQ ID NO: 265433 - protein, 5 aa, Mycobacterium
HTPTP

SEQ ID NO: 265434 - protein, 7 aa, Mycobacterium
HTPTTAA

SEQ ID NO: 265435 - protein, 8 aa, Mycobacterium
HTPYEDNS

SEQ ID NO: 265436 - protein, 9 aa, Mycobacterium
HTQANLAEG

SEQ ID NO: 265437 - protein, 20 aa, Mycobacterium
HTRDDGPPTHHAKRGTPSMG

SEQ ID NO: 265438 - protein, 20 aa, Mycobacterium
HTREDGPPSHHTKRGTPSMG

SEQ ID NO: 265439 - protein, 12 aa, Mycobacterium
HTREGQSPVVHP

SEQ ID NO: 265440 - protein, 5 aa, Mycobacterium
HTRGE

SEQ ID NO: 265441 - protein, 8 aa, Mycobacterium
HTRGSSDY

SEQ ID NO: 265442 - protein, 16 aa, Mycobacterium
HTRPTQEVSGATAGPL

SEQ ID NO: 265443 - protein, 10 aa, Mycobacterium
HTRQGSPQTA

SEQ ID NO: 265444 - protein, 5 aa, Mycobacterium
HTSGR

SEQ ID NO: 265445 - protein, 7 aa, Mycobacterium
HTSPPKR

SEQ ID NO: 265446 - protein, 14 aa, Mycobacterium
HTSPQHAGAQAASV

SEQ ID NO: 265447 - protein, 13 aa, Mycobacterium
HTTAAPPGEPIKD

SEQ ID NO: 265448 - protein, 38 aa, Mycobacterium
HTTDETPDTDAATAATSSGERAPLDTTTHPTQHRLDHI

SEQ ID NO: 265449 - protein, 6 aa, Mycobacterium
HTTEWR

SEQ ID NO: 265450 - protein, 6 aa, Mycobacterium
HTTGEL

SEQ ID NO: 265451 - protein, 8 aa, Mycobacterium
HTTGPYPL

SEQ ID NO: 265452 - protein, 22 aa, Mycobacterium
HTTGSDTDATPIPDHTEDRPPQ

SEQ ID NO: 265453 - protein, 10 aa, Mycobacterium
HTTGTTATAI

SEQ ID NO: 265454 - protein, 15 aa, Mycobacterium
HTTGTVRQSLDNQTD

SEQ ID NO: 265455 - protein, 76 aa, Mycobacterium
HTTPTPSPRPAPSPGASLPRPAPPASTPTTTPPESPAASPDPRTGTPAPVPPRTSSAPSPSGSAPPPPPSPSPTVT

SEQ ID NO: 265456 - protein, 5 aa, Mycobacterium
HTTPV

SEQ ID NO: 265457 - protein, 6 aa, Mycobacterium
HTTRPK

SEQ ID NO: 265458 - protein, 6 aa, Mycobacterium
HTTSAE

SEQ ID NO: 265459 - protein, 13 aa, Mycobacterium
HTTSGLKGTITGI

SEQ ID NO: 265460 - protein, 9 aa, Mycobacterium
HTTSGLQGT

SEQ ID NO: 265461 - protein, 6 aa, Mycobacterium
HTTSNE

SEQ ID NO: 265462 - protein, 7 aa, Mycobacterium
HTTSPTF

SEQ ID NO: 265463 - protein, 5 aa, Mycobacterium
HTVRT

SEQ ID NO: 265464 - protein, 8 aa, Mycobacterium
HVAGPDQQ

SEQ ID NO: 265465 - protein, 7 aa, Mycobacterium
HVAGPQH

SEQ ID NO: 265466 - protein, 12 aa, Mycobacterium
HVAPGDARRGIF

SEQ ID NO: 265467 - protein, 8 aa, Mycobacterium
HVDERSDA

SEQ ID NO: 265468 - protein, 12 aa, Mycobacterium
HVDGAPPRRPPA

SEQ ID NO: 265469 - protein, 13 aa, Mycobacterium
HVDSSEPPEEYGS

SEQ ID NO: 265470 - protein, 14 aa, Mycobacterium
HVDSSEPVLQYATA

SEQ ID NO: 265471 - protein, 5 aa, Mycobacterium
HVGGQ

SEQ ID NO: 265472 - protein, 10 aa, Mycobacterium
HVGPRSRHHR

SEQ ID NO: 265473 - protein, 4 aa, Mycobacterium
HVGT

SEQ ID NO: 265474 - protein, 5 aa, Mycobacterium
HVNGS

SEQ ID NO: 265475 - protein, 17 aa, Mycobacterium
HVPAESVPARAPHSADV

SEQ ID NO: 265476 - protein, 19 aa, Mycobacterium
HVPGGSRAQAQAPTDSPAT

SEQ ID NO: 265477 - protein, 13 aa, Mycobacterium
HVPHDSPGRGLSR

SEQ ID NO: 265478 - protein, 19 aa, Mycobacterium
HVPHRPGQEAGHPAAARPR

SEQ ID NO: 265479 - protein, 8 aa, Mycobacterium
HVPPPPPA

SEQ ID NO: 265480 - protein, 6 aa, Mycobacterium
HVSDPA

SEQ ID NO: 265481 - protein, 5 aa, Mycobacterium
HVSET

SEQ ID NO: 265482 - protein, 13 aa, Mycobacterium
HVTNGGDGKQEPR

SEQ ID NO: 265483 - protein, 7 aa, Mycobacterium
HVTPDGA

SEQ ID NO: 265484 - protein, 12 aa, Mycobacterium
HVTPKDGGLSTV

SEQ ID NO: 265485 - protein, 4 aa, Mycobacterium
HWPG

SEQ ID NO: 265486 - protein, 9 aa, Mycobacterium
HWPPPDLKE

SEQ ID NO: 265487 - protein, 10 aa, Mycobacterium
HYATGASGEF

SEQ ID NO: 265488 - protein, 10 aa, Mycobacterium
HYATGSAGEF

SEQ ID NO: 265489 - protein, 46 aa, Mycobacterium
HYDDHYDDRHDDRYGDSYEDRYDDGPHDDGPHDDRAPHTDYREGRF

SEQ ID NO: 265490 - protein, 6 aa, Mycobacterium
HYDSEA

SEQ ID NO: 265491 - protein, 5 aa, Mycobacterium
HYGDP

SEQ ID NO: 265492 - protein, 6 aa, Mycobacterium
HYPDDI

SEQ ID NO: 265493 - protein, 4 aa, Mycobacterium
HYPQ

SEQ ID NO: 265494 - protein, 8 aa, Mycobacterium
HYQDEQAA

SEQ ID NO: 265495 - protein, 8 aa, Mycobacterium
HYQEEQAN

SEQ ID NO: 265496 - protein, 8 aa, Mycobacterium
HYSESSRS

SEQ ID NO: 265497 - protein, 12 aa, Mycobacterium
IAAANRADEIRE

SEQ ID NO: 265498 - protein, 12 aa, Mycobacterium
IAADGSDNDEYE

SEQ ID NO: 265499 - protein, 5 aa, Mycobacterium
IAADS

SEQ ID NO: 265500 - protein, 11 aa, Mycobacterium
IAAGAEDDPDV

SEQ ID NO: 265501 - protein, 11 aa, Mycobacterium
IAAGDTPGGGL

SEQ ID NO: 265502 - protein, 13 aa, Mycobacterium
IAAGGNTAAENFG

SEQ ID NO: 265503 - protein, 12 aa, Mycobacterium
IAAGNGDTEGGL

SEQ ID NO: 265504 - protein, 10 aa, Mycobacterium
IAAGPKTLYR

SEQ ID NO: 265505 - protein, 7 aa, Mycobacterium
IAAKSSA

SEQ ID NO: 265506 - protein, 7 aa, Mycobacterium
IAASGPE

SEQ ID NO: 265507 - protein, 47 aa, Mycobacterium
IAASNADSRRPESTSPPASSASKTTSVATPEEEPLAGTRKRRSRRDP

SEQ ID NO: 265508 - protein, 5 aa, Mycobacterium
IAATG

SEQ ID NO: 265509 - protein, 15 aa, Mycobacterium
IADAGRQVENGAHGI

SEQ ID NO: 265510 - protein, 18 aa, Mycobacterium
IADDTGPDRRDARDASYP

SEQ ID NO: 265511 - protein, 8 aa, Mycobacterium
IADESTRV

SEQ ID NO: 265512 - protein, 4 aa, Mycobacterium
IADG

SEQ ID NO: 265513 - protein, 5 aa, Mycobacterium
IADGG

SEQ ID NO: 265514 - protein, 7 aa, Mycobacterium
IADPDLK

SEQ ID NO: 265515 - protein, 12 aa, Mycobacterium
IADPTRNVKGDS

SEQ ID NO: 265516 - protein, 40 aa, Mycobacterium
IADRTDHISPVDEPSPAAVADTSWSADPEDAEEAAARRRR

SEQ ID NO: 265517 - protein, 15 aa, Mycobacterium
IADRTRTLTEDSGPF

SEQ ID NO: 265518 - protein, 9 aa, Mycobacterium
IADSARGAD

SEQ ID NO: 265519 - protein, 10 aa, Mycobacterium
IADSDTEEQI

SEQ ID NO: 265520 - protein, 5 aa, Mycobacterium
IADSR

SEQ ID NO: 265521 - protein, 7 aa, Mycobacterium
IADTPDG

SEQ ID NO: 265522 - protein, 9 aa, Mycobacterium
IADTQDRGD

SEQ ID NO: 265523 - protein, 6 aa, Mycobacterium
IADTSE

SEQ ID NO: 265524 - protein, 7 aa, Mycobacterium
IADTSNQ

SEQ ID NO: 265525 - protein, 4 aa, Mycobacterium
IAEG

SEQ ID NO: 265526 - protein, 20 aa, Mycobacterium
IAEGASSGAGSSLPLPSPDD

SEQ ID NO: 265527 - protein, 7 aa, Mycobacterium
IAEPESY

SEQ ID NO: 265528 - protein, 14 aa, Mycobacterium
IAEPLDEGTGPVTA

SEQ ID NO: 265529 - protein, 6 aa, Mycobacterium
IAEQRR

SEQ ID NO: 265530 - protein, 7 aa, Mycobacterium
IAERAGG

SEQ ID NO: 265531 - protein, 7 aa, Mycobacterium
IAERGTH

SEQ ID NO: 265532 - protein, 5 aa, Mycobacterium
IAETN

SEQ ID NO: 265533 - protein, 10 aa, Mycobacterium
IAGAAARGAH

SEQ ID NO: 265534 - protein, 11 aa, Mycobacterium
IAGAPGQGNYA

SEQ ID NO: 265535 - protein, 13 aa, Mycobacterium
IAGAPTTSPATLS

SEQ ID NO: 265536 - protein, 12 aa, Mycobacterium
IAGDPGQGSYAA

SEQ ID NO: 265537 - protein, 10 aa, Mycobacterium
IAGDPTTSPW

SEQ ID NO: 265538 - protein, 5 aa, Mycobacterium
IAGDR

SEQ ID NO: 265539 - protein, 7 aa, Mycobacterium
IAGDTTE

SEQ ID NO: 265540 - protein, 12 aa, Mycobacterium
IAGEPTTSPAEL

SEQ ID NO: 265541 - protein, 13 aa, Mycobacterium
IAGESRSDPPDFD

SEQ ID NO: 265542 - protein, 7 aa, Mycobacterium
IAGEVDE

SEQ ID NO: 265543 - protein, 5 aa, Mycobacterium
IAGGA

SEQ ID NO: 265544 - protein, 173 aa, Mycobacterium
IAGGAKKPGAKKAAPAAEGKAEAAAPVKGAGHRRRRQETRGQEGGTGQGRGTCRSGRARGRDRGQGARRAREGPGPGRGRQATRRQEGGPEGRGPQGRSTRGRSGAGSRTRGQGARRAGEGPGHRRGRQTTRRQEGGPESRGAESRSRARRTGAGRAGTESGVGKAGRRRRRT

SEQ ID NO: 265545 - protein, 9 aa, Mycobacterium
IAGGRAVAE

SEQ ID NO: 265546 - protein, 9 aa, Mycobacterium
IAGGRTVAE

SEQ ID NO: 265547 - protein, 11 aa, Mycobacterium
IAGGVRDDSST

SEQ ID NO: 265548 - protein, 6 aa, Mycobacterium
IAGKEA

SEQ ID NO: 265549 - protein, 10 aa, Mycobacterium
IAGKSAGLRT

SEQ ID NO: 265550 - protein, 10 aa, Mycobacterium
IAGNPTAHPV

SEQ ID NO: 265551 - protein, 6 aa, Mycobacterium
IAGPEK

SEQ ID NO: 265552 - protein, 6 aa, Mycobacterium
IAGPES

SEQ ID NO: 265553 - protein, 8 aa, Mycobacterium
IAGPGGPR

SEQ ID NO: 265554 - protein, 7 aa, Mycobacterium
IAGPIES

SEQ ID NO: 265555 - protein, 7 aa, Mycobacterium
IAGPTDL

SEQ ID NO: 265556 - protein, 4 aa, Mycobacterium
IAGS

SEQ ID NO: 265557 - protein, 31 aa, Mycobacterium
IAGSAHPGPTKYAGPAARQATARRDDDGPMS

SEQ ID NO: 265558 - protein, 11 aa, Mycobacterium
IAGSEAAMRAS

SEQ ID NO: 265559 - protein, 7 aa, Mycobacterium
IAGSEQS

SEQ ID NO: 265560 - protein, 11 aa, Mycobacterium
IAGSGQAPDLN

SEQ ID NO: 265561 - protein, 7 aa, Mycobacterium
IAGSPDD

SEQ ID NO: 265562 - protein, 6 aa, Mycobacterium
IAGSSF

SEQ ID NO: 265563 - protein, 4 aa, Mycobacterium
IAGT

SEQ ID NO: 265564 - protein, 7 aa, Mycobacterium
IAGTAST

SEQ ID NO: 265565 - protein, 5 aa, Mycobacterium
IAGTN

SEQ ID NO: 265566 - protein, 11 aa, Mycobacterium
IAKDASGSKWG

SEQ ID NO: 265567 - protein, 9 aa, Mycobacterium
IAKDDNSAA

SEQ ID NO: 265568 - protein, 8 aa, Mycobacterium
IANTGNTG

SEQ ID NO: 265569 - protein, 6 aa, Mycobacterium
IAPAES

SEQ ID NO: 265570 - protein, 53 aa, Mycobacterium
IAPATGSAAHAAAAASSVAAQAGASGSSAGSEVLASESGAEISSIAGTAPDGA

SEQ ID NO: 265571 - protein, 16 aa, Mycobacterium
IAPDGTRTEEPRPDGV

SEQ ID NO: 265572 - protein, 15 aa, Mycobacterium
IAPDGTRTEEPRPEG

SEQ ID NO: 265573 - protein, 15 aa, Mycobacterium
IAPDGTVTEEERPEG

SEQ ID NO: 265574 - protein, 5 aa, Mycobacterium
IAPEA

SEQ ID NO: 265575 - protein, 7 aa, Mycobacterium
IAPEDQS

SEQ ID NO: 265576 - protein, 8 aa, Mycobacterium
IAPEDRPY

SEQ ID NO: 265577 - protein, 4 aa, Mycobacterium
IAPG

SEQ ID NO: 265578 - protein, 10 aa, Mycobacterium
IAPGDAQATM

SEQ ID NO: 265579 - protein, 9 aa, Mycobacterium
IAPGGARAT

SEQ ID NO: 265580 - protein, 11 aa, Mycobacterium
IAPGPPGARTV

SEQ ID NO: 265581 - protein, 11 aa, Mycobacterium
IAPNGQPSGFS

SEQ ID NO: 265582 - protein, 10 aa, Mycobacterium
IAPNQDAQAE

SEQ ID NO: 265583 - protein, 18 aa, Mycobacterium
IAPPPIPDAGAASPITTA

SEQ ID NO: 265584 - protein, 12 aa, Mycobacterium
IAPPPPPGTPPQ

SEQ ID NO: 265585 - protein, 13 aa, Mycobacterium
IAPPQAGGAPRLS

SEQ ID NO: 265586 - protein, 8 aa, Mycobacterium
IAPQSTST

SEQ ID NO: 265587 - protein, 7 aa, Mycobacterium
IAPRSSS

SEQ ID NO: 265588 - protein, 7 aa, Mycobacterium
IAPRTGY

SEQ ID NO: 265589 - protein, 12 aa, Mycobacterium
IAPSALRRSQTG

SEQ ID NO: 265590 - protein, 7 aa, Mycobacterium
IAPSEQR

SEQ ID NO: 265591 - protein, 5 aa, Mycobacterium
IAPSL

SEQ ID NO: 265592 - protein, 7 aa, Mycobacterium
IAPSQQR

SEQ ID NO: 265593 - protein, 24 aa, Mycobacterium
IAPTPTSAPTTTTTIASTPEQDSA

SEQ ID NO: 265594 - protein, 12 aa, Mycobacterium
IAPTSPGNPSGT

SEQ ID NO: 265595 - protein, 4 aa, Mycobacterium
IAPV

SEQ ID NO: 265596 - protein, 8 aa, Mycobacterium
IAQPGRDA

SEQ ID NO: 265597 - protein, 5 aa, Mycobacterium
IAQQQ

SEQ ID NO: 265598 - protein, 9 aa, Mycobacterium
IAQSAGAPF

SEQ ID NO: 265599 - protein, 11 aa, Mycobacterium
IAQTNAAAQAG

SEQ ID NO: 265600 - protein, 28 aa, Mycobacterium
IAREQAEAARVQARTEVEQRRTEQAQAA

SEQ ID NO: 265601 - protein, 10 aa, Mycobacterium
IARGRVGSGP

SEQ ID NO: 265602 - protein, 10 aa, Mycobacterium
IARGRVGSGT

SEQ ID NO: 265603 - protein, 10 aa, Mycobacterium
IARGTRRARS

SEQ ID NO: 265604 - protein, 7 aa, Mycobacterium
IARRGAD

SEQ ID NO: 265605 - protein, 4 aa, Mycobacterium
IASA

SEQ ID NO: 265606 - protein, 6 aa, Mycobacterium
IASAPE

SEQ ID NO: 265607 - protein, 12 aa, Mycobacterium
IASGAAASGPAI

SEQ ID NO: 265608 - protein, 13 aa, Mycobacterium
IASGDGARHLKIA

SEQ ID NO: 265609 - protein, 5 aa, Mycobacterium
IASGQ

SEQ ID NO: 265610 - protein, 7 aa, Mycobacterium
IASGQLD

SEQ ID NO: 265611 - protein, 7 aa, Mycobacterium
IASGRSA

SEQ ID NO: 265612 - protein, 14 aa, Mycobacterium
IASGRVPAEGYGDR

SEQ ID NO: 265613 - protein, 6 aa, Mycobacterium
IASGTP

SEQ ID NO: 265614 - protein, 8 aa, Mycobacterium
IASNPKNY

SEQ ID NO: 265615 - protein, 30 aa, Mycobacterium
IASPRALPAPIANTSSRPLQSGQPVAPRPS

SEQ ID NO: 265616 - protein, 12 aa, Mycobacterium
IASPSGDSPQQA

SEQ ID NO: 265617 - protein, 5 aa, Mycobacterium
IASPT

SEQ ID NO: 265618 - protein, 6 aa, Mycobacterium
IASPTG

SEQ ID NO: 265619 - protein, 12 aa, Mycobacterium
IASRTQQTPTES

SEQ ID NO: 265620 - protein, 14 aa, Mycobacterium
IATASHPDAGPDQH

SEQ ID NO: 265621 - protein, 4 aa, Mycobacterium
IATG

SEQ ID NO: 265622 - protein, 8 aa, Mycobacterium
IATGAGEA

SEQ ID NO: 265623 - protein, 6 aa, Mycobacterium
IATGGM

SEQ ID NO: 265624 - protein, 7 aa, Mycobacterium
IATGGTD

SEQ ID NO: 265625 - protein, 23 aa, Mycobacterium
IATPHGGALPSAGPEVNGGGFPE

SEQ ID NO: 265626 - protein, 13 aa, Mycobacterium
IATPPARPKRQPL

SEQ ID NO: 265627 - protein, 8 aa, Mycobacterium
IATTGAGP

SEQ ID NO: 265628 - protein, 8 aa, Mycobacterium
IATTSPAD

SEQ ID NO: 265629 - protein, 11 aa, Mycobacterium
ICNPADPNTWQ

SEQ ID NO: 265630 - protein, 5 aa, Mycobacterium
ICRPG

SEQ ID NO: 265631 - protein, 8 aa, Mycobacterium
IDAAEKRV

SEQ ID NO: 265632 - protein, 6 aa, Mycobacterium
IDAEPS

SEQ ID NO: 265633 - protein, 7 aa, Mycobacterium
IDARQDV

SEQ ID NO: 265634 - protein, 8 aa, Mycobacterium
IDASGDAA

SEQ ID NO: 265635 - protein, 17 aa, Mycobacterium
IDDDQPDGYLRQLVWPL

SEQ ID NO: 265636 - protein, 8 aa, Mycobacterium
IDDDSRER

SEQ ID NO: 265637 - protein, 11 aa, Mycobacterium
IDDPAGGTFDR

SEQ ID NO: 265638 - protein, 12 aa, Mycobacterium
IDDPAGKQELTN

SEQ ID NO: 265639 - protein, 6 aa, Mycobacterium
IDDPGW

SEQ ID NO: 265640 - protein, 17 aa, Mycobacterium
IDDSPAPAVAPASLSRD

SEQ ID NO: 265641 - protein, 11 aa, Mycobacterium
IDDSPSPSTAL

SEQ ID NO: 265642 - protein, 5 aa, Mycobacterium
IDEAR

SEQ ID NO: 265643 - protein, 26 aa, Mycobacterium
IDEEGPSKGKLQGGDAIDGVNGKPVA

SEQ ID NO: 265644 - protein, 4 aa, Mycobacterium
IDEP

SEQ ID NO: 265645 - protein, 7 aa, Mycobacterium
IDEQHEG

SEQ ID NO: 265646 - protein, 5 aa, Mycobacterium
IDERR

SEQ ID NO: 265647 - protein, 11 aa, Mycobacterium
IDESGPAPEMS

SEQ ID NO: 265648 - protein, 9 aa, Mycobacterium
IDESPPGDY

SEQ ID NO: 265649 - protein, 6 aa, Mycobacterium
IDETSL

SEQ ID NO: 265650 - protein, 12 aa, Mycobacterium
IDGAREAVSARA

SEQ ID NO: 265651 - protein, 4 aa, Mycobacterium
IDGD

SEQ ID NO: 265652 - protein, 13 aa, Mycobacterium
IDGDAKVSNVEFV

SEQ ID NO: 265653 - protein, 22 aa, Mycobacterium
IDGDGNQHLPRATGRAAPQRGH

SEQ ID NO: 265654 - protein, 12 aa, Mycobacterium
IDGDPNSAWPTD

SEQ ID NO: 265655 - protein, 7 aa, Mycobacterium
IDGDPST

SEQ ID NO: 265656 - protein, 12 aa, Mycobacterium
IDGEQPDPPLRP

SEQ ID NO: 265657 - protein, 10 aa, Mycobacterium
IDGKSNAQAL

SEQ ID NO: 265658 - protein, 9 aa, Mycobacterium
IDGKTNAEA

SEQ ID NO: 265659 - protein, 16 aa, Mycobacterium
IDGLDEPEYLGQEVQR

SEQ ID NO: 265660 - protein, 9 aa, Mycobacterium
IDGNPNTAW

SEQ ID NO: 265661 - protein, 15 aa, Mycobacterium
IDGNPSTSWQTDTYT

SEQ ID NO: 265662 - protein, 6 aa, Mycobacterium
IDGPDN

SEQ ID NO: 265663 - protein, 10 aa, Mycobacterium
IDGPESGTVR

SEQ ID NO: 265664 - protein, 13 aa, Mycobacterium
IDGPGPDGAVTGS

SEQ ID NO: 265665 - protein, 8 aa, Mycobacterium
IDGPPQTF

SEQ ID NO: 265666 - protein, 14 aa, Mycobacterium
IDGPPRNTMQIGQP

SEQ ID NO: 265667 - protein, 11 aa, Mycobacterium
IDGPSDPGEWQ

SEQ ID NO: 265668 - protein, 13 aa, Mycobacterium
IDGRDAGTGQSRW

SEQ ID NO: 265669 - protein, 4 aa, Mycobacterium
IDGS

SEQ ID NO: 265670 - protein, 9 aa, Mycobacterium
IDGSETGRR

SEQ ID NO: 265671 - protein, 8 aa, Mycobacterium
IDGSPTTV

SEQ ID NO: 265672 - protein, 9 aa, Mycobacterium
IDGSSSTMW

SEQ ID NO: 265673 - protein, 14 aa, Mycobacterium
IDGSTDASACPKRT

SEQ ID NO: 265674 - protein, 4 aa, Mycobacterium
IDGT

SEQ ID NO: 265675 - protein, 8 aa, Mycobacterium
IDGTPRNV

SEQ ID NO: 265676 - protein, 8 aa, Mycobacterium
IDGTPTRT

SEQ ID NO: 265677 - protein, 4 aa, Mycobacterium
IDGV

SEQ ID NO: 265678 - protein, 5 aa, Mycobacterium
IDIPS

SEQ ID NO: 265679 - protein, 9 aa, Mycobacterium
IDKARDQLA

SEQ ID NO: 265680 - protein, 23 aa, Mycobacterium
IDKDQDEEQETAPAAASKTTRPG

SEQ ID NO: 265681 - protein, 8 aa, Mycobacterium
IDKRGSIT

SEQ ID NO: 265682 - protein, 5 aa, Mycobacterium
IDKSN

SEQ ID NO: 265683 - protein, 11 aa, Mycobacterium
IDKTSGQVNAD

SEQ ID NO: 265684 - protein, 7 aa, Mycobacterium
IDKTTGP

SEQ ID NO: 265685 - protein, 5 aa, Mycobacterium
IDLSG

SEQ ID NO: 265686 - protein, 9 aa, Mycobacterium
IDNNSRVGR

SEQ ID NO: 265687 - protein, 7 aa, Mycobacterium
IDNPDQR

SEQ ID NO: 265688 - protein, 8 aa, Mycobacterium
IDNPDQRI

SEQ ID NO: 265689 - protein, 9 aa, Mycobacterium
IDNSPAAEK

SEQ ID NO: 265690 - protein, 4 aa, Mycobacterium
IDPA

SEQ ID NO: 265691 - protein, 15 aa, Mycobacterium
IDPAERPASAAELGR

SEQ ID NO: 265692 - protein, 7 aa, Mycobacterium
IDPATGR

SEQ ID NO: 265693 - protein, 4 aa, Mycobacterium
IDPD

SEQ ID NO: 265694 - protein, 9 aa, Mycobacterium
IDPDASAQD

SEQ ID NO: 265695 - protein, 10 aa, Mycobacterium
IDPDDSSYRN

SEQ ID NO: 265696 - protein, 15 aa, Mycobacterium
IDPDGPGPLAPQTFT

SEQ ID NO: 265697 - protein, 15 aa, Mycobacterium
IDPERDHVRGRPDAP

SEQ ID NO: 265698 - protein, 4 aa, Mycobacterium
IDPG

SEQ ID NO: 265699 - protein, 6 aa, Mycobacterium
IDPGKV

SEQ ID NO: 265700 - protein, 8 aa, Mycobacterium
IDPGSTVT

SEQ ID NO: 265701 - protein, 10 aa, Mycobacterium
IDPKAQEAAV

SEQ ID NO: 265702 - protein, 13 aa, Mycobacterium
IDPKAQSAAQDAV

SEQ ID NO: 265703 - protein, 16 aa, Mycobacterium
IDPKRDLNKVPTQQRG

SEQ ID NO: 265704 - protein, 7 aa, Mycobacterium
IDPPAVK

SEQ ID NO: 265705 - protein, 25 aa, Mycobacterium
IDPPEGAPQPRLTESIGSTTTVNND

SEQ ID NO: 265706 - protein, 12 aa, Mycobacterium
IDPPHGEGRAVG

SEQ ID NO: 265707 - protein, 7 aa, Mycobacterium
IDPPWPE

SEQ ID NO: 265708 - protein, 8 aa, Mycobacterium
IDPQGSRV

SEQ ID NO: 265709 - protein, 19 aa, Mycobacterium
IDPQPGQRPDWSPTTSRSW

SEQ ID NO: 265710 - protein, 11 aa, Mycobacterium
IDPRGSQTLRP

SEQ ID NO: 265711 - protein, 15 aa, Mycobacterium
IDPRKRDKILATYGV

SEQ ID NO: 265712 - protein, 15 aa, Mycobacterium
IDPRKRGRVLARYGS

SEQ ID NO: 265713 - protein, 4 aa, Mycobacterium
IDPT

SEQ ID NO: 265714 - protein, 5 aa, Mycobacterium
IDQAR

SEQ ID NO: 265715 - protein, 8 aa, Mycobacterium
IDQGPAAG

SEQ ID NO: 265716 - protein, 9 aa, Mycobacterium
IDQPDKPSL

SEQ ID NO: 265717 - protein, 7 aa, Mycobacterium
IDQPPAV

SEQ ID NO: 265718 - protein, 10 aa, Mycobacterium
IDQSGGRLRT

SEQ ID NO: 265719 - protein, 10 aa, Mycobacterium
IDQSGPRLRT

SEQ ID NO: 265720 - protein, 10 aa, Mycobacterium
IDQSGTRLRT

SEQ ID NO: 265721 - protein, 11 aa, Mycobacterium
IDQTERARNTV

SEQ ID NO: 265722 - protein, 7 aa, Mycobacterium
IDRAQQR

SEQ ID NO: 265723 - protein, 5 aa, Mycobacterium
IDRGQ

SEQ ID NO: 265724 - protein, 15 aa, Mycobacterium
IDRTDADSAQAALTT

SEQ ID NO: 265725 - protein, 15 aa, Mycobacterium
IDRTDADSAQDALNT

SEQ ID NO: 265726 - protein, 15 aa, Mycobacterium
IDSPRSSGSNDEQDI

SEQ ID NO: 265727 - protein, 5 aa, Mycobacterium
IDSRE

SEQ ID NO: 265728 - protein, 6 aa, Mycobacterium
IDSRTS

SEQ ID NO: 265729 - protein, 6 aa, Mycobacterium
IDSTRG

SEQ ID NO: 265730 - protein, 17 aa, Mycobacterium
IDTDNVKSARIDDREQQ

SEQ ID NO: 265731 - protein, 6 aa, Mycobacterium
IDTGGG

SEQ ID NO: 265732 - protein, 8 aa, Mycobacterium
IDTGTENL

SEQ ID NO: 265733 - protein, 12 aa, Mycobacterium
IDTGTVSSGLVG

SEQ ID NO: 265734 - protein, 11 aa, Mycobacterium
IDTKPGPDIPG

SEQ ID NO: 265735 - protein, 7 aa, Mycobacterium
IDTLDAD

SEQ ID NO: 265736 - protein, 15 aa, Mycobacterium
IDTPRTGDRLGTGTQ

SEQ ID NO: 265737 - protein, 10 aa, Mycobacterium
IDTPSSGTKV

SEQ ID NO: 265738 - protein, 10 aa, Mycobacterium
IDTPSTGTKV

SEQ ID NO: 265739 - protein, 6 aa, Mycobacterium
IDTRTQ

SEQ ID NO: 265740 - protein, 17 aa, Mycobacterium
IDTTAAVAASGAIAGED

SEQ ID NO: 265741 - protein, 17 aa, Mycobacterium
IDTTSAAPAASTTRHKA

SEQ ID NO: 265742 - protein, 5 aa, Mycobacterium
IDVPQ

SEQ ID NO: 265743 - protein, 14 aa, Mycobacterium
IDVPREGQQVPRGP

SEQ ID NO: 265744 - protein, 11 aa, Mycobacterium
IDVPRGGQTVP

SEQ ID NO: 265745 - protein, 7 aa, Mycobacterium
IEADGGS

SEQ ID NO: 265746 - protein, 10 aa, Mycobacterium
IEAEGDPANW

SEQ ID NO: 265747 - protein, 12 aa, Mycobacterium
IEAGRRRTSEVG

SEQ ID NO: 265748 - protein, 6 aa, Mycobacterium
IEAQGH

SEQ ID NO: 265749 - protein, 7 aa, Mycobacterium
IEASGIN

SEQ ID NO: 265750 - protein, 16 aa, Mycobacterium
IEATPRGGGELGTTGV

SEQ ID NO: 265751 - protein, 6 aa, Mycobacterium
IEDDEV

SEQ ID NO: 265752 - protein, 14 aa, Mycobacterium
IEDGPGGDVQGPDK

SEQ ID NO: 265753 - protein, 6 aa, Mycobacterium
IEDNPG

SEQ ID NO: 265754 - protein, 5 aa, Mycobacterium
IEEAA

SEQ ID NO: 265755 - protein, 35 aa, Mycobacterium
IEEEAAAAPEPPAPPAPKPAPVVKSTKKAKPKPQM

SEQ ID NO: 265756 - protein, 9 aa, Mycobacterium
IEENPDNKQ

SEQ ID NO: 265757 - protein, 9 aa, Mycobacterium
IEENPNNKQ

SEQ ID NO: 265758 - protein, 28 aa, Mycobacterium
IEEPEDDPIEDGGDANGLVERPDNEAGP

SEQ ID NO: 265759 - protein, 7 aa, Mycobacterium
IEEQDGD

SEQ ID NO: 265760 - protein, 4 aa, Mycobacterium
IEES

SEQ ID NO: 265761 - protein, 6 aa, Mycobacterium
IEESDA

SEQ ID NO: 265762 - protein, 6 aa, Mycobacterium
IEESHA

SEQ ID NO: 265763 - protein, 9 aa, Mycobacterium
IEFSPEDTA

SEQ ID NO: 265764 - protein, 5 aa, Mycobacterium
IEGAG

SEQ ID NO: 265765 - protein, 4 aa, Mycobacterium
IEGD

SEQ ID NO: 265766 - protein, 9 aa, Mycobacterium
IEGDRATAD

SEQ ID NO: 265767 - protein, 4 aa, Mycobacterium
IEGF

SEQ ID NO: 265768 - protein, 4 aa, Mycobacterium
IEGG

SEQ ID NO: 265769 - protein, 8 aa, Mycobacterium
IEGGHAPT

SEQ ID NO: 265770 - protein, 5 aa, Mycobacterium
IEGGN

SEQ ID NO: 265771 - protein, 7 aa, Mycobacterium
IEGGNVT

SEQ ID NO: 265772 - protein, 9 aa, Mycobacterium
IEGNPSPAL

SEQ ID NO: 265773 - protein, 18 aa, Mycobacterium
IEGVAGPEAANNASAAGT

SEQ ID NO: 265774 - protein, 9 aa, Mycobacterium
IEGVSSPRS

SEQ ID NO: 265775 - protein, 5 aa, Mycobacterium
IEKDA

SEQ ID NO: 265776 - protein, 5 aa, Mycobacterium
IEKGD

SEQ ID NO: 265777 - protein, 6 aa, Mycobacterium
IEKRKD

SEQ ID NO: 265778 - protein, 7 aa, Mycobacterium
IEKRSDV

SEQ ID NO: 265779 - protein, 11 aa, Mycobacterium
IEKTRDELGQT

SEQ ID NO: 265780 - protein, 14 aa, Mycobacterium
IENDDAGDGSGWSA

SEQ ID NO: 265781 - protein, 7 aa, Mycobacterium
IENPEEQ

SEQ ID NO: 265782 - protein, 6 aa, Mycobacterium
IENPNS

SEQ ID NO: 265783 - protein, 4 aa, Mycobacterium
IEPD

SEQ ID NO: 265784 - protein, 4 aa, Mycobacterium
IEPG

SEQ ID NO: 265785 - protein, 9 aa, Mycobacterium
IEPGSADAG

SEQ ID NO: 265786 - protein, 4 aa, Mycobacterium
IEPI

SEQ ID NO: 265787 - protein, 4 aa, Mycobacterium
IEPK

SEQ ID NO: 265788 - protein, 10 aa, Mycobacterium
IEPKLRDGDW

SEQ ID NO: 265789 - protein, 5 aa, Mycobacterium
IEPPA

SEQ ID NO: 265790 - protein, 16 aa, Mycobacterium
IEPPAEPPGTPPYRPA

SEQ ID NO: 265791 - protein, 22 aa, Mycobacterium
IEPPAPPAPARSPAPTGATFGR

SEQ ID NO: 265792 - protein, 10 aa, Mycobacterium
IEPPKPVRVA

SEQ ID NO: 265793 - protein, 8 aa, Mycobacterium
IEPPPELP

SEQ ID NO: 265794 - protein, 13 aa, Mycobacterium
IEPPPRLSPGGRT

SEQ ID NO: 265795 - protein, 7 aa, Mycobacterium
IEPPQNY

SEQ ID NO: 265796 - protein, 11 aa, Mycobacterium
IEPRGSDPLQA

SEQ ID NO: 265797 - protein, 25 aa, Mycobacterium
IEPSEPVNGKRNQADGALEGFSARA

SEQ ID NO: 265798 - protein, 7 aa, Mycobacterium
IEPSPGF

SEQ ID NO: 265799 - protein, 18 aa, Mycobacterium
IEPTDSSVSSPHATAGQR

SEQ ID NO: 265800 - protein, 9 aa, Mycobacterium
IEQAKARQR

SEQ ID NO: 265801 - protein, 6 aa, Mycobacterium
IEQASG

SEQ ID NO: 265802 - protein, 4 aa, Mycobacterium
IEQE

SEQ ID NO: 265803 - protein, 5 aa, Mycobacterium
IEQGA

SEQ ID NO: 265804 - protein, 11 aa, Mycobacterium
IEQSRAAQRRA

SEQ ID NO: 265805 - protein, 5 aa, Mycobacterium
IERAE

SEQ ID NO: 265806 - protein, 9 aa, Mycobacterium
IERDGTPAA

SEQ ID NO: 265807 - protein, 8 aa, Mycobacterium
IERDTGKK

SEQ ID NO: 265808 - protein, 12 aa, Mycobacterium
IERGTELGGQER

SEQ ID NO: 265809 - protein, 9 aa, Mycobacterium
IESGKDHKG

SEQ ID NO: 265810 - protein, 9 aa, Mycobacterium
IESGKEHKG

SEQ ID NO: 265811 - protein, 5 aa, Mycobacterium
IESRG

SEQ ID NO: 265812 - protein, 6 aa, Mycobacterium
IESSGL

SEQ ID NO: 265813 - protein, 9 aa, Mycobacterium
IESTGQVSS

SEQ ID NO: 265814 - protein, 8 aa, Mycobacterium
IESTPARL

SEQ ID NO: 265815 - protein, 6 aa, Mycobacterium
IETADD

SEQ ID NO: 265816 - protein, 8 aa, Mycobacterium
IETAEQAQ

SEQ ID NO: 265817 - protein, 5 aa, Mycobacterium
IETAG

SEQ ID NO: 265818 - protein, 5 aa, Mycobacterium
IETAV

SEQ ID NO: 265819 - protein, 12 aa, Mycobacterium
IETDTSELAGSP

SEQ ID NO: 265820 - protein, 7 aa, Mycobacterium
IETHTTK

SEQ ID NO: 265821 - protein, 13 aa, Mycobacterium
IETNGKNSERAGI

SEQ ID NO: 265822 - protein, 7 aa, Mycobacterium
IETSQQT

SEQ ID NO: 265823 - protein, 8 aa, Mycobacterium
IETTSRQE

SEQ ID NO: 265824 - protein, 13 aa, Mycobacterium
IEVGNQRQAVAAD

SEQ ID NO: 265825 - protein, 4 aa, Mycobacterium
IEVK

SEQ ID NO: 265826 - protein, 11 aa, Mycobacterium
IEYPGTRTLGS

SEQ ID NO: 265827 - protein, 6 aa, Mycobacterium
IGADTQ

SEQ ID NO: 265828 - protein, 4 aa, Mycobacterium
IGAG

SEQ ID NO: 265829 - protein, 9 aa, Mycobacterium
IGAGATVGP

SEQ ID NO: 265830 - protein, 28 aa, Mycobacterium
IGAGTPAPGPATSGAPHPGTQPSSKPAE

SEQ ID NO: 265831 - protein, 8 aa, Mycobacterium
IGAGTTAQ

SEQ ID NO: 265832 - protein, 9 aa, Mycobacterium
IGAGTTAQL

SEQ ID NO: 265833 - protein, 13 aa, Mycobacterium
IGANPEDPHAGAH

SEQ ID NO: 265834 - protein, 14 aa, Mycobacterium
IGANPEDPHAGAHG

SEQ ID NO: 265835 - protein, 5 aa, Mycobacterium
IGAPQ

SEQ ID NO: 265836 - protein, 16 aa, Mycobacterium
IGAPSWTADYGNETAN

SEQ ID NO: 265837 - protein, 4 aa, Mycobacterium
IGAR

SEQ ID NO: 265838 - protein, 5 aa, Mycobacterium
IGARP

SEQ ID NO: 265839 - protein, 18 aa, Mycobacterium
IGASTGATAHAPSSAVSA

SEQ ID NO: 265840 - protein, 7 aa, Mycobacterium
IGATPGV

SEQ ID NO: 265841 - protein, 9 aa, Mycobacterium
IGDDTVSPE

SEQ ID NO: 265842 - protein, 13 aa, Mycobacterium
IGDGEIGDGPGRL

SEQ ID NO: 265843 - protein, 4 aa, Mycobacterium
IGDK

SEQ ID NO: 265844 - protein, 4 aa, Mycobacterium
IGDP

SEQ ID NO: 265845 - protein, 7 aa, Mycobacterium
IGDPHER

SEQ ID NO: 265846 - protein, 8 aa, Mycobacterium
IGDPQHGP

SEQ ID NO: 265847 - protein, 8 aa, Mycobacterium
IGDPRDKA

SEQ ID NO: 265848 - protein, 11 aa, Mycobacterium
IGDRAAEADVT

SEQ ID NO: 265849 - protein, 9 aa, Mycobacterium
IGDRDSGAL

SEQ ID NO: 265850 - protein, 14 aa, Mycobacterium
IGDRPQGFSPSNQK

SEQ ID NO: 265851 - protein, 5 aa, Mycobacterium
IGDRY

SEQ ID NO: 265852 - protein, 6 aa, Mycobacterium
IGDTGA

SEQ ID NO: 265853 - protein, 5 aa, Mycobacterium
IGDTQ

SEQ ID NO: 265854 - protein, 13 aa, Mycobacterium
IGDTQTVGTGSCV

SEQ ID NO: 265855 - protein, 11 aa, Mycobacterium
IGDTSRHVKGD

SEQ ID NO: 265856 - protein, 11 aa, Mycobacterium
IGEAESYSLPS

SEQ ID NO: 265857 - protein, 5 aa, Mycobacterium
IGEGS

SEQ ID NO: 265858 - protein, 10 aa, Mycobacterium
IGEKARGREW

SEQ ID NO: 265859 - protein, 10 aa, Mycobacterium
IGEKTKGRDW

SEQ ID NO: 265860 - protein, 6 aa, Mycobacterium
IGENSP

SEQ ID NO: 265861 - protein, 10 aa, Mycobacterium
IGEPAGQALG

SEQ ID NO: 265862 - protein, 8 aa, Mycobacterium
IGEPEPLR

SEQ ID NO: 265863 - protein, 18 aa, Mycobacterium
IGEPGVAAGTTSGSPQMS

SEQ ID NO: 265864 - protein, 4 aa, Mycobacterium
IGEQ

SEQ ID NO: 265865 - protein, 5 aa, Mycobacterium
IGEQQ

SEQ ID NO: 265866 - protein, 5 aa, Mycobacterium
IGERT

SEQ ID NO: 265867 - protein, 10 aa, Mycobacterium
IGERTRGRDW

SEQ ID NO: 265868 - protein, 9 aa, Mycobacterium
IGESGVPSS

SEQ ID NO: 265869 - protein, 5 aa, Mycobacterium
IGESS

SEQ ID NO: 265870 - protein, 4 aa, Mycobacterium
IGGA

SEQ ID NO: 265871 - protein, 11 aa, Mycobacterium
IGGAEEAEHSG

SEQ ID NO: 265872 - protein, 5 aa, Mycobacterium
IGGAP

SEQ ID NO: 265873 - protein, 14 aa, Mycobacterium
IGGDANAEGQARHR

SEQ ID NO: 265874 - protein, 7 aa, Mycobacterium
IGGEGEA

SEQ ID NO: 265875 - protein, 5 aa, Mycobacterium
IGGEY

SEQ ID NO: 265876 - protein, 6 aa, Mycobacterium
IGGGGK

SEQ ID NO: 265877 - protein, 7 aa, Mycobacterium
IGGGGRI

SEQ ID NO: 265878 - protein, 7 aa, Mycobacterium
IGGPATD

SEQ ID NO: 265879 - protein, 13 aa, Mycobacterium
IGGPPPDALRATE

SEQ ID NO: 265880 - protein, 8 aa, Mycobacterium
IGGPRRKG

SEQ ID NO: 265881 - protein, 6 aa, Mycobacterium
IGGPSA

SEQ ID NO: 265882 - protein, 15 aa, Mycobacterium
IGGPSERGYSYQPTD

SEQ ID NO: 265883 - protein, 7 aa, Mycobacterium
IGGRDRY

SEQ ID NO: 265884 - protein, 5 aa, Mycobacterium
IGGRE

SEQ ID NO: 265885 - protein, 18 aa, Mycobacterium
IGGRRAEDGFGEHSSGNA

SEQ ID NO: 265886 - protein, 17 aa, Mycobacterium
IGGRRSEDGFGEHSTGN

SEQ ID NO: 265887 - protein, 7 aa, Mycobacterium
IGGSGGV

SEQ ID NO: 265888 - protein, 14 aa, Mycobacterium
IGGSSVQVSGPAAG

SEQ ID NO: 265889 - protein, 16 aa, Mycobacterium
IGGSTGAGDDQATSSA

SEQ ID NO: 265890 - protein, 10 aa, Mycobacterium
IGGSTTPASW

SEQ ID NO: 265891 - protein, 9 aa, Mycobacterium
IGGSVRSSI

SEQ ID NO: 265892 - protein, 6 aa, Mycobacterium
IGGTHG

SEQ ID NO: 265893 - protein, 9 aa, Mycobacterium
IGGTPQDVP

SEQ ID NO: 265894 - protein, 12 aa, Mycobacterium
IGGTPSGIPFPG

SEQ ID NO: 265895 - protein, 4 aa, Mycobacterium
IGGV

SEQ ID NO: 265896 - protein, 8 aa, Mycobacterium
IGKDHPDS

SEQ ID NO: 265897 - protein, 8 aa, Mycobacterium
IGKDTEIS

SEQ ID NO: 265898 - protein, 9 aa, Mycobacterium
IGKGTTPDD

SEQ ID NO: 265899 - protein, 5 aa, Mycobacterium
IGLPA

SEQ ID NO: 265900 - protein, 7 aa, Mycobacterium
IGMTPAQ

SEQ ID NO: 265901 - protein, 5 aa, Mycobacterium
IGNGA

SEQ ID NO: 265902 - protein, 5 aa, Mycobacterium
IGNGS

SEQ ID NO: 265903 - protein, 7 aa, Mycobacterium
IGNGSTY

SEQ ID NO: 265904 - protein, 21 aa, Mycobacterium
IGNPGRAAKANDEAESPDEPQ

SEQ ID NO: 265905 - protein, 12 aa, Mycobacterium
IGNTPDGETQSL

SEQ ID NO: 265906 - protein, 5 aa, Mycobacterium
IGPAD

SEQ ID NO: 265907 - protein, 37 aa, Mycobacterium
IGPAPSPSETGGQPPSGHGGSPPPPQQQHRPRDGSQS

SEQ ID NO: 265908 - protein, 10 aa, Mycobacterium
IGPDATIRQA

SEQ ID NO: 265909 - protein, 13 aa, Mycobacterium
IGPDGQPSKFSLG

SEQ ID NO: 265910 - protein, 8 aa, Mycobacterium
IGPDGREL

SEQ ID NO: 265911 - protein, 104 aa, Mycobacterium
IGPDGVATTTVSQPPPPPPSSTSSTTTTTPSSSTTTTTTTTTTTTTTTTNTAPTTTTTRTTTAPPTTTPPPTTTQAPPPPTTEEPPPTVDPPDPIVTTVIPDGG

SEQ ID NO: 265912 - protein, 9 aa, Mycobacterium
IGPENQQVP

SEQ ID NO: 265913 - protein, 6 aa, Mycobacterium
IGPEPA

SEQ ID NO: 265914 - protein, 8 aa, Mycobacterium
IGPGGVGS

SEQ ID NO: 265915 - protein, 5 aa, Mycobacterium
IGPKA

SEQ ID NO: 265916 - protein, 12 aa, Mycobacterium
IGPKNASSTGTI

SEQ ID NO: 265917 - protein, 5 aa, Mycobacterium
IGPND

SEQ ID NO: 265918 - protein, 6 aa, Mycobacterium
IGPNDP

SEQ ID NO: 265919 - protein, 8 aa, Mycobacterium
IGPPGNAA

SEQ ID NO: 265920 - protein, 42 aa, Mycobacterium
IGPPTTVPVGPPPGAPGAPVGPGAPEVPVAPGAPGVPGAPPP

SEQ ID NO: 265921 - protein, 6 aa, Mycobacterium
IGPQPA

SEQ ID NO: 265922 - protein, 10 aa, Mycobacterium
IGPSGSGKST

SEQ ID NO: 265923 - protein, 10 aa, Mycobacterium
IGPSWSQAEP

SEQ ID NO: 265924 - protein, 13 aa, Mycobacterium
IGQDSPTNSASSV

SEQ ID NO: 265925 - protein, 4 aa, Mycobacterium
IGQE

SEQ ID NO: 265926 - protein, 8 aa, Mycobacterium
IGQGGTTI

SEQ ID NO: 265927 - protein, 9 aa, Mycobacterium
IGQNGKPVP

SEQ ID NO: 265928 - protein, 11 aa, Mycobacterium
IGQNGQPSNFS

SEQ ID NO: 265929 - protein, 21 aa, Mycobacterium
IGQPPAAVTTHPFDTRRGQLS

SEQ ID NO: 265930 - protein, 13 aa, Mycobacterium
IGQPPDNAGPRAQ

SEQ ID NO: 265931 - protein, 7 aa, Mycobacterium
IGQPSPV

SEQ ID NO: 265932 - protein, 9 aa, Mycobacterium
IGQSGTTQI

SEQ ID NO: 265933 - protein, 18 aa, Mycobacterium
IGQTDPEPTVPPTIAEGA

SEQ ID NO: 265934 - protein, 12 aa, Mycobacterium
IGQTQANKSVEA

SEQ ID NO: 265935 - protein, 6 aa, Mycobacterium
IGRATD

SEQ ID NO: 265936 - protein, 8 aa, Mycobacterium
IGRATDND

SEQ ID NO: 265937 - protein, 6 aa, Mycobacterium
IGRDGR

SEQ ID NO: 265938 - protein, 7 aa, Mycobacterium
IGRDPTE

SEQ ID NO: 265939 - protein, 10 aa, Mycobacterium
IGREAHRRAP

SEQ ID NO: 265940 - protein, 4 aa, Mycobacterium
IGRK

SEQ ID NO: 265941 - protein, 6 aa, Mycobacterium
IGRKKS

SEQ ID NO: 265942 - protein, 4 aa, Mycobacterium
IGRR

SEQ ID NO: 265943 - protein, 8 aa, Mycobacterium
IGRRENGS

SEQ ID NO: 265944 - protein, 5 aa, Mycobacterium
IGRRP

SEQ ID NO: 265945 - protein, 7 aa, Mycobacterium
IGRRPAA

SEQ ID NO: 265946 - protein, 37 aa, Mycobacterium
IGRRRKASHGPEPIRADHASDTPSTNGQPIRSTEVNQ

SEQ ID NO: 265947 - protein, 8 aa, Mycobacterium
IGRSSDND

SEQ ID NO: 265948 - protein, 11 aa, Mycobacterium
IGRTGGDDATP

SEQ ID NO: 265949 - protein, 5 aa, Mycobacterium
IGRTR

SEQ ID NO: 265950 - protein, 5 aa, Mycobacterium
IGSAS

SEQ ID NO: 265951 - protein, 4 aa, Mycobacterium
IGSG

SEQ ID NO: 265952 - protein, 14 aa, Mycobacterium
IGSGGSGGREGPAA

SEQ ID NO: 265953 - protein, 9 aa, Mycobacterium
IGSGRAPTM

SEQ ID NO: 265954 - protein, 8 aa, Mycobacterium
IGSGVADA

SEQ ID NO: 265955 - protein, 7 aa, Mycobacterium
IGSPAGD

SEQ ID NO: 265956 - protein, 8 aa, Mycobacterium
IGSPASRV

SEQ ID NO: 265957 - protein, 7 aa, Mycobacterium
IGSPDGP

SEQ ID NO: 265958 - protein, 6 aa, Mycobacterium
IGSPPE

SEQ ID NO: 265959 - protein, 7 aa, Mycobacterium
IGSPTSR

SEQ ID NO: 265960 - protein, 6 aa, Mycobacterium
IGSQGG

SEQ ID NO: 265961 - protein, 6 aa, Mycobacterium
IGSRDA

SEQ ID NO: 265962 - protein, 10 aa, Mycobacterium
IGSSGLDTPT

SEQ ID NO: 265963 - protein, 6 aa, Mycobacterium
IGSSST

SEQ ID NO: 265964 - protein, 8 aa, Mycobacterium
IGSSTPAT

SEQ ID NO: 265965 - protein, 12 aa, Mycobacterium
IGSTHSTHGSPH

SEQ ID NO: 265966 - protein, 8 aa, Mycobacterium
IGSTPSRL

SEQ ID NO: 265967 - protein, 20 aa, Mycobacterium
IGSVSDGPHDGIANPEGQDI

SEQ ID NO: 265968 - protein, 7 aa, Mycobacterium
IGTASDA

SEQ ID NO: 265969 - protein, 11 aa, Mycobacterium
IGTASGKARYE

SEQ ID NO: 265970 - protein, 4 aa, Mycobacterium
IGTE

SEQ ID NO: 265971 - protein, 5 aa, Mycobacterium
IGTGG

SEQ ID NO: 265972 - protein, 8 aa, Mycobacterium
IGTGGPTR

SEQ ID NO: 265973 - protein, 14 aa, Mycobacterium
IGTGHSSVGDQDKA

SEQ ID NO: 265974 - protein, 6 aa, Mycobacterium
IGTGTH

SEQ ID NO: 265975 - protein, 8 aa, Mycobacterium
IGTKPPSW

SEQ ID NO: 265976 - protein, 10 aa, Mycobacterium
IGTNPPKGQM

SEQ ID NO: 265977 - protein, 5 aa, Mycobacterium
IGTPD

SEQ ID NO: 265978 - protein, 5 aa, Mycobacterium
IGTPE

SEQ ID NO: 265979 - protein, 7 aa, Mycobacterium
IGTPSEI

SEQ ID NO: 265980 - protein, 6 aa, Mycobacterium
IGTRGS

SEQ ID NO: 265981 - protein, 4 aa, Mycobacterium
IGTS

SEQ ID NO: 265982 - protein, 5 aa, Mycobacterium
IGTSG

SEQ ID NO: 265983 - protein, 6 aa, Mycobacterium
IGTSGL

SEQ ID NO: 265984 - protein, 14 aa, Mycobacterium
IGTSPSNSRAPAEV

SEQ ID NO: 265985 - protein, 6 aa, Mycobacterium
IGTTPA

SEQ ID NO: 265986 - protein, 11 aa, Mycobacterium
IGTYAGTREPL

SEQ ID NO: 265987 - protein, 4 aa, Mycobacterium
IGVN

SEQ ID NO: 265988 - protein, 12 aa, Mycobacterium
IGVQPGGPAPET

SEQ ID NO: 265989 - protein, 5 aa, Mycobacterium
IGYNT

SEQ ID NO: 265990 - protein, 7 aa, Mycobacterium
IHDGPQQ

SEQ ID NO: 265991 - protein, 12 aa, Mycobacterium
IHGEQRADGRNG

SEQ ID NO: 265992 - protein, 4 aa, Mycobacterium
IHKQ

SEQ ID NO: 265993 - protein, 6 aa, Mycobacterium
IHKQRQ

SEQ ID NO: 265994 - protein, 5 aa, Mycobacterium
IHNSQ

SEQ ID NO: 265995 - protein, 7 aa, Mycobacterium
IHRDENQ

SEQ ID NO: 265996 - protein, 4 aa, Mycobacterium
IHRQ

SEQ ID NO: 265997 - protein, 19 aa, Mycobacterium
IHTPAGTTVTTSLTATDTG

SEQ ID NO: 265998 - protein, 4 aa, Mycobacterium
IKDD

SEQ ID NO: 265999 - protein, 10 aa, Mycobacterium
IKEAKGFGGF

SEQ ID NO: 266000 - protein, 10 aa, Mycobacterium
IKEATAAARE

SEQ ID NO: 266001 - protein, 21 aa, Mycobacterium
IKESHRYTQTKARVQGRATRP

SEQ ID NO: 266002 - protein, 16 aa, Mycobacterium
IKGAPGAAADKAVTSL

SEQ ID NO: 266003 - protein, 8 aa, Mycobacterium
IKGDASAG

SEQ ID NO: 266004 - protein, 12 aa, Mycobacterium
IKGDQPGQTANG

SEQ ID NO: 266005 - protein, 6 aa, Mycobacterium
IKGDSS

SEQ ID NO: 266006 - protein, 7 aa, Mycobacterium
IKGRSTF

SEQ ID NO: 266007 - protein, 7 aa, Mycobacterium
IKGTPLE

SEQ ID NO: 266008 - protein, 11 aa, Mycobacterium
IKNVSDSEIEN

SEQ ID NO: 266009 - protein, 8 aa, Mycobacterium
IKPDVPAS

SEQ ID NO: 266010 - protein, 4 aa, Mycobacterium
IKPG

SEQ ID NO: 266011 - protein, 5 aa, Mycobacterium
IKPKA

SEQ ID NO: 266012 - protein, 6 aa, Mycobacterium
IKPSSI

SEQ ID NO: 266013 - protein, 8 aa, Mycobacterium
IKSTSPDT

SEQ ID NO: 266014 - protein, 18 aa, Mycobacterium
IKTATGLESAASSSASIP

SEQ ID NO: 266015 - protein, 12 aa, Mycobacterium
IKTGKDTSSGSL

SEQ ID NO: 266016 - protein, 12 aa, Mycobacterium
ILEGESGANDPV

SEQ ID NO: 266017 - protein, 10 aa, Mycobacterium
ILPPGEDDAI

SEQ ID NO: 266018 - protein, 5 aa, Mycobacterium
INADK

SEQ ID NO: 266019 - protein, 7 aa, Mycobacterium
INADPRP

SEQ ID NO: 266020 - protein, 5 aa, Mycobacterium
INADS

SEQ ID NO: 266021 - protein, 4 aa, Mycobacterium
INAE

SEQ ID NO: 266022 - protein, 11 aa, Mycobacterium
INAQSSPEEVQ

SEQ ID NO: 266023 - protein, 11 aa, Mycobacterium
INATPDENDPL

SEQ ID NO: 266024 - protein, 7 aa, Mycobacterium
INDAPAL

SEQ ID NO: 266025 - protein, 9 aa, Mycobacterium
INDAPALAQ

SEQ ID NO: 266026 - protein, 16 aa, Mycobacterium
INDGGQSQRAISSSTG

SEQ ID NO: 266027 - protein, 6 aa, Mycobacterium
INEQNQ

SEQ ID NO: 266028 - protein, 10 aa, Mycobacterium
INFSGGQRQR

SEQ ID NO: 266029 - protein, 18 aa, Mycobacterium
INGAKGGPGGQPGCGALP

SEQ ID NO: 266030 - protein, 8 aa, Mycobacterium
INGASSAE

SEQ ID NO: 266031 - protein, 4 aa, Mycobacterium
INGD

SEQ ID NO: 266032 - protein, 16 aa, Mycobacterium
INGDNVKSAQIDDREQ

SEQ ID NO: 266033 - protein, 10 aa, Mycobacterium
INGDTASSRV

SEQ ID NO: 266034 - protein, 4 aa, Mycobacterium
INGN

SEQ ID NO: 266035 - protein, 16 aa, Mycobacterium
INGNETGSASGPREGM

SEQ ID NO: 266036 - protein, 7 aa, Mycobacterium
INGPAGS

SEQ ID NO: 266037 - protein, 7 aa, Mycobacterium
INGPTSA

SEQ ID NO: 266038 - protein, 6 aa, Mycobacterium
INGQNQ

SEQ ID NO: 266039 - protein, 4 aa, Mycobacterium
INGT

SEQ ID NO: 266040 - protein, 10 aa, Mycobacterium
INHGNSGGPL

SEQ ID NO: 266041 - protein, 8 aa, Mycobacterium
INLSGGQR

SEQ ID NO: 266042 - protein, 7 aa, Mycobacterium
INPDSRL

SEQ ID NO: 266043 - protein, 7 aa, Mycobacterium
INPEASR

SEQ ID NO: 266044 - protein, 10 aa, Mycobacterium
INPGEAAKKL

SEQ ID NO: 266045 - protein, 10 aa, Mycobacterium
INPNETPSPW

SEQ ID NO: 266046 - protein, 15 aa, Mycobacterium
INPNPSLADPNPPLP

SEQ ID NO: 266047 - protein, 5 aa, Mycobacterium
INPRE

SEQ ID NO: 266048 - protein, 45 aa, Mycobacterium
INPTPNLTDPNPPLAPGITPSPPVPGSANPDNPSPGAPATPQPHQ

SEQ ID NO: 266049 - protein, 16 aa, Mycobacterium
INSDNVKSAQIDDREQ

SEQ ID NO: 266050 - protein, 12 aa, Mycobacterium
INSRAEDYGSGQ

SEQ ID NO: 266051 - protein, 16 aa, Mycobacterium
INTAGDQGSTLGNESV

SEQ ID NO: 266052 - protein, 9 aa, Mycobacterium
INTERRTRN

SEQ ID NO: 266053 - protein, 8 aa, Mycobacterium
INTPTTAT

SEQ ID NO: 266054 - protein, 6 aa, Mycobacterium
INTTGT

SEQ ID NO: 266055 - protein, 8 aa, Mycobacterium
IPAEGKTI

SEQ ID NO: 266056 - protein, 6 aa, Mycobacterium
IPAEGN

SEQ ID NO: 266057 - protein, 7 aa, Mycobacterium
IPAEGQT

SEQ ID NO: 266058 - protein, 5 aa, Mycobacterium
IPAES

SEQ ID NO: 266059 - protein, 21 aa, Mycobacterium
IPAESVPARAPHSVEGGNPGV

SEQ ID NO: 266060 - protein, 20 aa, Mycobacterium
IPAESVPTRAPYSASVGETG

SEQ ID NO: 266061 - protein, 7 aa, Mycobacterium
IPAGGGV

SEQ ID NO: 266062 - protein, 7 aa, Mycobacterium
IPAGKTV

SEQ ID NO: 266063 - protein, 9 aa, Mycobacterium
IPAGPPAPR

SEQ ID NO: 266064 - protein, 6 aa, Mycobacterium
IPAGTV

SEQ ID NO: 266065 - protein, 4 aa, Mycobacterium
IPAH

SEQ ID NO: 266066 - protein, 8 aa, Mycobacterium
IPANAGYA

SEQ ID NO: 266067 - protein, 8 aa, Mycobacterium
IPANGTAK

SEQ ID NO: 266068 - protein, 7 aa, Mycobacterium
IPANQGF

SEQ ID NO: 266069 - protein, 8 aa, Mycobacterium
IPANQGYA

SEQ ID NO: 266070 - protein, 5 aa, Mycobacterium
IPAPG

SEQ ID NO: 266071 - protein, 14 aa, Mycobacterium
IPAPGDATPSAPAM

SEQ ID NO: 266072 - protein, 8 aa, Mycobacterium
IPAPQANS

SEQ ID NO: 266073 - protein, 9 aa, Mycobacterium
IPAPSAPDK

SEQ ID NO: 266074 - protein, 12 aa, Mycobacterium
IPAPSGAAIATS

SEQ ID NO: 266075 - protein, 12 aa, Mycobacterium
IPAPSGAAIATT

SEQ ID NO: 266076 - protein, 12 aa, Mycobacterium
IPAPSQRRPDIP

SEQ ID NO: 266077 - protein, 7 aa, Mycobacterium
IPARPDT

SEQ ID NO: 266078 - protein, 11 aa, Mycobacterium
IPASETTIPQA

SEQ ID NO: 266079 - protein, 5 aa, Mycobacterium
IPASS

SEQ ID NO: 266080 - protein, 5 aa, Mycobacterium
IPATG

SEQ ID NO: 266081 - protein, 8 aa, Mycobacterium
IPATLAGS

SEQ ID NO: 266082 - protein, 5 aa, Mycobacterium
IPATP

SEQ ID NO: 266083 - protein, 6 aa, Mycobacterium
IPATQG

SEQ ID NO: 266084 - protein, 14 aa, Mycobacterium
IPAYTESGEPFPER

SEQ ID NO: 266085 - protein, 12 aa, Mycobacterium
IPDAQRYLKMRR

SEQ ID NO: 266086 - protein, 4 aa, Mycobacterium
IPDD

SEQ ID NO: 266087 - protein, 8 aa, Mycobacterium
IPDEGETV

SEQ ID NO: 266088 - protein, 9 aa, Mycobacterium
IPDEGLSKT

SEQ ID NO: 266089 - protein, 8 aa, Mycobacterium
IPDEPPSA

SEQ ID NO: 266090 - protein, 5 aa, Mycobacterium
IPDGE

SEQ ID NO: 266091 - protein, 9 aa, Mycobacterium
IPDGGGGSI

SEQ ID NO: 266092 - protein, 12 aa, Mycobacterium
IPDNSERPTPAG

SEQ ID NO: 266093 - protein, 8 aa, Mycobacterium
IPDPARRV

SEQ ID NO: 266094 - protein, 9 aa, Mycobacterium
IPDPASAAM

SEQ ID NO: 266095 - protein, 6 aa, Mycobacterium
IPDSAT

SEQ ID NO: 266096 - protein, 12 aa, Mycobacterium
IPDSQRLGTPAA

SEQ ID NO: 266097 - protein, 7 aa, Mycobacterium
IPDTTPG

SEQ ID NO: 266098 - protein, 4 aa, Mycobacterium
IPEA

SEQ ID NO: 266099 - protein, 6 aa, Mycobacterium
IPEDTE

SEQ ID NO: 266100 - protein, 4 aa, Mycobacterium
IPEE

SEQ ID NO: 266101 - protein, 12 aa, Mycobacterium
IPEGGPSPIGVS

SEQ ID NO: 266102 - protein, 20 aa, Mycobacterium
IPEPAAAAPPRRGSGRARMT

SEQ ID NO: 266103 - protein, 4 aa, Mycobacterium
IPER

SEQ ID NO: 266104 - protein, 5 aa, Mycobacterium
IPERT

SEQ ID NO: 266105 - protein, 7 aa, Mycobacterium
IPESLPD

SEQ ID NO: 266106 - protein, 6 aa, Mycobacterium
IPESPR

SEQ ID NO: 266107 - protein, 10 aa, Mycobacterium
IPESPSPRRL

SEQ ID NO: 266108 - protein, 7 aa, Mycobacterium
IPETGEA

SEQ ID NO: 266109 - protein, 4 aa, Mycobacterium
IPEY

SEQ ID NO: 266110 - protein, 24 aa, Mycobacterium
IPGAEQAPPPAAEAPQAEDESKPF

SEQ ID NO: 266111 - protein, 11 aa, Mycobacterium
IPGAGGGTGQA

SEQ ID NO: 266112 - protein, 8 aa, Mycobacterium
IPGAGSVG

SEQ ID NO: 266113 - protein, 11 aa, Mycobacterium
IPGAGTPNTVG

SEQ ID NO: 266114 - protein, 17 aa, Mycobacterium
IPGAPYATPVSGDTTST

SEQ ID NO: 266115 - protein, 7 aa, Mycobacterium
IPGDGHA

SEQ ID NO: 266116 - protein, 9 aa, Mycobacterium
IPGEGNHAR

SEQ ID NO: 266117 - protein, 5 aa, Mycobacterium
IPGEP

SEQ ID NO: 266118 - protein, 5 aa, Mycobacterium
IPGES

SEQ ID NO: 266119 - protein, 8 aa, Mycobacterium
IPGETEVS

SEQ ID NO: 266120 - protein, 5 aa, Mycobacterium
IPGGA

SEQ ID NO: 266121 - protein, 6 aa, Mycobacterium
IPGGAM

SEQ ID NO: 266122 - protein, 11 aa, Mycobacterium
IPGGAQDTVKR

SEQ ID NO: 266123 - protein, 6 aa, Mycobacterium
IPGGAV

SEQ ID NO: 266124 - protein, 10 aa, Mycobacterium
IPGGGGGSIE

SEQ ID NO: 266125 - protein, 19 aa, Mycobacterium
IPGGRTQISGGDPPFTAAT

SEQ ID NO: 266126 - protein, 19 aa, Mycobacterium
IPGGRTQITGGDPPFTAAT

SEQ ID NO: 266127 - protein, 5 aa, Mycobacterium
IPGHG

SEQ ID NO: 266128 - protein, 4 aa, Mycobacterium
IPGI

SEQ ID NO: 266129 - protein, 4 aa, Mycobacterium
IPGK

SEQ ID NO: 266130 - protein, 6 aa, Mycobacterium
IPGKPR

SEQ ID NO: 266131 - protein, 29 aa, Mycobacterium
IPGKRAATPRECRDPKPYVPAGTNPWYGD

SEQ ID NO: 266132 - protein, 4 aa, Mycobacterium
IPGQ

SEQ ID NO: 266133 - protein, 14 aa, Mycobacterium
IPGQQAGKYGPLGG

SEQ ID NO: 266134 - protein, 5 aa, Mycobacterium
IPGQR

SEQ ID NO: 266135 - protein, 9 aa, Mycobacterium
IPGRGSVTD

SEQ ID NO: 266136 - protein, 6 aa, Mycobacterium
IPGSAT

SEQ ID NO: 266137 - protein, 5 aa, Mycobacterium
IPGSG

SEQ ID NO: 266138 - protein, 8 aa, Mycobacterium
IPGSGTVT

SEQ ID NO: 266139 - protein, 12 aa, Mycobacterium
IPGSPEMSLPPA

SEQ ID NO: 266140 - protein, 8 aa, Mycobacterium
IPGVASGP

SEQ ID NO: 266141 - protein, 4 aa, Mycobacterium
IPHD

SEQ ID NO: 266142 - protein, 8 aa, Mycobacterium
IPITTSGK

SEQ ID NO: 266143 - protein, 5 aa, Mycobacterium
IPKDK

SEQ ID NO: 266144 - protein, 8 aa, Mycobacterium
IPKEPLDA

SEQ ID NO: 266145 - protein, 6 aa, Mycobacterium
IPKGKL

SEQ ID NO: 266146 - protein, 5 aa, Mycobacterium
IPKGT

SEQ ID NO: 266147 - protein, 9 aa, Mycobacterium
IPKPAPPRD

SEQ ID NO: 266148 - protein, 17 aa, Mycobacterium
IPKPSGDGGNPGSPGFD

SEQ ID NO: 266149 - protein, 8 aa, Mycobacterium
IPKQSRTS

SEQ ID NO: 266150 - protein, 15 aa, Mycobacterium
IPKVTDKSYRSASQP

SEQ ID NO: 266151 - protein, 12 aa, Mycobacterium
IPNADPNAYQNA

SEQ ID NO: 266152 - protein, 101 aa, Mycobacterium
IPNPGRGPAGGSLGPGRRGHFGGGAPGRSGPSGGGHGGQFGGGGHGGRFGGGGHGGGFGGGRGGGGHGGGFGGFGGGHGGGGHGGGFGGGHGGGFGGGHGG

SEQ ID NO: 266153 - protein, 8 aa, Mycobacterium
IPNRGTVT

SEQ ID NO: 266154 - protein, 39 aa, Mycobacterium
IPPADAKKPSGPKRPTADTPTGIGGHDDVTDDDREGAAQ

SEQ ID NO: 266155 - protein, 5 aa, Mycobacterium
IPPAR

SEQ ID NO: 266156 - protein, 5 aa, Mycobacterium
IPPDA

SEQ ID NO: 266157 - protein, 48 aa, Mycobacterium
IPPDADPDPGTPIAGPPPPGVVPGPGPAPHQPAQPAPPPNDNGPPPPF

SEQ ID NO: 266158 - protein, 48 aa, Mycobacterium
IPPDSDPDPGTPIVGPPPPGVIPGPPPAPNQPAQPAPPPNDNGPPPPF

SEQ ID NO: 266159 - protein, 5 aa, Mycobacterium
IPPGD

SEQ ID NO: 266160 - protein, 20 aa, Mycobacterium
IPPGDIPTLPNTPSPKPMPN

SEQ ID NO: 266161 - protein, 5 aa, Mycobacterium
IPPHD

SEQ ID NO: 266162 - protein, 4 aa, Mycobacterium
IPPM

SEQ ID NO: 266163 - protein, 7 aa, Mycobacterium
IPPPAMN

SEQ ID NO: 266164 - protein, 9 aa, Mycobacterium
IPPPDRSPI

SEQ ID NO: 266165 - protein, 7 aa, Mycobacterium
IPPPEGK

SEQ ID NO: 266166 - protein, 6 aa, Mycobacterium
IPPPEP

SEQ ID NO: 266167 - protein, 8 aa, Mycobacterium
IPPPGDQR

SEQ ID NO: 266168 - protein, 7 aa, Mycobacterium
IPPPNGV

SEQ ID NO: 266169 - protein, 18 aa, Mycobacterium
IPPPPDMTPEQRKAYKAP

SEQ ID NO: 266170 - protein, 15 aa, Mycobacterium
IPPPPHSALGQRGKL

SEQ ID NO: 266171 - protein, 7 aa, Mycobacterium
IPPPQIP

SEQ ID NO: 266172 - protein, 8 aa, Mycobacterium
IPPPQLPP

SEQ ID NO: 266173 - protein, 6 aa, Mycobacterium
IPPSAM

SEQ ID NO: 266174 - protein, 19 aa, Mycobacterium
IPPSDIPPLPNTPSPKPMP

SEQ ID NO: 266175 - protein, 10 aa, Mycobacterium
IPPSSLRGGP

SEQ ID NO: 266176 - protein, 6 aa, Mycobacterium
IPPTRF

SEQ ID NO: 266177 - protein, 5 aa, Mycobacterium
IPPVP

SEQ ID NO: 266178 - protein, 11 aa, Mycobacterium
IPQDIPANQGF

SEQ ID NO: 266179 - protein, 5 aa, Mycobacterium
IPQGQ

SEQ ID NO: 266180 - protein, 11 aa, Mycobacterium
IPQPAAQPNAL

SEQ ID NO: 266181 - protein, 15 aa, Mycobacterium
IPQPAEPARKPRSRR

SEQ ID NO: 266182 - protein, 5 aa, Mycobacterium
IPQPP

SEQ ID NO: 266183 - protein, 8 aa, Mycobacterium
IPQPSTVR

SEQ ID NO: 266184 - protein, 12 aa, Mycobacterium
IPQPTALRPGIP

SEQ ID NO: 266185 - protein, 8 aa, Mycobacterium
IPQPTPSS

SEQ ID NO: 266186 - protein, 17 aa, Mycobacterium
IPQVSNDTEATPATTSH

SEQ ID NO: 266187 - protein, 5 aa, Mycobacterium
IPRAP

SEQ ID NO: 266188 - protein, 9 aa, Mycobacterium
IPRAPHDQD

SEQ ID NO: 266189 - protein, 5 aa, Mycobacterium
IPRDD

SEQ ID NO: 266190 - protein, 12 aa, Mycobacterium
IPRDDNDKGPQL

SEQ ID NO: 266191 - protein, 28 aa, Mycobacterium
IPRDEPPPERRNRSRTPRRPQPDSWEYD

SEQ ID NO: 266192 - protein, 11 aa, Mycobacterium
IPRDGAGVSRK

SEQ ID NO: 266193 - protein, 7 aa, Mycobacterium
IPRDTAT

SEQ ID NO: 266194 - protein, 6 aa, Mycobacterium
IPRGDE

SEQ ID NO: 266195 - protein, 10 aa, Mycobacterium
IPRPSDVDPR

SEQ ID NO: 266196 - protein, 12 aa, Mycobacterium
IPRRSSMGGPQR

SEQ ID NO: 266197 - protein, 10 aa, Mycobacterium
IPRSDSPAGF

SEQ ID NO: 266198 - protein, 9 aa, Mycobacterium
IPRSPNDQD

SEQ ID NO: 266199 - protein, 19 aa, Mycobacterium
IPRTSVPPRTQHSADWRKP

SEQ ID NO: 266200 - protein, 22 aa, Mycobacterium
IPRTTSGKLARRSCRASYLDGT

SEQ ID NO: 266201 - protein, 12 aa, Mycobacterium
IPRTTSGKRQRL

SEQ ID NO: 266202 - protein, 11 aa, Mycobacterium
IPSAGAPGDPV

SEQ ID NO: 266203 - protein, 11 aa, Mycobacterium
IPSARPGQTFE

SEQ ID NO: 266204 - protein, 5 aa, Mycobacterium
IPSGP

SEQ ID NO: 266205 - protein, 6 aa, Mycobacterium
IPSGQL

SEQ ID NO: 266206 - protein, 11 aa, Mycobacterium
IPSLSERTKPV

SEQ ID NO: 266207 - protein, 4 aa, Mycobacterium
IPSP

SEQ ID NO: 266208 - protein, 9 aa, Mycobacterium
IPSPPPIPP

SEQ ID NO: 266209 - protein, 8 aa, Mycobacterium
IPSSGPAI

SEQ ID NO: 266210 - protein, 8 aa, Mycobacterium
IPSSTPLA

SEQ ID NO: 266211 - protein, 5 aa, Mycobacterium
IPSTA

SEQ ID NO: 266212 - protein, 5 aa, Mycobacterium
IPSYD

SEQ ID NO: 266213 - protein, 8 aa, Mycobacterium
IPSYSGGR

SEQ ID NO: 266214 - protein, 7 aa, Mycobacterium
IPTATSG

SEQ ID NO: 266215 - protein, 4 aa, Mycobacterium
IPTD

SEQ ID NO: 266216 - protein, 6 aa, Mycobacterium
IPTGAE

SEQ ID NO: 266217 - protein, 7 aa, Mycobacterium
IPTGAET

SEQ ID NO: 266218 - protein, 6 aa, Mycobacterium
IPTGTL

SEQ ID NO: 266219 - protein, 7 aa, Mycobacterium
IPTMSSG

SEQ ID NO: 266220 - protein, 8 aa, Mycobacterium
IPTPEPTS

SEQ ID NO: 266221 - protein, 13 aa, Mycobacterium
IPTSRTSSPYSLT

SEQ ID NO: 266222 - protein, 13 aa, Mycobacterium
IPTSTPADQGIQA

SEQ ID NO: 266223 - protein, 16 aa, Mycobacterium
IPTTEPPPKAPPPQTV

SEQ ID NO: 266224 - protein, 33 aa, Mycobacterium
IPTVPEPALQPGSEPGAARGRKRGRSADKQDTI

SEQ ID NO: 266225 - protein, 22 aa, Mycobacterium
IPVDDRNGLEGDRVGDKVEAEQ

SEQ ID NO: 266226 - protein, 18 aa, Mycobacterium
IPVDGTVAEGTSDVDESM

SEQ ID NO: 266227 - protein, 6 aa, Mycobacterium
IPVETK

SEQ ID NO: 266228 - protein, 11 aa, Mycobacterium
IPVPGETVDNE

SEQ ID NO: 266229 - protein, 14 aa, Mycobacterium
IPVPSGAAAATTAA

SEQ ID NO: 266230 - protein, 8 aa, Mycobacterium
IQAATPDH

SEQ ID NO: 266231 - protein, 5 aa, Mycobacterium
IQAGV

SEQ ID NO: 266232 - protein, 7 aa, Mycobacterium
IQANESV

SEQ ID NO: 266233 - protein, 8 aa, Mycobacterium
IQANQSVD

SEQ ID NO: 266234 - protein, 31 aa, Mycobacterium
IQAPSEKPTASEQPDAGGFAGDTRSDQTFGD

SEQ ID NO: 266235 - protein, 8 aa, Mycobacterium
IQATGTHS

SEQ ID NO: 266236 - protein, 5 aa, Mycobacterium
IQATT

SEQ ID NO: 266237 - protein, 6 aa, Mycobacterium
IQDDGT

SEQ ID NO: 266238 - protein, 6 aa, Mycobacterium
IQDDPG

SEQ ID NO: 266239 - protein, 5 aa, Mycobacterium
IQEEN

SEQ ID NO: 266240 - protein, 12 aa, Mycobacterium
IQETEEIPAKSD

SEQ ID NO: 266241 - protein, 4 aa, Mycobacterium
IQGA

SEQ ID NO: 266242 - protein, 5 aa, Mycobacterium
IQGDG

SEQ ID NO: 266243 - protein, 6 aa, Mycobacterium
IQGGSA

SEQ ID NO: 266244 - protein, 14 aa, Mycobacterium
IQGGSAAKLLGSTA

SEQ ID NO: 266245 - protein, 4 aa, Mycobacterium
IQGR

SEQ ID NO: 266246 - protein, 5 aa, Mycobacterium
IQGTG

SEQ ID NO: 266247 - protein, 4 aa, Mycobacterium
IQGV

SEQ ID NO: 266248 - protein, 10 aa, Mycobacterium
IQLPGDTTTL

SEQ ID NO: 266249 - protein, 5 aa, Mycobacterium
IQNPS

SEQ ID NO: 266250 - protein, 5 aa, Mycobacterium
IQPDT

SEQ ID NO: 266251 - protein, 4 aa, Mycobacterium
IQPG

SEQ ID NO: 266252 - protein, 5 aa, Mycobacterium
IQPGE

SEQ ID NO: 266253 - protein, 7 aa, Mycobacterium
IQPGPTL

SEQ ID NO: 266254 - protein, 19 aa, Mycobacterium
IQPGSLTKADAPEGDSLAA

SEQ ID NO: 266255 - protein, 5 aa, Mycobacterium
IQPKP

SEQ ID NO: 266256 - protein, 6 aa, Mycobacterium
IQPPRG

SEQ ID NO: 266257 - protein, 19 aa, Mycobacterium
IQPRSYEDLSTALDQALAR

SEQ ID NO: 266258 - protein, 13 aa, Mycobacterium
IQPSETGKSFPDN

SEQ ID NO: 266259 - protein, 7 aa, Mycobacterium
IQPSKRA

SEQ ID NO: 266260 - protein, 4 aa, Mycobacterium
IQPY

SEQ ID NO: 266261 - protein, 6 aa, Mycobacterium
IQQSGK

SEQ ID NO: 266262 - protein, 6 aa, Mycobacterium
IQRPDK

SEQ ID NO: 266263 - protein, 6 aa, Mycobacterium
IQSESM

SEQ ID NO: 266264 - protein, 7 aa, Mycobacterium
IQSESTN

SEQ ID NO: 266265 - protein, 6 aa, Mycobacterium
IQTEQT

SEQ ID NO: 266266 - protein, 6 aa, Mycobacterium
IQTGSK

SEQ ID NO: 266267 - protein, 6 aa, Mycobacterium
IQTPDE

SEQ ID NO: 266268 - protein, 25 aa, Mycobacterium
IRAGGGTLDVSSPAGGPSTIAVALP

SEQ ID NO: 266269 - protein, 14 aa, Mycobacterium
IRDAERGGPLGHAA

SEQ ID NO: 266270 - protein, 10 aa, Mycobacterium
IRDEGAYGPY

SEQ ID NO: 266271 - protein, 8 aa, Mycobacterium
IRDSDDDA

SEQ ID NO: 266272 - protein, 13 aa, Mycobacterium
IRDSPAVTAEPRT

SEQ ID NO: 266273 - protein, 45 aa, Mycobacterium
IREAARDETPQVRQREARADETAARARAAQAESNVKAAQASGLQQ

SEQ ID NO: 266274 - protein, 5 aa, Mycobacterium
IREDD

SEQ ID NO: 266275 - protein, 19 aa, Mycobacterium
IREDGPPSHAKKRGTPSMG

SEQ ID NO: 266276 - protein, 5 aa, Mycobacterium
IREGE

SEQ ID NO: 266277 - protein, 12 aa, Mycobacterium
IREPESQSAEDD

SEQ ID NO: 266278 - protein, 10 aa, Mycobacterium
IREQSESLGY

SEQ ID NO: 266279 - protein, 16 aa, Mycobacterium
IRESGGDRSAVTGGTT

SEQ ID NO: 266280 - protein, 17 aa, Mycobacterium
IRESGGDRSSVTGGTTV

SEQ ID NO: 266281 - protein, 9 aa, Mycobacterium
IRESVSGAL

SEQ ID NO: 266282 - protein, 8 aa, Mycobacterium
IRGAADEA

SEQ ID NO: 266283 - protein, 8 aa, Mycobacterium
IRGARRPG

SEQ ID NO: 266284 - protein, 5 aa, Mycobacterium
IRGDA

SEQ ID NO: 266285 - protein, 21 aa, Mycobacterium
IRGDTDRSAAERYLARYRSNA

SEQ ID NO: 266286 - protein, 11 aa, Mycobacterium
IRGGGDQQTAV

SEQ ID NO: 266287 - protein, 17 aa, Mycobacterium
IRGGVSAAAEALGPGAL

SEQ ID NO: 266288 - protein, 11 aa, Mycobacterium
IRGKPDLAERN

SEQ ID NO: 266289 - protein, 16 aa, Mycobacterium
IRGPEPVQGPSRPGRV

SEQ ID NO: 266290 - protein, 24 aa, Mycobacterium
IRGPPRSPVAQTGRDVLVRLCIAR

SEQ ID NO: 266291 - protein, 9 aa, Mycobacterium
IRGPQKTIE

SEQ ID NO: 266292 - protein, 6 aa, Mycobacterium
IRGQPQ

SEQ ID NO: 266293 - protein, 6 aa, Mycobacterium
IRGSEE

SEQ ID NO: 266294 - protein, 5 aa, Mycobacterium
IRGTY

SEQ ID NO: 266295 - protein, 18 aa, Mycobacterium
IRKQTGLNSPRPTPVLAE

SEQ ID NO: 266296 - protein, 8 aa, Mycobacterium
IRNAESSA

SEQ ID NO: 266297 - protein, 4 aa, Mycobacterium
IRNR

SEQ ID NO: 266298 - protein, 4 aa, Mycobacterium
IRPD

SEQ ID NO: 266299 - protein, 8 aa, Mycobacterium
IRPDAGDT

SEQ ID NO: 266300 - protein, 8 aa, Mycobacterium
IRPGDPAV

SEQ ID NO: 266301 - protein, 13 aa, Mycobacterium
IRPPAEPTETTQV

SEQ ID NO: 266302 - protein, 7 aa, Mycobacterium
IRPRPRR

SEQ ID NO: 266303 - protein, 11 aa, Mycobacterium
IRPTPQPRERK

SEQ ID NO: 266304 - protein, 8 aa, Mycobacterium
IRQSEDPR

SEQ ID NO: 266305 - protein, 4 aa, Mycobacterium
IRRA

SEQ ID NO: 266306 - protein, 12 aa, Mycobacterium
IRRSDPDLDPRD

SEQ ID NO: 266307 - protein, 5 aa, Mycobacterium
IRSAD

SEQ ID NO: 266308 - protein, 5 aa, Mycobacterium
IRSDN

SEQ ID NO: 266309 - protein, 6 aa, Mycobacterium
IRSDNP

SEQ ID NO: 266310 - protein, 10 aa, Mycobacterium
IRSGDGRGYG

SEQ ID NO: 266311 - protein, 14 aa, Mycobacterium
IRSSATLPPWPSPP

SEQ ID NO: 266312 - protein, 6 aa, Mycobacterium
IRSSNT

SEQ ID NO: 266313 - protein, 16 aa, Mycobacterium
IRSSPNPNPSKLDDTS

SEQ ID NO: 266314 - protein, 16 aa, Mycobacterium
IRSSPTPNPSKLDDTT

SEQ ID NO: 266315 - protein, 15 aa, Mycobacterium
IRSSSTASPAALNDT

SEQ ID NO: 266316 - protein, 8 aa, Mycobacterium
IRSTGTSW

SEQ ID NO: 266317 - protein, 9 aa, Mycobacterium
IRTEERDEI

SEQ ID NO: 266318 - protein, 6 aa, Mycobacterium
IRTESH

SEQ ID NO: 266319 - protein, 22 aa, Mycobacterium
IRTGDRGRRLRPDRADTELGRA

SEQ ID NO: 266320 - protein, 7 aa, Mycobacterium
IRTGSRE

SEQ ID NO: 266321 - protein, 6 aa, Mycobacterium
IRTNHG

SEQ ID NO: 266322 - protein, 10 aa, Mycobacterium
IRTNPKATLG

SEQ ID NO: 266323 - protein, 11 aa, Mycobacterium
IRTPTPRPAPA

SEQ ID NO: 266324 - protein, 12 aa, Mycobacterium
IRTQAAAQRAAA

SEQ ID NO: 266325 - protein, 8 aa, Mycobacterium
IRTTATDS

SEQ ID NO: 266326 - protein, 4 aa, Mycobacterium
ISAA

SEQ ID NO: 266327 - protein, 5 aa, Mycobacterium
ISAAD

SEQ ID NO: 266328 - protein, 9 aa, Mycobacterium
ISAAGHPSS

SEQ ID NO: 266329 - protein, 9 aa, Mycobacterium
ISAATDPRA

SEQ ID NO: 266330 - protein, 7 aa, Mycobacterium
ISADRPR

SEQ ID NO: 266331 - protein, 5 aa, Mycobacterium
ISAEK

SEQ ID NO: 266332 - protein, 4 aa, Mycobacterium
ISAG

SEQ ID NO: 266333 - protein, 5 aa, Mycobacterium
ISAGG

SEQ ID NO: 266334 - protein, 8 aa, Mycobacterium
ISAGGGTP

SEQ ID NO: 266335 - protein, 10 aa, Mycobacterium
ISAGSGAGTI

SEQ ID NO: 266336 - protein, 8 aa, Mycobacterium
ISAGSTTY

SEQ ID NO: 266337 - protein, 17 aa, Mycobacterium
ISAPEPAHAPRADRAPA

SEQ ID NO: 266338 - protein, 20 aa, Mycobacterium
ISARGGDVDEPAVQGTPLTD

SEQ ID NO: 266339 - protein, 6 aa, Mycobacterium
ISASSV

SEQ ID NO: 266340 - protein, 19 aa, Mycobacterium
ISATDTPGGGLTVVVDLAA

SEQ ID NO: 266341 - protein, 20 aa, Mycobacterium
ISATPGVVSATESGRSTTGL

SEQ ID NO: 266342 - protein, 8 aa, Mycobacterium
ISDAAGTI

SEQ ID NO: 266343 - protein, 5 aa, Mycobacterium
ISDAE

SEQ ID NO: 266344 - protein, 6 aa, Mycobacterium
ISDERA

SEQ ID NO: 266345 - protein, 12 aa, Mycobacterium
ISDGMSGGPTIE

SEQ ID NO: 266346 - protein, 10 aa, Mycobacterium
ISDGNGHSIG

SEQ ID NO: 266347 - protein, 16 aa, Mycobacterium
ISDNSGGKVGGKAPFA

SEQ ID NO: 266348 - protein, 9 aa, Mycobacterium
ISDPALPGR

SEQ ID NO: 266349 - protein, 12 aa, Mycobacterium
ISDVEDAAGENT

SEQ ID NO: 266350 - protein, 24 aa, Mycobacterium
ISEAAASVAGPTTTIATAAADEVS

SEQ ID NO: 266351 - protein, 5 aa, Mycobacterium
ISEGD

SEQ ID NO: 266352 - protein, 8 aa, Mycobacterium
ISENAAPH

SEQ ID NO: 266353 - protein, 10 aa, Mycobacterium
ISGAAQEHAK

SEQ ID NO: 266354 - protein, 8 aa, Mycobacterium
ISGASSAE

SEQ ID NO: 266355 - protein, 19 aa, Mycobacterium
ISGEDAGKLQRTGYPDPNL

SEQ ID NO: 266356 - protein, 22 aa, Mycobacterium
ISGEEDGGLTPASRKSAFAAED

SEQ ID NO: 266357 - protein, 4 aa, Mycobacterium
ISGG

SEQ ID NO: 266358 - protein, 8 aa, Mycobacterium
ISGGASAL

SEQ ID NO: 266359 - protein, 12 aa, Mycobacterium
ISGGERDPETPI

SEQ ID NO: 266360 - protein, 13 aa, Mycobacterium
ISGGGAKAVGNAV

SEQ ID NO: 266361 - protein, 10 aa, Mycobacterium
ISGGTTPASW

SEQ ID NO: 266362 - protein, 17 aa, Mycobacterium
ISGGVEAAPLPPQPQLA

SEQ ID NO: 266363 - protein, 18 aa, Mycobacterium
ISGGVQAAPLPPEPQLAS

SEQ ID NO: 266364 - protein, 11 aa, Mycobacterium
ISGNDYADPAA

SEQ ID NO: 266365 - protein, 5 aa, Mycobacterium
ISGPE

SEQ ID NO: 266366 - protein, 6 aa, Mycobacterium
ISGPQQ

SEQ ID NO: 266367 - protein, 4 aa, Mycobacterium
ISGS

SEQ ID NO: 266368 - protein, 11 aa, Mycobacterium
ISGSPDNPTMV

SEQ ID NO: 266369 - protein, 4 aa, Mycobacterium
ISGT

SEQ ID NO: 266370 - protein, 4 aa, Mycobacterium
ISHP

SEQ ID NO: 266371 - protein, 8 aa, Mycobacterium
ISKDNKSG

SEQ ID NO: 266372 - protein, 4 aa, Mycobacterium
ISKE

SEQ ID NO: 266373 - protein, 8 aa, Mycobacterium
ISLGGGGK

SEQ ID NO: 266374 - protein, 8 aa, Mycobacterium
ISLPPGQQ

SEQ ID NO: 266375 - protein, 11 aa, Mycobacterium
ISLPSGGSVAA

SEQ ID NO: 266376 - protein, 4 aa, Mycobacterium
ISNA

SEQ ID NO: 266377 - protein, 12 aa, Mycobacterium
ISNGGERVQPNT

SEQ ID NO: 266378 - protein, 11 aa, Mycobacterium
ISNRDSSRSQL

SEQ ID NO: 266379 - protein, 10 aa, Mycobacterium
ISNSDVGSVE

SEQ ID NO: 266380 - protein, 10 aa, Mycobacterium
ISNSEIGSVS

SEQ ID NO: 266381 - protein, 7 aa, Mycobacterium
ISNVSPP

SEQ ID NO: 266382 - protein, 9 aa, Mycobacterium
ISPAAYPAM

SEQ ID NO: 266383 - protein, 23 aa, Mycobacterium
ISPAQAANALEASRSSGGGHVGG

SEQ ID NO: 266384 - protein, 5 aa, Mycobacterium
ISPDG

SEQ ID NO: 266385 - protein, 6 aa, Mycobacterium
ISPDGK

SEQ ID NO: 266386 - protein, 6 aa, Mycobacterium
ISPDRS

SEQ ID NO: 266387 - protein, 4 aa, Mycobacterium
ISPE

SEQ ID NO: 266388 - protein, 6 aa, Mycobacterium
ISPEGN

SEQ ID NO: 266389 - protein, 8 aa, Mycobacterium
ISPEGTCN

SEQ ID NO: 266390 - protein, 10 aa, Mycobacterium
ISPFRAETRA

SEQ ID NO: 266391 - protein, 6 aa, Mycobacterium
ISPGAL

SEQ ID NO: 266392 - protein, 11 aa, Mycobacterium
ISPGQEQATFA

SEQ ID NO: 266393 - protein, 6 aa, Mycobacterium
ISPGSA

SEQ ID NO: 266394 - protein, 9 aa, Mycobacterium
ISPGTDPPA

SEQ ID NO: 266395 - protein, 10 aa, Mycobacterium
ISPKKSWEGF

SEQ ID NO: 266396 - protein, 4 aa, Mycobacterium
ISPP

SEQ ID NO: 266397 - protein, 11 aa, Mycobacterium
ISPPPPPGVPP

SEQ ID NO: 266398 - protein, 26 aa, Mycobacterium
ISPPTIDPAAVPPDGPPGPPAPMKQN

SEQ ID NO: 266399 - protein, 8 aa, Mycobacterium
ISPQLGPT

SEQ ID NO: 266400 - protein, 9 aa, Mycobacterium
ISPQQAAAQ

SEQ ID NO: 266401 - protein, 4 aa, Mycobacterium
ISPR

SEQ ID NO: 266402 - protein, 4 aa, Mycobacterium
ISPT

SEQ ID NO: 266403 - protein, 7 aa, Mycobacterium
ISQDQPD

SEQ ID NO: 266404 - protein, 4 aa, Mycobacterium
ISQG

SEQ ID NO: 266405 - protein, 8 aa, Mycobacterium
ISQGSVQA

SEQ ID NO: 266406 - protein, 9 aa, Mycobacterium
ISQQFPGSR

SEQ ID NO: 266407 - protein, 10 aa, Mycobacterium
ISQSDVGSVE

SEQ ID NO: 266408 - protein, 4 aa, Mycobacterium
ISRA

SEQ ID NO: 266409 - protein, 8 aa, Mycobacterium
ISRDHREP

SEQ ID NO: 266410 - protein, 5 aa, Mycobacterium
ISRED

SEQ ID NO: 266411 - protein, 10 aa, Mycobacterium
ISRERREPVP

SEQ ID NO: 266412 - protein, 6 aa, Mycobacterium
ISRPPT

SEQ ID NO: 266413 - protein, 13 aa, Mycobacterium
ISRQEQDLQDARR

SEQ ID NO: 266414 - protein, 7 aa, Mycobacterium
ISRSGGE

SEQ ID NO: 266415 - protein, 14 aa, Mycobacterium
ISSDTGWSAPAVTG

SEQ ID NO: 266416 - protein, 4 aa, Mycobacterium
ISSE

SEQ ID NO: 266417 - protein, 12 aa, Mycobacterium
ISSEEELEPVTG

SEQ ID NO: 266418 - protein, 5 aa, Mycobacterium
ISSET

SEQ ID NO: 266419 - protein, 9 aa, Mycobacterium
ISSGGAAIT

SEQ ID NO: 266420 - protein, 19 aa, Mycobacterium
ISSGGSVDSAEPALEYGSA

SEQ ID NO: 266421 - protein, 17 aa, Mycobacterium
ISSGVERAPLPPEPQLA

SEQ ID NO: 266422 - protein, 12 aa, Mycobacterium
ISSMPRGGPNAS

SEQ ID NO: 266423 - protein, 19 aa, Mycobacterium
ISSPEDGGTEVRLVIPMRG

SEQ ID NO: 266424 - protein, 6 aa, Mycobacterium
ISSSAV

SEQ ID NO: 266425 - protein, 9 aa, Mycobacterium
ISSTGTKVE

SEQ ID NO: 266426 - protein, 10 aa, Mycobacterium
ISSTPNASDV

SEQ ID NO: 266427 - protein, 12 aa, Mycobacterium
ISTADKTNGADL

SEQ ID NO: 266428 - protein, 9 aa, Mycobacterium
ISTAGPPGI

SEQ ID NO: 266429 - protein, 7 aa, Mycobacterium
ISTATPQ

SEQ ID NO: 266430 - protein, 13 aa, Mycobacterium
ISTGGAKAVGNAV

SEQ ID NO: 266431 - protein, 20 aa, Mycobacterium
ISTPAGASAPASALASAPVT

SEQ ID NO: 266432 - protein, 32 aa, Mycobacterium
ISTPPGPMSPGNKTQTPTAGPSTSAGPPAGST

SEQ ID NO: 266433 - protein, 16 aa, Mycobacterium
ISTQDPETRPSSHPHR

SEQ ID NO: 266434 - protein, 6 aa, Mycobacterium
ISTTPA

SEQ ID NO: 266435 - protein, 16 aa, Mycobacterium
ISVGGSEQQIWRLVER

SEQ ID NO: 266436 - protein, 15 aa, Mycobacterium
ISVGGTDQAIYRLLE

SEQ ID NO: 266437 - protein, 13 aa, Mycobacterium
ISYRDAEARSAEL

SEQ ID NO: 266438 - protein, 5 aa, Mycobacterium
ITAAG

SEQ ID NO: 266439 - protein, 12 aa, Mycobacterium
ITAAGAQSVDGK

SEQ ID NO: 266440 - protein, 13 aa, Mycobacterium
ITAAGSQSPDNKA

SEQ ID NO: 266441 - protein, 4 aa, Mycobacterium
ITAD

SEQ ID NO: 266442 - protein, 9 aa, Mycobacterium
ITADDRQQT

SEQ ID NO: 266443 - protein, 15 aa, Mycobacterium
ITADLGSRKMREETD

SEQ ID NO: 266444 - protein, 16 aa, Mycobacterium
ITADLGSRKMREETDA

SEQ ID NO: 266445 - protein, 14 aa, Mycobacterium
ITAEEFEALKAKAL

SEQ ID NO: 266446 - protein, 5 aa, Mycobacterium
ITAGR

SEQ ID NO: 266447 - protein, 5 aa, Mycobacterium
ITAKT

SEQ ID NO: 266448 - protein, 5 aa, Mycobacterium
ITAPG

SEQ ID NO: 266449 - protein, 7 aa, Mycobacterium
ITAPLGS

SEQ ID NO: 266450 - protein, 7 aa, Mycobacterium
ITAPPGS

SEQ ID NO: 266451 - protein, 4 aa, Mycobacterium
ITAR

SEQ ID NO: 266452 - protein, 10 aa, Mycobacterium
ITARGGAGQI

SEQ ID NO: 266453 - protein, 10 aa, Mycobacterium
ITARGGAGRI

SEQ ID NO: 266454 - protein, 19 aa, Mycobacterium
ITARGGTGQFSAAESKPRR

SEQ ID NO: 266455 - protein, 20 aa, Mycobacterium
ITARGGTGQISAHPARPGLN

SEQ ID NO: 266456 - protein, 18 aa, Mycobacterium
ITARGGTGQLSAYPARPK

SEQ ID NO: 266457 - protein, 6 aa, Mycobacterium
ITASGF

SEQ ID NO: 266458 - protein, 6 aa, Mycobacterium
ITATAG

SEQ ID NO: 266459 - protein, 11 aa, Mycobacterium
ITATDTPGGGL

SEQ ID NO: 266460 - protein, 6 aa, Mycobacterium
ITDAST

SEQ ID NO: 266461 - protein, 5 aa, Mycobacterium
ITDER

SEQ ID NO: 266462 - protein, 17 aa, Mycobacterium
ITDERKAKYDLSEPYSV

SEQ ID NO: 266463 - protein, 8 aa, Mycobacterium
ITDGGFPD

SEQ ID NO: 266464 - protein, 7 aa, Mycobacterium
ITDGGSA

SEQ ID NO: 266465 - protein, 5 aa, Mycobacterium
ITDGS

SEQ ID NO: 266466 - protein, 4 aa, Mycobacterium
ITDN

SEQ ID NO: 266467 - protein, 5 aa, Mycobacterium
ITDPH

SEQ ID NO: 266468 - protein, 17 aa, Mycobacterium
ITDQAGALSASQAASVQ

SEQ ID NO: 266469 - protein, 5 aa, Mycobacterium
ITDRE

SEQ ID NO: 266470 - protein, 9 aa, Mycobacterium
ITDTAEREE

SEQ ID NO: 266471 - protein, 17 aa, Mycobacterium
ITDTANTARPNTSLADA

SEQ ID NO: 266472 - protein, 33 aa, Mycobacterium
ITDTATDTAAVDTSTPATTTAATTAAAAAAQTA

SEQ ID NO: 266473 - protein, 7 aa, Mycobacterium
ITDTEGV

SEQ ID NO: 266474 - protein, 17 aa, Mycobacterium
ITDTHSNKSREALGQGA

SEQ ID NO: 266475 - protein, 19 aa, Mycobacterium
ITDTPSNKTREACGQGTAN

SEQ ID NO: 266476 - protein, 9 aa, Mycobacterium
ITDVSTDVE

SEQ ID NO: 266477 - protein, 5 aa, Mycobacterium
ITEAR

SEQ ID NO: 266478 - protein, 16 aa, Mycobacterium
ITEGSDGYPGAAGRLP

SEQ ID NO: 266479 - protein, 8 aa, Mycobacterium
ITEPAPGD

SEQ ID NO: 266480 - protein, 6 aa, Mycobacterium
ITEPTA

SEQ ID NO: 266481 - protein, 7 aa, Mycobacterium
ITEPTRL

SEQ ID NO: 266482 - protein, 10 aa, Mycobacterium
ITEQEISETD

SEQ ID NO: 266483 - protein, 6 aa, Mycobacterium
ITETGT

SEQ ID NO: 266484 - protein, 6 aa, Mycobacterium
ITGAQT

SEQ ID NO: 266485 - protein, 23 aa, Mycobacterium
ITGDGRRVDGRDPGSGQSRWSYE

SEQ ID NO: 266486 - protein, 6 aa, Mycobacterium
ITGDNA

SEQ ID NO: 266487 - protein, 16 aa, Mycobacterium
ITGDNVKSAQIDDREQ

SEQ ID NO: 266488 - protein, 102 aa, Mycobacterium
ITGDSDSETTPTSSLTPVTTTSAPAAVPPATVTETASESATTTTEPTTTTTTTEPTTTTTTTTPTTTTTPSTSVSTSTSTSTVTQTETQTETVTEPPPAPPT

SEQ ID NO: 266489 - protein, 4 aa, Mycobacterium
ITGE

SEQ ID NO: 266490 - protein, 13 aa, Mycobacterium
ITGESVPVEAEPG

SEQ ID NO: 266491 - protein, 16 aa, Mycobacterium
ITGESVPVEAGPGDDV

SEQ ID NO: 266492 - protein, 17 aa, Mycobacterium
ITGESVPVEAGPGSEVH

SEQ ID NO: 266493 - protein, 4 aa, Mycobacterium
ITGG

SEQ ID NO: 266494 - protein, 7 aa, Mycobacterium
ITGGGSA

SEQ ID NO: 266495 - protein, 25 aa, Mycobacterium
ITGGSYRNMADSTSPDLSSAISEML

SEQ ID NO: 266496 - protein, 5 aa, Mycobacterium
ITGGV

SEQ ID NO: 266497 - protein, 5 aa, Mycobacterium
ITGKT

SEQ ID NO: 266498 - protein, 23 aa, Mycobacterium
ITGNPGDHPCGSPGAASSGPGCY

SEQ ID NO: 266499 - protein, 12 aa, Mycobacterium
ITGNPGDPRYPY

SEQ ID NO: 266500 - protein, 47 aa, Mycobacterium
ITGNPGDPRYPYREPPPAPAPGGPPPGPPAPPVPGLESTPSPTPSPV

SEQ ID NO: 266501 - protein, 5 aa, Mycobacterium
ITGPA

SEQ ID NO: 266502 - protein, 18 aa, Mycobacterium
ITGPDTAPDPADAATLTA

SEQ ID NO: 266503 - protein, 10 aa, Mycobacterium
ITGPNDSTTV

SEQ ID NO: 266504 - protein, 11 aa, Mycobacterium
ITGPRAKGRTT

SEQ ID NO: 266505 - protein, 5 aa, Mycobacterium
ITGQP

SEQ ID NO: 266506 - protein, 10 aa, Mycobacterium
ITGQQTGHGA

SEQ ID NO: 266507 - protein, 9 aa, Mycobacterium
ITGQRDRTR

SEQ ID NO: 266508 - protein, 13 aa, Mycobacterium
ITGSGESVTVPTS

SEQ ID NO: 266509 - protein, 9 aa, Mycobacterium
ITGTPTGSE

SEQ ID NO: 266510 - protein, 12 aa, Mycobacterium
ITGTVSDDDAQI

SEQ ID NO: 266511 - protein, 12 aa, Mycobacterium
ITGVDEPDRIPD

SEQ ID NO: 266512 - protein, 10 aa, Mycobacterium
ITIEPPPQLP

SEQ ID NO: 266513 - protein, 4 aa, Mycobacterium
ITIN

SEQ ID NO: 266514 - protein, 5 aa, Mycobacterium
ITKGT

SEQ ID NO: 266515 - protein, 10 aa, Mycobacterium
ITKNDNSASF

SEQ ID NO: 266516 - protein, 9 aa, Mycobacterium
ITKQGGQAV

SEQ ID NO: 266517 - protein, 7 aa, Mycobacterium
ITNGPDA

SEQ ID NO: 266518 - protein, 14 aa, Mycobacterium
ITNGTVPQAGGLTT

SEQ ID NO: 266519 - protein, 7 aa, Mycobacterium
ITNKESG

SEQ ID NO: 266520 - protein, 6 aa, Mycobacterium
ITNSEN

SEQ ID NO: 266521 - protein, 9 aa, Mycobacterium
ITNTGGASY

SEQ ID NO: 266522 - protein, 13 aa, Mycobacterium
ITNTQRPDPRVDK

SEQ ID NO: 266523 - protein, 8 aa, Mycobacterium
ITPAEQTL

SEQ ID NO: 266524 - protein, 7 aa, Mycobacterium
ITPAKGQ

SEQ ID NO: 266525 - protein, 6 aa, Mycobacterium
ITPAPG

SEQ ID NO: 266526 - protein, 16 aa, Mycobacterium
ITPARKAKYDISTPYA

SEQ ID NO: 266527 - protein, 5 aa, Mycobacterium
ITPEA

SEQ ID NO: 266528 - protein, 6 aa, Mycobacterium
ITPEAV

SEQ ID NO: 266529 - protein, 16 aa, Mycobacterium
ITPERQQKYDLSEPYS

SEQ ID NO: 266530 - protein, 7 aa, Mycobacterium
ITPETEL

SEQ ID NO: 266531 - protein, 4 aa, Mycobacterium
ITPG

SEQ ID NO: 266532 - protein, 8 aa, Mycobacterium
ITPGKGLP

SEQ ID NO: 266533 - protein, 6 aa, Mycobacterium
ITPGTD

SEQ ID NO: 266534 - protein, 5 aa, Mycobacterium
ITPGV

SEQ ID NO: 266535 - protein, 16 aa, Mycobacterium
ITPKEPAPAIGDTELP

SEQ ID NO: 266536 - protein, 10 aa, Mycobacterium
ITPPSENHGG

SEQ ID NO: 266537 - protein, 6 aa, Mycobacterium
ITPQAQ

SEQ ID NO: 266538 - protein, 7 aa, Mycobacterium
ITPRRAG

SEQ ID NO: 266539 - protein, 7 aa, Mycobacterium
ITPSAEL

SEQ ID NO: 266540 - protein, 6 aa, Mycobacterium
ITPSDR

SEQ ID NO: 266541 - protein, 6 aa, Mycobacterium
ITPSEA

SEQ ID NO: 266542 - protein, 6 aa, Mycobacterium
ITPSGV

SEQ ID NO: 266543 - protein, 5 aa, Mycobacterium
ITPTG

SEQ ID NO: 266544 - protein, 8 aa, Mycobacterium
ITQESGAG

SEQ ID NO: 266545 - protein, 10 aa, Mycobacterium
ITQTYSPDTV

SEQ ID NO: 266546 - protein, 9 aa, Mycobacterium
ITRDGKPAA

SEQ ID NO: 266547 - protein, 11 aa, Mycobacterium
ITRDPTASTSI

SEQ ID NO: 266548 - protein, 7 aa, Mycobacterium
ITRDQPN

SEQ ID NO: 266549 - protein, 9 aa, Mycobacterium
ITRGQATVP

SEQ ID NO: 266550 - protein, 6 aa, Mycobacterium
ITRGQE

SEQ ID NO: 266551 - protein, 11 aa, Mycobacterium
ITRPDGDPIEH

SEQ ID NO: 266552 - protein, 10 aa, Mycobacterium
ITRPDGKPIE

SEQ ID NO: 266553 - protein, 11 aa, Mycobacterium
ITRPDGKPIEH

SEQ ID NO: 266554 - protein, 12 aa, Mycobacterium
ITRPDGKPIEST

SEQ ID NO: 266555 - protein, 11 aa, Mycobacterium
ITRPDGNKLTQ

SEQ ID NO: 266556 - protein, 10 aa, Mycobacterium
ITRPDGTAMD

SEQ ID NO: 266557 - protein, 11 aa, Mycobacterium
ITRPEGKPMDH

SEQ ID NO: 266558 - protein, 11 aa, Mycobacterium
ITRPEGRPMER

SEQ ID NO: 266559 - protein, 10 aa, Mycobacterium
ITRPEGTPIE

SEQ ID NO: 266560 - protein, 10 aa, Mycobacterium
ITRPEGTQIE

SEQ ID NO: 266561 - protein, 10 aa, Mycobacterium
ITRPPDARPP

SEQ ID NO: 266562 - protein, 9 aa, Mycobacterium
ITRPQGEPL

SEQ ID NO: 266563 - protein, 38 aa, Mycobacterium
ITRPTGRSLEQAKTSWQAGEVGDKLDEGSKQITDHTGD

SEQ ID NO: 266564 - protein, 24 aa, Mycobacterium
ITRRPRSPKPRPAPPADEAETPAV

SEQ ID NO: 266565 - protein, 44 aa, Mycobacterium
ITRTPDNPAPAYQAPVNSPGSGNLHGYPGSGGNAGSGSDGPSRH

SEQ ID NO: 266566 - protein, 13 aa, Mycobacterium
ITSAGAQSIDGKS

SEQ ID NO: 266567 - protein, 20 aa, Mycobacterium
ITSAPGAGTRVSVTAPADMA

SEQ ID NO: 266568 - protein, 6 aa, Mycobacterium
ITSDAN

SEQ ID NO: 266569 - protein, 16 aa, Mycobacterium
ITSDGDRQEVSAAAAR

SEQ ID NO: 266570 - protein, 6 aa, Mycobacterium
ITSGPL

SEQ ID NO: 266571 - protein, 11 aa, Mycobacterium
ITSNGKDPFAD

SEQ ID NO: 266572 - protein, 19 aa, Mycobacterium
ITSPSGVGTTITARIPLHH

SEQ ID NO: 266573 - protein, 11 aa, Mycobacterium
ITSPTSPPPVQ

SEQ ID NO: 266574 - protein, 14 aa, Mycobacterium
ITSRDNASDASRRE

SEQ ID NO: 266575 - protein, 19 aa, Mycobacterium
ITSSDGQGTEVTATSPPEP

SEQ ID NO: 266576 - protein, 14 aa, Mycobacterium
ITSYPDDPSGPYTE

SEQ ID NO: 266577 - protein, 11 aa, Mycobacterium
ITTASPKRAKE

SEQ ID NO: 266578 - protein, 5 aa, Mycobacterium
ITTDG

SEQ ID NO: 266579 - protein, 8 aa, Mycobacterium
ITTDNQVS

SEQ ID NO: 266580 - protein, 23 aa, Mycobacterium
ITTGDRGRRLHPERTDTELGRAA

SEQ ID NO: 266581 - protein, 6 aa, Mycobacterium
ITTGER

SEQ ID NO: 266582 - protein, 7 aa, Mycobacterium
ITTGTPV

SEQ ID NO: 266583 - protein, 7 aa, Mycobacterium
ITTPNSA

SEQ ID NO: 266584 - protein, 4 aa, Mycobacterium
ITTQ

SEQ ID NO: 266585 - protein, 20 aa, Mycobacterium
ITTSDGQVLSSNNNNSAQAT

SEQ ID NO: 266586 - protein, 20 aa, Mycobacterium
ITTSDGQVLSSNTGNAAQTS

SEQ ID NO: 266587 - protein, 20 aa, Mycobacterium
ITTSDGTVLSSNNNDAPQTS

SEQ ID NO: 266588 - protein, 20 aa, Mycobacterium
ITTSDGTVLSSNSNDAPQTS

SEQ ID NO: 266589 - protein, 4 aa, Mycobacterium
ITTT

SEQ ID NO: 266590 - protein, 18 aa, Mycobacterium
ITTTGSPASSPTPPARRV

SEQ ID NO: 266591 - protein, 31 aa, Mycobacterium
ITTTQPPPPPPPPPPPPTTEIPTATETQTVT

SEQ ID NO: 266592 - protein, 10 aa, Mycobacterium
ITTVSRGSLR

SEQ ID NO: 266593 - protein, 7 aa, Mycobacterium
ITVEPDS

SEQ ID NO: 266594 - protein, 5 aa, Mycobacterium
ITYGE

SEQ ID NO: 266595 - protein, 10 aa, Mycobacterium
ITYGPGGEEC

SEQ ID NO: 266596 - protein, 6 aa, Mycobacterium
IVEEGS

SEQ ID NO: 266597 - protein, 11 aa, Mycobacterium
IVGPSGSGKST

SEQ ID NO: 266598 - protein, 15 aa, Mycobacterium
IVGSSNGKNGENGEH

SEQ ID NO: 266599 - protein, 13 aa, Mycobacterium
IVKPDQTKPETRS

SEQ ID NO: 266600 - protein, 55 aa, Mycobacterium
IVPPPAPPAFGTTRGGNLPGPPNAFDENNPLPPPWYPQPGPPPAPAPGVIPGDPL

SEQ ID NO: 266601 - protein, 8 aa, Mycobacterium
IVPSPGDF

SEQ ID NO: 266602 - protein, 15 aa, Mycobacterium
IVSGSGPVGNVGPGT

SEQ ID NO: 266603 - protein, 9 aa, Mycobacterium
IYPKPSLST

SEQ ID NO: 266604 - protein, 8 aa, Mycobacterium
IYPKPSPM

SEQ ID NO: 266605 - protein, 9 aa, Mycobacterium
KAAADEVAA

SEQ ID NO: 266606 - protein, 8 aa, Mycobacterium
KAAAKRSS

SEQ ID NO: 266607 - protein, 6 aa, Mycobacterium
KAAARH

SEQ ID NO: 266608 - protein, 17 aa, Mycobacterium
KAAATAYRDLPEDERDR

SEQ ID NO: 266609 - protein, 7 aa, Mycobacterium
KAAATET

SEQ ID NO: 266610 - protein, 8 aa, Mycobacterium
KAAAVPGP

SEQ ID NO: 266611 - protein, 7 aa, Mycobacterium
KAADGQW

SEQ ID NO: 266612 - protein, 8 aa, Mycobacterium
KAADPTMV

SEQ ID NO: 266613 - protein, 7 aa, Mycobacterium
KAADRGV

SEQ ID NO: 266614 - protein, 15 aa, Mycobacterium
KAADSDADDPPTDPN

SEQ ID NO: 266615 - protein, 11 aa, Mycobacterium
KAADTPDDAGP

SEQ ID NO: 266616 - protein, 9 aa, Mycobacterium
KAAEEAASQ

SEQ ID NO: 266617 - protein, 6 aa, Mycobacterium
KAAELG

SEQ ID NO: 266618 - protein, 10 aa, Mycobacterium
KAAEQAASQF

SEQ ID NO: 266619 - protein, 8 aa, Mycobacterium
KAAEQVRD

SEQ ID NO: 266620 - protein, 14 aa, Mycobacterium
KAAGAAAVDTREFD

SEQ ID NO: 266621 - protein, 13 aa, Mycobacterium
KAAGMGDTAETYL

SEQ ID NO: 266622 - protein, 6 aa, Mycobacterium
KAAGNT

SEQ ID NO: 266623 - protein, 7 aa, Mycobacterium
KAAHTPK

SEQ ID NO: 266624 - protein, 5 aa, Mycobacterium
KAAIT

SEQ ID NO: 266625 - protein, 5 aa, Mycobacterium
KAALP

SEQ ID NO: 266626 - protein, 7 aa, Mycobacterium
KAAPEKL

SEQ ID NO: 266627 - protein, 16 aa, Mycobacterium
KAAPPSPRTAGGDQTV

SEQ ID NO: 266628 - protein, 20 aa, Mycobacterium
KAAPVTRADPANPPKPPTEV

SEQ ID NO: 266629 - protein, 7 aa, Mycobacterium
KAAQRAD

SEQ ID NO: 266630 - protein, 13 aa, Mycobacterium
KAAREAVKGTPLQ

SEQ ID NO: 266631 - protein, 21 aa, Mycobacterium
KAAREKLGDLPAAEEFTNREG

SEQ ID NO: 266632 - protein, 29 aa, Mycobacterium
KAARKSGGRKTAKAVATQQDAALDLIQTA

SEQ ID NO: 266633 - protein, 8 aa, Mycobacterium
KAASHGKV

SEQ ID NO: 266634 - protein, 30 aa, Mycobacterium
KAASLPSNVGGQGPSADATGAARQALPPDV

SEQ ID NO: 266635 - protein, 6 aa, Mycobacterium
KAASRG

SEQ ID NO: 266636 - protein, 8 aa, Mycobacterium
KAASVGRV

SEQ ID NO: 266637 - protein, 5 aa, Mycobacterium
KAATT

SEQ ID NO: 266638 - protein, 8 aa, Mycobacterium
KAATVGKV

SEQ ID NO: 266639 - protein, 11 aa, Mycobacterium
KAAVSSLRSDD

SEQ ID NO: 266640 - protein, 7 aa, Mycobacterium
KADACEQ

SEQ ID NO: 266641 - protein, 6 aa, Mycobacterium
KADADL

SEQ ID NO: 266642 - protein, 10 aa, Mycobacterium
KADAGAGLAG

SEQ ID NO: 266643 - protein, 18 aa, Mycobacterium
KADATGAANGDGAPPAVR

SEQ ID NO: 266644 - protein, 18 aa, Mycobacterium
KADEEPADLLTGRPHTVH

SEQ ID NO: 266645 - protein, 13 aa, Mycobacterium
KADEFHRDVATPA

SEQ ID NO: 266646 - protein, 10 aa, Mycobacterium
KADEGRARDH

SEQ ID NO: 266647 - protein, 8 aa, Mycobacterium
KADGSTAL

SEQ ID NO: 266648 - protein, 7 aa, Mycobacterium
KADGTMA

SEQ ID NO: 266649 - protein, 11 aa, Mycobacterium
KADKKAESPLR

SEQ ID NO: 266650 - protein, 8 aa, Mycobacterium
KADPDRIR

SEQ ID NO: 266651 - protein, 9 aa, Mycobacterium
KADPGLPAD

SEQ ID NO: 266652 - protein, 5 aa, Mycobacterium
KADPH

SEQ ID NO: 266653 - protein, 7 aa, Mycobacterium
KADPPQI

SEQ ID NO: 266654 - protein, 7 aa, Mycobacterium
KADPPTF

SEQ ID NO: 266655 - protein, 6 aa, Mycobacterium
KADPQL

SEQ ID NO: 266656 - protein, 6 aa, Mycobacterium
KADPTH

SEQ ID NO: 266657 - protein, 10 aa, Mycobacterium
KADQELEAQR

SEQ ID NO: 266658 - protein, 9 aa, Mycobacterium
KADQQRSRW

SEQ ID NO: 266659 - protein, 9 aa, Mycobacterium
KADRNTVTA

SEQ ID NO: 266660 - protein, 9 aa, Mycobacterium
KADTYGPFP

SEQ ID NO: 266661 - protein, 16 aa, Mycobacterium
KAEAAAAKINATPTIK

SEQ ID NO: 266662 - protein, 8 aa, Mycobacterium
KAEAASPI

SEQ ID NO: 266663 - protein, 7 aa, Mycobacterium
KAEAQPI

SEQ ID NO: 266664 - protein, 9 aa, Mycobacterium
KAEDRLDSG

SEQ ID NO: 266665 - protein, 6 aa, Mycobacterium
KAEEDV

SEQ ID NO: 266666 - protein, 8 aa, Mycobacterium
KAEERRLR

SEQ ID NO: 266667 - protein, 19 aa, Mycobacterium
KAEKQQLRAAAAAETDTAA

SEQ ID NO: 266668 - protein, 9 aa, Mycobacterium
KAENRLDDG

SEQ ID NO: 266669 - protein, 9 aa, Mycobacterium
KAENRLDEG

SEQ ID NO: 266670 - protein, 8 aa, Mycobacterium
KAENRLGA

SEQ ID NO: 266671 - protein, 6 aa, Mycobacterium
KAENVK

SEQ ID NO: 266672 - protein, 5 aa, Mycobacterium
KAEPA

SEQ ID NO: 266673 - protein, 7 aa, Mycobacterium
KAEPMKP

SEQ ID NO: 266674 - protein, 7 aa, Mycobacterium
KAEQRRS

SEQ ID NO: 266675 - protein, 15 aa, Mycobacterium
KAERAERDRREYAEN

SEQ ID NO: 266676 - protein, 13 aa, Mycobacterium
KAERVAAEEEYEV

SEQ ID NO: 266677 - protein, 12 aa, Mycobacterium
KAESRNGGGRST

SEQ ID NO: 266678 - protein, 4 aa, Mycobacterium
KAET

SEQ ID NO: 266679 - protein, 7 aa, Mycobacterium
KAFDNDP

SEQ ID NO: 266680 - protein, 10 aa, Mycobacterium
KAFGAPPPRW

SEQ ID NO: 266681 - protein, 6 aa, Mycobacterium
KAFSST

SEQ ID NO: 266682 - protein, 11 aa, Mycobacterium
KAFTTVPPELA

SEQ ID NO: 266683 - protein, 8 aa, Mycobacterium
KAGADPRP

SEQ ID NO: 266684 - protein, 11 aa, Mycobacterium
KAGADTSSGSM

SEQ ID NO: 266685 - protein, 9 aa, Mycobacterium
KAGAPAGKY

SEQ ID NO: 266686 - protein, 8 aa, Mycobacterium
KAGAQGPF

SEQ ID NO: 266687 - protein, 4 aa, Mycobacterium
KAGD

SEQ ID NO: 266688 - protein, 4 aa, Mycobacterium
KAGE

SEQ ID NO: 266689 - protein, 7 aa, Mycobacterium
KAGEPVA

SEQ ID NO: 266690 - protein, 6 aa, Mycobacterium
KAGESP

SEQ ID NO: 266691 - protein, 21 aa, Mycobacterium
KAGGDTSPLGPRKGDVYPAGE

SEQ ID NO: 266692 - protein, 17 aa, Mycobacterium
KAGGETSTLGARKGDVY

SEQ ID NO: 266693 - protein, 12 aa, Mycobacterium
KAGGTPAPVAAP

SEQ ID NO: 266694 - protein, 14 aa, Mycobacterium
KAGKTAEGSETPTG

SEQ ID NO: 266695 - protein, 7 aa, Mycobacterium
KAGLDGF

SEQ ID NO: 266696 - protein, 12 aa, Mycobacterium
KAGNLSAGERKR

SEQ ID NO: 266697 - protein, 7 aa, Mycobacterium
KAGNPVT

SEQ ID NO: 266698 - protein, 8 aa, Mycobacterium
KAGPTTNE

SEQ ID NO: 266699 - protein, 4 aa, Mycobacterium
KAGQ

SEQ ID NO: 266700 - protein, 5 aa, Mycobacterium
KAGQT

SEQ ID NO: 266701 - protein, 14 aa, Mycobacterium
KAGREPGAVPEDGY

SEQ ID NO: 266702 - protein, 10 aa, Mycobacterium
KAGREPTLAE

SEQ ID NO: 266703 - protein, 9 aa, Mycobacterium
KAGRGGRAD

SEQ ID NO: 266704 - protein, 7 aa, Mycobacterium
KAGRRRY

SEQ ID NO: 266705 - protein, 10 aa, Mycobacterium
KAGSPAQKAG

SEQ ID NO: 266706 - protein, 24 aa, Mycobacterium
KAGVAGGGEDGAPASEVTITSLLL

SEQ ID NO: 266707 - protein, 24 aa, Mycobacterium
KAGVAGGGEDGAPATEVTITSVLL

SEQ ID NO: 266708 - protein, 24 aa, Mycobacterium
KAGVAGGGEDGPPALDVTIKSVFL

SEQ ID NO: 266709 - protein, 63 aa, Mycobacterium
KAHAEAERDPETPPAATEAADDARVEESGQGAHEAVDDEAGDEAGDDGAGDDEAGDDESGGGA

SEQ ID NO: 266710 - protein, 22 aa, Mycobacterium
KAHGHGFPAATATADPSEPLPT

SEQ ID NO: 266711 - protein, 6 aa, Mycobacterium
KAHTDD

SEQ ID NO: 266712 - protein, 16 aa, Mycobacterium
KAIGNPGLQSNQPDLV

SEQ ID NO: 266713 - protein, 29 aa, Mycobacterium
KAKAAKNGRPADRPDAAATGHSARQRRTR

SEQ ID NO: 266714 - protein, 7 aa, Mycobacterium
KAKATGV

SEQ ID NO: 266715 - protein, 7 aa, Mycobacterium
KAKDKDF

SEQ ID NO: 266716 - protein, 12 aa, Mycobacterium
KAKEALKGTTLA

SEQ ID NO: 266717 - protein, 7 aa, Mycobacterium
KAKEDVQ

SEQ ID NO: 266718 - protein, 13 aa, Mycobacterium
KAKEGASATPNGV

SEQ ID NO: 266719 - protein, 7 aa, Mycobacterium
KAKGEVR

SEQ ID NO: 266720 - protein, 8 aa, Mycobacterium
KAKGITPR

SEQ ID NO: 266721 - protein, 7 aa, Mycobacterium
KAKGRSV

SEQ ID NO: 266722 - protein, 4 aa, Mycobacterium
KAKM

SEQ ID NO: 266723 - protein, 8 aa, Mycobacterium
KAKPGDEV

SEQ ID NO: 266724 - protein, 6 aa, Mycobacterium
KAKPGR

SEQ ID NO: 266725 - protein, 10 aa, Mycobacterium
KAKQGDNLPR

SEQ ID NO: 266726 - protein, 6 aa, Mycobacterium
KAKSYA

SEQ ID NO: 266727 - protein, 8 aa, Mycobacterium
KALAPEDS

SEQ ID NO: 266728 - protein, 6 aa, Mycobacterium
KALEGK

SEQ ID NO: 266729 - protein, 6 aa, Mycobacterium
KALENA

SEQ ID NO: 266730 - protein, 12 aa, Mycobacterium
KALGGDASTSQQ

SEQ ID NO: 266731 - protein, 6 aa, Mycobacterium
KALKRA

SEQ ID NO: 266732 - protein, 8 aa, Mycobacterium
KALPDGTV

SEQ ID NO: 266733 - protein, 5 aa, Mycobacterium
KALPG

SEQ ID NO: 266734 - protein, 13 aa, Mycobacterium
KALPPSAPSSVGY

SEQ ID NO: 266735 - protein, 6 aa, Mycobacterium
KANLPL

SEQ ID NO: 266736 - protein, 9 aa, Mycobacterium
KANNPGVAD

SEQ ID NO: 266737 - protein, 18 aa, Mycobacterium
KANNPGVPDSQALDAGGV

SEQ ID NO: 266738 - protein, 18 aa, Mycobacterium
KANNPGVPDTQALGAGGI

SEQ ID NO: 266739 - protein, 9 aa, Mycobacterium
KANPLSTES

SEQ ID NO: 266740 - protein, 5 aa, Mycobacterium
KANPR

SEQ ID NO: 266741 - protein, 48 aa, Mycobacterium
KAPAAASEDGATEAREAETEEPETGPETGPETGPETGPETGPETGEVA

SEQ ID NO: 266742 - protein, 12 aa, Mycobacterium
KAPAGVAVDSSG

SEQ ID NO: 266743 - protein, 15 aa, Mycobacterium
KAPALPSPLPEEPPV

SEQ ID NO: 266744 - protein, 18 aa, Mycobacterium
KAPAQERRREDDDRADTD

SEQ ID NO: 266745 - protein, 6 aa, Mycobacterium
KAPASD

SEQ ID NO: 266746 - protein, 5 aa, Mycobacterium
KAPCT

SEQ ID NO: 266747 - protein, 8 aa, Mycobacterium
KAPDDKID

SEQ ID NO: 266748 - protein, 5 aa, Mycobacterium
KAPET

SEQ ID NO: 266749 - protein, 12 aa, Mycobacterium
KAPKTWEDMLLA

SEQ ID NO: 266750 - protein, 43 aa, Mycobacterium
KAPPGARTENLAPAGPTSPPSTFAPGLPPGPPFPPGPGPQLPG

SEQ ID NO: 266751 - protein, 9 aa, Mycobacterium
KAPPVTRTR

SEQ ID NO: 266752 - protein, 6 aa, Mycobacterium
KAPRIS

SEQ ID NO: 266753 - protein, 12 aa, Mycobacterium
KAPSGKSSEAIQ

SEQ ID NO: 266754 - protein, 5 aa, Mycobacterium
KAPVI

SEQ ID NO: 266755 - protein, 11 aa, Mycobacterium
KAQATKSAHAG

SEQ ID NO: 266756 - protein, 20 aa, Mycobacterium
KAQEAGSSTSDDVPNPDERL

SEQ ID NO: 266757 - protein, 17 aa, Mycobacterium
KAQGRDDLDKEGKAAWS

SEQ ID NO: 266758 - protein, 6 aa, Mycobacterium
KAQGRY

SEQ ID NO: 266759 - protein, 7 aa, Mycobacterium
KAQIQES

SEQ ID NO: 266760 - protein, 7 aa, Mycobacterium
KAQLADE

SEQ ID NO: 266761 - protein, 11 aa, Mycobacterium
KAQNANTDRQA

SEQ ID NO: 266762 - protein, 6 aa, Mycobacterium
KAQPGA

SEQ ID NO: 266763 - protein, 4 aa, Mycobacterium
KAQQ

SEQ ID NO: 266764 - protein, 16 aa, Mycobacterium
KAQQRAEAGALPEAQP

SEQ ID NO: 266765 - protein, 9 aa, Mycobacterium
KAQRRGQSW

SEQ ID NO: 266766 - protein, 20 aa, Mycobacterium
KAQTGGAPLAGAAEEGLSSP

SEQ ID NO: 266767 - protein, 4 aa, Mycobacterium
KARA

SEQ ID NO: 266768 - protein, 7 aa, Mycobacterium
KARGGVE

SEQ ID NO: 266769 - protein, 7 aa, Mycobacterium
KARGPAY

SEQ ID NO: 266770 - protein, 7 aa, Mycobacterium
KARISDP

SEQ ID NO: 266771 - protein, 4 aa, Mycobacterium
KARL

SEQ ID NO: 266772 - protein, 8 aa, Mycobacterium
KARNSGGA

SEQ ID NO: 266773 - protein, 8 aa, Mycobacterium
KARRQRRG

SEQ ID NO: 266774 - protein, 9 aa, Mycobacterium
KARSAGLDE

SEQ ID NO: 266775 - protein, 4 aa, Mycobacterium
KASA

SEQ ID NO: 266776 - protein, 15 aa, Mycobacterium
KASAADRSADPVPAA

SEQ ID NO: 266777 - protein, 7 aa, Mycobacterium
KASANQL

SEQ ID NO: 266778 - protein, 11 aa, Mycobacterium
KASARQPRTNV

SEQ ID NO: 266779 - protein, 5 aa, Mycobacterium
KASDI

SEQ ID NO: 266780 - protein, 7 aa, Mycobacterium
KASEEQL

SEQ ID NO: 266781 - protein, 7 aa, Mycobacterium
KASGAVA

SEQ ID NO: 266782 - protein, 5 aa, Mycobacterium
KASGK

SEQ ID NO: 266783 - protein, 7 aa, Mycobacterium
KASGLDR

SEQ ID NO: 266784 - protein, 24 aa, Mycobacterium
KASLDASLQDDLPEESRASAFGRS

SEQ ID NO: 266785 - protein, 8 aa, Mycobacterium
KASPGSAV

SEQ ID NO: 266786 - protein, 33 aa, Mycobacterium
KASQPSEPPTTRLSTPGKPGAPGRGSSSPAPAA

SEQ ID NO: 266787 - protein, 8 aa, Mycobacterium
KASTDPRA

SEQ ID NO: 266788 - protein, 9 aa, Mycobacterium
KASTELSGG

SEQ ID NO: 266789 - protein, 4 aa, Mycobacterium
KASW

SEQ ID NO: 266790 - protein, 5 aa, Mycobacterium
KATAA

SEQ ID NO: 266791 - protein, 8 aa, Mycobacterium
KATAGNAG

SEQ ID NO: 266792 - protein, 7 aa, Mycobacterium
KATAHGT

SEQ ID NO: 266793 - protein, 6 aa, Mycobacterium
KATAYE

SEQ ID NO: 266794 - protein, 5 aa, Mycobacterium
KATDA

SEQ ID NO: 266795 - protein, 16 aa, Mycobacterium
KATDRTRAELATQGPK

SEQ ID NO: 266796 - protein, 11 aa, Mycobacterium
KATDSSPNITR

SEQ ID NO: 266797 - protein, 8 aa, Mycobacterium
KATDSTAF

SEQ ID NO: 266798 - protein, 8 aa, Mycobacterium
KATDTELP

SEQ ID NO: 266799 - protein, 5 aa, Mycobacterium
KATDW

SEQ ID NO: 266800 - protein, 18 aa, Mycobacterium
KATEEPTDLLAKDSRTAH

SEQ ID NO: 266801 - protein, 10 aa, Mycobacterium
KATGEGRGEA

SEQ ID NO: 266802 - protein, 8 aa, Mycobacterium
KATGIDEP

SEQ ID NO: 266803 - protein, 12 aa, Mycobacterium
KATKPARQLQEA

SEQ ID NO: 266804 - protein, 56 aa, Mycobacterium
KATLPEKGTAAKEAEKRAAAAPKAATATATAPAEEAEEAQAEAAPKAAAAPAAPVK

SEQ ID NO: 266805 - protein, 8 aa, Mycobacterium
KATPTAET

SEQ ID NO: 266806 - protein, 9 aa, Mycobacterium
KATQRDGRW

SEQ ID NO: 266807 - protein, 9 aa, Mycobacterium
KATRDAYGL

SEQ ID NO: 266808 - protein, 6 aa, Mycobacterium
KATTPI

SEQ ID NO: 266809 - protein, 8 aa, Mycobacterium
KATTVGTV

SEQ ID NO: 266810 - protein, 11 aa, Mycobacterium
KATTVLGERSN

SEQ ID NO: 266811 - protein, 9 aa, Mycobacterium
KAVDGTAGG

SEQ ID NO: 266812 - protein, 7 aa, Mycobacterium
KAVRDGD

SEQ ID NO: 266813 - protein, 9 aa, Mycobacterium
KAVSSEVQD

SEQ ID NO: 266814 - protein, 20 aa, Mycobacterium
KAVTNGRTSEVAPADGGQLH

SEQ ID NO: 266815 - protein, 6 aa, Mycobacterium
KAWGSI

SEQ ID NO: 266816 - protein, 9 aa, Mycobacterium
KAWKQSGER

SEQ ID NO: 266817 - protein, 6 aa, Mycobacterium
KAYDSD

SEQ ID NO: 266818 - protein, 11 aa, Mycobacterium
KAYETGDYGAA

SEQ ID NO: 266819 - protein, 4 aa, Mycobacterium
KAYF

SEQ ID NO: 266820 - protein, 12 aa, Mycobacterium
KAYRTSPDDQAL

SEQ ID NO: 266821 - protein, 8 aa, Mycobacterium
KAYTRREG

SEQ ID NO: 266822 - protein, 15 aa, Mycobacterium
KCNDGNNPEVKKGAT

SEQ ID NO: 266823 - protein, 15 aa, Mycobacterium
KCNDGTDPTVKKGAT

SEQ ID NO: 266824 - protein, 31 aa, Mycobacterium
KDAAAASDRLTESTTAHSKAVEDAKAESKRV

SEQ ID NO: 266825 - protein, 18 aa, Mycobacterium
KDAATEGGYVESGRGEHH

SEQ ID NO: 266826 - protein, 9 aa, Mycobacterium
KDAGIDPRD

SEQ ID NO: 266827 - protein, 13 aa, Mycobacterium
KDAKEQLRGQPEG

SEQ ID NO: 266828 - protein, 10 aa, Mycobacterium
KDAKRKRHTE

SEQ ID NO: 266829 - protein, 16 aa, Mycobacterium
KDAMDAGEIEVDQPPI

SEQ ID NO: 266830 - protein, 16 aa, Mycobacterium
KDAPEGHLSGPAPTAL

SEQ ID NO: 266831 - protein, 8 aa, Mycobacterium
KDAPESVP

SEQ ID NO: 266832 - protein, 6 aa, Mycobacterium
KDARAS

SEQ ID NO: 266833 - protein, 23 aa, Mycobacterium
KDASLPDHQAGQSLPPGSAFGRA

SEQ ID NO: 266834 - protein, 8 aa, Mycobacterium
KDATTTFE

SEQ ID NO: 266835 - protein, 6 aa, Mycobacterium
KDDAVS

SEQ ID NO: 266836 - protein, 14 aa, Mycobacterium
KDDEDDLVPTGRID

SEQ ID NO: 266837 - protein, 8 aa, Mycobacterium
KDDIPEST

SEQ ID NO: 266838 - protein, 9 aa, Mycobacterium
KDDKASAQA

SEQ ID NO: 266839 - protein, 11 aa, Mycobacterium
KDDLPQSTADS

SEQ ID NO: 266840 - protein, 11 aa, Mycobacterium
KDDLPQSTTDN

SEQ ID NO: 266841 - protein, 9 aa, Mycobacterium
KDDPDGEKY

SEQ ID NO: 266842 - protein, 7 aa, Mycobacterium
KDDPDRR

SEQ ID NO: 266843 - protein, 7 aa, Mycobacterium
KDDPEHV

SEQ ID NO: 266844 - protein, 7 aa, Mycobacterium
KDDPKHV

SEQ ID NO: 266845 - protein, 8 aa, Mycobacterium
KDDSVGLP

SEQ ID NO: 266846 - protein, 14 aa, Mycobacterium
KDEAREAIKGTPLQ

SEQ ID NO: 266847 - protein, 5 aa, Mycobacterium
KDEFK

SEQ ID NO: 266848 - protein, 9 aa, Mycobacterium
KDEGITDGE

SEQ ID NO: 266849 - protein, 4 aa, Mycobacterium
KDEI

SEQ ID NO: 266850 - protein, 8 aa, Mycobacterium
KDEKSEAR

SEQ ID NO: 266851 - protein, 8 aa, Mycobacterium
KDEQSGIT

SEQ ID NO: 266852 - protein, 10 aa, Mycobacterium
KDEVETVEEE

SEQ ID NO: 266853 - protein, 5 aa, Mycobacterium
KDFQS

SEQ ID NO: 266854 - protein, 5 aa, Mycobacterium
KDGAG

SEQ ID NO: 266855 - protein, 7 aa, Mycobacterium
KDGANQW

SEQ ID NO: 266856 - protein, 5 aa, Mycobacterium
KDGAR

SEQ ID NO: 266857 - protein, 6 aa, Mycobacterium
KDGDAW

SEQ ID NO: 266858 - protein, 10 aa, Mycobacterium
KDGFDQSDDP

SEQ ID NO: 266859 - protein, 6 aa, Mycobacterium
KDGHSV

SEQ ID NO: 266860 - protein, 5 aa, Mycobacterium
KDGLR

SEQ ID NO: 266861 - protein, 32 aa, Mycobacterium
KDGPDKGKPDYVTDSAASGTGWATGTKTYNGA

SEQ ID NO: 266862 - protein, 10 aa, Mycobacterium
KDGRPGASPV

SEQ ID NO: 266863 - protein, 10 aa, Mycobacterium
KDGSDVDEDT

SEQ ID NO: 266864 - protein, 6 aa, Mycobacterium
KDGSKI

SEQ ID NO: 266865 - protein, 6 aa, Mycobacterium
KDGSKV

SEQ ID NO: 266866 - protein, 7 aa, Mycobacterium
KDGSTVR

SEQ ID NO: 266867 - protein, 10 aa, Mycobacterium
KDGTPGSSPV

SEQ ID NO: 266868 - protein, 9 aa, Mycobacterium
KDHSPPAPR

SEQ ID NO: 266869 - protein, 8 aa, Mycobacterium
KDKATASF

SEQ ID NO: 266870 - protein, 9 aa, Mycobacterium
KDKDGTERR

SEQ ID NO: 266871 - protein, 8 aa, Mycobacterium
KDKLGDAA

SEQ ID NO: 266872 - protein, 7 aa, Mycobacterium
KDKPVPL

SEQ ID NO: 266873 - protein, 9 aa, Mycobacterium
KDKRSDQAL

SEQ ID NO: 266874 - protein, 7 aa, Mycobacterium
KDLGRGA

SEQ ID NO: 266875 - protein, 8 aa, Mycobacterium
KDLGTNGG

SEQ ID NO: 266876 - protein, 5 aa, Mycobacterium
KDLPP

SEQ ID NO: 266877 - protein, 6 aa, Mycobacterium
KDLRTP

SEQ ID NO: 266878 - protein, 6 aa, Mycobacterium
KDMATA

SEQ ID NO: 266879 - protein, 6 aa, Mycobacterium
KDNKPL

SEQ ID NO: 266880 - protein, 17 aa, Mycobacterium
KDNQGRVTSGALATATT

SEQ ID NO: 266881 - protein, 4 aa, Mycobacterium
KDPA

SEQ ID NO: 266882 - protein, 7 aa, Mycobacterium
KDPAARF

SEQ ID NO: 266883 - protein, 8 aa, Mycobacterium
KDPAGGTG

SEQ ID NO: 266884 - protein, 7 aa, Mycobacterium
KDPAKPV

SEQ ID NO: 266885 - protein, 5 aa, Mycobacterium
KDPDG

SEQ ID NO: 266886 - protein, 7 aa, Mycobacterium
KDPDRNL

SEQ ID NO: 266887 - protein, 7 aa, Mycobacterium
KDPETAA

SEQ ID NO: 266888 - protein, 6 aa, Mycobacterium
KDPETG

SEQ ID NO: 266889 - protein, 6 aa, Mycobacterium
KDPEVR

SEQ ID NO: 266890 - protein, 6 aa, Mycobacterium
KDPGAL

SEQ ID NO: 266891 - protein, 7 aa, Mycobacterium
KDPHGDP

SEQ ID NO: 266892 - protein, 38 aa, Mycobacterium
KDPNADNGHDDRADADSAEVADEPGAETSDKTKDVPAG

SEQ ID NO: 266893 - protein, 6 aa, Mycobacterium
KDPPAG

SEQ ID NO: 266894 - protein, 8 aa, Mycobacterium
KDPRQLSP

SEQ ID NO: 266895 - protein, 4 aa, Mycobacterium
KDPS

SEQ ID NO: 266896 - protein, 18 aa, Mycobacterium
KDPSGAPLRSGYPDPNLR

SEQ ID NO: 266897 - protein, 5 aa, Mycobacterium
KDPSW

SEQ ID NO: 266898 - protein, 30 aa, Mycobacterium
KDQAEPEYTEGVTAAKPTGERADVDPDIGD

SEQ ID NO: 266899 - protein, 30 aa, Mycobacterium
KDQAEPEYTEGVTNAKPTGERTDVDSDIGD

SEQ ID NO: 266900 - protein, 33 aa, Mycobacterium
KDQAEPEYTEGVTTAKPAAERTDSDGRDPDIGD

SEQ ID NO: 266901 - protein, 30 aa, Mycobacterium
KDQAEPEYTEGVTTAKPTGERTDVDPDIGD

SEQ ID NO: 266902 - protein, 8 aa, Mycobacterium
KDQATASF

SEQ ID NO: 266903 - protein, 5 aa, Mycobacterium
KDQDV

SEQ ID NO: 266904 - protein, 8 aa, Mycobacterium
KDQGSKTW

SEQ ID NO: 266905 - protein, 6 aa, Mycobacterium
KDQIGT

SEQ ID NO: 266906 - protein, 100 aa, Mycobacterium
KDQKKKKHSERGANVRGQQNGGSASQAGDRGSRRAPGFGPGPRHAGPDRSGRPGAHRAPDRPGPAGNRQGQPSSADDRDDQQTGTARRSAQSVDVPESAI

SEQ ID NO: 266907 - protein, 7 aa, Mycobacterium
KDQLGEG

SEQ ID NO: 266908 - protein, 7 aa, Mycobacterium
KDRDKRT

SEQ ID NO: 266909 - protein, 5 aa, Mycobacterium
KDRLQ

SEQ ID NO: 266910 - protein, 6 aa, Mycobacterium
KDRPDG

SEQ ID NO: 266911 - protein, 9 aa, Mycobacterium
KDRPEPSES

SEQ ID NO: 266912 - protein, 6 aa, Mycobacterium
KDRPEV

SEQ ID NO: 266913 - protein, 6 aa, Mycobacterium
KDRPPR

SEQ ID NO: 266914 - protein, 6 aa, Mycobacterium
KDRPQL

SEQ ID NO: 266915 - protein, 7 aa, Mycobacterium
KDRQRFA

SEQ ID NO: 266916 - protein, 21 aa, Mycobacterium
KDRRDEAVRRKKNEQPWTGIN

SEQ ID NO: 266917 - protein, 5 aa, Mycobacterium
KDRRP

SEQ ID NO: 266918 - protein, 10 aa, Mycobacterium
KDRSAKPARR

SEQ ID NO: 266919 - protein, 8 aa, Mycobacterium
KDRTRPQQ

SEQ ID NO: 266920 - protein, 5 aa, Mycobacterium
KDRVD

SEQ ID NO: 266921 - protein, 9 aa, Mycobacterium
KDSDRDATC

SEQ ID NO: 266922 - protein, 7 aa, Mycobacterium
KDSGAQR

SEQ ID NO: 266923 - protein, 4 aa, Mycobacterium
KDSL

SEQ ID NO: 266924 - protein, 22 aa, Mycobacterium
KDSSLPDHQSGASLPPGPTFGR

SEQ ID NO: 266925 - protein, 7 aa, Mycobacterium
KDSTATI

SEQ ID NO: 266926 - protein, 7 aa, Mycobacterium
KDSYADV

SEQ ID NO: 266927 - protein, 8 aa, Mycobacterium
KDSYQAGI

SEQ ID NO: 266928 - protein, 12 aa, Mycobacterium
KDTANSKGTIGS

SEQ ID NO: 266929 - protein, 4 aa, Mycobacterium
KDTG

SEQ ID NO: 266930 - protein, 11 aa, Mycobacterium
KDTGGLNKGDK

SEQ ID NO: 266931 - protein, 7 aa, Mycobacterium
KDTGPAA

SEQ ID NO: 266932 - protein, 13 aa, Mycobacterium
KDTHSRVAEAGRY

SEQ ID NO: 266933 - protein, 9 aa, Mycobacterium
KDTSPPAPR

SEQ ID NO: 266934 - protein, 8 aa, Mycobacterium
KDTTPPEH

SEQ ID NO: 266935 - protein, 8 aa, Mycobacterium
KDTTPQEY

SEQ ID NO: 266936 - protein, 10 aa, Mycobacterium
KDVAGKDSFP

SEQ ID NO: 266937 - protein, 6 aa, Mycobacterium
KDVPGM

SEQ ID NO: 266938 - protein, 36 aa, Mycobacterium
KDVSPAPGSSATAAPATPAEAAPATPAGPKKPDGVT

SEQ ID NO: 266939 - protein, 13 aa, Mycobacterium
KDVTQVNNGKTSR

SEQ ID NO: 266940 - protein, 7 aa, Mycobacterium
KDWSGAA

SEQ ID NO: 266941 - protein, 6 aa, Mycobacterium
KDYGSA

SEQ ID NO: 266942 - protein, 15 aa, Mycobacterium
KDYQGNSVRGARNYP

SEQ ID NO: 266943 - protein, 7 aa, Mycobacterium
KEAATTA

SEQ ID NO: 266944 - protein, 4 aa, Mycobacterium
KEAD

SEQ ID NO: 266945 - protein, 10 aa, Mycobacterium
KEAIKGTPLE

SEQ ID NO: 266946 - protein, 11 aa, Mycobacterium
KEAIKGTPLEG

SEQ ID NO: 266947 - protein, 6 aa, Mycobacterium
KEAIRD

SEQ ID NO: 266948 - protein, 7 aa, Mycobacterium
KEALASA

SEQ ID NO: 266949 - protein, 31 aa, Mycobacterium
KEALERDVREAGSAPALAEAARKQGMIPTRD

SEQ ID NO: 266950 - protein, 11 aa, Mycobacterium
KEAMKNTPWEG

SEQ ID NO: 266951 - protein, 6 aa, Mycobacterium
KEANDR

SEQ ID NO: 266952 - protein, 14 aa, Mycobacterium
KEARDGDDGDSEPI

SEQ ID NO: 266953 - protein, 25 aa, Mycobacterium
KEAREPEPEPAAPAEVAPSDAPALE

SEQ ID NO: 266954 - protein, 7 aa, Mycobacterium
KEASPTR

SEQ ID NO: 266955 - protein, 11 aa, Mycobacterium
KEATKEGTLTP

SEQ ID NO: 266956 - protein, 8 aa, Mycobacterium
KEAYPDGF

SEQ ID NO: 266957 - protein, 8 aa, Mycobacterium
KEAYPDTF

SEQ ID NO: 266958 - protein, 85 aa, Mycobacterium
KEDEAKKQEAIARRAANAPAPGAKPKRTPKAAAPGGNGSAKAGGDTEGSGSAEAESDDADGQAPEATDTPSNRTPRPGARPKKRK

SEQ ID NO: 266959 - protein, 10 aa, Mycobacterium
KEDEAKKQEV

SEQ ID NO: 266960 - protein, 9 aa, Mycobacterium
KEDEAKRQE

SEQ ID NO: 266961 - protein, 20 aa, Mycobacterium
KEDEDTGIDETEHAETAYEL

SEQ ID NO: 266962 - protein, 7 aa, Mycobacterium
KEDKENR

SEQ ID NO: 266963 - protein, 6 aa, Mycobacterium
KEDREN

SEQ ID NO: 266964 - protein, 10 aa, Mycobacterium
KEEAEGPTKP

SEQ ID NO: 266965 - protein, 92 aa, Mycobacterium
KEEEAKKQEALERRAANAPAPGAKPKRTPKAVAGSNGSPAESEDVSDTDATETSGEEAPSGDTKQDKPNSTARNSSPTNRTPRPGARPKKRK

SEQ ID NO: 266966 - protein, 85 aa, Mycobacterium
KEEEEKKQADLERRAANAPKPGAKPTRGKSQPAEQADDSDASPEVVESTGTDEDSGGPASPNSTNGSGTTSRTPKPGARPDRRRK

SEQ ID NO: 266967 - protein, 8 aa, Mycobacterium
KEEESAQT

SEQ ID NO: 266968 - protein, 19 aa, Mycobacterium
KEERTATGMNAETFCYVKA

SEQ ID NO: 266969 - protein, 9 aa, Mycobacterium
KEESGAGLN

SEQ ID NO: 266970 - protein, 5 aa, Mycobacterium
KEFKK

SEQ ID NO: 266971 - protein, 7 aa, Mycobacterium
KEFTTTP

SEQ ID NO: 266972 - protein, 10 aa, Mycobacterium
KEGDAERGGN

SEQ ID NO: 266973 - protein, 4 aa, Mycobacterium
KEGL

SEQ ID NO: 266974 - protein, 6 aa, Mycobacterium
KEGLRK

SEQ ID NO: 266975 - protein, 7 aa, Mycobacterium
KEGNNDQ

SEQ ID NO: 266976 - protein, 8 aa, Mycobacterium
KEGNSDQR

SEQ ID NO: 266977 - protein, 14 aa, Mycobacterium
KEGPDNGLSLQGAT

SEQ ID NO: 266978 - protein, 16 aa, Mycobacterium
KEGQAGPPTPPSPQER

SEQ ID NO: 266979 - protein, 11 aa, Mycobacterium
KEGQAGQAKMT

SEQ ID NO: 266980 - protein, 11 aa, Mycobacterium
KEGQAGQTKLT

SEQ ID NO: 266981 - protein, 14 aa, Mycobacterium
KEGQQWKISNLVQV

SEQ ID NO: 266982 - protein, 12 aa, Mycobacterium
KEGRQAWRGEHC

SEQ ID NO: 266983 - protein, 9 aa, Mycobacterium
KEGSGAAQV

SEQ ID NO: 266984 - protein, 8 aa, Mycobacterium
KEGVADGE

SEQ ID NO: 266985 - protein, 15 aa, Mycobacterium
KEGVEQAGEQLAKHT

SEQ ID NO: 266986 - protein, 12 aa, Mycobacterium
KEHAALQQSDTD

SEQ ID NO: 266987 - protein, 19 aa, Mycobacterium
KEHAEEPEVPEPQAVSLGE

SEQ ID NO: 266988 - protein, 6 aa, Mycobacterium
KEHAKT

SEQ ID NO: 266989 - protein, 13 aa, Mycobacterium
KEIEGGKLAPAEI

SEQ ID NO: 266990 - protein, 26 aa, Mycobacterium
KEKPHDYQHDSQHADGRADCRALAHH

SEQ ID NO: 266991 - protein, 45 aa, Mycobacterium
KELGEPGIPTVGTRSQGVGTAASAPAAPKAATTGNGKDIDPSESV

SEQ ID NO: 266992 - protein, 9 aa, Mycobacterium
KELNDESNF

SEQ ID NO: 266993 - protein, 8 aa, Mycobacterium
KELNEESN

SEQ ID NO: 266994 - protein, 9 aa, Mycobacterium
KELNEESNF

SEQ ID NO: 266995 - protein, 8 aa, Mycobacterium
KELNTESN

SEQ ID NO: 266996 - protein, 7 aa, Mycobacterium
KELQKDP

SEQ ID NO: 266997 - protein, 21 aa, Mycobacterium
KELSEKVKAAEADQAAAEAAY

SEQ ID NO: 266998 - protein, 4 aa, Mycobacterium
KENA

SEQ ID NO: 266999 - protein, 6 aa, Mycobacterium
KENQPL

SEQ ID NO: 267000 - protein, 24 aa, Mycobacterium
KENRNGSSGEGSTGDAARIPETAA

SEQ ID NO: 267001 - protein, 10 aa, Mycobacterium
KEPAEGGMGP

SEQ ID NO: 267002 - protein, 9 aa, Mycobacterium
KEPAERGMG

SEQ ID NO: 267003 - protein, 32 aa, Mycobacterium
KEPASGPTGGVSTTAGAPSGITATAGPTVAPT

SEQ ID NO: 267004 - protein, 26 aa, Mycobacterium
KEPEPAEDESDSETTDSENSKPKKRR

SEQ ID NO: 267005 - protein, 8 aa, Mycobacterium
KEPGDGPE

SEQ ID NO: 267006 - protein, 8 aa, Mycobacterium
KEPKPVAR

SEQ ID NO: 267007 - protein, 8 aa, Mycobacterium
KEPLGDDA

SEQ ID NO: 267008 - protein, 6 aa, Mycobacterium
KEPNPE

SEQ ID NO: 267009 - protein, 14 aa, Mycobacterium
KEPPPPLPAELPPN

SEQ ID NO: 267010 - protein, 32 aa, Mycobacterium
KEQAEPEYTEGVTTAKVGGGPGKDDVDPDIGD

SEQ ID NO: 267011 - protein, 8 aa, Mycobacterium
KEQAPQEH

SEQ ID NO: 267012 - protein, 11 aa, Mycobacterium
KEQGGRRPAPL

SEQ ID NO: 267013 - protein, 12 aa, Mycobacterium
KEQTAKTRGWPG

SEQ ID NO: 267014 - protein, 11 aa, Mycobacterium
KEQYAKSSADL

SEQ ID NO: 267015 - protein, 12 aa, Mycobacterium
KEQYTKSSAELA

SEQ ID NO: 267016 - protein, 13 aa, Mycobacterium
KEQYTKSSAELGQ

SEQ ID NO: 267017 - protein, 4 aa, Mycobacterium
KERA

SEQ ID NO: 267018 - protein, 6 aa, Mycobacterium
KERDAK

SEQ ID NO: 267019 - protein, 8 aa, Mycobacterium
KERGRGAT

SEQ ID NO: 267020 - protein, 8 aa, Mycobacterium
KERGSGER

SEQ ID NO: 267021 - protein, 4 aa, Mycobacterium
KERL

SEQ ID NO: 267022 - protein, 8 aa, Mycobacterium
KERPATNL

SEQ ID NO: 267023 - protein, 10 aa, Mycobacterium
KERRAELTQP

SEQ ID NO: 267024 - protein, 7 aa, Mycobacterium
KESDSDS

SEQ ID NO: 267025 - protein, 33 aa, Mycobacterium
KESPLENTPEGGLGEELRGEKHSEKHSHEHVPE

SEQ ID NO: 267026 - protein, 24 aa, Mycobacterium
KESPLESTPAGGLGEELSGEEHAE

SEQ ID NO: 267027 - protein, 6 aa, Mycobacterium
KESQTL

SEQ ID NO: 267028 - protein, 7 aa, Mycobacterium
KESRDRL

SEQ ID NO: 267029 - protein, 8 aa, Mycobacterium
KESRDRLK

SEQ ID NO: 267030 - protein, 6 aa, Mycobacterium
KESTGV

SEQ ID NO: 267031 - protein, 17 aa, Mycobacterium
KETAEKKDLEPVARTAG

SEQ ID NO: 267032 - protein, 22 aa, Mycobacterium
KETLDADHDGVPDVFGSAPGDR

SEQ ID NO: 267033 - protein, 27 aa, Mycobacterium
KETMPTNPDNPKGAYTAARTAKDQGVP

SEQ ID NO: 267034 - protein, 15 aa, Mycobacterium
KETPPPLPADLPPNV

SEQ ID NO: 267035 - protein, 14 aa, Mycobacterium
KETPSPLPADLPPN

SEQ ID NO: 267036 - protein, 5 aa, Mycobacterium
KETRD

SEQ ID NO: 267037 - protein, 7 aa, Mycobacterium
KETRPDV

SEQ ID NO: 267038 - protein, 6 aa, Mycobacterium
KETSLA

SEQ ID NO: 267039 - protein, 12 aa, Mycobacterium
KETSQQTPETAN

SEQ ID NO: 267040 - protein, 6 aa, Mycobacterium
KEVAET

SEQ ID NO: 267041 - protein, 5 aa, Mycobacterium
KEVAK

SEQ ID NO: 267042 - protein, 5 aa, Mycobacterium
KEVSK

SEQ ID NO: 267043 - protein, 6 aa, Mycobacterium
KEYEEK

SEQ ID NO: 267044 - protein, 6 aa, Mycobacterium
KEYEER

SEQ ID NO: 267045 - protein, 7 aa, Mycobacterium
KFATGAG

SEQ ID NO: 267046 - protein, 12 aa, Mycobacterium
KFEGTSTGDRKL

SEQ ID NO: 267047 - protein, 9 aa, Mycobacterium
KFETDEDGL

SEQ ID NO: 267048 - protein, 9 aa, Mycobacterium
KFGESDSTN

SEQ ID NO: 267049 - protein, 6 aa, Mycobacterium
KFGKGD

SEQ ID NO: 267050 - protein, 8 aa, Mycobacterium
KFGQGDQQ

SEQ ID NO: 267051 - protein, 4 aa, Mycobacterium
KFGR

SEQ ID NO: 267052 - protein, 6 aa, Mycobacterium
KFGYDD

SEQ ID NO: 267053 - protein, 9 aa, Mycobacterium
KFNNENSAQ

SEQ ID NO: 267054 - protein, 9 aa, Mycobacterium
KFPDNTETG

SEQ ID NO: 267055 - protein, 9 aa, Mycobacterium
KFPNNTESR

SEQ ID NO: 267056 - protein, 6 aa, Mycobacterium
KFPPAE

SEQ ID NO: 267057 - protein, 5 aa, Mycobacterium
KFQPP

SEQ ID NO: 267058 - protein, 6 aa, Mycobacterium
KFQPPM

SEQ ID NO: 267059 - protein, 7 aa, Mycobacterium
KFTGGEL

SEQ ID NO: 267060 - protein, 7 aa, Mycobacterium
KFTGGEV

SEQ ID NO: 267061 - protein, 7 aa, Mycobacterium
KFTNDTA

SEQ ID NO: 267062 - protein, 8 aa, Mycobacterium
KFTPAQAT

SEQ ID NO: 267063 - protein, 22 aa, Mycobacterium
KGAADGIQQGISKGSKSTTAAA

SEQ ID NO: 267064 - protein, 22 aa, Mycobacterium
KGAAEGIQRGLSTGSKSTPAAA

SEQ ID NO: 267065 - protein, 9 aa, Mycobacterium
KGAAGTAGG

SEQ ID NO: 267066 - protein, 10 aa, Mycobacterium
KGAAGVGNAV

SEQ ID NO: 267067 - protein, 10 aa, Mycobacterium
KGAAGVSGAG

SEQ ID NO: 267068 - protein, 10 aa, Mycobacterium
KGAAGVTGAG

SEQ ID NO: 267069 - protein, 8 aa, Mycobacterium
KGADFSNL

SEQ ID NO: 267070 - protein, 9 aa, Mycobacterium
KGAEVSERE

SEQ ID NO: 267071 - protein, 9 aa, Mycobacterium
KGAGGSAEY

SEQ ID NO: 267072 - protein, 13 aa, Mycobacterium
KGAGPSAAKPRLS

SEQ ID NO: 267073 - protein, 8 aa, Mycobacterium
KGAPKRPA

SEQ ID NO: 267074 - protein, 9 aa, Mycobacterium
KGAPQVPGP

SEQ ID NO: 267075 - protein, 5 aa, Mycobacterium
KGAPS

SEQ ID NO: 267076 - protein, 8 aa, Mycobacterium
KGAPTAHP

SEQ ID NO: 267077 - protein, 9 aa, Mycobacterium
KGAPTAHPP

SEQ ID NO: 267078 - protein, 8 aa, Mycobacterium
KGAPTQGA

SEQ ID NO: 267079 - protein, 7 aa, Mycobacterium
KGAPTQP

SEQ ID NO: 267080 - protein, 7 aa, Mycobacterium
KGAPTRG

SEQ ID NO: 267081 - protein, 8 aa, Mycobacterium
KGAPTRGA

SEQ ID NO: 267082 - protein, 7 aa, Mycobacterium
KGAPTRP

SEQ ID NO: 267083 - protein, 10 aa, Mycobacterium
KGASVEAART

SEQ ID NO: 267084 - protein, 8 aa, Mycobacterium
KGASVEVA

SEQ ID NO: 267085 - protein, 9 aa, Mycobacterium
KGATDSQLN

SEQ ID NO: 267086 - protein, 6 aa, Mycobacterium
KGATGF

SEQ ID NO: 267087 - protein, 8 aa, Mycobacterium
KGATGFSR

SEQ ID NO: 267088 - protein, 20 aa, Mycobacterium
KGATGKLGAPVADQTEAGDV

SEQ ID NO: 267089 - protein, 19 aa, Mycobacterium
KGATGKLGAPVADQTVDGD

SEQ ID NO: 267090 - protein, 6 aa, Mycobacterium
KGATGY

SEQ ID NO: 267091 - protein, 6 aa, Mycobacterium
KGATTG

SEQ ID NO: 267092 - protein, 6 aa, Mycobacterium
KGATVS

SEQ ID NO: 267093 - protein, 16 aa, Mycobacterium
KGAVDDDRHADPPSTR

SEQ ID NO: 267094 - protein, 18 aa, Mycobacterium
KGAVDDDRHADPPSTRAA

SEQ ID NO: 267095 - protein, 21 aa, Mycobacterium
KGAVEGVAAPETANNAAATSS

SEQ ID NO: 267096 - protein, 6 aa, Mycobacterium
KGAWEN

SEQ ID NO: 267097 - protein, 7 aa, Mycobacterium
KGCGEAG

SEQ ID NO: 267098 - protein, 8 aa, Mycobacterium
KGDEPLVT

SEQ ID NO: 267099 - protein, 40 aa, Mycobacterium
KGDKTDTAHDTASTTPVSTVDAPPTSSLPTPDEPPLAGPA

SEQ ID NO: 267100 - protein, 4 aa, Mycobacterium
KGDL

SEQ ID NO: 267101 - protein, 25 aa, Mycobacterium
KGDLTSGLQAADQPPPGDDGPTLGG

SEQ ID NO: 267102 - protein, 10 aa, Mycobacterium
KGDPASPAGL

SEQ ID NO: 267103 - protein, 10 aa, Mycobacterium
KGDPASPQGI

SEQ ID NO: 267104 - protein, 10 aa, Mycobacterium
KGDPATPEGL

SEQ ID NO: 267105 - protein, 14 aa, Mycobacterium
KGDPATPKGIAPVG

SEQ ID NO: 267106 - protein, 39 aa, Mycobacterium; identical to SEQ ID NO: 8559

SEQ ID NO: 267107 - protein, 9 aa, Mycobacterium
KGDPRADGG

SEQ ID NO: 267108 - protein, 5 aa, Mycobacterium
KGDRR

SEQ ID NO: 267109 - protein, 5 aa, Mycobacterium
KGDVP

SEQ ID NO: 267110 - protein, 9 aa, Mycobacterium
KGEAGADSF

SEQ ID NO: 267111 - protein, 14 aa, Mycobacterium
KGEDGFNLAVTILN

SEQ ID NO: 267112 - protein, 11 aa, Mycobacterium
KGEDNPADRKP

SEQ ID NO: 267113 - protein, 5 aa, Mycobacterium
KGEGS

SEQ ID NO: 267114 - protein, 8 aa, Mycobacterium
KGENDDEI

SEQ ID NO: 267115 - protein, 8 aa, Mycobacterium
KGEPEKTA

SEQ ID NO: 267116 - protein, 6 aa, Mycobacterium
KGERRT

SEQ ID NO: 267117 - protein, 5 aa, Mycobacterium
KGESP

SEQ ID NO: 267118 - protein, 6 aa, Mycobacterium
KGETAI

SEQ ID NO: 267119 - protein, 11 aa, Mycobacterium
KGFDADAQARY

SEQ ID NO: 267120 - protein, 5 aa, Mycobacterium
KGFPS

SEQ ID NO: 267121 - protein, 5 aa, Mycobacterium
KGGDG

SEQ ID NO: 267122 - protein, 18 aa, Mycobacterium
KGGDPARSLADGSCPSPM

SEQ ID NO: 267123 - protein, 14 aa, Mycobacterium
KGGDVQNSGQRTNA

SEQ ID NO: 267124 - protein, 10 aa, Mycobacterium
KGGENNAQKY

SEQ ID NO: 267125 - protein, 8 aa, Mycobacterium
KGGGPDGF

SEQ ID NO: 267126 - protein, 10 aa, Mycobacterium
KGGHEHLDRG

SEQ ID NO: 267127 - protein, 8 aa, Mycobacterium
KGGLKGTA

SEQ ID NO: 267128 - protein, 5 aa, Mycobacterium
KGGLS

SEQ ID NO: 267129 - protein, 11 aa, Mycobacterium
KGGPKGVGNAV

SEQ ID NO: 267130 - protein, 5 aa, Mycobacterium
KGGPL

SEQ ID NO: 267131 - protein, 16 aa, Mycobacterium
KGGPSAACPDGKRDHS

SEQ ID NO: 267132 - protein, 7 aa, Mycobacterium
KGGPVRG

SEQ ID NO: 267133 - protein, 16 aa, Mycobacterium
KGGRNARTADAVVHQT

SEQ ID NO: 267134 - protein, 7 aa, Mycobacterium
KGGSAVK

SEQ ID NO: 267135 - protein, 8 aa, Mycobacterium
KGGSGVRP

SEQ ID NO: 267136 - protein, 7 aa, Mycobacterium
KGGVDQI

SEQ ID NO: 267137 - protein, 10 aa, Mycobacterium
KGHDDPANRK

SEQ ID NO: 267138 - protein, 6 aa, Mycobacterium
KGHGEP

SEQ ID NO: 267139 - protein, 6 aa, Mycobacterium
KGIASG

SEQ ID NO: 267140 - protein, 18 aa, Mycobacterium
KGIDPSDAEALAKQPVTA

SEQ ID NO: 267141 - protein, 4 aa, Mycobacterium
KGIH

SEQ ID NO: 267142 - protein, 8 aa, Mycobacterium
KGKPGAVR

SEQ ID NO: 267143 - protein, 8 aa, Mycobacterium
KGKPGDVR

SEQ ID NO: 267144 - protein, 10 aa, Mycobacterium
KGKPGGPRRL

SEQ ID NO: 267145 - protein, 9 aa, Mycobacterium
KGKPGRVGR

SEQ ID NO: 267146 - protein, 8 aa, Mycobacterium
KGKPGSVR

SEQ ID NO: 267147 - protein, 13 aa, Mycobacterium
KGKPIADGADLDG

SEQ ID NO: 267148 - protein, 14 aa, Mycobacterium
KGKPIAPDADLDGL

SEQ ID NO: 267149 - protein, 10 aa, Mycobacterium
KGKPIGPDAD

SEQ ID NO: 267150 - protein, 14 aa, Mycobacterium
KGKPIGPDADLDGL

SEQ ID NO: 267151 - protein, 22 aa, Mycobacterium
KGKSSRVKSTWTTKTISPQAGT

SEQ ID NO: 267152 - protein, 6 aa, Mycobacterium
KGKYPT

SEQ ID NO: 267153 - protein, 4 aa, Mycobacterium
KGLA

SEQ ID NO: 267154 - protein, 6 aa, Mycobacterium
KGLDAH

SEQ ID NO: 267155 - protein, 28 aa, Mycobacterium
KGLGSANPIASNDTAEGRIKNRRVEIVV

SEQ ID NO: 267156 - protein, 4 aa, Mycobacterium
KGLP

SEQ ID NO: 267157 - protein, 9 aa, Mycobacterium
KGLPEPSAR

SEQ ID NO: 267158 - protein, 9 aa, Mycobacterium
KGLPHPSTR

SEQ ID NO: 267159 - protein, 9 aa, Mycobacterium
KGLQTTAPE

SEQ ID NO: 267160 - protein, 8 aa, Mycobacterium
KGLSPFSP

SEQ ID NO: 267161 - protein, 12 aa, Mycobacterium
KGLSTKGGPIGV

SEQ ID NO: 267162 - protein, 12 aa, Mycobacterium
KGLTAATARTVA

SEQ ID NO: 267163 - protein, 9 aa, Mycobacterium
KGLTPDDEA

SEQ ID NO: 267164 - protein, 19 aa, Mycobacterium
KGLTPPEGDEARAASGGKG

SEQ ID NO: 267165 - protein, 5 aa, Mycobacterium
KGLTR

SEQ ID NO: 267166 - protein, 9 aa, Mycobacterium
KGMAERARA

SEQ ID NO: 267167 - protein, 9 aa, Mycobacterium
KGMKNGGAG

SEQ ID NO: 267168 - protein, 12 aa, Mycobacterium
KGNESSAPAHAQ

SEQ ID NO: 267169 - protein, 7 aa, Mycobacterium
KGNGAQR

SEQ ID NO: 267170 - protein, 12 aa, Mycobacterium
KGNGDTDNSDKV

SEQ ID NO: 267171 - protein, 12 aa, Mycobacterium
KGNNDTDGSDKV

SEQ ID NO: 267172 - protein, 12 aa, Mycobacterium
KGNNDTDNSDKV

SEQ ID NO: 267173 - protein, 5 aa, Mycobacterium
KGNPD

SEQ ID NO: 267174 - protein, 22 aa, Mycobacterium
KGPAPTPGASPPPGSGAAGPCA

SEQ ID NO: 267175 - protein, 6 aa, Mycobacterium
KGPATA

SEQ ID NO: 267176 - protein, 7 aa, Mycobacterium
KGPDLGT

SEQ ID NO: 267177 - protein, 10 aa, Mycobacterium
KGPDTANEAS

SEQ ID NO: 267178 - protein, 13 aa, Mycobacterium
KGPDVDAGGSQHN

SEQ ID NO: 267179 - protein, 13 aa, Mycobacterium
KGPDVDAGGSQSH

SEQ ID NO: 267180 - protein, 14 aa, Mycobacterium
KGPDVRDSGQRTNA

SEQ ID NO: 267181 - protein, 6 aa, Mycobacterium
KGPGAD

SEQ ID NO: 267182 - protein, 14 aa, Mycobacterium
KGPGEKPVPDLGGQ

SEQ ID NO: 267183 - protein, 5 aa, Mycobacterium
KGPGL

SEQ ID NO: 267184 - protein, 8 aa, Mycobacterium
KGPHPASY

SEQ ID NO: 267185 - protein, 21 aa, Mycobacterium
KGPHPGLGPADPLGPAPTQPQ

SEQ ID NO: 267186 - protein, 21 aa, Mycobacterium
KGPHPGLGPADPMGPAPTQPQ

SEQ ID NO: 267187 - protein, 8 aa, Mycobacterium
KGPPRPYR

SEQ ID NO: 267188 - protein, 7 aa, Mycobacterium
KGPPTRA

SEQ ID NO: 267189 - protein, 5 aa, Mycobacterium
KGPRY

SEQ ID NO: 267190 - protein, 5 aa, Mycobacterium
KGPSC

SEQ ID NO: 267191 - protein, 9 aa, Mycobacterium
KGPSGCGKT

SEQ ID NO: 267192 - protein, 29 aa, Mycobacterium
KGPTSAGTMGPTAVTPSTKATLTDLGDST

SEQ ID NO: 267193 - protein, 4 aa, Mycobacterium
KGPV

SEQ ID NO: 267194 - protein, 11 aa, Mycobacterium
KGQDFSSGKTA

SEQ ID NO: 267195 - protein, 6 aa, Mycobacterium
KGQESF

SEQ ID NO: 267196 - protein, 7 aa, Mycobacterium
KGQMEAA

SEQ ID NO: 267197 - protein, 19 aa, Mycobacterium
KGQPAGSTPPTGPAATGAC

SEQ ID NO: 267198 - protein, 5 aa, Mycobacterium
KGQPH

SEQ ID NO: 267199 - protein, 20 aa, Mycobacterium
KGQPPQEPAVDDERPADKAA

SEQ ID NO: 267200 - protein, 16 aa, Mycobacterium
KGQPPQQPAAGDERAS

SEQ ID NO: 267201 - protein, 15 aa, Mycobacterium
KGQPPQQPASGDGHW

SEQ ID NO: 267202 - protein, 18 aa, Mycobacterium
KGQPVQQRAVGGLPEAAT

SEQ ID NO: 267203 - protein, 8 aa, Mycobacterium
KGQTANLA

SEQ ID NO: 267204 - protein, 6 aa, Mycobacterium
KGQWEA

SEQ ID NO: 267205 - protein, 7 aa, Mycobacterium
KGRAVES

SEQ ID NO: 267206 - protein, 10 aa, Mycobacterium
KGRDAGPLAN

SEQ ID NO: 267207 - protein, 26 aa, Mycobacterium
KGREAPESLHGTDHAAEESAEAEPAA

SEQ ID NO: 267208 - protein, 21 aa, Mycobacterium
KGREAPESLRGNQDAESDVED

SEQ ID NO: 267209 - protein, 103 aa, Mycobacterium
KGREDPASVRGTAAAAEEVPEPEPAGEVATAAAPAGDTEGDEPTGLAETAKAAEVAEPETVGSAVAGDESTADTEASDAVESEVGEAAEAEAPEAEAEEAEVG

SEQ ID NO: 267210 - protein, 65 aa, Mycobacterium
KGREDPATLGGTPSSADGGDDTAETEATADTEDTEDTEDGVTDAPEADATDKSVDESADNSGIVE

SEQ ID NO: 267211 - protein, 11 aa, Mycobacterium
KGREDPATVRG

SEQ ID NO: 267212 - protein, 32 aa, Mycobacterium
KGREEPESLRGKAADETEEGDEESLVDEAGKE

SEQ ID NO: 267213 - protein, 7 aa, Mycobacterium
KGRETST

SEQ ID NO: 267214 - protein, 9 aa, Mycobacterium
KGRGHLPGE

SEQ ID NO: 267215 - protein, 24 aa, Mycobacterium
KGRKARTAGRAQTASPRSTEAQLP

SEQ ID NO: 267216 - protein, 9 aa, Mycobacterium
KGRPADRPA

SEQ ID NO: 267217 - protein, 7 aa, Mycobacterium
KGRPGFA

SEQ ID NO: 267218 - protein, 7 aa, Mycobacterium
KGRPSLS

SEQ ID NO: 267219 - protein, 18 aa, Mycobacterium
KGRPWPEAHSTDVTEDPY

SEQ ID NO: 267220 - protein, 8 aa, Mycobacterium
KGSDLGTN

SEQ ID NO: 267221 - protein, 7 aa, Mycobacterium
KGSELSS

SEQ ID NO: 267222 - protein, 9 aa, Mycobacterium
KGSGERQAA

SEQ ID NO: 267223 - protein, 7 aa, Mycobacterium
KGSKAVT

SEQ ID NO: 267224 - protein, 5 aa, Mycobacterium
KGSLR

SEQ ID NO: 267225 - protein, 13 aa, Mycobacterium
KGSPAAKSGRVNH

SEQ ID NO: 267226 - protein, 7 aa, Mycobacterium
KGSPITG

SEQ ID NO: 267227 - protein, 4 aa, Mycobacterium
KGSR

SEQ ID NO: 267228 - protein, 8 aa, Mycobacterium
KGSSERYG

SEQ ID NO: 267229 - protein, 9 aa, Mycobacterium
KGSTDKAAK

SEQ ID NO: 267230 - protein, 8 aa, Mycobacterium
KGSTDPQA

SEQ ID NO: 267231 - protein, 20 aa, Mycobacterium
KGSTGDTSLSGRTCPNPTPV

SEQ ID NO: 267232 - protein, 4 aa, Mycobacterium
KGTA

SEQ ID NO: 267233 - protein, 14 aa, Mycobacterium
KGTATYKEKDAAGQ

SEQ ID NO: 267234 - protein, 6 aa, Mycobacterium
KGTDFT

SEQ ID NO: 267235 - protein, 13 aa, Mycobacterium
KGTGGAARSIGRA

SEQ ID NO: 267236 - protein, 8 aa, Mycobacterium
KGTPLEGS

SEQ ID NO: 267237 - protein, 6 aa, Mycobacterium
KGTPLR

SEQ ID NO: 267238 - protein, 7 aa, Mycobacterium
KGTPLTD

SEQ ID NO: 267239 - protein, 8 aa, Mycobacterium
KGTRSEKI

SEQ ID NO: 267240 - protein, 7 aa, Mycobacterium
KGTRVQK

SEQ ID NO: 267241 - protein, 18 aa, Mycobacterium
KGTSLAGSTVSIGGPGGT

SEQ ID NO: 267242 - protein, 4 aa, Mycobacterium
KGVA

SEQ ID NO: 267243 - protein, 9 aa, Mycobacterium
KGVRGAPRD

SEQ ID NO: 267244 - protein, 8 aa, Mycobacterium
KGVRPAHG

SEQ ID NO: 267245 - protein, 6 aa, Mycobacterium
KGVSER

SEQ ID NO: 267246 - protein, 5 aa, Mycobacterium
KGWAN

SEQ ID NO: 267247 - protein, 9 aa, Mycobacterium
KGWPGTPMR

SEQ ID NO: 267248 - protein, 5 aa, Mycobacterium
KGWPT

SEQ ID NO: 267249 - protein, 8 aa, Mycobacterium
KGWTEAGE

SEQ ID NO: 267250 - protein, 6 aa, Mycobacterium
KGYDAD

SEQ ID NO: 267251 - protein, 10 aa, Mycobacterium
KGYGGSNAQQ

SEQ ID NO: 267252 - protein, 6 aa, Mycobacterium
KGYLED

SEQ ID NO: 267253 - protein, 11 aa, Mycobacterium
KHAGSRVAGEP

SEQ ID NO: 267254 - protein, 8 aa, Mycobacterium
KHAPESKA

SEQ ID NO: 267255 - protein, 14 aa, Mycobacterium
KHASARIDAEPDRL

SEQ ID NO: 267256 - protein, 9 aa, Mycobacterium
KHDGGDQSR

SEQ ID NO: 267257 - protein, 36 aa, Mycobacterium
KHEHKSNTAASTTSSAATGSPESTTPAGPTPPVPPL

SEQ ID NO: 267258 - protein, 7 aa, Mycobacterium
KHGGATE

SEQ ID NO: 267259 - protein, 7 aa, Mycobacterium
KHGGATQ

SEQ ID NO: 267260 - protein, 7 aa, Mycobacterium
KHGGSTR

SEQ ID NO: 267261 - protein, 7 aa, Mycobacterium
KHGNAGK

SEQ ID NO: 267262 - protein, 5 aa, Mycobacterium
KHGPG

SEQ ID NO: 267263 - protein, 6 aa, Mycobacterium
KHGRAK

SEQ ID NO: 267264 - protein, 13 aa, Mycobacterium
KHGRPFRRRNPKP

SEQ ID NO: 267265 - protein, 6 aa, Mycobacterium
KHGTKR

SEQ ID NO: 267266 - protein, 6 aa, Mycobacterium
KHHSAD

SEQ ID NO: 267267 - protein, 16 aa, Mycobacterium
KHIEPQDVDREADAIA

SEQ ID NO: 267268 - protein, 10 aa, Mycobacterium
KHLAETRNRE

SEQ ID NO: 267269 - protein, 6 aa, Mycobacterium
KHNDSM

SEQ ID NO: 267270 - protein, 15 aa, Mycobacterium
KHPDDRYGSAGALGR

SEQ ID NO: 267271 - protein, 8 aa, Mycobacterium
KHPDRDQG

SEQ ID NO: 267272 - protein, 5 aa, Mycobacterium
KHPER

SEQ ID NO: 267273 - protein, 11 aa, Mycobacterium
KHPNVSQEDRV

SEQ ID NO: 267274 - protein, 7 aa, Mycobacterium
KHPSSAA

SEQ ID NO: 267275 - protein, 8 aa, Mycobacterium
KHSEATTC

SEQ ID NO: 267276 - protein, 12 aa, Mycobacterium
KHSKVSQEEQVR

SEQ ID NO: 267277 - protein, 8 aa, Mycobacterium
KHSPRSSA

SEQ ID NO: 267278 - protein, 8 aa, Mycobacterium
KHSPSPAP

SEQ ID NO: 267279 - protein, 11 aa, Mycobacterium
KHTGVSQEDQV

SEQ ID NO: 267280 - protein, 14 aa, Mycobacterium
KHTKVSQEDQVRTT

SEQ ID NO: 267281 - protein, 5 aa, Mycobacterium
KHTTR

SEQ ID NO: 267282 - protein, 10 aa, Mycobacterium
KIADRGRAQA

SEQ ID NO: 267283 - protein, 7 aa, Mycobacterium
KIDGASE

SEQ ID NO: 267284 - protein, 10 aa, Mycobacterium
KIDGRDGSVH

SEQ ID NO: 267285 - protein, 9 aa, Mycobacterium
KIERDGMTD

SEQ ID NO: 267286 - protein, 10 aa, Mycobacterium
KIGADTATAS

SEQ ID NO: 267287 - protein, 14 aa, Mycobacterium
KIGDTRQVGTGSCV

SEQ ID NO: 267288 - protein, 5 aa, Mycobacterium
KIKTR

SEQ ID NO: 267289 - protein, 8 aa, Mycobacterium
KINAKGGY

SEQ ID NO: 267290 - protein, 5 aa, Mycobacterium
KIPAG

SEQ ID NO: 267291 - protein, 5 aa, Mycobacterium
KIPPE

SEQ ID NO: 267292 - protein, 9 aa, Mycobacterium
KIPTDATAN

SEQ ID NO: 267293 - protein, 5 aa, Mycobacterium
KIQGT

SEQ ID NO: 267294 - protein, 9 aa, Mycobacterium
KIQNDNTAQ

SEQ ID NO: 267295 - protein, 13 aa, Mycobacterium
KIREARGKVAAAP

SEQ ID NO: 267296 - protein, 13 aa, Mycobacterium
KIRKTGAEGRRIN

SEQ ID NO: 267297 - protein, 5 aa, Mycobacterium
KISDE

SEQ ID NO: 267298 - protein, 18 aa, Mycobacterium
KISETPVHRGDPNTPELT

SEQ ID NO: 267299 - protein, 11 aa, Mycobacterium
KISGPGPSDPF

SEQ ID NO: 267300 - protein, 8 aa, Mycobacterium
KISKDSHS

SEQ ID NO: 267301 - protein, 13 aa, Mycobacterium
KISSAQNQSTNYH

SEQ ID NO: 267302 - protein, 7 aa, Mycobacterium
KITPQSG

SEQ ID NO: 267303 - protein, 7 aa, Mycobacterium
KITSRGT

SEQ ID NO: 267304 - protein, 80 aa, Mycobacterium
KKAAAKAKAPAKKTAAKAVSKAPAKRAPAKKAAAKKAASKPPAAEADPHESRAALKDGEAQRPADAAVRAEPPESPPEGR

SEQ ID NO: 267305 - protein, 6 aa, Mycobacterium
KKAESL

SEQ ID NO: 267306 - protein, 10 aa, Mycobacterium
KKAGGALRQP

SEQ ID NO: 267307 - protein, 7 aa, Mycobacterium
KKALASG

SEQ ID NO: 267308 - protein, 81 aa, Mycobacterium
KKAPAKKATPAKAAPVKKAPAKKAPVKKAAAKKAPPPPADAVTSAAKEAAAQAKSTVATASTAVTSPPPAPPGPASSSRLP

SEQ ID NO: 267309 - protein, 8 aa, Mycobacterium
KKAPDPTI

SEQ ID NO: 267310 - protein, 8 aa, Mycobacterium
KKAPDPTL

SEQ ID NO: 267311 - protein, 8 aa, Mycobacterium
KKAPTPTI

SEQ ID NO: 267312 - protein, 13 aa, Mycobacterium
KKAVPVKTEDLAA

SEQ ID NO: 267313 - protein, 17 aa, Mycobacterium
KKDAKKDAKKDDKGASH

SEQ ID NO: 267314 - protein, 6 aa, Mycobacterium
KKDAKM

SEQ ID NO: 267315 - protein, 14 aa, Mycobacterium
KKDEGPPAPPAGEV

SEQ ID NO: 267316 - protein, 6 aa, Mycobacterium
KKDPNL

SEQ ID NO: 267317 - protein, 10 aa, Mycobacterium
KKEGTDEPKA

SEQ ID NO: 267318 - protein, 8 aa, Mycobacterium
KKENDTHL

SEQ ID NO: 267319 - protein, 12 aa, Mycobacterium
KKETGGWKFCPR

SEQ ID NO: 267320 - protein, 6 aa, Mycobacterium
KKFHPP

SEQ ID NO: 267321 - protein, 14 aa, Mycobacterium
KKGAKSGAKKGVAQ

SEQ ID NO: 267322 - protein, 10 aa, Mycobacterium
KKGEVEQADD

SEQ ID NO: 267323 - protein, 4 aa, Mycobacterium
KKGN

SEQ ID NO: 267324 - protein, 5 aa, Mycobacterium
KKITD

SEQ ID NO: 267325 - protein, 14 aa, Mycobacterium
KKKPVPAASEEPAA

SEQ ID NO: 267326 - protein, 6 aa, Mycobacterium
KKLKRA

SEQ ID NO: 267327 - protein, 7 aa, Mycobacterium
KKLKRAD

SEQ ID NO: 267328 - protein, 7 aa, Mycobacterium
KKMADIT

SEQ ID NO: 267329 - protein, 9 aa, Mycobacterium
KKMKRTERR

SEQ ID NO: 267330 - protein, 11 aa, Mycobacterium
KKNAESTNRDA

SEQ ID NO: 267331 - protein, 9 aa, Mycobacterium
KKNKKSSDL

SEQ ID NO: 267332 - protein, 6 aa, Mycobacterium
KKPAER

SEQ ID NO: 267333 - protein, 13 aa, Mycobacterium
KKPAQSEQQKEAA

SEQ ID NO: 267334 - protein, 6 aa, Mycobacterium
KKPDLS

SEQ ID NO: 267335 - protein, 12 aa, Mycobacterium
KKPGDSGPPVKA

SEQ ID NO: 267336 - protein, 23 aa, Mycobacterium
KKPPAVRRNPPPQPAEHSDTEVN

SEQ ID NO: 267337 - protein, 17 aa, Mycobacterium
KKPQAATKAAKKEEPAA

SEQ ID NO: 267338 - protein, 6 aa, Mycobacterium
KKPSVL

SEQ ID NO: 267339 - protein, 8 aa, Mycobacterium
KKPTRSGD

SEQ ID NO: 267340 - protein, 6 aa, Mycobacterium
KKQARM

SEQ ID NO: 267341 - protein, 7 aa, Mycobacterium
KKQARMH

SEQ ID NO: 267342 - protein, 7 aa, Mycobacterium
KKQDDVE

SEQ ID NO: 267343 - protein, 4 aa, Mycobacterium
KKRI

SEQ ID NO: 267344 - protein, 8 aa, Mycobacterium
KKRQPDAA

SEQ ID NO: 267345 - protein, 9 aa, Mycobacterium
KKRSDADFP

SEQ ID NO: 267346 - protein, 4 aa, Mycobacterium
KKSE

SEQ ID NO: 267347 - protein, 15 aa, Mycobacterium
KKSHTQALRSAGPPP

SEQ ID NO: 267348 - protein, 8 aa, Mycobacterium
KKSRSSRV

SEQ ID NO: 267349 - protein, 13 aa, Mycobacterium
KKSVGEVIEELKA

SEQ ID NO: 267350 - protein, 13 aa, Mycobacterium
KKSVSAVIEELKA

SEQ ID NO: 267351 - protein, 13 aa, Mycobacterium
KKSVSEVTEELKA

SEQ ID NO: 267352 - protein, 9 aa, Mycobacterium
KKTADSLGT

SEQ ID NO: 267353 - protein, 4 aa, Mycobacterium
KKTE

SEQ ID NO: 267354 - protein, 9 aa, Mycobacterium
KKTKETLKN

SEQ ID NO: 267355 - protein, 16 aa, Mycobacterium
KKTSRRASSLQTTTQR

SEQ ID NO: 267356 - protein, 7 aa, Mycobacterium
KKVPANL

SEQ ID NO: 267357 - protein, 7 aa, Mycobacterium
KKVTEEL

SEQ ID NO: 267358 - protein, 10 aa, Mycobacterium
KKWRQSTRQG

SEQ ID NO: 267359 - protein, 9 aa, Mycobacterium
KKWRQSTSP

SEQ ID NO: 267360 - protein, 11 aa, Mycobacterium
KKWSGASYGEH

SEQ ID NO: 267361 - protein, 7 aa, Mycobacterium
KKYGPAV

SEQ ID NO: 267362 - protein, 9 aa, Mycobacterium
KKYKNDRQR

SEQ ID NO: 267363 - protein, 4 aa, Mycobacterium
KLAD

SEQ ID NO: 267364 - protein, 27 aa, Mycobacterium
KLADGAKQVPNWTSQQKDAVAETIGGP

SEQ ID NO: 267365 - protein, 21 aa, Mycobacterium
KLAKSGSWCSPNSGCSATPSP

SEQ ID NO: 267366 - protein, 4 aa, Mycobacterium
KLDG

SEQ ID NO: 267367 - protein, 6 aa, Mycobacterium
KLDGAT

SEQ ID NO: 267368 - protein, 7 aa, Mycobacterium
KLDGPTR

SEQ ID NO: 267369 - protein, 10 aa, Mycobacterium
KLDNEQSSKL

SEQ ID NO: 267370 - protein, 8 aa, Mycobacterium
KLDNGDTA

SEQ ID NO: 267371 - protein, 9 aa, Mycobacterium
KLDPDVSGY

SEQ ID NO: 267372 - protein, 9 aa, Mycobacterium
KLDSDLPAA

SEQ ID NO: 267373 - protein, 10 aa, Mycobacterium
KLDSDPPTAR

SEQ ID NO: 267374 - protein, 8 aa, Mycobacterium
KLENDKKH

SEQ ID NO: 267375 - protein, 13 aa, Mycobacterium
KLGDDAAQSAWAQ

SEQ ID NO: 267376 - protein, 8 aa, Mycobacterium
KLGDSYGR

SEQ ID NO: 267377 - protein, 6 aa, Mycobacterium
KLGGGM

SEQ ID NO: 267378 - protein, 7 aa, Mycobacterium
KLGGGNV

SEQ ID NO: 267379 - protein, 24 aa, Mycobacterium
KLGGRDTRAATPSGLDGPGMSTSA

SEQ ID NO: 267380 - protein, 6 aa, Mycobacterium
KLGGRQ

SEQ ID NO: 267381 - protein, 7 aa, Mycobacterium
KLGGSAG

SEQ ID NO: 267382 - protein, 8 aa, Mycobacterium
KLGGSSGV

SEQ ID NO: 267383 - protein, 9 aa, Mycobacterium
KLGKDTKAA

SEQ ID NO: 267384 - protein, 10 aa, Mycobacterium
KLGKQAQKRL

SEQ ID NO: 267385 - protein, 5 aa, Mycobacterium
KLGPV

SEQ ID NO: 267386 - protein, 10 aa, Mycobacterium
KLGQTGGQRE

SEQ ID NO: 267387 - protein, 11 aa, Mycobacterium
KLGSAGTPGSG

SEQ ID NO: 267388 - protein, 11 aa, Mycobacterium
KLGSGGAPGTG

SEQ ID NO: 267389 - protein, 6 aa, Mycobacterium
KLGSNS

SEQ ID NO: 267390 - protein, 8 aa, Mycobacterium
KLGSSGGV

SEQ ID NO: 267391 - protein, 9 aa, Mycobacterium
KLGSSGGVL

SEQ ID NO: 267392 - protein, 19 aa, Mycobacterium
KLHSSSEMSSEDLLERNFG

SEQ ID NO: 267393 - protein, 4 aa, Mycobacterium
KLIP

SEQ ID NO: 267394 - protein, 6 aa, Mycobacterium
KLIPSS

SEQ ID NO: 267395 - protein, 7 aa, Mycobacterium
KLITDPD

SEQ ID NO: 267396 - protein, 8 aa, Mycobacterium
KLKDAELS

SEQ ID NO: 267397 - protein, 8 aa, Mycobacterium
KLKGASKM

SEQ ID NO: 267398 - protein, 13 aa, Mycobacterium
KLKSPAAPDPQQR

SEQ ID NO: 267399 - protein, 6 aa, Mycobacterium
KLLPPS

SEQ ID NO: 267400 - protein, 6 aa, Mycobacterium
KLNDAD

SEQ ID NO: 267401 - protein, 5 aa, Mycobacterium
KLNET

SEQ ID NO: 267402 - protein, 5 aa, Mycobacterium
KLPAE

SEQ ID NO: 267403 - protein, 17 aa, Mycobacterium
KLPAGEAERCAPGTGTG

SEQ ID NO: 267404 - protein, 7 aa, Mycobacterium
KLPAGQQ

SEQ ID NO: 267405 - protein, 5 aa, Mycobacterium
KLPAN

SEQ ID NO: 267406 - protein, 15 aa, Mycobacterium
KLPAQRPSDLPPDRP

SEQ ID NO: 267407 - protein, 7 aa, Mycobacterium
KLPARRR

SEQ ID NO: 267408 - protein, 6 aa, Mycobacterium
KLPASL

SEQ ID NO: 267409 - protein, 9 aa, Mycobacterium
KLPDAARSL

SEQ ID NO: 267410 - protein, 19 aa, Mycobacterium
KLPEEGPPAPPKPAALPPE

SEQ ID NO: 267411 - protein, 17 aa, Mycobacterium
KLPEEGPPPPPTPPVVP

SEQ ID NO: 267412 - protein, 53 aa, Mycobacterium
KLPEKGTAAKEAEKRAAKTKKVANAAPKAAAPSAPAEASTAAPAEAGPAAPVK

SEQ ID NO: 267413 - protein, 12 aa, Mycobacterium
KLPKTPARTAAP

SEQ ID NO: 267414 - protein, 12 aa, Mycobacterium
KLPNGYANTTID

SEQ ID NO: 267415 - protein, 16 aa, Mycobacterium
KLPPGGTINAEHTQPA

SEQ ID NO: 267416 - protein, 16 aa, Mycobacterium
KLPQTKPTRSGRRTLP

SEQ ID NO: 267417 - protein, 12 aa, Mycobacterium
KLPRGQQARARN

SEQ ID NO: 267418 - protein, 5 aa, Mycobacterium
KLPRR

SEQ ID NO: 267419 - protein, 6 aa, Mycobacterium
KLPRRS

SEQ ID NO: 267420 - protein, 4 aa, Mycobacterium
KLPS

SEQ ID NO: 267421 - protein, 13 aa, Mycobacterium
KLPSGKPDYPAAR

SEQ ID NO: 267422 - protein, 7 aa, Mycobacterium
KLPTDEL

SEQ ID NO: 267423 - protein, 5 aa, Mycobacterium
KLPTT

SEQ ID NO: 267424 - protein, 5 aa, Mycobacterium
KLQQS

SEQ ID NO: 267425 - protein, 7 aa, Mycobacterium
KLRSAEV

SEQ ID NO: 267426 - protein, 7 aa, Mycobacterium
KLSARDR

SEQ ID NO: 267427 - protein, 4 aa, Mycobacterium
KLSE

SEQ ID NO: 267428 - protein, 8 aa, Mycobacterium
KLSPDGVY

SEQ ID NO: 267429 - protein, 21 aa, Mycobacterium
KLSPDQSPAMTADSREPIRVA

SEQ ID NO: 267430 - protein, 7 aa, Mycobacterium
KLSPEAR

SEQ ID NO: 267431 - protein, 7 aa, Mycobacterium
KLSPNGY

SEQ ID NO: 267432 - protein, 6 aa, Mycobacterium
KLSRGQ

SEQ ID NO: 267433 - protein, 9 aa, Mycobacterium
KLSRPVAKG

SEQ ID NO: 267434 - protein, 4 aa, Mycobacterium
KLSS

SEQ ID NO: 267435 - protein, 4 aa, Mycobacterium
KLST

SEQ ID NO: 267436 - protein, 7 aa, Mycobacterium
KLTPATR

SEQ ID NO: 267437 - protein, 12 aa, Mycobacterium
KLTQDSAEKSRE

SEQ ID NO: 267438 - protein, 50 aa, Mycobacterium
KMDDGAQQLKSGTAQLRSGSAELATKLTDGAKQVPTWSNQQKNAIADTIG

SEQ ID NO: 267439 - protein, 10 aa, Mycobacterium
KMEEAERTAR

SEQ ID NO: 267440 - protein, 25 aa, Mycobacterium
KMPAASSEAASTEHRGRFLRRHRAS

SEQ ID NO: 267441 - protein, 5 aa, Mycobacterium
KMPAS

SEQ ID NO: 267442 - protein, 9 aa, Mycobacterium
KMPPNATRV

SEQ ID NO: 267443 - protein, 5 aa, Mycobacterium
KMRTR

SEQ ID NO: 267444 - protein, 7 aa, Mycobacterium
KMSRGDL

SEQ ID NO: 267445 - protein, 7 aa, Mycobacterium
KMSRSQL

SEQ ID NO: 267446 - protein, 5 aa, Mycobacterium
KNAAG

SEQ ID NO: 267447 - protein, 14 aa, Mycobacterium
KNAAKEAIKGTPLE

SEQ ID NO: 267448 - protein, 5 aa, Mycobacterium
KNAAT

SEQ ID NO: 267449 - protein, 10 aa, Mycobacterium
KNADVAPASG

SEQ ID NO: 267450 - protein, 7 aa, Mycobacterium
KNAGIEV

SEQ ID NO: 267451 - protein, 7 aa, Mycobacterium
KNAGLAA

SEQ ID NO: 267452 - protein, 10 aa, Mycobacterium
KNAGRDTVTS

SEQ ID NO: 267453 - protein, 8 aa, Mycobacterium
KNAPMGTA

SEQ ID NO: 267454 - protein, 19 aa, Mycobacterium
KNAPRPAGDDTAGPPMGAD

SEQ ID NO: 267455 - protein, 31 aa, Mycobacterium
KNAPRPGGDDTAGPPAGADLGQTADPTPKGR

SEQ ID NO: 267456 - protein, 7 aa, Mycobacterium
KNAQRFK

SEQ ID NO: 267457 - protein, 7 aa, Mycobacterium
KNARSQD

SEQ ID NO: 267458 - protein, 26 aa, Mycobacterium
KNASLKKNASLKKNASLNENTENSHV

SEQ ID NO: 267459 - protein, 4 aa, Mycobacterium
KNDG

SEQ ID NO: 267460 - protein, 15 aa, Mycobacterium
KNDGGQYKMSNVEFI

SEQ ID NO: 267461 - protein, 10 aa, Mycobacterium
KNDKKGASAV

SEQ ID NO: 267462 - protein, 4 aa, Mycobacterium
KNDS

SEQ ID NO: 267463 - protein, 8 aa, Mycobacterium
KNEDGRRA

SEQ ID NO: 267464 - protein, 5 aa, Mycobacterium
KNEER

SEQ ID NO: 267465 - protein, 11 aa, Mycobacterium
KNGAGESTARN

SEQ ID NO: 267466 - protein, 9 aa, Mycobacterium
KNGERYERC

SEQ ID NO: 267467 - protein, 6 aa, Mycobacterium
KNGIKL

SEQ ID NO: 267468 - protein, 12 aa, Mycobacterium
KNGNGDTENSTQ

SEQ ID NO: 267469 - protein, 29 aa, Mycobacterium
KNGQYWKGSPAVKSGKARHPWPDHRPPRA

SEQ ID NO: 267470 - protein, 4 aa, Mycobacterium
KNGV

SEQ ID NO: 267471 - protein, 10 aa, Mycobacterium
KNGYKGPRKK

SEQ ID NO: 267472 - protein, 10 aa, Mycobacterium
KNGYKGPRNR

SEQ ID NO: 267473 - protein, 10 aa, Mycobacterium
KNHPTPPAQL

SEQ ID NO: 267474 - protein, 10 aa, Mycobacterium
KNIDGESRPG

SEQ ID NO: 267475 - protein, 4 aa, Mycobacterium
KNIK

SEQ ID NO: 267476 - protein, 8 aa, Mycobacterium
KNIKTNTV

SEQ ID NO: 267477 - protein, 6 aa, Mycobacterium
KNLGEV

SEQ ID NO: 267478 - protein, 6 aa, Mycobacterium
KNLPDG

SEQ ID NO: 267479 - protein, 5 aa, Mycobacterium
KNLPP

SEQ ID NO: 267480 - protein, 14 aa, Mycobacterium
KNLPPWADSNQGYA

SEQ ID NO: 267481 - protein, 16 aa, Mycobacterium
KNLTGQGGPGAPGVAE

SEQ ID NO: 267482 - protein, 6 aa, Mycobacterium
KNNPEL

SEQ ID NO: 267483 - protein, 8 aa, Mycobacterium
KNNRGATP

SEQ ID NO: 267484 - protein, 6 aa, Mycobacterium
KNPADR

SEQ ID NO: 267485 - protein, 8 aa, Mycobacterium
KNPADRYP

SEQ ID NO: 267486 - protein, 9 aa, Mycobacterium
KNPAERYPT

SEQ ID NO: 267487 - protein, 7 aa, Mycobacterium
KNPDGVA

SEQ ID NO: 267488 - protein, 11 aa, Mycobacterium
KNPDGVAVDAD

SEQ ID NO: 267489 - protein, 13 aa, Mycobacterium
KNPDGVAVDSDGN

SEQ ID NO: 267490 - protein, 7 aa, Mycobacterium
KNPDRSG

SEQ ID NO: 267491 - protein, 9 aa, Mycobacterium
KNPEADAER

SEQ ID NO: 267492 - protein, 8 aa, Mycobacterium
KNPGISVA

SEQ ID NO: 267493 - protein, 7 aa, Mycobacterium
KNPQEAI

SEQ ID NO: 267494 - protein, 13 aa, Mycobacterium
KNPVGSRQPLMSQ

SEQ ID NO: 267495 - protein, 7 aa, Mycobacterium
KNPWNPL

SEQ ID NO: 267496 - protein, 11 aa, Mycobacterium
KNQPDPTRANT

SEQ ID NO: 267497 - protein, 7 aa, Mycobacterium
KNRARRK

SEQ ID NO: 267498 - protein, 5 aa, Mycobacterium
KNRDL

SEQ ID NO: 267499 - protein, 6 aa, Mycobacterium
KNRGWT

SEQ ID NO: 267500 - protein, 7 aa, Mycobacterium
KNRNRAQ

SEQ ID NO: 267501 - protein, 6 aa, Mycobacterium
KNRRAT

SEQ ID NO: 267502 - protein, 33 aa, Mycobacterium
KNSEAAQEQAEAAKHEAEAAKDEAEAAKRQADA

SEQ ID NO: 267503 - protein, 10 aa, Mycobacterium
KNSEDASCGT

SEQ ID NO: 267504 - protein, 9 aa, Mycobacterium
KNSGPGHHH

SEQ ID NO: 267505 - protein, 10 aa, Mycobacterium
KNSPVPPGTR

SEQ ID NO: 267506 - protein, 9 aa, Mycobacterium
KNSSDVRGV

SEQ ID NO: 267507 - protein, 12 aa, Mycobacterium
KNTAGWDTQTVK

SEQ ID NO: 267508 - protein, 15 aa, Mycobacterium
KNTKTSRENNRIAQS

SEQ ID NO: 267509 - protein, 15 aa, Mycobacterium
KNTKTSRENSQIANS

SEQ ID NO: 267510 - protein, 15 aa, Mycobacterium
KNTQTSRENAQISRS

SEQ ID NO: 267511 - protein, 7 aa, Mycobacterium
KNTTDQI

SEQ ID NO: 267512 - protein, 11 aa, Mycobacterium
KNTTTPGRSRR

SEQ ID NO: 267513 - protein, 11 aa, Mycobacterium
KNVPGRPKTDK

SEQ ID NO: 267514 - protein, 14 aa, Mycobacterium
KNVSDTLAQRSGQV

SEQ ID NO: 267515 - protein, 8 aa, Mycobacterium
KNWADDSG

SEQ ID NO: 267516 - protein, 6 aa, Mycobacterium
KNYSNT

SEQ ID NO: 267517 - protein, 12 aa, Mycobacterium
KPADAPPPAGPP

SEQ ID NO: 267518 - protein, 7 aa, Mycobacterium
KPADFPT

SEQ ID NO: 267519 - protein, 12 aa, Mycobacterium
KPADRTDADLVA

SEQ ID NO: 267520 - protein, 7 aa, Mycobacterium
KPADSDA

SEQ ID NO: 267521 - protein, 4 aa, Mycobacterium
KPAE

SEQ ID NO: 267522 - protein, 13 aa, Mycobacterium
KPAEADAATTFEP

SEQ ID NO: 267523 - protein, 18 aa, Mycobacterium
KPAEQPADTLAEEPSTAG

SEQ ID NO: 267524 - protein, 12 aa, Mycobacterium
KPAETLAATAET

SEQ ID NO: 267525 - protein, 9 aa, Mycobacterium
KPAGAATSS

SEQ ID NO: 267526 - protein, 26 aa, Mycobacterium
KPAGAIPATTDGQSTAGTEHTPTAAT

SEQ ID NO: 267527 - protein, 9 aa, Mycobacterium
KPAGATTSS

SEQ ID NO: 267528 - protein, 7 aa, Mycobacterium
KPAGSDA

SEQ ID NO: 267529 - protein, 4 aa, Mycobacterium
KPAH

SEQ ID NO: 267530 - protein, 11 aa, Mycobacterium
KPAHVSAGSQP

SEQ ID NO: 267531 - protein, 10 aa, Mycobacterium
KPAKAASSSV

SEQ ID NO: 267532 - protein, 8 aa, Mycobacterium
KPAKTGDD

SEQ ID NO: 267533 - protein, 6 aa, Mycobacterium
KPAPAP

SEQ ID NO: 267534 - protein, 8 aa, Mycobacterium
KPAPLRGT

SEQ ID NO: 267535 - protein, 12 aa, Mycobacterium
KPAPPPDPIPAE

SEQ ID NO: 267536 - protein, 8 aa, Mycobacterium
KPARGTPI

SEQ ID NO: 267537 - protein, 27 aa, Mycobacterium
KPASKKFASAISPKLADGALAGRGWTE

SEQ ID NO: 267538 - protein, 5 aa, Mycobacterium
KPASM

SEQ ID NO: 267539 - protein, 6 aa, Mycobacterium
KPATAS

SEQ ID NO: 267540 - protein, 13 aa, Mycobacterium
KPATQPAPGNATD

SEQ ID NO: 267541 - protein, 5 aa, Mycobacterium
KPATS

SEQ ID NO: 267542 - protein, 5 aa, Mycobacterium
KPAYE

SEQ ID NO: 267543 - protein, 8 aa, Mycobacterium
KPAYQPPS

SEQ ID NO: 267544 - protein, 42 aa, Mycobacterium
KPDARGEEPTESAEQPEGAANAPEVSDTEDNTDTGPVPPLDD

SEQ ID NO: 267545 - protein, 7 aa, Mycobacterium
KPDDVSL

SEQ ID NO: 267546 - protein, 12 aa, Mycobacterium
KPDESPGPEPLE

SEQ ID NO: 267547 - protein, 6 aa, Mycobacterium
KPDEVA

SEQ ID NO: 267548 - protein, 7 aa, Mycobacterium
KPDGGFG

SEQ ID NO: 267549 - protein, 4 aa, Mycobacterium
KPDL

SEQ ID NO: 267550 - protein, 20 aa, Mycobacterium
KPDPRSGPQEVPEAPQRERR

SEQ ID NO: 267551 - protein, 6 aa, Mycobacterium
KPDQLA

SEQ ID NO: 267552 - protein, 9 aa, Mycobacterium
KPDRGTVQT

SEQ ID NO: 267553 - protein, 6 aa, Mycobacterium
KPDRIG

SEQ ID NO: 267554 - protein, 7 aa, Mycobacterium
KPDSPDR

SEQ ID NO: 267555 - protein, 9 aa, Mycobacterium
KPDTDLDEE

SEQ ID NO: 267556 - protein, 8 aa, Mycobacterium
KPDTPALV

SEQ ID NO: 267557 - protein, 5 aa, Mycobacterium
KPEIF

SEQ ID NO: 267558 - protein, 8 aa, Mycobacterium
KPELQSHD

SEQ ID NO: 267559 - protein, 8 aa, Mycobacterium
KPEQSDRT

SEQ ID NO: 267560 - protein, 10 aa, Mycobacterium
KPERRSGIPA

SEQ ID NO: 267561 - protein, 15 aa, Mycobacterium
KPFDANYDSEEDVNG

SEQ ID NO: 267562 - protein, 4 aa, Mycobacterium
KPFG

SEQ ID NO: 267563 - protein, 8 aa, Mycobacterium
KPFGRKGY

SEQ ID NO: 267564 - protein, 4 aa, Mycobacterium
KPFN

SEQ ID NO: 267565 - protein, 4 aa, Mycobacterium
KPFP

SEQ ID NO: 267566 - protein, 4 aa, Mycobacterium
KPGA

SEQ ID NO: 267567 - protein, 6 aa, Mycobacterium
KPGAGF

SEQ ID NO: 267568 - protein, 11 aa, Mycobacterium
KPGAPRIPEED

SEQ ID NO: 267569 - protein, 9 aa, Mycobacterium
KPGDAATAP

SEQ ID NO: 267570 - protein, 9 aa, Mycobacterium
KPGDLRTNQ

SEQ ID NO: 267571 - protein, 9 aa, Mycobacterium
KPGDPATAP

SEQ ID NO: 267572 - protein, 4 aa, Mycobacterium
KPGF

SEQ ID NO: 267573 - protein, 22 aa, Mycobacterium
KPGFEATGNMAANGYGEHSPNH

SEQ ID NO: 267574 - protein, 7 aa, Mycobacterium
KPGFPTD

SEQ ID NO: 267575 - protein, 10 aa, Mycobacterium
KPGGDPDAAL

SEQ ID NO: 267576 - protein, 38 aa, Mycobacterium
KPGGGPGGPGGPGRGPGMSGPGQQPTGVSPAPASPAPR

SEQ ID NO: 267577 - protein, 7 aa, Mycobacterium
KPGGPVA

SEQ ID NO: 267578 - protein, 4 aa, Mycobacterium
KPGL

SEQ ID NO: 267579 - protein, 8 aa, Mycobacterium
KPGNPGQL

SEQ ID NO: 267580 - protein, 4 aa, Mycobacterium
KPGP

SEQ ID NO: 267581 - protein, 8 aa, Mycobacterium
KPGPPPLT

SEQ ID NO: 267582 - protein, 10 aa, Mycobacterium
KPGQNSERRT

SEQ ID NO: 267583 - protein, 8 aa, Mycobacterium
KPGQTIPG

SEQ ID NO: 267584 - protein, 5 aa, Mycobacterium
KPGSF

SEQ ID NO: 267585 - protein, 10 aa, Mycobacterium
KPGTYERGGS

SEQ ID NO: 267586 - protein, 4 aa, Mycobacterium
KPGV

SEQ ID NO: 267587 - protein, 6 aa, Mycobacterium
KPGVGT

SEQ ID NO: 267588 - protein, 14 aa, Mycobacterium
KPGVKVDARSERWR

SEQ ID NO: 267589 - protein, 14 aa, Mycobacterium
KPGVLTPADAAPAR

SEQ ID NO: 267590 - protein, 7 aa, Mycobacterium
KPGVPAP

SEQ ID NO: 267591 - protein, 5 aa, Mycobacterium
KPGVR

SEQ ID NO: 267592 - protein, 19 aa, Mycobacterium
KPHADDTPSAQAAGLPAEA

SEQ ID NO: 267593 - protein, 4 aa, Mycobacterium
KPHN

SEQ ID NO: 267594 - protein, 7 aa, Mycobacterium
KPITAAD

SEQ ID NO: 267595 - protein, 14 aa, Mycobacterium
KPITAAGAQSLDGK

SEQ ID NO: 267596 - protein, 8 aa, Mycobacterium
KPIYPRSS

SEQ ID NO: 267597 - protein, 7 aa, Mycobacterium
KPKEAAD

SEQ ID NO: 267598 - protein, 9 aa, Mycobacterium
KPKGEPAVQ

SEQ ID NO: 267599 - protein, 6 aa, Mycobacterium
KPKVVE

SEQ ID NO: 267600 - protein, 4 aa, Mycobacterium
KPLG

SEQ ID NO: 267601 - protein, 7 aa, Mycobacterium
KPLGEDA

SEQ ID NO: 267602 - protein, 7 aa, Mycobacterium
KPLGQDA

SEQ ID NO: 267603 - protein, 7 aa, Mycobacterium
KPLKGGA

SEQ ID NO: 267604 - protein, 14 aa, Mycobacterium
KPLLDSQTQSADSV

SEQ ID NO: 267605 - protein, 4 aa, Mycobacterium
KPLP

SEQ ID NO: 267606 - protein, 5 aa, Mycobacterium
KPLPA

SEQ ID NO: 267607 - protein, 7 aa, Mycobacterium
KPLPKAD

SEQ ID NO: 267608 - protein, 11 aa, Mycobacterium
KPLPPLTTDQT

SEQ ID NO: 267609 - protein, 7 aa, Mycobacterium
KPLPSSG

SEQ ID NO: 267610 - protein, 4 aa, Mycobacterium
KPLR

SEQ ID NO: 267611 - protein, 9 aa, Mycobacterium
KPLRAASDA

SEQ ID NO: 267612 - protein, 8 aa, Mycobacterium
KPLRGHTR

SEQ ID NO: 267613 - protein, 4 aa, Mycobacterium
KPLS

SEQ ID NO: 267614 - protein, 5 aa, Mycobacterium
KPLSK

SEQ ID NO: 267615 - protein, 5 aa, Mycobacterium
KPMSP

SEQ ID NO: 267616 - protein, 4 aa, Mycobacterium
KPMT

SEQ ID NO: 267617 - protein, 11 aa, Mycobacterium
KPNAAQKEAEY

SEQ ID NO: 267618 - protein, 11 aa, Mycobacterium
KPNAAQKESEY

SEQ ID NO: 267619 - protein, 7 aa, Mycobacterium
KPNAQSV

SEQ ID NO: 267620 - protein, 7 aa, Mycobacterium
KPNGDSL

SEQ ID NO: 267621 - protein, 19 aa, Mycobacterium
KPNTSGELAGGQAAPAPHL

SEQ ID NO: 267622 - protein, 4 aa, Mycobacterium
KPPA

SEQ ID NO: 267623 - protein, 7 aa, Mycobacterium
KPPENHV

SEQ ID NO: 267624 - protein, 5 aa, Mycobacterium
KPPGF

SEQ ID NO: 267625 - protein, 5 aa, Mycobacterium
KPPGI

SEQ ID NO: 267626 - protein, 17 aa, Mycobacterium
KPPGPNLDQLYDWWSSH

SEQ ID NO: 267627 - protein, 5 aa, Mycobacterium
KPPIR

SEQ ID NO: 267628 - protein, 4 aa, Mycobacterium
KPPN

SEQ ID NO: 267629 - protein, 7 aa, Mycobacterium
KPPPGVK

SEQ ID NO: 267630 - protein, 12 aa, Mycobacterium
KPPQGMAAEASS

SEQ ID NO: 267631 - protein, 13 aa, Mycobacterium
KPPQGMAAESSSA

SEQ ID NO: 267632 - protein, 8 aa, Mycobacterium
KPPQMPWP

SEQ ID NO: 267633 - protein, 6 aa, Mycobacterium
KPPRGR

SEQ ID NO: 267634 - protein, 8 aa, Mycobacterium
KPPRGTPL

SEQ ID NO: 267635 - protein, 15 aa, Mycobacterium
KPPRIPRPSSGSPGW

SEQ ID NO: 267636 - protein, 9 aa, Mycobacterium
KPPRPEGYL

SEQ ID NO: 267637 - protein, 13 aa, Mycobacterium
KPPSDIVSGEPSF

SEQ ID NO: 267638 - protein, 7 aa, Mycobacterium
KPPTPSW

SEQ ID NO: 267639 - protein, 6 aa, Mycobacterium
KPPWQN

SEQ ID NO: 267640 - protein, 10 aa, Mycobacterium
KPPYQPPNAA

SEQ ID NO: 267641 - protein, 13 aa, Mycobacterium
KPQGKNDKGPQLD

SEQ ID NO: 267642 - protein, 4 aa, Mycobacterium
KPQM

SEQ ID NO: 267643 - protein, 7 aa, Mycobacterium
KPQYEGA

SEQ ID NO: 267644 - protein, 9 aa, Mycobacterium
KPQYSGAQR

SEQ ID NO: 267645 - protein, 4 aa, Mycobacterium
KPRA

SEQ ID NO: 267646 - protein, 24 aa, Mycobacterium
KPRARRKASRAAGPAKSESTQDVT

SEQ ID NO: 267647 - protein, 4 aa, Mycobacterium
KPRC

SEQ ID NO: 267648 - protein, 13 aa, Mycobacterium
KPRDGGDFGTTEE

SEQ ID NO: 267649 - protein, 7 aa, Mycobacterium
KPRPARP

SEQ ID NO: 267650 - protein, 8 aa, Mycobacterium
KPRPPTER

SEQ ID NO: 267651 - protein, 4 aa, Mycobacterium
KPRR

SEQ ID NO: 267652 - protein, 7 aa, Mycobacterium
KPRSTPG

SEQ ID NO: 267653 - protein, 7 aa, Mycobacterium
KPRTGAF

SEQ ID NO: 267654 - protein, 7 aa, Mycobacterium
KPSADLG

SEQ ID NO: 267655 - protein, 8 aa, Mycobacterium
KPSAEVGA

SEQ ID NO: 267656 - protein, 8 aa, Mycobacterium
KPSAGTGA

SEQ ID NO: 267657 - protein, 5 aa, Mycobacterium
KPSAI

SEQ ID NO: 267658 - protein, 10 aa, Mycobacterium
KPSDAAESSL

SEQ ID NO: 267659 - protein, 6 aa, Mycobacterium
KPSDVK

SEQ ID NO: 267660 - protein, 8 aa, Mycobacterium
KPSGDKGN

SEQ ID NO: 267661 - protein, 11 aa, Mycobacterium
KPSLGAEKPGI

SEQ ID NO: 267662 - protein, 4 aa, Mycobacterium
KPSQ

SEQ ID NO: 267663 - protein, 5 aa, Mycobacterium
KPSQA

SEQ ID NO: 267664 - protein, 8 aa, Mycobacterium
KPSQQTGV

SEQ ID NO: 267665 - protein, 9 aa, Mycobacterium
KPSRDPRAR

SEQ ID NO: 267666 - protein, 26 aa, Mycobacterium
KPSTSTHTPGAGTGTNPGHESEGDRD

SEQ ID NO: 267667 - protein, 8 aa, Mycobacterium
KPSYQPPS

SEQ ID NO: 267668 - protein, 6 aa, Mycobacterium
KPTAGA

SEQ ID NO: 267669 - protein, 5 aa, Mycobacterium
KPTAI

SEQ ID NO: 267670 - protein, 9 aa, Mycobacterium
KPTDNPERK

SEQ ID NO: 267671 - protein, 5 aa, Mycobacterium
KPTGA

SEQ ID NO: 267672 - protein, 12 aa, Mycobacterium
KPTGPASGSSGV

SEQ ID NO: 267673 - protein, 32 aa, Mycobacterium
KPTKATVYAPDGDADNTSTAGQAIDGDPSTAW

SEQ ID NO: 267674 - protein, 6 aa, Mycobacterium
KPTNQI

SEQ ID NO: 267675 - protein, 5 aa, Mycobacterium
KPTPI

SEQ ID NO: 267676 - protein, 13 aa, Mycobacterium
KPTPKDNDKPEEL

SEQ ID NO: 267677 - protein, 6 aa, Mycobacterium
KPTRDA

SEQ ID NO: 267678 - protein, 6 aa, Mycobacterium
KPTRPK

SEQ ID NO: 267679 - protein, 7 aa, Mycobacterium
KPTSPMS

SEQ ID NO: 267680 - protein, 8 aa, Mycobacterium
KPTSSVKD

SEQ ID NO: 267681 - protein, 11 aa, Mycobacterium
KPTSSVKDGKL

SEQ ID NO: 267682 - protein, 9 aa, Mycobacterium
KPTSTVKDG

SEQ ID NO: 267683 - protein, 13 aa, Mycobacterium
KPTTIAPGEVDVP

SEQ ID NO: 267684 - protein, 4 aa, Mycobacterium
KPVA

SEQ ID NO: 267685 - protein, 6 aa, Mycobacterium
KPVAAL

SEQ ID NO: 267686 - protein, 11 aa, Mycobacterium
KPVAAVTTGDL

SEQ ID NO: 267687 - protein, 4 aa, Mycobacterium
KPVD

SEQ ID NO: 267688 - protein, 4 aa, Mycobacterium
KPVG

SEQ ID NO: 267689 - protein, 18 aa, Mycobacterium
KPVGEPQKKQSRAGRNLP

SEQ ID NO: 267690 - protein, 13 aa, Mycobacterium
KPVGPAAPKSALT

SEQ ID NO: 267691 - protein, 6 aa, Mycobacterium
KPVGTL

SEQ ID NO: 267692 - protein, 4 aa, Mycobacterium
KPVI

SEQ ID NO: 267693 - protein, 40 aa, Mycobacterium
KPVNGAPPETPPPAPPTPANGQTLGAEQQTGDRTPFDTDA

SEQ ID NO: 267694 - protein, 17 aa, Mycobacterium
KPVNPTTVKSSELDRFP

SEQ ID NO: 267695 - protein, 7 aa, Mycobacterium
KPVPTAR

SEQ ID NO: 267696 - protein, 12 aa, Mycobacterium
KPVPVPKPSGPD

SEQ ID NO: 267697 - protein, 6 aa, Mycobacterium
KPVQRP

SEQ ID NO: 267698 - protein, 7 aa, Mycobacterium
KPVSDQV

SEQ ID NO: 267699 - protein, 6 aa, Mycobacterium
KPVSTL

SEQ ID NO: 267700 - protein, 4 aa, Mycobacterium
KPVT

SEQ ID NO: 267701 - protein, 7 aa, Mycobacterium
KPVVSGT

SEQ ID NO: 267702 - protein, 4 aa, Mycobacterium
KPWG

SEQ ID NO: 267703 - protein, 24 aa, Mycobacterium
KPWPAPGARLRGPGARAGRRRGGR

SEQ ID NO: 267704 - protein, 90 aa, Mycobacterium
KQAASQQRNQRAESTAAESRSPRPPRQSHGRPQSATSPPSIGSTDLPGESNAESTSRFAPPAAPPDTPSNPASSAEPSPGPRAPTAASTL

SEQ ID NO: 267705 - protein, 10 aa, Mycobacterium
KQAHDREVAT

SEQ ID NO: 267706 - protein, 4 aa, Mycobacterium
KQAI

SEQ ID NO: 267707 - protein, 15 aa, Mycobacterium
KQAVSAGKRTGSAYA

SEQ ID NO: 267708 - protein, 5 aa, Mycobacterium
KQDEV

SEQ ID NO: 267709 - protein, 9 aa, Mycobacterium
KQDEVDSMT

SEQ ID NO: 267710 - protein, 15 aa, Mycobacterium
KQDGDQIKLAKVEFV

SEQ ID NO: 267711 - protein, 10 aa, Mycobacterium
KQDGRLDQGI

SEQ ID NO: 267712 - protein, 8 aa, Mycobacterium
KQDPSLPA

SEQ ID NO: 267713 - protein, 10 aa, Mycobacterium
KQDSDTARRQ

SEQ ID NO: 267714 - protein, 5 aa, Mycobacterium
KQDSR

SEQ ID NO: 267715 - protein, 14 aa, Mycobacterium
KQEAREAIKGTPLQ

SEQ ID NO: 267716 - protein, 18 aa, Mycobacterium
KQEHPDWEEAGEGSRKAS

SEQ ID NO: 267717 - protein, 16 aa, Mycobacterium
KQEQPAFPSEASPAVD

SEQ ID NO: 267718 - protein, 12 aa, Mycobacterium
KQFTTEPPGLAD

SEQ ID NO: 267719 - protein, 25 aa, Mycobacterium
KQGNGGGSEAEPMVEDGSAGSSDGD

SEQ ID NO: 267720 - protein, 8 aa, Mycobacterium
KQGRAGTA

SEQ ID NO: 267721 - protein, 7 aa, Mycobacterium
KQIAGTY

SEQ ID NO: 267722 - protein, 11 aa, Mycobacterium
KQIRQTGEQGL

SEQ ID NO: 267723 - protein, 22 aa, Mycobacterium
KQKHISASATVPAAAPIEATGS

SEQ ID NO: 267724 - protein, 8 aa, Mycobacterium
KQKNHAGV

SEQ ID NO: 267725 - protein, 10 aa, Mycobacterium
KQLDKQGNAA

SEQ ID NO: 267726 - protein, 12 aa, Mycobacterium
KQLGSQSPAQVR

SEQ ID NO: 267727 - protein, 6 aa, Mycobacterium
KQLNDR

SEQ ID NO: 267728 - protein, 8 aa, Mycobacterium
KQLPSSTP

SEQ ID NO: 267729 - protein, 7 aa, Mycobacterium
KQLTDSK

SEQ ID NO: 267730 - protein, 8 aa, Mycobacterium
KQLTDSRA

SEQ ID NO: 267731 - protein, 10 aa, Mycobacterium
KQMGGQLGDA

SEQ ID NO: 267732 - protein, 15 aa, Mycobacterium
KQMSYNDSRAEGMRT

SEQ ID NO: 267733 - protein, 5 aa, Mycobacterium
KQNEI

SEQ ID NO: 267734 - protein, 7 aa, Mycobacterium
KQNRAAA

SEQ ID NO: 267735 - protein, 8 aa, Mycobacterium
KQNRGAAW

SEQ ID NO: 267736 - protein, 20 aa, Mycobacterium
KQPAPVPPTAWAVPGDAGWA

SEQ ID NO: 267737 - protein, 14 aa, Mycobacterium
KQPASAQTGAPGGL

SEQ ID NO: 267738 - protein, 12 aa, Mycobacterium
KQPGGVTVDSEG

SEQ ID NO: 267739 - protein, 8 aa, Mycobacterium
KQPLGDEA

SEQ ID NO: 267740 - protein, 9 aa, Mycobacterium
KQQITPNGT

SEQ ID NO: 267741 - protein, 8 aa, Mycobacterium
KQQPGVAR

SEQ ID NO: 267742 - protein, 6 aa, Mycobacterium
KQQSNV

SEQ ID NO: 267743 - protein, 9 aa, Mycobacterium
KQQVTPDGT

SEQ ID NO: 267744 - protein, 10 aa, Mycobacterium
KQQVTPEGTT

SEQ ID NO: 267745 - protein, 16 aa, Mycobacterium
KQRAGTAAAVSATGTL

SEQ ID NO: 267746 - protein, 5 aa, Mycobacterium
KQRAV

SEQ ID NO: 267747 - protein, 8 aa, Mycobacterium
KQRGDEWP

SEQ ID NO: 267748 - protein, 18 aa, Mycobacterium
KQRNRSRPSVSARDTAAN

SEQ ID NO: 267749 - protein, 7 aa, Mycobacterium
KQRPGHE

SEQ ID NO: 267750 - protein, 8 aa, Mycobacterium
KQRPSTNM

SEQ ID NO: 267751 - protein, 18 aa, Mycobacterium
KQRTARFDSAGSLARAAS

SEQ ID NO: 267752 - protein, 15 aa, Mycobacterium
KQSAAITHEQTEGFQ

SEQ ID NO: 267753 - protein, 12 aa, Mycobacterium
KQSESAIPAQSR

SEQ ID NO: 267754 - protein, 6 aa, Mycobacterium
KQTAAV

SEQ ID NO: 267755 - protein, 5 aa, Mycobacterium
KQTAL

SEQ ID NO: 267756 - protein, 6 aa, Mycobacterium
KQTAVS

SEQ ID NO: 267757 - protein, 6 aa, Mycobacterium
KQTDRG

SEQ ID NO: 267758 - protein, 19 aa, Mycobacterium
KQTENGAPASSSDKTNSSS

SEQ ID NO: 267759 - protein, 4 aa, Mycobacterium
KQTL

SEQ ID NO: 267760 - protein, 7 aa, Mycobacterium
KQTPPAG

SEQ ID NO: 267761 - protein, 8 aa, Mycobacterium
KQTPTQRV

SEQ ID NO: 267762 - protein, 20 aa, Mycobacterium
KQTRDDGHGLTTAMAWRLAA

SEQ ID NO: 267763 - protein, 8 aa, Mycobacterium
KQTREDGY

SEQ ID NO: 267764 - protein, 13 aa, Mycobacterium
KQTVNGKQTIGDM

SEQ ID NO: 267765 - protein, 12 aa, Mycobacterium
KQVEATPGAPLA

SEQ ID NO: 267766 - protein, 7 aa, Mycobacterium
KQYREKA

SEQ ID NO: 267767 - protein, 10 aa, Mycobacterium
KQYSSPGGAV

SEQ ID NO: 267768 - protein, 10 aa, Mycobacterium
KRAADREVAT

SEQ ID NO: 267769 - protein, 6 aa, Mycobacterium
KRAAKG

SEQ ID NO: 267770 - protein, 15 aa, Mycobacterium
KRAEASGNGADHVST

SEQ ID NO: 267771 - protein, 6 aa, Mycobacterium
KRAELS

SEQ ID NO: 267772 - protein, 5 aa, Mycobacterium
KRAEV

SEQ ID NO: 267773 - protein, 8 aa, Mycobacterium
KRAGGNQI

SEQ ID NO: 267774 - protein, 18 aa, Mycobacterium
KRAGGNQVRHAEMPVPPT

SEQ ID NO: 267775 - protein, 7 aa, Mycobacterium
KRAGGSP

SEQ ID NO: 267776 - protein, 6 aa, Mycobacterium
KRAGIG

SEQ ID NO: 267777 - protein, 63 aa, Mycobacterium
KRAHPQPARQTAKQQAKQPAARKAPKAVRKPGEPARPASPRRADRPVRRSAGTAHAPGRGHHP

SEQ ID NO: 267778 - protein, 9 aa, Mycobacterium
KRAPTTPRK

SEQ ID NO: 267779 - protein, 7 aa, Mycobacterium
KRAQGQC

SEQ ID NO: 267780 - protein, 7 aa, Mycobacterium
KRARGSP

SEQ ID NO: 267781 - protein, 9 aa, Mycobacterium
KRARPPHGS

SEQ ID NO: 267782 - protein, 7 aa, Mycobacterium
KRASATN

SEQ ID NO: 267783 - protein, 7 aa, Mycobacterium
KRATTTR

SEQ ID NO: 267784 - protein, 5 aa, Mycobacterium
KRDPN

SEQ ID NO: 267785 - protein, 10 aa, Mycobacterium
KRDRDGAAPI

SEQ ID NO: 267786 - protein, 7 aa, Mycobacterium
KRDRGTL

SEQ ID NO: 267787 - protein, 5 aa, Mycobacterium
KRDTV

SEQ ID NO: 267788 - protein, 10 aa, Mycobacterium
KRDWPTRNDS

SEQ ID NO: 267789 - protein, 8 aa, Mycobacterium
KREEPAPD

SEQ ID NO: 267790 - protein, 8 aa, Mycobacterium
KREGGERI

SEQ ID NO: 267791 - protein, 5 aa, Mycobacterium
KREGY

SEQ ID NO: 267792 - protein, 8 aa, Mycobacterium
KREKDAKM

SEQ ID NO: 267793 - protein, 11 aa, Mycobacterium
KREKTARPNRS

SEQ ID NO: 267794 - protein, 4 aa, Mycobacterium
KREL

SEQ ID NO: 267795 - protein, 8 aa, Mycobacterium
KRELSTKS

SEQ ID NO: 267796 - protein, 6 aa, Mycobacterium
KREPLP

SEQ ID NO: 267797 - protein, 6 aa, Mycobacterium
KREPMS

SEQ ID NO: 267798 - protein, 9 aa, Mycobacterium
KREPMSQDE

SEQ ID NO: 267799 - protein, 4 aa, Mycobacterium
KREQ

SEQ ID NO: 267800 - protein, 8 aa, Mycobacterium
KREQMSTD

SEQ ID NO: 267801 - protein, 20 aa, Mycobacterium
KRERPADSAQAVDAEADAIA

SEQ ID NO: 267802 - protein, 20 aa, Mycobacterium
KRERPAEAPDTVDAEADAVA

SEQ ID NO: 267803 - protein, 7 aa, Mycobacterium
KRETRGV

SEQ ID NO: 267804 - protein, 5 aa, Mycobacterium
KRFGD

SEQ ID NO: 267805 - protein, 4 aa, Mycobacterium
KRGA

SEQ ID NO: 267806 - protein, 9 aa, Mycobacterium
KRGADPGAV

SEQ ID NO: 267807 - protein, 8 aa, Mycobacterium
KRGATAQS

SEQ ID NO: 267808 - protein, 17 aa, Mycobacterium
KRGAWAPPTAASPTAMG

SEQ ID NO: 267809 - protein, 13 aa, Mycobacterium
KRGDSDEDATDSL

SEQ ID NO: 267810 - protein, 6 aa, Mycobacterium
KRGEAV

SEQ ID NO: 267811 - protein, 10 aa, Mycobacterium
KRGEVEQADD

SEQ ID NO: 267812 - protein, 16 aa, Mycobacterium
KRGGPAAGHRSDPDWK

SEQ ID NO: 267813 - protein, 10 aa, Mycobacterium
KRGGQPTEVG

SEQ ID NO: 267814 - protein, 6 aa, Mycobacterium
KRGGRS

SEQ ID NO: 267815 - protein, 14 aa, Mycobacterium
KRGIGEPKPDRTRR

SEQ ID NO: 267816 - protein, 7 aa, Mycobacterium
KRGINPE

SEQ ID NO: 267817 - protein, 4 aa, Mycobacterium
KRGL

SEQ ID NO: 267818 - protein, 11 aa, Mycobacterium
KRGLGLPGSDR

SEQ ID NO: 267819 - protein, 5 aa, Mycobacterium
KRGLT

SEQ ID NO: 267820 - protein, 5 aa, Mycobacterium
KRGPR

SEQ ID NO: 267821 - protein, 11 aa, Mycobacterium
KRGSASPSRTY

SEQ ID NO: 267822 - protein, 14 aa, Mycobacterium
KRGSDWLVADVLPI

SEQ ID NO: 267823 - protein, 12 aa, Mycobacterium
KRGSQEAPAPHT

SEQ ID NO: 267824 - protein, 9 aa, Mycobacterium
KRGTEVARD

SEQ ID NO: 267825 - protein, 15 aa, Mycobacterium
KRHPQAAASQPSQAS

SEQ ID NO: 267826 - protein, 4 aa, Mycobacterium
KRHQ

SEQ ID NO: 267827 - protein, 5 aa, Mycobacterium
KRIDD

SEQ ID NO: 267828 - protein, 9 aa, Mycobacterium
KRKAAGARE

SEQ ID NO: 267829 - protein, 6 aa, Mycobacterium
KRKAKR

SEQ ID NO: 267830 - protein, 37 aa, Mycobacterium
KRKAKREALIPDDEASAIDSPEPVPAPSVIGGSHDDV

SEQ ID NO: 267831 - protein, 19 aa, Mycobacterium
KRKAKREAQTEIPDDEASV

SEQ ID NO: 267832 - protein, 9 aa, Mycobacterium
KRKAPERDG

SEQ ID NO: 267833 - protein, 9 aa, Mycobacterium
KRKGQENFN

SEQ ID NO: 267834 - protein, 17 aa, Mycobacterium
KRKLERQLENRAERARK

SEQ ID NO: 267835 - protein, 19 aa, Mycobacterium
KRKLERQLERRAKQAKRRR

SEQ ID NO: 267836 - protein, 13 aa, Mycobacterium
KRKRATSAGTLGV

SEQ ID NO: 267837 - protein, 9 aa, Mycobacterium
KRKSEAPQQ

SEQ ID NO: 267838 - protein, 14 aa, Mycobacterium
KRKSNRPNKQGAND

SEQ ID NO: 267839 - protein, 8 aa, Mycobacterium
KRKVKTRG

SEQ ID NO: 267840 - protein, 9 aa, Mycobacterium
KRKYDEGGW

SEQ ID NO: 267841 - protein, 18 aa, Mycobacterium
KRLEQGTVRARYLPWFAW

SEQ ID NO: 267842 - protein, 6 aa, Mycobacterium
KRLGRG

SEQ ID NO: 267843 - protein, 30 aa, Mycobacterium
KRLPGSGPSAESKQEARELEGEERRSRPRP

SEQ ID NO: 267844 - protein, 6 aa, Mycobacterium
KRLPKS

SEQ ID NO: 267845 - protein, 8 aa, Mycobacterium
KRLPRDVS

SEQ ID NO: 267846 - protein, 6 aa, Mycobacterium
KRLRGS

SEQ ID NO: 267847 - protein, 4 aa, Mycobacterium
KRLS

SEQ ID NO: 267848 - protein, 10 aa, Mycobacterium
KRMDGDPEQM

SEQ ID NO: 267849 - protein, 9 aa, Mycobacterium
KRMGTGLDE

SEQ ID NO: 267850 - protein, 6 aa, Mycobacterium
KRMPET

SEQ ID NO: 267851 - protein, 6 aa, Mycobacterium
KRNEHR

SEQ ID NO: 267852 - protein, 8 aa, Mycobacterium
KRNGGNQC

SEQ ID NO: 267853 - protein, 16 aa, Mycobacterium
KRNGKDRVADDLVPVE

SEQ ID NO: 267854 - protein, 12 aa, Mycobacterium
KRNREQHNRRRR

SEQ ID NO: 267855 - protein, 5 aa, Mycobacterium
KRNRP

SEQ ID NO: 267856 - protein, 5 aa, Mycobacterium
KRNSA

SEQ ID NO: 267857 - protein, 20 aa, Mycobacterium
KRNVAGSPLTANLTGPAATV

SEQ ID NO: 267858 - protein, 26 aa, Mycobacterium
KRPALEPRRDPAPQSDSPDFDGWSNP

SEQ ID NO: 267859 - protein, 16 aa, Mycobacterium
KRPDAERRKRPRKQDL

SEQ ID NO: 267860 - protein, 9 aa, Mycobacterium
KRPDTDEDL

SEQ ID NO: 267861 - protein, 10 aa, Mycobacterium
KRPGRSSLEE

SEQ ID NO: 267862 - protein, 6 aa, Mycobacterium
KRPHDP

SEQ ID NO: 267863 - protein, 7 aa, Mycobacterium
KRPHDPA

SEQ ID NO: 267864 - protein, 6 aa, Mycobacterium
KRPHHP

SEQ ID NO: 267865 - protein, 5 aa, Mycobacterium
KRPRK

SEQ ID NO: 267866 - protein, 12 aa, Mycobacterium
KRPSFSYADQGP

SEQ ID NO: 267867 - protein, 28 aa, Mycobacterium
KRPTAARRDMSSPQDGVPGITNEKESIG

SEQ ID NO: 267868 - protein, 6 aa, Mycobacterium
KRPTMS

SEQ ID NO: 267869 - protein, 13 aa, Mycobacterium
KRQAEQTPSQNRA

SEQ ID NO: 267870 - protein, 8 aa, Mycobacterium
KRQGQESF

SEQ ID NO: 267871 - protein, 6 aa, Mycobacterium
KRQGTR

SEQ ID NO: 267872 - protein, 12 aa, Mycobacterium
KRQNGNTAQQAE

SEQ ID NO: 267873 - protein, 5 aa, Mycobacterium
KRQRK

SEQ ID NO: 267874 - protein, 6 aa, Mycobacterium
KRQRNP

SEQ ID NO: 267875 - protein, 7 aa, Mycobacterium
KRQTGGL

SEQ ID NO: 267876 - protein, 6 aa, Mycobacterium
KRQTLA

SEQ ID NO: 267877 - protein, 6 aa, Mycobacterium
KRREEG

SEQ ID NO: 267878 - protein, 7 aa, Mycobacterium
KRRGATT

SEQ ID NO: 267879 - protein, 8 aa, Mycobacterium
KRRPMSQE

SEQ ID NO: 267880 - protein, 11 aa, Mycobacterium
KRRPPAGLSAQ

SEQ ID NO: 267881 - protein, 11 aa, Mycobacterium
KRRPPAGLSPE

SEQ ID NO: 267882 - protein, 13 aa, Mycobacterium
KRRPPAGLSPQEL

SEQ ID NO: 267883 - protein, 10 aa, Mycobacterium
KRRPSAGTFG

SEQ ID NO: 267884 - protein, 7 aa, Mycobacterium
KRRQADE

SEQ ID NO: 267885 - protein, 16 aa, Mycobacterium
KRRQERGLLPGQQRPA

SEQ ID NO: 267886 - protein, 7 aa, Mycobacterium
KRRQPDP

SEQ ID NO: 267887 - protein, 11 aa, Mycobacterium
KRRQPKPDDRP

SEQ ID NO: 267888 - protein, 20 aa, Mycobacterium
KRRRTDTVADTTQKVSDRGA

SEQ ID NO: 267889 - protein, 9 aa, Mycobacterium
KRRSSAGSL

SEQ ID NO: 267890 - protein, 8 aa, Mycobacterium
KRRTDRGT

SEQ ID NO: 267891 - protein, 8 aa, Mycobacterium
KRSAPAPF

SEQ ID NO: 267892 - protein, 6 aa, Mycobacterium
KRSDEV

SEQ ID NO: 267893 - protein, 16 aa, Mycobacterium
KRSDGGAERAAPGNYL

SEQ ID NO: 267894 - protein, 5 aa, Mycobacterium
KRSGH

SEQ ID NO: 267895 - protein, 8 aa, Mycobacterium
KRSGPGAP

SEQ ID NO: 267896 - protein, 15 aa, Mycobacterium
KRSHKAAGRCVGGQE

SEQ ID NO: 267897 - protein, 9 aa, Mycobacterium
KRSIGPDKV

SEQ ID NO: 267898 - protein, 7 aa, Mycobacterium
KRSIPTQ

SEQ ID NO: 267899 - protein, 6 aa, Mycobacterium
KRSKER

SEQ ID NO: 267900 - protein, 10 aa, Mycobacterium
KRSKRRAGAA

SEQ ID NO: 267901 - protein, 10 aa, Mycobacterium
KRSPGGPAQV

SEQ ID NO: 267902 - protein, 8 aa, Mycobacterium
KRSPQAFR

SEQ ID NO: 267903 - protein, 7 aa, Mycobacterium
KRSQKQV

SEQ ID NO: 267904 - protein, 5 aa, Mycobacterium
KRSQP

SEQ ID NO: 267905 - protein, 7 aa, Mycobacterium
KRSRGKP

SEQ ID NO: 267906 - protein, 8 aa, Mycobacterium
KRSRHDVA

SEQ ID NO: 267907 - protein, 6 aa, Mycobacterium
KRSTFA

SEQ ID NO: 267908 - protein, 8 aa, Mycobacterium
KRSTSRLQ

SEQ ID NO: 267909 - protein, 8 aa, Mycobacterium
KRTDAPQA

SEQ ID NO: 267910 - protein, 8 aa, Mycobacterium
KRTDNPSE

SEQ ID NO: 267911 - protein, 5 aa, Mycobacterium
KRTFA

SEQ ID NO: 267912 - protein, 9 aa, Mycobacterium
KRTGEQGRS

SEQ ID NO: 267913 - protein, 7 aa, Mycobacterium
KRTGERG

SEQ ID NO: 267914 - protein, 9 aa, Mycobacterium
KRTGQNGRG

SEQ ID NO: 267915 - protein, 8 aa, Mycobacterium
KRTHNAGI

SEQ ID NO: 267916 - protein, 7 aa, Mycobacterium
KRTINTR

SEQ ID NO: 267917 - protein, 13 aa, Mycobacterium
KRTNGGSARQARS

SEQ ID NO: 267918 - protein, 5 aa, Mycobacterium
KRTPH

SEQ ID NO: 267919 - protein, 8 aa, Mycobacterium
KRTQQDGY

SEQ ID NO: 267920 - protein, 13 aa, Mycobacterium
KRTREARRASQEA

SEQ ID NO: 267921 - protein, 8 aa, Mycobacterium
KRTRGEYQ

SEQ ID NO: 267922 - protein, 8 aa, Mycobacterium
KRTRNAGI

SEQ ID NO: 267923 - protein, 7 aa, Mycobacterium
KRTRQEG

SEQ ID NO: 267924 - protein, 8 aa, Mycobacterium
KRTTADEL

SEQ ID NO: 267925 - protein, 7 aa, Mycobacterium
KRTVAGS

SEQ ID NO: 267926 - protein, 23 aa, Mycobacterium
KRTVSSGSLGTYAGNGLGPGAAY

SEQ ID NO: 267927 - protein, 32 aa, Mycobacterium
KRVPKKKVARAKRAPTEKTAVTEESSAAQLAP

SEQ ID NO: 267928 - protein, 6 aa, Mycobacterium
KRVPPQ

SEQ ID NO: 267929 - protein, 8 aa, Mycobacterium
KRVPPSAE

SEQ ID NO: 267930 - protein, 19 aa, Mycobacterium
KRVPVAGTYSTEAQQESRL

SEQ ID NO: 267931 - protein, 8 aa, Mycobacterium
KRYDNTQY

SEQ ID NO: 267932 - protein, 7 aa, Mycobacterium
KRYEDLN

SEQ ID NO: 267933 - protein, 44 aa, Mycobacterium
KSAAQRTARGASKTAPKPKGANSSGGATAPSGPPPTEASTEKLK

SEQ ID NO: 267934 - protein, 4 aa, Mycobacterium
KSAG

SEQ ID NO: 267935 - protein, 12 aa, Mycobacterium
KSAGAAHTATGQ

SEQ ID NO: 267936 - protein, 7 aa, Mycobacterium
KSAITGA

SEQ ID NO: 267937 - protein, 5 aa, Mycobacterium
KSAKY

SEQ ID NO: 267938 - protein, 8 aa, Mycobacterium
KSAPRIAT

SEQ ID NO: 267939 - protein, 7 aa, Mycobacterium
KSAPTRG

SEQ ID NO: 267940 - protein, 5 aa, Mycobacterium
KSASL

SEQ ID NO: 267941 - protein, 22 aa, Mycobacterium
KSASLGTNVRTGPYRQSNLRDA

SEQ ID NO: 267942 - protein, 9 aa, Mycobacterium
KSASPIAGV

SEQ ID NO: 267943 - protein, 8 aa, Mycobacterium
KSASSPHT

SEQ ID NO: 267944 - protein, 13 aa, Mycobacterium
KSATLSKPAYNGL

SEQ ID NO: 267945 - protein, 7 aa, Mycobacterium
KSATPDK

SEQ ID NO: 267946 - protein, 8 aa, Mycobacterium
KSATSAAG

SEQ ID NO: 267947 - protein, 6 aa, Mycobacterium
KSAVGP

SEQ ID NO: 267948 - protein, 7 aa, Mycobacterium
KSAVGPS

SEQ ID NO: 267949 - protein, 8 aa, Mycobacterium
KSCRQADP

SEQ ID NO: 267950 - protein, 10 aa, Mycobacterium
KSDDSARRSA

SEQ ID NO: 267951 - protein, 9 aa, Mycobacterium
KSDEDARRR

SEQ ID NO: 267952 - protein, 10 aa, Mycobacterium
KSDGKPATLT

SEQ ID NO: 267953 - protein, 5 aa, Mycobacterium
KSDGT

SEQ ID NO: 267954 - protein, 8 aa, Mycobacterium
KSDIPEAA

SEQ ID NO: 267955 - protein, 8 aa, Mycobacterium
KSDLAGAE

SEQ ID NO: 267956 - protein, 9 aa, Mycobacterium
KSDPANRGA

SEQ ID NO: 267957 - protein, 6 aa, Mycobacterium
KSDPHR

SEQ ID NO: 267958 - protein, 6 aa, Mycobacterium
KSDPYA

SEQ ID NO: 267959 - protein, 9 aa, Mycobacterium
KSDQEGLQG

SEQ ID NO: 267960 - protein, 6 aa, Mycobacterium
KSDQGR

SEQ ID NO: 267961 - protein, 5 aa, Mycobacterium
KSDSS

SEQ ID NO: 267962 - protein, 6 aa, Mycobacterium
KSDTEH

SEQ ID NO: 267963 - protein, 5 aa, Mycobacterium
KSDTL

SEQ ID NO: 267964 - protein, 4 aa, Mycobacterium
KSEA

SEQ ID NO: 267965 - protein, 8 aa, Mycobacterium
KSEAAVAA

SEQ ID NO: 267966 - protein, 10 aa, Mycobacterium
KSEDYPDAVD

SEQ ID NO: 267967 - protein, 11 aa, Mycobacterium
KSEGGKPVASD

SEQ ID NO: 267968 - protein, 8 aa, Mycobacterium
KSELSGDR

SEQ ID NO: 267969 - protein, 13 aa, Mycobacterium
KSELSSAKDRATL

SEQ ID NO: 267970 - protein, 15 aa, Mycobacterium
KSETYLDREKGAAFV

SEQ ID NO: 267971 - protein, 5 aa, Mycobacterium
KSFGA

SEQ ID NO: 267972 - protein, 16 aa, Mycobacterium
KSFSSDADGYTRSEGG

SEQ ID NO: 267973 - protein, 10 aa, Mycobacterium
KSFTDGDPNN

SEQ ID NO: 267974 - protein, 7 aa, Mycobacterium
KSGAPAA

SEQ ID NO: 267975 - protein, 9 aa, Mycobacterium
KSGDAAAAP

SEQ ID NO: 267976 - protein, 8 aa, Mycobacterium
KSGDDLPV

SEQ ID NO: 267977 - protein, 7 aa, Mycobacterium
KSGDRSM

SEQ ID NO: 267978 - protein, 8 aa, Mycobacterium
KSGGAQTW

SEQ ID NO: 267979 - protein, 13 aa, Mycobacterium
KSGGAWTIEALEP

SEQ ID NO: 267980 - protein, 10 aa, Mycobacterium
KSGGEVNPYT

SEQ ID NO: 267981 - protein, 12 aa, Mycobacterium
KSGNGDTENSDK

SEQ ID NO: 267982 - protein, 4 aa, Mycobacterium
KSGP

SEQ ID NO: 267983 - protein, 7 aa, Mycobacterium
KSGPDIT

SEQ ID NO: 267984 - protein, 8 aa, Mycobacterium
KSGQRQDA

SEQ ID NO: 267985 - protein, 11 aa, Mycobacterium
KSGRAVEAAGD

SEQ ID NO: 267986 - protein, 15 aa, Mycobacterium
KSGRITDPTHLGSSP

SEQ ID NO: 267987 - protein, 9 aa, Mycobacterium
KSGSIKSAA

SEQ ID NO: 267988 - protein, 10 aa, Mycobacterium
KSGSPRSRGL

SEQ ID NO: 267989 - protein, 7 aa, Mycobacterium
KSGTHRP

SEQ ID NO: 267990 - protein, 5 aa, Mycobacterium
KSHGT

SEQ ID NO: 267991 - protein, 4 aa, Mycobacterium
KSHL

SEQ ID NO: 267992 - protein, 8 aa, Mycobacterium
KSIPTDTE

SEQ ID NO: 267993 - protein, 6 aa, Mycobacterium
KSIRDT

SEQ ID NO: 267994 - protein, 17 aa, Mycobacterium
KSKGNPELAHDLGIVRA

SEQ ID NO: 267995 - protein, 9 aa, Mycobacterium
KSKRNQVDF

SEQ ID NO: 267996 - protein, 10 aa, Mycobacterium
KSKSVGTITE

SEQ ID NO: 267997 - protein, 6 aa, Mycobacterium
KSLATG

SEQ ID NO: 267998 - protein, 11 aa, Mycobacterium
KSLDDSKRALN

SEQ ID NO: 267999 - protein, 10 aa, Mycobacterium
KSLDSGGNAL

SEQ ID NO: 268000 - protein, 7 aa, Mycobacterium
KSLEGYT

SEQ ID NO: 268001 - protein, 7 aa, Mycobacterium
KSLESYT

SEQ ID NO: 268002 - protein, 6 aa, Mycobacterium
KSLRAG

SEQ ID NO: 268003 - protein, 6 aa, Mycobacterium
KSLRPG

SEQ ID NO: 268004 - protein, 12 aa, Mycobacterium
KSLSGEYASAAA

SEQ ID NO: 268005 - protein, 8 aa, Mycobacterium
KSMSTGGV

SEQ ID NO: 268006 - protein, 7 aa, Mycobacterium
KSNASTV

SEQ ID NO: 268007 - protein, 4 aa, Mycobacterium
KSNE

SEQ ID NO: 268008 - protein, 7 aa, Mycobacterium
KSNGTAA

SEQ ID NO: 268009 - protein, 5 aa, Mycobacterium
KSNNF

SEQ ID NO: 268010 - protein, 4 aa, Mycobacterium
KSNS

SEQ ID NO: 268011 - protein, 11 aa, Mycobacterium
KSPAEDGAAQD

SEQ ID NO: 268012 - protein, 8 aa, Mycobacterium
KSPALRAD

SEQ ID NO: 268013 - protein, 7 aa, Mycobacterium
KSPAQMS

SEQ ID NO: 268014 - protein, 7 aa, Mycobacterium
KSPDGKF

SEQ ID NO: 268015 - protein, 22 aa, Mycobacterium
KSPISREQADQAGRAALAAGSA

SEQ ID NO: 268016 - protein, 6 aa, Mycobacterium
KSPNVM

SEQ ID NO: 268017 - protein, 14 aa, Mycobacterium
KSPPDPTEGGEGAE

SEQ ID NO: 268018 - protein, 14 aa, Mycobacterium
KSPPDQTEHGEGAE

SEQ ID NO: 268019 - protein, 6 aa, Mycobacterium
KSPPTL

SEQ ID NO: 268020 - protein, 13 aa, Mycobacterium
KSPRLAKPAYNGL

SEQ ID NO: 268021 - protein, 12 aa, Mycobacterium
KSPTLAKPAYNG

SEQ ID NO: 268022 - protein, 13 aa, Mycobacterium
KSPTLAKPAYNGL

SEQ ID NO: 268023 - protein, 13 aa, Mycobacterium
KSPTMAKPKLNGL

SEQ ID NO: 268024 - protein, 4 aa, Mycobacterium
KSPV

SEQ ID NO: 268025 - protein, 6 aa, Mycobacterium
KSPVGS

SEQ ID NO: 268026 - protein, 8 aa, Mycobacterium
KSPWDPRT

SEQ ID NO: 268027 - protein, 5 aa, Mycobacterium
KSQGD

SEQ ID NO: 268028 - protein, 23 aa, Mycobacterium
KSQKTSQQDINTGKARYKKAQEE

SEQ ID NO: 268029 - protein, 6 aa, Mycobacterium
KSQPQA

SEQ ID NO: 268030 - protein, 6 aa, Mycobacterium
KSQPYC

SEQ ID NO: 268031 - protein, 6 aa, Mycobacterium
KSQSNY

SEQ ID NO: 268032 - protein, 6 aa, Mycobacterium
KSQTGI

SEQ ID NO: 268033 - protein, 15 aa, Mycobacterium
KSRAKQLSKDMPKTT

SEQ ID NO: 268034 - protein, 8 aa, Mycobacterium
KSRARRNG

SEQ ID NO: 268035 - protein, 7 aa, Mycobacterium
KSRDAVP

SEQ ID NO: 268036 - protein, 8 aa, Mycobacterium
KSRDELGD

SEQ ID NO: 268037 - protein, 6 aa, Mycobacterium
KSRGDQ

SEQ ID NO: 268038 - protein, 8 aa, Mycobacterium
KSRGQRNS

SEQ ID NO: 268039 - protein, 14 aa, Mycobacterium
KSRLAPSLPAPQRE

SEQ ID NO: 268040 - protein, 14 aa, Mycobacterium
KSRNRRRAAEADRI

SEQ ID NO: 268041 - protein, 4 aa, Mycobacterium
KSRP

SEQ ID NO: 268042 - protein, 5 aa, Mycobacterium
KSRPV

SEQ ID NO: 268043 - protein, 8 aa, Mycobacterium
KSSAPTSN

SEQ ID NO: 268044 - protein, 6 aa, Mycobacterium
KSSGVD

SEQ ID NO: 268045 - protein, 7 aa, Mycobacterium
KSSLAKP

SEQ ID NO: 268046 - protein, 9 aa, Mycobacterium
KSSPKIPTD

SEQ ID NO: 268047 - protein, 11 aa, Mycobacterium
KSSSDTDGSDK

SEQ ID NO: 268048 - protein, 13 aa, Mycobacterium
KSSTLAKPAYNGL

SEQ ID NO: 268049 - protein, 9 aa, Mycobacterium
KSSTTGQVD

SEQ ID NO: 268050 - protein, 12 aa, Mycobacterium
KSTANSKGTIGS

SEQ ID NO: 268051 - protein, 10 aa, Mycobacterium
KSTGSGEVTY

SEQ ID NO: 268052 - protein, 6 aa, Mycobacterium
KSTMPA

SEQ ID NO: 268053 - protein, 4 aa, Mycobacterium
KSTN

SEQ ID NO: 268054 - protein, 11 aa, Mycobacterium
KSTNAGVPEQA

SEQ ID NO: 268055 - protein, 8 aa, Mycobacterium
KSTPLAPA

SEQ ID NO: 268056 - protein, 11 aa, Mycobacterium
KSTPNSAGTLG

SEQ ID NO: 268057 - protein, 6 aa, Mycobacterium
KSTRES

SEQ ID NO: 268058 - protein, 9 aa, Mycobacterium
KSTTPRRRQ

SEQ ID NO: 268059 - protein, 14 aa, Mycobacterium
KSVASSAEGRRGSS

SEQ ID NO: 268060 - protein, 55 aa, Mycobacterium
KSVDDKNDENKVEAAPEAEAVESTEAVESTEAVEPTGTDPEATDADVTAAAPTRR

SEQ ID NO: 268061 - protein, 12 aa, Mycobacterium
KSVDNDKQISST

SEQ ID NO: 268062 - protein, 5 aa, Mycobacterium
KSVDT

SEQ ID NO: 268063 - protein, 10 aa, Mycobacterium
KSVGGPEGDL

SEQ ID NO: 268064 - protein, 5 aa, Mycobacterium
KSVGP

SEQ ID NO: 268065 - protein, 6 aa, Mycobacterium
KSVPGM

SEQ ID NO: 268066 - protein, 8 aa, Mycobacterium
KSVPNAGA

SEQ ID NO: 268067 - protein, 4 aa, Mycobacterium
KSYE

SEQ ID NO: 268068 - protein, 8 aa, Mycobacterium
KTAAARLA

SEQ ID NO: 268069 - protein, 14 aa, Mycobacterium
KTAADNKKAAEQFD

SEQ ID NO: 268070 - protein, 14 aa, Mycobacterium
KTAADTKKAAEQFE

SEQ ID NO: 268071 - protein, 14 aa, Mycobacterium
KTAAEEALKGTPLE

SEQ ID NO: 268072 - protein, 15 aa, Mycobacterium
KTAAEEALKGTPLED

SEQ ID NO: 268073 - protein, 14 aa, Mycobacterium
KTAAEESLKGTPLE

SEQ ID NO: 268074 - protein, 8 aa, Mycobacterium
KTAAGAAA

SEQ ID NO: 268075 - protein, 15 aa, Mycobacterium
KTAAKEAVKGTPLEG

SEQ ID NO: 268076 - protein, 6 aa, Mycobacterium
KTAAQA

SEQ ID NO: 268077 - protein, 6 aa, Mycobacterium
KTADGA

SEQ ID NO: 268078 - protein, 10 aa, Mycobacterium
KTAEPDPEAA

SEQ ID NO: 268079 - protein, 14 aa, Mycobacterium
KTAESARPNTSLTD

SEQ ID NO: 268080 - protein, 4 aa, Mycobacterium
KTAG

SEQ ID NO: 268081 - protein, 10 aa, Mycobacterium
KTAGNQIAQA

SEQ ID NO: 268082 - protein, 7 aa, Mycobacterium
KTAGPAA

SEQ ID NO: 268083 - protein, 8 aa, Mycobacterium
KTAGQATS

SEQ ID NO: 268084 - protein, 7 aa, Mycobacterium
KTAGSRG

SEQ ID NO: 268085 - protein, 9 aa, Mycobacterium
KTAKTPEAM

SEQ ID NO: 268086 - protein, 9 aa, Mycobacterium
KTAKTVGQI

SEQ ID NO: 268087 - protein, 7 aa, Mycobacterium
KTAKYAR

SEQ ID NO: 268088 - protein, 4 aa, Mycobacterium
KTAL

SEQ ID NO: 268089 - protein, 8 aa, Mycobacterium
KTAQRVAA

SEQ ID NO: 268090 - protein, 20 aa, Mycobacterium
KTATSNGHESGVSDGDGDRI

SEQ ID NO: 268091 - protein, 6 aa, Mycobacterium
KTAVTA

SEQ ID NO: 268092 - protein, 12 aa, Mycobacterium
KTDAEADGAAAE

SEQ ID NO: 268093 - protein, 25 aa, Mycobacterium
KTDASGTTKPQAGKGDSGSTRSDTQ

SEQ ID NO: 268094 - protein, 6 aa, Mycobacterium
KTDDGS

SEQ ID NO: 268095 - protein, 7 aa, Mycobacterium
KTDGGDD

SEQ ID NO: 268096 - protein, 13 aa, Mycobacterium
KTDIDGSDRFAQN

SEQ ID NO: 268097 - protein, 11 aa, Mycobacterium
KTDIGKPVNAD

SEQ ID NO: 268098 - protein, 6 aa, Mycobacterium
KTDPEL

SEQ ID NO: 268099 - protein, 8 aa, Mycobacterium
KTDSSREV

SEQ ID NO: 268100 - protein, 6 aa, Mycobacterium
KTDVPV

SEQ ID NO: 268101 - protein, 20 aa, Mycobacterium
KTEAGERSMGAETGNGGSVA

SEQ ID NO: 268102 - protein, 5 aa, Mycobacterium
KTEDL

SEQ ID NO: 268103 - protein, 7 aa, Mycobacterium
KTEESEA

SEQ ID NO: 268104 - protein, 5 aa, Mycobacterium
KTFDP

SEQ ID NO: 268105 - protein, 5 aa, Mycobacterium
KTFDT

SEQ ID NO: 268106 - protein, 28 aa, Mycobacterium
KTFEGKSNKKDAKAKPGSKPKEDPSDGS

SEQ ID NO: 268107 - protein, 8 aa, Mycobacterium
KTFEPKRA

SEQ ID NO: 268108 - protein, 8 aa, Mycobacterium
KTFTGRDD

SEQ ID NO: 268109 - protein, 11 aa, Mycobacterium
KTFTTVPPELA

SEQ ID NO: 268110 - protein, 4 aa, Mycobacterium
KTGA

SEQ ID NO: 268111 - protein, 10 aa, Mycobacterium
KTGADANKSL

SEQ ID NO: 268112 - protein, 28 aa, Mycobacterium
KTGADREYDYETSADTKNYTYTGSGGVS

SEQ ID NO: 268113 - protein, 7 aa, Mycobacterium
KTGAKIR

SEQ ID NO: 268114 - protein, 5 aa, Mycobacterium
KTGAL

SEQ ID NO: 268115 - protein, 8 aa, Mycobacterium
KTGARGTP

SEQ ID NO: 268116 - protein, 6 aa, Mycobacterium
KTGDTW

SEQ ID NO: 268117 - protein, 4 aa, Mycobacterium
KTGE

SEQ ID NO: 268118 - protein, 8 aa, Mycobacterium
KTGEHGTP

SEQ ID NO: 268119 - protein, 6 aa, Mycobacterium
KTGEQG

SEQ ID NO: 268120 - protein, 10 aa, Mycobacterium
KTGERTTARR

SEQ ID NO: 268121 - protein, 7 aa, Mycobacterium
KTGGSTY

SEQ ID NO: 268122 - protein, 15 aa, Mycobacterium
KTGHVTGVGAASGAI

SEQ ID NO: 268123 - protein, 5 aa, Mycobacterium
KTGMD

SEQ ID NO: 268124 - protein, 6 aa, Mycobacterium
KTGNAS

SEQ ID NO: 268125 - protein, 5 aa, Mycobacterium
KTGNS

SEQ ID NO: 268126 - protein, 9 aa, Mycobacterium
KTGPHGTPV

SEQ ID NO: 268127 - protein, 8 aa, Mycobacterium
KTGSHGTP

SEQ ID NO: 268128 - protein, 10 aa, Mycobacterium
KTGSLTGTNT

SEQ ID NO: 268129 - protein, 7 aa, Mycobacterium
KTGSYTP

SEQ ID NO: 268130 - protein, 12 aa, Mycobacterium
KTGTLTEGAPRL

SEQ ID NO: 268131 - protein, 8 aa, Mycobacterium
KTGTLTET

SEQ ID NO: 268132 - protein, 8 aa, Mycobacterium
KTGTLTRN

SEQ ID NO: 268133 - protein, 9 aa, Mycobacterium
KTGTLTSNE

SEQ ID NO: 268134 - protein, 5 aa, Mycobacterium
KTGVT

SEQ ID NO: 268135 - protein, 4 aa, Mycobacterium
KTHD

SEQ ID NO: 268136 - protein, 6 aa, Mycobacterium
KTISGG

SEQ ID NO: 268137 - protein, 8 aa, Mycobacterium
KTITDSRS

SEQ ID NO: 268138 - protein, 9 aa, Mycobacterium
KTITGQPVG

SEQ ID NO: 268139 - protein, 29 aa, Mycobacterium
KTITTDQNLEAGQTWNNPGRSSAEGAIDR

SEQ ID NO: 268140 - protein, 7 aa, Mycobacterium
KTKPSLA

SEQ ID NO: 268141 - protein, 16 aa, Mycobacterium
KTKTTPAADAVGDYRA

SEQ ID NO: 268142 - protein, 7 aa, Mycobacterium
KTKTWGP

SEQ ID NO: 268143 - protein, 24 aa, Mycobacterium
KTKVATATTAENPARDVGETATVT

SEQ ID NO: 268144 - protein, 6 aa, Mycobacterium
KTLDPE

SEQ ID NO: 268145 - protein, 13 aa, Mycobacterium
KTLEPKRFSRSPG

SEQ ID NO: 268146 - protein, 13 aa, Mycobacterium
KTLGATHKTHGSP

SEQ ID NO: 268147 - protein, 15 aa, Mycobacterium
KTLPEPAGQDAPDPS

SEQ ID NO: 268148 - protein, 7 aa, Mycobacterium
KTLSPAT

SEQ ID NO: 268149 - protein, 12 aa, Mycobacterium
KTLTADEIAQEQ

SEQ ID NO: 268150 - protein, 16 aa, Mycobacterium
KTLTKEERKAEKITRR

SEQ ID NO: 268151 - protein, 6 aa, Mycobacterium
KTMGAG

SEQ ID NO: 268152 - protein, 18 aa, Mycobacterium
KTNASGGQDTPQAQPRST

SEQ ID NO: 268153 - protein, 5 aa, Mycobacterium
KTNGR

SEQ ID NO: 268154 - protein, 7 aa, Mycobacterium
KTNRAAA

SEQ ID NO: 268155 - protein, 6 aa, Mycobacterium
KTPANY

SEQ ID NO: 268156 - protein, 8 aa, Mycobacterium
KTPAPEGL

SEQ ID NO: 268157 - protein, 6 aa, Mycobacterium
KTPDGM

SEQ ID NO: 268158 - protein, 7 aa, Mycobacterium
KTPEQLN

SEQ ID NO: 268159 - protein, 9 aa, Mycobacterium
KTPGINGST

SEQ ID NO: 268160 - protein, 5 aa, Mycobacterium
KTPMQ

SEQ ID NO: 268161 - protein, 6 aa, Mycobacterium
KTPQNY

SEQ ID NO: 268162 - protein, 8 aa, Mycobacterium
KTPQTGGW

SEQ ID NO: 268163 - protein, 7 aa, Mycobacterium
KTPRTVG

SEQ ID NO: 268164 - protein, 9 aa, Mycobacterium
KTPYTTPNK

SEQ ID NO: 268165 - protein, 14 aa, Mycobacterium
KTQDPGVSRAEGWR

SEQ ID NO: 268166 - protein, 11 aa, Mycobacterium
KTQKTKTRAEV

SEQ ID NO: 268167 - protein, 12 aa, Mycobacterium
KTQKTKTREEVE

SEQ ID NO: 268168 - protein, 7 aa, Mycobacterium
KTQPGRR

SEQ ID NO: 268169 - protein, 5 aa, Mycobacterium
KTQPQ

SEQ ID NO: 268170 - protein, 6 aa, Mycobacterium
KTQPQA

SEQ ID NO: 268171 - protein, 23 aa, Mycobacterium
KTQSKTEGTVTEAGIESVSADSA

SEQ ID NO: 268172 - protein, 14 aa, Mycobacterium
KTQSLPSAGPTDDG

SEQ ID NO: 268173 - protein, 9 aa, Mycobacterium
KTQTAVPPL

SEQ ID NO: 268174 - protein, 6 aa, Mycobacterium
KTQTWG

SEQ ID NO: 268175 - protein, 14 aa, Mycobacterium
KTRAEADGRSADHV

SEQ ID NO: 268176 - protein, 7 aa, Mycobacterium
KTRAPGE

SEQ ID NO: 268177 - protein, 10 aa, Mycobacterium
KTRQQDGKGI

SEQ ID NO: 268178 - protein, 16 aa, Mycobacterium
KTRTEVDVRGEYPKSR

SEQ ID NO: 268179 - protein, 12 aa, Mycobacterium
KTSAANLRQQYG

SEQ ID NO: 268180 - protein, 5 aa, Mycobacterium
KTSDE

SEQ ID NO: 268181 - protein, 11 aa, Mycobacterium
KTSGAAYTRAG

SEQ ID NO: 268182 - protein, 10 aa, Mycobacterium
KTSGQSGKEM

SEQ ID NO: 268183 - protein, 5 aa, Mycobacterium
KTSRD

SEQ ID NO: 268184 - protein, 8 aa, Mycobacterium
KTSRVQKK

SEQ ID NO: 268185 - protein, 14 aa, Mycobacterium
KTSSFSNTLADNDQ

SEQ ID NO: 268186 - protein, 16 aa, Mycobacterium
KTSSFSNTLADNNETV

SEQ ID NO: 268187 - protein, 6 aa, Mycobacterium
KTSSFT

SEQ ID NO: 268188 - protein, 13 aa, Mycobacterium
KTSSGKIRRAASR

SEQ ID NO: 268189 - protein, 15 aa, Mycobacterium
KTSSGKIRRAASRGL

SEQ ID NO: 268190 - protein, 16 aa, Mycobacterium
KTSSTEKPGPLKTTNS

SEQ ID NO: 268191 - protein, 4 aa, Mycobacterium
KTSY

SEQ ID NO: 268192 - protein, 4 aa, Mycobacterium
KTTC

SEQ ID NO: 268193 - protein, 13 aa, Mycobacterium
KTTTAGAPEQRPR

SEQ ID NO: 268194 - protein, 16 aa, Mycobacterium
KTTTRLPDGKTFESGS

SEQ ID NO: 268195 - protein, 4 aa, Mycobacterium
KTVT

SEQ ID NO: 268196 - protein, 7 aa, Mycobacterium
KTYNEDM

SEQ ID NO: 268197 - protein, 4 aa, Mycobacterium
KTYP

SEQ ID NO: 268198 - protein, 5 aa, Mycobacterium
KTYPY

SEQ ID NO: 268199 - protein, 15 aa, Mycobacterium
KVAAVKAEKAEGSAA

SEQ ID NO: 268200 - protein, 15 aa, Mycobacterium
KVADEKTDVSRTPSV

SEQ ID NO: 268201 - protein, 10 aa, Mycobacterium
KVADPTPKGR

SEQ ID NO: 268202 - protein, 4 aa, Mycobacterium
KVAH

SEQ ID NO: 268203 - protein, 10 aa, Mycobacterium
KVAPEGQPGL

SEQ ID NO: 268204 - protein, 4 aa, Mycobacterium
KVDE

SEQ ID NO: 268205 - protein, 12 aa, Mycobacterium
KVDTHQLKKCFD

SEQ ID NO: 268206 - protein, 7 aa, Mycobacterium
KVEADDS

SEQ ID NO: 268207 - protein, 12 aa, Mycobacterium
KVEEAERNTRVK

SEQ ID NO: 268208 - protein, 10 aa, Mycobacterium
KVEETDPGAV

SEQ ID NO: 268209 - protein, 24 aa, Mycobacterium
KVEKRDPNATLPAGGPPQSGPTGV

SEQ ID NO: 268210 - protein, 8 aa, Mycobacterium
KVESGRAD

SEQ ID NO: 268211 - protein, 65 aa, Mycobacterium
KVETPRTTRTTTPTTTTTTPPPTSETPTTTPTGPLGPGDTTSPTSPTSTSPGPATTVVDPDGPGI

SEQ ID NO: 268212 - protein, 7 aa, Mycobacterium
KVGADTQ

SEQ ID NO: 268213 - protein, 7 aa, Mycobacterium
KVGGEAI

SEQ ID NO: 268214 - protein, 7 aa, Mycobacterium
KVGKKTA

SEQ ID NO: 268215 - protein, 7 aa, Mycobacterium
KVGPRAP

SEQ ID NO: 268216 - protein, 4 aa, Mycobacterium
KVGR

SEQ ID NO: 268217 - protein, 5 aa, Mycobacterium
KVGRN

SEQ ID NO: 268218 - protein, 19 aa, Mycobacterium
KVGSSTSSGVAAAGGHGIR

SEQ ID NO: 268219 - protein, 10 aa, Mycobacterium
KVKRPSGKRV

SEQ ID NO: 268220 - protein, 16 aa, Mycobacterium
KVKSADTKSDDVTSQR

SEQ ID NO: 268221 - protein, 8 aa, Mycobacterium
KVKTSGDS

SEQ ID NO: 268222 - protein, 10 aa, Mycobacterium
KVNADDGSVH

SEQ ID NO: 268223 - protein, 10 aa, Mycobacterium
KVNATDGSVH

SEQ ID NO: 268224 - protein, 14 aa, Mycobacterium
KVNSTTAAALRATN

SEQ ID NO: 268225 - protein, 10 aa, Mycobacterium
KVPADAKAVT

SEQ ID NO: 268226 - protein, 9 aa, Mycobacterium
KVPADATAN

SEQ ID NO: 268227 - protein, 18 aa, Mycobacterium
KVPARDLADRGAGAPALT

SEQ ID NO: 268228 - protein, 16 aa, Mycobacterium
KVPDRGTARVDVGGPT

SEQ ID NO: 268229 - protein, 8 aa, Mycobacterium
KVPENATA

SEQ ID NO: 268230 - protein, 5 aa, Mycobacterium
KVPGN

SEQ ID NO: 268231 - protein, 5 aa, Mycobacterium
KVPGV

SEQ ID NO: 268232 - protein, 5 aa, Mycobacterium
KVPND

SEQ ID NO: 268233 - protein, 6 aa, Mycobacterium
KVRSGA

SEQ ID NO: 268234 - protein, 5 aa, Mycobacterium
KVRTE

SEQ ID NO: 268235 - protein, 18 aa, Mycobacterium
KVSAGQMSSWPGNELSGF

SEQ ID NO: 268236 - protein, 6 aa, Mycobacterium
KVSATT

SEQ ID NO: 268237 - protein, 11 aa, Mycobacterium
KVSDPTPRGKW

SEQ ID NO: 268238 - protein, 7 aa, Mycobacterium
KVSERIP

SEQ ID NO: 268239 - protein, 5 aa, Mycobacterium
KVSHE

SEQ ID NO: 268240 - protein, 9 aa, Mycobacterium
KVSKKASEW

SEQ ID NO: 268241 - protein, 9 aa, Mycobacterium
KVSRDGREL

SEQ ID NO: 268242 - protein, 7 aa, Mycobacterium
KVSTLER

SEQ ID NO: 268243 - protein, 7 aa, Mycobacterium
KVTAPER

SEQ ID NO: 268244 - protein, 12 aa, Mycobacterium
KVTDGESGNGYS

SEQ ID NO: 268245 - protein, 7 aa, Mycobacterium
KVTEAEQ

SEQ ID NO: 268246 - protein, 8 aa, Mycobacterium
KVTEDEQV

SEQ ID NO: 268247 - protein, 4 aa, Mycobacterium
KVTG

SEQ ID NO: 268248 - protein, 18 aa, Mycobacterium
KVTGEAAAAQIKATPTIK

SEQ ID NO: 268249 - protein, 8 aa, Mycobacterium
KVTGKPRD

SEQ ID NO: 268250 - protein, 11 aa, Mycobacterium
KVTREKSEPVA

SEQ ID NO: 268251 - protein, 10 aa, Mycobacterium
KVTRSSKNQL

SEQ ID NO: 268252 - protein, 84 aa, Mycobacterium
KVTVNSESSDSSNSTRDQPTPQSPVAEAPAGVNRIESSRGEADTGSYDGSHEGLSPNERYRPLERSPEDLAGLSTGSTGRANRR

SEQ ID NO: 268253 - protein, 15 aa, Mycobacterium
KWEGNQWKISNLLQV

SEQ ID NO: 268254 - protein, 12 aa, Mycobacterium
KWGPTDLGAESA

SEQ ID NO: 268255 - protein, 9 aa, Mycobacterium
KWRPGNLGQ

SEQ ID NO: 268256 - protein, 7 aa, Mycobacterium
KWRQSTN

SEQ ID NO: 268257 - protein, 18 aa, Mycobacterium
KWSDAAKAEGGHPATTTA

SEQ ID NO: 268258 - protein, 12 aa, Mycobacterium
KWSPDSGETIGD

SEQ ID NO: 268259 - protein, 11 aa, Mycobacterium
KWSPDSGETVA

SEQ ID NO: 268260 - protein, 8 aa, Mycobacterium
KWSPPGGH

SEQ ID NO: 268261 - protein, 8 aa, Mycobacterium
KWSPPGGR

SEQ ID NO: 268262 - protein, 6 aa, Mycobacterium
KYANNL

SEQ ID NO: 268263 - protein, 7 aa, Mycobacterium
KYAPDQL

SEQ ID NO: 268264 - protein, 13 aa, Mycobacterium
KYASSQDGQPAPS

SEQ ID NO: 268265 - protein, 4 aa, Mycobacterium
KYDE

SEQ ID NO: 268266 - protein, 13 aa, Mycobacterium
KYGPRSGPPSSHD

SEQ ID NO: 268267 - protein, 4 aa, Mycobacterium
KYGR

SEQ ID NO: 268268 - protein, 9 aa, Mycobacterium
KYGSEHGDP

SEQ ID NO: 268269 - protein, 7 aa, Mycobacterium
KYPDLSA

SEQ ID NO: 268270 - protein, 6 aa, Mycobacterium
KYPDQV

SEQ ID NO: 268271 - protein, 13 aa, Mycobacterium
KYPEKLGKAAEQW

SEQ ID NO: 268272 - protein, 12 aa, Mycobacterium
KYPEPGISTPSV

SEQ ID NO: 268273 - protein, 7 aa, Mycobacterium
KYPGLNA

SEQ ID NO: 268274 - protein, 6 aa, Mycobacterium
KYPRPN

SEQ ID NO: 268275 - protein, 6 aa, Mycobacterium
KYPTGY

SEQ ID NO: 268276 - protein, 11 aa, Mycobacterium
KYRERGADLPP

SEQ ID NO: 268277 - protein, 12 aa, Mycobacterium
KYRERGADLPPL

SEQ ID NO: 268278 - protein, 18 aa, Mycobacterium
KYRNGEHASTHPGTPPIG

SEQ ID NO: 268279 - protein, 15 aa, Mycobacterium
KYRSANKIPDTWKPR

SEQ ID NO: 268280 - protein, 7 aa, Mycobacterium
KYSEQYG

SEQ ID NO: 268281 - protein, 6 aa, Mycobacterium
KYSPVA

SEQ ID NO: 268282 - protein, 4 aa, Mycobacterium
KYTA

SEQ ID NO: 268283 - protein, 4 aa, Mycobacterium
KYTG

SEQ ID NO: 268284 - protein, 4 aa, Mycobacterium
KYTP

SEQ ID NO: 268285 - protein, 21 aa, Mycobacterium
KYTTPATRRSIARRDDASGAM

SEQ ID NO: 268286 - protein, 6 aa, Mycobacterium
KYVSNT

SEQ ID NO: 268287 - protein, 10 aa, Mycobacterium
LAAAADRPAL

SEQ ID NO: 268288 - protein, 21 aa, Mycobacterium
LAAAETQAREQAQESAAALRQ

SEQ ID NO: 268289 - protein, 8 aa, Mycobacterium
LAAAGKTP

SEQ ID NO: 268290 - protein, 12 aa, Mycobacterium
LAAAKAAASSLR

SEQ ID NO: 268291 - protein, 6 aa, Mycobacterium
LAAASG

SEQ ID NO: 268292 - protein, 8 aa, Mycobacterium
LAAASSPL

SEQ ID NO: 268293 - protein, 8 aa, Mycobacterium
LAAATGKD

SEQ ID NO: 268294 - protein, 8 aa, Mycobacterium
LAADADNY

SEQ ID NO: 268295 - protein, 11 aa, Mycobacterium
LAADDDRADTD

SEQ ID NO: 268296 - protein, 6 aa, Mycobacterium
LAADED

SEQ ID NO: 268297 - protein, 8 aa, Mycobacterium
LAADNGAA

SEQ ID NO: 268298 - protein, 27 aa, Mycobacterium
LAAEKDGQQDEPDDPWRDPAAAAALGT

SEQ ID NO: 268299 - protein, 9 aa, Mycobacterium
LAAEPGRRE

SEQ ID NO: 268300 - protein, 9 aa, Mycobacterium
LAAEPPDEV

SEQ ID NO: 268301 - protein, 6 aa, Mycobacterium
LAAESG

SEQ ID NO: 268302 - protein, 9 aa, Mycobacterium
LAAGADPAH

SEQ ID NO: 268303 - protein, 11 aa, Mycobacterium
LAAGATSDHFG

SEQ ID NO: 268304 - protein, 15 aa, Mycobacterium
LAAGGSSVSVTPGGS

SEQ ID NO: 268305 - protein, 7 aa, Mycobacterium
LAAGNAP

SEQ ID NO: 268306 - protein, 10 aa, Mycobacterium
LAAGPDAGAL

SEQ ID NO: 268307 - protein, 10 aa, Mycobacterium
LAAGPPPRRL

SEQ ID NO: 268308 - protein, 6 aa, Mycobacterium
LAAGQR

SEQ ID NO: 268309 - protein, 16 aa, Mycobacterium
LAAGSTTDETRPVQPQ

SEQ ID NO: 268310 - protein, 15 aa, Mycobacterium
LAAGTPLESPPDYRS

SEQ ID NO: 268311 - protein, 4 aa, Mycobacterium
LAAH

SEQ ID NO: 268312 - protein, 11 aa, Mycobacterium
LAAKQETDSYI

SEQ ID NO: 268313 - protein, 4 aa, Mycobacterium
LAAN

SEQ ID NO: 268314 - protein, 14 aa, Mycobacterium
LAAPAIPDAGNPAA

SEQ ID NO: 268315 - protein, 9 aa, Mycobacterium
LAAPAKTGQ

SEQ ID NO: 268316 - protein, 13 aa, Mycobacterium
LAAPAPDDGPKVT

SEQ ID NO: 268317 - protein, 9 aa, Mycobacterium
LAAPASTGR

SEQ ID NO: 268318 - protein, 8 aa, Mycobacterium
LAAPDGSE

SEQ ID NO: 268319 - protein, 7 aa, Mycobacterium
LAAPDRL

SEQ ID NO: 268320 - protein, 6 aa, Mycobacterium
LAAPGE

SEQ ID NO: 268321 - protein, 31 aa, Mycobacterium
LAAPGPETATGPELPAGPARLAGTAGAETAP

SEQ ID NO: 268322 - protein, 12 aa, Mycobacterium
LAAPGPPTRSTV

SEQ ID NO: 268323 - protein, 7 aa, Mycobacterium
LAAPKSV

SEQ ID NO: 268324 - protein, 19 aa, Mycobacterium
LAAPNPAAGEGKSWQDMLP

SEQ ID NO: 268325 - protein, 9 aa, Mycobacterium
LAARPGVRG

SEQ ID NO: 268326 - protein, 8 aa, Mycobacterium
LAASDSPF

SEQ ID NO: 268327 - protein, 17 aa, Mycobacterium
LAASGAPPDAVSSPGAL

SEQ ID NO: 268328 - protein, 15 aa, Mycobacterium
LAASGAPPEAAQSPQ

SEQ ID NO: 268329 - protein, 8 aa, Mycobacterium
LAASGTYR

SEQ ID NO: 268330 - protein, 9 aa, Mycobacterium
LAASQGDWS

SEQ ID NO: 268331 - protein, 6 aa, Mycobacterium
LAASVG

SEQ ID NO: 268332 - protein, 10 aa, Mycobacterium
LAATGSPLDS

SEQ ID NO: 268333 - protein, 7 aa, Mycobacterium
LAATGSS

SEQ ID NO: 268334 - protein, 8 aa, Mycobacterium
LAATRPPV

SEQ ID NO: 268335 - protein, 19 aa, Mycobacterium
LAATSRGDGGHGSSGGHAS

SEQ ID NO: 268336 - protein, 18 aa, Mycobacterium
LADAAPAHRINPSEPGTG

SEQ ID NO: 268337 - protein, 49 aa, Mycobacterium
LADAARASELGSSQPAGESAYQNYQGYQGYQGYPGYQPPPGSVPPSYGY

SEQ ID NO: 268338 - protein, 6 aa, Mycobacterium
LADAGG

SEQ ID NO: 268339 - protein, 8 aa, Mycobacterium
LADAGPTY

SEQ ID NO: 268340 - protein, 11 aa, Mycobacterium
LADAGSNLRQI

SEQ ID NO: 268341 - protein, 11 aa, Mycobacterium
LADATSAPALA

SEQ ID NO: 268342 - protein, 11 aa, Mycobacterium
LADDGDKFSGA

SEQ ID NO: 268343 - protein, 13 aa, Mycobacterium
LADDGEDAVEGRR

SEQ ID NO: 268344 - protein, 9 aa, Mycobacterium
LADDRSRGR

SEQ ID NO: 268345 - protein, 14 aa, Mycobacterium
LADEAGKAQAIEQA

SEQ ID NO: 268346 - protein, 28 aa, Mycobacterium
LADETAAKARAAQAEAEVKAAEAARLQE

SEQ ID NO: 268347 - protein, 9 aa, Mycobacterium
LADETPEGR

SEQ ID NO: 268348 - protein, 4 aa, Mycobacterium
LADG

SEQ ID NO: 268349 - protein, 7 aa, Mycobacterium
LADGDEV

SEQ ID NO: 268350 - protein, 17 aa, Mycobacterium
LADGGASATVPESGTLQ

SEQ ID NO: 268351 - protein, 9 aa, Mycobacterium
LADGHDRDT

SEQ ID NO: 268352 - protein, 28 aa, Mycobacterium
LADGSNQINQRSSDLNRLTSGANTLAGS

SEQ ID NO: 268353 - protein, 8 aa, Mycobacterium
LADGSNQL

SEQ ID NO: 268354 - protein, 28 aa, Mycobacterium
LADGSTQIDQRTSDLNRLTSGAKTLADS

SEQ ID NO: 268355 - protein, 4 aa, Mycobacterium
LADN

SEQ ID NO: 268356 - protein, 11 aa, Mycobacterium
LADNKKSAEQF

SEQ ID NO: 268357 - protein, 5 aa, Mycobacterium
LADNT

SEQ ID NO: 268358 - protein, 5 aa, Mycobacterium
LADPA

SEQ ID NO: 268359 - protein, 7 aa, Mycobacterium
LADPATA

SEQ ID NO: 268360 - protein, 8 aa, Mycobacterium
LADPATGE

SEQ ID NO: 268361 - protein, 5 aa, Mycobacterium
LADPH

SEQ ID NO: 268362 - protein, 8 aa, Mycobacterium
LADPSRRA

SEQ ID NO: 268363 - protein, 7 aa, Mycobacterium
LADQEGP

SEQ ID NO: 268364 - protein, 23 aa, Mycobacterium
LADRARASELGTHPYGAPPVPPY

SEQ ID NO: 268365 - protein, 9 aa, Mycobacterium
LADRPRPPT

SEQ ID NO: 268366 - protein, 10 aa, Mycobacterium
LADRRRSRRG

SEQ ID NO: 268367 - protein, 4 aa, Mycobacterium
LADS

SEQ ID NO: 268368 - protein, 5 aa, Mycobacterium
LADSA

SEQ ID NO: 268369 - protein, 12 aa, Mycobacterium
LADSKKAAEQFA

SEQ ID NO: 268370 - protein, 10 aa, Mycobacterium
LADSQDPDAL

SEQ ID NO: 268371 - protein, 8 aa, Mycobacterium
LADSRERA

SEQ ID NO: 268372 - protein, 8 aa, Mycobacterium
LADSTAHG

SEQ ID NO: 268373 - protein, 6 aa, Mycobacterium
LAEADS

SEQ ID NO: 268374 - protein, 17 aa, Mycobacterium
LAEDRAVPVSAEAPTAV

SEQ ID NO: 268375 - protein, 15 aa, Mycobacterium
LAEEASQASALAEAD

SEQ ID NO: 268376 - protein, 31 aa, Mycobacterium
LAEEQDEAQDEAQDSETEAETTQVSAGPSAA

SEQ ID NO: 268377 - protein, 14 aa, Mycobacterium
LAEESTGKKNPAGR

SEQ ID NO: 268378 - protein, 10 aa, Mycobacterium
LAEETHDPER

SEQ ID NO: 268379 - protein, 4 aa, Mycobacterium
LAEG

SEQ ID NO: 268380 - protein, 9 aa, Mycobacterium
LAEGADRET

SEQ ID NO: 268381 - protein, 8 aa, Mycobacterium
LAEGHDRD

SEQ ID NO: 268382 - protein, 15 aa, Mycobacterium
LAEGKSNDIPERATR

SEQ ID NO: 268383 - protein, 16 aa, Mycobacterium
LAEGNAQPSSTRTGSP

SEQ ID NO: 268384 - protein, 5 aa, Mycobacterium
LAEGR

SEQ ID NO: 268385 - protein, 12 aa, Mycobacterium
LAEGSSAARQRR

SEQ ID NO: 268386 - protein, 10 aa, Mycobacterium
LAENNGSASF

SEQ ID NO: 268387 - protein, 8 aa, Mycobacterium
LAEPAGGK

SEQ ID NO: 268388 - protein, 6 aa, Mycobacterium
LAEPES

SEQ ID NO: 268389 - protein, 9 aa, Mycobacterium
LAEPRTAVR

SEQ ID NO: 268390 - protein, 12 aa, Mycobacterium
LAEPTDDSAPKV

SEQ ID NO: 268391 - protein, 4 aa, Mycobacterium
LAEQ

SEQ ID NO: 268392 - protein, 7 aa, Mycobacterium
LAEQFGP

SEQ ID NO: 268393 - protein, 9 aa, Mycobacterium
LAEQGKKSA

SEQ ID NO: 268394 - protein, 8 aa, Mycobacterium
LAEQGRRV

SEQ ID NO: 268395 - protein, 7 aa, Mycobacterium
LAEQQSQ

SEQ ID NO: 268396 - protein, 7 aa, Mycobacterium
LAEQSEV

SEQ ID NO: 268397 - protein, 31 aa, Mycobacterium
LAERAKELGTGADEGHAPPAPPPPPPTQPWT

SEQ ID NO: 268398 - protein, 11 aa, Mycobacterium
LAERANPRRLA

SEQ ID NO: 268399 - protein, 5 aa, Mycobacterium
LAERD

SEQ ID NO: 268400 - protein, 11 aa, Mycobacterium
LAERDRQAPEL

SEQ ID NO: 268401 - protein, 14 aa, Mycobacterium
LAERDTGGLSGGEL

SEQ ID NO: 268402 - protein, 14 aa, Mycobacterium
LAERDTGSLSGGEL

SEQ ID NO: 268403 - protein, 11 aa, Mycobacterium
LAERRRGRRGL

SEQ ID NO: 268404 - protein, 11 aa, Mycobacterium
LAERTPADRDR

SEQ ID NO: 268405 - protein, 5 aa, Mycobacterium
LAESL

SEQ ID NO: 268406 - protein, 6 aa, Mycobacterium
LAETGY

SEQ ID NO: 268407 - protein, 11 aa, Mycobacterium
LAGADPTQREP

SEQ ID NO: 268408 - protein, 15 aa, Mycobacterium
LAGADSAADAERRRG

SEQ ID NO: 268409 - protein, 10 aa, Mycobacterium
LAGAGAASAH

SEQ ID NO: 268410 - protein, 14 aa, Mycobacterium
LAGAGSSPAAPTYL

SEQ ID NO: 268411 - protein, 12 aa, Mycobacterium
LAGAGSSPEVPT

SEQ ID NO: 268412 - protein, 14 aa, Mycobacterium
LAGAGTDPVSPSYL

SEQ ID NO: 268413 - protein, 10 aa, Mycobacterium
LAGAGTDVQP

SEQ ID NO: 268414 - protein, 7 aa, Mycobacterium
LAGAGYS

SEQ ID NO: 268415 - protein, 9 aa, Mycobacterium
LAGARSKMT

SEQ ID NO: 268416 - protein, 6 aa, Mycobacterium
LAGASA

SEQ ID NO: 268417 - protein, 7 aa, Mycobacterium
LAGASAD

SEQ ID NO: 268418 - protein, 6 aa, Mycobacterium
LAGATD

SEQ ID NO: 268419 - protein, 5 aa, Mycobacterium
LAGDA

SEQ ID NO: 268420 - protein, 6 aa, Mycobacterium
LAGDGN

SEQ ID NO: 268421 - protein, 7 aa, Mycobacterium
LAGDGSP

SEQ ID NO: 268422 - protein, 29 aa, Mycobacterium
LAGDPQSAGTSDDAKTESTTTDDRAAAAR

SEQ ID NO: 268423 - protein, 6 aa, Mycobacterium
LAGEGA

SEQ ID NO: 268424 - protein, 42 aa, Mycobacterium
LAGEREKPSETTQTPQTPVAQAAEKPQETLASTAPAVADPEP

SEQ ID NO: 268425 - protein, 4 aa, Mycobacterium
LAGG

SEQ ID NO: 268426 - protein, 9 aa, Mycobacterium
LAGGADRMA

SEQ ID NO: 268427 - protein, 8 aa, Mycobacterium
LAGGAPSI

SEQ ID NO: 268428 - protein, 9 aa, Mycobacterium
LAGGAPTAR

SEQ ID NO: 268429 - protein, 6 aa, Mycobacterium
LAGGAR

SEQ ID NO: 268430 - protein, 7 aa, Mycobacterium
LAGGASG

SEQ ID NO: 268431 - protein, 6 aa, Mycobacterium
LAGGDP

SEQ ID NO: 268432 - protein, 8 aa, Mycobacterium
LAGGDPDT

SEQ ID NO: 268433 - protein, 8 aa, Mycobacterium
LAGGHPES

SEQ ID NO: 268434 - protein, 24 aa, Mycobacterium
LAGGRESASKTGTAQLGDTKDNKD

SEQ ID NO: 268435 - protein, 24 aa, Mycobacterium
LAGGRPSAAKTGTTQLGDTNADKD

SEQ ID NO: 268436 - protein, 28 aa, Mycobacterium
LAGGTDTAGPGGAAEAKNGSNGQSAARK

SEQ ID NO: 268437 - protein, 10 aa, Mycobacterium
LAGGTGEREK

SEQ ID NO: 268438 - protein, 10 aa, Mycobacterium
LAGGTGERQR

SEQ ID NO: 268439 - protein, 9 aa, Mycobacterium
LAGGTREDV

SEQ ID NO: 268440 - protein, 7 aa, Mycobacterium
LAGGVNG

SEQ ID NO: 268441 - protein, 6 aa, Mycobacterium
LAGKGA

SEQ ID NO: 268442 - protein, 9 aa, Mycobacterium
LAGKGASAR

SEQ ID NO: 268443 - protein, 7 aa, Mycobacterium
LAGKGAT

SEQ ID NO: 268444 - protein, 6 aa, Mycobacterium
LAGLPP

SEQ ID NO: 268445 - protein, 5 aa, Mycobacterium
LAGMS

SEQ ID NO: 268446 - protein, 9 aa, Mycobacterium
LAGNDDPNL

SEQ ID NO: 268447 - protein, 8 aa, Mycobacterium
LAGNGGQP

SEQ ID NO: 268448 - protein, 7 aa, Mycobacterium
LAGNPGT

SEQ ID NO: 268449 - protein, 4 aa, Mycobacterium
LAGP

SEQ ID NO: 268450 - protein, 9 aa, Mycobacterium
LAGPARQGE

SEQ ID NO: 268451 - protein, 6 aa, Mycobacterium
LAGPGA

SEQ ID NO: 268452 - protein, 6 aa, Mycobacterium
LAGPGE

SEQ ID NO: 268453 - protein, 6 aa, Mycobacterium
LAGPQP

SEQ ID NO: 268454 - protein, 9 aa, Mycobacterium
LAGPRTRIG

SEQ ID NO: 268455 - protein, 7 aa, Mycobacterium
LAGPTAA

SEQ ID NO: 268456 - protein, 60 aa, Mycobacterium
LAGPTSATTQPAQQHTTPADHRTQDDATNTPDTATATAATSSSERAPLDTQTHPHRQRLL

SEQ ID NO: 268457 - protein, 63 aa, Mycobacterium
LAGPTSATTQPAQQHTTPADHRTRDDAIDTPDTAAATAGTTSSGEHAPLGSTTQPTQQHQKLV

SEQ ID NO: 268458 - protein, 63 aa, Mycobacterium
LAGPTSATTQPAQQHTTPADHRTRDDDTNTPDTDAATAGTTSSGERAPLGSTTQPTQQHQKLV

SEQ ID NO: 268459 - protein, 8 aa, Mycobacterium
LAGPTSAV

SEQ ID NO: 268460 - protein, 61 aa, Mycobacterium
LAGPTSTTTQPAQQHTTPADHPTQDDATDTPDTAAAATTTSGERAPLGSTTRPTQQNQDLV

SEQ ID NO: 268461 - protein, 9 aa, Mycobacterium
LAGQQDSGE

SEQ ID NO: 268462 - protein, 12 aa, Mycobacterium
LAGREPPPGLSA

SEQ ID NO: 268463 - protein, 13 aa, Mycobacterium
LAGRGAAALAGAA

SEQ ID NO: 268464 - protein, 15 aa, Mycobacterium
LAGRPGRGRATRRPR

SEQ ID NO: 268465 - protein, 7 aa, Mycobacterium
LAGRPGV

SEQ ID NO: 268466 - protein, 8 aa, Mycobacterium
LAGRPRPV

SEQ ID NO: 268467 - protein, 8 aa, Mycobacterium
LAGSLSDR

SEQ ID NO: 268468 - protein, 7 aa, Mycobacterium
LAGSTGH

SEQ ID NO: 268469 - protein, 4 aa, Mycobacterium
LAGT

SEQ ID NO: 268470 - protein, 5 aa, Mycobacterium
LAGTA

SEQ ID NO: 268471 - protein, 8 aa, Mycobacterium
LAGTAAGV

SEQ ID NO: 268472 - protein, 12 aa, Mycobacterium
LAGTDSHLESPT

SEQ ID NO: 268473 - protein, 9 aa, Mycobacterium
LAGTPSTWV

SEQ ID NO: 268474 - protein, 8 aa, Mycobacterium
LAGYTDGT

SEQ ID NO: 268475 - protein, 4 aa, Mycobacterium
LAHG

SEQ ID NO: 268476 - protein, 6 aa, Mycobacterium
LAKAAQ

SEQ ID NO: 268477 - protein, 9 aa, Mycobacterium
LAKDPDDRY

SEQ ID NO: 268478 - protein, 15 aa, Mycobacterium
LAKDYRKKKIRDTEE

SEQ ID NO: 268479 - protein, 9 aa, Mycobacterium
LAKGAVGTV

SEQ ID NO: 268480 - protein, 9 aa, Mycobacterium
LAKNPDDRF

SEQ ID NO: 268481 - protein, 21 aa, Mycobacterium
LAKPSEAGCAPTDPGDSRRSR

SEQ ID NO: 268482 - protein, 7 aa, Mycobacterium
LAKSGAA

SEQ ID NO: 268483 - protein, 14 aa, Mycobacterium
LAKSGEEPAAQTEA

SEQ ID NO: 268484 - protein, 5 aa, Mycobacterium
LALPA

SEQ ID NO: 268485 - protein, 10 aa, Mycobacterium
LANENNKDNV

SEQ ID NO: 268486 - protein, 16 aa, Mycobacterium
LANGHAELKGPDAEHA

SEQ ID NO: 268487 - protein, 8 aa, Mycobacterium
LANPAAAA

SEQ ID NO: 268488 - protein, 9 aa, Mycobacterium
LANPKGWTH

SEQ ID NO: 268489 - protein, 8 aa, Mycobacterium
LANPSDAQ

SEQ ID NO: 268490 - protein, 5 aa, Mycobacterium
LANRP

SEQ ID NO: 268491 - protein, 4 aa, Mycobacterium
LANS

SEQ ID NO: 268492 - protein, 5 aa, Mycobacterium
LANSG

SEQ ID NO: 268493 - protein, 4 aa, Mycobacterium
LANT

SEQ ID NO: 268494 - protein, 9 aa, Mycobacterium
LANTEDRIA

SEQ ID NO: 268495 - protein, 4 aa, Mycobacterium
LAPA

SEQ ID NO: 268496 - protein, 5 aa, Mycobacterium
LAPAD

SEQ ID NO: 268497 - protein, 10 aa, Mycobacterium
LAPARRRTSS

SEQ ID NO: 268498 - protein, 8 aa, Mycobacterium
LAPATAAA

SEQ ID NO: 268499 - protein, 7 aa, Mycobacterium
LAPDAAI

SEQ ID NO: 268500 - protein, 10 aa, Mycobacterium
LAPDAQLTEG

SEQ ID NO: 268501 - protein, 6 aa, Mycobacterium
LAPDAV

SEQ ID NO: 268502 - protein, 9 aa, Mycobacterium
LAPDEADRA

SEQ ID NO: 268503 - protein, 9 aa, Mycobacterium
LAPDERDRA

SEQ ID NO: 268504 - protein, 7 aa, Mycobacterium
LAPDERR

SEQ ID NO: 268505 - protein, 8 aa, Mycobacterium
LAPDETDR

SEQ ID NO: 268506 - protein, 5 aa, Mycobacterium
LAPDG

SEQ ID NO: 268507 - protein, 14 aa, Mycobacterium
LAPDGRGAEPTDVM

SEQ ID NO: 268508 - protein, 6 aa, Mycobacterium
LAPDKK

SEQ ID NO: 268509 - protein, 5 aa, Mycobacterium
LAPDL

SEQ ID NO: 268510 - protein, 12 aa, Mycobacterium
LAPDPVSGTSYA

SEQ ID NO: 268511 - protein, 7 aa, Mycobacterium
LAPDRPM

SEQ ID NO: 268512 - protein, 27 aa, Mycobacterium
LAPDSEPDPDAEADAETAAEAEQPSAG

SEQ ID NO: 268513 - protein, 17 aa, Mycobacterium
LAPDSKPGRPASAEGEP

SEQ ID NO: 268514 - protein, 17 aa, Mycobacterium
LAPDSRPGRVASAEGAP

SEQ ID NO: 268515 - protein, 8 aa, Mycobacterium
LAPEEPGT

SEQ ID NO: 268516 - protein, 9 aa, Mycobacterium
LAPEPGDTQ

SEQ ID NO: 268517 - protein, 6 aa, Mycobacterium
LAPERQ

SEQ ID NO: 268518 - protein, 9 aa, Mycobacterium
LAPESGVAG

SEQ ID NO: 268519 - protein, 5 aa, Mycobacterium
LAPEV

SEQ ID NO: 268520 - protein, 6 aa, Mycobacterium
LAPGAI

SEQ ID NO: 268521 - protein, 5 aa, Mycobacterium
LAPGD

SEQ ID NO: 268522 - protein, 18 aa, Mycobacterium
LAPGPPSAPPPADNPIPP

SEQ ID NO: 268523 - protein, 6 aa, Mycobacterium
LAPGQR

SEQ ID NO: 268524 - protein, 6 aa, Mycobacterium
LAPGSG

SEQ ID NO: 268525 - protein, 8 aa, Mycobacterium
LAPGTAAT

SEQ ID NO: 268526 - protein, 4 aa, Mycobacterium
LAPH

SEQ ID NO: 268527 - protein, 6 aa, Mycobacterium
LAPHGL

SEQ ID NO: 268528 - protein, 5 aa, Mycobacterium
LAPHQ

SEQ ID NO: 268529 - protein, 8 aa, Mycobacterium
LAPLPTQR

SEQ ID NO: 268530 - protein, 7 aa, Mycobacterium
LAPMNPE

SEQ ID NO: 268531 - protein, 18 aa, Mycobacterium
LAPNPSPARVEALPGLEN

SEQ ID NO: 268532 - protein, 7 aa, Mycobacterium
LAPNRLP

SEQ ID NO: 268533 - protein, 8 aa, Mycobacterium
LAPNTTLD

SEQ ID NO: 268534 - protein, 7 aa, Mycobacterium
LAPPASD

SEQ ID NO: 268535 - protein, 7 aa, Mycobacterium
LAPPERT

SEQ ID NO: 268536 - protein, 10 aa, Mycobacterium
LAPPNTRKGT

SEQ ID NO: 268537 - protein, 17 aa, Mycobacterium
LAPPPRDDDVCVLAVTF

SEQ ID NO: 268538 - protein, 6 aa, Mycobacterium
LAPPQL

SEQ ID NO: 268539 - protein, 10 aa, Mycobacterium
LAPPSADHPD

SEQ ID NO: 268540 - protein, 8 aa, Mycobacterium
LAPPVTRK

SEQ ID NO: 268541 - protein, 9 aa, Mycobacterium
LAPPVTRKG

SEQ ID NO: 268542 - protein, 4 aa, Mycobacterium
LAPQ

SEQ ID NO: 268543 - protein, 5 aa, Mycobacterium
LAPQA

SEQ ID NO: 268544 - protein, 9 aa, Mycobacterium
LAPQDAPAV

SEQ ID NO: 268545 - protein, 12 aa, Mycobacterium
LAPQPAPADFTP

SEQ ID NO: 268546 - protein, 8 aa, Mycobacterium
LAPQSQTS

SEQ ID NO: 268547 - protein, 7 aa, Mycobacterium
LAPRERR

SEQ ID NO: 268548 - protein, 5 aa, Mycobacterium
LAPRP

SEQ ID NO: 268549 - protein, 7 aa, Mycobacterium
LAPRPGA

SEQ ID NO: 268550 - protein, 6 aa, Mycobacterium
LAPRPI

SEQ ID NO: 268551 - protein, 9 aa, Mycobacterium
LAPRSRRRG

SEQ ID NO: 268552 - protein, 4 aa, Mycobacterium
LAPS

SEQ ID NO: 268553 - protein, 9 aa, Mycobacterium
LAPSDAPPV

SEQ ID NO: 268554 - protein, 11 aa, Mycobacterium
LAPSGAPPRLI

SEQ ID NO: 268555 - protein, 89 aa, Mycobacterium
LAPSPNPGHSPGGGAGVPGRRGPGGGPGGKGPIGGKGPLGGKGPVGGGGPFGGGGHGGGGHGGFGGGHGPLGGGGHGGGHGGFGGGHGP

SEQ ID NO: 268556 - protein, 6 aa, Mycobacterium
LAPTGQ

SEQ ID NO: 268557 - protein, 6 aa, Mycobacterium
LAPTGV

SEQ ID NO: 268558 - protein, 11 aa, Mycobacterium
LAPTKRAGRRW

SEQ ID NO: 268559 - protein, 5 aa, Mycobacterium
LAPTT

SEQ ID NO: 268560 - protein, 10 aa, Mycobacterium
LAQDRDPIGD

SEQ ID NO: 268561 - protein, 9 aa, Mycobacterium
LAQNPNDPN

SEQ ID NO: 268562 - protein, 8 aa, Mycobacterium
LAQRAESD

SEQ ID NO: 268563 - protein, 7 aa, Mycobacterium
LAQSGYS

SEQ ID NO: 268564 - protein, 6 aa, Mycobacterium
LAQSQD

SEQ ID NO: 268565 - protein, 6 aa, Mycobacterium
LAQSRR

SEQ ID NO: 268566 - protein, 11 aa, Mycobacterium
LAQTPDNGPLR

SEQ ID NO: 268567 - protein, 34 aa, Mycobacterium
LAQTQAAVDGLGNGLRGGSAGLADMSGAAEDMRA

SEQ ID NO: 268568 - protein, 7 aa, Mycobacterium
LARAGED

SEQ ID NO: 268569 - protein, 9 aa, Mycobacterium
LARATPDVP

SEQ ID NO: 268570 - protein, 13 aa, Mycobacterium
LARDAAQSVKTYP

SEQ ID NO: 268571 - protein, 5 aa, Mycobacterium
LARDP

SEQ ID NO: 268572 - protein, 11 aa, Mycobacterium
LAREDAGYHKG

SEQ ID NO: 268573 - protein, 6 aa, Mycobacterium
LARENG

SEQ ID NO: 268574 - protein, 19 aa, Mycobacterium
LARGGSAATRAKDTDRQDA

SEQ ID NO: 268575 - protein, 19 aa, Mycobacterium
LARGGSTTTRAKDSDRQDA

SEQ ID NO: 268576 - protein, 7 aa, Mycobacterium
LARGGYP

SEQ ID NO: 268577 - protein, 4 aa, Mycobacterium
LARN

SEQ ID NO: 268578 - protein, 7 aa, Mycobacterium
LARPDRL

SEQ ID NO: 268579 - protein, 4 aa, Mycobacterium
LARQ

SEQ ID NO: 268580 - protein, 5 aa, Mycobacterium
LARQG

SEQ ID NO: 268581 - protein, 17 aa, Mycobacterium
LARQGATPDSAGTLPTH

SEQ ID NO: 268582 - protein, 18 aa, Mycobacterium
LARQGATPESAGTLPTHR

SEQ ID NO: 268583 - protein, 18 aa, Mycobacterium
LARQGSTPASAGTLPTHR

SEQ ID NO: 268584 - protein, 14 aa, Mycobacterium
LARRANPTKTGDSL

SEQ ID NO: 268585 - protein, 16 aa, Mycobacterium
LARRDESATATPTGGL

SEQ ID NO: 268586 - protein, 16 aa, Mycobacterium
LARRDQTATATRTGGL

SEQ ID NO: 268587 - protein, 16 aa, Mycobacterium
LARRSETEADTRTGGL

SEQ ID NO: 268588 - protein, 4 aa, Mycobacterium
LARS

SEQ ID NO: 268589 - protein, 8 aa, Mycobacterium
LARSAGAD

SEQ ID NO: 268590 - protein, 8 aa, Mycobacterium
LARSARQQ

SEQ ID NO: 268591 - protein, 9 aa, Mycobacterium
LARSATMPR

SEQ ID NO: 268592 - protein, 6 aa, Mycobacterium
LARTAR

SEQ ID NO: 268593 - protein, 12 aa, Mycobacterium
LARTDSSGWGDE

SEQ ID NO: 268594 - protein, 9 aa, Mycobacterium
LARTEDRDR

SEQ ID NO: 268595 - protein, 7 aa, Mycobacterium
LARTGTR

SEQ ID NO: 268596 - protein, 11 aa, Mycobacterium
LARTPSRPASV

SEQ ID NO: 268597 - protein, 16 aa, Mycobacterium
LASAEPGFTPPDTSGC

SEQ ID NO: 268598 - protein, 9 aa, Mycobacterium
LASAGHSTQ

SEQ ID NO: 268599 - protein, 9 aa, Mycobacterium
LASASVGAY

SEQ ID NO: 268600 - protein, 5 aa, Mycobacterium
LASAT

SEQ ID NO: 268601 - protein, 7 aa, Mycobacterium
LASDDAV

SEQ ID NO: 268602 - protein, 4 aa, Mycobacterium
LASE

SEQ ID NO: 268603 - protein, 4 aa, Mycobacterium
LASG

SEQ ID NO: 268604 - protein, 14 aa, Mycobacterium
LASGAIAGAAGTTA

SEQ ID NO: 268605 - protein, 5 aa, Mycobacterium
LASGD

SEQ ID NO: 268606 - protein, 9 aa, Mycobacterium
LASGGDDAT

SEQ ID NO: 268607 - protein, 6 aa, Mycobacterium
LASGGY

SEQ ID NO: 268608 - protein, 10 aa, Mycobacterium
LASGLGPPIG

SEQ ID NO: 268609 - protein, 7 aa, Mycobacterium
LASGPAP

SEQ ID NO: 268610 - protein, 14 aa, Mycobacterium
LASGPDGLGNSPKH

SEQ ID NO: 268611 - protein, 8 aa, Mycobacterium
LASGPLGD

SEQ ID NO: 268612 - protein, 8 aa, Mycobacterium
LASGQEYS

SEQ ID NO: 268613 - protein, 7 aa, Mycobacterium
LASNGVD

SEQ ID NO: 268614 - protein, 7 aa, Mycobacterium
LASPASV

SEQ ID NO: 268615 - protein, 34 aa, Mycobacterium
LASPGTGSAGAPASGAGAGAPGSAPPGPAAPAPA

SEQ ID NO: 268616 - protein, 6 aa, Mycobacterium
LASPPA

SEQ ID NO: 268617 - protein, 8 aa, Mycobacterium
LASPPRLD

SEQ ID NO: 268618 - protein, 6 aa, Mycobacterium
LASPRA

SEQ ID NO: 268619 - protein, 6 aa, Mycobacterium
LASPRS

SEQ ID NO: 268620 - protein, 5 aa, Mycobacterium
LASPS

SEQ ID NO: 268621 - protein, 7 aa, Mycobacterium
LASPTAP

SEQ ID NO: 268622 - protein, 7 aa, Mycobacterium
LASPTFR

SEQ ID NO: 268623 - protein, 9 aa, Mycobacterium
LASPTRRGE

SEQ ID NO: 268624 - protein, 5 aa, Mycobacterium
LASQA

SEQ ID NO: 268625 - protein, 4 aa, Mycobacterium
LASR

SEQ ID NO: 268626 - protein, 11 aa, Mycobacterium
LASRAEDNDPI

SEQ ID NO: 268627 - protein, 9 aa, Mycobacterium
LASRGSQTA

SEQ ID NO: 268628 - protein, 44 aa, Mycobacterium
LASRNAATAAPESPESPGSPESPASPQPRPVEARKPTTSAEPEP

SEQ ID NO: 268629 - protein, 19 aa, Mycobacterium
LASSAGQQQEDPAARGQYR

SEQ ID NO: 268630 - protein, 15 aa, Mycobacterium
LASSATERAGCTDRH

SEQ ID NO: 268631 - protein, 17 aa, Mycobacterium
LASSESSAEKARGSEDR

SEQ ID NO: 268632 - protein, 17 aa, Mycobacterium
LASSESSAEKARGSEER

SEQ ID NO: 268633 - protein, 11 aa, Mycobacterium
LASSPLAKHAA

SEQ ID NO: 268634 - protein, 19 aa, Mycobacterium
LASTETKAVTRGPVETPPV

SEQ ID NO: 268635 - protein, 11 aa, Mycobacterium
LATADPGSSIK

SEQ ID NO: 268636 - protein, 7 aa, Mycobacterium
LATAEND

SEQ ID NO: 268637 - protein, 7 aa, Mycobacterium
LATAKGR

SEQ ID NO: 268638 - protein, 7 aa, Mycobacterium
LATAQTG

SEQ ID NO: 268639 - protein, 8 aa, Mycobacterium
LATEPGYR

SEQ ID NO: 268640 - protein, 8 aa, Mycobacterium
LATESAEH

SEQ ID NO: 268641 - protein, 4 aa, Mycobacterium
LATG

SEQ ID NO: 268642 - protein, 7 aa, Mycobacterium
LATGAAA

SEQ ID NO: 268643 - protein, 7 aa, Mycobacterium
LATGATT

SEQ ID NO: 268644 - protein, 9 aa, Mycobacterium
LATGDAEDF

SEQ ID NO: 268645 - protein, 11 aa, Mycobacterium
LATGEDGATRE

SEQ ID NO: 268646 - protein, 10 aa, Mycobacterium
LATGHDGHLS

SEQ ID NO: 268647 - protein, 10 aa, Mycobacterium
LATGNEEVKH

SEQ ID NO: 268648 - protein, 6 aa, Mycobacterium
LATGPG

SEQ ID NO: 268649 - protein, 9 aa, Mycobacterium
LATGSADAT

SEQ ID NO: 268650 - protein, 11 aa, Mycobacterium
LATGSDDPTWQ

SEQ ID NO: 268651 - protein, 11 aa, Mycobacterium
LATGTAGQPTW

SEQ ID NO: 268652 - protein, 8 aa, Mycobacterium
LATNAATI

SEQ ID NO: 268653 - protein, 4 aa, Mycobacterium
LATP

SEQ ID NO: 268654 - protein, 6 aa, Mycobacterium
LATPAD

SEQ ID NO: 268655 - protein, 11 aa, Mycobacterium
LATPDQDRATD

SEQ ID NO: 268656 - protein, 14 aa, Mycobacterium
LATPGAQNWEDLLP

SEQ ID NO: 268657 - protein, 13 aa, Mycobacterium
LATPPGGQTTTAG

SEQ ID NO: 268658 - protein, 12 aa, Mycobacterium
LATPQAPQQAAP

SEQ ID NO: 268659 - protein, 8 aa, Mycobacterium
LATRGDSS

SEQ ID NO: 268660 - protein, 9 aa, Mycobacterium
LATRPGLSG

SEQ ID NO: 268661 - protein, 8 aa, Mycobacterium
LATRTASQ

SEQ ID NO: 268662 - protein, 9 aa, Mycobacterium
LATSARALR

SEQ ID NO: 268663 - protein, 7 aa, Mycobacterium
LATSDGP

SEQ ID NO: 268664 - protein, 8 aa, Mycobacterium
LATSPRPQ

SEQ ID NO: 268665 - protein, 13 aa, Mycobacterium
LATSRDVDPEGAV

SEQ ID NO: 268666 - protein, 13 aa, Mycobacterium
LATSRDVDPEGTV

SEQ ID NO: 268667 - protein, 43 aa, Mycobacterium
LATSSKKQRASGRNKTRGQARPARAKAVPARKTGGATRPPSKV

SEQ ID NO: 268668 - protein, 12 aa, Mycobacterium
LATTAGDDELAG

SEQ ID NO: 268669 - protein, 6 aa, Mycobacterium
LATTGA

SEQ ID NO: 268670 - protein, 13 aa, Mycobacterium
LATTRGGGLINPG

SEQ ID NO: 268671 - protein, 11 aa, Mycobacterium
LDAAAQRRATR

SEQ ID NO: 268672 - protein, 12 aa, Mycobacterium
LDAAGQPVEPRA

SEQ ID NO: 268673 - protein, 10 aa, Mycobacterium
LDAAGSSVDS

SEQ ID NO: 268674 - protein, 7 aa, Mycobacterium
LDAATES

SEQ ID NO: 268675 - protein, 14 aa, Mycobacterium
LDADAPTGMAPTGM

SEQ ID NO: 268676 - protein, 10 aa, Mycobacterium
LDADDQEAVS

SEQ ID NO: 268677 - protein, 13 aa, Mycobacterium
LDAESAPPVPPEV

SEQ ID NO: 268678 - protein, 6 aa, Mycobacterium
LDAESP

SEQ ID NO: 268679 - protein, 7 aa, Mycobacterium
LDAGPAG

SEQ ID NO: 268680 - protein, 6 aa, Mycobacterium
LDAGRA

SEQ ID NO: 268681 - protein, 12 aa, Mycobacterium
LDAPPAAKPSRR

SEQ ID NO: 268682 - protein, 51 aa, Mycobacterium
LDAPPTRPIRSRRGGGGLPPDGGAPPPAGPAGPSGPTGRSRARSHRSTTQR

SEQ ID NO: 268683 - protein, 7 aa, Mycobacterium
LDASPSQ

SEQ ID NO: 268684 - protein, 13 aa, Mycobacterium
LDATATTGDGTTA

SEQ ID NO: 268685 - protein, 7 aa, Mycobacterium
LDATPSQ

SEQ ID NO: 268686 - protein, 7 aa, Mycobacterium
LDATSQR

SEQ ID NO: 268687 - protein, 9 aa, Mycobacterium
LDDAAAAKM

SEQ ID NO: 268688 - protein, 6 aa, Mycobacterium
LDDAGV

SEQ ID NO: 268689 - protein, 5 aa, Mycobacterium
LDDAR

SEQ ID NO: 268690 - protein, 16 aa, Mycobacterium
LDDDEPDDRIPSPPTA

SEQ ID NO: 268691 - protein, 9 aa, Mycobacterium
LDDDEPGGD

SEQ ID NO: 268692 - protein, 5 aa, Mycobacterium
LDDEN

SEQ ID NO: 268693 - protein, 8 aa, Mycobacterium
LDDEQAAK

SEQ ID NO: 268694 - protein, 9 aa, Mycobacterium
LDDEREPAT

SEQ ID NO: 268695 - protein, 4 aa, Mycobacterium
LDDG

SEQ ID NO: 268696 - protein, 16 aa, Mycobacterium
LDDGARQLKAGSAELA

SEQ ID NO: 268697 - protein, 16 aa, Mycobacterium
LDDGARQLKGGSAELA

SEQ ID NO: 268698 - protein, 10 aa, Mycobacterium
LDDGGAPGDL

SEQ ID NO: 268699 - protein, 6 aa, Mycobacterium
LDDGGQ

SEQ ID NO: 268700 - protein, 8 aa, Mycobacterium
LDDGQAAT

SEQ ID NO: 268701 - protein, 6 aa, Mycobacterium
LDDGSR

SEQ ID NO: 268702 - protein, 9 aa, Mycobacterium
LDDGTAQMS

SEQ ID NO: 268703 - protein, 9 aa, Mycobacterium
LDDGTLPPY

SEQ ID NO: 268704 - protein, 7 aa, Mycobacterium
LDDPAVT

SEQ ID NO: 268705 - protein, 7 aa, Mycobacterium
LDDPHED

SEQ ID NO: 268706 - protein, 10 aa, Mycobacterium
LDDPNPPGIR

SEQ ID NO: 268707 - protein, 6 aa, Mycobacterium
LDDQPE

SEQ ID NO: 268708 - protein, 4 aa, Mycobacterium
LDDR

SEQ ID NO: 268709 - protein, 5 aa, Mycobacterium
LDDRQ

SEQ ID NO: 268710 - protein, 11 aa, Mycobacterium
LDDSNAGQFTT

SEQ ID NO: 268711 - protein, 14 aa, Mycobacterium
LDDSNSVTSAGNVT

SEQ ID NO: 268712 - protein, 4 aa, Mycobacterium
LDEA

SEQ ID NO: 268713 - protein, 6 aa, Mycobacterium
LDEAER

SEQ ID NO: 268714 - protein, 6 aa, Mycobacterium
LDEAGV

SEQ ID NO: 268715 - protein, 9 aa, Mycobacterium
LDEAPAQTL

SEQ ID NO: 268716 - protein, 17 aa, Mycobacterium
LDEAPARTLSGPRAAAP

SEQ ID NO: 268717 - protein, 17 aa, Mycobacterium
LDEAPGQTLSGPRAATP

SEQ ID NO: 268718 - protein, 76 aa, Mycobacterium
LDEARKEAEAKAAEDKAAEEKAAEEATDTDGPKADDDVADTDEATDADEAETEKEEVSDETPEDAEPETEPARSRR

SEQ ID NO: 268719 - protein, 18 aa, Mycobacterium
LDEARNKNSAAPDPQQRL

SEQ ID NO: 268720 - protein, 7 aa, Mycobacterium
LDEASNR

SEQ ID NO: 268721 - protein, 9 aa, Mycobacterium
LDEDAHRDR

SEQ ID NO: 268722 - protein, 8 aa, Mycobacterium
LDEDDHND

SEQ ID NO: 268723 - protein, 6 aa, Mycobacterium
LDEDPE

SEQ ID NO: 268724 - protein, 10 aa, Mycobacterium
LDEDPENRQP

SEQ ID NO: 268725 - protein, 9 aa, Mycobacterium
LDEDTAAKM

SEQ ID NO: 268726 - protein, 5 aa, Mycobacterium
LDEEA

SEQ ID NO: 268727 - protein, 7 aa, Mycobacterium
LDEEEDY

SEQ ID NO: 268728 - protein, 8 aa, Mycobacterium
LDEEEDYS

SEQ ID NO: 268729 - protein, 6 aa, Mycobacterium
LDEEQD

SEQ ID NO: 268730 - protein, 4 aa, Mycobacterium
LDEG

SEQ ID NO: 268731 - protein, 5 aa, Mycobacterium
LDEGR

SEQ ID NO: 268732 - protein, 11 aa, Mycobacterium
LDEKGNEECGA

SEQ ID NO: 268733 - protein, 9 aa, Mycobacterium
LDEKTRAMA

SEQ ID NO: 268734 - protein, 6 aa, Mycobacterium
LDENAI

SEQ ID NO: 268735 - protein, 10 aa, Mycobacterium
LDENSELSDQ

SEQ ID NO: 268736 - protein, 57 aa, Mycobacterium
LDEPEAAAEAEAPQGEEADAAVADTADAEESEGDAEEPEAEAVADEAEAEESEAEEL

SEQ ID NO: 268737 - protein, 40 aa, Mycobacterium
LDEPESEAEAEAPQPEPADEAEDEEPEAESAEATTEEPVA

SEQ ID NO: 268738 - protein, 35 aa, Mycobacterium
LDEPPAPQGASATDPAEGAEPGPAPAPRQTGAGDS

SEQ ID NO: 268739 - protein, 5 aa, Mycobacterium
LDEPQ

SEQ ID NO: 268740 - protein, 11 aa, Mycobacterium
LDEQSQLSDET

SEQ ID NO: 268741 - protein, 4 aa, Mycobacterium
LDER

SEQ ID NO: 268742 - protein, 14 aa, Mycobacterium
LDERADSGRVQSAA

SEQ ID NO: 268743 - protein, 5 aa, Mycobacterium
LDERD

SEQ ID NO: 268744 - protein, 7 aa, Mycobacterium
LDERDAQ

SEQ ID NO: 268745 - protein, 10 aa, Mycobacterium
LDERQPETGF

SEQ ID NO: 268746 - protein, 7 aa, Mycobacterium
LDESTAA

SEQ ID NO: 268747 - protein, 4 aa, Mycobacterium
LDET

SEQ ID NO: 268748 - protein, 10 aa, Mycobacterium
LDETLTAQRG

SEQ ID NO: 268749 - protein, 9 aa, Mycobacterium
LDGADPSSP

SEQ ID NO: 268750 - protein, 5 aa, Mycobacterium
LDGAN

SEQ ID NO: 268751 - protein, 6 aa, Mycobacterium
LDGANT

SEQ ID NO: 268752 - protein, 7 aa, Mycobacterium
LDGAPVS

SEQ ID NO: 268753 - protein, 6 aa, Mycobacterium
LDGASD

SEQ ID NO: 268754 - protein, 15 aa, Mycobacterium
LDGDGGAADSTDMVE

SEQ ID NO: 268755 - protein, 6 aa, Mycobacterium
LDGDTV

SEQ ID NO: 268756 - protein, 8 aa, Mycobacterium
LDGEGVRD

SEQ ID NO: 268757 - protein, 5 aa, Mycobacterium
LDGEN

SEQ ID NO: 268758 - protein, 11 aa, Mycobacterium
LDGEQQARAEL

SEQ ID NO: 268759 - protein, 6 aa, Mycobacterium
LDGESL

SEQ ID NO: 268760 - protein, 5 aa, Mycobacterium
LDGGG

SEQ ID NO: 268761 - protein, 9 aa, Mycobacterium
LDGGGLAPG

SEQ ID NO: 268762 - protein, 19 aa, Mycobacterium
LDGGSGGQERSDQGNRTAA

SEQ ID NO: 268763 - protein, 5 aa, Mycobacterium
LDGGT

SEQ ID NO: 268764 - protein, 6 aa, Mycobacterium
LDGGTV

SEQ ID NO: 268765 - protein, 11 aa, Mycobacterium
LDGHSDAPPGL

SEQ ID NO: 268766 - protein, 4 aa, Mycobacterium
LDGK

SEQ ID NO: 268767 - protein, 6 aa, Mycobacterium
LDGKGG

SEQ ID NO: 268768 - protein, 15 aa, Mycobacterium
LDGNTEAASQSADEA

SEQ ID NO: 268769 - protein, 14 aa, Mycobacterium
LDGPPRNSMQIGQP

SEQ ID NO: 268770 - protein, 7 aa, Mycobacterium
LDGPQRN

SEQ ID NO: 268771 - protein, 6 aa, Mycobacterium
LDGPTA

SEQ ID NO: 268772 - protein, 11 aa, Mycobacterium
LDGQAASADAL

SEQ ID NO: 268773 - protein, 9 aa, Mycobacterium
LDGQDPDMR

SEQ ID NO: 268774 - protein, 8 aa, Mycobacterium
LDGQPRRV

SEQ ID NO: 268775 - protein, 6 aa, Mycobacterium
LDGRPL

SEQ ID NO: 268776 - protein, 5 aa, Mycobacterium
LDGRS

SEQ ID NO: 268777 - protein, 10 aa, Mycobacterium
LDGSGEHPHP

SEQ ID NO: 268778 - protein, 11 aa, Mycobacterium
LDGSPNLPSGY

SEQ ID NO: 268779 - protein, 8 aa, Mycobacterium
LDGSQRAD

SEQ ID NO: 268780 - protein, 5 aa, Mycobacterium
LDGTA

SEQ ID NO: 268781 - protein, 7 aa, Mycobacterium
LDGTAKG

SEQ ID NO: 268782 - protein, 14 aa, Mycobacterium
LDGTEDDISTPERI

SEQ ID NO: 268783 - protein, 11 aa, Mycobacterium
LDGTGGAARGR

SEQ ID NO: 268784 - protein, 7 aa, Mycobacterium
LDGTGPI

SEQ ID NO: 268785 - protein, 7 aa, Mycobacterium
LDGTPPQ

SEQ ID NO: 268786 - protein, 9 aa, Mycobacterium
LDGTTTDFT

SEQ ID NO: 268787 - protein, 6 aa, Mycobacterium
LDGVGP

SEQ ID NO: 268788 - protein, 16 aa, Mycobacterium
LDHGPSAGGLDHRDRP

SEQ ID NO: 268789 - protein, 5 aa, Mycobacterium
LDHPG

SEQ ID NO: 268790 - protein, 10 aa, Mycobacterium
LDKDKAAKMA

SEQ ID NO: 268791 - protein, 9 aa, Mycobacterium
LDKEKPDGL

SEQ ID NO: 268792 - protein, 9 aa, Mycobacterium
LDKERRKQA

SEQ ID NO: 268793 - protein, 4 aa, Mycobacterium
LDKG

SEQ ID NO: 268794 - protein, 14 aa, Mycobacterium
LDLRDDDRRQWSKN

SEQ ID NO: 268795 - protein, 11 aa, Mycobacterium
LDNAEAHAGPH

SEQ ID NO: 268796 - protein, 5 aa, Mycobacterium
LDNGD

SEQ ID NO: 268797 - protein, 7 aa, Mycobacterium
LDNGTAS

SEQ ID NO: 268798 - protein, 8 aa, Mycobacterium
LDNGTASL

SEQ ID NO: 268799 - protein, 4 aa, Mycobacterium
LDNP

SEQ ID NO: 268800 - protein, 6 aa, Mycobacterium
LDNPGQ

SEQ ID NO: 268801 - protein, 10 aa, Mycobacterium
LDNPPTTPLH

SEQ ID NO: 268802 - protein, 15 aa, Mycobacterium
LDNPRAPRRGSGMPN

SEQ ID NO: 268803 - protein, 15 aa, Mycobacterium
LDNPVRDRGKTQMEP

SEQ ID NO: 268804 - protein, 6 aa, Mycobacterium
LDNQGR

SEQ ID NO: 268805 - protein, 8 aa, Mycobacterium
LDNSNAAP

SEQ ID NO: 268806 - protein, 4 aa, Mycobacterium
LDPA

SEQ ID NO: 268807 - protein, 5 aa, Mycobacterium
LDPAD

SEQ ID NO: 268808 - protein, 12 aa, Mycobacterium
LDPADGRPRASA

SEQ ID NO: 268809 - protein, 8 aa, Mycobacterium
LDPADPRD

SEQ ID NO: 268810 - protein, 8 aa, Mycobacterium
LDPADRPY

SEQ ID NO: 268811 - protein, 6 aa, Mycobacterium
LDPAGI

SEQ ID NO: 268812 - protein, 11 aa, Mycobacterium
LDPAKLRDNQR

SEQ ID NO: 268813 - protein, 5 aa, Mycobacterium
LDPAT

SEQ ID NO: 268814 - protein, 8 aa, Mycobacterium
LDPATRRA

SEQ ID NO: 268815 - protein, 4 aa, Mycobacterium
LDPD

SEQ ID NO: 268816 - protein, 23 aa, Mycobacterium
LDPDEVGRAAQRLSGAVRSTTDR

SEQ ID NO: 268817 - protein, 11 aa, Mycobacterium
LDPDGGWRGNA

SEQ ID NO: 268818 - protein, 18 aa, Mycobacterium
LDPDGGWRGNAARAYGAK

SEQ ID NO: 268819 - protein, 8 aa, Mycobacterium
LDPDSDHA

SEQ ID NO: 268820 - protein, 9 aa, Mycobacterium
LDPDSRDIV

SEQ ID NO: 268821 - protein, 9 aa, Mycobacterium
LDPEDTTAM

SEQ ID NO: 268822 - protein, 13 aa, Mycobacterium
LDPEKDAEKYAPL

SEQ ID NO: 268823 - protein, 11 aa, Mycobacterium
LDPESSRSTRP

SEQ ID NO: 268824 - protein, 11 aa, Mycobacterium
LDPETVGQTTE

SEQ ID NO: 268825 - protein, 8 aa, Mycobacterium
LDPGAGEN

SEQ ID NO: 268826 - protein, 5 aa, Mycobacterium
LDPGN

SEQ ID NO: 268827 - protein, 12 aa, Mycobacterium
LDPGRASGVGGD

SEQ ID NO: 268828 - protein, 8 aa, Mycobacterium
LDPGSAVQ

SEQ ID NO: 268829 - protein, 16 aa, Mycobacterium
LDPGVRPPRRRMRRAR

SEQ ID NO: 268830 - protein, 7 aa, Mycobacterium
LDPHSGD

SEQ ID NO: 268831 - protein, 12 aa, Mycobacterium
LDPKPGAFTEND

SEQ ID NO: 268832 - protein, 10 aa, Mycobacterium
LDPLEGASGT

SEQ ID NO: 268833 - protein, 17 aa, Mycobacterium
LDPNSRDIRDPNAQYGD

SEQ ID NO: 268834 - protein, 13 aa, Mycobacterium
LDPPAAVETRTVT

SEQ ID NO: 268835 - protein, 7 aa, Mycobacterium
LDPPGGH

SEQ ID NO: 268836 - protein, 7 aa, Mycobacterium
LDPPGGR

SEQ ID NO: 268837 - protein, 12 aa, Mycobacterium
LDPPPPRAGRAG

SEQ ID NO: 268838 - protein, 4 aa, Mycobacterium
LDPQ

SEQ ID NO: 268839 - protein, 8 aa, Mycobacterium
LDPQDVNA

SEQ ID NO: 268840 - protein, 6 aa, Mycobacterium
LDPQQL

SEQ ID NO: 268841 - protein, 8 aa, Mycobacterium
LDPRAQRH

SEQ ID NO: 268842 - protein, 4 aa, Mycobacterium
LDPS

SEQ ID NO: 268843 - protein, 11 aa, Mycobacterium
LDPSIGNQPNQ

SEQ ID NO: 268844 - protein, 8 aa, Mycobacterium
LDPSKPPH

SEQ ID NO: 268845 - protein, 5 aa, Mycobacterium
LDPSV

SEQ ID NO: 268846 - protein, 6 aa, Mycobacterium
LDPTAA

SEQ ID NO: 268847 - protein, 6 aa, Mycobacterium
LDPTDT

SEQ ID NO: 268848 - protein, 6 aa, Mycobacterium
LDPTGW

SEQ ID NO: 268849 - protein, 7 aa, Mycobacterium
LDPTLRR

SEQ ID NO: 268850 - protein, 20 aa, Mycobacterium
LDPTNKSGKVSKKSTLESSP

SEQ ID NO: 268851 - protein, 6 aa, Mycobacterium
LDPTYD

SEQ ID NO: 268852 - protein, 5 aa, Mycobacterium
LDQES

SEQ ID NO: 268853 - protein, 8 aa, Mycobacterium
LDQESRTR

SEQ ID NO: 268854 - protein, 26 aa, Mycobacterium
LDQGRSEDAVTPDQVRGDDAATARRR

SEQ ID NO: 268855 - protein, 17 aa, Mycobacterium
LDQGSDDIRDRNGQYGD

SEQ ID NO: 268856 - protein, 8 aa, Mycobacterium
LDQPEDQA

SEQ ID NO: 268857 - protein, 12 aa, Mycobacterium
LDQPPRRPKEPI

SEQ ID NO: 268858 - protein, 24 aa, Mycobacterium
LDQPSGPAATSSAPHLSVEHTGSS

SEQ ID NO: 268859 - protein, 7 aa, Mycobacterium
LDQTQVG

SEQ ID NO: 268860 - protein, 13 aa, Mycobacterium
LDQVGGKGQELTN

SEQ ID NO: 268861 - protein, 11 aa, Mycobacterium
LDRADPGSNPR

SEQ ID NO: 268862 - protein, 6 aa, Mycobacterium
LDRDDT

SEQ ID NO: 268863 - protein, 8 aa, Mycobacterium
LDRDGFEP

SEQ ID NO: 268864 - protein, 6 aa, Mycobacterium
LDRDQV

SEQ ID NO: 268865 - protein, 4 aa, Mycobacterium
LDRE

SEQ ID NO: 268866 - protein, 7 aa, Mycobacterium
LDREPRE

SEQ ID NO: 268867 - protein, 5 aa, Mycobacterium
LDRFP

SEQ ID NO: 268868 - protein, 8 aa, Mycobacterium
LDRGTEAE

SEQ ID NO: 268869 - protein, 9 aa, Mycobacterium
LDRPEDQAL

SEQ ID NO: 268870 - protein, 13 aa, Mycobacterium
LDRPPDKPKWATT

SEQ ID NO: 268871 - protein, 12 aa, Mycobacterium
LDRRRPADHNEF

SEQ ID NO: 268872 - protein, 8 aa, Mycobacterium
LDRRSERQ

SEQ ID NO: 268873 - protein, 9 aa, Mycobacterium
LDSAAAGYE

SEQ ID NO: 268874 - protein, 8 aa, Mycobacterium
LDSAPGAG

SEQ ID NO: 268875 - protein, 14 aa, Mycobacterium
LDSAREQVAEQGPR

SEQ ID NO: 268876 - protein, 9 aa, Mycobacterium
LDSAVDDDE

SEQ ID NO: 268877 - protein, 6 aa, Mycobacterium
LDSEAV

SEQ ID NO: 268878 - protein, 8 aa, Mycobacterium
LDSEGTHR

SEQ ID NO: 268879 - protein, 6 aa, Mycobacterium
LDSGGA

SEQ ID NO: 268880 - protein, 8 aa, Mycobacterium
LDSGSGDQ

SEQ ID NO: 268881 - protein, 8 aa, Mycobacterium
LDSGTASL

SEQ ID NO: 268882 - protein, 7 aa, Mycobacterium
LDSNARA

SEQ ID NO: 268883 - protein, 15 aa, Mycobacterium
LDSPPEHGPIGPVPA

SEQ ID NO: 268884 - protein, 12 aa, Mycobacterium
LDSPPSAPLQRD

SEQ ID NO: 268885 - protein, 8 aa, Mycobacterium
LDSPSSLA

SEQ ID NO: 268886 - protein, 5 aa, Mycobacterium
LDSPT

SEQ ID NO: 268887 - protein, 4 aa, Mycobacterium
LDSR

SEQ ID NO: 268888 - protein, 45 aa, Mycobacterium
LDSRTPPRRDRTGGGGRPPEGPPPPPGPRGRSGGPDGSGPGPTGD

SEQ ID NO: 268889 - protein, 8 aa, Mycobacterium
LDSSTSDL

SEQ ID NO: 268890 - protein, 9 aa, Mycobacterium
LDSTGRLTD

SEQ ID NO: 268891 - protein, 10 aa, Mycobacterium
LDTAAKPAAI

SEQ ID NO: 268892 - protein, 25 aa, Mycobacterium
LDTATHGDHGDHAPAAGHTAGPQSV

SEQ ID NO: 268893 - protein, 10 aa, Mycobacterium
LDTDDRETIT

SEQ ID NO: 268894 - protein, 16 aa, Mycobacterium
LDTEEVGKSSHGCGGR

SEQ ID NO: 268895 - protein, 5 aa, Mycobacterium
LDTGA

SEQ ID NO: 268896 - protein, 6 aa, Mycobacterium
LDTGGE

SEQ ID NO: 268897 - protein, 29 aa, Mycobacterium
LDTGSLPTQPNAGSLPTQPNPEGQARDLD

SEQ ID NO: 268898 - protein, 25 aa, Mycobacterium
LDTPQAPRISLPGAGGAAAQVVTAG

SEQ ID NO: 268899 - protein, 13 aa, Mycobacterium
LDTPSYTGLPATG

SEQ ID NO: 268900 - protein, 10 aa, Mycobacterium
LDTQPGVSRP

SEQ ID NO: 268901 - protein, 23 aa, Mycobacterium
LDTRALPAPDYGDHGRYRAPANA

SEQ ID NO: 268902 - protein, 12 aa, Mycobacterium
LDTRALPRPEYQ

SEQ ID NO: 268903 - protein, 10 aa, Mycobacterium
LDTSAYPDNP

SEQ ID NO: 268904 - protein, 16 aa, Mycobacterium
LDTSTEPDEPDKPRAR

SEQ ID NO: 268905 - protein, 10 aa, Mycobacterium
LDTSTMTGES

SEQ ID NO: 268906 - protein, 4 aa, Mycobacterium
LDTT

SEQ ID NO: 268907 - protein, 7 aa, Mycobacterium
LDTTGPG

SEQ ID NO: 268908 - protein, 12 aa, Mycobacterium
LDTTRTALNNHT

SEQ ID NO: 268909 - protein, 10 aa, Mycobacterium
LDVSEDERRH

SEQ ID NO: 268910 - protein, 8 aa, Mycobacterium
LDYDPPEC

SEQ ID NO: 268911 - protein, 15 aa, Mycobacterium
LEAAPPAPAPQPAPA

SEQ ID NO: 268912 - protein, 9 aa, Mycobacterium
LEAASEHPI

SEQ ID NO: 268913 - protein, 6 aa, Mycobacterium
LEADGP

SEQ ID NO: 268914 - protein, 6 aa, Mycobacterium
LEADPD

SEQ ID NO: 268915 - protein, 14 aa, Mycobacterium
LEAEDRDARTNEVE

SEQ ID NO: 268916 - protein, 9 aa, Mycobacterium
LEAGPPPRR

SEQ ID NO: 268917 - protein, 10 aa, Mycobacterium
LEAGPPPRRL

SEQ ID NO: 268918 - protein, 9 aa, Mycobacterium
LEAGPPPVR

SEQ ID NO: 268919 - protein, 7 aa, Mycobacterium
LEAKAEE

SEQ ID NO: 268920 - protein, 8 aa, Mycobacterium
LEANESVD

SEQ ID NO: 268921 - protein, 10 aa, Mycobacterium
LEAPATRPSR

SEQ ID NO: 268922 - protein, 13 aa, Mycobacterium
LEAPDVAPSEQAR

SEQ ID NO: 268923 - protein, 7 aa, Mycobacterium
LEAPPVG

SEQ ID NO: 268924 - protein, 8 aa, Mycobacterium
LEASTTLP

SEQ ID NO: 268925 - protein, 6 aa, Mycobacterium
LEATDT

SEQ ID NO: 268926 - protein, 6 aa, Mycobacterium
LEATRS

SEQ ID NO: 268927 - protein, 9 aa, Mycobacterium
LEATSANPD

SEQ ID NO: 268928 - protein, 10 aa, Mycobacterium
LEDAPSATSA

SEQ ID NO: 268929 - protein, 11 aa, Mycobacterium
LEDKSRLSDET

SEQ ID NO: 268930 - protein, 11 aa, Mycobacterium
LEDNNGGRLTT

SEQ ID NO: 268931 - protein, 16 aa, Mycobacterium
LEDPAPRWDAQRFDER

SEQ ID NO: 268932 - protein, 17 aa, Mycobacterium
LEDPATDAGYDDEHPPR

SEQ ID NO: 268933 - protein, 22 aa, Mycobacterium
LEDPDDTGEASDADSPEASGKR

SEQ ID NO: 268934 - protein, 5 aa, Mycobacterium
LEDPT

SEQ ID NO: 268935 - protein, 12 aa, Mycobacterium
LEDSQPDMRADR

SEQ ID NO: 268936 - protein, 11 aa, Mycobacterium
LEDTGTEVGVR

SEQ ID NO: 268937 - protein, 5 aa, Mycobacterium
LEEAA

SEQ ID NO: 268938 - protein, 11 aa, Mycobacterium
LEEAARQGRLG

SEQ ID NO: 268939 - protein, 11 aa, Mycobacterium
LEEAASQGRLG

SEQ ID NO: 268940 - protein, 17 aa, Mycobacterium
LEEARAKSEEAPEPDAR

SEQ ID NO: 268941 - protein, 5 aa, Mycobacterium
LEEDP

SEQ ID NO: 268942 - protein, 7 aa, Mycobacterium
LEEDPQN

SEQ ID NO: 268943 - protein, 17 aa, Mycobacterium
LEEDRRRAAQTKADTEY

SEQ ID NO: 268944 - protein, 6 aa, Mycobacterium
LEEETG

SEQ ID NO: 268945 - protein, 11 aa, Mycobacterium
LEEGQETRLDD

SEQ ID NO: 268946 - protein, 5 aa, Mycobacterium
LEEGR

SEQ ID NO: 268947 - protein, 11 aa, Mycobacterium
LEEGSGSPGEV

SEQ ID NO: 268948 - protein, 8 aa, Mycobacterium
LEEPSGGT

SEQ ID NO: 268949 - protein, 64 aa, Mycobacterium
LEEPVPGAEAETEKLPTQRPDLRQESGGDPPGSAGSPGAPGPSGPDEPTEAGPTESNPPGPHDR

SEQ ID NO: 268950 - protein, 52 aa, Mycobacterium
LEEPVPGAEAETEKLPTQRPTSRDDAGADAPTLGADEPPESGPPEPTGPPER

SEQ ID NO: 268951 - protein, 6 aa, Mycobacterium
LEEQGR

SEQ ID NO: 268952 - protein, 7 aa, Mycobacterium
LEERERL

SEQ ID NO: 268953 - protein, 7 aa, Mycobacterium
LEESDTP

SEQ ID NO: 268954 - protein, 13 aa, Mycobacterium
LEETERDNRTREL

SEQ ID NO: 268955 - protein, 30 aa, Mycobacterium
LEGGCTPPDPNGPDSCPDDPEADTAPQPVI

SEQ ID NO: 268956 - protein, 11 aa, Mycobacterium
LEGGDPSVAAG

SEQ ID NO: 268957 - protein, 11 aa, Mycobacterium
LEGHDGDDYRA

SEQ ID NO: 268958 - protein, 5 aa, Mycobacterium
LEGLD

SEQ ID NO: 268959 - protein, 10 aa, Mycobacterium
LEGPTGTGFA

SEQ ID NO: 268960 - protein, 8 aa, Mycobacterium
LEGQDPDM

SEQ ID NO: 268961 - protein, 6 aa, Mycobacterium
LEGQGR

SEQ ID NO: 268962 - protein, 5 aa, Mycobacterium
LEGRP

SEQ ID NO: 268963 - protein, 34 aa, Mycobacterium
LEGSPPPKPPPPPPPGRGGGGPSGPGGPSGPGRQ

SEQ ID NO: 268964 - protein, 24 aa, Mycobacterium
LEHDSEPAPPSPPDKDDVAPLSFA

SEQ ID NO: 268965 - protein, 8 aa, Mycobacterium
LEHSRTAD

SEQ ID NO: 268966 - protein, 9 aa, Mycobacterium
LEKAASAQH

SEQ ID NO: 268967 - protein, 12 aa, Mycobacterium
LEKSGRFEQGET

SEQ ID NO: 268968 - protein, 18 aa, Mycobacterium
LEKSPGTTPQDSDTPSEV

SEQ ID NO: 268969 - protein, 11 aa, Mycobacterium
LENGNQEMPKD

SEQ ID NO: 268970 - protein, 9 aa, Mycobacterium
LENGSVPVQ

SEQ ID NO: 268971 - protein, 6 aa, Mycobacterium
LENPRT

SEQ ID NO: 268972 - protein, 12 aa, Mycobacterium
LENRNDAAKKID

SEQ ID NO: 268973 - protein, 14 aa, Mycobacterium
LENSREKPQSFTGS

SEQ ID NO: 268974 - protein, 44 aa, Mycobacterium
LEPARPSGTAPSAQAQPHPSEAGVSTASLGAADQPGAGKARHTK

SEQ ID NO: 268975 - protein, 33 aa, Mycobacterium
LEPASTDHSDAAEDNDRTGGHGGHGGHGGHRDE

SEQ ID NO: 268976 - protein, 8 aa, Mycobacterium
LEPDEHDR

SEQ ID NO: 268977 - protein, 5 aa, Mycobacterium
LEPER

SEQ ID NO: 268978 - protein, 5 aa, Mycobacterium
LEPET

SEQ ID NO: 268979 - protein, 7 aa, Mycobacterium
LEPETGR

SEQ ID NO: 268980 - protein, 4 aa, Mycobacterium
LEPG

SEQ ID NO: 268981 - protein, 12 aa, Mycobacterium
LEPGDTARRTAG

SEQ ID NO: 268982 - protein, 6 aa, Mycobacterium
LEPGET

SEQ ID NO: 268983 - protein, 8 aa, Mycobacterium
LEPGSTTA

SEQ ID NO: 268984 - protein, 8 aa, Mycobacterium
LEPGYAPD

SEQ ID NO: 268985 - protein, 18 aa, Mycobacterium
LEPPEPKNPPYTGMPATG

SEQ ID NO: 268986 - protein, 46 aa, Mycobacterium
LEPPPPPPPPIPAAPVAPGARDGGGAPIAPASFGGTVGPVGSQVER

SEQ ID NO: 268987 - protein, 6 aa, Mycobacterium
LEPPQD

SEQ ID NO: 268988 - protein, 10 aa, Mycobacterium
LEPPYKGGPV

SEQ ID NO: 268989 - protein, 6 aa, Mycobacterium
LEPREA

SEQ ID NO: 268990 - protein, 28 aa, Mycobacterium
LEPRPVSRPPVDPSAQRAFGRPSGVSGS

SEQ ID NO: 268991 - protein, 5 aa, Mycobacterium
LEPTT

SEQ ID NO: 268992 - protein, 8 aa, Mycobacterium
LEQDPSAY

SEQ ID NO: 268993 - protein, 8 aa, Mycobacterium
LEQGQQRP

SEQ ID NO: 268994 - protein, 13 aa, Mycobacterium
LEQPGVNTAELTG

SEQ ID NO: 268995 - protein, 9 aa, Mycobacterium
LEQPQPAGT

SEQ ID NO: 268996 - protein, 8 aa, Mycobacterium
LEQQAPGA

SEQ ID NO: 268997 - protein, 8 aa, Mycobacterium
LEQQGVSA

SEQ ID NO: 268998 - protein, 8 aa, Mycobacterium
LEQRPECD

SEQ ID NO: 268999 - protein, 7 aa, Mycobacterium
LEQRSEC

SEQ ID NO: 269000 - protein, 10 aa, Mycobacterium
LEQTSYRDSK

SEQ ID NO: 269001 - protein, 8 aa, Mycobacterium
LERAGKPT

SEQ ID NO: 269002 - protein, 7 aa, Mycobacterium
LERAGKS

SEQ ID NO: 269003 - protein, 4 aa, Mycobacterium
LERD

SEQ ID NO: 269004 - protein, 7 aa, Mycobacterium
LERDDAM

SEQ ID NO: 269005 - protein, 5 aa, Mycobacterium
LERDQ

SEQ ID NO: 269006 - protein, 10 aa, Mycobacterium
LEREDRPSWR

SEQ ID NO: 269007 - protein, 7 aa, Mycobacterium
LERETKG

SEQ ID NO: 269008 - protein, 11 aa, Mycobacterium
LERGTELGGQE

SEQ ID NO: 269009 - protein, 6 aa, Mycobacterium
LERIPG

SEQ ID NO: 269010 - protein, 9 aa, Mycobacterium
LERPGTPNA

SEQ ID NO: 269011 - protein, 4 aa, Mycobacterium
LERQ

SEQ ID NO: 269012 - protein, 4 aa, Mycobacterium
LERR

SEQ ID NO: 269013 - protein, 7 aa, Mycobacterium
LERRTGK

SEQ ID NO: 269014 - protein, 13 aa, Mycobacterium
LERTGSDSPEVAG

SEQ ID NO: 269015 - protein, 12 aa, Mycobacterium
LESADGIKATAE

SEQ ID NO: 269016 - protein, 9 aa, Mycobacterium
LESESDDAA

SEQ ID NO: 269017 - protein, 20 aa, Mycobacterium
LESGSPAVRSPVTNGGSRRI

SEQ ID NO: 269018 - protein, 9 aa, Mycobacterium
LESHSRDTA

SEQ ID NO: 269019 - protein, 9 aa, Mycobacterium
LESIDEVSK

SEQ ID NO: 269020 - protein, 4 aa, Mycobacterium
LESP

SEQ ID NO: 269021 - protein, 8 aa, Mycobacterium
LESPGNRG

SEQ ID NO: 269022 - protein, 9 aa, Mycobacterium
LESQSGDQA

SEQ ID NO: 269023 - protein, 8 aa, Mycobacterium
LESTPGAI

SEQ ID NO: 269024 - protein, 14 aa, Mycobacterium
LETAKETIAQAPNI

SEQ ID NO: 269025 - protein, 9 aa, Mycobacterium
LETATDTVD

SEQ ID NO: 269026 - protein, 9 aa, Mycobacterium
LETDESTLD

SEQ ID NO: 269027 - protein, 11 aa, Mycobacterium
LETEVSEKASD

SEQ ID NO: 269028 - protein, 14 aa, Mycobacterium
LETGDHPDPDAGRF

SEQ ID NO: 269029 - protein, 5 aa, Mycobacterium
LETGP

SEQ ID NO: 269030 - protein, 9 aa, Mycobacterium
LETGPPPRR

SEQ ID NO: 269031 - protein, 11 aa, Mycobacterium
LETGQGADAVD

SEQ ID NO: 269032 - protein, 6 aa, Mycobacterium
LETGTA

SEQ ID NO: 269033 - protein, 10 aa, Mycobacterium
LETRRRPLGS

SEQ ID NO: 269034 - protein, 16 aa, Mycobacterium
LETSGGDDNGEPRGQF

SEQ ID NO: 269035 - protein, 6 aa, Mycobacterium
LETSGV

SEQ ID NO: 269036 - protein, 7 aa, Mycobacterium
LETSRKE

SEQ ID NO: 269037 - protein, 7 aa, Mycobacterium
LETTQRR

SEQ ID NO: 269038 - protein, 9 aa, Mycobacterium
LEVSPQGGT

SEQ ID NO: 269039 - protein, 4 aa, Mycobacterium
LGAA

SEQ ID NO: 269040 - protein, 7 aa, Mycobacterium
LGAAAPA

SEQ ID NO: 269041 - protein, 16 aa, Mycobacterium
LGAAATEATKDDIAQA

SEQ ID NO: 269042 - protein, 12 aa, Mycobacterium
LGAAATQATKHD

SEQ ID NO: 269043 - protein, 11 aa, Mycobacterium
LGAAGTATLAR

SEQ ID NO: 269044 - protein, 11 aa, Mycobacterium
LGAANTATVAR

SEQ ID NO: 269045 - protein, 10 aa, Mycobacterium
LGAASDPRIA

SEQ ID NO: 269046 - protein, 11 aa, Mycobacterium
LGADASAARAI

SEQ ID NO: 269047 - protein, 10 aa, Mycobacterium
LGADGAPTHR

SEQ ID NO: 269048 - protein, 5 aa, Mycobacterium
LGADT

SEQ ID NO: 269049 - protein, 6 aa, Mycobacterium
LGADTA

SEQ ID NO: 269050 - protein, 4 aa, Mycobacterium
LGAE

SEQ ID NO: 269051 - protein, 11 aa, Mycobacterium
LGAEAKNAHRN

SEQ ID NO: 269052 - protein, 8 aa, Mycobacterium
LGAEAVNK

SEQ ID NO: 269053 - protein, 9 aa, Mycobacterium
LGAEDETGH

SEQ ID NO: 269054 - protein, 7 aa, Mycobacterium
LGAEPLP

SEQ ID NO: 269055 - protein, 6 aa, Mycobacterium
LGAEPR

SEQ ID NO: 269056 - protein, 11 aa, Mycobacterium
LGAESRDAHRT

SEQ ID NO: 269057 - protein, 10 aa, Mycobacterium
LGAESTAADL

SEQ ID NO: 269058 - protein, 10 aa, Mycobacterium
LGAETQAAIK

SEQ ID NO: 269059 - protein, 10 aa, Mycobacterium
LGAGATVGPG

SEQ ID NO: 269060 - protein, 7 aa, Mycobacterium
LGAGGEV

SEQ ID NO: 269061 - protein, 10 aa, Mycobacterium
LGAGPRDGLT

SEQ ID NO: 269062 - protein, 7 aa, Mycobacterium
LGAGSPV

SEQ ID NO: 269063 - protein, 11 aa, Mycobacterium
LGAGSTRQHDP

SEQ ID NO: 269064 - protein, 6 aa, Mycobacterium
LGAGTE

SEQ ID NO: 269065 - protein, 4 aa, Mycobacterium
LGAK

SEQ ID NO: 269066 - protein, 6 aa, Mycobacterium
LGANDI

SEQ ID NO: 269067 - protein, 13 aa, Mycobacterium
LGAPDSQPAESTL

SEQ ID NO: 269068 - protein, 5 aa, Mycobacterium
LGAPG

SEQ ID NO: 269069 - protein, 6 aa, Mycobacterium
LGAPGA

SEQ ID NO: 269070 - protein, 6 aa, Mycobacterium
LGAPPM

SEQ ID NO: 269071 - protein, 20 aa, Mycobacterium
LGAPPVEPAGADERRRGHGH

SEQ ID NO: 269072 - protein, 7 aa, Mycobacterium
LGAPQIA

SEQ ID NO: 269073 - protein, 7 aa, Mycobacterium
LGAPSIN

SEQ ID NO: 269074 - protein, 5 aa, Mycobacterium
LGAPV

SEQ ID NO: 269075 - protein, 8 aa, Mycobacterium
LGAQNTGQ

SEQ ID NO: 269076 - protein, 7 aa, Mycobacterium
LGAQPYG

SEQ ID NO: 269077 - protein, 6 aa, Mycobacterium
LGAQTG

SEQ ID NO: 269078 - protein, 23 aa, Mycobacterium
LGARDTRAATPSGLDGPGMSTSA

SEQ ID NO: 269079 - protein, 21 aa, Mycobacterium
LGARDTRVATPSGLDGPGMST

SEQ ID NO: 269080 - protein, 5 aa, Mycobacterium
LGARP

SEQ ID NO: 269081 - protein, 9 aa, Mycobacterium
LGASEGTAL

SEQ ID NO: 269082 - protein, 5 aa, Mycobacterium
LGASG

SEQ ID NO: 269083 - protein, 5 aa, Mycobacterium
LGASP

SEQ ID NO: 269084 - protein, 12 aa, Mycobacterium
LGASSEPRVSKT

SEQ ID NO: 269085 - protein, 10 aa, Mycobacterium
LGATDGETLS

SEQ ID NO: 269086 - protein, 6 aa, Mycobacterium
LGATGT

SEQ ID NO: 269087 - protein, 9 aa, Mycobacterium
LGDAPDVPG

SEQ ID NO: 269088 - protein, 9 aa, Mycobacterium
LGDCGSPSV

SEQ ID NO: 269089 - protein, 9 aa, Mycobacterium
LGDDEETSL

SEQ ID NO: 269090 - protein, 7 aa, Mycobacterium
LGDDGEL

SEQ ID NO: 269091 - protein, 5 aa, Mycobacterium
LGDEG

SEQ ID NO: 269092 - protein, 5 aa, Mycobacterium
LGDGA

SEQ ID NO: 269093 - protein, 33 aa, Mycobacterium
LGDGPHGAGAGLESADAAGAQVQRGAAVGELDR

SEQ ID NO: 269094 - protein, 10 aa, Mycobacterium
LGDGSPDPGV

SEQ ID NO: 269095 - protein, 8 aa, Mycobacterium
LGDGSSRR

SEQ ID NO: 269096 - protein, 37 aa, Mycobacterium
LGDNATKYASPASRRSVARAQDAAIATEKASKSAELD

SEQ ID NO: 269097 - protein, 7 aa, Mycobacterium
LGDPADA

SEQ ID NO: 269098 - protein, 7 aa, Mycobacterium
LGDPADD

SEQ ID NO: 269099 - protein, 7 aa, Mycobacterium
LGDPADS

SEQ ID NO: 269100 - protein, 7 aa, Mycobacterium
LGDPADT

SEQ ID NO: 269101 - protein, 8 aa, Mycobacterium
LGDPKRAA

SEQ ID NO: 269102 - protein, 9 aa, Mycobacterium
LGDPKRGHP

SEQ ID NO: 269103 - protein, 12 aa, Mycobacterium
LGDPRMRNNPVA

SEQ ID NO: 269104 - protein, 7 aa, Mycobacterium
LGDPSSC

SEQ ID NO: 269105 - protein, 8 aa, Mycobacterium
LGDQNKQF

SEQ ID NO: 269106 - protein, 12 aa, Mycobacterium
LGDRAASRFATP

SEQ ID NO: 269107 - protein, 7 aa, Mycobacterium
LGDRARA

SEQ ID NO: 269108 - protein, 5 aa, Mycobacterium
LGDRG

SEQ ID NO: 269109 - protein, 7 aa, Mycobacterium
LGDRYGR

SEQ ID NO: 269110 - protein, 9 aa, Mycobacterium
LGDSDKVAV

SEQ ID NO: 269111 - protein, 9 aa, Mycobacterium
LGDSDKVRV

SEQ ID NO: 269112 - protein, 8 aa, Mycobacterium
LGDSEKIR

SEQ ID NO: 269113 - protein, 8 aa, Mycobacterium
LGDSGRFG

SEQ ID NO: 269114 - protein, 9 aa, Mycobacterium
LGDSSKVRV

SEQ ID NO: 269115 - protein, 8 aa, Mycobacterium
LGDSTDGD

SEQ ID NO: 269116 - protein, 9 aa, Mycobacterium
LGDSYSGDT

SEQ ID NO: 269117 - protein, 4 aa, Mycobacterium
LGEA

SEQ ID NO: 269118 - protein, 44 aa, Mycobacterium
LGEAGIPTADDSASDVEKAAATETTEKPASRSGDGDLSGSSESL

SEQ ID NO: 269119 - protein, 12 aa, Mycobacterium
LGEALDDGGARD

SEQ ID NO: 269120 - protein, 5 aa, Mycobacterium
LGEAP

SEQ ID NO: 269121 - protein, 13 aa, Mycobacterium
LGEDGPRPIDPGY

SEQ ID NO: 269122 - protein, 7 aa, Mycobacterium
LGEERQI

SEQ ID NO: 269123 - protein, 8 aa, Mycobacterium
LGEERQLR

SEQ ID NO: 269124 - protein, 12 aa, Mycobacterium
LGEEVNAATEVP

SEQ ID NO: 269125 - protein, 17 aa, Mycobacterium
LGEGDDNGDDWPEQNRP

SEQ ID NO: 269126 - protein, 8 aa, Mycobacterium
LGEGRGRV

SEQ ID NO: 269127 - protein, 6 aa, Mycobacterium
LGEGST

SEQ ID NO: 269128 - protein, 4 aa, Mycobacterium
LGEP

SEQ ID NO: 269129 - protein, 9 aa, Mycobacterium
LGEPEGASA

SEQ ID NO: 269130 - protein, 23 aa, Mycobacterium
LGEPGPEQSPKPPASRRSSQVDV

SEQ ID NO: 269131 - protein, 22 aa, Mycobacterium
LGEPGTPDSAAAAAIRSSQVDV

SEQ ID NO: 269132 - protein, 8 aa, Mycobacterium
LGEPGTVG

SEQ ID NO: 269133 - protein, 12 aa, Mycobacterium
LGEPPLEATGRG

SEQ ID NO: 269134 - protein, 10 aa, Mycobacterium
LGEQIDADTD

SEQ ID NO: 269135 - protein, 6 aa, Mycobacterium
LGERAA

SEQ ID NO: 269136 - protein, 10 aa, Mycobacterium
LGERAKGRTW

SEQ ID NO: 269137 - protein, 7 aa, Mycobacterium
LGERTEA

SEQ ID NO: 269138 - protein, 4 aa, Mycobacterium
LGES

SEQ ID NO: 269139 - protein, 12 aa, Mycobacterium
LGESEDDSTPAF

SEQ ID NO: 269140 - protein, 8 aa, Mycobacterium
LGESGTIA

SEQ ID NO: 269141 - protein, 9 aa, Mycobacterium
LGESVASGP

SEQ ID NO: 269142 - protein, 23 aa, Mycobacterium
LGETELPDERKRPTVRESETDQR

SEQ ID NO: 269143 - protein, 9 aa, Mycobacterium
LGETGGDTV

SEQ ID NO: 269144 - protein, 10 aa, Mycobacterium
LGGAAGGAVR

SEQ ID NO: 269145 - protein, 11 aa, Mycobacterium
LGGADPAEREP

SEQ ID NO: 269146 - protein, 8 aa, Mycobacterium
LGGAEARR

SEQ ID NO: 269147 - protein, 6 aa, Mycobacterium
LGGAGF

SEQ ID NO: 269148 - protein, 21 aa, Mycobacterium
LGGAGRAETPPASQRSSQVDV

SEQ ID NO: 269149 - protein, 13 aa, Mycobacterium
LGGAGRASDTAGL

SEQ ID NO: 269150 - protein, 8 aa, Mycobacterium
LGGAGRPS

SEQ ID NO: 269151 - protein, 12 aa, Mycobacterium
LGGANYSASLST

SEQ ID NO: 269152 - protein, 9 aa, Mycobacterium
LGGAPTAAV

SEQ ID NO: 269153 - protein, 11 aa, Mycobacterium
LGGARAPSNVI

SEQ ID NO: 269154 - protein, 10 aa, Mycobacterium
LGGARNTVTN

SEQ ID NO: 269155 - protein, 25 aa, Mycobacterium
LGGATGELGAPVADQTESGNTLSQR

SEQ ID NO: 269156 - protein, 21 aa, Mycobacterium
LGGATGTLGAPTADQTEDGTV

SEQ ID NO: 269157 - protein, 43 aa, Mycobacterium
LGGATNPDAPFGGAAGTRTPGGNPSIHTGPVAPPTVPTPKAPA

SEQ ID NO: 269158 - protein, 5 aa, Mycobacterium
LGGDD

SEQ ID NO: 269159 - protein, 6 aa, Mycobacterium
LGGDDL

SEQ ID NO: 269160 - protein, 6 aa, Mycobacterium
LGGDDR

SEQ ID NO: 269161 - protein, 7 aa, Mycobacterium
LGGDPEQ

SEQ ID NO: 269162 - protein, 7 aa, Mycobacterium
LGGDPGV

SEQ ID NO: 269163 - protein, 4 aa, Mycobacterium
LGGE

SEQ ID NO: 269164 - protein, 10 aa, Mycobacterium
LGGEAEPTSY

SEQ ID NO: 269165 - protein, 10 aa, Mycobacterium
LGGEDDGAKA

SEQ ID NO: 269166 - protein, 6 aa, Mycobacterium
LGGEER

SEQ ID NO: 269167 - protein, 20 aa, Mycobacterium
LGGEHAARQPVAEGYAAESG

SEQ ID NO: 269168 - protein, 6 aa, Mycobacterium
LGGETQ

SEQ ID NO: 269169 - protein, 6 aa, Mycobacterium
LGGEYG

SEQ ID NO: 269170 - protein, 6 aa, Mycobacterium
LGGGAT

SEQ ID NO: 269171 - protein, 5 aa, Mycobacterium
LGGGD

SEQ ID NO: 269172 - protein, 10 aa, Mycobacterium
LGGGGAGRAE

SEQ ID NO: 269173 - protein, 12 aa, Mycobacterium
LGGGGDADETIA

SEQ ID NO: 269174 - protein, 26 aa, Mycobacterium
LGGGGGGNGGPGSGGARNAPSAPSFG

SEQ ID NO: 269175 - protein, 9 aa, Mycobacterium
LGGGKESEN

SEQ ID NO: 269176 - protein, 22 aa, Mycobacterium
LGGGLPPDPAGATTGDPDEVLG

SEQ ID NO: 269177 - protein, 7 aa, Mycobacterium
LGGGNYA

SEQ ID NO: 269178 - protein, 10 aa, Mycobacterium
LGGGNYSGSL

SEQ ID NO: 269179 - protein, 14 aa, Mycobacterium
LGGGPAPEVPPDVT

SEQ ID NO: 269180 - protein, 11 aa, Mycobacterium
LGGGRGPVLGP

SEQ ID NO: 269181 - protein, 5 aa, Mycobacterium
LGGGT

SEQ ID NO: 269182 - protein, 15 aa, Mycobacterium
LGGGTDDSATPTVGT

SEQ ID NO: 269183 - protein, 15 aa, Mycobacterium
LGGGTDDSDTPTVGQ

SEQ ID NO: 269184 - protein, 23 aa, Mycobacterium
LGGKDTRAATPSGLDGPGMSTSA

SEQ ID NO: 269185 - protein, 12 aa, Mycobacterium
LGGKHSAEPAGL

SEQ ID NO: 269186 - protein, 5 aa, Mycobacterium
LGGKT

SEQ ID NO: 269187 - protein, 15 aa, Mycobacterium
LGGKTGYTDDAGQTF

SEQ ID NO: 269188 - protein, 5 aa, Mycobacterium
LGGNR

SEQ ID NO: 269189 - protein, 10 aa, Mycobacterium
LGGPADSDLG

SEQ ID NO: 269190 - protein, 8 aa, Mycobacterium
LGGPEGQL

SEQ ID NO: 269191 - protein, 7 aa, Mycobacterium
LGGPGDD

SEQ ID NO: 269192 - protein, 23 aa, Mycobacterium
LGGQDTRVATPSGLDAPGMSTSA

SEQ ID NO: 269193 - protein, 9 aa, Mycobacterium
LGGRRRAQA

SEQ ID NO: 269194 - protein, 13 aa, Mycobacterium
LGGRSARVRRDGR

SEQ ID NO: 269195 - protein, 8 aa, Mycobacterium
LGGSADLP

SEQ ID NO: 269196 - protein, 8 aa, Mycobacterium
LGGSDSAV

SEQ ID NO: 269197 - protein, 8 aa, Mycobacterium
LGGSGDLP

SEQ ID NO: 269198 - protein, 6 aa, Mycobacterium
LGGSGN

SEQ ID NO: 269199 - protein, 14 aa, Mycobacterium
LGGSPLQVSGPAAG

SEQ ID NO: 269200 - protein, 8 aa, Mycobacterium
LGGSTDLP

SEQ ID NO: 269201 - protein, 9 aa, Mycobacterium
LGGSTVPAA

SEQ ID NO: 269202 - protein, 6 aa, Mycobacterium
LGGTAA

SEQ ID NO: 269203 - protein, 16 aa, Mycobacterium
LGGTAQLRSGPGEGTE

SEQ ID NO: 269204 - protein, 9 aa, Mycobacterium
LGGTDHAEQ

SEQ ID NO: 269205 - protein, 7 aa, Mycobacterium
LGGTGES

SEQ ID NO: 269206 - protein, 5 aa, Mycobacterium
LGGYT

SEQ ID NO: 269207 - protein, 10 aa, Mycobacterium
LGHDAGDESI

SEQ ID NO: 269208 - protein, 9 aa, Mycobacterium
LGHKKDSLE

SEQ ID NO: 269209 - protein, 4 aa, Mycobacterium
LGHP

SEQ ID NO: 269210 - protein, 6 aa, Mycobacterium
LGHPAA

SEQ ID NO: 269211 - protein, 9 aa, Mycobacterium
LGHPSNQSL

SEQ ID NO: 269212 - protein, 4 aa, Mycobacterium
LGHR

SEQ ID NO: 269213 - protein, 6 aa, Mycobacterium
LGHSRG

SEQ ID NO: 269214 - protein, 19 aa, Mycobacterium
LGKADAAPKPPTRLPESAA

SEQ ID NO: 269215 - protein, 13 aa, Mycobacterium
LGKASKEGAGAGM

SEQ ID NO: 269216 - protein, 9 aa, Mycobacterium
LGKDTKASI

SEQ ID NO: 269217 - protein, 6 aa, Mycobacterium
LGKGDA

SEQ ID NO: 269218 - protein, 10 aa, Mycobacterium
LGKPGPRSVA

SEQ ID NO: 269219 - protein, 8 aa, Mycobacterium
LGKQGSDQ

SEQ ID NO: 269220 - protein, 8 aa, Mycobacterium
LGKRGDDT

SEQ ID NO: 269221 - protein, 10 aa, Mycobacterium
LGKSGGPRRS

SEQ ID NO: 269222 - protein, 4 aa, Mycobacterium
LGLA

SEQ ID NO: 269223 - protein, 4 aa, Mycobacterium
LGLD

SEQ ID NO: 269224 - protein, 11 aa, Mycobacterium
LGLNKTSKTVG

SEQ ID NO: 269225 - protein, 8 aa, Mycobacterium
LGLPPGTY

SEQ ID NO: 269226 - protein, 4 aa, Mycobacterium
LGLS

SEQ ID NO: 269227 - protein, 5 aa, Mycobacterium
LGLSP

SEQ ID NO: 269228 - protein, 8 aa, Mycobacterium
LGLSPASA

SEQ ID NO: 269229 - protein, 4 aa, Mycobacterium
LGMK

SEQ ID NO: 269230 - protein, 12 aa, Mycobacterium
LGMNPDGSTGGI

SEQ ID NO: 269231 - protein, 9 aa, Mycobacterium
LGMTESDRR

SEQ ID NO: 269232 - protein, 6 aa, Mycobacterium
LGNDAE

SEQ ID NO: 269233 - protein, 8 aa, Mycobacterium
LGNETTMP

SEQ ID NO: 269234 - protein, 13 aa, Mycobacterium
LGNGQPDTVPAAS

SEQ ID NO: 269235 - protein, 13 aa, Mycobacterium
LGNGQPGTVPAAS

SEQ ID NO: 269236 - protein, 14 aa, Mycobacterium
LGNNGSDVFGRGGP

SEQ ID NO: 269237 - protein, 9 aa, Mycobacterium
LGNPANEEN

SEQ ID NO: 269238 - protein, 9 aa, Mycobacterium
LGNPDNSND

SEQ ID NO: 269239 - protein, 6 aa, Mycobacterium
LGNQGR

SEQ ID NO: 269240 - protein, 4 aa, Mycobacterium
LGNS

SEQ ID NO: 269241 - protein, 13 aa, Mycobacterium
LGNSDSDSTPAFD

SEQ ID NO: 269242 - protein, 15 aa, Mycobacterium
LGNSPGNKATLSTTV

SEQ ID NO: 269243 - protein, 4 aa, Mycobacterium
LGPA

SEQ ID NO: 269244 - protein, 6 aa, Mycobacterium
LGPAAA

SEQ ID NO: 269245 - protein, 37 aa, Mycobacterium
LGPAAGPAPLAQATPSAVGTPAPPAPAGPVGALLGAL

SEQ ID NO: 269246 - protein, 7 aa, Mycobacterium
LGPAGTY

SEQ ID NO: 269247 - protein, 43 aa, Mycobacterium
LGPAKQRAAVTAKASTTTTKRPSTAVKKRGELVSKPGTRKRVR

SEQ ID NO: 269248 - protein, 6 aa, Mycobacterium
LGPAPQ

SEQ ID NO: 269249 - protein, 7 aa, Mycobacterium
LGPAPSW

SEQ ID NO: 269250 - protein, 5 aa, Mycobacterium
LGPAR

SEQ ID NO: 269251 - protein, 10 aa, Mycobacterium
LGPAREREPV

SEQ ID NO: 269252 - protein, 8 aa, Mycobacterium
LGPAVKSG

SEQ ID NO: 269253 - protein, 9 aa, Mycobacterium
LGPDAGAAL

SEQ ID NO: 269254 - protein, 5 aa, Mycobacterium
LGPDD

SEQ ID NO: 269255 - protein, 8 aa, Mycobacterium
LGPDDGWQ

SEQ ID NO: 269256 - protein, 10 aa, Mycobacterium
LGPDDTKRAI

SEQ ID NO: 269257 - protein, 6 aa, Mycobacterium
LGPDEV

SEQ ID NO: 269258 - protein, 6 aa, Mycobacterium
LGPDPA

SEQ ID NO: 269259 - protein, 9 aa, Mycobacterium
LGPEADQLS

SEQ ID NO: 269260 - protein, 7 aa, Mycobacterium
LGPEDCA

SEQ ID NO: 269261 - protein, 36 aa, Mycobacterium
LGPESCPPADDDVPTVPEPAVGRGRKRSPKKQDTQV

SEQ ID NO: 269262 - protein, 9 aa, Mycobacterium
LGPETGPSV

SEQ ID NO: 269263 - protein, 4 aa, Mycobacterium
LGPG

SEQ ID NO: 269264 - protein, 5 aa, Mycobacterium
LGPGD

SEQ ID NO: 269265 - protein, 8 aa, Mycobacterium
LGPGDPDA

SEQ ID NO: 269266 - protein, 14 aa, Mycobacterium
LGPGGRGGNFGNDN

SEQ ID NO: 269267 - protein, 14 aa, Mycobacterium
LGPGIGGRAGDAGT

SEQ ID NO: 269268 - protein, 6 aa, Mycobacterium
LGPGLS

SEQ ID NO: 269269 - protein, 12 aa, Mycobacterium
LGPGPVTTGAAA

SEQ ID NO: 269270 - protein, 13 aa, Mycobacterium
LGPGPVTTGAGAG

SEQ ID NO: 269271 - protein, 6 aa, Mycobacterium
LGPGQR

SEQ ID NO: 269272 - protein, 14 aa, Mycobacterium
LGPGVGGRAGDAGT

SEQ ID NO: 269273 - protein, 7 aa, Mycobacterium
LGPHDAP

SEQ ID NO: 269274 - protein, 4 aa, Mycobacterium
LGPL

SEQ ID NO: 269275 - protein, 7 aa, Mycobacterium
LGPQTGG

SEQ ID NO: 269276 - protein, 5 aa, Mycobacterium
LGPRD

SEQ ID NO: 269277 - protein, 6 aa, Mycobacterium
LGPRGG

SEQ ID NO: 269278 - protein, 9 aa, Mycobacterium
LGPRGNETF

SEQ ID NO: 269279 - protein, 10 aa, Mycobacterium
LGPRTAAANL

SEQ ID NO: 269280 - protein, 4 aa, Mycobacterium
LGPS

SEQ ID NO: 269281 - protein, 8 aa, Mycobacterium
LGPSAGRR

SEQ ID NO: 269282 - protein, 7 aa, Mycobacterium
LGPSGTY

SEQ ID NO: 269283 - protein, 6 aa, Mycobacterium
LGPSGV

SEQ ID NO: 269284 - protein, 7 aa, Mycobacterium
LGPSPAW

SEQ ID NO: 269285 - protein, 4 aa, Mycobacterium
LGPT

SEQ ID NO: 269286 - protein, 7 aa, Mycobacterium
LGPTAGA

SEQ ID NO: 269287 - protein, 6 aa, Mycobacterium
LGPTGV

SEQ ID NO: 269288 - protein, 12 aa, Mycobacterium
LGPTPEQPTGPF

SEQ ID NO: 269289 - protein, 8 aa, Mycobacterium
LGPTPRYQ

SEQ ID NO: 269290 - protein, 4 aa, Mycobacterium
LGQA

SEQ ID NO: 269291 - protein, 5 aa, Mycobacterium
LGQAP

SEQ ID NO: 269292 - protein, 6 aa, Mycobacterium
LGQDLG

SEQ ID NO: 269293 - protein, 13 aa, Mycobacterium
LGQGNSEIPAPRP

SEQ ID NO: 269294 - protein, 6 aa, Mycobacterium
LGQGSA

SEQ ID NO: 269295 - protein, 6 aa, Mycobacterium
LGQNAG

SEQ ID NO: 269296 - protein, 6 aa, Mycobacterium
LGQPAD

SEQ ID NO: 269297 - protein, 7 aa, Mycobacterium
LGQPANE

SEQ ID NO: 269298 - protein, 10 aa, Mycobacterium
LGQPQEGRDS

SEQ ID NO: 269299 - protein, 4 aa, Mycobacterium
LGQR

SEQ ID NO: 269300 - protein, 7 aa, Mycobacterium
LGQRAAA

SEQ ID NO: 269301 - protein, 8 aa, Mycobacterium
LGQRAADR

SEQ ID NO: 269302 - protein, 15 aa, Mycobacterium
LGQRTGVGLPGESAG

SEQ ID NO: 269303 - protein, 8 aa, Mycobacterium
LGQSPAID

SEQ ID NO: 269304 - protein, 6 aa, Mycobacterium
LGQSTA

SEQ ID NO: 269305 - protein, 4 aa, Mycobacterium
LGQT

SEQ ID NO: 269306 - protein, 68 aa, Mycobacterium
LGQTTASFEGDGAIEADGTGGPGGSTGGGGSAPSGGGSPVFSGHGTQASAATLTAPPNTPTSPLPRRA

SEQ ID NO: 269307 - protein, 10 aa, Mycobacterium
LGRDDEEPEF

SEQ ID NO: 269308 - protein, 4 aa, Mycobacterium
LGRE

SEQ ID NO: 269309 - protein, 7 aa, Mycobacterium
LGREPRG

SEQ ID NO: 269310 - protein, 25 aa, Mycobacterium
LGRGEGAYEEQLEADQRTAQAASKS

SEQ ID NO: 269311 - protein, 18 aa, Mycobacterium
LGRGPEAGTEPEADDIGD

SEQ ID NO: 269312 - protein, 15 aa, Mycobacterium
LGRGPPMTTKAGPLS

SEQ ID NO: 269313 - protein, 8 aa, Mycobacterium
LGRGSGRA

SEQ ID NO: 269314 - protein, 12 aa, Mycobacterium
LGRLPRKPVQAR

SEQ ID NO: 269315 - protein, 5 aa, Mycobacterium
LGRNP

SEQ ID NO: 269316 - protein, 8 aa, Mycobacterium
LGRPGGWT

SEQ ID NO: 269317 - protein, 9 aa, Mycobacterium
LGRPGQTAT

SEQ ID NO: 269318 - protein, 12 aa, Mycobacterium
LGRPQARADGLG

SEQ ID NO: 269319 - protein, 7 aa, Mycobacterium
LGRPTGI

SEQ ID NO: 269320 - protein, 4 aa, Mycobacterium
LGRR

SEQ ID NO: 269321 - protein, 14 aa, Mycobacterium
LGRREPDVYGSTTH

SEQ ID NO: 269322 - protein, 15 aa, Mycobacterium
LGRRPAADQAPTPPT

SEQ ID NO: 269323 - protein, 13 aa, Mycobacterium
LGRSDEDAGESPM

SEQ ID NO: 269324 - protein, 8 aa, Mycobacterium
LGRSPESV

SEQ ID NO: 269325 - protein, 7 aa, Mycobacterium
LGRSPFG

SEQ ID NO: 269326 - protein, 6 aa, Mycobacterium
LGRSQR

SEQ ID NO: 269327 - protein, 12 aa, Mycobacterium
LGRTNENPKQAL

SEQ ID NO: 269328 - protein, 9 aa, Mycobacterium
LGSAAAATA

SEQ ID NO: 269329 - protein, 8 aa, Mycobacterium
LGSAAESS

SEQ ID NO: 269330 - protein, 11 aa, Mycobacterium
LGSAGSPGSGS

SEQ ID NO: 269331 - protein, 12 aa, Mycobacterium
LGSAGSPGSGSF

SEQ ID NO: 269332 - protein, 6 aa, Mycobacterium
LGSAGY

SEQ ID NO: 269333 - protein, 10 aa, Mycobacterium
LGSARANDSV

SEQ ID NO: 269334 - protein, 35 aa, Mycobacterium
LGSDKSASSDSTSTSVSAAAAPKSTTPPPAPKPEV

SEQ ID NO: 269335 - protein, 17 aa, Mycobacterium
LGSDPDTAEDDAPDTSL

SEQ ID NO: 269336 - protein, 8 aa, Mycobacterium
LGSDPESV

SEQ ID NO: 269337 - protein, 6 aa, Mycobacterium
LGSDRH

SEQ ID NO: 269338 - protein, 20 aa, Mycobacterium
LGSEEGDSRSTGRGRERPPA

SEQ ID NO: 269339 - protein, 7 aa, Mycobacterium
LGSEPAV

SEQ ID NO: 269340 - protein, 7 aa, Mycobacterium
LGSERDE

SEQ ID NO: 269341 - protein, 14 aa, Mycobacterium
LGSEVQGEAPSTGA

SEQ ID NO: 269342 - protein, 9 aa, Mycobacterium
LGSEVYSGA

SEQ ID NO: 269343 - protein, 6 aa, Mycobacterium
LGSGAR

SEQ ID NO: 269344 - protein, 11 aa, Mycobacterium
LGSGATEAEGI

SEQ ID NO: 269345 - protein, 7 aa, Mycobacterium
LGSGLNE

SEQ ID NO: 269346 - protein, 11 aa, Mycobacterium
LGSGNGGAAGG

SEQ ID NO: 269347 - protein, 22 aa, Mycobacterium
LGSGRTAAAAENPRAEAPASTV

SEQ ID NO: 269348 - protein, 20 aa, Mycobacterium
LGSGYGGYNEDHEFFGRHQT

SEQ ID NO: 269349 - protein, 4 aa, Mycobacterium
LGSN

SEQ ID NO: 269350 - protein, 7 aa, Mycobacterium
LGSPAFA

SEQ ID NO: 269351 - protein, 8 aa, Mycobacterium
LGSPGGLR

SEQ ID NO: 269352 - protein, 5 aa, Mycobacterium
LGSPP

SEQ ID NO: 269353 - protein, 8 aa, Mycobacterium
LGSPQDAP

SEQ ID NO: 269354 - protein, 29 aa, Mycobacterium
LGSRAAGALPKGPLPNAGKMRGVQRTVRR

SEQ ID NO: 269355 - protein, 11 aa, Mycobacterium
LGSRTMREETD

SEQ ID NO: 269356 - protein, 12 aa, Mycobacterium
LGSRVGSVESSS

SEQ ID NO: 269357 - protein, 5 aa, Mycobacterium
LGSSA

SEQ ID NO: 269358 - protein, 12 aa, Mycobacterium
LGSSEDDSTPAF

SEQ ID NO: 269359 - protein, 12 aa, Mycobacterium
LGSSEEDSTPAF

SEQ ID NO: 269360 - protein, 7 aa, Mycobacterium
LGSSGGV

SEQ ID NO: 269361 - protein, 13 aa, Mycobacterium
LGSSLTTHTAANG

SEQ ID NO: 269362 - protein, 9 aa, Mycobacterium
LGSSPIAPV

SEQ ID NO: 269363 - protein, 7 aa, Mycobacterium
LGSSPRE

SEQ ID NO: 269364 - protein, 9 aa, Mycobacterium
LGSSRRTHT

SEQ ID NO: 269365 - protein, 10 aa, Mycobacterium
LGSSRSPRYA

SEQ ID NO: 269366 - protein, 6 aa, Mycobacterium
LGSSST

SEQ ID NO: 269367 - protein, 7 aa, Mycobacterium
LGSSTAI

SEQ ID NO: 269368 - protein, 7 aa, Mycobacterium
LGSSTTV

SEQ ID NO: 269369 - protein, 4 aa, Mycobacterium
LGST

SEQ ID NO: 269370 - protein, 11 aa, Mycobacterium
LGSTAGASADL

SEQ ID NO: 269371 - protein, 13 aa, Mycobacterium
LGSTGTTKTGATA

SEQ ID NO: 269372 - protein, 12 aa, Mycobacterium
LGSTRRTAPPGS

SEQ ID NO: 269373 - protein, 5 aa, Mycobacterium
LGTAA

SEQ ID NO: 269374 - protein, 5 aa, Mycobacterium
LGTAT

SEQ ID NO: 269375 - protein, 4 aa, Mycobacterium
LGTD

SEQ ID NO: 269376 - protein, 9 aa, Mycobacterium
LGTDPDAVA

SEQ ID NO: 269377 - protein, 13 aa, Mycobacterium
LGTDTRTPIPVDT

SEQ ID NO: 269378 - protein, 11 aa, Mycobacterium
LGTEIRDNSIN

SEQ ID NO: 269379 - protein, 8 aa, Mycobacterium
LGTERTDA

SEQ ID NO: 269380 - protein, 6 aa, Mycobacterium
LGTGAA

SEQ ID NO: 269381 - protein, 6 aa, Mycobacterium
LGTGAI

SEQ ID NO: 269382 - protein, 12 aa, Mycobacterium
LGTGEDDATPAF

SEQ ID NO: 269383 - protein, 13 aa, Mycobacterium
LGTGEDDSTPAFD

SEQ ID NO: 269384 - protein, 6 aa, Mycobacterium
LGTGGM

SEQ ID NO: 269385 - protein, 9 aa, Mycobacterium
LGTGGQHGG

SEQ ID NO: 269386 - protein, 6 aa, Mycobacterium
LGTGRA

SEQ ID NO: 269387 - protein, 10 aa, Mycobacterium
LGTGRAPVGT

SEQ ID NO: 269388 - protein, 9 aa, Mycobacterium
LGTGSDGHS

SEQ ID NO: 269389 - protein, 12 aa, Mycobacterium
LGTIGSEKPVTP

SEQ ID NO: 269390 - protein, 13 aa, Mycobacterium
LGTNENADGTEGL

SEQ ID NO: 269391 - protein, 18 aa, Mycobacterium
LGTNPDKDEPSGSTDETL

SEQ ID NO: 269392 - protein, 18 aa, Mycobacterium
LGTNPDKEEPSGSTDETL

SEQ ID NO: 269393 - protein, 18 aa, Mycobacterium
LGTNPDSDEPSGSTDETL

SEQ ID NO: 269394 - protein, 13 aa, Mycobacterium
LGTPDDGSRFGDG

SEQ ID NO: 269395 - protein, 18 aa, Mycobacterium
LGTPEQKAAFRKATNRAH

SEQ ID NO: 269396 - protein, 7 aa, Mycobacterium
LGTPRAY

SEQ ID NO: 269397 - protein, 7 aa, Mycobacterium
LGTQNTS

SEQ ID NO: 269398 - protein, 9 aa, Mycobacterium
LGTQNTSQH

SEQ ID NO: 269399 - protein, 8 aa, Mycobacterium
LGTQNTTQ

SEQ ID NO: 269400 - protein, 10 aa, Mycobacterium
LGTQRRTNEE

SEQ ID NO: 269401 - protein, 18 aa, Mycobacterium
LGTQSADEFGSEEQSEAG

SEQ ID NO: 269402 - protein, 4 aa, Mycobacterium
LGTR

SEQ ID NO: 269403 - protein, 6 aa, Mycobacterium
LGTSGD

SEQ ID NO: 269404 - protein, 8 aa, Mycobacterium
LGTTETDV

SEQ ID NO: 269405 - protein, 8 aa, Mycobacterium
LGTTETEV

SEQ ID NO: 269406 - protein, 10 aa, Mycobacterium
LGTTQALETG

SEQ ID NO: 269407 - protein, 8 aa, Mycobacterium
LGTTSTDV

SEQ ID NO: 269408 - protein, 4 aa, Mycobacterium
LGTV

SEQ ID NO: 269409 - protein, 6 aa, Mycobacterium
LGVEPQ

SEQ ID NO: 269410 - protein, 10 aa, Mycobacterium
LGVTDEQTGL

SEQ ID NO: 269411 - protein, 19 aa, Mycobacterium
LGYSDRPGRARQSPEVGPP

SEQ ID NO: 269412 - protein, 5 aa, Mycobacterium
LHDGP

SEQ ID NO: 269413 - protein, 4 aa, Mycobacterium
LHPD

SEQ ID NO: 269414 - protein, 4 aa, Mycobacterium
LHPG

SEQ ID NO: 269415 - protein, 5 aa, Mycobacterium
LHPGS

SEQ ID NO: 269416 - protein, 4 aa, Mycobacterium
LHPN

SEQ ID NO: 269417 - protein, 23 aa, Mycobacterium
LHPTRGKDSQGEPLVGPETPGWQ

SEQ ID NO: 269418 - protein, 7 aa, Mycobacterium
LHQGSGP

SEQ ID NO: 269419 - protein, 13 aa, Mycobacterium
LHRDGSAPDVTGL

SEQ ID NO: 269420 - protein, 7 aa, Mycobacterium
LHSDTHD

SEQ ID NO: 269421 - protein, 5 aa, Mycobacterium
LHSGE

SEQ ID NO: 269422 - protein, 5 aa, Mycobacterium
LHSPS

SEQ ID NO: 269423 - protein, 4 aa, Mycobacterium
LHST

SEQ ID NO: 269424 - protein, 5 aa, Mycobacterium
LHTPT

SEQ ID NO: 269425 - protein, 8 aa, Mycobacterium
LHTPTPTE

SEQ ID NO: 269426 - protein, 4 aa, Mycobacterium
LIND

SEQ ID NO: 269427 - protein, 9 aa, Mycobacterium
LKAAAEKAG

SEQ ID NO: 269428 - protein, 8 aa, Mycobacterium
LKAADRKR

SEQ ID NO: 269429 - protein, 8 aa, Mycobacterium
LKAAREGK

SEQ ID NO: 269430 - protein, 11 aa, Mycobacterium
LKAQRDSDRAA

SEQ ID NO: 269431 - protein, 14 aa, Mycobacterium
LKARAEAGDAAAAR

SEQ ID NO: 269432 - protein, 7 aa, Mycobacterium
LKASGPE

SEQ ID NO: 269433 - protein, 8 aa, Mycobacterium
LKASPKQT

SEQ ID NO: 269434 - protein, 8 aa, Mycobacterium
LKDEGADS

SEQ ID NO: 269435 - protein, 9 aa, Mycobacterium
LKDEGDSTH

SEQ ID NO: 269436 - protein, 7 aa, Mycobacterium
LKDGTEL

SEQ ID NO: 269437 - protein, 7 aa, Mycobacterium
LKDPATK

SEQ ID NO: 269438 - protein, 17 aa, Mycobacterium
LKDPGKSDADKAAAAKI

SEQ ID NO: 269439 - protein, 8 aa, Mycobacterium
LKDPQGCS

SEQ ID NO: 269440 - protein, 8 aa, Mycobacterium
LKDPRGRD

SEQ ID NO: 269441 - protein, 31 aa, Mycobacterium
LKDSAAAADRLSESTTAHSKAVESAKTEAER

SEQ ID NO: 269442 - protein, 6 aa, Mycobacterium
LKEGNA

SEQ ID NO: 269443 - protein, 4 aa, Mycobacterium
LKEK

SEQ ID NO: 269444 - protein, 9 aa, Mycobacterium
LKEKGYGTN

SEQ ID NO: 269445 - protein, 14 aa, Mycobacterium
LKENERLKRENRDH

SEQ ID NO: 269446 - protein, 7 aa, Mycobacterium
LKEPDRS

SEQ ID NO: 269447 - protein, 7 aa, Mycobacterium
LKEPERN

SEQ ID NO: 269448 - protein, 7 aa, Mycobacterium
LKEPREN

SEQ ID NO: 269449 - protein, 7 aa, Mycobacterium
LKEPTRT

SEQ ID NO: 269450 - protein, 8 aa, Mycobacterium
LKESGRYD

SEQ ID NO: 269451 - protein, 7 aa, Mycobacterium
LKEVSSD

SEQ ID NO: 269452 - protein, 10 aa, Mycobacterium
LKGDDDDSIL

SEQ ID NO: 269453 - protein, 9 aa, Mycobacterium
LKGDDDDTI

SEQ ID NO: 269454 - protein, 12 aa, Mycobacterium
LKGDGNGQGPVS

SEQ ID NO: 269455 - protein, 8 aa, Mycobacterium
LKGESGDL

SEQ ID NO: 269456 - protein, 5 aa, Mycobacterium
LKGGA

SEQ ID NO: 269457 - protein, 10 aa, Mycobacterium
LKGKENAPDG

SEQ ID NO: 269458 - protein, 8 aa, Mycobacterium
LKGSETVP

SEQ ID NO: 269459 - protein, 5 aa, Mycobacterium
LKGSG

SEQ ID NO: 269460 - protein, 17 aa, Mycobacterium
LKGTEVESFPKPTEIGG

SEQ ID NO: 269461 - protein, 9 aa, Mycobacterium
LKGTPLSNA

SEQ ID NO: 269462 - protein, 8 aa, Mycobacterium
LKMPRGKP

SEQ ID NO: 269463 - protein, 7 aa, Mycobacterium
LKPAQDW

SEQ ID NO: 269464 - protein, 7 aa, Mycobacterium
LKPGART

SEQ ID NO: 269465 - protein, 18 aa, Mycobacterium
LKPGASSLTSLPPPPSPP

SEQ ID NO: 269466 - protein, 7 aa, Mycobacterium
LKPGESV

SEQ ID NO: 269467 - protein, 6 aa, Mycobacterium
LKPGET

SEQ ID NO: 269468 - protein, 8 aa, Mycobacterium
LKPGPDWE

SEQ ID NO: 269469 - protein, 8 aa, Mycobacterium
LKPGRPLP

SEQ ID NO: 269470 - protein, 14 aa, Mycobacterium
LKPKGGPKEPPTVT

SEQ ID NO: 269471 - protein, 6 aa, Mycobacterium
LKPPPV

SEQ ID NO: 269472 - protein, 12 aa, Mycobacterium
LKPRDAGDFGTT

SEQ ID NO: 269473 - protein, 13 aa, Mycobacterium
LKPRDAGDFGTTE

SEQ ID NO: 269474 - protein, 13 aa, Mycobacterium
LKPRDGNDFGTTE

SEQ ID NO: 269475 - protein, 12 aa, Mycobacterium
LKPREGGDFGTT

SEQ ID NO: 269476 - protein, 6 aa, Mycobacterium
LKPRGR

SEQ ID NO: 269477 - protein, 13 aa, Mycobacterium
LKPRNDGDFGTTD

SEQ ID NO: 269478 - protein, 6 aa, Mycobacterium
LKPSDY

SEQ ID NO: 269479 - protein, 5 aa, Mycobacterium
LKPSQ

SEQ ID NO: 269480 - protein, 6 aa, Mycobacterium
LKQADD

SEQ ID NO: 269481 - protein, 8 aa, Mycobacterium
LKQGKSQL

SEQ ID NO: 269482 - protein, 13 aa, Mycobacterium
LKQPDTGAGADEG

SEQ ID NO: 269483 - protein, 15 aa, Mycobacterium
LKQRPARDPQPGGVG

SEQ ID NO: 269484 - protein, 10 aa, Mycobacterium
LKRAPQAQGR

SEQ ID NO: 269485 - protein, 7 aa, Mycobacterium
LKRERDA

SEQ ID NO: 269486 - protein, 4 aa, Mycobacterium
LKRN

SEQ ID NO: 269487 - protein, 16 aa, Mycobacterium
LKRPEPEVEPASPTKE

SEQ ID NO: 269488 - protein, 8 aa, Mycobacterium
LKSATSPQ

SEQ ID NO: 269489 - protein, 7 aa, Mycobacterium
LKSDTKH

SEQ ID NO: 269490 - protein, 6 aa, Mycobacterium
LKSGAE

SEQ ID NO: 269491 - protein, 12 aa, Mycobacterium
LKSGATEGEGTQ

SEQ ID NO: 269492 - protein, 10 aa, Mycobacterium
LKSPSDCANP

SEQ ID NO: 269493 - protein, 11 aa, Mycobacterium
LKSSTDPLTGL

SEQ ID NO: 269494 - protein, 8 aa, Mycobacterium
LKSSTGLT

SEQ ID NO: 269495 - protein, 4 aa, Mycobacterium
LKTA

SEQ ID NO: 269496 - protein, 15 aa, Mycobacterium
LKTAAKEAIKGTPLE

SEQ ID NO: 269497 - protein, 4 aa, Mycobacterium
LKTD

SEQ ID NO: 269498 - protein, 7 aa, Mycobacterium
LKTESKM

SEQ ID NO: 269499 - protein, 9 aa, Mycobacterium
LKTPSGEIT

SEQ ID NO: 269500 - protein, 7 aa, Mycobacterium
LLGPPQK

SEQ ID NO: 269501 - protein, 5 aa, Mycobacterium
LLGPS

SEQ ID NO: 269502 - protein, 6 aa, Mycobacterium
LLGPSG

SEQ ID NO: 269503 - protein, 6 aa, Mycobacterium
LLGSDT

SEQ ID NO: 269504 - protein, 6 aa, Mycobacterium
LLGSPA

SEQ ID NO: 269505 - protein, 5 aa, Mycobacterium
LLPDQ

SEQ ID NO: 269506 - protein, 5 aa, Mycobacterium
LLPER

SEQ ID NO: 269507 - protein, 4 aa, Mycobacterium
LLPP

SEQ ID NO: 269508 - protein, 5 aa, Mycobacterium
LLPPR

SEQ ID NO: 269509 - protein, 6 aa, Mycobacterium
LLPRTG

SEQ ID NO: 269510 - protein, 6 aa, Mycobacterium
LLSPSG

SEQ ID NO: 269511 - protein, 29 aa, Mycobacterium
LMPEGPEAPAAPGKTPAPGLPPLPVLPGQ

SEQ ID NO: 269512 - protein, 7 aa, Mycobacterium
LNADGPK

SEQ ID NO: 269513 - protein, 9 aa, Mycobacterium
LNALTGKTC

SEQ ID NO: 269514 - protein, 8 aa, Mycobacterium
LNANAGGG

SEQ ID NO: 269515 - protein, 24 aa, Mycobacterium
LNAPSSETESEGGDTAAAGATVKP

SEQ ID NO: 269516 - protein, 22 aa, Mycobacterium
LNAPSSSQTDSPSTATGSALEP

SEQ ID NO: 269517 - protein, 9 aa, Mycobacterium
LNAQTGSLS

SEQ ID NO: 269518 - protein, 10 aa, Mycobacterium
LNARGSTGDR

SEQ ID NO: 269519 - protein, 19 aa, Mycobacterium
LNDAAAAAAYEDEKPARQL

SEQ ID NO: 269520 - protein, 13 aa, Mycobacterium
LNDETVGEVSSGS

SEQ ID NO: 269521 - protein, 8 aa, Mycobacterium
LNDPDDDA

SEQ ID NO: 269522 - protein, 27 aa, Mycobacterium
LNDPDPLGESDLGDELSPDQEPAGRRS

SEQ ID NO: 269523 - protein, 5 aa, Mycobacterium
LNDQQ

SEQ ID NO: 269524 - protein, 11 aa, Mycobacterium
LNDTHGHGAGD

SEQ ID NO: 269525 - protein, 6 aa, Mycobacterium
LNDTKI

SEQ ID NO: 269526 - protein, 12 aa, Mycobacterium
LNDTRGHAAGDE

SEQ ID NO: 269527 - protein, 5 aa, Mycobacterium
LNEGR

SEQ ID NO: 269528 - protein, 11 aa, Mycobacterium
LNENTDRQADI

SEQ ID NO: 269529 - protein, 5 aa, Mycobacterium
LNEPA

SEQ ID NO: 269530 - protein, 6 aa, Mycobacterium
LNESEG

SEQ ID NO: 269531 - protein, 11 aa, Mycobacterium
LNGAGGETPQR

SEQ ID NO: 269532 - protein, 18 aa, Mycobacterium
LNGAQQTVTGGPVASQEA

SEQ ID NO: 269533 - protein, 10 aa, Mycobacterium
LNGNPAEREL

SEQ ID NO: 269534 - protein, 8 aa, Mycobacterium
LNGPGDYV

SEQ ID NO: 269535 - protein, 6 aa, Mycobacterium
LNGPTV

SEQ ID NO: 269536 - protein, 8 aa, Mycobacterium
LNGRGDLS

SEQ ID NO: 269537 - protein, 6 aa, Mycobacterium
LNGTGT

SEQ ID NO: 269538 - protein, 9 aa, Mycobacterium
LNKTASLKR

SEQ ID NO: 269539 - protein, 10 aa, Mycobacterium
LNKTTKTIGQ

SEQ ID NO: 269540 - protein, 13 aa, Mycobacterium
LNNGENASGASKA

SEQ ID NO: 269541 - protein, 9 aa, Mycobacterium
LNNKPDAAT

SEQ ID NO: 269542 - protein, 9 aa, Mycobacterium
LNNTPDAKT

SEQ ID NO: 269543 - protein, 5 aa, Mycobacterium
LNPDD

SEQ ID NO: 269544 - protein, 8 aa, Mycobacterium
LNPDDVNA

SEQ ID NO: 269545 - protein, 6 aa, Mycobacterium
LNPDEK

SEQ ID NO: 269546 - protein, 6 aa, Mycobacterium
LNPDEY

SEQ ID NO: 269547 - protein, 7 aa, Mycobacterium
LNPDNSV

SEQ ID NO: 269548 - protein, 6 aa, Mycobacterium
LNPDNT

SEQ ID NO: 269549 - protein, 8 aa, Mycobacterium
LNPDRERS

SEQ ID NO: 269550 - protein, 4 aa, Mycobacterium
LNPE

SEQ ID NO: 269551 - protein, 6 aa, Mycobacterium
LNPENV

SEQ ID NO: 269552 - protein, 4 aa, Mycobacterium
LNPG

SEQ ID NO: 269553 - protein, 5 aa, Mycobacterium
LNPGA

SEQ ID NO: 269554 - protein, 6 aa, Mycobacterium
LNPIPT

SEQ ID NO: 269555 - protein, 6 aa, Mycobacterium
LNPKKN

SEQ ID NO: 269556 - protein, 9 aa, Mycobacterium
LNPNDPRDW

SEQ ID NO: 269557 - protein, 9 aa, Mycobacterium
LNPNGAYTA

SEQ ID NO: 269558 - protein, 7 aa, Mycobacterium
LNPNGVT

SEQ ID NO: 269559 - protein, 10 aa, Mycobacterium
LNPPANRPLD

SEQ ID NO: 269560 - protein, 7 aa, Mycobacterium
LNPRRSP

SEQ ID NO: 269561 - protein, 7 aa, Mycobacterium
LNPSGVT

SEQ ID NO: 269562 - protein, 7 aa, Mycobacterium
LNPSRSP

SEQ ID NO: 269563 - protein, 5 aa, Mycobacterium
LNPWG

SEQ ID NO: 269564 - protein, 7 aa, Mycobacterium
LNPYGPE

SEQ ID NO: 269565 - protein, 7 aa, Mycobacterium
LNQRDAQ

SEQ ID NO: 269566 - protein, 9 aa, Mycobacterium
LNQSGGRKF

SEQ ID NO: 269567 - protein, 4 aa, Mycobacterium
LNRA

SEQ ID NO: 269568 - protein, 11 aa, Mycobacterium
LNRDGGKFSAT

SEQ ID NO: 269569 - protein, 6 aa, Mycobacterium
LNRDNS

SEQ ID NO: 269570 - protein, 5 aa, Mycobacterium
LNRGR

SEQ ID NO: 269571 - protein, 7 aa, Mycobacterium
LNRRDDA

SEQ ID NO: 269572 - protein, 5 aa, Mycobacterium
LNRRG

SEQ ID NO: 269573 - protein, 14 aa, Mycobacterium
LNRYGGAAGRGLDD

SEQ ID NO: 269574 - protein, 13 aa, Mycobacterium
LNSDGYTGGGGKA

SEQ ID NO: 269575 - protein, 10 aa, Mycobacterium
LNSETQQSSF

SEQ ID NO: 269576 - protein, 8 aa, Mycobacterium
LNSHTTPL

SEQ ID NO: 269577 - protein, 9 aa, Mycobacterium
LNSNRDSLA

SEQ ID NO: 269578 - protein, 9 aa, Mycobacterium
LNSNRDTLA

SEQ ID NO: 269579 - protein, 5 aa, Mycobacterium
LNSRE

SEQ ID NO: 269580 - protein, 14 aa, Mycobacterium
LNSTAQAAQDQLAA

SEQ ID NO: 269581 - protein, 4 aa, Mycobacterium
LNTD

SEQ ID NO: 269582 - protein, 15 aa, Mycobacterium
LNTESDTVCPGRNTP

SEQ ID NO: 269583 - protein, 6 aa, Mycobacterium
LNTGRA

SEQ ID NO: 269584 - protein, 14 aa, Mycobacterium
LNTGTSSAAMLVGM

SEQ ID NO: 269585 - protein, 12 aa, Mycobacterium
LNTNTNAALAAM

SEQ ID NO: 269586 - protein, 4 aa, Mycobacterium
LNTP

SEQ ID NO: 269587 - protein, 12 aa, Mycobacterium
LNTPEPRPRHER

SEQ ID NO: 269588 - protein, 34 aa, Mycobacterium
LNTQAAGDSGGAGSTDLAAREQTAREAGRKAEIS

SEQ ID NO: 269589 - protein, 26 aa, Mycobacterium
LNTQTSSASEASSAPAGSTVKPTKAT

SEQ ID NO: 269590 - protein, 7 aa, Mycobacterium
LNTRDEA

SEQ ID NO: 269591 - protein, 6 aa, Mycobacterium
LNTRNT

SEQ ID NO: 269592 - protein, 7 aa, Mycobacterium
LNTSDRT

SEQ ID NO: 269593 - protein, 8 aa, Mycobacterium
LNTSDRTY

SEQ ID NO: 269594 - protein, 7 aa, Mycobacterium
LNTSRTA

SEQ ID NO: 269595 - protein, 4 aa, Mycobacterium
LNVR

SEQ ID NO: 269596 - protein, 4 aa, Mycobacterium
LPAA

SEQ ID NO: 269597 - protein, 16 aa, Mycobacterium
LPAAEGNRASAAGSSL

SEQ ID NO: 269598 - protein, 16 aa, Mycobacterium
LPAAEPLDDHQGHDHV

SEQ ID NO: 269599 - protein, 17 aa, Mycobacterium
LPAAGDTGGQIEAGPVR

SEQ ID NO: 269600 - protein, 8 aa, Mycobacterium
LPAAGQRS

SEQ ID NO: 269601 - protein, 7 aa, Mycobacterium
LPAAPGA

SEQ ID NO: 269602 - protein, 13 aa, Mycobacterium
LPAAPSGAAVATT

SEQ ID NO: 269603 - protein, 11 aa, Mycobacterium
LPAASAATAAT

SEQ ID NO: 269604 - protein, 4 aa, Mycobacterium
LPAD

SEQ ID NO: 269605 - protein, 6 aa, Mycobacterium
LPADGA

SEQ ID NO: 269606 - protein, 5 aa, Mycobacterium
LPADK

SEQ ID NO: 269607 - protein, 5 aa, Mycobacterium
LPADL

SEQ ID NO: 269608 - protein, 5 aa, Mycobacterium
LPADM

SEQ ID NO: 269609 - protein, 14 aa, Mycobacterium
LPADPNPRKVASGE

SEQ ID NO: 269610 - protein, 17 aa, Mycobacterium
LPADPSPRKVPAGTPGA

SEQ ID NO: 269611 - protein, 23 aa, Mycobacterium
LPAEPALEGSHTDTPGTEDAPDA

SEQ ID NO: 269612 - protein, 9 aa, Mycobacterium
LPAEPDQDS

SEQ ID NO: 269613 - protein, 9 aa, Mycobacterium
LPAEPSSRL

SEQ ID NO: 269614 - protein, 8 aa, Mycobacterium
LPAERESG

SEQ ID NO: 269615 - protein, 6 aa, Mycobacterium
LPAERV

SEQ ID NO: 269616 - protein, 6 aa, Mycobacterium
LPAESV

SEQ ID NO: 269617 - protein, 14 aa, Mycobacterium
LPAGAAKADTDTTH

SEQ ID NO: 269618 - protein, 11 aa, Mycobacterium
LPAGAGRAGWP

SEQ ID NO: 269619 - protein, 12 aa, Mycobacterium
LPAGATASTELP

SEQ ID NO: 269620 - protein, 7 aa, Mycobacterium
LPAGEAT

SEQ ID NO: 269621 - protein, 5 aa, Mycobacterium
LPAGG

SEQ ID NO: 269622 - protein, 8 aa, Mycobacterium
LPAGGTSF

SEQ ID NO: 269623 - protein, 21 aa, Mycobacterium
LPAGISKAQAVSAARGRGENT

SEQ ID NO: 269624 - protein, 10 aa, Mycobacterium
LPAGPAAGVR

SEQ ID NO: 269625 - protein, 8 aa, Mycobacterium
LPAGPRPW

SEQ ID NO: 269626 - protein, 21 aa, Mycobacterium
LPAGQSREQAVETARARGDGQ

SEQ ID NO: 269627 - protein, 5 aa, Mycobacterium
LPAGS

SEQ ID NO: 269628 - protein, 21 aa, Mycobacterium
LPAGSTKEQAIEAARARGDTT

SEQ ID NO: 269629 - protein, 8 aa, Mycobacterium
LPAGSTTQ

SEQ ID NO: 269630 - protein, 18 aa, Mycobacterium
LPAGTLPAGGPYTQAGDK

SEQ ID NO: 269631 - protein, 19 aa, Mycobacterium
LPAGTLPDGGPFTEGGEKS

SEQ ID NO: 269632 - protein, 12 aa, Mycobacterium
LPAGTTKEQAVS

SEQ ID NO: 269633 - protein, 9 aa, Mycobacterium
LPANEGYAA

SEQ ID NO: 269634 - protein, 10 aa, Mycobacterium
LPANEGYSAA

SEQ ID NO: 269635 - protein, 9 aa, Mycobacterium
LPANTGYAA

SEQ ID NO: 269636 - protein, 4 aa, Mycobacterium
LPAP

SEQ ID NO: 269637 - protein, 9 aa, Mycobacterium
LPAPAPAHE

SEQ ID NO: 269638 - protein, 15 aa, Mycobacterium
LPAPAPGDDQPRTHP

SEQ ID NO: 269639 - protein, 17 aa, Mycobacterium
LPAPARPNPVALQPVPA

SEQ ID NO: 269640 - protein, 8 aa, Mycobacterium
LPAPEYQS

SEQ ID NO: 269641 - protein, 7 aa, Mycobacterium
LPAPGED

SEQ ID NO: 269642 - protein, 7 aa, Mycobacterium
LPAPGER

SEQ ID NO: 269643 - protein, 5 aa, Mycobacterium
LPAPI

SEQ ID NO: 269644 - protein, 8 aa, Mycobacterium
LPAPKPRR

SEQ ID NO: 269645 - protein, 15 aa, Mycobacterium
LPAPPLQPGIDCRTV

SEQ ID NO: 269646 - protein, 24 aa, Mycobacterium
LPAPPQPETGGTEQDPEDRATDAL

SEQ ID NO: 269647 - protein, 17 aa, Mycobacterium
LPAPQATAPPTQAPQTV

SEQ ID NO: 269648 - protein, 28 aa, Mycobacterium
LPAPQPEPAPQAAHQPATEDADNPGRLR

SEQ ID NO: 269649 - protein, 8 aa, Mycobacterium
LPAPRPIA

SEQ ID NO: 269650 - protein, 12 aa, Mycobacterium
LPAPRRAPEDEP

SEQ ID NO: 269651 - protein, 8 aa, Mycobacterium
LPAPVARK

SEQ ID NO: 269652 - protein, 7 aa, Mycobacterium
LPARSAR

SEQ ID NO: 269653 - protein, 10 aa, Mycobacterium
LPARSARNKV

SEQ ID NO: 269654 - protein, 4 aa, Mycobacterium
LPAS

SEQ ID NO: 269655 - protein, 11 aa, Mycobacterium
LPASAGGDSLA

SEQ ID NO: 269656 - protein, 12 aa, Mycobacterium
LPASASAHQVGD

SEQ ID NO: 269657 - protein, 12 aa, Mycobacterium
LPASASAHQVGN

SEQ ID NO: 269658 - protein, 11 aa, Mycobacterium
LPASASSRQVG

SEQ ID NO: 269659 - protein, 7 aa, Mycobacterium
LPASGTI

SEQ ID NO: 269660 - protein, 7 aa, Mycobacterium
LPASPKR

SEQ ID NO: 269661 - protein, 9 aa, Mycobacterium
LPASRNADL

SEQ ID NO: 269662 - protein, 12 aa, Mycobacterium
LPASSSARAVSD

SEQ ID NO: 269663 - protein, 5 aa, Mycobacterium
LPATA

SEQ ID NO: 269664 - protein, 5 aa, Mycobacterium
LPATQ

SEQ ID NO: 269665 - protein, 7 aa, Mycobacterium
LPATQVE

SEQ ID NO: 269666 - protein, 5 aa, Mycobacterium
LPATR

SEQ ID NO: 269667 - protein, 7 aa, Mycobacterium
LPATSTL

SEQ ID NO: 269668 - protein, 12 aa, Mycobacterium
LPAVKPDPKPLP

SEQ ID NO: 269669 - protein, 8 aa, Mycobacterium
LPDAGAAG

SEQ ID NO: 269670 - protein, 9 aa, Mycobacterium
LPDAGEPDV

SEQ ID NO: 269671 - protein, 8 aa, Mycobacterium
LPDAPTPR

SEQ ID NO: 269672 - protein, 12 aa, Mycobacterium
LPDARRYLKLRR

SEQ ID NO: 269673 - protein, 8 aa, Mycobacterium
LPDDAAAQ

SEQ ID NO: 269674 - protein, 17 aa, Mycobacterium
LPDDDGSSHTEPATSRP

SEQ ID NO: 269675 - protein, 7 aa, Mycobacterium
LPDDDPV

SEQ ID NO: 269676 - protein, 8 aa, Mycobacterium
LPDDDRIG

SEQ ID NO: 269677 - protein, 8 aa, Mycobacterium
LPDDQRKE

SEQ ID NO: 269678 - protein, 7 aa, Mycobacterium
LPDDSRP

SEQ ID NO: 269679 - protein, 8 aa, Mycobacterium
LPDDYDGP

SEQ ID NO: 269680 - protein, 8 aa, Mycobacterium
LPDEQRKE

SEQ ID NO: 269681 - protein, 14 aa, Mycobacterium
LPDERKRPTGREQA

SEQ ID NO: 269682 - protein, 13 aa, Mycobacterium
LPDERKRPTLNGR

SEQ ID NO: 269683 - protein, 4 aa, Mycobacterium
LPDG

SEQ ID NO: 269684 - protein, 5 aa, Mycobacterium
LPDGA

SEQ ID NO: 269685 - protein, 23 aa, Mycobacterium
LPDGADSVVGEAGSALSGGERQR

SEQ ID NO: 269686 - protein, 8 aa, Mycobacterium
LPDGADTV

SEQ ID NO: 269687 - protein, 8 aa, Mycobacterium
LPDGGNIG

SEQ ID NO: 269688 - protein, 15 aa, Mycobacterium
LPDGGTLDKEHTQPA

SEQ ID NO: 269689 - protein, 10 aa, Mycobacterium
LPDGSNALPD

SEQ ID NO: 269690 - protein, 5 aa, Mycobacterium
LPDGT

SEQ ID NO: 269691 - protein, 8 aa, Mycobacterium
LPDGTYSE

SEQ ID NO: 269692 - protein, 7 aa, Mycobacterium
LPDGWTS

SEQ ID NO: 269693 - protein, 17 aa, Mycobacterium
LPDHDDESATVPTVAGR

SEQ ID NO: 269694 - protein, 14 aa, Mycobacterium
LPDKRKGLTDPEAR

SEQ ID NO: 269695 - protein, 5 aa, Mycobacterium
LPDNY

SEQ ID NO: 269696 - protein, 7 aa, Mycobacterium
LPDPDLR

SEQ ID NO: 269697 - protein, 7 aa, Mycobacterium
LPDPDTP

SEQ ID NO: 269698 - protein, 8 aa, Mycobacterium
LPDPKDAQ

SEQ ID NO: 269699 - protein, 9 aa, Mycobacterium
LPDQETAAR

SEQ ID NO: 269700 - protein, 5 aa, Mycobacterium
LPDQP

SEQ ID NO: 269701 - protein, 5 aa, Mycobacterium
LPDRR

SEQ ID NO: 269702 - protein, 13 aa, Mycobacterium
LPDSARANIAPDG

SEQ ID NO: 269703 - protein, 13 aa, Mycobacterium
LPDSGGPRTSRTR

SEQ ID NO: 269704 - protein, 6 aa, Mycobacterium
LPDSVG

SEQ ID NO: 269705 - protein, 8 aa, Mycobacterium
LPDTDSVT

SEQ ID NO: 269706 - protein, 6 aa, Mycobacterium
LPDTDT

SEQ ID NO: 269707 - protein, 18 aa, Mycobacterium
LPDTDTVSLPATQTYSDG

SEQ ID NO: 269708 - protein, 4 aa, Mycobacterium
LPDV

SEQ ID NO: 269709 - protein, 9 aa, Mycobacterium
LPDVGDPDV

SEQ ID NO: 269710 - protein, 12 aa, Mycobacterium
LPDVPSKQYGGS

SEQ ID NO: 269711 - protein, 17 aa, Mycobacterium
LPEAPPPPRTPADGTYK

SEQ ID NO: 269712 - protein, 7 aa, Mycobacterium
LPEATPV

SEQ ID NO: 269713 - protein, 7 aa, Mycobacterium
LPEATRA

SEQ ID NO: 269714 - protein, 8 aa, Mycobacterium
LPEDQRKE

SEQ ID NO: 269715 - protein, 15 aa, Mycobacterium
LPEDSREKSDAYAES

SEQ ID NO: 269716 - protein, 5 aa, Mycobacterium
LPEDV

SEQ ID NO: 269717 - protein, 12 aa, Mycobacterium
LPEGGDTVLGRG

SEQ ID NO: 269718 - protein, 5 aa, Mycobacterium
LPEGK

SEQ ID NO: 269719 - protein, 6 aa, Mycobacterium
LPEGSD

SEQ ID NO: 269720 - protein, 10 aa, Mycobacterium
LPENAREITG

SEQ ID NO: 269721 - protein, 12 aa, Mycobacterium
LPENGPGSLAPM

SEQ ID NO: 269722 - protein, 32 aa, Mycobacterium
LPEPETLAPPPAAPPAPEAPVAPPAPAAPEIE

SEQ ID NO: 269723 - protein, 13 aa, Mycobacterium
LPEPHGNEDRREA

SEQ ID NO: 269724 - protein, 11 aa, Mycobacterium
LPEPKANNSDN

SEQ ID NO: 269725 - protein, 8 aa, Mycobacterium
LPEPRSPR

SEQ ID NO: 269726 - protein, 8 aa, Mycobacterium
LPEPRSSR

SEQ ID NO: 269727 - protein, 4 aa, Mycobacterium
LPEQ

SEQ ID NO: 269728 - protein, 5 aa, Mycobacterium
LPEQP

SEQ ID NO: 269729 - protein, 8 aa, Mycobacterium
LPERGTVA

SEQ ID NO: 269730 - protein, 5 aa, Mycobacterium
LPERL

SEQ ID NO: 269731 - protein, 5 aa, Mycobacterium
LPERS

SEQ ID NO: 269732 - protein, 4 aa, Mycobacterium
LPES

SEQ ID NO: 269733 - protein, 10 aa, Mycobacterium
LPESASARQV

SEQ ID NO: 269734 - protein, 14 aa, Mycobacterium
LPESGEPSGLEPAA

SEQ ID NO: 269735 - protein, 10 aa, Mycobacterium
LPESGGLIPE

SEQ ID NO: 269736 - protein, 9 aa, Mycobacterium
LPESGGLLP

SEQ ID NO: 269737 - protein, 10 aa, Mycobacterium
LPESGGLLPN

SEQ ID NO: 269738 - protein, 13 aa, Mycobacterium
LPESGPGSAAPLS

SEQ ID NO: 269739 - protein, 25 aa, Mycobacterium
LPESGTRSGFPPAERNASGEPVEPT

SEQ ID NO: 269740 - protein, 17 aa, Mycobacterium
LPESPRGARGEPTGNPA

SEQ ID NO: 269741 - protein, 13 aa, Mycobacterium
LPETASARQIGDE

SEQ ID NO: 269742 - protein, 27 aa, Mycobacterium
LPETGEPSGLAPAELDAAGQPAEPRSI

SEQ ID NO: 269743 - protein, 6 aa, Mycobacterium
LPETGS

SEQ ID NO: 269744 - protein, 7 aa, Mycobacterium
LPETPAY

SEQ ID NO: 269745 - protein, 4 aa, Mycobacterium
LPGA

SEQ ID NO: 269746 - protein, 7 aa, Mycobacterium
LPGAGDA

SEQ ID NO: 269747 - protein, 7 aa, Mycobacterium
LPGAPTV

SEQ ID NO: 269748 - protein, 5 aa, Mycobacterium
LPGAS

SEQ ID NO: 269749 - protein, 13 aa, Mycobacterium
LPGATAGTPDEAA

SEQ ID NO: 269750 - protein, 7 aa, Mycobacterium
LPGATGA

SEQ ID NO: 269751 - protein, 15 aa, Mycobacterium
LPGATVPVPEGTPGT

SEQ ID NO: 269752 - protein, 5 aa, Mycobacterium
LPGDQ

SEQ ID NO: 269753 - protein, 8 aa, Mycobacterium
LPGDQAAA

SEQ ID NO: 269754 - protein, 25 aa, Mycobacterium
LPGEGDYLDGNGTDTRNYGGGNGLP

SEQ ID NO: 269755 - protein, 8 aa, Mycobacterium
LPGESRRD

SEQ ID NO: 269756 - protein, 9 aa, Mycobacterium
LPGGAGAAQ

SEQ ID NO: 269757 - protein, 11 aa, Mycobacterium
LPGGAGNATRQ

SEQ ID NO: 269758 - protein, 9 aa, Mycobacterium
LPGGGSAGM

SEQ ID NO: 269759 - protein, 11 aa, Mycobacterium
LPGGGTPPSPT

SEQ ID NO: 269760 - protein, 8 aa, Mycobacterium
LPGGNTWN

SEQ ID NO: 269761 - protein, 12 aa, Mycobacterium
LPGGPALASLAG

SEQ ID NO: 269762 - protein, 9 aa, Mycobacterium
LPGGPDDAI

SEQ ID NO: 269763 - protein, 9 aa, Mycobacterium
LPGGQAHDA

SEQ ID NO: 269764 - protein, 6 aa, Mycobacterium
LPGGTL

SEQ ID NO: 269765 - protein, 6 aa, Mycobacterium
LPGGTY

SEQ ID NO: 269766 - protein, 5 aa, Mycobacterium
LPGHA

SEQ ID NO: 269767 - protein, 6 aa, Mycobacterium
LPGHSE

SEQ ID NO: 269768 - protein, 5 aa, Mycobacterium
LPGIG

SEQ ID NO: 269769 - protein, 22 aa, Mycobacterium
LPGKHGSTPRFGTDVTADDAVR

SEQ ID NO: 269770 - protein, 5 aa, Mycobacterium
LPGKQ

SEQ ID NO: 269771 - protein, 16 aa, Mycobacterium
LPGKRGGTPRFGTDTA

SEQ ID NO: 269772 - protein, 10 aa, Mycobacterium
LPGKRTESGF

SEQ ID NO: 269773 - protein, 4 aa, Mycobacterium
LPGL

SEQ ID NO: 269774 - protein, 5 aa, Mycobacterium
LPGLD

SEQ ID NO: 269775 - protein, 6 aa, Mycobacterium
LPGNGA

SEQ ID NO: 269776 - protein, 12 aa, Mycobacterium
LPGNGALPISQG

SEQ ID NO: 269777 - protein, 7 aa, Mycobacterium
LPGNGKS

SEQ ID NO: 269778 - protein, 6 aa, Mycobacterium
LPGNPL

SEQ ID NO: 269779 - protein, 5 aa, Mycobacterium
LPGPA

SEQ ID NO: 269780 - protein, 7 aa, Mycobacterium
LPGPAER

SEQ ID NO: 269781 - protein, 12 aa, Mycobacterium
LPGPAGDTGAGI

SEQ ID NO: 269782 - protein, 8 aa, Mycobacterium
LPGPDAGL

SEQ ID NO: 269783 - protein, 5 aa, Mycobacterium
LPGPG

SEQ ID NO: 269784 - protein, 8 aa, Mycobacterium
LPGPGFPD

SEQ ID NO: 269785 - protein, 8 aa, Mycobacterium
LPGPHSES

SEQ ID NO: 269786 - protein, 5 aa, Mycobacterium
LPGPQ

SEQ ID NO: 269787 - protein, 15 aa, Mycobacterium
LPGPRPPAPIEPTEQ

SEQ ID NO: 269788 - protein, 57 aa, Mycobacterium
LPGPTPPQYPSGPPPMENIDPSPPPPPPPPGPVEGPPSTGDPAKKHEPPPRYYEPPP

SEQ ID NO: 269789 - protein, 5 aa, Mycobacterium
LPGQD

SEQ ID NO: 269790 - protein, 14 aa, Mycobacterium
LPGQDGGDAAPPAE

SEQ ID NO: 269791 - protein, 9 aa, Mycobacterium
LPGQPASEV

SEQ ID NO: 269792 - protein, 6 aa, Mycobacterium
LPGQRV

SEQ ID NO: 269793 - protein, 5 aa, Mycobacterium
LPGQS

SEQ ID NO: 269794 - protein, 7 aa, Mycobacterium
LPGRDRR

SEQ ID NO: 269795 - protein, 8 aa, Mycobacterium
LPGRDRRE

SEQ ID NO: 269796 - protein, 9 aa, Mycobacterium
LPGRESAPR

SEQ ID NO: 269797 - protein, 12 aa, Mycobacterium
LPGRGSDTLVPP

SEQ ID NO: 269798 - protein, 6 aa, Mycobacterium
LPGRGV

SEQ ID NO: 269799 - protein, 7 aa, Mycobacterium
LPGRGVR

SEQ ID NO: 269800 - protein, 5 aa, Mycobacterium
LPGRQ

SEQ ID NO: 269801 - protein, 12 aa, Mycobacterium
LPGRRGGVPQFG

SEQ ID NO: 269802 - protein, 11 aa, Mycobacterium
LPGRRGNTPRF

SEQ ID NO: 269803 - protein, 5 aa, Mycobacterium
LPGRS

SEQ ID NO: 269804 - protein, 23 aa, Mycobacterium
LPGRVSPAELAATAATDDRTPTS

SEQ ID NO: 269805 - protein, 5 aa, Mycobacterium
LPGSA

SEQ ID NO: 269806 - protein, 8 aa, Mycobacterium
LPGSAPKP

SEQ ID NO: 269807 - protein, 7 aa, Mycobacterium
LPGSAPR

SEQ ID NO: 269808 - protein, 9 aa, Mycobacterium
LPGSAPRSE

SEQ ID NO: 269809 - protein, 13 aa, Mycobacterium
LPGSATKPLGARK

SEQ ID NO: 269810 - protein, 11 aa, Mycobacterium
LPGSGSLSRSA

SEQ ID NO: 269811 - protein, 5 aa, Mycobacterium
LPGSL

SEQ ID NO: 269812 - protein, 7 aa, Mycobacterium
LPGSPEF

SEQ ID NO: 269813 - protein, 9 aa, Mycobacterium
LPGSPGDQP

SEQ ID NO: 269814 - protein, 10 aa, Mycobacterium
LPGSPGYTYP

SEQ ID NO: 269815 - protein, 17 aa, Mycobacterium
LPGSTAAQSVAGPDTTQ

SEQ ID NO: 269816 - protein, 4 aa, Mycobacterium
LPGT

SEQ ID NO: 269817 - protein, 15 aa, Mycobacterium
LPGTASPATQVVPAG

SEQ ID NO: 269818 - protein, 12 aa, Mycobacterium
LPGTDPGAVSPN

SEQ ID NO: 269819 - protein, 7 aa, Mycobacterium
LPGTDRR

SEQ ID NO: 269820 - protein, 8 aa, Mycobacterium
LPGTDRRA

SEQ ID NO: 269821 - protein, 7 aa, Mycobacterium
LPGTGLP

SEQ ID NO: 269822 - protein, 26 aa, Mycobacterium
LPGTPGHVGRGDVSGRGIPSDSDATS

SEQ ID NO: 269823 - protein, 4 aa, Mycobacterium
LPGV

SEQ ID NO: 269824 - protein, 7 aa, Mycobacterium
LPGVPDA

SEQ ID NO: 269825 - protein, 5 aa, Mycobacterium
LPGVS

SEQ ID NO: 269826 - protein, 6 aa, Mycobacterium
LPGYGT

SEQ ID NO: 269827 - protein, 9 aa, Mycobacterium
LPGYKTSYN

SEQ ID NO: 269828 - protein, 6 aa, Mycobacterium
LPGYTS

SEQ ID NO: 269829 - protein, 13 aa, Mycobacterium
LPHGVQGAADPNF

SEQ ID NO: 269830 - protein, 8 aa, Mycobacterium
LPKPGFSN

SEQ ID NO: 269831 - protein, 5 aa, Mycobacterium
LPKPL

SEQ ID NO: 269832 - protein, 8 aa, Mycobacterium
LPKPPAER

SEQ ID NO: 269833 - protein, 7 aa, Mycobacterium
LPKPPGL

SEQ ID NO: 269834 - protein, 10 aa, Mycobacterium
LPKPPSPAAV

SEQ ID NO: 269835 - protein, 9 aa, Mycobacterium
LPKPPTERN

SEQ ID NO: 269836 - protein, 18 aa, Mycobacterium
LPKRRTAERLGLRRPGRP

SEQ ID NO: 269837 - protein, 12 aa, Mycobacterium
LPKSAGSHVSGH

SEQ ID NO: 269838 - protein, 17 aa, Mycobacterium
LPKTPAGSSATSPGTGK

SEQ ID NO: 269839 - protein, 11 aa, Mycobacterium
LPKTPPRTAPP

SEQ ID NO: 269840 - protein, 13 aa, Mycobacterium
LPKTPSRKAPPAF

SEQ ID NO: 269841 - protein, 10 aa, Mycobacterium
LPKTPSRKTA

SEQ ID NO: 269842 - protein, 11 aa, Mycobacterium
LPKTPSRKVPP

SEQ ID NO: 269843 - protein, 10 aa, Mycobacterium
LPLPRSAQGP

SEQ ID NO: 269844 - protein, 8 aa, Mycobacterium
LPLPRTRP

SEQ ID NO: 269845 - protein, 5 aa, Mycobacterium
LPMSS

SEQ ID NO: 269846 - protein, 10 aa, Mycobacterium
LPNDDDADRL

SEQ ID NO: 269847 - protein, 7 aa, Mycobacterium
LPNDDGL

SEQ ID NO: 269848 - protein, 11 aa, Mycobacterium
LPNDRQPIPQI

SEQ ID NO: 269849 - protein, 6 aa, Mycobacterium
LPNEGA

SEQ ID NO: 269850 - protein, 5 aa, Mycobacterium
LPNGD

SEQ ID NO: 269851 - protein, 6 aa, Mycobacterium
LPNGGI

SEQ ID NO: 269852 - protein, 11 aa, Mycobacterium
LPNGPSLSAYQ

SEQ ID NO: 269853 - protein, 7 aa, Mycobacterium
LPNMSPP

SEQ ID NO: 269854 - protein, 9 aa, Mycobacterium
LPNNSVPYT

SEQ ID NO: 269855 - protein, 5 aa, Mycobacterium
LPNNY

SEQ ID NO: 269856 - protein, 9 aa, Mycobacterium
LPNPAEPEH

SEQ ID NO: 269857 - protein, 11 aa, Mycobacterium
LPNPKENNSDN

SEQ ID NO: 269858 - protein, 6 aa, Mycobacterium
LPNRRS

SEQ ID NO: 269859 - protein, 8 aa, Mycobacterium
LPNTPGAG

SEQ ID NO: 269860 - protein, 8 aa, Mycobacterium
LPNTPGSC

SEQ ID NO: 269861 - protein, 4 aa, Mycobacterium
LPPA

SEQ ID NO: 269862 - protein, 17 aa, Mycobacterium
LPPAAPPAPPHPTEQRR

SEQ ID NO: 269863 - protein, 5 aa, Mycobacterium
LPPAD

SEQ ID NO: 269864 - protein, 13 aa, Mycobacterium
LPPAEAPTTEPRV

SEQ ID NO: 269865 - protein, 7 aa, Mycobacterium
LPPAEAQ

SEQ ID NO: 269866 - protein, 20 aa, Mycobacterium
LPPAKAEPGAEPNAAPASCP

SEQ ID NO: 269867 - protein, 26 aa, Mycobacterium
LPPALTGPPPPPGPGPSPGPAGQPLL

SEQ ID NO: 269868 - protein, 21 aa, Mycobacterium
LPPAPPPGAPRDPGPRPGSEP

SEQ ID NO: 269869 - protein, 36 aa, Mycobacterium
LPPAPPPSDQPPPDPNNPPPGAEPFVPPAPAAMTPT

SEQ ID NO: 269870 - protein, 11 aa, Mycobacterium
LPPARRGTTSV

SEQ ID NO: 269871 - protein, 15 aa, Mycobacterium
LPPDGTPGPPAPMKQ

SEQ ID NO: 269872 - protein, 17 aa, Mycobacterium
LPPDPNPAKIDAAAAGA

SEQ ID NO: 269873 - protein, 13 aa, Mycobacterium
LPPDPPPHPPPRS

SEQ ID NO: 269874 - protein, 9 aa, Mycobacterium
LPPDPVVPT

SEQ ID NO: 269875 - protein, 12 aa, Mycobacterium
LPPDPVVPTRDA

SEQ ID NO: 269876 - protein, 13 aa, Mycobacterium
LPPDPVVPTRDAG

SEQ ID NO: 269877 - protein, 7 aa, Mycobacterium
LPPDRRP

SEQ ID NO: 269878 - protein, 6 aa, Mycobacterium
LPPDSG

SEQ ID NO: 269879 - protein, 12 aa, Mycobacterium
LPPDTGKADRAG

SEQ ID NO: 269880 - protein, 6 aa, Mycobacterium
LPPDTP

SEQ ID NO: 269881 - protein, 12 aa, Mycobacterium
LPPDTPAATRDR

SEQ ID NO: 269882 - protein, 12 aa, Mycobacterium
LPPDTSAAERRA

SEQ ID NO: 269883 - protein, 12 aa, Mycobacterium
LPPDTSADNRRR

SEQ ID NO: 269884 - protein, 12 aa, Mycobacterium
LPPDTSKADRDQ

SEQ ID NO: 269885 - protein, 12 aa, Mycobacterium
LPPDTSKADRGR

SEQ ID NO: 269886 - protein, 12 aa, Mycobacterium
LPPDTSKAERAQ

SEQ ID NO: 269887 - protein, 12 aa, Mycobacterium
LPPDTSKEERAR

SEQ ID NO: 269888 - protein, 12 aa, Mycobacterium
LPPDTSKQDRAQ

SEQ ID NO: 269889 - protein, 12 aa, Mycobacterium
LPPDTSKSDRAK

SEQ ID NO: 269890 - protein, 12 aa, Mycobacterium
LPPDTSRADREE

SEQ ID NO: 269891 - protein, 12 aa, Mycobacterium
LPPDTSSADRAK

SEQ ID NO: 269892 - protein, 12 aa, Mycobacterium
LPPDTTKADREQ

SEQ ID NO: 269893 - protein, 13 aa, Mycobacterium
LPPDTTKEDREQV

SEQ ID NO: 269894 - protein, 5 aa, Mycobacterium
LPPEA

SEQ ID NO: 269895 - protein, 12 aa, Mycobacterium
LPPEASAEQRER

SEQ ID NO: 269896 - protein, 6 aa, Mycobacterium
LPPEES

SEQ ID NO: 269897 - protein, 6 aa, Mycobacterium
LPPEGG

SEQ ID NO: 269898 - protein, 21 aa, Mycobacterium
LPPEKATDTPLRPGTSVPAQD

SEQ ID NO: 269899 - protein, 7 aa, Mycobacterium
LPPEQAR

SEQ ID NO: 269900 - protein, 6 aa, Mycobacterium
LPPEQR

SEQ ID NO: 269901 - protein, 19 aa, Mycobacterium
LPPEQRKEITEDTMRTQSR

SEQ ID NO: 269902 - protein, 6 aa, Mycobacterium
LPPERR

SEQ ID NO: 269903 - protein, 5 aa, Mycobacterium
LPPGA

SEQ ID NO: 269904 - protein, 43 aa, Mycobacterium
LPPGAGPPPAPAGPPMDGPPMEGPPMEGPPPGQAPAGAPPPGP

SEQ ID NO: 269905 - protein, 8 aa, Mycobacterium
LPPGAPGS

SEQ ID NO: 269906 - protein, 6 aa, Mycobacterium
LPPGDR

SEQ ID NO: 269907 - protein, 10 aa, Mycobacterium
LPPGEPVGPQ

SEQ ID NO: 269908 - protein, 7 aa, Mycobacterium
LPPGFDS

SEQ ID NO: 269909 - protein, 6 aa, Mycobacterium
LPPGFS

SEQ ID NO: 269910 - protein, 9 aa, Mycobacterium
LPPGFSDPT

SEQ ID NO: 269911 - protein, 8 aa, Mycobacterium
LPPGGAPR

SEQ ID NO: 269912 - protein, 11 aa, Mycobacterium
LPPGGMDAGKN

SEQ ID NO: 269913 - protein, 8 aa, Mycobacterium
LPPGGTVV

SEQ ID NO: 269914 - protein, 5 aa, Mycobacterium
LPPGP

SEQ ID NO: 269915 - protein, 5 aa, Mycobacterium
LPPGQ

SEQ ID NO: 269916 - protein, 15 aa, Mycobacterium
LPPGRSAPDGDEIAS

SEQ ID NO: 269917 - protein, 5 aa, Mycobacterium
LPPGS

SEQ ID NO: 269918 - protein, 7 aa, Mycobacterium
LPPGSRI

SEQ ID NO: 269919 - protein, 6 aa, Mycobacterium
LPPGST

SEQ ID NO: 269920 - protein, 114 aa, Mycobacterium
LPPGTAGSNWASNEPVAPPSPYQAEPAAGGRHSGTPSRHQAPAAAENTGGGHWAPEPSYPPPPAPEQPNYPESSGGHRAPETEPEEKRGKRRAPEPEESEETRGRRRAEDTGGF

SEQ ID NO: 269921 - protein, 6 aa, Mycobacterium
LPPGTP

SEQ ID NO: 269922 - protein, 7 aa, Mycobacterium
LPPGTRT

SEQ ID NO: 269923 - protein, 18 aa, Mycobacterium
LPPGWKPGSKAAPAPTLP

SEQ ID NO: 269924 - protein, 18 aa, Mycobacterium
LPPGWKPGSKAAPEPQLP

SEQ ID NO: 269925 - protein, 17 aa, Mycobacterium
LPPGWKPGSKAVAAPTL

SEQ ID NO: 269926 - protein, 16 aa, Mycobacterium
LPPGWKPGSKTAPTPV

SEQ ID NO: 269927 - protein, 16 aa, Mycobacterium
LPPGWKPGSLAAPPPV

SEQ ID NO: 269928 - protein, 17 aa, Mycobacterium
LPPGWKPGSRAVAAPTL

SEQ ID NO: 269929 - protein, 11 aa, Mycobacterium
LPPIPPPPVLP

SEQ ID NO: 269930 - protein, 31 aa, Mycobacterium
LPPNDPKTTSSSAATTTTAPPPVPSSPIKPV

SEQ ID NO: 269931 - protein, 23 aa, Mycobacterium
LPPNPNPRRAGGGSTAQANVGGG

SEQ ID NO: 269932 - protein, 7 aa, Mycobacterium
LPPPGPY

SEQ ID NO: 269933 - protein, 11 aa, Mycobacterium
LPPPGSAARPA

SEQ ID NO: 269934 - protein, 7 aa, Mycobacterium
LPPPPLP

SEQ ID NO: 269935 - protein, 15 aa, Mycobacterium
LPPPPPEPGTNCREV

SEQ ID NO: 269936 - protein, 9 aa, Mycobacterium
LPPPPPKPI

SEQ ID NO: 269937 - protein, 86 aa, Mycobacterium
LPPPPPKPIKAKKPKKAKKGGLRRKKGEEADEAGEADEADSADEAGEAEEADAVTEAEASEPDETDAATDAAAEAAPDEPAETEVA

SEQ ID NO: 269938 - protein, 103 aa, Mycobacterium
LPPPPPKPIKEKKPKTRRLRRKKGAEADEAEDTEADEVDDAEAAEATEAVEAEDTEEAAETAETEQPETVTAEAPEATEEPPAEETAEAGEETEHTEAAQARL

SEQ ID NO: 269939 - protein, 105 aa, Mycobacterium
LPPPPPKPLKATKRTGRGRKGDGSEDSADVEGSEGEVLESERTDGVTDADVDTGENGVKAEDAPAAVSDADDADDADGKLRNRRPTGKGTGLGRRKRTRGGVAVE

SEQ ID NO: 269940 - protein, 121 aa, Mycobacterium
LPPPPPKPLKPKATKQRRIRRKKPAETEEAETEEGEAEEGEAEEEAEAAETTEAETPATEDEPAEPETPEPTAEVEPEVTAEEAPATEETEETKEPEELEETEETKEPEETEAAEEPRSAI

SEQ ID NO: 269941 - protein, 14 aa, Mycobacterium
LPPPPPKPVKPKVN

SEQ ID NO: 269942 - protein, 21 aa, Mycobacterium
LPPPPPPPPPDGASWHPRATP

SEQ ID NO: 269943 - protein, 59 aa, Mycobacterium
LPPPPPPPPPPPPPQFAATPPPGGAATYQGGYQPPPPPGWGPPPVPPGRPGGSGGSKGP

SEQ ID NO: 269944 - protein, 69 aa, Mycobacterium
LPPPPPPPSSSEQPPATTTTTAPPTTTTTTTTAPPTTTTTTPPPTTTTAPPTTTSQATTTEAPPTTTRR

SEQ ID NO: 269945 - protein, 6 aa, Mycobacterium
LPPPPR

SEQ ID NO: 269946 - protein, 17 aa, Mycobacterium
LPPPPSRCEANATAPIP

SEQ ID NO: 269947 - protein, 15 aa, Mycobacterium
LPPPPSSARIPLPGG

SEQ ID NO: 269948 - protein, 6 aa, Mycobacterium
LPPPPT

SEQ ID NO: 269949 - protein, 9 aa, Mycobacterium
LPPPSPDRP

SEQ ID NO: 269950 - protein, 12 aa, Mycobacterium
LPPPVQYPKRRR

SEQ ID NO: 269951 - protein, 4 aa, Mycobacterium
LPPQ

SEQ ID NO: 269952 - protein, 5 aa, Mycobacterium
LPPQA

SEQ ID NO: 269953 - protein, 5 aa, Mycobacterium
LPPQG

SEQ ID NO: 269954 - protein, 5 aa, Mycobacterium
LPPQP

SEQ ID NO: 269955 - protein, 9 aa, Mycobacterium
LPPQTSPGK

SEQ ID NO: 269956 - protein, 4 aa, Mycobacterium
LPPR

SEQ ID NO: 269957 - protein, 4 aa, Mycobacterium
LPPS

SEQ ID NO: 269958 - protein, 7 aa, Mycobacterium
LPPSASA

SEQ ID NO: 269959 - protein, 12 aa, Mycobacterium
LPPSASSHRVGD

SEQ ID NO: 269960 - protein, 23 aa, Mycobacterium
LPPSDDPHSRGMAPPPPEGPKSP

SEQ ID NO: 269961 - protein, 5 aa, Mycobacterium
LPPSE

SEQ ID NO: 269962 - protein, 12 aa, Mycobacterium
LPPSGSKPISSE

SEQ ID NO: 269963 - protein, 7 aa, Mycobacterium
LPPSPGL

SEQ ID NO: 269964 - protein, 6 aa, Mycobacterium
LPPSRG

SEQ ID NO: 269965 - protein, 4 aa, Mycobacterium
LPPT

SEQ ID NO: 269966 - protein, 8 aa, Mycobacterium
LPPTGASD

SEQ ID NO: 269967 - protein, 8 aa, Mycobacterium
LPPTHSRS

SEQ ID NO: 269968 - protein, 5 aa, Mycobacterium
LPPTI

SEQ ID NO: 269969 - protein, 4 aa, Mycobacterium
LPPV

SEQ ID NO: 269970 - protein, 5 aa, Mycobacterium
LPPVE

SEQ ID NO: 269971 - protein, 17 aa, Mycobacterium
LPPVQPVSSSSVSAPSS

SEQ ID NO: 269972 - protein, 5 aa, Mycobacterium
LPPWT

SEQ ID NO: 269973 - protein, 13 aa, Mycobacterium
LPPYGSSARPPMA

SEQ ID NO: 269974 - protein, 15 aa, Mycobacterium
LPQAAGGQASGPGMW

SEQ ID NO: 269975 - protein, 41 aa, Mycobacterium
LPQDETSPESAEPARNAAPGRPLASARQAELPPRRAQVDPA

SEQ ID NO: 269976 - protein, 13 aa, Mycobacterium
LPQEEPVDGDGAP

SEQ ID NO: 269977 - protein, 41 aa, Mycobacterium
LPQESPQEAEESEPAQSGNRSLTPSRRPELPPRRAQVDPAA

SEQ ID NO: 269978 - protein, 4 aa, Mycobacterium
LPQG

SEQ ID NO: 269979 - protein, 6 aa, Mycobacterium
LPQGDE

SEQ ID NO: 269980 - protein, 6 aa, Mycobacterium
LPQGTL

SEQ ID NO: 269981 - protein, 4 aa, Mycobacterium
LPQI

SEQ ID NO: 269982 - protein, 11 aa, Mycobacterium
LPQLKPGTIPE

SEQ ID NO: 269983 - protein, 4 aa, Mycobacterium
LPQP

SEQ ID NO: 269984 - protein, 8 aa, Mycobacterium
LPQPAQDP

SEQ ID NO: 269985 - protein, 6 aa, Mycobacterium
LPQPEW

SEQ ID NO: 269986 - protein, 12 aa, Mycobacterium
LPQPGDLPNDGN

SEQ ID NO: 269987 - protein, 20 aa, Mycobacterium
LPQPGTTAPPIPADVQPKGV

SEQ ID NO: 269988 - protein, 12 aa, Mycobacterium
LPQPPSVPAPAI

SEQ ID NO: 269989 - protein, 13 aa, Mycobacterium
LPQSASARQIGDE

SEQ ID NO: 269990 - protein, 8 aa, Mycobacterium
LPQSDAPA

SEQ ID NO: 269991 - protein, 11 aa, Mycobacterium
LPQSPSGSHAS

SEQ ID NO: 269992 - protein, 9 aa, Mycobacterium
LPQSTLEAA

SEQ ID NO: 269993 - protein, 6 aa, Mycobacterium
LPQTAA

SEQ ID NO: 269994 - protein, 5 aa, Mycobacterium
LPQTL

SEQ ID NO: 269995 - protein, 6 aa, Mycobacterium
LPRDAK

SEQ ID NO: 269996 - protein, 10 aa, Mycobacterium
LPRELGGSNP

SEQ ID NO: 269997 - protein, 4 aa, Mycobacterium
LPRG

SEQ ID NO: 269998 - protein, 11 aa, Mycobacterium
LPRGQSEAAAS

SEQ ID NO: 269999 - protein, 6 aa, Mycobacterium
LPRGTD

SEQ ID NO: 270000 - protein, 23 aa, Mycobacterium
LPRPAEAPRAASPQLPAPLPAAS

SEQ ID NO: 270001 - protein, 6 aa, Mycobacterium
LPRPAL

SEQ ID NO: 270002 - protein, 6 aa, Mycobacterium
LPRPET

SEQ ID NO: 270003 - protein, 10 aa, Mycobacterium
LPRPGESSAS

SEQ ID NO: 270004 - protein, 8 aa, Mycobacterium
LPRPGFPD

SEQ ID NO: 270005 - protein, 26 aa, Mycobacterium
LPRPGGPDAPTEQIRARRPDAAPTER

SEQ ID NO: 270006 - protein, 6 aa, Mycobacterium
LPRPGR

SEQ ID NO: 270007 - protein, 8 aa, Mycobacterium
LPRPGTSF

SEQ ID NO: 270008 - protein, 9 aa, Mycobacterium
LPRPPHSRL

SEQ ID NO: 270009 - protein, 7 aa, Mycobacterium
LPRPPTL

SEQ ID NO: 270010 - protein, 9 aa, Mycobacterium
LPRPPTLSN

SEQ ID NO: 270011 - protein, 19 aa, Mycobacterium
LPRPQPPSHPPGPVAAGPF

SEQ ID NO: 270012 - protein, 19 aa, Mycobacterium
LPRPRSPARPIPAEVQPKG

SEQ ID NO: 270013 - protein, 4 aa, Mycobacterium
LPRQ

SEQ ID NO: 270014 - protein, 4 aa, Mycobacterium
LPRR

SEQ ID NO: 270015 - protein, 15 aa, Mycobacterium
LPRRARAQRRLLKRY

SEQ ID NO: 270016 - protein, 6 aa, Mycobacterium
LPRRAS

SEQ ID NO: 270017 - protein, 13 aa, Mycobacterium
LPRRASGRIERDA

SEQ ID NO: 270018 - protein, 13 aa, Mycobacterium
LPRRATTDQLDTA

SEQ ID NO: 270019 - protein, 38 aa, Mycobacterium
LPRRPDRPGARSGQQGAGQRYAGQRHSGRVRALEGQRY

SEQ ID NO: 270020 - protein, 14 aa, Mycobacterium
LPRRPSGRIERPAA

SEQ ID NO: 270021 - protein, 12 aa, Mycobacterium
LPRSASAHQVGD

SEQ ID NO: 270022 - protein, 11 aa, Mycobacterium
LPRSGTKRPWN

SEQ ID NO: 270023 - protein, 9 aa, Mycobacterium
LPRSTSGRA

SEQ ID NO: 270024 - protein, 8 aa, Mycobacterium
LPRSVPAR

SEQ ID NO: 270025 - protein, 12 aa, Mycobacterium
LPRTASAHQVGD

SEQ ID NO: 270026 - protein, 9 aa, Mycobacterium
LPRTKTPVE

SEQ ID NO: 270027 - protein, 26 aa, Mycobacterium
LPRTPDGASTLGADSNHLPGQLPGVP

SEQ ID NO: 270028 - protein, 12 aa, Mycobacterium
LPRTTSTTSAAG

SEQ ID NO: 270029 - protein, 8 aa, Mycobacterium
LPRVDGGP

SEQ ID NO: 270030 - protein, 8 aa, Mycobacterium
LPSAESNF

SEQ ID NO: 270031 - protein, 11 aa, Mycobacterium
LPSAGAPGDPV

SEQ ID NO: 270032 - protein, 6 aa, Mycobacterium
LPSAGP

SEQ ID NO: 270033 - protein, 5 aa, Mycobacterium
LPSAP

SEQ ID NO: 270034 - protein, 6 aa, Mycobacterium
LPSAPA

SEQ ID NO: 270035 - protein, 19 aa, Mycobacterium
LPSASAEPNAEANSGAQEC

SEQ ID NO: 270036 - protein, 18 aa, Mycobacterium
LPSDPNPRKVPAGTPGAP

SEQ ID NO: 270037 - protein, 14 aa, Mycobacterium
LPSDRSAPEAAVVK

SEQ ID NO: 270038 - protein, 8 aa, Mycobacterium
LPSGKTGP

SEQ ID NO: 270039 - protein, 9 aa, Mycobacterium
LPSGNDPKA

SEQ ID NO: 270040 - protein, 7 aa, Mycobacterium
LPSGRYE

SEQ ID NO: 270041 - protein, 8 aa, Mycobacterium
LPSGSGLP

SEQ ID NO: 270042 - protein, 8 aa, Mycobacterium
LPSGSLDQ

SEQ ID NO: 270043 - protein, 7 aa, Mycobacterium
LPSGSQV

SEQ ID NO: 270044 - protein, 17 aa, Mycobacterium
LPSGSSQPESNTSRQAY

SEQ ID NO: 270045 - protein, 6 aa, Mycobacterium
LPSGTS

SEQ ID NO: 270046 - protein, 8 aa, Mycobacterium
LPSPGFPD

SEQ ID NO: 270047 - protein, 6 aa, Mycobacterium
LPSPGV

SEQ ID NO: 270048 - protein, 48 aa, Mycobacterium
LPSPVEEEEPAEPQPTSVPQAPTSAPAVPAEPSGPSGDPARPPVTATT

SEQ ID NO: 270049 - protein, 13 aa, Mycobacterium
LPSRGENPNAPEI

SEQ ID NO: 270050 - protein, 5 aa, Mycobacterium
LPSRV

SEQ ID NO: 270051 - protein, 8 aa, Mycobacterium
LPSSNAQK

SEQ ID NO: 270052 - protein, 8 aa, Mycobacterium
LPSSRHAD

SEQ ID NO: 270053 - protein, 12 aa, Mycobacterium
LPSSTPDRESAK

SEQ ID NO: 270054 - protein, 5 aa, Mycobacterium
LPSSV

SEQ ID NO: 270055 - protein, 15 aa, Mycobacterium
LPSTTPDPTTPGATD

SEQ ID NO: 270056 - protein, 4 aa, Mycobacterium
LPTA

SEQ ID NO: 270057 - protein, 9 aa, Mycobacterium
LPTAKEMNT

SEQ ID NO: 270058 - protein, 14 aa, Mycobacterium
LPTAPKEIPAIEPT

SEQ ID NO: 270059 - protein, 10 aa, Mycobacterium
LPTAPSPGFA

SEQ ID NO: 270060 - protein, 12 aa, Mycobacterium
LPTDTSKSDRAQ

SEQ ID NO: 270061 - protein, 5 aa, Mycobacterium
LPTEP

SEQ ID NO: 270062 - protein, 6 aa, Mycobacterium
LPTESY

SEQ ID NO: 270063 - protein, 14 aa, Mycobacterium
LPTGARFEVRLPLA

SEQ ID NO: 270064 - protein, 11 aa, Mycobacterium
LPTGKPDYRSL

SEQ ID NO: 270065 - protein, 5 aa, Mycobacterium
LPTGP

SEQ ID NO: 270066 - protein, 5 aa, Mycobacterium
LPTGQ

SEQ ID NO: 270067 - protein, 8 aa, Mycobacterium
LPTHPSSA

SEQ ID NO: 270068 - protein, 26 aa, Mycobacterium
LPTPAADEIRSAPTTSAETGTWTADR

SEQ ID NO: 270069 - protein, 7 aa, Mycobacterium
LPTPAGR

SEQ ID NO: 270070 - protein, 6 aa, Mycobacterium
LPTPHT

SEQ ID NO: 270071 - protein, 22 aa, Mycobacterium
LPTPKRATFRDKPEAGEPVTTR

SEQ ID NO: 270072 - protein, 14 aa, Mycobacterium
LPTPPNEQGPQPAP

SEQ ID NO: 270073 - protein, 14 aa, Mycobacterium
LPTPPWPTEGLSPA

SEQ ID NO: 270074 - protein, 6 aa, Mycobacterium
LPTPYG

SEQ ID NO: 270075 - protein, 4 aa, Mycobacterium
LPTQ

SEQ ID NO: 270076 - protein, 5 aa, Mycobacterium
LPTQE

SEQ ID NO: 270077 - protein, 4 aa, Mycobacterium
LPTR

SEQ ID NO: 270078 - protein, 11 aa, Mycobacterium
LPTRPGTAAGV

SEQ ID NO: 270079 - protein, 8 aa, Mycobacterium
LPTRRQRR

SEQ ID NO: 270080 - protein, 12 aa, Mycobacterium
LPTRTSGKVDRD

SEQ ID NO: 270081 - protein, 9 aa, Mycobacterium
LPTSGGLYP

SEQ ID NO: 270082 - protein, 6 aa, Mycobacterium
LPTTDV

SEQ ID NO: 270083 - protein, 5 aa, Mycobacterium
LPTTG

SEQ ID NO: 270084 - protein, 6 aa, Mycobacterium
LPTTGP

SEQ ID NO: 270085 - protein, 6 aa, Mycobacterium
LPTTKD

SEQ ID NO: 270086 - protein, 19 aa, Mycobacterium
LPVKSSGKIDVAALRELFD

SEQ ID NO: 270087 - protein, 6 aa, Mycobacterium
LPVPAG

SEQ ID NO: 270088 - protein, 7 aa, Mycobacterium
LPVPGKR

SEQ ID NO: 270089 - protein, 8 aa, Mycobacterium
LPVPPGQA

SEQ ID NO: 270090 - protein, 7 aa, Mycobacterium
LPVPSTR

SEQ ID NO: 270091 - protein, 15 aa, Mycobacterium
LQAAQDKGATNPNEA

SEQ ID NO: 270092 - protein, 10 aa, Mycobacterium
LQADPTARGP

SEQ ID NO: 270093 - protein, 6 aa, Mycobacterium
LQAEPV

SEQ ID NO: 270094 - protein, 5 aa, Mycobacterium
LQAER

SEQ ID NO: 270095 - protein, 8 aa, Mycobacterium
LQAQGAGG

SEQ ID NO: 270096 - protein, 13 aa, Mycobacterium
LQASGNNDQAAIQ

SEQ ID NO: 270097 - protein, 18 aa, Mycobacterium
LQASGNNDQAAIQSAQSR

SEQ ID NO: 270098 - protein, 9 aa, Mycobacterium
LQATHNSTA

SEQ ID NO: 270099 - protein, 7 aa, Mycobacterium
LQATPDV

SEQ ID NO: 270100 - protein, 9 aa, Mycobacterium
LQAVTGKTC

SEQ ID NO: 270101 - protein, 9 aa, Mycobacterium
LQDASERLR

SEQ ID NO: 270102 - protein, 10 aa, Mycobacterium
LQDATSTFEQ

SEQ ID NO: 270103 - protein, 7 aa, Mycobacterium
LQDDPDD

SEQ ID NO: 270104 - protein, 8 aa, Mycobacterium
LQDPHGNA

SEQ ID NO: 270105 - protein, 24 aa, Mycobacterium
LQDPQSRDELTSDLERRKREAEEA

SEQ ID NO: 270106 - protein, 16 aa, Mycobacterium
LQDQQQLSSQDRQRID

SEQ ID NO: 270107 - protein, 5 aa, Mycobacterium
LQDRG

SEQ ID NO: 270108 - protein, 7 aa, Mycobacterium
LQDTPDD

SEQ ID NO: 270109 - protein, 6 aa, Mycobacterium
LQEAGR

SEQ ID NO: 270110 - protein, 7 aa, Mycobacterium
LQEAGRT

SEQ ID NO: 270111 - protein, 26 aa, Mycobacterium
LQEDAARRGVPVDPSSIPPQALNPDF

SEQ ID NO: 270112 - protein, 6 aa, Mycobacterium
LQEGAN

SEQ ID NO: 270113 - protein, 9 aa, Mycobacterium
LQEGASNNW

SEQ ID NO: 270114 - protein, 19 aa, Mycobacterium
LQEKGIDTYPVGSPPSHTV

SEQ ID NO: 270115 - protein, 16 aa, Mycobacterium
LQEKQQQSSQDRQRID

SEQ ID NO: 270116 - protein, 4 aa, Mycobacterium
LQER

SEQ ID NO: 270117 - protein, 6 aa, Mycobacterium
LQERQQ

SEQ ID NO: 270118 - protein, 18 aa, Mycobacterium
LQESPDKRTLKASTDRVR

SEQ ID NO: 270119 - protein, 4 aa, Mycobacterium
LQET

SEQ ID NO: 270120 - protein, 8 aa, Mycobacterium
LQETNRER

SEQ ID NO: 270121 - protein, 4 aa, Mycobacterium
LQGA

SEQ ID NO: 270122 - protein, 6 aa, Mycobacterium
LQGDEA

SEQ ID NO: 270123 - protein, 7 aa, Mycobacterium
LQGDQAS

SEQ ID NO: 270124 - protein, 8 aa, Mycobacterium
LQGDQGSI

SEQ ID NO: 270125 - protein, 7 aa, Mycobacterium
LQGDTAA

SEQ ID NO: 270126 - protein, 8 aa, Mycobacterium
LQGDTSSL

SEQ ID NO: 270127 - protein, 5 aa, Mycobacterium
LQGIG

SEQ ID NO: 270128 - protein, 6 aa, Mycobacterium
LQGIGG

SEQ ID NO: 270129 - protein, 9 aa, Mycobacterium
LQGKPADSL

SEQ ID NO: 270130 - protein, 6 aa, Mycobacterium
LQGNGV

SEQ ID NO: 270131 - protein, 12 aa, Mycobacterium
LQGNSGGPLIDT

SEQ ID NO: 270132 - protein, 9 aa, Mycobacterium
LQGRKRDDG

SEQ ID NO: 270133 - protein, 7 aa, Mycobacterium
LQGVGGG

SEQ ID NO: 270134 - protein, 7 aa, Mycobacterium
LQHPHAS

SEQ ID NO: 270135 - protein, 14 aa, Mycobacterium
LQKEYEQKFGPRNY

SEQ ID NO: 270136 - protein, 11 aa, Mycobacterium
LQNDADTIARA

SEQ ID NO: 270137 - protein, 11 aa, Mycobacterium
LQNDPATIARA

SEQ ID NO: 270138 - protein, 14 aa, Mycobacterium
LQNDPATIQRAENV

SEQ ID NO: 270139 - protein, 11 aa, Mycobacterium
LQNGESPATDW

SEQ ID NO: 270140 - protein, 17 aa, Mycobacterium
LQNSSRAAADSDSSSGF

SEQ ID NO: 270141 - protein, 6 aa, Mycobacterium
LQPDSV

SEQ ID NO: 270142 - protein, 6 aa, Mycobacterium
LQPEEP

SEQ ID NO: 270143 - protein, 7 aa, Mycobacterium
LQPEQRK

SEQ ID NO: 270144 - protein, 8 aa, Mycobacterium
LQPGDPDH

SEQ ID NO: 270145 - protein, 7 aa, Mycobacterium
LQPGNPV

SEQ ID NO: 270146 - protein, 6 aa, Mycobacterium
LQPGPV

SEQ ID NO: 270147 - protein, 6 aa, Mycobacterium
LQPGSL

SEQ ID NO: 270148 - protein, 24 aa, Mycobacterium
LQPGTPDSGPPRQGDNLERAAKKS

SEQ ID NO: 270149 - protein, 11 aa, Mycobacterium
LQPGTYARGGS

SEQ ID NO: 270150 - protein, 5 aa, Mycobacterium
LQPKD

SEQ ID NO: 270151 - protein, 4 aa, Mycobacterium
LQPM

SEQ ID NO: 270152 - protein, 9 aa, Mycobacterium
LQPPGSPVP

SEQ ID NO: 270153 - protein, 7 aa, Mycobacterium
LQPPPGV

SEQ ID NO: 270154 - protein, 20 aa, Mycobacterium
LQPPRVGAGPGELAAQGAVG

SEQ ID NO: 270155 - protein, 4 aa, Mycobacterium
LQPR

SEQ ID NO: 270156 - protein, 4 aa, Mycobacterium
LQPS

SEQ ID NO: 270157 - protein, 9 aa, Mycobacterium
LQPSDPRDW

SEQ ID NO: 270158 - protein, 13 aa, Mycobacterium
LQPSERGPSFPDN

SEQ ID NO: 270159 - protein, 9 aa, Mycobacterium
LQPTGNGAV

SEQ ID NO: 270160 - protein, 9 aa, Mycobacterium
LQQKPECDE

SEQ ID NO: 270161 - protein, 8 aa, Mycobacterium
LQQPLSNQ

SEQ ID NO: 270162 - protein, 5 aa, Mycobacterium
LQRDN

SEQ ID NO: 270163 - protein, 9 aa, Mycobacterium
LQRDSDDTI

SEQ ID NO: 270164 - protein, 26 aa, Mycobacterium
LQRGAAKMKKDTADEGKHTEAEVTGA

SEQ ID NO: 270165 - protein, 9 aa, Mycobacterium
LQRGDTRAA

SEQ ID NO: 270166 - protein, 7 aa, Mycobacterium
LQRGGKA

SEQ ID NO: 270167 - protein, 8 aa, Mycobacterium
LQRGQEAG

SEQ ID NO: 270168 - protein, 9 aa, Mycobacterium
LQRGQGAGF

SEQ ID NO: 270169 - protein, 15 aa, Mycobacterium
LQRNDPASRRHRATI

SEQ ID NO: 270170 - protein, 8 aa, Mycobacterium
LQRQDSSL

SEQ ID NO: 270171 - protein, 10 aa, Mycobacterium
LQRSSRDITE

SEQ ID NO: 270172 - protein, 4 aa, Mycobacterium
LQSA

SEQ ID NO: 270173 - protein, 10 aa, Mycobacterium
LQSAHDSASI

SEQ ID NO: 270174 - protein, 9 aa, Mycobacterium
LQSASERLR

SEQ ID NO: 270175 - protein, 8 aa, Mycobacterium
LQSGGAVA

SEQ ID NO: 270176 - protein, 9 aa, Mycobacterium
LQSKSAGRI

SEQ ID NO: 270177 - protein, 5 aa, Mycobacterium
LQSQG

SEQ ID NO: 270178 - protein, 7 aa, Mycobacterium
LQSSAQG

SEQ ID NO: 270179 - protein, 10 aa, Mycobacterium
LQSTQTDQTY

SEQ ID NO: 270180 - protein, 11 aa, Mycobacterium
LQSTQTDQTYD

SEQ ID NO: 270181 - protein, 20 aa, Mycobacterium
LQTDSTALHPPSAEARPVPA

SEQ ID NO: 270182 - protein, 13 aa, Mycobacterium
LQTETSREHTRAW

SEQ ID NO: 270183 - protein, 6 aa, Mycobacterium
LQTIGR

SEQ ID NO: 270184 - protein, 37 aa, Mycobacterium
LQTNGPAVPPRTAGAVTYPDQRNSSPGRGPTTPAPGW

SEQ ID NO: 270185 - protein, 11 aa, Mycobacterium
LQTPPGPPNAY

SEQ ID NO: 270186 - protein, 12 aa, Mycobacterium
LQTPPGPPNAYD

SEQ ID NO: 270187 - protein, 14 aa, Mycobacterium
LQTPPGPPNAYDEN

SEQ ID NO: 270188 - protein, 8 aa, Mycobacterium
LRADEPDL

SEQ ID NO: 270189 - protein, 9 aa, Mycobacterium
LRADRGDAH

SEQ ID NO: 270190 - protein, 4 aa, Mycobacterium
LRAG

SEQ ID NO: 270191 - protein, 5 aa, Mycobacterium
LRAGG

SEQ ID NO: 270192 - protein, 17 aa, Mycobacterium
LRAGRPTTLSATIGSEP

SEQ ID NO: 270193 - protein, 6 aa, Mycobacterium
LRAGSL

SEQ ID NO: 270194 - protein, 12 aa, Mycobacterium
LRANAAEGLPGD

SEQ ID NO: 270195 - protein, 8 aa, Mycobacterium
LRAQGAGR

SEQ ID NO: 270196 - protein, 6 aa, Mycobacterium
LRATQS

SEQ ID NO: 270197 - protein, 5 aa, Mycobacterium
LRATS

SEQ ID NO: 270198 - protein, 10 aa, Mycobacterium
LRDAESPNLA

SEQ ID NO: 270199 - protein, 9 aa, Mycobacterium
LRDDADLRD

SEQ ID NO: 270200 - protein, 9 aa, Mycobacterium
LRDDGELRD

SEQ ID NO: 270201 - protein, 6 aa, Mycobacterium
LRDDPE

SEQ ID NO: 270202 - protein, 6 aa, Mycobacterium
LRDGAN

SEQ ID NO: 270203 - protein, 32 aa, Mycobacterium
LRDGANREIDGARRSGDGFTVTGSDGARYDVQ

SEQ ID NO: 270204 - protein, 17 aa, Mycobacterium
LRDGAQQVATGNAELAG

SEQ ID NO: 270205 - protein, 6 aa, Mycobacterium
LRDGSA

SEQ ID NO: 270206 - protein, 19 aa, Mycobacterium
LRDGSTQIPSWTPQQRTEV

SEQ ID NO: 270207 - protein, 19 aa, Mycobacterium
LRDGSTQVPSWTPQQRTEV

SEQ ID NO: 270208 - protein, 7 aa, Mycobacterium
LRDPGRA

SEQ ID NO: 270209 - protein, 6 aa, Mycobacterium
LRDPLT

SEQ ID NO: 270210 - protein, 6 aa, Mycobacterium
LRDPSQ

SEQ ID NO: 270211 - protein, 8 aa, Mycobacterium
LRDPSRAA

SEQ ID NO: 270212 - protein, 8 aa, Mycobacterium
LRDPVTDT

SEQ ID NO: 270213 - protein, 10 aa, Mycobacterium
LRDREARRDK

SEQ ID NO: 270214 - protein, 8 aa, Mycobacterium
LRDSIDTN

SEQ ID NO: 270215 - protein, 16 aa, Mycobacterium
LREAAPRERAEDGSSR

SEQ ID NO: 270216 - protein, 5 aa, Mycobacterium
LREAS

SEQ ID NO: 270217 - protein, 7 aa, Mycobacterium
LREERGS

SEQ ID NO: 270218 - protein, 13 aa, Mycobacterium
LREPKPRQYAQPG

SEQ ID NO: 270219 - protein, 9 aa, Mycobacterium
LREQADAEV

SEQ ID NO: 270220 - protein, 11 aa, Mycobacterium
LREREAARRAY

SEQ ID NO: 270221 - protein, 20 aa, Mycobacterium
LRESSTAVSDEASETGAEVT

SEQ ID NO: 270222 - protein, 9 aa, Mycobacterium
LRETAAELR

SEQ ID NO: 270223 - protein, 8 aa, Mycobacterium
LRETPSVP

SEQ ID NO: 270224 - protein, 13 aa, Mycobacterium
LRGAATDGLPEGL

SEQ ID NO: 270225 - protein, 6 aa, Mycobacterium
LRGADQ

SEQ ID NO: 270226 - protein, 12 aa, Mycobacterium
LRGANGGSLDNP

SEQ ID NO: 270227 - protein, 4 aa, Mycobacterium
LRGD

SEQ ID NO: 270228 - protein, 7 aa, Mycobacterium
LRGDEYG

SEQ ID NO: 270229 - protein, 5 aa, Mycobacterium
LRGDN

SEQ ID NO: 270230 - protein, 5 aa, Mycobacterium
LRGEA

SEQ ID NO: 270231 - protein, 17 aa, Mycobacterium
LRGEDPDDPNSDQRAGE

SEQ ID NO: 270232 - protein, 8 aa, Mycobacterium
LRGEPDVP

SEQ ID NO: 270233 - protein, 8 aa, Mycobacterium
LRGEPRPL

SEQ ID NO: 270234 - protein, 6 aa, Mycobacterium
LRGETY

SEQ ID NO: 270235 - protein, 4 aa, Mycobacterium
LRGG

SEQ ID NO: 270236 - protein, 18 aa, Mycobacterium
LRGGAGKPAPKSDPKRRD

SEQ ID NO: 270237 - protein, 6 aa, Mycobacterium
LRGGDA

SEQ ID NO: 270238 - protein, 9 aa, Mycobacterium
LRGKATEVS

SEQ ID NO: 270239 - protein, 8 aa, Mycobacterium
LRGNPATE

SEQ ID NO: 270240 - protein, 6 aa, Mycobacterium
LRGNPD

SEQ ID NO: 270241 - protein, 9 aa, Mycobacterium
LRGNPGTEL

SEQ ID NO: 270242 - protein, 12 aa, Mycobacterium
LRGPAGAATAGA

SEQ ID NO: 270243 - protein, 20 aa, Mycobacterium
LRGPAGKLGAPVGDQAVDGD

SEQ ID NO: 270244 - protein, 10 aa, Mycobacterium
LRGPASHAQL

SEQ ID NO: 270245 - protein, 11 aa, Mycobacterium
LRGPATAALPS

SEQ ID NO: 270246 - protein, 10 aa, Mycobacterium
LRGPGSPLKS

SEQ ID NO: 270247 - protein, 12 aa, Mycobacterium
LRGPPSAPTAMA

SEQ ID NO: 270248 - protein, 5 aa, Mycobacterium
LRGPR

SEQ ID NO: 270249 - protein, 9 aa, Mycobacterium
LRGPSAAPL

SEQ ID NO: 270250 - protein, 6 aa, Mycobacterium
LRGRSD

SEQ ID NO: 270251 - protein, 14 aa, Mycobacterium
LRGTAGTGKTAPVP

SEQ ID NO: 270252 - protein, 9 aa, Mycobacterium
LRGTEMSTA

SEQ ID NO: 270253 - protein, 15 aa, Mycobacterium
LRGTRKAEEAAESAR

SEQ ID NO: 270254 - protein, 9 aa, Mycobacterium
LRKRTSDMG

SEQ ID NO: 270255 - protein, 6 aa, Mycobacterium
LRNADK

SEQ ID NO: 270256 - protein, 4 aa, Mycobacterium
LRNG

SEQ ID NO: 270257 - protein, 18 aa, Mycobacterium
LRNGAQQLATGNAQLSSG

SEQ ID NO: 270258 - protein, 7 aa, Mycobacterium
LRNGDRA

SEQ ID NO: 270259 - protein, 6 aa, Mycobacterium
LRNGGE

SEQ ID NO: 270260 - protein, 4 aa, Mycobacterium
LRNP

SEQ ID NO: 270261 - protein, 11 aa, Mycobacterium
LRNPGSPLGSA

SEQ ID NO: 270262 - protein, 6 aa, Mycobacterium
LRNPQA

SEQ ID NO: 270263 - protein, 5 aa, Mycobacterium
LRNPT

SEQ ID NO: 270264 - protein, 6 aa, Mycobacterium
LRNTRK

SEQ ID NO: 270265 - protein, 4 aa, Mycobacterium
LRPA

SEQ ID NO: 270266 - protein, 4 aa, Mycobacterium
LRPD

SEQ ID NO: 270267 - protein, 7 aa, Mycobacterium
LRPDAPA

SEQ ID NO: 270268 - protein, 5 aa, Mycobacterium
LRPDE

SEQ ID NO: 270269 - protein, 13 aa, Mycobacterium
LRPDEREESRKAD

SEQ ID NO: 270270 - protein, 11 aa, Mycobacterium
LRPDHSMPEDA

SEQ ID NO: 270271 - protein, 5 aa, Mycobacterium
LRPEA

SEQ ID NO: 270272 - protein, 7 aa, Mycobacterium
LRPEAAD

SEQ ID NO: 270273 - protein, 8 aa, Mycobacterium
LRPEAADT

SEQ ID NO: 270274 - protein, 7 aa, Mycobacterium
LRPEAPE

SEQ ID NO: 270275 - protein, 6 aa, Mycobacterium
LRPEGQ

SEQ ID NO: 270276 - protein, 4 aa, Mycobacterium
LRPG

SEQ ID NO: 270277 - protein, 10 aa, Mycobacterium
LRPGAGGSQT

SEQ ID NO: 270278 - protein, 5 aa, Mycobacterium
LRPGD

SEQ ID NO: 270279 - protein, 6 aa, Mycobacterium
LRPGDA

SEQ ID NO: 270280 - protein, 12 aa, Mycobacterium
LRPGDVDARRRA

SEQ ID NO: 270281 - protein, 14 aa, Mycobacterium
LRPGGESQAAASGI

SEQ ID NO: 270282 - protein, 7 aa, Mycobacterium
LRPGGKI

SEQ ID NO: 270283 - protein, 8 aa, Mycobacterium
LRPGPTQY

SEQ ID NO: 270284 - protein, 7 aa, Mycobacterium
LRPGQPI

SEQ ID NO: 270285 - protein, 6 aa, Mycobacterium
LRPGQV

SEQ ID NO: 270286 - protein, 7 aa, Mycobacterium
LRPGRAS

SEQ ID NO: 270287 - protein, 7 aa, Mycobacterium
LRPGRPS

SEQ ID NO: 270288 - protein, 5 aa, Mycobacterium
LRPGS

SEQ ID NO: 270289 - protein, 5 aa, Mycobacterium
LRPGT

SEQ ID NO: 270290 - protein, 23 aa, Mycobacterium
LRPGTNGADGSEFEDDDARPTPL

SEQ ID NO: 270291 - protein, 4 aa, Mycobacterium
LRPN

SEQ ID NO: 270292 - protein, 7 aa, Mycobacterium
LRPNDTD

SEQ ID NO: 270293 - protein, 19 aa, Mycobacterium
LRPNETPRSRRARRRQQAR

SEQ ID NO: 270294 - protein, 6 aa, Mycobacterium
LRPPDV

SEQ ID NO: 270295 - protein, 8 aa, Mycobacterium
LRPPERAQ

SEQ ID NO: 270296 - protein, 9 aa, Mycobacterium
LRPPGGAQS

SEQ ID NO: 270297 - protein, 14 aa, Mycobacterium
LRPPQVREGRRGRR

SEQ ID NO: 270298 - protein, 5 aa, Mycobacterium
LRPPS

SEQ ID NO: 270299 - protein, 11 aa, Mycobacterium
LRPQDGTGNPW

SEQ ID NO: 270300 - protein, 10 aa, Mycobacterium
LRPRERPDTF

SEQ ID NO: 270301 - protein, 9 aa, Mycobacterium
LRPSERAQV

SEQ ID NO: 270302 - protein, 19 aa, Mycobacterium
LRPSERQQVETGLPGGTLD

SEQ ID NO: 270303 - protein, 18 aa, Mycobacterium
LRPSGPRPLVRSLLLKQP

SEQ ID NO: 270304 - protein, 15 aa, Mycobacterium
LRPSTLNPSERTPAR

SEQ ID NO: 270305 - protein, 32 aa, Mycobacterium
LRPTASRVRAERASAAGISDQTRPQRTVDDRL

SEQ ID NO: 270306 - protein, 6 aa, Mycobacterium
LRPTEA

SEQ ID NO: 270307 - protein, 7 aa, Mycobacterium
LRPTPTG

SEQ ID NO: 270308 - protein, 4 aa, Mycobacterium
LRPY

SEQ ID NO: 270309 - protein, 14 aa, Mycobacterium
LRQAATTASQGELD

SEQ ID NO: 270310 - protein, 10 aa, Mycobacterium
LRQAPQAAGR

SEQ ID NO: 270311 - protein, 19 aa, Mycobacterium
LRQGRTKKTIEKDLSQDFG

SEQ ID NO: 270312 - protein, 10 aa, Mycobacterium
LRQGTADAPI

SEQ ID NO: 270313 - protein, 4 aa, Mycobacterium
LRQP

SEQ ID NO: 270314 - protein, 6 aa, Mycobacterium
LRQRKG

SEQ ID NO: 270315 - protein, 7 aa, Mycobacterium
LRQRPGA

SEQ ID NO: 270316 - protein, 13 aa, Mycobacterium
LRRAGGGRLGSAA

SEQ ID NO: 270317 - protein, 4 aa, Mycobacterium
LRRD

SEQ ID NO: 270318 - protein, 6 aa, Mycobacterium
LRRDGR

SEQ ID NO: 270319 - protein, 6 aa, Mycobacterium
LRRGAH

SEQ ID NO: 270320 - protein, 5 aa, Mycobacterium
LRRGQ

SEQ ID NO: 270321 - protein, 11 aa, Mycobacterium
LRRNGLKPDSM

SEQ ID NO: 270322 - protein, 6 aa, Mycobacterium
LRRPAQ

SEQ ID NO: 270323 - protein, 6 aa, Mycobacterium
LRRPRG

SEQ ID NO: 270324 - protein, 17 aa, Mycobacterium
LRRQAKQLPAGQTTTPV

SEQ ID NO: 270325 - protein, 11 aa, Mycobacterium
LRRRPRPQRIT

SEQ ID NO: 270326 - protein, 6 aa, Mycobacterium
LRRSAA

SEQ ID NO: 270327 - protein, 8 aa, Mycobacterium
LRRSAGRS

SEQ ID NO: 270328 - protein, 10 aa, Mycobacterium
LRRSGEEAKA

SEQ ID NO: 270329 - protein, 5 aa, Mycobacterium
LRRSN

SEQ ID NO: 270330 - protein, 7 aa, Mycobacterium
LRRSNAE

SEQ ID NO: 270331 - protein, 11 aa, Mycobacterium
LRRTDQQGDNG

SEQ ID NO: 270332 - protein, 10 aa, Mycobacterium
LRRTDRQQDA

SEQ ID NO: 270333 - protein, 9 aa, Mycobacterium
LRSAAAEEV

SEQ ID NO: 270334 - protein, 6 aa, Mycobacterium
LRSAAE

SEQ ID NO: 270335 - protein, 5 aa, Mycobacterium
LRSAG

SEQ ID NO: 270336 - protein, 9 aa, Mycobacterium
LRSAGAGYE

SEQ ID NO: 270337 - protein, 9 aa, Mycobacterium
LRSAGDRYE

SEQ ID NO: 270338 - protein, 8 aa, Mycobacterium
LRSAWGPD

SEQ ID NO: 270339 - protein, 4 aa, Mycobacterium
LRSG

SEQ ID NO: 270340 - protein, 9 aa, Mycobacterium
LRSGDDGRF

SEQ ID NO: 270341 - protein, 7 aa, Mycobacterium
LRSGDGE

SEQ ID NO: 270342 - protein, 9 aa, Mycobacterium
LRSGDSDVA

SEQ ID NO: 270343 - protein, 10 aa, Mycobacterium
LRSGKAGTDA

SEQ ID NO: 270344 - protein, 11 aa, Mycobacterium
LRSGPAATARL

SEQ ID NO: 270345 - protein, 11 aa, Mycobacterium
LRSGRDPQEAV

SEQ ID NO: 270346 - protein, 6 aa, Mycobacterium
LRSGTA

SEQ ID NO: 270347 - protein, 14 aa, Mycobacterium
LRSGVSSPTVFATG

SEQ ID NO: 270348 - protein, 8 aa, Mycobacterium
LRSNAGTL

SEQ ID NO: 270349 - protein, 11 aa, Mycobacterium
LRSNPAASRGA

SEQ ID NO: 270350 - protein, 9 aa, Mycobacterium
LRSPAEPAH

SEQ ID NO: 270351 - protein, 10 aa, Mycobacterium
LRSPDAPVLS

SEQ ID NO: 270352 - protein, 16 aa, Mycobacterium
LRSPIRGREPETDAKR

SEQ ID NO: 270353 - protein, 4 aa, Mycobacterium
LRSR

SEQ ID NO: 270354 - protein, 5 aa, Mycobacterium
LRSRA

SEQ ID NO: 270355 - protein, 8 aa, Mycobacterium
LRSSDPKS

SEQ ID NO: 270356 - protein, 6 aa, Mycobacterium
LRSSGI

SEQ ID NO: 270357 - protein, 5 aa, Mycobacterium
LRSVP

SEQ ID NO: 270358 - protein, 20 aa, Mycobacterium
LRSVSASSLTQNIDTPTQLG

SEQ ID NO: 270359 - protein, 20 aa, Mycobacterium
LRTAQQSAAQFSAAAGPIQA

SEQ ID NO: 270360 - protein, 16 aa, Mycobacterium
LRTDAYPGDPALAGRY

SEQ ID NO: 270361 - protein, 11 aa, Mycobacterium
LRTEPNPDLGT

SEQ ID NO: 270362 - protein, 21 aa, Mycobacterium
LRTEREERIESDARIWRGPWK

SEQ ID NO: 270363 - protein, 8 aa, Mycobacterium
LRTGARSS

SEQ ID NO: 270364 - protein, 12 aa, Mycobacterium
LRTGDPASAALA

SEQ ID NO: 270365 - protein, 8 aa, Mycobacterium
LRTGEPAA

SEQ ID NO: 270366 - protein, 5 aa, Mycobacterium
LRTGS

SEQ ID NO: 270367 - protein, 59 aa, Mycobacterium
LRTKPEKKKAGKRPEKKPARARAAQSARHPVRSGRSSDGYGDGRRNQGRRARTMEGQRY

SEQ ID NO: 270368 - protein, 6 aa, Mycobacterium
LRTNGA

SEQ ID NO: 270369 - protein, 8 aa, Mycobacterium
LRTNRGGD

SEQ ID NO: 270370 - protein, 4 aa, Mycobacterium
LRTP

SEQ ID NO: 270371 - protein, 6 aa, Mycobacterium
LRTPLS

SEQ ID NO: 270372 - protein, 12 aa, Mycobacterium
LRTQPGRAPVPA

SEQ ID NO: 270373 - protein, 24 aa, Mycobacterium
LRTRPGETPADEPAAPLDMGTKDP

SEQ ID NO: 270374 - protein, 7 aa, Mycobacterium
LRTSANE

SEQ ID NO: 270375 - protein, 9 aa, Mycobacterium
LRTSDGGLT

SEQ ID NO: 270376 - protein, 12 aa, Mycobacterium
LRTSKPASAALA

SEQ ID NO: 270377 - protein, 14 aa, Mycobacterium
LRTTARRAGPEPDA

SEQ ID NO: 270378 - protein, 7 aa, Mycobacterium
LRYPDGR

SEQ ID NO: 270379 - protein, 15 aa, Mycobacterium
LSAAAAANTKHDIAD

SEQ ID NO: 270380 - protein, 12 aa, Mycobacterium
LSAAAAQNTKHD

SEQ ID NO: 270381 - protein, 13 aa, Mycobacterium
LSAAARDGKPNVA

SEQ ID NO: 270382 - protein, 23 aa, Mycobacterium
LSAADTGPINTKGLSRAERGHRP

SEQ ID NO: 270383 - protein, 9 aa, Mycobacterium
LSAAGSRGI

SEQ ID NO: 270384 - protein, 12 aa, Mycobacterium
LSAASDKPWTPY

SEQ ID NO: 270385 - protein, 6 aa, Mycobacterium
LSAAYA

SEQ ID NO: 270386 - protein, 11 aa, Mycobacterium
LSADGGAMTRD

SEQ ID NO: 270387 - protein, 8 aa, Mycobacterium
LSADPAGR

SEQ ID NO: 270388 - protein, 7 aa, Mycobacterium
LSAEETK

SEQ ID NO: 270389 - protein, 10 aa, Mycobacterium
LSAETNTPLD

SEQ ID NO: 270390 - protein, 8 aa, Mycobacterium
LSAGERQD

SEQ ID NO: 270391 - protein, 18 aa, Mycobacterium
LSAGGFQDPTAESARATQ

SEQ ID NO: 270392 - protein, 17 aa, Mycobacterium
LSAGGFQDPTSESAHAN

SEQ ID NO: 270393 - protein, 15 aa, Mycobacterium
LSAGGGLDPGAESSH

SEQ ID NO: 270394 - protein, 15 aa, Mycobacterium
LSAGGVTARPYPARS

SEQ ID NO: 270395 - protein, 7 aa, Mycobacterium
LSAGQAE

SEQ ID NO: 270396 - protein, 5 aa, Mycobacterium
LSAGS

SEQ ID NO: 270397 - protein, 6 aa, Mycobacterium
LSAGSA

SEQ ID NO: 270398 - protein, 7 aa, Mycobacterium
LSAGSET

SEQ ID NO: 270399 - protein, 60 aa, Mycobacterium
LSAPEPKKTIDRSGGYTASSGITFSQGGTAPPAERIDTTGLPAVGDDATIPRDAPKRPIA

SEQ ID NO: 270400 - protein, 7 aa, Mycobacterium
LSAPGGL

SEQ ID NO: 270401 - protein, 12 aa, Mycobacterium
LSAPPAPEPQHP

SEQ ID NO: 270402 - protein, 15 aa, Mycobacterium
LSAPPIPADVQPKGV

SEQ ID NO: 270403 - protein, 8 aa, Mycobacterium
LSAQEQDA

SEQ ID NO: 270404 - protein, 7 aa, Mycobacterium
LSAQTGV

SEQ ID NO: 270405 - protein, 4 aa, Mycobacterium
LSAR

SEQ ID NO: 270406 - protein, 8 aa, Mycobacterium
LSARATGA

SEQ ID NO: 270407 - protein, 12 aa, Mycobacterium
LSARDSRAPALD

SEQ ID NO: 270408 - protein, 8 aa, Mycobacterium
LSARGGSI

SEQ ID NO: 270409 - protein, 53 aa, Mycobacterium
LSARGSASSRSRRKSEEPSSDDVEAPAGAAAAAAAKKKARARRRRGGTATERA

SEQ ID NO: 270410 - protein, 6 aa, Mycobacterium
LSARRD

SEQ ID NO: 270411 - protein, 14 aa, Mycobacterium
LSARTKSAATTAAK

SEQ ID NO: 270412 - protein, 13 aa, Mycobacterium
LSASASSGRGQSH

SEQ ID NO: 270413 - protein, 7 aa, Mycobacterium
LSASAST

SEQ ID NO: 270414 - protein, 7 aa, Mycobacterium
LSASPAQ

SEQ ID NO: 270415 - protein, 7 aa, Mycobacterium
LSASPSQ

SEQ ID NO: 270416 - protein, 14 aa, Mycobacterium
LSASRSRVGREALI

SEQ ID NO: 270417 - protein, 9 aa, Mycobacterium
LSASSDPGE

SEQ ID NO: 270418 - protein, 18 aa, Mycobacterium
LSASTGAATSGGNSNAES

SEQ ID NO: 270419 - protein, 6 aa, Mycobacterium
LSATGK

SEQ ID NO: 270420 - protein, 9 aa, Mycobacterium
LSATPATNT

SEQ ID NO: 270421 - protein, 7 aa, Mycobacterium
LSATSTV

SEQ ID NO: 270422 - protein, 7 aa, Mycobacterium
LSATTKL

SEQ ID NO: 270423 - protein, 8 aa, Mycobacterium
LSDAKKKL

SEQ ID NO: 270424 - protein, 7 aa, Mycobacterium
LSDCDAH

SEQ ID NO: 270425 - protein, 11 aa, Mycobacterium
LSDDAVAGDDM

SEQ ID NO: 270426 - protein, 8 aa, Mycobacterium
LSDDPAPA

SEQ ID NO: 270427 - protein, 9 aa, Mycobacterium
LSDDQNATV

SEQ ID NO: 270428 - protein, 8 aa, Mycobacterium
LSDDQREE

SEQ ID NO: 270429 - protein, 7 aa, Mycobacterium
LSDEDGR

SEQ ID NO: 270430 - protein, 9 aa, Mycobacterium
LSDEQNNEV

SEQ ID NO: 270431 - protein, 9 aa, Mycobacterium
LSDEQNTTV

SEQ ID NO: 270432 - protein, 9 aa, Mycobacterium
LSDGEARSI

SEQ ID NO: 270433 - protein, 22 aa, Mycobacterium
LSDGEVSAEEHRERVSAATKAV

SEQ ID NO: 270434 - protein, 4 aa, Mycobacterium
LSDN

SEQ ID NO: 270435 - protein, 9 aa, Mycobacterium
LSDNQRELK

SEQ ID NO: 270436 - protein, 4 aa, Mycobacterium
LSDP

SEQ ID NO: 270437 - protein, 7 aa, Mycobacterium
LSDPAQG

SEQ ID NO: 270438 - protein, 8 aa, Mycobacterium
LSDPDDPV

SEQ ID NO: 270439 - protein, 5 aa, Mycobacterium
LSDPI

SEQ ID NO: 270440 - protein, 5 aa, Mycobacterium
LSDPL

SEQ ID NO: 270441 - protein, 14 aa, Mycobacterium
LSDPNATGTGEPTI

SEQ ID NO: 270442 - protein, 6 aa, Mycobacterium
LSDPTG

SEQ ID NO: 270443 - protein, 7 aa, Mycobacterium
LSDPVSH

SEQ ID NO: 270444 - protein, 10 aa, Mycobacterium
LSDPVSQDTI

SEQ ID NO: 270445 - protein, 10 aa, Mycobacterium
LSDPVSQETI

SEQ ID NO: 270446 - protein, 7 aa, Mycobacterium
LSDRIPP

SEQ ID NO: 270447 - protein, 5 aa, Mycobacterium
LSDRP

SEQ ID NO: 270448 - protein, 10 aa, Mycobacterium
LSDRSDAAAA

SEQ ID NO: 270449 - protein, 7 aa, Mycobacterium
LSDRSDI

SEQ ID NO: 270450 - protein, 9 aa, Mycobacterium
LSDRSYNPP

SEQ ID NO: 270451 - protein, 6 aa, Mycobacterium
LSDRYG

SEQ ID NO: 270452 - protein, 8 aa, Mycobacterium
LSDRYGRR

SEQ ID NO: 270453 - protein, 11 aa, Mycobacterium
LSDSGAGAGQA

SEQ ID NO: 270454 - protein, 10 aa, Mycobacterium
LSDSPDNADM

SEQ ID NO: 270455 - protein, 10 aa, Mycobacterium
LSDSPDNTGM

SEQ ID NO: 270456 - protein, 6 aa, Mycobacterium
LSDSTD

SEQ ID NO: 270457 - protein, 6 aa, Mycobacterium
LSDSTL

SEQ ID NO: 270458 - protein, 7 aa, Mycobacterium
LSDTTDA

SEQ ID NO: 270459 - protein, 9 aa, Mycobacterium
LSDTTDLAS

SEQ ID NO: 270460 - protein, 7 aa, Mycobacterium
LSEAATA

SEQ ID NO: 270461 - protein, 7 aa, Mycobacterium
LSEAGAN

SEQ ID NO: 270462 - protein, 4 aa, Mycobacterium
LSED

SEQ ID NO: 270463 - protein, 13 aa, Mycobacterium
LSEDGQGGPPNNG

SEQ ID NO: 270464 - protein, 6 aa, Mycobacterium
LSEDGT

SEQ ID NO: 270465 - protein, 6 aa, Mycobacterium
LSEDVG

SEQ ID NO: 270466 - protein, 8 aa, Mycobacterium
LSEDVGTL

SEQ ID NO: 270467 - protein, 4 aa, Mycobacterium
LSEE

SEQ ID NO: 270468 - protein, 10 aa, Mycobacterium
LSEEEQRRLA

SEQ ID NO: 270469 - protein, 7 aa, Mycobacterium
LSEENGS

SEQ ID NO: 270470 - protein, 8 aa, Mycobacterium
LSEEPAPT

SEQ ID NO: 270471 - protein, 4 aa, Mycobacterium
LSEG

SEQ ID NO: 270472 - protein, 10 aa, Mycobacterium
LSEGDPGITE

SEQ ID NO: 270473 - protein, 7 aa, Mycobacterium
LSEGQRH

SEQ ID NO: 270474 - protein, 9 aa, Mycobacterium
LSEGSGGVS

SEQ ID NO: 270475 - protein, 7 aa, Mycobacterium
LSEGSVR

SEQ ID NO: 270476 - protein, 8 aa, Mycobacterium
LSEGSYGN

SEQ ID NO: 270477 - protein, 8 aa, Mycobacterium
LSENATAM

SEQ ID NO: 270478 - protein, 12 aa, Mycobacterium
LSENSGTEAPQT

SEQ ID NO: 270479 - protein, 7 aa, Mycobacterium
LSENTIR

SEQ ID NO: 270480 - protein, 12 aa, Mycobacterium
LSEPDTARIGTP

SEQ ID NO: 270481 - protein, 11 aa, Mycobacterium
LSEPERSGHRE

SEQ ID NO: 270482 - protein, 7 aa, Mycobacterium
LSEPGTL

SEQ ID NO: 270483 - protein, 8 aa, Mycobacterium
LSEPSLGE

SEQ ID NO: 270484 - protein, 5 aa, Mycobacterium
LSEPV

SEQ ID NO: 270485 - protein, 19 aa, Mycobacterium
LSEQAGSEAERIKAQGAQQ

SEQ ID NO: 270486 - protein, 7 aa, Mycobacterium
LSEQGGA

SEQ ID NO: 270487 - protein, 10 aa, Mycobacterium
LSERADGPIT

SEQ ID NO: 270488 - protein, 13 aa, Mycobacterium
LSERADGTVTAEQ

SEQ ID NO: 270489 - protein, 9 aa, Mycobacterium
LSERQEKTD

SEQ ID NO: 270490 - protein, 5 aa, Mycobacterium
LSESK

SEQ ID NO: 270491 - protein, 14 aa, Mycobacterium
LSESPQPGNRHAEL

SEQ ID NO: 270492 - protein, 9 aa, Mycobacterium
LSGAAGGLS

SEQ ID NO: 270493 - protein, 19 aa, Mycobacterium
LSGAAGGPSQLAGVDDQRA

SEQ ID NO: 270494 - protein, 25 aa, Mycobacterium
LSGAAGPPGPAGPGGPRGARAARPW

SEQ ID NO: 270495 - protein, 5 aa, Mycobacterium
LSGAG

SEQ ID NO: 270496 - protein, 6 aa, Mycobacterium
LSGAGG

SEQ ID NO: 270497 - protein, 5 aa, Mycobacterium
LSGAP

SEQ ID NO: 270498 - protein, 9 aa, Mycobacterium
LSGDDAAAI

SEQ ID NO: 270499 - protein, 6 aa, Mycobacterium
LSGDER

SEQ ID NO: 270500 - protein, 35 aa, Mycobacterium
LSGDGRGRRTAPAAPRQPRGTEGAEASAPRGRSRS

SEQ ID NO: 270501 - protein, 12 aa, Mycobacterium
LSGGDAFTASSL

SEQ ID NO: 270502 - protein, 12 aa, Mycobacterium
LSGGETYTASTL

SEQ ID NO: 270503 - protein, 5 aa, Mycobacterium
LSGGG

SEQ ID NO: 270504 - protein, 18 aa, Mycobacterium
LSGGGFQDPTSESARATE

SEQ ID NO: 270505 - protein, 25 aa, Mycobacterium
LSGGGYQNLTTSASPELAAALNAFL

SEQ ID NO: 270506 - protein, 9 aa, Mycobacterium
LSGGQRKRA

SEQ ID NO: 270507 - protein, 11 aa, Mycobacterium
LSGGQSYTAGN

SEQ ID NO: 270508 - protein, 8 aa, Mycobacterium
LSGGRPSL

SEQ ID NO: 270509 - protein, 25 aa, Mycobacterium
LSGGSYQNIATSASPELATAVNAFL

SEQ ID NO: 270510 - protein, 25 aa, Mycobacterium
LSGGSYQNLATSAGPDLATALSIFL

SEQ ID NO: 270511 - protein, 25 aa, Mycobacterium
LSGGSYQNLATSTGPNLAAAVDTFL

SEQ ID NO: 270512 - protein, 6 aa, Mycobacterium
LSGGTS

SEQ ID NO: 270513 - protein, 14 aa, Mycobacterium
LSGISTGVKTETGL

SEQ ID NO: 270514 - protein, 10 aa, Mycobacterium
LSGKEDDDIE

SEQ ID NO: 270515 - protein, 8 aa, Mycobacterium
LSGKTGAL

SEQ ID NO: 270516 - protein, 12 aa, Mycobacterium
LSGKTGTAQQIN

SEQ ID NO: 270517 - protein, 9 aa, Mycobacterium
LSGLASAPE

SEQ ID NO: 270518 - protein, 5 aa, Mycobacterium
LSGLT

SEQ ID NO: 270519 - protein, 24 aa, Mycobacterium
LSGNDKSTVAATSGRRRNRAGGSP

SEQ ID NO: 270520 - protein, 20 aa, Mycobacterium
LSGNPASADQITQAAAGVGE

SEQ ID NO: 270521 - protein, 6 aa, Mycobacterium
LSGNTD

SEQ ID NO: 270522 - protein, 8 aa, Mycobacterium
LSGPAELY

SEQ ID NO: 270523 - protein, 7 aa, Mycobacterium
LSGPDMR

SEQ ID NO: 270524 - protein, 7 aa, Mycobacterium
LSGPGAG

SEQ ID NO: 270525 - protein, 9 aa, Mycobacterium
LSGPGGATQ

SEQ ID NO: 270526 - protein, 7 aa, Mycobacterium
LSGPHQA

SEQ ID NO: 270527 - protein, 21 aa, Mycobacterium
LSGPKITGDQLTQTARDIGET

SEQ ID NO: 270528 - protein, 9 aa, Mycobacterium
LSGPPPSLD

SEQ ID NO: 270529 - protein, 6 aa, Mycobacterium
LSGQGG

SEQ ID NO: 270530 - protein, 14 aa, Mycobacterium
LSGQRVAPAPVTTS

SEQ ID NO: 270531 - protein, 8 aa, Mycobacterium
LSGQSSTI

SEQ ID NO: 270532 - protein, 12 aa, Mycobacterium
LSGRPEPTRQPI

SEQ ID NO: 270533 - protein, 9 aa, Mycobacterium
LSGRPGVSM

SEQ ID NO: 270534 - protein, 9 aa, Mycobacterium
LSGRTEPLR

SEQ ID NO: 270535 - protein, 4 aa, Mycobacterium
LSGS

SEQ ID NO: 270536 - protein, 12 aa, Mycobacterium
LSGSADAGHFTD

SEQ ID NO: 270537 - protein, 12 aa, Mycobacterium
LSGSGDSKGTIG

SEQ ID NO: 270538 - protein, 13 aa, Mycobacterium
LSGSGTNGSAQPA

SEQ ID NO: 270539 - protein, 6 aa, Mycobacterium
LSGSQR

SEQ ID NO: 270540 - protein, 17 aa, Mycobacterium
LSGSSDAAGREGGLAGR

SEQ ID NO: 270541 - protein, 5 aa, Mycobacterium
LSGTA

SEQ ID NO: 270542 - protein, 11 aa, Mycobacterium
LSGTAQPNQTA

SEQ ID NO: 270543 - protein, 9 aa, Mycobacterium
LSGTPGRPA

SEQ ID NO: 270544 - protein, 7 aa, Mycobacterium
LSGTQRA

SEQ ID NO: 270545 - protein, 7 aa, Mycobacterium
LSGTTTA

SEQ ID NO: 270546 - protein, 5 aa, Mycobacterium
LSGVR

SEQ ID NO: 270547 - protein, 5 aa, Mycobacterium
LSHDD

SEQ ID NO: 270548 - protein, 10 aa, Mycobacterium
LSHPDDPRNW

SEQ ID NO: 270549 - protein, 8 aa, Mycobacterium
LSHRNTQP

SEQ ID NO: 270550 - protein, 8 aa, Mycobacterium
LSIGGGPP

SEQ ID NO: 270551 - protein, 24 aa, Mycobacterium
LSKARRAVGRRHGDDPGRRRRPPI

SEQ ID NO: 270552 - protein, 9 aa, Mycobacterium
LSKEGPQKL

SEQ ID NO: 270553 - protein, 8 aa, Mycobacterium
LSKGGFGG

SEQ ID NO: 270554 - protein, 12 aa, Mycobacterium
LSKHKDEFGNGA

SEQ ID NO: 270555 - protein, 9 aa, Mycobacterium
LSKNSTAMG

SEQ ID NO: 270556 - protein, 10 aa, Mycobacterium
LSKSATHPAN

SEQ ID NO: 270557 - protein, 7 aa, Mycobacterium
LSKSPSV

SEQ ID NO: 270558 - protein, 9 aa, Mycobacterium
LSLPRPPTL

SEQ ID NO: 270559 - protein, 9 aa, Mycobacterium
LSMDPGSKV

SEQ ID NO: 270560 - protein, 10 aa, Mycobacterium
LSMPRSRGAV

SEQ ID NO: 270561 - protein, 9 aa, Mycobacterium
LSNDGGRRM

SEQ ID NO: 270562 - protein, 10 aa, Mycobacterium
LSNDRDTIGS

SEQ ID NO: 270563 - protein, 5 aa, Mycobacterium
LSNGT

SEQ ID NO: 270564 - protein, 10 aa, Mycobacterium
LSNKSARNFS

SEQ ID NO: 270565 - protein, 6 aa, Mycobacterium
LSNLGS

SEQ ID NO: 270566 - protein, 7 aa, Mycobacterium
LSNNGVP

SEQ ID NO: 270567 - protein, 9 aa, Mycobacterium
LSNTSPPSL

SEQ ID NO: 270568 - protein, 5 aa, Mycobacterium
LSPAA

SEQ ID NO: 270569 - protein, 9 aa, Mycobacterium
LSPAASADE

SEQ ID NO: 270570 - protein, 9 aa, Mycobacterium
LSPADEGTY

SEQ ID NO: 270571 - protein, 6 aa, Mycobacterium
LSPAGE

SEQ ID NO: 270572 - protein, 7 aa, Mycobacterium
LSPAQSA

SEQ ID NO: 270573 - protein, 7 aa, Mycobacterium
LSPARAG

SEQ ID NO: 270574 - protein, 18 aa, Mycobacterium
LSPCNSQSNSVGRSGAAR

SEQ ID NO: 270575 - protein, 15 aa, Mycobacterium
LSPDAEATGASQDRE

SEQ ID NO: 270576 - protein, 6 aa, Mycobacterium
LSPDAV

SEQ ID NO: 270577 - protein, 7 aa, Mycobacterium
LSPDAVS

SEQ ID NO: 270578 - protein, 6 aa, Mycobacterium
LSPDGK

SEQ ID NO: 270579 - protein, 7 aa, Mycobacterium
LSPDSNV

SEQ ID NO: 270580 - protein, 12 aa, Mycobacterium
LSPEASTRAVLN

SEQ ID NO: 270581 - protein, 17 aa, Mycobacterium
LSPEDVPGQLDKDSYPR

SEQ ID NO: 270582 - protein, 16 aa, Mycobacterium
LSPEQARGDTVDARSD

SEQ ID NO: 270583 - protein, 9 aa, Mycobacterium
LSPEQARGV

SEQ ID NO: 270584 - protein, 7 aa, Mycobacterium
LSPEQRH

SEQ ID NO: 270585 - protein, 7 aa, Mycobacterium
LSPEQRR

SEQ ID NO: 270586 - protein, 16 aa, Mycobacterium
LSPEQVATGDADPRSD

SEQ ID NO: 270587 - protein, 17 aa, Mycobacterium
LSPEQVATGETDSRGDV

SEQ ID NO: 270588 - protein, 17 aa, Mycobacterium
LSPEQVRDGRAGPRSDV

SEQ ID NO: 270589 - protein, 17 aa, Mycobacterium
LSPEQVRTGSAGPRSDV

SEQ ID NO: 270590 - protein, 7 aa, Mycobacterium
LSPERTE

SEQ ID NO: 270591 - protein, 10 aa, Mycobacterium
LSPESPGHQV

SEQ ID NO: 270592 - protein, 9 aa, Mycobacterium
LSPETDALG

SEQ ID NO: 270593 - protein, 6 aa, Mycobacterium
LSPETV

SEQ ID NO: 270594 - protein, 5 aa, Mycobacterium
LSPEV

SEQ ID NO: 270595 - protein, 8 aa, Mycobacterium
LSPEVASS

SEQ ID NO: 270596 - protein, 5 aa, Mycobacterium
LSPGA

SEQ ID NO: 270597 - protein, 6 aa, Mycobacterium
LSPGAT

SEQ ID NO: 270598 - protein, 8 aa, Mycobacterium
LSPGDAPG

SEQ ID NO: 270599 - protein, 7 aa, Mycobacterium
LSPGPYG

SEQ ID NO: 270600 - protein, 7 aa, Mycobacterium
LSPGTTV

SEQ ID NO: 270601 - protein, 6 aa, Mycobacterium
LSPGVA

SEQ ID NO: 270602 - protein, 11 aa, Mycobacterium
LSPGVNDPTTA

SEQ ID NO: 270603 - protein, 4 aa, Mycobacterium
LSPI

SEQ ID NO: 270604 - protein, 5 aa, Mycobacterium
LSPIE

SEQ ID NO: 270605 - protein, 7 aa, Mycobacterium
LSPLSET

SEQ ID NO: 270606 - protein, 12 aa, Mycobacterium
LSPPIAPDQPWA

SEQ ID NO: 270607 - protein, 8 aa, Mycobacterium
LSPPPEIT

SEQ ID NO: 270608 - protein, 8 aa, Mycobacterium
LSPPSVTV

SEQ ID NO: 270609 - protein, 9 aa, Mycobacterium
LSPQDAPSF

SEQ ID NO: 270610 - protein, 9 aa, Mycobacterium
LSPQQAAAA

SEQ ID NO: 270611 - protein, 7 aa, Mycobacterium
LSPQQRR

SEQ ID NO: 270612 - protein, 8 aa, Mycobacterium
LSPQSVRD

SEQ ID NO: 270613 - protein, 19 aa, Mycobacterium
LSPQTAAAAADEIHRDENT

SEQ ID NO: 270614 - protein, 4 aa, Mycobacterium
LSPS

SEQ ID NO: 270615 - protein, 8 aa, Mycobacterium
LSPSDSRA

SEQ ID NO: 270616 - protein, 7 aa, Mycobacterium
LSPSSFQ

SEQ ID NO: 270617 - protein, 4 aa, Mycobacterium
LSPT

SEQ ID NO: 270618 - protein, 7 aa, Mycobacterium
LSPTAGQ

SEQ ID NO: 270619 - protein, 8 aa, Mycobacterium
LSPTMTPE

SEQ ID NO: 270620 - protein, 20 aa, Mycobacterium
LSPVGGPGNRHRRRRRKWRK

SEQ ID NO: 270621 - protein, 8 aa, Mycobacterium
LSQAGPKK

SEQ ID NO: 270622 - protein, 10 aa, Mycobacterium
LSQDTPDCGT

SEQ ID NO: 270623 - protein, 21 aa, Mycobacterium
LSQEAVSKALNSDVPPRDAAE

SEQ ID NO: 270624 - protein, 6 aa, Mycobacterium
LSQGDT

SEQ ID NO: 270625 - protein, 21 aa, Mycobacterium
LSQGNSEIRSAGRRRGARGLA

SEQ ID NO: 270626 - protein, 5 aa, Mycobacterium
LSQGS

SEQ ID NO: 270627 - protein, 7 aa, Mycobacterium
LSQITKD

SEQ ID NO: 270628 - protein, 9 aa, Mycobacterium
LSQPKTVTY

SEQ ID NO: 270629 - protein, 4 aa, Mycobacterium
LSQQ

SEQ ID NO: 270630 - protein, 4 aa, Mycobacterium
LSQR

SEQ ID NO: 270631 - protein, 6 aa, Mycobacterium
LSQRGS

SEQ ID NO: 270632 - protein, 9 aa, Mycobacterium
LSQSGTDLI

SEQ ID NO: 270633 - protein, 9 aa, Mycobacterium
LSQSPTGLR

SEQ ID NO: 270634 - protein, 12 aa, Mycobacterium
LSQTAGRLGDSR

SEQ ID NO: 270635 - protein, 7 aa, Mycobacterium
LSQTPSA

SEQ ID NO: 270636 - protein, 46 aa, Mycobacterium
LSQTSSLERTPEPDAAPHGRQSPPEDTRPGAGRNSSSNDLTPSGPD

SEQ ID NO: 270637 - protein, 9 aa, Mycobacterium
LSRDKKDVQ

SEQ ID NO: 270638 - protein, 6 aa, Mycobacterium
LSRDNE

SEQ ID NO: 270639 - protein, 7 aa, Mycobacterium
LSRDPRT

SEQ ID NO: 270640 - protein, 8 aa, Mycobacterium
LSRGGDAL

SEQ ID NO: 270641 - protein, 10 aa, Mycobacterium
LSRGGDSVSC

SEQ ID NO: 270642 - protein, 15 aa, Mycobacterium
LSRGSKATRTTDNTA

SEQ ID NO: 270643 - protein, 5 aa, Mycobacterium
LSRGT

SEQ ID NO: 270644 - protein, 16 aa, Mycobacterium
LSRKADTVADETNSAF

SEQ ID NO: 270645 - protein, 12 aa, Mycobacterium
LSRPESLSGGTT

SEQ ID NO: 270646 - protein, 17 aa, Mycobacterium
LSRPGTEAMENTNYNPK

SEQ ID NO: 270647 - protein, 8 aa, Mycobacterium
LSRPPGGH

SEQ ID NO: 270648 - protein, 9 aa, Mycobacterium
LSRPPGPHK

SEQ ID NO: 270649 - protein, 7 aa, Mycobacterium
LSRPPRA

SEQ ID NO: 270650 - protein, 10 aa, Mycobacterium
LSRPSVPDIP

SEQ ID NO: 270651 - protein, 12 aa, Mycobacterium
LSRQAEQTTEAM

SEQ ID NO: 270652 - protein, 9 aa, Mycobacterium
LSRQSDGSW

SEQ ID NO: 270653 - protein, 5 aa, Mycobacterium
LSRRD

SEQ ID NO: 270654 - protein, 8 aa, Mycobacterium
LSRRGKPV

SEQ ID NO: 270655 - protein, 10 aa, Mycobacterium
LSRSANHPAS

SEQ ID NO: 270656 - protein, 6 aa, Mycobacterium
LSRSDL

SEQ ID NO: 270657 - protein, 27 aa, Mycobacterium
LSRTRSRRSPGHETRSSSSGIADDEPC

SEQ ID NO: 270658 - protein, 19 aa, Mycobacterium
LSSAADDSARTTAETADIT

SEQ ID NO: 270659 - protein, 8 aa, Mycobacterium
LSSAGGVT

SEQ ID NO: 270660 - protein, 12 aa, Mycobacterium
LSSASADEDVRG

SEQ ID NO: 270661 - protein, 10 aa, Mycobacterium
LSSATADSNE

SEQ ID NO: 270662 - protein, 11 aa, Mycobacterium
LSSATADSNEV

SEQ ID NO: 270663 - protein, 10 aa, Mycobacterium
LSSATADSTE

SEQ ID NO: 270664 - protein, 4 aa, Mycobacterium
LSSD

SEQ ID NO: 270665 - protein, 6 aa, Mycobacterium
LSSDAF

SEQ ID NO: 270666 - protein, 7 aa, Mycobacterium
LSSDEAR

SEQ ID NO: 270667 - protein, 12 aa, Mycobacterium
LSSDGGTTTREQ

SEQ ID NO: 270668 - protein, 12 aa, Mycobacterium
LSSEGGVTTREQ

SEQ ID NO: 270669 - protein, 7 aa, Mycobacterium
LSSEHAA

SEQ ID NO: 270670 - protein, 5 aa, Mycobacterium
LSSGA

SEQ ID NO: 270671 - protein, 10 aa, Mycobacterium
LSSGPGPGSL

SEQ ID NO: 270672 - protein, 6 aa, Mycobacterium
LSSGPT

SEQ ID NO: 270673 - protein, 9 aa, Mycobacterium
LSSGQPAGA

SEQ ID NO: 270674 - protein, 8 aa, Mycobacterium
LSSGSATT

SEQ ID NO: 270675 - protein, 5 aa, Mycobacterium
LSSGY

SEQ ID NO: 270676 - protein, 13 aa, Mycobacterium
LSSPKQPVARKVT

SEQ ID NO: 270677 - protein, 15 aa, Mycobacterium
LSSPNSAPFADPGNP

SEQ ID NO: 270678 - protein, 7 aa, Mycobacterium
LSSPPSH

SEQ ID NO: 270679 - protein, 4 aa, Mycobacterium
LSSQ

SEQ ID NO: 270680 - protein, 40 aa, Mycobacterium
LSSSIGAYTASQASSSSSGGGSSSSSGGGGGGGGGGGGGS

SEQ ID NO: 270681 - protein, 39 aa, Mycobacterium
LSSSISAYTASQSSSSSSSGGGGSSGGGGGGGGGGGGGS

SEQ ID NO: 270682 - protein, 5 aa, Mycobacterium
LSSTE

SEQ ID NO: 270683 - protein, 17 aa, Mycobacterium
LSSTPSGVQAGPRVGYA

SEQ ID NO: 270684 - protein, 7 aa, Mycobacterium
LSSTQTT

SEQ ID NO: 270685 - protein, 5 aa, Mycobacterium
LSSVS

SEQ ID NO: 270686 - protein, 12 aa, Mycobacterium
LSSVSGNVATAE

SEQ ID NO: 270687 - protein, 4 aa, Mycobacterium
LSTA

SEQ ID NO: 270688 - protein, 12 aa, Mycobacterium
LSTAAAAAADRP

SEQ ID NO: 270689 - protein, 7 aa, Mycobacterium
LSTAAAG

SEQ ID NO: 270690 - protein, 6 aa, Mycobacterium
LSTALP

SEQ ID NO: 270691 - protein, 5 aa, Mycobacterium
LSTAT

SEQ ID NO: 270692 - protein, 4 aa, Mycobacterium
LSTD

SEQ ID NO: 270693 - protein, 11 aa, Mycobacterium
LSTDADRRSMP

SEQ ID NO: 270694 - protein, 11 aa, Mycobacterium
LSTDDGGKTRL

SEQ ID NO: 270695 - protein, 9 aa, Mycobacterium
LSTDERTGL

SEQ ID NO: 270696 - protein, 5 aa, Mycobacterium
LSTDG

SEQ ID NO: 270697 - protein, 26 aa, Mycobacterium
LSTDSPPPAPAAKPDAAAAPITAPTM

SEQ ID NO: 270698 - protein, 8 aa, Mycobacterium
LSTEDAAP

SEQ ID NO: 270699 - protein, 7 aa, Mycobacterium
LSTEPAA

SEQ ID NO: 270700 - protein, 7 aa, Mycobacterium
LSTEPSH

SEQ ID NO: 270701 - protein, 12 aa, Mycobacterium
LSTGPGPGPLQN

SEQ ID NO: 270702 - protein, 6 aa, Mycobacterium
LSTGQR

SEQ ID NO: 270703 - protein, 6 aa, Mycobacterium
LSTGTD

SEQ ID NO: 270704 - protein, 8 aa, Mycobacterium
LSTGTDTS

SEQ ID NO: 270705 - protein, 8 aa, Mycobacterium
LSTGTETA

SEQ ID NO: 270706 - protein, 18 aa, Mycobacterium
LSTGTPSAATPVAATAHP

SEQ ID NO: 270707 - protein, 4 aa, Mycobacterium
LSTI

SEQ ID NO: 270708 - protein, 6 aa, Mycobacterium
LSTLGD

SEQ ID NO: 270709 - protein, 5 aa, Mycobacterium
LSTMR

SEQ ID NO: 270710 - protein, 10 aa, Mycobacterium
LSTNPPANTM

SEQ ID NO: 270711 - protein, 6 aa, Mycobacterium
LSTNTR

SEQ ID NO: 270712 - protein, 4 aa, Mycobacterium
LSTP

SEQ ID NO: 270713 - protein, 31 aa, Mycobacterium
LSTPANTRAFPASGPQTGPLPSQYEEPRRNP

SEQ ID NO: 270714 - protein, 8 aa, Mycobacterium
LSTQLSGA

SEQ ID NO: 270715 - protein, 6 aa, Mycobacterium
LSTRQT

SEQ ID NO: 270716 - protein, 7 aa, Mycobacterium
LSTSAGR

SEQ ID NO: 270717 - protein, 15 aa, Mycobacterium
LSTSAPTSATTPIQA

SEQ ID NO: 270718 - protein, 15 aa, Mycobacterium
LSTSSVPQPPQPSIP

SEQ ID NO: 270719 - protein, 15 aa, Mycobacterium
LSTTGYGDITPYTEG

SEQ ID NO: 270720 - protein, 15 aa, Mycobacterium
LSTTGYGDITPYTES

SEQ ID NO: 270721 - protein, 10 aa, Mycobacterium
LSTTMPGGPV

SEQ ID NO: 270722 - protein, 14 aa, Mycobacterium
LSTTSTTITSHSTQ

SEQ ID NO: 270723 - protein, 6 aa, Mycobacterium
LSTVGD

SEQ ID NO: 270724 - protein, 10 aa, Mycobacterium
LSVGPESTTA

SEQ ID NO: 270725 - protein, 5 aa, Mycobacterium
LSVPN

SEQ ID NO: 270726 - protein, 11 aa, Mycobacterium
LSVTPAGAGRI

SEQ ID NO: 270727 - protein, 13 aa, Mycobacterium
LSVTPKGAGSPSV

SEQ ID NO: 270728 - protein, 12 aa, Mycobacterium
LSVTPKGNGEST

SEQ ID NO: 270729 - protein, 10 aa, Mycobacterium
LSVTTPEEPE

SEQ ID NO: 270730 - protein, 8 aa, Mycobacterium
LSYASAAP

SEQ ID NO: 270731 - protein, 4 aa, Mycobacterium
LTAA

SEQ ID NO: 270732 - protein, 9 aa, Mycobacterium
LTAAEHRAA

SEQ ID NO: 270733 - protein, 14 aa, Mycobacterium
LTAAEQRAVPGEGA

SEQ ID NO: 270734 - protein, 12 aa, Mycobacterium
LTAAGAQSADGM

SEQ ID NO: 270735 - protein, 13 aa, Mycobacterium
LTAAGSQSVDGKA

SEQ ID NO: 270736 - protein, 13 aa, Mycobacterium
LTAAGSQSVDGKS

SEQ ID NO: 270737 - protein, 13 aa, Mycobacterium
LTAAGSQSVDGRS

SEQ ID NO: 270738 - protein, 6 aa, Mycobacterium
LTAAGT

SEQ ID NO: 270739 - protein, 18 aa, Mycobacterium
LTAAPEAAPLESDTPSEV

SEQ ID NO: 270740 - protein, 5 aa, Mycobacterium
LTAAQ

SEQ ID NO: 270741 - protein, 6 aa, Mycobacterium
LTAATG

SEQ ID NO: 270742 - protein, 10 aa, Mycobacterium
LTADADYGRY

SEQ ID NO: 270743 - protein, 6 aa, Mycobacterium
LTADDT

SEQ ID NO: 270744 - protein, 11 aa, Mycobacterium
LTADSTVAETT

SEQ ID NO: 270745 - protein, 8 aa, Mycobacterium
LTAEQNRQ

SEQ ID NO: 270746 - protein, 7 aa, Mycobacterium
LTAESST

SEQ ID NO: 270747 - protein, 4 aa, Mycobacterium
LTAG

SEQ ID NO: 270748 - protein, 8 aa, Mycobacterium
LTAGANLG

SEQ ID NO: 270749 - protein, 13 aa, Mycobacterium
LTAGGSQSADDKA

SEQ ID NO: 270750 - protein, 8 aa, Mycobacterium
LTAGGTRG

SEQ ID NO: 270751 - protein, 5 aa, Mycobacterium
LTAGS

SEQ ID NO: 270752 - protein, 7 aa, Mycobacterium
LTAGTES

SEQ ID NO: 270753 - protein, 15 aa, Mycobacterium
LTAKQASAAAADPDR

SEQ ID NO: 270754 - protein, 31 aa, Mycobacterium
LTANGKTDRRALPAPDLERSGTVKPPRTPRE

SEQ ID NO: 270755 - protein, 20 aa, Mycobacterium
LTAPDDLASAAEHAESQGHT

SEQ ID NO: 270756 - protein, 6 aa, Mycobacterium
LTAPDG

SEQ ID NO: 270757 - protein, 14 aa, Mycobacterium
LTAPGAESNDGRSV

SEQ ID NO: 270758 - protein, 7 aa, Mycobacterium
LTAPGDT

SEQ ID NO: 270759 - protein, 6 aa, Mycobacterium
LTAPNA

SEQ ID NO: 270760 - protein, 20 aa, Mycobacterium
LTAPPARAEPGAEPNAATAN

SEQ ID NO: 270761 - protein, 8 aa, Mycobacterium
LTAPQRYG

SEQ ID NO: 270762 - protein, 7 aa, Mycobacterium
LTAQPDH

SEQ ID NO: 270763 - protein, 6 aa, Mycobacterium
LTAQRG

SEQ ID NO: 270764 - protein, 6 aa, Mycobacterium
LTARSD

SEQ ID NO: 270765 - protein, 4 aa, Mycobacterium
LTAS

SEQ ID NO: 270766 - protein, 13 aa, Mycobacterium
LTASGAQSPDGLA

SEQ ID NO: 270767 - protein, 13 aa, Mycobacterium
LTASGAQSSDGLA

SEQ ID NO: 270768 - protein, 14 aa, Mycobacterium
LTASGAQSTDGKAA

SEQ ID NO: 270769 - protein, 14 aa, Mycobacterium
LTASGSQSADDKAA

SEQ ID NO: 270770 - protein, 14 aa, Mycobacterium
LTASGSQSNDGKAA

SEQ ID NO: 270771 - protein, 14 aa, Mycobacterium
LTASGSQSSDDKAA

SEQ ID NO: 270772 - protein, 13 aa, Mycobacterium
LTASGVQSGDGKS

SEQ ID NO: 270773 - protein, 14 aa, Mycobacterium
LTASGVQSRDGRAA

SEQ ID NO: 270774 - protein, 7 aa, Mycobacterium
LTATAAT

SEQ ID NO: 270775 - protein, 12 aa, Mycobacterium
LTATAQALDGLG

SEQ ID NO: 270776 - protein, 5 aa, Mycobacterium
LTATG

SEQ ID NO: 270777 - protein, 17 aa, Mycobacterium
LTATGAATEVASSPEAL

SEQ ID NO: 270778 - protein, 5 aa, Mycobacterium
LTDAA

SEQ ID NO: 270779 - protein, 12 aa, Mycobacterium
LTDADSRGNNDD

SEQ ID NO: 270780 - protein, 13 aa, Mycobacterium
LTDAENLASTTGF

SEQ ID NO: 270781 - protein, 54 aa, Mycobacterium
LTDAQEREASTAAEPTDTDIDTEDTEDADAPEAVEDDSVDADVDETDATPATGA

SEQ ID NO: 270782 - protein, 6 aa, Mycobacterium
LTDAQN

SEQ ID NO: 270783 - protein, 9 aa, Mycobacterium
LTDDLGAQA

SEQ ID NO: 270784 - protein, 7 aa, Mycobacterium
LTDDPQY

SEQ ID NO: 270785 - protein, 5 aa, Mycobacterium
LTDGR

SEQ ID NO: 270786 - protein, 7 aa, Mycobacterium
LTDGRTV

SEQ ID NO: 270787 - protein, 11 aa, Mycobacterium
LTDNGFRASVG

SEQ ID NO: 270788 - protein, 12 aa, Mycobacterium
LTDNGKLDTRAL

SEQ ID NO: 270789 - protein, 7 aa, Mycobacterium
LTDPRRG

SEQ ID NO: 270790 - protein, 10 aa, Mycobacterium
LTDPSSGDLA

SEQ ID NO: 270791 - protein, 7 aa, Mycobacterium
LTDPVEQ

SEQ ID NO: 270792 - protein, 10 aa, Mycobacterium
LTDQGAPDIV

SEQ ID NO: 270793 - protein, 9 aa, Mycobacterium
LTDREPPDF

SEQ ID NO: 270794 - protein, 4 aa, Mycobacterium
LTDS

SEQ ID NO: 270795 - protein, 6 aa, Mycobacterium
LTDTTH

SEQ ID NO: 270796 - protein, 13 aa, Mycobacterium
LTEAGAQSNDGRA

SEQ ID NO: 270797 - protein, 14 aa, Mycobacterium
LTEAGAQSTDGKAT

SEQ ID NO: 270798 - protein, 13 aa, Mycobacterium
LTEASSGRIPNPY

SEQ ID NO: 270799 - protein, 13 aa, Mycobacterium
LTEASSGRVPNPY

SEQ ID NO: 270800 - protein, 12 aa, Mycobacterium
LTEETHDAERTI

SEQ ID NO: 270801 - protein, 9 aa, Mycobacterium
LTEGETADF

SEQ ID NO: 270802 - protein, 13 aa, Mycobacterium
LTEGSAQSPDGKA

SEQ ID NO: 270803 - protein, 7 aa, Mycobacterium
LTEHGSG

SEQ ID NO: 270804 - protein, 7 aa, Mycobacterium
LTENGAE

SEQ ID NO: 270805 - protein, 10 aa, Mycobacterium
LTEPDPNAGM

SEQ ID NO: 270806 - protein, 19 aa, Mycobacterium
LTEPLGPAAPPPPPPPPDL

SEQ ID NO: 270807 - protein, 4 aa, Mycobacterium
LTEQ

SEQ ID NO: 270808 - protein, 13 aa, Mycobacterium
LTERAASLDDDAY

SEQ ID NO: 270809 - protein, 15 aa, Mycobacterium
LTERSEAAASTGGLE

SEQ ID NO: 270810 - protein, 16 aa, Mycobacterium
LTESGAEEAVPAPQLR

SEQ ID NO: 270811 - protein, 14 aa, Mycobacterium
LTESGAQSTDGKAT

SEQ ID NO: 270812 - protein, 8 aa, Mycobacterium
LTETEREP

SEQ ID NO: 270813 - protein, 11 aa, Mycobacterium
LTETGAEATLS

SEQ ID NO: 270814 - protein, 10 aa, Mycobacterium
LTETGTRIND

SEQ ID NO: 270815 - protein, 11 aa, Mycobacterium
LTETGTRINDQ

SEQ ID NO: 270816 - protein, 4 aa, Mycobacterium
LTGA

SEQ ID NO: 270817 - protein, 9 aa, Mycobacterium
LTGAAPGPR

SEQ ID NO: 270818 - protein, 9 aa, Mycobacterium
LTGADAKTI

SEQ ID NO: 270819 - protein, 8 aa, Mycobacterium
LTGAGVSN

SEQ ID NO: 270820 - protein, 6 aa, Mycobacterium
LTGDDA

SEQ ID NO: 270821 - protein, 20 aa, Mycobacterium
LTGDESRKSWPSTYKVRDKR

SEQ ID NO: 270822 - protein, 31 aa, Mycobacterium
LTGDETAMAPAGLTGDETTVVPPPDAQEPQL

SEQ ID NO: 270823 - protein, 6 aa, Mycobacterium
LTGDNA

SEQ ID NO: 270824 - protein, 8 aa, Mycobacterium
LTGDPEYR

SEQ ID NO: 270825 - protein, 7 aa, Mycobacterium
LTGETAE

SEQ ID NO: 270826 - protein, 5 aa, Mycobacterium
LTGEV

SEQ ID NO: 270827 - protein, 5 aa, Mycobacterium
LTGGN

SEQ ID NO: 270828 - protein, 8 aa, Mycobacterium
LTGGPTTL

SEQ ID NO: 270829 - protein, 83 aa, Mycobacterium
LTGGTAPAHADSGGESSQTHGESRQSRASRDTAERPSQTRSADDGAGSNSDDRSTDDERPLATGNKTRLSKTTRESSSGEARF

SEQ ID NO: 270830 - protein, 4 aa, Mycobacterium
LTGH

SEQ ID NO: 270831 - protein, 9 aa, Mycobacterium
LTGHDGDDV

SEQ ID NO: 270832 - protein, 10 aa, Mycobacterium
LTGHDGDDYL

SEQ ID NO: 270833 - protein, 12 aa, Mycobacterium
LTGHEGDDYSGK

SEQ ID NO: 270834 - protein, 9 aa, Mycobacterium
LTGHQDDDY

SEQ ID NO: 270835 - protein, 7 aa, Mycobacterium
LTGHTGA

SEQ ID NO: 270836 - protein, 19 aa, Mycobacterium
LTGHTGPVESAGFSPDGRR

SEQ ID NO: 270837 - protein, 15 aa, Mycobacterium
LTGKENSDDVAAGRR

SEQ ID NO: 270838 - protein, 6 aa, Mycobacterium
LTGNED

SEQ ID NO: 270839 - protein, 5 aa, Mycobacterium
LTGNG

SEQ ID NO: 270840 - protein, 6 aa, Mycobacterium
LTGNLP

SEQ ID NO: 270841 - protein, 6 aa, Mycobacterium
LTGPAP

SEQ ID NO: 270842 - protein, 8 aa, Mycobacterium
LTGPDDQV

SEQ ID NO: 270843 - protein, 5 aa, Mycobacterium
LTGPE

SEQ ID NO: 270844 - protein, 13 aa, Mycobacterium
LTGPPKPAAPGAG

SEQ ID NO: 270845 - protein, 14 aa, Mycobacterium
LTGPPSAPAGMAAG

SEQ ID NO: 270846 - protein, 5 aa, Mycobacterium
LTGPQ

SEQ ID NO: 270847 - protein, 5 aa, Mycobacterium
LTGPR

SEQ ID NO: 270848 - protein, 8 aa, Mycobacterium
LTGPTSAI

SEQ ID NO: 270849 - protein, 8 aa, Mycobacterium
LTGPTSTV

SEQ ID NO: 270850 - protein, 4 aa, Mycobacterium
LTGQ

SEQ ID NO: 270851 - protein, 6 aa, Mycobacterium
LTGQGV

SEQ ID NO: 270852 - protein, 10 aa, Mycobacterium
LTGQPGPNQT

SEQ ID NO: 270853 - protein, 8 aa, Mycobacterium
LTGQPRAT

SEQ ID NO: 270854 - protein, 41 aa, Mycobacterium
LTGRDKSNPEPPPDPAEPPAPSSESRPPRRATTAHRVPVTA

SEQ ID NO: 270855 - protein, 15 aa, Mycobacterium
LTGRENSDDVAAGRR

SEQ ID NO: 270856 - protein, 11 aa, Mycobacterium
LTGRPGVNQTA

SEQ ID NO: 270857 - protein, 9 aa, Mycobacterium
LTGSDDADA

SEQ ID NO: 270858 - protein, 17 aa, Mycobacterium
LTGSGARAALSDKAQAQ

SEQ ID NO: 270859 - protein, 17 aa, Mycobacterium
LTGSGTRAALTPAAQAQ

SEQ ID NO: 270860 - protein, 7 aa, Mycobacterium
LTGSPEF

SEQ ID NO: 270861 - protein, 6 aa, Mycobacterium
LTGSPV

SEQ ID NO: 270862 - protein, 9 aa, Mycobacterium
LTGSPVSVA

SEQ ID NO: 270863 - protein, 9 aa, Mycobacterium
LTGSSLAGD

SEQ ID NO: 270864 - protein, 11 aa, Mycobacterium
LTGTIGKDQQR

SEQ ID NO: 270865 - protein, 5 aa, Mycobacterium
LTGTP

SEQ ID NO: 270866 - protein, 6 aa, Mycobacterium
LTGTSG

SEQ ID NO: 270867 - protein, 8 aa, Mycobacterium
LTKGDTRT

SEQ ID NO: 270868 - protein, 10 aa, Mycobacterium
LTKGSNRTPV

SEQ ID NO: 270869 - protein, 10 aa, Mycobacterium
LTKGTKRKPI

SEQ ID NO: 270870 - protein, 7 aa, Mycobacterium
LTKGTNR

SEQ ID NO: 270871 - protein, 19 aa, Mycobacterium
LTKPYAEGVPLNSANGVAE

SEQ ID NO: 270872 - protein, 10 aa, Mycobacterium
LTKSAVPKRI

SEQ ID NO: 270873 - protein, 18 aa, Mycobacterium
LTLPEGAQLPKTVPFEPG

SEQ ID NO: 270874 - protein, 4 aa, Mycobacterium
LTNA

SEQ ID NO: 270875 - protein, 12 aa, Mycobacterium
LTNADGNHHPWE

SEQ ID NO: 270876 - protein, 5 aa, Mycobacterium
LTNAP

SEQ ID NO: 270877 - protein, 6 aa, Mycobacterium
LTNAPQ

SEQ ID NO: 270878 - protein, 7 aa, Mycobacterium
LTNGADR

SEQ ID NO: 270879 - protein, 6 aa, Mycobacterium
LTNKGI

SEQ ID NO: 270880 - protein, 11 aa, Mycobacterium
LTNSNGNHHPW

SEQ ID NO: 270881 - protein, 9 aa, Mycobacterium
LTNTASQQA

SEQ ID NO: 270882 - protein, 5 aa, Mycobacterium
LTNTT

SEQ ID NO: 270883 - protein, 15 aa, Mycobacterium
LTNTTHETTKLTKET

SEQ ID NO: 270884 - protein, 4 aa, Mycobacterium
LTPA

SEQ ID NO: 270885 - protein, 6 aa, Mycobacterium
LTPAEG

SEQ ID NO: 270886 - protein, 19 aa, Mycobacterium
LTPAPAAATETDAAESPSL

SEQ ID NO: 270887 - protein, 10 aa, Mycobacterium
LTPARRGDQV

SEQ ID NO: 270888 - protein, 6 aa, Mycobacterium
LTPATQ

SEQ ID NO: 270889 - protein, 6 aa, Mycobacterium
LTPATR

SEQ ID NO: 270890 - protein, 4 aa, Mycobacterium
LTPD

SEQ ID NO: 270891 - protein, 7 aa, Mycobacterium
LTPDEQD

SEQ ID NO: 270892 - protein, 6 aa, Mycobacterium
LTPDER

SEQ ID NO: 270893 - protein, 14 aa, Mycobacterium
LTPDPYQGADPSMP

SEQ ID NO: 270894 - protein, 5 aa, Mycobacterium
LTPDR

SEQ ID NO: 270895 - protein, 4 aa, Mycobacterium
LTPE

SEQ ID NO: 270896 - protein, 6 aa, Mycobacterium
LTPEAR

SEQ ID NO: 270897 - protein, 13 aa, Mycobacterium
LTPEDPREDGATS

SEQ ID NO: 270898 - protein, 11 aa, Mycobacterium
LTPEEIGRATS

SEQ ID NO: 270899 - protein, 10 aa, Mycobacterium
LTPEGQPSKF

SEQ ID NO: 270900 - protein, 6 aa, Mycobacterium
LTPEGV

SEQ ID NO: 270901 - protein, 5 aa, Mycobacterium
LTPER

SEQ ID NO: 270902 - protein, 14 aa, Mycobacterium
LTPESRPETRVPAP

SEQ ID NO: 270903 - protein, 8 aa, Mycobacterium
LTPGASLS

SEQ ID NO: 270904 - protein, 7 aa, Mycobacterium
LTPGGAQ

SEQ ID NO: 270905 - protein, 9 aa, Mycobacterium
LTPGGELSS

SEQ ID NO: 270906 - protein, 6 aa, Mycobacterium
LTPGGS

SEQ ID NO: 270907 - protein, 7 aa, Mycobacterium
LTPGGTA

SEQ ID NO: 270908 - protein, 19 aa, Mycobacterium
LTPGPTTSHPRKPRPAFQD

SEQ ID NO: 270909 - protein, 7 aa, Mycobacterium
LTPGQRR

SEQ ID NO: 270910 - protein, 7 aa, Mycobacterium
LTPGRGF

SEQ ID NO: 270911 - protein, 12 aa, Mycobacterium
LTPGRGLRNGPF

SEQ ID NO: 270912 - protein, 5 aa, Mycobacterium
LTPGT

SEQ ID NO: 270913 - protein, 7 aa, Mycobacterium
LTPKPGR

SEQ ID NO: 270914 - protein, 18 aa, Mycobacterium
LTPNDPKWQPGFEDADTS

SEQ ID NO: 270915 - protein, 4 aa, Mycobacterium
LTPP

SEQ ID NO: 270916 - protein, 6 aa, Mycobacterium
LTPPDD

SEQ ID NO: 270917 - protein, 9 aa, Mycobacterium
LTPPEPPAR

SEQ ID NO: 270918 - protein, 7 aa, Mycobacterium
LTPPGSF

SEQ ID NO: 270919 - protein, 6 aa, Mycobacterium
LTPPGT

SEQ ID NO: 270920 - protein, 7 aa, Mycobacterium
LTPPGTF

SEQ ID NO: 270921 - protein, 7 aa, Mycobacterium
LTPPGTY

SEQ ID NO: 270922 - protein, 13 aa, Mycobacterium
LTPPGWTPSSPGW

SEQ ID NO: 270923 - protein, 7 aa, Mycobacterium
LTPPKGV

SEQ ID NO: 270924 - protein, 13 aa, Mycobacterium
LTPPNESTLPAVR

SEQ ID NO: 270925 - protein, 145 aa, Mycobacterium
LTPPPPKPAYEQQPQYGQYGAPSQYYGQQPGQQPGQQPGQHGQQPGQQQGQPSYQQGQRPGYPSQYGGYSAGPSTGGFPTPGSQPGGQQHGQQSGPPTPPTGFPTYGQPQQSSGPSSAPTSQVPAQPQQQQPGQQPSSPQSGQSS

SEQ ID NO: 270926 - protein, 8 aa, Mycobacterium
LTPPRAGV

SEQ ID NO: 270927 - protein, 27 aa, Mycobacterium
LTPPYRGGPTLQDGDTIGLDKTKTPVE

SEQ ID NO: 270928 - protein, 5 aa, Mycobacterium
LTPRR

SEQ ID NO: 270929 - protein, 8 aa, Mycobacterium
LTPRRAGV

SEQ ID NO: 270930 - protein, 8 aa, Mycobacterium
LTPSGALT

SEQ ID NO: 270931 - protein, 9 aa, Mycobacterium
LTPSGALTE

SEQ ID NO: 270932 - protein, 9 aa, Mycobacterium
LTPSGKLDR

SEQ ID NO: 270933 - protein, 7 aa, Mycobacterium
LTPSPDD

SEQ ID NO: 270934 - protein, 10 aa, Mycobacterium
LTPSQGRPAR

SEQ ID NO: 270935 - protein, 8 aa, Mycobacterium
LTPSQPAF

SEQ ID NO: 270936 - protein, 13 aa, Mycobacterium
LTPSRKSGSDAVE

SEQ ID NO: 270937 - protein, 6 aa, Mycobacterium
LTPSRV

SEQ ID NO: 270938 - protein, 11 aa, Mycobacterium
LTPSSSALPAH

SEQ ID NO: 270939 - protein, 5 aa, Mycobacterium
LTPTG

SEQ ID NO: 270940 - protein, 14 aa, Mycobacterium
LTPTQARQKLKDAG

SEQ ID NO: 270941 - protein, 5 aa, Mycobacterium
LTPTT

SEQ ID NO: 270942 - protein, 5 aa, Mycobacterium
LTQAE

SEQ ID NO: 270943 - protein, 5 aa, Mycobacterium
LTQAG

SEQ ID NO: 270944 - protein, 12 aa, Mycobacterium
LTQAGEQARQAA

SEQ ID NO: 270945 - protein, 27 aa, Mycobacterium
LTQASNAEKKPPGQKASAGAPHAAGNN

SEQ ID NO: 270946 - protein, 15 aa, Mycobacterium
LTQASSADGQGRGAN

SEQ ID NO: 270947 - protein, 11 aa, Mycobacterium
LTQATQGGGGA

SEQ ID NO: 270948 - protein, 5 aa, Mycobacterium
LTQDH

SEQ ID NO: 270949 - protein, 10 aa, Mycobacterium
LTQDSTEMGK

SEQ ID NO: 270950 - protein, 7 aa, Mycobacterium
LTQGATA

SEQ ID NO: 270951 - protein, 7 aa, Mycobacterium
LTQGEAI

SEQ ID NO: 270952 - protein, 7 aa, Mycobacterium
LTQISKD

SEQ ID NO: 270953 - protein, 7 aa, Mycobacterium
LTQITKD

SEQ ID NO: 270954 - protein, 15 aa, Mycobacterium
LTQLGDSSDPRVSKT

SEQ ID NO: 270955 - protein, 5 aa, Mycobacterium
LTQPG

SEQ ID NO: 270956 - protein, 32 aa, Mycobacterium
LTQPGQADDQETDEKSGVDTDSREPTSAQVRG

SEQ ID NO: 270957 - protein, 4 aa, Mycobacterium
LTQR

SEQ ID NO: 270958 - protein, 8 aa, Mycobacterium
LTQTTAST

SEQ ID NO: 270959 - protein, 11 aa, Mycobacterium
LTRDRDGVTVR

SEQ ID NO: 270960 - protein, 14 aa, Mycobacterium
LTRDRNPVATAGPL

SEQ ID NO: 270961 - protein, 10 aa, Mycobacterium
LTREDRGYHK

SEQ ID NO: 270962 - protein, 6 aa, Mycobacterium
LTREGA

SEQ ID NO: 270963 - protein, 6 aa, Mycobacterium
LTRETP

SEQ ID NO: 270964 - protein, 11 aa, Mycobacterium
LTRGPPPHTRP

SEQ ID NO: 270965 - protein, 9 aa, Mycobacterium
LTRGSDGGW

SEQ ID NO: 270966 - protein, 10 aa, Mycobacterium
LTRGTKRKPI

SEQ ID NO: 270967 - protein, 4 aa, Mycobacterium
LTRH

SEQ ID NO: 270968 - protein, 5 aa, Mycobacterium
LTRKQ

SEQ ID NO: 270969 - protein, 6 aa, Mycobacterium
LTRPHR

SEQ ID NO: 270970 - protein, 13 aa, Mycobacterium
LTRPNGEPLQQTK

SEQ ID NO: 270971 - protein, 14 aa, Mycobacterium
LTRQADAGTPAGGL

SEQ ID NO: 270972 - protein, 11 aa, Mycobacterium
LTRQANPKLPA

SEQ ID NO: 270973 - protein, 12 aa, Mycobacterium
LTRQANPKLPTL

SEQ ID NO: 270974 - protein, 14 aa, Mycobacterium
LTRQDSSALPPTTE

SEQ ID NO: 270975 - protein, 14 aa, Mycobacterium
LTRQDSSDLPPTTE

SEQ ID NO: 270976 - protein, 14 aa, Mycobacterium
LTRQDSSVLPETTE

SEQ ID NO: 270977 - protein, 8 aa, Mycobacterium
LTRQSDGS

SEQ ID NO: 270978 - protein, 5 aa, Mycobacterium
LTRRP

SEQ ID NO: 270979 - protein, 6 aa, Mycobacterium
LTRRSD

SEQ ID NO: 270980 - protein, 4 aa, Mycobacterium
LTSA

SEQ ID NO: 270981 - protein, 16 aa, Mycobacterium
LTSAESAENDTSGVES

SEQ ID NO: 270982 - protein, 6 aa, Mycobacterium
LTSAPP

SEQ ID NO: 270983 - protein, 8 aa, Mycobacterium
LTSDKTVN

SEQ ID NO: 270984 - protein, 8 aa, Mycobacterium
LTSEQATA

SEQ ID NO: 270985 - protein, 15 aa, Mycobacterium
LTSEQPMSRADRDTS

SEQ ID NO: 270986 - protein, 5 aa, Mycobacterium
LTSGN

SEQ ID NO: 270987 - protein, 6 aa, Mycobacterium
LTSGNR

SEQ ID NO: 270988 - protein, 8 aa, Mycobacterium
LTSGQRLA

SEQ ID NO: 270989 - protein, 4 aa, Mycobacterium
LTSN

SEQ ID NO: 270990 - protein, 25 aa, Mycobacterium
LTSNGNDVTMRPDRDTNARRTAPDT

SEQ ID NO: 270991 - protein, 8 aa, Mycobacterium
LTSPAADS

SEQ ID NO: 270992 - protein, 11 aa, Mycobacterium
LTSPDDEDPAI

SEQ ID NO: 270993 - protein, 12 aa, Mycobacterium
LTSPDDEDPKVA

SEQ ID NO: 270994 - protein, 13 aa, Mycobacterium
LTSPKKPTPQRIT

SEQ ID NO: 270995 - protein, 12 aa, Mycobacterium
LTSPTDPAPQHI

SEQ ID NO: 270996 - protein, 11 aa, Mycobacterium
LTSSGAKATLA

SEQ ID NO: 270997 - protein, 17 aa, Mycobacterium
LTSSGTRDDLTPTAQTQ

SEQ ID NO: 270998 - protein, 8 aa, Mycobacterium
LTSSPDDY

SEQ ID NO: 270999 - protein, 15 aa, Mycobacterium
LTSSPVPPVAGATPV

SEQ ID NO: 271000 - protein, 10 aa, Mycobacterium
LTSSQAPPVR

SEQ ID NO: 271001 - protein, 4 aa, Mycobacterium
LTST

SEQ ID NO: 271002 - protein, 9 aa, Mycobacterium
LTSTDPDSR

SEQ ID NO: 271003 - protein, 5 aa, Mycobacterium
LTSTG

SEQ ID NO: 271004 - protein, 33 aa, Mycobacterium
LTSTSGDSTPVTETSTTYSMGPSPEGPPPEPVT

SEQ ID NO: 271005 - protein, 9 aa, Mycobacterium
LTTAPATEA

SEQ ID NO: 271006 - protein, 7 aa, Mycobacterium
LTTAPGE

SEQ ID NO: 271007 - protein, 23 aa, Mycobacterium
LTTATTADGNAPIPPSGQGSTYR

SEQ ID NO: 271008 - protein, 11 aa, Mycobacterium
LTTDDRTGLTG

SEQ ID NO: 271009 - protein, 11 aa, Mycobacterium
LTTDERTGLTG

SEQ ID NO: 271010 - protein, 4 aa, Mycobacterium
LTTG

SEQ ID NO: 271011 - protein, 48 aa, Mycobacterium
LTTGHDDDTPDTEGATADTEGATADTTVGERAPIDAETRPNDQQRGLV

SEQ ID NO: 271012 - protein, 5 aa, Mycobacterium
LTTGN

SEQ ID NO: 271013 - protein, 10 aa, Mycobacterium
LTTGPDSGTE

SEQ ID NO: 271014 - protein, 7 aa, Mycobacterium
LTTKDEY

SEQ ID NO: 271015 - protein, 6 aa, Mycobacterium
LTTPDE

SEQ ID NO: 271016 - protein, 10 aa, Mycobacterium
LTTPEQRQEA

SEQ ID NO: 271017 - protein, 15 aa, Mycobacterium
LTTPKTRRRNGSTRT

SEQ ID NO: 271018 - protein, 6 aa, Mycobacterium
LTTPRA

SEQ ID NO: 271019 - protein, 11 aa, Mycobacterium
LTTPRDDRGNV

SEQ ID NO: 271020 - protein, 4 aa, Mycobacterium
LTTQ

SEQ ID NO: 271021 - protein, 4 aa, Mycobacterium
LTTR

SEQ ID NO: 271022 - protein, 7 aa, Mycobacterium
LTTSPSL

SEQ ID NO: 271023 - protein, 5 aa, Mycobacterium
LTTSR

SEQ ID NO: 271024 - protein, 10 aa, Mycobacterium
LTTTGQRYDE

SEQ ID NO: 271025 - protein, 6 aa, Mycobacterium
LTTTPL

SEQ ID NO: 271026 - protein, 5 aa, Mycobacterium
LTVDE

SEQ ID NO: 271027 - protein, 25 aa, Mycobacterium
LVDPEDDLTPVGYPGDFNPSTGTTT

SEQ ID NO: 271028 - protein, 8 aa, Mycobacterium
LVEGPPPR

SEQ ID NO: 271029 - protein, 8 aa, Mycobacterium
LVGPDGGL

SEQ ID NO: 271030 - protein, 9 aa, Mycobacterium
LVGPENRNR

SEQ ID NO: 271031 - protein, 15 aa, Mycobacterium
LVGPPQKSGLGRRGV

SEQ ID NO: 271032 - protein, 14 aa, Mycobacterium
LVGPSTPDGPGHRG

SEQ ID NO: 271033 - protein, 4 aa, Mycobacterium
LVGT

SEQ ID NO: 271034 - protein, 17 aa, Mycobacterium
LVNPNPDLRDPNPPVPP

SEQ ID NO: 271035 - protein, 5 aa, Mycobacterium
LVPED

SEQ ID NO: 271036 - protein, 9 aa, Mycobacterium
LVPGDDQAR

SEQ ID NO: 271037 - protein, 24 aa, Mycobacterium
LVPPDGPPRPDQPMRRSNSCSAPI

SEQ ID NO: 271038 - protein, 79 aa, Mycobacterium
LVPPPQLPAPLSPPAPVAPKPGDPPPRPAAPAPAAPAPAPAAPAPAPAAPGPGSAEAPFAPASFGGNVGPVGSQQEQRQ

SEQ ID NO: 271039 - protein, 12 aa, Mycobacterium
LVPSEASKHRQA

SEQ ID NO: 271040 - protein, 8 aa, Mycobacterium
LVRPPTPR

SEQ ID NO: 271041 - protein, 8 aa, Mycobacterium
LVTGGGTV

SEQ ID NO: 271042 - protein, 16 aa, Mycobacterium
LYDKDEDSKVTARAQQ

SEQ ID NO: 271043 - protein, 8 aa, Mycobacterium
LYDPKSAV

SEQ ID NO: 271044 - protein, 15 aa, Mycobacterium
LYDSGDDAGAAEAAN

SEQ ID NO: 271045 - protein, 13 aa, Mycobacterium
LYGEESKNPRRTV

SEQ ID NO: 271046 - protein, 7 aa, Mycobacterium
LYGPPKA

SEQ ID NO: 271047 - protein, 5 aa, Mycobacterium
LYPDN

SEQ ID NO: 271048 - protein, 10 aa, Mycobacterium
LYSGPGSASM

SEQ ID NO: 271049 - protein, 6 aa, Mycobacterium
LYTSRG

SEQ ID NO: 271050 - protein, 5 aa, Mycobacterium
MAADP

SEQ ID NO: 271051 - protein, 10 aa, Mycobacterium
MAAGATAPGW

SEQ ID NO: 271052 - protein, 7 aa, Mycobacterium
MAAQAGA

SEQ ID NO: 271053 - protein, 22 aa, Mycobacterium
MAATDVPPDRLTAAKEAGKQFA

SEQ ID NO: 271054 - protein, 5 aa, Mycobacterium
MADSS

SEQ ID NO: 271055 - protein, 10 aa, Mycobacterium
MAEEASRTEA

SEQ ID NO: 271056 - protein, 9 aa, Mycobacterium
MAEETKDPV

SEQ ID NO: 271057 - protein, 11 aa, Mycobacterium
MAEETKDPVRT

SEQ ID NO: 271058 - protein, 13 aa, Mycobacterium
MAEPKRPAKPVTA

SEQ ID NO: 271059 - protein, 4 aa, Mycobacterium
MAER

SEQ ID NO: 271060 - protein, 14 aa, Mycobacterium
MAERDTGGLSGGEL

SEQ ID NO: 271061 - protein, 12 aa, Mycobacterium
MAEREPELRRQA

SEQ ID NO: 271062 - protein, 6 aa, Mycobacterium
MAETQA

SEQ ID NO: 271063 - protein, 5 aa, Mycobacterium
MAGAP

SEQ ID NO: 271064 - protein, 5 aa, Mycobacterium
MAGGA

SEQ ID NO: 271065 - protein, 5 aa, Mycobacterium
MAGGG

SEQ ID NO: 271066 - protein, 5 aa, Mycobacterium
MAGGN

SEQ ID NO: 271067 - protein, 7 aa, Mycobacterium
MAGPRTT

SEQ ID NO: 271068 - protein, 9 aa, Mycobacterium
MAGQDEGEY

SEQ ID NO: 271069 - protein, 9 aa, Mycobacterium
MAGQDESEY

SEQ ID NO: 271070 - protein, 6 aa, Mycobacterium
MAGQDR

SEQ ID NO: 271071 - protein, 7 aa, Mycobacterium
MAGTGGV

SEQ ID NO: 271072 - protein, 8 aa, Mycobacterium
MAGTGSVV

SEQ ID NO: 271073 - protein, 4 aa, Mycobacterium
MAHS

SEQ ID NO: 271074 - protein, 12 aa, Mycobacterium
MAKDPDDRYQTA

SEQ ID NO: 271075 - protein, 14 aa, Mycobacterium
MAKKPAKRYQTAGQ

SEQ ID NO: 271076 - protein, 10 aa, Mycobacterium
MAKNPDERYM

SEQ ID NO: 271077 - protein, 10 aa, Mycobacterium
MAKNPQERYM

SEQ ID NO: 271078 - protein, 11 aa, Mycobacterium
MAPADSEDEKL

SEQ ID NO: 271079 - protein, 24 aa, Mycobacterium
MAPAPLSSTPDQVAAATTRALAKG

SEQ ID NO: 271080 - protein, 7 aa, Mycobacterium
MAPASAD

SEQ ID NO: 271081 - protein, 88 aa, Mycobacterium
MAPPATPPSPAPTANTPPPSAAGLTPVPAQGAPPWRPESGPFPSAAQPPTTPPYYQPAGPTWGPPPPGTPQPFTGPPAWNPPPPNRRN

SEQ ID NO: 271082 - protein, 15 aa, Mycobacterium
MAPPPYGGPPPYGAH

SEQ ID NO: 271083 - protein, 8 aa, Mycobacterium
MAPQPPAT

SEQ ID NO: 271084 - protein, 15 aa, Mycobacterium
MAPQSAPGDARRGFL

SEQ ID NO: 271085 - protein, 13 aa, Mycobacterium
MAPSGSAADAEAA

SEQ ID NO: 271086 - protein, 12 aa, Mycobacterium
MAPTGPYDPDRE

SEQ ID NO: 271087 - protein, 43 aa, Mycobacterium
MAQQGKGTAPAEDTAQAEATTVEDVEGAGADSAGAAAGRAPIE

SEQ ID NO: 271088 - protein, 12 aa, Mycobacterium
MAQTSDDTADVR

SEQ ID NO: 271089 - protein, 10 aa, Mycobacterium
MARASTGSGG

SEQ ID NO: 271090 - protein, 4 aa, Mycobacterium
MARP

SEQ ID NO: 271091 - protein, 6 aa, Mycobacterium
MASGNP

SEQ ID NO: 271092 - protein, 17 aa, Mycobacterium
MASSGLSAESVSSPEAL

SEQ ID NO: 271093 - protein, 7 aa, Mycobacterium
MATEDKK

SEQ ID NO: 271094 - protein, 4 aa, Mycobacterium
MATP

SEQ ID NO: 271095 - protein, 6 aa, Mycobacterium
MATPSI

SEQ ID NO: 271096 - protein, 8 aa, Mycobacterium
MATPSSGL

SEQ ID NO: 271097 - protein, 4 aa, Mycobacterium
MATV

SEQ ID NO: 271098 - protein, 6 aa, Mycobacterium
MDADPE

SEQ ID NO: 271099 - protein, 8 aa, Mycobacterium
MDAPSHTR

SEQ ID NO: 271100 - protein, 5 aa, Mycobacterium
MDARD

SEQ ID NO: 271101 - protein, 11 aa, Mycobacterium
MDASDPAVAAT

SEQ ID NO: 271102 - protein, 4 aa, Mycobacterium
MDDG

SEQ ID NO: 271103 - protein, 6 aa, Mycobacterium
MDDTDE

SEQ ID NO: 271104 - protein, 18 aa, Mycobacterium
MDEDDERIRAASRRGTQN

SEQ ID NO: 271105 - protein, 5 aa, Mycobacterium
MDETD

SEQ ID NO: 271106 - protein, 7 aa, Mycobacterium
MDETTDD

SEQ ID NO: 271107 - protein, 9 aa, Mycobacterium
MDGKSNAAA

SEQ ID NO: 271108 - protein, 7 aa, Mycobacterium
MDGPALD

SEQ ID NO: 271109 - protein, 4 aa, Mycobacterium
MDGR

SEQ ID NO: 271110 - protein, 8 aa, Mycobacterium
MDKKPDLS

SEQ ID NO: 271111 - protein, 7 aa, Mycobacterium
MDPLPTT

SEQ ID NO: 271112 - protein, 6 aa, Mycobacterium
MDPLTG

SEQ ID NO: 271113 - protein, 4 aa, Mycobacterium
MDRD

SEQ ID NO: 271114 - protein, 8 aa, Mycobacterium
MDSKPDLS

SEQ ID NO: 271115 - protein, 9 aa, Mycobacterium
MDSNNKDAV

SEQ ID NO: 271116 - protein, 11 aa, Mycobacterium
MDSSAKDPSVM

SEQ ID NO: 271117 - protein, 4 aa, Mycobacterium
MDTA

SEQ ID NO: 271118 - protein, 7 aa, Mycobacterium
MDTSTAA

SEQ ID NO: 271119 - protein, 12 aa, Mycobacterium
MEAKGGPRGVAD

SEQ ID NO: 271120 - protein, 5 aa, Mycobacterium
MEEKP

SEQ ID NO: 271121 - protein, 19 aa, Mycobacterium
MEKQGSAAKLAAAQNQGLP

SEQ ID NO: 271122 - protein, 8 aa, Mycobacterium
MEKTRDNL

SEQ ID NO: 271123 - protein, 6 aa, Mycobacterium
MENNRG

SEQ ID NO: 271124 - protein, 10 aa, Mycobacterium
MENSATSERS

SEQ ID NO: 271125 - protein, 5 aa, Mycobacterium
MEPET

SEQ ID NO: 271126 - protein, 4 aa, Mycobacterium
MEPR

SEQ ID NO: 271127 - protein, 14 aa, Mycobacterium
MERPYRTPGGIATS

SEQ ID NO: 271128 - protein, 9 aa, Mycobacterium
MERTSTQDI

SEQ ID NO: 271129 - protein, 15 aa, Mycobacterium
MESAGGAQRPGTAAA

SEQ ID NO: 271130 - protein, 9 aa, Mycobacterium
MGAAPNEPG

SEQ ID NO: 271131 - protein, 11 aa, Mycobacterium
MGADDKATLSV

SEQ ID NO: 271132 - protein, 4 aa, Mycobacterium
MGAG

SEQ ID NO: 271133 - protein, 10 aa, Mycobacterium
MGAQNTTQRL

SEQ ID NO: 271134 - protein, 10 aa, Mycobacterium
MGDCGSPSVS

SEQ ID NO: 271135 - protein, 5 aa, Mycobacterium
MGDDR

SEQ ID NO: 271136 - protein, 9 aa, Mycobacterium
MGDSEKLQV

SEQ ID NO: 271137 - protein, 30 aa, Mycobacterium
MGDTAGRRNSGPNAREISVDSQSVPAAWRP

SEQ ID NO: 271138 - protein, 7 aa, Mycobacterium
MGEADPR

SEQ ID NO: 271139 - protein, 6 aa, Mycobacterium
MGEDAT

SEQ ID NO: 271140 - protein, 21 aa, Mycobacterium
MGEMSSQASMASTAEPEPQGL

SEQ ID NO: 271141 - protein, 9 aa, Mycobacterium
MGEQTDEQG

SEQ ID NO: 271142 - protein, 7 aa, Mycobacterium
MGESGNK

SEQ ID NO: 271143 - protein, 7 aa, Mycobacterium
MGETGGV

SEQ ID NO: 271144 - protein, 5 aa, Mycobacterium
MGGAN

SEQ ID NO: 271145 - protein, 9 aa, Mycobacterium
MGGANATNS

SEQ ID NO: 271146 - protein, 10 aa, Mycobacterium
MGGANATNSV

SEQ ID NO: 271147 - protein, 11 aa, Mycobacterium
MGGGDGPPPAR

SEQ ID NO: 271148 - protein, 12 aa, Mycobacterium
MGGHGATGMPGM

SEQ ID NO: 271149 - protein, 8 aa, Mycobacterium
MGGNGDAS

SEQ ID NO: 271150 - protein, 14 aa, Mycobacterium
MGGPPARRCSTNGR

SEQ ID NO: 271151 - protein, 14 aa, Mycobacterium
MGGPPARRISTNGP

SEQ ID NO: 271152 - protein, 8 aa, Mycobacterium
MGGTPTTR

SEQ ID NO: 271153 - protein, 7 aa, Mycobacterium
MGHAGDS

SEQ ID NO: 271154 - protein, 4 aa, Mycobacterium
MGHK

SEQ ID NO: 271155 - protein, 9 aa, Mycobacterium
MGHKKDSLE

SEQ ID NO: 271156 - protein, 8 aa, Mycobacterium
MGHTRSGS

SEQ ID NO: 271157 - protein, 4 aa, Mycobacterium
MGKA

SEQ ID NO: 271158 - protein, 9 aa, Mycobacterium
MGNAPNEPG

SEQ ID NO: 271159 - protein, 8 aa, Mycobacterium
MGNPDGFR

SEQ ID NO: 271160 - protein, 71 aa, Mycobacterium
MGNSPGPSLPYPDSGDPVGGSDAIGSTTANKPAHGGGADTRKGRAVTDTPGSSTRPVPTQSPSTGPVPTSV

SEQ ID NO: 271161 - protein, 11 aa, Mycobacterium
MGNYGGEQQDP

SEQ ID NO: 271162 - protein, 4 aa, Mycobacterium
MGPA

SEQ ID NO: 271163 - protein, 46 aa, Mycobacterium
MGPGGMGSGGMMGPGGMGSGGMMGPGGMGPGGPTGPQQTPTPSAPR

SEQ ID NO: 271164 - protein, 29 aa, Mycobacterium
MGPGGPGGMMGPGGPGGMMGPGSWGPGGM

SEQ ID NO: 271165 - protein, 6 aa, Mycobacterium
MGPGTV

SEQ ID NO: 271166 - protein, 10 aa, Mycobacterium
MGPNVQDSAS

SEQ ID NO: 271167 - protein, 5 aa, Mycobacterium
MGPPA

SEQ ID NO: 271168 - protein, 4 aa, Mycobacterium
MGRP

SEQ ID NO: 271169 - protein, 14 aa, Mycobacterium
MGSGQSNAQQNAGW

SEQ ID NO: 271170 - protein, 7 aa, Mycobacterium
MGSPGGM

SEQ ID NO: 271171 - protein, 6 aa, Mycobacterium
MGSSAM

SEQ ID NO: 271172 - protein, 4 aa, Mycobacterium
MGTA

SEQ ID NO: 271173 - protein, 20 aa, Mycobacterium
MGTAAANPILPQGHRGKPWQ

SEQ ID NO: 271174 - protein, 16 aa, Mycobacterium
MGTPAPQTKTLGRGAV

SEQ ID NO: 271175 - protein, 24 aa, Mycobacterium
MGTPLTGDEARKSWPSTYKVRDKR

SEQ ID NO: 271176 - protein, 24 aa, Mycobacterium
MGTPLTGDESRKSWPSTYKVRDKK

SEQ ID NO: 271177 - protein, 24 aa, Mycobacterium
MGTPLTGDESRKSWPSTYKVRDKR

SEQ ID NO: 271178 - protein, 5 aa, Mycobacterium
MGTPQ

SEQ ID NO: 271179 - protein, 40 aa, Mycobacterium
MGTPTYPDPAAAGTTRIPTAPPRPPVTPPPPAQDEPQTTR

SEQ ID NO: 271180 - protein, 8 aa, Mycobacterium
MGTQSDYS

SEQ ID NO: 271181 - protein, 9 aa, Mycobacterium
MGTQSDYSH

SEQ ID NO: 271182 - protein, 22 aa, Mycobacterium
MGTSEITSARNYQYGAAGTLPG

SEQ ID NO: 271183 - protein, 5 aa, Mycobacterium
MGTTD

SEQ ID NO: 271184 - protein, 8 aa, Mycobacterium
MGTTPTGT

SEQ ID NO: 271185 - protein, 4 aa, Mycobacterium
MGVG

SEQ ID NO: 271186 - protein, 5 aa, Mycobacterium
MHSGE

SEQ ID NO: 271187 - protein, 9 aa, Mycobacterium
MHSGPTTEL

SEQ ID NO: 271188 - protein, 8 aa, Mycobacterium
MHSPGAGG

SEQ ID NO: 271189 - protein, 8 aa, Mycobacterium
MHTPTPTE

SEQ ID NO: 271190 - protein, 10 aa, Mycobacterium
MIPESEGRQV

SEQ ID NO: 271191 - protein, 8 aa, Mycobacterium
MKDPHNRS

SEQ ID NO: 271192 - protein, 6 aa, Mycobacterium
MKGDPS

SEQ ID NO: 271193 - protein, 7 aa, Mycobacterium
MKGNGDA

SEQ ID NO: 271194 - protein, 4 aa, Mycobacterium
MKHG

SEQ ID NO: 271195 - protein, 7 aa, Mycobacterium
MKNQKQT

SEQ ID NO: 271196 - protein, 10 aa, Mycobacterium
MKSQAADAYE

SEQ ID NO: 271197 - protein, 7 aa, Mycobacterium
MKTQDGT

SEQ ID NO: 271198 - protein, 7 aa, Mycobacterium
MKTSQGN

SEQ ID NO: 271199 - protein, 18 aa, Mycobacterium
MNESGPAAGGPPAAPQLS

SEQ ID NO: 271200 - protein, 9 aa, Mycobacterium
MNFSGGQRQ

SEQ ID NO: 271201 - protein, 7 aa, Mycobacterium
MNGEAGA

SEQ ID NO: 271202 - protein, 4 aa, Mycobacterium
MNGT

SEQ ID NO: 271203 - protein, 16 aa, Mycobacterium
MNGTTEGILPPDASAR

SEQ ID NO: 271204 - protein, 13 aa, Mycobacterium
MNPDAAPSFQATQ

SEQ ID NO: 271205 - protein, 6 aa, Mycobacterium
MNPNGG

SEQ ID NO: 271206 - protein, 9 aa, Mycobacterium
MNPRDAPSA

SEQ ID NO: 271207 - protein, 5 aa, Mycobacterium
MNTRG

SEQ ID NO: 271208 - protein, 4 aa, Mycobacterium
MPAE

SEQ ID NO: 271209 - protein, 7 aa, Mycobacterium
MPAEPSI

SEQ ID NO: 271210 - protein, 5 aa, Mycobacterium
MPAGG

SEQ ID NO: 271211 - protein, 8 aa, Mycobacterium
MPAPAGAI

SEQ ID NO: 271212 - protein, 11 aa, Mycobacterium
MPASAESTISS

SEQ ID NO: 271213 - protein, 4 aa, Mycobacterium
MPAT

SEQ ID NO: 271214 - protein, 11 aa, Mycobacterium
MPDANPQDDIR

SEQ ID NO: 271215 - protein, 5 aa, Mycobacterium
MPDDK

SEQ ID NO: 271216 - protein, 8 aa, Mycobacterium
MPDEQRKE

SEQ ID NO: 271217 - protein, 20 aa, Mycobacterium
MPDGRYATDNIGSPAAADTT

SEQ ID NO: 271218 - protein, 11 aa, Mycobacterium
MPDPPKSMTSK

SEQ ID NO: 271219 - protein, 14 aa, Mycobacterium
MPDPPSSRPLTRAE

SEQ ID NO: 271220 - protein, 15 aa, Mycobacterium
MPEADRSRWSQATSG

SEQ ID NO: 271221 - protein, 21 aa, Mycobacterium
MPEPLPSHGEGPYWAPTPAAD

SEQ ID NO: 271222 - protein, 8 aa, Mycobacterium
MPEQRQEA

SEQ ID NO: 271223 - protein, 4 aa, Mycobacterium
MPES

SEQ ID NO: 271224 - protein, 8 aa, Mycobacterium
MPGAPYTG

SEQ ID NO: 271225 - protein, 11 aa, Mycobacterium
MPGEDVTQRQL

SEQ ID NO: 271226 - protein, 5 aa, Mycobacterium
MPGEN

SEQ ID NO: 271227 - protein, 12 aa, Mycobacterium
MPGGGTADATTE

SEQ ID NO: 271228 - protein, 5 aa, Mycobacterium
MPGGY

SEQ ID NO: 271229 - protein, 10 aa, Mycobacterium
MPGLTQGKPF

SEQ ID NO: 271230 - protein, 8 aa, Mycobacterium
MPGNGAQI

SEQ ID NO: 271231 - protein, 13 aa, Mycobacterium
MPGPVAASESHSD

SEQ ID NO: 271232 - protein, 11 aa, Mycobacterium
MPGQEGAKSRL

SEQ ID NO: 271233 - protein, 11 aa, Mycobacterium
MPGQEGGKTRL

SEQ ID NO: 271234 - protein, 4 aa, Mycobacterium
MPGS

SEQ ID NO: 271235 - protein, 7 aa, Mycobacterium
MPHTPPA

SEQ ID NO: 271236 - protein, 7 aa, Mycobacterium
MPHTTPA

SEQ ID NO: 271237 - protein, 7 aa, Mycobacterium
MPKPQGW

SEQ ID NO: 271238 - protein, 8 aa, Mycobacterium
MPKQPMEA

SEQ ID NO: 271239 - protein, 5 aa, Mycobacterium
MPNAT

SEQ ID NO: 271240 - protein, 9 aa, Mycobacterium
MPNPTTLPA

SEQ ID NO: 271241 - protein, 16 aa, Mycobacterium
MPNRPERRLPQRSGEN

SEQ ID NO: 271242 - protein, 10 aa, Mycobacterium
MPNTETPDQM

SEQ ID NO: 271243 - protein, 5 aa, Mycobacterium
MPPAA

SEQ ID NO: 271244 - protein, 12 aa, Mycobacterium
MPPAEVSQTQLR

SEQ ID NO: 271245 - protein, 12 aa, Mycobacterium
MPPEAPSAVAAA

SEQ ID NO: 271246 - protein, 15 aa, Mycobacterium
MPPEPEQDAAQTEIP

SEQ ID NO: 271247 - protein, 10 aa, Mycobacterium
MPPESSQPGW

SEQ ID NO: 271248 - protein, 5 aa, Mycobacterium
MPPGF

SEQ ID NO: 271249 - protein, 5 aa, Mycobacterium
MPPKS

SEQ ID NO: 271250 - protein, 12 aa, Mycobacterium
MPPPDASQAELR

SEQ ID NO: 271251 - protein, 7 aa, Mycobacterium
MPPPPGI

SEQ ID NO: 271252 - protein, 18 aa, Mycobacterium
MPPTGASKDLRANGSGLQ

SEQ ID NO: 271253 - protein, 4 aa, Mycobacterium
MPPV

SEQ ID NO: 271254 - protein, 8 aa, Mycobacterium
MPQKPDLS

SEQ ID NO: 271255 - protein, 9 aa, Mycobacterium
MPRPDTPAF

SEQ ID NO: 271256 - protein, 15 aa, Mycobacterium
MPRRPAGGGIDEDAA

SEQ ID NO: 271257 - protein, 9 aa, Mycobacterium
MPRSRGAAS

SEQ ID NO: 271258 - protein, 5 aa, Mycobacterium
MPRTT

SEQ ID NO: 271259 - protein, 4 aa, Mycobacterium
MPSA

SEQ ID NO: 271260 - protein, 6 aa, Mycobacterium
MPSAAG

SEQ ID NO: 271261 - protein, 7 aa, Mycobacterium
MPSGTDR

SEQ ID NO: 271262 - protein, 9 aa, Mycobacterium
MPSHSGGSH

SEQ ID NO: 271263 - protein, 8 aa, Mycobacterium
MPSNTQAA

SEQ ID NO: 271264 - protein, 13 aa, Mycobacterium
MPSNVGDAAAGRH

SEQ ID NO: 271265 - protein, 6 aa, Mycobacterium
MPSPDS

SEQ ID NO: 271266 - protein, 9 aa, Mycobacterium
MPSPPKSMT

SEQ ID NO: 271267 - protein, 10 aa, Mycobacterium
MPSRPPLPAA

SEQ ID NO: 271268 - protein, 11 aa, Mycobacterium
MPSSRYSEIAP

SEQ ID NO: 271269 - protein, 9 aa, Mycobacterium
MPSTEPAEK

SEQ ID NO: 271270 - protein, 9 aa, Mycobacterium
MPSTETPEK

SEQ ID NO: 271271 - protein, 11 aa, Mycobacterium
MPTDDGGKTRL

SEQ ID NO: 271272 - protein, 11 aa, Mycobacterium
MPTDEGGRSRL

SEQ ID NO: 271273 - protein, 10 aa, Mycobacterium
MPTNTQSAAA

SEQ ID NO: 271274 - protein, 7 aa, Mycobacterium
MPTPATP

SEQ ID NO: 271275 - protein, 8 aa, Mycobacterium
MPTPGSAV

SEQ ID NO: 271276 - protein, 16 aa, Mycobacterium
MPTPPGWADAGTRTPA

SEQ ID NO: 271277 - protein, 5 aa, Mycobacterium
MPTPV

SEQ ID NO: 271278 - protein, 10 aa, Mycobacterium
MPTSETPDQM

SEQ ID NO: 271279 - protein, 14 aa, Mycobacterium
MPVTGTERHAPAIA

SEQ ID NO: 271280 - protein, 8 aa, Mycobacterium
MQANTDQL

SEQ ID NO: 271281 - protein, 12 aa, Mycobacterium
MQAPEGLQSTAT

SEQ ID NO: 271282 - protein, 10 aa, Mycobacterium
MQDDQRRAAE

SEQ ID NO: 271283 - protein, 6 aa, Mycobacterium
MQEGAN

SEQ ID NO: 271284 - protein, 6 aa, Mycobacterium
MQEGNN

SEQ ID NO: 271285 - protein, 7 aa, Mycobacterium
MQGDPRS

SEQ ID NO: 271286 - protein, 8 aa, Mycobacterium
MQGQQVGP

SEQ ID NO: 271287 - protein, 22 aa, Mycobacterium
MQKAQSAQNQQYRRNNGTRTMP

SEQ ID NO: 271288 - protein, 5 aa, Mycobacterium
MQPSE

SEQ ID NO: 271289 - protein, 6 aa, Mycobacterium
MQPSEL

SEQ ID NO: 271290 - protein, 17 aa, Mycobacterium
MQQGANALAQGSRAVAD

SEQ ID NO: 271291 - protein, 15 aa, Mycobacterium
MQQGASALAQGSRAI

SEQ ID NO: 271292 - protein, 6 aa, Mycobacterium
MQQGGA

SEQ ID NO: 271293 - protein, 6 aa, Mycobacterium
MQRGQS

SEQ ID NO: 271294 - protein, 11 aa, Mycobacterium
MQSDERHNREV

SEQ ID NO: 271295 - protein, 10 aa, Mycobacterium
MQSGTGLPEP

SEQ ID NO: 271296 - protein, 7 aa, Mycobacterium
MQSLTDP

SEQ ID NO: 271297 - protein, 7 aa, Mycobacterium
MQSQTTM

SEQ ID NO: 271298 - protein, 8 aa, Mycobacterium
MQTENKDL

SEQ ID NO: 271299 - protein, 7 aa, Mycobacterium
MQTSELG

SEQ ID NO: 271300 - protein, 25 aa, Mycobacterium
MRAADRSARRDHANGRSEGTQWSSE

SEQ ID NO: 271301 - protein, 8 aa, Mycobacterium
MRARGQDM

SEQ ID NO: 271302 - protein, 9 aa, Mycobacterium
MRATDVEPN

SEQ ID NO: 271303 - protein, 7 aa, Mycobacterium
MRATHRS

SEQ ID NO: 271304 - protein, 5 aa, Mycobacterium
MRDGS

SEQ ID NO: 271305 - protein, 6 aa, Mycobacterium
MRDGSK

SEQ ID NO: 271306 - protein, 5 aa, Mycobacterium
MRDST

SEQ ID NO: 271307 - protein, 6 aa, Mycobacterium
MRDSTE

SEQ ID NO: 271308 - protein, 12 aa, Mycobacterium
MREANGGALDDP

SEQ ID NO: 271309 - protein, 20 aa, Mycobacterium
MRETPPTAAEARAATDESAA

SEQ ID NO: 271310 - protein, 8 aa, Mycobacterium
MRGGEVDE

SEQ ID NO: 271311 - protein, 4 aa, Mycobacterium
MRGS

SEQ ID NO: 271312 - protein, 5 aa, Mycobacterium
MRGSY

SEQ ID NO: 271313 - protein, 13 aa, Mycobacterium
MRNGADDPDGASG

SEQ ID NO: 271314 - protein, 4 aa, Mycobacterium
MRPD

SEQ ID NO: 271315 - protein, 15 aa, Mycobacterium
MRPEGQPQPSDRLKG

SEQ ID NO: 271316 - protein, 6 aa, Mycobacterium
MRPGET

SEQ ID NO: 271317 - protein, 8 aa, Mycobacterium
MRPNPGIG

SEQ ID NO: 271318 - protein, 7 aa, Mycobacterium
MRPNRDP

SEQ ID NO: 271319 - protein, 6 aa, Mycobacterium
MRPSER

SEQ ID NO: 271320 - protein, 7 aa, Mycobacterium
MRPSERA

SEQ ID NO: 271321 - protein, 10 aa, Mycobacterium
MRPTSDGLQP

SEQ ID NO: 271322 - protein, 19 aa, Mycobacterium
MRQDPYTAYPEAQAGVSRP

SEQ ID NO: 271323 - protein, 12 aa, Mycobacterium
MRQTGADQIETQ

SEQ ID NO: 271324 - protein, 13 aa, Mycobacterium
MRRANGGSLDSPR

SEQ ID NO: 271325 - protein, 4 aa, Mycobacterium
MRRP

SEQ ID NO: 271326 - protein, 5 aa, Mycobacterium
MRRSN

SEQ ID NO: 271327 - protein, 9 aa, Mycobacterium
MRSPDGYTQ

SEQ ID NO: 271328 - protein, 6 aa, Mycobacterium
MRSPRN

SEQ ID NO: 271329 - protein, 7 aa, Mycobacterium
MRSPRNR

SEQ ID NO: 271330 - protein, 6 aa, Mycobacterium
MRSQSS

SEQ ID NO: 271331 - protein, 7 aa, Mycobacterium
MRSRRNR

SEQ ID NO: 271332 - protein, 11 aa, Mycobacterium
MRSSRGGDPAL

SEQ ID NO: 271333 - protein, 9 aa, Mycobacterium
MRTNGFADT

SEQ ID NO: 271334 - protein, 6 aa, Mycobacterium
MRTNRD

SEQ ID NO: 271335 - protein, 8 aa, Mycobacterium
MRTNRGGD

SEQ ID NO: 271336 - protein, 9 aa, Mycobacterium
MRTNRGGDY

SEQ ID NO: 271337 - protein, 14 aa, Mycobacterium
MRTSPEDPDGASGR

SEQ ID NO: 271338 - protein, 11 aa, Mycobacterium
MRTTSEHTSEV

SEQ ID NO: 271339 - protein, 4 aa, Mycobacterium
MSAA

SEQ ID NO: 271340 - protein, 10 aa, Mycobacterium
MSANEATAAF

SEQ ID NO: 271341 - protein, 7 aa, Mycobacterium
MSATETT

SEQ ID NO: 271342 - protein, 6 aa, Mycobacterium
MSATGP

SEQ ID NO: 271343 - protein, 9 aa, Mycobacterium
MSDAPGPPM

SEQ ID NO: 271344 - protein, 9 aa, Mycobacterium
MSDDQRKEV

SEQ ID NO: 271345 - protein, 6 aa, Mycobacterium
MSDGAK

SEQ ID NO: 271346 - protein, 7 aa, Mycobacterium
MSDSAAA

SEQ ID NO: 271347 - protein, 7 aa, Mycobacterium
MSDTGCP

SEQ ID NO: 271348 - protein, 6 aa, Mycobacterium
MSEGKQ

SEQ ID NO: 271349 - protein, 8 aa, Mycobacterium
MSENANAM

SEQ ID NO: 271350 - protein, 9 aa, Mycobacterium
MSEPADPDE

SEQ ID NO: 271351 - protein, 5 aa, Mycobacterium
MSEQY

SEQ ID NO: 271352 - protein, 6 aa, Mycobacterium
MSETQG

SEQ ID NO: 271353 - protein, 6 aa, Mycobacterium
MSGEWS

SEQ ID NO: 271354 - protein, 26 aa, Mycobacterium
MSGPARDSGFGGPGGPAGPDGDNTEL

SEQ ID NO: 271355 - protein, 10 aa, Mycobacterium
MSGPDAAEDW

SEQ ID NO: 271356 - protein, 6 aa, Mycobacterium
MSGPDS

SEQ ID NO: 271357 - protein, 6 aa, Mycobacterium
MSGPFA

SEQ ID NO: 271358 - protein, 6 aa, Mycobacterium
MSGREA

SEQ ID NO: 271359 - protein, 9 aa, Mycobacterium
MSKNSTAMG

SEQ ID NO: 271360 - protein, 10 aa, Mycobacterium
MSLSGGQRQR

SEQ ID NO: 271361 - protein, 15 aa, Mycobacterium
MSNGEGPDPARPPSK

SEQ ID NO: 271362 - protein, 7 aa, Mycobacterium
MSNVSPP

SEQ ID NO: 271363 - protein, 8 aa, Mycobacterium
MSPDAAPS

SEQ ID NO: 271364 - protein, 8 aa, Mycobacterium
MSPDDAPA

SEQ ID NO: 271365 - protein, 10 aa, Mycobacterium
MSPDGSTSGI

SEQ ID NO: 271366 - protein, 7 aa, Mycobacterium
MSPDYAP

SEQ ID NO: 271367 - protein, 8 aa, Mycobacterium
MSPNDAPA

SEQ ID NO: 271368 - protein, 6 aa, Mycobacterium
MSPRRA

SEQ ID NO: 271369 - protein, 5 aa, Mycobacterium
MSPSS

SEQ ID NO: 271370 - protein, 9 aa, Mycobacterium
MSQNSTAMG

SEQ ID NO: 271371 - protein, 18 aa, Mycobacterium
MSQSEPAARAMTAPNRPP

SEQ ID NO: 271372 - protein, 9 aa, Mycobacterium
MSRDEAETF

SEQ ID NO: 271373 - protein, 5 aa, Mycobacterium
MSSGA

SEQ ID NO: 271374 - protein, 6 aa, Mycobacterium
MSSGRA

SEQ ID NO: 271375 - protein, 7 aa, Mycobacterium
MSSSGRA

SEQ ID NO: 271376 - protein, 5 aa, Mycobacterium
MSTAN

SEQ ID NO: 271377 - protein, 19 aa, Mycobacterium
MSTESTGLIGDSSRNDHTA

SEQ ID NO: 271378 - protein, 8 aa, Mycobacterium
MSTGTTAL

SEQ ID NO: 271379 - protein, 7 aa, Mycobacterium
MSTPGHG

SEQ ID NO: 271380 - protein, 9 aa, Mycobacterium
MSVPGPPGG

SEQ ID NO: 271381 - protein, 25 aa, Mycobacterium
MSYDGVDNERKEAMTSAPEGADEHG

SEQ ID NO: 271382 - protein, 10 aa, Mycobacterium
MTAGTTSDDY

SEQ ID NO: 271383 - protein, 15 aa, Mycobacterium
MTAPAALSDDGKATY

SEQ ID NO: 271384 - protein, 18 aa, Mycobacterium
MTAPPRESPLNAQGVEKE

SEQ ID NO: 271385 - protein, 10 aa, Mycobacterium
MTASDEAARR

SEQ ID NO: 271386 - protein, 10 aa, Mycobacterium
MTASKTYEEM

SEQ ID NO: 271387 - protein, 10 aa, Mycobacterium
MTDANTTKEL

SEQ ID NO: 271388 - protein, 7 aa, Mycobacterium
MTDSDRR

SEQ ID NO: 271389 - protein, 6 aa, Mycobacterium
MTEEAA

SEQ ID NO: 271390 - protein, 9 aa, Mycobacterium
MTETPGGGL

SEQ ID NO: 271391 - protein, 5 aa, Mycobacterium
MTETT

SEQ ID NO: 271392 - protein, 4 aa, Mycobacterium
MTGE

SEQ ID NO: 271393 - protein, 14 aa, Mycobacterium
MTGEAKPTRVRPGG

SEQ ID NO: 271394 - protein, 17 aa, Mycobacterium
MTGEAKPVRAAPDSPVL

SEQ ID NO: 271395 - protein, 10 aa, Mycobacterium
MTGEPASADA

SEQ ID NO: 271396 - protein, 11 aa, Mycobacterium
MTGPTPAAAAR

SEQ ID NO: 271397 - protein, 10 aa, Mycobacterium
MTGSSTPASA

SEQ ID NO: 271398 - protein, 4 aa, Mycobacterium
MTGT

SEQ ID NO: 271399 - protein, 7 aa, Mycobacterium
MTGTGNA

SEQ ID NO: 271400 - protein, 7 aa, Mycobacterium
MTKAPSV

SEQ ID NO: 271401 - protein, 17 aa, Mycobacterium
MTNASSVPAGHGHNYGE

SEQ ID NO: 271402 - protein, 14 aa, Mycobacterium
MTNASSVPGGHGHN

SEQ ID NO: 271403 - protein, 5 aa, Mycobacterium
MTNRQ

SEQ ID NO: 271404 - protein, 11 aa, Mycobacterium
MTPAEKEVQKQ

SEQ ID NO: 271405 - protein, 25 aa, Mycobacterium
MTPAPLPSTPAQVAAATARALAKGR

SEQ ID NO: 271406 - protein, 6 aa, Mycobacterium
MTPDQV

SEQ ID NO: 271407 - protein, 7 aa, Mycobacterium
MTPEQAE

SEQ ID NO: 271408 - protein, 7 aa, Mycobacterium
MTPEQRQ

SEQ ID NO: 271409 - protein, 18 aa, Mycobacterium
MTPETATKATEEIHRDEA

SEQ ID NO: 271410 - protein, 11 aa, Mycobacterium
MTPPPAPAPIA

SEQ ID NO: 271411 - protein, 9 aa, Mycobacterium
MTPQPHTAP

SEQ ID NO: 271412 - protein, 9 aa, Mycobacterium
MTPQPPRRA

SEQ ID NO: 271413 - protein, 5 aa, Mycobacterium
MTPRA

SEQ ID NO: 271414 - protein, 4 aa, Mycobacterium
MTQA

SEQ ID NO: 271415 - protein, 30 aa, Mycobacterium
MTQNPETSAGSTTVTDQPGDTHRSGEHSRL

SEQ ID NO: 271416 - protein, 4 aa, Mycobacterium
MTRP

SEQ ID NO: 271417 - protein, 4 aa, Mycobacterium
MTRR

SEQ ID NO: 271418 - protein, 9 aa, Mycobacterium
MTSNSPGMT

SEQ ID NO: 271419 - protein, 17 aa, Mycobacterium
MTTDDRTGLTGAQYTAP

SEQ ID NO: 271420 - protein, 12 aa, Mycobacterium
MTTDGAETKDQL

SEQ ID NO: 271421 - protein, 7 aa, Mycobacterium
MVPRPGR

SEQ ID NO: 271422 - protein, 4 aa, Mycobacterium
MYNP

SEQ ID NO: 271423 - protein, 9 aa, Mycobacterium
NAAADPRAK

SEQ ID NO: 271424 - protein, 7 aa, Mycobacterium
NAAAEDI

SEQ ID NO: 271425 - protein, 21 aa, Mycobacterium
NAAAGQAPQSVPSNSASAEVE

SEQ ID NO: 271426 - protein, 6 aa, Mycobacterium
NAAAHD

SEQ ID NO: 271427 - protein, 9 aa, Mycobacterium
NAAAQDTPA

SEQ ID NO: 271428 - protein, 7 aa, Mycobacterium
NAAATAW

SEQ ID NO: 271429 - protein, 15 aa, Mycobacterium
NAAATPAQRDRPPRR

SEQ ID NO: 271430 - protein, 18 aa, Mycobacterium
NAADDSAKTTAVTSQITD

SEQ ID NO: 271431 - protein, 18 aa, Mycobacterium
NAADDSAKTTQVTSQITD

SEQ ID NO: 271432 - protein, 10 aa, Mycobacterium
NAADPSQAGF

SEQ ID NO: 271433 - protein, 11 aa, Mycobacterium
NAADPSQAGFN

SEQ ID NO: 271434 - protein, 13 aa, Mycobacterium
NAAEEALKGTPLV

SEQ ID NO: 271435 - protein, 4 aa, Mycobacterium
NAAG

SEQ ID NO: 271436 - protein, 12 aa, Mycobacterium
NAAGGAVTTETG

SEQ ID NO: 271437 - protein, 9 aa, Mycobacterium
NAAGNYHPW

SEQ ID NO: 271438 - protein, 5 aa, Mycobacterium
NAAGT

SEQ ID NO: 271439 - protein, 7 aa, Mycobacterium
NAAGTGP

SEQ ID NO: 271440 - protein, 9 aa, Mycobacterium
NAAGWDTQA

SEQ ID NO: 271441 - protein, 5 aa, Mycobacterium
NAAHD

SEQ ID NO: 271442 - protein, 11 aa, Mycobacterium
NAAKHASASEV

SEQ ID NO: 271443 - protein, 8 aa, Mycobacterium
NAAKYAEA

SEQ ID NO: 271444 - protein, 8 aa, Mycobacterium
NAANDDAY

SEQ ID NO: 271445 - protein, 5 aa, Mycobacterium
NAANN

SEQ ID NO: 271446 - protein, 6 aa, Mycobacterium
NAANVT

SEQ ID NO: 271447 - protein, 13 aa, Mycobacterium
NAAPELVDSSTQA

SEQ ID NO: 271448 - protein, 10 aa, Mycobacterium
NAARHAQASR

SEQ ID NO: 271449 - protein, 15 aa, Mycobacterium
NAARRSRLEGDAEGR

SEQ ID NO: 271450 - protein, 10 aa, Mycobacterium
NAARTDGADA

SEQ ID NO: 271451 - protein, 14 aa, Mycobacterium
NAASATPAAESDAR

SEQ ID NO: 271452 - protein, 6 aa, Mycobacterium
NAASDI

SEQ ID NO: 271453 - protein, 7 aa, Mycobacterium
NAASTLA

SEQ ID NO: 271454 - protein, 7 aa, Mycobacterium
NAATADE

SEQ ID NO: 271455 - protein, 10 aa, Mycobacterium
NAATERAGRL

SEQ ID NO: 271456 - protein, 10 aa, Mycobacterium
NAATREELAA

SEQ ID NO: 271457 - protein, 30 aa, Mycobacterium
NAAVPSAPAPSPTTTTLADNDNSQHSDNSG

SEQ ID NO: 271458 - protein, 4 aa, Mycobacterium
NADA

SEQ ID NO: 271459 - protein, 8 aa, Mycobacterium
NADDPAAT

SEQ ID NO: 271460 - protein, 38 aa, Mycobacterium
NADESAVTSDAEKAESSAPSSAAVESTAEGTTEAATAE

SEQ ID NO: 271461 - protein, 30 aa, Mycobacterium
NADGDSESEIAARPEPLAQSYRNDAAAVVG

SEQ ID NO: 271462 - protein, 8 aa, Mycobacterium
NADGSKTV

SEQ ID NO: 271463 - protein, 8 aa, Mycobacterium
NADGSVAL

SEQ ID NO: 271464 - protein, 10 aa, Mycobacterium
NADPDASPAE

SEQ ID NO: 271465 - protein, 6 aa, Mycobacterium
NADPTR

SEQ ID NO: 271466 - protein, 8 aa, Mycobacterium
NADPVSVS

SEQ ID NO: 271467 - protein, 12 aa, Mycobacterium
NADRELESQTEA

SEQ ID NO: 271468 - protein, 5 aa, Mycobacterium
NADRG

SEQ ID NO: 271469 - protein, 6 aa, Mycobacterium
NADRTY

SEQ ID NO: 271470 - protein, 9 aa, Mycobacterium
NADVAPGSG

SEQ ID NO: 271471 - protein, 10 aa, Mycobacterium
NADVAPGSGV

SEQ ID NO: 271472 - protein, 6 aa, Mycobacterium
NADYPQ

SEQ ID NO: 271473 - protein, 9 aa, Mycobacterium
NAEAADQRV

SEQ ID NO: 271474 - protein, 10 aa, Mycobacterium
NAEARGTGGL

SEQ ID NO: 271475 - protein, 9 aa, Mycobacterium
NAEARVRQT

SEQ ID NO: 271476 - protein, 13 aa, Mycobacterium
NAEDDLGKHHNQS

SEQ ID NO: 271477 - protein, 5 aa, Mycobacterium
NAEDG

SEQ ID NO: 271478 - protein, 8 aa, Mycobacterium
NAEEQTTT

SEQ ID NO: 271479 - protein, 6 aa, Mycobacterium
NAEGGL

SEQ ID NO: 271480 - protein, 7 aa, Mycobacterium
NAEHGSA

SEQ ID NO: 271481 - protein, 27 aa, Mycobacterium
NAELEETTEELRTQKEELRASSERLEA

SEQ ID NO: 271482 - protein, 6 aa, Mycobacterium
NAENPV

SEQ ID NO: 271483 - protein, 4 aa, Mycobacterium
NAER

SEQ ID NO: 271484 - protein, 7 aa, Mycobacterium
NAERDDA

SEQ ID NO: 271485 - protein, 6 aa, Mycobacterium
NAEYTQ

SEQ ID NO: 271486 - protein, 8 aa, Mycobacterium
NAFSGGPR

SEQ ID NO: 271487 - protein, 62 aa, Mycobacterium
NAGAKPANADKPAGAQDHPGSSAPQAPQPAGQTEGNAPGAPPQGQNPETPTPTAAVQPPPVL

SEQ ID NO: 271488 - protein, 6 aa, Mycobacterium
NAGAPL

SEQ ID NO: 271489 - protein, 9 aa, Mycobacterium
NAGCSRTTT

SEQ ID NO: 271490 - protein, 11 aa, Mycobacterium
NAGDGSAWSAA

SEQ ID NO: 271491 - protein, 10 aa, Mycobacterium
NAGGAAEFGK

SEQ ID NO: 271492 - protein, 7 aa, Mycobacterium
NAGGGLG

SEQ ID NO: 271493 - protein, 15 aa, Mycobacterium
NAGGTPNIPSNGTGS

SEQ ID NO: 271494 - protein, 20 aa, Mycobacterium
NAGKGPHDLTQGRPTADGTT

SEQ ID NO: 271495 - protein, 6 aa, Mycobacterium
NAGLQD

SEQ ID NO: 271496 - protein, 6 aa, Mycobacterium
NAGLRT

SEQ ID NO: 271497 - protein, 8 aa, Mycobacterium
NAGMQPNE

SEQ ID NO: 271498 - protein, 7 aa, Mycobacterium
NAGPAGA

SEQ ID NO: 271499 - protein, 9 aa, Mycobacterium
NAGPGPDSL

SEQ ID NO: 271500 - protein, 11 aa, Mycobacterium
NAGPRAEPRAA

SEQ ID NO: 271501 - protein, 6 aa, Mycobacterium
NAGPTA

SEQ ID NO: 271502 - protein, 5 aa, Mycobacterium
NAGPV

SEQ ID NO: 271503 - protein, 36 aa, Mycobacterium
NAGQGAQLAADANPQLKAEAEQAQQLTQAGGQVADL

SEQ ID NO: 271504 - protein, 16 aa, Mycobacterium
NAGRPGNTKPVTVEPS

SEQ ID NO: 271505 - protein, 17 aa, Mycobacterium
NAGRPGNTKPVTVQPSS

SEQ ID NO: 271506 - protein, 6 aa, Mycobacterium
NAGRTG

SEQ ID NO: 271507 - protein, 6 aa, Mycobacterium
NAGTMQ

SEQ ID NO: 271508 - protein, 14 aa, Mycobacterium
NAGTSNAAMLAAGM

SEQ ID NO: 271509 - protein, 27 aa, Mycobacterium
NAGYSAALPTPEKPALTGETGETEDPD

SEQ ID NO: 271510 - protein, 6 aa, Mycobacterium
NAHDRD

SEQ ID NO: 271511 - protein, 12 aa, Mycobacterium
NAHGDSAAGRLA

SEQ ID NO: 271512 - protein, 13 aa, Mycobacterium
NAHGGAVTTESGT

SEQ ID NO: 271513 - protein, 4 aa, Mycobacterium
NAHR

SEQ ID NO: 271514 - protein, 8 aa, Mycobacterium
NAIASGAQ

SEQ ID NO: 271515 - protein, 6 aa, Mycobacterium
NAIQTG

SEQ ID NO: 271516 - protein, 5 aa, Mycobacterium
NAKAA

SEQ ID NO: 271517 - protein, 6 aa, Mycobacterium
NAKAAL

SEQ ID NO: 271518 - protein, 7 aa, Mycobacterium
NAKAALS

SEQ ID NO: 271519 - protein, 11 aa, Mycobacterium
NAKNPDAGASF

SEQ ID NO: 271520 - protein, 6 aa, Mycobacterium
NAKPGY

SEQ ID NO: 271521 - protein, 8 aa, Mycobacterium
NAKPVEDG

SEQ ID NO: 271522 - protein, 19 aa, Mycobacterium
NALDGTDNETFPKPEEIGG

SEQ ID NO: 271523 - protein, 11 aa, Mycobacterium
NALKSNSAALP

SEQ ID NO: 271524 - protein, 4 aa, Mycobacterium
NALP

SEQ ID NO: 271525 - protein, 7 aa, Mycobacterium
NALPAGE

SEQ ID NO: 271526 - protein, 68 aa, Mycobacterium
NALSNGQPGEPDQGEVAPMAGSDGLPSLPSHPRRPAQGVGRHQAPPSATPDEDPGLPLDTSSEQQRSF

SEQ ID NO: 271527 - protein, 9 aa, Mycobacterium
NALTGDDES

SEQ ID NO: 271528 - protein, 7 aa, Mycobacterium
NAMAPEG

SEQ ID NO: 271529 - protein, 6 aa, Mycobacterium
NAMAQE

SEQ ID NO: 271530 - protein, 7 aa, Mycobacterium
NAMGPEG

SEQ ID NO: 271531 - protein, 5 aa, Mycobacterium
NAMTK

SEQ ID NO: 271532 - protein, 5 aa, Mycobacterium
NANAA

SEQ ID NO: 271533 - protein, 4 aa, Mycobacterium
NANG

SEQ ID NO: 271534 - protein, 8 aa, Mycobacterium
NANPGLDR

SEQ ID NO: 271535 - protein, 7 aa, Mycobacterium
NANPRDA

SEQ ID NO: 271536 - protein, 8 aa, Mycobacterium
NANSQPRV

SEQ ID NO: 271537 - protein, 14 aa, Mycobacterium
NANSYGLEQPPRLT

SEQ ID NO: 271538 - protein, 8 aa, Mycobacterium
NANTHQVD

SEQ ID NO: 271539 - protein, 11 aa, Mycobacterium
NANYPGAKAPA

SEQ ID NO: 271540 - protein, 5 aa, Mycobacterium
NAPDV

SEQ ID NO: 271541 - protein, 7 aa, Mycobacterium
NAPEEPE

SEQ ID NO: 271542 - protein, 5 aa, Mycobacterium
NAPGY

SEQ ID NO: 271543 - protein, 17 aa, Mycobacterium
NAPKGHPVASQSATLRD

SEQ ID NO: 271544 - protein, 16 aa, Mycobacterium
NAPPPALGDSRPELAP

SEQ ID NO: 271545 - protein, 9 aa, Mycobacterium
NAPPPPIGA

SEQ ID NO: 271546 - protein, 7 aa, Mycobacterium
NAPSEAE

SEQ ID NO: 271547 - protein, 7 aa, Mycobacterium
NAPSLTA

SEQ ID NO: 271548 - protein, 12 aa, Mycobacterium
NAPSPPGSADQR

SEQ ID NO: 271549 - protein, 25 aa, Mycobacterium
NAPTASTSAAASSAPAGSVVKPTKA

SEQ ID NO: 271550 - protein, 6 aa, Mycobacterium
NAQPAV

SEQ ID NO: 271551 - protein, 25 aa, Mycobacterium
NAQTAPAVAAASESLRQSRTARRSL

SEQ ID NO: 271552 - protein, 9 aa, Mycobacterium
NAQTGKAQV

SEQ ID NO: 271553 - protein, 6 aa, Mycobacterium
NAQTLS

SEQ ID NO: 271554 - protein, 11 aa, Mycobacterium
NARAEPSPDDR

SEQ ID NO: 271555 - protein, 19 aa, Mycobacterium
NARDAGQTAFGAAKDAGQL

SEQ ID NO: 271556 - protein, 19 aa, Mycobacterium
NARDGGATTFGAAKDAGQL

SEQ ID NO: 271557 - protein, 8 aa, Mycobacterium
NAREQQRV

SEQ ID NO: 271558 - protein, 8 aa, Mycobacterium
NARESAGV

SEQ ID NO: 271559 - protein, 10 aa, Mycobacterium
NARESGAAGT

SEQ ID NO: 271560 - protein, 7 aa, Mycobacterium
NARESWR

SEQ ID NO: 271561 - protein, 11 aa, Mycobacterium
NARGGPGGRPG

SEQ ID NO: 271562 - protein, 5 aa, Mycobacterium
NARKA

SEQ ID NO: 271563 - protein, 8 aa, Mycobacterium
NARKPRRR

SEQ ID NO: 271564 - protein, 4 aa, Mycobacterium
NARP

SEQ ID NO: 271565 - protein, 6 aa, Mycobacterium
NARPAA

SEQ ID NO: 271566 - protein, 23 aa, Mycobacterium
NARPQGSPLGRDAPQPPKPIPTA

SEQ ID NO: 271567 - protein, 11 aa, Mycobacterium
NARQRKTGQDV

SEQ ID NO: 271568 - protein, 16 aa, Mycobacterium
NARQTSSAKPSAAAPA

SEQ ID NO: 271569 - protein, 9 aa, Mycobacterium
NARRGLAGA

SEQ ID NO: 271570 - protein, 7 aa, Mycobacterium
NARRRTP

SEQ ID NO: 271571 - protein, 28 aa, Mycobacterium
NARSDPGESTNGKPHPIDRPLEAISVRA

SEQ ID NO: 271572 - protein, 8 aa, Mycobacterium
NARSETRS

SEQ ID NO: 271573 - protein, 12 aa, Mycobacterium
NARSLQAATQSL

SEQ ID NO: 271574 - protein, 8 aa, Mycobacterium
NARTRGGY

SEQ ID NO: 271575 - protein, 11 aa, Mycobacterium
NARVTGAADPL

SEQ ID NO: 271576 - protein, 10 aa, Mycobacterium
NASAAGGGTI

SEQ ID NO: 271577 - protein, 15 aa, Mycobacterium
NASAGGYASAEAANA

SEQ ID NO: 271578 - protein, 13 aa, Mycobacterium
NASAPGRPRQPSD

SEQ ID NO: 271579 - protein, 8 aa, Mycobacterium
NASEFNNE

SEQ ID NO: 271580 - protein, 4 aa, Mycobacterium
NASG

SEQ ID NO: 271581 - protein, 5 aa, Mycobacterium
NASGA

SEQ ID NO: 271582 - protein, 12 aa, Mycobacterium
NASGGAVSTQAG

SEQ ID NO: 271583 - protein, 11 aa, Mycobacterium
NASGGPAGVGR

SEQ ID NO: 271584 - protein, 6 aa, Mycobacterium
NASGLY

SEQ ID NO: 271585 - protein, 7 aa, Mycobacterium
NASGYGN

SEQ ID NO: 271586 - protein, 10 aa, Mycobacterium
NASNLQAATQ

SEQ ID NO: 271587 - protein, 6 aa, Mycobacterium
NASPGN

SEQ ID NO: 271588 - protein, 9 aa, Mycobacterium
NASQAERRQ

SEQ ID NO: 271589 - protein, 4 aa, Mycobacterium
NASR

SEQ ID NO: 271590 - protein, 7 aa, Mycobacterium
NASRGRR

SEQ ID NO: 271591 - protein, 7 aa, Mycobacterium
NASSPTS

SEQ ID NO: 271592 - protein, 4 aa, Mycobacterium
NASY

SEQ ID NO: 271593 - protein, 8 aa, Mycobacterium
NATAGAPL

SEQ ID NO: 271594 - protein, 6 aa, Mycobacterium
NATAMS

SEQ ID NO: 271595 - protein, 8 aa, Mycobacterium
NATESDVD

SEQ ID NO: 271596 - protein, 19 aa, Mycobacterium
NATGGPAGVGEAVGRATRT

SEQ ID NO: 271597 - protein, 7 aa, Mycobacterium
NATGGRY

SEQ ID NO: 271598 - protein, 6 aa, Mycobacterium
NATGLT

SEQ ID NO: 271599 - protein, 6 aa, Mycobacterium
NATGMG

SEQ ID NO: 271600 - protein, 10 aa, Mycobacterium
NATGQRDKAR

SEQ ID NO: 271601 - protein, 14 aa, Mycobacterium
NATGQSPDSISETA

SEQ ID NO: 271602 - protein, 15 aa, Mycobacterium
NATIPTGSQNPCFAN

SEQ ID NO: 271603 - protein, 14 aa, Mycobacterium
NATPALASADRKTA

SEQ ID NO: 271604 - protein, 7 aa, Mycobacterium
NATPGRD

SEQ ID NO: 271605 - protein, 14 aa, Mycobacterium
NATPVNPGPDPIPA

SEQ ID NO: 271606 - protein, 5 aa, Mycobacterium
NATSA

SEQ ID NO: 271607 - protein, 10 aa, Mycobacterium
NATSKMGEEI

SEQ ID NO: 271608 - protein, 9 aa, Mycobacterium
NATSPPLKD

SEQ ID NO: 271609 - protein, 13 aa, Mycobacterium
NATTAAALRATQS

SEQ ID NO: 271610 - protein, 4 aa, Mycobacterium
NATV

SEQ ID NO: 271611 - protein, 5 aa, Mycobacterium
NATYG

SEQ ID NO: 271612 - protein, 18 aa, Mycobacterium
NATYGKREQERHARALAA

SEQ ID NO: 271613 - protein, 4 aa, Mycobacterium
NAVA

SEQ ID NO: 271614 - protein, 12 aa, Mycobacterium
NAVDNGGRGSIS

SEQ ID NO: 271615 - protein, 4 aa, Mycobacterium
NAVG

SEQ ID NO: 271616 - protein, 7 aa, Mycobacterium
NAVNDAT

SEQ ID NO: 271617 - protein, 6 aa, Mycobacterium
NAVREG

SEQ ID NO: 271618 - protein, 7 aa, Mycobacterium
NAVRGAR

SEQ ID NO: 271619 - protein, 18 aa, Mycobacterium
NAVTEPEPVEDKQPAPRA

SEQ ID NO: 271620 - protein, 5 aa, Mycobacterium
NAYSG

SEQ ID NO: 271621 - protein, 4 aa, Mycobacterium
NCGA

SEQ ID NO: 271622 - protein, 5 aa, Mycobacterium
NCGKS

SEQ ID NO: 271623 - protein, 20 aa, Mycobacterium
NDAADARRDAAAGRRDKPVV

SEQ ID NO: 271624 - protein, 4 aa, Mycobacterium
NDAE

SEQ ID NO: 271625 - protein, 7 aa, Mycobacterium
NDAETET

SEQ ID NO: 271626 - protein, 17 aa, Mycobacterium
NDAGGVATYAQAGQSYG

SEQ ID NO: 271627 - protein, 16 aa, Mycobacterium
NDAGGVATYTQAGQNY

SEQ ID NO: 271628 - protein, 7 aa, Mycobacterium
NDAGGVS

SEQ ID NO: 271629 - protein, 7 aa, Mycobacterium
NDAGNSS

SEQ ID NO: 271630 - protein, 14 aa, Mycobacterium
NDAGPRSVTPELSP

SEQ ID NO: 271631 - protein, 10 aa, Mycobacterium
NDAGPTGRTS

SEQ ID NO: 271632 - protein, 15 aa, Mycobacterium
NDAITAATGRTPTLY

SEQ ID NO: 271633 - protein, 4 aa, Mycobacterium
NDAK

SEQ ID NO: 271634 - protein, 5 aa, Mycobacterium
NDAKA

SEQ ID NO: 271635 - protein, 7 aa, Mycobacterium
NDAKTNV

SEQ ID NO: 271636 - protein, 13 aa, Mycobacterium
NDALPTQRNGSDR

SEQ ID NO: 271637 - protein, 9 aa, Mycobacterium
NDASSSNMA

SEQ ID NO: 271638 - protein, 8 aa, Mycobacterium
NDATIGAR

SEQ ID NO: 271639 - protein, 8 aa, Mycobacterium
NDATVGAR

SEQ ID NO: 271640 - protein, 7 aa, Mycobacterium
NDCGQQG

SEQ ID NO: 271641 - protein, 4 aa, Mycobacterium
NDDD

SEQ ID NO: 271642 - protein, 5 aa, Mycobacterium
NDDDL

SEQ ID NO: 271643 - protein, 6 aa, Mycobacterium
NDDNNR

SEQ ID NO: 271644 - protein, 4 aa, Mycobacterium
NDDP

SEQ ID NO: 271645 - protein, 8 aa, Mycobacterium
NDDPAGAA

SEQ ID NO: 271646 - protein, 7 aa, Mycobacterium
NDDQGGY

SEQ ID NO: 271647 - protein, 7 aa, Mycobacterium
NDDRAYV

SEQ ID NO: 271648 - protein, 9 aa, Mycobacterium
NDDTAGLTA

SEQ ID NO: 271649 - protein, 5 aa, Mycobacterium
NDDTM

SEQ ID NO: 271650 - protein, 9 aa, Mycobacterium
NDDVGGPLT

SEQ ID NO: 271651 - protein, 7 aa, Mycobacterium
NDDYESL

SEQ ID NO: 271652 - protein, 6 aa, Mycobacterium
NDEAGA

SEQ ID NO: 271653 - protein, 6 aa, Mycobacterium
NDEAGI

SEQ ID NO: 271654 - protein, 8 aa, Mycobacterium
NDEDKGTY

SEQ ID NO: 271655 - protein, 11 aa, Mycobacterium
NDEDPNPYSPA

SEQ ID NO: 271656 - protein, 8 aa, Mycobacterium
NDEDRAAF

SEQ ID NO: 271657 - protein, 5 aa, Mycobacterium
NDEQI

SEQ ID NO: 271658 - protein, 6 aa, Mycobacterium
NDETTL

SEQ ID NO: 271659 - protein, 4 aa, Mycobacterium
NDEV

SEQ ID NO: 271660 - protein, 5 aa, Mycobacterium
NDEVT

SEQ ID NO: 271661 - protein, 8 aa, Mycobacterium
NDFSDSPR

SEQ ID NO: 271662 - protein, 11 aa, Mycobacterium
NDGAEAPGYGH

SEQ ID NO: 271663 - protein, 27 aa, Mycobacterium
NDGDGGDPQRPASPSLRSSRSGERTRG

SEQ ID NO: 271664 - protein, 12 aa, Mycobacterium
NDGEIGDGSGQL

SEQ ID NO: 271665 - protein, 7 aa, Mycobacterium
NDGEIGV

SEQ ID NO: 271666 - protein, 5 aa, Mycobacterium
NDGEL

SEQ ID NO: 271667 - protein, 6 aa, Mycobacterium
NDGERA

SEQ ID NO: 271668 - protein, 5 aa, Mycobacterium
NDGET

SEQ ID NO: 271669 - protein, 11 aa, Mycobacterium
NDGGEERNRGV

SEQ ID NO: 271670 - protein, 9 aa, Mycobacterium
NDGGERTRG

SEQ ID NO: 271671 - protein, 9 aa, Mycobacterium
NDGGQRTRG

SEQ ID NO: 271672 - protein, 4 aa, Mycobacterium
NDGN

SEQ ID NO: 271673 - protein, 20 aa, Mycobacterium
NDGPDAGRFTPTRPGAGQEA

SEQ ID NO: 271674 - protein, 4 aa, Mycobacterium
NDGQ

SEQ ID NO: 271675 - protein, 7 aa, Mycobacterium
NDGQRPL

SEQ ID NO: 271676 - protein, 7 aa, Mycobacterium
NDGTATH

SEQ ID NO: 271677 - protein, 9 aa, Mycobacterium
NDGTPQRQS

SEQ ID NO: 271678 - protein, 7 aa, Mycobacterium
NDHGGGR

SEQ ID NO: 271679 - protein, 13 aa, Mycobacterium
NDIGPNPPGQGAE

SEQ ID NO: 271680 - protein, 6 aa, Mycobacterium
NDKARL

SEQ ID NO: 271681 - protein, 4 aa, Mycobacterium
NDLA

SEQ ID NO: 271682 - protein, 8 aa, Mycobacterium
NDLAGHAD

SEQ ID NO: 271683 - protein, 6 aa, Mycobacterium
NDLGEE

SEQ ID NO: 271684 - protein, 5 aa, Mycobacterium
NDLGI

SEQ ID NO: 271685 - protein, 12 aa, Mycobacterium
NDLGSGNIEAAK

SEQ ID NO: 271686 - protein, 6 aa, Mycobacterium
NDLRDG

SEQ ID NO: 271687 - protein, 5 aa, Mycobacterium
NDMAA

SEQ ID NO: 271688 - protein, 4 aa, Mycobacterium
NDMG

SEQ ID NO: 271689 - protein, 6 aa, Mycobacterium
NDPASL

SEQ ID NO: 271690 - protein, 12 aa, Mycobacterium
NDPASPTDPPSV

SEQ ID NO: 271691 - protein, 15 aa, Mycobacterium
NDPGLTATATTTGNS

SEQ ID NO: 271692 - protein, 4 aa, Mycobacterium
NDPQ

SEQ ID NO: 271693 - protein, 7 aa, Mycobacterium
NDPQNRI

SEQ ID NO: 271694 - protein, 8 aa, Mycobacterium
NDPQNRIN

SEQ ID NO: 271695 - protein, 4 aa, Mycobacterium
NDPR

SEQ ID NO: 271696 - protein, 5 aa, Mycobacterium
NDPRL

SEQ ID NO: 271697 - protein, 12 aa, Mycobacterium
NDPSEAGDETFS

SEQ ID NO: 271698 - protein, 8 aa, Mycobacterium
NDPTLPGR

SEQ ID NO: 271699 - protein, 7 aa, Mycobacterium
NDPYPKC

SEQ ID NO: 271700 - protein, 11 aa, Mycobacterium
NDQAQDQETGY

SEQ ID NO: 271701 - protein, 6 aa, Mycobacterium
NDQNER

SEQ ID NO: 271702 - protein, 7 aa, Mycobacterium
NDQPTSY

SEQ ID NO: 271703 - protein, 8 aa, Mycobacterium
NDQSESPA

SEQ ID NO: 271704 - protein, 6 aa, Mycobacterium
NDQYDQ

SEQ ID NO: 271705 - protein, 18 aa, Mycobacterium
NDRDYAPKSVESSQGYAA

SEQ ID NO: 271706 - protein, 19 aa, Mycobacterium
NDRDYAPKSVESSRGYDAA

SEQ ID NO: 271707 - protein, 4 aa, Mycobacterium
NDRE

SEQ ID NO: 271708 - protein, 5 aa, Mycobacterium
NDREH

SEQ ID NO: 271709 - protein, 14 aa, Mycobacterium
NDRGLSAAATTGVN

SEQ ID NO: 271710 - protein, 8 aa, Mycobacterium
NDRHGHHA

SEQ ID NO: 271711 - protein, 22 aa, Mycobacterium
NDRNAEPALPPSNDVGPDPTTL

SEQ ID NO: 271712 - protein, 29 aa, Mycobacterium
NDRNSEPALPPNNDVGPNPTTLPSVNGSD

SEQ ID NO: 271713 - protein, 5 aa, Mycobacterium
NDRPT

SEQ ID NO: 271714 - protein, 13 aa, Mycobacterium
NDRSAKPFTGAGY

SEQ ID NO: 271715 - protein, 7 aa, Mycobacterium
NDRTAQA

SEQ ID NO: 271716 - protein, 9 aa, Mycobacterium
NDRYGHAAG

SEQ ID NO: 271717 - protein, 26 aa, Mycobacterium
NDSRPGTDYDWDSKDRNTTPGVNGST

SEQ ID NO: 271718 - protein, 10 aa, Mycobacterium
NDSSASPDDR

SEQ ID NO: 271719 - protein, 10 aa, Mycobacterium
NDSSSSNAQI

SEQ ID NO: 271720 - protein, 7 aa, Mycobacterium
NDTADEI

SEQ ID NO: 271721 - protein, 5 aa, Mycobacterium
NDTAR

SEQ ID NO: 271722 - protein, 5 aa, Mycobacterium
NDTAY

SEQ ID NO: 271723 - protein, 7 aa, Mycobacterium
NDTHGHH

SEQ ID NO: 271724 - protein, 5 aa, Mycobacterium
NDTKH

SEQ ID NO: 271725 - protein, 6 aa, Mycobacterium
NDTPDG

SEQ ID NO: 271726 - protein, 8 aa, Mycobacterium
NDTPDGEL

SEQ ID NO: 271727 - protein, 10 aa, Mycobacterium
NDTRGHATGD

SEQ ID NO: 271728 - protein, 14 aa, Mycobacterium
NDTRLSLDRVLARR

SEQ ID NO: 271729 - protein, 11 aa, Mycobacterium
NDVAAKATSSW

SEQ ID NO: 271730 - protein, 7 aa, Mycobacterium
NDVPTDD

SEQ ID NO: 271731 - protein, 18 aa, Mycobacterium
NDYSDGIRGTDDDRAGPV

SEQ ID NO: 271732 - protein, 17 aa, Mycobacterium
NDYSDGIRGTDDDRTGP

SEQ ID NO: 271733 - protein, 17 aa, Mycobacterium
NDYSDGIRGTDDERAGP

SEQ ID NO: 271734 - protein, 17 aa, Mycobacterium
NDYSDGIRGTDDVRSGP

SEQ ID NO: 271735 - protein, 17 aa, Mycobacterium
NDYSDGVRGTDDERAGP

SEQ ID NO: 271736 - protein, 7 aa, Mycobacterium
NDYTDVP

SEQ ID NO: 271737 - protein, 7 aa, Mycobacterium
NEAASAD

SEQ ID NO: 271738 - protein, 10 aa, Mycobacterium
NEADSADRTV

SEQ ID NO: 271739 - protein, 14 aa, Mycobacterium
NEAEHSAAGQNKTV

SEQ ID NO: 271740 - protein, 6 aa, Mycobacterium
NEAELA

SEQ ID NO: 271741 - protein, 6 aa, Mycobacterium
NEAKAN

SEQ ID NO: 271742 - protein, 10 aa, Mycobacterium
NEAQAQRKDP

SEQ ID NO: 271743 - protein, 16 aa, Mycobacterium
NEAREAGTKGSKLTAL

SEQ ID NO: 271744 - protein, 13 aa, Mycobacterium
NEARQGGVSGSKL

SEQ ID NO: 271745 - protein, 6 aa, Mycobacterium
NEASTN

SEQ ID NO: 271746 - protein, 8 aa, Mycobacterium
NEATTPAM

SEQ ID NO: 271747 - protein, 4 aa, Mycobacterium
NECA

SEQ ID NO: 271748 - protein, 6 aa, Mycobacterium
NECGQQ

SEQ ID NO: 271749 - protein, 4 aa, Mycobacterium
NEDE

SEQ ID NO: 271750 - protein, 8 aa, Mycobacterium
NEDGQVPL

SEQ ID NO: 271751 - protein, 7 aa, Mycobacterium
NEDITSY

SEQ ID NO: 271752 - protein, 20 aa, Mycobacterium
NEDKRGVQGPASNAPTPVPQ

SEQ ID NO: 271753 - protein, 18 aa, Mycobacterium
NEDLDKAQTLATDNYRPE

SEQ ID NO: 271754 - protein, 10 aa, Mycobacterium
NEDVDIPDRA

SEQ ID NO: 271755 - protein, 6 aa, Mycobacterium
NEEARK

SEQ ID NO: 271756 - protein, 11 aa, Mycobacterium
NEEATKETIDE

SEQ ID NO: 271757 - protein, 5 aa, Mycobacterium
NEEAY

SEQ ID NO: 271758 - protein, 10 aa, Mycobacterium
NEEPRPQPAA

SEQ ID NO: 271759 - protein, 5 aa, Mycobacterium
NEEST

SEQ ID NO: 271760 - protein, 6 aa, Mycobacterium
NEESTI

SEQ ID NO: 271761 - protein, 14 aa, Mycobacterium
NEETDDPGRTPGRA

SEQ ID NO: 271762 - protein, 4 aa, Mycobacterium
NEGA

SEQ ID NO: 271763 - protein, 7 aa, Mycobacterium
NEGAPRS

SEQ ID NO: 271764 - protein, 12 aa, Mycobacterium
NEGDGSAGDAPF

SEQ ID NO: 271765 - protein, 5 aa, Mycobacterium
NEGKL

SEQ ID NO: 271766 - protein, 8 aa, Mycobacterium
NEGNSDSQ

SEQ ID NO: 271767 - protein, 8 aa, Mycobacterium
NEGPDTRI

SEQ ID NO: 271768 - protein, 4 aa, Mycobacterium
NEGR

SEQ ID NO: 271769 - protein, 7 aa, Mycobacterium
NEGTPPI

SEQ ID NO: 271770 - protein, 12 aa, Mycobacterium
NEHGDVTTRGPI

SEQ ID NO: 271771 - protein, 24 aa, Mycobacterium
NEINKPADKPAEAPVHDGPPIAKP

SEQ ID NO: 271772 - protein, 10 aa, Mycobacterium
NEIPAPPPAV

SEQ ID NO: 271773 - protein, 9 aa, Mycobacterium
NEKDPPPTV

SEQ ID NO: 271774 - protein, 8 aa, Mycobacterium
NELEGTGG

SEQ ID NO: 271775 - protein, 7 aa, Mycobacterium
NELGAEG

SEQ ID NO: 271776 - protein, 10 aa, Mycobacterium
NELGDGDPAR

SEQ ID NO: 271777 - protein, 7 aa, Mycobacterium
NELGPQG

SEQ ID NO: 271778 - protein, 6 aa, Mycobacterium
NELRSE

SEQ ID NO: 271779 - protein, 5 aa, Mycobacterium
NELSG

SEQ ID NO: 271780 - protein, 7 aa, Mycobacterium
NENDKAI

SEQ ID NO: 271781 - protein, 4 aa, Mycobacterium
NENH

SEQ ID NO: 271782 - protein, 243 aa, Mycobacterium
NENPSAGQVPSQTGGQQSMQDPSFRANPDGSWQARNGEWSPPNYQTATPGLTQGPGQPNPGWSGNQAPQINTPQQPVQQAPQAPQPAQQAPQQPAQAPQNPAGQQPVEQAPQQPAQQNWPQTGQNQTGQTQPGQQPQKEPEAPKKNPMDPTDLASAATRRGSQQAGEQAGQQAVQQGTQQATQQAPKSTAQTQQAPQSTQQGQQTPKPAQQSQQAPQQTKPTNGKPKGIDGAAKGAPEEQPWD

SEQ ID NO: 271783 - protein, 5 aa, Mycobacterium
NEPDI

SEQ ID NO: 271784 - protein, 4 aa, Mycobacterium
NEPL

SEQ ID NO: 271785 - protein, 8 aa, Mycobacterium
NEPLGDEA

SEQ ID NO: 271786 - protein, 10 aa, Mycobacterium
NEPQDAPTDI

SEQ ID NO: 271787 - protein, 5 aa, Mycobacterium
NEPSV

SEQ ID NO: 271788 - protein, 5 aa, Mycobacterium
NEPVP

SEQ ID NO: 271789 - protein, 15 aa, Mycobacterium
NEQAGVTPVDQRPEV

SEQ ID NO: 271790 - protein, 9 aa, Mycobacterium
NEQKLAPTL

SEQ ID NO: 271791 - protein, 5 aa, Mycobacterium
NEQNQ

SEQ ID NO: 271792 - protein, 5 aa, Mycobacterium
NEQRE

SEQ ID NO: 271793 - protein, 8 aa, Mycobacterium
NEQRKEND

SEQ ID NO: 271794 - protein, 4 aa, Mycobacterium
NEQV

SEQ ID NO: 271795 - protein, 16 aa, Mycobacterium
NERAAETARSDEAALQ

SEQ ID NO: 271796 - protein, 11 aa, Mycobacterium
NERATRETIDD

SEQ ID NO: 271797 - protein, 6 aa, Mycobacterium
NEREPL

SEQ ID NO: 271798 - protein, 4 aa, Mycobacterium
NERG

SEQ ID NO: 271799 - protein, 6 aa, Mycobacterium
NERGRS

SEQ ID NO: 271800 - protein, 6 aa, Mycobacterium
NERKQD

SEQ ID NO: 271801 - protein, 8 aa, Mycobacterium
NERPNRAT

SEQ ID NO: 271802 - protein, 7 aa, Mycobacterium
NERPVPP

SEQ ID NO: 271803 - protein, 10 aa, Mycobacterium
NESATRRGIP

SEQ ID NO: 271804 - protein, 11 aa, Mycobacterium
NESDGGITPAS

SEQ ID NO: 271805 - protein, 4 aa, Mycobacterium
NESE

SEQ ID NO: 271806 - protein, 9 aa, Mycobacterium
NESKLAPTL

SEQ ID NO: 271807 - protein, 10 aa, Mycobacterium
NESNVGAATT

SEQ ID NO: 271808 - protein, 135 aa, Mycobacterium
NESPGQGGQQIPQQNMGPQTSGQRAAHGEPLPNYGPWQPDAQPPAQAPVQQAPVQQAPQAPQQPAQAPQNPAGQQPAQQAPQQPAGQQPAQQNPPQQGQPGQQQPQNPVNQQTPQQQPQKEPDTPKKNPMDPTDL

SEQ ID NO: 271809 - protein, 7 aa, Mycobacterium
NESQRDR

SEQ ID NO: 271810 - protein, 5 aa, Mycobacterium
NESRT

SEQ ID NO: 271811 - protein, 8 aa, Mycobacterium
NESTLAPT

SEQ ID NO: 271812 - protein, 7 aa, Mycobacterium
NETDPAI

SEQ ID NO: 271813 - protein, 8 aa, Mycobacterium
NETDYTED

SEQ ID NO: 271814 - protein, 6 aa, Mycobacterium
NETEAY

SEQ ID NO: 271815 - protein, 7 aa, Mycobacterium
NETGMTV

SEQ ID NO: 271816 - protein, 5 aa, Mycobacterium
NETLK

SEQ ID NO: 271817 - protein, 11 aa, Mycobacterium
NETPGPLRDDN

SEQ ID NO: 271818 - protein, 9 aa, Mycobacterium
NEVDANKGE

SEQ ID NO: 271819 - protein, 16 aa, Mycobacterium
NEVGDAQQKAELASRV

SEQ ID NO: 271820 - protein, 5 aa, Mycobacterium
NEYPG

SEQ ID NO: 271821 - protein, 8 aa, Mycobacterium
NEYPQVGG

SEQ ID NO: 271822 - protein, 17 aa, Mycobacterium
NEYPTDQYQPDDPKLGE

SEQ ID NO: 271823 - protein, 6 aa, Mycobacterium
NEYTPN

SEQ ID NO: 271824 - protein, 7 aa, Mycobacterium
NFATGSA

SEQ ID NO: 271825 - protein, 17 aa, Mycobacterium
NFGTGTLPKLAPGKVVA

SEQ ID NO: 271826 - protein, 9 aa, Mycobacterium
NFPGTDEHG

SEQ ID NO: 271827 - protein, 7 aa, Mycobacterium
NFPNADE

SEQ ID NO: 271828 - protein, 9 aa, Mycobacterium
NFPNADEHG

SEQ ID NO: 271829 - protein, 5 aa, Mycobacterium
NFPPN

SEQ ID NO: 271830 - protein, 10 aa, Mycobacterium
NFTSQGPASL

SEQ ID NO: 271831 - protein, 9 aa, Mycobacterium
NGAAGDAVG

SEQ ID NO: 271832 - protein, 6 aa, Mycobacterium
NGAAGE

SEQ ID NO: 271833 - protein, 19 aa, Mycobacterium
NGAAVNASPGNDPGTGNGV

SEQ ID NO: 271834 - protein, 6 aa, Mycobacterium
NGAEIG

SEQ ID NO: 271835 - protein, 5 aa, Mycobacterium
NGAFE

SEQ ID NO: 271836 - protein, 4 aa, Mycobacterium
NGAG

SEQ ID NO: 271837 - protein, 6 aa, Mycobacterium
NGAGAP

SEQ ID NO: 271838 - protein, 8 aa, Mycobacterium
NGAGPEFG

SEQ ID NO: 271839 - protein, 14 aa, Mycobacterium
NGAKTPPAAQNPAD

SEQ ID NO: 271840 - protein, 9 aa, Mycobacterium
NGAPATEPI

SEQ ID NO: 271841 - protein, 10 aa, Mycobacterium
NGAPLGPDEP

SEQ ID NO: 271842 - protein, 14 aa, Mycobacterium
NGAPPPPKPSPQDL

SEQ ID NO: 271843 - protein, 4 aa, Mycobacterium
NGAQ

SEQ ID NO: 271844 - protein, 8 aa, Mycobacterium
NGASATVQ

SEQ ID NO: 271845 - protein, 8 aa, Mycobacterium
NGASDVDR

SEQ ID NO: 271846 - protein, 15 aa, Mycobacterium
NGASGEGSPNGSVNE

SEQ ID NO: 271847 - protein, 13 aa, Mycobacterium
NGASRDPRRDRAA

SEQ ID NO: 271848 - protein, 8 aa, Mycobacterium
NGATGHTF

SEQ ID NO: 271849 - protein, 15 aa, Mycobacterium
NGATIAQENTRVGQD

SEQ ID NO: 271850 - protein, 23 aa, Mycobacterium
NGCAATGARLDDATHQAAGGRTD

SEQ ID NO: 271851 - protein, 8 aa, Mycobacterium
NGDADTRE

SEQ ID NO: 271852 - protein, 7 aa, Mycobacterium
NGDDEVP

SEQ ID NO: 271853 - protein, 12 aa, Mycobacterium
NGDDYDPSTPDA

SEQ ID NO: 271854 - protein, 20 aa, Mycobacterium
NGDGATSNGDGTTNGSGADC

SEQ ID NO: 271855 - protein, 7 aa, Mycobacterium
NGDGEIP

SEQ ID NO: 271856 - protein, 7 aa, Mycobacterium
NGDGEVP

SEQ ID NO: 271857 - protein, 12 aa, Mycobacterium
NGDGSVTCPPDG

SEQ ID NO: 271858 - protein, 4 aa, Mycobacterium
NGDL

SEQ ID NO: 271859 - protein, 5 aa, Mycobacterium
NGDLR

SEQ ID NO: 271860 - protein, 15 aa, Mycobacterium
NGDNVNSAQIDDREQ

SEQ ID NO: 271861 - protein, 10 aa, Mycobacterium
NGDPATPEGI

SEQ ID NO: 271862 - protein, 8 aa, Mycobacterium
NGDPSSMT

SEQ ID NO: 271863 - protein, 16 aa, Mycobacterium
NGDPVWESGESGALNE

SEQ ID NO: 271864 - protein, 8 aa, Mycobacterium
NGDRDSRV

SEQ ID NO: 271865 - protein, 6 aa, Mycobacterium
NGDRFD

SEQ ID NO: 271866 - protein, 6 aa, Mycobacterium
NGDTSA

SEQ ID NO: 271867 - protein, 6 aa, Mycobacterium
NGEAAR

SEQ ID NO: 271868 - protein, 7 aa, Mycobacterium
NGEDEVP

SEQ ID NO: 271869 - protein, 13 aa, Mycobacterium
NGEDYDPSTPDAL

SEQ ID NO: 271870 - protein, 10 aa, Mycobacterium
NGEEARSLDS

SEQ ID NO: 271871 - protein, 20 aa, Mycobacterium
NGEERTGALRPTGKVQPGDK

SEQ ID NO: 271872 - protein, 9 aa, Mycobacterium
NGEEYEWST

SEQ ID NO: 271873 - protein, 7 aa, Mycobacterium
NGEFSRT

SEQ ID NO: 271874 - protein, 10 aa, Mycobacterium
NGEKPEAPKV

SEQ ID NO: 271875 - protein, 17 aa, Mycobacterium
NGENVTSLSNDAEGGLA

SEQ ID NO: 271876 - protein, 5 aa, Mycobacterium
NGEPA

SEQ ID NO: 271877 - protein, 8 aa, Mycobacterium
NGEPVSYG

SEQ ID NO: 271878 - protein, 7 aa, Mycobacterium
NGEQPKA

SEQ ID NO: 271879 - protein, 9 aa, Mycobacterium
NGESGHGSR

SEQ ID NO: 271880 - protein, 10 aa, Mycobacterium
NGESPEAPKV

SEQ ID NO: 271881 - protein, 5 aa, Mycobacterium
NGEVG

SEQ ID NO: 271882 - protein, 6 aa, Mycobacterium
NGFAPD

SEQ ID NO: 271883 - protein, 7 aa, Mycobacterium
NGFDQSV

SEQ ID NO: 271884 - protein, 4 aa, Mycobacterium
NGFG

SEQ ID NO: 271885 - protein, 5 aa, Mycobacterium
NGFSE

SEQ ID NO: 271886 - protein, 6 aa, Mycobacterium
NGFTEA

SEQ ID NO: 271887 - protein, 9 aa, Mycobacterium
NGGAGGSGV

SEQ ID NO: 271888 - protein, 7 aa, Mycobacterium
NGGAKIA

SEQ ID NO: 271889 - protein, 6 aa, Mycobacterium
NGGASA

SEQ ID NO: 271890 - protein, 7 aa, Mycobacterium
NGGASSR

SEQ ID NO: 271891 - protein, 6 aa, Mycobacterium
NGGDNI

SEQ ID NO: 271892 - protein, 4 aa, Mycobacterium
NGGE

SEQ ID NO: 271893 - protein, 18 aa, Mycobacterium
NGGEDDPASRHRHRSSRP

SEQ ID NO: 271894 - protein, 19 aa, Mycobacterium
NGGEGDPSSRHRHRTSPPT

SEQ ID NO: 271895 - protein, 12 aa, Mycobacterium
NGGEGSAPRHAR

SEQ ID NO: 271896 - protein, 14 aa, Mycobacterium
NGGENGAQQHAKEL

SEQ ID NO: 271897 - protein, 5 aa, Mycobacterium
NGGEV

SEQ ID NO: 271898 - protein, 4 aa, Mycobacterium
NGGG

SEQ ID NO: 271899 - protein, 13 aa, Mycobacterium
NGGGKAYEREHRA

SEQ ID NO: 271900 - protein, 23 aa, Mycobacterium
NGGGPEGISAAPLSPAEAFAGPS

SEQ ID NO: 271901 - protein, 10 aa, Mycobacterium
NGGGTHLSKN

SEQ ID NO: 271902 - protein, 4 aa, Mycobacterium
NGGL

SEQ ID NO: 271903 - protein, 10 aa, Mycobacterium
NGGPAPASAQ

SEQ ID NO: 271904 - protein, 4 aa, Mycobacterium
NGGQ

SEQ ID NO: 271905 - protein, 12 aa, Mycobacterium
NGGRDALGGSNG

SEQ ID NO: 271906 - protein, 33 aa, Mycobacterium
NGGRDIDATGTEADADGAGATGASRTATRATPS

SEQ ID NO: 271907 - protein, 28 aa, Mycobacterium
NGGRDTEHPTDDTPGTGAATTATRTAPA

SEQ ID NO: 271908 - protein, 6 aa, Mycobacterium
NGGRFA

SEQ ID NO: 271909 - protein, 6 aa, Mycobacterium
NGGRIR

SEQ ID NO: 271910 - protein, 4 aa, Mycobacterium
NGGS

SEQ ID NO: 271911 - protein, 8 aa, Mycobacterium
NGGSSLTG

SEQ ID NO: 271912 - protein, 5 aa, Mycobacterium
NGGTA

SEQ ID NO: 271913 - protein, 8 aa, Mycobacterium
NGGTKATA

SEQ ID NO: 271914 - protein, 9 aa, Mycobacterium
NGHQEAPLT

SEQ ID NO: 271915 - protein, 18 aa, Mycobacterium
NGHTDHGHDGHGDHPHKH

SEQ ID NO: 271916 - protein, 8 aa, Mycobacterium
NGIAPDAV

SEQ ID NO: 271917 - protein, 11 aa, Mycobacterium
NGIDARPARSF

SEQ ID NO: 271918 - protein, 5 aa, Mycobacterium
NGIGI

SEQ ID NO: 271919 - protein, 7 aa, Mycobacterium
NGIGIPE

SEQ ID NO: 271920 - protein, 6 aa, Mycobacterium
NGIGSD

SEQ ID NO: 271921 - protein, 5 aa, Mycobacterium
NGIHP

SEQ ID NO: 271922 - protein, 13 aa, Mycobacterium
NGINSAGAQLAQG

SEQ ID NO: 271923 - protein, 9 aa, Mycobacterium
NGIPGTRRQ

SEQ ID NO: 271924 - protein, 7 aa, Mycobacterium
NGIPRGP

SEQ ID NO: 271925 - protein, 42 aa, Mycobacterium
NGIPSDVSADEENNPQGSDSFVERDKSGNANGSQDTEGGTTI

SEQ ID NO: 271926 - protein, 4 aa, Mycobacterium
NGIR

SEQ ID NO: 271927 - protein, 5 aa, Mycobacterium
NGISP

SEQ ID NO: 271928 - protein, 9 aa, Mycobacterium
NGITASTSE

SEQ ID NO: 271929 - protein, 12 aa, Mycobacterium
NGITPDGTRTGS

SEQ ID NO: 271930 - protein, 13 aa, Mycobacterium
NGITVKDSDGTIR

SEQ ID NO: 271931 - protein, 9 aa, Mycobacterium
NGKAARTAI

SEQ ID NO: 271932 - protein, 5 aa, Mycobacterium
NGKFT

SEQ ID NO: 271933 - protein, 6 aa, Mycobacterium
NGKFTS

SEQ ID NO: 271934 - protein, 15 aa, Mycobacterium
NGKGAAVNTTVNQGS

SEQ ID NO: 271935 - protein, 7 aa, Mycobacterium
NGKGGQP

SEQ ID NO: 271936 - protein, 8 aa, Mycobacterium
NGKGGQPV

SEQ ID NO: 271937 - protein, 12 aa, Mycobacterium
NGKLPETDTYCP

SEQ ID NO: 271938 - protein, 17 aa, Mycobacterium
NGKNVTSKPSAERGKTE

SEQ ID NO: 271939 - protein, 8 aa, Mycobacterium
NGKPPTAS

SEQ ID NO: 271940 - protein, 8 aa, Mycobacterium
NGKPVPLG

SEQ ID NO: 271941 - protein, 8 aa, Mycobacterium
NGKSPCTV

SEQ ID NO: 271942 - protein, 6 aa, Mycobacterium
NGLDRE

SEQ ID NO: 271943 - protein, 7 aa, Mycobacterium
NGLGGVE

SEQ ID NO: 271944 - protein, 12 aa, Mycobacterium
NGLGKDDADSYR

SEQ ID NO: 271945 - protein, 8 aa, Mycobacterium
NGLGPGDL

SEQ ID NO: 271946 - protein, 5 aa, Mycobacterium
NGLGT

SEQ ID NO: 271947 - protein, 4 aa, Mycobacterium
NGLT

SEQ ID NO: 271948 - protein, 10 aa, Mycobacterium
NGLTPADEQT

SEQ ID NO: 271949 - protein, 9 aa, Mycobacterium
NGLTPASAD

SEQ ID NO: 271950 - protein, 7 aa, Mycobacterium
NGMPRET

SEQ ID NO: 271951 - protein, 10 aa, Mycobacterium
NGNADEDTKR

SEQ ID NO: 271952 - protein, 14 aa, Mycobacterium
NGNAGAAAGDESVA

SEQ ID NO: 271953 - protein, 6 aa, Mycobacterium
NGNAWP

SEQ ID NO: 271954 - protein, 84 aa, Mycobacterium
NGNGNGNGHANGNGHTNGNGHTNGNGHTNGNGHTNGNGHTNGNGHTNGNGHTNGNGHTNGNGHTNGNGKQPVDTGSALPDRSAI

SEQ ID NO: 271955 - protein, 6 aa, Mycobacterium
NGNITD

SEQ ID NO: 271956 - protein, 8 aa, Mycobacterium
NGNPDDPI

SEQ ID NO: 271957 - protein, 6 aa, Mycobacterium
NGNPWS

SEQ ID NO: 271958 - protein, 5 aa, Mycobacterium
NGNTA

SEQ ID NO: 271959 - protein, 5 aa, Mycobacterium
NGNVD

SEQ ID NO: 271960 - protein, 23 aa, Mycobacterium
NGNVGAPAVTRRRRRRRGDTDSI

SEQ ID NO: 271961 - protein, 4 aa, Mycobacterium
NGPA

SEQ ID NO: 271962 - protein, 15 aa, Mycobacterium
NGPADVAEAAHDAGV

SEQ ID NO: 271963 - protein, 6 aa, Mycobacterium
NGPAGS

SEQ ID NO: 271964 - protein, 22 aa, Mycobacterium
NGPDGLDDAQTEKLGAAGIPVN

SEQ ID NO: 271965 - protein, 4 aa, Mycobacterium
NGPE

SEQ ID NO: 271966 - protein, 7 aa, Mycobacterium
NGPEDVA

SEQ ID NO: 271967 - protein, 14 aa, Mycobacterium
NGPGFCSSSPAAFD

SEQ ID NO: 271968 - protein, 8 aa, Mycobacterium
NGPGIPAA

SEQ ID NO: 271969 - protein, 8 aa, Mycobacterium
NGPGIPEA

SEQ ID NO: 271970 - protein, 6 aa, Mycobacterium
NGPHAP

SEQ ID NO: 271971 - protein, 7 aa, Mycobacterium
NGPIAPD

SEQ ID NO: 271972 - protein, 4 aa, Mycobacterium
NGPL

SEQ ID NO: 271973 - protein, 10 aa, Mycobacterium
NGPPVPSSDA

SEQ ID NO: 271974 - protein, 15 aa, Mycobacterium
NGPQDVADAAHQAGI

SEQ ID NO: 271975 - protein, 10 aa, Mycobacterium
NGPRSDRTRQ

SEQ ID NO: 271976 - protein, 8 aa, Mycobacterium
NGPSRDVQ

SEQ ID NO: 271977 - protein, 5 aa, Mycobacterium
NGPTH

SEQ ID NO: 271978 - protein, 29 aa, Mycobacterium
NGPTSAGTMGPAAVAPSTKATLTNLGNST

SEQ ID NO: 271979 - protein, 7 aa, Mycobacterium
NGPTVSE

SEQ ID NO: 271980 - protein, 17 aa, Mycobacterium
NGPVFNEGERVEANTST

SEQ ID NO: 271981 - protein, 16 aa, Mycobacterium
NGPVFNKGERVEANTS

SEQ ID NO: 271982 - protein, 17 aa, Mycobacterium
NGPVFNQGERVEANTST

SEQ ID NO: 271983 - protein, 5 aa, Mycobacterium
NGPVG

SEQ ID NO: 271984 - protein, 13 aa, Mycobacterium
NGPYGGGGGGGQM

SEQ ID NO: 271985 - protein, 5 aa, Mycobacterium
NGQFA

SEQ ID NO: 271986 - protein, 4 aa, Mycobacterium
NGQG

SEQ ID NO: 271987 - protein, 7 aa, Mycobacterium
NGQIGNK

SEQ ID NO: 271988 - protein, 16 aa, Mycobacterium
NGQIPGQNPAVPPADG

SEQ ID NO: 271989 - protein, 4 aa, Mycobacterium
NGQP

SEQ ID NO: 271990 - protein, 13 aa, Mycobacterium
NGQPKLDDAELST

SEQ ID NO: 271991 - protein, 6 aa, Mycobacterium
NGQPPI

SEQ ID NO: 271992 - protein, 6 aa, Mycobacterium
NGQPVT

SEQ ID NO: 271993 - protein, 4 aa, Mycobacterium
NGQR

SEQ ID NO: 271994 - protein, 9 aa, Mycobacterium
NGQRTAQGT

SEQ ID NO: 271995 - protein, 6 aa, Mycobacterium
NGQSLP

SEQ ID NO: 271996 - protein, 5 aa, Mycobacterium
NGQSW

SEQ ID NO: 271997 - protein, 9 aa, Mycobacterium
NGQTTGEVT

SEQ ID NO: 271998 - protein, 7 aa, Mycobacterium
NGQVGSN

SEQ ID NO: 271999 - protein, 28 aa, Mycobacterium
NGQYWKGSPAVKSGKAKHPWPDHRPPRA

SEQ ID NO: 272000 - protein, 29 aa, Mycobacterium
NGQYWKGSPAVKSGKARHPWPDYRPPRAG

SEQ ID NO: 272001 - protein, 5 aa, Mycobacterium
NGRAA

SEQ ID NO: 272002 - protein, 8 aa, Mycobacterium
NGRATHAS

SEQ ID NO: 272003 - protein, 10 aa, Mycobacterium
NGRDPGPLAN

SEQ ID NO: 272004 - protein, 7 aa, Mycobacterium
NGRGGQP

SEQ ID NO: 272005 - protein, 6 aa, Mycobacterium
NGRGLP

SEQ ID NO: 272006 - protein, 10 aa, Mycobacterium
NGRGLPADEH

SEQ ID NO: 272007 - protein, 5 aa, Mycobacterium
NGRMP

SEQ ID NO: 272008 - protein, 8 aa, Mycobacterium
NGRPAEEP

SEQ ID NO: 272009 - protein, 7 aa, Mycobacterium
NGRPDTA

SEQ ID NO: 272010 - protein, 8 aa, Mycobacterium
NGRPPNIS

SEQ ID NO: 272011 - protein, 8 aa, Mycobacterium
NGRPVGPR

SEQ ID NO: 272012 - protein, 7 aa, Mycobacterium
NGRSPCT

SEQ ID NO: 272013 - protein, 9 aa, Mycobacterium
NGRSPSVAD

SEQ ID NO: 272014 - protein, 8 aa, Mycobacterium
NGRTGTPI

SEQ ID NO: 272015 - protein, 7 aa, Mycobacterium
NGSAADA

SEQ ID NO: 272016 - protein, 5 aa, Mycobacterium
NGSAD

SEQ ID NO: 272017 - protein, 7 aa, Mycobacterium
NGSAPKV

SEQ ID NO: 272018 - protein, 6 aa, Mycobacterium
NGSAPS

SEQ ID NO: 272019 - protein, 6 aa, Mycobacterium
NGSAVD

SEQ ID NO: 272020 - protein, 33 aa, Mycobacterium
NGSDLPDQTPGKHAVPEEPTQVSGTDPETGETE

SEQ ID NO: 272021 - protein, 6 aa, Mycobacterium
NGSEPV

SEQ ID NO: 272022 - protein, 7 aa, Mycobacterium
NGSEPVS

SEQ ID NO: 272023 - protein, 10 aa, Mycobacterium
NGSEPVSPAS

SEQ ID NO: 272024 - protein, 4 aa, Mycobacterium
NGSG

SEQ ID NO: 272025 - protein, 6 aa, Mycobacterium
NGSGHE

SEQ ID NO: 272026 - protein, 10 aa, Mycobacterium
NGSGPRFTAP

SEQ ID NO: 272027 - protein, 7 aa, Mycobacterium
NGSHAPA

SEQ ID NO: 272028 - protein, 8 aa, Mycobacterium
NGSHAPAG

SEQ ID NO: 272029 - protein, 7 aa, Mycobacterium
NGSHEGT

SEQ ID NO: 272030 - protein, 4 aa, Mycobacterium
NGSK

SEQ ID NO: 272031 - protein, 13 aa, Mycobacterium
NGSKGSEGGGAGA

SEQ ID NO: 272032 - protein, 12 aa, Mycobacterium
NGSLTNPQAAPS

SEQ ID NO: 272033 - protein, 7 aa, Mycobacterium
NGSNDLA

SEQ ID NO: 272034 - protein, 10 aa, Mycobacterium
NGSPQPMPAP

SEQ ID NO: 272035 - protein, 8 aa, Mycobacterium
NGSQWQTV

SEQ ID NO: 272036 - protein, 10 aa, Mycobacterium
NGSRPAPRTT

SEQ ID NO: 272037 - protein, 7 aa, Mycobacterium
NGSSTPY

SEQ ID NO: 272038 - protein, 8 aa, Mycobacterium
NGSTDDTM

SEQ ID NO: 272039 - protein, 6 aa, Mycobacterium
NGSTTL

SEQ ID NO: 272040 - protein, 8 aa, Mycobacterium
NGSTWRDS

SEQ ID NO: 272041 - protein, 8 aa, Mycobacterium
NGSVDDDK

SEQ ID NO: 272042 - protein, 5 aa, Mycobacterium
NGSVG

SEQ ID NO: 272043 - protein, 21 aa, Mycobacterium
NGTATPGTDEAPAPVEYEKSS

SEQ ID NO: 272044 - protein, 36 aa, Mycobacterium
NGTDKDVAEDATDATASTAQEPKSTAVETVSAAPEH

SEQ ID NO: 272045 - protein, 9 aa, Mycobacterium
NGTDPSPTL

SEQ ID NO: 272046 - protein, 9 aa, Mycobacterium
NGTEYEWST

SEQ ID NO: 272047 - protein, 7 aa, Mycobacterium
NGTGGTR

SEQ ID NO: 272048 - protein, 10 aa, Mycobacterium
NGTGIPEGER

SEQ ID NO: 272049 - protein, 10 aa, Mycobacterium
NGTGNAETSQ

SEQ ID NO: 272050 - protein, 5 aa, Mycobacterium
NGTGR

SEQ ID NO: 272051 - protein, 7 aa, Mycobacterium
NGTGTLA

SEQ ID NO: 272052 - protein, 24 aa, Mycobacterium
NGTIGAPAVTRRRRRRRGDSDSVT

SEQ ID NO: 272053 - protein, 23 aa, Mycobacterium
NGTIGAPPVGGRRRRRRGNSDAV

SEQ ID NO: 272054 - protein, 12 aa, Mycobacterium
NGTITSGGGQAQ

SEQ ID NO: 272055 - protein, 13 aa, Mycobacterium
NGTITVNSSPGHT

SEQ ID NO: 272056 - protein, 14 aa, Mycobacterium
NGTPHTTKSTRTSA

SEQ ID NO: 272057 - protein, 7 aa, Mycobacterium
NGTQAEI

SEQ ID NO: 272058 - protein, 19 aa, Mycobacterium
NGTQRESRTGAGLTICAPT

SEQ ID NO: 272059 - protein, 8 aa, Mycobacterium
NGTQSATT

SEQ ID NO: 272060 - protein, 8 aa, Mycobacterium
NGTSGPLR

SEQ ID NO: 272061 - protein, 8 aa, Mycobacterium
NGTSTIGK

SEQ ID NO: 272062 - protein, 7 aa, Mycobacterium
NGTTGGH

SEQ ID NO: 272063 - protein, 8 aa, Mycobacterium
NGTTPVGG

SEQ ID NO: 272064 - protein, 7 aa, Mycobacterium
NGTVGTN

SEQ ID NO: 272065 - protein, 14 aa, Mycobacterium
NGTVVSDGPAQLDQ

SEQ ID NO: 272066 - protein, 9 aa, Mycobacterium
NGVAEPDRL

SEQ ID NO: 272067 - protein, 4 aa, Mycobacterium
NGVD

SEQ ID NO: 272068 - protein, 7 aa, Mycobacterium
NGVDESP

SEQ ID NO: 272069 - protein, 9 aa, Mycobacterium
NGVEDNPGY

SEQ ID NO: 272070 - protein, 11 aa, Mycobacterium
NGVEEDEGLQP

SEQ ID NO: 272071 - protein, 9 aa, Mycobacterium
NGVGVPEGE

SEQ ID NO: 272072 - protein, 6 aa, Mycobacterium
NGVPDD

SEQ ID NO: 272073 - protein, 6 aa, Mycobacterium
NGVPRA

SEQ ID NO: 272074 - protein, 6 aa, Mycobacterium
NGVPRT

SEQ ID NO: 272075 - protein, 4 aa, Mycobacterium
NGVS

SEQ ID NO: 272076 - protein, 22 aa, Mycobacterium
NGVTGPAATDDAARASERGAGQ

SEQ ID NO: 272077 - protein, 7 aa, Mycobacterium
NGWDPGR

SEQ ID NO: 272078 - protein, 18 aa, Mycobacterium
NGYDTRVDDDGGAISAGE

SEQ ID NO: 272079 - protein, 7 aa, Mycobacterium
NGYEGPS

SEQ ID NO: 272080 - protein, 7 aa, Mycobacterium
NGYGSMT

SEQ ID NO: 272081 - protein, 18 aa, Mycobacterium
NGYRTEVAGTGVPLSAGQ

SEQ ID NO: 272082 - protein, 12 aa, Mycobacterium
NGYSDNGGGEGI

SEQ ID NO: 272083 - protein, 7 aa, Mycobacterium
NGYTTAT

SEQ ID NO: 272084 - protein, 7 aa, Mycobacterium
NHAGASL

SEQ ID NO: 272085 - protein, 7 aa, Mycobacterium
NHAGDGS

SEQ ID NO: 272086 - protein, 12 aa, Mycobacterium
NHAGNATAAAIT

SEQ ID NO: 272087 - protein, 14 aa, Mycobacterium
NHANPKPTSQVQGG

SEQ ID NO: 272088 - protein, 14 aa, Mycobacterium
NHAPGDHDVPAEGT

SEQ ID NO: 272089 - protein, 5 aa, Mycobacterium
NHATH

SEQ ID NO: 272090 - protein, 8 aa, Mycobacterium
NHDAGAQV

SEQ ID NO: 272091 - protein, 5 aa, Mycobacterium
NHDGR

SEQ ID NO: 272092 - protein, 8 aa, Mycobacterium
NHEHAEDD

SEQ ID NO: 272093 - protein, 8 aa, Mycobacterium
NHEPPPSH

SEQ ID NO: 272094 - protein, 8 aa, Mycobacterium
NHGAGGRM

SEQ ID NO: 272095 - protein, 14 aa, Mycobacterium
NHGDASPLVFLELH

SEQ ID NO: 272096 - protein, 5 aa, Mycobacterium
NHGDP

SEQ ID NO: 272097 - protein, 9 aa, Mycobacterium
NHGDSQAAG

SEQ ID NO: 272098 - protein, 6 aa, Mycobacterium
NHGRPT

SEQ ID NO: 272099 - protein, 8 aa, Mycobacterium
NHMPTGRR

SEQ ID NO: 272100 - protein, 6 aa, Mycobacterium
NHNGYG

SEQ ID NO: 272101 - protein, 5 aa, Mycobacterium
NHPEG

SEQ ID NO: 272102 - protein, 6 aa, Mycobacterium
NHPESK

SEQ ID NO: 272103 - protein, 7 aa, Mycobacterium
NHPSPTV

SEQ ID NO: 272104 - protein, 5 aa, Mycobacterium
NHQPG

SEQ ID NO: 272105 - protein, 6 aa, Mycobacterium
NHTGLS

SEQ ID NO: 272106 - protein, 7 aa, Mycobacterium
NHTSGDI

SEQ ID NO: 272107 - protein, 5 aa, Mycobacterium
NHTTH

SEQ ID NO: 272108 - protein, 6 aa, Mycobacterium
NHYPDD

SEQ ID NO: 272109 - protein, 7 aa, Mycobacterium
NHYPDDI

SEQ ID NO: 272110 - protein, 6 aa, Mycobacterium
NHYPQD

SEQ ID NO: 272111 - protein, 4 aa, Mycobacterium
NIAG

SEQ ID NO: 272112 - protein, 10 aa, Mycobacterium
NIAGDSKEQL

SEQ ID NO: 272113 - protein, 5 aa, Mycobacterium
NIAPG

SEQ ID NO: 272114 - protein, 17 aa, Mycobacterium
NIAQDGKGYASGTQLGE

SEQ ID NO: 272115 - protein, 13 aa, Mycobacterium
NIDDTDVDASPGG

SEQ ID NO: 272116 - protein, 9 aa, Mycobacterium
NIDKTSPQF

SEQ ID NO: 272117 - protein, 5 aa, Mycobacterium
NIDSS

SEQ ID NO: 272118 - protein, 8 aa, Mycobacterium
NIDTNNPI

SEQ ID NO: 272119 - protein, 4 aa, Mycobacterium
NIEG

SEQ ID NO: 272120 - protein, 5 aa, Mycobacterium
NIEGS

SEQ ID NO: 272121 - protein, 7 aa, Mycobacterium
NIEPAGD

SEQ ID NO: 272122 - protein, 5 aa, Mycobacterium
NIGGA

SEQ ID NO: 272123 - protein, 26 aa, Mycobacterium
NIGGSTDKLQQGAEALRQANDQIDGI

SEQ ID NO: 272124 - protein, 5 aa, Mycobacterium
NIGHD

SEQ ID NO: 272125 - protein, 10 aa, Mycobacterium
NIGHTQAAAG

SEQ ID NO: 272126 - protein, 11 aa, Mycobacterium
NIGHTSAAAGV

SEQ ID NO: 272127 - protein, 8 aa, Mycobacterium
NIGNPDGP

SEQ ID NO: 272128 - protein, 4 aa, Mycobacterium
NIGS

SEQ ID NO: 272129 - protein, 6 aa, Mycobacterium
NIGTAR

SEQ ID NO: 272130 - protein, 11 aa, Mycobacterium
NIKAGAKTRAS

SEQ ID NO: 272131 - protein, 6 aa, Mycobacterium
NINPGN

SEQ ID NO: 272132 - protein, 9 aa, Mycobacterium
NIPADGPAI

SEQ ID NO: 272133 - protein, 5 aa, Mycobacterium
NIPDS

SEQ ID NO: 272134 - protein, 5 aa, Mycobacterium
NIPEP

SEQ ID NO: 272135 - protein, 11 aa, Mycobacterium
NIQPGKPITSM

SEQ ID NO: 272136 - protein, 18 aa, Mycobacterium
NIQSPGPWRRNAAPDQPV

SEQ ID NO: 272137 - protein, 9 aa, Mycobacterium
NISGCGTNS

SEQ ID NO: 272138 - protein, 7 aa, Mycobacterium
NISPAAG

SEQ ID NO: 272139 - protein, 8 aa, Mycobacterium
NISSAREL

SEQ ID NO: 272140 - protein, 19 aa, Mycobacterium
NISTARDLAGEAVSGRQAG

SEQ ID NO: 272141 - protein, 12 aa, Mycobacterium
NISTDNTGVTAE

SEQ ID NO: 272142 - protein, 7 aa, Mycobacterium
NISYGRS

SEQ ID NO: 272143 - protein, 8 aa, Mycobacterium
NITGDGNA

SEQ ID NO: 272144 - protein, 13 aa, Mycobacterium
NITKSTGVQQEPR

SEQ ID NO: 272145 - protein, 8 aa, Mycobacterium
NITPAEEQ

SEQ ID NO: 272146 - protein, 5 aa, Mycobacterium
NITTA

SEQ ID NO: 272147 - protein, 8 aa, Mycobacterium
NKAEPDCG

SEQ ID NO: 272148 - protein, 9 aa, Mycobacterium
NKAEPDCGT

SEQ ID NO: 272149 - protein, 8 aa, Mycobacterium
NKAKEDVQ

SEQ ID NO: 272150 - protein, 8 aa, Mycobacterium
NKANSGVQ

SEQ ID NO: 272151 - protein, 7 aa, Mycobacterium
NKAQAGV

SEQ ID NO: 272152 - protein, 7 aa, Mycobacterium
NKAQDGV

SEQ ID NO: 272153 - protein, 8 aa, Mycobacterium
NKARGGTA

SEQ ID NO: 272154 - protein, 6 aa, Mycobacterium
NKATGE

SEQ ID NO: 272155 - protein, 7 aa, Mycobacterium
NKAVADT

SEQ ID NO: 272156 - protein, 6 aa, Mycobacterium
NKDGRR

SEQ ID NO: 272157 - protein, 9 aa, Mycobacterium
NKEGEASKV

SEQ ID NO: 272158 - protein, 6 aa, Mycobacterium
NKESGV

SEQ ID NO: 272159 - protein, 8 aa, Mycobacterium
NKEYSAPR

SEQ ID NO: 272160 - protein, 6 aa, Mycobacterium
NKGNGR

SEQ ID NO: 272161 - protein, 15 aa, Mycobacterium
NKGNPWGQNASDRTN

SEQ ID NO: 272162 - protein, 7 aa, Mycobacterium
NKGPDLG

SEQ ID NO: 272163 - protein, 10 aa, Mycobacterium
NKGSRSDKIR

SEQ ID NO: 272164 - protein, 10 aa, Mycobacterium
NKGTRSEKIR

SEQ ID NO: 272165 - protein, 12 aa, Mycobacterium
NKHKEAATTPEP

SEQ ID NO: 272166 - protein, 13 aa, Mycobacterium
NKIPGTASGPSRR

SEQ ID NO: 272167 - protein, 10 aa, Mycobacterium
NKLPKGQTIG

SEQ ID NO: 272168 - protein, 19 aa, Mycobacterium
NKLSAEARATSNKRHAEEI

SEQ ID NO: 272169 - protein, 10 aa, Mycobacterium
NKNDAAKKIT

SEQ ID NO: 272170 - protein, 7 aa, Mycobacterium
NKPAEIS

SEQ ID NO: 272171 - protein, 10 aa, Mycobacterium
NKPAFAPDGI

SEQ ID NO: 272172 - protein, 5 aa, Mycobacterium
NKPAT

SEQ ID NO: 272173 - protein, 4 aa, Mycobacterium
NKPD

SEQ ID NO: 272174 - protein, 9 aa, Mycobacterium
NKPKTPPYK

SEQ ID NO: 272175 - protein, 22 aa, Mycobacterium
NKPPPPAQTEAPADLGVPPRTS

SEQ ID NO: 272176 - protein, 6 aa, Mycobacterium
NKPRRA

SEQ ID NO: 272177 - protein, 7 aa, Mycobacterium
NKPSAFS

SEQ ID NO: 272178 - protein, 8 aa, Mycobacterium
NKPSAYST

SEQ ID NO: 272179 - protein, 11 aa, Mycobacterium
NKQAQVTNTTQ

SEQ ID NO: 272180 - protein, 6 aa, Mycobacterium
NKRTAP

SEQ ID NO: 272181 - protein, 4 aa, Mycobacterium
NKRW

SEQ ID NO: 272182 - protein, 28 aa, Mycobacterium
NKSARANRSDARSAAQLGASSEPRVSKT

SEQ ID NO: 272183 - protein, 9 aa, Mycobacterium
NKSDGFSRL

SEQ ID NO: 272184 - protein, 9 aa, Mycobacterium
NKSPAWKTG

SEQ ID NO: 272185 - protein, 15 aa, Mycobacterium
NKTAAAAAIAPDSVG

SEQ ID NO: 272186 - protein, 6 aa, Mycobacterium
NKTAKT

SEQ ID NO: 272187 - protein, 8 aa, Mycobacterium
NKTAKTVG

SEQ ID NO: 272188 - protein, 9 aa, Mycobacterium
NKTAKTVGQ

SEQ ID NO: 272189 - protein, 10 aa, Mycobacterium
NKTAKTVGQI

SEQ ID NO: 272190 - protein, 9 aa, Mycobacterium
NKTPATEPI

SEQ ID NO: 272191 - protein, 18 aa, Mycobacterium
NKTSSNASSLRAATQRAT

SEQ ID NO: 272192 - protein, 8 aa, Mycobacterium
NKTTLKPA

SEQ ID NO: 272193 - protein, 15 aa, Mycobacterium
NKVGPPAGATGFADG

SEQ ID NO: 272194 - protein, 7 aa, Mycobacterium
NKVPGGG

SEQ ID NO: 272195 - protein, 7 aa, Mycobacterium
NKVPNAS

SEQ ID NO: 272196 - protein, 12 aa, Mycobacterium
NKYNQSASPVGD

SEQ ID NO: 272197 - protein, 25 aa, Mycobacterium
NLAGGRPSAAKTGTVQLGDTGDNRD

SEQ ID NO: 272198 - protein, 25 aa, Mycobacterium
NLAGGRPSASKTGTVQLGDTSANRD

SEQ ID NO: 272199 - protein, 8 aa, Mycobacterium
NLAKAGGN

SEQ ID NO: 272200 - protein, 13 aa, Mycobacterium
NLAPGQPAAAAGG

SEQ ID NO: 272201 - protein, 7 aa, Mycobacterium
NLAQSQH

SEQ ID NO: 272202 - protein, 7 aa, Mycobacterium
NLAQSQR

SEQ ID NO: 272203 - protein, 10 aa, Mycobacterium
NLARPKDPWD

SEQ ID NO: 272204 - protein, 14 aa, Mycobacterium
NLASDAANSVKTYP

SEQ ID NO: 272205 - protein, 6 aa, Mycobacterium
NLATAT

SEQ ID NO: 272206 - protein, 8 aa, Mycobacterium
NLATPDDT

SEQ ID NO: 272207 - protein, 8 aa, Mycobacterium
NLATPDET

SEQ ID NO: 272208 - protein, 8 aa, Mycobacterium
NLATPNET

SEQ ID NO: 272209 - protein, 5 aa, Mycobacterium
NLATT

SEQ ID NO: 272210 - protein, 7 aa, Mycobacterium
NLDEDGC

SEQ ID NO: 272211 - protein, 5 aa, Mycobacterium
NLDGT

SEQ ID NO: 272212 - protein, 6 aa, Mycobacterium
NLDGTY

SEQ ID NO: 272213 - protein, 40 aa, Mycobacterium
NLDRGEIDPAVEAPDDDVAADPAEAQESARDAGTSTVTTR

SEQ ID NO: 272214 - protein, 15 aa, Mycobacterium
NLENQNVPADQIEQR

SEQ ID NO: 272215 - protein, 8 aa, Mycobacterium
NLEPRTPV

SEQ ID NO: 272216 - protein, 10 aa, Mycobacterium
NLGDNDVRAA

SEQ ID NO: 272217 - protein, 6 aa, Mycobacterium
NLGDTA

SEQ ID NO: 272218 - protein, 9 aa, Mycobacterium
NLGDTERRQ

SEQ ID NO: 272219 - protein, 6 aa, Mycobacterium
NLGEPA

SEQ ID NO: 272220 - protein, 5 aa, Mycobacterium
NLGET

SEQ ID NO: 272221 - protein, 5 aa, Mycobacterium
NLGGP

SEQ ID NO: 272222 - protein, 19 aa, Mycobacterium
NLGRLGQREPAVYGSTTHA

SEQ ID NO: 272223 - protein, 7 aa, Mycobacterium
NLKPPDI

SEQ ID NO: 272224 - protein, 4 aa, Mycobacterium
NLPA

SEQ ID NO: 272225 - protein, 10 aa, Mycobacterium
NLPADARQPV

SEQ ID NO: 272226 - protein, 24 aa, Mycobacterium
NLPAGETAVNPQTGQHLTKDTSGA

SEQ ID NO: 272227 - protein, 5 aa, Mycobacterium
NLPDD

SEQ ID NO: 272228 - protein, 5 aa, Mycobacterium
NLPDQ

SEQ ID NO: 272229 - protein, 4 aa, Mycobacterium
NLPG

SEQ ID NO: 272230 - protein, 6 aa, Mycobacterium
NLPGGY

SEQ ID NO: 272231 - protein, 8 aa, Mycobacterium
NLPGQSQT

SEQ ID NO: 272232 - protein, 7 aa, Mycobacterium
NLPGTSQ

SEQ ID NO: 272233 - protein, 8 aa, Mycobacterium
NLPGTSQT

SEQ ID NO: 272234 - protein, 5 aa, Mycobacterium
NLPGV

SEQ ID NO: 272235 - protein, 6 aa, Mycobacterium
NLPQTG

SEQ ID NO: 272236 - protein, 13 aa, Mycobacterium
NLPSSELDTDADV

SEQ ID NO: 272237 - protein, 12 aa, Mycobacterium
NLPSTTTTTYSG

SEQ ID NO: 272238 - protein, 14 aa, Mycobacterium
NLQDPQLGESSGGL

SEQ ID NO: 272239 - protein, 15 aa, Mycobacterium
NLQGRGDTDSIEGAH

SEQ ID NO: 272240 - protein, 6 aa, Mycobacterium
NLRGPT

SEQ ID NO: 272241 - protein, 12 aa, Mycobacterium
NLRGRDGVDTIE

SEQ ID NO: 272242 - protein, 8 aa, Mycobacterium
NLRPPDVR

SEQ ID NO: 272243 - protein, 6 aa, Mycobacterium
NLRSNA

SEQ ID NO: 272244 - protein, 22 aa, Mycobacterium
NLSGQAADPFKIPPGTATQHEG

SEQ ID NO: 272245 - protein, 6 aa, Mycobacterium
NLSPPY

SEQ ID NO: 272246 - protein, 5 aa, Mycobacterium
NLSPR

SEQ ID NO: 272247 - protein, 10 aa, Mycobacterium
NLSQNSDSTW

SEQ ID NO: 272248 - protein, 8 aa, Mycobacterium
NLSRPANV

SEQ ID NO: 272249 - protein, 9 aa, Mycobacterium
NLSRPEAAH

SEQ ID NO: 272250 - protein, 8 aa, Mycobacterium
NLTGDGNA

SEQ ID NO: 272251 - protein, 8 aa, Mycobacterium
NLTGEGNA

SEQ ID NO: 272252 - protein, 7 aa, Mycobacterium
NLTPDSD

SEQ ID NO: 272253 - protein, 8 aa, Mycobacterium
NMAGARAT

SEQ ID NO: 272254 - protein, 11 aa, Mycobacterium
NMDEAVSAGKD

SEQ ID NO: 272255 - protein, 11 aa, Mycobacterium
NMGETESNEAV

SEQ ID NO: 272256 - protein, 15 aa, Mycobacterium
NMGETLSNESTEAAR

SEQ ID NO: 272257 - protein, 10 aa, Mycobacterium
NMGGPLANQS

SEQ ID NO: 272258 - protein, 9 aa, Mycobacterium
NMGHTQAAA

SEQ ID NO: 272259 - protein, 10 aa, Mycobacterium
NMGHTQAAAG

SEQ ID NO: 272260 - protein, 11 aa, Mycobacterium
NMGHTSAAAGV

SEQ ID NO: 272261 - protein, 12 aa, Mycobacterium
NMGPNTDDPASG

SEQ ID NO: 272262 - protein, 9 aa, Mycobacterium
NMKNTAQDI

SEQ ID NO: 272263 - protein, 12 aa, Mycobacterium
NMPGTAGHGPGS

SEQ ID NO: 272264 - protein, 5 aa, Mycobacterium
NMTPP

SEQ ID NO: 272265 - protein, 7 aa, Mycobacterium
NMTTTST

SEQ ID NO: 272266 - protein, 7 aa, Mycobacterium
NNADGDV

SEQ ID NO: 272267 - protein, 5 aa, Mycobacterium
NNAGN

SEQ ID NO: 272268 - protein, 12 aa, Mycobacterium
NNAITTDPAVSQ

SEQ ID NO: 272269 - protein, 14 aa, Mycobacterium
NNAPPPAPPPRAGT

SEQ ID NO: 272270 - protein, 5 aa, Mycobacterium
NNAQQ

SEQ ID NO: 272271 - protein, 5 aa, Mycobacterium
NNASK

SEQ ID NO: 272272 - protein, 8 aa, Mycobacterium
NNASRASA

SEQ ID NO: 272273 - protein, 5 aa, Mycobacterium
NNCDG

SEQ ID NO: 272274 - protein, 6 aa, Mycobacterium
NNCGSV

SEQ ID NO: 272275 - protein, 8 aa, Mycobacterium
NNDNDPVA

SEQ ID NO: 272276 - protein, 6 aa, Mycobacterium
NNDPNL

SEQ ID NO: 272277 - protein, 5 aa, Mycobacterium
NNDRP

SEQ ID NO: 272278 - protein, 12 aa, Mycobacterium
NNEADSADRTIS

SEQ ID NO: 272279 - protein, 13 aa, Mycobacterium
NNEDGQARSEGAA

SEQ ID NO: 272280 - protein, 12 aa, Mycobacterium
NNGGSDLGLSRR

SEQ ID NO: 272281 - protein, 5 aa, Mycobacterium
NNGGT

SEQ ID NO: 272282 - protein, 4 aa, Mycobacterium
NNGR

SEQ ID NO: 272283 - protein, 4 aa, Mycobacterium
NNGT

SEQ ID NO: 272284 - protein, 18 aa, Mycobacterium
NNGTNTQNEESTRTATEL

SEQ ID NO: 272285 - protein, 4 aa, Mycobacterium
NNIE

SEQ ID NO: 272286 - protein, 6 aa, Mycobacterium
NNIPGV

SEQ ID NO: 272287 - protein, 6 aa, Mycobacterium
NNISSN

SEQ ID NO: 272288 - protein, 10 aa, Mycobacterium
NNLRAPRGKP

SEQ ID NO: 272289 - protein, 5 aa, Mycobacterium
NNNVD

SEQ ID NO: 272290 - protein, 6 aa, Mycobacterium
NNPAAL

SEQ ID NO: 272291 - protein, 6 aa, Mycobacterium
NNPAAT

SEQ ID NO: 272292 - protein, 5 aa, Mycobacterium
NNPAD

SEQ ID NO: 272293 - protein, 7 aa, Mycobacterium
NNPASSY

SEQ ID NO: 272294 - protein, 4 aa, Mycobacterium
NNPE

SEQ ID NO: 272295 - protein, 4 aa, Mycobacterium
NNPF

SEQ ID NO: 272296 - protein, 16 aa, Mycobacterium
NNPGVPDTQALNANGV

SEQ ID NO: 272297 - protein, 12 aa, Mycobacterium
NNPLPGWDGAPA

SEQ ID NO: 272298 - protein, 15 aa, Mycobacterium
NNPLPGWDGAPAITS

SEQ ID NO: 272299 - protein, 8 aa, Mycobacterium
NNPNNTDD

SEQ ID NO: 272300 - protein, 7 aa, Mycobacterium
NNPQARG

SEQ ID NO: 272301 - protein, 12 aa, Mycobacterium
NNPQGISVDSAG

SEQ ID NO: 272302 - protein, 8 aa, Mycobacterium
NNPSADDD

SEQ ID NO: 272303 - protein, 8 aa, Mycobacterium
NNPTPTRS

SEQ ID NO: 272304 - protein, 15 aa, Mycobacterium
NNQAKLESGALSTAA

SEQ ID NO: 272305 - protein, 15 aa, Mycobacterium
NNQAKLTSGAISTAA

SEQ ID NO: 272306 - protein, 8 aa, Mycobacterium
NNQHPRGS

SEQ ID NO: 272307 - protein, 4 aa, Mycobacterium
NNQL

SEQ ID NO: 272308 - protein, 5 aa, Mycobacterium
NNQPL

SEQ ID NO: 272309 - protein, 7 aa, Mycobacterium
NNQPSVY

SEQ ID NO: 272310 - protein, 14 aa, Mycobacterium
NNRSGGGVRVQDGT

SEQ ID NO: 272311 - protein, 9 aa, Mycobacterium
NNSPRGSFQ

SEQ ID NO: 272312 - protein, 7 aa, Mycobacterium
NNSQSGI

SEQ ID NO: 272313 - protein, 6 aa, Mycobacterium
NNTARA

SEQ ID NO: 272314 - protein, 5 aa, Mycobacterium
NNTEG

SEQ ID NO: 272315 - protein, 6 aa, Mycobacterium
NNTGRT

SEQ ID NO: 272316 - protein, 6 aa, Mycobacterium
NNTPEG

SEQ ID NO: 272317 - protein, 8 aa, Mycobacterium
NNTRSARH

SEQ ID NO: 272318 - protein, 5 aa, Mycobacterium
NNTTA

SEQ ID NO: 272319 - protein, 15 aa, Mycobacterium
NNWPAEPRVDNGPTA

SEQ ID NO: 272320 - protein, 16 aa, Mycobacterium
NNWPAEPRVDNGPTAP

SEQ ID NO: 272321 - protein, 15 aa, Mycobacterium
NNWPAEQRVDNGPTA

SEQ ID NO: 272322 - protein, 6 aa, Mycobacterium
NNYANT

SEQ ID NO: 272323 - protein, 4 aa, Mycobacterium
NNYI

SEQ ID NO: 272324 - protein, 5 aa, Mycobacterium
NNYIS

SEQ ID NO: 272325 - protein, 5 aa, Mycobacterium
NNYPH

SEQ ID NO: 272326 - protein, 9 aa, Mycobacterium
NNYPPARTS

SEQ ID NO: 272327 - protein, 10 aa, Mycobacterium
NPAAGSGNQD

SEQ ID NO: 272328 - protein, 13 aa, Mycobacterium
NPAAPRVERAEET

SEQ ID NO: 272329 - protein, 11 aa, Mycobacterium
NPAAPTSMRSS

SEQ ID NO: 272330 - protein, 6 aa, Mycobacterium
NPAARD

SEQ ID NO: 272331 - protein, 13 aa, Mycobacterium
NPADGARYEVSPE

SEQ ID NO: 272332 - protein, 5 aa, Mycobacterium
NPADI

SEQ ID NO: 272333 - protein, 5 aa, Mycobacterium
NPAGA

SEQ ID NO: 272334 - protein, 10 aa, Mycobacterium
NPAGHEGRAA

SEQ ID NO: 272335 - protein, 15 aa, Mycobacterium
NPAGTAGADPAGTDL

SEQ ID NO: 272336 - protein, 6 aa, Mycobacterium
NPAIAA

SEQ ID NO: 272337 - protein, 11 aa, Mycobacterium
NPAITRAQNTE

SEQ ID NO: 272338 - protein, 16 aa, Mycobacterium
NPAPGRTANELANDAG

SEQ ID NO: 272339 - protein, 19 aa, Mycobacterium
NPAPGRTANELASDAGAAL

SEQ ID NO: 272340 - protein, 19 aa, Mycobacterium
NPAPGRTANELATDAGAAL

SEQ ID NO: 272341 - protein, 10 aa, Mycobacterium
NPAPGTPEGP

SEQ ID NO: 272342 - protein, 6 aa, Mycobacterium
NPAPRL

SEQ ID NO: 272343 - protein, 5 aa, Mycobacterium
NPARS

SEQ ID NO: 272344 - protein, 5 aa, Mycobacterium
NPASD

SEQ ID NO: 272345 - protein, 14 aa, Mycobacterium
NPASPATVKSSELS

SEQ ID NO: 272346 - protein, 12 aa, Mycobacterium
NPATDSPEATGD

SEQ ID NO: 272347 - protein, 17 aa, Mycobacterium
NPATGESVGGPLAGHTD

SEQ ID NO: 272348 - protein, 5 aa, Mycobacterium
NPATS

SEQ ID NO: 272349 - protein, 7 aa, Mycobacterium
NPATTPV

SEQ ID NO: 272350 - protein, 4 aa, Mycobacterium
NPAV

SEQ ID NO: 272351 - protein, 18 aa, Mycobacterium
NPAVPPGSATNIGGTPVG

SEQ ID NO: 272352 - protein, 5 aa, Mycobacterium
NPCAA

SEQ ID NO: 272353 - protein, 6 aa, Mycobacterium
NPDAAG

SEQ ID NO: 272354 - protein, 5 aa, Mycobacterium
NPDAE

SEQ ID NO: 272355 - protein, 11 aa, Mycobacterium
NPDARAKLGQE

SEQ ID NO: 272356 - protein, 5 aa, Mycobacterium
NPDCQ

SEQ ID NO: 272357 - protein, 4 aa, Mycobacterium
NPDE

SEQ ID NO: 272358 - protein, 6 aa, Mycobacterium
NPDETI

SEQ ID NO: 272359 - protein, 4 aa, Mycobacterium
NPDF

SEQ ID NO: 272360 - protein, 8 aa, Mycobacterium
NPDGSYQA

SEQ ID NO: 272361 - protein, 8 aa, Mycobacterium
NPDKTEAT

SEQ ID NO: 272362 - protein, 6 aa, Mycobacterium
NPDLAD

SEQ ID NO: 272363 - protein, 13 aa, Mycobacterium
NPDLPRDQPQLSA

SEQ ID NO: 272364 - protein, 8 aa, Mycobacterium
NPDNDQPM

SEQ ID NO: 272365 - protein, 8 aa, Mycobacterium
NPDNGQPM

SEQ ID NO: 272366 - protein, 6 aa, Mycobacterium
NPDPSA

SEQ ID NO: 272367 - protein, 6 aa, Mycobacterium
NPDPVG

SEQ ID NO: 272368 - protein, 14 aa, Mycobacterium
NPDRGLRKEATARG

SEQ ID NO: 272369 - protein, 14 aa, Mycobacterium
NPDRNADGTPGHSA

SEQ ID NO: 272370 - protein, 5 aa, Mycobacterium
NPDSL

SEQ ID NO: 272371 - protein, 11 aa, Mycobacterium
NPDTGKYGPIY

SEQ ID NO: 272372 - protein, 11 aa, Mycobacterium
NPDTGKYGPLY

SEQ ID NO: 272373 - protein, 8 aa, Mycobacterium
NPDTTPRT

SEQ ID NO: 272374 - protein, 17 aa, Mycobacterium
NPEDTKAWENGNKAVAR

SEQ ID NO: 272375 - protein, 9 aa, Mycobacterium
NPEERADEM

SEQ ID NO: 272376 - protein, 12 aa, Mycobacterium
NPEHLQDPQRGV

SEQ ID NO: 272377 - protein, 15 aa, Mycobacterium
NPENDPMDTGYQARQ

SEQ ID NO: 272378 - protein, 9 aa, Mycobacterium
NPEPDGKQV

SEQ ID NO: 272379 - protein, 12 aa, Mycobacterium
NPEPGVPQRKGP

SEQ ID NO: 272380 - protein, 5 aa, Mycobacterium
NPEQR

SEQ ID NO: 272381 - protein, 14 aa, Mycobacterium
NPERNADGSPGHSA

SEQ ID NO: 272382 - protein, 14 aa, Mycobacterium
NPERNADGTPGHSA

SEQ ID NO: 272383 - protein, 15 aa, Mycobacterium
NPERNSDGTAGHSSA

SEQ ID NO: 272384 - protein, 16 aa, Mycobacterium
NPERTHKSAQRRDAGV

SEQ ID NO: 272385 - protein, 11 aa, Mycobacterium
NPEVMGSDTNH

SEQ ID NO: 272386 - protein, 10 aa, Mycobacterium
NPFPGEPPRY

SEQ ID NO: 272387 - protein, 7 aa, Mycobacterium
NPFPPLP

SEQ ID NO: 272388 - protein, 6 aa, Mycobacterium
NPFSPE

SEQ ID NO: 272389 - protein, 7 aa, Mycobacterium
NPFSPEA

SEQ ID NO: 272390 - protein, 6 aa, Mycobacterium
NPFSSE

SEQ ID NO: 272391 - protein, 6 aa, Mycobacterium
NPFSTE

SEQ ID NO: 272392 - protein, 7 aa, Mycobacterium
NPFSTGA

SEQ ID NO: 272393 - protein, 5 aa, Mycobacterium
NPFTT

SEQ ID NO: 272394 - protein, 8 aa, Mycobacterium
NPGAGGLG

SEQ ID NO: 272395 - protein, 9 aa, Mycobacterium
NPGDAPTKL

SEQ ID NO: 272396 - protein, 9 aa, Mycobacterium
NPGDDCPDA

SEQ ID NO: 272397 - protein, 5 aa, Mycobacterium
NPGDL

SEQ ID NO: 272398 - protein, 8 aa, Mycobacterium
NPGEQVTT

SEQ ID NO: 272399 - protein, 7 aa, Mycobacterium
NPGGAAP

SEQ ID NO: 272400 - protein, 15 aa, Mycobacterium
NPGGAGGSGVTGGSQ

SEQ ID NO: 272401 - protein, 6 aa, Mycobacterium
NPGGAY

SEQ ID NO: 272402 - protein, 11 aa, Mycobacterium
NPGGPGESGIE

SEQ ID NO: 272403 - protein, 8 aa, Mycobacterium
NPGGSYTL

SEQ ID NO: 272404 - protein, 6 aa, Mycobacterium
NPGIPA

SEQ ID NO: 272405 - protein, 4 aa, Mycobacterium
NPGL

SEQ ID NO: 272406 - protein, 6 aa, Mycobacterium
NPGNTV

SEQ ID NO: 272407 - protein, 7 aa, Mycobacterium
NPGPAGL

SEQ ID NO: 272408 - protein, 6 aa, Mycobacterium
NPGPGL

SEQ ID NO: 272409 - protein, 5 aa, Mycobacterium
NPGRR

SEQ ID NO: 272410 - protein, 6 aa, Mycobacterium
NPGRYQ

SEQ ID NO: 272411 - protein, 5 aa, Mycobacterium
NPGVY

SEQ ID NO: 272412 - protein, 5 aa, Mycobacterium
NPIAA

SEQ ID NO: 272413 - protein, 7 aa, Mycobacterium
NPIEANE

SEQ ID NO: 272414 - protein, 6 aa, Mycobacterium
NPIGAP

SEQ ID NO: 272415 - protein, 8 aa, Mycobacterium
NPIGGHQR

SEQ ID NO: 272416 - protein, 7 aa, Mycobacterium
NPIGPDD

SEQ ID NO: 272417 - protein, 6 aa, Mycobacterium
NPKATL

SEQ ID NO: 272418 - protein, 7 aa, Mycobacterium
NPKATLG

SEQ ID NO: 272419 - protein, 5 aa, Mycobacterium
NPKHN

SEQ ID NO: 272420 - protein, 9 aa, Mycobacterium
NPKPDGKEV

SEQ ID NO: 272421 - protein, 7 aa, Mycobacterium
NPLGPGD

SEQ ID NO: 272422 - protein, 6 aa, Mycobacterium
NPLGSP

SEQ ID NO: 272423 - protein, 11 aa, Mycobacterium
NPLPDGTGNGL

SEQ ID NO: 272424 - protein, 11 aa, Mycobacterium
NPLPNGTGNGL

SEQ ID NO: 272425 - protein, 8 aa, Mycobacterium
NPLPSSSF

SEQ ID NO: 272426 - protein, 4 aa, Mycobacterium
NPLT

SEQ ID NO: 272427 - protein, 11 aa, Mycobacterium
NPMGDAPNEPG

SEQ ID NO: 272428 - protein, 11 aa, Mycobacterium
NPMGNAPNEPG

SEQ ID NO: 272429 - protein, 4 aa, Mycobacterium
NPNL

SEQ ID NO: 272430 - protein, 5 aa, Mycobacterium
NPNLN

SEQ ID NO: 272431 - protein, 7 aa, Mycobacterium
NPNLQRS

SEQ ID NO: 272432 - protein, 4 aa, Mycobacterium
NPNM

SEQ ID NO: 272433 - protein, 6 aa, Mycobacterium
NPNNPH

SEQ ID NO: 272434 - protein, 8 aa, Mycobacterium
NPNNPNGG

SEQ ID NO: 272435 - protein, 9 aa, Mycobacterium
NPNPDGKEV

SEQ ID NO: 272436 - protein, 9 aa, Mycobacterium
NPNPDGKQV

SEQ ID NO: 272437 - protein, 6 aa, Mycobacterium
NPNRNI

SEQ ID NO: 272438 - protein, 19 aa, Mycobacterium
NPPAGAGVNRDGIVTLKFG

SEQ ID NO: 272439 - protein, 19 aa, Mycobacterium
NPPAGSGVNRDGIITLKFG

SEQ ID NO: 272440 - protein, 19 aa, Mycobacterium
NPPAGTGCNKDGIITLKFG

SEQ ID NO: 272441 - protein, 9 aa, Mycobacterium
NPPATEPAN

SEQ ID NO: 272442 - protein, 10 aa, Mycobacterium
NPPEGTPEGP

SEQ ID NO: 272443 - protein, 12 aa, Mycobacterium
NPPGPDAPRNAP

SEQ ID NO: 272444 - protein, 6 aa, Mycobacterium
NPPIHS

SEQ ID NO: 272445 - protein, 7 aa, Mycobacterium
NPPPGGA

SEQ ID NO: 272446 - protein, 19 aa, Mycobacterium
NPPPKADGSAPAQLGEQVS

SEQ ID NO: 272447 - protein, 7 aa, Mycobacterium
NPPPNGA

SEQ ID NO: 272448 - protein, 14 aa, Mycobacterium
NPPPPPAEPNTPAV

SEQ ID NO: 272449 - protein, 23 aa, Mycobacterium
NPPPPPAPPPEPAPVEPPPPEPG

SEQ ID NO: 272450 - protein, 19 aa, Mycobacterium
NPPPQATGAASAQLGEQVS

SEQ ID NO: 272451 - protein, 12 aa, Mycobacterium
NPPPQPADATAT

SEQ ID NO: 272452 - protein, 9 aa, Mycobacterium
NPPQGLDPR

SEQ ID NO: 272453 - protein, 14 aa, Mycobacterium
NPPRGPLRQTATTN

SEQ ID NO: 272454 - protein, 8 aa, Mycobacterium
NPPRNRPA

SEQ ID NO: 272455 - protein, 8 aa, Mycobacterium
NPPRVAGR

SEQ ID NO: 272456 - protein, 66 aa, Mycobacterium
NPPSAPRAATRGAEPELARPTRGVRPDLNPTGVRAQPAGQPRWPADTSAPAATDHAAATAGPDLPG

SEQ ID NO: 272457 - protein, 23 aa, Mycobacterium
NPPSIDPGAVPPDVTGPDQPTEQ

SEQ ID NO: 272458 - protein, 9 aa, Mycobacterium
NPPSPSGSA

SEQ ID NO: 272459 - protein, 7 aa, Mycobacterium
NPPTGLA

SEQ ID NO: 272460 - protein, 7 aa, Mycobacterium
NPPTGVA

SEQ ID NO: 272461 - protein, 16 aa, Mycobacterium
NPPTVAEYENATDGYA

SEQ ID NO: 272462 - protein, 16 aa, Mycobacterium
NPPTVAEYESATDGYA

SEQ ID NO: 272463 - protein, 14 aa, Mycobacterium
NPPTVGKYESSYDD

SEQ ID NO: 272464 - protein, 4 aa, Mycobacterium
NPQA

SEQ ID NO: 272465 - protein, 12 aa, Mycobacterium
NPQAGRASASLG

SEQ ID NO: 272466 - protein, 11 aa, Mycobacterium
NPQAGRSTAPL

SEQ ID NO: 272467 - protein, 5 aa, Mycobacterium
NPQAP

SEQ ID NO: 272468 - protein, 5 aa, Mycobacterium
NPQAY

SEQ ID NO: 272469 - protein, 5 aa, Mycobacterium
NPQDI

SEQ ID NO: 272470 - protein, 6 aa, Mycobacterium
NPQGRE

SEQ ID NO: 272471 - protein, 4 aa, Mycobacterium
NPQL

SEQ ID NO: 272472 - protein, 13 aa, Mycobacterium
NPQNRYTSGGPFA

SEQ ID NO: 272473 - protein, 7 aa, Mycobacterium
NPQPAGQ

SEQ ID NO: 272474 - protein, 8 aa, Mycobacterium
NPQPPRRE

SEQ ID NO: 272475 - protein, 17 aa, Mycobacterium
NPQRPGPFGLPAPTEEA

SEQ ID NO: 272476 - protein, 6 aa, Mycobacterium
NPQTVT

SEQ ID NO: 272477 - protein, 8 aa, Mycobacterium
NPQVNEPL

SEQ ID NO: 272478 - protein, 6 aa, Mycobacterium
NPRDGY

SEQ ID NO: 272479 - protein, 6 aa, Mycobacterium
NPREIG

SEQ ID NO: 272480 - protein, 5 aa, Mycobacterium
NPRKP

SEQ ID NO: 272481 - protein, 27 aa, Mycobacterium
NPRPLDPPPAPPPPAPTKGGPDAFSGI

SEQ ID NO: 272482 - protein, 11 aa, Mycobacterium
NPRPTNPEGKL

SEQ ID NO: 272483 - protein, 11 aa, Mycobacterium
NPRPTNPEGKM

SEQ ID NO: 272484 - protein, 4 aa, Mycobacterium
NPRQ

SEQ ID NO: 272485 - protein, 4 aa, Mycobacterium
NPRR

SEQ ID NO: 272486 - protein, 5 aa, Mycobacterium
NPRRA

SEQ ID NO: 272487 - protein, 9 aa, Mycobacterium
NPRRAAPAA

SEQ ID NO: 272488 - protein, 7 aa, Mycobacterium
NPRSETI

SEQ ID NO: 272489 - protein, 31 aa, Mycobacterium
NPRSITTSYGPHRDRYSTRYTGKGDDGGEHV

SEQ ID NO: 272490 - protein, 4 aa, Mycobacterium
NPRT

SEQ ID NO: 272491 - protein, 10 aa, Mycobacterium
NPRTAPDIPG

SEQ ID NO: 272492 - protein, 9 aa, Mycobacterium
NPRTGTPIA

SEQ ID NO: 272493 - protein, 7 aa, Mycobacterium
NPRTMTP

SEQ ID NO: 272494 - protein, 9 aa, Mycobacterium
NPRTQTPVS

SEQ ID NO: 272495 - protein, 8 aa, Mycobacterium
NPSAFTAA

SEQ ID NO: 272496 - protein, 11 aa, Mycobacterium
NPSAGTPEGPW

SEQ ID NO: 272497 - protein, 9 aa, Mycobacterium
NPSATLGTA

SEQ ID NO: 272498 - protein, 5 aa, Mycobacterium
NPSDD

SEQ ID NO: 272499 - protein, 8 aa, Mycobacterium
NPSFGADR

SEQ ID NO: 272500 - protein, 6 aa, Mycobacterium
NPSGEA

SEQ ID NO: 272501 - protein, 8 aa, Mycobacterium
NPSGQYGD

SEQ ID NO: 272502 - protein, 4 aa, Mycobacterium
NPSL

SEQ ID NO: 272503 - protein, 13 aa, Mycobacterium
NPSPNLTDPNPPL

SEQ ID NO: 272504 - protein, 49 aa, Mycobacterium
NPSPRVPGSADPDDLEPPPGSPGMPIPSTAPASFGGAVGPVGSKTERDQ

SEQ ID NO: 272505 - protein, 6 aa, Mycobacterium
NPSRSL

SEQ ID NO: 272506 - protein, 5 aa, Mycobacterium
NPSSL

SEQ ID NO: 272507 - protein, 4 aa, Mycobacterium
NPST

SEQ ID NO: 272508 - protein, 4 aa, Mycobacterium
NPSW

SEQ ID NO: 272509 - protein, 9 aa, Mycobacterium
NPSYGPDRQ

SEQ ID NO: 272510 - protein, 8 aa, Mycobacterium
NPSYNGSD

SEQ ID NO: 272511 - protein, 7 aa, Mycobacterium
NPTAPDS

SEQ ID NO: 272512 - protein, 6 aa, Mycobacterium
NPTGDP

SEQ ID NO: 272513 - protein, 7 aa, Mycobacterium
NPTGDQD

SEQ ID NO: 272514 - protein, 5 aa, Mycobacterium
NPTGE

SEQ ID NO: 272515 - protein, 5 aa, Mycobacterium
NPTGT

SEQ ID NO: 272516 - protein, 4 aa, Mycobacterium
NPTI

SEQ ID NO: 272517 - protein, 31 aa, Mycobacterium
NPTPNLEDPNPPLPAGVTPAPPVPGTANPDL

SEQ ID NO: 272518 - protein, 13 aa, Mycobacterium
NPTPRSDDSKPVC

SEQ ID NO: 272519 - protein, 4 aa, Mycobacterium
NPTQ

SEQ ID NO: 272520 - protein, 5 aa, Mycobacterium
NPTRS

SEQ ID NO: 272521 - protein, 5 aa, Mycobacterium
NPTVD

SEQ ID NO: 272522 - protein, 4 aa, Mycobacterium
NPVA

SEQ ID NO: 272523 - protein, 16 aa, Mycobacterium
NPVAGETFASDKRSPL

SEQ ID NO: 272524 - protein, 14 aa, Mycobacterium
NPVCDGDPSCSATR

SEQ ID NO: 272525 - protein, 6 aa, Mycobacterium
NPVGGD

SEQ ID NO: 272526 - protein, 6 aa, Mycobacterium
NPVGGE

SEQ ID NO: 272527 - protein, 6 aa, Mycobacterium
NPVGGP

SEQ ID NO: 272528 - protein, 4 aa, Mycobacterium
NPVN

SEQ ID NO: 272529 - protein, 19 aa, Mycobacterium
NPVPSTGTKSNAAFNRATT

SEQ ID NO: 272530 - protein, 5 aa, Mycobacterium
NPVPT

SEQ ID NO: 272531 - protein, 31 aa, Mycobacterium
NPVTTPQTELPSSATQSVRAPNASPSAPLDP

SEQ ID NO: 272532 - protein, 8 aa, Mycobacterium
NPVVPPTP

SEQ ID NO: 272533 - protein, 4 aa, Mycobacterium
NPWG

SEQ ID NO: 272534 - protein, 5 aa, Mycobacterium
NPWQY

SEQ ID NO: 272535 - protein, 15 aa, Mycobacterium
NPWRGPPVPYDTPMT

SEQ ID NO: 272536 - protein, 5 aa, Mycobacterium
NPYAK

SEQ ID NO: 272537 - protein, 5 aa, Mycobacterium
NPYRG

SEQ ID NO: 272538 - protein, 4 aa, Mycobacterium
NPYS

SEQ ID NO: 272539 - protein, 5 aa, Mycobacterium
NQAGL

SEQ ID NO: 272540 - protein, 6 aa, Mycobacterium
NQAGLS

SEQ ID NO: 272541 - protein, 15 aa, Mycobacterium
NQAKLTSGALSTAAT

SEQ ID NO: 272542 - protein, 17 aa, Mycobacterium
NQASAHATKAPGYADIA

SEQ ID NO: 272543 - protein, 30 aa, Mycobacterium
NQATQHADYGIPDQPTSGEPAEHPPGGFPR

SEQ ID NO: 272544 - protein, 9 aa, Mycobacterium
NQATRSLNE

SEQ ID NO: 272545 - protein, 6 aa, Mycobacterium
NQDEVA

SEQ ID NO: 272546 - protein, 8 aa, Mycobacterium
NQDGTRTM

SEQ ID NO: 272547 - protein, 10 aa, Mycobacterium
NQDPDGTASL

SEQ ID NO: 272548 - protein, 10 aa, Mycobacterium
NQDPEGTTSV

SEQ ID NO: 272549 - protein, 5 aa, Mycobacterium
NQDSP

SEQ ID NO: 272550 - protein, 5 aa, Mycobacterium
NQEQG

SEQ ID NO: 272551 - protein, 6 aa, Mycobacterium
NQEQGV

SEQ ID NO: 272552 - protein, 4 aa, Mycobacterium
NQFQ

SEQ ID NO: 272553 - protein, 4 aa, Mycobacterium
NQGD

SEQ ID NO: 272554 - protein, 12 aa, Mycobacterium
NQGEAKANESVD

SEQ ID NO: 272555 - protein, 12 aa, Mycobacterium
NQGEALANESVE

SEQ ID NO: 272556 - protein, 13 aa, Mycobacterium
NQGEALANESVES

SEQ ID NO: 272557 - protein, 14 aa, Mycobacterium
NQGESGAVKVAFDQ

SEQ ID NO: 272558 - protein, 10 aa, Mycobacterium
NQGPAKGDFD

SEQ ID NO: 272559 - protein, 11 aa, Mycobacterium
NQGTAQGDQSV

SEQ ID NO: 272560 - protein, 14 aa, Mycobacterium
NQHPGDSDAAGPAR

SEQ ID NO: 272561 - protein, 11 aa, Mycobacterium
NQHYAASAARR

SEQ ID NO: 272562 - protein, 7 aa, Mycobacterium
NQINDPD

SEQ ID NO: 272563 - protein, 5 aa, Mycobacterium
NQIQQ

SEQ ID NO: 272564 - protein, 6 aa, Mycobacterium
NQKSNF

SEQ ID NO: 272565 - protein, 12 aa, Mycobacterium
NQNDPHLRQKPE

SEQ ID NO: 272566 - protein, 22 aa, Mycobacterium
NQNKAVPGTNDDSAAEGTKVGV

SEQ ID NO: 272567 - protein, 6 aa, Mycobacterium
NQPAAL

SEQ ID NO: 272568 - protein, 7 aa, Mycobacterium
NQPAGTY

SEQ ID NO: 272569 - protein, 8 aa, Mycobacterium
NQPDDELD

SEQ ID NO: 272570 - protein, 8 aa, Mycobacterium
NQPFSTAA

SEQ ID NO: 272571 - protein, 7 aa, Mycobacterium
NQPGGLG

SEQ ID NO: 272572 - protein, 9 aa, Mycobacterium
NQPGGVTLD

SEQ ID NO: 272573 - protein, 7 aa, Mycobacterium
NQPLGAE

SEQ ID NO: 272574 - protein, 22 aa, Mycobacterium
NQPPAPAPIETPTDLGEPAHTS

SEQ ID NO: 272575 - protein, 5 aa, Mycobacterium
NQPPL

SEQ ID NO: 272576 - protein, 6 aa, Mycobacterium
NQPPPC

SEQ ID NO: 272577 - protein, 15 aa, Mycobacterium
NQPQTNTGGYSAPGF

SEQ ID NO: 272578 - protein, 9 aa, Mycobacterium
NQPTQYGGF

SEQ ID NO: 272579 - protein, 8 aa, Mycobacterium
NQPTSSPY

SEQ ID NO: 272580 - protein, 15 aa, Mycobacterium
NQQGSNTGGYSAPGF

SEQ ID NO: 272581 - protein, 11 aa, Mycobacterium
NQQLTSEQARP

SEQ ID NO: 272582 - protein, 4 aa, Mycobacterium
NQQT

SEQ ID NO: 272583 - protein, 6 aa, Mycobacterium
NQQTEK

SEQ ID NO: 272584 - protein, 6 aa, Mycobacterium
NQQTQK

SEQ ID NO: 272585 - protein, 5 aa, Mycobacterium
NQREL

SEQ ID NO: 272586 - protein, 10 aa, Mycobacterium
NQRFGPNDYR

SEQ ID NO: 272587 - protein, 37 aa, Mycobacterium
NQRPDVDDDSDDSPWTPQKPPRTPSQPPTTRPPVPQV

SEQ ID NO: 272588 - protein, 8 aa, Mycobacterium
NQRPTRAT

SEQ ID NO: 272589 - protein, 5 aa, Mycobacterium
NQRPV

SEQ ID NO: 272590 - protein, 6 aa, Mycobacterium
NQRPVI

SEQ ID NO: 272591 - protein, 6 aa, Mycobacterium
NQRPVV

SEQ ID NO: 272592 - protein, 7 aa, Mycobacterium
NQRRSDL

SEQ ID NO: 272593 - protein, 4 aa, Mycobacterium
NQRY

SEQ ID NO: 272594 - protein, 5 aa, Mycobacterium
NQRYA

SEQ ID NO: 272595 - protein, 8 aa, Mycobacterium
NQSAQVTA

SEQ ID NO: 272596 - protein, 11 aa, Mycobacterium
NQSPPITPQRA

SEQ ID NO: 272597 - protein, 5 aa, Mycobacterium
NQTAA

SEQ ID NO: 272598 - protein, 6 aa, Mycobacterium
NQTAAV

SEQ ID NO: 272599 - protein, 5 aa, Mycobacterium
NQTAL

SEQ ID NO: 272600 - protein, 13 aa, Mycobacterium
NQTIGKQGVPTEI

SEQ ID NO: 272601 - protein, 126 aa, Mycobacterium
NQTPEKAAGGESPKPSAPARPAKAAKRPAAKRAPAKRPAGSSAPPKSGPKAAPAPSADAAPKPPAAAKPAEAPKPAAPAPAPAAEPAPAPKPAAQPVSEAPAAPKPVAPASKPEAAKPEPAQPDLA

SEQ ID NO: 272602 - protein, 6 aa, Mycobacterium
NQTPSN

SEQ ID NO: 272603 - protein, 5 aa, Mycobacterium
NQTWP

SEQ ID NO: 272604 - protein, 9 aa, Mycobacterium
NQVDASETL

SEQ ID NO: 272605 - protein, 4 aa, Mycobacterium
NQVG

SEQ ID NO: 272606 - protein, 8 aa, Mycobacterium
NQVKIGGR

SEQ ID NO: 272607 - protein, 6 aa, Mycobacterium
NQYSQL

SEQ ID NO: 272608 - protein, 4 aa, Mycobacterium
NRAA

SEQ ID NO: 272609 - protein, 6 aa, Mycobacterium
NRAADL

SEQ ID NO: 272610 - protein, 9 aa, Mycobacterium
NRAADPHLA

SEQ ID NO: 272611 - protein, 11 aa, Mycobacterium
NRAADPHLART

SEQ ID NO: 272612 - protein, 10 aa, Mycobacterium
NRAAGDSIRT

SEQ ID NO: 272613 - protein, 20 aa, Mycobacterium
NRAAGHPEPEHAGDYPDDDE

SEQ ID NO: 272614 - protein, 16 aa, Mycobacterium
NRADEAPGVALRQHRD

SEQ ID NO: 272615 - protein, 8 aa, Mycobacterium
NRADPLAE

SEQ ID NO: 272616 - protein, 5 aa, Mycobacterium
NRADT

SEQ ID NO: 272617 - protein, 12 aa, Mycobacterium
NRAEDTVETDAH

SEQ ID NO: 272618 - protein, 5 aa, Mycobacterium
NRAGA

SEQ ID NO: 272619 - protein, 11 aa, Mycobacterium
NRAGAADTDDI

SEQ ID NO: 272620 - protein, 6 aa, Mycobacterium
NRAGGR

SEQ ID NO: 272621 - protein, 4 aa, Mycobacterium
NRAL

SEQ ID NO: 272622 - protein, 8 aa, Mycobacterium
NRAMKRGA

SEQ ID NO: 272623 - protein, 5 aa, Mycobacterium
NRANA

SEQ ID NO: 272624 - protein, 8 aa, Mycobacterium
NRAPSPTA

SEQ ID NO: 272625 - protein, 7 aa, Mycobacterium
NRARRSG

SEQ ID NO: 272626 - protein, 9 aa, Mycobacterium
NRARTTSGS

SEQ ID NO: 272627 - protein, 6 aa, Mycobacterium
NRASLN

SEQ ID NO: 272628 - protein, 14 aa, Mycobacterium
NRASTLAAQAQTLA

SEQ ID NO: 272629 - protein, 4 aa, Mycobacterium
NRAT

SEQ ID NO: 272630 - protein, 16 aa, Mycobacterium
NRATAETAVDQSTSAT

SEQ ID NO: 272631 - protein, 12 aa, Mycobacterium
NRDAAGAGRRAR

SEQ ID NO: 272632 - protein, 9 aa, Mycobacterium
NRDDEGNPA

SEQ ID NO: 272633 - protein, 10 aa, Mycobacterium
NRDDSDATSV

SEQ ID NO: 272634 - protein, 11 aa, Mycobacterium
NRDDSDPMSTN

SEQ ID NO: 272635 - protein, 5 aa, Mycobacterium
NRDDT

SEQ ID NO: 272636 - protein, 6 aa, Mycobacterium
NRDDTS

SEQ ID NO: 272637 - protein, 10 aa, Mycobacterium
NRDGSDAMST

SEQ ID NO: 272638 - protein, 10 aa, Mycobacterium
NRDGSDATSV

SEQ ID NO: 272639 - protein, 11 aa, Mycobacterium
NRDGSDEISTD

SEQ ID NO: 272640 - protein, 9 aa, Mycobacterium
NRDGSDVIS

SEQ ID NO: 272641 - protein, 7 aa, Mycobacterium
NRDGSYS

SEQ ID NO: 272642 - protein, 12 aa, Mycobacterium
NRDKPRHTGQYS

SEQ ID NO: 272643 - protein, 4 aa, Mycobacterium
NRDN

SEQ ID NO: 272644 - protein, 8 aa, Mycobacterium
NRDNIAKS

SEQ ID NO: 272645 - protein, 5 aa, Mycobacterium
NRDNL

SEQ ID NO: 272646 - protein, 10 aa, Mycobacterium
NRDNLSQALP

SEQ ID NO: 272647 - protein, 55 aa, Mycobacterium
NRDPGEGFTPTLGNKSQVAAPASGVPAAASGVAASLASRRKRRRKKGAQIEERGY

SEQ ID NO: 272648 - protein, 21 aa, Mycobacterium
NRDQVEELAETQKGQSAEEIA

SEQ ID NO: 272649 - protein, 10 aa, Mycobacterium
NRDRADSTRD

SEQ ID NO: 272650 - protein, 15 aa, Mycobacterium
NRDRSPRPGEPQEQT

SEQ ID NO: 272651 - protein, 9 aa, Mycobacterium
NRDSADAIT

SEQ ID NO: 272652 - protein, 35 aa, Mycobacterium
NRDSSARPAEIPPSVAPPKPVAPPKPVAPQAPASR

SEQ ID NO: 272653 - protein, 8 aa, Mycobacterium
NRDTLKPA

SEQ ID NO: 272654 - protein, 4 aa, Mycobacterium
NREA

SEQ ID NO: 272655 - protein, 18 aa, Mycobacterium
NREAAEAERAERARKAPP

SEQ ID NO: 272656 - protein, 6 aa, Mycobacterium
NREDRT

SEQ ID NO: 272657 - protein, 8 aa, Mycobacterium
NREGTKFS

SEQ ID NO: 272658 - protein, 5 aa, Mycobacterium
NREPA

SEQ ID NO: 272659 - protein, 6 aa, Mycobacterium
NRESLT

SEQ ID NO: 272660 - protein, 6 aa, Mycobacterium
NRESPW

SEQ ID NO: 272661 - protein, 17 aa, Mycobacterium
NRETAEAERAARAADRG

SEQ ID NO: 272662 - protein, 33 aa, Mycobacterium
NRETAEAVSSETNPGGSVQKPRAMEDENPPTSI

SEQ ID NO: 272663 - protein, 4 aa, Mycobacterium
NRGA

SEQ ID NO: 272664 - protein, 5 aa, Mycobacterium
NRGEP

SEQ ID NO: 272665 - protein, 13 aa, Mycobacterium
NRGESGERGQRGL

SEQ ID NO: 272666 - protein, 8 aa, Mycobacterium
NRGETDDG

SEQ ID NO: 272667 - protein, 8 aa, Mycobacterium
NRGETPEG

SEQ ID NO: 272668 - protein, 10 aa, Mycobacterium
NRGGENVSSV

SEQ ID NO: 272669 - protein, 13 aa, Mycobacterium
NRGGNGSAPDDGY

SEQ ID NO: 272670 - protein, 8 aa, Mycobacterium
NRGGRERH

SEQ ID NO: 272671 - protein, 8 aa, Mycobacterium
NRGQYDPK

SEQ ID NO: 272672 - protein, 15 aa, Mycobacterium
NRGRDDDETRSLSPA

SEQ ID NO: 272673 - protein, 5 aa, Mycobacterium
NRGTL

SEQ ID NO: 272674 - protein, 4 aa, Mycobacterium
NRGV

SEQ ID NO: 272675 - protein, 15 aa, Mycobacterium
NRGVGASSAPKPVSA

SEQ ID NO: 272676 - protein, 6 aa, Mycobacterium
NRGVPA

SEQ ID NO: 272677 - protein, 5 aa, Mycobacterium
NRHRA

SEQ ID NO: 272678 - protein, 11 aa, Mycobacterium
NRIGPSPEDRE

SEQ ID NO: 272679 - protein, 14 aa, Mycobacterium
NRIQNPEAQMTPEQ

SEQ ID NO: 272680 - protein, 8 aa, Mycobacterium
NRISPDSG

SEQ ID NO: 272681 - protein, 8 aa, Mycobacterium
NRKEFGPA

SEQ ID NO: 272682 - protein, 14 aa, Mycobacterium
NRKRRNDAAAREQI

SEQ ID NO: 272683 - protein, 10 aa, Mycobacterium
NRLDRPEEQA

SEQ ID NO: 272684 - protein, 10 aa, Mycobacterium
NRLDSPEDAA

SEQ ID NO: 272685 - protein, 21 aa, Mycobacterium
NRLEDAAATSAAARAALRSAG

SEQ ID NO: 272686 - protein, 7 aa, Mycobacterium
NRLGPNA

SEQ ID NO: 272687 - protein, 40 aa, Mycobacterium
NRLRSGRRDEESSRTDDPEPEEAAETAPPRPQHSGSRAPH

SEQ ID NO: 272688 - protein, 4 aa, Mycobacterium
NRLV

SEQ ID NO: 272689 - protein, 8 aa, Mycobacterium
NRMDADPQ

SEQ ID NO: 272690 - protein, 5 aa, Mycobacterium
NRNRL

SEQ ID NO: 272691 - protein, 33 aa, Mycobacterium
NRNTAEAVSSENNPGGAVQKPRAIEDEKPPTNI

SEQ ID NO: 272692 - protein, 4 aa, Mycobacterium
NRPD

SEQ ID NO: 272693 - protein, 7 aa, Mycobacterium
NRPEPRR

SEQ ID NO: 272694 - protein, 23 aa, Mycobacterium
NRPEPSEDGRSAKPEHTGASAHA

SEQ ID NO: 272695 - protein, 6 aa, Mycobacterium
NRPGEY

SEQ ID NO: 272696 - protein, 5 aa, Mycobacterium
NRPGI

SEQ ID NO: 272697 - protein, 19 aa, Mycobacterium
NRPHDGAGSDGVPASGTYL

SEQ ID NO: 272698 - protein, 6 aa, Mycobacterium
NRPIET

SEQ ID NO: 272699 - protein, 25 aa, Mycobacterium
NRPPPPRRTQTPAELGAPPRTSKRH

SEQ ID NO: 272700 - protein, 37 aa, Mycobacterium
NRPQPDLETTAEVAPPPPAPATVPRQHTREITRDQQD

SEQ ID NO: 272701 - protein, 10 aa, Mycobacterium
NRPQPSGPVR

SEQ ID NO: 272702 - protein, 6 aa, Mycobacterium
NRPVGP

SEQ ID NO: 272703 - protein, 9 aa, Mycobacterium
NRPVQSPAG

SEQ ID NO: 272704 - protein, 14 aa, Mycobacterium
NRQAHPGTSNRLPV

SEQ ID NO: 272705 - protein, 12 aa, Mycobacterium
NRQAHPSTRDRL

SEQ ID NO: 272706 - protein, 7 aa, Mycobacterium
NRQENRD

SEQ ID NO: 272707 - protein, 9 aa, Mycobacterium
NRQENRDRV

SEQ ID NO: 272708 - protein, 26 aa, Mycobacterium
NRQENRDRVSLEEDRRRAEQTKADTE

SEQ ID NO: 272709 - protein, 6 aa, Mycobacterium
NRQPQP

SEQ ID NO: 272710 - protein, 6 aa, Mycobacterium
NRQTEN

SEQ ID NO: 272711 - protein, 9 aa, Mycobacterium
NRRAGQKHK

SEQ ID NO: 272712 - protein, 4 aa, Mycobacterium
NRRD

SEQ ID NO: 272713 - protein, 6 aa, Mycobacterium
NRREAF

SEQ ID NO: 272714 - protein, 7 aa, Mycobacterium
NRRELSE

SEQ ID NO: 272715 - protein, 8 aa, Mycobacterium
NRRETFPG

SEQ ID NO: 272716 - protein, 5 aa, Mycobacterium
NRRGQ

SEQ ID NO: 272717 - protein, 7 aa, Mycobacterium
NRRKAPT

SEQ ID NO: 272718 - protein, 15 aa, Mycobacterium
NRRQTAAAKAAGVEV

SEQ ID NO: 272719 - protein, 5 aa, Mycobacterium
NRRRD

SEQ ID NO: 272720 - protein, 32 aa, Mycobacterium
NRRSGDGAVDHAPQDRAAGQPDDALPGSKPAQ

SEQ ID NO: 272721 - protein, 9 aa, Mycobacterium
NRRTGQKRR

SEQ ID NO: 272722 - protein, 6 aa, Mycobacterium
NRRWGD

SEQ ID NO: 272723 - protein, 4 aa, Mycobacterium
NRRY

SEQ ID NO: 272724 - protein, 6 aa, Mycobacterium
NRSAEA

SEQ ID NO: 272725 - protein, 8 aa, Mycobacterium
NRSENIAA

SEQ ID NO: 272726 - protein, 9 aa, Mycobacterium
NRSENVAAA

SEQ ID NO: 272727 - protein, 19 aa, Mycobacterium
NRSGDVGVRDSQYTAVAGA

SEQ ID NO: 272728 - protein, 8 aa, Mycobacterium
NRSGGWPD

SEQ ID NO: 272729 - protein, 9 aa, Mycobacterium
NRSKNRVTT

SEQ ID NO: 272730 - protein, 9 aa, Mycobacterium
NRSQDHQTL

SEQ ID NO: 272731 - protein, 7 aa, Mycobacterium
NRSQTAA

SEQ ID NO: 272732 - protein, 11 aa, Mycobacterium
NRSTTAGRMQS

SEQ ID NO: 272733 - protein, 12 aa, Mycobacterium
NRSTVQYRDTGE

SEQ ID NO: 272734 - protein, 15 aa, Mycobacterium
NRTADEDLVQVAWSP

SEQ ID NO: 272735 - protein, 9 aa, Mycobacterium
NRTDTMGRS

SEQ ID NO: 272736 - protein, 8 aa, Mycobacterium
NRTHSADS

SEQ ID NO: 272737 - protein, 10 aa, Mycobacterium
NRTHSADSRA

SEQ ID NO: 272738 - protein, 20 aa, Mycobacterium
NRTHSADSRTHCTNEPADVQ

SEQ ID NO: 272739 - protein, 7 aa, Mycobacterium
NRTHTEL

SEQ ID NO: 272740 - protein, 18 aa, Mycobacterium
NRTPPEPAGGSPSPSYLR

SEQ ID NO: 272741 - protein, 6 aa, Mycobacterium
NRTSLN

SEQ ID NO: 272742 - protein, 5 aa, Mycobacterium
NRTSR

SEQ ID NO: 272743 - protein, 8 aa, Mycobacterium
NRTSTPLT

SEQ ID NO: 272744 - protein, 6 aa, Mycobacterium
NRTVAD

SEQ ID NO: 272745 - protein, 6 aa, Mycobacterium
NRVGPA

SEQ ID NO: 272746 - protein, 6 aa, Mycobacterium
NRVGSG

SEQ ID NO: 272747 - protein, 4 aa, Mycobacterium
NRWD

SEQ ID NO: 272748 - protein, 7 aa, Mycobacterium
NRWSTES

SEQ ID NO: 272749 - protein, 7 aa, Mycobacterium
NRYNADT

SEQ ID NO: 272750 - protein, 7 aa, Mycobacterium
NRYNPAT

SEQ ID NO: 272751 - protein, 8 aa, Mycobacterium
NRYNPDTK

SEQ ID NO: 272752 - protein, 8 aa, Mycobacterium
NRYNPETK

SEQ ID NO: 272753 - protein, 5 aa, Mycobacterium
NRYRR

SEQ ID NO: 272754 - protein, 23 aa, Mycobacterium
NSAAGQAPQSVPADAESAKVESE

SEQ ID NO: 272755 - protein, 6 aa, Mycobacterium
NSAANG

SEQ ID NO: 272756 - protein, 10 aa, Mycobacterium
NSADGIKETA

SEQ ID NO: 272757 - protein, 16 aa, Mycobacterium
NSADPAGPVHPGTGQG

SEQ ID NO: 272758 - protein, 15 aa, Mycobacterium
NSAETPGTTTKASVP

SEQ ID NO: 272759 - protein, 13 aa, Mycobacterium
NSAGLSPLNPTGA

SEQ ID NO: 272760 - protein, 4 aa, Mycobacterium
NSAI

SEQ ID NO: 272761 - protein, 7 aa, Mycobacterium
NSAKSGQ

SEQ ID NO: 272762 - protein, 4 aa, Mycobacterium
NSAN

SEQ ID NO: 272763 - protein, 5 aa, Mycobacterium
NSARA

SEQ ID NO: 272764 - protein, 27 aa, Mycobacterium
NSARHPLRARERKDSPIAAAKTEVIEK

SEQ ID NO: 272765 - protein, 10 aa, Mycobacterium
NSARSGSLDP

SEQ ID NO: 272766 - protein, 9 aa, Mycobacterium
NSATAGASG

SEQ ID NO: 272767 - protein, 8 aa, Mycobacterium
NSATPQAG

SEQ ID NO: 272768 - protein, 6 aa, Mycobacterium
NSDAAG

SEQ ID NO: 272769 - protein, 7 aa, Mycobacterium
NSDAQGV

SEQ ID NO: 272770 - protein, 7 aa, Mycobacterium
NSDASGV

SEQ ID NO: 272771 - protein, 18 aa, Mycobacterium
NSDDSPLPLVSEKRKPRK

SEQ ID NO: 272772 - protein, 10 aa, Mycobacterium
NSDDVAAGRR

SEQ ID NO: 272773 - protein, 5 aa, Mycobacterium
NSDES

SEQ ID NO: 272774 - protein, 7 aa, Mycobacterium
NSDESRH

SEQ ID NO: 272775 - protein, 9 aa, Mycobacterium
NSDGEEDTA

SEQ ID NO: 272776 - protein, 6 aa, Mycobacterium
NSDGSI

SEQ ID NO: 272777 - protein, 6 aa, Mycobacterium
NSDGSL

SEQ ID NO: 272778 - protein, 8 aa, Mycobacterium
NSDKESWH

SEQ ID NO: 272779 - protein, 16 aa, Mycobacterium
NSDPAARIAGKNANPA

SEQ ID NO: 272780 - protein, 6 aa, Mycobacterium
NSDSTF

SEQ ID NO: 272781 - protein, 10 aa, Mycobacterium
NSDVPPRDAA

SEQ ID NO: 272782 - protein, 6 aa, Mycobacterium
NSEGTM

SEQ ID NO: 272783 - protein, 7 aa, Mycobacterium
NSELGIP

SEQ ID NO: 272784 - protein, 6 aa, Mycobacterium
NSELTE

SEQ ID NO: 272785 - protein, 6 aa, Mycobacterium
NSEPAH

SEQ ID NO: 272786 - protein, 4 aa, Mycobacterium
NSER

SEQ ID NO: 272787 - protein, 10 aa, Mycobacterium
NSETLGDGPQ

SEQ ID NO: 272788 - protein, 13 aa, Mycobacterium
NSEYGATDAQLQS

SEQ ID NO: 272789 - protein, 5 aa, Mycobacterium
NSFGD

SEQ ID NO: 272790 - protein, 4 aa, Mycobacterium
NSFS

SEQ ID NO: 272791 - protein, 7 aa, Mycobacterium
NSGDRWR

SEQ ID NO: 272792 - protein, 6 aa, Mycobacterium
NSGEPQ

SEQ ID NO: 272793 - protein, 6 aa, Mycobacterium
NSGGVQ

SEQ ID NO: 272794 - protein, 8 aa, Mycobacterium
NSGHDPAR

SEQ ID NO: 272795 - protein, 9 aa, Mycobacterium
NSGKIAGPA

SEQ ID NO: 272796 - protein, 6 aa, Mycobacterium
NSGPHG

SEQ ID NO: 272797 - protein, 5 aa, Mycobacterium
NSGPL

SEQ ID NO: 272798 - protein, 6 aa, Mycobacterium
NSGPVL

SEQ ID NO: 272799 - protein, 4 aa, Mycobacterium
NSGR

SEQ ID NO: 272800 - protein, 30 aa, Mycobacterium
NSGRNAQRLRRGPAAGHNSDPHWRPTPDHL

SEQ ID NO: 272801 - protein, 4 aa, Mycobacterium
NSGT

SEQ ID NO: 272802 - protein, 8 aa, Mycobacterium
NSGTLQTA

SEQ ID NO: 272803 - protein, 14 aa, Mycobacterium
NSGVSQRPSEAKIE

SEQ ID NO: 272804 - protein, 6 aa, Mycobacterium
NSHPSS

SEQ ID NO: 272805 - protein, 4 aa, Mycobacterium
NSKA

SEQ ID NO: 272806 - protein, 17 aa, Mycobacterium
NSKAGAKGLAKNPPAVK

SEQ ID NO: 272807 - protein, 18 aa, Mycobacterium
NSKRPEPFAGSPSANYLR

SEQ ID NO: 272808 - protein, 9 aa, Mycobacterium
NSLANGGRL

SEQ ID NO: 272809 - protein, 9 aa, Mycobacterium
NSLASGGRL

SEQ ID NO: 272810 - protein, 5 aa, Mycobacterium
NSLNG

SEQ ID NO: 272811 - protein, 9 aa, Mycobacterium
NSLPDPAAL

SEQ ID NO: 272812 - protein, 12 aa, Mycobacterium
NSLPDPAALPPR

SEQ ID NO: 272813 - protein, 6 aa, Mycobacterium
NSLPEA

SEQ ID NO: 272814 - protein, 9 aa, Mycobacterium
NSMSSSSVS

SEQ ID NO: 272815 - protein, 9 aa, Mycobacterium
NSNREQWDE

SEQ ID NO: 272816 - protein, 4 aa, Mycobacterium
NSPA

SEQ ID NO: 272817 - protein, 7 aa, Mycobacterium
NSPAERI

SEQ ID NO: 272818 - protein, 16 aa, Mycobacterium
NSPAPPPEGDDTEPPG

SEQ ID NO: 272819 - protein, 7 aa, Mycobacterium
NSPATRV

SEQ ID NO: 272820 - protein, 9 aa, Mycobacterium
NSPDAPSLK

SEQ ID NO: 272821 - protein, 17 aa, Mycobacterium
NSPDEELAGSQDFESEL

SEQ ID NO: 272822 - protein, 7 aa, Mycobacterium
NSPDGKF

SEQ ID NO: 272823 - protein, 10 aa, Mycobacterium
NSPDGVADDQ

SEQ ID NO: 272824 - protein, 12 aa, Mycobacterium
NSPDPTARDTGE

SEQ ID NO: 272825 - protein, 8 aa, Mycobacterium
NSPDRLPE

SEQ ID NO: 272826 - protein, 10 aa, Mycobacterium
NSPEDVSDEE

SEQ ID NO: 272827 - protein, 12 aa, Mycobacterium
NSPGMGADATRV

SEQ ID NO: 272828 - protein, 10 aa, Mycobacterium
NSPGMGDDAT

SEQ ID NO: 272829 - protein, 10 aa, Mycobacterium
NSPGPDARVS

SEQ ID NO: 272830 - protein, 5 aa, Mycobacterium
NSPGW

SEQ ID NO: 272831 - protein, 9 aa, Mycobacterium
NSPIPATGL

SEQ ID NO: 272832 - protein, 7 aa, Mycobacterium
NSPNQGG

SEQ ID NO: 272833 - protein, 15 aa, Mycobacterium
NSPPPKLGDTKPALA

SEQ ID NO: 272834 - protein, 8 aa, Mycobacterium
NSPPPPGV

SEQ ID NO: 272835 - protein, 26 aa, Mycobacterium
NSPRFAPRTPGADSEATRAASDAETL

SEQ ID NO: 272836 - protein, 6 aa, Mycobacterium
NSPRQT

SEQ ID NO: 272837 - protein, 5 aa, Mycobacterium
NSPTG

SEQ ID NO: 272838 - protein, 8 aa, Mycobacterium
NSPTRSAA

SEQ ID NO: 272839 - protein, 11 aa, Mycobacterium
NSQPKTKPKAC

SEQ ID NO: 272840 - protein, 7 aa, Mycobacterium
NSQSDYL

SEQ ID NO: 272841 - protein, 5 aa, Mycobacterium
NSREG

SEQ ID NO: 272842 - protein, 8 aa, Mycobacterium
NSRGTATA

SEQ ID NO: 272843 - protein, 8 aa, Mycobacterium
NSRQNYPQ

SEQ ID NO: 272844 - protein, 9 aa, Mycobacterium
NSRQSAAKL

SEQ ID NO: 272845 - protein, 12 aa, Mycobacterium
NSRRLTNVPNSD

SEQ ID NO: 272846 - protein, 11 aa, Mycobacterium
NSRRLTTVPNS

SEQ ID NO: 272847 - protein, 7 aa, Mycobacterium
NSRSGQS

SEQ ID NO: 272848 - protein, 12 aa, Mycobacterium
NSRSTPGAESEA

SEQ ID NO: 272849 - protein, 7 aa, Mycobacterium
NSRTDAR

SEQ ID NO: 272850 - protein, 6 aa, Mycobacterium
NSRYLS

SEQ ID NO: 272851 - protein, 6 aa, Mycobacterium
NSSDID

SEQ ID NO: 272852 - protein, 19 aa, Mycobacterium
NSSDIDPIANPDAAQEISR

SEQ ID NO: 272853 - protein, 19 aa, Mycobacterium
NSSDIDPIRNADAAEAINE

SEQ ID NO: 272854 - protein, 16 aa, Mycobacterium
NSSDVDPLANPDAAER

SEQ ID NO: 272855 - protein, 4 aa, Mycobacterium
NSSG

SEQ ID NO: 272856 - protein, 6 aa, Mycobacterium
NSSGPV

SEQ ID NO: 272857 - protein, 18 aa, Mycobacterium
NSSPTCNADPACAASRSQ

SEQ ID NO: 272858 - protein, 38 aa, Mycobacterium
NSSSGSENTAADQSNETAAQEAAPPTPLPGEDPAVKTP

SEQ ID NO: 272859 - protein, 8 aa, Mycobacterium
NSSTETTT

SEQ ID NO: 272860 - protein, 4 aa, Mycobacterium
NSTA

SEQ ID NO: 272861 - protein, 27 aa, Mycobacterium
NSTAPSVDASAPAHHHGHGTAPTTLDG

SEQ ID NO: 272862 - protein, 8 aa, Mycobacterium
NSTDAGAT

SEQ ID NO: 272863 - protein, 7 aa, Mycobacterium
NSTGEFR

SEQ ID NO: 272864 - protein, 6 aa, Mycobacterium
NSTGLQ

SEQ ID NO: 272865 - protein, 14 aa, Mycobacterium
NSTGQFKDDFESQA

SEQ ID NO: 272866 - protein, 7 aa, Mycobacterium
NSTGTAV

SEQ ID NO: 272867 - protein, 7 aa, Mycobacterium
NSTGTFR

SEQ ID NO: 272868 - protein, 8 aa, Mycobacterium
NSTGTGNA

SEQ ID NO: 272869 - protein, 12 aa, Mycobacterium
NSTNALSGNGEL

SEQ ID NO: 272870 - protein, 6 aa, Mycobacterium
NSTRDF

SEQ ID NO: 272871 - protein, 8 aa, Mycobacterium
NSTSGPLR

SEQ ID NO: 272872 - protein, 18 aa, Mycobacterium
NSTSGPLRGTFNPDNTAN

SEQ ID NO: 272873 - protein, 5 aa, Mycobacterium
NSTYR

SEQ ID NO: 272874 - protein, 11 aa, Mycobacterium
NSVDSGQVEAA

SEQ ID NO: 272875 - protein, 4 aa, Mycobacterium
NSVN

SEQ ID NO: 272876 - protein, 8 aa, Mycobacterium
NSVPKVGG

SEQ ID NO: 272877 - protein, 6 aa, Mycobacterium
NSVSGP

SEQ ID NO: 272878 - protein, 6 aa, Mycobacterium
NSWGET

SEQ ID NO: 272879 - protein, 6 aa, Mycobacterium
NSYDDY

SEQ ID NO: 272880 - protein, 13 aa, Mycobacterium
NSYGLQQPPRIGA

SEQ ID NO: 272881 - protein, 7 aa, Mycobacterium
NSYGSAD

SEQ ID NO: 272882 - protein, 8 aa, Mycobacterium
NTAAAQQA

SEQ ID NO: 272883 - protein, 7 aa, Mycobacterium
NTAAEGV

SEQ ID NO: 272884 - protein, 16 aa, Mycobacterium
NTAAKPPAAAEPPPAA

SEQ ID NO: 272885 - protein, 5 aa, Mycobacterium
NTAAQ

SEQ ID NO: 272886 - protein, 4 aa, Mycobacterium
NTAG

SEQ ID NO: 272887 - protein, 62 aa, Mycobacterium
NTAGAKPVNAEKPGSAQSHPGSNAPEAPQPAGQSAANTPAAPQGQNPEMPTPTAAVQPPPVL

SEQ ID NO: 272888 - protein, 9 aa, Mycobacterium
NTAKHSQAS

SEQ ID NO: 272889 - protein, 8 aa, Mycobacterium
NTAKNDDT

SEQ ID NO: 272890 - protein, 10 aa, Mycobacterium
NTANPASPRP

SEQ ID NO: 272891 - protein, 6 aa, Mycobacterium
NTAPTD

SEQ ID NO: 272892 - protein, 4 aa, Mycobacterium
NTAQ

SEQ ID NO: 272893 - protein, 6 aa, Mycobacterium
NTAQAA

SEQ ID NO: 272894 - protein, 9 aa, Mycobacterium
NTARATALR

SEQ ID NO: 272895 - protein, 9 aa, Mycobacterium
NTATAGASG

SEQ ID NO: 272896 - protein, 6 aa, Mycobacterium
NTATAM

SEQ ID NO: 272897 - protein, 7 aa, Mycobacterium
NTATARQ

SEQ ID NO: 272898 - protein, 9 aa, Mycobacterium
NTATESELD

SEQ ID NO: 272899 - protein, 8 aa, Mycobacterium
NTATGTRT

SEQ ID NO: 272900 - protein, 8 aa, Mycobacterium
NTDAGSPI

SEQ ID NO: 272901 - protein, 8 aa, Mycobacterium
NTDARADA

SEQ ID NO: 272902 - protein, 6 aa, Mycobacterium
NTDETM

SEQ ID NO: 272903 - protein, 14 aa, Mycobacterium
NTDGDVPAKKTDLT

SEQ ID NO: 272904 - protein, 5 aa, Mycobacterium
NTDGS

SEQ ID NO: 272905 - protein, 15 aa, Mycobacterium
NTDPGANASVSAGDE

SEQ ID NO: 272906 - protein, 6 aa, Mycobacterium
NTDSAE

SEQ ID NO: 272907 - protein, 4 aa, Mycobacterium
NTEN

SEQ ID NO: 272908 - protein, 15 aa, Mycobacterium
NTEQEKTKAALESAR

SEQ ID NO: 272909 - protein, 5 aa, Mycobacterium
NTEQV

SEQ ID NO: 272910 - protein, 4 aa, Mycobacterium
NTER

SEQ ID NO: 272911 - protein, 5 aa, Mycobacterium
NTESA

SEQ ID NO: 272912 - protein, 30 aa, Mycobacterium; identical to SEQ ID NO: 6024

SEQ ID NO: 272913 - protein, 17 aa, Mycobacterium
NTFDPSQDIGRQGDRQL

SEQ ID NO: 272914 - protein, 4 aa, Mycobacterium
NTGA

SEQ ID NO: 272915 - protein, 10 aa, Mycobacterium
NTGASAPAVA

SEQ ID NO: 272916 - protein, 9 aa, Mycobacterium
NTGATDIAK

SEQ ID NO: 272917 - protein, 5 aa, Mycobacterium
NTGAV

SEQ ID NO: 272918 - protein, 28 aa, Mycobacterium
NTGAVQTADQVDPVPDGATGWHTVAFTV

SEQ ID NO: 272919 - protein, 19 aa, Mycobacterium
NTGAVQTEDRADPVPDGAT

SEQ ID NO: 272920 - protein, 30 aa, Mycobacterium
NTGAVQTEERANPVPDGATGWHTVNFAVVP

SEQ ID NO: 272921 - protein, 11 aa, Mycobacterium
NTGCGAATTEV

SEQ ID NO: 272922 - protein, 11 aa, Mycobacterium
NTGCGTATSDV

SEQ ID NO: 272923 - protein, 8 aa, Mycobacterium
NTGDPDDL

SEQ ID NO: 272924 - protein, 6 aa, Mycobacterium
NTGGVV

SEQ ID NO: 272925 - protein, 5 aa, Mycobacterium
NTGKL

SEQ ID NO: 272926 - protein, 6 aa, Mycobacterium
NTGNGY

SEQ ID NO: 272927 - protein, 8 aa, Mycobacterium
NTGNLGAN

SEQ ID NO: 272928 - protein, 4 aa, Mycobacterium
NTGQ

SEQ ID NO: 272929 - protein, 6 aa, Mycobacterium
NTGQGG

SEQ ID NO: 272930 - protein, 4 aa, Mycobacterium
NTGR

SEQ ID NO: 272931 - protein, 9 aa, Mycobacterium
NTGSENTCP

SEQ ID NO: 272932 - protein, 9 aa, Mycobacterium
NTGSPDWPG

SEQ ID NO: 272933 - protein, 12 aa, Mycobacterium
NTGTAAAKEAGN

SEQ ID NO: 272934 - protein, 7 aa, Mycobacterium
NTGTPMP

SEQ ID NO: 272935 - protein, 10 aa, Mycobacterium
NTGVPTGTAL

SEQ ID NO: 272936 - protein, 17 aa, Mycobacterium
NTGVRSTPGRLDPPPLR

SEQ ID NO: 272937 - protein, 10 aa, Mycobacterium
NTGWTTATGN

SEQ ID NO: 272938 - protein, 6 aa, Mycobacterium
NTHDRD

SEQ ID NO: 272939 - protein, 6 aa, Mycobacterium
NTHPVE

SEQ ID NO: 272940 - protein, 5 aa, Mycobacterium
NTIEP

SEQ ID NO: 272941 - protein, 4 aa, Mycobacterium
NTIG

SEQ ID NO: 272942 - protein, 8 aa, Mycobacterium
NTIGSESR

SEQ ID NO: 272943 - protein, 6 aa, Mycobacterium
NTISDL

SEQ ID NO: 272944 - protein, 4 aa, Mycobacterium
NTKA

SEQ ID NO: 272945 - protein, 6 aa, Mycobacterium
NTKDFQ

SEQ ID NO: 272946 - protein, 11 aa, Mycobacterium
NTKIPAASPVR

SEQ ID NO: 272947 - protein, 5 aa, Mycobacterium
NTKQG

SEQ ID NO: 272948 - protein, 4 aa, Mycobacterium
NTKT

SEQ ID NO: 272949 - protein, 4 aa, Mycobacterium
NTLA

SEQ ID NO: 272950 - protein, 10 aa, Mycobacterium
NTLADNGQTV

SEQ ID NO: 272951 - protein, 8 aa, Mycobacterium
NTLADRGQ

SEQ ID NO: 272952 - protein, 4 aa, Mycobacterium
NTLD

SEQ ID NO: 272953 - protein, 6 aa, Mycobacterium
NTLDEP

SEQ ID NO: 272954 - protein, 5 aa, Mycobacterium
NTLRG

SEQ ID NO: 272955 - protein, 18 aa, Mycobacterium
NTLTSKADPASGTGQAGA

SEQ ID NO: 272956 - protein, 6 aa, Mycobacterium
NTNPVY

SEQ ID NO: 272957 - protein, 6 aa, Mycobacterium
NTNQLS

SEQ ID NO: 272958 - protein, 7 aa, Mycobacterium
NTNVGSG

SEQ ID NO: 272959 - protein, 8 aa, Mycobacterium
NTNYDSTT

SEQ ID NO: 272960 - protein, 13 aa, Mycobacterium
NTPADWARAGNAI

SEQ ID NO: 272961 - protein, 7 aa, Mycobacterium
NTPAPGR

SEQ ID NO: 272962 - protein, 8 aa, Mycobacterium
NTPAPPGI

SEQ ID NO: 272963 - protein, 8 aa, Mycobacterium
NTPAPPGL

SEQ ID NO: 272964 - protein, 40 aa, Mycobacterium
NTPAPQQVPAPAPLPGAVPQGAPLGALPGAQPAVPDPATA

SEQ ID NO: 272965 - protein, 15 aa, Mycobacterium
NTPDESDGTAAEKDQ

SEQ ID NO: 272966 - protein, 13 aa, Mycobacterium
NTPDGKPLDPAEV

SEQ ID NO: 272967 - protein, 13 aa, Mycobacterium
NTPDGKPLDREAV

SEQ ID NO: 272968 - protein, 4 aa, Mycobacterium
NTPG

SEQ ID NO: 272969 - protein, 8 aa, Mycobacterium
NTPGGGFA

SEQ ID NO: 272970 - protein, 9 aa, Mycobacterium
NTPGPDERI

SEQ ID NO: 272971 - protein, 5 aa, Mycobacterium
NTPHG

SEQ ID NO: 272972 - protein, 20 aa, Mycobacterium
NTPPAVDSSEVPQAGDPPMP

SEQ ID NO: 272973 - protein, 20 aa, Mycobacterium
NTPPAVDSSEVPTAGDPPIP

SEQ ID NO: 272974 - protein, 13 aa, Mycobacterium
NTPPPRISERRPE

SEQ ID NO: 272975 - protein, 10 aa, Mycobacterium
NTPQPANARG

SEQ ID NO: 272976 - protein, 10 aa, Mycobacterium
NTPSPVDPSQ

SEQ ID NO: 272977 - protein, 4 aa, Mycobacterium
NTPT

SEQ ID NO: 272978 - protein, 19 aa, Mycobacterium
NTPVDVKPQGQGPVDTGNP

SEQ ID NO: 272979 - protein, 9 aa, Mycobacterium
NTQEGGGGW

SEQ ID NO: 272980 - protein, 5 aa, Mycobacterium
NTQNQ

SEQ ID NO: 272981 - protein, 10 aa, Mycobacterium
NTQPSAGKVS

SEQ ID NO: 272982 - protein, 13 aa, Mycobacterium
NTQRRSDDAVQQK

SEQ ID NO: 272983 - protein, 8 aa, Mycobacterium
NTRDGTAV

SEQ ID NO: 272984 - protein, 7 aa, Mycobacterium
NTRGVPT

SEQ ID NO: 272985 - protein, 4 aa, Mycobacterium
NTRK

SEQ ID NO: 272986 - protein, 29 aa, Mycobacterium
NTRRLSQPDQLAEATSGAAAGAPTDERAP

SEQ ID NO: 272987 - protein, 8 aa, Mycobacterium
NTRTAIRA

SEQ ID NO: 272988 - protein, 4 aa, Mycobacterium
NTSA

SEQ ID NO: 272989 - protein, 9 aa, Mycobacterium
NTSGAGLGT

SEQ ID NO: 272990 - protein, 9 aa, Mycobacterium
NTSGYSDPT

SEQ ID NO: 272991 - protein, 9 aa, Mycobacterium
NTSIGGGGN

SEQ ID NO: 272992 - protein, 10 aa, Mycobacterium
NTSRGNSDDV

SEQ ID NO: 272993 - protein, 6 aa, Mycobacterium
NTSRQS

SEQ ID NO: 272994 - protein, 5 aa, Mycobacterium
NTTGT

SEQ ID NO: 272995 - protein, 5 aa, Mycobacterium
NTTIA

SEQ ID NO: 272996 - protein, 7 aa, Mycobacterium
NTTIPQQ

SEQ ID NO: 272997 - protein, 7 aa, Mycobacterium
NTTPHPA

SEQ ID NO: 272998 - protein, 8 aa, Mycobacterium
NTTQPIRS

SEQ ID NO: 272999 - protein, 8 aa, Mycobacterium
NTTQPLRT

SEQ ID NO: 273000 - protein, 7 aa, Mycobacterium
NTTQVEN

SEQ ID NO: 273001 - protein, 4 aa, Mycobacterium
NTTR

SEQ ID NO: 273002 - protein, 8 aa, Mycobacterium
NTTRMAAS

SEQ ID NO: 273003 - protein, 11 aa, Mycobacterium
NTTRSGEAGHG

SEQ ID NO: 273004 - protein, 5 aa, Mycobacterium
NTTSA

SEQ ID NO: 273005 - protein, 12 aa, Mycobacterium
NTTSTSPLTKNV

SEQ ID NO: 273006 - protein, 11 aa, Mycobacterium
NTTTTSPLTKN

SEQ ID NO: 273007 - protein, 30 aa, Mycobacterium
NTTVSRDGLKTPGVDALGPGGISGPPVARR

SEQ ID NO: 273008 - protein, 11 aa, Mycobacterium
NTVEEDEGLRP

SEQ ID NO: 273009 - protein, 7 aa, Mycobacterium
NTVEPHH

SEQ ID NO: 273010 - protein, 7 aa, Mycobacterium
NTVGARG

SEQ ID NO: 273011 - protein, 8 aa, Mycobacterium
NTVGDAGG

SEQ ID NO: 273012 - protein, 15 aa, Mycobacterium
NTVTVESAGTISASG

SEQ ID NO: 273013 - protein, 6 aa, Mycobacterium
NTYDAA

SEQ ID NO: 273014 - protein, 5 aa, Mycobacterium
NTYGG

SEQ ID NO: 273015 - protein, 6 aa, Mycobacterium
NTYPGA

SEQ ID NO: 273016 - protein, 10 aa, Mycobacterium
NTYTENADLP

SEQ ID NO: 273017 - protein, 11 aa, Mycobacterium
NVAAGARTRTS

SEQ ID NO: 273018 - protein, 16 aa, Mycobacterium
NVADSDADDPPTDPEL

SEQ ID NO: 273019 - protein, 14 aa, Mycobacterium
NVADTDPALPGNRA

SEQ ID NO: 273020 - protein, 6 aa, Mycobacterium
NVAGHG

SEQ ID NO: 273021 - protein, 13 aa, Mycobacterium
NVAGTDTATLNQS

SEQ ID NO: 273022 - protein, 5 aa, Mycobacterium
NVAPP

SEQ ID NO: 273023 - protein, 9 aa, Mycobacterium
NVAQPAPGN

SEQ ID NO: 273024 - protein, 15 aa, Mycobacterium
NVASADTASRSPSDG

SEQ ID NO: 273025 - protein, 15 aa, Mycobacterium
NVASARDDGPGPGRA

SEQ ID NO: 273026 - protein, 6 aa, Mycobacterium
NVASGA

SEQ ID NO: 273027 - protein, 7 aa, Mycobacterium
NVATTEV

SEQ ID NO: 273028 - protein, 13 aa, Mycobacterium
NVDDSDDDPITGP

SEQ ID NO: 273029 - protein, 7 aa, Mycobacterium
NVDGSLT

SEQ ID NO: 273030 - protein, 10 aa, Mycobacterium
NVDMSGASAD

SEQ ID NO: 273031 - protein, 10 aa, Mycobacterium
NVDPGGPSRG

SEQ ID NO: 273032 - protein, 8 aa, Mycobacterium
NVEGEGCG

SEQ ID NO: 273033 - protein, 9 aa, Mycobacterium
NVEGSSCGS

SEQ ID NO: 273034 - protein, 50 aa, Mycobacterium
NVETRAPEPTTTTTTTTTTPTTTTTTTPSPTPDTPTTSPETSTPPPAGPL

SEQ ID NO: 273035 - protein, 6 aa, Mycobacterium
NVFPGE

SEQ ID NO: 273036 - protein, 5 aa, Mycobacterium
NVGDE

SEQ ID NO: 273037 - protein, 24 aa, Mycobacterium
NVGDGQCKSQNPPPDPARPNTPDW

SEQ ID NO: 273038 - protein, 7 aa, Mycobacterium
NVGDRPV

SEQ ID NO: 273039 - protein, 6 aa, Mycobacterium
NVGGAA

SEQ ID NO: 273040 - protein, 11 aa, Mycobacterium
NVGLPGESAGL

SEQ ID NO: 273041 - protein, 5 aa, Mycobacterium
NVGTG

SEQ ID NO: 273042 - protein, 7 aa, Mycobacterium
NVGTQTA

SEQ ID NO: 273043 - protein, 5 aa, Mycobacterium
NVLTP

SEQ ID NO: 273044 - protein, 14 aa, Mycobacterium
NVMSPASGAGELVD

SEQ ID NO: 273045 - protein, 12 aa, Mycobacterium
NVNAGAKTRAST

SEQ ID NO: 273046 - protein, 11 aa, Mycobacterium
NVNAGARTRAS

SEQ ID NO: 273047 - protein, 8 aa, Mycobacterium
NVPCGDPR

SEQ ID NO: 273048 - protein, 9 aa, Mycobacterium
NVPGCGPQS

SEQ ID NO: 273049 - protein, 7 aa, Mycobacterium
NVPGPRQ

SEQ ID NO: 273050 - protein, 13 aa, Mycobacterium
NVPHTNQNPSITQ

SEQ ID NO: 273051 - protein, 15 aa, Mycobacterium
NVPPTDADSPAPNPL

SEQ ID NO: 273052 - protein, 14 aa, Mycobacterium
NVPPTPPAPAPVDA

SEQ ID NO: 273053 - protein, 10 aa, Mycobacterium
NVPTAGDGGT

SEQ ID NO: 273054 - protein, 16 aa, Mycobacterium
NVPTVDSEKPRPITSP

SEQ ID NO: 273055 - protein, 5 aa, Mycobacterium
NVPYE

SEQ ID NO: 273056 - protein, 10 aa, Mycobacterium
NVQATEGSHR

SEQ ID NO: 273057 - protein, 7 aa, Mycobacterium
NVQHPNE

SEQ ID NO: 273058 - protein, 9 aa, Mycobacterium
NVRTEADAR

SEQ ID NO: 273059 - protein, 12 aa, Mycobacterium
NVSDGKPLLGEG

SEQ ID NO: 273060 - protein, 6 aa, Mycobacterium
NVSDSG

SEQ ID NO: 273061 - protein, 9 aa, Mycobacterium
NVSGCGGQS

SEQ ID NO: 273062 - protein, 41 aa, Mycobacterium
NVSGSADADDAGDANDANEPDGPAEPDTGRRRNRISERLSG

SEQ ID NO: 273063 - protein, 5 aa, Mycobacterium
NVSPH

SEQ ID NO: 273064 - protein, 7 aa, Mycobacterium
NVSRTPV

SEQ ID NO: 273065 - protein, 5 aa, Mycobacterium
NVSTE

SEQ ID NO: 273066 - protein, 6 aa, Mycobacterium
NVSTGY

SEQ ID NO: 273067 - protein, 18 aa, Mycobacterium
NVTDQASEIADTMAAKVP

SEQ ID NO: 273068 - protein, 10 aa, Mycobacterium
NVTDTGAAQR

SEQ ID NO: 273069 - protein, 9 aa, Mycobacterium
NVTGADRPD

SEQ ID NO: 273070 - protein, 16 aa, Mycobacterium
NVTPGGTPKSWKDLLP

SEQ ID NO: 273071 - protein, 15 aa, Mycobacterium
NVTRTGDRQPGPGRA

SEQ ID NO: 273072 - protein, 7 aa, Mycobacterium
NVTSNTS

SEQ ID NO: 273073 - protein, 7 aa, Mycobacterium
NVTTSEL

SEQ ID NO: 273074 - protein, 16 aa, Mycobacterium
NWADRTRSASGLGGQD

SEQ ID NO: 273075 - protein, 5 aa, Mycobacterium
NWDPE

SEQ ID NO: 273076 - protein, 14 aa, Mycobacterium
NWGEGGAAAYGSGP

SEQ ID NO: 273077 - protein, 9 aa, Mycobacterium
NWPAGATHA

SEQ ID NO: 273078 - protein, 7 aa, Mycobacterium
NYAGARA

SEQ ID NO: 273079 - protein, 7 aa, Mycobacterium
NYAPDGV

SEQ ID NO: 273080 - protein, 16 aa, Mycobacterium
NYATEKAKVDYPNSVD

SEQ ID NO: 273081 - protein, 18 aa, Mycobacterium
NYATEKASVEVAGEVSPE

SEQ ID NO: 273082 - protein, 15 aa, Mycobacterium
NYDDASDADDEHGAP

SEQ ID NO: 273083 - protein, 6 aa, Mycobacterium
NYDGEV

SEQ ID NO: 273084 - protein, 7 aa, Mycobacterium
NYDPASE

SEQ ID NO: 273085 - protein, 9 aa, Mycobacterium
NYDSSTAVE

SEQ ID NO: 273086 - protein, 21 aa, Mycobacterium
NYGGGGQYDEGSATFDYPPNL

SEQ ID NO: 273087 - protein, 6 aa, Mycobacterium
NYGPAH

SEQ ID NO: 273088 - protein, 9 aa, Mycobacterium
NYGRPNHPA

SEQ ID NO: 273089 - protein, 5 aa, Mycobacterium
NYGSA

SEQ ID NO: 273090 - protein, 4 aa, Mycobacterium
NYIS

SEQ ID NO: 273091 - protein, 20 aa, Mycobacterium
NYKPPADLAPPAGTVIGPNG

SEQ ID NO: 273092 - protein, 29 aa, Mycobacterium
NYKPPGDAFDKTGAKSPGYPGDYPAGSLP

SEQ ID NO: 273093 - protein, 5 aa, Mycobacterium
NYPDG

SEQ ID NO: 273094 - protein, 13 aa, Mycobacterium
NYPPDRGRQLTAT

SEQ ID NO: 273095 - protein, 21 aa, Mycobacterium
NYPTDGPGNRRTRRPPPMPSA

SEQ ID NO: 273096 - protein, 16 aa, Mycobacterium
NYQPPANLAPPPGTVL

SEQ ID NO: 273097 - protein, 20 aa, Mycobacterium
NYQPPKDLAPPPGTAVGPDG

SEQ ID NO: 273098 - protein, 19 aa, Mycobacterium
NYQPPKDLAPPPGTVVGEN

SEQ ID NO: 273099 - protein, 20 aa, Mycobacterium
NYQPPKDLQPPPGTEIGPSG

SEQ ID NO: 273100 - protein, 20 aa, Mycobacterium
NYQPPPNLAPPPGTVVGPDG

SEQ ID NO: 273101 - protein, 10 aa, Mycobacterium
NYQSGAATRF

SEQ ID NO: 273102 - protein, 5 aa, Mycobacterium
NYRAG

SEQ ID NO: 273103 - protein, 7 aa, Mycobacterium
NYRTATE

SEQ ID NO: 273104 - protein, 6 aa, Mycobacterium
NYSPFI

SEQ ID NO: 273105 - protein, 6 aa, Mycobacterium
NYTDST

SEQ ID NO: 273106 - protein, 22 aa, Mycobacterium
NYTGEGQATAQQVAADRATTSN

SEQ ID NO: 273107 - protein, 7 aa, Mycobacterium
NYTGPNP

SEQ ID NO: 273108 - protein, 12 aa, Mycobacterium
NYTQSNPNCQND

SEQ ID NO: 273109 - protein, 5 aa, Mycobacterium
PAAAA

SEQ ID NO: 273110 - protein, 9 aa, Mycobacterium
PAAAAAGSG

SEQ ID NO: 273111 - protein, 7 aa, Mycobacterium
PAAAAPL

SEQ ID NO: 273112 - protein, 10 aa, Mycobacterium
PAAAASASAA

SEQ ID NO: 273113 - protein, 11 aa, Mycobacterium
PAAAEMTDNPQ

SEQ ID NO: 273114 - protein, 24 aa, Mycobacterium
PAAAEVSATGYAKEMGDDYKAREA

SEQ ID NO: 273115 - protein, 6 aa, Mycobacterium
PAAAGE

SEQ ID NO: 273116 - protein, 6 aa, Mycobacterium
PAAAGL

SEQ ID NO: 273117 - protein, 18 aa, Mycobacterium
PAAALSRKPCDAGGLVTA

SEQ ID NO: 273118 - protein, 6 aa, Mycobacterium
PAAANT

SEQ ID NO: 273119 - protein, 11 aa, Mycobacterium
PAAAPPESPRR

SEQ ID NO: 273120 - protein, 12 aa, Mycobacterium
PAAAPRDFDTPT

SEQ ID NO: 273121 - protein, 26 aa, Mycobacterium
PAAAPTASADPPQAHRPTPPPTGQWR

SEQ ID NO: 273122 - protein, 10 aa, Mycobacterium
PAAAQLGPNF

SEQ ID NO: 273123 - protein, 11 aa, Mycobacterium
PAAAQTEVGQL

SEQ ID NO: 273124 - protein, 7 aa, Mycobacterium
PAAARPP

SEQ ID NO: 273125 - protein, 12 aa, Mycobacterium
PAAASVSANPNH

SEQ ID NO: 273126 - protein, 11 aa, Mycobacterium
PAAASVSATGE

SEQ ID NO: 273127 - protein, 5 aa, Mycobacterium
PAAAT

SEQ ID NO: 273128 - protein, 7 aa, Mycobacterium
PAAATAA

SEQ ID NO: 273129 - protein, 13 aa, Mycobacterium
PAAATTSATKTSG

SEQ ID NO: 273130 - protein, 12 aa, Mycobacterium
PAADLEPGTTPY

SEQ ID NO: 273131 - protein, 8 aa, Mycobacterium
PAADRTRT

SEQ ID NO: 273132 - protein, 11 aa, Mycobacterium
PAADSASQDYT

SEQ ID NO: 273133 - protein, 14 aa, Mycobacterium
PAADTESRGGTAVA

SEQ ID NO: 273134 - protein, 4 aa, Mycobacterium
PAAE

SEQ ID NO: 273135 - protein, 6 aa, Mycobacterium
PAAEEV

SEQ ID NO: 273136 - protein, 9 aa, Mycobacterium
PAAEGDIAD

SEQ ID NO: 273137 - protein, 7 aa, Mycobacterium
PAAGAGG

SEQ ID NO: 273138 - protein, 11 aa, Mycobacterium
PAAGAPNSVGL

SEQ ID NO: 273139 - protein, 8 aa, Mycobacterium
PAAGAQAP

SEQ ID NO: 273140 - protein, 11 aa, Mycobacterium
PAAGAVEPPQI

SEQ ID NO: 273141 - protein, 8 aa, Mycobacterium
PAAGAVGG

SEQ ID NO: 273142 - protein, 5 aa, Mycobacterium
PAAGD

SEQ ID NO: 273143 - protein, 6 aa, Mycobacterium
PAAGDT

SEQ ID NO: 273144 - protein, 12 aa, Mycobacterium
PAAGEGQPPGPR

SEQ ID NO: 273145 - protein, 7 aa, Mycobacterium
PAAGELS

SEQ ID NO: 273146 - protein, 10 aa, Mycobacterium
PAAGEPNTLG

SEQ ID NO: 273147 - protein, 8 aa, Mycobacterium
PAAGGPTA

SEQ ID NO: 273148 - protein, 8 aa, Mycobacterium
PAAGHQRA

SEQ ID NO: 273149 - protein, 11 aa, Mycobacterium
PAAGRDAPPGM

SEQ ID NO: 273150 - protein, 17 aa, Mycobacterium
PAAGRDARRDAGDSATA

SEQ ID NO: 273151 - protein, 11 aa, Mycobacterium
PAAGRDDPPGM

SEQ ID NO: 273152 - protein, 14 aa, Mycobacterium
PAAGRGETDRRTVA

SEQ ID NO: 273153 - protein, 12 aa, Mycobacterium
PAAGRGQPPGPR

SEQ ID NO: 273154 - protein, 7 aa, Mycobacterium
PAAGSAA

SEQ ID NO: 273155 - protein, 10 aa, Mycobacterium
PAAGSASQDY

SEQ ID NO: 273156 - protein, 5 aa, Mycobacterium
PAAGT

SEQ ID NO: 273157 - protein, 6 aa, Mycobacterium
PAAGTL

SEQ ID NO: 273158 - protein, 7 aa, Mycobacterium
PAAIAAA

SEQ ID NO: 273159 - protein, 11 aa, Mycobacterium
PAAKANFEEDA

SEQ ID NO: 273160 - protein, 9 aa, Mycobacterium
PAAKGRTSV

SEQ ID NO: 273161 - protein, 12 aa, Mycobacterium
PAAKQKALKTSA

SEQ ID NO: 273162 - protein, 10 aa, Mycobacterium
PAAKQKAVKT

SEQ ID NO: 273163 - protein, 12 aa, Mycobacterium
PAAKQKSLKTTA

SEQ ID NO: 273164 - protein, 11 aa, Mycobacterium
PAAKQKSVKTS

SEQ ID NO: 273165 - protein, 10 aa, Mycobacterium
PAAKRKSVRT

SEQ ID NO: 273166 - protein, 15 aa, Mycobacterium
PAAKSGAASAVSETA

SEQ ID NO: 273167 - protein, 15 aa, Mycobacterium
PAAKTGGTAASAADY

SEQ ID NO: 273168 - protein, 12 aa, Mycobacterium
PAALNNPQHPRF

SEQ ID NO: 273169 - protein, 13 aa, Mycobacterium
PAALTTDMNEAAD

SEQ ID NO: 273170 - protein, 11 aa, Mycobacterium
PAANGVATARG

SEQ ID NO: 273171 - protein, 11 aa, Mycobacterium
PAANSSLRGSV

SEQ ID NO: 273172 - protein, 14 aa, Mycobacterium
PAAPAAALTPPSVD

SEQ ID NO: 273173 - protein, 20 aa, Mycobacterium
PAAPAAPGDPVTAADSPTLS

SEQ ID NO: 273174 - protein, 9 aa, Mycobacterium
PAAPAHKTT

SEQ ID NO: 273175 - protein, 12 aa, Mycobacterium
PAAPAPQADSAA

SEQ ID NO: 273176 - protein, 6 aa, Mycobacterium
PAAPAQ

SEQ ID NO: 273177 - protein, 11 aa, Mycobacterium
PAAPDYRKPAP

SEQ ID NO: 273178 - protein, 32 aa, Mycobacterium
PAAPEPSMTTSSPRSPTTTSRAPRTTTRPTTP

SEQ ID NO: 273179 - protein, 15 aa, Mycobacterium
PAAPEQIPTPLSADE

SEQ ID NO: 273180 - protein, 5 aa, Mycobacterium
PAAPG

SEQ ID NO: 273181 - protein, 7 aa, Mycobacterium
PAAPGQR

SEQ ID NO: 273182 - protein, 16 aa, Mycobacterium
PAAPPPAPEPEPEPVV

SEQ ID NO: 273183 - protein, 12 aa, Mycobacterium
PAAPPPPPDHRA

SEQ ID NO: 273184 - protein, 6 aa, Mycobacterium
PAAPPR

SEQ ID NO: 273185 - protein, 15 aa, Mycobacterium
PAAPRASAGEPGATP

SEQ ID NO: 273186 - protein, 10 aa, Mycobacterium
PAAPRPTAPQ

SEQ ID NO: 273187 - protein, 6 aa, Mycobacterium
PAAPTP

SEQ ID NO: 273188 - protein, 7 aa, Mycobacterium
PAAPTTR

SEQ ID NO: 273189 - protein, 30 aa, Mycobacterium
PAAPVGKAEPGASELKAATGTGSEGARVRP

SEQ ID NO: 273190 - protein, 8 aa, Mycobacterium
PAAPVTVK

SEQ ID NO: 273191 - protein, 9 aa, Mycobacterium
PAAQGFTPA

SEQ ID NO: 273192 - protein, 10 aa, Mycobacterium
PAAQRGQITT

SEQ ID NO: 273193 - protein, 11 aa, Mycobacterium
PAAQRGQITTT

SEQ ID NO: 273194 - protein, 15 aa, Mycobacterium
PAAQTGGTAASAAQY

SEQ ID NO: 273195 - protein, 5 aa, Mycobacterium
PAAQW

SEQ ID NO: 273196 - protein, 4 aa, Mycobacterium
PAAR

SEQ ID NO: 273197 - protein, 5 aa, Mycobacterium
PAARA

SEQ ID NO: 273198 - protein, 7 aa, Mycobacterium
PAARGMG

SEQ ID NO: 273199 - protein, 13 aa, Mycobacterium
PAARRNAQSIGEK

SEQ ID NO: 273200 - protein, 8 aa, Mycobacterium
PAARSAGS

SEQ ID NO: 273201 - protein, 10 aa, Mycobacterium
PAARSHPAGS

SEQ ID NO: 273202 - protein, 10 aa, Mycobacterium
PAASAPPATL

SEQ ID NO: 273203 - protein, 20 aa, Mycobacterium
PAASGPSQHEAAASRDLPRA

SEQ ID NO: 273204 - protein, 34 aa, Mycobacterium
PAASPVEPDTVSPARTRSRPKSPLTRQHAEQAGR

SEQ ID NO: 273205 - protein, 11 aa, Mycobacterium
PAASSASQDYT

SEQ ID NO: 273206 - protein, 12 aa, Mycobacterium
PAASTGPSSLSA

SEQ ID NO: 273207 - protein, 9 aa, Mycobacterium
PAATAATDF

SEQ ID NO: 273208 - protein, 6 aa, Mycobacterium
PAATAR

SEQ ID NO: 273209 - protein, 6 aa, Mycobacterium
PAATAV

SEQ ID NO: 273210 - protein, 8 aa, Mycobacterium
PAATETRR

SEQ ID NO: 273211 - protein, 10 aa, Mycobacterium
PAATNSSGAH

SEQ ID NO: 273212 - protein, 7 aa, Mycobacterium
PAATPKC

SEQ ID NO: 273213 - protein, 7 aa, Mycobacterium
PAATPTR

SEQ ID NO: 273214 - protein, 7 aa, Mycobacterium
PAATSAD

SEQ ID NO: 273215 - protein, 5 aa, Mycobacterium
PAATT

SEQ ID NO: 273216 - protein, 10 aa, Mycobacterium
PAATTSAVPA

SEQ ID NO: 273217 - protein, 6 aa, Mycobacterium
PAATTV

SEQ ID NO: 273218 - protein, 11 aa, Mycobacterium
PAATVPTPSGW

SEQ ID NO: 273219 - protein, 7 aa, Mycobacterium
PAAVQPA

SEQ ID NO: 273220 - protein, 13 aa, Mycobacterium
PAAVTGPLTGHGR

SEQ ID NO: 273221 - protein, 5 aa, Mycobacterium
PACAA

SEQ ID NO: 273222 - protein, 9 aa, Mycobacterium
PADAEATEA

SEQ ID NO: 273223 - protein, 14 aa, Mycobacterium
PADAGDSDVLAQRD

SEQ ID NO: 273224 - protein, 13 aa, Mycobacterium
PADAGSSQQRSPM

SEQ ID NO: 273225 - protein, 7 aa, Mycobacterium
PADAGSV

SEQ ID NO: 273226 - protein, 10 aa, Mycobacterium
PADAPQRADL

SEQ ID NO: 273227 - protein, 7 aa, Mycobacterium
PADAQAV

SEQ ID NO: 273228 - protein, 6 aa, Mycobacterium
PADAQK

SEQ ID NO: 273229 - protein, 7 aa, Mycobacterium
PADARGR

SEQ ID NO: 273230 - protein, 5 aa, Mycobacterium
PADAS

SEQ ID NO: 273231 - protein, 8 aa, Mycobacterium
PADASGFR

SEQ ID NO: 273232 - protein, 7 aa, Mycobacterium
PADASWG

SEQ ID NO: 273233 - protein, 9 aa, Mycobacterium
PADATGAQC

SEQ ID NO: 273234 - protein, 7 aa, Mycobacterium
PADATGP

SEQ ID NO: 273235 - protein, 7 aa, Mycobacterium
PADDAVA

SEQ ID NO: 273236 - protein, 10 aa, Mycobacterium
PADDETYDGD

SEQ ID NO: 273237 - protein, 17 aa, Mycobacterium
PADEGAGTSTTPHRAPT

SEQ ID NO: 273238 - protein, 4 aa, Mycobacterium
PADG

SEQ ID NO: 273239 - protein, 5 aa, Mycobacterium
PADGD

SEQ ID NO: 273240 - protein, 9 aa, Mycobacterium
PADGEPRTV

SEQ ID NO: 273241 - protein, 8 aa, Mycobacterium
PADGHSPA

SEQ ID NO: 273242 - protein, 20 aa, Mycobacterium
PADGNSRTAPVLRGKCCTAR

SEQ ID NO: 273243 - protein, 11 aa, Mycobacterium
PADGRSPQEIA

SEQ ID NO: 273244 - protein, 5 aa, Mycobacterium
PADGS

SEQ ID NO: 273245 - protein, 7 aa, Mycobacterium
PADGSVD

SEQ ID NO: 273246 - protein, 8 aa, Mycobacterium
PADGTDAA

SEQ ID NO: 273247 - protein, 23 aa, Mycobacterium
PADKGLAPYGAEEAQAAAPVVPA

SEQ ID NO: 273248 - protein, 7 aa, Mycobacterium
PADLDSA

SEQ ID NO: 273249 - protein, 4 aa, Mycobacterium
PADP

SEQ ID NO: 273250 - protein, 19 aa, Mycobacterium
PADPEIAKRARLPKVTVRR

SEQ ID NO: 273251 - protein, 14 aa, Mycobacterium
PADPVTATDSTTTL

SEQ ID NO: 273252 - protein, 8 aa, Mycobacterium
PADQPRRF

SEQ ID NO: 273253 - protein, 9 aa, Mycobacterium
PADQSDHRT

SEQ ID NO: 273254 - protein, 15 aa, Mycobacterium
PADQSRNGAGKRPSF

SEQ ID NO: 273255 - protein, 4 aa, Mycobacterium
PADR

SEQ ID NO: 273256 - protein, 20 aa, Mycobacterium
PADRAGVGSAVNDTTRELGG

SEQ ID NO: 273257 - protein, 7 aa, Mycobacterium
PADREAL

SEQ ID NO: 273258 - protein, 17 aa, Mycobacterium
PADRPRPARPTGAGGTL

SEQ ID NO: 273259 - protein, 8 aa, Mycobacterium
PADRQELS

SEQ ID NO: 273260 - protein, 10 aa, Mycobacterium
PADRRDVAEA

SEQ ID NO: 273261 - protein, 14 aa, Mycobacterium
PADRTDKSDPPRVW

SEQ ID NO: 273262 - protein, 10 aa, Mycobacterium
PADSPLQATR

SEQ ID NO: 273263 - protein, 10 aa, Mycobacterium
PADSSTPTVK

SEQ ID NO: 273264 - protein, 10 aa, Mycobacterium
PADSTDPRAE

SEQ ID NO: 273265 - protein, 9 aa, Mycobacterium
PADTDMPAT

SEQ ID NO: 273266 - protein, 9 aa, Mycobacterium
PADTDMPET

SEQ ID NO: 273267 - protein, 14 aa, Mycobacterium
PADTEVDVGANDMS

SEQ ID NO: 273268 - protein, 5 aa, Mycobacterium
PADTP

SEQ ID NO: 273269 - protein, 8 aa, Mycobacterium
PADTPDAV

SEQ ID NO: 273270 - protein, 4 aa, Mycobacterium
PADV

SEQ ID NO: 273271 - protein, 26 aa, Mycobacterium
PADVPPPVADAPQASNITNSPVTGEQ

SEQ ID NO: 273272 - protein, 14 aa, Mycobacterium
PAEADAANINKNRL

SEQ ID NO: 273273 - protein, 18 aa, Mycobacterium
PAEADHKRTRDAATEHDL

SEQ ID NO: 273274 - protein, 7 aa, Mycobacterium
PAEAGAA

SEQ ID NO: 273275 - protein, 13 aa, Mycobacterium
PAEAGSSSRQGLD

SEQ ID NO: 273276 - protein, 10 aa, Mycobacterium
PAEALRGSYH

SEQ ID NO: 273277 - protein, 18 aa, Mycobacterium
PAEAQRQADVARAEGQRQ

SEQ ID NO: 273278 - protein, 8 aa, Mycobacterium
PAEARRQA

SEQ ID NO: 273279 - protein, 22 aa, Mycobacterium
PAEATEPPQAAEEPAAGQAGRA

SEQ ID NO: 273280 - protein, 10 aa, Mycobacterium
PAEDAPITGP

SEQ ID NO: 273281 - protein, 7 aa, Mycobacterium
PAEDSSR

SEQ ID NO: 273282 - protein, 13 aa, Mycobacterium
PAEELRSARSPQE

SEQ ID NO: 273283 - protein, 14 aa, Mycobacterium
PAEELRSARSPQEL

SEQ ID NO: 273284 - protein, 4 aa, Mycobacterium
PAEF

SEQ ID NO: 273285 - protein, 8 aa, Mycobacterium
PAEGETLD

SEQ ID NO: 273286 - protein, 5 aa, Mycobacterium
PAEGF

SEQ ID NO: 273287 - protein, 6 aa, Mycobacterium
PAEGKD

SEQ ID NO: 273288 - protein, 17 aa, Mycobacterium
PAEGSDAEIDSGAKTPT

SEQ ID NO: 273289 - protein, 8 aa, Mycobacterium
PAEGVGQT

SEQ ID NO: 273290 - protein, 25 aa, Mycobacterium
PAEHPDAGPEHASGGVAVQLPPRGN

SEQ ID NO: 273291 - protein, 7 aa, Mycobacterium
PAEIGLG

SEQ ID NO: 273292 - protein, 11 aa, Mycobacterium
PAEKPSASAAA

SEQ ID NO: 273293 - protein, 4 aa, Mycobacterium
PAEN

SEQ ID NO: 273294 - protein, 28 aa, Mycobacterium
PAEPGRPRPSARASPSGPGREVVGAPRS

SEQ ID NO: 273295 - protein, 31 aa, Mycobacterium
PAEPQDGDPSDDAGERRFTAPSGFDAGSTQV

SEQ ID NO: 273296 - protein, 23 aa, Mycobacterium
PAEPSRPSSEPDVRRPEQAAAAE

SEQ ID NO: 273297 - protein, 4 aa, Mycobacterium
PAEQ

SEQ ID NO: 273298 - protein, 7 aa, Mycobacterium
PAERGGL

SEQ ID NO: 273299 - protein, 29 aa, Mycobacterium
PAERPARPKNTGQAKARAKARKAKAPKVV

SEQ ID NO: 273300 - protein, 12 aa, Mycobacterium
PAERPASAAEFG

SEQ ID NO: 273301 - protein, 20 aa, Mycobacterium
PAERTNPTRRPAPAGPSKWR

SEQ ID NO: 273302 - protein, 8 aa, Mycobacterium
PAESDIQQ

SEQ ID NO: 273303 - protein, 8 aa, Mycobacterium
PAESEARG

SEQ ID NO: 273304 - protein, 7 aa, Mycobacterium
PAESGAA

SEQ ID NO: 273305 - protein, 9 aa, Mycobacterium
PAESQSRRR

SEQ ID NO: 273306 - protein, 5 aa, Mycobacterium
PAESY

SEQ ID NO: 273307 - protein, 8 aa, Mycobacterium
PAETDGSR

SEQ ID NO: 273308 - protein, 17 aa, Mycobacterium
PAETSHTDPADNTFASS

SEQ ID NO: 273309 - protein, 12 aa, Mycobacterium
PAETSREENTRY

SEQ ID NO: 273310 - protein, 11 aa, Mycobacterium
PAEYDDEQMEP

SEQ ID NO: 273311 - protein, 35 aa, Mycobacterium
PAFDAPGTPTMGTPPLGTPPTGNPPHPPKSAVHRT

SEQ ID NO: 273312 - protein, 24 aa, Mycobacterium
PAFDDDTDDDSEADTEYDEYPSHT

SEQ ID NO: 273313 - protein, 18 aa, Mycobacterium
PAFDDEDLDDRDSDELPS

SEQ ID NO: 273314 - protein, 9 aa, Mycobacterium
PAFDPPPNL

SEQ ID NO: 273315 - protein, 11 aa, Mycobacterium
PAFESRDRKAS

SEQ ID NO: 273316 - protein, 4 aa, Mycobacterium
PAFG

SEQ ID NO: 273317 - protein, 6 aa, Mycobacterium
PAFGGQ

SEQ ID NO: 273318 - protein, 13 aa, Mycobacterium
PAFQKPKSRNAAT

SEQ ID NO: 273319 - protein, 9 aa, Mycobacterium
PAFTGEPAD

SEQ ID NO: 273320 - protein, 4 aa, Mycobacterium
PAGA

SEQ ID NO: 273321 - protein, 10 aa, Mycobacterium
PAGAASGFGK

SEQ ID NO: 273322 - protein, 5 aa, Mycobacterium
PAGAE

SEQ ID NO: 273323 - protein, 11 aa, Mycobacterium
PAGAEADGRSQ

SEQ ID NO: 273324 - protein, 6 aa, Mycobacterium
PAGAGP

SEQ ID NO: 273325 - protein, 7 aa, Mycobacterium
PAGAGTV

SEQ ID NO: 273326 - protein, 8 aa, Mycobacterium
PAGALGGF

SEQ ID NO: 273327 - protein, 6 aa, Mycobacterium
PAGARK

SEQ ID NO: 273328 - protein, 13 aa, Mycobacterium
PAGARSAPARRVG

SEQ ID NO: 273329 - protein, 11 aa, Mycobacterium
PAGASGQTAAV

SEQ ID NO: 273330 - protein, 6 aa, Mycobacterium
PAGAST

SEQ ID NO: 273331 - protein, 4 aa, Mycobacterium
PAGD

SEQ ID NO: 273332 - protein, 10 aa, Mycobacterium
PAGDPKPVEH

SEQ ID NO: 273333 - protein, 13 aa, Mycobacterium
PAGDPSTASRRRR

SEQ ID NO: 273334 - protein, 4 aa, Mycobacterium
PAGE

SEQ ID NO: 273335 - protein, 14 aa, Mycobacterium
PAGEAASTIQRGDP

SEQ ID NO: 273336 - protein, 10 aa, Mycobacterium
PAGEENRRDL

SEQ ID NO: 273337 - protein, 55 aa, Mycobacterium
PAGEGAAPGGAPEGMPPGAIPGMPGGVPGMPPGAIPGMPPGAIPGMPGDAMPGMP

SEQ ID NO: 273338 - protein, 6 aa, Mycobacterium
PAGEGP

SEQ ID NO: 273339 - protein, 6 aa, Mycobacterium
PAGELT

SEQ ID NO: 273340 - protein, 6 aa, Mycobacterium
PAGEND

SEQ ID NO: 273341 - protein, 11 aa, Mycobacterium
PAGERGAASGV

SEQ ID NO: 273342 - protein, 8 aa, Mycobacterium
PAGETAGN

SEQ ID NO: 273343 - protein, 12 aa, Mycobacterium
PAGEWDERARES

SEQ ID NO: 273344 - protein, 63 aa, Mycobacterium
PAGFGPAAVAPGGAGPASAALPAASAAAPASPAAPAAPGRSMPASAGDRVTIPASASRAGYGE

SEQ ID NO: 273345 - protein, 9 aa, Mycobacterium
PAGGAGSAR

SEQ ID NO: 273346 - protein, 8 aa, Mycobacterium
PAGGDRRS

SEQ ID NO: 273347 - protein, 5 aa, Mycobacterium
PAGGG

SEQ ID NO: 273348 - protein, 6 aa, Mycobacterium
PAGGGW

SEQ ID NO: 273349 - protein, 7 aa, Mycobacterium
PAGGLSN

SEQ ID NO: 273350 - protein, 17 aa, Mycobacterium
PAGGLSNDAVRRTAATF

SEQ ID NO: 273351 - protein, 5 aa, Mycobacterium
PAGGV

SEQ ID NO: 273352 - protein, 9 aa, Mycobacterium
PAGGVDTGK

SEQ ID NO: 273353 - protein, 10 aa, Mycobacterium
PAGGVDTGKN

SEQ ID NO: 273354 - protein, 8 aa, Mycobacterium
PAGGVSNA

SEQ ID NO: 273355 - protein, 28 aa, Mycobacterium
PAGIEEPGQEDEPGREPTRIERRSPQQD

SEQ ID NO: 273356 - protein, 9 aa, Mycobacterium
PAGIEPSAI

SEQ ID NO: 273357 - protein, 7 aa, Mycobacterium
PAGIGTS

SEQ ID NO: 273358 - protein, 7 aa, Mycobacterium
PAGIRTE

SEQ ID NO: 273359 - protein, 5 aa, Mycobacterium
PAGIT

SEQ ID NO: 273360 - protein, 6 aa, Mycobacterium
PAGKGL

SEQ ID NO: 273361 - protein, 16 aa, Mycobacterium
PAGLRAEGRRSPSPGH

SEQ ID NO: 273362 - protein, 10 aa, Mycobacterium
PAGLTAPVRG

SEQ ID NO: 273363 - protein, 21 aa, Mycobacterium
PAGLTKEQAVEAARARGDGTF

SEQ ID NO: 273364 - protein, 10 aa, Mycobacterium
PAGLTPGSAQ

SEQ ID NO: 273365 - protein, 7 aa, Mycobacterium
PAGMDGR

SEQ ID NO: 273366 - protein, 21 aa, Mycobacterium
PAGNTDSGAQCPGQRPDVSRD

SEQ ID NO: 273367 - protein, 5 aa, Mycobacterium
PAGPA

SEQ ID NO: 273368 - protein, 8 aa, Mycobacterium
PAGPADIP

SEQ ID NO: 273369 - protein, 21 aa, Mycobacterium
PAGPELGREQASIARDSVAGC

SEQ ID NO: 273370 - protein, 10 aa, Mycobacterium
PAGPGAPRDV

SEQ ID NO: 273371 - protein, 7 aa, Mycobacterium
PAGPGLS

SEQ ID NO: 273372 - protein, 13 aa, Mycobacterium
PAGPGTAKAPGPL

SEQ ID NO: 273373 - protein, 8 aa, Mycobacterium
PAGPIARG

SEQ ID NO: 273374 - protein, 18 aa, Mycobacterium
PAGPPLADDPTASIRANH

SEQ ID NO: 273375 - protein, 7 aa, Mycobacterium
PAGPSAV

SEQ ID NO: 273376 - protein, 4 aa, Mycobacterium
PAGQ

SEQ ID NO: 273377 - protein, 20 aa, Mycobacterium
PAGQEQQELQEHEAHETEAA

SEQ ID NO: 273378 - protein, 9 aa, Mycobacterium
PAGQVGDSP

SEQ ID NO: 273379 - protein, 4 aa, Mycobacterium
PAGR

SEQ ID NO: 273380 - protein, 6 aa, Mycobacterium
PAGRDW

SEQ ID NO: 273381 - protein, 6 aa, Mycobacterium
PAGREA

SEQ ID NO: 273382 - protein, 37 aa, Mycobacterium
PAGREFDDDDDDDDDDEDDDEDEDLARAAAGSEPESA

SEQ ID NO: 273383 - protein, 6 aa, Mycobacterium
PAGRGH

SEQ ID NO: 273384 - protein, 7 aa, Mycobacterium
PAGRGSR

SEQ ID NO: 273385 - protein, 8 aa, Mycobacterium
PAGRQGRG

SEQ ID NO: 273386 - protein, 6 aa, Mycobacterium
PAGRYG

SEQ ID NO: 273387 - protein, 9 aa, Mycobacterium
PAGSAGQAR

SEQ ID NO: 273388 - protein, 9 aa, Mycobacterium
PAGSGGARI

SEQ ID NO: 273389 - protein, 7 aa, Mycobacterium
PAGSGGD

SEQ ID NO: 273390 - protein, 9 aa, Mycobacterium
PAGSGQPLQ

SEQ ID NO: 273391 - protein, 10 aa, Mycobacterium
PAGSNTPSAF

SEQ ID NO: 273392 - protein, 8 aa, Mycobacterium
PAGSNTPT

SEQ ID NO: 273393 - protein, 7 aa, Mycobacterium
PAGSRTL

SEQ ID NO: 273394 - protein, 11 aa, Mycobacterium
PAGSSTPSELG

SEQ ID NO: 273395 - protein, 10 aa, Mycobacterium
PAGSSTPTVK

SEQ ID NO: 273396 - protein, 7 aa, Mycobacterium
PAGSTFG

SEQ ID NO: 273397 - protein, 6 aa, Mycobacterium
PAGSTS

SEQ ID NO: 273398 - protein, 7 aa, Mycobacterium
PAGSTTQ

SEQ ID NO: 273399 - protein, 10 aa, Mycobacterium
PAGTAAQSAA

SEQ ID NO: 273400 - protein, 10 aa, Mycobacterium
PAGTALPEGH

SEQ ID NO: 273401 - protein, 7 aa, Mycobacterium
PAGTDIT

SEQ ID NO: 273402 - protein, 5 aa, Mycobacterium
PAGTE

SEQ ID NO: 273403 - protein, 5 aa, Mycobacterium
PAGTP

SEQ ID NO: 273404 - protein, 31 aa, Mycobacterium
PAGVPGSAATAAAPAPAPAGTTVAAPAPAAA

SEQ ID NO: 273405 - protein, 14 aa, Mycobacterium
PAGVQSQRARDVGT

SEQ ID NO: 273406 - protein, 5 aa, Mycobacterium
PAGVT

SEQ ID NO: 273407 - protein, 9 aa, Mycobacterium
PAGYAAGAL

SEQ ID NO: 273408 - protein, 68 aa, Mycobacterium
PAHAAPAPQPQAPAPQAPAPQAQAPAPQAQVPAPAPAPQAPAPRAPAPQAPAPQAQVPAPKAPAPVPV

SEQ ID NO: 273409 - protein, 5 aa, Mycobacterium
PAHAG

SEQ ID NO: 273410 - protein, 6 aa, Mycobacterium
PAHAPS

SEQ ID NO: 273411 - protein, 6 aa, Mycobacterium
PAHARQ

SEQ ID NO: 273412 - protein, 10 aa, Mycobacterium
PAHPAPPTRL

SEQ ID NO: 273413 - protein, 17 aa, Mycobacterium
PAHPGPLDPPLEDHSAG

SEQ ID NO: 273414 - protein, 17 aa, Mycobacterium
PAHPGPLGPPLEGHSAS

SEQ ID NO: 273415 - protein, 17 aa, Mycobacterium
PAHPGPLGPPLQGHSAG

SEQ ID NO: 273416 - protein, 7 aa, Mycobacterium
PAHPRRL

SEQ ID NO: 273417 - protein, 5 aa, Mycobacterium
PAHPS

SEQ ID NO: 273418 - protein, 7 aa, Mycobacterium
PAHPSPL

SEQ ID NO: 273419 - protein, 4 aa, Mycobacterium
PAHR

SEQ ID NO: 273420 - protein, 13 aa, Mycobacterium
PAHRGPQRASGLA

SEQ ID NO: 273421 - protein, 6 aa, Mycobacterium
PAHTAG

SEQ ID NO: 273422 - protein, 5 aa, Mycobacterium
PAHTP

SEQ ID NO: 273423 - protein, 4 aa, Mycobacterium
PAIA

SEQ ID NO: 273424 - protein, 7 aa, Mycobacterium
PAIGPGT

SEQ ID NO: 273425 - protein, 13 aa, Mycobacterium
PAIGPNPGGPPYG

SEQ ID NO: 273426 - protein, 14 aa, Mycobacterium
PAIGPPPSRVRPSS

SEQ ID NO: 273427 - protein, 5 aa, Mycobacterium
PAIKA

SEQ ID NO: 273428 - protein, 4 aa, Mycobacterium
PAIP

SEQ ID NO: 273429 - protein, 14 aa, Mycobacterium
PAIPPGPVYGPTPA

SEQ ID NO: 273430 - protein, 33 aa, Mycobacterium
PAIRPDAASVTEVANDSVRRPFPPLPEGHAPEI

SEQ ID NO: 273431 - protein, 31 aa, Mycobacterium
PAIRPDDAAAFGGGEPDCDLPEARRAGETQL

SEQ ID NO: 273432 - protein, 12 aa, Mycobacterium
PAISPKKSWEGL

SEQ ID NO: 273433 - protein, 7 aa, Mycobacterium
PAISSKG

SEQ ID NO: 273434 - protein, 5 aa, Mycobacterium
PAITD

SEQ ID NO: 273435 - protein, 4 aa, Mycobacterium
PAKA

SEQ ID NO: 273436 - protein, 15 aa, Mycobacterium
PAKAVDSGEPEGGGG

SEQ ID NO: 273437 - protein, 8 aa, Mycobacterium
PAKGETVE

SEQ ID NO: 273438 - protein, 4 aa, Mycobacterium
PAKK

SEQ ID NO: 273439 - protein, 4 aa, Mycobacterium
PAKL

SEQ ID NO: 273440 - protein, 7 aa, Mycobacterium
PAKLGET

SEQ ID NO: 273441 - protein, 4 aa, Mycobacterium
PAKM

SEQ ID NO: 273442 - protein, 5 aa, Mycobacterium
PAKTQ

SEQ ID NO: 273443 - protein, 4 aa, Mycobacterium
PALA

SEQ ID NO: 273444 - protein, 5 aa, Mycobacterium
PALAT

SEQ ID NO: 273445 - protein, 4 aa, Mycobacterium
PALD

SEQ ID NO: 273446 - protein, 8 aa, Mycobacterium
PALDGPDF

SEQ ID NO: 273447 - protein, 19 aa, Mycobacterium
PALEEQEDPDNVDTAPTRV

SEQ ID NO: 273448 - protein, 10 aa, Mycobacterium
PALGASAKPI

SEQ ID NO: 273449 - protein, 6 aa, Mycobacterium
PALGDR

SEQ ID NO: 273450 - protein, 9 aa, Mycobacterium
PALGSTPDN

SEQ ID NO: 273451 - protein, 8 aa, Mycobacterium
PALGTTPD

SEQ ID NO: 273452 - protein, 6 aa, Mycobacterium
PALKKT

SEQ ID NO: 273453 - protein, 6 aa, Mycobacterium
PALNDP

SEQ ID NO: 273454 - protein, 8 aa, Mycobacterium
PALPNRRN

SEQ ID NO: 273455 - protein, 6 aa, Mycobacterium
PALPRA

SEQ ID NO: 273456 - protein, 6 aa, Mycobacterium
PALQRN

SEQ ID NO: 273457 - protein, 11 aa, Mycobacterium
PALRPTAAPAH

SEQ ID NO: 273458 - protein, 9 aa, Mycobacterium
PALSSDPEF

SEQ ID NO: 273459 - protein, 9 aa, Mycobacterium
PALTAEPGR

SEQ ID NO: 273460 - protein, 9 aa, Mycobacterium
PALTDAARG

SEQ ID NO: 273461 - protein, 13 aa, Mycobacterium
PALTSEDLRTSAG

SEQ ID NO: 273462 - protein, 18 aa, Mycobacterium
PAMATERGVGTPGFAGTV

SEQ ID NO: 273463 - protein, 5 aa, Mycobacterium
PAMGT

SEQ ID NO: 273464 - protein, 6 aa, Mycobacterium
PANAGF

SEQ ID NO: 273465 - protein, 9 aa, Mycobacterium
PANAPVATS

SEQ ID NO: 273466 - protein, 11 aa, Mycobacterium
PANATGPGNIR

SEQ ID NO: 273467 - protein, 52 aa, Mycobacterium
PANEPAPPANRPPPPAPVPPPANQPPPANQPPPPASASPSPRPAPGPSHGDQ

SEQ ID NO: 273468 - protein, 5 aa, Mycobacterium
PANGG

SEQ ID NO: 273469 - protein, 6 aa, Mycobacterium
PANGGP

SEQ ID NO: 273470 - protein, 5 aa, Mycobacterium
PANPD

SEQ ID NO: 273471 - protein, 10 aa, Mycobacterium
PANPGPEPDD

SEQ ID NO: 273472 - protein, 13 aa, Mycobacterium
PANPSAPQSVSPI

SEQ ID NO: 273473 - protein, 16 aa, Mycobacterium
PANQAAAAMRPGDPAV

SEQ ID NO: 273474 - protein, 5 aa, Mycobacterium
PANQR

SEQ ID NO: 273475 - protein, 6 aa, Mycobacterium
PANRAK

SEQ ID NO: 273476 - protein, 8 aa, Mycobacterium
PANRGGKL

SEQ ID NO: 273477 - protein, 11 aa, Mycobacterium
PANRPEPPPML

SEQ ID NO: 273478 - protein, 5 aa, Mycobacterium
PANRS

SEQ ID NO: 273479 - protein, 5 aa, Mycobacterium
PANTI

SEQ ID NO: 273480 - protein, 19 aa, Mycobacterium
PANTVRGVADKPDENGGYP

SEQ ID NO: 273481 - protein, 5 aa, Mycobacterium
PANVG

SEQ ID NO: 273482 - protein, 6 aa, Mycobacterium
PANVGY

SEQ ID NO: 273483 - protein, 4 aa, Mycobacterium
PAPA

SEQ ID NO: 273484 - protein, 5 aa, Mycobacterium
PAPAA

SEQ ID NO: 273485 - protein, 30 aa, Mycobacterium
PAPAAEQDGTASTDTASADTTSTDTTSTDT

SEQ ID NO: 273486 - protein, 24 aa, Mycobacterium
PAPAEAVTPESAPPAQAPLPQPSV

SEQ ID NO: 273487 - protein, 8 aa, Mycobacterium
PAPAESDH

SEQ ID NO: 273488 - protein, 6 aa, Mycobacterium
PAPAHA

SEQ ID NO: 273489 - protein, 10 aa, Mycobacterium
PAPAHGPATA

SEQ ID NO: 273490 - protein, 7 aa, Mycobacterium
PAPAKIS

SEQ ID NO: 273491 - protein, 9 aa, Mycobacterium
PAPANHRGR

SEQ ID NO: 273492 - protein, 18 aa, Mycobacterium
PAPAPAPAPAPAPVPGAG

SEQ ID NO: 273493 - protein, 9 aa, Mycobacterium
PAPASGPTV

SEQ ID NO: 273494 - protein, 4 aa, Mycobacterium
PAPD

SEQ ID NO: 273495 - protein, 7 aa, Mycobacterium
PAPDADL

SEQ ID NO: 273496 - protein, 6 aa, Mycobacterium
PAPDPH

SEQ ID NO: 273497 - protein, 15 aa, Mycobacterium
PAPDQDDAAGSGHSL

SEQ ID NO: 273498 - protein, 7 aa, Mycobacterium
PAPDYQD

SEQ ID NO: 273499 - protein, 4 aa, Mycobacterium
PAPE

SEQ ID NO: 273500 - protein, 6 aa, Mycobacterium
PAPEGV

SEQ ID NO: 273501 - protein, 7 aa, Mycobacterium
PAPETIP

SEQ ID NO: 273502 - protein, 9 aa, Mycobacterium
PAPETPRAV

SEQ ID NO: 273503 - protein, 20 aa, Mycobacterium
PAPEYQDAERYRAPADAVEE

SEQ ID NO: 273504 - protein, 15 aa, Mycobacterium
PAPGAPGATGDPARR

SEQ ID NO: 273505 - protein, 12 aa, Mycobacterium
PAPGDPAPSALP

SEQ ID NO: 273506 - protein, 12 aa, Mycobacterium
PAPGDPTPAARP

SEQ ID NO: 273507 - protein, 15 aa, Mycobacterium
PAPGEPTTPIPAGEG

SEQ ID NO: 273508 - protein, 10 aa, Mycobacterium
PAPGGPITRG

SEQ ID NO: 273509 - protein, 23 aa, Mycobacterium
PAPGGSYAGGTPSFTKDDDGTTK

SEQ ID NO: 273510 - protein, 16 aa, Mycobacterium
PAPGGTEIHDNRSING

SEQ ID NO: 273511 - protein, 11 aa, Mycobacterium
PAPGPDEQGGL

SEQ ID NO: 273512 - protein, 43 aa, Mycobacterium
PAPGQPTALGSSVASGSPPTSKAPPPRPGAGPGSAKPKAGEAV

SEQ ID NO: 273513 - protein, 55 aa, Mycobacterium
PAPGSAVPGAPPPLRRPLTPADGVPVGPRPETAAVPADPPSHGVPAASGTTGARF

SEQ ID NO: 273514 - protein, 7 aa, Mycobacterium
PAPGTGV

SEQ ID NO: 273515 - protein, 4 aa, Mycobacterium
PAPH

SEQ ID NO: 273516 - protein, 10 aa, Mycobacterium
PAPHAGSPAC

SEQ ID NO: 273517 - protein, 9 aa, Mycobacterium
PAPHRPGDE

SEQ ID NO: 273518 - protein, 4 aa, Mycobacterium
PAPI

SEQ ID NO: 273519 - protein, 8 aa, Mycobacterium
PAPKATAA

SEQ ID NO: 273520 - protein, 30 aa, Mycobacterium
PAPLDQVDGGQPQAAPSSFGANTSKPAPSV

SEQ ID NO: 273521 - protein, 12 aa, Mycobacterium
PAPMTCPAEARR

SEQ ID NO: 273522 - protein, 20 aa, Mycobacterium
PAPNRPTSQAAAGQPDLPRA

SEQ ID NO: 273523 - protein, 14 aa, Mycobacterium
PAPPAAAVTPPTVD

SEQ ID NO: 273524 - protein, 21 aa, Mycobacterium
PAPPAGMDLGDDPEIDSESEQ

SEQ ID NO: 273525 - protein, 6 aa, Mycobacterium
PAPPAL

SEQ ID NO: 273526 - protein, 15 aa, Mycobacterium
PAPPAVLPPGQGPLL

SEQ ID NO: 273527 - protein, 7 aa, Mycobacterium
PAPPGVA

SEQ ID NO: 273528 - protein, 14 aa, Mycobacterium
PAPPPKAAERLLTA

SEQ ID NO: 273529 - protein, 60 aa, Mycobacterium
PAPPPPSSEAPATTTTTTPPPEPSTTTTTPPPSTTTTTTAPPTTTSQVTTTSAAPTTTTR

SEQ ID NO: 273530 - protein, 17 aa, Mycobacterium
PAPPPTASRPPEPRRHS

SEQ ID NO: 273531 - protein, 12 aa, Mycobacterium
PAPPQRRPGADY

SEQ ID NO: 273532 - protein, 37 aa, Mycobacterium
PAPPSEEGAPGAAPAPGPVPPAAPGQAPAGTHGGGTV

SEQ ID NO: 273533 - protein, 8 aa, Mycobacterium
PAPPTKKP

SEQ ID NO: 273534 - protein, 20 aa, Mycobacterium
PAPPVEVPPPALPPPPPTPV

SEQ ID NO: 273535 - protein, 14 aa, Mycobacterium
PAPPVPGSADPGQI

SEQ ID NO: 273536 - protein, 5 aa, Mycobacterium
PAPPW

SEQ ID NO: 273537 - protein, 4 aa, Mycobacterium
PAPQ

SEQ ID NO: 273538 - protein, 10 aa, Mycobacterium
PAPQDPTTKA

SEQ ID NO: 273539 - protein, 54 aa, Mycobacterium
PAPQHNPAPAPKQVAPAPVQAAPQAPAPAPEAPAPAAPAPVPEEQPAPVAPPPA

SEQ ID NO: 273540 - protein, 29 aa, Mycobacterium
PAPQSGSQYGATQPFGKPAETAPAGESSL

SEQ ID NO: 273541 - protein, 38 aa, Mycobacterium
PAPQSPPRVRGASQNAVATRRAEGSARGDSEAKRSKVR

SEQ ID NO: 273542 - protein, 10 aa, Mycobacterium
PAPRDSKQHV

SEQ ID NO: 273543 - protein, 6 aa, Mycobacterium
PAPRGH

SEQ ID NO: 273544 - protein, 9 aa, Mycobacterium
PAPRNSAQH

SEQ ID NO: 273545 - protein, 10 aa, Mycobacterium
PAPRNSAQHR

SEQ ID NO: 273546 - protein, 7 aa, Mycobacterium
PAPRPSI

SEQ ID NO: 273547 - protein, 29 aa, Mycobacterium
PAPRTAAERARQPRVQAPAAETDAEWSGE

SEQ ID NO: 273548 - protein, 5 aa, Mycobacterium
PAPSA

SEQ ID NO: 273549 - protein, 11 aa, Mycobacterium
PAPSDDQQLTN

SEQ ID NO: 273550 - protein, 20 aa, Mycobacterium
PAPSEPARSQRRRRTKVGQL

SEQ ID NO: 273551 - protein, 45 aa, Mycobacterium
PAPSIDTGLNPAPSDRVAGTPPPTSDPLSRPGSGTVQCNGQQPNP

SEQ ID NO: 273552 - protein, 75 aa, Mycobacterium
PAPSINNGQNPLPADELPPPASLAPVSDPVSPPGSGTVRCSGQQPNPCTYTPAQGPPGTTAGYSPSSGEVVGPDG

SEQ ID NO: 273553 - protein, 11 aa, Mycobacterium
PAPSLGLPPPL

SEQ ID NO: 273554 - protein, 7 aa, Mycobacterium
PAPSSEP

SEQ ID NO: 273555 - protein, 7 aa, Mycobacterium
PAPSTIA

SEQ ID NO: 273556 - protein, 5 aa, Mycobacterium
PAPTE

SEQ ID NO: 273557 - protein, 6 aa, Mycobacterium
PAPTMR

SEQ ID NO: 273558 - protein, 5 aa, Mycobacterium
PAPTT

SEQ ID NO: 273559 - protein, 6 aa, Mycobacterium
PAPTVR

SEQ ID NO: 273560 - protein, 6 aa, Mycobacterium
PAPTVT

SEQ ID NO: 273561 - protein, 4 aa, Mycobacterium
PAPV

SEQ ID NO: 273562 - protein, 23 aa, Mycobacterium
PAPVAPAAAAPAAAPAAAPPAAK

SEQ ID NO: 273563 - protein, 16 aa, Mycobacterium
PAPVASRRPRHRRGPL

SEQ ID NO: 273564 - protein, 20 aa, Mycobacterium
PAPVDATDLTPQQQTTPETY

SEQ ID NO: 273565 - protein, 7 aa, Mycobacterium
PAPVGST

SEQ ID NO: 273566 - protein, 6 aa, Mycobacterium
PAPVPA

SEQ ID NO: 273567 - protein, 5 aa, Mycobacterium
PAPVR

SEQ ID NO: 273568 - protein, 7 aa, Mycobacterium
PAPVRKQ

SEQ ID NO: 273569 - protein, 10 aa, Mycobacterium
PAPVYQPPGY

SEQ ID NO: 273570 - protein, 34 aa, Mycobacterium
PAPYVPPAPAYVPPPPPANYLPPAPPPAAPPYVP

SEQ ID NO: 273571 - protein, 4 aa, Mycobacterium
PAQA

SEQ ID NO: 273572 - protein, 6 aa, Mycobacterium
PAQAAD

SEQ ID NO: 273573 - protein, 6 aa, Mycobacterium
PAQAGY

SEQ ID NO: 273574 - protein, 21 aa, Mycobacterium
PAQAQPTPLPPAPLPQEVAPS

SEQ ID NO: 273575 - protein, 22 aa, Mycobacterium
PAQAVQPKPAPQAPPPSGQPAP

SEQ ID NO: 273576 - protein, 9 aa, Mycobacterium
PAQDGGQRE

SEQ ID NO: 273577 - protein, 6 aa, Mycobacterium
PAQGAL

SEQ ID NO: 273578 - protein, 6 aa, Mycobacterium
PAQGTL

SEQ ID NO: 273579 - protein, 6 aa, Mycobacterium
PAQGTV

SEQ ID NO: 273580 - protein, 11 aa, Mycobacterium
PAQLAGTGAGV

SEQ ID NO: 273581 - protein, 11 aa, Mycobacterium
PAQLPQATEVP

SEQ ID NO: 273582 - protein, 12 aa, Mycobacterium
PAQLQPTPAPPP

SEQ ID NO: 273583 - protein, 113 aa, Mycobacterium
PAQPAAQEPQQEPQQPGGTAPAPGGPAPNAGQPPESGAPASPQSGAPAAPQSGTPGRPGAQPRPYPQDPPPSPAPAPSPAPTGSPAPPATGAQQPADLPPGEEPALPDPRKDL

SEQ ID NO: 273584 - protein, 8 aa, Mycobacterium
PAQPALAA

SEQ ID NO: 273585 - protein, 5 aa, Mycobacterium
PAQPE

SEQ ID NO: 273586 - protein, 14 aa, Mycobacterium
PAQPETNGSDEGNP

SEQ ID NO: 273587 - protein, 6 aa, Mycobacterium
PAQPGL

SEQ ID NO: 273588 - protein, 7 aa, Mycobacterium
PAQPGLS

SEQ ID NO: 273589 - protein, 66 aa, Mycobacterium
PAQPNPTSAGPTAPAAASPSTPVSPLPSAPAPTSTSSTPTTSTPSPTPSTAPSTTQTAGPAVDSQG

SEQ ID NO: 273590 - protein, 12 aa, Mycobacterium
PAQPSNPYGTPS

SEQ ID NO: 273591 - protein, 6 aa, Mycobacterium
PAQPTP

SEQ ID NO: 273592 - protein, 5 aa, Mycobacterium
PAQRA

SEQ ID NO: 273593 - protein, 7 aa, Mycobacterium
PAQRAGA

SEQ ID NO: 273594 - protein, 10 aa, Mycobacterium
PAQRNQVDAE

SEQ ID NO: 273595 - protein, 12 aa, Mycobacterium
PAQRSTEGGRPL

SEQ ID NO: 273596 - protein, 5 aa, Mycobacterium
PAQRV

SEQ ID NO: 273597 - protein, 23 aa, Mycobacterium
PAQSAGSYGAATPSFAKADDGVS

SEQ ID NO: 273598 - protein, 46 aa, Mycobacterium
PAQSEPKVSTRIPDTPDAESPKAAEPVPDSADAPEAGSPERTKRSA

SEQ ID NO: 273599 - protein, 24 aa, Mycobacterium
PAQSGGSYGGATPSFAQADDAASK

SEQ ID NO: 273600 - protein, 7 aa, Mycobacterium
PAQSGIA

SEQ ID NO: 273601 - protein, 8 aa, Mycobacterium
PAQSRKAP

SEQ ID NO: 273602 - protein, 6 aa, Mycobacterium
PAQSRW

SEQ ID NO: 273603 - protein, 7 aa, Mycobacterium
PAQTGLS

SEQ ID NO: 273604 - protein, 7 aa, Mycobacterium
PAQVRDA

SEQ ID NO: 273605 - protein, 11 aa, Mycobacterium
PARAAGDSIPG

SEQ ID NO: 273606 - protein, 6 aa, Mycobacterium
PARAAN

SEQ ID NO: 273607 - protein, 13 aa, Mycobacterium
PARCDPGNPPAAV

SEQ ID NO: 273608 - protein, 7 aa, Mycobacterium
PARDATV

SEQ ID NO: 273609 - protein, 7 aa, Mycobacterium
PARDFGP

SEQ ID NO: 273610 - protein, 31 aa, Mycobacterium
PAREEAPQAAPEKTPETEPRPARNGATPREA

SEQ ID NO: 273611 - protein, 18 aa, Mycobacterium
PARENDGAADPAAAPNPV

SEQ ID NO: 273612 - protein, 11 aa, Mycobacterium
PARGDDRTRAD

SEQ ID NO: 273613 - protein, 5 aa, Mycobacterium
PARGI

SEQ ID NO: 273614 - protein, 8 aa, Mycobacterium
PARGTIGD

SEQ ID NO: 273615 - protein, 6 aa, Mycobacterium
PARGWT

SEQ ID NO: 273616 - protein, 10 aa, Mycobacterium
PARHSNGRYA

SEQ ID NO: 273617 - protein, 4 aa, Mycobacterium
PARI

SEQ ID NO: 273618 - protein, 10 aa, Mycobacterium
PARKPIPDGS

SEQ ID NO: 273619 - protein, 20 aa, Mycobacterium
PARPERSTADKAELASPYRG

SEQ ID NO: 273620 - protein, 5 aa, Mycobacterium
PARPM

SEQ ID NO: 273621 - protein, 10 aa, Mycobacterium
PARPPHRPWG

SEQ ID NO: 273622 - protein, 8 aa, Mycobacterium
PARPVRPG

SEQ ID NO: 273623 - protein, 15 aa, Mycobacterium
PARQPDTPPKPRSEG

SEQ ID NO: 273624 - protein, 9 aa, Mycobacterium
PARRAGTAA

SEQ ID NO: 273625 - protein, 7 aa, Mycobacterium
PARRFDS

SEQ ID NO: 273626 - protein, 5 aa, Mycobacterium
PARRG

SEQ ID NO: 273627 - protein, 7 aa, Mycobacterium
PARRGRA

SEQ ID NO: 273628 - protein, 5 aa, Mycobacterium
PARRL

SEQ ID NO: 273629 - protein, 10 aa, Mycobacterium
PARRPRPEIG

SEQ ID NO: 273630 - protein, 5 aa, Mycobacterium
PARRR

SEQ ID NO: 273631 - protein, 10 aa, Mycobacterium
PARRSGEGTD

SEQ ID NO: 273632 - protein, 31 aa, Mycobacterium
PARSAAPARQPAVPRPAPAASGPASATNPAW

SEQ ID NO: 273633 - protein, 6 aa, Mycobacterium
PARSLK

SEQ ID NO: 273634 - protein, 18 aa, Mycobacterium
PARSSSRGQRPPAEEQQG

SEQ ID NO: 273635 - protein, 5 aa, Mycobacterium
PARTA

SEQ ID NO: 273636 - protein, 7 aa, Mycobacterium
PARTNGG

SEQ ID NO: 273637 - protein, 7 aa, Mycobacterium
PARTRTA

SEQ ID NO: 273638 - protein, 18 aa, Mycobacterium
PARVNGPGAGADAPLGYS

SEQ ID NO: 273639 - protein, 15 aa, Mycobacterium
PARVSRQADDARTAA

SEQ ID NO: 273640 - protein, 6 aa, Mycobacterium
PARYSD

SEQ ID NO: 273641 - protein, 4 aa, Mycobacterium
PASA

SEQ ID NO: 273642 - protein, 30 aa, Mycobacterium
PASAGSKGATSKKYSEGAAAGTEDAERAPV

SEQ ID NO: 273643 - protein, 19 aa, Mycobacterium
PASAPSAPAFIETGKTAGP

SEQ ID NO: 273644 - protein, 9 aa, Mycobacterium
PASAPTPAE

SEQ ID NO: 273645 - protein, 9 aa, Mycobacterium
PASARANLS

SEQ ID NO: 273646 - protein, 12 aa, Mycobacterium
PASASARQVGDQ

SEQ ID NO: 273647 - protein, 7 aa, Mycobacterium
PASASGV

SEQ ID NO: 273648 - protein, 10 aa, Mycobacterium
PASDPTTPGA

SEQ ID NO: 273649 - protein, 20 aa, Mycobacterium
PASFGGNVGPVGSTQERGQL

SEQ ID NO: 273650 - protein, 4 aa, Mycobacterium
PASG

SEQ ID NO: 273651 - protein, 9 aa, Mycobacterium
PASGENGDQ

SEQ ID NO: 273652 - protein, 5 aa, Mycobacterium
PASGF

SEQ ID NO: 273653 - protein, 5 aa, Mycobacterium
PASGG

SEQ ID NO: 273654 - protein, 7 aa, Mycobacterium
PASGGTY

SEQ ID NO: 273655 - protein, 21 aa, Mycobacterium
PASGQLHPQAAPPPRGPKPPP

SEQ ID NO: 273656 - protein, 4 aa, Mycobacterium
PASI

SEQ ID NO: 273657 - protein, 7 aa, Mycobacterium
PASIDPD

SEQ ID NO: 273658 - protein, 6 aa, Mycobacterium
PASLTN

SEQ ID NO: 273659 - protein, 4 aa, Mycobacterium
PASN

SEQ ID NO: 273660 - protein, 9 aa, Mycobacterium
PASNSGPFL

SEQ ID NO: 273661 - protein, 4 aa, Mycobacterium
PASP

SEQ ID NO: 273662 - protein, 7 aa, Mycobacterium
PASPAQT

SEQ ID NO: 273663 - protein, 55 aa, Mycobacterium
PASPDSGESDVAPPVDGGGGVATPQASPPVSDVATPTTNSPSGDVSDDAPRPPRG

SEQ ID NO: 273664 - protein, 7 aa, Mycobacterium
PASPGPN

SEQ ID NO: 273665 - protein, 7 aa, Mycobacterium
PASPLGP

SEQ ID NO: 273666 - protein, 8 aa, Mycobacterium
PASPPEVA

SEQ ID NO: 273667 - protein, 17 aa, Mycobacterium
PASPPPVVSPNPRGRGG

SEQ ID NO: 273668 - protein, 7 aa, Mycobacterium
PASPRRQ

SEQ ID NO: 273669 - protein, 9 aa, Mycobacterium
PASPWATPP

SEQ ID NO: 273670 - protein, 11 aa, Mycobacterium
PASPWATPPPA

SEQ ID NO: 273671 - protein, 11 aa, Mycobacterium
PASPWATPPPS

SEQ ID NO: 273672 - protein, 11 aa, Mycobacterium
PASPWGTPPPA

SEQ ID NO: 273673 - protein, 6 aa, Mycobacterium
PASQAK

SEQ ID NO: 273674 - protein, 9 aa, Mycobacterium
PASQEDRSR

SEQ ID NO: 273675 - protein, 4 aa, Mycobacterium
PASR

SEQ ID NO: 273676 - protein, 8 aa, Mycobacterium
PASRGGKI

SEQ ID NO: 273677 - protein, 11 aa, Mycobacterium
PASRGGKLKTT

SEQ ID NO: 273678 - protein, 12 aa, Mycobacterium
PASRGPPERGQL

SEQ ID NO: 273679 - protein, 41 aa, Mycobacterium
PASRPGKAGDPVRRRRTAKPSAKPSSKPSQTAKQAAARPGV

SEQ ID NO: 273680 - protein, 7 aa, Mycobacterium
PASRQTM

SEQ ID NO: 273681 - protein, 7 aa, Mycobacterium
PASRSSI

SEQ ID NO: 273682 - protein, 15 aa, Mycobacterium
PASSAFSGAPTVTQQ

SEQ ID NO: 273683 - protein, 8 aa, Mycobacterium
PASSLRGE

SEQ ID NO: 273684 - protein, 9 aa, Mycobacterium
PASSLRGES

SEQ ID NO: 273685 - protein, 8 aa, Mycobacterium
PASSLRGG

SEQ ID NO: 273686 - protein, 9 aa, Mycobacterium
PASSLRGGS

SEQ ID NO: 273687 - protein, 16 aa, Mycobacterium
PASSTATERVPKSWEP

SEQ ID NO: 273688 - protein, 7 aa, Mycobacterium
PASSTIS

SEQ ID NO: 273689 - protein, 13 aa, Mycobacterium
PASTIRTERFGPS

SEQ ID NO: 273690 - protein, 7 aa, Mycobacterium
PASTPEC

SEQ ID NO: 273691 - protein, 8 aa, Mycobacterium
PASTSNEY

SEQ ID NO: 273692 - protein, 61 aa, Mycobacterium
PASVAGAGTRKGSPVTDESAGGPALDGTATTKLPRQAPDDFQPDVADDESEAAGAEPTVEE

SEQ ID NO: 273693 - protein, 13 aa, Mycobacterium
PASVGNAAAQRHF

SEQ ID NO: 273694 - protein, 25 aa, Mycobacterium
PASWAEPTEPGTTTEPGEPARTTAS

SEQ ID NO: 273695 - protein, 5 aa, Mycobacterium
PASYT

SEQ ID NO: 273696 - protein, 89 aa, Mycobacterium
PATAASPRGPHAQPPGAHWPGPQQQPASASFRQSTHQPSGPQSVYPPSGSTPIHPPSGSMPSHPSGPPPRYPTGGQPSAPHSAPQHAPQ

SEQ ID NO: 273697 - protein, 13 aa, Mycobacterium
PATAATSATGKSG

SEQ ID NO: 273698 - protein, 10 aa, Mycobacterium
PATADVSDDT

SEQ ID NO: 273699 - protein, 12 aa, Mycobacterium
PATALGGETDWA

SEQ ID NO: 273700 - protein, 6 aa, Mycobacterium
PATAQA

SEQ ID NO: 273701 - protein, 11 aa, Mycobacterium
PATASSHQVGD

SEQ ID NO: 273702 - protein, 5 aa, Mycobacterium
PATAV

SEQ ID NO: 273703 - protein, 6 aa, Mycobacterium
PATDPL

SEQ ID NO: 273704 - protein, 10 aa, Mycobacterium
PATDPTTPGA

SEQ ID NO: 273705 - protein, 139 aa, Mycobacterium
PATDRSASRQRARQSTRRDRAERAGTGAAPRKRTGERPPRRRPAAAAAADAKEPTRNGRPTKRTAPPRARRPRDPELDPTLDAPERPRRPRSARTEPPVVPPAEPRRRVRTQPREPREPRKQPPGDRLGPYERPQRRRR

SEQ ID NO: 273706 - protein, 9 aa, Mycobacterium
PATDTPGTV

SEQ ID NO: 273707 - protein, 6 aa, Mycobacterium
PATEPL

SEQ ID NO: 273708 - protein, 7 aa, Mycobacterium
PATEPLG

SEQ ID NO: 273709 - protein, 4 aa, Mycobacterium
PATF

SEQ ID NO: 273710 - protein, 8 aa, Mycobacterium
PATGANAV

SEQ ID NO: 273711 - protein, 9 aa, Mycobacterium
PATGANAVE

SEQ ID NO: 273712 - protein, 14 aa, Mycobacterium
PATGDEVDGEREPE

SEQ ID NO: 273713 - protein, 12 aa, Mycobacterium
PATGGPPKGQVQ

SEQ ID NO: 273714 - protein, 17 aa, Mycobacterium
PATGPAAAIDSDSSTAW

SEQ ID NO: 273715 - protein, 7 aa, Mycobacterium
PATGQAI

SEQ ID NO: 273716 - protein, 15 aa, Mycobacterium
PATGSFDPSGTAAIG

SEQ ID NO: 273717 - protein, 15 aa, Mycobacterium
PATGSFDPSGTSAIG

SEQ ID NO: 273718 - protein, 4 aa, Mycobacterium
PATI

SEQ ID NO: 273719 - protein, 11 aa, Mycobacterium
PATNNQQQAFK

SEQ ID NO: 273720 - protein, 7 aa, Mycobacterium
PATPGRG

SEQ ID NO: 273721 - protein, 5 aa, Mycobacterium
PATPM

SEQ ID NO: 273722 - protein, 6 aa, Mycobacterium
PATPMT

SEQ ID NO: 273723 - protein, 6 aa, Mycobacterium
PATPPR

SEQ ID NO: 273724 - protein, 9 aa, Mycobacterium
PATPRGQRS

SEQ ID NO: 273725 - protein, 7 aa, Mycobacterium
PATPVAD

SEQ ID NO: 273726 - protein, 6 aa, Mycobacterium
PATRAA

SEQ ID NO: 273727 - protein, 9 aa, Mycobacterium
PATREPQTI

SEQ ID NO: 273728 - protein, 17 aa, Mycobacterium
PATRPQQTPNTQLTGAL

SEQ ID NO: 273729 - protein, 8 aa, Mycobacterium
PATRPSIG

SEQ ID NO: 273730 - protein, 5 aa, Mycobacterium
PATRW

SEQ ID NO: 273731 - protein, 8 aa, Mycobacterium
PATSAARV

SEQ ID NO: 273732 - protein, 6 aa, Mycobacterium
PATSGA

SEQ ID NO: 273733 - protein, 10 aa, Mycobacterium
PATSGTVRYD

SEQ ID NO: 273734 - protein, 21 aa, Mycobacterium
PATTPAPHGVSQRHRDSRPAS

SEQ ID NO: 273735 - protein, 8 aa, Mycobacterium
PATTSNEY

SEQ ID NO: 273736 - protein, 18 aa, Mycobacterium
PATVEGANGLSDDPGTAA

SEQ ID NO: 273737 - protein, 5 aa, Mycobacterium
PATVG

SEQ ID NO: 273738 - protein, 6 aa, Mycobacterium
PATVSP

SEQ ID NO: 273739 - protein, 7 aa, Mycobacterium
PAVAGSR

SEQ ID NO: 273740 - protein, 7 aa, Mycobacterium
PAVARPR

SEQ ID NO: 273741 - protein, 5 aa, Mycobacterium
PAVAS

SEQ ID NO: 273742 - protein, 15 aa, Mycobacterium
PAVATAAPPPPPPVE

SEQ ID NO: 273743 - protein, 9 aa, Mycobacterium
PAVDPDASA

SEQ ID NO: 273744 - protein, 4 aa, Mycobacterium
PAVG

SEQ ID NO: 273745 - protein, 5 aa, Mycobacterium
PAVGS

SEQ ID NO: 273746 - protein, 4 aa, Mycobacterium
PAVK

SEQ ID NO: 273747 - protein, 7 aa, Mycobacterium
PAVNDPY

SEQ ID NO: 273748 - protein, 21 aa, Mycobacterium
PAVPAAEAAEAAEPSEVKGAV

SEQ ID NO: 273749 - protein, 23 aa, Mycobacterium
PAVPAAQAAEGRTDDDVKGAVQQ

SEQ ID NO: 273750 - protein, 5 aa, Mycobacterium
PAVPD

SEQ ID NO: 273751 - protein, 5 aa, Mycobacterium
PAVPE

SEQ ID NO: 273752 - protein, 7 aa, Mycobacterium
PAVPGRS

SEQ ID NO: 273753 - protein, 8 aa, Mycobacterium
PAVPQTGV

SEQ ID NO: 273754 - protein, 11 aa, Mycobacterium
PAVPRDPRDSA

SEQ ID NO: 273755 - protein, 15 aa, Mycobacterium
PAVSPNPSSSRVKPA

SEQ ID NO: 273756 - protein, 4 aa, Mycobacterium
PAVT

SEQ ID NO: 273757 - protein, 9 aa, Mycobacterium
PAVTGADGR

SEQ ID NO: 273758 - protein, 12 aa, Mycobacterium
PAVTSSKAANWA

SEQ ID NO: 273759 - protein, 5 aa, Mycobacterium
PAWTT

SEQ ID NO: 273760 - protein, 9 aa, Mycobacterium
PAYAGSAAD

SEQ ID NO: 273761 - protein, 27 aa, Mycobacterium
PAYAPTYGGGGAIDPYDAGDADDAPTE

SEQ ID NO: 273762 - protein, 9 aa, Mycobacterium
PAYEEQHRQ

SEQ ID NO: 273763 - protein, 40 aa, Mycobacterium
PAYPPYGYDPYASGQYGSGQYGGFPPAGPPPEPEPEDREP

SEQ ID NO: 273764 - protein, 40 aa, Mycobacterium
PAYPPYGYNPTADPNATGQYPPQYPPHGPGPEPPQDPKSP

SEQ ID NO: 273765 - protein, 17 aa, Mycobacterium
PAYTDGKALQDGASLGL

SEQ ID NO: 273766 - protein, 6 aa, Mycobacterium
PAYTGG

SEQ ID NO: 273767 - protein, 12 aa, Mycobacterium
PAYTGGNTLPDN

SEQ ID NO: 273768 - protein, 4 aa, Mycobacterium
PCGD

SEQ ID NO: 273769 - protein, 6 aa, Mycobacterium
PCGYQK

SEQ ID NO: 273770 - protein, 15 aa, Mycobacterium
PCLQQSGTGNGAQRV

SEQ ID NO: 273771 - protein, 99 aa, Mycobacterium
PCPAPRATSPPESSAPSTASETPGQPSVTSSPASTTPPTPSASTTPTTTSGSTAATSTPPTGTSPAAPTSPTPTLTTSSPNVTALPPPPPQPGIDCRAV

SEQ ID NO: 273772 - protein, 13 aa, Mycobacterium
PCPDPARAHESRT

SEQ ID NO: 273773 - protein, 4 aa, Mycobacterium
PCSP

SEQ ID NO: 273774 - protein, 6 aa, Mycobacterium
PCSYQK

SEQ ID NO: 273775 - protein, 10 aa, Mycobacterium
PDAAAADGGF

SEQ ID NO: 273776 - protein, 9 aa, Mycobacterium
PDAAAETVQ

SEQ ID NO: 273777 - protein, 9 aa, Mycobacterium
PDAAGSGNL

SEQ ID NO: 273778 - protein, 8 aa, Mycobacterium
PDAAPTPP

SEQ ID NO: 273779 - protein, 8 aa, Mycobacterium
PDAARAEF

SEQ ID NO: 273780 - protein, 5 aa, Mycobacterium
PDAAT

SEQ ID NO: 273781 - protein, 9 aa, Mycobacterium
PDAATRGTR

SEQ ID NO: 273782 - protein, 47 aa, Mycobacterium
PDADPDPGTPMVGPPPPGVVPGPGPAPHQPAFAPPPPNDNGPPPPFT

SEQ ID NO: 273783 - protein, 6 aa, Mycobacterium
PDADPH

SEQ ID NO: 273784 - protein, 6 aa, Mycobacterium
PDAEKQ

SEQ ID NO: 273785 - protein, 6 aa, Mycobacterium
PDAEPR

SEQ ID NO: 273786 - protein, 8 aa, Mycobacterium
PDAEVDED

SEQ ID NO: 273787 - protein, 8 aa, Mycobacterium
PDAGAAPQ

SEQ ID NO: 273788 - protein, 10 aa, Mycobacterium
PDAGATGEMP

SEQ ID NO: 273789 - protein, 10 aa, Mycobacterium
PDAGGAPGTV

SEQ ID NO: 273790 - protein, 22 aa, Mycobacterium
PDAGGNPADPGEYADGQQRERR

SEQ ID NO: 273791 - protein, 9 aa, Mycobacterium
PDAGGPRDL

SEQ ID NO: 273792 - protein, 16 aa, Mycobacterium
PDAGLASTTTPAPTIG

SEQ ID NO: 273793 - protein, 9 aa, Mycobacterium
PDAGTGGSS

SEQ ID NO: 273794 - protein, 5 aa, Mycobacterium
PDAIN

SEQ ID NO: 273795 - protein, 12 aa, Mycobacterium
PDAKDGAGNPIP

SEQ ID NO: 273796 - protein, 6 aa, Mycobacterium
PDAKGG

SEQ ID NO: 273797 - protein, 5 aa, Mycobacterium
PDAMP

SEQ ID NO: 273798 - protein, 6 aa, Mycobacterium
PDANAQ

SEQ ID NO: 273799 - protein, 16 aa, Mycobacterium
PDAPAAQIQAAAGQAQ

SEQ ID NO: 273800 - protein, 10 aa, Mycobacterium
PDAPPLPTDV

SEQ ID NO: 273801 - protein, 7 aa, Mycobacterium
PDAPPRH

SEQ ID NO: 273802 - protein, 4 aa, Mycobacterium
PDAQ

SEQ ID NO: 273803 - protein, 7 aa, Mycobacterium
PDAQRGQ

SEQ ID NO: 273804 - protein, 5 aa, Mycobacterium
PDARI

SEQ ID NO: 273805 - protein, 15 aa, Mycobacterium
PDASADDPTCDNDPC

SEQ ID NO: 273806 - protein, 8 aa, Mycobacterium
PDASAEAG

SEQ ID NO: 273807 - protein, 12 aa, Mycobacterium
PDASPDASAPSN

SEQ ID NO: 273808 - protein, 10 aa, Mycobacterium
PDATAGAPLV

SEQ ID NO: 273809 - protein, 9 aa, Mycobacterium
PDATGISDA

SEQ ID NO: 273810 - protein, 74 aa, Mycobacterium
PDATPGQPAKKPPADKAAKTPAKKTPAKKTPAKKAPAQKAPAKKAPAKKAPAKKAPATKPPAQSPEPAPQPTAL

SEQ ID NO: 273811 - protein, 9 aa, Mycobacterium
PDATQQQVE

SEQ ID NO: 273812 - protein, 4 aa, Mycobacterium
PDAV

SEQ ID NO: 273813 - protein, 12 aa, Mycobacterium
PDAVDKPDLQGA

SEQ ID NO: 273814 - protein, 18 aa, Mycobacterium
PDAVRRSRGEPDGELPRI

SEQ ID NO: 273815 - protein, 27 aa, Mycobacterium
PDAVTAPQAAEPAGPPPATQEHDPHSQ

SEQ ID NO: 273816 - protein, 10 aa, Mycobacterium
PDAVTQRGGH

SEQ ID NO: 273817 - protein, 8 aa, Mycobacterium
PDDAASVQ

SEQ ID NO: 273818 - protein, 10 aa, Mycobacterium
PDDAAVDEQL

SEQ ID NO: 273819 - protein, 15 aa, Mycobacterium
PDDADAVPKAGNSVE

SEQ ID NO: 273820 - protein, 7 aa, Mycobacterium
PDDAPRT

SEQ ID NO: 273821 - protein, 9 aa, Mycobacterium
PDDASSFGD

SEQ ID NO: 273822 - protein, 17 aa, Mycobacterium
PDDDAQGAALTQATGRR

SEQ ID NO: 273823 - protein, 22 aa, Mycobacterium
PDDDEDLVDGDEPADEGSVAKD

SEQ ID NO: 273824 - protein, 6 aa, Mycobacterium
PDDDGV

SEQ ID NO: 273825 - protein, 27 aa, Mycobacterium
PDDDSDGDLDAESPEISEISESHTAKE

SEQ ID NO: 273826 - protein, 9 aa, Mycobacterium
PDDEFNRDR

SEQ ID NO: 273827 - protein, 14 aa, Mycobacterium
PDDEIRRQDALPEA

SEQ ID NO: 273828 - protein, 127 aa, Mycobacterium
PDDGAAAPPPEPPEKQPPAEAAKKAAKAPAKKAPAKKAAAKKAPAKKAPAKKAAAKKAPAKKAPAKAAPPPAKAAEPKPELQQRIESNGDLAAAAKDVAAQAKSTVDAANNPVPAGAPAAGPGQSPM

SEQ ID NO: 273829 - protein, 5 aa, Mycobacterium
PDDGR

SEQ ID NO: 273830 - protein, 5 aa, Mycobacterium
PDDID

SEQ ID NO: 273831 - protein, 6 aa, Mycobacterium
PDDLAD

SEQ ID NO: 273832 - protein, 7 aa, Mycobacterium
PDDLADG

SEQ ID NO: 273833 - protein, 5 aa, Mycobacterium
PDDLQ

SEQ ID NO: 273834 - protein, 11 aa, Mycobacterium
PDDMSPGSPRV

SEQ ID NO: 273835 - protein, 11 aa, Mycobacterium
PDDNSVYGDTR

SEQ ID NO: 273836 - protein, 10 aa, Mycobacterium
PDDPARGAIT

SEQ ID NO: 273837 - protein, 29 aa, Mycobacterium
PDDPPPAPVTAPETVAEPIEEAPAEAEVE

SEQ ID NO: 273838 - protein, 7 aa, Mycobacterium
PDDPRVA

SEQ ID NO: 273839 - protein, 6 aa, Mycobacterium
PDDQQM

SEQ ID NO: 273840 - protein, 4 aa, Mycobacterium
PDDR

SEQ ID NO: 273841 - protein, 10 aa, Mycobacterium
PDDRASRADF

SEQ ID NO: 273842 - protein, 13 aa, Mycobacterium
PDDSPGPIPGRPV

SEQ ID NO: 273843 - protein, 4 aa, Mycobacterium
PDDT

SEQ ID NO: 273844 - protein, 22 aa, Mycobacterium
PDDTDQPEHRRGSFGRPAPGFE

SEQ ID NO: 273845 - protein, 9 aa, Mycobacterium
PDDYPSAVN

SEQ ID NO: 273846 - protein, 9 aa, Mycobacterium
PDDYPSSLK

SEQ ID NO: 273847 - protein, 8 aa, Mycobacterium
PDEAAAAE

SEQ ID NO: 273848 - protein, 13 aa, Mycobacterium
PDEAEKVDGDRTI

SEQ ID NO: 273849 - protein, 9 aa, Mycobacterium
PDEAQRQSR

SEQ ID NO: 273850 - protein, 6 aa, Mycobacterium
PDEEAR

SEQ ID NO: 273851 - protein, 7 aa, Mycobacterium
PDEERDE

SEQ ID NO: 273852 - protein, 14 aa, Mycobacterium
PDEETVAESTQPVR

SEQ ID NO: 273853 - protein, 6 aa, Mycobacterium
PDEGPW

SEQ ID NO: 273854 - protein, 4 aa, Mycobacterium
PDEH

SEQ ID NO: 273855 - protein, 19 aa, Mycobacterium
PDEKQGVASAVNDTSREMG

SEQ ID NO: 273856 - protein, 19 aa, Mycobacterium
PDEKQGVASAVNDTTREVG

SEQ ID NO: 273857 - protein, 7 aa, Mycobacterium
PDEKQMQ

SEQ ID NO: 273858 - protein, 7 aa, Mycobacterium
PDEPPAI

SEQ ID NO: 273859 - protein, 8 aa, Mycobacterium
PDERADEM

SEQ ID NO: 273860 - protein, 5 aa, Mycobacterium
PDERK

SEQ ID NO: 273861 - protein, 18 aa, Mycobacterium
PDERKRPANNGSARPPVK

SEQ ID NO: 273862 - protein, 19 aa, Mycobacterium
PDERKRPVTDGRAARPPVT

SEQ ID NO: 273863 - protein, 8 aa, Mycobacterium
PDERLGEH

SEQ ID NO: 273864 - protein, 26 aa, Mycobacterium
PDESRGAVRQVDSPGTVTAARGDGEL

SEQ ID NO: 273865 - protein, 13 aa, Mycobacterium
PDETGAVPAGALA

SEQ ID NO: 273866 - protein, 17 aa, Mycobacterium
PDEVAPGPTDSSIPQGR

SEQ ID NO: 273867 - protein, 11 aa, Mycobacterium
PDEYAAEQQDW

SEQ ID NO: 273868 - protein, 6 aa, Mycobacterium
PDEYRR

SEQ ID NO: 273869 - protein, 15 aa, Mycobacterium
PDEYRRQSVAAGTPL

SEQ ID NO: 273870 - protein, 5 aa, Mycobacterium
PDEYS

SEQ ID NO: 273871 - protein, 56 aa, Mycobacterium
PDFADSDDDPGTQSWTPDFSDDTGERPAATDEPPAPEPAPEPAAEGPGADDESAIA

SEQ ID NO: 273872 - protein, 7 aa, Mycobacterium
PDFATAT

SEQ ID NO: 273873 - protein, 11 aa, Mycobacterium
PDFESEGSEAV

SEQ ID NO: 273874 - protein, 10 aa, Mycobacterium
PDFGQRSNSG

SEQ ID NO: 273875 - protein, 5 aa, Mycobacterium
PDFQR

SEQ ID NO: 273876 - protein, 8 aa, Mycobacterium
PDFSGAQT

SEQ ID NO: 273877 - protein, 4 aa, Mycobacterium
PDFT

SEQ ID NO: 273878 - protein, 10 aa, Mycobacterium
PDFTPNTGPV

SEQ ID NO: 273879 - protein, 5 aa, Mycobacterium
PDGAA

SEQ ID NO: 273880 - protein, 22 aa, Mycobacterium
PDGADTIVGEAGSALSGGERQR

SEQ ID NO: 273881 - protein, 22 aa, Mycobacterium
PDGADTVVGEAGSALSGGERQR

SEQ ID NO: 273882 - protein, 9 aa, Mycobacterium
PDGAGSEPL

SEQ ID NO: 273883 - protein, 112 aa, Mycobacterium
PDGAGTPPEKKPPAKAAKKTAKAPAKKAPAKKAPAKKAPAKKAPAKKAPAKNAEPAPPGPPEPPAGVQQRAETNGDLTAAAKDAAAQAKSTVEAANNPVSPAVPGPAVGQSP

SEQ ID NO: 273884 - protein, 5 aa, Mycobacterium
PDGAS

SEQ ID NO: 273885 - protein, 9 aa, Mycobacterium
PDGASYPAD

SEQ ID NO: 273886 - protein, 6 aa, Mycobacterium
PDGDSL

SEQ ID NO: 273887 - protein, 8 aa, Mycobacterium
PDGEKDPE

SEQ ID NO: 273888 - protein, 9 aa, Mycobacterium
PDGENPPDE

SEQ ID NO: 273889 - protein, 4 aa, Mycobacterium
PDGG

SEQ ID NO: 273890 - protein, 7 aa, Mycobacterium
PDGGAFD

SEQ ID NO: 273891 - protein, 12 aa, Mycobacterium
PDGGASTPAHSQ

SEQ ID NO: 273892 - protein, 22 aa, Mycobacterium
PDGGVVAPEGGWHSTGDRGYLD

SEQ ID NO: 273893 - protein, 5 aa, Mycobacterium
PDGHR

SEQ ID NO: 273894 - protein, 5 aa, Mycobacterium
PDGHS

SEQ ID NO: 273895 - protein, 8 aa, Mycobacterium
PDGHSPGL

SEQ ID NO: 273896 - protein, 14 aa, Mycobacterium
PDGHTLASGSDDGT

SEQ ID NO: 273897 - protein, 14 aa, Mycobacterium
PDGHTLASGSHDGT

SEQ ID NO: 273898 - protein, 13 aa, Mycobacterium
PDGHTLTTGSHDG

SEQ ID NO: 273899 - protein, 10 aa, Mycobacterium
PDGKAAAVQK

SEQ ID NO: 273900 - protein, 7 aa, Mycobacterium
PDGKAAK

SEQ ID NO: 273901 - protein, 5 aa, Mycobacterium
PDGKS

SEQ ID NO: 273902 - protein, 7 aa, Mycobacterium
PDGKSSR

SEQ ID NO: 273903 - protein, 5 aa, Mycobacterium
PDGMP

SEQ ID NO: 273904 - protein, 5 aa, Mycobacterium
PDGND

SEQ ID NO: 273905 - protein, 5 aa, Mycobacterium
PDGNS

SEQ ID NO: 273906 - protein, 14 aa, Mycobacterium
PDGNVWSTGDPTVR

SEQ ID NO: 273907 - protein, 4 aa, Mycobacterium
PDGP

SEQ ID NO: 273908 - protein, 9 aa, Mycobacterium
PDGPEKAPF

SEQ ID NO: 273909 - protein, 15 aa, Mycobacterium
PDGPLPSSVDTARTA

SEQ ID NO: 273910 - protein, 7 aa, Mycobacterium
PDGPLTK

SEQ ID NO: 273911 - protein, 7 aa, Mycobacterium
PDGPLTN

SEQ ID NO: 273912 - protein, 7 aa, Mycobacterium
PDGPLTR

SEQ ID NO: 273913 - protein, 7 aa, Mycobacterium
PDGPLTS

SEQ ID NO: 273914 - protein, 24 aa, Mycobacterium
PDGPPPQPAPAAAGAVELQGQEPA

SEQ ID NO: 273915 - protein, 12 aa, Mycobacterium
PDGPVKPPQQLS

SEQ ID NO: 273916 - protein, 12 aa, Mycobacterium
PDGQDYSRETGN

SEQ ID NO: 273917 - protein, 15 aa, Mycobacterium
PDGQLQYRGRADDQV

SEQ ID NO: 273918 - protein, 9 aa, Mycobacterium
PDGQNPPDE

SEQ ID NO: 273919 - protein, 10 aa, Mycobacterium
PDGQNPPDEV

SEQ ID NO: 273920 - protein, 6 aa, Mycobacterium
PDGQTL

SEQ ID NO: 273921 - protein, 9 aa, Mycobacterium
PDGQTRSQT

SEQ ID NO: 273922 - protein, 9 aa, Mycobacterium
PDGQTRTQT

SEQ ID NO: 273923 - protein, 16 aa, Mycobacterium
PDGRGGASRHGEDEVR

SEQ ID NO: 273924 - protein, 15 aa, Mycobacterium
PDGRHIASASSDGTV

SEQ ID NO: 273925 - protein, 10 aa, Mycobacterium
PDGRKRSETI

SEQ ID NO: 273926 - protein, 12 aa, Mycobacterium
PDGRPGRGITRD

SEQ ID NO: 273927 - protein, 5 aa, Mycobacterium
PDGRR

SEQ ID NO: 273928 - protein, 16 aa, Mycobacterium
PDGRRIAADEDTVAGT

SEQ ID NO: 273929 - protein, 5 aa, Mycobacterium
PDGRS

SEQ ID NO: 273930 - protein, 9 aa, Mycobacterium
PDGSGGQRY

SEQ ID NO: 273931 - protein, 14 aa, Mycobacterium
PDGSPGPTAGRPVS

SEQ ID NO: 273932 - protein, 6 aa, Mycobacterium
PDGSTV

SEQ ID NO: 273933 - protein, 6 aa, Mycobacterium
PDGSVA

SEQ ID NO: 273934 - protein, 7 aa, Mycobacterium
PDGSYSK

SEQ ID NO: 273935 - protein, 4 aa, Mycobacterium
PDGT

SEQ ID NO: 273936 - protein, 5 aa, Mycobacterium
PDGTF

SEQ ID NO: 273937 - protein, 9 aa, Mycobacterium
PDGTGHTDV

SEQ ID NO: 273938 - protein, 8 aa, Mycobacterium
PDGTNGEA

SEQ ID NO: 273939 - protein, 55 aa, Mycobacterium
PDGTPRPPAKKQPAKKAAKAPAKKTPAKKTPAKKAPAKKAPAKKAPAGNPEPAAA

SEQ ID NO: 273940 - protein, 6 aa, Mycobacterium
PDGTPV

SEQ ID NO: 273941 - protein, 14 aa, Mycobacterium
PDGTRIVSGGDDQT

SEQ ID NO: 273942 - protein, 46 aa, Mycobacterium
PDGTRVPMPGTTTQDTTLAASEHGAASELGETSTAPPTPAATPTEQ

SEQ ID NO: 273943 - protein, 6 aa, Mycobacterium
PDGTYP

SEQ ID NO: 273944 - protein, 15 aa, Mycobacterium
PDGVLPEGEPFTAQG

SEQ ID NO: 273945 - protein, 6 aa, Mycobacterium
PDGVPG

SEQ ID NO: 273946 - protein, 12 aa, Mycobacterium
PDGVRSESARRV

SEQ ID NO: 273947 - protein, 7 aa, Mycobacterium
PDGVSDE

SEQ ID NO: 273948 - protein, 10 aa, Mycobacterium
PDGYANTTIN

SEQ ID NO: 273949 - protein, 10 aa, Mycobacterium
PDGYATPVGA

SEQ ID NO: 273950 - protein, 19 aa, Mycobacterium
PDGYDTKIADDGGNISAGE

SEQ ID NO: 273951 - protein, 18 aa, Mycobacterium
PDGYDTRISDEGGDVSVG

SEQ ID NO: 273952 - protein, 19 aa, Mycobacterium
PDGYETRISGDGSNISAGE

SEQ ID NO: 273953 - protein, 19 aa, Mycobacterium
PDGYQTRVSGDGANISAGE

SEQ ID NO: 273954 - protein, 6 aa, Mycobacterium
PDGYSD

SEQ ID NO: 273955 - protein, 4 aa, Mycobacterium
PDHA

SEQ ID NO: 273956 - protein, 17 aa, Mycobacterium
PDHDDHPSARDGGTARV

SEQ ID NO: 273957 - protein, 5 aa, Mycobacterium
PDHDT

SEQ ID NO: 273958 - protein, 8 aa, Mycobacterium
PDHDTLGG

SEQ ID NO: 273959 - protein, 5 aa, Mycobacterium
PDHGA

SEQ ID NO: 273960 - protein, 5 aa, Mycobacterium
PDHIS

SEQ ID NO: 273961 - protein, 5 aa, Mycobacterium
PDHQG

SEQ ID NO: 273962 - protein, 4 aa, Mycobacterium
PDHR

SEQ ID NO: 273963 - protein, 7 aa, Mycobacterium
PDHRETY

SEQ ID NO: 273964 - protein, 6 aa, Mycobacterium
PDIEPV

SEQ ID NO: 273965 - protein, 7 aa, Mycobacterium
PDIEPVQ

SEQ ID NO: 273966 - protein, 5 aa, Mycobacterium
PDIGP

SEQ ID NO: 273967 - protein, 6 aa, Mycobacterium
PDIGRS

SEQ ID NO: 273968 - protein, 12 aa, Mycobacterium
PDIPTKQNGGSF

SEQ ID NO: 273969 - protein, 13 aa, Mycobacterium
PDKARAALAQGTF

SEQ ID NO: 273970 - protein, 8 aa, Mycobacterium
PDKARAAV

SEQ ID NO: 273971 - protein, 8 aa, Mycobacterium
PDKFPADT

SEQ ID NO: 273972 - protein, 11 aa, Mycobacterium
PDKGPPVSRTD

SEQ ID NO: 273973 - protein, 6 aa, Mycobacterium
PDKIST

SEQ ID NO: 273974 - protein, 9 aa, Mycobacterium
PDKKRGKYG

SEQ ID NO: 273975 - protein, 5 aa, Mycobacterium
PDKPI

SEQ ID NO: 273976 - protein, 8 aa, Mycobacterium
PDKRQKSD

SEQ ID NO: 273977 - protein, 7 aa, Mycobacterium
PDKTPDF

SEQ ID NO: 273978 - protein, 8 aa, Mycobacterium
PDLATRPI

SEQ ID NO: 273979 - protein, 4 aa, Mycobacterium
PDLD

SEQ ID NO: 273980 - protein, 7 aa, Mycobacterium
PDLDPPA

SEQ ID NO: 273981 - protein, 7 aa, Mycobacterium
PDLESGD

SEQ ID NO: 273982 - protein, 7 aa, Mycobacterium
PDLESPD

SEQ ID NO: 273983 - protein, 11 aa, Mycobacterium
PDLGPLADPAR

SEQ ID NO: 273984 - protein, 6 aa, Mycobacterium
PDLPAD

SEQ ID NO: 273985 - protein, 9 aa, Mycobacterium
PDLPDREGH

SEQ ID NO: 273986 - protein, 10 aa, Mycobacterium
PDLPNPSGTL

SEQ ID NO: 273987 - protein, 5 aa, Mycobacterium
PDLPT

SEQ ID NO: 273988 - protein, 12 aa, Mycobacterium
PDLPTKQNGGSF

SEQ ID NO: 273989 - protein, 9 aa, Mycobacterium
PDLQAKAVP

SEQ ID NO: 273990 - protein, 11 aa, Mycobacterium
PDLQSNPNSLD

SEQ ID NO: 273991 - protein, 7 aa, Mycobacterium
PDLSGGV

SEQ ID NO: 273992 - protein, 7 aa, Mycobacterium
PDLSGKA

SEQ ID NO: 273993 - protein, 7 aa, Mycobacterium
PDLSGLP

SEQ ID NO: 273994 - protein, 4 aa, Mycobacterium
PDMD

SEQ ID NO: 273995 - protein, 11 aa, Mycobacterium
PDMSPGGRPWT

SEQ ID NO: 273996 - protein, 4 aa, Mycobacterium
PDMV

SEQ ID NO: 273997 - protein, 5 aa, Mycobacterium
PDNAG

SEQ ID NO: 273998 - protein, 14 aa, Mycobacterium
PDNDPMDSGYQARQ

SEQ ID NO: 273999 - protein, 14 aa, Mycobacterium
PDNDPQDSGYQARQ

SEQ ID NO: 274000 - protein, 11 aa, Mycobacterium
PDNGPPRTRYG

SEQ ID NO: 274001 - protein, 20 aa, Mycobacterium
PDNKQGSTGASGQPTAQPPM

SEQ ID NO: 274002 - protein, 5 aa, Mycobacterium
PDNLG

SEQ ID NO: 274003 - protein, 34 aa, Mycobacterium
PDNPGTGDSARPAGASLVDPEDDLPSASYGGDFE

SEQ ID NO: 274004 - protein, 8 aa, Mycobacterium
PDNPNEPG

SEQ ID NO: 274005 - protein, 11 aa, Mycobacterium
PDNPPGEPRAD

SEQ ID NO: 274006 - protein, 10 aa, Mycobacterium
PDNTPNRNKQ

SEQ ID NO: 274007 - protein, 4 aa, Mycobacterium
PDPA

SEQ ID NO: 274008 - protein, 20 aa, Mycobacterium
PDPAAEAEKQTEEADEGTPI

SEQ ID NO: 274009 - protein, 9 aa, Mycobacterium
PDPALNSQS

SEQ ID NO: 274010 - protein, 8 aa, Mycobacterium
PDPAPQPL

SEQ ID NO: 274011 - protein, 5 aa, Mycobacterium
PDPAR

SEQ ID NO: 274012 - protein, 6 aa, Mycobacterium
PDPARA

SEQ ID NO: 274013 - protein, 8 aa, Mycobacterium
PDPARRAK

SEQ ID NO: 274014 - protein, 6 aa, Mycobacterium
PDPASA

SEQ ID NO: 274015 - protein, 5 aa, Mycobacterium
PDPAT

SEQ ID NO: 274016 - protein, 15 aa, Mycobacterium
PDPDAESDEKAEERD

SEQ ID NO: 274017 - protein, 13 aa, Mycobacterium
PDPDARGKTYTRR

SEQ ID NO: 274018 - protein, 8 aa, Mycobacterium
PDPDTPAL

SEQ ID NO: 274019 - protein, 12 aa, Mycobacterium
PDPEADDTIEEL

SEQ ID NO: 274020 - protein, 6 aa, Mycobacterium
PDPEPA

SEQ ID NO: 274021 - protein, 13 aa, Mycobacterium
PDPEPPPPAPLEA

SEQ ID NO: 274022 - protein, 7 aa, Mycobacterium
PDPERGQ

SEQ ID NO: 274023 - protein, 8 aa, Mycobacterium
PDPGGPYA

SEQ ID NO: 274024 - protein, 5 aa, Mycobacterium
PDPGM

SEQ ID NO: 274025 - protein, 7 aa, Mycobacterium
PDPGNEI

SEQ ID NO: 274026 - protein, 5 aa, Mycobacterium
PDPGR

SEQ ID NO: 274027 - protein, 9 aa, Mycobacterium
PDPHGAGQR

SEQ ID NO: 274028 - protein, 6 aa, Mycobacterium
PDPKRA

SEQ ID NO: 274029 - protein, 6 aa, Mycobacterium
PDPLNG

SEQ ID NO: 274030 - protein, 7 aa, Mycobacterium
PDPLNGL

SEQ ID NO: 274031 - protein, 53 aa, Mycobacterium
PDPNGERHENGAPPAAPTPLEGTPEHPGPAVPPGSPCSYTPPADGIPSPGNPL

SEQ ID NO: 274032 - protein, 36 aa, Mycobacterium
PDPNGTRFPNGAPPPAPPVREGTPDHPGPAVPPGTA

SEQ ID NO: 274033 - protein, 7 aa, Mycobacterium
PDPQRGQ

SEQ ID NO: 274034 - protein, 5 aa, Mycobacterium
PDPRA

SEQ ID NO: 274035 - protein, 6 aa, Mycobacterium
PDPRYA

SEQ ID NO: 274036 - protein, 5 aa, Mycobacterium
PDPSL

SEQ ID NO: 274037 - protein, 9 aa, Mycobacterium
PDPSSHSRC

SEQ ID NO: 274038 - protein, 5 aa, Mycobacterium
PDPST

SEQ ID NO: 274039 - protein, 6 aa, Mycobacterium
PDPSTN

SEQ ID NO: 274040 - protein, 4 aa, Mycobacterium
PDPT

SEQ ID NO: 274041 - protein, 10 aa, Mycobacterium
PDPTNPDQTQ

SEQ ID NO: 274042 - protein, 19 aa, Mycobacterium
PDPTPLPAPPAKPKSRVAP

SEQ ID NO: 274043 - protein, 7 aa, Mycobacterium
PDQAARA

SEQ ID NO: 274044 - protein, 7 aa, Mycobacterium
PDQERGQ

SEQ ID NO: 274045 - protein, 4 aa, Mycobacterium
PDQG

SEQ ID NO: 274046 - protein, 11 aa, Mycobacterium
PDQGDGLHSSG

SEQ ID NO: 274047 - protein, 12 aa, Mycobacterium
PDQGDRLDSSGS

SEQ ID NO: 274048 - protein, 7 aa, Mycobacterium
PDQGRKI

SEQ ID NO: 274049 - protein, 18 aa, Mycobacterium
PDQITQGGPDAQAWDPTS

SEQ ID NO: 274050 - protein, 5 aa, Mycobacterium
PDQKW

SEQ ID NO: 274051 - protein, 8 aa, Mycobacterium
PDQMARGS

SEQ ID NO: 274052 - protein, 10 aa, Mycobacterium
PDQQEPAGPI

SEQ ID NO: 274053 - protein, 14 aa, Mycobacterium
PDQQTDDAAARDAI

SEQ ID NO: 274054 - protein, 7 aa, Mycobacterium
PDQRERK

SEQ ID NO: 274055 - protein, 5 aa, Mycobacterium
PDQTA

SEQ ID NO: 274056 - protein, 17 aa, Mycobacterium
PDQTRTRAGSEDMDDEL

SEQ ID NO: 274057 - protein, 6 aa, Mycobacterium
PDQVNK

SEQ ID NO: 274058 - protein, 7 aa, Mycobacterium
PDQVNTL

SEQ ID NO: 274059 - protein, 5 aa, Mycobacterium
PDQVP

SEQ ID NO: 274060 - protein, 10 aa, Mycobacterium
PDRAPGLVGD

SEQ ID NO: 274061 - protein, 11 aa, Mycobacterium
PDRAPTLPEAA

SEQ ID NO: 274062 - protein, 21 aa, Mycobacterium
PDRATDAAAAKSAISAASDGT

SEQ ID NO: 274063 - protein, 8 aa, Mycobacterium
PDRATDPM

SEQ ID NO: 274064 - protein, 4 aa, Mycobacterium
PDRD

SEQ ID NO: 274065 - protein, 10 aa, Mycobacterium
PDRDATPRRR

SEQ ID NO: 274066 - protein, 9 aa, Mycobacterium
PDRDGDEDA

SEQ ID NO: 274067 - protein, 12 aa, Mycobacterium
PDREGNADRAAV

SEQ ID NO: 274068 - protein, 21 aa, Mycobacterium
PDREVDAQAAGAAVSAASDGA

SEQ ID NO: 274069 - protein, 21 aa, Mycobacterium
PDREVDAQAAKSAVAAATDGT

SEQ ID NO: 274070 - protein, 5 aa, Mycobacterium
PDRFD

SEQ ID NO: 274071 - protein, 4 aa, Mycobacterium
PDRG

SEQ ID NO: 274072 - protein, 21 aa, Mycobacterium
PDRHRESKQRLAESRAMNHEW

SEQ ID NO: 274073 - protein, 4 aa, Mycobacterium
PDRK

SEQ ID NO: 274074 - protein, 19 aa, Mycobacterium
PDRLPSRQVPGTPSFNDRR

SEQ ID NO: 274075 - protein, 26 aa, Mycobacterium
PDRPAAQAPHSASTDGPATEMSAADP

SEQ ID NO: 274076 - protein, 17 aa, Mycobacterium
PDRPTPPPQAPDDPALR

SEQ ID NO: 274077 - protein, 4 aa, Mycobacterium
PDRQ

SEQ ID NO: 274078 - protein, 12 aa, Mycobacterium
PDRQTDKAAAHE

SEQ ID NO: 274079 - protein, 9 aa, Mycobacterium
PDRRAGTGA

SEQ ID NO: 274080 - protein, 17 aa, Mycobacterium
PDRRVNQPSRANPAQAR

SEQ ID NO: 274081 - protein, 5 aa, Mycobacterium
PDRSS

SEQ ID NO: 274082 - protein, 5 aa, Mycobacterium
PDRTR

SEQ ID NO: 274083 - protein, 9 aa, Mycobacterium
PDRTSAQPV

SEQ ID NO: 274084 - protein, 8 aa, Mycobacterium
PDRVAPAV

SEQ ID NO: 274085 - protein, 5 aa, Mycobacterium
PDRVP

SEQ ID NO: 274086 - protein, 5 aa, Mycobacterium
PDRVR

SEQ ID NO: 274087 - protein, 13 aa, Mycobacterium
PDSARASITPDGE

SEQ ID NO: 274088 - protein, 8 aa, Mycobacterium
PDSDERCA

SEQ ID NO: 274089 - protein, 7 aa, Mycobacterium
PDSGAAP

SEQ ID NO: 274090 - protein, 9 aa, Mycobacterium
PDSGASQEL

SEQ ID NO: 274091 - protein, 7 aa, Mycobacterium
PDSGDDL

SEQ ID NO: 274092 - protein, 6 aa, Mycobacterium
PDSGDM

SEQ ID NO: 274093 - protein, 10 aa, Mycobacterium
PDSGEVHAPT

SEQ ID NO: 274094 - protein, 7 aa, Mycobacterium
PDSGGQE

SEQ ID NO: 274095 - protein, 6 aa, Mycobacterium
PDSGPW

SEQ ID NO: 274096 - protein, 10 aa, Mycobacterium
PDSGSSPQTR

SEQ ID NO: 274097 - protein, 11 aa, Mycobacterium
PDSMEDDLPDP

SEQ ID NO: 274098 - protein, 6 aa, Mycobacterium
PDSNTR

SEQ ID NO: 274099 - protein, 4 aa, Mycobacterium
PDSP

SEQ ID NO: 274100 - protein, 12 aa, Mycobacterium
PDSPGSPPLTRA

SEQ ID NO: 274101 - protein, 6 aa, Mycobacterium
PDSPQV

SEQ ID NO: 274102 - protein, 6 aa, Mycobacterium
PDSSAH

SEQ ID NO: 274103 - protein, 15 aa, Mycobacterium
PDSSATVTSPTTGEP

SEQ ID NO: 274104 - protein, 6 aa, Mycobacterium
PDSTAA

SEQ ID NO: 274105 - protein, 7 aa, Mycobacterium
PDSTIPP

SEQ ID NO: 274106 - protein, 13 aa, Mycobacterium
PDSTPENGTAKGS

SEQ ID NO: 274107 - protein, 11 aa, Mycobacterium
PDSTPEQPKSI

SEQ ID NO: 274108 - protein, 4 aa, Mycobacterium
PDSV

SEQ ID NO: 274109 - protein, 7 aa, Mycobacterium
PDSVSAT

SEQ ID NO: 274110 - protein, 5 aa, Mycobacterium
PDSYR

SEQ ID NO: 274111 - protein, 7 aa, Mycobacterium
PDTAHGA

SEQ ID NO: 274112 - protein, 14 aa, Mycobacterium
PDTATRITPAGADE

SEQ ID NO: 274113 - protein, 5 aa, Mycobacterium
PDTCD

SEQ ID NO: 274114 - protein, 4 aa, Mycobacterium
PDTD

SEQ ID NO: 274115 - protein, 39 aa, Mycobacterium
PDTDEDLDDDTDEDLDEERAHPDDDEQVPAGDESSATKE

SEQ ID NO: 274116 - protein, 13 aa, Mycobacterium
PDTDEPLPPRRRK

SEQ ID NO: 274117 - protein, 8 aa, Mycobacterium
PDTDRAPA

SEQ ID NO: 274118 - protein, 7 aa, Mycobacterium
PDTDRAT

SEQ ID NO: 274119 - protein, 6 aa, Mycobacterium
PDTEGP

SEQ ID NO: 274120 - protein, 6 aa, Mycobacterium
PDTEIT

SEQ ID NO: 274121 - protein, 8 aa, Mycobacterium
PDTGDIEA

SEQ ID NO: 274122 - protein, 7 aa, Mycobacterium
PDTGGRA

SEQ ID NO: 274123 - protein, 21 aa, Mycobacterium
PDTGPGDDAPEPPPASPRPAR

SEQ ID NO: 274124 - protein, 11 aa, Mycobacterium
PDTGPNDAATA

SEQ ID NO: 274125 - protein, 10 aa, Mycobacterium
PDTGVECPEG

SEQ ID NO: 274126 - protein, 5 aa, Mycobacterium
PDTID

SEQ ID NO: 274127 - protein, 5 aa, Mycobacterium
PDTLE

SEQ ID NO: 274128 - protein, 12 aa, Mycobacterium
PDTLGPADQSYY

SEQ ID NO: 274129 - protein, 5 aa, Mycobacterium
PDTLR

SEQ ID NO: 274130 - protein, 14 aa, Mycobacterium
PDTNPLRESDTREE

SEQ ID NO: 274131 - protein, 16 aa, Mycobacterium
PDTPATPPPSAEPPGG

SEQ ID NO: 274132 - protein, 30 aa, Mycobacterium
PDTPPTAVPPSAVPPGAVPPTSKPRPEFQD

SEQ ID NO: 274133 - protein, 10 aa, Mycobacterium
PDTPPVPGDV

SEQ ID NO: 274134 - protein, 8 aa, Mycobacterium
PDTQPEID

SEQ ID NO: 274135 - protein, 7 aa, Mycobacterium
PDTQRGE

SEQ ID NO: 274136 - protein, 4 aa, Mycobacterium
PDTR

SEQ ID NO: 274137 - protein, 4 aa, Mycobacterium
PDTS

SEQ ID NO: 274138 - protein, 16 aa, Mycobacterium
PDTTAAQIQEAARKAQ

SEQ ID NO: 274139 - protein, 9 aa, Mycobacterium
PDTTEGQRP

SEQ ID NO: 274140 - protein, 18 aa, Mycobacterium
PDTVEKDLGAARDRLTGK

SEQ ID NO: 274141 - protein, 8 aa, Mycobacterium
PDTVEQQL

SEQ ID NO: 274142 - protein, 7 aa, Mycobacterium
PDTVHGT

SEQ ID NO: 274143 - protein, 8 aa, Mycobacterium
PDTVRSDL

SEQ ID NO: 274144 - protein, 7 aa, Mycobacterium
PDTYDPN

SEQ ID NO: 274145 - protein, 8 aa, Mycobacterium
PDVAAARG

SEQ ID NO: 274146 - protein, 9 aa, Mycobacterium
PDVAAARGV

SEQ ID NO: 274147 - protein, 9 aa, Mycobacterium
PDVAEARGV

SEQ ID NO: 274148 - protein, 7 aa, Mycobacterium
PDVASQV

SEQ ID NO: 274149 - protein, 11 aa, Mycobacterium
PDVGEASAGGW

SEQ ID NO: 274150 - protein, 32 aa, Mycobacterium
PDVGRGNPPSGERAHAAATPPAGVRHRGPDDS

SEQ ID NO: 274151 - protein, 13 aa, Mycobacterium
PDVGTAEEGAPDF

SEQ ID NO: 274152 - protein, 8 aa, Mycobacterium
PDVGVSRG

SEQ ID NO: 274153 - protein, 4 aa, Mycobacterium
PDVL

SEQ ID NO: 274154 - protein, 14 aa, Mycobacterium
PDVPDDPDVPDDGG

SEQ ID NO: 274155 - protein, 13 aa, Mycobacterium
PDVPGQVGAATAT

SEQ ID NO: 274156 - protein, 6 aa, Mycobacterium
PDVPPA

SEQ ID NO: 274157 - protein, 18 aa, Mycobacterium
PDVQRPGSSSRFRPELPG

SEQ ID NO: 274158 - protein, 4 aa, Mycobacterium
PDVT

SEQ ID NO: 274159 - protein, 12 aa, Mycobacterium
PDVTGKSQSDAV

SEQ ID NO: 274160 - protein, 8 aa, Mycobacterium
PDWNADDR

SEQ ID NO: 274161 - protein, 5 aa, Mycobacterium
PDWPA

SEQ ID NO: 274162 - protein, 27 aa, Mycobacterium
PDWPDTPRPPWPVDDDGNPIDVDEAAE

SEQ ID NO: 274163 - protein, 10 aa, Mycobacterium
PDWSRTPAAR

SEQ ID NO: 274164 - protein, 5 aa, Mycobacterium
PDYAP

SEQ ID NO: 274165 - protein, 4 aa, Mycobacterium
PDYD

SEQ ID NO: 274166 - protein, 5 aa, Mycobacterium
PDYDL

SEQ ID NO: 274167 - protein, 21 aa, Mycobacterium
PDYDQKRKDTDTWQDGENGGL

SEQ ID NO: 274168 - protein, 4 aa, Mycobacterium
PDYG

SEQ ID NO: 274169 - protein, 13 aa, Mycobacterium
PDYGPFADPSRRA

SEQ ID NO: 274170 - protein, 4 aa, Mycobacterium
PDYN

SEQ ID NO: 274171 - protein, 18 aa, Mycobacterium
PDYNAKKLDTDTWEDGVN

SEQ ID NO: 274172 - protein, 17 aa, Mycobacterium
PDYNAKKQDTDTWQDGV

SEQ ID NO: 274173 - protein, 14 aa, Mycobacterium
PDYPAERKALIPGV

SEQ ID NO: 274174 - protein, 33 aa, Mycobacterium
PDYPATPPPAPSAPPPAPEPSESSTGRSGFATP

SEQ ID NO: 274175 - protein, 12 aa, Mycobacterium
PDYPPQAPQIPY

SEQ ID NO: 274176 - protein, 9 aa, Mycobacterium
PDYPPQPPL

SEQ ID NO: 274177 - protein, 9 aa, Mycobacterium
PDYPSDGAD

SEQ ID NO: 274178 - protein, 8 aa, Mycobacterium
PDYPSEGA

SEQ ID NO: 274179 - protein, 17 aa, Mycobacterium
PDYQGGINQPPLDQNSG

SEQ ID NO: 274180 - protein, 20 aa, Mycobacterium
PDYTAKKMDTDTWEDGTNGG

SEQ ID NO: 274181 - protein, 18 aa, Mycobacterium
PDYTSSLQDRLGSDQQIR

SEQ ID NO: 274182 - protein, 18 aa, Mycobacterium
PEAAGGAKEMSEGGRSNG

SEQ ID NO: 274183 - protein, 37 aa, Mycobacterium
PEADTADEVVDTPTAEASDPSPDQDVPADTRRPTRLG

SEQ ID NO: 274184 - protein, 18 aa, Mycobacterium
PEAEATGIDEAEHAESGY

SEQ ID NO: 274185 - protein, 11 aa, Mycobacterium
PEAEGHGTDDA

SEQ ID NO: 274186 - protein, 25 aa, Mycobacterium
PEAGADSGFAPAERDASGNPVEPAA

SEQ ID NO: 274187 - protein, 6 aa, Mycobacterium
PEAGPG

SEQ ID NO: 274188 - protein, 16 aa, Mycobacterium
PEAIDDPAPIAPTAPS

SEQ ID NO: 274189 - protein, 11 aa, Mycobacterium
PEAIGQPIPGG

SEQ ID NO: 274190 - protein, 6 aa, Mycobacterium
PEAPPI

SEQ ID NO: 274191 - protein, 9 aa, Mycobacterium
PEAPPISAP

SEQ ID NO: 274192 - protein, 8 aa, Mycobacterium
PEAPTSEL

SEQ ID NO: 274193 - protein, 5 aa, Mycobacterium
PEAQE

SEQ ID NO: 274194 - protein, 5 aa, Mycobacterium
PEAQR

SEQ ID NO: 274195 - protein, 4 aa, Mycobacterium
PEAR

SEQ ID NO: 274196 - protein, 5 aa, Mycobacterium
PEARE

SEQ ID NO: 274197 - protein, 8 aa, Mycobacterium
PEAREQIA

SEQ ID NO: 274198 - protein, 20 aa, Mycobacterium
PEASEPRPEPERLDSGSGSV

SEQ ID NO: 274199 - protein, 5 aa, Mycobacterium
PEASG

SEQ ID NO: 274200 - protein, 11 aa, Mycobacterium
PEASGSEVPKW

SEQ ID NO: 274201 - protein, 9 aa, Mycobacterium
PEASHDHAG

SEQ ID NO: 274202 - protein, 16 aa, Mycobacterium
PEATDDDVESAARDAQ

SEQ ID NO: 274203 - protein, 12 aa, Mycobacterium
PEATQKARENAG

SEQ ID NO: 274204 - protein, 4 aa, Mycobacterium
PEAV

SEQ ID NO: 274205 - protein, 5 aa, Mycobacterium
PEAVE

SEQ ID NO: 274206 - protein, 9 aa, Mycobacterium
PEAVGRTTE

SEQ ID NO: 274207 - protein, 14 aa, Mycobacterium
PEAVPQESDTPSEV

SEQ ID NO: 274208 - protein, 4 aa, Mycobacterium
PEDA

SEQ ID NO: 274209 - protein, 8 aa, Mycobacterium
PEDAGAQI

SEQ ID NO: 274210 - protein, 7 aa, Mycobacterium
PEDAGRI

SEQ ID NO: 274211 - protein, 8 aa, Mycobacterium
PEDAQAWE

SEQ ID NO: 274212 - protein, 7 aa, Mycobacterium
PEDARGR

SEQ ID NO: 274213 - protein, 5 aa, Mycobacterium
PEDAT

SEQ ID NO: 274214 - protein, 8 aa, Mycobacterium
PEDATHAE

SEQ ID NO: 274215 - protein, 8 aa, Mycobacterium
PEDDEAAV

SEQ ID NO: 274216 - protein, 6 aa, Mycobacterium
PEDDSF

SEQ ID NO: 274217 - protein, 7 aa, Mycobacterium
PEDERDE

SEQ ID NO: 274218 - protein, 6 aa, Mycobacterium
PEDGGI

SEQ ID NO: 274219 - protein, 7 aa, Mycobacterium
PEDHGDF

SEQ ID NO: 274220 - protein, 4 aa, Mycobacterium
PEDK

SEQ ID NO: 274221 - protein, 6 aa, Mycobacterium
PEDLGS

SEQ ID NO: 274222 - protein, 12 aa, Mycobacterium
PEDLKRPADPWA

SEQ ID NO: 274223 - protein, 4 aa, Mycobacterium
PEDM

SEQ ID NO: 274224 - protein, 10 aa, Mycobacterium
PEDPSGPELA

SEQ ID NO: 274225 - protein, 20 aa, Mycobacterium
PEDPSGQPLRPGAEVKADDV

SEQ ID NO: 274226 - protein, 5 aa, Mycobacterium
PEDSA

SEQ ID NO: 274227 - protein, 10 aa, Mycobacterium
PEDSAGPGLG

SEQ ID NO: 274228 - protein, 15 aa, Mycobacterium
PEDTAAWEAGNKKIA

SEQ ID NO: 274229 - protein, 15 aa, Mycobacterium
PEDTAAWEAGNNRIA

SEQ ID NO: 274230 - protein, 15 aa, Mycobacterium
PEDTKAWESGNKDIA

SEQ ID NO: 274231 - protein, 5 aa, Mycobacterium
PEEAQ

SEQ ID NO: 274232 - protein, 13 aa, Mycobacterium
PEEDEADTASPPS

SEQ ID NO: 274233 - protein, 11 aa, Mycobacterium
PEEDLPPRPQP

SEQ ID NO: 274234 - protein, 9 aa, Mycobacterium
PEEEKEFSA

SEQ ID NO: 274235 - protein, 5 aa, Mycobacterium
PEEHT

SEQ ID NO: 274236 - protein, 6 aa, Mycobacterium
PEEHTR

SEQ ID NO: 274237 - protein, 15 aa, Mycobacterium
PEELTNPWQAASSSA

SEQ ID NO: 274238 - protein, 16 aa, Mycobacterium
PEELTNPWQAASSSAL

SEQ ID NO: 274239 - protein, 5 aa, Mycobacterium
PEEPD

SEQ ID NO: 274240 - protein, 9 aa, Mycobacterium
PEEQAERRA

SEQ ID NO: 274241 - protein, 6 aa, Mycobacterium
PEERTQ

SEQ ID NO: 274242 - protein, 7 aa, Mycobacterium
PEERTRD

SEQ ID NO: 274243 - protein, 7 aa, Mycobacterium
PEETGGV

SEQ ID NO: 274244 - protein, 7 aa, Mycobacterium
PEFAPAT

SEQ ID NO: 274245 - protein, 7 aa, Mycobacterium
PEFASAT

SEQ ID NO: 274246 - protein, 7 aa, Mycobacterium
PEFETAT

SEQ ID NO: 274247 - protein, 9 aa, Mycobacterium
PEGEGDTAG

SEQ ID NO: 274248 - protein, 5 aa, Mycobacterium
PEGFE

SEQ ID NO: 274249 - protein, 8 aa, Mycobacterium
PEGGGSYA

SEQ ID NO: 274250 - protein, 6 aa, Mycobacterium
PEGGQR

SEQ ID NO: 274251 - protein, 7 aa, Mycobacterium
PEGGRTH

SEQ ID NO: 274252 - protein, 4 aa, Mycobacterium
PEGH

SEQ ID NO: 274253 - protein, 18 aa, Mycobacterium
PEGIGTTRITSSADAPQT

SEQ ID NO: 274254 - protein, 8 aa, Mycobacterium
PEGNQGQG

SEQ ID NO: 274255 - protein, 4 aa, Mycobacterium
PEGP

SEQ ID NO: 274256 - protein, 10 aa, Mycobacterium
PEGPELGPDA

SEQ ID NO: 274257 - protein, 13 aa, Mycobacterium
PEGPELSGANASV

SEQ ID NO: 274258 - protein, 7 aa, Mycobacterium
PEGPERK

SEQ ID NO: 274259 - protein, 5 aa, Mycobacterium
PEGPL

SEQ ID NO: 274260 - protein, 6 aa, Mycobacterium
PEGPLT

SEQ ID NO: 274261 - protein, 14 aa, Mycobacterium
PEGQDFPRTASGKV

SEQ ID NO: 274262 - protein, 14 aa, Mycobacterium
PEGQNAPPTPPQSL

SEQ ID NO: 274263 - protein, 7 aa, Mycobacterium
PEGRRGR

SEQ ID NO: 274264 - protein, 10 aa, Mycobacterium
PEGSAPLTDQ

SEQ ID NO: 274265 - protein, 7 aa, Mycobacterium
PEGSIGP

SEQ ID NO: 274266 - protein, 12 aa, Mycobacterium
PEGTARRNKNTG

SEQ ID NO: 274267 - protein, 6 aa, Mycobacterium
PEGTAV

SEQ ID NO: 274268 - protein, 5 aa, Mycobacterium
PEGTH

SEQ ID NO: 274269 - protein, 18 aa, Mycobacterium
PEGTRSPDGRLYKGKTGL

SEQ ID NO: 274270 - protein, 7 aa, Mycobacterium
PEGVAED

SEQ ID NO: 274271 - protein, 51 aa, Mycobacterium
PEGVGEDLKSDPVVSKPGLVNSDASPNKPNAAISDSAGTAGGKGPAGINGS

SEQ ID NO: 274272 - protein, 4 aa, Mycobacterium
PEHG

SEQ ID NO: 274273 - protein, 7 aa, Mycobacterium
PEHGAAA

SEQ ID NO: 274274 - protein, 8 aa, Mycobacterium
PEHGSGSI

SEQ ID NO: 274275 - protein, 14 aa, Mycobacterium
PEHMAGSASGVNNA

SEQ ID NO: 274276 - protein, 4 aa, Mycobacterium
PEHQ

SEQ ID NO: 274277 - protein, 9 aa, Mycobacterium
PEHQASAQG

SEQ ID NO: 274278 - protein, 6 aa, Mycobacterium
PEHQGT

SEQ ID NO: 274279 - protein, 7 aa, Mycobacterium
PEHRDAD

SEQ ID NO: 274280 - protein, 7 aa, Mycobacterium
PEHRSSR

SEQ ID NO: 274281 - protein, 14 aa, Mycobacterium
PEIAPAADLEPATG

SEQ ID NO: 274282 - protein, 25 aa, Mycobacterium
PEIGASTHAAGESRLGDDGRPDAHP

SEQ ID NO: 274283 - protein, 7 aa, Mycobacterium
PEIGRKG

SEQ ID NO: 274284 - protein, 8 aa, Mycobacterium
PEIGSGPV

SEQ ID NO: 274285 - protein, 9 aa, Mycobacterium
PEIKGTPTG

SEQ ID NO: 274286 - protein, 11 aa, Mycobacterium
PEIPSRPSRPM

SEQ ID NO: 274287 - protein, 13 aa, Mycobacterium
PEITQQAGHVGSQ

SEQ ID NO: 274288 - protein, 11 aa, Mycobacterium
PEKARAAVTQG

SEQ ID NO: 274289 - protein, 5 aa, Mycobacterium
PEKHA

SEQ ID NO: 274290 - protein, 4 aa, Mycobacterium
PEKL

SEQ ID NO: 274291 - protein, 5 aa, Mycobacterium
PEKNL

SEQ ID NO: 274292 - protein, 13 aa, Mycobacterium
PEKPSQAESSTAL

SEQ ID NO: 274293 - protein, 9 aa, Mycobacterium
PELAPPDWR

SEQ ID NO: 274294 - protein, 4 aa, Mycobacterium
PELE

SEQ ID NO: 274295 - protein, 4 aa, Mycobacterium
PELH

SEQ ID NO: 274296 - protein, 5 aa, Mycobacterium
PELNA

SEQ ID NO: 274297 - protein, 16 aa, Mycobacterium
PELNAARQAVKGTPLA

SEQ ID NO: 274298 - protein, 7 aa, Mycobacterium
PELPTSV

SEQ ID NO: 274299 - protein, 4 aa, Mycobacterium
PELS

SEQ ID NO: 274300 - protein, 17 aa, Mycobacterium
PELSDQRPAVRPNNPAP

SEQ ID NO: 274301 - protein, 22 aa, Mycobacterium
PELSGDPGHGPLPGRGRGTTAL

SEQ ID NO: 274302 - protein, 4 aa, Mycobacterium
PELT

SEQ ID NO: 274303 - protein, 6 aa, Mycobacterium
PELTPR

SEQ ID NO: 274304 - protein, 20 aa, Mycobacterium
PELVDPEDDVPSATYGGDFE

SEQ ID NO: 274305 - protein, 5 aa, Mycobacterium
PELYE

SEQ ID NO: 274306 - protein, 4 aa, Mycobacterium
PENA

SEQ ID NO: 274307 - protein, 9 aa, Mycobacterium
PENASEETI

SEQ ID NO: 274308 - protein, 7 aa, Mycobacterium
PENATAT

SEQ ID NO: 274309 - protein, 14 aa, Mycobacterium
PENDPQDTGYQARQ

SEQ ID NO: 274310 - protein, 7 aa, Mycobacterium
PENHEEF

SEQ ID NO: 274311 - protein, 11 aa, Mycobacterium
PENHTSVPPDI

SEQ ID NO: 274312 - protein, 26 aa, Mycobacterium
PENKSPEGHRLPEPGAPGTPNSSDVT

SEQ ID NO: 274313 - protein, 9 aa, Mycobacterium
PENLGDASL

SEQ ID NO: 274314 - protein, 9 aa, Mycobacterium
PENPDSTGV

SEQ ID NO: 274315 - protein, 8 aa, Mycobacterium
PENPSTKH

SEQ ID NO: 274316 - protein, 5 aa, Mycobacterium
PENRA

SEQ ID NO: 274317 - protein, 6 aa, Mycobacterium
PENRTG

SEQ ID NO: 274318 - protein, 16 aa, Mycobacterium
PENSAWKKSAPGTMQT

SEQ ID NO: 274319 - protein, 5 aa, Mycobacterium
PENSN

SEQ ID NO: 274320 - protein, 5 aa, Mycobacterium
PENSS

SEQ ID NO: 274321 - protein, 8 aa, Mycobacterium
PENVETKL

SEQ ID NO: 274322 - protein, 13 aa, Mycobacterium
PEPAAPRDATEPA

SEQ ID NO: 274323 - protein, 13 aa, Mycobacterium
PEPATTASDVQEA

SEQ ID NO: 274324 - protein, 55 aa, Mycobacterium
PEPAVEPEAPPARDSVAAPPEAPAPPEPVAEPAPEPAPEAAPETTAEPVTEPEPV

SEQ ID NO: 274325 - protein, 51 aa, Mycobacterium
PEPDPFRDVSSGGSPWQPRGTNDIEPGGTGAQPGGFDDSELSAPSKEPVPE

SEQ ID NO: 274326 - protein, 9 aa, Mycobacterium
PEPDSPRRM

SEQ ID NO: 274327 - protein, 10 aa, Mycobacterium
PEPDSPRRMP

SEQ ID NO: 274328 - protein, 14 aa, Mycobacterium
PEPEAGPEGRGADQ

SEQ ID NO: 274329 - protein, 15 aa, Mycobacterium
PEPENSEASGKPLAK

SEQ ID NO: 274330 - protein, 15 aa, Mycobacterium
PEPEPEHQGKGADQS

SEQ ID NO: 274331 - protein, 6 aa, Mycobacterium
PEPEYT

SEQ ID NO: 274332 - protein, 10 aa, Mycobacterium
PEPGDIRTPQ

SEQ ID NO: 274333 - protein, 16 aa, Mycobacterium
PEPGGNTDEKAPATVG

SEQ ID NO: 274334 - protein, 5 aa, Mycobacterium
PEPGI

SEQ ID NO: 274335 - protein, 8 aa, Mycobacterium
PEPGNPDH

SEQ ID NO: 274336 - protein, 6 aa, Mycobacterium
PEPGNY

SEQ ID NO: 274337 - protein, 8 aa, Mycobacterium
PEPGQPHQ

SEQ ID NO: 274338 - protein, 7 aa, Mycobacterium
PEPGTVN

SEQ ID NO: 274339 - protein, 65 aa, Mycobacterium
PEPIASPPRSAAESPVRQPAAPSPVPPAPVAPAPDPAPEPVAPAAEDVPVEAPPAPQELPEQVSP

SEQ ID NO: 274340 - protein, 4 aa, Mycobacterium
PEPK

SEQ ID NO: 274341 - protein, 10 aa, Mycobacterium
PEPKANNSDN

SEQ ID NO: 274342 - protein, 8 aa, Mycobacterium
PEPKRPGW

SEQ ID NO: 274343 - protein, 6 aa, Mycobacterium
PEPLDG

SEQ ID NO: 274344 - protein, 6 aa, Mycobacterium
PEPLNG

SEQ ID NO: 274345 - protein, 5 aa, Mycobacterium
PEPLP

SEQ ID NO: 274346 - protein, 17 aa, Mycobacterium
PEPLSQPDRSPDAAEQM

SEQ ID NO: 274347 - protein, 9 aa, Mycobacterium
PEPPAAPQA

SEQ ID NO: 274348 - protein, 7 aa, Mycobacterium
PEPPEIS

SEQ ID NO: 274349 - protein, 9 aa, Mycobacterium
PEPPRRHEP

SEQ ID NO: 274350 - protein, 31 aa, Mycobacterium
PEPPVVEPAPAPAPPEPVAEPEPVAEPEPLP

SEQ ID NO: 274351 - protein, 12 aa, Mycobacterium
PEPQGGLQDKRT

SEQ ID NO: 274352 - protein, 13 aa, Mycobacterium
PEPQSAGDAGRST

SEQ ID NO: 274353 - protein, 11 aa, Mycobacterium
PEPRSKPTRRR

SEQ ID NO: 274354 - protein, 8 aa, Mycobacterium
PEPSRRAK

SEQ ID NO: 274355 - protein, 29 aa, Mycobacterium
PEPTHGMPPPPPAPGKPKELAAEPKLTRA

SEQ ID NO: 274356 - protein, 7 aa, Mycobacterium
PEPTPLR

SEQ ID NO: 274357 - protein, 5 aa, Mycobacterium
PEPVP

SEQ ID NO: 274358 - protein, 7 aa, Mycobacterium
PEPVPES

SEQ ID NO: 274359 - protein, 16 aa, Mycobacterium
PEPYSPTRLEAFRDRK

SEQ ID NO: 274360 - protein, 12 aa, Mycobacterium
PEQEPDPAATLP

SEQ ID NO: 274361 - protein, 9 aa, Mycobacterium
PEQGPGPGF

SEQ ID NO: 274362 - protein, 15 aa, Mycobacterium
PEQLTDEPIDGRADQ

SEQ ID NO: 274363 - protein, 10 aa, Mycobacterium
PEQQDDPGLE

SEQ ID NO: 274364 - protein, 11 aa, Mycobacterium
PEQVGQAKPMS

SEQ ID NO: 274365 - protein, 10 aa, Mycobacterium
PEQVSQARPM

SEQ ID NO: 274366 - protein, 9 aa, Mycobacterium
PEQVTQARP

SEQ ID NO: 274367 - protein, 23 aa, Mycobacterium
PERADGSRSLEDHHDESRQAQRH

SEQ ID NO: 274368 - protein, 6 aa, Mycobacterium
PERAGQ

SEQ ID NO: 274369 - protein, 8 aa, Mycobacterium
PERASTPD

SEQ ID NO: 274370 - protein, 4 aa, Mycobacterium
PERD

SEQ ID NO: 274371 - protein, 6 aa, Mycobacterium
PERDKR

SEQ ID NO: 274372 - protein, 7 aa, Mycobacterium
PERDPQL

SEQ ID NO: 274373 - protein, 7 aa, Mycobacterium
PERDYPG

SEQ ID NO: 274374 - protein, 7 aa, Mycobacterium
PEREADP

SEQ ID NO: 274375 - protein, 12 aa, Mycobacterium
PERGAVADDPDK

SEQ ID NO: 274376 - protein, 19 aa, Mycobacterium
PERKAREKRRAGTATPRAK

SEQ ID NO: 274377 - protein, 19 aa, Mycobacterium
PERKARELKKAGERPSSPK

SEQ ID NO: 274378 - protein, 19 aa, Mycobacterium
PERKARSKRTAGTASPRWK

SEQ ID NO: 274379 - protein, 10 aa, Mycobacterium
PERKGGKTGF

SEQ ID NO: 274380 - protein, 4 aa, Mycobacterium
PERL

SEQ ID NO: 274381 - protein, 4 aa, Mycobacterium
PERM

SEQ ID NO: 274382 - protein, 7 aa, Mycobacterium
PERNPEL

SEQ ID NO: 274383 - protein, 17 aa, Mycobacterium
PERPAAAKPDPADRTLT

SEQ ID NO: 274384 - protein, 17 aa, Mycobacterium
PERPAPAHQPSDDPALA

SEQ ID NO: 274385 - protein, 29 aa, Mycobacterium
PERPHRAEFEPASKRGGSLLDGSDPGPNI

SEQ ID NO: 274386 - protein, 17 aa, Mycobacterium
PERPKPAPQPSDDPALQ

SEQ ID NO: 274387 - protein, 5 aa, Mycobacterium
PERPR

SEQ ID NO: 274388 - protein, 24 aa, Mycobacterium
PERPRAAAASEPSTGRLQSVAARA

SEQ ID NO: 274389 - protein, 30 aa, Mycobacterium
PERPRPTTPRGVEPDDAVGTDPDDADPTLR

SEQ ID NO: 274390 - protein, 36 aa, Mycobacterium
PERPSPTTAPARAAPSTAEPSPSAPAAKAGSDTKAS

SEQ ID NO: 274391 - protein, 6 aa, Mycobacterium
PERPWA

SEQ ID NO: 274392 - protein, 8 aa, Mycobacterium
PERRGAAA

SEQ ID NO: 274393 - protein, 5 aa, Mycobacterium
PERRP

SEQ ID NO: 274394 - protein, 6 aa, Mycobacterium
PERRRP

SEQ ID NO: 274395 - protein, 7 aa, Mycobacterium
PERSGLS

SEQ ID NO: 274396 - protein, 7 aa, Mycobacterium
PERSPAL

SEQ ID NO: 274397 - protein, 4 aa, Mycobacterium
PERT

SEQ ID NO: 274398 - protein, 7 aa, Mycobacterium
PERVPRQ

SEQ ID NO: 274399 - protein, 11 aa, Mycobacterium
PESAAERAPGR

SEQ ID NO: 274400 - protein, 8 aa, Mycobacterium
PESAGDPL

SEQ ID NO: 274401 - protein, 64 aa, Mycobacterium
PESAGSDEAEVAAAESAADAEDGPSDAESAEVPAEAAADDAVVSEPAGTVDETEVAEEAAAEAA

SEQ ID NO: 274402 - protein, 11 aa, Mycobacterium
PESAQSNQGMR

SEQ ID NO: 274403 - protein, 7 aa, Mycobacterium
PESDRTT

SEQ ID NO: 274404 - protein, 10 aa, Mycobacterium
PESDTGPYLG

SEQ ID NO: 274405 - protein, 8 aa, Mycobacterium
PESEGSSV

SEQ ID NO: 274406 - protein, 5 aa, Mycobacterium
PESGG

SEQ ID NO: 274407 - protein, 9 aa, Mycobacterium
PESGGLLPN

SEQ ID NO: 274408 - protein, 8 aa, Mycobacterium
PESGGSEH

SEQ ID NO: 274409 - protein, 12 aa, Mycobacterium
PESGMPVATGTA

SEQ ID NO: 274410 - protein, 9 aa, Mycobacterium
PESGPNRPL

SEQ ID NO: 274411 - protein, 9 aa, Mycobacterium
PESGRNRRL

SEQ ID NO: 274412 - protein, 16 aa, Mycobacterium
PESIGSASDMRSAGHP

SEQ ID NO: 274413 - protein, 11 aa, Mycobacterium
PESPAINGVEG

SEQ ID NO: 274414 - protein, 5 aa, Mycobacterium
PESPK

SEQ ID NO: 274415 - protein, 4 aa, Mycobacterium
PESQ

SEQ ID NO: 274416 - protein, 12 aa, Mycobacterium
PESRDPNPGPFD

SEQ ID NO: 274417 - protein, 5 aa, Mycobacterium
PESRS

SEQ ID NO: 274418 - protein, 9 aa, Mycobacterium
PESSRTTDL

SEQ ID NO: 274419 - protein, 34 aa, Mycobacterium
PESTQNVTGASLDPTYKSGTVSKKSVAGTNPAYE

SEQ ID NO: 274420 - protein, 4 aa, Mycobacterium
PESV

SEQ ID NO: 274421 - protein, 5 aa, Mycobacterium
PESVR

SEQ ID NO: 274422 - protein, 6 aa, Mycobacterium
PESVSA

SEQ ID NO: 274423 - protein, 4 aa, Mycobacterium
PESW

SEQ ID NO: 274424 - protein, 4 aa, Mycobacterium
PETA

SEQ ID NO: 274425 - protein, 13 aa, Mycobacterium
PETAAPEAAVPET

SEQ ID NO: 274426 - protein, 15 aa, Mycobacterium
PETAAPPAEPVAATS

SEQ ID NO: 274427 - protein, 6 aa, Mycobacterium
PETAAS

SEQ ID NO: 274428 - protein, 6 aa, Mycobacterium
PETART

SEQ ID NO: 274429 - protein, 10 aa, Mycobacterium
PETATECPQG

SEQ ID NO: 274430 - protein, 11 aa, Mycobacterium
PETDLDTDRPF

SEQ ID NO: 274431 - protein, 10 aa, Mycobacterium
PETESSGKDL

SEQ ID NO: 274432 - protein, 6 aa, Mycobacterium
PETGAA

SEQ ID NO: 274433 - protein, 5 aa, Mycobacterium
PETGG

SEQ ID NO: 274434 - protein, 11 aa, Mycobacterium
PETGPSDRHDK

SEQ ID NO: 274435 - protein, 8 aa, Mycobacterium
PETGQIRS

SEQ ID NO: 274436 - protein, 11 aa, Mycobacterium
PETGTRVPAET

SEQ ID NO: 274437 - protein, 7 aa, Mycobacterium
PETIGPN

SEQ ID NO: 274438 - protein, 10 aa, Mycobacterium
PETKGKELED

SEQ ID NO: 274439 - protein, 8 aa, Mycobacterium
PETKGRNL

SEQ ID NO: 274440 - protein, 6 aa, Mycobacterium
PETLSG

SEQ ID NO: 274441 - protein, 8 aa, Mycobacterium
PETPTPSL

SEQ ID NO: 274442 - protein, 10 aa, Mycobacterium
PETRAEQTRP

SEQ ID NO: 274443 - protein, 11 aa, Mycobacterium
PETRARQGITS

SEQ ID NO: 274444 - protein, 7 aa, Mycobacterium
PETRARS

SEQ ID NO: 274445 - protein, 7 aa, Mycobacterium
PETRGSS

SEQ ID NO: 274446 - protein, 8 aa, Mycobacterium
PETRRNVP

SEQ ID NO: 274447 - protein, 11 aa, Mycobacterium
PETSSRSGSIG

SEQ ID NO: 274448 - protein, 6 aa, Mycobacterium
PETTPV

SEQ ID NO: 274449 - protein, 7 aa, Mycobacterium
PETTQRV

SEQ ID NO: 274450 - protein, 6 aa, Mycobacterium
PETTYR

SEQ ID NO: 274451 - protein, 7 aa, Mycobacterium
PETVEKD

SEQ ID NO: 274452 - protein, 7 aa, Mycobacterium
PETVGRP

SEQ ID NO: 274453 - protein, 4 aa, Mycobacterium
PETY

SEQ ID NO: 274454 - protein, 8 aa, Mycobacterium
PETYNPAR

SEQ ID NO: 274455 - protein, 4 aa, Mycobacterium
PEVA

SEQ ID NO: 274456 - protein, 7 aa, Mycobacterium
PEVDSIE

SEQ ID NO: 274457 - protein, 7 aa, Mycobacterium
PEVDTPN

SEQ ID NO: 274458 - protein, 18 aa, Mycobacterium
PEVGAERQDIRQYPGGSL

SEQ ID NO: 274459 - protein, 5 aa, Mycobacterium
PEVPK

SEQ ID NO: 274460 - protein, 13 aa, Mycobacterium
PEVQASVGTPSEI

SEQ ID NO: 274461 - protein, 70 aa, Mycobacterium
PEVQRQGPPRAQRPQPEQQQPAKPSTDATEALPAPGQNRTPQQQEVDEATRRSRGGSVSAQDLLRREGRR

SEQ ID NO: 274462 - protein, 4 aa, Mycobacterium
PEVR

SEQ ID NO: 274463 - protein, 38 aa, Mycobacterium
PEWQGQPPPWQGQQPGWPGQQPGWQAPQPGWPGQPEPE

SEQ ID NO: 274464 - protein, 31 aa, Mycobacterium
PEWQGQQPGWQGQQPQPGWPAAQPGYAPEPD

SEQ ID NO: 274465 - protein, 29 aa, Mycobacterium
PEWQGQQPGWQPPQPGWPAQQPGYAPEPD

SEQ ID NO: 274466 - protein, 7 aa, Mycobacterium
PEWSGGS

SEQ ID NO: 274467 - protein, 5 aa, Mycobacterium
PEYAA

SEQ ID NO: 274468 - protein, 6 aa, Mycobacterium
PEYDVT

SEQ ID NO: 274469 - protein, 4 aa, Mycobacterium
PEYG

SEQ ID NO: 274470 - protein, 8 aa, Mycobacterium
PEYGSDKI

SEQ ID NO: 274471 - protein, 12 aa, Mycobacterium
PEYMGENTNGKV

SEQ ID NO: 274472 - protein, 5 aa, Mycobacterium
PEYPR

SEQ ID NO: 274473 - protein, 21 aa, Mycobacterium
PEYSRPGGYYGPAADPSAPFG

SEQ ID NO: 274474 - protein, 4 aa, Mycobacterium
PEYT

SEQ ID NO: 274475 - protein, 20 aa, Mycobacterium
PFADTDDVRAEQKPFNPGGG

SEQ ID NO: 274476 - protein, 9 aa, Mycobacterium
PFANDANDL

SEQ ID NO: 274477 - protein, 18 aa, Mycobacterium
PFAPEAAVPEAAAPEVAV

SEQ ID NO: 274478 - protein, 6 aa, Mycobacterium
PFASRT

SEQ ID NO: 274479 - protein, 5 aa, Mycobacterium
PFATR

SEQ ID NO: 274480 - protein, 11 aa, Mycobacterium
PFDGNGSRMYR

SEQ ID NO: 274481 - protein, 4 aa, Mycobacterium
PFDH

SEQ ID NO: 274482 - protein, 11 aa, Mycobacterium
PFDQEPEPTPW

SEQ ID NO: 274483 - protein, 13 aa, Mycobacterium
PFDTRRGQLAGSQ

SEQ ID NO: 274484 - protein, 10 aa, Mycobacterium
PFEAATPRTA

SEQ ID NO: 274485 - protein, 6 aa, Mycobacterium
PFEPGS

SEQ ID NO: 274486 - protein, 14 aa, Mycobacterium
PFEVPGDANALTRN

SEQ ID NO: 274487 - protein, 8 aa, Mycobacterium
PFGDPGNA

SEQ ID NO: 274488 - protein, 11 aa, Mycobacterium
PFGGEGTTTTA

SEQ ID NO: 274489 - protein, 9 aa, Mycobacterium
PFGNRSDNG

SEQ ID NO: 274490 - protein, 34 aa, Mycobacterium
PFGPPPNPAPAPVAPASFGGNVGPVGSAVEREQL

SEQ ID NO: 274491 - protein, 5 aa, Mycobacterium
PFGSE

SEQ ID NO: 274492 - protein, 11 aa, Mycobacterium
PFPARSGPKGA

SEQ ID NO: 274493 - protein, 8 aa, Mycobacterium
PFPDAPPR

SEQ ID NO: 274494 - protein, 9 aa, Mycobacterium
PFPDTPPRY

SEQ ID NO: 274495 - protein, 8 aa, Mycobacterium
PFPESPPR

SEQ ID NO: 274496 - protein, 7 aa, Mycobacterium
PFPGNTV

SEQ ID NO: 274497 - protein, 5 aa, Mycobacterium
PFPSA

SEQ ID NO: 274498 - protein, 5 aa, Mycobacterium
PFRSG

SEQ ID NO: 274499 - protein, 4 aa, Mycobacterium
PFSA

SEQ ID NO: 274500 - protein, 18 aa, Mycobacterium
PFSAPGGPPAPPARPGMP

SEQ ID NO: 274501 - protein, 10 aa, Mycobacterium
PFSDDQSPNL

SEQ ID NO: 274502 - protein, 7 aa, Mycobacterium
PFSDRPG

SEQ ID NO: 274503 - protein, 6 aa, Mycobacterium
PFSPEA

SEQ ID NO: 274504 - protein, 50 aa, Mycobacterium
PFSSPPPPAPTTTTTTPTPPPTTTTTTTPTAEPAVPPGPPPHPGKHKGHG

SEQ ID NO: 274505 - protein, 9 aa, Mycobacterium
PFSSSSESM

SEQ ID NO: 274506 - protein, 5 aa, Mycobacterium
PFSTN

SEQ ID NO: 274507 - protein, 27 aa, Mycobacterium
PFSTPNAVTKARRRGKQPAAGPDEQGA

SEQ ID NO: 274508 - protein, 20 aa, Mycobacterium
PFTDPETAEQRTSARWSGGT

SEQ ID NO: 274509 - protein, 12 aa, Mycobacterium
PFTGDGTAPGFS

SEQ ID NO: 274510 - protein, 6 aa, Mycobacterium
PFTGKK

SEQ ID NO: 274511 - protein, 4 aa, Mycobacterium
PFTR

SEQ ID NO: 274512 - protein, 4 aa, Mycobacterium
PGAA

SEQ ID NO: 274513 - protein, 5 aa, Mycobacterium
PGAAA

SEQ ID NO: 274514 - protein, 25 aa, Mycobacterium
PGAAASGADLDRLDDDTLREQSPSF

SEQ ID NO: 274515 - protein, 15 aa, Mycobacterium
PGAADGARIDVGGPT

SEQ ID NO: 274516 - protein, 34 aa, Mycobacterium
PGAADSDEPNQDEADRPPASDRGLPPDQPAQHTA

SEQ ID NO: 274517 - protein, 12 aa, Mycobacterium
PGAAELNPESLP

SEQ ID NO: 274518 - protein, 31 aa, Mycobacterium
PGAAEPEPGVGPHPDRQPPAAAAVRDPDAVR

SEQ ID NO: 274519 - protein, 5 aa, Mycobacterium
PGAAP

SEQ ID NO: 274520 - protein, 8 aa, Mycobacterium
PGAAQDAL

SEQ ID NO: 274521 - protein, 7 aa, Mycobacterium
PGAATAL

SEQ ID NO: 274522 - protein, 8 aa, Mycobacterium
PGAATYQR

SEQ ID NO: 274523 - protein, 8 aa, Mycobacterium
PGADAAAQ

SEQ ID NO: 274524 - protein, 8 aa, Mycobacterium
PGADGRLA

SEQ ID NO: 274525 - protein, 7 aa, Mycobacterium
PGADGRR

SEQ ID NO: 274526 - protein, 9 aa, Mycobacterium
PGADHDALG

SEQ ID NO: 274527 - protein, 8 aa, Mycobacterium
PGADNQQQ

SEQ ID NO: 274528 - protein, 22 aa, Mycobacterium
PGADPGGGVGDAVGQAAGVAGS

SEQ ID NO: 274529 - protein, 8 aa, Mycobacterium
PGADRPAL

SEQ ID NO: 274530 - protein, 14 aa, Mycobacterium
PGADTQGSGYQARQ

SEQ ID NO: 274531 - protein, 5 aa, Mycobacterium
PGAEI

SEQ ID NO: 274532 - protein, 4 aa, Mycobacterium
PGAG

SEQ ID NO: 274533 - protein, 10 aa, Mycobacterium
PGAGAIQSMS

SEQ ID NO: 274534 - protein, 27 aa, Mycobacterium
PGAGATATAPAVEPGAMPPAPPGGQNV

SEQ ID NO: 274535 - protein, 6 aa, Mycobacterium
PGAGDA

SEQ ID NO: 274536 - protein, 7 aa, Mycobacterium
PGAGDAI

SEQ ID NO: 274537 - protein, 19 aa, Mycobacterium
PGAGDFGEDAGYRKGLKPR

SEQ ID NO: 274538 - protein, 5 aa, Mycobacterium
PGAGL

SEQ ID NO: 274539 - protein, 9 aa, Mycobacterium
PGAGQNSDE

SEQ ID NO: 274540 - protein, 8 aa, Mycobacterium
PGAGRTGR

SEQ ID NO: 274541 - protein, 6 aa, Mycobacterium
PGAGTE

SEQ ID NO: 274542 - protein, 16 aa, Mycobacterium
PGAKTTTIGDGNVDGS

SEQ ID NO: 274543 - protein, 18 aa, Mycobacterium
PGALGGKTGYTDDAGQTF

SEQ ID NO: 274544 - protein, 5 aa, Mycobacterium
PGALT

SEQ ID NO: 274545 - protein, 4 aa, Mycobacterium
PGAN

SEQ ID NO: 274546 - protein, 6 aa, Mycobacterium
PGAPAA

SEQ ID NO: 274547 - protein, 26 aa, Mycobacterium
PGAPAGTTASPPGGSAASPSARPHMS

SEQ ID NO: 274548 - protein, 18 aa, Mycobacterium
PGAPAPRAARGRYGSTSL

SEQ ID NO: 274549 - protein, 16 aa, Mycobacterium
PGAPARGPGVNSERRT

SEQ ID NO: 274550 - protein, 7 aa, Mycobacterium
PGAPARI

SEQ ID NO: 274551 - protein, 15 aa, Mycobacterium
PGAPASIPGALTGDD

SEQ ID NO: 274552 - protein, 7 aa, Mycobacterium
PGAPESR

SEQ ID NO: 274553 - protein, 5 aa, Mycobacterium
PGAPG

SEQ ID NO: 274554 - protein, 6 aa, Mycobacterium
PGAPGL

SEQ ID NO: 274555 - protein, 6 aa, Mycobacterium
PGAPGM

SEQ ID NO: 274556 - protein, 6 aa, Mycobacterium
PGAPGR

SEQ ID NO: 274557 - protein, 16 aa, Mycobacterium
PGAPNQFYPKSPPASS

SEQ ID NO: 274558 - protein, 8 aa, Mycobacterium
PGAPPAMP

SEQ ID NO: 274559 - protein, 17 aa, Mycobacterium
PGAPPLKADESLDDAGV

SEQ ID NO: 274560 - protein, 10 aa, Mycobacterium
PGAPPRPRRV

SEQ ID NO: 274561 - protein, 8 aa, Mycobacterium
PGAPPTGA

SEQ ID NO: 274562 - protein, 10 aa, Mycobacterium
PGAPRLPDEE

SEQ ID NO: 274563 - protein, 15 aa, Mycobacterium
PGAPSDFNPASPATS

SEQ ID NO: 274564 - protein, 16 aa, Mycobacterium
PGAPSNFHTTSPSTSS

SEQ ID NO: 274565 - protein, 15 aa, Mycobacterium
PGAPSSFHPTSPGAS

SEQ ID NO: 274566 - protein, 12 aa, Mycobacterium
PGAPTLASAGNI

SEQ ID NO: 274567 - protein, 8 aa, Mycobacterium
PGAPTNFN

SEQ ID NO: 274568 - protein, 16 aa, Mycobacterium
PGAPYATAVSAPSESQ

SEQ ID NO: 274569 - protein, 16 aa, Mycobacterium
PGAPYATPVSADSAST

SEQ ID NO: 274570 - protein, 16 aa, Mycobacterium
PGAPYATPVSGDTTST

SEQ ID NO: 274571 - protein, 6 aa, Mycobacterium
PGAPYT

SEQ ID NO: 274572 - protein, 7 aa, Mycobacterium
PGARDTV

SEQ ID NO: 274573 - protein, 5 aa, Mycobacterium
PGARE

SEQ ID NO: 274574 - protein, 4 aa, Mycobacterium
PGAS

SEQ ID NO: 274575 - protein, 19 aa, Mycobacterium
PGASALDPSTTLAQNRIGD

SEQ ID NO: 274576 - protein, 8 aa, Mycobacterium
PGASEQAS

SEQ ID NO: 274577 - protein, 18 aa, Mycobacterium
PGASRPGLTAPAAIAVRE

SEQ ID NO: 274578 - protein, 19 aa, Mycobacterium
PGASRRRRFDTKTAAAVSA

SEQ ID NO: 274579 - protein, 4 aa, Mycobacterium
PGAT

SEQ ID NO: 274580 - protein, 7 aa, Mycobacterium
PGATAPQ

SEQ ID NO: 274581 - protein, 26 aa, Mycobacterium
PGATFRADGSVTAGKKLNRAKTDMAD

SEQ ID NO: 274582 - protein, 5 aa, Mycobacterium
PGATL

SEQ ID NO: 274583 - protein, 16 aa, Mycobacterium
PGATSVPAPPPGQPSA

SEQ ID NO: 274584 - protein, 11 aa, Mycobacterium
PGAVAGASELG

SEQ ID NO: 274585 - protein, 10 aa, Mycobacterium
PGCAPAPDSV

SEQ ID NO: 274586 - protein, 9 aa, Mycobacterium
PGCAPAPDT

SEQ ID NO: 274587 - protein, 23 aa, Mycobacterium
PGCAPTLAGSGPSGQDTQLAPTR

SEQ ID NO: 274588 - protein, 21 aa, Mycobacterium
PGCSQTDPQRVAQTRIGATPS

SEQ ID NO: 274589 - protein, 7 aa, Mycobacterium
PGDAANA

SEQ ID NO: 274590 - protein, 7 aa, Mycobacterium
PGDAGTA

SEQ ID NO: 274591 - protein, 5 aa, Mycobacterium
PGDAV

SEQ ID NO: 274592 - protein, 6 aa, Mycobacterium
PGDDRV

SEQ ID NO: 274593 - protein, 13 aa, Mycobacterium
PGDDTSEARSLGQ

SEQ ID NO: 274594 - protein, 5 aa, Mycobacterium
PGDEH

SEQ ID NO: 274595 - protein, 8 aa, Mycobacterium
PGDGDGVV

SEQ ID NO: 274596 - protein, 10 aa, Mycobacterium
PGDGGRGRGR

SEQ ID NO: 274597 - protein, 8 aa, Mycobacterium
PGDGKSAT

SEQ ID NO: 274598 - protein, 9 aa, Mycobacterium
PGDGNGVVT

SEQ ID NO: 274599 - protein, 6 aa, Mycobacterium
PGDGRE

SEQ ID NO: 274600 - protein, 8 aa, Mycobacterium
PGDGSGVV

SEQ ID NO: 274601 - protein, 5 aa, Mycobacterium
PGDGV

SEQ ID NO: 274602 - protein, 6 aa, Mycobacterium
PGDGWR

SEQ ID NO: 274603 - protein, 13 aa, Mycobacterium
PGDHVTGATVNAG

SEQ ID NO: 274604 - protein, 17 aa, Mycobacterium
PGDIDDSTAREAASEAI

SEQ ID NO: 274605 - protein, 16 aa, Mycobacterium
PGDKAAKVAELQRQGK

SEQ ID NO: 274606 - protein, 7 aa, Mycobacterium
PGDPADL

SEQ ID NO: 274607 - protein, 7 aa, Mycobacterium
PGDPALA

SEQ ID NO: 274608 - protein, 8 aa, Mycobacterium
PGDPAQTI

SEQ ID NO: 274609 - protein, 7 aa, Mycobacterium
PGDPGGY

SEQ ID NO: 274610 - protein, 5 aa, Mycobacterium
PGDPI

SEQ ID NO: 274611 - protein, 8 aa, Mycobacterium
PGDQEDGV

SEQ ID NO: 274612 - protein, 10 aa, Mycobacterium
PGDQPTPSES

SEQ ID NO: 274613 - protein, 15 aa, Mycobacterium
PGDRPRTQALAEQGR

SEQ ID NO: 274614 - protein, 5 aa, Mycobacterium
PGDSL

SEQ ID NO: 274615 - protein, 10 aa, Mycobacterium
PGDSTTAVGE

SEQ ID NO: 274616 - protein, 5 aa, Mycobacterium
PGDTA

SEQ ID NO: 274617 - protein, 10 aa, Mycobacterium
PGDTEPPAHP

SEQ ID NO: 274618 - protein, 7 aa, Mycobacterium
PGDTGVH

SEQ ID NO: 274619 - protein, 7 aa, Mycobacterium
PGDTLSD

SEQ ID NO: 274620 - protein, 7 aa, Mycobacterium
PGDTTTL

SEQ ID NO: 274621 - protein, 9 aa, Mycobacterium
PGDTVGRVA

SEQ ID NO: 274622 - protein, 6 aa, Mycobacterium
PGEASS

SEQ ID NO: 274623 - protein, 4 aa, Mycobacterium
PGEG

SEQ ID NO: 274624 - protein, 15 aa, Mycobacterium
PGEGDASSQAATTTI

SEQ ID NO: 274625 - protein, 7 aa, Mycobacterium
PGEGFGE

SEQ ID NO: 274626 - protein, 10 aa, Mycobacterium
PGEGPSPDGW

SEQ ID NO: 274627 - protein, 8 aa, Mycobacterium
PGEGTHDG

SEQ ID NO: 274628 - protein, 4 aa, Mycobacterium
PGEH

SEQ ID NO: 274629 - protein, 8 aa, Mycobacterium
PGEKIPVD

SEQ ID NO: 274630 - protein, 15 aa, Mycobacterium
PGEKIPVDGEITDGR

SEQ ID NO: 274631 - protein, 18 aa, Mycobacterium
PGEKIPVDGEVTDGRAAV

SEQ ID NO: 274632 - protein, 10 aa, Mycobacterium
PGEKKSPTAW

SEQ ID NO: 274633 - protein, 10 aa, Mycobacterium
PGEKRTRLDK

SEQ ID NO: 274634 - protein, 4 aa, Mycobacterium
PGEL

SEQ ID NO: 274635 - protein, 7 aa, Mycobacterium
PGELGSK

SEQ ID NO: 274636 - protein, 10 aa, Mycobacterium
PGEMNSPEET

SEQ ID NO: 274637 - protein, 4 aa, Mycobacterium
PGEP

SEQ ID NO: 274638 - protein, 8 aa, Mycobacterium
PGEPDEEI

SEQ ID NO: 274639 - protein, 8 aa, Mycobacterium
PGEPGEQI

SEQ ID NO: 274640 - protein, 5 aa, Mycobacterium
PGEPL

SEQ ID NO: 274641 - protein, 6 aa, Mycobacterium
PGEPQL

SEQ ID NO: 274642 - protein, 10 aa, Mycobacterium
PGEPSTSSYT

SEQ ID NO: 274643 - protein, 5 aa, Mycobacterium
PGEQA

SEQ ID NO: 274644 - protein, 37 aa, Mycobacterium
PGEQQPGGYRDGRDGRDSDDYDGRGVRPSARTGDGVK

SEQ ID NO: 274645 - protein, 6 aa, Mycobacterium
PGEQVT

SEQ ID NO: 274646 - protein, 10 aa, Mycobacterium
PGESGAQPRV

SEQ ID NO: 274647 - protein, 18 aa, Mycobacterium
PGESKSPTGWHRPESPQV

SEQ ID NO: 274648 - protein, 7 aa, Mycobacterium
PGESTVD

SEQ ID NO: 274649 - protein, 26 aa, Mycobacterium
PGETPADTSVVAPGSPAAAGVAATGA

SEQ ID NO: 274650 - protein, 5 aa, Mycobacterium
PGETT

SEQ ID NO: 274651 - protein, 27 aa, Mycobacterium
PGEVPDLDGPNEEAAAPDSSGADSAAF

SEQ ID NO: 274652 - protein, 7 aa, Mycobacterium
PGEVPER

SEQ ID NO: 274653 - protein, 32 aa, Mycobacterium
PGFAGPSGGGPGMDAPRPQSPTTGNAPTPSPR

SEQ ID NO: 274654 - protein, 7 aa, Mycobacterium
PGFDAKE

SEQ ID NO: 274655 - protein, 4 aa, Mycobacterium
PGFP

SEQ ID NO: 274656 - protein, 4 aa, Mycobacterium
PGFQ

SEQ ID NO: 274657 - protein, 9 aa, Mycobacterium
PGFQPPPKA

SEQ ID NO: 274658 - protein, 5 aa, Mycobacterium
PGFRG

SEQ ID NO: 274659 - protein, 7 aa, Mycobacterium
PGGAAVE

SEQ ID NO: 274660 - protein, 9 aa, Mycobacterium
PGGADGPEG

SEQ ID NO: 274661 - protein, 8 aa, Mycobacterium
PGGADSAA

SEQ ID NO: 274662 - protein, 6 aa, Mycobacterium
PGGAGP

SEQ ID NO: 274663 - protein, 6 aa, Mycobacterium
PGGASL

SEQ ID NO: 274664 - protein, 10 aa, Mycobacterium
PGGAYSGQAF

SEQ ID NO: 274665 - protein, 19 aa, Mycobacterium
PGGDRLASATTLAESDIRD

SEQ ID NO: 274666 - protein, 19 aa, Mycobacterium
PGGDYADAGGSGYTSARPQ

SEQ ID NO: 274667 - protein, 18 aa, Mycobacterium
PGGDYVSTGDGTQDCDAH

SEQ ID NO: 274668 - protein, 4 aa, Mycobacterium
PGGE

SEQ ID NO: 274669 - protein, 4 aa, Mycobacterium
PGGG

SEQ ID NO: 274670 - protein, 11 aa, Mycobacterium
PGGGALGAEGA

SEQ ID NO: 274671 - protein, 12 aa, Mycobacterium
PGGGDFTATPAR

SEQ ID NO: 274672 - protein, 13 aa, Mycobacterium
PGGGDYKASPARV

SEQ ID NO: 274673 - protein, 11 aa, Mycobacterium
PGGGELGAEGA

SEQ ID NO: 274674 - protein, 8 aa, Mycobacterium
PGGGELGV

SEQ ID NO: 274675 - protein, 8 aa, Mycobacterium
PGGGGPQT

SEQ ID NO: 274676 - protein, 12 aa, Mycobacterium
PGGGNIQVPVGG

SEQ ID NO: 274677 - protein, 11 aa, Mycobacterium
PGGGQLGAEGA

SEQ ID NO: 274678 - protein, 11 aa, Mycobacterium
PGGGVSGVSGV

SEQ ID NO: 274679 - protein, 7 aa, Mycobacterium
PGGGWRG

SEQ ID NO: 274680 - protein, 4 aa, Mycobacterium
PGGH

SEQ ID NO: 274681 - protein, 7 aa, Mycobacterium
PGGHREP

SEQ ID NO: 274682 - protein, 20 aa, Mycobacterium
PGGKTAFCGPPNQIGPAMGT

SEQ ID NO: 274683 - protein, 20 aa, Mycobacterium
PGGKTAFLGPPAQIGPAMGT

SEQ ID NO: 274684 - protein, 17 aa, Mycobacterium
PGGKTAFLGPPDQIGQA

SEQ ID NO: 274685 - protein, 20 aa, Mycobacterium
PGGKTAFLGPPDQIGQAMGT

SEQ ID NO: 274686 - protein, 17 aa, Mycobacterium
PGGKTAFLGPPSEISQA

SEQ ID NO: 274687 - protein, 21 aa, Mycobacterium
PGGKTAFYGPPSQIGSAMGTT

SEQ ID NO: 274688 - protein, 14 aa, Mycobacterium
PGGKTAYCGPPDQI

SEQ ID NO: 274689 - protein, 15 aa, Mycobacterium
PGGKTAYCGPPGDIE

SEQ ID NO: 274690 - protein, 21 aa, Mycobacterium
PGGKTAYCGPPRSIGQEMGTT

SEQ ID NO: 274691 - protein, 15 aa, Mycobacterium
PGGKTAYFGPPDQVG

SEQ ID NO: 274692 - protein, 5 aa, Mycobacterium
PGGLA

SEQ ID NO: 274693 - protein, 14 aa, Mycobacterium
PGGLPWPDAARPPE

SEQ ID NO: 274694 - protein, 10 aa, Mycobacterium
PGGLTMPSED

SEQ ID NO: 274695 - protein, 4 aa, Mycobacterium
PGGP

SEQ ID NO: 274696 - protein, 53 aa, Mycobacterium
PGGPGPGNGPWGPGPGPGNGPWGPGPGGPGSWYGGPGGPGPDNGPWGPVPAAP

SEQ ID NO: 274697 - protein, 10 aa, Mycobacterium
PGGPHETPSR

SEQ ID NO: 274698 - protein, 5 aa, Mycobacterium
PGGQL

SEQ ID NO: 274699 - protein, 4 aa, Mycobacterium
PGGR

SEQ ID NO: 274700 - protein, 6 aa, Mycobacterium
PGGRFS

SEQ ID NO: 274701 - protein, 7 aa, Mycobacterium
PGGRFSK

SEQ ID NO: 274702 - protein, 21 aa, Mycobacterium
PGGRTQISGGEPPFSASTARQ

SEQ ID NO: 274703 - protein, 4 aa, Mycobacterium
PGGS

SEQ ID NO: 274704 - protein, 17 aa, Mycobacterium
PGGSGGPGGPGGPGGPG

SEQ ID NO: 274705 - protein, 9 aa, Mycobacterium
PGGSIPADG

SEQ ID NO: 274706 - protein, 18 aa, Mycobacterium
PGGSQVGAVPLDDVVSVE

SEQ ID NO: 274707 - protein, 27 aa, Mycobacterium
PGGSTSYGSWPQSSQPLDYPEDPAYAS

SEQ ID NO: 274708 - protein, 21 aa, Mycobacterium
PGGSVPADGRVVEGSASLDES

SEQ ID NO: 274709 - protein, 13 aa, Mycobacterium
PGGTEIRDERSIN

SEQ ID NO: 274710 - protein, 6 aa, Mycobacterium
PGGTLG

SEQ ID NO: 274711 - protein, 17 aa, Mycobacterium
PGGTTAIVGPSGSGKST

SEQ ID NO: 274712 - protein, 10 aa, Mycobacterium
PGGVALDSAG

SEQ ID NO: 274713 - protein, 18 aa, Mycobacterium
PGGVENGPEGTKSFPAAM

SEQ ID NO: 274714 - protein, 8 aa, Mycobacterium
PGGVESAG

SEQ ID NO: 274715 - protein, 13 aa, Mycobacterium
PGGVGTERARAVG

SEQ ID NO: 274716 - protein, 19 aa, Mycobacterium
PGGYPPPPPAAGAPALPGG

SEQ ID NO: 274717 - protein, 5 aa, Mycobacterium
PGHAE

SEQ ID NO: 274718 - protein, 8 aa, Mycobacterium
PGHAGTTS

SEQ ID NO: 274719 - protein, 21 aa, Mycobacterium
PGHAPGATAAQPLGRSASRDN

SEQ ID NO: 274720 - protein, 11 aa, Mycobacterium
PGHGGADIQPG

SEQ ID NO: 274721 - protein, 12 aa, Mycobacterium
PGHGGPATAAGD

SEQ ID NO: 274722 - protein, 12 aa, Mycobacterium
PGHGGPVTGAGD

SEQ ID NO: 274723 - protein, 12 aa, Mycobacterium
PGHGGPVTTAGD

SEQ ID NO: 274724 - protein, 9 aa, Mycobacterium
PGHGTPQRA

SEQ ID NO: 274725 - protein, 5 aa, Mycobacterium
PGHRS

SEQ ID NO: 274726 - protein, 11 aa, Mycobacterium
PGHTATPAGSI

SEQ ID NO: 274727 - protein, 15 aa, Mycobacterium
PGHTATPAGSISTPV

SEQ ID NO: 274728 - protein, 5 aa, Mycobacterium
PGHTI

SEQ ID NO: 274729 - protein, 9 aa, Mycobacterium
PGIAPDSGA

SEQ ID NO: 274730 - protein, 19 aa, Mycobacterium
PGIAYADDGRPQANPEERA

SEQ ID NO: 274731 - protein, 16 aa, Mycobacterium
PGIDSTEVSGTATSMG

SEQ ID NO: 274732 - protein, 12 aa, Mycobacterium
PGIGAEEVPAEA

SEQ ID NO: 274733 - protein, 6 aa, Mycobacterium
PGIPDS

SEQ ID NO: 274734 - protein, 9 aa, Mycobacterium
PGIRPGSGA

SEQ ID NO: 274735 - protein, 17 aa, Mycobacterium
PGISAKAAGVDPDSVAD

SEQ ID NO: 274736 - protein, 9 aa, Mycobacterium
PGITADSGA

SEQ ID NO: 274737 - protein, 6 aa, Mycobacterium
PGITPH

SEQ ID NO: 274738 - protein, 12 aa, Mycobacterium
PGKAAGELPPGS

SEQ ID NO: 274739 - protein, 6 aa, Mycobacterium
PGKAGL

SEQ ID NO: 274740 - protein, 4 aa, Mycobacterium
PGKD

SEQ ID NO: 274741 - protein, 10 aa, Mycobacterium
PGKDDDEPQQ

SEQ ID NO: 274742 - protein, 11 aa, Mycobacterium
PGKDDDEPQQR

SEQ ID NO: 274743 - protein, 11 aa, Mycobacterium
PGKEGGGYAQF

SEQ ID NO: 274744 - protein, 8 aa, Mycobacterium
PGKKRNRV

SEQ ID NO: 274745 - protein, 7 aa, Mycobacterium
PGKPHPY

SEQ ID NO: 274746 - protein, 13 aa, Mycobacterium
PGKPKPKPARSAA

SEQ ID NO: 274747 - protein, 6 aa, Mycobacterium
PGKPVP

SEQ ID NO: 274748 - protein, 20 aa, Mycobacterium
PGKSRPVNTTSPVPPPTPQT

SEQ ID NO: 274749 - protein, 26 aa, Mycobacterium
PGKSSDAGSALLSPDSTASAASSRIG

SEQ ID NO: 274750 - protein, 26 aa, Mycobacterium
PGKTTVDDPATDRTPAGSVSPPATRL

SEQ ID NO: 274751 - protein, 9 aa, Mycobacterium
PGKYTPNAA

SEQ ID NO: 274752 - protein, 8 aa, Mycobacterium
PGLAGPDS

SEQ ID NO: 274753 - protein, 18 aa, Mycobacterium
PGLAGPDSRVSTFSASDN

SEQ ID NO: 274754 - protein, 5 aa, Mycobacterium
PGLDT

SEQ ID NO: 274755 - protein, 12 aa, Mycobacterium
PGLETRARRQSV

SEQ ID NO: 274756 - protein, 11 aa, Mycobacterium
PGLETRARRQT

SEQ ID NO: 274757 - protein, 6 aa, Mycobacterium
PGLGGG

SEQ ID NO: 274758 - protein, 7 aa, Mycobacterium
PGLGGNR

SEQ ID NO: 274759 - protein, 24 aa, Mycobacterium
PGLGGNRPVHAEQEGVRTDAVVTR

SEQ ID NO: 274760 - protein, 13 aa, Mycobacterium
PGLGPPVDPATRL

SEQ ID NO: 274761 - protein, 4 aa, Mycobacterium
PGLN

SEQ ID NO: 274762 - protein, 4 aa, Mycobacterium
PGLP

SEQ ID NO: 274763 - protein, 28 aa, Mycobacterium
PGLPDVPAAPSPITGPPDDTGPLPKTPD

SEQ ID NO: 274764 - protein, 10 aa, Mycobacterium
PGLPGLPSFP

SEQ ID NO: 274765 - protein, 20 aa, Mycobacterium
PGLPGSPEFSQPSAPSPGFA

SEQ ID NO: 274766 - protein, 15 aa, Mycobacterium
PGLPPAPGGYRNRRP

SEQ ID NO: 274767 - protein, 6 aa, Mycobacterium
PGLPTG

SEQ ID NO: 274768 - protein, 4 aa, Mycobacterium
PGLQ

SEQ ID NO: 274769 - protein, 12 aa, Mycobacterium
PGLRDKADGSVL

SEQ ID NO: 274770 - protein, 4 aa, Mycobacterium
PGLT

SEQ ID NO: 274771 - protein, 11 aa, Mycobacterium
PGLTDSSDDLG

SEQ ID NO: 274772 - protein, 5 aa, Mycobacterium
PGLTP

SEQ ID NO: 274773 - protein, 13 aa, Mycobacterium
PGLVNSDASPNAP

SEQ ID NO: 274774 - protein, 4 aa, Mycobacterium
PGMA

SEQ ID NO: 274775 - protein, 19 aa, Mycobacterium
PGMAAADDGRPQAKPEERA

SEQ ID NO: 274776 - protein, 7 aa, Mycobacterium
PGMPPQS

SEQ ID NO: 274777 - protein, 9 aa, Mycobacterium
PGMPTPSTV

SEQ ID NO: 274778 - protein, 4 aa, Mycobacterium
PGMS

SEQ ID NO: 274779 - protein, 5 aa, Mycobacterium
PGMST

SEQ ID NO: 274780 - protein, 19 aa, Mycobacterium
PGNDGNEARNLGQTARLYI

SEQ ID NO: 274781 - protein, 14 aa, Mycobacterium
PGNDGSEARNLGQT

SEQ ID NO: 274782 - protein, 10 aa, Mycobacterium
PGNEEAAATV

SEQ ID NO: 274783 - protein, 14 aa, Mycobacterium
PGNEEAAATVASSF

SEQ ID NO: 274784 - protein, 25 aa, Mycobacterium
PGNEEAAATVASSFGDATVERASGL

SEQ ID NO: 274785 - protein, 8 aa, Mycobacterium
PGNEQAAA

SEQ ID NO: 274786 - protein, 9 aa, Mycobacterium
PGNEQAAAT

SEQ ID NO: 274787 - protein, 10 aa, Mycobacterium
PGNEQAAATV

SEQ ID NO: 274788 - protein, 6 aa, Mycobacterium
PGNGKS

SEQ ID NO: 274789 - protein, 9 aa, Mycobacterium
PGNPPPGSW

SEQ ID NO: 274790 - protein, 14 aa, Mycobacterium
PGNQAEAAIRPGDP

SEQ ID NO: 274791 - protein, 9 aa, Mycobacterium
PGNQAETVA

SEQ ID NO: 274792 - protein, 8 aa, Mycobacterium
PGNRQNRA

SEQ ID NO: 274793 - protein, 12 aa, Mycobacterium
PGNRRDVGGALS

SEQ ID NO: 274794 - protein, 17 aa, Mycobacterium
PGNRRPGRPYSPGQAGN

SEQ ID NO: 274795 - protein, 7 aa, Mycobacterium
PGNSPGV

SEQ ID NO: 274796 - protein, 12 aa, Mycobacterium
PGNVAANVSAGA

SEQ ID NO: 274797 - protein, 13 aa, Mycobacterium
PGNVAANVSSGAQ

SEQ ID NO: 274798 - protein, 13 aa, Mycobacterium
PGNVAANVSSGTQ

SEQ ID NO: 274799 - protein, 10 aa, Mycobacterium
PGNVAKGAAD

SEQ ID NO: 274800 - protein, 15 aa, Mycobacterium
PGNYGPLGPLGGEHP

SEQ ID NO: 274801 - protein, 6 aa, Mycobacterium
PGPAEV

SEQ ID NO: 274802 - protein, 8 aa, Mycobacterium
PGPAGPAD

SEQ ID NO: 274803 - protein, 10 aa, Mycobacterium
PGPAGRPAPD

SEQ ID NO: 274804 - protein, 7 aa, Mycobacterium
PGPAGTV

SEQ ID NO: 274805 - protein, 14 aa, Mycobacterium
PGPALPAPTRPTVQ

SEQ ID NO: 274806 - protein, 7 aa, Mycobacterium
PGPALSR

SEQ ID NO: 274807 - protein, 5 aa, Mycobacterium
PGPAP

SEQ ID NO: 274808 - protein, 46 aa, Mycobacterium
PGPAPGPIPYSGAPPYGAAQYGPDGTPLNPPPPGPQHSPSDTSGTH

SEQ ID NO: 274809 - protein, 7 aa, Mycobacterium
PGPDDPA

SEQ ID NO: 274810 - protein, 13 aa, Mycobacterium
PGPDGHPTATITG

SEQ ID NO: 274811 - protein, 11 aa, Mycobacterium
PGPDGRPTASI

SEQ ID NO: 274812 - protein, 11 aa, Mycobacterium
PGPDGRPTSTI

SEQ ID NO: 274813 - protein, 11 aa, Mycobacterium
PGPDGRPTTSI

SEQ ID NO: 274814 - protein, 5 aa, Mycobacterium
PGPEV

SEQ ID NO: 274815 - protein, 16 aa, Mycobacterium
PGPGDQAPPARSGPQV

SEQ ID NO: 274816 - protein, 13 aa, Mycobacterium
PGPGGETPDDPNA

SEQ ID NO: 274817 - protein, 25 aa, Mycobacterium
PGPGLPKPDPRDATPPYAAKTAIYE

SEQ ID NO: 274818 - protein, 5 aa, Mycobacterium
PGPGP

SEQ ID NO: 274819 - protein, 5 aa, Mycobacterium
PGPGW

SEQ ID NO: 274820 - protein, 4 aa, Mycobacterium
PGPI

SEQ ID NO: 274821 - protein, 5 aa, Mycobacterium
PGPIA

SEQ ID NO: 274822 - protein, 5 aa, Mycobacterium
PGPLA

SEQ ID NO: 274823 - protein, 6 aa, Mycobacterium
PGPLAD

SEQ ID NO: 274824 - protein, 8 aa, Mycobacterium
PGPLAPKD

SEQ ID NO: 274825 - protein, 7 aa, Mycobacterium
PGPLATT

SEQ ID NO: 274826 - protein, 5 aa, Mycobacterium
PGPLL

SEQ ID NO: 274827 - protein, 10 aa, Mycobacterium
PGPLSPKDSH

SEQ ID NO: 274828 - protein, 10 aa, Mycobacterium
PGPLTPKDSH

SEQ ID NO: 274829 - protein, 5 aa, Mycobacterium
PGPMP

SEQ ID NO: 274830 - protein, 10 aa, Mycobacterium
PGPNNQQTAF

SEQ ID NO: 274831 - protein, 9 aa, Mycobacterium
PGPNPGQTW

SEQ ID NO: 274832 - protein, 10 aa, Mycobacterium
PGPNRAGPWG

SEQ ID NO: 274833 - protein, 5 aa, Mycobacterium
PGPPM

SEQ ID NO: 274834 - protein, 37 aa, Mycobacterium
PGPPPEEGAPQGEPGPGPVPPPAPGQPPASNHGGGTV

SEQ ID NO: 274835 - protein, 8 aa, Mycobacterium
PGPPPGAE

SEQ ID NO: 274836 - protein, 7 aa, Mycobacterium
PGPPPLS

SEQ ID NO: 274837 - protein, 7 aa, Mycobacterium
PGPPPLT

SEQ ID NO: 274838 - protein, 65 aa, Mycobacterium
PGPPPPGMGPGMGPGMGPGMGPGMGPGFPGGPGGPGGPGGPGAGQMGPGAPQTPSSPSPTTAPSR

SEQ ID NO: 274839 - protein, 78 aa, Mycobacterium
PGPPQQQGWQGNAPTPAYPGYPPYQPYPQPGQHAPHGGAPAPNPTDDPGQDRGRENGHRDTERRDTDRGDTNRNGPAN

SEQ ID NO: 274840 - protein, 6 aa, Mycobacterium
PGPQLV

SEQ ID NO: 274841 - protein, 7 aa, Mycobacterium
PGPQPNC

SEQ ID NO: 274842 - protein, 6 aa, Mycobacterium
PGPQPR

SEQ ID NO: 274843 - protein, 5 aa, Mycobacterium
PGPSD

SEQ ID NO: 274844 - protein, 9 aa, Mycobacterium
PGPSEQTDA

SEQ ID NO: 274845 - protein, 15 aa, Mycobacterium
PGPSGFSAPVPDSVP

SEQ ID NO: 274846 - protein, 11 aa, Mycobacterium
PGPTDPKDQHW

SEQ ID NO: 274847 - protein, 12 aa, Mycobacterium
PGPTDPKDQHWD

SEQ ID NO: 274848 - protein, 7 aa, Mycobacterium
PGPTLSR

SEQ ID NO: 274849 - protein, 10 aa, Mycobacterium
PGQADGVGPA

SEQ ID NO: 274850 - protein, 11 aa, Mycobacterium
PGQADGVGPAR

SEQ ID NO: 274851 - protein, 8 aa, Mycobacterium
PGQASKAV

SEQ ID NO: 274852 - protein, 5 aa, Mycobacterium
PGQAW

SEQ ID NO: 274853 - protein, 7 aa, Mycobacterium
PGQDPVT

SEQ ID NO: 274854 - protein, 8 aa, Mycobacterium
PGQDRNVP

SEQ ID NO: 274855 - protein, 6 aa, Mycobacterium
PGQEPV

SEQ ID NO: 274856 - protein, 4 aa, Mycobacterium
PGQG

SEQ ID NO: 274857 - protein, 11 aa, Mycobacterium
PGQGAYAAGNA

SEQ ID NO: 274858 - protein, 8 aa, Mycobacterium
PGQGSQRI

SEQ ID NO: 274859 - protein, 10 aa, Mycobacterium
PGQGSYAAAN

SEQ ID NO: 274860 - protein, 7 aa, Mycobacterium
PGQLGPA

SEQ ID NO: 274861 - protein, 4 aa, Mycobacterium
PGQN

SEQ ID NO: 274862 - protein, 4 aa, Mycobacterium
PGQP

SEQ ID NO: 274863 - protein, 12 aa, Mycobacterium
PGQPAGRRDTPI

SEQ ID NO: 274864 - protein, 11 aa, Mycobacterium
PGQPATEVRDA

SEQ ID NO: 274865 - protein, 5 aa, Mycobacterium
PGQPL

SEQ ID NO: 274866 - protein, 7 aa, Mycobacterium
PGQPQAQ

SEQ ID NO: 274867 - protein, 8 aa, Mycobacterium
PGQQPRRE

SEQ ID NO: 274868 - protein, 10 aa, Mycobacterium
PGQRATIEGR

SEQ ID NO: 274869 - protein, 4 aa, Mycobacterium
PGQT

SEQ ID NO: 274870 - protein, 13 aa, Mycobacterium
PGQTFGPGGPLGG

SEQ ID NO: 274871 - protein, 6 aa, Mycobacterium
PGRAAG

SEQ ID NO: 274872 - protein, 12 aa, Mycobacterium
PGRAAGELPPGA

SEQ ID NO: 274873 - protein, 6 aa, Mycobacterium
PGRAAW

SEQ ID NO: 274874 - protein, 36 aa, Mycobacterium
PGRAETDSASASASASDSDSGSSTGTGTGELPSTNR

SEQ ID NO: 274875 - protein, 18 aa, Mycobacterium
PGRAPRQATAEEAVALSV

SEQ ID NO: 274876 - protein, 26 aa, Mycobacterium
PGRASSPASSEPIVDPEAPITSERST

SEQ ID NO: 274877 - protein, 8 aa, Mycobacterium
PGRDGRQL

SEQ ID NO: 274878 - protein, 9 aa, Mycobacterium
PGRDGRQLG

SEQ ID NO: 274879 - protein, 16 aa, Mycobacterium
PGRDGRQWSVVRRLRK

SEQ ID NO: 274880 - protein, 20 aa, Mycobacterium
PGRERPSTVYADPAGPAPEP

SEQ ID NO: 274881 - protein, 8 aa, Mycobacterium
PGRGAGAE

SEQ ID NO: 274882 - protein, 8 aa, Mycobacterium
PGRGEGRL

SEQ ID NO: 274883 - protein, 5 aa, Mycobacterium
PGRGH

SEQ ID NO: 274884 - protein, 4 aa, Mycobacterium
PGRH

SEQ ID NO: 274885 - protein, 13 aa, Mycobacterium
PGRHRADGDGRDA

SEQ ID NO: 274886 - protein, 16 aa, Mycobacterium
PGRHSTWQEQTQASTA

SEQ ID NO: 274887 - protein, 4 aa, Mycobacterium
PGRI

SEQ ID NO: 274888 - protein, 4 aa, Mycobacterium
PGRK

SEQ ID NO: 274889 - protein, 4 aa, Mycobacterium
PGRL

SEQ ID NO: 274890 - protein, 9 aa, Mycobacterium
PGRLPPGRG

SEQ ID NO: 274891 - protein, 8 aa, Mycobacterium
PGRNPDAA

SEQ ID NO: 274892 - protein, 4 aa, Mycobacterium
PGRP

SEQ ID NO: 274893 - protein, 11 aa, Mycobacterium
PGRPADVPAGS

SEQ ID NO: 274894 - protein, 8 aa, Mycobacterium
PGRPASEV

SEQ ID NO: 274895 - protein, 10 aa, Mycobacterium
PGRPPEDPHY

SEQ ID NO: 274896 - protein, 8 aa, Mycobacterium
PGRPSVQT

SEQ ID NO: 274897 - protein, 5 aa, Mycobacterium
PGRPW

SEQ ID NO: 274898 - protein, 7 aa, Mycobacterium
PGRQRKP

SEQ ID NO: 274899 - protein, 23 aa, Mycobacterium
PGRRSGAAVAPSSTKTSTLASAS

SEQ ID NO: 274900 - protein, 4 aa, Mycobacterium
PGRS

SEQ ID NO: 274901 - protein, 11 aa, Mycobacterium
PGRSAPAPAGA

SEQ ID NO: 274902 - protein, 26 aa, Mycobacterium
PGRSAVGESDDRATTDPTDPKGRAVP

SEQ ID NO: 274903 - protein, 6 aa, Mycobacterium
PGRSHA

SEQ ID NO: 274904 - protein, 9 aa, Mycobacterium
PGRTDTDMQ

SEQ ID NO: 274905 - protein, 5 aa, Mycobacterium
PGRTP

SEQ ID NO: 274906 - protein, 7 aa, Mycobacterium
PGRVPDG

SEQ ID NO: 274907 - protein, 7 aa, Mycobacterium
PGRVPPA

SEQ ID NO: 274908 - protein, 5 aa, Mycobacterium
PGRYG

SEQ ID NO: 274909 - protein, 4 aa, Mycobacterium
PGSA

SEQ ID NO: 274910 - protein, 5 aa, Mycobacterium
PGSAG

SEQ ID NO: 274911 - protein, 11 aa, Mycobacterium
PGSAGAARGRG

SEQ ID NO: 274912 - protein, 5 aa, Mycobacterium
PGSAI

SEQ ID NO: 274913 - protein, 14 aa, Mycobacterium
PGSAPGIPASEKPQ

SEQ ID NO: 274914 - protein, 12 aa, Mycobacterium
PGSCAEGRATGS

SEQ ID NO: 274915 - protein, 6 aa, Mycobacterium
PGSDLY

SEQ ID NO: 274916 - protein, 5 aa, Mycobacterium
PGSDP

SEQ ID NO: 274917 - protein, 6 aa, Mycobacterium
PGSDPF

SEQ ID NO: 274918 - protein, 6 aa, Mycobacterium
PGSEEF

SEQ ID NO: 274919 - protein, 6 aa, Mycobacterium
PGSELS

SEQ ID NO: 274920 - protein, 16 aa, Mycobacterium
PGSEYGPDAAPPSPAR

SEQ ID NO: 274921 - protein, 16 aa, Mycobacterium
PGSEYGPNAAPPTPAR

SEQ ID NO: 274922 - protein, 15 aa, Mycobacterium
PGSEYGPSAPPPSMD

SEQ ID NO: 274923 - protein, 6 aa, Mycobacterium
PGSGLA

SEQ ID NO: 274924 - protein, 11 aa, Mycobacterium
PGSGSALISPQ

SEQ ID NO: 274925 - protein, 6 aa, Mycobacterium
PGSGTN

SEQ ID NO: 274926 - protein, 10 aa, Mycobacterium
PGSGVDSPTT

SEQ ID NO: 274927 - protein, 22 aa, Mycobacterium
PGSHRGAVPTYDAPAALRADAA

SEQ ID NO: 274928 - protein, 4 aa, Mycobacterium
PGSI

SEQ ID NO: 274929 - protein, 5 aa, Mycobacterium
PGSLT

SEQ ID NO: 274930 - protein, 6 aa, Mycobacterium
PGSNVT

SEQ ID NO: 274931 - protein, 9 aa, Mycobacterium
PGSPAYTYP

SEQ ID NO: 274932 - protein, 7 aa, Mycobacterium
PGSPEFS

SEQ ID NO: 274933 - protein, 16 aa, Mycobacterium
PGSPEFSGPTSPIPGF

SEQ ID NO: 274934 - protein, 9 aa, Mycobacterium
PGSPEPRNV

SEQ ID NO: 274935 - protein, 8 aa, Mycobacterium
PGSPPAGA

SEQ ID NO: 274936 - protein, 9 aa, Mycobacterium
PGSPPAGSW

SEQ ID NO: 274937 - protein, 9 aa, Mycobacterium
PGSPPPGSW

SEQ ID NO: 274938 - protein, 7 aa, Mycobacterium
PGSPQGL

SEQ ID NO: 274939 - protein, 5 aa, Mycobacterium
PGSPR

SEQ ID NO: 274940 - protein, 6 aa, Mycobacterium
PGSQYD

SEQ ID NO: 274941 - protein, 5 aa, Mycobacterium
PGSRP

SEQ ID NO: 274942 - protein, 15 aa, Mycobacterium
PGSSFPDADSLSEGV

SEQ ID NO: 274943 - protein, 13 aa, Mycobacterium
PGSTLSDRYGGGW

SEQ ID NO: 274944 - protein, 5 aa, Mycobacterium
PGSTP

SEQ ID NO: 274945 - protein, 17 aa, Mycobacterium
PGSTTAIVGPSGSGKST

SEQ ID NO: 274946 - protein, 14 aa, Mycobacterium
PGTAAALPAPGAQL

SEQ ID NO: 274947 - protein, 13 aa, Mycobacterium
PGTAGAEGETYTV

SEQ ID NO: 274948 - protein, 29 aa, Mycobacterium
PGTAPGPFPQDPSQPSAPAPQDDSSLPAK

SEQ ID NO: 274949 - protein, 14 aa, Mycobacterium
PGTDPHSGAPDGLP

SEQ ID NO: 274950 - protein, 11 aa, Mycobacterium
PGTDPRPGDAI

SEQ ID NO: 274951 - protein, 12 aa, Mycobacterium
PGTDRPYDAQGP

SEQ ID NO: 274952 - protein, 5 aa, Mycobacterium
PGTEH

SEQ ID NO: 274953 - protein, 15 aa, Mycobacterium
PGTEYGPNSKPPTVG

SEQ ID NO: 274954 - protein, 5 aa, Mycobacterium
PGTGD

SEQ ID NO: 274955 - protein, 7 aa, Mycobacterium
PGTGEVA

SEQ ID NO: 274956 - protein, 11 aa, Mycobacterium
PGTGPADRHDK

SEQ ID NO: 274957 - protein, 6 aa, Mycobacterium
PGTGRL

SEQ ID NO: 274958 - protein, 6 aa, Mycobacterium
PGTGTG

SEQ ID NO: 274959 - protein, 19 aa, Mycobacterium
PGTGTPGPPAGGAPAGGDV

SEQ ID NO: 274960 - protein, 14 aa, Mycobacterium
PGTGTSGKPSPEFE

SEQ ID NO: 274961 - protein, 5 aa, Mycobacterium
PGTGY

SEQ ID NO: 274962 - protein, 4 aa, Mycobacterium
PGTI

SEQ ID NO: 274963 - protein, 4 aa, Mycobacterium
PGTN

SEQ ID NO: 274964 - protein, 4 aa, Mycobacterium
PGTP

SEQ ID NO: 274965 - protein, 6 aa, Mycobacterium
PGTPVP

SEQ ID NO: 274966 - protein, 12 aa, Mycobacterium
PGTQGLARSAAA

SEQ ID NO: 274967 - protein, 13 aa, Mycobacterium
PGTRRQWERDPRD

SEQ ID NO: 274968 - protein, 4 aa, Mycobacterium
PGTS

SEQ ID NO: 274969 - protein, 13 aa, Mycobacterium
PGTSASYAQPVTT

SEQ ID NO: 274970 - protein, 5 aa, Mycobacterium
PGTTA

SEQ ID NO: 274971 - protein, 11 aa, Mycobacterium
PGTTPQVGQGT

SEQ ID NO: 274972 - protein, 5 aa, Mycobacterium
PGTTT

SEQ ID NO: 274973 - protein, 27 aa, Mycobacterium
PGTVASPTIPATAEPTESPLPTEQESP

SEQ ID NO: 274974 - protein, 12 aa, Mycobacterium
PGTYGDTGMEPP

SEQ ID NO: 274975 - protein, 35 aa, Mycobacterium
PGTYPGGYPPQPYGGYPGPYSPQPYPVAPKNGLGT

SEQ ID NO: 274976 - protein, 16 aa, Mycobacterium
PGVAGQNATIDVGGPT

SEQ ID NO: 274977 - protein, 7 aa, Mycobacterium
PGVASGP

SEQ ID NO: 274978 - protein, 7 aa, Mycobacterium
PGVATTG

SEQ ID NO: 274979 - protein, 12 aa, Mycobacterium
PGVDAGQPRAPG

SEQ ID NO: 274980 - protein, 13 aa, Mycobacterium
PGVDSGDSGDATY

SEQ ID NO: 274981 - protein, 14 aa, Mycobacterium
PGVEPGPGPAPHAP

SEQ ID NO: 274982 - protein, 11 aa, Mycobacterium
PGVEQQPDHQE

SEQ ID NO: 274983 - protein, 10 aa, Mycobacterium
PGVGEASAGG

SEQ ID NO: 274984 - protein, 6 aa, Mycobacterium
PGVGEN

SEQ ID NO: 274985 - protein, 10 aa, Mycobacterium
PGVGGFGQPH

SEQ ID NO: 274986 - protein, 7 aa, Mycobacterium
PGVGGGF

SEQ ID NO: 274987 - protein, 5 aa, Mycobacterium
PGVGP

SEQ ID NO: 274988 - protein, 4 aa, Mycobacterium
PGVP

SEQ ID NO: 274989 - protein, 13 aa, Mycobacterium
PGVPADHGIAHSR

SEQ ID NO: 274990 - protein, 8 aa, Mycobacterium
PGVPSDSL

SEQ ID NO: 274991 - protein, 7 aa, Mycobacterium
PGVSAPP

SEQ ID NO: 274992 - protein, 12 aa, Mycobacterium
PGVSEPAGGGFP

SEQ ID NO: 274993 - protein, 10 aa, Mycobacterium
PGVSGLEPGD

SEQ ID NO: 274994 - protein, 11 aa, Mycobacterium
PGVTGRSVGDP

SEQ ID NO: 274995 - protein, 4 aa, Mycobacterium
PGVV

SEQ ID NO: 274996 - protein, 35 aa, Mycobacterium
PGVVNSDASPNKPNAAMSDSAGTAGGKGPAGVNGS

SEQ ID NO: 274997 - protein, 16 aa, Mycobacterium
PGVVSATDSARSASGL

SEQ ID NO: 274998 - protein, 20 aa, Mycobacterium
PGWAPRTAGQTDAAAALVTS

SEQ ID NO: 274999 - protein, 20 aa, Mycobacterium
PGWAPRTTDRVDAAVPVASS

SEQ ID NO: 275000 - protein, 4 aa, Mycobacterium
PGWD

SEQ ID NO: 275001 - protein, 19 aa, Mycobacterium
PGWKPQTPANQETGRLAKS

SEQ ID NO: 275002 - protein, 48 aa, Mycobacterium
PGWPPPPSSPSRPQPAPGYRLPEKSEPDSDEPSDQQNKDVSRSNPSAH

SEQ ID NO: 275003 - protein, 42 aa, Mycobacterium
PGWPPPSERPQPSGYSPDQPSDTDESSEQQDRDVSRSNPPAH

SEQ ID NO: 275004 - protein, 19 aa, Mycobacterium
PGWQETKTDTAQPELVHTA

SEQ ID NO: 275005 - protein, 5 aa, Mycobacterium
PGWQP

SEQ ID NO: 275006 - protein, 15 aa, Mycobacterium
PGWQPAQVQTPAPVA

SEQ ID NO: 275007 - protein, 20 aa, Mycobacterium
PGWTPEKTERLRPLLTNNES

SEQ ID NO: 275008 - protein, 4 aa, Mycobacterium
PGYA

SEQ ID NO: 275009 - protein, 12 aa, Mycobacterium
PGYAEGLNPGAD

SEQ ID NO: 275010 - protein, 29 aa, Mycobacterium
PGYANAQPTLGPAKTSSITVDGTKAARVD

SEQ ID NO: 275011 - protein, 12 aa, Mycobacterium
PGYAQGLNPGAD

SEQ ID NO: 275012 - protein, 4 aa, Mycobacterium
PGYI

SEQ ID NO: 275013 - protein, 7 aa, Mycobacterium
PGYKTSY

SEQ ID NO: 275014 - protein, 24 aa, Mycobacterium
PGYKTSYDDKKYIPKDIPANQGFQ

SEQ ID NO: 275015 - protein, 125 aa, Mycobacterium
PGYPRPPYNPPYTPPSTTTITPPTTTVPTTTVPTTTVPTTTVPTTTSPPTTTETAPTTTYTPPTTTETAPTTTYSPPTTTEAAPTTTYTPPTTHEQPATTYSPPPTHTQTQTQQTVPQTHTQQPV

SEQ ID NO: 275016 - protein, 13 aa, Mycobacterium
PGYQTSYDDTRYV

SEQ ID NO: 275017 - protein, 5 aa, Mycobacterium
PGYRT

SEQ ID NO: 275018 - protein, 24 aa, Mycobacterium
PGYRTSYDDKKYIPKDIPANAGFQ

SEQ ID NO: 275019 - protein, 4 aa, Mycobacterium
PGYT

SEQ ID NO: 275020 - protein, 5 aa, Mycobacterium
PGYTP

SEQ ID NO: 275021 - protein, 22 aa, Mycobacterium
PGYVQSSPTLGPTKKSSTTVDG

SEQ ID NO: 275022 - protein, 18 aa, Mycobacterium
PGYVTAGSELPSTDDSGL

SEQ ID NO: 275023 - protein, 13 aa, Mycobacterium
PHAAPGDMRRGIF

SEQ ID NO: 275024 - protein, 6 aa, Mycobacterium
PHADGP

SEQ ID NO: 275025 - protein, 22 aa, Mycobacterium
PHAERGDGGRIRRSRRAAPDVA

SEQ ID NO: 275026 - protein, 9 aa, Mycobacterium
PHAGPTGAP

SEQ ID NO: 275027 - protein, 7 aa, Mycobacterium
PHAPTEV

SEQ ID NO: 275028 - protein, 7 aa, Mycobacterium
PHARHRP

SEQ ID NO: 275029 - protein, 11 aa, Mycobacterium
PHARPAEPSIG

SEQ ID NO: 275030 - protein, 11 aa, Mycobacterium
PHARPGEPSIG

SEQ ID NO: 275031 - protein, 7 aa, Mycobacterium
PHARSTA

SEQ ID NO: 275032 - protein, 7 aa, Mycobacterium
PHDPRGT

SEQ ID NO: 275033 - protein, 5 aa, Mycobacterium
PHDSM

SEQ ID NO: 275034 - protein, 12 aa, Mycobacterium
PHEEPAQPPQPW

SEQ ID NO: 275035 - protein, 13 aa, Mycobacterium
PHEGTRSRSLGNL

SEQ ID NO: 275036 - protein, 11 aa, Mycobacterium
PHEPGDLPDDA

SEQ ID NO: 275037 - protein, 8 aa, Mycobacterium
PHESKRAI

SEQ ID NO: 275038 - protein, 5 aa, Mycobacterium
PHESP

SEQ ID NO: 275039 - protein, 10 aa, Mycobacterium
PHGAPGDATG

SEQ ID NO: 275040 - protein, 5 aa, Mycobacterium
PHGDE

SEQ ID NO: 275041 - protein, 10 aa, Mycobacterium
PHGNQVGYGE

SEQ ID NO: 275042 - protein, 12 aa, Mycobacterium
PHGPEPKGNVTP

SEQ ID NO: 275043 - protein, 15 aa, Mycobacterium
PHGRTPDQTPPTPVV

SEQ ID NO: 275044 - protein, 7 aa, Mycobacterium
PHGSPQR

SEQ ID NO: 275045 - protein, 5 aa, Mycobacterium
PHGTD

SEQ ID NO: 275046 - protein, 13 aa, Mycobacterium
PHGTNEAKGAIRR

SEQ ID NO: 275047 - protein, 30 aa, Mycobacterium
PHGTPPAPEAGHPPPADQPAPAGEEPRGRG

SEQ ID NO: 275048 - protein, 14 aa, Mycobacterium
PHGVTADRVDPSAL

SEQ ID NO: 275049 - protein, 4 aa, Mycobacterium
PHHS

SEQ ID NO: 275050 - protein, 33 aa, Mycobacterium
PHLPPAAAEPPAPEPEPEPGLPAPVPPEPTAPG

SEQ ID NO: 275051 - protein, 29 aa, Mycobacterium
PHLPPAAAPEPTPEPGPPGAVPPNPTAPG

SEQ ID NO: 275052 - protein, 31 aa, Mycobacterium
PHLPPANVPPPAAPAPAGPVPPEAPNPPAPG

SEQ ID NO: 275053 - protein, 8 aa, Mycobacterium
PHLTDDPD

SEQ ID NO: 275054 - protein, 7 aa, Mycobacterium
PHLTNNP

SEQ ID NO: 275055 - protein, 4 aa, Mycobacterium
PHMP

SEQ ID NO: 275056 - protein, 11 aa, Mycobacterium
PHNANGKPDYA

SEQ ID NO: 275057 - protein, 7 aa, Mycobacterium
PHNTNSV

SEQ ID NO: 275058 - protein, 8 aa, Mycobacterium
PHPATASE

SEQ ID NO: 275059 - protein, 5 aa, Mycobacterium
PHPEL

SEQ ID NO: 275060 - protein, 7 aa, Mycobacterium
PHPGPVA

SEQ ID NO: 275061 - protein, 9 aa, Mycobacterium
PHPPARPEP

SEQ ID NO: 275062 - protein, 11 aa, Mycobacterium
PHPSVKPPGVK

SEQ ID NO: 275063 - protein, 9 aa, Mycobacterium
PHQRSGGTL

SEQ ID NO: 275064 - protein, 12 aa, Mycobacterium
PHREQYSDPEKP

SEQ ID NO: 275065 - protein, 14 aa, Mycobacterium
PHRGDEPLTEKPSW

SEQ ID NO: 275066 - protein, 5 aa, Mycobacterium
PHRKT

SEQ ID NO: 275067 - protein, 10 aa, Mycobacterium
PHRPGGPTPF

SEQ ID NO: 275068 - protein, 10 aa, Mycobacterium
PHRPGTPAPF

SEQ ID NO: 275069 - protein, 10 aa, Mycobacterium
PHRPGTQTPF

SEQ ID NO: 275070 - protein, 7 aa, Mycobacterium
PHRSPRR

SEQ ID NO: 275071 - protein, 8 aa, Mycobacterium
PHRSPRRP

SEQ ID NO: 275072 - protein, 18 aa, Mycobacterium
PHRTNPQTATPPKDLPRA

SEQ ID NO: 275073 - protein, 5 aa, Mycobacterium
PHRTT

SEQ ID NO: 275074 - protein, 4 aa, Mycobacterium
PHRV

SEQ ID NO: 275075 - protein, 24 aa, Mycobacterium
PHSEKRTIEASQDPPAAAQPVRQE

SEQ ID NO: 275076 - protein, 9 aa, Mycobacterium
PHSGGTAAR

SEQ ID NO: 275077 - protein, 6 aa, Mycobacterium
PHSPSV

SEQ ID NO: 275078 - protein, 6 aa, Mycobacterium
PHTAPA

SEQ ID NO: 275079 - protein, 9 aa, Mycobacterium
PHTARTRGP

SEQ ID NO: 275080 - protein, 4 aa, Mycobacterium
PHTG

SEQ ID NO: 275081 - protein, 37 aa, Mycobacterium
PHTNHANHATHGEHGGHPDHQTNAAHDGHSGHAGHGA

SEQ ID NO: 275082 - protein, 7 aa, Mycobacterium
PHTNKST

SEQ ID NO: 275083 - protein, 4 aa, Mycobacterium
PHTS

SEQ ID NO: 275084 - protein, 6 aa, Mycobacterium
PHTTPA

SEQ ID NO: 275085 - protein, 9 aa, Mycobacterium
PHTTPAPPV

SEQ ID NO: 275086 - protein, 6 aa, Mycobacterium
PIAAGT

SEQ ID NO: 275087 - protein, 4 aa, Mycobacterium
PIAE

SEQ ID NO: 275088 - protein, 12 aa, Mycobacterium
PIAEAQQQDQDP

SEQ ID NO: 275089 - protein, 4 aa, Mycobacterium
PIAG

SEQ ID NO: 275090 - protein, 14 aa, Mycobacterium
PIAGAPTTSPATLS

SEQ ID NO: 275091 - protein, 15 aa, Mycobacterium
PIAGAPTTSPSAVTE

SEQ ID NO: 275092 - protein, 14 aa, Mycobacterium
PIAGAQPQQGQSGQ

SEQ ID NO: 275093 - protein, 14 aa, Mycobacterium
PIAGEPTTSPAKLS

SEQ ID NO: 275094 - protein, 7 aa, Mycobacterium
PIAGTTT

SEQ ID NO: 275095 - protein, 40 aa, Mycobacterium
PIAPADVPDGASPPPPGPGSTRPQAAPSAFGGNASGSHPS

SEQ ID NO: 275096 - protein, 8 aa, Mycobacterium
PIAPAGDN

SEQ ID NO: 275097 - protein, 8 aa, Mycobacterium
PIAPPEGR

SEQ ID NO: 275098 - protein, 9 aa, Mycobacterium
PIATASDRD

SEQ ID NO: 275099 - protein, 5 aa, Mycobacterium
PIATD

SEQ ID NO: 275100 - protein, 8 aa, Mycobacterium
PICSPGNP

SEQ ID NO: 275101 - protein, 85 aa, Mycobacterium
PIDADNSSSPEATDEDSAESEAQTGSDSPDTEGELTAESEAGPDSAEATDEDSAESEDEAGPDISDSTGEDQTAAPAVERRPSRL

SEQ ID NO: 275102 - protein, 17 aa, Mycobacterium
PIDEPTAVPADEPNAAR

SEQ ID NO: 275103 - protein, 7 aa, Mycobacterium
PIDGPEA

SEQ ID NO: 275104 - protein, 8 aa, Mycobacterium
PIDPSADA

SEQ ID NO: 275105 - protein, 16 aa, Mycobacterium
PIDRTDADSAQAALTT

SEQ ID NO: 275106 - protein, 8 aa, Mycobacterium
PIDSSANV

SEQ ID NO: 275107 - protein, 55 aa, Mycobacterium
PIDTDDDSLSPEDKDEDSTAPDSGAEQADPQGDPQDPAESGEPGATAPRGPSRVG

SEQ ID NO: 275108 - protein, 9 aa, Mycobacterium
PIEAGPGDA

SEQ ID NO: 275109 - protein, 51 aa, Mycobacterium
PIEPEADTTTKKAPGTAGTGTTGANPPAAQSNTPAPGLSNPQRDTDDPDVK

SEQ ID NO: 275110 - protein, 5 aa, Mycobacterium
PIEPN

SEQ ID NO: 275111 - protein, 5 aa, Mycobacterium
PIESE

SEQ ID NO: 275112 - protein, 4 aa, Mycobacterium
PIGA

SEQ ID NO: 275113 - protein, 11 aa, Mycobacterium
PIGDAASAATI

SEQ ID NO: 275114 - protein, 11 aa, Mycobacterium
PIGDAGSAATI

SEQ ID NO: 275115 - protein, 8 aa, Mycobacterium
PIGGAPYS

SEQ ID NO: 275116 - protein, 4 aa, Mycobacterium
PIGQ

SEQ ID NO: 275117 - protein, 11 aa, Mycobacterium
PIGQDPAAVPQ

SEQ ID NO: 275118 - protein, 5 aa, Mycobacterium
PIGTA

SEQ ID NO: 275119 - protein, 4 aa, Mycobacterium
PIHG

SEQ ID NO: 275120 - protein, 10 aa, Mycobacterium
PIIGDRDSGA

SEQ ID NO: 275121 - protein, 6 aa, Mycobacterium
PIKQRG

SEQ ID NO: 275122 - protein, 5 aa, Mycobacterium
PINDP

SEQ ID NO: 275123 - protein, 24 aa, Mycobacterium
PIPAAPADDEYAGEYDEYDYSTVS

SEQ ID NO: 275124 - protein, 10 aa, Mycobacterium
PIPADPATLL

SEQ ID NO: 275125 - protein, 12 aa, Mycobacterium
PIPAPGEHVSND

SEQ ID NO: 275126 - protein, 12 aa, Mycobacterium
PIPAPGESVTND

SEQ ID NO: 275127 - protein, 7 aa, Mycobacterium
PIPEGKN

SEQ ID NO: 275128 - protein, 12 aa, Mycobacterium
PIPGAGTPNTLG

SEQ ID NO: 275129 - protein, 12 aa, Mycobacterium
PIPGATASTTTW

SEQ ID NO: 275130 - protein, 28 aa, Mycobacterium
PIPPAATTTTGPQHAKDRSRQREHAERS

SEQ ID NO: 275131 - protein, 13 aa, Mycobacterium
PIPPQLTPQPDRP

SEQ ID NO: 275132 - protein, 20 aa, Mycobacterium
PIPPTSGPELPTSTTGPAAM

SEQ ID NO: 275133 - protein, 34 aa, Mycobacterium
PIPQPSQPGGQSAPQSGSERKERPQRQREHAERT

SEQ ID NO: 275134 - protein, 5 aa, Mycobacterium
PIPRD

SEQ ID NO: 275135 - protein, 8 aa, Mycobacterium
PIPRNAPG

SEQ ID NO: 275136 - protein, 6 aa, Mycobacterium
PIPTKH

SEQ ID NO: 275137 - protein, 11 aa, Mycobacterium
PIPYPGAPAYG

SEQ ID NO: 275138 - protein, 25 aa, Mycobacterium
PIQAPPAGPAAPETGRVGGDASNIA

SEQ ID NO: 275139 - protein, 11 aa, Mycobacterium
PIQPPPPGPEV

SEQ ID NO: 275140 - protein, 12 aa, Mycobacterium
PIQPPPPGPEVI

SEQ ID NO: 275141 - protein, 42 aa, Mycobacterium
PIQPPPPGPNVAPGPVAPTPAPVAAPAPNAGGPAVPTDFGGG

SEQ ID NO: 275142 - protein, 7 aa, Mycobacterium
PIQRQTQ

SEQ ID NO: 275143 - protein, 21 aa, Mycobacterium
PIRAERPSITVSTNPRAGTLG

SEQ ID NO: 275144 - protein, 5 aa, Mycobacterium
PIRAS

SEQ ID NO: 275145 - protein, 39 aa, Mycobacterium
PIRRRPPERAAPARLAKGPEVTDRPVESAASGAELPRPV

SEQ ID NO: 275146 - protein, 47 aa, Mycobacterium
PIRRRPPERANRARLAKGPEVTDRPMESPASSAGPGTGSGTSRPVAD

SEQ ID NO: 275147 - protein, 24 aa, Mycobacterium
PISAPGPGANVKEGYDHPLSPNSP

SEQ ID NO: 275148 - protein, 7 aa, Mycobacterium
PISPDEE

SEQ ID NO: 275149 - protein, 12 aa, Mycobacterium
PISPGDAAGGAA

SEQ ID NO: 275150 - protein, 11 aa, Mycobacterium
PISQSDVGSVE

SEQ ID NO: 275151 - protein, 11 aa, Mycobacterium
PISQSEVGSVQ

SEQ ID NO: 275152 - protein, 15 aa, Mycobacterium
PITAGGSQSKDGKAA

SEQ ID NO: 275153 - protein, 8 aa, Mycobacterium
PITDPTTA

SEQ ID NO: 275154 - protein, 12 aa, Mycobacterium
PITEAQAVSADR

SEQ ID NO: 275155 - protein, 9 aa, Mycobacterium
PIYGSGLPS

SEQ ID NO: 275156 - protein, 7 aa, Mycobacterium
PIYPKSS

SEQ ID NO: 275157 - protein, 7 aa, Mycobacterium
PKAAPGS

SEQ ID NO: 275158 - protein, 11 aa, Mycobacterium
PKAAQNGSIDD

SEQ ID NO: 275159 - protein, 8 aa, Mycobacterium
PKADIGKP

SEQ ID NO: 275160 - protein, 8 aa, Mycobacterium
PKADVRRT

SEQ ID NO: 275161 - protein, 6 aa, Mycobacterium
PKAERD

SEQ ID NO: 275162 - protein, 7 aa, Mycobacterium
PKAGTSF

SEQ ID NO: 275163 - protein, 4 aa, Mycobacterium
PKAK

SEQ ID NO: 275164 - protein, 8 aa, Mycobacterium
PKAKAKAQ

SEQ ID NO: 275165 - protein, 6 aa, Mycobacterium
PKAKRI

SEQ ID NO: 275166 - protein, 6 aa, Mycobacterium
PKAKRV

SEQ ID NO: 275167 - protein, 7 aa, Mycobacterium
PKAKSGF

SEQ ID NO: 275168 - protein, 4 aa, Mycobacterium
PKAL

SEQ ID NO: 275169 - protein, 5 aa, Mycobacterium
PKALD

SEQ ID NO: 275170 - protein, 7 aa, Mycobacterium
PKALDNA

SEQ ID NO: 275171 - protein, 7 aa, Mycobacterium
PKAMDNS

SEQ ID NO: 275172 - protein, 32 aa, Mycobacterium
PKAPQAPATSESPSETPTVTPTTPTTAPSGPG

SEQ ID NO: 275173 - protein, 8 aa, Mycobacterium
PKAPTAEA

SEQ ID NO: 275174 - protein, 6 aa, Mycobacterium
PKAPWI

SEQ ID NO: 275175 - protein, 16 aa, Mycobacterium
PKAVRDSVRDAGATMS

SEQ ID NO: 275176 - protein, 7 aa, Mycobacterium
PKCGRTT

SEQ ID NO: 275177 - protein, 9 aa, Mycobacterium
PKDADDLTK

SEQ ID NO: 275178 - protein, 4 aa, Mycobacterium
PKDE

SEQ ID NO: 275179 - protein, 6 aa, Mycobacterium
PKDGAE

SEQ ID NO: 275180 - protein, 4 aa, Mycobacterium
PKDL

SEQ ID NO: 275181 - protein, 7 aa, Mycobacterium
PKDLDPA

SEQ ID NO: 275182 - protein, 9 aa, Mycobacterium
PKDLRNPQA

SEQ ID NO: 275183 - protein, 6 aa, Mycobacterium
PKDLSV

SEQ ID NO: 275184 - protein, 5 aa, Mycobacterium
PKDRI

SEQ ID NO: 275185 - protein, 4 aa, Mycobacterium
PKDV

SEQ ID NO: 275186 - protein, 22 aa, Mycobacterium
PKDYNGPGSPAYRAATEAAAKR

SEQ ID NO: 275187 - protein, 8 aa, Mycobacterium
PKEDRTKA

SEQ ID NO: 275188 - protein, 5 aa, Mycobacterium
PKEER

SEQ ID NO: 275189 - protein, 8 aa, Mycobacterium
PKEIGRSS

SEQ ID NO: 275190 - protein, 12 aa, Mycobacterium
PKEPFEASEVDG

SEQ ID NO: 275191 - protein, 6 aa, Mycobacterium
PKEPGI

SEQ ID NO: 275192 - protein, 15 aa, Mycobacterium
PKERAGAAAAVSETA

SEQ ID NO: 275193 - protein, 7 aa, Mycobacterium
PKFDRGP

SEQ ID NO: 275194 - protein, 17 aa, Mycobacterium
PKGADGKPSKKAISDAA

SEQ ID NO: 275195 - protein, 26 aa, Mycobacterium
PKGADGKPSKKAISDAAVSETWGGQI

SEQ ID NO: 275196 - protein, 6 aa, Mycobacterium
PKGAPL

SEQ ID NO: 275197 - protein, 19 aa, Mycobacterium
PKGAWGPDRREVTAEPSAH

SEQ ID NO: 275198 - protein, 4 aa, Mycobacterium
PKGI

SEQ ID NO: 275199 - protein, 5 aa, Mycobacterium
PKGKL

SEQ ID NO: 275200 - protein, 7 aa, Mycobacterium
PKGMKRA

SEQ ID NO: 275201 - protein, 7 aa, Mycobacterium
PKGPLRT

SEQ ID NO: 275202 - protein, 5 aa, Mycobacterium
PKGQI

SEQ ID NO: 275203 - protein, 10 aa, Mycobacterium
PKGQTPGSID

SEQ ID NO: 275204 - protein, 6 aa, Mycobacterium
PKGQWE

SEQ ID NO: 275205 - protein, 9 aa, Mycobacterium
PKGSNTEYQ

SEQ ID NO: 275206 - protein, 9 aa, Mycobacterium
PKGSTEPRG

SEQ ID NO: 275207 - protein, 13 aa, Mycobacterium
PKGTYRAEPTRRP

SEQ ID NO: 275208 - protein, 4 aa, Mycobacterium
PKHA

SEQ ID NO: 275209 - protein, 7 aa, Mycobacterium
PKHEQYA

SEQ ID NO: 275210 - protein, 20 aa, Mycobacterium
PKHSSSPARLTDPADPGTLA

SEQ ID NO: 275211 - protein, 10 aa, Mycobacterium
PKIASPDTYS

SEQ ID NO: 275212 - protein, 9 aa, Mycobacterium
PKKHGRDSR

SEQ ID NO: 275213 - protein, 8 aa, Mycobacterium
PKKIGRDS

SEQ ID NO: 275214 - protein, 16 aa, Mycobacterium
PKKPASETAGEQRIRV

SEQ ID NO: 275215 - protein, 9 aa, Mycobacterium
PKKSRKSPG

SEQ ID NO: 275216 - protein, 39 aa, Mycobacterium
PKKTKPAKSAKPTKRRNGASKATATGPSARPRRSAPQTM

SEQ ID NO: 275217 - protein, 5 aa, Mycobacterium
PKLAD

SEQ ID NO: 275218 - protein, 10 aa, Mycobacterium
PKLADESLTE

SEQ ID NO: 275219 - protein, 10 aa, Mycobacterium
PKLADGSLSE

SEQ ID NO: 275220 - protein, 5 aa, Mycobacterium
PKLER

SEQ ID NO: 275221 - protein, 6 aa, Mycobacterium
PKLERY

SEQ ID NO: 275222 - protein, 7 aa, Mycobacterium
PKLGERL

SEQ ID NO: 275223 - protein, 4 aa, Mycobacterium
PKLP

SEQ ID NO: 275224 - protein, 16 aa, Mycobacterium
PKLPAAPGSEEAPELA

SEQ ID NO: 275225 - protein, 28 aa, Mycobacterium
PKLPKSERLAAEDPARHSSQAKEASLAA

SEQ ID NO: 275226 - protein, 8 aa, Mycobacterium
PKLPPAPR

SEQ ID NO: 275227 - protein, 7 aa, Mycobacterium
PKLPTLQ

SEQ ID NO: 275228 - protein, 10 aa, Mycobacterium
PKLSPAEANG

SEQ ID NO: 275229 - protein, 16 aa, Mycobacterium
PKLSSSASSGPGRTTV

SEQ ID NO: 275230 - protein, 11 aa, Mycobacterium
PKLTPQPAGGE

SEQ ID NO: 275231 - protein, 7 aa, Mycobacterium
PKNDAGK

SEQ ID NO: 275232 - protein, 7 aa, Mycobacterium
PKNEAGK

SEQ ID NO: 275233 - protein, 16 aa, Mycobacterium
PKNPDNWRFAPPEPPP

SEQ ID NO: 275234 - protein, 22 aa, Mycobacterium
PKNPSAERLSASTPIRAQGVTT

SEQ ID NO: 275235 - protein, 50 aa, Mycobacterium
PKNQDPAAADPTNPDVTAEDSAQAEDGPDSTSPEPTAEASAEAEDGPDLI

SEQ ID NO: 275236 - protein, 4 aa, Mycobacterium
PKNR

SEQ ID NO: 275237 - protein, 4 aa, Mycobacterium
PKNW

SEQ ID NO: 275238 - protein, 14 aa, Mycobacterium
PKPAAPQSTTTRAG

SEQ ID NO: 275239 - protein, 12 aa, Mycobacterium
PKPAEGVAPAPL

SEQ ID NO: 275240 - protein, 7 aa, Mycobacterium
PKPARRP

SEQ ID NO: 275241 - protein, 10 aa, Mycobacterium
PKPATDPRRR

SEQ ID NO: 275242 - protein, 7 aa, Mycobacterium
PKPDDGH

SEQ ID NO: 275243 - protein, 13 aa, Mycobacterium
PKPEAGHEASGIN

SEQ ID NO: 275244 - protein, 8 aa, Mycobacterium
PKPGDIRT

SEQ ID NO: 275245 - protein, 10 aa, Mycobacterium
PKPGDIRTSQ

SEQ ID NO: 275246 - protein, 10 aa, Mycobacterium
PKPGQTIPGV

SEQ ID NO: 275247 - protein, 15 aa, Mycobacterium
PKPGTGPSESARERG

SEQ ID NO: 275248 - protein, 4 aa, Mycobacterium
PKPL

SEQ ID NO: 275249 - protein, 5 aa, Mycobacterium
PKPLR

SEQ ID NO: 275250 - protein, 14 aa, Mycobacterium
PKPPSPEATVSQSG

SEQ ID NO: 275251 - protein, 12 aa, Mycobacterium
PKPPSRSAAVSH

SEQ ID NO: 275252 - protein, 12 aa, Mycobacterium
PKPPSSRGAVSH

SEQ ID NO: 275253 - protein, 7 aa, Mycobacterium
PKPSAVH

SEQ ID NO: 275254 - protein, 6 aa, Mycobacterium
PKPSEN

SEQ ID NO: 275255 - protein, 10 aa, Mycobacterium
PKPYSASPSD

SEQ ID NO: 275256 - protein, 4 aa, Mycobacterium
PKQL

SEQ ID NO: 275257 - protein, 12 aa, Mycobacterium
PKQNGHQPDSAS

SEQ ID NO: 275258 - protein, 22 aa, Mycobacterium
PKQQQGGYAQFGTGAAAGYGAQ

SEQ ID NO: 275259 - protein, 37 aa, Mycobacterium
PKQRGGYAQFGPGLAQPGYAGDPYAAPYQETRAARPL

SEQ ID NO: 275260 - protein, 42 aa, Mycobacterium
PKQRGGYAQFGTGAAPMQGYGADPYAAPYQAPYQEARASRPL

SEQ ID NO: 275261 - protein, 22 aa, Mycobacterium
PKQRGGYAQFGTGAGAGYAGDP

SEQ ID NO: 275262 - protein, 14 aa, Mycobacterium
PKRATPRVKLLEAD

SEQ ID NO: 275263 - protein, 5 aa, Mycobacterium
PKRGE

SEQ ID NO: 275264 - protein, 17 aa, Mycobacterium
PKRIPRGRKARRQRRRT

SEQ ID NO: 275265 - protein, 9 aa, Mycobacterium
PKRKADSGI

SEQ ID NO: 275266 - protein, 10 aa, Mycobacterium
PKRLEAVGAT

SEQ ID NO: 275267 - protein, 7 aa, Mycobacterium
PKRLGRP

SEQ ID NO: 275268 - protein, 17 aa, Mycobacterium
PKRPAERAGRPDPLASD

SEQ ID NO: 275269 - protein, 7 aa, Mycobacterium
PKRPTRG

SEQ ID NO: 275270 - protein, 6 aa, Mycobacterium
PKRPVN

SEQ ID NO: 275271 - protein, 25 aa, Mycobacterium
PKRTAGAPPEPAPADNAVTAEPSAP

SEQ ID NO: 275272 - protein, 15 aa, Mycobacterium
PKSAAGKILRKELRT

SEQ ID NO: 275273 - protein, 15 aa, Mycobacterium
PKSASGKILRKDLRT

SEQ ID NO: 275274 - protein, 8 aa, Mycobacterium
PKSERNKA

SEQ ID NO: 275275 - protein, 25 aa, Mycobacterium
PKSESASTSPSTASPSAPSPASADA

SEQ ID NO: 275276 - protein, 4 aa, Mycobacterium
PKSL

SEQ ID NO: 275277 - protein, 7 aa, Mycobacterium
PKSLDTL

SEQ ID NO: 275278 - protein, 8 aa, Mycobacterium
PKTGADAM

SEQ ID NO: 275279 - protein, 6 aa, Mycobacterium
PKTLRE

SEQ ID NO: 275280 - protein, 8 aa, Mycobacterium
PKTPENSR

SEQ ID NO: 275281 - protein, 20 aa, Mycobacterium
PKTQGGYATFGTGAAGYGAQ

SEQ ID NO: 275282 - protein, 10 aa, Mycobacterium
PKTRAPTERR

SEQ ID NO: 275283 - protein, 6 aa, Mycobacterium
PKVGRD

SEQ ID NO: 275284 - protein, 5 aa, Mycobacterium
PKVPS

SEQ ID NO: 275285 - protein, 26 aa, Mycobacterium
PKVSASHSSADTTAVTARTNQPTNTR

SEQ ID NO: 275286 - protein, 5 aa, Mycobacterium
PKVTG

SEQ ID NO: 275287 - protein, 11 aa, Mycobacterium
PKVYAKPAGGA

SEQ ID NO: 275288 - protein, 7 aa, Mycobacterium
PKWGPPV

SEQ ID NO: 275289 - protein, 4 aa, Mycobacterium
PKWP

SEQ ID NO: 275290 - protein, 4 aa, Mycobacterium
PKYR

SEQ ID NO: 275291 - protein, 68 aa, Mycobacterium
PLADAARASELGSPQPPGGSAYQGYPPPGPVPPPPPMPPPYGSTYGSYDSYGYQSPFPGATPRSSSGN

SEQ ID NO: 275292 - protein, 6 aa, Mycobacterium
PLADRT

SEQ ID NO: 275293 - protein, 8 aa, Mycobacterium
PLAETQRR

SEQ ID NO: 275294 - protein, 4 aa, Mycobacterium
PLAG

SEQ ID NO: 275295 - protein, 10 aa, Mycobacterium
PLAGASAVQP

SEQ ID NO: 275296 - protein, 10 aa, Mycobacterium
PLAGGKSTAI

SEQ ID NO: 275297 - protein, 5 aa, Mycobacterium
PLAGK

SEQ ID NO: 275298 - protein, 6 aa, Mycobacterium
PLAGPA

SEQ ID NO: 275299 - protein, 7 aa, Mycobacterium
PLAGPAG

SEQ ID NO: 275300 - protein, 15 aa, Mycobacterium
PLAGPARDTRRQDNS

SEQ ID NO: 275301 - protein, 13 aa, Mycobacterium
PLAGPEGLIPGTA

SEQ ID NO: 275302 - protein, 16 aa, Mycobacterium
PLAGPEGLVPGKPAQF

SEQ ID NO: 275303 - protein, 12 aa, Mycobacterium
PLAGREGLHPGS

SEQ ID NO: 275304 - protein, 24 aa, Mycobacterium
PLAGSRNTRDRGTARRNGTTNLWP

SEQ ID NO: 275305 - protein, 10 aa, Mycobacterium
PLAGSVTKPV

SEQ ID NO: 275306 - protein, 9 aa, Mycobacterium
PLAKGNERI

SEQ ID NO: 275307 - protein, 5 aa, Mycobacterium
PLAPA

SEQ ID NO: 275308 - protein, 46 aa, Mycobacterium
PLAPAEAAAAPAVEPYREPAYEPAEVSSGALTKPRTAADPQQKRGW

SEQ ID NO: 275309 - protein, 15 aa, Mycobacterium
PLAPATTGTPTVEPY

SEQ ID NO: 275310 - protein, 15 aa, Mycobacterium
PLAPGGADAPASAVQ

SEQ ID NO: 275311 - protein, 15 aa, Mycobacterium
PLAPGLGAPPIGSPT

SEQ ID NO: 275312 - protein, 6 aa, Mycobacterium
PLAPGN

SEQ ID NO: 275313 - protein, 11 aa, Mycobacterium
PLAPGNETIGD

SEQ ID NO: 275314 - protein, 9 aa, Mycobacterium
PLAPPIAPN

SEQ ID NO: 275315 - protein, 6 aa, Mycobacterium
PLAPPR

SEQ ID NO: 275316 - protein, 10 aa, Mycobacterium
PLAPQDAPAV

SEQ ID NO: 275317 - protein, 9 aa, Mycobacterium
PLAQTSPAL

SEQ ID NO: 275318 - protein, 14 aa, Mycobacterium
PLARPREPATATVW

SEQ ID NO: 275319 - protein, 6 aa, Mycobacterium
PLASSP

SEQ ID NO: 275320 - protein, 9 aa, Mycobacterium
PLASTTTDL

SEQ ID NO: 275321 - protein, 20 aa, Mycobacterium
PLATELDNRKDEVNNDVEQL

SEQ ID NO: 275322 - protein, 27 aa, Mycobacterium
PLAVGPPRQRMTRRERARAERQRRRRR

SEQ ID NO: 275323 - protein, 13 aa, Mycobacterium
PLDENDVYEPGEP

SEQ ID NO: 275324 - protein, 17 aa, Mycobacterium
PLDEQRREKVPAKRLRP

SEQ ID NO: 275325 - protein, 7 aa, Mycobacterium
PLDGNAE

SEQ ID NO: 275326 - protein, 26 aa, Mycobacterium
PLDGPAAPEGRPIAAPPEPEPRDNTP

SEQ ID NO: 275327 - protein, 6 aa, Mycobacterium
PLDGPT

SEQ ID NO: 275328 - protein, 8 aa, Mycobacterium
PLDGRADQ

SEQ ID NO: 275329 - protein, 10 aa, Mycobacterium
PLDGRADQYS

SEQ ID NO: 275330 - protein, 4 aa, Mycobacterium
PLDP

SEQ ID NO: 275331 - protein, 5 aa, Mycobacterium
PLDPA

SEQ ID NO: 275332 - protein, 39 aa, Mycobacterium
PLDPRPWQRPDDSAGRPASASLVDPEDDLPSANYGGDFE

SEQ ID NO: 275333 - protein, 21 aa, Mycobacterium
PLDPSDAEALEAAAAADAEPD

SEQ ID NO: 275334 - protein, 9 aa, Mycobacterium
PLDPSDPRD

SEQ ID NO: 275335 - protein, 5 aa, Mycobacterium
PLDSD

SEQ ID NO: 275336 - protein, 6 aa, Mycobacterium
PLDSDF

SEQ ID NO: 275337 - protein, 16 aa, Mycobacterium
PLDTDGDKAADLPRDR

SEQ ID NO: 275338 - protein, 11 aa, Mycobacterium
PLDTPHGRQRP

SEQ ID NO: 275339 - protein, 15 aa, Mycobacterium
PLEGGDADEPETPGR

SEQ ID NO: 275340 - protein, 5 aa, Mycobacterium
PLEPY

SEQ ID NO: 275341 - protein, 4 aa, Mycobacterium
PLES

SEQ ID NO: 275342 - protein, 11 aa, Mycobacterium
PLFSPASDAQL

SEQ ID NO: 275343 - protein, 15 aa, Mycobacterium
PLGADGERAAPLPPD

SEQ ID NO: 275344 - protein, 5 aa, Mycobacterium
PLGDE

SEQ ID NO: 275345 - protein, 5 aa, Mycobacterium
PLGDK

SEQ ID NO: 275346 - protein, 5 aa, Mycobacterium
PLGEE

SEQ ID NO: 275347 - protein, 23 aa, Mycobacterium
PLGEERRERVRRRPPPEQDHPQK

SEQ ID NO: 275348 - protein, 9 aa, Mycobacterium
PLGGEGAAI

SEQ ID NO: 275349 - protein, 7 aa, Mycobacterium
PLGKPIE

SEQ ID NO: 275350 - protein, 5 aa, Mycobacterium
PLGLQ

SEQ ID NO: 275351 - protein, 9 aa, Mycobacterium
PLGNADRGY

SEQ ID NO: 275352 - protein, 8 aa, Mycobacterium
PLGNRRAP

SEQ ID NO: 275353 - protein, 8 aa, Mycobacterium
PLGPAGTY

SEQ ID NO: 275354 - protein, 10 aa, Mycobacterium
PLGPSNASDT

SEQ ID NO: 275355 - protein, 9 aa, Mycobacterium
PLGQAEAAR

SEQ ID NO: 275356 - protein, 25 aa, Mycobacterium
PLGQEQERQRDSQPPPREFNGGERI

SEQ ID NO: 275357 - protein, 10 aa, Mycobacterium
PLGQSDESNT

SEQ ID NO: 275358 - protein, 10 aa, Mycobacterium
PLGQTDESNT

SEQ ID NO: 275359 - protein, 10 aa, Mycobacterium
PLGQTTSPYQ

SEQ ID NO: 275360 - protein, 13 aa, Mycobacterium
PLGSGEATATMSR

SEQ ID NO: 275361 - protein, 7 aa, Mycobacterium
PLGSGTG

SEQ ID NO: 275362 - protein, 12 aa, Mycobacterium
PLGSRSPAEPAH

SEQ ID NO: 275363 - protein, 13 aa, Mycobacterium
PLGSSEATAPMSR

SEQ ID NO: 275364 - protein, 5 aa, Mycobacterium
PLGTE

SEQ ID NO: 275365 - protein, 13 aa, Mycobacterium
PLGTEIRDNSVNG

SEQ ID NO: 275366 - protein, 5 aa, Mycobacterium
PLGTP

SEQ ID NO: 275367 - protein, 6 aa, Mycobacterium
PLGTPI

SEQ ID NO: 275368 - protein, 5 aa, Mycobacterium
PLGTR

SEQ ID NO: 275369 - protein, 12 aa, Mycobacterium
PLHDPANEPLPK

SEQ ID NO: 275370 - protein, 6 aa, Mycobacterium
PLHPDT

SEQ ID NO: 275371 - protein, 6 aa, Mycobacterium
PLHPNT

SEQ ID NO: 275372 - protein, 10 aa, Mycobacterium
PLHSSPSMEE

SEQ ID NO: 275373 - protein, 4 aa, Mycobacterium
PLHT

SEQ ID NO: 275374 - protein, 5 aa, Mycobacterium
PLHTP

SEQ ID NO: 275375 - protein, 13 aa, Mycobacterium
PLKSGTDKSIDDA

SEQ ID NO: 275376 - protein, 6 aa, Mycobacterium
PLLGPS

SEQ ID NO: 275377 - protein, 4 aa, Mycobacterium
PLNE

SEQ ID NO: 275378 - protein, 12 aa, Mycobacterium
PLNGDSPPDETV

SEQ ID NO: 275379 - protein, 21 aa, Mycobacterium
PLNGYNGPPPPDYKPPAPPKL

SEQ ID NO: 275380 - protein, 29 aa, Mycobacterium
PLPAEAPKQAAPPPSPVEAPAPAVSPAPV

SEQ ID NO: 275381 - protein, 8 aa, Mycobacterium
PLPAGADQ

SEQ ID NO: 275382 - protein, 10 aa, Mycobacterium
PLPAGGAPVT

SEQ ID NO: 275383 - protein, 22 aa, Mycobacterium
PLPAPPPGGPPPGPPAPAPPEL

SEQ ID NO: 275384 - protein, 40 aa, Mycobacterium; identical to SEQ ID NO: 9088

SEQ ID NO: 275385 - protein, 4 aa, Mycobacterium
PLPD

SEQ ID NO: 275386 - protein, 5 aa, Mycobacterium
PLPDQ

SEQ ID NO: 275387 - protein, 7 aa, Mycobacterium
PLPDTVG

SEQ ID NO: 275388 - protein, 7 aa, Mycobacterium
PLPEPET

SEQ ID NO: 275389 - protein, 6 aa, Mycobacterium
PLPGAK

SEQ ID NO: 275390 - protein, 12 aa, Mycobacterium
PLPGEHRPPVRG

SEQ ID NO: 275391 - protein, 5 aa, Mycobacterium
PLPGL

SEQ ID NO: 275392 - protein, 18 aa, Mycobacterium
PLPGPAPGPGSAPPNQGG

SEQ ID NO: 275393 - protein, 7 aa, Mycobacterium
PLPGRDD

SEQ ID NO: 275394 - protein, 20 aa, Mycobacterium
PLPHAPAGQPGADTREYPDK

SEQ ID NO: 275395 - protein, 5 aa, Mycobacterium
PLPIR

SEQ ID NO: 275396 - protein, 5 aa, Mycobacterium
PLPLE

SEQ ID NO: 275397 - protein, 38 aa, Mycobacterium
PLPLENDHNAQTLGNSPTTAPTTTKKTPPPNGTGEVQR

SEQ ID NO: 275398 - protein, 12 aa, Mycobacterium
PLPNTAGCRSAA

SEQ ID NO: 275399 - protein, 9 aa, Mycobacterium
PLPPAPPIA

SEQ ID NO: 275400 - protein, 65 aa, Mycobacterium
PLPPGALQGGPGGPGEPVAPAPQPRPFPQQPAPSPAPEPPADPAAPIPPGTPAGPGGMPADDENL

SEQ ID NO: 275401 - protein, 7 aa, Mycobacterium
PLPPGTE

SEQ ID NO: 275402 - protein, 18 aa, Mycobacterium
PLPPPDELDESPAVDGEV

SEQ ID NO: 275403 - protein, 16 aa, Mycobacterium
PLPPPGAAARSAPPQE

SEQ ID NO: 275404 - protein, 12 aa, Mycobacterium
PLPPPHRSDPVT

SEQ ID NO: 275405 - protein, 25 aa, Mycobacterium
PLPPSAGFTSAPVGYPTAAPPPPTR

SEQ ID NO: 275406 - protein, 7 aa, Mycobacterium
PLPPSAL

SEQ ID NO: 275407 - protein, 13 aa, Mycobacterium
PLPQSPAGNHSSG

SEQ ID NO: 275408 - protein, 9 aa, Mycobacterium
PLPRNAGGK

SEQ ID NO: 275409 - protein, 4 aa, Mycobacterium
PLPS

SEQ ID NO: 275410 - protein, 24 aa, Mycobacterium
PLPSQRPTTTRRLPPMGSAARPAM

SEQ ID NO: 275411 - protein, 6 aa, Mycobacterium
PLPTGQ

SEQ ID NO: 275412 - protein, 7 aa, Mycobacterium
PLPTPRP

SEQ ID NO: 275413 - protein, 25 aa, Mycobacterium
PLPTPRPANTRRLPPPGSAARPAMS

SEQ ID NO: 275414 - protein, 4 aa, Mycobacterium
PLPY

SEQ ID NO: 275415 - protein, 7 aa, Mycobacterium
PLQGGDA

SEQ ID NO: 275416 - protein, 17 aa, Mycobacterium
PLQPEQRWTREDSSTHG

SEQ ID NO: 275417 - protein, 5 aa, Mycobacterium
PLQTD

SEQ ID NO: 275418 - protein, 14 aa, Mycobacterium
PLQTGPSAGQSARA

SEQ ID NO: 275419 - protein, 10 aa, Mycobacterium
PLQVSGPAAG

SEQ ID NO: 275420 - protein, 14 aa, Mycobacterium
PLRATQSLTEQDVY

SEQ ID NO: 275421 - protein, 10 aa, Mycobacterium
PLRDEGDAYA

SEQ ID NO: 275422 - protein, 17 aa, Mycobacterium
PLREGAKALSGELSPET

SEQ ID NO: 275423 - protein, 4 aa, Mycobacterium
PLRN

SEQ ID NO: 275424 - protein, 8 aa, Mycobacterium
PLRPGDPY

SEQ ID NO: 275425 - protein, 17 aa, Mycobacterium
PLRPRPQQQALGVGGQQ

SEQ ID NO: 275426 - protein, 7 aa, Mycobacterium
PLRRNTD

SEQ ID NO: 275427 - protein, 10 aa, Mycobacterium
PLRRSSPESV

SEQ ID NO: 275428 - protein, 12 aa, Mycobacterium
PLRTPADDSAAR

SEQ ID NO: 275429 - protein, 6 aa, Mycobacterium
PLRTPD

SEQ ID NO: 275430 - protein, 4 aa, Mycobacterium
PLRV

SEQ ID NO: 275431 - protein, 14 aa, Mycobacterium
PLSADPGAPLTLQA

SEQ ID NO: 275432 - protein, 14 aa, Mycobacterium
PLSADPGPPLLLQA

SEQ ID NO: 275433 - protein, 20 aa, Mycobacterium
PLSADQQMSYNDSREEGTRA

SEQ ID NO: 275434 - protein, 5 aa, Mycobacterium
PLSAE

SEQ ID NO: 275435 - protein, 5 aa, Mycobacterium
PLSED

SEQ ID NO: 275436 - protein, 5 aa, Mycobacterium
PLSEH

SEQ ID NO: 275437 - protein, 22 aa, Mycobacterium
PLSGASGNGPAVAGRGQQPHSA

SEQ ID NO: 275438 - protein, 10 aa, Mycobacterium
PLSHRNTQPG

SEQ ID NO: 275439 - protein, 4 aa, Mycobacterium
PLSI

SEQ ID NO: 275440 - protein, 5 aa, Mycobacterium
PLSLA

SEQ ID NO: 275441 - protein, 10 aa, Mycobacterium
PLSNDSASWQ

SEQ ID NO: 275442 - protein, 9 aa, Mycobacterium
PLSNKIGRK

SEQ ID NO: 275443 - protein, 22 aa, Mycobacterium
PLSNRSSRHRADMAPGPTPLTP

SEQ ID NO: 275444 - protein, 4 aa, Mycobacterium
PLSP

SEQ ID NO: 275445 - protein, 14 aa, Mycobacterium
PLSPDPGPPLILQA

SEQ ID NO: 275446 - protein, 14 aa, Mycobacterium
PLSPDPGPPLVLQA

SEQ ID NO: 275447 - protein, 24 aa, Mycobacterium
PLSPHASSSPAAPLAEARTELIDR

SEQ ID NO: 275448 - protein, 19 aa, Mycobacterium
PLSSDGQISYNQSRAEGTR

SEQ ID NO: 275449 - protein, 13 aa, Mycobacterium
PLSSKTLAGAGAA

SEQ ID NO: 275450 - protein, 11 aa, Mycobacterium
PLSTERLDGTA

SEQ ID NO: 275451 - protein, 9 aa, Mycobacterium
PLSVSGPAN

SEQ ID NO: 275452 - protein, 4 aa, Mycobacterium
PLTA

SEQ ID NO: 275453 - protein, 6 aa, Mycobacterium
PLTAEE

SEQ ID NO: 275454 - protein, 15 aa, Mycobacterium
PLTAGQGVPIGTPVT

SEQ ID NO: 275455 - protein, 16 aa, Mycobacterium
PLTASGAQSADGKSAY

SEQ ID NO: 275456 - protein, 6 aa, Mycobacterium
PLTDRT

SEQ ID NO: 275457 - protein, 4 aa, Mycobacterium
PLTE

SEQ ID NO: 275458 - protein, 5 aa, Mycobacterium
PLTEG

SEQ ID NO: 275459 - protein, 10 aa, Mycobacterium
PLTGGAPRRY

SEQ ID NO: 275460 - protein, 15 aa, Mycobacterium
PLTNPTQPALTPQRA

SEQ ID NO: 275461 - protein, 8 aa, Mycobacterium
PLTPGNRT

SEQ ID NO: 275462 - protein, 13 aa, Mycobacterium
PLTRPHRSKPGIA

SEQ ID NO: 275463 - protein, 13 aa, Mycobacterium
PLTSSGAQSMDGK

SEQ ID NO: 275464 - protein, 10 aa, Mycobacterium
PLTTSGKVRR

SEQ ID NO: 275465 - protein, 20 aa, Mycobacterium
PMAPKKPKSGKVSPNKNSGA

SEQ ID NO: 275466 - protein, 8 aa, Mycobacterium
PMAPPSAQ

SEQ ID NO: 275467 - protein, 10 aa, Mycobacterium
PMDADTQTAR

SEQ ID NO: 275468 - protein, 4 aa, Mycobacterium
PMDE

SEQ ID NO: 275469 - protein, 10 aa, Mycobacterium
PMDNNSSRGP

SEQ ID NO: 275470 - protein, 12 aa, Mycobacterium
PMDTSPGELAVP

SEQ ID NO: 275471 - protein, 20 aa, Mycobacterium
PMGGRDSASDLSRSQPTVSV

SEQ ID NO: 275472 - protein, 20 aa, Mycobacterium
PMGGRDSSTNLGRSQPSVSV

SEQ ID NO: 275473 - protein, 4 aa, Mycobacterium
PMGP

SEQ ID NO: 275474 - protein, 16 aa, Mycobacterium
PMGYQQGTGSAAAVTG

SEQ ID NO: 275475 - protein, 16 aa, Mycobacterium
PMGYQQGTGTAAAVPG

SEQ ID NO: 275476 - protein, 4 aa, Mycobacterium
PMMS

SEQ ID NO: 275477 - protein, 8 aa, Mycobacterium
PMNSPEEM

SEQ ID NO: 275478 - protein, 9 aa, Mycobacterium
PMNSPEEVH

SEQ ID NO: 275479 - protein, 5 aa, Mycobacterium
PMPAT

SEQ ID NO: 275480 - protein, 4 aa, Mycobacterium
PMPG

SEQ ID NO: 275481 - protein, 6 aa, Mycobacterium
PMPLPP

SEQ ID NO: 275482 - protein, 4 aa, Mycobacterium
PMPT

SEQ ID NO: 275483 - protein, 11 aa, Mycobacterium
PMQSSQDGAND

SEQ ID NO: 275484 - protein, 4 aa, Mycobacterium
PMSA

SEQ ID NO: 275485 - protein, 6 aa, Mycobacterium
PMSPTA

SEQ ID NO: 275486 - protein, 10 aa, Mycobacterium
PMTGPPPPLA

SEQ ID NO: 275487 - protein, 11 aa, Mycobacterium
PMTGPPPPLGD

SEQ ID NO: 275488 - protein, 35 aa, Mycobacterium
PMTSAEARARRKKLARPKLSREERKAEKAAGRARM

SEQ ID NO: 275489 - protein, 8 aa, Mycobacterium
PNADANNS

SEQ ID NO: 275490 - protein, 8 aa, Mycobacterium
PNAEANNS

SEQ ID NO: 275491 - protein, 4 aa, Mycobacterium
PNAG

SEQ ID NO: 275492 - protein, 5 aa, Mycobacterium
PNAGA

SEQ ID NO: 275493 - protein, 17 aa, Mycobacterium
PNAGAPATFPGAPGPVG

SEQ ID NO: 275494 - protein, 10 aa, Mycobacterium
PNAGGPPGFA

SEQ ID NO: 275495 - protein, 11 aa, Mycobacterium
PNAGLDPAQQS

SEQ ID NO: 275496 - protein, 10 aa, Mycobacterium
PNAGNKAQTI

SEQ ID NO: 275497 - protein, 10 aa, Mycobacterium
PNAGQPSPWD

SEQ ID NO: 275498 - protein, 18 aa, Mycobacterium
PNAGSPARFAGAPGPVGT

SEQ ID NO: 275499 - protein, 9 aa, Mycobacterium
PNAGTKAQT

SEQ ID NO: 275500 - protein, 6 aa, Mycobacterium
PNAPPF

SEQ ID NO: 275501 - protein, 6 aa, Mycobacterium
PNAQFG

SEQ ID NO: 275502 - protein, 7 aa, Mycobacterium
PNAQFGD

SEQ ID NO: 275503 - protein, 11 aa, Mycobacterium
PNARGTEDSSQ

SEQ ID NO: 275504 - protein, 8 aa, Mycobacterium
PNDAPNRA

SEQ ID NO: 275505 - protein, 19 aa, Mycobacterium
PNDASPVESTDNGRPSTVS

SEQ ID NO: 275506 - protein, 8 aa, Mycobacterium
PNDERAYP

SEQ ID NO: 275507 - protein, 6 aa, Mycobacterium
PNDLPA

SEQ ID NO: 275508 - protein, 6 aa, Mycobacterium
PNDTTT

SEQ ID NO: 275509 - protein, 4 aa, Mycobacterium
PNDY

SEQ ID NO: 275510 - protein, 11 aa, Mycobacterium
PNEADGVGPAR

SEQ ID NO: 275511 - protein, 6 aa, Mycobacterium
PNEDAK

SEQ ID NO: 275512 - protein, 4 aa, Mycobacterium
PNEP

SEQ ID NO: 275513 - protein, 12 aa, Mycobacterium
PNEQGNQLEPAT

SEQ ID NO: 275514 - protein, 10 aa, Mycobacterium
PNESNTGAMT

SEQ ID NO: 275515 - protein, 11 aa, Mycobacterium
PNESQTKSLTT

SEQ ID NO: 275516 - protein, 4 aa, Mycobacterium
PNEV

SEQ ID NO: 275517 - protein, 18 aa, Mycobacterium
PNFPPQPPHGFEQPQGFD

SEQ ID NO: 275518 - protein, 8 aa, Mycobacterium
PNFTSSAN

SEQ ID NO: 275519 - protein, 10 aa, Mycobacterium
PNGAASLGDN

SEQ ID NO: 275520 - protein, 11 aa, Mycobacterium
PNGAASTQATT

SEQ ID NO: 275521 - protein, 16 aa, Mycobacterium
PNGASDTDRAAPAPGR

SEQ ID NO: 275522 - protein, 10 aa, Mycobacterium
PNGEANTQTT

SEQ ID NO: 275523 - protein, 7 aa, Mycobacterium
PNGEPGV

SEQ ID NO: 275524 - protein, 7 aa, Mycobacterium
PNGERFG

SEQ ID NO: 275525 - protein, 6 aa, Mycobacterium
PNGESV

SEQ ID NO: 275526 - protein, 4 aa, Mycobacterium
PNGF

SEQ ID NO: 275527 - protein, 44 aa, Mycobacterium
PNGHATQSPEPEKTDFASGHASSDGVGEPTDADVEASQAEERRA

SEQ ID NO: 275528 - protein, 10 aa, Mycobacterium
PNGKRDNNAL

SEQ ID NO: 275529 - protein, 5 aa, Mycobacterium
PNGLS

SEQ ID NO: 275530 - protein, 13 aa, Mycobacterium
PNGLSTNGSSPVA

SEQ ID NO: 275531 - protein, 8 aa, Mycobacterium
PNGMPGPE

SEQ ID NO: 275532 - protein, 16 aa, Mycobacterium
PNGQAGSSPVLADRST

SEQ ID NO: 275533 - protein, 19 aa, Mycobacterium
PNGSEPDANDTAAPTRANH

SEQ ID NO: 275534 - protein, 4 aa, Mycobacterium
PNGT

SEQ ID NO: 275535 - protein, 9 aa, Mycobacterium
PNGTAGTNA

SEQ ID NO: 275536 - protein, 5 aa, Mycobacterium
PNGTF

SEQ ID NO: 275537 - protein, 46 aa, Mycobacterium
PNGTSATGDRRDGVGPGGAPSAMSSPHETASGSFDHADDSDPAGRR

SEQ ID NO: 275538 - protein, 287 aa, Mycobacterium
PNGTTNGNGNGNGHTNGNGHTNGNGHTNGNGHTNGTNGHGTNGATNGNGHTNGTNGTNGHGTNGATNGHTNGTNGNGHTNGTNGHGTNGATNGNGHTNGTNGTNGHGTNGATNGHTNGNGNGTNGNGNGTNGHGTNGHTNGNGTNGATNGASNGATNGTNGHTNGNGNGNGTNGHTSGNGNGTNGATNGASNGATNGTNGHTNGNGNGTNGATNGHTNGNGNGTNGHTSGNGNGTNGATNGASNGATNGTNGHTNGNGNGNGTNGATNEHGTNGSTNGDIDDADEGH

SEQ ID NO: 275539 - protein, 4 aa, Mycobacterium
PNGV

SEQ ID NO: 275540 - protein, 5 aa, Mycobacterium
PNHQS

SEQ ID NO: 275541 - protein, 4 aa, Mycobacterium
PNIP

SEQ ID NO: 275542 - protein, 14 aa, Mycobacterium
PNIPASELTADQRA

SEQ ID NO: 275543 - protein, 32 aa, Mycobacterium
PNIPPGAEPDPGTPTLPPPSPPAPEVPPAGGD

SEQ ID NO: 275544 - protein, 16 aa, Mycobacterium
PNKQAKITNHTDVTGA

SEQ ID NO: 275545 - protein, 17 aa, Mycobacterium
PNKQAKITNHTDVTGAA

SEQ ID NO: 275546 - protein, 14 aa, Mycobacterium
PNKQAKITNNTEVT

SEQ ID NO: 275547 - protein, 17 aa, Mycobacterium
PNLGPESERVTDRPGRA

SEQ ID NO: 275548 - protein, 15 aa, Mycobacterium
PNMPRPYRTPGGAVT

SEQ ID NO: 275549 - protein, 13 aa, Mycobacterium
PNMPRPYRTPGGI

SEQ ID NO: 275550 - protein, 6 aa, Mycobacterium
PNMSPP

SEQ ID NO: 275551 - protein, 9 aa, Mycobacterium
PNNERAEPG

SEQ ID NO: 275552 - protein, 8 aa, Mycobacterium
PNNERAHP

SEQ ID NO: 275553 - protein, 9 aa, Mycobacterium
PNNERAKTG

SEQ ID NO: 275554 - protein, 9 aa, Mycobacterium
PNNERAQTG

SEQ ID NO: 275555 - protein, 4 aa, Mycobacterium
PNNT

SEQ ID NO: 275556 - protein, 7 aa, Mycobacterium
PNNTEGR

SEQ ID NO: 275557 - protein, 8 aa, Mycobacterium
PNPAANNS

SEQ ID NO: 275558 - protein, 9 aa, Mycobacterium
PNPAANNSV

SEQ ID NO: 275559 - protein, 8 aa, Mycobacterium
PNPAEPDH

SEQ ID NO: 275560 - protein, 8 aa, Mycobacterium
PNPAGEDV

SEQ ID NO: 275561 - protein, 10 aa, Mycobacterium
PNPALSPRAQ

SEQ ID NO: 275562 - protein, 19 aa, Mycobacterium
PNPEAEAEKQTEEADEKNA

SEQ ID NO: 275563 - protein, 35 aa, Mycobacterium
PNPEHTGFTPYPPAYPSVPAPPRRTPTPPAPAAVA

SEQ ID NO: 275564 - protein, 4 aa, Mycobacterium
PNPG

SEQ ID NO: 275565 - protein, 5 aa, Mycobacterium
PNPGI

SEQ ID NO: 275566 - protein, 6 aa, Mycobacterium
PNPKTY

SEQ ID NO: 275567 - protein, 17 aa, Mycobacterium
PNPPTVAEYENASDGYA

SEQ ID NO: 275568 - protein, 13 aa, Mycobacterium
PNPQQPAPQPDRP

SEQ ID NO: 275569 - protein, 12 aa, Mycobacterium
PNPSLEDPNPPL

SEQ ID NO: 275570 - protein, 7 aa, Mycobacterium
PNPTGDP

SEQ ID NO: 275571 - protein, 9 aa, Mycobacterium
PNPTGDPNV

SEQ ID NO: 275572 - protein, 7 aa, Mycobacterium
PNPTGVD

SEQ ID NO: 275573 - protein, 5 aa, Mycobacterium
PNPVR

SEQ ID NO: 275574 - protein, 12 aa, Mycobacterium
PNPYGAAPNEPG

SEQ ID NO: 275575 - protein, 7 aa, Mycobacterium
PNQIARG

SEQ ID NO: 275576 - protein, 9 aa, Mycobacterium
PNQNPERRT

SEQ ID NO: 275577 - protein, 10 aa, Mycobacterium
PNRATDRTRA

SEQ ID NO: 275578 - protein, 6 aa, Mycobacterium
PNRERS

SEQ ID NO: 275579 - protein, 5 aa, Mycobacterium
PNRGP

SEQ ID NO: 275580 - protein, 4 aa, Mycobacterium
PNRH

SEQ ID NO: 275581 - protein, 6 aa, Mycobacterium
PNRPAG

SEQ ID NO: 275582 - protein, 8 aa, Mycobacterium
PNRPAGRG

SEQ ID NO: 275583 - protein, 14 aa, Mycobacterium
PNRTVGAPGGGGPT

SEQ ID NO: 275584 - protein, 7 aa, Mycobacterium
PNRVGPR

SEQ ID NO: 275585 - protein, 5 aa, Mycobacterium
PNRYA

SEQ ID NO: 275586 - protein, 14 aa, Mycobacterium
PNSDAGQDTAETNQ

SEQ ID NO: 275587 - protein, 13 aa, Mycobacterium
PNSDTGAELPDGH

SEQ ID NO: 275588 - protein, 4 aa, Mycobacterium
PNSK

SEQ ID NO: 275589 - protein, 5 aa, Mycobacterium
PNSLA

SEQ ID NO: 275590 - protein, 9 aa, Mycobacterium
PNSPTSIAD

SEQ ID NO: 275591 - protein, 5 aa, Mycobacterium
PNSSA

SEQ ID NO: 275592 - protein, 7 aa, Mycobacterium
PNSVSPD

SEQ ID NO: 275593 - protein, 4 aa, Mycobacterium
PNSW

SEQ ID NO: 275594 - protein, 7 aa, Mycobacterium
PNTASGF

SEQ ID NO: 275595 - protein, 27 aa, Mycobacterium
PNTASGPRTVTASPSPTSPASTASADA

SEQ ID NO: 275596 - protein, 5 aa, Mycobacterium
PNTDR

SEQ ID NO: 275597 - protein, 5 aa, Mycobacterium
PNTGG

SEQ ID NO: 275598 - protein, 9 aa, Mycobacterium
PNTGGNPSI

SEQ ID NO: 275599 - protein, 5 aa, Mycobacterium
PNTGL

SEQ ID NO: 275600 - protein, 11 aa, Mycobacterium
PNTGPGERHDK

SEQ ID NO: 275601 - protein, 5 aa, Mycobacterium
PNTID

SEQ ID NO: 275602 - protein, 11 aa, Mycobacterium
PNTPDEKKTVR

SEQ ID NO: 275603 - protein, 16 aa, Mycobacterium
PNTPGSGLLSSPTAEL

SEQ ID NO: 275604 - protein, 5 aa, Mycobacterium
PNTTR

SEQ ID NO: 275605 - protein, 14 aa, Mycobacterium
PNVANAGTANTVKQ

SEQ ID NO: 275606 - protein, 7 aa, Mycobacterium
PNVPGAG

SEQ ID NO: 275607 - protein, 5 aa, Mycobacterium
PPAAA

SEQ ID NO: 275608 - protein, 82 aa, Mycobacterium
PPAAPAPAPRQTQTAPPSNQHLPNQQPVVTPSRAPAAPATTTQATQPPPATQSQPPPADGGAPPPAQAPEPEAPAPAEPAPG

SEQ ID NO: 275609 - protein, 41 aa, Mycobacterium
PPAAPPPPPPTTQEEEAPRQAPVYRPPQRQRESTKKPEIGV

SEQ ID NO: 275610 - protein, 5 aa, Mycobacterium
PPAAS

SEQ ID NO: 275611 - protein, 6 aa, Mycobacterium
PPADPL

SEQ ID NO: 275612 - protein, 9 aa, Mycobacterium
PPADQRKKT

SEQ ID NO: 275613 - protein, 20 aa, Mycobacterium
PPAEAESEIAGAKPVAAPSA

SEQ ID NO: 275614 - protein, 7 aa, Mycobacterium
PPAEELP

SEQ ID NO: 275615 - protein, 5 aa, Mycobacterium
PPAEF

SEQ ID NO: 275616 - protein, 13 aa, Mycobacterium
PPAEGSDGAGEAF

SEQ ID NO: 275617 - protein, 12 aa, Mycobacterium
PPAEPSPRPLRS

SEQ ID NO: 275618 - protein, 17 aa, Mycobacterium
PPAESGDGSGGGTGAEQ

SEQ ID NO: 275619 - protein, 4 aa, Mycobacterium
PPAF

SEQ ID NO: 275620 - protein, 8 aa, Mycobacterium
PPAGAPGQ

SEQ ID NO: 275621 - protein, 8 aa, Mycobacterium
PPAGAQQP

SEQ ID NO: 275622 - protein, 29 aa, Mycobacterium
PPAGPTERLATAPGDDATPGKKKRRFGRD

SEQ ID NO: 275623 - protein, 7 aa, Mycobacterium
PPAGTSF

SEQ ID NO: 275624 - protein, 10 aa, Mycobacterium
PPAKKTKMTA

SEQ ID NO: 275625 - protein, 4 aa, Mycobacterium
PPAL

SEQ ID NO: 275626 - protein, 20 aa, Mycobacterium
PPALPAAPPPPPQAPPAAEV

SEQ ID NO: 275627 - protein, 25 aa, Mycobacterium
PPANPSPAKLRNGSKIERKNTRIGQ

SEQ ID NO: 275628 - protein, 17 aa, Mycobacterium
PPAPAAAPPAEVPAPSG

SEQ ID NO: 275629 - protein, 20 aa, Mycobacterium
PPAPPPGAPRESGPTPGSEP

SEQ ID NO: 275630 - protein, 8 aa, Mycobacterium
PPAPPPMP

SEQ ID NO: 275631 - protein, 12 aa, Mycobacterium
PPAPPPPDPRPR

SEQ ID NO: 275632 - protein, 8 aa, Mycobacterium
PPAPPQWS

SEQ ID NO: 275633 - protein, 13 aa, Mycobacterium
PPAQAYTYDNPPR

SEQ ID NO: 275634 - protein, 10 aa, Mycobacterium
PPAQPPQQPY

SEQ ID NO: 275635 - protein, 16 aa, Mycobacterium
PPAQQPTNQFSAPTQQ

SEQ ID NO: 275636 - protein, 5 aa, Mycobacterium
PPAQW

SEQ ID NO: 275637 - protein, 18 aa, Mycobacterium
PPAREPGSSEQTTSRISP

SEQ ID NO: 275638 - protein, 8 aa, Mycobacterium
PPARPSQL

SEQ ID NO: 275639 - protein, 8 aa, Mycobacterium
PPARRGET

SEQ ID NO: 275640 - protein, 5 aa, Mycobacterium
PPARY

SEQ ID NO: 275641 - protein, 4 aa, Mycobacterium
PPAS

SEQ ID NO: 275642 - protein, 7 aa, Mycobacterium
PPASGGR

SEQ ID NO: 275643 - protein, 5 aa, Mycobacterium
PPASM

SEQ ID NO: 275644 - protein, 9 aa, Mycobacterium
PPASRRTDG

SEQ ID NO: 275645 - protein, 8 aa, Mycobacterium
PPASTSDE

SEQ ID NO: 275646 - protein, 19 aa, Mycobacterium
PPATEPASATEAVATTGWA

SEQ ID NO: 275647 - protein, 17 aa, Mycobacterium
PPAVAPDPGQRADGGPQ

SEQ ID NO: 275648 - protein, 26 aa, Mycobacterium
PPAVDAAPADEIRPELGSTVNGQREH

SEQ ID NO: 275649 - protein, 30 aa, Mycobacterium
PPAVDTSEVPKAGGDPPAPLPVPAKPIGGE

SEQ ID NO: 275650 - protein, 18 aa, Mycobacterium
PPCGKYHDSPARALRAGG

SEQ ID NO: 275651 - protein, 94 aa, Mycobacterium
PPCPPPRATSPPESPPGPLTPTTASGTPEPSVTSSPASPTTTSSAGAPPTTSGSAGPNHASTSPTAPTSPSTTSPPVTALPPPPPQPGIDCRAA

SEQ ID NO: 275652 - protein, 16 aa, Mycobacterium
PPDAGYRATEDRSLAS

SEQ ID NO: 275653 - protein, 7 aa, Mycobacterium
PPDARGR

SEQ ID NO: 275654 - protein, 10 aa, Mycobacterium
PPDATERRAD

SEQ ID NO: 275655 - protein, 9 aa, Mycobacterium
PPDAVSATA

SEQ ID NO: 275656 - protein, 11 aa, Mycobacterium
PPDDPSAGRLH

SEQ ID NO: 275657 - protein, 7 aa, Mycobacterium
PPDDTHV

SEQ ID NO: 275658 - protein, 5 aa, Mycobacterium
PPDDV

SEQ ID NO: 275659 - protein, 6 aa, Mycobacterium
PPDEND

SEQ ID NO: 275660 - protein, 6 aa, Mycobacterium
PPDERE

SEQ ID NO: 275661 - protein, 6 aa, Mycobacterium
PPDERR

SEQ ID NO: 275662 - protein, 5 aa, Mycobacterium
PPDGH

SEQ ID NO: 275663 - protein, 7 aa, Mycobacterium
PPDGSKP

SEQ ID NO: 275664 - protein, 12 aa, Mycobacterium
PPDGYATAPTAF

SEQ ID NO: 275665 - protein, 20 aa, Mycobacterium
PPDKAGRAAGNARNSEKSSV

SEQ ID NO: 275666 - protein, 26 aa, Mycobacterium
PPDKTREEIDEANSQDFRQSEDSAEY

SEQ ID NO: 275667 - protein, 12 aa, Mycobacterium
PPDLPPSAGPGL

SEQ ID NO: 275668 - protein, 7 aa, Mycobacterium
PPDLSTV

SEQ ID NO: 275669 - protein, 5 aa, Mycobacterium
PPDNW

SEQ ID NO: 275670 - protein, 41 aa, Mycobacterium
PPDPEPAATPGLSKGGGTQSGDTPPASGQETQPSNPDPVSL

SEQ ID NO: 275671 - protein, 11 aa, Mycobacterium
PPDPVVPTRDT

SEQ ID NO: 275672 - protein, 5 aa, Mycobacterium
PPDQA

SEQ ID NO: 275673 - protein, 6 aa, Mycobacterium
PPDQND

SEQ ID NO: 275674 - protein, 15 aa, Mycobacterium
PPDQPTEAASAADNL

SEQ ID NO: 275675 - protein, 14 aa, Mycobacterium
PPDRPEMREAPRVQ

SEQ ID NO: 275676 - protein, 8 aa, Mycobacterium
PPDRRSGL

SEQ ID NO: 275677 - protein, 6 aa, Mycobacterium
PPDSTI

SEQ ID NO: 275678 - protein, 10 aa, Mycobacterium
PPDTPANVGY

SEQ ID NO: 275679 - protein, 8 aa, Mycobacterium
PPDVPANV

SEQ ID NO: 275680 - protein, 8 aa, Mycobacterium
PPDVSADT

SEQ ID NO: 275681 - protein, 12 aa, Mycobacterium
PPEAAPEPARPW

SEQ ID NO: 275682 - protein, 5 aa, Mycobacterium
PPEAD

SEQ ID NO: 275683 - protein, 33 aa, Mycobacterium
PPEAGEGARADELRNQRQAAVRRTRSSKSERTL

SEQ ID NO: 275684 - protein, 11 aa, Mycobacterium
PPEAGTRRAEL

SEQ ID NO: 275685 - protein, 10 aa, Mycobacterium
PPEDASQQML

SEQ ID NO: 275686 - protein, 11 aa, Mycobacterium
PPEGAESVDIS

SEQ ID NO: 275687 - protein, 5 aa, Mycobacterium
PPEGL

SEQ ID NO: 275688 - protein, 7 aa, Mycobacterium
PPEGNRV

SEQ ID NO: 275689 - protein, 7 aa, Mycobacterium
PPEHADE

SEQ ID NO: 275690 - protein, 5 aa, Mycobacterium
PPEHT

SEQ ID NO: 275691 - protein, 4 aa, Mycobacterium
PPEP

SEQ ID NO: 275692 - protein, 12 aa, Mycobacterium
PPEQPSSESLQP

SEQ ID NO: 275693 - protein, 11 aa, Mycobacterium
PPEQRARPGAR

SEQ ID NO: 275694 - protein, 11 aa, Mycobacterium
PPERRAQPGAR

SEQ ID NO: 275695 - protein, 8 aa, Mycobacterium
PPERRGAA

SEQ ID NO: 275696 - protein, 8 aa, Mycobacterium
PPERRGTA

SEQ ID NO: 275697 - protein, 8 aa, Mycobacterium
PPETAGYG

SEQ ID NO: 275698 - protein, 15 aa, Mycobacterium
PPETDDTTTPDSPTV

SEQ ID NO: 275699 - protein, 5 aa, Mycobacterium
PPEVH

SEQ ID NO: 275700 - protein, 7 aa, Mycobacterium
PPFASRT

SEQ ID NO: 275701 - protein, 11 aa, Mycobacterium
PPFPATNGAAG

SEQ ID NO: 275702 - protein, 5 aa, Mycobacterium
PPFRH

SEQ ID NO: 275703 - protein, 4 aa, Mycobacterium
PPFV

SEQ ID NO: 275704 - protein, 10 aa, Mycobacterium
PPGAAPESGL

SEQ ID NO: 275705 - protein, 11 aa, Mycobacterium
PPGAAVAPNIP

SEQ ID NO: 275706 - protein, 43 aa, Mycobacterium
PPGAPAGGGGAPGPSPATPSVPALTPPAVTAPAPAGPPPNAVP

SEQ ID NO: 275707 - protein, 8 aa, Mycobacterium
PPGDIAPQ

SEQ ID NO: 275708 - protein, 6 aa, Mycobacterium
PPGDYE

SEQ ID NO: 275709 - protein, 17 aa, Mycobacterium
PPGERPFVGGSTDDNEL

SEQ ID NO: 275710 - protein, 11 aa, Mycobacterium
PPGETFAPGVQ

SEQ ID NO: 275711 - protein, 4 aa, Mycobacterium
PPGF

SEQ ID NO: 275712 - protein, 5 aa, Mycobacterium
PPGFG

SEQ ID NO: 275713 - protein, 4 aa, Mycobacterium
PPGG

SEQ ID NO: 275714 - protein, 9 aa, Mycobacterium
PPGGAPLDE

SEQ ID NO: 275715 - protein, 7 aa, Mycobacterium
PPGLEGS

SEQ ID NO: 275716 - protein, 8 aa, Mycobacterium
PPGLEGSV

SEQ ID NO: 275717 - protein, 6 aa, Mycobacterium
PPGMPS

SEQ ID NO: 275718 - protein, 4 aa, Mycobacterium
PPGP

SEQ ID NO: 275719 - protein, 16 aa, Mycobacterium
PPGPAASSKVGIGSNA

SEQ ID NO: 275720 - protein, 9 aa, Mycobacterium
PPGPAPVAD

SEQ ID NO: 275721 - protein, 8 aa, Mycobacterium
PPGPASAP

SEQ ID NO: 275722 - protein, 11 aa, Mycobacterium
PPGPASVPPSV

SEQ ID NO: 275723 - protein, 13 aa, Mycobacterium
PPGPLGPPSPMGE

SEQ ID NO: 275724 - protein, 26 aa, Mycobacterium
PPGPPPGYPGGSPWGAAQPNGPRGRG

SEQ ID NO: 275725 - protein, 9 aa, Mycobacterium
PPGPRLSKE

SEQ ID NO: 275726 - protein, 5 aa, Mycobacterium
PPGPV

SEQ ID NO: 275727 - protein, 6 aa, Mycobacterium
PPGPVP

SEQ ID NO: 275728 - protein, 4 aa, Mycobacterium
PPGQ

SEQ ID NO: 275729 - protein, 16 aa, Mycobacterium
PPGQGYPPVGGPPSLD

SEQ ID NO: 275730 - protein, 5 aa, Mycobacterium
PPGQP

SEQ ID NO: 275731 - protein, 9 aa, Mycobacterium
PPGQRPSAR

SEQ ID NO: 275732 - protein, 4 aa, Mycobacterium
PPGR

SEQ ID NO: 275733 - protein, 6 aa, Mycobacterium
PPGRNG

SEQ ID NO: 275734 - protein, 11 aa, Mycobacterium
PPGRSAHARAG

SEQ ID NO: 275735 - protein, 7 aa, Mycobacterium
PPGRSAY

SEQ ID NO: 275736 - protein, 8 aa, Mycobacterium
PPGRTASD

SEQ ID NO: 275737 - protein, 14 aa, Mycobacterium
PPGSAPVTVGKNPQ

SEQ ID NO: 275738 - protein, 6 aa, Mycobacterium
PPGSDR

SEQ ID NO: 275739 - protein, 11 aa, Mycobacterium
PPGSFISPGGP

SEQ ID NO: 275740 - protein, 6 aa, Mycobacterium
PPGSPI

SEQ ID NO: 275741 - protein, 15 aa, Mycobacterium
PPGSRPWIGGSPDNS

SEQ ID NO: 275742 - protein, 7 aa, Mycobacterium
PPGSSTQ

SEQ ID NO: 275743 - protein, 5 aa, Mycobacterium
PPGTA

SEQ ID NO: 275744 - protein, 15 aa, Mycobacterium
PPGTAPGIPATQKPQ

SEQ ID NO: 275745 - protein, 8 aa, Mycobacterium
PPGTATDV

SEQ ID NO: 275746 - protein, 6 aa, Mycobacterium
PPGTAV

SEQ ID NO: 275747 - protein, 5 aa, Mycobacterium
PPGTI

SEQ ID NO: 275748 - protein, 6 aa, Mycobacterium
PPGTKI

SEQ ID NO: 275749 - protein, 5 aa, Mycobacterium
PPGTT

SEQ ID NO: 275750 - protein, 6 aa, Mycobacterium
PPGTTI

SEQ ID NO: 275751 - protein, 5 aa, Mycobacterium
PPGTV

SEQ ID NO: 275752 - protein, 7 aa, Mycobacterium
PPGVEPV

SEQ ID NO: 275753 - protein, 5 aa, Mycobacterium
PPGVT

SEQ ID NO: 275754 - protein, 6 aa, Mycobacterium
PPGVTV

SEQ ID NO: 275755 - protein, 15 aa, Mycobacterium
PPGWSEKAVPAPSLT

SEQ ID NO: 275756 - protein, 16 aa, Mycobacterium
PPGWTPARTCETTEVT

SEQ ID NO: 275757 - protein, 21 aa, Mycobacterium
PPGWTPEKTEKLRTMLRSDEN

SEQ ID NO: 275758 - protein, 19 aa, Mycobacterium
PPGWTPEKTQRLRPLLHSG

SEQ ID NO: 275759 - protein, 4 aa, Mycobacterium
PPGY

SEQ ID NO: 275760 - protein, 4 aa, Mycobacterium
PPHE

SEQ ID NO: 275761 - protein, 6 aa, Mycobacterium
PPHPGP

SEQ ID NO: 275762 - protein, 10 aa, Mycobacterium
PPHPGPTAAA

SEQ ID NO: 275763 - protein, 24 aa, Mycobacterium
PPHTKAPSTPAPKPSPSSGEPPIK

SEQ ID NO: 275764 - protein, 11 aa, Mycobacterium
PPHYPGSAGRV

SEQ ID NO: 275765 - protein, 11 aa, Mycobacterium
PPHYPHGGGRV

SEQ ID NO: 275766 - protein, 4 aa, Mycobacterium
PPIA

SEQ ID NO: 275767 - protein, 12 aa, Mycobacterium
PPIAGPALAVSW

SEQ ID NO: 275768 - protein, 44 aa, Mycobacterium
PPIAGPSSTIAPPTTRTSPTPSSSPAPTTTSGSATPTTTPTAGA

SEQ ID NO: 275769 - protein, 96 aa, Mycobacterium
PPIGGGDSDRGSHGGSRGGSGRGGWGDDGDSRGGSDSGSRGGWGDNGGSRGGWGDSGSSRGGSDSGSRGGWGGNSGSHGGGSGGGSNSGFPWPFGG

SEQ ID NO: 275770 - protein, 6 aa, Mycobacterium
PPIPGW

SEQ ID NO: 275771 - protein, 6 aa, Mycobacterium
PPISDA

SEQ ID NO: 275772 - protein, 7 aa, Mycobacterium
PPKDATK

SEQ ID NO: 275773 - protein, 9 aa, Mycobacterium
PPKEERNKT

SEQ ID NO: 275774 - protein, 5 aa, Mycobacterium
PPKGL

SEQ ID NO: 275775 - protein, 7 aa, Mycobacterium
PPKNPDR

SEQ ID NO: 275776 - protein, 11 aa, Mycobacterium
PPKPPAPDLRP

SEQ ID NO: 275777 - protein, 14 aa, Mycobacterium
PPKPSPPPKPIAED

SEQ ID NO: 275778 - protein, 4 aa, Mycobacterium
PPKQ

SEQ ID NO: 275779 - protein, 5 aa, Mycobacterium
PPKSY

SEQ ID NO: 275780 - protein, 20 aa, Mycobacterium
PPKYQDQAEFRSPEQPPDPV

SEQ ID NO: 275781 - protein, 11 aa, Mycobacterium
PPLASTASSLE

SEQ ID NO: 275782 - protein, 14 aa, Mycobacterium
PPLDERDVQPGGGP

SEQ ID NO: 275783 - protein, 11 aa, Mycobacterium
PPLKSATREEQ

SEQ ID NO: 275784 - protein, 5 aa, Mycobacterium
PPLNG

SEQ ID NO: 275785 - protein, 6 aa, Mycobacterium
PPLPAD

SEQ ID NO: 275786 - protein, 12 aa, Mycobacterium
PPLPAGDAPAVP

SEQ ID NO: 275787 - protein, 5 aa, Mycobacterium
PPLPE

SEQ ID NO: 275788 - protein, 5 aa, Mycobacterium
PPLPP

SEQ ID NO: 275789 - protein, 7 aa, Mycobacterium
PPLPPED

SEQ ID NO: 275790 - protein, 42 aa, Mycobacterium
PPLPPPPAERPAAPHPPPPPVLPPPPAAPPPAPAPDKGGPGL

SEQ ID NO: 275791 - protein, 10 aa, Mycobacterium
PPLPQGTTAT

SEQ ID NO: 275792 - protein, 7 aa, Mycobacterium
PPLPTGY

SEQ ID NO: 275793 - protein, 21 aa, Mycobacterium
PPLTDEHGAEGVPLGRPGAGQ

SEQ ID NO: 275794 - protein, 5 aa, Mycobacterium
PPMPG

SEQ ID NO: 275795 - protein, 10 aa, Mycobacterium
PPMPPDLPAD

SEQ ID NO: 275796 - protein, 7 aa, Mycobacterium
PPMPPGV

SEQ ID NO: 275797 - protein, 9 aa, Mycobacterium
PPMSPAMPA

SEQ ID NO: 275798 - protein, 9 aa, Mycobacterium
PPMSPRMPA

SEQ ID NO: 275799 - protein, 4 aa, Mycobacterium
PPMT

SEQ ID NO: 275800 - protein, 15 aa, Mycobacterium
PPNAEKGRDLLARLT

SEQ ID NO: 275801 - protein, 5 aa, Mycobacterium
PPNDR

SEQ ID NO: 275802 - protein, 26 aa, Mycobacterium
PPNKPVATPKPAAPPKPGPAPKEPAI

SEQ ID NO: 275803 - protein, 11 aa, Mycobacterium
PPNLARPNAAW

SEQ ID NO: 275804 - protein, 30 aa, Mycobacterium
PPNLSPKGKWGVAPSTSPQVARPGRRSNHA

SEQ ID NO: 275805 - protein, 5 aa, Mycobacterium
PPNMT

SEQ ID NO: 275806 - protein, 14 aa, Mycobacterium
PPNPPAVGQADTIG

SEQ ID NO: 275807 - protein, 15 aa, Mycobacterium
PPNPPAVGQADTIGS

SEQ ID NO: 275808 - protein, 9 aa, Mycobacterium
PPNQARKAG

SEQ ID NO: 275809 - protein, 16 aa, Mycobacterium
PPNRAPASGAGPERRT

SEQ ID NO: 275810 - protein, 40 aa, Mycobacterium
PPNRPGFDPRESRNDPSDEWGAESGPEAGFETGDDATESV

SEQ ID NO: 275811 - protein, 5 aa, Mycobacterium
PPNST

SEQ ID NO: 275812 - protein, 12 aa, Mycobacterium
PPNWPGNPYPPA

SEQ ID NO: 275813 - protein, 7 aa, Mycobacterium
PPPADDH

SEQ ID NO: 275814 - protein, 23 aa, Mycobacterium
PPPAGGGGFPPQQPGGAAAPNSN

SEQ ID NO: 275815 - protein, 7 aa, Mycobacterium
PPPAGIP

SEQ ID NO: 275816 - protein, 18 aa, Mycobacterium
PPPAGSDRNPTGRNPAPR

SEQ ID NO: 275817 - protein, 5 aa, Mycobacterium
PPPAL

SEQ ID NO: 275818 - protein, 6 aa, Mycobacterium
PPPALS

SEQ ID NO: 275819 - protein, 7 aa, Mycobacterium
PPPAPNT

SEQ ID NO: 275820 - protein, 46 aa, Mycobacterium
PPPAPPLGINPPPPGPGPEKPWGPPPGGQPQASGPAYATYDEKTGA

SEQ ID NO: 275821 - protein, 18 aa, Mycobacterium
PPPARPGGHTTASHYPDR

SEQ ID NO: 275822 - protein, 70 aa, Mycobacterium
PPPASSPESSGGQDTPPPPPASTGGSYPPPPPPPGGGSYPPPPPPPGGGSYPPPPPPSGGYAPPPPGPAI

SEQ ID NO: 275823 - protein, 65 aa, Mycobacterium
PPPAYGPPPQYGPPPQYGPPPVYPTYGPPPGYPPPPGHGVPPGYGRPPGYGTPPAFGAPPGYGTV

SEQ ID NO: 275824 - protein, 4 aa, Mycobacterium
PPPC

SEQ ID NO: 275825 - protein, 5 aa, Mycobacterium
PPPCS

SEQ ID NO: 275826 - protein, 5 aa, Mycobacterium
PPPCT

SEQ ID NO: 275827 - protein, 4 aa, Mycobacterium
PPPD

SEQ ID NO: 275828 - protein, 8 aa, Mycobacterium
PPPDRGPI

SEQ ID NO: 275829 - protein, 8 aa, Mycobacterium
PPPETMPG

SEQ ID NO: 275830 - protein, 9 aa, Mycobacterium
PPPGAGPEY

SEQ ID NO: 275831 - protein, 5 aa, Mycobacterium
PPPGE

SEQ ID NO: 275832 - protein, 105 aa, Mycobacterium
PPPGPDGPWQQPPQAYPQYGDAQQGYQPGSAPGAQPAYGAPQYDPQAYGYPQQPAYGQQQYGQPQYGQPQYGQPQYGQPQYGQQPYGYGPQGYPQPQPPSSNKKG

SEQ ID NO: 275833 - protein, 52 aa, Mycobacterium
PPPHPSGWQQPQPYPYQPYPHPGQQGTSPEHGRPSEQSGQDDGHTGDRSNPH

SEQ ID NO: 275834 - protein, 4 aa, Mycobacterium
PPPL

SEQ ID NO: 275835 - protein, 5 aa, Mycobacterium
PPPLE

SEQ ID NO: 275836 - protein, 5 aa, Mycobacterium
PPPLP

SEQ ID NO: 275837 - protein, 8 aa, Mycobacterium
PPPLPEAA

SEQ ID NO: 275838 - protein, 73 aa, Mycobacterium
PPPMPSGAWPSQAPPQTGSHRPVPPQPAPPTTRMPAQPPSGPQHVQPSAQQPQYPSGPQTSRSQTGAQPAPQI

SEQ ID NO: 275839 - protein, 9 aa, Mycobacterium
PPPNAGQNT

SEQ ID NO: 275840 - protein, 8 aa, Mycobacterium
PPPNLTSV

SEQ ID NO: 275841 - protein, 9 aa, Mycobacterium
PPPPIGERR

SEQ ID NO: 275842 - protein, 5 aa, Mycobacterium
PPPPL

SEQ ID NO: 275843 - protein, 7 aa, Mycobacterium
PPPPLSL

SEQ ID NO: 275844 - protein, 24 aa, Mycobacterium
PPPPPGMGMPPPPGVGMPPPPGVG

SEQ ID NO: 275845 - protein, 77 aa, Mycobacterium
PPPPPPPGSSGGFEPPSQPSQPSGGSYPPPPPSGGSYPPPPPPPEGGYPPPPPPSAAGYAPPPPGPAIRSQPTESYT

SEQ ID NO: 275846 - protein, 95 aa, Mycobacterium
PPPPPPPGSSGGSEPPAGGYQAPPPPSAPSGGGYPPPPPPPSPSTSGYPPPPPPPSAPGGSAYPPPPPPPPLEGGYPPPPPPSAGGYAPPPPGPA

SEQ ID NO: 275847 - protein, 29 aa, Mycobacterium
PPPPPPPSPPPAVATAAPPPPPREKPPRL

SEQ ID NO: 275848 - protein, 64 aa, Mycobacterium
PPPPSSPGPSGGQQPPSGGQEFPPPPSAPGGGSYPPPPPPPGGSYPPPPPSSGGYAPPPPGPAI

SEQ ID NO: 275849 - protein, 17 aa, Mycobacterium
PPPPVPGAPVAPVPPPL

SEQ ID NO: 275850 - protein, 16 aa, Mycobacterium
PPPPYPPPLSSQSGGG

SEQ ID NO: 275851 - protein, 4 aa, Mycobacterium
PPPR

SEQ ID NO: 275852 - protein, 12 aa, Mycobacterium
PPPRDPDRAPYR

SEQ ID NO: 275853 - protein, 12 aa, Mycobacterium
PPPRIEPGPDHR

SEQ ID NO: 275854 - protein, 8 aa, Mycobacterium
PPPRISKR

SEQ ID NO: 275855 - protein, 15 aa, Mycobacterium
PPPRVTDQVPSLPSA

SEQ ID NO: 275856 - protein, 11 aa, Mycobacterium
PPPSAPPPDLT

SEQ ID NO: 275857 - protein, 13 aa, Mycobacterium
PPPTGAAGTLRSG

SEQ ID NO: 275858 - protein, 6 aa, Mycobacterium
PPPVPP

SEQ ID NO: 275859 - protein, 6 aa, Mycobacterium
PPPVSY

SEQ ID NO: 275860 - protein, 5 aa, Mycobacterium
PPPWN

SEQ ID NO: 275861 - protein, 13 aa, Mycobacterium
PPPWTSPARRTRT

SEQ ID NO: 275862 - protein, 8 aa, Mycobacterium
PPQATPIP

SEQ ID NO: 275863 - protein, 4 aa, Mycobacterium
PPQD

SEQ ID NO: 275864 - protein, 5 aa, Mycobacterium
PPQDR

SEQ ID NO: 275865 - protein, 13 aa, Mycobacterium
PPQEITTQGHRNP

SEQ ID NO: 275866 - protein, 4 aa, Mycobacterium
PPQL

SEQ ID NO: 275867 - protein, 5 aa, Mycobacterium
PPQLG

SEQ ID NO: 275868 - protein, 4 aa, Mycobacterium
PPQM

SEQ ID NO: 275869 - protein, 35 aa, Mycobacterium
PPQPGPGPGWPQGPVNTPPADPAYADQAPYAPTYG

SEQ ID NO: 275870 - protein, 25 aa, Mycobacterium
PPQSGGTYAGATPSFAKEDDGKSKL

SEQ ID NO: 275871 - protein, 5 aa, Mycobacterium
PPQTE

SEQ ID NO: 275872 - protein, 5 aa, Mycobacterium
PPQVP

SEQ ID NO: 275873 - protein, 4 aa, Mycobacterium
PPRA

SEQ ID NO: 275874 - protein, 7 aa, Mycobacterium
PPRAGVS

SEQ ID NO: 275875 - protein, 62 aa, Mycobacterium
PPRATSPPGSPSTGGTPQSSTTATPSPPTTSSTSASPPPSTSASNGPATSSPAGPTTTSQTV

SEQ ID NO: 275876 - protein, 5 aa, Mycobacterium
PPREG

SEQ ID NO: 275877 - protein, 8 aa, Mycobacterium
PPRERRNA

SEQ ID NO: 275878 - protein, 4 aa, Mycobacterium
PPRG

SEQ ID NO: 275879 - protein, 14 aa, Mycobacterium
PPRHGATVSASARR

SEQ ID NO: 275880 - protein, 5 aa, Mycobacterium
PPRIP

SEQ ID NO: 275881 - protein, 6 aa, Mycobacterium
PPRIRT

SEQ ID NO: 275882 - protein, 17 aa, Mycobacterium
PPRKKRESDPKPKKSAA

SEQ ID NO: 275883 - protein, 5 aa, Mycobacterium
PPRKL

SEQ ID NO: 275884 - protein, 19 aa, Mycobacterium
PPRKPRASASHQELASPYR

SEQ ID NO: 275885 - protein, 4 aa, Mycobacterium
PPRL

SEQ ID NO: 275886 - protein, 5 aa, Mycobacterium
PPRLE

SEQ ID NO: 275887 - protein, 6 aa, Mycobacterium
PPRLPD

SEQ ID NO: 275888 - protein, 14 aa, Mycobacterium
PPRNLAKAKPASIL

SEQ ID NO: 275889 - protein, 11 aa, Mycobacterium
PPRPGAPSGFD

SEQ ID NO: 275890 - protein, 6 aa, Mycobacterium
PPRPGF

SEQ ID NO: 275891 - protein, 12 aa, Mycobacterium
PPRPPRAEAPAE

SEQ ID NO: 275892 - protein, 13 aa, Mycobacterium
PPRPPRSEAPEEH

SEQ ID NO: 275893 - protein, 8 aa, Mycobacterium
PPRPRTHH

SEQ ID NO: 275894 - protein, 6 aa, Mycobacterium
PPRPSI

SEQ ID NO: 275895 - protein, 73 aa, Mycobacterium
PPRPTTTTRAPAPPPAPPSSPAPGASGRGAGESPVPPSPSPTTTAAPAPSGAPGSPNPPPPASPSPTPSPTVT

SEQ ID NO: 275896 - protein, 5 aa, Mycobacterium
PPRQR

SEQ ID NO: 275897 - protein, 9 aa, Mycobacterium
PPRRQENPW

SEQ ID NO: 275898 - protein, 10 aa, Mycobacterium
PPRSTRGATA

SEQ ID NO: 275899 - protein, 7 aa, Mycobacterium
PPRTPDR

SEQ ID NO: 275900 - protein, 12 aa, Mycobacterium
PPRVDRRPGSGR

SEQ ID NO: 275901 - protein, 6 aa, Mycobacterium
PPRVPE

SEQ ID NO: 275902 - protein, 13 aa, Mycobacterium
PPRVVPPGGPNLI

SEQ ID NO: 275903 - protein, 8 aa, Mycobacterium
PPSAAPTA

SEQ ID NO: 275904 - protein, 9 aa, Mycobacterium
PPSAAQPPF

SEQ ID NO: 275905 - protein, 9 aa, Mycobacterium
PPSAERSVP

SEQ ID NO: 275906 - protein, 11 aa, Mycobacterium
PPSASSVQAYT

SEQ ID NO: 275907 - protein, 8 aa, Mycobacterium
PPSDAATV

SEQ ID NO: 275908 - protein, 5 aa, Mycobacterium
PPSDR

SEQ ID NO: 275909 - protein, 5 aa, Mycobacterium
PPSEG

SEQ ID NO: 275910 - protein, 9 aa, Mycobacterium
PPSGAQPPF

SEQ ID NO: 275911 - protein, 43 aa, Mycobacterium
PPSGESAPSPIQAAARPSRPVGSNAAPVADRQPAPVGQGQPQG

SEQ ID NO: 275912 - protein, 8 aa, Mycobacterium
PPSHAGRA

SEQ ID NO: 275913 - protein, 11 aa, Mycobacterium
PPSHAGRATTS

SEQ ID NO: 275914 - protein, 12 aa, Mycobacterium
PPSKSRPGSPAW

SEQ ID NO: 275915 - protein, 9 aa, Mycobacterium
PPSKVHQHP

SEQ ID NO: 275916 - protein, 8 aa, Mycobacterium
PPSLEEQA

SEQ ID NO: 275917 - protein, 7 aa, Mycobacterium
PPSLGLS

SEQ ID NO: 275918 - protein, 5 aa, Mycobacterium
PPSME

SEQ ID NO: 275919 - protein, 5 aa, Mycobacterium
PPSNL

SEQ ID NO: 275920 - protein, 15 aa, Mycobacterium
PPSPGPVPATPANIA

SEQ ID NO: 275921 - protein, 8 aa, Mycobacterium
PPSPRHRG

SEQ ID NO: 275922 - protein, 5 aa, Mycobacterium
PPSPV

SEQ ID NO: 275923 - protein, 5 aa, Mycobacterium
PPSPY

SEQ ID NO: 275924 - protein, 10 aa, Mycobacterium
PPSRNDEIRS

SEQ ID NO: 275925 - protein, 14 aa, Mycobacterium
PPSSAPVKASKDPV

SEQ ID NO: 275926 - protein, 8 aa, Mycobacterium
PPSSETTV

SEQ ID NO: 275927 - protein, 25 aa, Mycobacterium
PPSSPASSKLTNGARIERQNTRIGQ

SEQ ID NO: 275928 - protein, 84 aa, Mycobacterium
PPSSSSATVTGSTTSTTSGTITSTSPPMTSDINDTSTSTTPSESTTTRSTRPPRTRESDENDDRTTTRTTRAPRTNVTRTLYPG

SEQ ID NO: 275929 - protein, 14 aa, Mycobacterium
PPSTAAVKASKEPV

SEQ ID NO: 275930 - protein, 15 aa, Mycobacterium
PPSTPAAGMPARTRS

SEQ ID NO: 275931 - protein, 20 aa, Mycobacterium
PPSVASSPDVTAPLPGTPDA

SEQ ID NO: 275932 - protein, 29 aa, Mycobacterium
PPSVSGQDRDRSVGMPPTIPAPALGPQRS

SEQ ID NO: 275933 - protein, 4 aa, Mycobacterium
PPTA

SEQ ID NO: 275934 - protein, 16 aa, Mycobacterium
PPTDTSPQPGAPHSTL

SEQ ID NO: 275935 - protein, 44 aa, Mycobacterium
PPTEEPPPGPFGLPPAPPPPPQQPAGPPPGPPPAGQAPASNHVG

SEQ ID NO: 275936 - protein, 4 aa, Mycobacterium
PPTF

SEQ ID NO: 275937 - protein, 6 aa, Mycobacterium
PPTGNE

SEQ ID NO: 275938 - protein, 7 aa, Mycobacterium
PPTGPAL

SEQ ID NO: 275939 - protein, 4 aa, Mycobacterium
PPTL

SEQ ID NO: 275940 - protein, 5 aa, Mycobacterium
PPTPD

SEQ ID NO: 275941 - protein, 26 aa, Mycobacterium
PPTPEPAADPAATSSYQNGADKPVPP

SEQ ID NO: 275942 - protein, 8 aa, Mycobacterium
PPTPEPGP

SEQ ID NO: 275943 - protein, 17 aa, Mycobacterium
PPTPPVVKEPEKRPGPA

SEQ ID NO: 275944 - protein, 8 aa, Mycobacterium
PPTPSRAR

SEQ ID NO: 275945 - protein, 17 aa, Mycobacterium
PPTPTPATRPGEPRKSI

SEQ ID NO: 275946 - protein, 8 aa, Mycobacterium
PPTPVGGN

SEQ ID NO: 275947 - protein, 8 aa, Mycobacterium
PPTPVPPV

SEQ ID NO: 275948 - protein, 4 aa, Mycobacterium
PPTQ

SEQ ID NO: 275949 - protein, 4 aa, Mycobacterium
PPTR

SEQ ID NO: 275950 - protein, 6 aa, Mycobacterium
PPTRES

SEQ ID NO: 275951 - protein, 7 aa, Mycobacterium
PPTSGIP

SEQ ID NO: 275952 - protein, 6 aa, Mycobacterium
PPTSKP

SEQ ID NO: 275953 - protein, 14 aa, Mycobacterium
PPTSPELSASDSAR

SEQ ID NO: 275954 - protein, 27 aa, Mycobacterium
PPTTNRGAVKSGIDSLQPAPKTATGEG

SEQ ID NO: 275955 - protein, 14 aa, Mycobacterium
PPTTWEAPTPEQNA

SEQ ID NO: 275956 - protein, 5 aa, Mycobacterium
PPTVA

SEQ ID NO: 275957 - protein, 7 aa, Mycobacterium
PPTVPPD

SEQ ID NO: 275958 - protein, 4 aa, Mycobacterium
PPVA

SEQ ID NO: 275959 - protein, 16 aa, Mycobacterium
PPVAGDAASIDVGGPT

SEQ ID NO: 275960 - protein, 9 aa, Mycobacterium
PPVATDRSR

SEQ ID NO: 275961 - protein, 4 aa, Mycobacterium
PPVD

SEQ ID NO: 275962 - protein, 48 aa, Mycobacterium
PPVDEAAEPVQSAEPGETGETAEDAEGPRRRARREREERRAAQARATA

SEQ ID NO: 275963 - protein, 11 aa, Mycobacterium
PPVENPDQRIQ

SEQ ID NO: 275964 - protein, 12 aa, Mycobacterium
PPVEQPVPEPVK

SEQ ID NO: 275965 - protein, 24 aa, Mycobacterium
PPVERASTVSATPTASPAAGPDRP

SEQ ID NO: 275966 - protein, 6 aa, Mycobacterium
PPVERP

SEQ ID NO: 275967 - protein, 10 aa, Mycobacterium
PPVGPPPRRG

SEQ ID NO: 275968 - protein, 6 aa, Mycobacterium
PPVNAG

SEQ ID NO: 275969 - protein, 25 aa, Mycobacterium
PPVPAPGPATECPGGQCRQQPHQAD

SEQ ID NO: 275970 - protein, 7 aa, Mycobacterium
PPVPASA

SEQ ID NO: 275971 - protein, 7 aa, Mycobacterium
PPVPATP

SEQ ID NO: 275972 - protein, 13 aa, Mycobacterium
PPVPGQPPAPIRN

SEQ ID NO: 275973 - protein, 7 aa, Mycobacterium
PPVPLPA

SEQ ID NO: 275974 - protein, 31 aa, Mycobacterium
PPVPQAPAQLPRPQPQAPAPRVEVPASPPRI

SEQ ID NO: 275975 - protein, 19 aa, Mycobacterium
PPVPTQGAPSRPEHSTAPI

SEQ ID NO: 275976 - protein, 9 aa, Mycobacterium
PPVPYPKRR

SEQ ID NO: 275977 - protein, 4 aa, Mycobacterium
PPVR

SEQ ID NO: 275978 - protein, 8 aa, Mycobacterium
PPVSGGRF

SEQ ID NO: 275979 - protein, 45 aa, Mycobacterium
PPVSPQPSFSEPTTTAPSPSRTPRPVPVPPRTSAPTSPTTPGATE

SEQ ID NO: 275980 - protein, 5 aa, Mycobacterium
PPVSR

SEQ ID NO: 275981 - protein, 19 aa, Mycobacterium
PPVSSESAPPPAGTAKGRR

SEQ ID NO: 275982 - protein, 6 aa, Mycobacterium
PPVTAN

SEQ ID NO: 275983 - protein, 7 aa, Mycobacterium
PPVTSTM

SEQ ID NO: 275984 - protein, 67 aa, Mycobacterium
PPVTTTTTEPTSTTSPTTTTTTTTTTTTTTTTTTTPTTTRTTTTQPTTTAPTTTAPPTTTQAPITTT

SEQ ID NO: 275985 - protein, 12 aa, Mycobacterium
PPVTVPSASTAG

SEQ ID NO: 275986 - protein, 12 aa, Mycobacterium
PPVVEPGPDRGP

SEQ ID NO: 275987 - protein, 11 aa, Mycobacterium
PPVVSDDNDSA

SEQ ID NO: 275988 - protein, 11 aa, Mycobacterium
PPWGSAARQPM

SEQ ID NO: 275989 - protein, 19 aa, Mycobacterium
PPWPPPPPPPPPPPADATA

SEQ ID NO: 275990 - protein, 17 aa, Mycobacterium
PPYAAPYPDGGPGPVYP

SEQ ID NO: 275991 - protein, 8 aa, Mycobacterium
PPYAGSNS

SEQ ID NO: 275992 - protein, 13 aa, Mycobacterium
PPYDPANSGAVSS

SEQ ID NO: 275993 - protein, 39 aa, Mycobacterium
PPYEPPKPVPVQATPPPNLPPANTAPTINPAGPDAPRNV

SEQ ID NO: 275994 - protein, 4 aa, Mycobacterium
PPYG

SEQ ID NO: 275995 - protein, 45 aa, Mycobacterium
PPYGRPPLAPPPAPGPAPAPAPAPGAPPLPAEAPLASSTSVATYD

SEQ ID NO: 275996 - protein, 45 aa, Mycobacterium
PPYGRTPPPPAGAPAPPPPAPPAPEGALPAEAPLAAPAGIGTYDQ

SEQ ID NO: 275997 - protein, 5 aa, Mycobacterium
PPYPP

SEQ ID NO: 275998 - protein, 11 aa, Mycobacterium
PPYRPEDSPAT

SEQ ID NO: 275999 - protein, 5 aa, Mycobacterium
PPYSR

SEQ ID NO: 276000 - protein, 8 aa, Mycobacterium
PQAADDLT

SEQ ID NO: 276001 - protein, 9 aa, Mycobacterium
PQAAGSGIP

SEQ ID NO: 276002 - protein, 10 aa, Mycobacterium
PQADGTLRGT

SEQ ID NO: 276003 - protein, 15 aa, Mycobacterium
PQAPAPAPEAPVPAP

SEQ ID NO: 276004 - protein, 15 aa, Mycobacterium
PQAPEEPEADTLTDS

SEQ ID NO: 276005 - protein, 10 aa, Mycobacterium
PQAPFGRDPV

SEQ ID NO: 276006 - protein, 13 aa, Mycobacterium
PQAPLERTRDFKG

SEQ ID NO: 276007 - protein, 10 aa, Mycobacterium
PQAPQNDQPN

SEQ ID NO: 276008 - protein, 5 aa, Mycobacterium
PQASG

SEQ ID NO: 276009 - protein, 27 aa, Mycobacterium
PQAYYGQPYPQGYYPPPPPPPKKNKTG

SEQ ID NO: 276010 - protein, 12 aa, Mycobacterium
PQDALPDGDPYV

SEQ ID NO: 276011 - protein, 6 aa, Mycobacterium
PQDAPA

SEQ ID NO: 276012 - protein, 5 aa, Mycobacterium
PQDEV

SEQ ID NO: 276013 - protein, 9 aa, Mycobacterium
PQDFDTPSE

SEQ ID NO: 276014 - protein, 8 aa, Mycobacterium
PQDHTPTV

SEQ ID NO: 276015 - protein, 8 aa, Mycobacterium
PQDIDPDA

SEQ ID NO: 276016 - protein, 5 aa, Mycobacterium
PQDKA

SEQ ID NO: 276017 - protein, 5 aa, Mycobacterium
PQDNP

SEQ ID NO: 276018 - protein, 12 aa, Mycobacterium
PQDTPANAVRGA

SEQ ID NO: 276019 - protein, 8 aa, Mycobacterium
PQEADAAD

SEQ ID NO: 276020 - protein, 8 aa, Mycobacterium
PQERRGGP

SEQ ID NO: 276021 - protein, 5 aa, Mycobacterium
PQEWD

SEQ ID NO: 276022 - protein, 5 aa, Mycobacterium
PQEYE

SEQ ID NO: 276023 - protein, 10 aa, Mycobacterium
PQFAEDNGSA

SEQ ID NO: 276024 - protein, 11 aa, Mycobacterium
PQFASGRSGLI

SEQ ID NO: 276025 - protein, 18 aa, Mycobacterium
PQFGTTTEGTARTKTATL

SEQ ID NO: 276026 - protein, 6 aa, Mycobacterium
PQFPGG

SEQ ID NO: 276027 - protein, 11 aa, Mycobacterium
PQGAGADGNIT

SEQ ID NO: 276028 - protein, 6 aa, Mycobacterium
PQGANA

SEQ ID NO: 276029 - protein, 5 aa, Mycobacterium
PQGAR

SEQ ID NO: 276030 - protein, 19 aa, Mycobacterium
PQGASEGQTVTSAFPGYAS

SEQ ID NO: 276031 - protein, 9 aa, Mycobacterium
PQGATSSYA

SEQ ID NO: 276032 - protein, 19 aa, Mycobacterium
PQGDHGDDYQESDEDFDDD

SEQ ID NO: 276033 - protein, 5 aa, Mycobacterium
PQGET

SEQ ID NO: 276034 - protein, 4 aa, Mycobacterium
PQGF

SEQ ID NO: 276035 - protein, 10 aa, Mycobacterium
PQGFSAETTS

SEQ ID NO: 276036 - protein, 29 aa, Mycobacterium
PQGISPTAPPVPPGAPAPPPTAPGAPAPG

SEQ ID NO: 276037 - protein, 10 aa, Mycobacterium
PQGPAAQSVL

SEQ ID NO: 276038 - protein, 7 aa, Mycobacterium
PQGPAAR

SEQ ID NO: 276039 - protein, 9 aa, Mycobacterium
PQGPAAVAD

SEQ ID NO: 276040 - protein, 8 aa, Mycobacterium
PQGPSDPP

SEQ ID NO: 276041 - protein, 7 aa, Mycobacterium
PQGQLGD

SEQ ID NO: 276042 - protein, 4 aa, Mycobacterium
PQGS

SEQ ID NO: 276043 - protein, 5 aa, Mycobacterium
PQGSG

SEQ ID NO: 276044 - protein, 12 aa, Mycobacterium
PQGSRSPAEPAH

SEQ ID NO: 276045 - protein, 10 aa, Mycobacterium
PQGSRSPVEP

SEQ ID NO: 276046 - protein, 13 aa, Mycobacterium
PQGTGRGGNNYAG

SEQ ID NO: 276047 - protein, 16 aa, Mycobacterium
PQGTPVRIGKTVIELR

SEQ ID NO: 276048 - protein, 19 aa, Mycobacterium
PQHAKAVAGQAERQQERSI

SEQ ID NO: 276049 - protein, 5 aa, Mycobacterium
PQHRP

SEQ ID NO: 276050 - protein, 5 aa, Mycobacterium
PQIGG

SEQ ID NO: 276051 - protein, 4 aa, Mycobacterium
PQIP

SEQ ID NO: 276052 - protein, 5 aa, Mycobacterium
PQLAA

SEQ ID NO: 276053 - protein, 16 aa, Mycobacterium
PQLAGAGSGVYNTAGS

SEQ ID NO: 276054 - protein, 4 aa, Mycobacterium
PQLD

SEQ ID NO: 276055 - protein, 13 aa, Mycobacterium
PQLGALGPSVNDA

SEQ ID NO: 276056 - protein, 7 aa, Mycobacterium
PQLGDGT

SEQ ID NO: 276057 - protein, 8 aa, Mycobacterium
PQLGHGAT

SEQ ID NO: 276058 - protein, 8 aa, Mycobacterium
PQLGPPGV

SEQ ID NO: 276059 - protein, 6 aa, Mycobacterium
PQLGPT

SEQ ID NO: 276060 - protein, 31 aa, Mycobacterium
PQLPGGWQANSGHRGGIPNGRSDPATGQRVN

SEQ ID NO: 276061 - protein, 4 aa, Mycobacterium
PQMG

SEQ ID NO: 276062 - protein, 6 aa, Mycobacterium
PQMPQA

SEQ ID NO: 276063 - protein, 59 aa, Mycobacterium
PQNAATASADPCGDRCGGGGNGQGSYGPDTGNFQPPQMPGQQPDYQGGINQPPLDQNSG

SEQ ID NO: 276064 - protein, 15 aa, Mycobacterium
PQNAEQGRDLLARLT

SEQ ID NO: 276065 - protein, 16 aa, Mycobacterium
PQNAPGPDDVKRQGQA

SEQ ID NO: 276066 - protein, 8 aa, Mycobacterium
PQNDPSVV

SEQ ID NO: 276067 - protein, 19 aa, Mycobacterium
PQNGQNGRDDGTPTQSPEG

SEQ ID NO: 276068 - protein, 8 aa, Mycobacterium
PQNGTFGS

SEQ ID NO: 276069 - protein, 7 aa, Mycobacterium
PQNNTLA

SEQ ID NO: 276070 - protein, 5 aa, Mycobacterium
PQNQR

SEQ ID NO: 276071 - protein, 4 aa, Mycobacterium
PQNY

SEQ ID NO: 276072 - protein, 7 aa, Mycobacterium
PQPAKQH

SEQ ID NO: 276073 - protein, 7 aa, Mycobacterium
PQPAQGT

SEQ ID NO: 276074 - protein, 5 aa, Mycobacterium
PQPAV

SEQ ID NO: 276075 - protein, 9 aa, Mycobacterium
PQPDGEPPL

SEQ ID NO: 276076 - protein, 8 aa, Mycobacterium
PQPDGTLR

SEQ ID NO: 276077 - protein, 6 aa, Mycobacterium
PQPELG

SEQ ID NO: 276078 - protein, 31 aa, Mycobacterium
PQPGDASADPTEAALQGPLPPDRNPETEGRD

SEQ ID NO: 276079 - protein, 7 aa, Mycobacterium
PQPGKHD

SEQ ID NO: 276080 - protein, 14 aa, Mycobacterium
PQPIPPPAPSSGEQ

SEQ ID NO: 276081 - protein, 10 aa, Mycobacterium
PQPLSDSVST

SEQ ID NO: 276082 - protein, 17 aa, Mycobacterium
PQPMRTPGAQPLDRPLG

SEQ ID NO: 276083 - protein, 5 aa, Mycobacterium
PQPNW

SEQ ID NO: 276084 - protein, 6 aa, Mycobacterium
PQPPDV

SEQ ID NO: 276085 - protein, 7 aa, Mycobacterium
PQPPEGS

SEQ ID NO: 276086 - protein, 8 aa, Mycobacterium
PQPPEGSA

SEQ ID NO: 276087 - protein, 14 aa, Mycobacterium
PQPPIPPQSEPSQV

SEQ ID NO: 276088 - protein, 7 aa, Mycobacterium
PQPPLGS

SEQ ID NO: 276089 - protein, 5 aa, Mycobacterium
PQPPN

SEQ ID NO: 276090 - protein, 13 aa, Mycobacterium
PQPPPPPPDMAPR

SEQ ID NO: 276091 - protein, 6 aa, Mycobacterium
PQPQAN

SEQ ID NO: 276092 - protein, 5 aa, Mycobacterium
PQPRT

SEQ ID NO: 276093 - protein, 8 aa, Mycobacterium
PQPTTGAG

SEQ ID NO: 276094 - protein, 25 aa, Mycobacterium
PQPVPQPNAPEQKDRQHQREPAEWS

SEQ ID NO: 276095 - protein, 4 aa, Mycobacterium
PQQA

SEQ ID NO: 276096 - protein, 6 aa, Mycobacterium
PQQAGS

SEQ ID NO: 276097 - protein, 35 aa, Mycobacterium
PQQAPPQQAPAQSSQWQPVPAEGQYIPAGAPGSNW

SEQ ID NO: 276098 - protein, 11 aa, Mycobacterium
PQQDSSAPEAQ

SEQ ID NO: 276099 - protein, 7 aa, Mycobacterium
PQQGRLD

SEQ ID NO: 276100 - protein, 12 aa, Mycobacterium
PQQPHTGGGHNG

SEQ ID NO: 276101 - protein, 8 aa, Mycobacterium
PQQQGPGY

SEQ ID NO: 276102 - protein, 4 aa, Mycobacterium
PQQR

SEQ ID NO: 276103 - protein, 8 aa, Mycobacterium
PQQTIRAG

SEQ ID NO: 276104 - protein, 14 aa, Mycobacterium
PQRAADGSPGSSAA

SEQ ID NO: 276105 - protein, 13 aa, Mycobacterium
PQRAADPNPVVGE

SEQ ID NO: 276106 - protein, 5 aa, Mycobacterium
PQRCD

SEQ ID NO: 276107 - protein, 4 aa, Mycobacterium
PQRG

SEQ ID NO: 276108 - protein, 5 aa, Mycobacterium
PQRGE

SEQ ID NO: 276109 - protein, 5 aa, Mycobacterium
PQRGH

SEQ ID NO: 276110 - protein, 5 aa, Mycobacterium
PQRGW

SEQ ID NO: 276111 - protein, 4 aa, Mycobacterium
PQRH

SEQ ID NO: 276112 - protein, 8 aa, Mycobacterium
PQRIPPYR

SEQ ID NO: 276113 - protein, 5 aa, Mycobacterium
PQRKR

SEQ ID NO: 276114 - protein, 12 aa, Mycobacterium
PQRNPGASGISE

SEQ ID NO: 276115 - protein, 11 aa, Mycobacterium
PQRPGAPSPFN

SEQ ID NO: 276116 - protein, 11 aa, Mycobacterium
PQRPLDERVGR

SEQ ID NO: 276117 - protein, 12 aa, Mycobacterium
PQRQADNRRSGF

SEQ ID NO: 276118 - protein, 4 aa, Mycobacterium
PQRR

SEQ ID NO: 276119 - protein, 16 aa, Mycobacterium
PQRRAPGQVATASTGL

SEQ ID NO: 276120 - protein, 32 aa, Mycobacterium
PQRRPEPPPPVEPPPPVETPPPVETPRPGHAD

SEQ ID NO: 276121 - protein, 6 aa, Mycobacterium
PQRRSA

SEQ ID NO: 276122 - protein, 5 aa, Mycobacterium
PQRTF

SEQ ID NO: 276123 - protein, 9 aa, Mycobacterium
PQRVESTPL

SEQ ID NO: 276124 - protein, 12 aa, Mycobacterium
PQRVTGQPAGFA

SEQ ID NO: 276125 - protein, 7 aa, Mycobacterium
PQRYKRD

SEQ ID NO: 276126 - protein, 4 aa, Mycobacterium
PQSA

SEQ ID NO: 276127 - protein, 12 aa, Mycobacterium
PQSARADISANG

SEQ ID NO: 276128 - protein, 7 aa, Mycobacterium
PQSGGTY

SEQ ID NO: 276129 - protein, 4 aa, Mycobacterium
PQSM

SEQ ID NO: 276130 - protein, 17 aa, Mycobacterium
PQSPPAPPTPPPAPEPV

SEQ ID NO: 276131 - protein, 22 aa, Mycobacterium
PQSRHASISAASRETTAGETVK

SEQ ID NO: 276132 - protein, 11 aa, Mycobacterium
PQSRQALGEGR

SEQ ID NO: 276133 - protein, 11 aa, Mycobacterium
PQSSIDSGEGL

SEQ ID NO: 276134 - protein, 6 aa, Mycobacterium
PQSTGD

SEQ ID NO: 276135 - protein, 23 aa, Mycobacterium
PQSVGDPLPPVSRRSVAETTTFD

SEQ ID NO: 276136 - protein, 5 aa, Mycobacterium
PQSVS

SEQ ID NO: 276137 - protein, 6 aa, Mycobacterium
PQSYRG

SEQ ID NO: 276138 - protein, 11 aa, Mycobacterium
PQTAPQQRVPE

SEQ ID NO: 276139 - protein, 5 aa, Mycobacterium
PQTGT

SEQ ID NO: 276140 - protein, 12 aa, Mycobacterium
PQTPDTAADQDN

SEQ ID NO: 276141 - protein, 85 aa, Mycobacterium
PQTPSGDSAAGASGSGDNSAPAKKAPAKKSPAEKAPAKKAPAKKAPAKAAKKAPAKKAPAKKAPAKKAEPAAPAPVEKPTAAPVD

SEQ ID NO: 276142 - protein, 8 aa, Mycobacterium
PQTRSSRS

SEQ ID NO: 276143 - protein, 5 aa, Mycobacterium
PQTSG

SEQ ID NO: 276144 - protein, 7 aa, Mycobacterium
PQTSRAI

SEQ ID NO: 276145 - protein, 28 aa, Mycobacterium
PQTSTSGYGGNSRSSYSYSYEGPELSGG

SEQ ID NO: 276146 - protein, 4 aa, Mycobacterium
PQTT

SEQ ID NO: 276147 - protein, 6 aa, Mycobacterium
PQTTPV

SEQ ID NO: 276148 - protein, 5 aa, Mycobacterium
PQTVF

SEQ ID NO: 276149 - protein, 5 aa, Mycobacterium
PQTVS

SEQ ID NO: 276150 - protein, 9 aa, Mycobacterium
PQTYPSEEQ

SEQ ID NO: 276151 - protein, 8 aa, Mycobacterium
PQVGQGTT

SEQ ID NO: 276152 - protein, 7 aa, Mycobacterium
PQVNEPL

SEQ ID NO: 276153 - protein, 10 aa, Mycobacterium
PQVPGLTPAE

SEQ ID NO: 276154 - protein, 12 aa, Mycobacterium
PQVQGPTAAGLD

SEQ ID NO: 276155 - protein, 10 aa, Mycobacterium
PQVRDAATAV

SEQ ID NO: 276156 - protein, 5 aa, Mycobacterium
PQVSA

SEQ ID NO: 276157 - protein, 12 aa, Mycobacterium
PQVSEPADPVTA

SEQ ID NO: 276158 - protein, 21 aa, Mycobacterium
PQWSPQAPQQPPRQWTPQPVA

SEQ ID NO: 276159 - protein, 8 aa, Mycobacterium
PQYEGTQR

SEQ ID NO: 276160 - protein, 6 aa, Mycobacterium
PQYHGA

SEQ ID NO: 276161 - protein, 14 aa, Mycobacterium
PQYPSPTSLRPDAH

SEQ ID NO: 276162 - protein, 6 aa, Mycobacterium
PQYQAS

SEQ ID NO: 276163 - protein, 19 aa, Mycobacterium
PQYREPEEAEDGVDRDAEE

SEQ ID NO: 276164 - protein, 6 aa, Mycobacterium
PRAATP

SEQ ID NO: 276165 - protein, 10 aa, Mycobacterium
PRADASYEDM

SEQ ID NO: 276166 - protein, 10 aa, Mycobacterium
PRADATYQDM

SEQ ID NO: 276167 - protein, 7 aa, Mycobacterium
PRADRQP

SEQ ID NO: 276168 - protein, 10 aa, Mycobacterium
PRADTRAGLR

SEQ ID NO: 276169 - protein, 6 aa, Mycobacterium
PRADTV

SEQ ID NO: 276170 - protein, 7 aa, Mycobacterium
PRAEPGL

SEQ ID NO: 276171 - protein, 4 aa, Mycobacterium
PRAG

SEQ ID NO: 276172 - protein, 11 aa, Mycobacterium
PRAGHSGASLG

SEQ ID NO: 276173 - protein, 10 aa, Mycobacterium
PRAGLTASPP

SEQ ID NO: 276174 - protein, 10 aa, Mycobacterium
PRAGSGVAER

SEQ ID NO: 276175 - protein, 5 aa, Mycobacterium
PRAHY

SEQ ID NO: 276176 - protein, 5 aa, Mycobacterium
PRAPY

SEQ ID NO: 276177 - protein, 11 aa, Mycobacterium
PRARADNDESI

SEQ ID NO: 276178 - protein, 6 aa, Mycobacterium
PRARPD

SEQ ID NO: 276179 - protein, 5 aa, Mycobacterium
PRARV

SEQ ID NO: 276180 - protein, 12 aa, Mycobacterium
PRASSAAGTTGA

SEQ ID NO: 276181 - protein, 5 aa, Mycobacterium
PRATA

SEQ ID NO: 276182 - protein, 12 aa, Mycobacterium
PRATAGEPTPTP

SEQ ID NO: 276183 - protein, 7 aa, Mycobacterium
PRATPQD

SEQ ID NO: 276184 - protein, 10 aa, Mycobacterium
PRAVAPSAGD

SEQ ID NO: 276185 - protein, 23 aa, Mycobacterium
PRDAPSSAAAITQGQDFQESAYT

SEQ ID NO: 276186 - protein, 23 aa, Mycobacterium
PRDAPSSAAAITQGQDFQESDYT

SEQ ID NO: 276187 - protein, 7 aa, Mycobacterium
PRDAPVR

SEQ ID NO: 276188 - protein, 14 aa, Mycobacterium
PRDDASTAHPPEGP

SEQ ID NO: 276189 - protein, 10 aa, Mycobacterium
PRDDNATPAE

SEQ ID NO: 276190 - protein, 10 aa, Mycobacterium
PRDDRATPAE

SEQ ID NO: 276191 - protein, 10 aa, Mycobacterium
PRDDSLPAES

SEQ ID NO: 276192 - protein, 5 aa, Mycobacterium
PRDDW

SEQ ID NO: 276193 - protein, 8 aa, Mycobacterium
PRDKRDRV

SEQ ID NO: 276194 - protein, 7 aa, Mycobacterium
PRDLRTA

SEQ ID NO: 276195 - protein, 8 aa, Mycobacterium
PRDPEAVR

SEQ ID NO: 276196 - protein, 9 aa, Mycobacterium
PRDPQQRQT

SEQ ID NO: 276197 - protein, 5 aa, Mycobacterium
PRDQP

SEQ ID NO: 276198 - protein, 10 aa, Mycobacterium
PRDSGPTAIQ

SEQ ID NO: 276199 - protein, 5 aa, Mycobacterium
PRDSH

SEQ ID NO: 276200 - protein, 7 aa, Mycobacterium
PRDTPSW

SEQ ID NO: 276201 - protein, 15 aa, Mycobacterium
PRDVPPDQGGCGEVQ

SEQ ID NO: 276202 - protein, 5 aa, Mycobacterium
PREDQ

SEQ ID NO: 276203 - protein, 10 aa, Mycobacterium
PREDRSVPLG

SEQ ID NO: 276204 - protein, 8 aa, Mycobacterium
PREEAPRG

SEQ ID NO: 276205 - protein, 12 aa, Mycobacterium
PREESRYQMALE

SEQ ID NO: 276206 - protein, 40 aa, Mycobacterium
PREGADAGGGDDADPTDRPDDAPEQPPEAPGEAPERSRRT

SEQ ID NO: 276207 - protein, 10 aa, Mycobacterium
PREGHHRPPV

SEQ ID NO: 276208 - protein, 10 aa, Mycobacterium
PRELAASPDL

SEQ ID NO: 276209 - protein, 16 aa, Mycobacterium
PREPAAATGRARQPLG

SEQ ID NO: 276210 - protein, 4 aa, Mycobacterium
PREQ

SEQ ID NO: 276211 - protein, 7 aa, Mycobacterium
PREQRQE

SEQ ID NO: 276212 - protein, 7 aa, Mycobacterium
PREQRSR

SEQ ID NO: 276213 - protein, 8 aa, Mycobacterium
PREQTPRG

SEQ ID NO: 276214 - protein, 10 aa, Mycobacterium
PRERGKATSL

SEQ ID NO: 276215 - protein, 14 aa, Mycobacterium
PRERTSTGRKSSPL

SEQ ID NO: 276216 - protein, 9 aa, Mycobacterium
PRFAGESKA

SEQ ID NO: 276217 - protein, 24 aa, Mycobacterium
PRFAPEGADTAPGATTDAASETIT

SEQ ID NO: 276218 - protein, 7 aa, Mycobacterium
PRFPGQP

SEQ ID NO: 276219 - protein, 12 aa, Mycobacterium
PRGADEEEREPE

SEQ ID NO: 276220 - protein, 10 aa, Mycobacterium
PRGAEVSKRG

SEQ ID NO: 276221 - protein, 10 aa, Mycobacterium
PRGAGTIPNK

SEQ ID NO: 276222 - protein, 9 aa, Mycobacterium
PRGAPSLQT

SEQ ID NO: 276223 - protein, 25 aa, Mycobacterium
PRGARVPAPNQRRPYRPPPRPSSET

SEQ ID NO: 276224 - protein, 14 aa, Mycobacterium
PRGDNARPRVAAPT

SEQ ID NO: 276225 - protein, 14 aa, Mycobacterium
PRGDNARRSVAPAS

SEQ ID NO: 276226 - protein, 10 aa, Mycobacterium
PRGDRVTATA

SEQ ID NO: 276227 - protein, 5 aa, Mycobacterium
PRGEC

SEQ ID NO: 276228 - protein, 9 aa, Mycobacterium
PRGESDALA

SEQ ID NO: 276229 - protein, 4 aa, Mycobacterium
PRGG

SEQ ID NO: 276230 - protein, 7 aa, Mycobacterium
PRGGAVR

SEQ ID NO: 276231 - protein, 7 aa, Mycobacterium
PRGGGQL

SEQ ID NO: 276232 - protein, 9 aa, Mycobacterium
PRGGGVGRS

SEQ ID NO: 276233 - protein, 8 aa, Mycobacterium
PRGIEPEA

SEQ ID NO: 276234 - protein, 7 aa, Mycobacterium
PRGIEPP

SEQ ID NO: 276235 - protein, 18 aa, Mycobacterium
PRGIGSQSAPAATSNRSC

SEQ ID NO: 276236 - protein, 4 aa, Mycobacterium
PRGL

SEQ ID NO: 276237 - protein, 12 aa, Mycobacterium
PRGLSVPQTGGV

SEQ ID NO: 276238 - protein, 8 aa, Mycobacterium
PRGNAEGR

SEQ ID NO: 276239 - protein, 8 aa, Mycobacterium
PRGNAGRR

SEQ ID NO: 276240 - protein, 8 aa, Mycobacterium
PRGPDNQS

SEQ ID NO: 276241 - protein, 13 aa, Mycobacterium
PRGPELSRDAATG

SEQ ID NO: 276242 - protein, 9 aa, Mycobacterium
PRGPERAAV

SEQ ID NO: 276243 - protein, 6 aa, Mycobacterium
PRGPLP

SEQ ID NO: 276244 - protein, 8 aa, Mycobacterium
PRGPRGEV

SEQ ID NO: 276245 - protein, 10 aa, Mycobacterium
PRGQAEASSA

SEQ ID NO: 276246 - protein, 5 aa, Mycobacterium
PRGQI

SEQ ID NO: 276247 - protein, 7 aa, Mycobacterium
PRGQSAA

SEQ ID NO: 276248 - protein, 4 aa, Mycobacterium
PRGR

SEQ ID NO: 276249 - protein, 96 aa, Mycobacterium
PRGREDPESLRGNQYVDEESAELEPATVAATAGAAGTTAAAGGGDDDVPTESAVGTAAVADADEAQAEEPQSEAVAEEAEAEQSEAEAEESEAEEL

SEQ ID NO: 276250 - protein, 7 aa, Mycobacterium
PRGSAAS

SEQ ID NO: 276251 - protein, 5 aa, Mycobacterium
PRGTT

SEQ ID NO: 276252 - protein, 8 aa, Mycobacterium
PRGVASSR

SEQ ID NO: 276253 - protein, 4 aa, Mycobacterium
PRGW

SEQ ID NO: 276254 - protein, 5 aa, Mycobacterium
PRGWP

SEQ ID NO: 276255 - protein, 12 aa, Mycobacterium
PRHDEIGDRMPH

SEQ ID NO: 276256 - protein, 18 aa, Mycobacterium
PRHDHQSQTARRRGDGAA

SEQ ID NO: 276257 - protein, 5 aa, Mycobacterium
PRHGE

SEQ ID NO: 276258 - protein, 4 aa, Mycobacterium
PRHP

SEQ ID NO: 276259 - protein, 7 aa, Mycobacterium
PRHPTPA

SEQ ID NO: 276260 - protein, 11 aa, Mycobacterium
PRHTGPETAPA

SEQ ID NO: 276261 - protein, 4 aa, Mycobacterium
PRID

SEQ ID NO: 276262 - protein, 6 aa, Mycobacterium
PRIDPE

SEQ ID NO: 276263 - protein, 4 aa, Mycobacterium
PRIK

SEQ ID NO: 276264 - protein, 17 aa, Mycobacterium
PRIPAPPIPADVQPNGV

SEQ ID NO: 276265 - protein, 12 aa, Mycobacterium
PRIPSRGARTAT

SEQ ID NO: 276266 - protein, 7 aa, Mycobacterium
PRIPTMG

SEQ ID NO: 276267 - protein, 4 aa, Mycobacterium
PRIS

SEQ ID NO: 276268 - protein, 7 aa, Mycobacterium
PRISKPS

SEQ ID NO: 276269 - protein, 21 aa, Mycobacterium
PRKAAKKTARKAAKKAPAKGR

SEQ ID NO: 276270 - protein, 7 aa, Mycobacterium
PRKAPEK

SEQ ID NO: 276271 - protein, 8 aa, Mycobacterium
PRKAVRNG

SEQ ID NO: 276272 - protein, 5 aa, Mycobacterium
PRKEL

SEQ ID NO: 276273 - protein, 4 aa, Mycobacterium
PRKI

SEQ ID NO: 276274 - protein, 31 aa, Mycobacterium
PRKPMTPDRSSGRSPVTYPEQRNSSPPGVNA

SEQ ID NO: 276275 - protein, 23 aa, Mycobacterium
PRKPRVSGAGDDIPQAGLRGPRA

SEQ ID NO: 276276 - protein, 11 aa, Mycobacterium
PRKPVRQPPPV

SEQ ID NO: 276277 - protein, 9 aa, Mycobacterium
PRKPVSDAS

SEQ ID NO: 276278 - protein, 7 aa, Mycobacterium
PRKSREI

SEQ ID NO: 276279 - protein, 20 aa, Mycobacterium
PRKYREQAEFSPHDEPADPV

SEQ ID NO: 276280 - protein, 13 aa, Mycobacterium
PRLAAGAPGGTTP

SEQ ID NO: 276281 - protein, 14 aa, Mycobacterium
PRLAAGAPGGTTPV

SEQ ID NO: 276282 - protein, 14 aa, Mycobacterium
PRLAPGQPGGPTPV

SEQ ID NO: 276283 - protein, 7 aa, Mycobacterium
PRLGEPR

SEQ ID NO: 276284 - protein, 13 aa, Mycobacterium
PRLGESEKLPNGV

SEQ ID NO: 276285 - protein, 5 aa, Mycobacterium
PRLGR

SEQ ID NO: 276286 - protein, 4 aa, Mycobacterium
PRLR

SEQ ID NO: 276287 - protein, 5 aa, Mycobacterium
PRLSG

SEQ ID NO: 276288 - protein, 30 aa, Mycobacterium
PRLSGRPDHSGSAPTSLRQRRNKGGGSFTS
